United States Patent 8,822,426 (PREVENTION AND TREATMENT OF NOSEMA DISEASE IN BEES) - sequence listing, part 7

SEQ ID NO: 196023 - DNA, 19 bp, Artificial sequence
  SiRNA target sequence
ttctctgaaagaactactg

SEQ ID NO: 196024 - DNA, 19 bp, Artificial sequence
  SiRNA target sequence
tctctgaaagaactactgg

SEQ ID NO: 196025 - DNA, 19 bp, Artificial sequence
  SiRNA target sequence
ctctgaaagaactactggc

SEQ ID NO: 196026 - DNA, 19 bp, Artificial sequence
  SiRNA target sequence
tctgaaagaactactggct

SEQ ID NO: 196027 - DNA, 19 bp, Artificial sequence
  SiRNA target sequence
ctgaaagaactactggcta

SEQ ID NO: 196028 - DNA, 19 bp, Artificial sequence
  SiRNA target sequence
tgaaagaactactggctaa

SEQ ID NO: 196029 - DNA, 19 bp, Artificial sequence
  SiRNA target sequence
gaaagaactactggctaat

SEQ ID NO: 196030 - DNA, 19 bp, Artificial sequence
  SiRNA target sequence
aaagaactactggctaatc

SEQ ID NO: 196031 - DNA, 19 bp, Artificial sequence
  SiRNA target sequence
aagaactactggctaatcc

SEQ ID NO: 196032 - DNA, 19 bp, Artificial sequence
  SiRNA target sequence
agaactactggctaatcca

SEQ ID NO: 196033 - DNA, 19 bp, Artificial sequence
  SiRNA target sequence
gaactactggctaatccag

SEQ ID NO: 196034 - DNA, 19 bp, Artificial sequence
  SiRNA target sequence
aactactggctaatccaga

SEQ ID NO: 196035 - DNA, 19 bp, Artificial sequence
  SiRNA target sequence
actactggctaatccagat

SEQ ID NO: 196036 - DNA, 19 bp, Artificial sequence
  SiRNA target sequence
ctactggctaatccagata

SEQ ID NO: 196037 - DNA, 19 bp, Artificial sequence
  SiRNA target sequence
tactggctaatccagatac

SEQ ID NO: 196038 - DNA, 19 bp, Artificial sequence
  SiRNA target sequence
actggctaatccagatact

SEQ ID NO: 196039 - DNA, 19 bp, Artificial sequence
  SiRNA target sequence
ctggctaatccagatacta

SEQ ID NO: 196040 - DNA, 19 bp, Artificial sequence
  SiRNA target sequence
tggctaatccagatactag

SEQ ID NO: 196041 - DNA, 19 bp, Artificial sequence
  SiRNA target sequence
ggctaatccagatactagt

SEQ ID NO: 196042 - DNA, 19 bp, Artificial sequence
  SiRNA target sequence
gctaatccagatactagta

SEQ ID NO: 196043 - DNA, 19 bp, Artificial sequence
  SiRNA target sequence
ctaatccagatactagtaa

SEQ ID NO: 196044 - DNA, 19 bp, Artificial sequence
  SiRNA target sequence
taatccagatactagtaaa

SEQ ID NO: 196045 - DNA, 19 bp, Artificial sequence
  SiRNA target sequence
aatccagatactagtaaag

SEQ ID NO: 196046 - DNA, 19 bp, Artificial sequence
  SiRNA target sequence
atccagatactagtaaagc

SEQ ID NO: 196047 - DNA, 19 bp, Artificial sequence
  SiRNA target sequence
tccagatactagtaaagct

SEQ ID NO: 196048 - DNA, 19 bp, Artificial sequence
  SiRNA target sequence
ccagatactagtaaagcta

SEQ ID NO: 196049 - DNA, 19 bp, Artificial sequence
  SiRNA target sequence
cagatactagtaaagctaa

SEQ ID NO: 196050 - DNA, 19 bp, Artificial sequence
  SiRNA target sequence
agatactagtaaagctaaa

SEQ ID NO: 196051 - DNA, 19 bp, Artificial sequence
  SiRNA target sequence
gatactagtaaagctaaat

SEQ ID NO: 196052 - DNA, 19 bp, Artificial sequence
  SiRNA target sequence
atactagtaaagctaaatt

SEQ ID NO: 196053 - DNA, 19 bp, Artificial sequence
  SiRNA target sequence
tactagtaaagctaaattt

SEQ ID NO: 196054 - DNA, 19 bp, Artificial sequence
  SiRNA target sequence
actagtaaagctaaatttg

SEQ ID NO: 196055 - DNA, 19 bp, Artificial sequence
  SiRNA target sequence
ctagtaaagctaaatttgc

SEQ ID NO: 196056 - DNA, 19 bp, Artificial sequence
  SiRNA target sequence
tagtaaagctaaatttgct

SEQ ID NO: 196057 - DNA, 19 bp, Artificial sequence
  SiRNA target sequence
agtaaagctaaatttgcta

SEQ ID NO: 196058 - DNA, 19 bp, Artificial sequence
  SiRNA target sequence
gtaaagctaaatttgctat

SEQ ID NO: 196059 - DNA, 19 bp, Artificial sequence
  SiRNA target sequence
taaagctaaatttgctatt

SEQ ID NO: 196060 - DNA, 19 bp, Artificial sequence
  SiRNA target sequence
aaagctaaatttgctatta

SEQ ID NO: 196061 - DNA, 19 bp, Artificial sequence
  SiRNA target sequence
aagctaaatttgctattat

SEQ ID NO: 196062 - DNA, 19 bp, Artificial sequence
  SiRNA target sequence
agctaaatttgctattatg

SEQ ID NO: 196063 - DNA, 19 bp, Artificial sequence
  SiRNA target sequence
gctaaatttgctattatgt

SEQ ID NO: 196064 - DNA, 19 bp, Artificial sequence
  SiRNA target sequence
ctaaatttgctattatgta

SEQ ID NO: 196065 - DNA, 19 bp, Artificial sequence
  SiRNA target sequence
taaatttgctattatgtaa

SEQ ID NO: 196066 - DNA, 19 bp, Artificial sequence
  SiRNA target sequence
aaatttgctattatgtaaa

SEQ ID NO: 196067 - DNA, 19 bp, Artificial sequence
  SiRNA target sequence
aatttgctattatgtaaaa

SEQ ID NO: 196068 - DNA, 19 bp, Artificial sequence
  SiRNA target sequence
atttgctattatgtaaaaa

SEQ ID NO: 196069 - DNA, 19 bp, Artificial sequence
  SiRNA target sequence
tttgctattatgtaaaaag

SEQ ID NO: 196070 - DNA, 19 bp, Artificial sequence
  SiRNA target sequence
ttgctattatgtaaaaagg

SEQ ID NO: 196071 - DNA, 19 bp, Artificial sequence
  SiRNA target sequence
tgctattatgtaaaaaggt

SEQ ID NO: 196072 - DNA, 19 bp, Artificial sequence
  SiRNA target sequence
gctattatgtaaaaaggtg

SEQ ID NO: 196073 - DNA, 19 bp, Artificial sequence
  SiRNA target sequence
ctattatgtaaaaaggtgg

SEQ ID NO: 196074 - DNA, 19 bp, Artificial sequence
  SiRNA target sequence
tattatgtaaaaaggtggt

SEQ ID NO: 196075 - DNA, 19 bp, Artificial sequence
  SiRNA target sequence
attatgtaaaaaggtggta

SEQ ID NO: 196076 - DNA, 19 bp, Artificial sequence
  SiRNA target sequence
ttatgtaaaaaggtggtaa

SEQ ID NO: 196077 - DNA, 19 bp, Artificial sequence
  SiRNA target sequence
tatgtaaaaaggtggtaaa

SEQ ID NO: 196078 - DNA, 19 bp, Artificial sequence
  SiRNA target sequence
atgtaaaaaggtggtaaaa

SEQ ID NO: 196079 - DNA, 19 bp, Artificial sequence
  SiRNA target sequence
tgtaaaaaggtggtaaaaa

SEQ ID NO: 196080 - DNA, 19 bp, Artificial sequence
  SiRNA target sequence
gtaaaaaggtggtaaaaat

SEQ ID NO: 196081 - DNA, 19 bp, Artificial sequence
  SiRNA target sequence
taaaaaggtggtaaaaatc

SEQ ID NO: 196082 - DNA, 19 bp, Artificial sequence
  SiRNA target sequence
aaaaaggtggtaaaaatct

SEQ ID NO: 196083 - DNA, 19 bp, Artificial sequence
  SiRNA target sequence
aaaaggtggtaaaaatctt

SEQ ID NO: 196084 - DNA, 19 bp, Artificial sequence
  SiRNA target sequence
aaaggtggtaaaaatcttg

SEQ ID NO: 196085 - DNA, 19 bp, Artificial sequence
  SiRNA target sequence
aaggtggtaaaaatcttgt

SEQ ID NO: 196086 - DNA, 19 bp, Artificial sequence
  SiRNA target sequence
aggtggtaaaaatcttgta

SEQ ID NO: 196087 - DNA, 19 bp, Artificial sequence
  SiRNA target sequence
ggtggtaaaaatcttgtaa

SEQ ID NO: 196088 - DNA, 19 bp, Artificial sequence
  SiRNA target sequence
gtggtaaaaatcttgtaaa

SEQ ID NO: 196089 - DNA, 19 bp, Artificial sequence
  SiRNA target sequence
tggtaaaaatcttgtaaac

SEQ ID NO: 196090 - DNA, 19 bp, Artificial sequence
  SiRNA target sequence
ggtaaaaatcttgtaaact

SEQ ID NO: 196091 - DNA, 19 bp, Artificial sequence
  SiRNA target sequence
gtaaaaatcttgtaaactg

SEQ ID NO: 196092 - DNA, 19 bp, Artificial sequence
  SiRNA target sequence
taaaaatcttgtaaactgt

SEQ ID NO: 196093 - DNA, 19 bp, Artificial sequence
  SiRNA target sequence
aaaaatcttgtaaactgtc

SEQ ID NO: 196094 - DNA, 19 bp, Artificial sequence
  SiRNA target sequence
aaaatcttgtaaactgtct

SEQ ID NO: 196095 - DNA, 19 bp, Artificial sequence
  SiRNA target sequence
aaatcttgtaaactgtctg

SEQ ID NO: 196096 - DNA, 19 bp, Artificial sequence
  SiRNA target sequence
aatcttgtaaactgtctga

SEQ ID NO: 196097 - DNA, 19 bp, Artificial sequence
  SiRNA target sequence
atcttgtaaactgtctgat

SEQ ID NO: 196098 - DNA, 19 bp, Artificial sequence
  SiRNA target sequence
tcttgtaaactgtctgata

SEQ ID NO: 196099 - DNA, 19 bp, Artificial sequence
  SiRNA target sequence
cttgtaaactgtctgatag

SEQ ID NO: 196100 - DNA, 19 bp, Artificial sequence
  SiRNA target sequence
ttgtaaactgtctgatagt

SEQ ID NO: 196101 - DNA, 19 bp, Artificial sequence
  SiRNA target sequence
tgtaaactgtctgatagta

SEQ ID NO: 196102 - DNA, 19 bp, Artificial sequence
  SiRNA target sequence
gtaaactgtctgatagtac

SEQ ID NO: 196103 - DNA, 19 bp, Artificial sequence
  SiRNA target sequence
taaactgtctgatagtaca

SEQ ID NO: 196104 - DNA, 19 bp, Artificial sequence
  SiRNA target sequence
aaactgtctgatagtacaa

SEQ ID NO: 196105 - DNA, 19 bp, Artificial sequence
  SiRNA target sequence
aactgtctgatagtacaac

SEQ ID NO: 196106 - DNA, 19 bp, Artificial sequence
  SiRNA target sequence
actgtctgatagtacaact

SEQ ID NO: 196107 - DNA, 19 bp, Artificial sequence
  SiRNA target sequence
ctgtctgatagtacaactt

SEQ ID NO: 196108 - DNA, 19 bp, Artificial sequence
  SiRNA target sequence
tgtctgatagtacaacttt

SEQ ID NO: 196109 - DNA, 19 bp, Artificial sequence
  SiRNA target sequence
gtctgatagtacaactttc

SEQ ID NO: 196110 - DNA, 19 bp, Artificial sequence
  SiRNA target sequence
tctgatagtacaactttca

SEQ ID NO: 196111 - DNA, 19 bp, Artificial sequence
  SiRNA target sequence
ctgatagtacaactttcat

SEQ ID NO: 196112 - DNA, 19 bp, Artificial sequence
  SiRNA target sequence
tgatagtacaactttcatt

SEQ ID NO: 196113 - DNA, 19 bp, Artificial sequence
  SiRNA target sequence
gatagtacaactttcattt

SEQ ID NO: 196114 - DNA, 19 bp, Artificial sequence
  SiRNA target sequence
atagtacaactttcattta

SEQ ID NO: 196115 - DNA, 19 bp, Artificial sequence
  SiRNA target sequence
tagtacaactttcatttaa

SEQ ID NO: 196116 - DNA, 19 bp, Artificial sequence
  SiRNA target sequence
agtacaactttcatttaaa

SEQ ID NO: 196117 - DNA, 19 bp, Artificial sequence
  SiRNA target sequence
gtacaactttcatttaaaa

SEQ ID NO: 196118 - DNA, 19 bp, Artificial sequence
  SiRNA target sequence
tacaactttcatttaaaaa

SEQ ID NO: 196119 - DNA, 19 bp, Artificial sequence
  SiRNA target sequence
acaactttcatttaaaaaa

SEQ ID NO: 196120 - DNA, 19 bp, Artificial sequence
  SiRNA target sequence
caactttcatttaaaaaac

SEQ ID NO: 196121 - DNA, 19 bp, Artificial sequence
  SiRNA target sequence
aactttcatttaaaaaact

SEQ ID NO: 196122 - DNA, 19 bp, Artificial sequence
  SiRNA target sequence
actttcatttaaaaaactc

SEQ ID NO: 196123 - DNA, 19 bp, Artificial sequence
  SiRNA target sequence
ctttcatttaaaaaactca

SEQ ID NO: 196124 - DNA, 19 bp, Artificial sequence
  SiRNA target sequence
tttcatttaaaaaactcat

SEQ ID NO: 196125 - DNA, 19 bp, Artificial sequence
  SiRNA target sequence
ttcatttaaaaaactcatg

SEQ ID NO: 196126 - DNA, 19 bp, Artificial sequence
  SiRNA target sequence
tcatttaaaaaactcatgt

SEQ ID NO: 196127 - DNA, 19 bp, Artificial sequence
  SiRNA target sequence
catttaaaaaactcatgta

SEQ ID NO: 196128 - DNA, 19 bp, Artificial sequence
  SiRNA target sequence
atttaaaaaactcatgtat

SEQ ID NO: 196129 - DNA, 19 bp, Artificial sequence
  SiRNA target sequence
tttaaaaaactcatgtata

SEQ ID NO: 196130 - DNA, 19 bp, Artificial sequence
  SiRNA target sequence
ttaaaaaactcatgtataa

SEQ ID NO: 196131 - DNA, 19 bp, Artificial sequence
  SiRNA target sequence
taaaaaactcatgtataaa

SEQ ID NO: 196132 - DNA, 19 bp, Artificial sequence
  SiRNA target sequence
aaaaaactcatgtataaat

SEQ ID NO: 196133 - DNA, 19 bp, Artificial sequence
  SiRNA target sequence
aaaaactcatgtataaata

SEQ ID NO: 196134 - DNA, 19 bp, Artificial sequence
  SiRNA target sequence
aaaactcatgtataaataa

SEQ ID NO: 196135 - DNA, 19 bp, Artificial sequence
  SiRNA target sequence
aaactcatgtataaataag

SEQ ID NO: 196136 - DNA, 19 bp, Artificial sequence
  SiRNA target sequence
aactcatgtataaataagc

SEQ ID NO: 196137 - DNA, 19 bp, Artificial sequence
  SiRNA target sequence
actcatgtataaataagcc

SEQ ID NO: 196138 - DNA, 19 bp, Artificial sequence
  SiRNA target sequence
ctcatgtataaataagcca

SEQ ID NO: 196139 - DNA, 19 bp, Artificial sequence
  SiRNA target sequence
tcatgtataaataagccat

SEQ ID NO: 196140 - DNA, 19 bp, Artificial sequence
  SiRNA target sequence
catgtataaataagccata

SEQ ID NO: 196141 - DNA, 19 bp, Artificial sequence
  SiRNA target sequence
atgtataaataagccataa

SEQ ID NO: 196142 - DNA, 19 bp, Artificial sequence
  SiRNA target sequence
tgtataaataagccataag

SEQ ID NO: 196143 - DNA, 19 bp, Artificial sequence
  SiRNA target sequence
gtataaataagccataagt

SEQ ID NO: 196144 - DNA, 19 bp, Artificial sequence
  SiRNA target sequence
tataaataagccataagta

SEQ ID NO: 196145 - DNA, 19 bp, Artificial sequence
  SiRNA target sequence
ataaataagccataagtaa

SEQ ID NO: 196146 - DNA, 19 bp, Artificial sequence
  SiRNA target sequence
taaataagccataagtaaa

SEQ ID NO: 196147 - DNA, 19 bp, Artificial sequence
  SiRNA target sequence
aaataagccataagtaaac

SEQ ID NO: 196148 - DNA, 19 bp, Artificial sequence
  SiRNA target sequence
aataagccataagtaaact

SEQ ID NO: 196149 - DNA, 19 bp, Artificial sequence
  SiRNA target sequence
ataagccataagtaaactg

SEQ ID NO: 196150 - DNA, 19 bp, Artificial sequence
  SiRNA target sequence
taagccataagtaaactgc

SEQ ID NO: 196151 - DNA, 19 bp, Artificial sequence
  SiRNA target sequence
aagccataagtaaactgcc

SEQ ID NO: 196152 - DNA, 19 bp, Artificial sequence
  SiRNA target sequence
agccataagtaaactgccc

SEQ ID NO: 196153 - DNA, 19 bp, Artificial sequence
  SiRNA target sequence
gccataagtaaactgcccc

SEQ ID NO: 196154 - DNA, 19 bp, Artificial sequence
  SiRNA target sequence
ccataagtaaactgcccca

SEQ ID NO: 196155 - DNA, 19 bp, Artificial sequence
  SiRNA target sequence
cataagtaaactgccccac

SEQ ID NO: 196156 - DNA, 19 bp, Artificial sequence
  SiRNA target sequence
ataagtaaactgccccaca

SEQ ID NO: 196157 - DNA, 19 bp, Artificial sequence
  SiRNA target sequence
taagtaaactgccccacat

SEQ ID NO: 196158 - DNA, 19 bp, Artificial sequence
  SiRNA target sequence
aagtaaactgccccacatt

SEQ ID NO: 196159 - DNA, 19 bp, Artificial sequence
  SiRNA target sequence
agtaaactgccccacattt

SEQ ID NO: 196160 - DNA, 19 bp, Artificial sequence
  SiRNA target sequence
gtaaactgccccacatttc

SEQ ID NO: 196161 - DNA, 19 bp, Artificial sequence
  SiRNA target sequence
taaactgccccacatttct

SEQ ID NO: 196162 - DNA, 19 bp, Artificial sequence
  SiRNA target sequence
aaactgccccacatttctg

SEQ ID NO: 196163 - DNA, 19 bp, Artificial sequence
  SiRNA target sequence
aactgccccacatttctgc

SEQ ID NO: 196164 - DNA, 19 bp, Artificial sequence
  SiRNA target sequence
actgccccacatttctgct

SEQ ID NO: 196165 - DNA, 19 bp, Artificial sequence
  SiRNA target sequence
ctgccccacatttctgcta

SEQ ID NO: 196166 - DNA, 19 bp, Artificial sequence
  SiRNA target sequence
tgccccacatttctgctat

SEQ ID NO: 196167 - DNA, 19 bp, Artificial sequence
  SiRNA target sequence
gccccacatttctgctatt

SEQ ID NO: 196168 - DNA, 19 bp, Artificial sequence
  SiRNA target sequence
ccccacatttctgctatta

SEQ ID NO: 196169 - DNA, 19 bp, Artificial sequence
  SiRNA target sequence
cccacatttctgctattat

SEQ ID NO: 196170 - DNA, 19 bp, Artificial sequence
  SiRNA target sequence
ccacatttctgctattata

SEQ ID NO: 196171 - DNA, 19 bp, Artificial sequence
  SiRNA target sequence
cacatttctgctattataa

SEQ ID NO: 196172 - DNA, 19 bp, Artificial sequence
  SiRNA target sequence
acatttctgctattataaa

SEQ ID NO: 196173 - DNA, 19 bp, Artificial sequence
  SiRNA target sequence
catttctgctattataaaa

SEQ ID NO: 196174 - DNA, 19 bp, Artificial sequence
  SiRNA target sequence
atttctgctattataaaaa

SEQ ID NO: 196175 - DNA, 19 bp, Artificial sequence
  SiRNA target sequence
tttctgctattataaaaat

SEQ ID NO: 196176 - DNA, 19 bp, Artificial sequence
  SiRNA target sequence
ttctgctattataaaaata

SEQ ID NO: 196177 - DNA, 19 bp, Artificial sequence
  SiRNA target sequence
tctgctattataaaaatac

SEQ ID NO: 196178 - DNA, 19 bp, Artificial sequence
  SiRNA target sequence
ctgctattataaaaataca

SEQ ID NO: 196179 - DNA, 19 bp, Artificial sequence
  SiRNA target sequence
tgctattataaaaatacaa

SEQ ID NO: 196180 - DNA, 19 bp, Artificial sequence
  SiRNA target sequence
gctattataaaaatacaag

SEQ ID NO: 196181 - DNA, 19 bp, Artificial sequence
  SiRNA target sequence
ctattataaaaatacaagt

SEQ ID NO: 196182 - DNA, 19 bp, Artificial sequence
  SiRNA target sequence
tattataaaaatacaagtt

SEQ ID NO: 196183 - DNA, 19 bp, Artificial sequence
  SiRNA target sequence
attataaaaatacaagttg

SEQ ID NO: 196184 - DNA, 19 bp, Artificial sequence
  SiRNA target sequence
ttataaaaatacaagttga

SEQ ID NO: 196185 - DNA, 19 bp, Artificial sequence
  SiRNA target sequence
tataaaaatacaagttgaa

SEQ ID NO: 196186 - DNA, 19 bp, Artificial sequence
  SiRNA target sequence
ataaaaatacaagttgaaa

SEQ ID NO: 196187 - DNA, 19 bp, Artificial sequence
  SiRNA target sequence
taaaaatacaagttgaaac

SEQ ID NO: 196188 - DNA, 19 bp, Artificial sequence
  SiRNA target sequence
aaaaatacaagttgaaacg

SEQ ID NO: 196189 - DNA, 19 bp, Artificial sequence
  SiRNA target sequence
aaaatacaagttgaaacgg

SEQ ID NO: 196190 - DNA, 19 bp, Artificial sequence
  SiRNA target sequence
aaatacaagttgaaacggg

SEQ ID NO: 196191 - DNA, 19 bp, Artificial sequence
  SiRNA target sequence
aatacaagttgaaacgggc

SEQ ID NO: 196192 - DNA, 19 bp, Artificial sequence
  SiRNA target sequence
atacaagttgaaacgggct

SEQ ID NO: 196193 - DNA, 19 bp, Artificial sequence
  SiRNA target sequence
tacaagttgaaacgggctc

SEQ ID NO: 196194 - DNA, 19 bp, Artificial sequence
  SiRNA target sequence
acaagttgaaacgggctcg

SEQ ID NO: 196195 - DNA, 19 bp, Artificial sequence
  SiRNA target sequence
caagttgaaacgggctcgt

SEQ ID NO: 196196 - DNA, 19 bp, Artificial sequence
  SiRNA target sequence
aagttgaaacgggctcgtt

SEQ ID NO: 196197 - DNA, 19 bp, Artificial sequence
  SiRNA target sequence
agttgaaacgggctcgtta

SEQ ID NO: 196198 - DNA, 19 bp, Artificial sequence
  SiRNA target sequence
gttgaaacgggctcgttag

SEQ ID NO: 196199 - DNA, 19 bp, Artificial sequence
  SiRNA target sequence
ttgaaacgggctcgttagc

SEQ ID NO: 196200 - DNA, 19 bp, Artificial sequence
  SiRNA target sequence
tgaaacgggctcgttagct

SEQ ID NO: 196201 - DNA, 19 bp, Artificial sequence
  SiRNA target sequence
gaaacgggctcgttagctg

SEQ ID NO: 196202 - DNA, 19 bp, Artificial sequence
  SiRNA target sequence
aaacgggctcgttagctgt

SEQ ID NO: 196203 - DNA, 19 bp, Artificial sequence
  SiRNA target sequence
aacgggctcgttagctgta

SEQ ID NO: 196204 - DNA, 19 bp, Artificial sequence
  SiRNA target sequence
acgggctcgttagctgtaa

SEQ ID NO: 196205 - DNA, 19 bp, Artificial sequence
  SiRNA target sequence
cgggctcgttagctgtaat

SEQ ID NO: 196206 - DNA, 19 bp, Artificial sequence
  SiRNA target sequence
gggctcgttagctgtaatt

SEQ ID NO: 196207 - DNA, 19 bp, Artificial sequence
  SiRNA target sequence
ggctcgttagctgtaatta

SEQ ID NO: 196208 - DNA, 19 bp, Artificial sequence
  SiRNA target sequence
gctcgttagctgtaattaa

SEQ ID NO: 196209 - DNA, 19 bp, Artificial sequence
  SiRNA target sequence
ctcgttagctgtaattaaa

SEQ ID NO: 196210 - DNA, 19 bp, Artificial sequence
  SiRNA target sequence
tcgttagctgtaattaaaa

SEQ ID NO: 196211 - DNA, 19 bp, Artificial sequence
  SiRNA target sequence
cgttagctgtaattaaaaa

SEQ ID NO: 196212 - DNA, 19 bp, Artificial sequence
  SiRNA target sequence
gttagctgtaattaaaaaa

SEQ ID NO: 196213 - DNA, 19 bp, Artificial sequence
  SiRNA target sequence
ttagctgtaattaaaaaat

SEQ ID NO: 196214 - DNA, 19 bp, Artificial sequence
  SiRNA target sequence
tagctgtaattaaaaaata

SEQ ID NO: 196215 - DNA, 19 bp, Artificial sequence
  SiRNA target sequence
agctgtaattaaaaaatat

SEQ ID NO: 196216 - DNA, 19 bp, Artificial sequence
  SiRNA target sequence
gctgtaattaaaaaatatt

SEQ ID NO: 196217 - DNA, 19 bp, Artificial sequence
  SiRNA target sequence
ctgtaattaaaaaatattt

SEQ ID NO: 196218 - DNA, 19 bp, Artificial sequence
  SiRNA target sequence
tgtaattaaaaaatatttt

SEQ ID NO: 196219 - DNA, 19 bp, Artificial sequence
  SiRNA target sequence
gtaattaaaaaatatttta

SEQ ID NO: 196220 - DNA, 19 bp, Artificial sequence
  SiRNA target sequence
taattaaaaaatattttat

SEQ ID NO: 196221 - DNA, 19 bp, Artificial sequence
  SiRNA target sequence
aattaaaaaatattttata

SEQ ID NO: 196222 - DNA, 19 bp, Artificial sequence
  SiRNA target sequence
attaaaaaatattttataa

SEQ ID NO: 196223 - DNA, 19 bp, Artificial sequence
  SiRNA target sequence
ttaaaaaatattttataaa

SEQ ID NO: 196224 - DNA, 19 bp, Artificial sequence
  SiRNA target sequence
taaaaaatattttataaag

SEQ ID NO: 196225 - DNA, 19 bp, Artificial sequence
  SiRNA target sequence
aaaaaatattttataaagt

SEQ ID NO: 196226 - DNA, 19 bp, Artificial sequence
  SiRNA target sequence
aaaaatattttataaagtt

SEQ ID NO: 196227 - DNA, 19 bp, Artificial sequence
  SiRNA target sequence
aaaatattttataaagttc

SEQ ID NO: 196228 - DNA, 19 bp, Artificial sequence
  SiRNA target sequence
aaatattttataaagttca

SEQ ID NO: 196229 - DNA, 19 bp, Artificial sequence
  SiRNA target sequence
aatattttataaagttcaa

SEQ ID NO: 196230 - DNA, 19 bp, Artificial sequence
  SiRNA target sequence
atattttataaagttcaat

SEQ ID NO: 196231 - DNA, 19 bp, Artificial sequence
  SiRNA target sequence
tattttataaagttcaatc

SEQ ID NO: 196232 - DNA, 19 bp, Artificial sequence
  SiRNA target sequence
attttataaagttcaatcc

SEQ ID NO: 196233 - DNA, 19 bp, Artificial sequence
  SiRNA target sequence
ttttataaagttcaatccc

SEQ ID NO: 196234 - DNA, 19 bp, Artificial sequence
  SiRNA target sequence
tttataaagttcaatccct

SEQ ID NO: 196235 - DNA, 19 bp, Artificial sequence
  SiRNA target sequence
ttataaagttcaatccctt

SEQ ID NO: 196236 - DNA, 19 bp, Artificial sequence
  SiRNA target sequence
tataaagttcaatcccttc

SEQ ID NO: 196237 - DNA, 19 bp, Artificial sequence
  SiRNA target sequence
ataaagttcaatcccttca

SEQ ID NO: 196238 - DNA, 19 bp, Artificial sequence
  SiRNA target sequence
taaagttcaatcccttcaa

SEQ ID NO: 196239 - DNA, 19 bp, Artificial sequence
  SiRNA target sequence
aaagttcaatcccttcaat

SEQ ID NO: 196240 - DNA, 19 bp, Artificial sequence
  SiRNA target sequence
aagttcaatcccttcaatg

SEQ ID NO: 196241 - DNA, 19 bp, Artificial sequence
  SiRNA target sequence
agttcaatcccttcaatgc

SEQ ID NO: 196242 - DNA, 19 bp, Artificial sequence
  SiRNA target sequence
gttcaatcccttcaatgca

SEQ ID NO: 196243 - DNA, 19 bp, Artificial sequence
  SiRNA target sequence
ttcaatcccttcaatgcac

SEQ ID NO: 196244 - DNA, 19 bp, Artificial sequence
  SiRNA target sequence
tcaatcccttcaatgcacc

SEQ ID NO: 196245 - DNA, 19 bp, Artificial sequence
  SiRNA target sequence
caatcccttcaatgcacct

SEQ ID NO: 196246 - DNA, 19 bp, Artificial sequence
  SiRNA target sequence
aatcccttcaatgcacctt

SEQ ID NO: 196247 - DNA, 19 bp, Artificial sequence
  SiRNA target sequence
atcccttcaatgcaccttt

SEQ ID NO: 196248 - DNA, 19 bp, Artificial sequence
  SiRNA target sequence
tcccttcaatgcacctttg

SEQ ID NO: 196249 - DNA, 19 bp, Artificial sequence
  SiRNA target sequence
cccttcaatgcacctttgt

SEQ ID NO: 196250 - DNA, 19 bp, Artificial sequence
  SiRNA target sequence
ccttcaatgcacctttgtt

SEQ ID NO: 196251 - DNA, 19 bp, Artificial sequence
  SiRNA target sequence
cttcaatgcacctttgtta

SEQ ID NO: 196252 - DNA, 19 bp, Artificial sequence
  SiRNA target sequence
ttcaatgcacctttgttat

SEQ ID NO: 196253 - DNA, 19 bp, Artificial sequence
  SiRNA target sequence
tcaatgcacctttgttatc

SEQ ID NO: 196254 - DNA, 19 bp, Artificial sequence
  SiRNA target sequence
caatgcacctttgttatca

SEQ ID NO: 196255 - DNA, 19 bp, Artificial sequence
  SiRNA target sequence
aatgcacctttgttatcag

SEQ ID NO: 196256 - DNA, 19 bp, Artificial sequence
  SiRNA target sequence
atgcacctttgttatcagc

SEQ ID NO: 196257 - DNA, 19 bp, Artificial sequence
  SiRNA target sequence
tgcacctttgttatcagcg

SEQ ID NO: 196258 - DNA, 19 bp, Artificial sequence
  SiRNA target sequence
gcacctttgttatcagcga

SEQ ID NO: 196259 - DNA, 19 bp, Artificial sequence
  SiRNA target sequence
cacctttgttatcagcgaa

SEQ ID NO: 196260 - DNA, 19 bp, Artificial sequence
  SiRNA target sequence
acctttgttatcagcgaaa

SEQ ID NO: 196261 - DNA, 19 bp, Artificial sequence
  SiRNA target sequence
cctttgttatcagcgaaaa

SEQ ID NO: 196262 - DNA, 19 bp, Artificial sequence
  SiRNA target sequence
ctttgttatcagcgaaaat

SEQ ID NO: 196263 - DNA, 19 bp, Artificial sequence
  SiRNA target sequence
tttgttatcagcgaaaata

SEQ ID NO: 196264 - DNA, 19 bp, Artificial sequence
  SiRNA target sequence
ttgttatcagcgaaaatat

SEQ ID NO: 196265 - DNA, 19 bp, Artificial sequence
  SiRNA target sequence
tgttatcagcgaaaatatc

SEQ ID NO: 196266 - DNA, 19 bp, Artificial sequence
  SiRNA target sequence
gttatcagcgaaaatatct

SEQ ID NO: 196267 - DNA, 19 bp, Artificial sequence
  SiRNA target sequence
ttatcagcgaaaatatctc

SEQ ID NO: 196268 - DNA, 19 bp, Artificial sequence
  SiRNA target sequence
tatcagcgaaaatatctct

SEQ ID NO: 196269 - DNA, 19 bp, Artificial sequence
  SiRNA target sequence
atcagcgaaaatatctcta

SEQ ID NO: 196270 - DNA, 19 bp, Artificial sequence
  SiRNA target sequence
tcagcgaaaatatctctaa

SEQ ID NO: 196271 - DNA, 19 bp, Artificial sequence
  SiRNA target sequence
cagcgaaaatatctctaaa

SEQ ID NO: 196272 - DNA, 19 bp, Artificial sequence
  SiRNA target sequence
agcgaaaatatctctaaat

SEQ ID NO: 196273 - DNA, 19 bp, Artificial sequence
  SiRNA target sequence
gcgaaaatatctctaaata

SEQ ID NO: 196274 - DNA, 19 bp, Artificial sequence
  SiRNA target sequence
cgaaaatatctctaaataa

SEQ ID NO: 196275 - DNA, 19 bp, Artificial sequence
  SiRNA target sequence
gaaaatatctctaaataaa

SEQ ID NO: 196276 - DNA, 19 bp, Artificial sequence
  SiRNA target sequence
aaaatatctctaaataaaa

SEQ ID NO: 196277 - DNA, 19 bp, Artificial sequence
  SiRNA target sequence
aaatatctctaaataaaaa

SEQ ID NO: 196278 - DNA, 19 bp, Artificial sequence
  SiRNA target sequence
aatatctctaaataaaaag

SEQ ID NO: 196279 - DNA, 19 bp, Artificial sequence
  SiRNA target sequence
atatctctaaataaaaagc

SEQ ID NO: 196280 - DNA, 19 bp, Artificial sequence
  SiRNA target sequence
tatctctaaataaaaagct

SEQ ID NO: 196281 - DNA, 19 bp, Artificial sequence
  SiRNA target sequence
atctctaaataaaaagcta

SEQ ID NO: 196282 - DNA, 19 bp, Artificial sequence
  SiRNA target sequence
tctctaaataaaaagctag

SEQ ID NO: 196283 - DNA, 19 bp, Artificial sequence
  SiRNA target sequence
ctctaaataaaaagctaga

SEQ ID NO: 196284 - DNA, 19 bp, Artificial sequence
  SiRNA target sequence
tctaaataaaaagctagat

SEQ ID NO: 196285 - DNA, 19 bp, Artificial sequence
  SiRNA target sequence
ctaaataaaaagctagatg

SEQ ID NO: 196286 - DNA, 19 bp, Artificial sequence
  SiRNA target sequence
taaataaaaagctagatgg

SEQ ID NO: 196287 - DNA, 19 bp, Artificial sequence
  SiRNA target sequence
aaataaaaagctagatggt

SEQ ID NO: 196288 - DNA, 19 bp, Artificial sequence
  SiRNA target sequence
aataaaaagctagatggtg

SEQ ID NO: 196289 - DNA, 19 bp, Artificial sequence
  SiRNA target sequence
ataaaaagctagatggtgt

SEQ ID NO: 196290 - DNA, 19 bp, Artificial sequence
  SiRNA target sequence
taaaaagctagatggtgtt

SEQ ID NO: 196291 - DNA, 19 bp, Artificial sequence
  SiRNA target sequence
aaaaagctagatggtgtta

SEQ ID NO: 196292 - DNA, 19 bp, Artificial sequence
  SiRNA target sequence
aaaagctagatggtgttac

SEQ ID NO: 196293 - DNA, 19 bp, Artificial sequence
  SiRNA target sequence
aaagctagatggtgttact

SEQ ID NO: 196294 - DNA, 19 bp, Artificial sequence
  SiRNA target sequence
aagctagatggtgttactt

SEQ ID NO: 196295 - DNA, 19 bp, Artificial sequence
  SiRNA target sequence
agctagatggtgttacttt

SEQ ID NO: 196296 - DNA, 19 bp, Artificial sequence
  SiRNA target sequence
gctagatggtgttactttc

SEQ ID NO: 196297 - DNA, 19 bp, Artificial sequence
  SiRNA target sequence
ctagatggtgttactttct

SEQ ID NO: 196298 - DNA, 19 bp, Artificial sequence
  SiRNA target sequence
tagatggtgttactttctc

SEQ ID NO: 196299 - DNA, 19 bp, Artificial sequence
  SiRNA target sequence
agatggtgttactttctct

SEQ ID NO: 196300 - DNA, 19 bp, Artificial sequence
  SiRNA target sequence
gatggtgttactttctctt

SEQ ID NO: 196301 - DNA, 19 bp, Artificial sequence
  SiRNA target sequence
atggtgttactttctcttc

SEQ ID NO: 196302 - DNA, 19 bp, Artificial sequence
  SiRNA target sequence
tggtgttactttctcttca

SEQ ID NO: 196303 - DNA, 19 bp, Artificial sequence
  SiRNA target sequence
ggtgttactttctcttcaa

SEQ ID NO: 196304 - DNA, 19 bp, Artificial sequence
  SiRNA target sequence
gtgttactttctcttcaaa

SEQ ID NO: 196305 - DNA, 19 bp, Artificial sequence
  SiRNA target sequence
tgttactttctcttcaaac

SEQ ID NO: 196306 - DNA, 19 bp, Artificial sequence
  SiRNA target sequence
gttactttctcttcaaaca

SEQ ID NO: 196307 - DNA, 19 bp, Artificial sequence
  SiRNA target sequence
ttactttctcttcaaacaa

SEQ ID NO: 196308 - DNA, 19 bp, Artificial sequence
  SiRNA target sequence
tactttctcttcaaacaaa

SEQ ID NO: 196309 - DNA, 19 bp, Artificial sequence
  SiRNA target sequence
actttctcttcaaacaaaa

SEQ ID NO: 196310 - DNA, 19 bp, Artificial sequence
  SiRNA target sequence
ctttctcttcaaacaaaaa

SEQ ID NO: 196311 - DNA, 19 bp, Artificial sequence
  SiRNA target sequence
tttctcttcaaacaaaaag

SEQ ID NO: 196312 - DNA, 19 bp, Artificial sequence
  SiRNA target sequence
ttctcttcaaacaaaaaga

SEQ ID NO: 196313 - DNA, 19 bp, Artificial sequence
  SiRNA target sequence
tctcttcaaacaaaaagat

SEQ ID NO: 196314 - DNA, 19 bp, Artificial sequence
  SiRNA target sequence
ctcttcaaacaaaaagatt

SEQ ID NO: 196315 - DNA, 19 bp, Artificial sequence
  SiRNA target sequence
tcttcaaacaaaaagattg

SEQ ID NO: 196316 - DNA, 19 bp, Artificial sequence
  SiRNA target sequence
cttcaaacaaaaagattgc

SEQ ID NO: 196317 - DNA, 19 bp, Artificial sequence
  SiRNA target sequence
ttcaaacaaaaagattgcc

SEQ ID NO: 196318 - DNA, 19 bp, Artificial sequence
  SiRNA target sequence
tcaaacaaaaagattgccc

SEQ ID NO: 196319 - DNA, 19 bp, Artificial sequence
  SiRNA target sequence
caaacaaaaagattgcccc

SEQ ID NO: 196320 - DNA, 19 bp, Artificial sequence
  SiRNA target sequence
aaacaaaaagattgcccct

SEQ ID NO: 196321 - DNA, 19 bp, Artificial sequence
  SiRNA target sequence
aacaaaaagattgccccta

SEQ ID NO: 196322 - DNA, 19 bp, Artificial sequence
  SiRNA target sequence
acaaaaagattgcccctag

SEQ ID NO: 196323 - DNA, 19 bp, Artificial sequence
  SiRNA target sequence
caaaaagattgcccctagt

SEQ ID NO: 196324 - DNA, 19 bp, Artificial sequence
  SiRNA target sequence
aaaaagattgcccctagtc

SEQ ID NO: 196325 - DNA, 19 bp, Artificial sequence
  SiRNA target sequence
aaaagattgcccctagtcc

SEQ ID NO: 196326 - DNA, 19 bp, Artificial sequence
  SiRNA target sequence
aaagattgcccctagtccg

SEQ ID NO: 196327 - DNA, 19 bp, Artificial sequence
  SiRNA target sequence
aagattgcccctagtccga

SEQ ID NO: 196328 - DNA, 19 bp, Artificial sequence
  SiRNA target sequence
agattgcccctagtccgaa

SEQ ID NO: 196329 - DNA, 19 bp, Artificial sequence
  SiRNA target sequence
gattgcccctagtccgaag

SEQ ID NO: 196330 - DNA, 19 bp, Artificial sequence
  SiRNA target sequence
attgcccctagtccgaaga

SEQ ID NO: 196331 - DNA, 19 bp, Artificial sequence
  SiRNA target sequence
ttgcccctagtccgaagaa

SEQ ID NO: 196332 - DNA, 19 bp, Artificial sequence
  SiRNA target sequence
tgcccctagtccgaagaaa

SEQ ID NO: 196333 - DNA, 19 bp, Artificial sequence
  SiRNA target sequence
gcccctagtccgaagaaaa

SEQ ID NO: 196334 - DNA, 19 bp, Artificial sequence
  SiRNA target sequence
cccctagtccgaagaaaaa

SEQ ID NO: 196335 - DNA, 19 bp, Artificial sequence
  SiRNA target sequence
ccctagtccgaagaaaaat

SEQ ID NO: 196336 - DNA, 19 bp, Artificial sequence
  SiRNA target sequence
cctagtccgaagaaaaatg

SEQ ID NO: 196337 - DNA, 19 bp, Artificial sequence
  SiRNA target sequence
ctagtccgaagaaaaatgc

SEQ ID NO: 196338 - DNA, 19 bp, Artificial sequence
  SiRNA target sequence
tagtccgaagaaaaatgca

SEQ ID NO: 196339 - DNA, 19 bp, Artificial sequence
  SiRNA target sequence
agtccgaagaaaaatgcag

SEQ ID NO: 196340 - DNA, 19 bp, Artificial sequence
  SiRNA target sequence
gtccgaagaaaaatgcagt

SEQ ID NO: 196341 - DNA, 19 bp, Artificial sequence
  SiRNA target sequence
tccgaagaaaaatgcagta

SEQ ID NO: 196342 - DNA, 19 bp, Artificial sequence
  SiRNA target sequence
ccgaagaaaaatgcagtaa

SEQ ID NO: 196343 - DNA, 19 bp, Artificial sequence
  SiRNA target sequence
cgaagaaaaatgcagtaaa

SEQ ID NO: 196344 - DNA, 19 bp, Artificial sequence
  SiRNA target sequence
gaagaaaaatgcagtaaaa

SEQ ID NO: 196345 - DNA, 19 bp, Artificial sequence
  SiRNA target sequence
aagaaaaatgcagtaaaaa

SEQ ID NO: 196346 - DNA, 19 bp, Artificial sequence
  SiRNA target sequence
agaaaaatgcagtaaaaat

SEQ ID NO: 196347 - DNA, 19 bp, Artificial sequence
  SiRNA target sequence
gaaaaatgcagtaaaaatt

SEQ ID NO: 196348 - DNA, 19 bp, Artificial sequence
  SiRNA target sequence
aaaaatgcagtaaaaatta

SEQ ID NO: 196349 - DNA, 19 bp, Artificial sequence
  SiRNA target sequence
aaaatgcagtaaaaattat

SEQ ID NO: 196350 - DNA, 19 bp, Artificial sequence
  SiRNA target sequence
aaatgcagtaaaaattatt

SEQ ID NO: 196351 - DNA, 19 bp, Artificial sequence
  SiRNA target sequence
aatgcagtaaaaattatta

SEQ ID NO: 196352 - DNA, 19 bp, Artificial sequence
  SiRNA target sequence
atgcagtaaaaattattag

SEQ ID NO: 196353 - DNA, 19 bp, Artificial sequence
  SiRNA target sequence
tgcagtaaaaattattaga

SEQ ID NO: 196354 - DNA, 19 bp, Artificial sequence
  SiRNA target sequence
gcagtaaaaattattagaa

SEQ ID NO: 196355 - DNA, 19 bp, Artificial sequence
  SiRNA target sequence
cagtaaaaattattagaaa

SEQ ID NO: 196356 - DNA, 19 bp, Artificial sequence
  SiRNA target sequence
agtaaaaattattagaaat

SEQ ID NO: 196357 - DNA, 19 bp, Artificial sequence
  SiRNA target sequence
gtaaaaattattagaaata

SEQ ID NO: 196358 - DNA, 19 bp, Artificial sequence
  SiRNA target sequence
taaaaattattagaaatag

SEQ ID NO: 196359 - DNA, 19 bp, Artificial sequence
  SiRNA target sequence
aaaaattattagaaataga

SEQ ID NO: 196360 - DNA, 19 bp, Artificial sequence
  SiRNA target sequence
aaaattattagaaatagat

SEQ ID NO: 196361 - DNA, 19 bp, Artificial sequence
  SiRNA target sequence
aaattattagaaatagatt

SEQ ID NO: 196362 - DNA, 19 bp, Artificial sequence
  SiRNA target sequence
aattattagaaatagatta

SEQ ID NO: 196363 - DNA, 19 bp, Artificial sequence
  SiRNA target sequence
attattagaaatagattaa

SEQ ID NO: 196364 - DNA, 19 bp, Artificial sequence
  SiRNA target sequence
ttattagaaatagattaaa

SEQ ID NO: 196365 - DNA, 19 bp, Artificial sequence
  SiRNA target sequence
tattagaaatagattaaaa

SEQ ID NO: 196366 - DNA, 19 bp, Artificial sequence
  SiRNA target sequence
attagaaatagattaaaaa

SEQ ID NO: 196367 - DNA, 19 bp, Artificial sequence
  SiRNA target sequence
ttagaaatagattaaaaat

SEQ ID NO: 196368 - DNA, 19 bp, Artificial sequence
  SiRNA target sequence
tagaaatagattaaaaatc

SEQ ID NO: 196369 - DNA, 19 bp, Artificial sequence
  SiRNA target sequence
agaaatagattaaaaatcg

SEQ ID NO: 196370 - DNA, 19 bp, Artificial sequence
  SiRNA target sequence
gaaatagattaaaaatcga

SEQ ID NO: 196371 - DNA, 19 bp, Artificial sequence
  SiRNA target sequence
aaatagattaaaaatcgat

SEQ ID NO: 196372 - DNA, 19 bp, Artificial sequence
  SiRNA target sequence
aatagattaaaaatcgatg

SEQ ID NO: 196373 - DNA, 19 bp, Artificial sequence
  SiRNA target sequence
atagattaaaaatcgatga

SEQ ID NO: 196374 - DNA, 19 bp, Artificial sequence
  SiRNA target sequence
tagattaaaaatcgatgat

SEQ ID NO: 196375 - DNA, 19 bp, Artificial sequence
  SiRNA target sequence
agattaaaaatcgatgata

SEQ ID NO: 196376 - DNA, 19 bp, Artificial sequence
  SiRNA target sequence
gattaaaaatcgatgatac

SEQ ID NO: 196377 - DNA, 19 bp, Artificial sequence
  SiRNA target sequence
attaaaaatcgatgataca

SEQ ID NO: 196378 - DNA, 19 bp, Artificial sequence
  SiRNA target sequence
ttaaaaatcgatgatacag

SEQ ID NO: 196379 - DNA, 19 bp, Artificial sequence
  SiRNA target sequence
taaaaatcgatgatacagg

SEQ ID NO: 196380 - DNA, 19 bp, Artificial sequence
  SiRNA target sequence
aaaaatcgatgatacaggt

SEQ ID NO: 196381 - DNA, 19 bp, Artificial sequence
  SiRNA target sequence
aaaatcgatgatacaggtt

SEQ ID NO: 196382 - DNA, 19 bp, Artificial sequence
  SiRNA target sequence
aaatcgatgatacaggttt

SEQ ID NO: 196383 - DNA, 19 bp, Artificial sequence
  SiRNA target sequence
aatcgatgatacaggttta

SEQ ID NO: 196384 - DNA, 19 bp, Artificial sequence
  SiRNA target sequence
atcgatgatacaggtttat

SEQ ID NO: 196385 - DNA, 19 bp, Artificial sequence
  SiRNA target sequence
tcgatgatacaggtttatt

SEQ ID NO: 196386 - DNA, 19 bp, Artificial sequence
  SiRNA target sequence
cgatgatacaggtttattt

SEQ ID NO: 196387 - DNA, 19 bp, Artificial sequence
  SiRNA target sequence
gatgatacaggtttatttt

SEQ ID NO: 196388 - DNA, 19 bp, Artificial sequence
  SiRNA target sequence
atgatacaggtttattttg

SEQ ID NO: 196389 - DNA, 19 bp, Artificial sequence
  SiRNA target sequence
tgatacaggtttattttgc

SEQ ID NO: 196390 - DNA, 19 bp, Artificial sequence
  SiRNA target sequence
gatacaggtttattttgca

SEQ ID NO: 196391 - DNA, 19 bp, Artificial sequence
  SiRNA target sequence
atacaggtttattttgcat

SEQ ID NO: 196392 - DNA, 19 bp, Artificial sequence
  SiRNA target sequence
tacaggtttattttgcata

SEQ ID NO: 196393 - DNA, 19 bp, Artificial sequence
  SiRNA target sequence
acaggtttattttgcataa

SEQ ID NO: 196394 - DNA, 19 bp, Artificial sequence
  SiRNA target sequence
caggtttattttgcataag

SEQ ID NO: 196395 - DNA, 19 bp, Artificial sequence
  SiRNA target sequence
aggtttattttgcataagc

SEQ ID NO: 196396 - DNA, 19 bp, Artificial sequence
  SiRNA target sequence
ggtttattttgcataagcc

SEQ ID NO: 196397 - DNA, 19 bp, Artificial sequence
  SiRNA target sequence
gtttattttgcataagcca

SEQ ID NO: 196398 - DNA, 19 bp, Artificial sequence
  SiRNA target sequence
tttattttgcataagccac

SEQ ID NO: 196399 - DNA, 19 bp, Artificial sequence
  SiRNA target sequence
ttattttgcataagccact

SEQ ID NO: 196400 - DNA, 19 bp, Artificial sequence
  SiRNA target sequence
tattttgcataagccactg

SEQ ID NO: 196401 - DNA, 19 bp, Artificial sequence
  SiRNA target sequence
attttgcataagccactgt

SEQ ID NO: 196402 - DNA, 19 bp, Artificial sequence
  SiRNA target sequence
ttttgcataagccactgta

SEQ ID NO: 196403 - DNA, 19 bp, Artificial sequence
  SiRNA target sequence
tttgcataagccactgtat

SEQ ID NO: 196404 - DNA, 19 bp, Artificial sequence
  SiRNA target sequence
ttgcataagccactgtatt

SEQ ID NO: 196405 - DNA, 19 bp, Artificial sequence
  SiRNA target sequence
tgcataagccactgtatta

SEQ ID NO: 196406 - DNA, 19 bp, Artificial sequence
  SiRNA target sequence
gcataagccactgtattaa

SEQ ID NO: 196407 - DNA, 19 bp, Artificial sequence
  SiRNA target sequence
cataagccactgtattaaa

SEQ ID NO: 196408 - DNA, 19 bp, Artificial sequence
  SiRNA target sequence
ataagccactgtattaaaa

SEQ ID NO: 196409 - DNA, 19 bp, Artificial sequence
  SiRNA target sequence
taagccactgtattaaaat

SEQ ID NO: 196410 - DNA, 19 bp, Artificial sequence
  SiRNA target sequence
aagccactgtattaaaatt

SEQ ID NO: 196411 - DNA, 19 bp, Artificial sequence
  SiRNA target sequence
agccactgtattaaaatta

SEQ ID NO: 196412 - DNA, 19 bp, Artificial sequence
  SiRNA target sequence
gccactgtattaaaattac

SEQ ID NO: 196413 - DNA, 19 bp, Artificial sequence
  SiRNA target sequence
ccactgtattaaaattaca

SEQ ID NO: 196414 - DNA, 19 bp, Artificial sequence
  SiRNA target sequence
cactgtattaaaattacag

SEQ ID NO: 196415 - DNA, 19 bp, Artificial sequence
  SiRNA target sequence
actgtattaaaattacaga

SEQ ID NO: 196416 - DNA, 19 bp, Artificial sequence
  SiRNA target sequence
ctgtattaaaattacagat

SEQ ID NO: 196417 - DNA, 19 bp, Artificial sequence
  SiRNA target sequence
tgtattaaaattacagatg

SEQ ID NO: 196418 - DNA, 19 bp, Artificial sequence
  SiRNA target sequence
gtattaaaattacagatgc

SEQ ID NO: 196419 - DNA, 19 bp, Artificial sequence
  SiRNA target sequence
tattaaaattacagatgca

SEQ ID NO: 196420 - DNA, 19 bp, Artificial sequence
  SiRNA target sequence
attaaaattacagatgcaa

SEQ ID NO: 196421 - DNA, 19 bp, Artificial sequence
  SiRNA target sequence
ttaaaattacagatgcaaa

SEQ ID NO: 196422 - DNA, 19 bp, Artificial sequence
  SiRNA target sequence
taaaattacagatgcaaaa

SEQ ID NO: 196423 - DNA, 19 bp, Artificial sequence
  SiRNA target sequence
aaaattacagatgcaaaag

SEQ ID NO: 196424 - DNA, 19 bp, Artificial sequence
  SiRNA target sequence
aaattacagatgcaaaaga

SEQ ID NO: 196425 - DNA, 19 bp, Artificial sequence
  SiRNA target sequence
aattacagatgcaaaagat

SEQ ID NO: 196426 - DNA, 19 bp, Artificial sequence
  SiRNA target sequence
attacagatgcaaaagata

SEQ ID NO: 196427 - DNA, 19 bp, Artificial sequence
  SiRNA target sequence
ttacagatgcaaaagatat

SEQ ID NO: 196428 - DNA, 19 bp, Artificial sequence
  SiRNA target sequence
tacagatgcaaaagatata

SEQ ID NO: 196429 - DNA, 19 bp, Artificial sequence
  SiRNA target sequence
acagatgcaaaagatatag

SEQ ID NO: 196430 - DNA, 19 bp, Artificial sequence
  SiRNA target sequence
cagatgcaaaagatatagg

SEQ ID NO: 196431 - DNA, 19 bp, Artificial sequence
  SiRNA target sequence
agatgcaaaagatatagga

SEQ ID NO: 196432 - DNA, 19 bp, Artificial sequence
  SiRNA target sequence
gatgcaaaagatataggaa

SEQ ID NO: 196433 - DNA, 19 bp, Artificial sequence
  SiRNA target sequence
atgcaaaagatataggaag

SEQ ID NO: 196434 - DNA, 19 bp, Artificial sequence
  SiRNA target sequence
tgcaaaagatataggaaga

SEQ ID NO: 196435 - DNA, 19 bp, Artificial sequence
  SiRNA target sequence
gcaaaagatataggaagaa

SEQ ID NO: 196436 - DNA, 19 bp, Artificial sequence
  SiRNA target sequence
caaaagatataggaagaac

SEQ ID NO: 196437 - DNA, 19 bp, Artificial sequence
  SiRNA target sequence
aaaagatataggaagaaca

SEQ ID NO: 196438 - DNA, 19 bp, Artificial sequence
  SiRNA target sequence
aaagatataggaagaacat

SEQ ID NO: 196439 - DNA, 19 bp, Artificial sequence
  SiRNA target sequence
aagatataggaagaacata

SEQ ID NO: 196440 - DNA, 19 bp, Artificial sequence
  SiRNA target sequence
agatataggaagaacataa

SEQ ID NO: 196441 - DNA, 19 bp, Artificial sequence
  SiRNA target sequence
gatataggaagaacataaa

SEQ ID NO: 196442 - DNA, 19 bp, Artificial sequence
  SiRNA target sequence
atataggaagaacataaaa

SEQ ID NO: 196443 - DNA, 19 bp, Artificial sequence
  SiRNA target sequence
tataggaagaacataaaaa

SEQ ID NO: 196444 - DNA, 19 bp, Artificial sequence
  SiRNA target sequence
ataggaagaacataaaaaa

SEQ ID NO: 196445 - DNA, 19 bp, Artificial sequence
  SiRNA target sequence
taggaagaacataaaaaat

SEQ ID NO: 196446 - DNA, 19 bp, Artificial sequence
  SiRNA target sequence
aggaagaacataaaaaatt

SEQ ID NO: 196447 - DNA, 19 bp, Artificial sequence
  SiRNA target sequence
ggaagaacataaaaaattt

SEQ ID NO: 196448 - DNA, 19 bp, Artificial sequence
  SiRNA target sequence
gaagaacataaaaaatttt

SEQ ID NO: 196449 - DNA, 19 bp, Artificial sequence
  SiRNA target sequence
aagaacataaaaaattttc

SEQ ID NO: 196450 - DNA, 19 bp, Artificial sequence
  SiRNA target sequence
agaacataaaaaattttca

SEQ ID NO: 196451 - DNA, 19 bp, Artificial sequence
  SiRNA target sequence
gaacataaaaaattttcat

SEQ ID NO: 196452 - DNA, 19 bp, Artificial sequence
  SiRNA target sequence
aacataaaaaattttcata

SEQ ID NO: 196453 - DNA, 19 bp, Artificial sequence
  SiRNA target sequence
acataaaaaattttcataa

SEQ ID NO: 196454 - DNA, 19 bp, Artificial sequence
  SiRNA target sequence
cataaaaaattttcataaa

SEQ ID NO: 196455 - DNA, 19 bp, Artificial sequence
  SiRNA target sequence
ataaaaaattttcataaac

SEQ ID NO: 196456 - DNA, 19 bp, Artificial sequence
  SiRNA target sequence
taaaaaattttcataaaca

SEQ ID NO: 196457 - DNA, 19 bp, Artificial sequence
  SiRNA target sequence
aaaaaattttcataaacat

SEQ ID NO: 196458 - DNA, 19 bp, Artificial sequence
  SiRNA target sequence
aaaaattttcataaacata

SEQ ID NO: 196459 - DNA, 19 bp, Artificial sequence
  SiRNA target sequence
aaaattttcataaacataa

SEQ ID NO: 196460 - DNA, 19 bp, Artificial sequence
  SiRNA target sequence
aaattttcataaacataat

SEQ ID NO: 196461 - DNA, 19 bp, Artificial sequence
  SiRNA target sequence
aattttcataaacataatt

SEQ ID NO: 196462 - DNA, 19 bp, Artificial sequence
  SiRNA target sequence
attttcataaacataattg

SEQ ID NO: 196463 - DNA, 19 bp, Artificial sequence
  SiRNA target sequence
ttttcataaacataattga

SEQ ID NO: 196464 - DNA, 19 bp, Artificial sequence
  SiRNA target sequence
tttcataaacataattgaa

SEQ ID NO: 196465 - DNA, 19 bp, Artificial sequence
  SiRNA target sequence
ttcataaacataattgaat

SEQ ID NO: 196466 - DNA, 19 bp, Artificial sequence
  SiRNA target sequence
tcataaacataattgaatt

SEQ ID NO: 196467 - DNA, 19 bp, Artificial sequence
  SiRNA target sequence
cataaacataattgaattc

SEQ ID NO: 196468 - DNA, 19 bp, Artificial sequence
  SiRNA target sequence
ataaacataattgaattct

SEQ ID NO: 196469 - DNA, 19 bp, Artificial sequence
  SiRNA target sequence
taaacataattgaattctg

SEQ ID NO: 196470 - DNA, 19 bp, Artificial sequence
  SiRNA target sequence
aaacataattgaattctga

SEQ ID NO: 196471 - DNA, 19 bp, Artificial sequence
  SiRNA target sequence
aacataattgaattctgat

SEQ ID NO: 196472 - DNA, 19 bp, Artificial sequence
  SiRNA target sequence
acataattgaattctgatc

SEQ ID NO: 196473 - DNA, 19 bp, Artificial sequence
  SiRNA target sequence
cataattgaattctgatct

SEQ ID NO: 196474 - DNA, 19 bp, Artificial sequence
  SiRNA target sequence
ataattgaattctgatctt

SEQ ID NO: 196475 - DNA, 19 bp, Artificial sequence
  SiRNA target sequence
taattgaattctgatcttg

SEQ ID NO: 196476 - DNA, 19 bp, Artificial sequence
  SiRNA target sequence
aattgaattctgatcttgc

SEQ ID NO: 196477 - DNA, 19 bp, Artificial sequence
  SiRNA target sequence
attgaattctgatcttgcc

SEQ ID NO: 196478 - DNA, 19 bp, Artificial sequence
  SiRNA target sequence
ttgaattctgatcttgcct

SEQ ID NO: 196479 - DNA, 19 bp, Artificial sequence
  SiRNA target sequence
tgaattctgatcttgcctt

SEQ ID NO: 196480 - DNA, 19 bp, Artificial sequence
  SiRNA target sequence
gaattctgatcttgcctta

SEQ ID NO: 196481 - DNA, 19 bp, Artificial sequence
  SiRNA target sequence
aattctgatcttgccttac

SEQ ID NO: 196482 - DNA, 19 bp, Artificial sequence
  SiRNA target sequence
attctgatcttgccttacc

SEQ ID NO: 196483 - DNA, 19 bp, Artificial sequence
  SiRNA target sequence
ttctgatcttgccttacca

SEQ ID NO: 196484 - DNA, 19 bp, Artificial sequence
  SiRNA target sequence
tctgatcttgccttaccat

SEQ ID NO: 196485 - DNA, 19 bp, Artificial sequence
  SiRNA target sequence
ctgatcttgccttaccatc

SEQ ID NO: 196486 - DNA, 19 bp, Artificial sequence
  SiRNA target sequence
tgatcttgccttaccatca

SEQ ID NO: 196487 - DNA, 19 bp, Artificial sequence
  SiRNA target sequence
gatcttgccttaccatcac

SEQ ID NO: 196488 - DNA, 19 bp, Artificial sequence
  SiRNA target sequence
atcttgccttaccatcaca

SEQ ID NO: 196489 - DNA, 19 bp, Artificial sequence
  SiRNA target sequence
tcttgccttaccatcacaa

SEQ ID NO: 196490 - DNA, 19 bp, Artificial sequence
  SiRNA target sequence
cttgccttaccatcacaaa

SEQ ID NO: 196491 - DNA, 19 bp, Artificial sequence
  SiRNA target sequence
ttgccttaccatcacaaat

SEQ ID NO: 196492 - DNA, 19 bp, Artificial sequence
  SiRNA target sequence
tgccttaccatcacaaata

SEQ ID NO: 196493 - DNA, 19 bp, Artificial sequence
  SiRNA target sequence
gccttaccatcacaaataa

SEQ ID NO: 196494 - DNA, 19 bp, Artificial sequence
  SiRNA target sequence
ccttaccatcacaaataaa

SEQ ID NO: 196495 - DNA, 19 bp, Artificial sequence
  SiRNA target sequence
cttaccatcacaaataaat

SEQ ID NO: 196496 - DNA, 19 bp, Artificial sequence
  SiRNA target sequence
ttaccatcacaaataaatc

SEQ ID NO: 196497 - DNA, 19 bp, Artificial sequence
  SiRNA target sequence
taccatcacaaataaatct

SEQ ID NO: 196498 - DNA, 19 bp, Artificial sequence
  SiRNA target sequence
accatcacaaataaatctt

SEQ ID NO: 196499 - DNA, 19 bp, Artificial sequence
  SiRNA target sequence
ccatcacaaataaatcttt

SEQ ID NO: 196500 - DNA, 19 bp, Artificial sequence
  SiRNA target sequence
catcacaaataaatctttt

SEQ ID NO: 196501 - DNA, 19 bp, Artificial sequence
  SiRNA target sequence
atcacaaataaatctttta

SEQ ID NO: 196502 - DNA, 19 bp, Artificial sequence
  SiRNA target sequence
tcacaaataaatcttttaa

SEQ ID NO: 196503 - DNA, 19 bp, Artificial sequence
  SiRNA target sequence
cacaaataaatcttttaaa

SEQ ID NO: 196504 - DNA, 19 bp, Artificial sequence
  SiRNA target sequence
acaaataaatcttttaaaa

SEQ ID NO: 196505 - DNA, 19 bp, Artificial sequence
  SiRNA target sequence
caaataaatcttttaaaat

SEQ ID NO: 196506 - DNA, 19 bp, Artificial sequence
  SiRNA target sequence
aaataaatcttttaaaatt

SEQ ID NO: 196507 - DNA, 19 bp, Artificial sequence
  SiRNA target sequence
aataaatcttttaaaattc

SEQ ID NO: 196508 - DNA, 19 bp, Artificial sequence
  SiRNA target sequence
ataaatcttttaaaattct

SEQ ID NO: 196509 - DNA, 19 bp, Artificial sequence
  SiRNA target sequence
taaatcttttaaaattctt

SEQ ID NO: 196510 - DNA, 19 bp, Artificial sequence
  SiRNA target sequence
aaatcttttaaaattctta

SEQ ID NO: 196511 - DNA, 19 bp, Artificial sequence
  SiRNA target sequence
aatcttttaaaattcttaa

SEQ ID NO: 196512 - DNA, 19 bp, Artificial sequence
  SiRNA target sequence
atcttttaaaattcttaaa

SEQ ID NO: 196513 - DNA, 19 bp, Artificial sequence
  SiRNA target sequence
tcttttaaaattcttaaaa

SEQ ID NO: 196514 - DNA, 19 bp, Artificial sequence
  SiRNA target sequence
cttttaaaattcttaaaaa

SEQ ID NO: 196515 - DNA, 19 bp, Artificial sequence
  SiRNA target sequence
ttttaaaattcttaaaaat

SEQ ID NO: 196516 - DNA, 19 bp, Artificial sequence
  SiRNA target sequence
tttaaaattcttaaaaatg

SEQ ID NO: 196517 - DNA, 19 bp, Artificial sequence
  SiRNA target sequence
ttaaaattcttaaaaatga

SEQ ID NO: 196518 - DNA, 19 bp, Artificial sequence
  SiRNA target sequence
taaaattcttaaaaatgaa

SEQ ID NO: 196519 - DNA, 19 bp, Artificial sequence
  SiRNA target sequence
aaaattcttaaaaatgaat

SEQ ID NO: 196520 - DNA, 19 bp, Artificial sequence
  SiRNA target sequence
aaattcttaaaaatgaata

SEQ ID NO: 196521 - DNA, 19 bp, Artificial sequence
  SiRNA target sequence
aattcttaaaaatgaatac

SEQ ID NO: 196522 - DNA, 19 bp, Artificial sequence
  SiRNA target sequence
attcttaaaaatgaataca

SEQ ID NO: 196523 - DNA, 19 bp, Artificial sequence
  SiRNA target sequence
ttcttaaaaatgaatacac

SEQ ID NO: 196524 - DNA, 19 bp, Artificial sequence
  SiRNA target sequence
tcttaaaaatgaatacaca

SEQ ID NO: 196525 - DNA, 19 bp, Artificial sequence
  SiRNA target sequence
cttaaaaatgaatacacaa

SEQ ID NO: 196526 - DNA, 19 bp, Artificial sequence
  SiRNA target sequence
ttaaaaatgaatacacaaa

SEQ ID NO: 196527 - DNA, 19 bp, Artificial sequence
  SiRNA target sequence
taaaaatgaatacacaaag

SEQ ID NO: 196528 - DNA, 19 bp, Artificial sequence
  SiRNA target sequence
aaaaatgaatacacaaagt

SEQ ID NO: 196529 - DNA, 19 bp, Artificial sequence
  SiRNA target sequence
aaaatgaatacacaaagtt

SEQ ID NO: 196530 - DNA, 19 bp, Artificial sequence
  SiRNA target sequence
aaatgaatacacaaagtta

SEQ ID NO: 196531 - DNA, 19 bp, Artificial sequence
  SiRNA target sequence
aatgaatacacaaagttaa

SEQ ID NO: 196532 - DNA, 19 bp, Artificial sequence
  SiRNA target sequence
atgaatacacaaagttaat

SEQ ID NO: 196533 - DNA, 19 bp, Artificial sequence
  SiRNA target sequence
tgaatacacaaagttaatt

SEQ ID NO: 196534 - DNA, 19 bp, Artificial sequence
  SiRNA target sequence
gaatacacaaagttaatta

SEQ ID NO: 196535 - DNA, 19 bp, Artificial sequence
  SiRNA target sequence
aatacacaaagttaattaa

SEQ ID NO: 196536 - DNA, 19 bp, Artificial sequence
  SiRNA target sequence
atacacaaagttaattaat

SEQ ID NO: 196537 - DNA, 19 bp, Artificial sequence
  SiRNA target sequence
tacacaaagttaattaatc

SEQ ID NO: 196538 - DNA, 19 bp, Artificial sequence
  SiRNA target sequence
acacaaagttaattaatcc

SEQ ID NO: 196539 - DNA, 19 bp, Artificial sequence
  SiRNA target sequence
cacaaagttaattaatcca

SEQ ID NO: 196540 - DNA, 19 bp, Artificial sequence
  SiRNA target sequence
acaaagttaattaatccaa

SEQ ID NO: 196541 - DNA, 19 bp, Artificial sequence
  SiRNA target sequence
caaagttaattaatccaaa

SEQ ID NO: 196542 - DNA, 19 bp, Artificial sequence
  SiRNA target sequence
aaagttaattaatccaaac

SEQ ID NO: 196543 - DNA, 19 bp, Artificial sequence
  SiRNA target sequence
aagttaattaatccaaaca

SEQ ID NO: 196544 - DNA, 19 bp, Artificial sequence
  SiRNA target sequence
agttaattaatccaaacat

SEQ ID NO: 196545 - DNA, 19 bp, Artificial sequence
  SiRNA target sequence
gttaattaatccaaacata

SEQ ID NO: 196546 - DNA, 19 bp, Artificial sequence
  SiRNA target sequence
ttaattaatccaaacataa

SEQ ID NO: 196547 - DNA, 19 bp, Artificial sequence
  SiRNA target sequence
taattaatccaaacataat

SEQ ID NO: 196548 - DNA, 19 bp, Artificial sequence
  SiRNA target sequence
aattaatccaaacataata

SEQ ID NO: 196549 - DNA, 19 bp, Artificial sequence
  SiRNA target sequence
attaatccaaacataatac

SEQ ID NO: 196550 - DNA, 19 bp, Artificial sequence
  SiRNA target sequence
ttaatccaaacataatacc

SEQ ID NO: 196551 - DNA, 19 bp, Artificial sequence
  SiRNA target sequence
taatccaaacataatacca

SEQ ID NO: 196552 - DNA, 19 bp, Artificial sequence
  SiRNA target sequence
aatccaaacataataccaa

SEQ ID NO: 196553 - DNA, 19 bp, Artificial sequence
  SiRNA target sequence
atccaaacataataccaag

SEQ ID NO: 196554 - DNA, 19 bp, Artificial sequence
  SiRNA target sequence
tccaaacataataccaagt

SEQ ID NO: 196555 - DNA, 19 bp, Artificial sequence
  SiRNA target sequence
ccaaacataataccaagta

SEQ ID NO: 196556 - DNA, 19 bp, Artificial sequence
  SiRNA target sequence
caaacataataccaagtat

SEQ ID NO: 196557 - DNA, 19 bp, Artificial sequence
  SiRNA target sequence
aaacataataccaagtata

SEQ ID NO: 196558 - DNA, 19 bp, Artificial sequence
  SiRNA target sequence
aacataataccaagtataa

SEQ ID NO: 196559 - DNA, 19 bp, Artificial sequence
  SiRNA target sequence
acataataccaagtataaa

SEQ ID NO: 196560 - DNA, 19 bp, Artificial sequence
  SiRNA target sequence
cataataccaagtataaaa

SEQ ID NO: 196561 - DNA, 19 bp, Artificial sequence
  SiRNA target sequence
ataataccaagtataaaaa

SEQ ID NO: 196562 - DNA, 19 bp, Artificial sequence
  SiRNA target sequence
taataccaagtataaaaaa

SEQ ID NO: 196563 - DNA, 19 bp, Artificial sequence
  SiRNA target sequence
aataccaagtataaaaaat

SEQ ID NO: 196564 - DNA, 19 bp, Artificial sequence
  SiRNA target sequence
ataccaagtataaaaaatt

SEQ ID NO: 196565 - DNA, 19 bp, Artificial sequence
  SiRNA target sequence
taccaagtataaaaaattt

SEQ ID NO: 196566 - DNA, 19 bp, Artificial sequence
  SiRNA target sequence
accaagtataaaaaattta

SEQ ID NO: 196567 - DNA, 19 bp, Artificial sequence
  SiRNA target sequence
ccaagtataaaaaatttag

SEQ ID NO: 196568 - DNA, 19 bp, Artificial sequence
  SiRNA target sequence
caagtataaaaaatttagg

SEQ ID NO: 196569 - DNA, 19 bp, Artificial sequence
  SiRNA target sequence
aagtataaaaaatttaggc

SEQ ID NO: 196570 - DNA, 19 bp, Artificial sequence
  SiRNA target sequence
agtataaaaaatttaggca

SEQ ID NO: 196571 - DNA, 19 bp, Artificial sequence
  SiRNA target sequence
gtataaaaaatttaggcat

SEQ ID NO: 196572 - DNA, 19 bp, Artificial sequence
  SiRNA target sequence
tataaaaaatttaggcatt

SEQ ID NO: 196573 - DNA, 19 bp, Artificial sequence
  SiRNA target sequence
ataaaaaatttaggcattt

SEQ ID NO: 196574 - DNA, 19 bp, Artificial sequence
  SiRNA target sequence
taaaaaatttaggcatttc

SEQ ID NO: 196575 - DNA, 19 bp, Artificial sequence
  SiRNA target sequence
aaaaaatttaggcatttca

SEQ ID NO: 196576 - DNA, 19 bp, Artificial sequence
  SiRNA target sequence
aaaaatttaggcatttcaa

SEQ ID NO: 196577 - DNA, 19 bp, Artificial sequence
  SiRNA target sequence
aaaatttaggcatttcaac

SEQ ID NO: 196578 - DNA, 19 bp, Artificial sequence
  SiRNA target sequence
aaatttaggcatttcaacc

SEQ ID NO: 196579 - DNA, 19 bp, Artificial sequence
  SiRNA target sequence
aatttaggcatttcaacct

SEQ ID NO: 196580 - DNA, 19 bp, Artificial sequence
  SiRNA target sequence
atttaggcatttcaacctt

SEQ ID NO: 196581 - DNA, 19 bp, Artificial sequence
  SiRNA target sequence
tttaggcatttcaacctta

SEQ ID NO: 196582 - DNA, 19 bp, Artificial sequence
  SiRNA target sequence
ttaggcatttcaaccttag

SEQ ID NO: 196583 - DNA, 19 bp, Artificial sequence
  SiRNA target sequence
taggcatttcaaccttagc

SEQ ID NO: 196584 - DNA, 19 bp, Artificial sequence
  SiRNA target sequence
aggcatttcaaccttagca

SEQ ID NO: 196585 - DNA, 19 bp, Artificial sequence
  SiRNA target sequence
ggcatttcaaccttagcaa

SEQ ID NO: 196586 - DNA, 19 bp, Artificial sequence
  SiRNA target sequence
gcatttcaaccttagcaac

SEQ ID NO: 196587 - DNA, 19 bp, Artificial sequence
  SiRNA target sequence
catttcaaccttagcaact

SEQ ID NO: 196588 - DNA, 19 bp, Artificial sequence
  SiRNA target sequence
atttcaaccttagcaactt

SEQ ID NO: 196589 - DNA, 19 bp, Artificial sequence
  SiRNA target sequence
tttcaaccttagcaacttt

SEQ ID NO: 196590 - DNA, 19 bp, Artificial sequence
  SiRNA target sequence
ttcaaccttagcaacttta

SEQ ID NO: 196591 - DNA, 19 bp, Artificial sequence
  SiRNA target sequence
tcaaccttagcaactttaa

SEQ ID NO: 196592 - DNA, 19 bp, Artificial sequence
  SiRNA target sequence
caaccttagcaactttaaa

SEQ ID NO: 196593 - DNA, 19 bp, Artificial sequence
  SiRNA target sequence
aaccttagcaactttaaaa

SEQ ID NO: 196594 - DNA, 19 bp, Artificial sequence
  SiRNA target sequence
accttagcaactttaaaat

SEQ ID NO: 196595 - DNA, 19 bp, Artificial sequence
  SiRNA target sequence
ccttagcaactttaaaata

SEQ ID NO: 196596 - DNA, 19 bp, Artificial sequence
  SiRNA target sequence
cttagcaactttaaaataa

SEQ ID NO: 196597 - DNA, 19 bp, Artificial sequence
  SiRNA target sequence
ttagcaactttaaaataac

SEQ ID NO: 196598 - DNA, 19 bp, Artificial sequence
  SiRNA target sequence
tagcaactttaaaataact

SEQ ID NO: 196599 - DNA, 19 bp, Artificial sequence
  SiRNA target sequence
agcaactttaaaataactc

SEQ ID NO: 196600 - DNA, 19 bp, Artificial sequence
  SiRNA target sequence
gcaactttaaaataactca

SEQ ID NO: 196601 - DNA, 19 bp, Artificial sequence
  SiRNA target sequence
caactttaaaataactcag

SEQ ID NO: 196602 - DNA, 19 bp, Artificial sequence
  SiRNA target sequence
aactttaaaataactcagt

SEQ ID NO: 196603 - DNA, 19 bp, Artificial sequence
  SiRNA target sequence
actttaaaataactcagta

SEQ ID NO: 196604 - DNA, 19 bp, Artificial sequence
  SiRNA target sequence
ctttaaaataactcagtaa

SEQ ID NO: 196605 - DNA, 19 bp, Artificial sequence
  SiRNA target sequence
tttaaaataactcagtaat

SEQ ID NO: 196606 - DNA, 19 bp, Artificial sequence
  SiRNA target sequence
ttaaaataactcagtaatc

SEQ ID NO: 196607 - DNA, 19 bp, Artificial sequence
  SiRNA target sequence
taaaataactcagtaatcc

SEQ ID NO: 196608 - DNA, 19 bp, Artificial sequence
  SiRNA target sequence
aaaataactcagtaatcct

SEQ ID NO: 196609 - DNA, 19 bp, Artificial sequence
  SiRNA target sequence
aaataactcagtaatcctg

SEQ ID NO: 196610 - DNA, 19 bp, Artificial sequence
  SiRNA target sequence
aataactcagtaatcctgt

SEQ ID NO: 196611 - DNA, 19 bp, Artificial sequence
  SiRNA target sequence
ataactcagtaatcctgtt

SEQ ID NO: 196612 - DNA, 19 bp, Artificial sequence
  SiRNA target sequence
taactcagtaatcctgttc

SEQ ID NO: 196613 - DNA, 19 bp, Artificial sequence
  SiRNA target sequence
aactcagtaatcctgttct

SEQ ID NO: 196614 - DNA, 19 bp, Artificial sequence
  SiRNA target sequence
actcagtaatcctgttctt

SEQ ID NO: 196615 - DNA, 19 bp, Artificial sequence
  SiRNA target sequence
ctcagtaatcctgttcttg

SEQ ID NO: 196616 - DNA, 19 bp, Artificial sequence
  SiRNA target sequence
tcagtaatcctgttcttga

SEQ ID NO: 196617 - DNA, 19 bp, Artificial sequence
  SiRNA target sequence
cagtaatcctgttcttgaa

SEQ ID NO: 196618 - DNA, 19 bp, Artificial sequence
  SiRNA target sequence
agtaatcctgttcttgaat

SEQ ID NO: 196619 - DNA, 19 bp, Artificial sequence
  SiRNA target sequence
gtaatcctgttcttgaatt

SEQ ID NO: 196620 - DNA, 19 bp, Artificial sequence
  SiRNA target sequence
taatcctgttcttgaattt

SEQ ID NO: 196621 - DNA, 19 bp, Artificial sequence
  SiRNA target sequence
aatcctgttcttgaatttg

SEQ ID NO: 196622 - DNA, 19 bp, Artificial sequence
  SiRNA target sequence
atcctgttcttgaatttgc

SEQ ID NO: 196623 - DNA, 19 bp, Artificial sequence
  SiRNA target sequence
tcctgttcttgaatttgct

SEQ ID NO: 196624 - DNA, 19 bp, Artificial sequence
  SiRNA target sequence
cctgttcttgaatttgcta

SEQ ID NO: 196625 - DNA, 19 bp, Artificial sequence
  SiRNA target sequence
ctgttcttgaatttgctaa

SEQ ID NO: 196626 - DNA, 19 bp, Artificial sequence
  SiRNA target sequence
tgttcttgaatttgctaat

SEQ ID NO: 196627 - DNA, 19 bp, Artificial sequence
  SiRNA target sequence
gttcttgaatttgctaatt

SEQ ID NO: 196628 - DNA, 19 bp, Artificial sequence
  SiRNA target sequence
ttcttgaatttgctaattg

SEQ ID NO: 196629 - DNA, 19 bp, Artificial sequence
  SiRNA target sequence
tcttgaatttgctaattga

SEQ ID NO: 196630 - DNA, 19 bp, Artificial sequence
  SiRNA target sequence
cttgaatttgctaattgat

SEQ ID NO: 196631 - DNA, 19 bp, Artificial sequence
  SiRNA target sequence
ttgaatttgctaattgatc

SEQ ID NO: 196632 - DNA, 19 bp, Artificial sequence
  SiRNA target sequence
tgaatttgctaattgatca

SEQ ID NO: 196633 - DNA, 19 bp, Artificial sequence
  SiRNA target sequence
gaatttgctaattgatcaa

SEQ ID NO: 196634 - DNA, 19 bp, Artificial sequence
  SiRNA target sequence
aatttgctaattgatcaat

SEQ ID NO: 196635 - DNA, 19 bp, Artificial sequence
  SiRNA target sequence
atttgctaattgatcaatc

SEQ ID NO: 196636 - DNA, 19 bp, Artificial sequence
  SiRNA target sequence
tttgctaattgatcaatct

SEQ ID NO: 196637 - DNA, 19 bp, Artificial sequence
  SiRNA target sequence
ttgctaattgatcaatctc

SEQ ID NO: 196638 - DNA, 19 bp, Artificial sequence
  SiRNA target sequence
tgctaattgatcaatctca

SEQ ID NO: 196639 - DNA, 19 bp, Artificial sequence
  SiRNA target sequence
gctaattgatcaatctcat

SEQ ID NO: 196640 - DNA, 19 bp, Artificial sequence
  SiRNA target sequence
ctaattgatcaatctcatc

SEQ ID NO: 196641 - DNA, 19 bp, Artificial sequence
  SiRNA target sequence
taattgatcaatctcatct

SEQ ID NO: 196642 - DNA, 19 bp, Artificial sequence
  SiRNA target sequence
aattgatcaatctcatctt

SEQ ID NO: 196643 - DNA, 19 bp, Artificial sequence
  SiRNA target sequence
attgatcaatctcatcttc

SEQ ID NO: 196644 - DNA, 19 bp, Artificial sequence
  SiRNA target sequence
ttgatcaatctcatcttcc

SEQ ID NO: 196645 - DNA, 19 bp, Artificial sequence
  SiRNA target sequence
tgatcaatctcatcttccg

SEQ ID NO: 196646 - DNA, 19 bp, Artificial sequence
  SiRNA target sequence
gatcaatctcatcttccgt

SEQ ID NO: 196647 - DNA, 19 bp, Artificial sequence
  SiRNA target sequence
atcaatctcatcttccgta

SEQ ID NO: 196648 - DNA, 19 bp, Artificial sequence
  SiRNA target sequence
tcaatctcatcttccgtag

SEQ ID NO: 196649 - DNA, 19 bp, Artificial sequence
  SiRNA target sequence
caatctcatcttccgtagg

SEQ ID NO: 196650 - DNA, 19 bp, Artificial sequence
  SiRNA target sequence
aatctcatcttccgtaggt

SEQ ID NO: 196651 - DNA, 19 bp, Artificial sequence
  SiRNA target sequence
atctcatcttccgtaggta

SEQ ID NO: 196652 - DNA, 19 bp, Artificial sequence
  SiRNA target sequence
tctcatcttccgtaggtaa

SEQ ID NO: 196653 - DNA, 19 bp, Artificial sequence
  SiRNA target sequence
ctcatcttccgtaggtaag

SEQ ID NO: 196654 - DNA, 19 bp, Artificial sequence
  SiRNA target sequence
tcatcttccgtaggtaagt

SEQ ID NO: 196655 - DNA, 19 bp, Artificial sequence
  SiRNA target sequence
catcttccgtaggtaagtt

SEQ ID NO: 196656 - DNA, 19 bp, Artificial sequence
  SiRNA target sequence
atcttccgtaggtaagttg

SEQ ID NO: 196657 - DNA, 19 bp, Artificial sequence
  SiRNA target sequence
tcttccgtaggtaagttgt

SEQ ID NO: 196658 - DNA, 19 bp, Artificial sequence
  SiRNA target sequence
cttccgtaggtaagttgtt

SEQ ID NO: 196659 - DNA, 19 bp, Artificial sequence
  SiRNA target sequence
ttccgtaggtaagttgttt

SEQ ID NO: 196660 - DNA, 19 bp, Artificial sequence
  SiRNA target sequence
tccgtaggtaagttgtttt

SEQ ID NO: 196661 - DNA, 19 bp, Artificial sequence
  SiRNA target sequence
ccgtaggtaagttgttttc

SEQ ID NO: 196662 - DNA, 19 bp, Artificial sequence
  SiRNA target sequence
cgtaggtaagttgttttca

SEQ ID NO: 196663 - DNA, 19 bp, Artificial sequence
  SiRNA target sequence
gtaggtaagttgttttcag

SEQ ID NO: 196664 - DNA, 19 bp, Artificial sequence
  SiRNA target sequence
taggtaagttgttttcagg

SEQ ID NO: 196665 - DNA, 19 bp, Artificial sequence
  SiRNA target sequence
aggtaagttgttttcaggt

SEQ ID NO: 196666 - DNA, 19 bp, Artificial sequence
  SiRNA target sequence
ggtaagttgttttcaggtg

SEQ ID NO: 196667 - DNA, 19 bp, Artificial sequence
  SiRNA target sequence
gtaagttgttttcaggtgt

SEQ ID NO: 196668 - DNA, 19 bp, Artificial sequence
  SiRNA target sequence
taagttgttttcaggtgtt

SEQ ID NO: 196669 - DNA, 19 bp, Artificial sequence
  SiRNA target sequence
aagttgttttcaggtgttt

SEQ ID NO: 196670 - DNA, 19 bp, Artificial sequence
  SiRNA target sequence
agttgttttcaggtgtttc

SEQ ID NO: 196671 - DNA, 19 bp, Artificial sequence
  SiRNA target sequence
gttgttttcaggtgtttca

SEQ ID NO: 196672 - DNA, 19 bp, Artificial sequence
  SiRNA target sequence
ttgttttcaggtgtttcat

SEQ ID NO: 196673 - DNA, 19 bp, Artificial sequence
  SiRNA target sequence
tgttttcaggtgtttcatt

SEQ ID NO: 196674 - DNA, 19 bp, Artificial sequence
  SiRNA target sequence
gttttcaggtgtttcattt

SEQ ID NO: 196675 - DNA, 19 bp, Artificial sequence
  SiRNA target sequence
ttttcaggtgtttcattta

SEQ ID NO: 196676 - DNA, 19 bp, Artificial sequence
  SiRNA target sequence
tttcaggtgtttcatttat

SEQ ID NO: 196677 - DNA, 19 bp, Artificial sequence
  SiRNA target sequence
ttcaggtgtttcatttatt

SEQ ID NO: 196678 - DNA, 19 bp, Artificial sequence
  SiRNA target sequence
tcaggtgtttcatttatta

SEQ ID NO: 196679 - DNA, 19 bp, Artificial sequence
  SiRNA target sequence
caggtgtttcatttattac

SEQ ID NO: 196680 - DNA, 19 bp, Artificial sequence
  SiRNA target sequence
aggtgtttcatttattaca

SEQ ID NO: 196681 - DNA, 19 bp, Artificial sequence
  SiRNA target sequence
ggtgtttcatttattacac

SEQ ID NO: 196682 - DNA, 19 bp, Artificial sequence
  SiRNA target sequence
gtgtttcatttattacact

SEQ ID NO: 196683 - DNA, 19 bp, Artificial sequence
  SiRNA target sequence
tgtttcatttattacactc

SEQ ID NO: 196684 - DNA, 19 bp, Artificial sequence
  SiRNA target sequence
gtttcatttattacactca

SEQ ID NO: 196685 - DNA, 19 bp, Artificial sequence
  SiRNA target sequence
tttcatttattacactcat

SEQ ID NO: 196686 - DNA, 20 bp, Artificial sequence
  SiRNA target sequence
ttattctgcgttttcttttt

SEQ ID NO: 196687 - DNA, 20 bp, Artificial sequence
  SiRNA target sequence
tattctgcgttttctttttt

SEQ ID NO: 196688 - DNA, 20 bp, Artificial sequence
  SiRNA target sequence
attctgcgttttcttttttg

SEQ ID NO: 196689 - DNA, 20 bp, Artificial sequence
  SiRNA target sequence
ttctgcgttttcttttttgt

SEQ ID NO: 196690 - DNA, 20 bp, Artificial sequence
  SiRNA target sequence
tctgcgttttcttttttgtc

SEQ ID NO: 196691 - DNA, 20 bp, Artificial sequence
  SiRNA target sequence
ctgcgttttcttttttgtcg

SEQ ID NO: 196692 - DNA, 20 bp, Artificial sequence
  SiRNA target sequence
tgcgttttcttttttgtcgt

SEQ ID NO: 196693 - DNA, 20 bp, Artificial sequence
  SiRNA target sequence
gcgttttcttttttgtcgtc

SEQ ID NO: 196694 - DNA, 20 bp, Artificial sequence
  SiRNA target sequence
cgttttcttttttgtcgtct

SEQ ID NO: 196695 - DNA, 20 bp, Artificial sequence
  SiRNA target sequence
gttttcttttttgtcgtctt

SEQ ID NO: 196696 - DNA, 20 bp, Artificial sequence
  SiRNA target sequence
ttttcttttttgtcgtcttt

SEQ ID NO: 196697 - DNA, 20 bp, Artificial sequence
  SiRNA target sequence
tttcttttttgtcgtctttt

SEQ ID NO: 196698 - DNA, 20 bp, Artificial sequence
  SiRNA target sequence
ttcttttttgtcgtctttta

SEQ ID NO: 196699 - DNA, 20 bp, Artificial sequence
  SiRNA target sequence
tcttttttgtcgtcttttat

SEQ ID NO: 196700 - DNA, 20 bp, Artificial sequence
  SiRNA target sequence
cttttttgtcgtcttttatt

SEQ ID NO: 196701 - DNA, 20 bp, Artificial sequence
  SiRNA target sequence
ttttttgtcgtcttttatta

SEQ ID NO: 196702 - DNA, 20 bp, Artificial sequence
  SiRNA target sequence
tttttgtcgtcttttattaa

SEQ ID NO: 196703 - DNA, 20 bp, Artificial sequence
  SiRNA target sequence
ttttgtcgtcttttattaaa

SEQ ID NO: 196704 - DNA, 20 bp, Artificial sequence
  SiRNA target sequence
tttgtcgtcttttattaaat

SEQ ID NO: 196705 - DNA, 20 bp, Artificial sequence
  SiRNA target sequence
ttgtcgtcttttattaaatc

SEQ ID NO: 196706 - DNA, 20 bp, Artificial sequence
  SiRNA target sequence
tgtcgtcttttattaaatct

SEQ ID NO: 196707 - DNA, 20 bp, Artificial sequence
  SiRNA target sequence
gtcgtcttttattaaatcta

SEQ ID NO: 196708 - DNA, 20 bp, Artificial sequence
  SiRNA target sequence
tcgtcttttattaaatctat

SEQ ID NO: 196709 - DNA, 20 bp, Artificial sequence
  SiRNA target sequence
cgtcttttattaaatctatg

SEQ ID NO: 196710 - DNA, 20 bp, Artificial sequence
  SiRNA target sequence
gtcttttattaaatctatgt

SEQ ID NO: 196711 - DNA, 20 bp, Artificial sequence
  SiRNA target sequence
tcttttattaaatctatgtc

SEQ ID NO: 196712 - DNA, 20 bp, Artificial sequence
  SiRNA target sequence
cttttattaaatctatgtct

SEQ ID NO: 196713 - DNA, 20 bp, Artificial sequence
  SiRNA target sequence
ttttattaaatctatgtcta

SEQ ID NO: 196714 - DNA, 20 bp, Artificial sequence
  SiRNA target sequence
tttattaaatctatgtctac

SEQ ID NO: 196715 - DNA, 20 bp, Artificial sequence
  SiRNA target sequence
ttattaaatctatgtctaca

SEQ ID NO: 196716 - DNA, 20 bp, Artificial sequence
  SiRNA target sequence
tattaaatctatgtctacac

SEQ ID NO: 196717 - DNA, 20 bp, Artificial sequence
  SiRNA target sequence
attaaatctatgtctacact

SEQ ID NO: 196718 - DNA, 20 bp, Artificial sequence
  SiRNA target sequence
ttaaatctatgtctacactt

SEQ ID NO: 196719 - DNA, 20 bp, Artificial sequence
  SiRNA target sequence
taaatctatgtctacacttg

SEQ ID NO: 196720 - DNA, 20 bp, Artificial sequence
  SiRNA target sequence
aaatctatgtctacacttgt

SEQ ID NO: 196721 - DNA, 20 bp, Artificial sequence
  SiRNA target sequence
aatctatgtctacacttgta

SEQ ID NO: 196722 - DNA, 20 bp, Artificial sequence
  SiRNA target sequence
atctatgtctacacttgtat

SEQ ID NO: 196723 - DNA, 20 bp, Artificial sequence
  SiRNA target sequence
tctatgtctacacttgtatt

SEQ ID NO: 196724 - DNA, 20 bp, Artificial sequence
  SiRNA target sequence
ctatgtctacacttgtatta

SEQ ID NO: 196725 - DNA, 20 bp, Artificial sequence
  SiRNA target sequence
tatgtctacacttgtattat

SEQ ID NO: 196726 - DNA, 20 bp, Artificial sequence
  SiRNA target sequence
atgtctacacttgtattatt

SEQ ID NO: 196727 - DNA, 20 bp, Artificial sequence
  SiRNA target sequence
tgtctacacttgtattattt

SEQ ID NO: 196728 - DNA, 20 bp, Artificial sequence
  SiRNA target sequence
gtctacacttgtattatttt

SEQ ID NO: 196729 - DNA, 20 bp, Artificial sequence
  SiRNA target sequence
tctacacttgtattattttt

SEQ ID NO: 196730 - DNA, 20 bp, Artificial sequence
  SiRNA target sequence
ctacacttgtattattttta

SEQ ID NO: 196731 - DNA, 20 bp, Artificial sequence
  SiRNA target sequence
tacacttgtattatttttaa

SEQ ID NO: 196732 - DNA, 20 bp, Artificial sequence
  SiRNA target sequence
acacttgtattatttttaat

SEQ ID NO: 196733 - DNA, 20 bp, Artificial sequence
  SiRNA target sequence
cacttgtattatttttaatt

SEQ ID NO: 196734 - DNA, 20 bp, Artificial sequence
  SiRNA target sequence
acttgtattatttttaattg

SEQ ID NO: 196735 - DNA, 20 bp, Artificial sequence
  SiRNA target sequence
cttgtattatttttaattga

SEQ ID NO: 196736 - DNA, 20 bp, Artificial sequence
  SiRNA target sequence
ttgtattatttttaattgaa

SEQ ID NO: 196737 - DNA, 20 bp, Artificial sequence
  SiRNA target sequence
tgtattatttttaattgaaa

SEQ ID NO: 196738 - DNA, 20 bp, Artificial sequence
  SiRNA target sequence
gtattatttttaattgaaac

SEQ ID NO: 196739 - DNA, 20 bp, Artificial sequence
  SiRNA target sequence
tattatttttaattgaaacg

SEQ ID NO: 196740 - DNA, 20 bp, Artificial sequence
  SiRNA target sequence
attatttttaattgaaacgt

SEQ ID NO: 196741 - DNA, 20 bp, Artificial sequence
  SiRNA target sequence
ttatttttaattgaaacgtt

SEQ ID NO: 196742 - DNA, 20 bp, Artificial sequence
  SiRNA target sequence
tatttttaattgaaacgtta

SEQ ID NO: 196743 - DNA, 20 bp, Artificial sequence
  SiRNA target sequence
atttttaattgaaacgttat

SEQ ID NO: 196744 - DNA, 20 bp, Artificial sequence
  SiRNA target sequence
tttttaattgaaacgttata

SEQ ID NO: 196745 - DNA, 20 bp, Artificial sequence
  SiRNA target sequence
ttttaattgaaacgttatat

SEQ ID NO: 196746 - DNA, 20 bp, Artificial sequence
  SiRNA target sequence
tttaattgaaacgttatatg

SEQ ID NO: 196747 - DNA, 20 bp, Artificial sequence
  SiRNA target sequence
ttaattgaaacgttatatgc

SEQ ID NO: 196748 - DNA, 20 bp, Artificial sequence
  SiRNA target sequence
taattgaaacgttatatgca

SEQ ID NO: 196749 - DNA, 20 bp, Artificial sequence
  SiRNA target sequence
aattgaaacgttatatgcac

SEQ ID NO: 196750 - DNA, 20 bp, Artificial sequence
  SiRNA target sequence
attgaaacgttatatgcacc

SEQ ID NO: 196751 - DNA, 20 bp, Artificial sequence
  SiRNA target sequence
ttgaaacgttatatgcaccc

SEQ ID NO: 196752 - DNA, 20 bp, Artificial sequence
  SiRNA target sequence
tgaaacgttatatgcacccg

SEQ ID NO: 196753 - DNA, 20 bp, Artificial sequence
  SiRNA target sequence
gaaacgttatatgcacccgc

SEQ ID NO: 196754 - DNA, 20 bp, Artificial sequence
  SiRNA target sequence
aaacgttatatgcacccgct

SEQ ID NO: 196755 - DNA, 20 bp, Artificial sequence
  SiRNA target sequence
aacgttatatgcacccgcta

SEQ ID NO: 196756 - DNA, 20 bp, Artificial sequence
  SiRNA target sequence
acgttatatgcacccgctaa

SEQ ID NO: 196757 - DNA, 20 bp, Artificial sequence
  SiRNA target sequence
cgttatatgcacccgctaaa

SEQ ID NO: 196758 - DNA, 20 bp, Artificial sequence
  SiRNA target sequence
gttatatgcacccgctaaat

SEQ ID NO: 196759 - DNA, 20 bp, Artificial sequence
  SiRNA target sequence
ttatatgcacccgctaaata

SEQ ID NO: 196760 - DNA, 20 bp, Artificial sequence
  SiRNA target sequence
tatatgcacccgctaaatag

SEQ ID NO: 196761 - DNA, 20 bp, Artificial sequence
  SiRNA target sequence
atatgcacccgctaaataga

SEQ ID NO: 196762 - DNA, 20 bp, Artificial sequence
  SiRNA target sequence
tatgcacccgctaaatagat

SEQ ID NO: 196763 - DNA, 20 bp, Artificial sequence
  SiRNA target sequence
atgcacccgctaaatagatt

SEQ ID NO: 196764 - DNA, 20 bp, Artificial sequence
  SiRNA target sequence
tgcacccgctaaatagatta

SEQ ID NO: 196765 - DNA, 20 bp, Artificial sequence
  SiRNA target sequence
gcacccgctaaatagattat

SEQ ID NO: 196766 - DNA, 20 bp, Artificial sequence
  SiRNA target sequence
cacccgctaaatagattata

SEQ ID NO: 196767 - DNA, 20 bp, Artificial sequence
  SiRNA target sequence
acccgctaaatagattatag

SEQ ID NO: 196768 - DNA, 20 bp, Artificial sequence
  SiRNA target sequence
cccgctaaatagattatagc

SEQ ID NO: 196769 - DNA, 20 bp, Artificial sequence
  SiRNA target sequence
ccgctaaatagattatagct

SEQ ID NO: 196770 - DNA, 20 bp, Artificial sequence
  SiRNA target sequence
cgctaaatagattatagctc

SEQ ID NO: 196771 - DNA, 20 bp, Artificial sequence
  SiRNA target sequence
gctaaatagattatagctct

SEQ ID NO: 196772 - DNA, 20 bp, Artificial sequence
  SiRNA target sequence
ctaaatagattatagctcta

SEQ ID NO: 196773 - DNA, 20 bp, Artificial sequence
  SiRNA target sequence
taaatagattatagctctaa

SEQ ID NO: 196774 - DNA, 20 bp, Artificial sequence
  SiRNA target sequence
aaatagattatagctctaat

SEQ ID NO: 196775 - DNA, 20 bp, Artificial sequence
  SiRNA target sequence
aatagattatagctctaatc

SEQ ID NO: 196776 - DNA, 20 bp, Artificial sequence
  SiRNA target sequence
atagattatagctctaatcc

SEQ ID NO: 196777 - DNA, 20 bp, Artificial sequence
  SiRNA target sequence
tagattatagctctaatcca

SEQ ID NO: 196778 - DNA, 20 bp, Artificial sequence
  SiRNA target sequence
agattatagctctaatccaa

SEQ ID NO: 196779 - DNA, 20 bp, Artificial sequence
  SiRNA target sequence
gattatagctctaatccaaa

SEQ ID NO: 196780 - DNA, 20 bp, Artificial sequence
  SiRNA target sequence
attatagctctaatccaaat

SEQ ID NO: 196781 - DNA, 20 bp, Artificial sequence
  SiRNA target sequence
ttatagctctaatccaaata

SEQ ID NO: 196782 - DNA, 20 bp, Artificial sequence
  SiRNA target sequence
tatagctctaatccaaatat

SEQ ID NO: 196783 - DNA, 20 bp, Artificial sequence
  SiRNA target sequence
atagctctaatccaaatata

SEQ ID NO: 196784 - DNA, 20 bp, Artificial sequence
  SiRNA target sequence
tagctctaatccaaatataa

SEQ ID NO: 196785 - DNA, 20 bp, Artificial sequence
  SiRNA target sequence
agctctaatccaaatataaa

SEQ ID NO: 196786 - DNA, 20 bp, Artificial sequence
  SiRNA target sequence
gctctaatccaaatataaat

SEQ ID NO: 196787 - DNA, 20 bp, Artificial sequence
  SiRNA target sequence
ctctaatccaaatataaatc

SEQ ID NO: 196788 - DNA, 20 bp, Artificial sequence
  SiRNA target sequence
tctaatccaaatataaatca

SEQ ID NO: 196789 - DNA, 20 bp, Artificial sequence
  SiRNA target sequence
ctaatccaaatataaatcaa

SEQ ID NO: 196790 - DNA, 20 bp, Artificial sequence
  SiRNA target sequence
taatccaaatataaatcaat

SEQ ID NO: 196791 - DNA, 20 bp, Artificial sequence
  SiRNA target sequence
aatccaaatataaatcaata

SEQ ID NO: 196792 - DNA, 20 bp, Artificial sequence
  SiRNA target sequence
atccaaatataaatcaatat

SEQ ID NO: 196793 - DNA, 20 bp, Artificial sequence
  SiRNA target sequence
tccaaatataaatcaatatt

SEQ ID NO: 196794 - DNA, 20 bp, Artificial sequence
  SiRNA target sequence
ccaaatataaatcaatatta

SEQ ID NO: 196795 - DNA, 20 bp, Artificial sequence
  SiRNA target sequence
caaatataaatcaatattat

SEQ ID NO: 196796 - DNA, 20 bp, Artificial sequence
  SiRNA target sequence
aaatataaatcaatattatt

SEQ ID NO: 196797 - DNA, 20 bp, Artificial sequence
  SiRNA target sequence
aatataaatcaatattattg

SEQ ID NO: 196798 - DNA, 20 bp, Artificial sequence
  SiRNA target sequence
atataaatcaatattattgc

SEQ ID NO: 196799 - DNA, 20 bp, Artificial sequence
  SiRNA target sequence
tataaatcaatattattgca

SEQ ID NO: 196800 - DNA, 20 bp, Artificial sequence
  SiRNA target sequence
ataaatcaatattattgcaa

SEQ ID NO: 196801 - DNA, 20 bp, Artificial sequence
  SiRNA target sequence
taaatcaatattattgcaat

SEQ ID NO: 196802 - DNA, 20 bp, Artificial sequence
  SiRNA target sequence
aaatcaatattattgcaatc

SEQ ID NO: 196803 - DNA, 20 bp, Artificial sequence
  SiRNA target sequence
aatcaatattattgcaatcg

SEQ ID NO: 196804 - DNA, 20 bp, Artificial sequence
  SiRNA target sequence
atcaatattattgcaatcgt

SEQ ID NO: 196805 - DNA, 20 bp, Artificial sequence
  SiRNA target sequence
tcaatattattgcaatcgtt

SEQ ID NO: 196806 - DNA, 20 bp, Artificial sequence
  SiRNA target sequence
caatattattgcaatcgtta

SEQ ID NO: 196807 - DNA, 20 bp, Artificial sequence
  SiRNA target sequence
aatattattgcaatcgttaa

SEQ ID NO: 196808 - DNA, 20 bp, Artificial sequence
  SiRNA target sequence
atattattgcaatcgttaat

SEQ ID NO: 196809 - DNA, 20 bp, Artificial sequence
  SiRNA target sequence
tattattgcaatcgttaatg

SEQ ID NO: 196810 - DNA, 20 bp, Artificial sequence
  SiRNA target sequence
attattgcaatcgttaatgt

SEQ ID NO: 196811 - DNA, 20 bp, Artificial sequence
  SiRNA target sequence
ttattgcaatcgttaatgtg

SEQ ID NO: 196812 - DNA, 20 bp, Artificial sequence
  SiRNA target sequence
tattgcaatcgttaatgtga

SEQ ID NO: 196813 - DNA, 20 bp, Artificial sequence
  SiRNA target sequence
attgcaatcgttaatgtgat

SEQ ID NO: 196814 - DNA, 20 bp, Artificial sequence
  SiRNA target sequence
ttgcaatcgttaatgtgatt

SEQ ID NO: 196815 - DNA, 20 bp, Artificial sequence
  SiRNA target sequence
tgcaatcgttaatgtgattg

SEQ ID NO: 196816 - DNA, 20 bp, Artificial sequence
  SiRNA target sequence
gcaatcgttaatgtgattgg

SEQ ID NO: 196817 - DNA, 20 bp, Artificial sequence
  SiRNA target sequence
caatcgttaatgtgattgga

SEQ ID NO: 196818 - DNA, 20 bp, Artificial sequence
  SiRNA target sequence
aatcgttaatgtgattggac

SEQ ID NO: 196819 - DNA, 20 bp, Artificial sequence
  SiRNA target sequence
atcgttaatgtgattggact

SEQ ID NO: 196820 - DNA, 20 bp, Artificial sequence
  SiRNA target sequence
tcgttaatgtgattggacta

SEQ ID NO: 196821 - DNA, 20 bp, Artificial sequence
  SiRNA target sequence
cgttaatgtgattggactac

SEQ ID NO: 196822 - DNA, 20 bp, Artificial sequence
  SiRNA target sequence
gttaatgtgattggactacc

SEQ ID NO: 196823 - DNA, 20 bp, Artificial sequence
  SiRNA target sequence
ttaatgtgattggactaccc

SEQ ID NO: 196824 - DNA, 20 bp, Artificial sequence
  SiRNA target sequence
taatgtgattggactaccct

SEQ ID NO: 196825 - DNA, 20 bp, Artificial sequence
  SiRNA target sequence
aatgtgattggactaccctt

SEQ ID NO: 196826 - DNA, 20 bp, Artificial sequence
  SiRNA target sequence
atgtgattggactacccttc

SEQ ID NO: 196827 - DNA, 20 bp, Artificial sequence
  SiRNA target sequence
tgtgattggactacccttcc

SEQ ID NO: 196828 - DNA, 20 bp, Artificial sequence
  SiRNA target sequence
gtgattggactacccttcct

SEQ ID NO: 196829 - DNA, 20 bp, Artificial sequence
  SiRNA target sequence
tgattggactacccttcctt

SEQ ID NO: 196830 - DNA, 20 bp, Artificial sequence
  SiRNA target sequence
gattggactacccttcctta

SEQ ID NO: 196831 - DNA, 20 bp, Artificial sequence
  SiRNA target sequence
attggactacccttccttac

SEQ ID NO: 196832 - DNA, 20 bp, Artificial sequence
  SiRNA target sequence
ttggactacccttccttaca

SEQ ID NO: 196833 - DNA, 20 bp, Artificial sequence
  SiRNA target sequence
tggactacccttccttacat

SEQ ID NO: 196834 - DNA, 20 bp, Artificial sequence
  SiRNA target sequence
ggactacccttccttacatt

SEQ ID NO: 196835 - DNA, 20 bp, Artificial sequence
  SiRNA target sequence
gactacccttccttacatta

SEQ ID NO: 196836 - DNA, 20 bp, Artificial sequence
  SiRNA target sequence
actacccttccttacattat

SEQ ID NO: 196837 - DNA, 20 bp, Artificial sequence
  SiRNA target sequence
ctacccttccttacattatc

SEQ ID NO: 196838 - DNA, 20 bp, Artificial sequence
  SiRNA target sequence
tacccttccttacattatca

SEQ ID NO: 196839 - DNA, 20 bp, Artificial sequence
  SiRNA target sequence
acccttccttacattatcag

SEQ ID NO: 196840 - DNA, 20 bp, Artificial sequence
  SiRNA target sequence
cccttccttacattatcagt

SEQ ID NO: 196841 - DNA, 20 bp, Artificial sequence
  SiRNA target sequence
ccttccttacattatcagta

SEQ ID NO: 196842 - DNA, 20 bp, Artificial sequence
  SiRNA target sequence
cttccttacattatcagtat

SEQ ID NO: 196843 - DNA, 20 bp, Artificial sequence
  SiRNA target sequence
ttccttacattatcagtatc

SEQ ID NO: 196844 - DNA, 20 bp, Artificial sequence
  SiRNA target sequence
tccttacattatcagtatca

SEQ ID NO: 196845 - DNA, 20 bp, Artificial sequence
  SiRNA target sequence
ccttacattatcagtatcaa

SEQ ID NO: 196846 - DNA, 20 bp, Artificial sequence
  SiRNA target sequence
cttacattatcagtatcaag

SEQ ID NO: 196847 - DNA, 20 bp, Artificial sequence
  SiRNA target sequence
ttacattatcagtatcaagt

SEQ ID NO: 196848 - DNA, 20 bp, Artificial sequence
  SiRNA target sequence
tacattatcagtatcaagtg

SEQ ID NO: 196849 - DNA, 20 bp, Artificial sequence
  SiRNA target sequence
acattatcagtatcaagtgc

SEQ ID NO: 196850 - DNA, 20 bp, Artificial sequence
  SiRNA target sequence
cattatcagtatcaagtgct

SEQ ID NO: 196851 - DNA, 20 bp, Artificial sequence
  SiRNA target sequence
attatcagtatcaagtgcta

SEQ ID NO: 196852 - DNA, 20 bp, Artificial sequence
  SiRNA target sequence
ttatcagtatcaagtgctac

SEQ ID NO: 196853 - DNA, 20 bp, Artificial sequence
  SiRNA target sequence
tatcagtatcaagtgctact

SEQ ID NO: 196854 - DNA, 20 bp, Artificial sequence
  SiRNA target sequence
atcagtatcaagtgctacta

SEQ ID NO: 196855 - DNA, 20 bp, Artificial sequence
  SiRNA target sequence
tcagtatcaagtgctactaa

SEQ ID NO: 196856 - DNA, 20 bp, Artificial sequence
  SiRNA target sequence
cagtatcaagtgctactaat

SEQ ID NO: 196857 - DNA, 20 bp, Artificial sequence
  SiRNA target sequence
agtatcaagtgctactaata

SEQ ID NO: 196858 - DNA, 20 bp, Artificial sequence
  SiRNA target sequence
gtatcaagtgctactaatat

SEQ ID NO: 196859 - DNA, 20 bp, Artificial sequence
  SiRNA target sequence
tatcaagtgctactaatatg

SEQ ID NO: 196860 - DNA, 20 bp, Artificial sequence
  SiRNA target sequence
atcaagtgctactaatatgg

SEQ ID NO: 196861 - DNA, 20 bp, Artificial sequence
  SiRNA target sequence
tcaagtgctactaatatggc

SEQ ID NO: 196862 - DNA, 20 bp, Artificial sequence
  SiRNA target sequence
caagtgctactaatatggct

SEQ ID NO: 196863 - DNA, 20 bp, Artificial sequence
  SiRNA target sequence
aagtgctactaatatggcta

SEQ ID NO: 196864 - DNA, 20 bp, Artificial sequence
  SiRNA target sequence
agtgctactaatatggctag

SEQ ID NO: 196865 - DNA, 20 bp, Artificial sequence
  SiRNA target sequence
gtgctactaatatggctagt

SEQ ID NO: 196866 - DNA, 20 bp, Artificial sequence
  SiRNA target sequence
tgctactaatatggctagtc

SEQ ID NO: 196867 - DNA, 20 bp, Artificial sequence
  SiRNA target sequence
gctactaatatggctagtcc

SEQ ID NO: 196868 - DNA, 20 bp, Artificial sequence
  SiRNA target sequence
ctactaatatggctagtcca

SEQ ID NO: 196869 - DNA, 20 bp, Artificial sequence
  SiRNA target sequence
tactaatatggctagtccat

SEQ ID NO: 196870 - DNA, 20 bp, Artificial sequence
  SiRNA target sequence
actaatatggctagtccata

SEQ ID NO: 196871 - DNA, 20 bp, Artificial sequence
  SiRNA target sequence
ctaatatggctagtccatat

SEQ ID NO: 196872 - DNA, 20 bp, Artificial sequence
  SiRNA target sequence
taatatggctagtccatata

SEQ ID NO: 196873 - DNA, 20 bp, Artificial sequence
  SiRNA target sequence
aatatggctagtccatataa

SEQ ID NO: 196874 - DNA, 20 bp, Artificial sequence
  SiRNA target sequence
atatggctagtccatataat

SEQ ID NO: 196875 - DNA, 20 bp, Artificial sequence
  SiRNA target sequence
tatggctagtccatataatg

SEQ ID NO: 196876 - DNA, 20 bp, Artificial sequence
  SiRNA target sequence
atggctagtccatataatga

SEQ ID NO: 196877 - DNA, 20 bp, Artificial sequence
  SiRNA target sequence
tggctagtccatataatgaa

SEQ ID NO: 196878 - DNA, 20 bp, Artificial sequence
  SiRNA target sequence
ggctagtccatataatgaac

SEQ ID NO: 196879 - DNA, 20 bp, Artificial sequence
  SiRNA target sequence
gctagtccatataatgaacc

SEQ ID NO: 196880 - DNA, 20 bp, Artificial sequence
  SiRNA target sequence
ctagtccatataatgaacca

SEQ ID NO: 196881 - DNA, 20 bp, Artificial sequence
  SiRNA target sequence
tagtccatataatgaaccaa

SEQ ID NO: 196882 - DNA, 20 bp, Artificial sequence
  SiRNA target sequence
agtccatataatgaaccaat

SEQ ID NO: 196883 - DNA, 20 bp, Artificial sequence
  SiRNA target sequence
gtccatataatgaaccaata

SEQ ID NO: 196884 - DNA, 20 bp, Artificial sequence
  SiRNA target sequence
tccatataatgaaccaatag

SEQ ID NO: 196885 - DNA, 20 bp, Artificial sequence
  SiRNA target sequence
ccatataatgaaccaataga

SEQ ID NO: 196886 - DNA, 20 bp, Artificial sequence
  SiRNA target sequence
catataatgaaccaatagat

SEQ ID NO: 196887 - DNA, 20 bp, Artificial sequence
  SiRNA target sequence
atataatgaaccaatagatt

SEQ ID NO: 196888 - DNA, 20 bp, Artificial sequence
  SiRNA target sequence
tataatgaaccaatagattt

SEQ ID NO: 196889 - DNA, 20 bp, Artificial sequence
  SiRNA target sequence
ataatgaaccaatagatttt

SEQ ID NO: 196890 - DNA, 20 bp, Artificial sequence
  SiRNA target sequence
taatgaaccaatagattttc

SEQ ID NO: 196891 - DNA, 20 bp, Artificial sequence
  SiRNA target sequence
aatgaaccaatagattttcc

SEQ ID NO: 196892 - DNA, 20 bp, Artificial sequence
  SiRNA target sequence
atgaaccaatagattttcct

SEQ ID NO: 196893 - DNA, 20 bp, Artificial sequence
  SiRNA target sequence
tgaaccaatagattttccta

SEQ ID NO: 196894 - DNA, 20 bp, Artificial sequence
  SiRNA target sequence
gaaccaatagattttcctaa

SEQ ID NO: 196895 - DNA, 20 bp, Artificial sequence
  SiRNA target sequence
aaccaatagattttcctaat

SEQ ID NO: 196896 - DNA, 20 bp, Artificial sequence
  SiRNA target sequence
accaatagattttcctaatt

SEQ ID NO: 196897 - DNA, 20 bp, Artificial sequence
  SiRNA target sequence
ccaatagattttcctaattt

SEQ ID NO: 196898 - DNA, 20 bp, Artificial sequence
  SiRNA target sequence
caatagattttcctaattta

SEQ ID NO: 196899 - DNA, 20 bp, Artificial sequence
  SiRNA target sequence
aatagattttcctaatttat

SEQ ID NO: 196900 - DNA, 20 bp, Artificial sequence
  SiRNA target sequence
atagattttcctaatttatt

SEQ ID NO: 196901 - DNA, 20 bp, Artificial sequence
  SiRNA target sequence
tagattttcctaatttatta

SEQ ID NO: 196902 - DNA, 20 bp, Artificial sequence
  SiRNA target sequence
agattttcctaatttattaa

SEQ ID NO: 196903 - DNA, 20 bp, Artificial sequence
  SiRNA target sequence
gattttcctaatttattaaa

SEQ ID NO: 196904 - DNA, 20 bp, Artificial sequence
  SiRNA target sequence
attttcctaatttattaaaa

SEQ ID NO: 196905 - DNA, 20 bp, Artificial sequence
  SiRNA target sequence
ttttcctaatttattaaaaa

SEQ ID NO: 196906 - DNA, 20 bp, Artificial sequence
  SiRNA target sequence
tttcctaatttattaaaaat

SEQ ID NO: 196907 - DNA, 20 bp, Artificial sequence
  SiRNA target sequence
ttcctaatttattaaaaata

SEQ ID NO: 196908 - DNA, 20 bp, Artificial sequence
  SiRNA target sequence
tcctaatttattaaaaatac

SEQ ID NO: 196909 - DNA, 20 bp, Artificial sequence
  SiRNA target sequence
cctaatttattaaaaatacc

SEQ ID NO: 196910 - DNA, 20 bp, Artificial sequence
  SiRNA target sequence
ctaatttattaaaaatacca

SEQ ID NO: 196911 - DNA, 20 bp, Artificial sequence
  SiRNA target sequence
taatttattaaaaataccat

SEQ ID NO: 196912 - DNA, 20 bp, Artificial sequence
  SiRNA target sequence
aatttattaaaaataccatc

SEQ ID NO: 196913 - DNA, 20 bp, Artificial sequence
  SiRNA target sequence
atttattaaaaataccatca

SEQ ID NO: 196914 - DNA, 20 bp, Artificial sequence
  SiRNA target sequence
tttattaaaaataccatcat

SEQ ID NO: 196915 - DNA, 20 bp, Artificial sequence
  SiRNA target sequence
ttattaaaaataccatcata

SEQ ID NO: 196916 - DNA, 20 bp, Artificial sequence
  SiRNA target sequence
tattaaaaataccatcataa

SEQ ID NO: 196917 - DNA, 20 bp, Artificial sequence
  SiRNA target sequence
attaaaaataccatcataaa

SEQ ID NO: 196918 - DNA, 20 bp, Artificial sequence
  SiRNA target sequence
ttaaaaataccatcataaac

SEQ ID NO: 196919 - DNA, 20 bp, Artificial sequence
  SiRNA target sequence
taaaaataccatcataaaca

SEQ ID NO: 196920 - DNA, 20 bp, Artificial sequence
  SiRNA target sequence
aaaaataccatcataaacac

SEQ ID NO: 196921 - DNA, 20 bp, Artificial sequence
  SiRNA target sequence
aaaataccatcataaacact

SEQ ID NO: 196922 - DNA, 20 bp, Artificial sequence
  SiRNA target sequence
aaataccatcataaacactt

SEQ ID NO: 196923 - DNA, 20 bp, Artificial sequence
  SiRNA target sequence
aataccatcataaacacttt

SEQ ID NO: 196924 - DNA, 20 bp, Artificial sequence
  SiRNA target sequence
ataccatcataaacactttt

SEQ ID NO: 196925 - DNA, 20 bp, Artificial sequence
  SiRNA target sequence
taccatcataaacactttta

SEQ ID NO: 196926 - DNA, 20 bp, Artificial sequence
  SiRNA target sequence
accatcataaacacttttaa

SEQ ID NO: 196927 - DNA, 20 bp, Artificial sequence
  SiRNA target sequence
ccatcataaacacttttaaa

SEQ ID NO: 196928 - DNA, 20 bp, Artificial sequence
  SiRNA target sequence
catcataaacacttttaaac

SEQ ID NO: 196929 - DNA, 20 bp, Artificial sequence
  SiRNA target sequence
atcataaacacttttaaacc

SEQ ID NO: 196930 - DNA, 20 bp, Artificial sequence
  SiRNA target sequence
tcataaacacttttaaaccg

SEQ ID NO: 196931 - DNA, 20 bp, Artificial sequence
  SiRNA target sequence
cataaacacttttaaaccgt

SEQ ID NO: 196932 - DNA, 20 bp, Artificial sequence
  SiRNA target sequence
ataaacacttttaaaccgtg

SEQ ID NO: 196933 - DNA, 20 bp, Artificial sequence
  SiRNA target sequence
taaacacttttaaaccgtgc

SEQ ID NO: 196934 - DNA, 20 bp, Artificial sequence
  SiRNA target sequence
aaacacttttaaaccgtgcc

SEQ ID NO: 196935 - DNA, 20 bp, Artificial sequence
  SiRNA target sequence
aacacttttaaaccgtgccc

SEQ ID NO: 196936 - DNA, 20 bp, Artificial sequence
  SiRNA target sequence
acacttttaaaccgtgccct

SEQ ID NO: 196937 - DNA, 20 bp, Artificial sequence
  SiRNA target sequence
cacttttaaaccgtgccctg

SEQ ID NO: 196938 - DNA, 20 bp, Artificial sequence
  SiRNA target sequence
acttttaaaccgtgccctgt

SEQ ID NO: 196939 - DNA, 20 bp, Artificial sequence
  SiRNA target sequence
cttttaaaccgtgccctgtg

SEQ ID NO: 196940 - DNA, 20 bp, Artificial sequence
  SiRNA target sequence
ttttaaaccgtgccctgtgt

SEQ ID NO: 196941 - DNA, 20 bp, Artificial sequence
  SiRNA target sequence
tttaaaccgtgccctgtgtg

SEQ ID NO: 196942 - DNA, 20 bp, Artificial sequence
  SiRNA target sequence
ttaaaccgtgccctgtgtgc

SEQ ID NO: 196943 - DNA, 20 bp, Artificial sequence
  SiRNA target sequence
taaaccgtgccctgtgtgca

SEQ ID NO: 196944 - DNA, 20 bp, Artificial sequence
  SiRNA target sequence
aaaccgtgccctgtgtgcag

SEQ ID NO: 196945 - DNA, 20 bp, Artificial sequence
  SiRNA target sequence
aaccgtgccctgtgtgcagg

SEQ ID NO: 196946 - DNA, 20 bp, Artificial sequence
  SiRNA target sequence
accgtgccctgtgtgcagga

SEQ ID NO: 196947 - DNA, 20 bp, Artificial sequence
  SiRNA target sequence
ccgtgccctgtgtgcaggat

SEQ ID NO: 196948 - DNA, 20 bp, Artificial sequence
  SiRNA target sequence
cgtgccctgtgtgcaggatc

SEQ ID NO: 196949 - DNA, 20 bp, Artificial sequence
  SiRNA target sequence
gtgccctgtgtgcaggatcg

SEQ ID NO: 196950 - DNA, 20 bp, Artificial sequence
  SiRNA target sequence
tgccctgtgtgcaggatcga

SEQ ID NO: 196951 - DNA, 20 bp, Artificial sequence
  SiRNA target sequence
gccctgtgtgcaggatcgat

SEQ ID NO: 196952 - DNA, 20 bp, Artificial sequence
  SiRNA target sequence
ccctgtgtgcaggatcgatt

SEQ ID NO: 196953 - DNA, 20 bp, Artificial sequence
  SiRNA target sequence
cctgtgtgcaggatcgattc

SEQ ID NO: 196954 - DNA, 20 bp, Artificial sequence
  SiRNA target sequence
ctgtgtgcaggatcgattct

SEQ ID NO: 196955 - DNA, 20 bp, Artificial sequence
  SiRNA target sequence
tgtgtgcaggatcgattctc

SEQ ID NO: 196956 - DNA, 20 bp, Artificial sequence
  SiRNA target sequence
gtgtgcaggatcgattctca

SEQ ID NO: 196957 - DNA, 20 bp, Artificial sequence
  SiRNA target sequence
tgtgcaggatcgattctcat

SEQ ID NO: 196958 - DNA, 20 bp, Artificial sequence
  SiRNA target sequence
gtgcaggatcgattctcata

SEQ ID NO: 196959 - DNA, 20 bp, Artificial sequence
  SiRNA target sequence
tgcaggatcgattctcatac

SEQ ID NO: 196960 - DNA, 20 bp, Artificial sequence
  SiRNA target sequence
gcaggatcgattctcatacc

SEQ ID NO: 196961 - DNA, 20 bp, Artificial sequence
  SiRNA target sequence
caggatcgattctcataccc

SEQ ID NO: 196962 - DNA, 20 bp, Artificial sequence
  SiRNA target sequence
aggatcgattctcataccca

SEQ ID NO: 196963 - DNA, 20 bp, Artificial sequence
  SiRNA target sequence
ggatcgattctcatacccat

SEQ ID NO: 196964 - DNA, 20 bp, Artificial sequence
  SiRNA target sequence
gatcgattctcatacccatt

SEQ ID NO: 196965 - DNA, 20 bp, Artificial sequence
  SiRNA target sequence
atcgattctcatacccattt

SEQ ID NO: 196966 - DNA, 20 bp, Artificial sequence
  SiRNA target sequence
tcgattctcatacccatttt

SEQ ID NO: 196967 - DNA, 20 bp, Artificial sequence
  SiRNA target sequence
cgattctcatacccattttc

SEQ ID NO: 196968 - DNA, 20 bp, Artificial sequence
  SiRNA target sequence
gattctcatacccattttct

SEQ ID NO: 196969 - DNA, 20 bp, Artificial sequence
  SiRNA target sequence
attctcatacccattttctc

SEQ ID NO: 196970 - DNA, 20 bp, Artificial sequence
  SiRNA target sequence
ttctcatacccattttctct

SEQ ID NO: 196971 - DNA, 20 bp, Artificial sequence
  SiRNA target sequence
tctcatacccattttctctt

SEQ ID NO: 196972 - DNA, 20 bp, Artificial sequence
  SiRNA target sequence
ctcatacccattttctcttt

SEQ ID NO: 196973 - DNA, 20 bp, Artificial sequence
  SiRNA target sequence
tcatacccattttctcttta

SEQ ID NO: 196974 - DNA, 20 bp, Artificial sequence
  SiRNA target sequence
catacccattttctctttac

SEQ ID NO: 196975 - DNA, 20 bp, Artificial sequence
  SiRNA target sequence
atacccattttctctttaca

SEQ ID NO: 196976 - DNA, 20 bp, Artificial sequence
  SiRNA target sequence
tacccattttctctttacaa

SEQ ID NO: 196977 - DNA, 20 bp, Artificial sequence
  SiRNA target sequence
acccattttctctttacaaa

SEQ ID NO: 196978 - DNA, 20 bp, Artificial sequence
  SiRNA target sequence
cccattttctctttacaaat

SEQ ID NO: 196979 - DNA, 20 bp, Artificial sequence
  SiRNA target sequence
ccattttctctttacaaata

SEQ ID NO: 196980 - DNA, 20 bp, Artificial sequence
  SiRNA target sequence
cattttctctttacaaatat

SEQ ID NO: 196981 - DNA, 20 bp, Artificial sequence
  SiRNA target sequence
attttctctttacaaatatc

SEQ ID NO: 196982 - DNA, 20 bp, Artificial sequence
  SiRNA target sequence
ttttctctttacaaatatca

SEQ ID NO: 196983 - DNA, 20 bp, Artificial sequence
  SiRNA target sequence
tttctctttacaaatatcaa

SEQ ID NO: 196984 - DNA, 20 bp, Artificial sequence
  SiRNA target sequence
ttctctttacaaatatcaaa

SEQ ID NO: 196985 - DNA, 20 bp, Artificial sequence
  SiRNA target sequence
tctctttacaaatatcaaag

SEQ ID NO: 196986 - DNA, 20 bp, Artificial sequence
  SiRNA target sequence
ctctttacaaatatcaaagg

SEQ ID NO: 196987 - DNA, 20 bp, Artificial sequence
  SiRNA target sequence
tctttacaaatatcaaaggc

SEQ ID NO: 196988 - DNA, 20 bp, Artificial sequence
  SiRNA target sequence
ctttacaaatatcaaaggct

SEQ ID NO: 196989 - DNA, 20 bp, Artificial sequence
  SiRNA target sequence
tttacaaatatcaaaggctg

SEQ ID NO: 196990 - DNA, 20 bp, Artificial sequence
  SiRNA target sequence
ttacaaatatcaaaggctga

SEQ ID NO: 196991 - DNA, 20 bp, Artificial sequence
  SiRNA target sequence
tacaaatatcaaaggctgaa

SEQ ID NO: 196992 - DNA, 20 bp, Artificial sequence
  SiRNA target sequence
acaaatatcaaaggctgaat

SEQ ID NO: 196993 - DNA, 20 bp, Artificial sequence
  SiRNA target sequence
caaatatcaaaggctgaata

SEQ ID NO: 196994 - DNA, 20 bp, Artificial sequence
  SiRNA target sequence
aaatatcaaaggctgaatat

SEQ ID NO: 196995 - DNA, 20 bp, Artificial sequence
  SiRNA target sequence
aatatcaaaggctgaatatt

SEQ ID NO: 196996 - DNA, 20 bp, Artificial sequence
  SiRNA target sequence
atatcaaaggctgaatattt

SEQ ID NO: 196997 - DNA, 20 bp, Artificial sequence
  SiRNA target sequence
tatcaaaggctgaatatttt

SEQ ID NO: 196998 - DNA, 20 bp, Artificial sequence
  SiRNA target sequence
atcaaaggctgaatatttta

SEQ ID NO: 196999 - DNA, 20 bp, Artificial sequence
  SiRNA target sequence
tcaaaggctgaatattttaa

SEQ ID NO: 197000 - DNA, 20 bp, Artificial sequence
  SiRNA target sequence
caaaggctgaatattttaat

SEQ ID NO: 197001 - DNA, 20 bp, Artificial sequence
  SiRNA target sequence
aaaggctgaatattttaata

SEQ ID NO: 197002 - DNA, 20 bp, Artificial sequence
  SiRNA target sequence
aaggctgaatattttaatac

SEQ ID NO: 197003 - DNA, 20 bp, Artificial sequence
  SiRNA target sequence
aggctgaatattttaatact

SEQ ID NO: 197004 - DNA, 20 bp, Artificial sequence
  SiRNA target sequence
ggctgaatattttaatactt

SEQ ID NO: 197005 - DNA, 20 bp, Artificial sequence
  SiRNA target sequence
gctgaatattttaatacttt

SEQ ID NO: 197006 - DNA, 20 bp, Artificial sequence
  SiRNA target sequence
ctgaatattttaatactttt

SEQ ID NO: 197007 - DNA, 20 bp, Artificial sequence
  SiRNA target sequence
tgaatattttaatactttta

SEQ ID NO: 197008 - DNA, 20 bp, Artificial sequence
  SiRNA target sequence
gaatattttaatacttttat

SEQ ID NO: 197009 - DNA, 20 bp, Artificial sequence
  SiRNA target sequence
aatattttaatacttttatg

SEQ ID NO: 197010 - DNA, 20 bp, Artificial sequence
  SiRNA target sequence
atattttaatacttttatga

SEQ ID NO: 197011 - DNA, 20 bp, Artificial sequence
  SiRNA target sequence
tattttaatacttttatgaa

SEQ ID NO: 197012 - DNA, 20 bp, Artificial sequence
  SiRNA target sequence
attttaatacttttatgaat

SEQ ID NO: 197013 - DNA, 20 bp, Artificial sequence
  SiRNA target sequence
ttttaatacttttatgaatg

SEQ ID NO: 197014 - DNA, 20 bp, Artificial sequence
  SiRNA target sequence
tttaatacttttatgaatgc

SEQ ID NO: 197015 - DNA, 20 bp, Artificial sequence
  SiRNA target sequence
ttaatacttttatgaatgct

SEQ ID NO: 197016 - DNA, 20 bp, Artificial sequence
  SiRNA target sequence
taatacttttatgaatgcta

SEQ ID NO: 197017 - DNA, 20 bp, Artificial sequence
  SiRNA target sequence
aatacttttatgaatgctaa

SEQ ID NO: 197018 - DNA, 20 bp, Artificial sequence
  SiRNA target sequence
atacttttatgaatgctaaa

SEQ ID NO: 197019 - DNA, 20 bp, Artificial sequence
  SiRNA target sequence
tacttttatgaatgctaaaa

SEQ ID NO: 197020 - DNA, 20 bp, Artificial sequence
  SiRNA target sequence
acttttatgaatgctaaaaa

SEQ ID NO: 197021 - DNA, 20 bp, Artificial sequence
  SiRNA target sequence
cttttatgaatgctaaaaag

SEQ ID NO: 197022 - DNA, 20 bp, Artificial sequence
  SiRNA target sequence
ttttatgaatgctaaaaaga

SEQ ID NO: 197023 - DNA, 20 bp, Artificial sequence
  SiRNA target sequence
tttatgaatgctaaaaagaa

SEQ ID NO: 197024 - DNA, 20 bp, Artificial sequence
  SiRNA target sequence
ttatgaatgctaaaaagaac

SEQ ID NO: 197025 - DNA, 20 bp, Artificial sequence
  SiRNA target sequence
tatgaatgctaaaaagaaca

SEQ ID NO: 197026 - DNA, 20 bp, Artificial sequence
  SiRNA target sequence
atgaatgctaaaaagaacat

SEQ ID NO: 197027 - DNA, 20 bp, Artificial sequence
  SiRNA target sequence
tgaatgctaaaaagaacatt

SEQ ID NO: 197028 - DNA, 20 bp, Artificial sequence
  SiRNA target sequence
gaatgctaaaaagaacattc

SEQ ID NO: 197029 - DNA, 20 bp, Artificial sequence
  SiRNA target sequence
aatgctaaaaagaacattcc

SEQ ID NO: 197030 - DNA, 20 bp, Artificial sequence
  SiRNA target sequence
atgctaaaaagaacattcca

SEQ ID NO: 197031 - DNA, 20 bp, Artificial sequence
  SiRNA target sequence
tgctaaaaagaacattccac

SEQ ID NO: 197032 - DNA, 20 bp, Artificial sequence
  SiRNA target sequence
gctaaaaagaacattccact

SEQ ID NO: 197033 - DNA, 20 bp, Artificial sequence
  SiRNA target sequence
ctaaaaagaacattccactg

SEQ ID NO: 197034 - DNA, 20 bp, Artificial sequence
  SiRNA target sequence
taaaaagaacattccactgt

SEQ ID NO: 197035 - DNA, 20 bp, Artificial sequence
  SiRNA target sequence
aaaaagaacattccactgta

SEQ ID NO: 197036 - DNA, 20 bp, Artificial sequence
  SiRNA target sequence
aaaagaacattccactgtaa

SEQ ID NO: 197037 - DNA, 20 bp, Artificial sequence
  SiRNA target sequence
aaagaacattccactgtaat

SEQ ID NO: 197038 - DNA, 20 bp, Artificial sequence
  SiRNA target sequence
aagaacattccactgtaatt

SEQ ID NO: 197039 - DNA, 20 bp, Artificial sequence
  SiRNA target sequence
agaacattccactgtaattt

SEQ ID NO: 197040 - DNA, 20 bp, Artificial sequence
  SiRNA target sequence
gaacattccactgtaatttt

SEQ ID NO: 197041 - DNA, 20 bp, Artificial sequence
  SiRNA target sequence
aacattccactgtaattttc

SEQ ID NO: 197042 - DNA, 20 bp, Artificial sequence
  SiRNA target sequence
acattccactgtaattttcg

SEQ ID NO: 197043 - DNA, 20 bp, Artificial sequence
  SiRNA target sequence
cattccactgtaattttcga

SEQ ID NO: 197044 - DNA, 20 bp, Artificial sequence
  SiRNA target sequence
attccactgtaattttcgat

SEQ ID NO: 197045 - DNA, 20 bp, Artificial sequence
  SiRNA target sequence
ttccactgtaattttcgatc

SEQ ID NO: 197046 - DNA, 20 bp, Artificial sequence
  SiRNA target sequence
tccactgtaattttcgatcg

SEQ ID NO: 197047 - DNA, 20 bp, Artificial sequence
  SiRNA target sequence
ccactgtaattttcgatcgt

SEQ ID NO: 197048 - DNA, 20 bp, Artificial sequence
  SiRNA target sequence
cactgtaattttcgatcgta

SEQ ID NO: 197049 - DNA, 20 bp, Artificial sequence
  SiRNA target sequence
actgtaattttcgatcgtat

SEQ ID NO: 197050 - DNA, 20 bp, Artificial sequence
  SiRNA target sequence
ctgtaattttcgatcgtata

SEQ ID NO: 197051 - DNA, 20 bp, Artificial sequence
  SiRNA target sequence
tgtaattttcgatcgtataa

SEQ ID NO: 197052 - DNA, 20 bp, Artificial sequence
  SiRNA target sequence
gtaattttcgatcgtataaa

SEQ ID NO: 197053 - DNA, 20 bp, Artificial sequence
  SiRNA target sequence
taattttcgatcgtataaat

SEQ ID NO: 197054 - DNA, 20 bp, Artificial sequence
  SiRNA target sequence
aattttcgatcgtataaatg

SEQ ID NO: 197055 - DNA, 20 bp, Artificial sequence
  SiRNA target sequence
attttcgatcgtataaatgt

SEQ ID NO: 197056 - DNA, 20 bp, Artificial sequence
  SiRNA target sequence
ttttcgatcgtataaatgta

SEQ ID NO: 197057 - DNA, 20 bp, Artificial sequence
  SiRNA target sequence
tttcgatcgtataaatgtac

SEQ ID NO: 197058 - DNA, 20 bp, Artificial sequence
  SiRNA target sequence
ttcgatcgtataaatgtacg

SEQ ID NO: 197059 - DNA, 20 bp, Artificial sequence
  SiRNA target sequence
tcgatcgtataaatgtacga

SEQ ID NO: 197060 - DNA, 20 bp, Artificial sequence
  SiRNA target sequence
cgatcgtataaatgtacgac

SEQ ID NO: 197061 - DNA, 20 bp, Artificial sequence
  SiRNA target sequence
gatcgtataaatgtacgaca

SEQ ID NO: 197062 - DNA, 20 bp, Artificial sequence
  SiRNA target sequence
atcgtataaatgtacgacat

SEQ ID NO: 197063 - DNA, 20 bp, Artificial sequence
  SiRNA target sequence
tcgtataaatgtacgacatt

SEQ ID NO: 197064 - DNA, 20 bp, Artificial sequence
  SiRNA target sequence
cgtataaatgtacgacattt

SEQ ID NO: 197065 - DNA, 20 bp, Artificial sequence
  SiRNA target sequence
gtataaatgtacgacatttt

SEQ ID NO: 197066 - DNA, 20 bp, Artificial sequence
  SiRNA target sequence
tataaatgtacgacattttt

SEQ ID NO: 197067 - DNA, 20 bp, Artificial sequence
  SiRNA target sequence
ataaatgtacgacatttttt

SEQ ID NO: 197068 - DNA, 20 bp, Artificial sequence
  SiRNA target sequence
taaatgtacgacattttttt

SEQ ID NO: 197069 - DNA, 20 bp, Artificial sequence
  SiRNA target sequence
aaatgtacgacattttttta

SEQ ID NO: 197070 - DNA, 20 bp, Artificial sequence
  SiRNA target sequence
aatgtacgacatttttttaa

SEQ ID NO: 197071 - DNA, 20 bp, Artificial sequence
  SiRNA target sequence
atgtacgacatttttttaaa

SEQ ID NO: 197072 - DNA, 20 bp, Artificial sequence
  SiRNA target sequence
tgtacgacatttttttaaaa

SEQ ID NO: 197073 - DNA, 20 bp, Artificial sequence
  SiRNA target sequence
gtacgacatttttttaaaaa

SEQ ID NO: 197074 - DNA, 20 bp, Artificial sequence
  SiRNA target sequence
tacgacatttttttaaaaaa

SEQ ID NO: 197075 - DNA, 20 bp, Artificial sequence
  SiRNA target sequence
acgacatttttttaaaaaat

SEQ ID NO: 197076 - DNA, 20 bp, Artificial sequence
  SiRNA target sequence
cgacatttttttaaaaaata

SEQ ID NO: 197077 - DNA, 20 bp, Artificial sequence
  SiRNA target sequence
gacatttttttaaaaaatac

SEQ ID NO: 197078 - DNA, 20 bp, Artificial sequence
  SiRNA target sequence
acatttttttaaaaaataca

SEQ ID NO: 197079 - DNA, 20 bp, Artificial sequence
  SiRNA target sequence
catttttttaaaaaatacag

SEQ ID NO: 197080 - DNA, 20 bp, Artificial sequence
  SiRNA target sequence
atttttttaaaaaatacaga

SEQ ID NO: 197081 - DNA, 20 bp, Artificial sequence
  SiRNA target sequence
tttttttaaaaaatacagaa

SEQ ID NO: 197082 - DNA, 20 bp, Artificial sequence
  SiRNA target sequence
ttttttaaaaaatacagaaa

SEQ ID NO: 197083 - DNA, 20 bp, Artificial sequence
  SiRNA target sequence
tttttaaaaaatacagaaat

SEQ ID NO: 197084 - DNA, 20 bp, Artificial sequence
  SiRNA target sequence
ttttaaaaaatacagaaatc

SEQ ID NO: 197085 - DNA, 20 bp, Artificial sequence
  SiRNA target sequence
tttaaaaaatacagaaatcc

SEQ ID NO: 197086 - DNA, 20 bp, Artificial sequence
  SiRNA target sequence
ttaaaaaatacagaaatcca

SEQ ID NO: 197087 - DNA, 20 bp, Artificial sequence
  SiRNA target sequence
taaaaaatacagaaatccat

SEQ ID NO: 197088 - DNA, 20 bp, Artificial sequence
  SiRNA target sequence
aaaaaatacagaaatccatg

SEQ ID NO: 197089 - DNA, 20 bp, Artificial sequence
  SiRNA target sequence
aaaaatacagaaatccatga

SEQ ID NO: 197090 - DNA, 20 bp, Artificial sequence
  SiRNA target sequence
aaaatacagaaatccatgaa

SEQ ID NO: 197091 - DNA, 20 bp, Artificial sequence
  SiRNA target sequence
aaatacagaaatccatgaaa

SEQ ID NO: 197092 - DNA, 20 bp, Artificial sequence
  SiRNA target sequence
aatacagaaatccatgaaaa

SEQ ID NO: 197093 - DNA, 20 bp, Artificial sequence
  SiRNA target sequence
atacagaaatccatgaaaaa

SEQ ID NO: 197094 - DNA, 20 bp, Artificial sequence
  SiRNA target sequence
tacagaaatccatgaaaaag

SEQ ID NO: 197095 - DNA, 20 bp, Artificial sequence
  SiRNA target sequence
acagaaatccatgaaaaagc

SEQ ID NO: 197096 - DNA, 20 bp, Artificial sequence
  SiRNA target sequence
cagaaatccatgaaaaagca

SEQ ID NO: 197097 - DNA, 20 bp, Artificial sequence
  SiRNA target sequence
agaaatccatgaaaaagcaa

SEQ ID NO: 197098 - DNA, 20 bp, Artificial sequence
  SiRNA target sequence
gaaatccatgaaaaagcaag

SEQ ID NO: 197099 - DNA, 20 bp, Artificial sequence
  SiRNA target sequence
aaatccatgaaaaagcaagt

SEQ ID NO: 197100 - DNA, 20 bp, Artificial sequence
  SiRNA target sequence
aatccatgaaaaagcaagtc

SEQ ID NO: 197101 - DNA, 20 bp, Artificial sequence
  SiRNA target sequence
atccatgaaaaagcaagtcc

SEQ ID NO: 197102 - DNA, 20 bp, Artificial sequence
  SiRNA target sequence
tccatgaaaaagcaagtcct

SEQ ID NO: 197103 - DNA, 20 bp, Artificial sequence
  SiRNA target sequence
ccatgaaaaagcaagtcctt

SEQ ID NO: 197104 - DNA, 20 bp, Artificial sequence
  SiRNA target sequence
catgaaaaagcaagtccttc

SEQ ID NO: 197105 - DNA, 20 bp, Artificial sequence
  SiRNA target sequence
atgaaaaagcaagtccttca

SEQ ID NO: 197106 - DNA, 20 bp, Artificial sequence
  SiRNA target sequence
tgaaaaagcaagtccttcaa

SEQ ID NO: 197107 - DNA, 20 bp, Artificial sequence
  SiRNA target sequence
gaaaaagcaagtccttcaat

SEQ ID NO: 197108 - DNA, 20 bp, Artificial sequence
  SiRNA target sequence
aaaaagcaagtccttcaatg

SEQ ID NO: 197109 - DNA, 20 bp, Artificial sequence
  SiRNA target sequence
aaaagcaagtccttcaatgg

SEQ ID NO: 197110 - DNA, 20 bp, Artificial sequence
  SiRNA target sequence
aaagcaagtccttcaatggc

SEQ ID NO: 197111 - DNA, 20 bp, Artificial sequence
  SiRNA target sequence
aagcaagtccttcaatggca

SEQ ID NO: 197112 - DNA, 20 bp, Artificial sequence
  SiRNA target sequence
agcaagtccttcaatggcag

SEQ ID NO: 197113 - DNA, 20 bp, Artificial sequence
  SiRNA target sequence
gcaagtccttcaatggcaga

SEQ ID NO: 197114 - DNA, 20 bp, Artificial sequence
  SiRNA target sequence
caagtccttcaatggcagaa

SEQ ID NO: 197115 - DNA, 20 bp, Artificial sequence
  SiRNA target sequence
aagtccttcaatggcagaat

SEQ ID NO: 197116 - DNA, 20 bp, Artificial sequence
  SiRNA target sequence
agtccttcaatggcagaatt

SEQ ID NO: 197117 - DNA, 20 bp, Artificial sequence
  SiRNA target sequence
gtccttcaatggcagaattg

SEQ ID NO: 197118 - DNA, 20 bp, Artificial sequence
  SiRNA target sequence
tccttcaatggcagaattgt

SEQ ID NO: 197119 - DNA, 20 bp, Artificial sequence
  SiRNA target sequence
ccttcaatggcagaattgta

SEQ ID NO: 197120 - DNA, 20 bp, Artificial sequence
  SiRNA target sequence
cttcaatggcagaattgtag

SEQ ID NO: 197121 - DNA, 20 bp, Artificial sequence
  SiRNA target sequence
ttcaatggcagaattgtaga

SEQ ID NO: 197122 - DNA, 20 bp, Artificial sequence
  SiRNA target sequence
tcaatggcagaattgtagat

SEQ ID NO: 197123 - DNA, 20 bp, Artificial sequence
  SiRNA target sequence
caatggcagaattgtagatt

SEQ ID NO: 197124 - DNA, 20 bp, Artificial sequence
  SiRNA target sequence
aatggcagaattgtagattg

SEQ ID NO: 197125 - DNA, 20 bp, Artificial sequence
  SiRNA target sequence
atggcagaattgtagattga

SEQ ID NO: 197126 - DNA, 20 bp, Artificial sequence
  SiRNA target sequence
tggcagaattgtagattgat

SEQ ID NO: 197127 - DNA, 20 bp, Artificial sequence
  SiRNA target sequence
ggcagaattgtagattgatg

SEQ ID NO: 197128 - DNA, 20 bp, Artificial sequence
  SiRNA target sequence
gcagaattgtagattgatgc

SEQ ID NO: 197129 - DNA, 20 bp, Artificial sequence
  SiRNA target sequence
cagaattgtagattgatgct

SEQ ID NO: 197130 - DNA, 20 bp, Artificial sequence
  SiRNA target sequence
agaattgtagattgatgctc

SEQ ID NO: 197131 - DNA, 20 bp, Artificial sequence
  SiRNA target sequence
gaattgtagattgatgctcc

SEQ ID NO: 197132 - DNA, 20 bp, Artificial sequence
  SiRNA target sequence
aattgtagattgatgctccc

SEQ ID NO: 197133 - DNA, 20 bp, Artificial sequence
  SiRNA target sequence
attgtagattgatgctccca

SEQ ID NO: 197134 - DNA, 20 bp, Artificial sequence
  SiRNA target sequence
ttgtagattgatgctcccat

SEQ ID NO: 197135 - DNA, 20 bp, Artificial sequence
  SiRNA target sequence
tgtagattgatgctcccata

SEQ ID NO: 197136 - DNA, 20 bp, Artificial sequence
  SiRNA target sequence
gtagattgatgctcccataa

SEQ ID NO: 197137 - DNA, 20 bp, Artificial sequence
  SiRNA target sequence
tagattgatgctcccataac

SEQ ID NO: 197138 - DNA, 20 bp, Artificial sequence
  SiRNA target sequence
agattgatgctcccataacg

SEQ ID NO: 197139 - DNA, 20 bp, Artificial sequence
  SiRNA target sequence
gattgatgctcccataacga

SEQ ID NO: 197140 - DNA, 20 bp, Artificial sequence
  SiRNA target sequence
attgatgctcccataacgat

SEQ ID NO: 197141 - DNA, 20 bp, Artificial sequence
  SiRNA target sequence
ttgatgctcccataacgatt

SEQ ID NO: 197142 - DNA, 20 bp, Artificial sequence
  SiRNA target sequence
tgatgctcccataacgatta

SEQ ID NO: 197143 - DNA, 20 bp, Artificial sequence
  SiRNA target sequence
gatgctcccataacgattat

SEQ ID NO: 197144 - DNA, 20 bp, Artificial sequence
  SiRNA target sequence
atgctcccataacgattatt

SEQ ID NO: 197145 - DNA, 20 bp, Artificial sequence
  SiRNA target sequence
tgctcccataacgattattg

SEQ ID NO: 197146 - DNA, 20 bp, Artificial sequence
  SiRNA target sequence
gctcccataacgattattga

SEQ ID NO: 197147 - DNA, 20 bp, Artificial sequence
  SiRNA target sequence
ctcccataacgattattgac

SEQ ID NO: 197148 - DNA, 20 bp, Artificial sequence
  SiRNA target sequence
tcccataacgattattgacc

SEQ ID NO: 197149 - DNA, 20 bp, Artificial sequence
  SiRNA target sequence
cccataacgattattgaccc

SEQ ID NO: 197150 - DNA, 20 bp, Artificial sequence
  SiRNA target sequence
ccataacgattattgacccc

SEQ ID NO: 197151 - DNA, 20 bp, Artificial sequence
  SiRNA target sequence
cataacgattattgacccca

SEQ ID NO: 197152 - DNA, 20 bp, Artificial sequence
  SiRNA target sequence
ataacgattattgaccccaa

SEQ ID NO: 197153 - DNA, 20 bp, Artificial sequence
  SiRNA target sequence
taacgattattgaccccaac

SEQ ID NO: 197154 - DNA, 20 bp, Artificial sequence
  SiRNA target sequence
aacgattattgaccccaaca

SEQ ID NO: 197155 - DNA, 20 bp, Artificial sequence
  SiRNA target sequence
acgattattgaccccaacaa

SEQ ID NO: 197156 - DNA, 20 bp, Artificial sequence
  SiRNA target sequence
cgattattgaccccaacaac

SEQ ID NO: 197157 - DNA, 20 bp, Artificial sequence
  SiRNA target sequence
gattattgaccccaacaaca

SEQ ID NO: 197158 - DNA, 20 bp, Artificial sequence
  SiRNA target sequence
attattgaccccaacaacaa

SEQ ID NO: 197159 - DNA, 20 bp, Artificial sequence
  SiRNA target sequence
ttattgaccccaacaacaag

SEQ ID NO: 197160 - DNA, 20 bp, Artificial sequence
  SiRNA target sequence
tattgaccccaacaacaaga

SEQ ID NO: 197161 - DNA, 20 bp, Artificial sequence
  SiRNA target sequence
attgaccccaacaacaagaa

SEQ ID NO: 197162 - DNA, 20 bp, Artificial sequence
  SiRNA target sequence
ttgaccccaacaacaagaat

SEQ ID NO: 197163 - DNA, 20 bp, Artificial sequence
  SiRNA target sequence
tgaccccaacaacaagaata

SEQ ID NO: 197164 - DNA, 20 bp, Artificial sequence
  SiRNA target sequence
gaccccaacaacaagaataa

SEQ ID NO: 197165 - DNA, 20 bp, Artificial sequence
  SiRNA target sequence
accccaacaacaagaataaa

SEQ ID NO: 197166 - DNA, 20 bp, Artificial sequence
  SiRNA target sequence
ccccaacaacaagaataaag

SEQ ID NO: 197167 - DNA, 20 bp, Artificial sequence
  SiRNA target sequence
cccaacaacaagaataaagg

SEQ ID NO: 197168 - DNA, 20 bp, Artificial sequence
  SiRNA target sequence
ccaacaacaagaataaaggt

SEQ ID NO: 197169 - DNA, 20 bp, Artificial sequence
  SiRNA target sequence
caacaacaagaataaaggtg

SEQ ID NO: 197170 - DNA, 20 bp, Artificial sequence
  SiRNA target sequence
aacaacaagaataaaggtgt

SEQ ID NO: 197171 - DNA, 20 bp, Artificial sequence
  SiRNA target sequence
acaacaagaataaaggtgtt

SEQ ID NO: 197172 - DNA, 20 bp, Artificial sequence
  SiRNA target sequence
caacaagaataaaggtgtta

SEQ ID NO: 197173 - DNA, 20 bp, Artificial sequence
  SiRNA target sequence
aacaagaataaaggtgttaa

SEQ ID NO: 197174 - DNA, 20 bp, Artificial sequence
  SiRNA target sequence
acaagaataaaggtgttaag

SEQ ID NO: 197175 - DNA, 20 bp, Artificial sequence
  SiRNA target sequence
caagaataaaggtgttaaga

SEQ ID NO: 197176 - DNA, 20 bp, Artificial sequence
  SiRNA target sequence
aagaataaaggtgttaagag

SEQ ID NO: 197177 - DNA, 20 bp, Artificial sequence
  SiRNA target sequence
agaataaaggtgttaagagt

SEQ ID NO: 197178 - DNA, 20 bp, Artificial sequence
  SiRNA target sequence
gaataaaggtgttaagagtc

SEQ ID NO: 197179 - DNA, 20 bp, Artificial sequence
  SiRNA target sequence
aataaaggtgttaagagtcc

SEQ ID NO: 197180 - DNA, 20 bp, Artificial sequence
  SiRNA target sequence
ataaaggtgttaagagtccc

SEQ ID NO: 197181 - DNA, 20 bp, Artificial sequence
  SiRNA target sequence
taaaggtgttaagagtccca

SEQ ID NO: 197182 - DNA, 20 bp, Artificial sequence
  SiRNA target sequence
aaaggtgttaagagtcccat

SEQ ID NO: 197183 - DNA, 20 bp, Artificial sequence
  SiRNA target sequence
aaggtgttaagagtcccata

SEQ ID NO: 197184 - DNA, 20 bp, Artificial sequence
  SiRNA target sequence
aggtgttaagagtcccatag

SEQ ID NO: 197185 - DNA, 20 bp, Artificial sequence
  SiRNA target sequence
ggtgttaagagtcccatagt

SEQ ID NO: 197186 - DNA, 20 bp, Artificial sequence
  SiRNA target sequence
gtgttaagagtcccatagta

SEQ ID NO: 197187 - DNA, 20 bp, Artificial sequence
  SiRNA target sequence
tgttaagagtcccatagtaa

SEQ ID NO: 197188 - DNA, 20 bp, Artificial sequence
  SiRNA target sequence
gttaagagtcccatagtaat

SEQ ID NO: 197189 - DNA, 20 bp, Artificial sequence
  SiRNA target sequence
ttaagagtcccatagtaatc

SEQ ID NO: 197190 - DNA, 20 bp, Artificial sequence
  SiRNA target sequence
taagagtcccatagtaatcc

SEQ ID NO: 197191 - DNA, 20 bp, Artificial sequence
  SiRNA target sequence
aagagtcccatagtaatcca

SEQ ID NO: 197192 - DNA, 20 bp, Artificial sequence
  SiRNA target sequence
agagtcccatagtaatccat

SEQ ID NO: 197193 - DNA, 20 bp, Artificial sequence
  SiRNA target sequence
gagtcccatagtaatccatc

SEQ ID NO: 197194 - DNA, 20 bp, Artificial sequence
  SiRNA target sequence
agtcccatagtaatccatcc

SEQ ID NO: 197195 - DNA, 20 bp, Artificial sequence
  SiRNA target sequence
gtcccatagtaatccatcca

SEQ ID NO: 197196 - DNA, 20 bp, Artificial sequence
  SiRNA target sequence
tcccatagtaatccatccac

SEQ ID NO: 197197 - DNA, 20 bp, Artificial sequence
  SiRNA target sequence
cccatagtaatccatccact

SEQ ID NO: 197198 - DNA, 20 bp, Artificial sequence
  SiRNA target sequence
ccatagtaatccatccacta

SEQ ID NO: 197199 - DNA, 20 bp, Artificial sequence
  SiRNA target sequence
catagtaatccatccactac

SEQ ID NO: 197200 - DNA, 20 bp, Artificial sequence
  SiRNA target sequence
atagtaatccatccactact

SEQ ID NO: 197201 - DNA, 20 bp, Artificial sequence
  SiRNA target sequence
tagtaatccatccactactt

SEQ ID NO: 197202 - DNA, 20 bp, Artificial sequence
  SiRNA target sequence
agtaatccatccactacttt

SEQ ID NO: 197203 - DNA, 20 bp, Artificial sequence
  SiRNA target sequence
gtaatccatccactactttc

SEQ ID NO: 197204 - DNA, 20 bp, Artificial sequence
  SiRNA target sequence
taatccatccactactttct

SEQ ID NO: 197205 - DNA, 20 bp, Artificial sequence
  SiRNA target sequence
aatccatccactactttcta

SEQ ID NO: 197206 - DNA, 20 bp, Artificial sequence
  SiRNA target sequence
atccatccactactttctac

SEQ ID NO: 197207 - DNA, 20 bp, Artificial sequence
  SiRNA target sequence
tccatccactactttctact

SEQ ID NO: 197208 - DNA, 20 bp, Artificial sequence
  SiRNA target sequence
ccatccactactttctacta

SEQ ID NO: 197209 - DNA, 20 bp, Artificial sequence
  SiRNA target sequence
catccactactttctactaa

SEQ ID NO: 197210 - DNA, 20 bp, Artificial sequence
  SiRNA target sequence
atccactactttctactaaa

SEQ ID NO: 197211 - DNA, 20 bp, Artificial sequence
  SiRNA target sequence
tccactactttctactaaag

SEQ ID NO: 197212 - DNA, 20 bp, Artificial sequence
  SiRNA target sequence
ccactactttctactaaagt

SEQ ID NO: 197213 - DNA, 20 bp, Artificial sequence
  SiRNA target sequence
cactactttctactaaagta

SEQ ID NO: 197214 - DNA, 20 bp, Artificial sequence
  SiRNA target sequence
actactttctactaaagtag

SEQ ID NO: 197215 - DNA, 20 bp, Artificial sequence
  SiRNA target sequence
ctactttctactaaagtaga

SEQ ID NO: 197216 - DNA, 20 bp, Artificial sequence
  SiRNA target sequence
tactttctactaaagtagaa

SEQ ID NO: 197217 - DNA, 20 bp, Artificial sequence
  SiRNA target sequence
actttctactaaagtagaaa

SEQ ID NO: 197218 - DNA, 20 bp, Artificial sequence
  SiRNA target sequence
ctttctactaaagtagaaaa

SEQ ID NO: 197219 - DNA, 20 bp, Artificial sequence
  SiRNA target sequence
tttctactaaagtagaaaat

SEQ ID NO: 197220 - DNA, 20 bp, Artificial sequence
  SiRNA target sequence
ttctactaaagtagaaaatg

SEQ ID NO: 197221 - DNA, 20 bp, Artificial sequence
  SiRNA target sequence
tctactaaagtagaaaatgc

SEQ ID NO: 197222 - DNA, 20 bp, Artificial sequence
  SiRNA target sequence
ctactaaagtagaaaatgct

SEQ ID NO: 197223 - DNA, 20 bp, Artificial sequence
  SiRNA target sequence
tactaaagtagaaaatgctg

SEQ ID NO: 197224 - DNA, 20 bp, Artificial sequence
  SiRNA target sequence
actaaagtagaaaatgctga

SEQ ID NO: 197225 - DNA, 20 bp, Artificial sequence
  SiRNA target sequence
ctaaagtagaaaatgctgac

SEQ ID NO: 197226 - DNA, 20 bp, Artificial sequence
  SiRNA target sequence
taaagtagaaaatgctgaca

SEQ ID NO: 197227 - DNA, 20 bp, Artificial sequence
  SiRNA target sequence
aaagtagaaaatgctgacaa

SEQ ID NO: 197228 - DNA, 20 bp, Artificial sequence
  SiRNA target sequence
aagtagaaaatgctgacaaa

SEQ ID NO: 197229 - DNA, 20 bp, Artificial sequence
  SiRNA target sequence
agtagaaaatgctgacaaat

SEQ ID NO: 197230 - DNA, 20 bp, Artificial sequence
  SiRNA target sequence
gtagaaaatgctgacaaatt

SEQ ID NO: 197231 - DNA, 20 bp, Artificial sequence
  SiRNA target sequence
tagaaaatgctgacaaatta

SEQ ID NO: 197232 - DNA, 20 bp, Artificial sequence
  SiRNA target sequence
agaaaatgctgacaaattaa

SEQ ID NO: 197233 - DNA, 20 bp, Artificial sequence
  SiRNA target sequence
gaaaatgctgacaaattaag

SEQ ID NO: 197234 - DNA, 20 bp, Artificial sequence
  SiRNA target sequence
aaaatgctgacaaattaagt

SEQ ID NO: 197235 - DNA, 20 bp, Artificial sequence
  SiRNA target sequence
aaatgctgacaaattaagtg

SEQ ID NO: 197236 - DNA, 20 bp, Artificial sequence
  SiRNA target sequence
aatgctgacaaattaagtgt

SEQ ID NO: 197237 - DNA, 20 bp, Artificial sequence
  SiRNA target sequence
atgctgacaaattaagtgtt

SEQ ID NO: 197238 - DNA, 20 bp, Artificial sequence
  SiRNA target sequence
tgctgacaaattaagtgtta

SEQ ID NO: 197239 - DNA, 20 bp, Artificial sequence
  SiRNA target sequence
gctgacaaattaagtgttat

SEQ ID NO: 197240 - DNA, 20 bp, Artificial sequence
  SiRNA target sequence
ctgacaaattaagtgttatt

SEQ ID NO: 197241 - DNA, 20 bp, Artificial sequence
  SiRNA target sequence
tgacaaattaagtgttatta

SEQ ID NO: 197242 - DNA, 20 bp, Artificial sequence
  SiRNA target sequence
gacaaattaagtgttattac

SEQ ID NO: 197243 - DNA, 20 bp, Artificial sequence
  SiRNA target sequence
acaaattaagtgttattaca

SEQ ID NO: 197244 - DNA, 20 bp, Artificial sequence
  SiRNA target sequence
caaattaagtgttattacag

SEQ ID NO: 197245 - DNA, 20 bp, Artificial sequence
  SiRNA target sequence
aaattaagtgttattacagt

SEQ ID NO: 197246 - DNA, 20 bp, Artificial sequence
  SiRNA target sequence
aattaagtgttattacagta

SEQ ID NO: 197247 - DNA, 20 bp, Artificial sequence
  SiRNA target sequence
attaagtgttattacagtaa

SEQ ID NO: 197248 - DNA, 20 bp, Artificial sequence
  SiRNA target sequence
ttaagtgttattacagtaac

SEQ ID NO: 197249 - DNA, 20 bp, Artificial sequence
  SiRNA target sequence
taagtgttattacagtaact

SEQ ID NO: 197250 - DNA, 20 bp, Artificial sequence
  SiRNA target sequence
aagtgttattacagtaactg

SEQ ID NO: 197251 - DNA, 20 bp, Artificial sequence
  SiRNA target sequence
agtgttattacagtaactgc

SEQ ID NO: 197252 - DNA, 20 bp, Artificial sequence
  SiRNA target sequence
gtgttattacagtaactgct

SEQ ID NO: 197253 - DNA, 20 bp, Artificial sequence
  SiRNA target sequence
tgttattacagtaactgcta

SEQ ID NO: 197254 - DNA, 20 bp, Artificial sequence
  SiRNA target sequence
gttattacagtaactgctac

SEQ ID NO: 197255 - DNA, 20 bp, Artificial sequence
  SiRNA target sequence
ttattacagtaactgctacc

SEQ ID NO: 197256 - DNA, 20 bp, Artificial sequence
  SiRNA target sequence
tattacagtaactgctacca

SEQ ID NO: 197257 - DNA, 20 bp, Artificial sequence
  SiRNA target sequence
attacagtaactgctaccaa

SEQ ID NO: 197258 - DNA, 20 bp, Artificial sequence
  SiRNA target sequence
ttacagtaactgctaccaat

SEQ ID NO: 197259 - DNA, 20 bp, Artificial sequence
  SiRNA target sequence
tacagtaactgctaccaata

SEQ ID NO: 197260 - DNA, 20 bp, Artificial sequence
  SiRNA target sequence
acagtaactgctaccaatat

SEQ ID NO: 197261 - DNA, 20 bp, Artificial sequence
  SiRNA target sequence
cagtaactgctaccaatatt

SEQ ID NO: 197262 - DNA, 20 bp, Artificial sequence
  SiRNA target sequence
agtaactgctaccaatattt

SEQ ID NO: 197263 - DNA, 20 bp, Artificial sequence
  SiRNA target sequence
gtaactgctaccaatatttg

SEQ ID NO: 197264 - DNA, 20 bp, Artificial sequence
  SiRNA target sequence
taactgctaccaatatttga

SEQ ID NO: 197265 - DNA, 20 bp, Artificial sequence
  SiRNA target sequence
aactgctaccaatatttgat

SEQ ID NO: 197266 - DNA, 20 bp, Artificial sequence
  SiRNA target sequence
actgctaccaatatttgatc

SEQ ID NO: 197267 - DNA, 20 bp, Artificial sequence
  SiRNA target sequence
ctgctaccaatatttgatct

SEQ ID NO: 197268 - DNA, 20 bp, Artificial sequence
  SiRNA target sequence
tgctaccaatatttgatcta

SEQ ID NO: 197269 - DNA, 20 bp, Artificial sequence
  SiRNA target sequence
gctaccaatatttgatctat

SEQ ID NO: 197270 - DNA, 20 bp, Artificial sequence
  SiRNA target sequence
ctaccaatatttgatctatt

SEQ ID NO: 197271 - DNA, 20 bp, Artificial sequence
  SiRNA target sequence
taccaatatttgatctattg

SEQ ID NO: 197272 - DNA, 20 bp, Artificial sequence
  SiRNA target sequence
accaatatttgatctattgt

SEQ ID NO: 197273 - DNA, 20 bp, Artificial sequence
  SiRNA target sequence
ccaatatttgatctattgta

SEQ ID NO: 197274 - DNA, 20 bp, Artificial sequence
  SiRNA target sequence
caatatttgatctattgtat

SEQ ID NO: 197275 - DNA, 20 bp, Artificial sequence
  SiRNA target sequence
aatatttgatctattgtatt

SEQ ID NO: 197276 - DNA, 20 bp, Artificial sequence
  SiRNA target sequence
atatttgatctattgtatta

SEQ ID NO: 197277 - DNA, 20 bp, Artificial sequence
  SiRNA target sequence
tatttgatctattgtattaa

SEQ ID NO: 197278 - DNA, 20 bp, Artificial sequence
  SiRNA target sequence
atttgatctattgtattaaa

SEQ ID NO: 197279 - DNA, 20 bp, Artificial sequence
  SiRNA target sequence
tttgatctattgtattaaat

SEQ ID NO: 197280 - DNA, 20 bp, Artificial sequence
  SiRNA target sequence
ttgatctattgtattaaatt

SEQ ID NO: 197281 - DNA, 20 bp, Artificial sequence
  SiRNA target sequence
tgatctattgtattaaattt

SEQ ID NO: 197282 - DNA, 20 bp, Artificial sequence
  SiRNA target sequence
gatctattgtattaaatttg

SEQ ID NO: 197283 - DNA, 20 bp, Artificial sequence
  SiRNA target sequence
atctattgtattaaatttgc

SEQ ID NO: 197284 - DNA, 20 bp, Artificial sequence
  SiRNA target sequence
tctattgtattaaatttgcc

SEQ ID NO: 197285 - DNA, 20 bp, Artificial sequence
  SiRNA target sequence
ctattgtattaaatttgccg

SEQ ID NO: 197286 - DNA, 20 bp, Artificial sequence
  SiRNA target sequence
tattgtattaaatttgccgg

SEQ ID NO: 197287 - DNA, 20 bp, Artificial sequence
  SiRNA target sequence
attgtattaaatttgccgga

SEQ ID NO: 197288 - DNA, 20 bp, Artificial sequence
  SiRNA target sequence
ttgtattaaatttgccggag

SEQ ID NO: 197289 - DNA, 20 bp, Artificial sequence
  SiRNA target sequence
tgtattaaatttgccggagt

SEQ ID NO: 197290 - DNA, 20 bp, Artificial sequence
  SiRNA target sequence
gtattaaatttgccggagta

SEQ ID NO: 197291 - DNA, 20 bp, Artificial sequence
  SiRNA target sequence
tattaaatttgccggagtat

SEQ ID NO: 197292 - DNA, 20 bp, Artificial sequence
  SiRNA target sequence
attaaatttgccggagtatt

SEQ ID NO: 197293 - DNA, 20 bp, Artificial sequence
  SiRNA target sequence
ttaaatttgccggagtattc

SEQ ID NO: 197294 - DNA, 20 bp, Artificial sequence
  SiRNA target sequence
taaatttgccggagtattct

SEQ ID NO: 197295 - DNA, 20 bp, Artificial sequence
  SiRNA target sequence
aaatttgccggagtattctc

SEQ ID NO: 197296 - DNA, 20 bp, Artificial sequence
  SiRNA target sequence
aatttgccggagtattctcc

SEQ ID NO: 197297 - DNA, 20 bp, Artificial sequence
  SiRNA target sequence
atttgccggagtattctcct

SEQ ID NO: 197298 - DNA, 20 bp, Artificial sequence
  SiRNA target sequence
tttgccggagtattctccta

SEQ ID NO: 197299 - DNA, 20 bp, Artificial sequence
  SiRNA target sequence
ttgccggagtattctcctac

SEQ ID NO: 197300 - DNA, 20 bp, Artificial sequence
  SiRNA target sequence
tgccggagtattctcctacc

SEQ ID NO: 197301 - DNA, 20 bp, Artificial sequence
  SiRNA target sequence
gccggagtattctcctacct

SEQ ID NO: 197302 - DNA, 20 bp, Artificial sequence
  SiRNA target sequence
ccggagtattctcctacctc

SEQ ID NO: 197303 - DNA, 20 bp, Artificial sequence
  SiRNA target sequence
cggagtattctcctacctct

SEQ ID NO: 197304 - DNA, 20 bp, Artificial sequence
  SiRNA target sequence
ggagtattctcctacctcta

SEQ ID NO: 197305 - DNA, 20 bp, Artificial sequence
  SiRNA target sequence
gagtattctcctacctctaa

SEQ ID NO: 197306 - DNA, 20 bp, Artificial sequence
  SiRNA target sequence
agtattctcctacctctaat

SEQ ID NO: 197307 - DNA, 20 bp, Artificial sequence
  SiRNA target sequence
gtattctcctacctctaatc

SEQ ID NO: 197308 - DNA, 20 bp, Artificial sequence
  SiRNA target sequence
tattctcctacctctaatcc

SEQ ID NO: 197309 - DNA, 20 bp, Artificial sequence
  SiRNA target sequence
attctcctacctctaatcct

SEQ ID NO: 197310 - DNA, 20 bp, Artificial sequence
  SiRNA target sequence
ttctcctacctctaatccta

SEQ ID NO: 197311 - DNA, 20 bp, Artificial sequence
  SiRNA target sequence
tctcctacctctaatcctaa

SEQ ID NO: 197312 - DNA, 20 bp, Artificial sequence
  SiRNA target sequence
ctcctacctctaatcctaaa

SEQ ID NO: 197313 - DNA, 20 bp, Artificial sequence
  SiRNA target sequence
tcctacctctaatcctaaac

SEQ ID NO: 197314 - DNA, 20 bp, Artificial sequence
  SiRNA target sequence
cctacctctaatcctaaact

SEQ ID NO: 197315 - DNA, 20 bp, Artificial sequence
  SiRNA target sequence
ctacctctaatcctaaactt

SEQ ID NO: 197316 - DNA, 20 bp, Artificial sequence
  SiRNA target sequence
tacctctaatcctaaacttt

SEQ ID NO: 197317 - DNA, 20 bp, Artificial sequence
  SiRNA target sequence
acctctaatcctaaactttt

SEQ ID NO: 197318 - DNA, 20 bp, Artificial sequence
  SiRNA target sequence
cctctaatcctaaacttttt

SEQ ID NO: 197319 - DNA, 20 bp, Artificial sequence
  SiRNA target sequence
ctctaatcctaaactttttg

SEQ ID NO: 197320 - DNA, 20 bp, Artificial sequence
  SiRNA target sequence
tctaatcctaaactttttga

SEQ ID NO: 197321 - DNA, 20 bp, Artificial sequence
  SiRNA target sequence
ctaatcctaaactttttgac

SEQ ID NO: 197322 - DNA, 20 bp, Artificial sequence
  SiRNA target sequence
taatcctaaactttttgacg

SEQ ID NO: 197323 - DNA, 20 bp, Artificial sequence
  SiRNA target sequence
aatcctaaactttttgacgc

SEQ ID NO: 197324 - DNA, 20 bp, Artificial sequence
  SiRNA target sequence
atcctaaactttttgacgca

SEQ ID NO: 197325 - DNA, 20 bp, Artificial sequence
  SiRNA target sequence
tcctaaactttttgacgcag

SEQ ID NO: 197326 - DNA, 20 bp, Artificial sequence
  SiRNA target sequence
cctaaactttttgacgcagc

SEQ ID NO: 197327 - DNA, 20 bp, Artificial sequence
  SiRNA target sequence
ctaaactttttgacgcagct

SEQ ID NO: 197328 - DNA, 20 bp, Artificial sequence
  SiRNA target sequence
taaactttttgacgcagctt

SEQ ID NO: 197329 - DNA, 20 bp, Artificial sequence
  SiRNA target sequence
aaactttttgacgcagcttt

SEQ ID NO: 197330 - DNA, 20 bp, Artificial sequence
  SiRNA target sequence
aactttttgacgcagcttta

SEQ ID NO: 197331 - DNA, 20 bp, Artificial sequence
  SiRNA target sequence
actttttgacgcagctttaa

SEQ ID NO: 197332 - DNA, 20 bp, Artificial sequence
  SiRNA target sequence
ctttttgacgcagctttaat

SEQ ID NO: 197333 - DNA, 20 bp, Artificial sequence
  SiRNA target sequence
tttttgacgcagctttaatt

SEQ ID NO: 197334 - DNA, 20 bp, Artificial sequence
  SiRNA target sequence
ttttgacgcagctttaattc

SEQ ID NO: 197335 - DNA, 20 bp, Artificial sequence
  SiRNA target sequence
tttgacgcagctttaattcc

SEQ ID NO: 197336 - DNA, 20 bp, Artificial sequence
  SiRNA target sequence
ttgacgcagctttaattcct

SEQ ID NO: 197337 - DNA, 20 bp, Artificial sequence
  SiRNA target sequence
tgacgcagctttaattcctg

SEQ ID NO: 197338 - DNA, 20 bp, Artificial sequence
  SiRNA target sequence
gacgcagctttaattcctgc

SEQ ID NO: 197339 - DNA, 20 bp, Artificial sequence
  SiRNA target sequence
acgcagctttaattcctgct

SEQ ID NO: 197340 - DNA, 20 bp, Artificial sequence
  SiRNA target sequence
cgcagctttaattcctgctt

SEQ ID NO: 197341 - DNA, 20 bp, Artificial sequence
  SiRNA target sequence
gcagctttaattcctgcttt

SEQ ID NO: 197342 - DNA, 20 bp, Artificial sequence
  SiRNA target sequence
cagctttaattcctgcttta

SEQ ID NO: 197343 - DNA, 20 bp, Artificial sequence
  SiRNA target sequence
agctttaattcctgctttat

SEQ ID NO: 197344 - DNA, 20 bp, Artificial sequence
  SiRNA target sequence
gctttaattcctgctttata

SEQ ID NO: 197345 - DNA, 20 bp, Artificial sequence
  SiRNA target sequence
ctttaattcctgctttatag

SEQ ID NO: 197346 - DNA, 20 bp, Artificial sequence
  SiRNA target sequence
tttaattcctgctttataga

SEQ ID NO: 197347 - DNA, 20 bp, Artificial sequence
  SiRNA target sequence
ttaattcctgctttatagac

SEQ ID NO: 197348 - DNA, 20 bp, Artificial sequence
  SiRNA target sequence
taattcctgctttatagaca

SEQ ID NO: 197349 - DNA, 20 bp, Artificial sequence
  SiRNA target sequence
aattcctgctttatagacag

SEQ ID NO: 197350 - DNA, 20 bp, Artificial sequence
  SiRNA target sequence
attcctgctttatagacaga

SEQ ID NO: 197351 - DNA, 20 bp, Artificial sequence
  SiRNA target sequence
ttcctgctttatagacagat

SEQ ID NO: 197352 - DNA, 20 bp, Artificial sequence
  SiRNA target sequence
tcctgctttatagacagatt

SEQ ID NO: 197353 - DNA, 20 bp, Artificial sequence
  SiRNA target sequence
cctgctttatagacagattc

SEQ ID NO: 197354 - DNA, 20 bp, Artificial sequence
  SiRNA target sequence
ctgctttatagacagattca

SEQ ID NO: 197355 - DNA, 20 bp, Artificial sequence
  SiRNA target sequence
tgctttatagacagattcaa

SEQ ID NO: 197356 - DNA, 20 bp, Artificial sequence
  SiRNA target sequence
gctttatagacagattcaat

SEQ ID NO: 197357 - DNA, 20 bp, Artificial sequence
  SiRNA target sequence
ctttatagacagattcaatt

SEQ ID NO: 197358 - DNA, 20 bp, Artificial sequence
  SiRNA target sequence
tttatagacagattcaatta

SEQ ID NO: 197359 - DNA, 20 bp, Artificial sequence
  SiRNA target sequence
ttatagacagattcaattaa

SEQ ID NO: 197360 - DNA, 20 bp, Artificial sequence
  SiRNA target sequence
tatagacagattcaattaaa

SEQ ID NO: 197361 - DNA, 20 bp, Artificial sequence
  SiRNA target sequence
atagacagattcaattaaat

SEQ ID NO: 197362 - DNA, 20 bp, Artificial sequence
  SiRNA target sequence
tagacagattcaattaaatt

SEQ ID NO: 197363 - DNA, 20 bp, Artificial sequence
  SiRNA target sequence
agacagattcaattaaatta

SEQ ID NO: 197364 - DNA, 20 bp, Artificial sequence
  SiRNA target sequence
gacagattcaattaaattaa

SEQ ID NO: 197365 - DNA, 20 bp, Artificial sequence
  SiRNA target sequence
acagattcaattaaattaaa

SEQ ID NO: 197366 - DNA, 20 bp, Artificial sequence
  SiRNA target sequence
cagattcaattaaattaaat

SEQ ID NO: 197367 - DNA, 20 bp, Artificial sequence
  SiRNA target sequence
agattcaattaaattaaatg

SEQ ID NO: 197368 - DNA, 20 bp, Artificial sequence
  SiRNA target sequence
gattcaattaaattaaatgt

SEQ ID NO: 197369 - DNA, 20 bp, Artificial sequence
  SiRNA target sequence
attcaattaaattaaatgtt

SEQ ID NO: 197370 - DNA, 20 bp, Artificial sequence
  SiRNA target sequence
ttcaattaaattaaatgtta

SEQ ID NO: 197371 - DNA, 20 bp, Artificial sequence
  SiRNA target sequence
tcaattaaattaaatgttat

SEQ ID NO: 197372 - DNA, 20 bp, Artificial sequence
  SiRNA target sequence
caattaaattaaatgttata

SEQ ID NO: 197373 - DNA, 20 bp, Artificial sequence
  SiRNA target sequence
aattaaattaaatgttatat

SEQ ID NO: 197374 - DNA, 20 bp, Artificial sequence
  SiRNA target sequence
attaaattaaatgttatatt

SEQ ID NO: 197375 - DNA, 20 bp, Artificial sequence
  SiRNA target sequence
ttaaattaaatgttatattg

SEQ ID NO: 197376 - DNA, 20 bp, Artificial sequence
  SiRNA target sequence
taaattaaatgttatattgt

SEQ ID NO: 197377 - DNA, 20 bp, Artificial sequence
  SiRNA target sequence
aaattaaatgttatattgta

SEQ ID NO: 197378 - DNA, 20 bp, Artificial sequence
  SiRNA target sequence
aattaaatgttatattgtaa

SEQ ID NO: 197379 - DNA, 20 bp, Artificial sequence
  SiRNA target sequence
attaaatgttatattgtaaa

SEQ ID NO: 197380 - DNA, 20 bp, Artificial sequence
  SiRNA target sequence
ttaaatgttatattgtaaaa

SEQ ID NO: 197381 - DNA, 20 bp, Artificial sequence
  SiRNA target sequence
taaatgttatattgtaaaaa

SEQ ID NO: 197382 - DNA, 20 bp, Artificial sequence
  SiRNA target sequence
aaatgttatattgtaaaaaa

SEQ ID NO: 197383 - DNA, 20 bp, Artificial sequence
  SiRNA target sequence
aatgttatattgtaaaaaaa

SEQ ID NO: 197384 - DNA, 20 bp, Artificial sequence
  SiRNA target sequence
atgttatattgtaaaaaaag

SEQ ID NO: 197385 - DNA, 20 bp, Artificial sequence
  SiRNA target sequence
tgttatattgtaaaaaaaga

SEQ ID NO: 197386 - DNA, 20 bp, Artificial sequence
  SiRNA target sequence
gttatattgtaaaaaaagac

SEQ ID NO: 197387 - DNA, 20 bp, Artificial sequence
  SiRNA target sequence
ttatattgtaaaaaaagact

SEQ ID NO: 197388 - DNA, 20 bp, Artificial sequence
  SiRNA target sequence
tatattgtaaaaaaagacta

SEQ ID NO: 197389 - DNA, 20 bp, Artificial sequence
  SiRNA target sequence
atattgtaaaaaaagactat

SEQ ID NO: 197390 - DNA, 20 bp, Artificial sequence
  SiRNA target sequence
tattgtaaaaaaagactatt

SEQ ID NO: 197391 - DNA, 20 bp, Artificial sequence
  SiRNA target sequence
attgtaaaaaaagactatta

SEQ ID NO: 197392 - DNA, 20 bp, Artificial sequence
  SiRNA target sequence
ttgtaaaaaaagactattat

SEQ ID NO: 197393 - DNA, 20 bp, Artificial sequence
  SiRNA target sequence
tgtaaaaaaagactattata

SEQ ID NO: 197394 - DNA, 20 bp, Artificial sequence
  SiRNA target sequence
gtaaaaaaagactattatac

SEQ ID NO: 197395 - DNA, 20 bp, Artificial sequence
  SiRNA target sequence
taaaaaaagactattataca

SEQ ID NO: 197396 - DNA, 20 bp, Artificial sequence
  SiRNA target sequence
aaaaaaagactattatacaa

SEQ ID NO: 197397 - DNA, 20 bp, Artificial sequence
  SiRNA target sequence
aaaaaagactattatacaaa

SEQ ID NO: 197398 - DNA, 20 bp, Artificial sequence
  SiRNA target sequence
aaaaagactattatacaaag

SEQ ID NO: 197399 - DNA, 20 bp, Artificial sequence
  SiRNA target sequence
aaaagactattatacaaagt

SEQ ID NO: 197400 - DNA, 20 bp, Artificial sequence
  SiRNA target sequence
aaagactattatacaaagtg

SEQ ID NO: 197401 - DNA, 20 bp, Artificial sequence
  SiRNA target sequence
aagactattatacaaagtga

SEQ ID NO: 197402 - DNA, 20 bp, Artificial sequence
  SiRNA target sequence
agactattatacaaagtgac

SEQ ID NO: 197403 - DNA, 20 bp, Artificial sequence
  SiRNA target sequence
gactattatacaaagtgaca

SEQ ID NO: 197404 - DNA, 20 bp, Artificial sequence
  SiRNA target sequence
actattatacaaagtgacat

SEQ ID NO: 197405 - DNA, 20 bp, Artificial sequence
  SiRNA target sequence
ctattatacaaagtgacatt

SEQ ID NO: 197406 - DNA, 20 bp, Artificial sequence
  SiRNA target sequence
tattatacaaagtgacatta

SEQ ID NO: 197407 - DNA, 20 bp, Artificial sequence
  SiRNA target sequence
attatacaaagtgacattaa

SEQ ID NO: 197408 - DNA, 20 bp, Artificial sequence
  SiRNA target sequence
ttatacaaagtgacattaat

SEQ ID NO: 197409 - DNA, 20 bp, Artificial sequence
  SiRNA target sequence
tatacaaagtgacattaata

SEQ ID NO: 197410 - DNA, 20 bp, Artificial sequence
  SiRNA target sequence
atacaaagtgacattaataa

SEQ ID NO: 197411 - DNA, 20 bp, Artificial sequence
  SiRNA target sequence
tacaaagtgacattaataat

SEQ ID NO: 197412 - DNA, 20 bp, Artificial sequence
  SiRNA target sequence
acaaagtgacattaataatt

SEQ ID NO: 197413 - DNA, 20 bp, Artificial sequence
  SiRNA target sequence
caaagtgacattaataattt

SEQ ID NO: 197414 - DNA, 20 bp, Artificial sequence
  SiRNA target sequence
aaagtgacattaataatttt

SEQ ID NO: 197415 - DNA, 20 bp, Artificial sequence
  SiRNA target sequence
aagtgacattaataattttg

SEQ ID NO: 197416 - DNA, 20 bp, Artificial sequence
  SiRNA target sequence
agtgacattaataattttga

SEQ ID NO: 197417 - DNA, 20 bp, Artificial sequence
  SiRNA target sequence
gtgacattaataattttgat

SEQ ID NO: 197418 - DNA, 20 bp, Artificial sequence
  SiRNA target sequence
tgacattaataattttgatt

SEQ ID NO: 197419 - DNA, 20 bp, Artificial sequence
  SiRNA target sequence
gacattaataattttgattt

SEQ ID NO: 197420 - DNA, 20 bp, Artificial sequence
  SiRNA target sequence
acattaataattttgatttc

SEQ ID NO: 197421 - DNA, 20 bp, Artificial sequence
  SiRNA target sequence
cattaataattttgatttca

SEQ ID NO: 197422 - DNA, 20 bp, Artificial sequence
  SiRNA target sequence
attaataattttgatttcat

SEQ ID NO: 197423 - DNA, 20 bp, Artificial sequence
  SiRNA target sequence
ttaataattttgatttcatc

SEQ ID NO: 197424 - DNA, 20 bp, Artificial sequence
  SiRNA target sequence
taataattttgatttcatca

SEQ ID NO: 197425 - DNA, 20 bp, Artificial sequence
  SiRNA target sequence
aataattttgatttcatcat

SEQ ID NO: 197426 - DNA, 20 bp, Artificial sequence
  SiRNA target sequence
ataattttgatttcatcatt

SEQ ID NO: 197427 - DNA, 20 bp, Artificial sequence
  SiRNA target sequence
taattttgatttcatcatta

SEQ ID NO: 197428 - DNA, 20 bp, Artificial sequence
  SiRNA target sequence
aattttgatttcatcattat

SEQ ID NO: 197429 - DNA, 20 bp, Artificial sequence
  SiRNA target sequence
attttgatttcatcattata

SEQ ID NO: 197430 - DNA, 20 bp, Artificial sequence
  SiRNA target sequence
ttttgatttcatcattatac

SEQ ID NO: 197431 - DNA, 20 bp, Artificial sequence
  SiRNA target sequence
tttgatttcatcattatact

SEQ ID NO: 197432 - DNA, 20 bp, Artificial sequence
  SiRNA target sequence
ttgatttcatcattatacta

SEQ ID NO: 197433 - DNA, 20 bp, Artificial sequence
  SiRNA target sequence
tgatttcatcattatactaa

SEQ ID NO: 197434 - DNA, 20 bp, Artificial sequence
  SiRNA target sequence
gatttcatcattatactaat

SEQ ID NO: 197435 - DNA, 20 bp, Artificial sequence
  SiRNA target sequence
atttcatcattatactaata

SEQ ID NO: 197436 - DNA, 20 bp, Artificial sequence
  SiRNA target sequence
tttcatcattatactaatac

SEQ ID NO: 197437 - DNA, 20 bp, Artificial sequence
  SiRNA target sequence
ttcatcattatactaatacc

SEQ ID NO: 197438 - DNA, 20 bp, Artificial sequence
  SiRNA target sequence
tcatcattatactaatacct

SEQ ID NO: 197439 - DNA, 20 bp, Artificial sequence
  SiRNA target sequence
catcattatactaatacctt

SEQ ID NO: 197440 - DNA, 20 bp, Artificial sequence
  SiRNA target sequence
atcattatactaataccttc

SEQ ID NO: 197441 - DNA, 20 bp, Artificial sequence
  SiRNA target sequence
tcattatactaataccttcg

SEQ ID NO: 197442 - DNA, 20 bp, Artificial sequence
  SiRNA target sequence
cattatactaataccttcgg

SEQ ID NO: 197443 - DNA, 20 bp, Artificial sequence
  SiRNA target sequence
attatactaataccttcgga

SEQ ID NO: 197444 - DNA, 20 bp, Artificial sequence
  SiRNA target sequence
ttatactaataccttcggag

SEQ ID NO: 197445 - DNA, 20 bp, Artificial sequence
  SiRNA target sequence
tatactaataccttcggaga

SEQ ID NO: 197446 - DNA, 20 bp, Artificial sequence
  SiRNA target sequence
atactaataccttcggagaa

SEQ ID NO: 197447 - DNA, 20 bp, Artificial sequence
  SiRNA target sequence
tactaataccttcggagaaa

SEQ ID NO: 197448 - DNA, 20 bp, Artificial sequence
  SiRNA target sequence
actaataccttcggagaaac

SEQ ID NO: 197449 - DNA, 20 bp, Artificial sequence
  SiRNA target sequence
ctaataccttcggagaaacc

SEQ ID NO: 197450 - DNA, 20 bp, Artificial sequence
  SiRNA target sequence
taataccttcggagaaacct

SEQ ID NO: 197451 - DNA, 20 bp, Artificial sequence
  SiRNA target sequence
aataccttcggagaaaccta

SEQ ID NO: 197452 - DNA, 20 bp, Artificial sequence
  SiRNA target sequence
ataccttcggagaaacctac

SEQ ID NO: 197453 - DNA, 20 bp, Artificial sequence
  SiRNA target sequence
taccttcggagaaacctaca

SEQ ID NO: 197454 - DNA, 20 bp, Artificial sequence
  SiRNA target sequence
accttcggagaaacctacac

SEQ ID NO: 197455 - DNA, 20 bp, Artificial sequence
  SiRNA target sequence
ccttcggagaaacctacact

SEQ ID NO: 197456 - DNA, 20 bp, Artificial sequence
  SiRNA target sequence
cttcggagaaacctacacta

SEQ ID NO: 197457 - DNA, 20 bp, Artificial sequence
  SiRNA target sequence
ttcggagaaacctacactaa

SEQ ID NO: 197458 - DNA, 20 bp, Artificial sequence
  SiRNA target sequence
tcggagaaacctacactaac

SEQ ID NO: 197459 - DNA, 20 bp, Artificial sequence
  SiRNA target sequence
cggagaaacctacactaact

SEQ ID NO: 197460 - DNA, 20 bp, Artificial sequence
  SiRNA target sequence
ggagaaacctacactaactt

SEQ ID NO: 197461 - DNA, 20 bp, Artificial sequence
  SiRNA target sequence
gagaaacctacactaacttt

SEQ ID NO: 197462 - DNA, 20 bp, Artificial sequence
  SiRNA target sequence
agaaacctacactaactttt

SEQ ID NO: 197463 - DNA, 20 bp, Artificial sequence
  SiRNA target sequence
gaaacctacactaacttttt

SEQ ID NO: 197464 - DNA, 20 bp, Artificial sequence
  SiRNA target sequence
aaacctacactaactttttg

SEQ ID NO: 197465 - DNA, 20 bp, Artificial sequence
  SiRNA target sequence
aacctacactaactttttgt

SEQ ID NO: 197466 - DNA, 20 bp, Artificial sequence
  SiRNA target sequence
acctacactaactttttgtt

SEQ ID NO: 197467 - DNA, 20 bp, Artificial sequence
  SiRNA target sequence
cctacactaactttttgttt

SEQ ID NO: 197468 - DNA, 20 bp, Artificial sequence
  SiRNA target sequence
ctacactaactttttgtttc

SEQ ID NO: 197469 - DNA, 20 bp, Artificial sequence
  SiRNA target sequence
tacactaactttttgtttct

SEQ ID NO: 197470 - DNA, 20 bp, Artificial sequence
  SiRNA target sequence
acactaactttttgtttctt

SEQ ID NO: 197471 - DNA, 20 bp, Artificial sequence
  SiRNA target sequence
cactaactttttgtttcttt

SEQ ID NO: 197472 - DNA, 20 bp, Artificial sequence
  SiRNA target sequence
actaactttttgtttctttt

SEQ ID NO: 197473 - DNA, 20 bp, Artificial sequence
  SiRNA target sequence
ctaactttttgtttcttttt

SEQ ID NO: 197474 - DNA, 20 bp, Artificial sequence
  SiRNA target sequence
taactttttgtttctttttt

SEQ ID NO: 197475 - DNA, 20 bp, Artificial sequence
  SiRNA target sequence
aactttttgtttctttttta

SEQ ID NO: 197476 - DNA, 20 bp, Artificial sequence
  SiRNA target sequence
actttttgtttcttttttat

SEQ ID NO: 197477 - DNA, 20 bp, Artificial sequence
  SiRNA target sequence
ctttttgtttcttttttatc

SEQ ID NO: 197478 - DNA, 20 bp, Artificial sequence
  SiRNA target sequence
tttttgtttcttttttatcg

SEQ ID NO: 197479 - DNA, 20 bp, Artificial sequence
  SiRNA target sequence
ttttgtttcttttttatcgt

SEQ ID NO: 197480 - DNA, 20 bp, Artificial sequence
  SiRNA target sequence
tttgtttcttttttatcgta

SEQ ID NO: 197481 - DNA, 20 bp, Artificial sequence
  SiRNA target sequence
ttgtttcttttttatcgtat

SEQ ID NO: 197482 - DNA, 20 bp, Artificial sequence
  SiRNA target sequence
tgtttcttttttatcgtatt

SEQ ID NO: 197483 - DNA, 20 bp, Artificial sequence
  SiRNA target sequence
gtttcttttttatcgtatta

SEQ ID NO: 197484 - DNA, 20 bp, Artificial sequence
  SiRNA target sequence
tttcttttttatcgtattag

SEQ ID NO: 197485 - DNA, 20 bp, Artificial sequence
  SiRNA target sequence
ttcttttttatcgtattaga

SEQ ID NO: 197486 - DNA, 20 bp, Artificial sequence
  SiRNA target sequence
tcttttttatcgtattagaa

SEQ ID NO: 197487 - DNA, 20 bp, Artificial sequence
  SiRNA target sequence
cttttttatcgtattagaag

SEQ ID NO: 197488 - DNA, 20 bp, Artificial sequence
  SiRNA target sequence
ttttttatcgtattagaagg

SEQ ID NO: 197489 - DNA, 20 bp, Artificial sequence
  SiRNA target sequence
tttttatcgtattagaaggt

SEQ ID NO: 197490 - DNA, 20 bp, Artificial sequence
  SiRNA target sequence
ttttatcgtattagaaggta

SEQ ID NO: 197491 - DNA, 20 bp, Artificial sequence
  SiRNA target sequence
tttatcgtattagaaggtat

SEQ ID NO: 197492 - DNA, 20 bp, Artificial sequence
  SiRNA target sequence
ttatcgtattagaaggtata

SEQ ID NO: 197493 - DNA, 20 bp, Artificial sequence
  SiRNA target sequence
tatcgtattagaaggtataa

SEQ ID NO: 197494 - DNA, 20 bp, Artificial sequence
  SiRNA target sequence
atcgtattagaaggtataaa

SEQ ID NO: 197495 - DNA, 20 bp, Artificial sequence
  SiRNA target sequence
tcgtattagaaggtataaat

SEQ ID NO: 197496 - DNA, 20 bp, Artificial sequence
  SiRNA target sequence
cgtattagaaggtataaata

SEQ ID NO: 197497 - DNA, 20 bp, Artificial sequence
  SiRNA target sequence
gtattagaaggtataaatat

SEQ ID NO: 197498 - DNA, 20 bp, Artificial sequence
  SiRNA target sequence
tattagaaggtataaatatt

SEQ ID NO: 197499 - DNA, 20 bp, Artificial sequence
  SiRNA target sequence
attagaaggtataaatattg

SEQ ID NO: 197500 - DNA, 20 bp, Artificial sequence
  SiRNA target sequence
ttagaaggtataaatattgg

SEQ ID NO: 197501 - DNA, 20 bp, Artificial sequence
  SiRNA target sequence
tagaaggtataaatattggt

SEQ ID NO: 197502 - DNA, 20 bp, Artificial sequence
  SiRNA target sequence
agaaggtataaatattggta

SEQ ID NO: 197503 - DNA, 20 bp, Artificial sequence
  SiRNA target sequence
gaaggtataaatattggtac

SEQ ID NO: 197504 - DNA, 20 bp, Artificial sequence
  SiRNA target sequence
aaggtataaatattggtaca

SEQ ID NO: 197505 - DNA, 20 bp, Artificial sequence
  SiRNA target sequence
aggtataaatattggtacac

SEQ ID NO: 197506 - DNA, 20 bp, Artificial sequence
  SiRNA target sequence
ggtataaatattggtacact

SEQ ID NO: 197507 - DNA, 20 bp, Artificial sequence
  SiRNA target sequence
gtataaatattggtacactc

SEQ ID NO: 197508 - DNA, 20 bp, Artificial sequence
  SiRNA target sequence
tataaatattggtacactca

SEQ ID NO: 197509 - DNA, 20 bp, Artificial sequence
  SiRNA target sequence
ataaatattggtacactcat

SEQ ID NO: 197510 - DNA, 20 bp, Artificial sequence
  SiRNA target sequence
taaatattggtacactcatt

SEQ ID NO: 197511 - DNA, 20 bp, Artificial sequence
  SiRNA target sequence
aaatattggtacactcatta

SEQ ID NO: 197512 - DNA, 20 bp, Artificial sequence
  SiRNA target sequence
aatattggtacactcattat

SEQ ID NO: 197513 - DNA, 20 bp, Artificial sequence
  SiRNA target sequence
atattggtacactcattatt

SEQ ID NO: 197514 - DNA, 20 bp, Artificial sequence
  SiRNA target sequence
tattggtacactcattattt

SEQ ID NO: 197515 - DNA, 20 bp, Artificial sequence
  SiRNA target sequence
attggtacactcattatttt

SEQ ID NO: 197516 - DNA, 20 bp, Artificial sequence
  SiRNA target sequence
ttggtacactcattatttta

SEQ ID NO: 197517 - DNA, 20 bp, Artificial sequence
  SiRNA target sequence
tggtacactcattattttat

SEQ ID NO: 197518 - DNA, 20 bp, Artificial sequence
  SiRNA target sequence
ggtacactcattattttatt

SEQ ID NO: 197519 - DNA, 20 bp, Artificial sequence
  SiRNA target sequence
gtacactcattattttattc

SEQ ID NO: 197520 - DNA, 20 bp, Artificial sequence
  SiRNA target sequence
tacactcattattttattct

SEQ ID NO: 197521 - DNA, 20 bp, Artificial sequence
  SiRNA target sequence
acactcattattttattctc

SEQ ID NO: 197522 - DNA, 20 bp, Artificial sequence
  SiRNA target sequence
cactcattattttattctcg

SEQ ID NO: 197523 - DNA, 20 bp, Artificial sequence
  SiRNA target sequence
actcattattttattctcga

SEQ ID NO: 197524 - DNA, 20 bp, Artificial sequence
  SiRNA target sequence
ctcattattttattctcgaa

SEQ ID NO: 197525 - DNA, 20 bp, Artificial sequence
  SiRNA target sequence
tcattattttattctcgaaa

SEQ ID NO: 197526 - DNA, 20 bp, Artificial sequence
  SiRNA target sequence
cattattttattctcgaaat

SEQ ID NO: 197527 - DNA, 20 bp, Artificial sequence
  SiRNA target sequence
attattttattctcgaaata

SEQ ID NO: 197528 - DNA, 20 bp, Artificial sequence
  SiRNA target sequence
ttattttattctcgaaataa

SEQ ID NO: 197529 - DNA, 20 bp, Artificial sequence
  SiRNA target sequence
tattttattctcgaaataat

SEQ ID NO: 197530 - DNA, 20 bp, Artificial sequence
  SiRNA target sequence
attttattctcgaaataata

SEQ ID NO: 197531 - DNA, 20 bp, Artificial sequence
  SiRNA target sequence
ttttattctcgaaataatat

SEQ ID NO: 197532 - DNA, 20 bp, Artificial sequence
  SiRNA target sequence
tttattctcgaaataatatt

SEQ ID NO: 197533 - DNA, 20 bp, Artificial sequence
  SiRNA target sequence
ttattctcgaaataatattt

SEQ ID NO: 197534 - DNA, 20 bp, Artificial sequence
  SiRNA target sequence
tattctcgaaataatatttc

SEQ ID NO: 197535 - DNA, 20 bp, Artificial sequence
  SiRNA target sequence
attctcgaaataatatttca

SEQ ID NO: 197536 - DNA, 20 bp, Artificial sequence
  SiRNA target sequence
ttctcgaaataatatttcat

SEQ ID NO: 197537 - DNA, 20 bp, Artificial sequence
  SiRNA target sequence
tctcgaaataatatttcatg

SEQ ID NO: 197538 - DNA, 20 bp, Artificial sequence
  SiRNA target sequence
ctcgaaataatatttcatgt

SEQ ID NO: 197539 - DNA, 20 bp, Artificial sequence
  SiRNA target sequence
tcgaaataatatttcatgta

SEQ ID NO: 197540 - DNA, 20 bp, Artificial sequence
  SiRNA target sequence
cgaaataatatttcatgtac

SEQ ID NO: 197541 - DNA, 20 bp, Artificial sequence
  SiRNA target sequence
gaaataatatttcatgtaca

SEQ ID NO: 197542 - DNA, 20 bp, Artificial sequence
  SiRNA target sequence
aaataatatttcatgtacat

SEQ ID NO: 197543 - DNA, 20 bp, Artificial sequence
  SiRNA target sequence
aataatatttcatgtacatt

SEQ ID NO: 197544 - DNA, 20 bp, Artificial sequence
  SiRNA target sequence
ataatatttcatgtacatta

SEQ ID NO: 197545 - DNA, 20 bp, Artificial sequence
  SiRNA target sequence
taatatttcatgtacattaa

SEQ ID NO: 197546 - DNA, 20 bp, Artificial sequence
  SiRNA target sequence
aatatttcatgtacattaat

SEQ ID NO: 197547 - DNA, 20 bp, Artificial sequence
  SiRNA target sequence
atatttcatgtacattaata

SEQ ID NO: 197548 - DNA, 20 bp, Artificial sequence
  SiRNA target sequence
tatttcatgtacattaatat

SEQ ID NO: 197549 - DNA, 20 bp, Artificial sequence
  SiRNA target sequence
atttcatgtacattaatatt

SEQ ID NO: 197550 - DNA, 20 bp, Artificial sequence
  SiRNA target sequence
tttcatgtacattaatatta

SEQ ID NO: 197551 - DNA, 20 bp, Artificial sequence
  SiRNA target sequence
ttcatgtacattaatattag

SEQ ID NO: 197552 - DNA, 20 bp, Artificial sequence
  SiRNA target sequence
tcatgtacattaatattaga

SEQ ID NO: 197553 - DNA, 20 bp, Artificial sequence
  SiRNA target sequence
catgtacattaatattagac

SEQ ID NO: 197554 - DNA, 20 bp, Artificial sequence
  SiRNA target sequence
atgtacattaatattagaca

SEQ ID NO: 197555 - DNA, 20 bp, Artificial sequence
  SiRNA target sequence
tgtacattaatattagacat

SEQ ID NO: 197556 - DNA, 20 bp, Artificial sequence
  SiRNA target sequence
gtacattaatattagacata

SEQ ID NO: 197557 - DNA, 20 bp, Artificial sequence
  SiRNA target sequence
tacattaatattagacatat

SEQ ID NO: 197558 - DNA, 20 bp, Artificial sequence
  SiRNA target sequence
acattaatattagacatata

SEQ ID NO: 197559 - DNA, 20 bp, Artificial sequence
  SiRNA target sequence
cattaatattagacatatac

SEQ ID NO: 197560 - DNA, 20 bp, Artificial sequence
  SiRNA target sequence
attaatattagacatatacc

SEQ ID NO: 197561 - DNA, 20 bp, Artificial sequence
  SiRNA target sequence
ttaatattagacatataccg

SEQ ID NO: 197562 - DNA, 20 bp, Artificial sequence
  SiRNA target sequence
taatattagacatataccgc

SEQ ID NO: 197563 - DNA, 20 bp, Artificial sequence
  SiRNA target sequence
aatattagacatataccgcc

SEQ ID NO: 197564 - DNA, 20 bp, Artificial sequence
  SiRNA target sequence
atattagacatataccgccc

SEQ ID NO: 197565 - DNA, 20 bp, Artificial sequence
  SiRNA target sequence
tattagacatataccgccca

SEQ ID NO: 197566 - DNA, 20 bp, Artificial sequence
  SiRNA target sequence
attagacatataccgcccat

SEQ ID NO: 197567 - DNA, 20 bp, Artificial sequence
  SiRNA target sequence
ttagacatataccgcccatg

SEQ ID NO: 197568 - DNA, 20 bp, Artificial sequence
  SiRNA target sequence
tagacatataccgcccatgg

SEQ ID NO: 197569 - DNA, 20 bp, Artificial sequence
  SiRNA target sequence
agacatataccgcccatggc

SEQ ID NO: 197570 - DNA, 20 bp, Artificial sequence
  SiRNA target sequence
gacatataccgcccatggca

SEQ ID NO: 197571 - DNA, 20 bp, Artificial sequence
  SiRNA target sequence
acatataccgcccatggcaa

SEQ ID NO: 197572 - DNA, 20 bp, Artificial sequence
  SiRNA target sequence
catataccgcccatggcaat

SEQ ID NO: 197573 - DNA, 20 bp, Artificial sequence
  SiRNA target sequence
atataccgcccatggcaata

SEQ ID NO: 197574 - DNA, 20 bp, Artificial sequence
  SiRNA target sequence
tataccgcccatggcaataa

SEQ ID NO: 197575 - DNA, 20 bp, Artificial sequence
  SiRNA target sequence
ataccgcccatggcaataaa

SEQ ID NO: 197576 - DNA, 20 bp, Artificial sequence
  SiRNA target sequence
taccgcccatggcaataaaa

SEQ ID NO: 197577 - DNA, 20 bp, Artificial sequence
  SiRNA target sequence
accgcccatggcaataaaaa

SEQ ID NO: 197578 - DNA, 20 bp, Artificial sequence
  SiRNA target sequence
ccgcccatggcaataaaaac

SEQ ID NO: 197579 - DNA, 20 bp, Artificial sequence
  SiRNA target sequence
cgcccatggcaataaaaacc

SEQ ID NO: 197580 - DNA, 20 bp, Artificial sequence
  SiRNA target sequence
gcccatggcaataaaaaccg

SEQ ID NO: 197581 - DNA, 20 bp, Artificial sequence
  SiRNA target sequence
cccatggcaataaaaaccga

SEQ ID NO: 197582 - DNA, 20 bp, Artificial sequence
  SiRNA target sequence
ccatggcaataaaaaccgaa

SEQ ID NO: 197583 - DNA, 20 bp, Artificial sequence
  SiRNA target sequence
catggcaataaaaaccgaag

SEQ ID NO: 197584 - DNA, 20 bp, Artificial sequence
  SiRNA target sequence
atggcaataaaaaccgaaga

SEQ ID NO: 197585 - DNA, 20 bp, Artificial sequence
  SiRNA target sequence
tggcaataaaaaccgaagaa

SEQ ID NO: 197586 - DNA, 20 bp, Artificial sequence
  SiRNA target sequence
ggcaataaaaaccgaagaat

SEQ ID NO: 197587 - DNA, 20 bp, Artificial sequence
  SiRNA target sequence
gcaataaaaaccgaagaata

SEQ ID NO: 197588 - DNA, 20 bp, Artificial sequence
  SiRNA target sequence
caataaaaaccgaagaatat

SEQ ID NO: 197589 - DNA, 20 bp, Artificial sequence
  SiRNA target sequence
aataaaaaccgaagaatata

SEQ ID NO: 197590 - DNA, 20 bp, Artificial sequence
  SiRNA target sequence
ataaaaaccgaagaatataa

SEQ ID NO: 197591 - DNA, 20 bp, Artificial sequence
  SiRNA target sequence
taaaaaccgaagaatataat

SEQ ID NO: 197592 - DNA, 20 bp, Artificial sequence
  SiRNA target sequence
aaaaaccgaagaatataata

SEQ ID NO: 197593 - DNA, 20 bp, Artificial sequence
  SiRNA target sequence
aaaaccgaagaatataataa

SEQ ID NO: 197594 - DNA, 20 bp, Artificial sequence
  SiRNA target sequence
aaaccgaagaatataataac

SEQ ID NO: 197595 - DNA, 20 bp, Artificial sequence
  SiRNA target sequence
aaccgaagaatataataact

SEQ ID NO: 197596 - DNA, 20 bp, Artificial sequence
  SiRNA target sequence
accgaagaatataataactg

SEQ ID NO: 197597 - DNA, 20 bp, Artificial sequence
  SiRNA target sequence
ccgaagaatataataactga

SEQ ID NO: 197598 - DNA, 20 bp, Artificial sequence
  SiRNA target sequence
cgaagaatataataactgat

SEQ ID NO: 197599 - DNA, 20 bp, Artificial sequence
  SiRNA target sequence
gaagaatataataactgatt

SEQ ID NO: 197600 - DNA, 20 bp, Artificial sequence
  SiRNA target sequence
aagaatataataactgattt

SEQ ID NO: 197601 - DNA, 20 bp, Artificial sequence
  SiRNA target sequence
agaatataataactgatttt

SEQ ID NO: 197602 - DNA, 20 bp, Artificial sequence
  SiRNA target sequence
gaatataataactgattttg

SEQ ID NO: 197603 - DNA, 20 bp, Artificial sequence
  SiRNA target sequence
aatataataactgattttgc

SEQ ID NO: 197604 - DNA, 20 bp, Artificial sequence
  SiRNA target sequence
atataataactgattttgct

SEQ ID NO: 197605 - DNA, 20 bp, Artificial sequence
  SiRNA target sequence
tataataactgattttgctc

SEQ ID NO: 197606 - DNA, 20 bp, Artificial sequence
  SiRNA target sequence
ataataactgattttgctca

SEQ ID NO: 197607 - DNA, 20 bp, Artificial sequence
  SiRNA target sequence
taataactgattttgctcat

SEQ ID NO: 197608 - DNA, 20 bp, Artificial sequence
  SiRNA target sequence
aataactgattttgctcata

SEQ ID NO: 197609 - DNA, 20 bp, Artificial sequence
  SiRNA target sequence
ataactgattttgctcatag

SEQ ID NO: 197610 - DNA, 20 bp, Artificial sequence
  SiRNA target sequence
taactgattttgctcatagc

SEQ ID NO: 197611 - DNA, 20 bp, Artificial sequence
  SiRNA target sequence
aactgattttgctcatagct

SEQ ID NO: 197612 - DNA, 20 bp, Artificial sequence
  SiRNA target sequence
actgattttgctcatagcta

SEQ ID NO: 197613 - DNA, 20 bp, Artificial sequence
  SiRNA target sequence
ctgattttgctcatagctaa

SEQ ID NO: 197614 - DNA, 20 bp, Artificial sequence
  SiRNA target sequence
tgattttgctcatagctaaa

SEQ ID NO: 197615 - DNA, 20 bp, Artificial sequence
  SiRNA target sequence
gattttgctcatagctaaat

SEQ ID NO: 197616 - DNA, 20 bp, Artificial sequence
  SiRNA target sequence
attttgctcatagctaaatc

SEQ ID NO: 197617 - DNA, 20 bp, Artificial sequence
  SiRNA target sequence
ttttgctcatagctaaatcc

SEQ ID NO: 197618 - DNA, 20 bp, Artificial sequence
  SiRNA target sequence
tttgctcatagctaaatcct

SEQ ID NO: 197619 - DNA, 20 bp, Artificial sequence
  SiRNA target sequence
ttgctcatagctaaatcctt

SEQ ID NO: 197620 - DNA, 20 bp, Artificial sequence
  SiRNA target sequence
tgctcatagctaaatccttt

SEQ ID NO: 197621 - DNA, 20 bp, Artificial sequence
  SiRNA target sequence
gctcatagctaaatcctttt

SEQ ID NO: 197622 - DNA, 20 bp, Artificial sequence
  SiRNA target sequence
ctcatagctaaatccttttc

SEQ ID NO: 197623 - DNA, 20 bp, Artificial sequence
  SiRNA target sequence
tcatagctaaatccttttcg

SEQ ID NO: 197624 - DNA, 20 bp, Artificial sequence
  SiRNA target sequence
catagctaaatccttttcgc

SEQ ID NO: 197625 - DNA, 20 bp, Artificial sequence
  SiRNA target sequence
atagctaaatccttttcgca

SEQ ID NO: 197626 - DNA, 20 bp, Artificial sequence
  SiRNA target sequence
tagctaaatccttttcgcaa

SEQ ID NO: 197627 - DNA, 20 bp, Artificial sequence
  SiRNA target sequence
agctaaatccttttcgcaat

SEQ ID NO: 197628 - DNA, 20 bp, Artificial sequence
  SiRNA target sequence
gctaaatccttttcgcaatt

SEQ ID NO: 197629 - DNA, 20 bp, Artificial sequence
  SiRNA target sequence
ctaaatccttttcgcaattc

SEQ ID NO: 197630 - DNA, 20 bp, Artificial sequence
  SiRNA target sequence
taaatccttttcgcaattct

SEQ ID NO: 197631 - DNA, 20 bp, Artificial sequence
  SiRNA target sequence
aaatccttttcgcaattctc

SEQ ID NO: 197632 - DNA, 20 bp, Artificial sequence
  SiRNA target sequence
aatccttttcgcaattctct

SEQ ID NO: 197633 - DNA, 20 bp, Artificial sequence
  SiRNA target sequence
atccttttcgcaattctctg

SEQ ID NO: 197634 - DNA, 20 bp, Artificial sequence
  SiRNA target sequence
tccttttcgcaattctctga

SEQ ID NO: 197635 - DNA, 20 bp, Artificial sequence
  SiRNA target sequence
ccttttcgcaattctctgaa

SEQ ID NO: 197636 - DNA, 20 bp, Artificial sequence
  SiRNA target sequence
cttttcgcaattctctgaaa

SEQ ID NO: 197637 - DNA, 20 bp, Artificial sequence
  SiRNA target sequence
ttttcgcaattctctgaaag

SEQ ID NO: 197638 - DNA, 20 bp, Artificial sequence
  SiRNA target sequence
tttcgcaattctctgaaaga

SEQ ID NO: 197639 - DNA, 20 bp, Artificial sequence
  SiRNA target sequence
ttcgcaattctctgaaagaa

SEQ ID NO: 197640 - DNA, 20 bp, Artificial sequence
  SiRNA target sequence
tcgcaattctctgaaagaac

SEQ ID NO: 197641 - DNA, 20 bp, Artificial sequence
  SiRNA target sequence
cgcaattctctgaaagaact

SEQ ID NO: 197642 - DNA, 20 bp, Artificial sequence
  SiRNA target sequence
gcaattctctgaaagaacta

SEQ ID NO: 197643 - DNA, 20 bp, Artificial sequence
  SiRNA target sequence
caattctctgaaagaactac

SEQ ID NO: 197644 - DNA, 20 bp, Artificial sequence
  SiRNA target sequence
aattctctgaaagaactact

SEQ ID NO: 197645 - DNA, 20 bp, Artificial sequence
  SiRNA target sequence
attctctgaaagaactactg

SEQ ID NO: 197646 - DNA, 20 bp, Artificial sequence
  SiRNA target sequence
ttctctgaaagaactactgg

SEQ ID NO: 197647 - DNA, 20 bp, Artificial sequence
  SiRNA target sequence
tctctgaaagaactactggc

SEQ ID NO: 197648 - DNA, 20 bp, Artificial sequence
  SiRNA target sequence
ctctgaaagaactactggct

SEQ ID NO: 197649 - DNA, 20 bp, Artificial sequence
  SiRNA target sequence
tctgaaagaactactggcta

SEQ ID NO: 197650 - DNA, 20 bp, Artificial sequence
  SiRNA target sequence
ctgaaagaactactggctaa

SEQ ID NO: 197651 - DNA, 20 bp, Artificial sequence
  SiRNA target sequence
tgaaagaactactggctaat

SEQ ID NO: 197652 - DNA, 20 bp, Artificial sequence
  SiRNA target sequence
gaaagaactactggctaatc

SEQ ID NO: 197653 - DNA, 20 bp, Artificial sequence
  SiRNA target sequence
aaagaactactggctaatcc

SEQ ID NO: 197654 - DNA, 20 bp, Artificial sequence
  SiRNA target sequence
aagaactactggctaatcca

SEQ ID NO: 197655 - DNA, 20 bp, Artificial sequence
  SiRNA target sequence
agaactactggctaatccag

SEQ ID NO: 197656 - DNA, 20 bp, Artificial sequence
  SiRNA target sequence
gaactactggctaatccaga

SEQ ID NO: 197657 - DNA, 20 bp, Artificial sequence
  SiRNA target sequence
aactactggctaatccagat

SEQ ID NO: 197658 - DNA, 20 bp, Artificial sequence
  SiRNA target sequence
actactggctaatccagata

SEQ ID NO: 197659 - DNA, 20 bp, Artificial sequence
  SiRNA target sequence
ctactggctaatccagatac

SEQ ID NO: 197660 - DNA, 20 bp, Artificial sequence
  SiRNA target sequence
tactggctaatccagatact

SEQ ID NO: 197661 - DNA, 20 bp, Artificial sequence
  SiRNA target sequence
actggctaatccagatacta

SEQ ID NO: 197662 - DNA, 20 bp, Artificial sequence
  SiRNA target sequence
ctggctaatccagatactag

SEQ ID NO: 197663 - DNA, 20 bp, Artificial sequence
  SiRNA target sequence
tggctaatccagatactagt

SEQ ID NO: 197664 - DNA, 20 bp, Artificial sequence
  SiRNA target sequence
ggctaatccagatactagta

SEQ ID NO: 197665 - DNA, 20 bp, Artificial sequence
  SiRNA target sequence
gctaatccagatactagtaa

SEQ ID NO: 197666 - DNA, 20 bp, Artificial sequence
  SiRNA target sequence
ctaatccagatactagtaaa

SEQ ID NO: 197667 - DNA, 20 bp, Artificial sequence
  SiRNA target sequence
taatccagatactagtaaag

SEQ ID NO: 197668 - DNA, 20 bp, Artificial sequence
  SiRNA target sequence
aatccagatactagtaaagc

SEQ ID NO: 197669 - DNA, 20 bp, Artificial sequence
  SiRNA target sequence
atccagatactagtaaagct

SEQ ID NO: 197670 - DNA, 20 bp, Artificial sequence
  SiRNA target sequence
tccagatactagtaaagcta

SEQ ID NO: 197671 - DNA, 20 bp, Artificial sequence
  SiRNA target sequence
ccagatactagtaaagctaa

SEQ ID NO: 197672 - DNA, 20 bp, Artificial sequence
  SiRNA target sequence
cagatactagtaaagctaaa

SEQ ID NO: 197673 - DNA, 20 bp, Artificial sequence
  SiRNA target sequence
agatactagtaaagctaaat

SEQ ID NO: 197674 - DNA, 20 bp, Artificial sequence
  SiRNA target sequence
gatactagtaaagctaaatt

SEQ ID NO: 197675 - DNA, 20 bp, Artificial sequence
  SiRNA target sequence
atactagtaaagctaaattt

SEQ ID NO: 197676 - DNA, 20 bp, Artificial sequence
  SiRNA target sequence
tactagtaaagctaaatttg

SEQ ID NO: 197677 - DNA, 20 bp, Artificial sequence
  SiRNA target sequence
actagtaaagctaaatttgc

SEQ ID NO: 197678 - DNA, 20 bp, Artificial sequence
  SiRNA target sequence
ctagtaaagctaaatttgct

SEQ ID NO: 197679 - DNA, 20 bp, Artificial sequence
  SiRNA target sequence
tagtaaagctaaatttgcta

SEQ ID NO: 197680 - DNA, 20 bp, Artificial sequence
  SiRNA target sequence
agtaaagctaaatttgctat

SEQ ID NO: 197681 - DNA, 20 bp, Artificial sequence
  SiRNA target sequence
gtaaagctaaatttgctatt

SEQ ID NO: 197682 - DNA, 20 bp, Artificial sequence
  SiRNA target sequence
taaagctaaatttgctatta

SEQ ID NO: 197683 - DNA, 20 bp, Artificial sequence
  SiRNA target sequence
aaagctaaatttgctattat

SEQ ID NO: 197684 - DNA, 20 bp, Artificial sequence
  SiRNA target sequence
aagctaaatttgctattatg

SEQ ID NO: 197685 - DNA, 20 bp, Artificial sequence
  SiRNA target sequence
agctaaatttgctattatgt

SEQ ID NO: 197686 - DNA, 20 bp, Artificial sequence
  SiRNA target sequence
gctaaatttgctattatgta

SEQ ID NO: 197687 - DNA, 20 bp, Artificial sequence
  SiRNA target sequence
ctaaatttgctattatgtaa

SEQ ID NO: 197688 - DNA, 20 bp, Artificial sequence
  SiRNA target sequence
taaatttgctattatgtaaa

SEQ ID NO: 197689 - DNA, 20 bp, Artificial sequence
  SiRNA target sequence
aaatttgctattatgtaaaa

SEQ ID NO: 197690 - DNA, 20 bp, Artificial sequence
  SiRNA target sequence
aatttgctattatgtaaaaa

SEQ ID NO: 197691 - DNA, 20 bp, Artificial sequence
  SiRNA target sequence
atttgctattatgtaaaaag

SEQ ID NO: 197692 - DNA, 20 bp, Artificial sequence
  SiRNA target sequence
tttgctattatgtaaaaagg

SEQ ID NO: 197693 - DNA, 20 bp, Artificial sequence
  SiRNA target sequence
ttgctattatgtaaaaaggt

SEQ ID NO: 197694 - DNA, 20 bp, Artificial sequence
  SiRNA target sequence
tgctattatgtaaaaaggtg

SEQ ID NO: 197695 - DNA, 20 bp, Artificial sequence
  SiRNA target sequence
gctattatgtaaaaaggtgg

SEQ ID NO: 197696 - DNA, 20 bp, Artificial sequence
  SiRNA target sequence
ctattatgtaaaaaggtggt

SEQ ID NO: 197697 - DNA, 20 bp, Artificial sequence
  SiRNA target sequence
tattatgtaaaaaggtggta

SEQ ID NO: 197698 - DNA, 20 bp, Artificial sequence
  SiRNA target sequence
attatgtaaaaaggtggtaa

SEQ ID NO: 197699 - DNA, 20 bp, Artificial sequence
  SiRNA target sequence
ttatgtaaaaaggtggtaaa

SEQ ID NO: 197700 - DNA, 20 bp, Artificial sequence
  SiRNA target sequence
tatgtaaaaaggtggtaaaa

SEQ ID NO: 197701 - DNA, 20 bp, Artificial sequence
  SiRNA target sequence
atgtaaaaaggtggtaaaaa

SEQ ID NO: 197702 - DNA, 20 bp, Artificial sequence
  SiRNA target sequence
tgtaaaaaggtggtaaaaat

SEQ ID NO: 197703 - DNA, 20 bp, Artificial sequence
  SiRNA target sequence
gtaaaaaggtggtaaaaatc

SEQ ID NO: 197704 - DNA, 20 bp, Artificial sequence
  SiRNA target sequence
taaaaaggtggtaaaaatct

SEQ ID NO: 197705 - DNA, 20 bp, Artificial sequence
  SiRNA target sequence
aaaaaggtggtaaaaatctt

SEQ ID NO: 197706 - DNA, 20 bp, Artificial sequence
  SiRNA target sequence
aaaaggtggtaaaaatcttg

SEQ ID NO: 197707 - DNA, 20 bp, Artificial sequence
  SiRNA target sequence
aaaggtggtaaaaatcttgt

SEQ ID NO: 197708 - DNA, 20 bp, Artificial sequence
  SiRNA target sequence
aaggtggtaaaaatcttgta

SEQ ID NO: 197709 - DNA, 20 bp, Artificial sequence
  SiRNA target sequence
aggtggtaaaaatcttgtaa

SEQ ID NO: 197710 - DNA, 20 bp, Artificial sequence
  SiRNA target sequence
ggtggtaaaaatcttgtaaa

SEQ ID NO: 197711 - DNA, 20 bp, Artificial sequence
  SiRNA target sequence
gtggtaaaaatcttgtaaac

SEQ ID NO: 197712 - DNA, 20 bp, Artificial sequence
  SiRNA target sequence
tggtaaaaatcttgtaaact

SEQ ID NO: 197713 - DNA, 20 bp, Artificial sequence
  SiRNA target sequence
ggtaaaaatcttgtaaactg

SEQ ID NO: 197714 - DNA, 20 bp, Artificial sequence
  SiRNA target sequence
gtaaaaatcttgtaaactgt

SEQ ID NO: 197715 - DNA, 20 bp, Artificial sequence
  SiRNA target sequence
taaaaatcttgtaaactgtc

SEQ ID NO: 197716 - DNA, 20 bp, Artificial sequence
  SiRNA target sequence
aaaaatcttgtaaactgtct

SEQ ID NO: 197717 - DNA, 20 bp, Artificial sequence
  SiRNA target sequence
aaaatcttgtaaactgtctg

SEQ ID NO: 197718 - DNA, 20 bp, Artificial sequence
  SiRNA target sequence
aaatcttgtaaactgtctga

SEQ ID NO: 197719 - DNA, 20 bp, Artificial sequence
  SiRNA target sequence
aatcttgtaaactgtctgat

SEQ ID NO: 197720 - DNA, 20 bp, Artificial sequence
  SiRNA target sequence
atcttgtaaactgtctgata

SEQ ID NO: 197721 - DNA, 20 bp, Artificial sequence
  SiRNA target sequence
tcttgtaaactgtctgatag

SEQ ID NO: 197722 - DNA, 20 bp, Artificial sequence
  SiRNA target sequence
cttgtaaactgtctgatagt

SEQ ID NO: 197723 - DNA, 20 bp, Artificial sequence
  SiRNA target sequence
ttgtaaactgtctgatagta

SEQ ID NO: 197724 - DNA, 20 bp, Artificial sequence
  SiRNA target sequence
tgtaaactgtctgatagtac

SEQ ID NO: 197725 - DNA, 20 bp, Artificial sequence
  SiRNA target sequence
gtaaactgtctgatagtaca

SEQ ID NO: 197726 - DNA, 20 bp, Artificial sequence
  SiRNA target sequence
taaactgtctgatagtacaa

SEQ ID NO: 197727 - DNA, 20 bp, Artificial sequence
  SiRNA target sequence
aaactgtctgatagtacaac

SEQ ID NO: 197728 - DNA, 20 bp, Artificial sequence
  SiRNA target sequence
aactgtctgatagtacaact

SEQ ID NO: 197729 - DNA, 20 bp, Artificial sequence
  SiRNA target sequence
actgtctgatagtacaactt

SEQ ID NO: 197730 - DNA, 20 bp, Artificial sequence
  SiRNA target sequence
ctgtctgatagtacaacttt

SEQ ID NO: 197731 - DNA, 20 bp, Artificial sequence
  SiRNA target sequence
tgtctgatagtacaactttc

SEQ ID NO: 197732 - DNA, 20 bp, Artificial sequence
  SiRNA target sequence
gtctgatagtacaactttca

SEQ ID NO: 197733 - DNA, 20 bp, Artificial sequence
  SiRNA target sequence
tctgatagtacaactttcat

SEQ ID NO: 197734 - DNA, 20 bp, Artificial sequence
  SiRNA target sequence
ctgatagtacaactttcatt

SEQ ID NO: 197735 - DNA, 20 bp, Artificial sequence
  SiRNA target sequence
tgatagtacaactttcattt

SEQ ID NO: 197736 - DNA, 20 bp, Artificial sequence
  SiRNA target sequence
gatagtacaactttcattta

SEQ ID NO: 197737 - DNA, 20 bp, Artificial sequence
  SiRNA target sequence
atagtacaactttcatttaa

SEQ ID NO: 197738 - DNA, 20 bp, Artificial sequence
  SiRNA target sequence
tagtacaactttcatttaaa

SEQ ID NO: 197739 - DNA, 20 bp, Artificial sequence
  SiRNA target sequence
agtacaactttcatttaaaa

SEQ ID NO: 197740 - DNA, 20 bp, Artificial sequence
  SiRNA target sequence
gtacaactttcatttaaaaa

SEQ ID NO: 197741 - DNA, 20 bp, Artificial sequence
  SiRNA target sequence
tacaactttcatttaaaaaa

SEQ ID NO: 197742 - DNA, 20 bp, Artificial sequence
  SiRNA target sequence
acaactttcatttaaaaaac

SEQ ID NO: 197743 - DNA, 20 bp, Artificial sequence
  SiRNA target sequence
caactttcatttaaaaaact

SEQ ID NO: 197744 - DNA, 20 bp, Artificial sequence
  SiRNA target sequence
aactttcatttaaaaaactc

SEQ ID NO: 197745 - DNA, 20 bp, Artificial sequence
  SiRNA target sequence
actttcatttaaaaaactca

SEQ ID NO: 197746 - DNA, 20 bp, Artificial sequence
  SiRNA target sequence
ctttcatttaaaaaactcat

SEQ ID NO: 197747 - DNA, 20 bp, Artificial sequence
  SiRNA target sequence
tttcatttaaaaaactcatg

SEQ ID NO: 197748 - DNA, 20 bp, Artificial sequence
  SiRNA target sequence
ttcatttaaaaaactcatgt

SEQ ID NO: 197749 - DNA, 20 bp, Artificial sequence
  SiRNA target sequence
tcatttaaaaaactcatgta

SEQ ID NO: 197750 - DNA, 20 bp, Artificial sequence
  SiRNA target sequence
catttaaaaaactcatgtat

SEQ ID NO: 197751 - DNA, 20 bp, Artificial sequence
  SiRNA target sequence
atttaaaaaactcatgtata

SEQ ID NO: 197752 - DNA, 20 bp, Artificial sequence
  SiRNA target sequence
tttaaaaaactcatgtataa

SEQ ID NO: 197753 - DNA, 20 bp, Artificial sequence
  SiRNA target sequence
ttaaaaaactcatgtataaa

SEQ ID NO: 197754 - DNA, 20 bp, Artificial sequence
  SiRNA target sequence
taaaaaactcatgtataaat

SEQ ID NO: 197755 - DNA, 20 bp, Artificial sequence
  SiRNA target sequence
aaaaaactcatgtataaata

SEQ ID NO: 197756 - DNA, 20 bp, Artificial sequence
  SiRNA target sequence
aaaaactcatgtataaataa

SEQ ID NO: 197757 - DNA, 20 bp, Artificial sequence
  SiRNA target sequence
aaaactcatgtataaataag

SEQ ID NO: 197758 - DNA, 20 bp, Artificial sequence
  SiRNA target sequence
aaactcatgtataaataagc

SEQ ID NO: 197759 - DNA, 20 bp, Artificial sequence
  SiRNA target sequence
aactcatgtataaataagcc

SEQ ID NO: 197760 - DNA, 20 bp, Artificial sequence
  SiRNA target sequence
actcatgtataaataagcca

SEQ ID NO: 197761 - DNA, 20 bp, Artificial sequence
  SiRNA target sequence
ctcatgtataaataagccat

SEQ ID NO: 197762 - DNA, 20 bp, Artificial sequence
  SiRNA target sequence
tcatgtataaataagccata

SEQ ID NO: 197763 - DNA, 20 bp, Artificial sequence
  SiRNA target sequence
catgtataaataagccataa

SEQ ID NO: 197764 - DNA, 20 bp, Artificial sequence
  SiRNA target sequence
atgtataaataagccataag

SEQ ID NO: 197765 - DNA, 20 bp, Artificial sequence
  SiRNA target sequence
tgtataaataagccataagt

SEQ ID NO: 197766 - DNA, 20 bp, Artificial sequence
  SiRNA target sequence
gtataaataagccataagta

SEQ ID NO: 197767 - DNA, 20 bp, Artificial sequence
  SiRNA target sequence
tataaataagccataagtaa

SEQ ID NO: 197768 - DNA, 20 bp, Artificial sequence
  SiRNA target sequence
ataaataagccataagtaaa

SEQ ID NO: 197769 - DNA, 20 bp, Artificial sequence
  SiRNA target sequence
taaataagccataagtaaac

SEQ ID NO: 197770 - DNA, 20 bp, Artificial sequence
  SiRNA target sequence
aaataagccataagtaaact

SEQ ID NO: 197771 - DNA, 20 bp, Artificial sequence
  SiRNA target sequence
aataagccataagtaaactg

SEQ ID NO: 197772 - DNA, 20 bp, Artificial sequence
  SiRNA target sequence
ataagccataagtaaactgc

SEQ ID NO: 197773 - DNA, 20 bp, Artificial sequence
  SiRNA target sequence
taagccataagtaaactgcc

SEQ ID NO: 197774 - DNA, 20 bp, Artificial sequence
  SiRNA target sequence
aagccataagtaaactgccc

SEQ ID NO: 197775 - DNA, 20 bp, Artificial sequence
  SiRNA target sequence
agccataagtaaactgcccc

SEQ ID NO: 197776 - DNA, 20 bp, Artificial sequence
  SiRNA target sequence
gccataagtaaactgcccca

SEQ ID NO: 197777 - DNA, 20 bp, Artificial sequence
  SiRNA target sequence
ccataagtaaactgccccac

SEQ ID NO: 197778 - DNA, 20 bp, Artificial sequence
  SiRNA target sequence
cataagtaaactgccccaca

SEQ ID NO: 197779 - DNA, 20 bp, Artificial sequence
  SiRNA target sequence
ataagtaaactgccccacat

SEQ ID NO: 197780 - DNA, 20 bp, Artificial sequence
  SiRNA target sequence
taagtaaactgccccacatt

SEQ ID NO: 197781 - DNA, 20 bp, Artificial sequence
  SiRNA target sequence
aagtaaactgccccacattt

SEQ ID NO: 197782 - DNA, 20 bp, Artificial sequence
  SiRNA target sequence
agtaaactgccccacatttc

SEQ ID NO: 197783 - DNA, 20 bp, Artificial sequence
  SiRNA target sequence
gtaaactgccccacatttct

SEQ ID NO: 197784 - DNA, 20 bp, Artificial sequence
  SiRNA target sequence
taaactgccccacatttctg

SEQ ID NO: 197785 - DNA, 20 bp, Artificial sequence
  SiRNA target sequence
aaactgccccacatttctgc

SEQ ID NO: 197786 - DNA, 20 bp, Artificial sequence
  SiRNA target sequence
aactgccccacatttctgct

SEQ ID NO: 197787 - DNA, 20 bp, Artificial sequence
  SiRNA target sequence
actgccccacatttctgcta

SEQ ID NO: 197788 - DNA, 20 bp, Artificial sequence
  SiRNA target sequence
ctgccccacatttctgctat

SEQ ID NO: 197789 - DNA, 20 bp, Artificial sequence
  SiRNA target sequence
tgccccacatttctgctatt

SEQ ID NO: 197790 - DNA, 20 bp, Artificial sequence
  SiRNA target sequence
gccccacatttctgctatta

SEQ ID NO: 197791 - DNA, 20 bp, Artificial sequence
  SiRNA target sequence
ccccacatttctgctattat

SEQ ID NO: 197792 - DNA, 20 bp, Artificial sequence
  SiRNA target sequence
cccacatttctgctattata

SEQ ID NO: 197793 - DNA, 20 bp, Artificial sequence
  SiRNA target sequence
ccacatttctgctattataa

SEQ ID NO: 197794 - DNA, 20 bp, Artificial sequence
  SiRNA target sequence
cacatttctgctattataaa

SEQ ID NO: 197795 - DNA, 20 bp, Artificial sequence
  SiRNA target sequence
acatttctgctattataaaa

SEQ ID NO: 197796 - DNA, 20 bp, Artificial sequence
  SiRNA target sequence
catttctgctattataaaaa

SEQ ID NO: 197797 - DNA, 20 bp, Artificial sequence
  SiRNA target sequence
atttctgctattataaaaat

SEQ ID NO: 197798 - DNA, 20 bp, Artificial sequence
  SiRNA target sequence
tttctgctattataaaaata

SEQ ID NO: 197799 - DNA, 20 bp, Artificial sequence
  SiRNA target sequence
ttctgctattataaaaatac

SEQ ID NO: 197800 - DNA, 20 bp, Artificial sequence
  SiRNA target sequence
tctgctattataaaaataca

SEQ ID NO: 197801 - DNA, 20 bp, Artificial sequence
  SiRNA target sequence
ctgctattataaaaatacaa

SEQ ID NO: 197802 - DNA, 20 bp, Artificial sequence
  SiRNA target sequence
tgctattataaaaatacaag

SEQ ID NO: 197803 - DNA, 20 bp, Artificial sequence
  SiRNA target sequence
gctattataaaaatacaagt

SEQ ID NO: 197804 - DNA, 20 bp, Artificial sequence
  SiRNA target sequence
ctattataaaaatacaagtt

SEQ ID NO: 197805 - DNA, 20 bp, Artificial sequence
  SiRNA target sequence
tattataaaaatacaagttg

SEQ ID NO: 197806 - DNA, 20 bp, Artificial sequence
  SiRNA target sequence
attataaaaatacaagttga

SEQ ID NO: 197807 - DNA, 20 bp, Artificial sequence
  SiRNA target sequence
ttataaaaatacaagttgaa

SEQ ID NO: 197808 - DNA, 20 bp, Artificial sequence
  SiRNA target sequence
tataaaaatacaagttgaaa

SEQ ID NO: 197809 - DNA, 20 bp, Artificial sequence
  SiRNA target sequence
ataaaaatacaagttgaaac

SEQ ID NO: 197810 - DNA, 20 bp, Artificial sequence
  SiRNA target sequence
taaaaatacaagttgaaacg

SEQ ID NO: 197811 - DNA, 20 bp, Artificial sequence
  SiRNA target sequence
aaaaatacaagttgaaacgg

SEQ ID NO: 197812 - DNA, 20 bp, Artificial sequence
  SiRNA target sequence
aaaatacaagttgaaacggg

SEQ ID NO: 197813 - DNA, 20 bp, Artificial sequence
  SiRNA target sequence
aaatacaagttgaaacgggc

SEQ ID NO: 197814 - DNA, 20 bp, Artificial sequence
  SiRNA target sequence
aatacaagttgaaacgggct

SEQ ID NO: 197815 - DNA, 20 bp, Artificial sequence
  SiRNA target sequence
atacaagttgaaacgggctc

SEQ ID NO: 197816 - DNA, 20 bp, Artificial sequence
  SiRNA target sequence
tacaagttgaaacgggctcg

SEQ ID NO: 197817 - DNA, 20 bp, Artificial sequence
  SiRNA target sequence
acaagttgaaacgggctcgt

SEQ ID NO: 197818 - DNA, 20 bp, Artificial sequence
  SiRNA target sequence
caagttgaaacgggctcgtt

SEQ ID NO: 197819 - DNA, 20 bp, Artificial sequence
  SiRNA target sequence
aagttgaaacgggctcgtta

SEQ ID NO: 197820 - DNA, 20 bp, Artificial sequence
  SiRNA target sequence
agttgaaacgggctcgttag

SEQ ID NO: 197821 - DNA, 20 bp, Artificial sequence
  SiRNA target sequence
gttgaaacgggctcgttagc

SEQ ID NO: 197822 - DNA, 20 bp, Artificial sequence
  SiRNA target sequence
ttgaaacgggctcgttagct

SEQ ID NO: 197823 - DNA, 20 bp, Artificial sequence
  SiRNA target sequence
tgaaacgggctcgttagctg

SEQ ID NO: 197824 - DNA, 20 bp, Artificial sequence
  SiRNA target sequence
gaaacgggctcgttagctgt

SEQ ID NO: 197825 - DNA, 20 bp, Artificial sequence
  SiRNA target sequence
aaacgggctcgttagctgta

SEQ ID NO: 197826 - DNA, 20 bp, Artificial sequence
  SiRNA target sequence
aacgggctcgttagctgtaa

SEQ ID NO: 197827 - DNA, 20 bp, Artificial sequence
  SiRNA target sequence
acgggctcgttagctgtaat

SEQ ID NO: 197828 - DNA, 20 bp, Artificial sequence
  SiRNA target sequence
cgggctcgttagctgtaatt

SEQ ID NO: 197829 - DNA, 20 bp, Artificial sequence
  SiRNA target sequence
gggctcgttagctgtaatta

SEQ ID NO: 197830 - DNA, 20 bp, Artificial sequence
  SiRNA target sequence
ggctcgttagctgtaattaa

SEQ ID NO: 197831 - DNA, 20 bp, Artificial sequence
  SiRNA target sequence
gctcgttagctgtaattaaa

SEQ ID NO: 197832 - DNA, 20 bp, Artificial sequence
  SiRNA target sequence
ctcgttagctgtaattaaaa

SEQ ID NO: 197833 - DNA, 20 bp, Artificial sequence
  SiRNA target sequence
tcgttagctgtaattaaaaa

SEQ ID NO: 197834 - DNA, 20 bp, Artificial sequence
  SiRNA target sequence
cgttagctgtaattaaaaaa

SEQ ID NO: 197835 - DNA, 20 bp, Artificial sequence
  SiRNA target sequence
gttagctgtaattaaaaaat

SEQ ID NO: 197836 - DNA, 20 bp, Artificial sequence
  SiRNA target sequence
ttagctgtaattaaaaaata

SEQ ID NO: 197837 - DNA, 20 bp, Artificial sequence
  SiRNA target sequence
tagctgtaattaaaaaatat

SEQ ID NO: 197838 - DNA, 20 bp, Artificial sequence
  SiRNA target sequence
agctgtaattaaaaaatatt

SEQ ID NO: 197839 - DNA, 20 bp, Artificial sequence
  SiRNA target sequence
gctgtaattaaaaaatattt

SEQ ID NO: 197840 - DNA, 20 bp, Artificial sequence
  SiRNA target sequence
ctgtaattaaaaaatatttt

SEQ ID NO: 197841 - DNA, 20 bp, Artificial sequence
  SiRNA target sequence
tgtaattaaaaaatatttta

SEQ ID NO: 197842 - DNA, 20 bp, Artificial sequence
  SiRNA target sequence
gtaattaaaaaatattttat

SEQ ID NO: 197843 - DNA, 20 bp, Artificial sequence
  SiRNA target sequence
taattaaaaaatattttata

SEQ ID NO: 197844 - DNA, 20 bp, Artificial sequence
  SiRNA target sequence
aattaaaaaatattttataa

SEQ ID NO: 197845 - DNA, 20 bp, Artificial sequence
  SiRNA target sequence
attaaaaaatattttataaa

SEQ ID NO: 197846 - DNA, 20 bp, Artificial sequence
  SiRNA target sequence
ttaaaaaatattttataaag

SEQ ID NO: 197847 - DNA, 20 bp, Artificial sequence
  SiRNA target sequence
taaaaaatattttataaagt

SEQ ID NO: 197848 - DNA, 20 bp, Artificial sequence
  SiRNA target sequence
aaaaaatattttataaagtt

SEQ ID NO: 197849 - DNA, 20 bp, Artificial sequence
  SiRNA target sequence
aaaaatattttataaagttc

SEQ ID NO: 197850 - DNA, 20 bp, Artificial sequence
  SiRNA target sequence
aaaatattttataaagttca

SEQ ID NO: 197851 - DNA, 20 bp, Artificial sequence
  SiRNA target sequence
aaatattttataaagttcaa

SEQ ID NO: 197852 - DNA, 20 bp, Artificial sequence
  SiRNA target sequence
aatattttataaagttcaat

SEQ ID NO: 197853 - DNA, 20 bp, Artificial sequence
  SiRNA target sequence
atattttataaagttcaatc

SEQ ID NO: 197854 - DNA, 20 bp, Artificial sequence
  SiRNA target sequence
tattttataaagttcaatcc

SEQ ID NO: 197855 - DNA, 20 bp, Artificial sequence
  SiRNA target sequence
attttataaagttcaatccc

SEQ ID NO: 197856 - DNA, 20 bp, Artificial sequence
  SiRNA target sequence
ttttataaagttcaatccct

SEQ ID NO: 197857 - DNA, 20 bp, Artificial sequence
  SiRNA target sequence
tttataaagttcaatccctt

SEQ ID NO: 197858 - DNA, 20 bp, Artificial sequence
  SiRNA target sequence
ttataaagttcaatcccttc

SEQ ID NO: 197859 - DNA, 20 bp, Artificial sequence
  SiRNA target sequence
tataaagttcaatcccttca

SEQ ID NO: 197860 - DNA, 20 bp, Artificial sequence
  SiRNA target sequence
ataaagttcaatcccttcaa

SEQ ID NO: 197861 - DNA, 20 bp, Artificial sequence
  SiRNA target sequence
taaagttcaatcccttcaat

SEQ ID NO: 197862 - DNA, 20 bp, Artificial sequence
  SiRNA target sequence
aaagttcaatcccttcaatg

SEQ ID NO: 197863 - DNA, 20 bp, Artificial sequence
  SiRNA target sequence
aagttcaatcccttcaatgc

SEQ ID NO: 197864 - DNA, 20 bp, Artificial sequence
  SiRNA target sequence
agttcaatcccttcaatgca

SEQ ID NO: 197865 - DNA, 20 bp, Artificial sequence
  SiRNA target sequence
gttcaatcccttcaatgcac

SEQ ID NO: 197866 - DNA, 20 bp, Artificial sequence
  SiRNA target sequence
ttcaatcccttcaatgcacc

SEQ ID NO: 197867 - DNA, 20 bp, Artificial sequence
  SiRNA target sequence
tcaatcccttcaatgcacct

SEQ ID NO: 197868 - DNA, 20 bp, Artificial sequence
  SiRNA target sequence
caatcccttcaatgcacctt

SEQ ID NO: 197869 - DNA, 20 bp, Artificial sequence
  SiRNA target sequence
aatcccttcaatgcaccttt

SEQ ID NO: 197870 - DNA, 20 bp, Artificial sequence
  SiRNA target sequence
atcccttcaatgcacctttg

SEQ ID NO: 197871 - DNA, 20 bp, Artificial sequence
  SiRNA target sequence
tcccttcaatgcacctttgt

SEQ ID NO: 197872 - DNA, 20 bp, Artificial sequence
  SiRNA target sequence
cccttcaatgcacctttgtt

SEQ ID NO: 197873 - DNA, 20 bp, Artificial sequence
  SiRNA target sequence
ccttcaatgcacctttgtta

SEQ ID NO: 197874 - DNA, 20 bp, Artificial sequence
  SiRNA target sequence
cttcaatgcacctttgttat

SEQ ID NO: 197875 - DNA, 20 bp, Artificial sequence
  SiRNA target sequence
ttcaatgcacctttgttatc

SEQ ID NO: 197876 - DNA, 20 bp, Artificial sequence
  SiRNA target sequence
tcaatgcacctttgttatca

SEQ ID NO: 197877 - DNA, 20 bp, Artificial sequence
  SiRNA target sequence
caatgcacctttgttatcag

SEQ ID NO: 197878 - DNA, 20 bp, Artificial sequence
  SiRNA target sequence
aatgcacctttgttatcagc

SEQ ID NO: 197879 - DNA, 20 bp, Artificial sequence
  SiRNA target sequence
atgcacctttgttatcagcg

SEQ ID NO: 197880 - DNA, 20 bp, Artificial sequence
  SiRNA target sequence
tgcacctttgttatcagcga

SEQ ID NO: 197881 - DNA, 20 bp, Artificial sequence
  SiRNA target sequence
gcacctttgttatcagcgaa

SEQ ID NO: 197882 - DNA, 20 bp, Artificial sequence
  SiRNA target sequence
cacctttgttatcagcgaaa

SEQ ID NO: 197883 - DNA, 20 bp, Artificial sequence
  SiRNA target sequence
acctttgttatcagcgaaaa

SEQ ID NO: 197884 - DNA, 20 bp, Artificial sequence
  SiRNA target sequence
cctttgttatcagcgaaaat

SEQ ID NO: 197885 - DNA, 20 bp, Artificial sequence
  SiRNA target sequence
ctttgttatcagcgaaaata

SEQ ID NO: 197886 - DNA, 20 bp, Artificial sequence
  SiRNA target sequence
tttgttatcagcgaaaatat

SEQ ID NO: 197887 - DNA, 20 bp, Artificial sequence
  SiRNA target sequence
ttgttatcagcgaaaatatc

SEQ ID NO: 197888 - DNA, 20 bp, Artificial sequence
  SiRNA target sequence
tgttatcagcgaaaatatct

SEQ ID NO: 197889 - DNA, 20 bp, Artificial sequence
  SiRNA target sequence
gttatcagcgaaaatatctc

SEQ ID NO: 197890 - DNA, 20 bp, Artificial sequence
  SiRNA target sequence
ttatcagcgaaaatatctct

SEQ ID NO: 197891 - DNA, 20 bp, Artificial sequence
  SiRNA target sequence
tatcagcgaaaatatctcta

SEQ ID NO: 197892 - DNA, 20 bp, Artificial sequence
  SiRNA target sequence
atcagcgaaaatatctctaa

SEQ ID NO: 197893 - DNA, 20 bp, Artificial sequence
  SiRNA target sequence
tcagcgaaaatatctctaaa

SEQ ID NO: 197894 - DNA, 20 bp, Artificial sequence
  SiRNA target sequence
cagcgaaaatatctctaaat

SEQ ID NO: 197895 - DNA, 20 bp, Artificial sequence
  SiRNA target sequence
agcgaaaatatctctaaata

SEQ ID NO: 197896 - DNA, 20 bp, Artificial sequence
  SiRNA target sequence
gcgaaaatatctctaaataa

SEQ ID NO: 197897 - DNA, 20 bp, Artificial sequence
  SiRNA target sequence
cgaaaatatctctaaataaa

SEQ ID NO: 197898 - DNA, 20 bp, Artificial sequence
  SiRNA target sequence
gaaaatatctctaaataaaa

SEQ ID NO: 197899 - DNA, 20 bp, Artificial sequence
  SiRNA target sequence
aaaatatctctaaataaaaa

SEQ ID NO: 197900 - DNA, 20 bp, Artificial sequence
  SiRNA target sequence
aaatatctctaaataaaaag

SEQ ID NO: 197901 - DNA, 20 bp, Artificial sequence
  SiRNA target sequence
aatatctctaaataaaaagc

SEQ ID NO: 197902 - DNA, 20 bp, Artificial sequence
  SiRNA target sequence
atatctctaaataaaaagct

SEQ ID NO: 197903 - DNA, 20 bp, Artificial sequence
  SiRNA target sequence
tatctctaaataaaaagcta

SEQ ID NO: 197904 - DNA, 20 bp, Artificial sequence
  SiRNA target sequence
atctctaaataaaaagctag

SEQ ID NO: 197905 - DNA, 20 bp, Artificial sequence
  SiRNA target sequence
tctctaaataaaaagctaga

SEQ ID NO: 197906 - DNA, 20 bp, Artificial sequence
  SiRNA target sequence
ctctaaataaaaagctagat

SEQ ID NO: 197907 - DNA, 20 bp, Artificial sequence
  SiRNA target sequence
tctaaataaaaagctagatg

SEQ ID NO: 197908 - DNA, 20 bp, Artificial sequence
  SiRNA target sequence
ctaaataaaaagctagatgg

SEQ ID NO: 197909 - DNA, 20 bp, Artificial sequence
  SiRNA target sequence
taaataaaaagctagatggt

SEQ ID NO: 197910 - DNA, 20 bp, Artificial sequence
  SiRNA target sequence
aaataaaaagctagatggtg

SEQ ID NO: 197911 - DNA, 20 bp, Artificial sequence
  SiRNA target sequence
aataaaaagctagatggtgt

SEQ ID NO: 197912 - DNA, 20 bp, Artificial sequence
  SiRNA target sequence
ataaaaagctagatggtgtt

SEQ ID NO: 197913 - DNA, 20 bp, Artificial sequence
  SiRNA target sequence
taaaaagctagatggtgtta

SEQ ID NO: 197914 - DNA, 20 bp, Artificial sequence
  SiRNA target sequence
aaaaagctagatggtgttac

SEQ ID NO: 197915 - DNA, 20 bp, Artificial sequence
  SiRNA target sequence
aaaagctagatggtgttact

SEQ ID NO: 197916 - DNA, 20 bp, Artificial sequence
  SiRNA target sequence
aaagctagatggtgttactt

SEQ ID NO: 197917 - DNA, 20 bp, Artificial sequence
  SiRNA target sequence
aagctagatggtgttacttt

SEQ ID NO: 197918 - DNA, 20 bp, Artificial sequence
  SiRNA target sequence
agctagatggtgttactttc

SEQ ID NO: 197919 - DNA, 20 bp, Artificial sequence
  SiRNA target sequence
gctagatggtgttactttct

SEQ ID NO: 197920 - DNA, 20 bp, Artificial sequence
  SiRNA target sequence
ctagatggtgttactttctc

SEQ ID NO: 197921 - DNA, 20 bp, Artificial sequence
  SiRNA target sequence
tagatggtgttactttctct

SEQ ID NO: 197922 - DNA, 20 bp, Artificial sequence
  SiRNA target sequence
agatggtgttactttctctt

SEQ ID NO: 197923 - DNA, 20 bp, Artificial sequence
  SiRNA target sequence
gatggtgttactttctcttc

SEQ ID NO: 197924 - DNA, 20 bp, Artificial sequence
  SiRNA target sequence
atggtgttactttctcttca

SEQ ID NO: 197925 - DNA, 20 bp, Artificial sequence
  SiRNA target sequence
tggtgttactttctcttcaa

SEQ ID NO: 197926 - DNA, 20 bp, Artificial sequence
  SiRNA target sequence
ggtgttactttctcttcaaa

SEQ ID NO: 197927 - DNA, 20 bp, Artificial sequence
  SiRNA target sequence
gtgttactttctcttcaaac

SEQ ID NO: 197928 - DNA, 20 bp, Artificial sequence
  SiRNA target sequence
tgttactttctcttcaaaca

SEQ ID NO: 197929 - DNA, 20 bp, Artificial sequence
  SiRNA target sequence
gttactttctcttcaaacaa

SEQ ID NO: 197930 - DNA, 20 bp, Artificial sequence
  SiRNA target sequence
ttactttctcttcaaacaaa

SEQ ID NO: 197931 - DNA, 20 bp, Artificial sequence
  SiRNA target sequence
tactttctcttcaaacaaaa

SEQ ID NO: 197932 - DNA, 20 bp, Artificial sequence
  SiRNA target sequence
actttctcttcaaacaaaaa

SEQ ID NO: 197933 - DNA, 20 bp, Artificial sequence
  SiRNA target sequence
ctttctcttcaaacaaaaag

SEQ ID NO: 197934 - DNA, 20 bp, Artificial sequence
  SiRNA target sequence
tttctcttcaaacaaaaaga

SEQ ID NO: 197935 - DNA, 20 bp, Artificial sequence
  SiRNA target sequence
ttctcttcaaacaaaaagat

SEQ ID NO: 197936 - DNA, 20 bp, Artificial sequence
  SiRNA target sequence
tctcttcaaacaaaaagatt

SEQ ID NO: 197937 - DNA, 20 bp, Artificial sequence
  SiRNA target sequence
ctcttcaaacaaaaagattg

SEQ ID NO: 197938 - DNA, 20 bp, Artificial sequence
  SiRNA target sequence
tcttcaaacaaaaagattgc

SEQ ID NO: 197939 - DNA, 20 bp, Artificial sequence
  SiRNA target sequence
cttcaaacaaaaagattgcc

SEQ ID NO: 197940 - DNA, 20 bp, Artificial sequence
  SiRNA target sequence
ttcaaacaaaaagattgccc

SEQ ID NO: 197941 - DNA, 20 bp, Artificial sequence
  SiRNA target sequence
tcaaacaaaaagattgcccc

SEQ ID NO: 197942 - DNA, 20 bp, Artificial sequence
  SiRNA target sequence
caaacaaaaagattgcccct

SEQ ID NO: 197943 - DNA, 20 bp, Artificial sequence
  SiRNA target sequence
aaacaaaaagattgccccta

SEQ ID NO: 197944 - DNA, 20 bp, Artificial sequence
  SiRNA target sequence
aacaaaaagattgcccctag

SEQ ID NO: 197945 - DNA, 20 bp, Artificial sequence
  SiRNA target sequence
acaaaaagattgcccctagt

SEQ ID NO: 197946 - DNA, 20 bp, Artificial sequence
  SiRNA target sequence
caaaaagattgcccctagtc

SEQ ID NO: 197947 - DNA, 20 bp, Artificial sequence
  SiRNA target sequence
aaaaagattgcccctagtcc

SEQ ID NO: 197948 - DNA, 20 bp, Artificial sequence
  SiRNA target sequence
aaaagattgcccctagtccg

SEQ ID NO: 197949 - DNA, 20 bp, Artificial sequence
  SiRNA target sequence
aaagattgcccctagtccga

SEQ ID NO: 197950 - DNA, 20 bp, Artificial sequence
  SiRNA target sequence
aagattgcccctagtccgaa

SEQ ID NO: 197951 - DNA, 20 bp, Artificial sequence
  SiRNA target sequence
agattgcccctagtccgaag

SEQ ID NO: 197952 - DNA, 20 bp, Artificial sequence
  SiRNA target sequence
gattgcccctagtccgaaga

SEQ ID NO: 197953 - DNA, 20 bp, Artificial sequence
  SiRNA target sequence
attgcccctagtccgaagaa

SEQ ID NO: 197954 - DNA, 20 bp, Artificial sequence
  SiRNA target sequence
ttgcccctagtccgaagaaa

SEQ ID NO: 197955 - DNA, 20 bp, Artificial sequence
  SiRNA target sequence
tgcccctagtccgaagaaaa

SEQ ID NO: 197956 - DNA, 20 bp, Artificial sequence
  SiRNA target sequence
gcccctagtccgaagaaaaa

SEQ ID NO: 197957 - DNA, 20 bp, Artificial sequence
  SiRNA target sequence
cccctagtccgaagaaaaat

SEQ ID NO: 197958 - DNA, 20 bp, Artificial sequence
  SiRNA target sequence
ccctagtccgaagaaaaatg

SEQ ID NO: 197959 - DNA, 20 bp, Artificial sequence
  SiRNA target sequence
cctagtccgaagaaaaatgc

SEQ ID NO: 197960 - DNA, 20 bp, Artificial sequence
  SiRNA target sequence
ctagtccgaagaaaaatgca

SEQ ID NO: 197961 - DNA, 20 bp, Artificial sequence
  SiRNA target sequence
tagtccgaagaaaaatgcag

SEQ ID NO: 197962 - DNA, 20 bp, Artificial sequence
  SiRNA target sequence
agtccgaagaaaaatgcagt

SEQ ID NO: 197963 - DNA, 20 bp, Artificial sequence
  SiRNA target sequence
gtccgaagaaaaatgcagta

SEQ ID NO: 197964 - DNA, 20 bp, Artificial sequence
  SiRNA target sequence
tccgaagaaaaatgcagtaa

SEQ ID NO: 197965 - DNA, 20 bp, Artificial sequence
  SiRNA target sequence
ccgaagaaaaatgcagtaaa

SEQ ID NO: 197966 - DNA, 20 bp, Artificial sequence
  SiRNA target sequence
cgaagaaaaatgcagtaaaa

SEQ ID NO: 197967 - DNA, 20 bp, Artificial sequence
  SiRNA target sequence
gaagaaaaatgcagtaaaaa

SEQ ID NO: 197968 - DNA, 20 bp, Artificial sequence
  SiRNA target sequence
aagaaaaatgcagtaaaaat

SEQ ID NO: 197969 - DNA, 20 bp, Artificial sequence
  SiRNA target sequence
agaaaaatgcagtaaaaatt

SEQ ID NO: 197970 - DNA, 20 bp, Artificial sequence
  SiRNA target sequence
gaaaaatgcagtaaaaatta

SEQ ID NO: 197971 - DNA, 20 bp, Artificial sequence
  SiRNA target sequence
aaaaatgcagtaaaaattat

SEQ ID NO: 197972 - DNA, 20 bp, Artificial sequence
  SiRNA target sequence
aaaatgcagtaaaaattatt

SEQ ID NO: 197973 - DNA, 20 bp, Artificial sequence
  SiRNA target sequence
aaatgcagtaaaaattatta

SEQ ID NO: 197974 - DNA, 20 bp, Artificial sequence
  SiRNA target sequence
aatgcagtaaaaattattag

SEQ ID NO: 197975 - DNA, 20 bp, Artificial sequence
  SiRNA target sequence
atgcagtaaaaattattaga

SEQ ID NO: 197976 - DNA, 20 bp, Artificial sequence
  SiRNA target sequence
tgcagtaaaaattattagaa

SEQ ID NO: 197977 - DNA, 20 bp, Artificial sequence
  SiRNA target sequence
gcagtaaaaattattagaaa

SEQ ID NO: 197978 - DNA, 20 bp, Artificial sequence
  SiRNA target sequence
cagtaaaaattattagaaat

SEQ ID NO: 197979 - DNA, 20 bp, Artificial sequence
  SiRNA target sequence
agtaaaaattattagaaata

SEQ ID NO: 197980 - DNA, 20 bp, Artificial sequence
  SiRNA target sequence
gtaaaaattattagaaatag

SEQ ID NO: 197981 - DNA, 20 bp, Artificial sequence
  SiRNA target sequence
taaaaattattagaaataga

SEQ ID NO: 197982 - DNA, 20 bp, Artificial sequence
  SiRNA target sequence
aaaaattattagaaatagat

SEQ ID NO: 197983 - DNA, 20 bp, Artificial sequence
  SiRNA target sequence
aaaattattagaaatagatt

SEQ ID NO: 197984 - DNA, 20 bp, Artificial sequence
  SiRNA target sequence
aaattattagaaatagatta

SEQ ID NO: 197985 - DNA, 20 bp, Artificial sequence
  SiRNA target sequence
aattattagaaatagattaa

SEQ ID NO: 197986 - DNA, 20 bp, Artificial sequence
  SiRNA target sequence
attattagaaatagattaaa

SEQ ID NO: 197987 - DNA, 20 bp, Artificial sequence
  SiRNA target sequence
ttattagaaatagattaaaa

SEQ ID NO: 197988 - DNA, 20 bp, Artificial sequence
  SiRNA target sequence
tattagaaatagattaaaaa

SEQ ID NO: 197989 - DNA, 20 bp, Artificial sequence
  SiRNA target sequence
attagaaatagattaaaaat

SEQ ID NO: 197990 - DNA, 20 bp, Artificial sequence
  SiRNA target sequence
ttagaaatagattaaaaatc

SEQ ID NO: 197991 - DNA, 20 bp, Artificial sequence
  SiRNA target sequence
tagaaatagattaaaaatcg

SEQ ID NO: 197992 - DNA, 20 bp, Artificial sequence
  SiRNA target sequence
agaaatagattaaaaatcga

SEQ ID NO: 197993 - DNA, 20 bp, Artificial sequence
  SiRNA target sequence
gaaatagattaaaaatcgat

SEQ ID NO: 197994 - DNA, 20 bp, Artificial sequence
  SiRNA target sequence
aaatagattaaaaatcgatg

SEQ ID NO: 197995 - DNA, 20 bp, Artificial sequence
  SiRNA target sequence
aatagattaaaaatcgatga

SEQ ID NO: 197996 - DNA, 20 bp, Artificial sequence
  SiRNA target sequence
atagattaaaaatcgatgat

SEQ ID NO: 197997 - DNA, 20 bp, Artificial sequence
  SiRNA target sequence
tagattaaaaatcgatgata

SEQ ID NO: 197998 - DNA, 20 bp, Artificial sequence
  SiRNA target sequence
agattaaaaatcgatgatac

SEQ ID NO: 197999 - DNA, 20 bp, Artificial sequence
  SiRNA target sequence
gattaaaaatcgatgataca

SEQ ID NO: 198000 - DNA, 20 bp, Artificial sequence
  SiRNA target sequence
attaaaaatcgatgatacag

SEQ ID NO: 198001 - DNA, 20 bp, Artificial sequence
  SiRNA target sequence
ttaaaaatcgatgatacagg

SEQ ID NO: 198002 - DNA, 20 bp, Artificial sequence
  SiRNA target sequence
taaaaatcgatgatacaggt

SEQ ID NO: 198003 - DNA, 20 bp, Artificial sequence
  SiRNA target sequence
aaaaatcgatgatacaggtt

SEQ ID NO: 198004 - DNA, 20 bp, Artificial sequence
  SiRNA target sequence
aaaatcgatgatacaggttt

SEQ ID NO: 198005 - DNA, 20 bp, Artificial sequence
  SiRNA target sequence
aaatcgatgatacaggttta

SEQ ID NO: 198006 - DNA, 20 bp, Artificial sequence
  SiRNA target sequence
aatcgatgatacaggtttat

SEQ ID NO: 198007 - DNA, 20 bp, Artificial sequence
  SiRNA target sequence
atcgatgatacaggtttatt

SEQ ID NO: 198008 - DNA, 20 bp, Artificial sequence
  SiRNA target sequence
tcgatgatacaggtttattt

SEQ ID NO: 198009 - DNA, 20 bp, Artificial sequence
  SiRNA target sequence
cgatgatacaggtttatttt

SEQ ID NO: 198010 - DNA, 20 bp, Artificial sequence
  SiRNA target sequence
gatgatacaggtttattttg

SEQ ID NO: 198011 - DNA, 20 bp, Artificial sequence
  SiRNA target sequence
atgatacaggtttattttgc

SEQ ID NO: 198012 - DNA, 20 bp, Artificial sequence
  SiRNA target sequence
tgatacaggtttattttgca

SEQ ID NO: 198013 - DNA, 20 bp, Artificial sequence
  SiRNA target sequence
gatacaggtttattttgcat

SEQ ID NO: 198014 - DNA, 20 bp, Artificial sequence
  SiRNA target sequence
atacaggtttattttgcata

SEQ ID NO: 198015 - DNA, 20 bp, Artificial sequence
  SiRNA target sequence
tacaggtttattttgcataa

SEQ ID NO: 198016 - DNA, 20 bp, Artificial sequence
  SiRNA target sequence
acaggtttattttgcataag

SEQ ID NO: 198017 - DNA, 20 bp, Artificial sequence
  SiRNA target sequence
caggtttattttgcataagc

SEQ ID NO: 198018 - DNA, 20 bp, Artificial sequence
  SiRNA target sequence
aggtttattttgcataagcc

SEQ ID NO: 198019 - DNA, 20 bp, Artificial sequence
  SiRNA target sequence
ggtttattttgcataagcca

SEQ ID NO: 198020 - DNA, 20 bp, Artificial sequence
  SiRNA target sequence
gtttattttgcataagccac

SEQ ID NO: 198021 - DNA, 20 bp, Artificial sequence
  SiRNA target sequence
tttattttgcataagccact

SEQ ID NO: 198022 - DNA, 20 bp, Artificial sequence
  SiRNA target sequence
ttattttgcataagccactg

SEQ ID NO: 198023 - DNA, 20 bp, Artificial sequence
  SiRNA target sequence
tattttgcataagccactgt

SEQ ID NO: 198024 - DNA, 20 bp, Artificial sequence
  SiRNA target sequence
attttgcataagccactgta

SEQ ID NO: 198025 - DNA, 20 bp, Artificial sequence
  SiRNA target sequence
ttttgcataagccactgtat

SEQ ID NO: 198026 - DNA, 20 bp, Artificial sequence
  SiRNA target sequence
tttgcataagccactgtatt

SEQ ID NO: 198027 - DNA, 20 bp, Artificial sequence
  SiRNA target sequence
ttgcataagccactgtatta

SEQ ID NO: 198028 - DNA, 20 bp, Artificial sequence
  SiRNA target sequence
tgcataagccactgtattaa

SEQ ID NO: 198029 - DNA, 20 bp, Artificial sequence
  SiRNA target sequence
gcataagccactgtattaaa

SEQ ID NO: 198030 - DNA, 20 bp, Artificial sequence
  SiRNA target sequence
cataagccactgtattaaaa

SEQ ID NO: 198031 - DNA, 20 bp, Artificial sequence
  SiRNA target sequence
ataagccactgtattaaaat

SEQ ID NO: 198032 - DNA, 20 bp, Artificial sequence
  SiRNA target sequence
taagccactgtattaaaatt

SEQ ID NO: 198033 - DNA, 20 bp, Artificial sequence
  SiRNA target sequence
aagccactgtattaaaatta

SEQ ID NO: 198034 - DNA, 20 bp, Artificial sequence
  SiRNA target sequence
agccactgtattaaaattac

SEQ ID NO: 198035 - DNA, 20 bp, Artificial sequence
  SiRNA target sequence
gccactgtattaaaattaca

SEQ ID NO: 198036 - DNA, 20 bp, Artificial sequence
  SiRNA target sequence
ccactgtattaaaattacag

SEQ ID NO: 198037 - DNA, 20 bp, Artificial sequence
  SiRNA target sequence
cactgtattaaaattacaga

SEQ ID NO: 198038 - DNA, 20 bp, Artificial sequence
  SiRNA target sequence
actgtattaaaattacagat

SEQ ID NO: 198039 - DNA, 20 bp, Artificial sequence
  SiRNA target sequence
ctgtattaaaattacagatg

SEQ ID NO: 198040 - DNA, 20 bp, Artificial sequence
  SiRNA target sequence
tgtattaaaattacagatgc

SEQ ID NO: 198041 - DNA, 20 bp, Artificial sequence
  SiRNA target sequence
gtattaaaattacagatgca

SEQ ID NO: 198042 - DNA, 20 bp, Artificial sequence
  SiRNA target sequence
tattaaaattacagatgcaa

SEQ ID NO: 198043 - DNA, 20 bp, Artificial sequence
  SiRNA target sequence
attaaaattacagatgcaaa

SEQ ID NO: 198044 - DNA, 20 bp, Artificial sequence
  SiRNA target sequence
ttaaaattacagatgcaaaa

SEQ ID NO: 198045 - DNA, 20 bp, Artificial sequence
  SiRNA target sequence
taaaattacagatgcaaaag

SEQ ID NO: 198046 - DNA, 20 bp, Artificial sequence
  SiRNA target sequence
aaaattacagatgcaaaaga

SEQ ID NO: 198047 - DNA, 20 bp, Artificial sequence
  SiRNA target sequence
aaattacagatgcaaaagat

SEQ ID NO: 198048 - DNA, 20 bp, Artificial sequence
  SiRNA target sequence
aattacagatgcaaaagata

SEQ ID NO: 198049 - DNA, 20 bp, Artificial sequence
  SiRNA target sequence
attacagatgcaaaagatat

SEQ ID NO: 198050 - DNA, 20 bp, Artificial sequence
  SiRNA target sequence
ttacagatgcaaaagatata

SEQ ID NO: 198051 - DNA, 20 bp, Artificial sequence
  SiRNA target sequence
tacagatgcaaaagatatag

SEQ ID NO: 198052 - DNA, 20 bp, Artificial sequence
  SiRNA target sequence
acagatgcaaaagatatagg

SEQ ID NO: 198053 - DNA, 20 bp, Artificial sequence
  SiRNA target sequence
cagatgcaaaagatatagga

SEQ ID NO: 198054 - DNA, 20 bp, Artificial sequence
  SiRNA target sequence
agatgcaaaagatataggaa

SEQ ID NO: 198055 - DNA, 20 bp, Artificial sequence
  SiRNA target sequence
gatgcaaaagatataggaag

SEQ ID NO: 198056 - DNA, 20 bp, Artificial sequence
  SiRNA target sequence
atgcaaaagatataggaaga

SEQ ID NO: 198057 - DNA, 20 bp, Artificial sequence
  SiRNA target sequence
tgcaaaagatataggaagaa

SEQ ID NO: 198058 - DNA, 20 bp, Artificial sequence
  SiRNA target sequence
gcaaaagatataggaagaac

SEQ ID NO: 198059 - DNA, 20 bp, Artificial sequence
  SiRNA target sequence
caaaagatataggaagaaca

SEQ ID NO: 198060 - DNA, 20 bp, Artificial sequence
  SiRNA target sequence
aaaagatataggaagaacat

SEQ ID NO: 198061 - DNA, 20 bp, Artificial sequence
  SiRNA target sequence
aaagatataggaagaacata

SEQ ID NO: 198062 - DNA, 20 bp, Artificial sequence
  SiRNA target sequence
aagatataggaagaacataa

SEQ ID NO: 198063 - DNA, 20 bp, Artificial sequence
  SiRNA target sequence
agatataggaagaacataaa

SEQ ID NO: 198064 - DNA, 20 bp, Artificial sequence
  SiRNA target sequence
gatataggaagaacataaaa

SEQ ID NO: 198065 - DNA, 20 bp, Artificial sequence
  SiRNA target sequence
atataggaagaacataaaaa

SEQ ID NO: 198066 - DNA, 20 bp, Artificial sequence
  SiRNA target sequence
tataggaagaacataaaaaa

SEQ ID NO: 198067 - DNA, 20 bp, Artificial sequence
  SiRNA target sequence
ataggaagaacataaaaaat

SEQ ID NO: 198068 - DNA, 20 bp, Artificial sequence
  SiRNA target sequence
taggaagaacataaaaaatt

SEQ ID NO: 198069 - DNA, 20 bp, Artificial sequence
  SiRNA target sequence
aggaagaacataaaaaattt

SEQ ID NO: 198070 - DNA, 20 bp, Artificial sequence
  SiRNA target sequence
ggaagaacataaaaaatttt

SEQ ID NO: 198071 - DNA, 20 bp, Artificial sequence
  SiRNA target sequence
gaagaacataaaaaattttc

SEQ ID NO: 198072 - DNA, 20 bp, Artificial sequence
  SiRNA target sequence
aagaacataaaaaattttca

SEQ ID NO: 198073 - DNA, 20 bp, Artificial sequence
  SiRNA target sequence
agaacataaaaaattttcat

SEQ ID NO: 198074 - DNA, 20 bp, Artificial sequence
  SiRNA target sequence
gaacataaaaaattttcata

SEQ ID NO: 198075 - DNA, 20 bp, Artificial sequence
  SiRNA target sequence
aacataaaaaattttcataa

SEQ ID NO: 198076 - DNA, 20 bp, Artificial sequence
  SiRNA target sequence
acataaaaaattttcataaa

SEQ ID NO: 198077 - DNA, 20 bp, Artificial sequence
  SiRNA target sequence
cataaaaaattttcataaac

SEQ ID NO: 198078 - DNA, 20 bp, Artificial sequence
  SiRNA target sequence
ataaaaaattttcataaaca

SEQ ID NO: 198079 - DNA, 20 bp, Artificial sequence
  SiRNA target sequence
taaaaaattttcataaacat

SEQ ID NO: 198080 - DNA, 20 bp, Artificial sequence
  SiRNA target sequence
aaaaaattttcataaacata

SEQ ID NO: 198081 - DNA, 20 bp, Artificial sequence
  SiRNA target sequence
aaaaattttcataaacataa

SEQ ID NO: 198082 - DNA, 20 bp, Artificial sequence
  SiRNA target sequence
aaaattttcataaacataat

SEQ ID NO: 198083 - DNA, 20 bp, Artificial sequence
  SiRNA target sequence
aaattttcataaacataatt

SEQ ID NO: 198084 - DNA, 20 bp, Artificial sequence
  SiRNA target sequence
aattttcataaacataattg

SEQ ID NO: 198085 - DNA, 20 bp, Artificial sequence
  SiRNA target sequence
attttcataaacataattga

SEQ ID NO: 198086 - DNA, 20 bp, Artificial sequence
  SiRNA target sequence
ttttcataaacataattgaa

SEQ ID NO: 198087 - DNA, 20 bp, Artificial sequence
  SiRNA target sequence
tttcataaacataattgaat

SEQ ID NO: 198088 - DNA, 20 bp, Artificial sequence
  SiRNA target sequence
ttcataaacataattgaatt

SEQ ID NO: 198089 - DNA, 20 bp, Artificial sequence
  SiRNA target sequence
tcataaacataattgaattc

SEQ ID NO: 198090 - DNA, 20 bp, Artificial sequence
  SiRNA target sequence
cataaacataattgaattct

SEQ ID NO: 198091 - DNA, 20 bp, Artificial sequence
  SiRNA target sequence
ataaacataattgaattctg

SEQ ID NO: 198092 - DNA, 20 bp, Artificial sequence
  SiRNA target sequence
taaacataattgaattctga

SEQ ID NO: 198093 - DNA, 20 bp, Artificial sequence
  SiRNA target sequence
aaacataattgaattctgat

SEQ ID NO: 198094 - DNA, 20 bp, Artificial sequence
  SiRNA target sequence
aacataattgaattctgatc

SEQ ID NO: 198095 - DNA, 20 bp, Artificial sequence
  SiRNA target sequence
acataattgaattctgatct

SEQ ID NO: 198096 - DNA, 20 bp, Artificial sequence
  SiRNA target sequence
cataattgaattctgatctt

SEQ ID NO: 198097 - DNA, 20 bp, Artificial sequence
  SiRNA target sequence
ataattgaattctgatcttg

SEQ ID NO: 198098 - DNA, 20 bp, Artificial sequence
  SiRNA target sequence
taattgaattctgatcttgc

SEQ ID NO: 198099 - DNA, 20 bp, Artificial sequence
  SiRNA target sequence
aattgaattctgatcttgcc

SEQ ID NO: 198100 - DNA, 20 bp, Artificial sequence
  SiRNA target sequence
attgaattctgatcttgcct

SEQ ID NO: 198101 - DNA, 20 bp, Artificial sequence
  SiRNA target sequence
ttgaattctgatcttgcctt

SEQ ID NO: 198102 - DNA, 20 bp, Artificial sequence
  SiRNA target sequence
tgaattctgatcttgcctta

SEQ ID NO: 198103 - DNA, 20 bp, Artificial sequence
  SiRNA target sequence
gaattctgatcttgccttac

SEQ ID NO: 198104 - DNA, 20 bp, Artificial sequence
  SiRNA target sequence
aattctgatcttgccttacc

SEQ ID NO: 198105 - DNA, 20 bp, Artificial sequence
  SiRNA target sequence
attctgatcttgccttacca

SEQ ID NO: 198106 - DNA, 20 bp, Artificial sequence
  SiRNA target sequence
ttctgatcttgccttaccat

SEQ ID NO: 198107 - DNA, 20 bp, Artificial sequence
  SiRNA target sequence
tctgatcttgccttaccatc

SEQ ID NO: 198108 - DNA, 20 bp, Artificial sequence
  SiRNA target sequence
ctgatcttgccttaccatca

SEQ ID NO: 198109 - DNA, 20 bp, Artificial sequence
  SiRNA target sequence
tgatcttgccttaccatcac

SEQ ID NO: 198110 - DNA, 20 bp, Artificial sequence
  SiRNA target sequence
gatcttgccttaccatcaca

SEQ ID NO: 198111 - DNA, 20 bp, Artificial sequence
  SiRNA target sequence
atcttgccttaccatcacaa

SEQ ID NO: 198112 - DNA, 20 bp, Artificial sequence
  SiRNA target sequence
tcttgccttaccatcacaaa

SEQ ID NO: 198113 - DNA, 20 bp, Artificial sequence
  SiRNA target sequence
cttgccttaccatcacaaat

SEQ ID NO: 198114 - DNA, 20 bp, Artificial sequence
  SiRNA target sequence
ttgccttaccatcacaaata

SEQ ID NO: 198115 - DNA, 20 bp, Artificial sequence
  SiRNA target sequence
tgccttaccatcacaaataa

SEQ ID NO: 198116 - DNA, 20 bp, Artificial sequence
  SiRNA target sequence
gccttaccatcacaaataaa

SEQ ID NO: 198117 - DNA, 20 bp, Artificial sequence
  SiRNA target sequence
ccttaccatcacaaataaat

SEQ ID NO: 198118 - DNA, 20 bp, Artificial sequence
  SiRNA target sequence
cttaccatcacaaataaatc

SEQ ID NO: 198119 - DNA, 20 bp, Artificial sequence
  SiRNA target sequence
ttaccatcacaaataaatct

SEQ ID NO: 198120 - DNA, 20 bp, Artificial sequence
  SiRNA target sequence
taccatcacaaataaatctt

SEQ ID NO: 198121 - DNA, 20 bp, Artificial sequence
  SiRNA target sequence
accatcacaaataaatcttt

SEQ ID NO: 198122 - DNA, 20 bp, Artificial sequence
  SiRNA target sequence
ccatcacaaataaatctttt

SEQ ID NO: 198123 - DNA, 20 bp, Artificial sequence
  SiRNA target sequence
catcacaaataaatctttta

SEQ ID NO: 198124 - DNA, 20 bp, Artificial sequence
  SiRNA target sequence
atcacaaataaatcttttaa

SEQ ID NO: 198125 - DNA, 20 bp, Artificial sequence
  SiRNA target sequence
tcacaaataaatcttttaaa

SEQ ID NO: 198126 - DNA, 20 bp, Artificial sequence
  SiRNA target sequence
cacaaataaatcttttaaaa

SEQ ID NO: 198127 - DNA, 20 bp, Artificial sequence
  SiRNA target sequence
acaaataaatcttttaaaat

SEQ ID NO: 198128 - DNA, 20 bp, Artificial sequence
  SiRNA target sequence
caaataaatcttttaaaatt

SEQ ID NO: 198129 - DNA, 20 bp, Artificial sequence
  SiRNA target sequence
aaataaatcttttaaaattc

SEQ ID NO: 198130 - DNA, 20 bp, Artificial sequence
  SiRNA target sequence
aataaatcttttaaaattct

SEQ ID NO: 198131 - DNA, 20 bp, Artificial sequence
  SiRNA target sequence
ataaatcttttaaaattctt

SEQ ID NO: 198132 - DNA, 20 bp, Artificial sequence
  SiRNA target sequence
taaatcttttaaaattctta

SEQ ID NO: 198133 - DNA, 20 bp, Artificial sequence
  SiRNA target sequence
aaatcttttaaaattcttaa

SEQ ID NO: 198134 - DNA, 20 bp, Artificial sequence
  SiRNA target sequence
aatcttttaaaattcttaaa

SEQ ID NO: 198135 - DNA, 20 bp, Artificial sequence
  SiRNA target sequence
atcttttaaaattcttaaaa

SEQ ID NO: 198136 - DNA, 20 bp, Artificial sequence
  SiRNA target sequence
tcttttaaaattcttaaaaa

SEQ ID NO: 198137 - DNA, 20 bp, Artificial sequence
  SiRNA target sequence
cttttaaaattcttaaaaat

SEQ ID NO: 198138 - DNA, 20 bp, Artificial sequence
  SiRNA target sequence
ttttaaaattcttaaaaatg

SEQ ID NO: 198139 - DNA, 20 bp, Artificial sequence
  SiRNA target sequence
tttaaaattcttaaaaatga

SEQ ID NO: 198140 - DNA, 20 bp, Artificial sequence
  SiRNA target sequence
ttaaaattcttaaaaatgaa

SEQ ID NO: 198141 - DNA, 20 bp, Artificial sequence
  SiRNA target sequence
taaaattcttaaaaatgaat

SEQ ID NO: 198142 - DNA, 20 bp, Artificial sequence
  SiRNA target sequence
aaaattcttaaaaatgaata

SEQ ID NO: 198143 - DNA, 20 bp, Artificial sequence
  SiRNA target sequence
aaattcttaaaaatgaatac

SEQ ID NO: 198144 - DNA, 20 bp, Artificial sequence
  SiRNA target sequence
aattcttaaaaatgaataca

SEQ ID NO: 198145 - DNA, 20 bp, Artificial sequence
  SiRNA target sequence
attcttaaaaatgaatacac

SEQ ID NO: 198146 - DNA, 20 bp, Artificial sequence
  SiRNA target sequence
ttcttaaaaatgaatacaca

SEQ ID NO: 198147 - DNA, 20 bp, Artificial sequence
  SiRNA target sequence
tcttaaaaatgaatacacaa

SEQ ID NO: 198148 - DNA, 20 bp, Artificial sequence
  SiRNA target sequence
cttaaaaatgaatacacaaa

SEQ ID NO: 198149 - DNA, 20 bp, Artificial sequence
  SiRNA target sequence
ttaaaaatgaatacacaaag

SEQ ID NO: 198150 - DNA, 20 bp, Artificial sequence
  SiRNA target sequence
taaaaatgaatacacaaagt

SEQ ID NO: 198151 - DNA, 20 bp, Artificial sequence
  SiRNA target sequence
aaaaatgaatacacaaagtt

SEQ ID NO: 198152 - DNA, 20 bp, Artificial sequence
  SiRNA target sequence
aaaatgaatacacaaagtta

SEQ ID NO: 198153 - DNA, 20 bp, Artificial sequence
  SiRNA target sequence
aaatgaatacacaaagttaa

SEQ ID NO: 198154 - DNA, 20 bp, Artificial sequence
  SiRNA target sequence
aatgaatacacaaagttaat

SEQ ID NO: 198155 - DNA, 20 bp, Artificial sequence
  SiRNA target sequence
atgaatacacaaagttaatt

SEQ ID NO: 198156 - DNA, 20 bp, Artificial sequence
  SiRNA target sequence
tgaatacacaaagttaatta

SEQ ID NO: 198157 - DNA, 20 bp, Artificial sequence
  SiRNA target sequence
gaatacacaaagttaattaa

SEQ ID NO: 198158 - DNA, 20 bp, Artificial sequence
  SiRNA target sequence
aatacacaaagttaattaat

SEQ ID NO: 198159 - DNA, 20 bp, Artificial sequence
  SiRNA target sequence
atacacaaagttaattaatc

SEQ ID NO: 198160 - DNA, 20 bp, Artificial sequence
  SiRNA target sequence
tacacaaagttaattaatcc

SEQ ID NO: 198161 - DNA, 20 bp, Artificial sequence
  SiRNA target sequence
acacaaagttaattaatcca

SEQ ID NO: 198162 - DNA, 20 bp, Artificial sequence
  SiRNA target sequence
cacaaagttaattaatccaa

SEQ ID NO: 198163 - DNA, 20 bp, Artificial sequence
  SiRNA target sequence
acaaagttaattaatccaaa

SEQ ID NO: 198164 - DNA, 20 bp, Artificial sequence
  SiRNA target sequence
caaagttaattaatccaaac

SEQ ID NO: 198165 - DNA, 20 bp, Artificial sequence
  SiRNA target sequence
aaagttaattaatccaaaca

SEQ ID NO: 198166 - DNA, 20 bp, Artificial sequence
  SiRNA target sequence
aagttaattaatccaaacat

SEQ ID NO: 198167 - DNA, 20 bp, Artificial sequence
  SiRNA target sequence
agttaattaatccaaacata

SEQ ID NO: 198168 - DNA, 20 bp, Artificial sequence
  SiRNA target sequence
gttaattaatccaaacataa

SEQ ID NO: 198169 - DNA, 20 bp, Artificial sequence
  SiRNA target sequence
ttaattaatccaaacataat

SEQ ID NO: 198170 - DNA, 20 bp, Artificial sequence
  SiRNA target sequence
taattaatccaaacataata

SEQ ID NO: 198171 - DNA, 20 bp, Artificial sequence
  SiRNA target sequence
aattaatccaaacataatac

SEQ ID NO: 198172 - DNA, 20 bp, Artificial sequence
  SiRNA target sequence
attaatccaaacataatacc

SEQ ID NO: 198173 - DNA, 20 bp, Artificial sequence
  SiRNA target sequence
ttaatccaaacataatacca

SEQ ID NO: 198174 - DNA, 20 bp, Artificial sequence
  SiRNA target sequence
taatccaaacataataccaa

SEQ ID NO: 198175 - DNA, 20 bp, Artificial sequence
  SiRNA target sequence
aatccaaacataataccaag

SEQ ID NO: 198176 - DNA, 20 bp, Artificial sequence
  SiRNA target sequence
atccaaacataataccaagt

SEQ ID NO: 198177 - DNA, 20 bp, Artificial sequence
  SiRNA target sequence
tccaaacataataccaagta

SEQ ID NO: 198178 - DNA, 20 bp, Artificial sequence
  SiRNA target sequence
ccaaacataataccaagtat

SEQ ID NO: 198179 - DNA, 20 bp, Artificial sequence
  SiRNA target sequence
caaacataataccaagtata

SEQ ID NO: 198180 - DNA, 20 bp, Artificial sequence
  SiRNA target sequence
aaacataataccaagtataa

SEQ ID NO: 198181 - DNA, 20 bp, Artificial sequence
  SiRNA target sequence
aacataataccaagtataaa

SEQ ID NO: 198182 - DNA, 20 bp, Artificial sequence
  SiRNA target sequence
acataataccaagtataaaa

SEQ ID NO: 198183 - DNA, 20 bp, Artificial sequence
  SiRNA target sequence
cataataccaagtataaaaa

SEQ ID NO: 198184 - DNA, 20 bp, Artificial sequence
  SiRNA target sequence
ataataccaagtataaaaaa

SEQ ID NO: 198185 - DNA, 20 bp, Artificial sequence
  SiRNA target sequence
taataccaagtataaaaaat

SEQ ID NO: 198186 - DNA, 20 bp, Artificial sequence
  SiRNA target sequence
aataccaagtataaaaaatt

SEQ ID NO: 198187 - DNA, 20 bp, Artificial sequence
  SiRNA target sequence
ataccaagtataaaaaattt

SEQ ID NO: 198188 - DNA, 20 bp, Artificial sequence
  SiRNA target sequence
taccaagtataaaaaattta

SEQ ID NO: 198189 - DNA, 20 bp, Artificial sequence
  SiRNA target sequence
accaagtataaaaaatttag

SEQ ID NO: 198190 - DNA, 20 bp, Artificial sequence
  SiRNA target sequence
ccaagtataaaaaatttagg

SEQ ID NO: 198191 - DNA, 20 bp, Artificial sequence
  SiRNA target sequence
caagtataaaaaatttaggc

SEQ ID NO: 198192 - DNA, 20 bp, Artificial sequence
  SiRNA target sequence
aagtataaaaaatttaggca

SEQ ID NO: 198193 - DNA, 20 bp, Artificial sequence
  SiRNA target sequence
agtataaaaaatttaggcat

SEQ ID NO: 198194 - DNA, 20 bp, Artificial sequence
  SiRNA target sequence
gtataaaaaatttaggcatt

SEQ ID NO: 198195 - DNA, 20 bp, Artificial sequence
  SiRNA target sequence
tataaaaaatttaggcattt

SEQ ID NO: 198196 - DNA, 20 bp, Artificial sequence
  SiRNA target sequence
ataaaaaatttaggcatttc

SEQ ID NO: 198197 - DNA, 20 bp, Artificial sequence
  SiRNA target sequence
taaaaaatttaggcatttca

SEQ ID NO: 198198 - DNA, 20 bp, Artificial sequence
  SiRNA target sequence
aaaaaatttaggcatttcaa

SEQ ID NO: 198199 - DNA, 20 bp, Artificial sequence
  SiRNA target sequence
aaaaatttaggcatttcaac

SEQ ID NO: 198200 - DNA, 20 bp, Artificial sequence
  SiRNA target sequence
aaaatttaggcatttcaacc

SEQ ID NO: 198201 - DNA, 20 bp, Artificial sequence
  SiRNA target sequence
aaatttaggcatttcaacct

SEQ ID NO: 198202 - DNA, 20 bp, Artificial sequence
  SiRNA target sequence
aatttaggcatttcaacctt

SEQ ID NO: 198203 - DNA, 20 bp, Artificial sequence
  SiRNA target sequence
atttaggcatttcaacctta

SEQ ID NO: 198204 - DNA, 20 bp, Artificial sequence
  SiRNA target sequence
tttaggcatttcaaccttag

SEQ ID NO: 198205 - DNA, 20 bp, Artificial sequence
  SiRNA target sequence
ttaggcatttcaaccttagc

SEQ ID NO: 198206 - DNA, 20 bp, Artificial sequence
  SiRNA target sequence
taggcatttcaaccttagca

SEQ ID NO: 198207 - DNA, 20 bp, Artificial sequence
  SiRNA target sequence
aggcatttcaaccttagcaa

SEQ ID NO: 198208 - DNA, 20 bp, Artificial sequence
  SiRNA target sequence
ggcatttcaaccttagcaac

SEQ ID NO: 198209 - DNA, 20 bp, Artificial sequence
  SiRNA target sequence
gcatttcaaccttagcaact

SEQ ID NO: 198210 - DNA, 20 bp, Artificial sequence
  SiRNA target sequence
catttcaaccttagcaactt

SEQ ID NO: 198211 - DNA, 20 bp, Artificial sequence
  SiRNA target sequence
atttcaaccttagcaacttt

SEQ ID NO: 198212 - DNA, 20 bp, Artificial sequence
  SiRNA target sequence
tttcaaccttagcaacttta

SEQ ID NO: 198213 - DNA, 20 bp, Artificial sequence
  SiRNA target sequence
ttcaaccttagcaactttaa

SEQ ID NO: 198214 - DNA, 20 bp, Artificial sequence
  SiRNA target sequence
tcaaccttagcaactttaaa

SEQ ID NO: 198215 - DNA, 20 bp, Artificial sequence
  SiRNA target sequence
caaccttagcaactttaaaa

SEQ ID NO: 198216 - DNA, 20 bp, Artificial sequence
  SiRNA target sequence
aaccttagcaactttaaaat

SEQ ID NO: 198217 - DNA, 20 bp, Artificial sequence
  SiRNA target sequence
accttagcaactttaaaata

SEQ ID NO: 198218 - DNA, 20 bp, Artificial sequence
  SiRNA target sequence
ccttagcaactttaaaataa

SEQ ID NO: 198219 - DNA, 20 bp, Artificial sequence
  SiRNA target sequence
cttagcaactttaaaataac

SEQ ID NO: 198220 - DNA, 20 bp, Artificial sequence
  SiRNA target sequence
ttagcaactttaaaataact

SEQ ID NO: 198221 - DNA, 20 bp, Artificial sequence
  SiRNA target sequence
tagcaactttaaaataactc

SEQ ID NO: 198222 - DNA, 20 bp, Artificial sequence
  SiRNA target sequence
agcaactttaaaataactca

SEQ ID NO: 198223 - DNA, 20 bp, Artificial sequence
  SiRNA target sequence
gcaactttaaaataactcag

SEQ ID NO: 198224 - DNA, 20 bp, Artificial sequence
  SiRNA target sequence
caactttaaaataactcagt

SEQ ID NO: 198225 - DNA, 20 bp, Artificial sequence
  SiRNA target sequence
aactttaaaataactcagta

SEQ ID NO: 198226 - DNA, 20 bp, Artificial sequence
  SiRNA target sequence
actttaaaataactcagtaa

SEQ ID NO: 198227 - DNA, 20 bp, Artificial sequence
  SiRNA target sequence
ctttaaaataactcagtaat

SEQ ID NO: 198228 - DNA, 20 bp, Artificial sequence
  SiRNA target sequence
tttaaaataactcagtaatc

SEQ ID NO: 198229 - DNA, 20 bp, Artificial sequence
  SiRNA target sequence
ttaaaataactcagtaatcc

SEQ ID NO: 198230 - DNA, 20 bp, Artificial sequence
  SiRNA target sequence
taaaataactcagtaatcct

SEQ ID NO: 198231 - DNA, 20 bp, Artificial sequence
  SiRNA target sequence
aaaataactcagtaatcctg

SEQ ID NO: 198232 - DNA, 20 bp, Artificial sequence
  SiRNA target sequence
aaataactcagtaatcctgt

SEQ ID NO: 198233 - DNA, 20 bp, Artificial sequence
  SiRNA target sequence
aataactcagtaatcctgtt

SEQ ID NO: 198234 - DNA, 20 bp, Artificial sequence
  SiRNA target sequence
ataactcagtaatcctgttc

SEQ ID NO: 198235 - DNA, 20 bp, Artificial sequence
  SiRNA target sequence
taactcagtaatcctgttct

SEQ ID NO: 198236 - DNA, 20 bp, Artificial sequence
  SiRNA target sequence
aactcagtaatcctgttctt

SEQ ID NO: 198237 - DNA, 20 bp, Artificial sequence
  SiRNA target sequence
actcagtaatcctgttcttg

SEQ ID NO: 198238 - DNA, 20 bp, Artificial sequence
  SiRNA target sequence
ctcagtaatcctgttcttga

SEQ ID NO: 198239 - DNA, 20 bp, Artificial sequence
  SiRNA target sequence
tcagtaatcctgttcttgaa

SEQ ID NO: 198240 - DNA, 20 bp, Artificial sequence
  SiRNA target sequence
cagtaatcctgttcttgaat

SEQ ID NO: 198241 - DNA, 20 bp, Artificial sequence
  SiRNA target sequence
agtaatcctgttcttgaatt

SEQ ID NO: 198242 - DNA, 20 bp, Artificial sequence
  SiRNA target sequence
gtaatcctgttcttgaattt

SEQ ID NO: 198243 - DNA, 20 bp, Artificial sequence
  SiRNA target sequence
taatcctgttcttgaatttg

SEQ ID NO: 198244 - DNA, 20 bp, Artificial sequence
  SiRNA target sequence
aatcctgttcttgaatttgc

SEQ ID NO: 198245 - DNA, 20 bp, Artificial sequence
  SiRNA target sequence
atcctgttcttgaatttgct

SEQ ID NO: 198246 - DNA, 20 bp, Artificial sequence
  SiRNA target sequence
tcctgttcttgaatttgcta

SEQ ID NO: 198247 - DNA, 20 bp, Artificial sequence
  SiRNA target sequence
cctgttcttgaatttgctaa

SEQ ID NO: 198248 - DNA, 20 bp, Artificial sequence
  SiRNA target sequence
ctgttcttgaatttgctaat

SEQ ID NO: 198249 - DNA, 20 bp, Artificial sequence
  SiRNA target sequence
tgttcttgaatttgctaatt

SEQ ID NO: 198250 - DNA, 20 bp, Artificial sequence
  SiRNA target sequence
gttcttgaatttgctaattg

SEQ ID NO: 198251 - DNA, 20 bp, Artificial sequence
  SiRNA target sequence
ttcttgaatttgctaattga

SEQ ID NO: 198252 - DNA, 20 bp, Artificial sequence
  SiRNA target sequence
tcttgaatttgctaattgat

SEQ ID NO: 198253 - DNA, 20 bp, Artificial sequence
  SiRNA target sequence
cttgaatttgctaattgatc

SEQ ID NO: 198254 - DNA, 20 bp, Artificial sequence
  SiRNA target sequence
ttgaatttgctaattgatca

SEQ ID NO: 198255 - DNA, 20 bp, Artificial sequence
  SiRNA target sequence
tgaatttgctaattgatcaa

SEQ ID NO: 198256 - DNA, 20 bp, Artificial sequence
  SiRNA target sequence
gaatttgctaattgatcaat

SEQ ID NO: 198257 - DNA, 20 bp, Artificial sequence
  SiRNA target sequence
aatttgctaattgatcaatc

SEQ ID NO: 198258 - DNA, 20 bp, Artificial sequence
  SiRNA target sequence
atttgctaattgatcaatct

SEQ ID NO: 198259 - DNA, 20 bp, Artificial sequence
  SiRNA target sequence
tttgctaattgatcaatctc

SEQ ID NO: 198260 - DNA, 20 bp, Artificial sequence
  SiRNA target sequence
ttgctaattgatcaatctca

SEQ ID NO: 198261 - DNA, 20 bp, Artificial sequence
  SiRNA target sequence
tgctaattgatcaatctcat

SEQ ID NO: 198262 - DNA, 20 bp, Artificial sequence
  SiRNA target sequence
gctaattgatcaatctcatc

SEQ ID NO: 198263 - DNA, 20 bp, Artificial sequence
  SiRNA target sequence
ctaattgatcaatctcatct

SEQ ID NO: 198264 - DNA, 20 bp, Artificial sequence
  SiRNA target sequence
taattgatcaatctcatctt

SEQ ID NO: 198265 - DNA, 20 bp, Artificial sequence
  SiRNA target sequence
aattgatcaatctcatcttc

SEQ ID NO: 198266 - DNA, 20 bp, Artificial sequence
  SiRNA target sequence
attgatcaatctcatcttcc

SEQ ID NO: 198267 - DNA, 20 bp, Artificial sequence
  SiRNA target sequence
ttgatcaatctcatcttccg

SEQ ID NO: 198268 - DNA, 20 bp, Artificial sequence
  SiRNA target sequence
tgatcaatctcatcttccgt

SEQ ID NO: 198269 - DNA, 20 bp, Artificial sequence
  SiRNA target sequence
gatcaatctcatcttccgta

SEQ ID NO: 198270 - DNA, 20 bp, Artificial sequence
  SiRNA target sequence
atcaatctcatcttccgtag

SEQ ID NO: 198271 - DNA, 20 bp, Artificial sequence
  SiRNA target sequence
tcaatctcatcttccgtagg

SEQ ID NO: 198272 - DNA, 20 bp, Artificial sequence
  SiRNA target sequence
caatctcatcttccgtaggt

SEQ ID NO: 198273 - DNA, 20 bp, Artificial sequence
  SiRNA target sequence
aatctcatcttccgtaggta

SEQ ID NO: 198274 - DNA, 20 bp, Artificial sequence
  SiRNA target sequence
atctcatcttccgtaggtaa

SEQ ID NO: 198275 - DNA, 20 bp, Artificial sequence
  SiRNA target sequence
tctcatcttccgtaggtaag

SEQ ID NO: 198276 - DNA, 20 bp, Artificial sequence
  SiRNA target sequence
ctcatcttccgtaggtaagt

SEQ ID NO: 198277 - DNA, 20 bp, Artificial sequence
  SiRNA target sequence
tcatcttccgtaggtaagtt

SEQ ID NO: 198278 - DNA, 20 bp, Artificial sequence
  SiRNA target sequence
catcttccgtaggtaagttg

SEQ ID NO: 198279 - DNA, 20 bp, Artificial sequence
  SiRNA target sequence
atcttccgtaggtaagttgt

SEQ ID NO: 198280 - DNA, 20 bp, Artificial sequence
  SiRNA target sequence
tcttccgtaggtaagttgtt

SEQ ID NO: 198281 - DNA, 20 bp, Artificial sequence
  SiRNA target sequence
cttccgtaggtaagttgttt

SEQ ID NO: 198282 - DNA, 20 bp, Artificial sequence
  SiRNA target sequence
ttccgtaggtaagttgtttt

SEQ ID NO: 198283 - DNA, 20 bp, Artificial sequence
  SiRNA target sequence
tccgtaggtaagttgttttc

SEQ ID NO: 198284 - DNA, 20 bp, Artificial sequence
  SiRNA target sequence
ccgtaggtaagttgttttca

SEQ ID NO: 198285 - DNA, 20 bp, Artificial sequence
  SiRNA target sequence
cgtaggtaagttgttttcag

SEQ ID NO: 198286 - DNA, 20 bp, Artificial sequence
  SiRNA target sequence
gtaggtaagttgttttcagg

SEQ ID NO: 198287 - DNA, 20 bp, Artificial sequence
  SiRNA target sequence
taggtaagttgttttcaggt

SEQ ID NO: 198288 - DNA, 20 bp, Artificial sequence
  SiRNA target sequence
aggtaagttgttttcaggtg

SEQ ID NO: 198289 - DNA, 20 bp, Artificial sequence
  SiRNA target sequence
ggtaagttgttttcaggtgt

SEQ ID NO: 198290 - DNA, 20 bp, Artificial sequence
  SiRNA target sequence
gtaagttgttttcaggtgtt

SEQ ID NO: 198291 - DNA, 20 bp, Artificial sequence
  SiRNA target sequence
taagttgttttcaggtgttt

SEQ ID NO: 198292 - DNA, 20 bp, Artificial sequence
  SiRNA target sequence
aagttgttttcaggtgtttc

SEQ ID NO: 198293 - DNA, 20 bp, Artificial sequence
  SiRNA target sequence
agttgttttcaggtgtttca

SEQ ID NO: 198294 - DNA, 20 bp, Artificial sequence
  SiRNA target sequence
gttgttttcaggtgtttcat

SEQ ID NO: 198295 - DNA, 20 bp, Artificial sequence
  SiRNA target sequence
ttgttttcaggtgtttcatt

SEQ ID NO: 198296 - DNA, 20 bp, Artificial sequence
  SiRNA target sequence
tgttttcaggtgtttcattt

SEQ ID NO: 198297 - DNA, 20 bp, Artificial sequence
  SiRNA target sequence
gttttcaggtgtttcattta

SEQ ID NO: 198298 - DNA, 20 bp, Artificial sequence
  SiRNA target sequence
ttttcaggtgtttcatttat

SEQ ID NO: 198299 - DNA, 20 bp, Artificial sequence
  SiRNA target sequence
tttcaggtgtttcatttatt

SEQ ID NO: 198300 - DNA, 20 bp, Artificial sequence
  SiRNA target sequence
ttcaggtgtttcatttatta

SEQ ID NO: 198301 - DNA, 20 bp, Artificial sequence
  SiRNA target sequence
tcaggtgtttcatttattac

SEQ ID NO: 198302 - DNA, 20 bp, Artificial sequence
  SiRNA target sequence
caggtgtttcatttattaca

SEQ ID NO: 198303 - DNA, 20 bp, Artificial sequence
  SiRNA target sequence
aggtgtttcatttattacac

SEQ ID NO: 198304 - DNA, 20 bp, Artificial sequence
  SiRNA target sequence
ggtgtttcatttattacact

SEQ ID NO: 198305 - DNA, 20 bp, Artificial sequence
  SiRNA target sequence
gtgtttcatttattacactc

SEQ ID NO: 198306 - DNA, 20 bp, Artificial sequence
  SiRNA target sequence
tgtttcatttattacactca

SEQ ID NO: 198307 - DNA, 20 bp, Artificial sequence
  SiRNA target sequence
gtttcatttattacactcat

SEQ ID NO: 198308 - DNA, 21 bp, Artificial sequence
  SiRNA target sequence
ttattctgcgttttctttttt

SEQ ID NO: 198309 - DNA, 21 bp, Artificial sequence
  SiRNA target sequence
tattctgcgttttcttttttg

SEQ ID NO: 198310 - DNA, 21 bp, Artificial sequence
  SiRNA target sequence
attctgcgttttcttttttgt

SEQ ID NO: 198311 - DNA, 21 bp, Artificial sequence
  SiRNA target sequence
ttctgcgttttcttttttgtc

SEQ ID NO: 198312 - DNA, 21 bp, Artificial sequence
  SiRNA target sequence
tctgcgttttcttttttgtcg

SEQ ID NO: 198313 - DNA, 21 bp, Artificial sequence
  SiRNA target sequence
ctgcgttttcttttttgtcgt

SEQ ID NO: 198314 - DNA, 21 bp, Artificial sequence
  SiRNA target sequence
tgcgttttcttttttgtcgtc

SEQ ID NO: 198315 - DNA, 21 bp, Artificial sequence
  SiRNA target sequence
gcgttttcttttttgtcgtct

SEQ ID NO: 198316 - DNA, 21 bp, Artificial sequence
  SiRNA target sequence
cgttttcttttttgtcgtctt

SEQ ID NO: 198317 - DNA, 21 bp, Artificial sequence
  SiRNA target sequence
gttttcttttttgtcgtcttt

SEQ ID NO: 198318 - DNA, 21 bp, Artificial sequence
  SiRNA target sequence
ttttcttttttgtcgtctttt

SEQ ID NO: 198319 - DNA, 21 bp, Artificial sequence
  SiRNA target sequence
tttcttttttgtcgtctttta

SEQ ID NO: 198320 - DNA, 21 bp, Artificial sequence
  SiRNA target sequence
ttcttttttgtcgtcttttat

SEQ ID NO: 198321 - DNA, 21 bp, Artificial sequence
  SiRNA target sequence
tcttttttgtcgtcttttatt

SEQ ID NO: 198322 - DNA, 21 bp, Artificial sequence
  SiRNA target sequence
cttttttgtcgtcttttatta

SEQ ID NO: 198323 - DNA, 21 bp, Artificial sequence
  SiRNA target sequence
ttttttgtcgtcttttattaa

SEQ ID NO: 198324 - DNA, 21 bp, Artificial sequence
  SiRNA target sequence
tttttgtcgtcttttattaaa

SEQ ID NO: 198325 - DNA, 21 bp, Artificial sequence
  SiRNA target sequence
ttttgtcgtcttttattaaat

SEQ ID NO: 198326 - DNA, 21 bp, Artificial sequence
  SiRNA target sequence
tttgtcgtcttttattaaatc

SEQ ID NO: 198327 - DNA, 21 bp, Artificial sequence
  SiRNA target sequence
ttgtcgtcttttattaaatct

SEQ ID NO: 198328 - DNA, 21 bp, Artificial sequence
  SiRNA target sequence
tgtcgtcttttattaaatcta

SEQ ID NO: 198329 - DNA, 21 bp, Artificial sequence
  SiRNA target sequence
gtcgtcttttattaaatctat

SEQ ID NO: 198330 - DNA, 21 bp, Artificial sequence
  SiRNA target sequence
tcgtcttttattaaatctatg

SEQ ID NO: 198331 - DNA, 21 bp, Artificial sequence
  SiRNA target sequence
cgtcttttattaaatctatgt

SEQ ID NO: 198332 - DNA, 21 bp, Artificial sequence
  SiRNA target sequence
gtcttttattaaatctatgtc

SEQ ID NO: 198333 - DNA, 21 bp, Artificial sequence
  SiRNA target sequence
tcttttattaaatctatgtct

SEQ ID NO: 198334 - DNA, 21 bp, Artificial sequence
  SiRNA target sequence
cttttattaaatctatgtcta

SEQ ID NO: 198335 - DNA, 21 bp, Artificial sequence
  SiRNA target sequence
ttttattaaatctatgtctac

SEQ ID NO: 198336 - DNA, 21 bp, Artificial sequence
  SiRNA target sequence
tttattaaatctatgtctaca

SEQ ID NO: 198337 - DNA, 21 bp, Artificial sequence
  SiRNA target sequence
ttattaaatctatgtctacac

SEQ ID NO: 198338 - DNA, 21 bp, Artificial sequence
  SiRNA target sequence
tattaaatctatgtctacact

SEQ ID NO: 198339 - DNA, 21 bp, Artificial sequence
  SiRNA target sequence
attaaatctatgtctacactt

SEQ ID NO: 198340 - DNA, 21 bp, Artificial sequence
  SiRNA target sequence
ttaaatctatgtctacacttg

SEQ ID NO: 198341 - DNA, 21 bp, Artificial sequence
  SiRNA target sequence
taaatctatgtctacacttgt

SEQ ID NO: 198342 - DNA, 21 bp, Artificial sequence
  SiRNA target sequence
aaatctatgtctacacttgta

SEQ ID NO: 198343 - DNA, 21 bp, Artificial sequence
  SiRNA target sequence
aatctatgtctacacttgtat

SEQ ID NO: 198344 - DNA, 21 bp, Artificial sequence
  SiRNA target sequence
atctatgtctacacttgtatt

SEQ ID NO: 198345 - DNA, 21 bp, Artificial sequence
  SiRNA target sequence
tctatgtctacacttgtatta

SEQ ID NO: 198346 - DNA, 21 bp, Artificial sequence
  SiRNA target sequence
ctatgtctacacttgtattat

SEQ ID NO: 198347 - DNA, 21 bp, Artificial sequence
  SiRNA target sequence
tatgtctacacttgtattatt

SEQ ID NO: 198348 - DNA, 21 bp, Artificial sequence
  SiRNA target sequence
atgtctacacttgtattattt

SEQ ID NO: 198349 - DNA, 21 bp, Artificial sequence
  SiRNA target sequence
tgtctacacttgtattatttt

SEQ ID NO: 198350 - DNA, 21 bp, Artificial sequence
  SiRNA target sequence
gtctacacttgtattattttt

SEQ ID NO: 198351 - DNA, 21 bp, Artificial sequence
  SiRNA target sequence
tctacacttgtattattttta

SEQ ID NO: 198352 - DNA, 21 bp, Artificial sequence
  SiRNA target sequence
ctacacttgtattatttttaa

SEQ ID NO: 198353 - DNA, 21 bp, Artificial sequence
  SiRNA target sequence
tacacttgtattatttttaat

SEQ ID NO: 198354 - DNA, 21 bp, Artificial sequence
  SiRNA target sequence
acacttgtattatttttaatt

SEQ ID NO: 198355 - DNA, 21 bp, Artificial sequence
  SiRNA target sequence
cacttgtattatttttaattg

SEQ ID NO: 198356 - DNA, 21 bp, Artificial sequence
  SiRNA target sequence
acttgtattatttttaattga

SEQ ID NO: 198357 - DNA, 21 bp, Artificial sequence
  SiRNA target sequence
cttgtattatttttaattgaa

SEQ ID NO: 198358 - DNA, 21 bp, Artificial sequence
  SiRNA target sequence
ttgtattatttttaattgaaa

SEQ ID NO: 198359 - DNA, 21 bp, Artificial sequence
  SiRNA target sequence
tgtattatttttaattgaaac

SEQ ID NO: 198360 - DNA, 21 bp, Artificial sequence
  SiRNA target sequence
gtattatttttaattgaaacg

SEQ ID NO: 198361 - DNA, 21 bp, Artificial sequence
  SiRNA target sequence
tattatttttaattgaaacgt

SEQ ID NO: 198362 - DNA, 21 bp, Artificial sequence
  SiRNA target sequence
attatttttaattgaaacgtt

SEQ ID NO: 198363 - DNA, 21 bp, Artificial sequence
  SiRNA target sequence
ttatttttaattgaaacgtta

SEQ ID NO: 198364 - DNA, 21 bp, Artificial sequence
  SiRNA target sequence
tatttttaattgaaacgttat

SEQ ID NO: 198365 - DNA, 21 bp, Artificial sequence
  SiRNA target sequence
atttttaattgaaacgttata

SEQ ID NO: 198366 - DNA, 21 bp, Artificial sequence
  SiRNA target sequence
tttttaattgaaacgttatat

SEQ ID NO: 198367 - DNA, 21 bp, Artificial sequence
  SiRNA target sequence
ttttaattgaaacgttatatg

SEQ ID NO: 198368 - DNA, 21 bp, Artificial sequence
  SiRNA target sequence
tttaattgaaacgttatatgc

SEQ ID NO: 198369 - DNA, 21 bp, Artificial sequence
  SiRNA target sequence
ttaattgaaacgttatatgca

SEQ ID NO: 198370 - DNA, 21 bp, Artificial sequence
  SiRNA target sequence
taattgaaacgttatatgcac

SEQ ID NO: 198371 - DNA, 21 bp, Artificial sequence
  SiRNA target sequence
aattgaaacgttatatgcacc

SEQ ID NO: 198372 - DNA, 21 bp, Artificial sequence
  SiRNA target sequence
attgaaacgttatatgcaccc

SEQ ID NO: 198373 - DNA, 21 bp, Artificial sequence
  SiRNA target sequence
ttgaaacgttatatgcacccg

SEQ ID NO: 198374 - DNA, 21 bp, Artificial sequence
  SiRNA target sequence
tgaaacgttatatgcacccgc

SEQ ID NO: 198375 - DNA, 21 bp, Artificial sequence
  SiRNA target sequence
gaaacgttatatgcacccgct

SEQ ID NO: 198376 - DNA, 21 bp, Artificial sequence
  SiRNA target sequence
aaacgttatatgcacccgcta

SEQ ID NO: 198377 - DNA, 21 bp, Artificial sequence
  SiRNA target sequence
aacgttatatgcacccgctaa

SEQ ID NO: 198378 - DNA, 21 bp, Artificial sequence
  SiRNA target sequence
acgttatatgcacccgctaaa

SEQ ID NO: 198379 - DNA, 21 bp, Artificial sequence
  SiRNA target sequence
cgttatatgcacccgctaaat

SEQ ID NO: 198380 - DNA, 21 bp, Artificial sequence
  SiRNA target sequence
gttatatgcacccgctaaata

SEQ ID NO: 198381 - DNA, 21 bp, Artificial sequence
  SiRNA target sequence
ttatatgcacccgctaaatag

SEQ ID NO: 198382 - DNA, 21 bp, Artificial sequence
  SiRNA target sequence
tatatgcacccgctaaataga

SEQ ID NO: 198383 - DNA, 21 bp, Artificial sequence
  SiRNA target sequence
atatgcacccgctaaatagat

SEQ ID NO: 198384 - DNA, 21 bp, Artificial sequence
  SiRNA target sequence
tatgcacccgctaaatagatt

SEQ ID NO: 198385 - DNA, 21 bp, Artificial sequence
  SiRNA target sequence
atgcacccgctaaatagatta

SEQ ID NO: 198386 - DNA, 21 bp, Artificial sequence
  SiRNA target sequence
tgcacccgctaaatagattat

SEQ ID NO: 198387 - DNA, 21 bp, Artificial sequence
  SiRNA target sequence
gcacccgctaaatagattata

SEQ ID NO: 198388 - DNA, 21 bp, Artificial sequence
  SiRNA target sequence
cacccgctaaatagattatag

SEQ ID NO: 198389 - DNA, 21 bp, Artificial sequence
  SiRNA target sequence
acccgctaaatagattatagc

SEQ ID NO: 198390 - DNA, 21 bp, Artificial sequence
  SiRNA target sequence
cccgctaaatagattatagct

SEQ ID NO: 198391 - DNA, 21 bp, Artificial sequence
  SiRNA target sequence
ccgctaaatagattatagctc

SEQ ID NO: 198392 - DNA, 21 bp, Artificial sequence
  SiRNA target sequence
cgctaaatagattatagctct

SEQ ID NO: 198393 - DNA, 21 bp, Artificial sequence
  SiRNA target sequence
gctaaatagattatagctcta

SEQ ID NO: 198394 - DNA, 21 bp, Artificial sequence
  SiRNA target sequence
ctaaatagattatagctctaa

SEQ ID NO: 198395 - DNA, 21 bp, Artificial sequence
  SiRNA target sequence
taaatagattatagctctaat

SEQ ID NO: 198396 - DNA, 21 bp, Artificial sequence
  SiRNA target sequence
aaatagattatagctctaatc

SEQ ID NO: 198397 - DNA, 21 bp, Artificial sequence
  SiRNA target sequence
aatagattatagctctaatcc

SEQ ID NO: 198398 - DNA, 21 bp, Artificial sequence
  SiRNA target sequence
atagattatagctctaatcca

SEQ ID NO: 198399 - DNA, 21 bp, Artificial sequence
  SiRNA target sequence
tagattatagctctaatccaa

SEQ ID NO: 198400 - DNA, 21 bp, Artificial sequence
  SiRNA target sequence
agattatagctctaatccaaa

SEQ ID NO: 198401 - DNA, 21 bp, Artificial sequence
  SiRNA target sequence
gattatagctctaatccaaat

SEQ ID NO: 198402 - DNA, 21 bp, Artificial sequence
  SiRNA target sequence
attatagctctaatccaaata

SEQ ID NO: 198403 - DNA, 21 bp, Artificial sequence
  SiRNA target sequence
ttatagctctaatccaaatat

SEQ ID NO: 198404 - DNA, 21 bp, Artificial sequence
  SiRNA target sequence
tatagctctaatccaaatata

SEQ ID NO: 198405 - DNA, 21 bp, Artificial sequence
  SiRNA target sequence
atagctctaatccaaatataa

SEQ ID NO: 198406 - DNA, 21 bp, Artificial sequence
  SiRNA target sequence
tagctctaatccaaatataaa

SEQ ID NO: 198407 - DNA, 21 bp, Artificial sequence
  SiRNA target sequence
agctctaatccaaatataaat

SEQ ID NO: 198408 - DNA, 21 bp, Artificial sequence
  SiRNA target sequence
gctctaatccaaatataaatc

SEQ ID NO: 198409 - DNA, 21 bp, Artificial sequence
  SiRNA target sequence
ctctaatccaaatataaatca

SEQ ID NO: 198410 - DNA, 21 bp, Artificial sequence
  SiRNA target sequence
tctaatccaaatataaatcaa

SEQ ID NO: 198411 - DNA, 21 bp, Artificial sequence
  SiRNA target sequence
ctaatccaaatataaatcaat

SEQ ID NO: 198412 - DNA, 21 bp, Artificial sequence
  SiRNA target sequence
taatccaaatataaatcaata

SEQ ID NO: 198413 - DNA, 21 bp, Artificial sequence
  SiRNA target sequence
aatccaaatataaatcaatat

SEQ ID NO: 198414 - DNA, 21 bp, Artificial sequence
  SiRNA target sequence
atccaaatataaatcaatatt

SEQ ID NO: 198415 - DNA, 21 bp, Artificial sequence
  SiRNA target sequence
tccaaatataaatcaatatta

SEQ ID NO: 198416 - DNA, 21 bp, Artificial sequence
  SiRNA target sequence
ccaaatataaatcaatattat

SEQ ID NO: 198417 - DNA, 21 bp, Artificial sequence
  SiRNA target sequence
caaatataaatcaatattatt

SEQ ID NO: 198418 - DNA, 21 bp, Artificial sequence
  SiRNA target sequence
aaatataaatcaatattattg

SEQ ID NO: 198419 - DNA, 21 bp, Artificial sequence
  SiRNA target sequence
aatataaatcaatattattgc

SEQ ID NO: 198420 - DNA, 21 bp, Artificial sequence
  SiRNA target sequence
atataaatcaatattattgca

SEQ ID NO: 198421 - DNA, 21 bp, Artificial sequence
  SiRNA target sequence
tataaatcaatattattgcaa

SEQ ID NO: 198422 - DNA, 21 bp, Artificial sequence
  SiRNA target sequence
ataaatcaatattattgcaat

SEQ ID NO: 198423 - DNA, 21 bp, Artificial sequence
  SiRNA target sequence
taaatcaatattattgcaatc

SEQ ID NO: 198424 - DNA, 21 bp, Artificial sequence
  SiRNA target sequence
aaatcaatattattgcaatcg

SEQ ID NO: 198425 - DNA, 21 bp, Artificial sequence
  SiRNA target sequence
aatcaatattattgcaatcgt

SEQ ID NO: 198426 - DNA, 21 bp, Artificial sequence
  SiRNA target sequence
atcaatattattgcaatcgtt

SEQ ID NO: 198427 - DNA, 21 bp, Artificial sequence
  SiRNA target sequence
tcaatattattgcaatcgtta

SEQ ID NO: 198428 - DNA, 21 bp, Artificial sequence
  SiRNA target sequence
caatattattgcaatcgttaa

SEQ ID NO: 198429 - DNA, 21 bp, Artificial sequence
  SiRNA target sequence
aatattattgcaatcgttaat

SEQ ID NO: 198430 - DNA, 21 bp, Artificial sequence
  SiRNA target sequence
atattattgcaatcgttaatg

SEQ ID NO: 198431 - DNA, 21 bp, Artificial sequence
  SiRNA target sequence
tattattgcaatcgttaatgt

SEQ ID NO: 198432 - DNA, 21 bp, Artificial sequence
  SiRNA target sequence
attattgcaatcgttaatgtg

SEQ ID NO: 198433 - DNA, 21 bp, Artificial sequence
  SiRNA target sequence
ttattgcaatcgttaatgtga

SEQ ID NO: 198434 - DNA, 21 bp, Artificial sequence
  SiRNA target sequence
tattgcaatcgttaatgtgat

SEQ ID NO: 198435 - DNA, 21 bp, Artificial sequence
  SiRNA target sequence
attgcaatcgttaatgtgatt

SEQ ID NO: 198436 - DNA, 21 bp, Artificial sequence
  SiRNA target sequence
ttgcaatcgttaatgtgattg

SEQ ID NO: 198437 - DNA, 21 bp, Artificial sequence
  SiRNA target sequence
tgcaatcgttaatgtgattgg

SEQ ID NO: 198438 - DNA, 21 bp, Artificial sequence
  SiRNA target sequence
gcaatcgttaatgtgattgga

SEQ ID NO: 198439 - DNA, 21 bp, Artificial sequence
  SiRNA target sequence
caatcgttaatgtgattggac

SEQ ID NO: 198440 - DNA, 21 bp, Artificial sequence
  SiRNA target sequence
aatcgttaatgtgattggact

SEQ ID NO: 198441 - DNA, 21 bp, Artificial sequence
  SiRNA target sequence
atcgttaatgtgattggacta

SEQ ID NO: 198442 - DNA, 21 bp, Artificial sequence
  SiRNA target sequence
tcgttaatgtgattggactac

SEQ ID NO: 198443 - DNA, 21 bp, Artificial sequence
  SiRNA target sequence
cgttaatgtgattggactacc

SEQ ID NO: 198444 - DNA, 21 bp, Artificial sequence
  SiRNA target sequence
gttaatgtgattggactaccc

SEQ ID NO: 198445 - DNA, 21 bp, Artificial sequence
  SiRNA target sequence
ttaatgtgattggactaccct

SEQ ID NO: 198446 - DNA, 21 bp, Artificial sequence
  SiRNA target sequence
taatgtgattggactaccctt

SEQ ID NO: 198447 - DNA, 21 bp, Artificial sequence
  SiRNA target sequence
aatgtgattggactacccttc

SEQ ID NO: 198448 - DNA, 21 bp, Artificial sequence
  SiRNA target sequence
atgtgattggactacccttcc

SEQ ID NO: 198449 - DNA, 21 bp, Artificial sequence
  SiRNA target sequence
tgtgattggactacccttcct

SEQ ID NO: 198450 - DNA, 21 bp, Artificial sequence
  SiRNA target sequence
gtgattggactacccttcctt

SEQ ID NO: 198451 - DNA, 21 bp, Artificial sequence
  SiRNA target sequence
tgattggactacccttcctta

SEQ ID NO: 198452 - DNA, 21 bp, Artificial sequence
  SiRNA target sequence
gattggactacccttccttac

SEQ ID NO: 198453 - DNA, 21 bp, Artificial sequence
  SiRNA target sequence
attggactacccttccttaca

SEQ ID NO: 198454 - DNA, 21 bp, Artificial sequence
  SiRNA target sequence
ttggactacccttccttacat

SEQ ID NO: 198455 - DNA, 21 bp, Artificial sequence
  SiRNA target sequence
tggactacccttccttacatt

SEQ ID NO: 198456 - DNA, 21 bp, Artificial sequence
  SiRNA target sequence
ggactacccttccttacatta

SEQ ID NO: 198457 - DNA, 21 bp, Artificial sequence
  SiRNA target sequence
gactacccttccttacattat

SEQ ID NO: 198458 - DNA, 21 bp, Artificial sequence
  SiRNA target sequence
actacccttccttacattatc

SEQ ID NO: 198459 - DNA, 21 bp, Artificial sequence
  SiRNA target sequence
ctacccttccttacattatca

SEQ ID NO: 198460 - DNA, 21 bp, Artificial sequence
  SiRNA target sequence
tacccttccttacattatcag

SEQ ID NO: 198461 - DNA, 21 bp, Artificial sequence
  SiRNA target sequence
acccttccttacattatcagt

SEQ ID NO: 198462 - DNA, 21 bp, Artificial sequence
  SiRNA target sequence
cccttccttacattatcagta

SEQ ID NO: 198463 - DNA, 21 bp, Artificial sequence
  SiRNA target sequence
ccttccttacattatcagtat

SEQ ID NO: 198464 - DNA, 21 bp, Artificial sequence
  SiRNA target sequence
cttccttacattatcagtatc

SEQ ID NO: 198465 - DNA, 21 bp, Artificial sequence
  SiRNA target sequence
ttccttacattatcagtatca

SEQ ID NO: 198466 - DNA, 21 bp, Artificial sequence
  SiRNA target sequence
tccttacattatcagtatcaa

SEQ ID NO: 198467 - DNA, 21 bp, Artificial sequence
  SiRNA target sequence
ccttacattatcagtatcaag

SEQ ID NO: 198468 - DNA, 21 bp, Artificial sequence
  SiRNA target sequence
cttacattatcagtatcaagt

SEQ ID NO: 198469 - DNA, 21 bp, Artificial sequence
  SiRNA target sequence
ttacattatcagtatcaagtg

SEQ ID NO: 198470 - DNA, 21 bp, Artificial sequence
  SiRNA target sequence
tacattatcagtatcaagtgc

SEQ ID NO: 198471 - DNA, 21 bp, Artificial sequence
  SiRNA target sequence
acattatcagtatcaagtgct

SEQ ID NO: 198472 - DNA, 21 bp, Artificial sequence
  SiRNA target sequence
cattatcagtatcaagtgcta

SEQ ID NO: 198473 - DNA, 21 bp, Artificial sequence
  SiRNA target sequence
attatcagtatcaagtgctac

SEQ ID NO: 198474 - DNA, 21 bp, Artificial sequence
  SiRNA target sequence
ttatcagtatcaagtgctact

SEQ ID NO: 198475 - DNA, 21 bp, Artificial sequence
  SiRNA target sequence
tatcagtatcaagtgctacta

SEQ ID NO: 198476 - DNA, 21 bp, Artificial sequence
  SiRNA target sequence
atcagtatcaagtgctactaa

SEQ ID NO: 198477 - DNA, 21 bp, Artificial sequence
  SiRNA target sequence
tcagtatcaagtgctactaat

SEQ ID NO: 198478 - DNA, 21 bp, Artificial sequence
  SiRNA target sequence
cagtatcaagtgctactaata

SEQ ID NO: 198479 - DNA, 21 bp, Artificial sequence
  SiRNA target sequence
agtatcaagtgctactaatat

SEQ ID NO: 198480 - DNA, 21 bp, Artificial sequence
  SiRNA target sequence
gtatcaagtgctactaatatg

SEQ ID NO: 198481 - DNA, 21 bp, Artificial sequence
  SiRNA target sequence
tatcaagtgctactaatatgg

SEQ ID NO: 198482 - DNA, 21 bp, Artificial sequence
  SiRNA target sequence
atcaagtgctactaatatggc

SEQ ID NO: 198483 - DNA, 21 bp, Artificial sequence
  SiRNA target sequence
tcaagtgctactaatatggct

SEQ ID NO: 198484 - DNA, 21 bp, Artificial sequence
  SiRNA target sequence
caagtgctactaatatggcta

SEQ ID NO: 198485 - DNA, 21 bp, Artificial sequence
  SiRNA target sequence
aagtgctactaatatggctag

SEQ ID NO: 198486 - DNA, 21 bp, Artificial sequence
  SiRNA target sequence
agtgctactaatatggctagt

SEQ ID NO: 198487 - DNA, 21 bp, Artificial sequence
  SiRNA target sequence
gtgctactaatatggctagtc

SEQ ID NO: 198488 - DNA, 21 bp, Artificial sequence
  SiRNA target sequence
tgctactaatatggctagtcc

SEQ ID NO: 198489 - DNA, 21 bp, Artificial sequence
  SiRNA target sequence
gctactaatatggctagtcca

SEQ ID NO: 198490 - DNA, 21 bp, Artificial sequence
  SiRNA target sequence
ctactaatatggctagtccat

SEQ ID NO: 198491 - DNA, 21 bp, Artificial sequence
  SiRNA target sequence
tactaatatggctagtccata

SEQ ID NO: 198492 - DNA, 21 bp, Artificial sequence
  SiRNA target sequence
actaatatggctagtccatat

SEQ ID NO: 198493 - DNA, 21 bp, Artificial sequence
  SiRNA target sequence
ctaatatggctagtccatata

SEQ ID NO: 198494 - DNA, 21 bp, Artificial sequence
  SiRNA target sequence
taatatggctagtccatataa

SEQ ID NO: 198495 - DNA, 21 bp, Artificial sequence
  SiRNA target sequence
aatatggctagtccatataat

SEQ ID NO: 198496 - DNA, 21 bp, Artificial sequence
  SiRNA target sequence
atatggctagtccatataatg

SEQ ID NO: 198497 - DNA, 21 bp, Artificial sequence
  SiRNA target sequence
tatggctagtccatataatga

SEQ ID NO: 198498 - DNA, 21 bp, Artificial sequence
  SiRNA target sequence
atggctagtccatataatgaa

SEQ ID NO: 198499 - DNA, 21 bp, Artificial sequence
  SiRNA target sequence
tggctagtccatataatgaac

SEQ ID NO: 198500 - DNA, 21 bp, Artificial sequence
  SiRNA target sequence
ggctagtccatataatgaacc

SEQ ID NO: 198501 - DNA, 21 bp, Artificial sequence
  SiRNA target sequence
gctagtccatataatgaacca

SEQ ID NO: 198502 - DNA, 21 bp, Artificial sequence
  SiRNA target sequence
ctagtccatataatgaaccaa

SEQ ID NO: 198503 - DNA, 21 bp, Artificial sequence
  SiRNA target sequence
tagtccatataatgaaccaat

SEQ ID NO: 198504 - DNA, 21 bp, Artificial sequence
  SiRNA target sequence
agtccatataatgaaccaata

SEQ ID NO: 198505 - DNA, 21 bp, Artificial sequence
  SiRNA target sequence
gtccatataatgaaccaatag

SEQ ID NO: 198506 - DNA, 21 bp, Artificial sequence
  SiRNA target sequence
tccatataatgaaccaataga

SEQ ID NO: 198507 - DNA, 21 bp, Artificial sequence
  SiRNA target sequence
ccatataatgaaccaatagat

SEQ ID NO: 198508 - DNA, 21 bp, Artificial sequence
  SiRNA target sequence
catataatgaaccaatagatt

SEQ ID NO: 198509 - DNA, 21 bp, Artificial sequence
  SiRNA target sequence
atataatgaaccaatagattt

SEQ ID NO: 198510 - DNA, 21 bp, Artificial sequence
  SiRNA target sequence
tataatgaaccaatagatttt

SEQ ID NO: 198511 - DNA, 21 bp, Artificial sequence
  SiRNA target sequence
ataatgaaccaatagattttc

SEQ ID NO: 198512 - DNA, 21 bp, Artificial sequence
  SiRNA target sequence
taatgaaccaatagattttcc

SEQ ID NO: 198513 - DNA, 21 bp, Artificial sequence
  SiRNA target sequence
aatgaaccaatagattttcct

SEQ ID NO: 198514 - DNA, 21 bp, Artificial sequence
  SiRNA target sequence
atgaaccaatagattttccta

SEQ ID NO: 198515 - DNA, 21 bp, Artificial sequence
  SiRNA target sequence
tgaaccaatagattttcctaa

SEQ ID NO: 198516 - DNA, 21 bp, Artificial sequence
  SiRNA target sequence
gaaccaatagattttcctaat

SEQ ID NO: 198517 - DNA, 21 bp, Artificial sequence
  SiRNA target sequence
aaccaatagattttcctaatt

SEQ ID NO: 198518 - DNA, 21 bp, Artificial sequence
  SiRNA target sequence
accaatagattttcctaattt

SEQ ID NO: 198519 - DNA, 21 bp, Artificial sequence
  SiRNA target sequence
ccaatagattttcctaattta

SEQ ID NO: 198520 - DNA, 21 bp, Artificial sequence
  SiRNA target sequence
caatagattttcctaatttat

SEQ ID NO: 198521 - DNA, 21 bp, Artificial sequence
  SiRNA target sequence
aatagattttcctaatttatt

SEQ ID NO: 198522 - DNA, 21 bp, Artificial sequence
  SiRNA target sequence
atagattttcctaatttatta

SEQ ID NO: 198523 - DNA, 21 bp, Artificial sequence
  SiRNA target sequence
tagattttcctaatttattaa

SEQ ID NO: 198524 - DNA, 21 bp, Artificial sequence
  SiRNA target sequence
agattttcctaatttattaaa

SEQ ID NO: 198525 - DNA, 21 bp, Artificial sequence
  SiRNA target sequence
gattttcctaatttattaaaa

SEQ ID NO: 198526 - DNA, 21 bp, Artificial sequence
  SiRNA target sequence
attttcctaatttattaaaaa

SEQ ID NO: 198527 - DNA, 21 bp, Artificial sequence
  SiRNA target sequence
ttttcctaatttattaaaaat

SEQ ID NO: 198528 - DNA, 21 bp, Artificial sequence
  SiRNA target sequence
tttcctaatttattaaaaata

SEQ ID NO: 198529 - DNA, 21 bp, Artificial sequence
  SiRNA target sequence
ttcctaatttattaaaaatac

SEQ ID NO: 198530 - DNA, 21 bp, Artificial sequence
  SiRNA target sequence
tcctaatttattaaaaatacc

SEQ ID NO: 198531 - DNA, 21 bp, Artificial sequence
  SiRNA target sequence
cctaatttattaaaaatacca

SEQ ID NO: 198532 - DNA, 21 bp, Artificial sequence
  SiRNA target sequence
ctaatttattaaaaataccat

SEQ ID NO: 198533 - DNA, 21 bp, Artificial sequence
  SiRNA target sequence
taatttattaaaaataccatc

SEQ ID NO: 198534 - DNA, 21 bp, Artificial sequence
  SiRNA target sequence
aatttattaaaaataccatca

SEQ ID NO: 198535 - DNA, 21 bp, Artificial sequence
  SiRNA target sequence
atttattaaaaataccatcat

SEQ ID NO: 198536 - DNA, 21 bp, Artificial sequence
  SiRNA target sequence
tttattaaaaataccatcata

SEQ ID NO: 198537 - DNA, 21 bp, Artificial sequence
  SiRNA target sequence
ttattaaaaataccatcataa

SEQ ID NO: 198538 - DNA, 21 bp, Artificial sequence
  SiRNA target sequence
tattaaaaataccatcataaa

SEQ ID NO: 198539 - DNA, 21 bp, Artificial sequence
  SiRNA target sequence
attaaaaataccatcataaac

SEQ ID NO: 198540 - DNA, 21 bp, Artificial sequence
  SiRNA target sequence
ttaaaaataccatcataaaca

SEQ ID NO: 198541 - DNA, 21 bp, Artificial sequence
  SiRNA target sequence
taaaaataccatcataaacac

SEQ ID NO: 198542 - DNA, 21 bp, Artificial sequence
  SiRNA target sequence
aaaaataccatcataaacact

SEQ ID NO: 198543 - DNA, 21 bp, Artificial sequence
  SiRNA target sequence
aaaataccatcataaacactt

SEQ ID NO: 198544 - DNA, 21 bp, Artificial sequence
  SiRNA target sequence
aaataccatcataaacacttt

SEQ ID NO: 198545 - DNA, 21 bp, Artificial sequence
  SiRNA target sequence
aataccatcataaacactttt

SEQ ID NO: 198546 - DNA, 21 bp, Artificial sequence
  SiRNA target sequence
ataccatcataaacactttta

SEQ ID NO: 198547 - DNA, 21 bp, Artificial sequence
  SiRNA target sequence
taccatcataaacacttttaa

SEQ ID NO: 198548 - DNA, 21 bp, Artificial sequence
  SiRNA target sequence
accatcataaacacttttaaa

SEQ ID NO: 198549 - DNA, 21 bp, Artificial sequence
  SiRNA target sequence
ccatcataaacacttttaaac

SEQ ID NO: 198550 - DNA, 21 bp, Artificial sequence
  SiRNA target sequence
catcataaacacttttaaacc

SEQ ID NO: 198551 - DNA, 21 bp, Artificial sequence
  SiRNA target sequence
atcataaacacttttaaaccg

SEQ ID NO: 198552 - DNA, 21 bp, Artificial sequence
  SiRNA target sequence
tcataaacacttttaaaccgt

SEQ ID NO: 198553 - DNA, 21 bp, Artificial sequence
  SiRNA target sequence
cataaacacttttaaaccgtg

SEQ ID NO: 198554 - DNA, 21 bp, Artificial sequence
  SiRNA target sequence
ataaacacttttaaaccgtgc

SEQ ID NO: 198555 - DNA, 21 bp, Artificial sequence
  SiRNA target sequence
taaacacttttaaaccgtgcc

SEQ ID NO: 198556 - DNA, 21 bp, Artificial sequence
  SiRNA target sequence
aaacacttttaaaccgtgccc

SEQ ID NO: 198557 - DNA, 21 bp, Artificial sequence
  SiRNA target sequence
aacacttttaaaccgtgccct

SEQ ID NO: 198558 - DNA, 21 bp, Artificial sequence
  SiRNA target sequence
acacttttaaaccgtgccctg

SEQ ID NO: 198559 - DNA, 21 bp, Artificial sequence
  SiRNA target sequence
cacttttaaaccgtgccctgt

SEQ ID NO: 198560 - DNA, 21 bp, Artificial sequence
  SiRNA target sequence
acttttaaaccgtgccctgtg

SEQ ID NO: 198561 - DNA, 21 bp, Artificial sequence
  SiRNA target sequence
cttttaaaccgtgccctgtgt

SEQ ID NO: 198562 - DNA, 21 bp, Artificial sequence
  SiRNA target sequence
ttttaaaccgtgccctgtgtg

SEQ ID NO: 198563 - DNA, 21 bp, Artificial sequence
  SiRNA target sequence
tttaaaccgtgccctgtgtgc

SEQ ID NO: 198564 - DNA, 21 bp, Artificial sequence
  SiRNA target sequence
ttaaaccgtgccctgtgtgca

SEQ ID NO: 198565 - DNA, 21 bp, Artificial sequence
  SiRNA target sequence
taaaccgtgccctgtgtgcag

SEQ ID NO: 198566 - DNA, 21 bp, Artificial sequence
  SiRNA target sequence
aaaccgtgccctgtgtgcagg

SEQ ID NO: 198567 - DNA, 21 bp, Artificial sequence
  SiRNA target sequence
aaccgtgccctgtgtgcagga

SEQ ID NO: 198568 - DNA, 21 bp, Artificial sequence
  SiRNA target sequence
accgtgccctgtgtgcaggat

SEQ ID NO: 198569 - DNA, 21 bp, Artificial sequence
  SiRNA target sequence
ccgtgccctgtgtgcaggatc

SEQ ID NO: 198570 - DNA, 21 bp, Artificial sequence
  SiRNA target sequence
cgtgccctgtgtgcaggatcg

SEQ ID NO: 198571 - DNA, 21 bp, Artificial sequence
  SiRNA target sequence
gtgccctgtgtgcaggatcga

SEQ ID NO: 198572 - DNA, 21 bp, Artificial sequence
  SiRNA target sequence
tgccctgtgtgcaggatcgat

SEQ ID NO: 198573 - DNA, 21 bp, Artificial sequence
  SiRNA target sequence
gccctgtgtgcaggatcgatt

SEQ ID NO: 198574 - DNA, 21 bp, Artificial sequence
  SiRNA target sequence
ccctgtgtgcaggatcgattc

SEQ ID NO: 198575 - DNA, 21 bp, Artificial sequence
  SiRNA target sequence
cctgtgtgcaggatcgattct

SEQ ID NO: 198576 - DNA, 21 bp, Artificial sequence
  SiRNA target sequence
ctgtgtgcaggatcgattctc

SEQ ID NO: 198577 - DNA, 21 bp, Artificial sequence
  SiRNA target sequence
tgtgtgcaggatcgattctca

SEQ ID NO: 198578 - DNA, 21 bp, Artificial sequence
  SiRNA target sequence
gtgtgcaggatcgattctcat

SEQ ID NO: 198579 - DNA, 21 bp, Artificial sequence
  SiRNA target sequence
tgtgcaggatcgattctcata

SEQ ID NO: 198580 - DNA, 21 bp, Artificial sequence
  SiRNA target sequence
gtgcaggatcgattctcatac

SEQ ID NO: 198581 - DNA, 21 bp, Artificial sequence
  SiRNA target sequence
tgcaggatcgattctcatacc

SEQ ID NO: 198582 - DNA, 21 bp, Artificial sequence
  SiRNA target sequence
gcaggatcgattctcataccc

SEQ ID NO: 198583 - DNA, 21 bp, Artificial sequence
  SiRNA target sequence
caggatcgattctcataccca

SEQ ID NO: 198584 - DNA, 21 bp, Artificial sequence
  SiRNA target sequence
aggatcgattctcatacccat

SEQ ID NO: 198585 - DNA, 21 bp, Artificial sequence
  SiRNA target sequence
ggatcgattctcatacccatt

SEQ ID NO: 198586 - DNA, 21 bp, Artificial sequence
  SiRNA target sequence
gatcgattctcatacccattt

SEQ ID NO: 198587 - DNA, 21 bp, Artificial sequence
  SiRNA target sequence
atcgattctcatacccatttt

SEQ ID NO: 198588 - DNA, 21 bp, Artificial sequence
  SiRNA target sequence
tcgattctcatacccattttc

SEQ ID NO: 198589 - DNA, 21 bp, Artificial sequence
  SiRNA target sequence
cgattctcatacccattttct

SEQ ID NO: 198590 - DNA, 21 bp, Artificial sequence
  SiRNA target sequence
gattctcatacccattttctc

SEQ ID NO: 198591 - DNA, 21 bp, Artificial sequence
  SiRNA target sequence
attctcatacccattttctct

SEQ ID NO: 198592 - DNA, 21 bp, Artificial sequence
  SiRNA target sequence
ttctcatacccattttctctt

SEQ ID NO: 198593 - DNA, 21 bp, Artificial sequence
  SiRNA target sequence
tctcatacccattttctcttt

SEQ ID NO: 198594 - DNA, 21 bp, Artificial sequence
  SiRNA target sequence
ctcatacccattttctcttta

SEQ ID NO: 198595 - DNA, 21 bp, Artificial sequence
  SiRNA target sequence
tcatacccattttctctttac

SEQ ID NO: 198596 - DNA, 21 bp, Artificial sequence
  SiRNA target sequence
catacccattttctctttaca

SEQ ID NO: 198597 - DNA, 21 bp, Artificial sequence
  SiRNA target sequence
atacccattttctctttacaa

SEQ ID NO: 198598 - DNA, 21 bp, Artificial sequence
  SiRNA target sequence
tacccattttctctttacaaa

SEQ ID NO: 198599 - DNA, 21 bp, Artificial sequence
  SiRNA target sequence
acccattttctctttacaaat

SEQ ID NO: 198600 - DNA, 21 bp, Artificial sequence
  SiRNA target sequence
cccattttctctttacaaata

SEQ ID NO: 198601 - DNA, 21 bp, Artificial sequence
  SiRNA target sequence
ccattttctctttacaaatat

SEQ ID NO: 198602 - DNA, 21 bp, Artificial sequence
  SiRNA target sequence
cattttctctttacaaatatc

SEQ ID NO: 198603 - DNA, 21 bp, Artificial sequence
  SiRNA target sequence
attttctctttacaaatatca

SEQ ID NO: 198604 - DNA, 21 bp, Artificial sequence
  SiRNA target sequence
ttttctctttacaaatatcaa

SEQ ID NO: 198605 - DNA, 21 bp, Artificial sequence
  SiRNA target sequence
tttctctttacaaatatcaaa

SEQ ID NO: 198606 - DNA, 21 bp, Artificial sequence
  SiRNA target sequence
ttctctttacaaatatcaaag

SEQ ID NO: 198607 - DNA, 21 bp, Artificial sequence
  SiRNA target sequence
tctctttacaaatatcaaagg

SEQ ID NO: 198608 - DNA, 21 bp, Artificial sequence
  SiRNA target sequence
ctctttacaaatatcaaaggc

SEQ ID NO: 198609 - DNA, 21 bp, Artificial sequence
  SiRNA target sequence
tctttacaaatatcaaaggct

SEQ ID NO: 198610 - DNA, 21 bp, Artificial sequence
  SiRNA target sequence
ctttacaaatatcaaaggctg

SEQ ID NO: 198611 - DNA, 21 bp, Artificial sequence
  SiRNA target sequence
tttacaaatatcaaaggctga

SEQ ID NO: 198612 - DNA, 21 bp, Artificial sequence
  SiRNA target sequence
ttacaaatatcaaaggctgaa

SEQ ID NO: 198613 - DNA, 21 bp, Artificial sequence
  SiRNA target sequence
tacaaatatcaaaggctgaat

SEQ ID NO: 198614 - DNA, 21 bp, Artificial sequence
  SiRNA target sequence
acaaatatcaaaggctgaata

SEQ ID NO: 198615 - DNA, 21 bp, Artificial sequence
  SiRNA target sequence
caaatatcaaaggctgaatat

SEQ ID NO: 198616 - DNA, 21 bp, Artificial sequence
  SiRNA target sequence
aaatatcaaaggctgaatatt

SEQ ID NO: 198617 - DNA, 21 bp, Artificial sequence
  SiRNA target sequence
aatatcaaaggctgaatattt

SEQ ID NO: 198618 - DNA, 21 bp, Artificial sequence
  SiRNA target sequence
atatcaaaggctgaatatttt

SEQ ID NO: 198619 - DNA, 21 bp, Artificial sequence
  SiRNA target sequence
tatcaaaggctgaatatttta

SEQ ID NO: 198620 - DNA, 21 bp, Artificial sequence
  SiRNA target sequence
atcaaaggctgaatattttaa

SEQ ID NO: 198621 - DNA, 21 bp, Artificial sequence
  SiRNA target sequence
tcaaaggctgaatattttaat

SEQ ID NO: 198622 - DNA, 21 bp, Artificial sequence
  SiRNA target sequence
caaaggctgaatattttaata

SEQ ID NO: 198623 - DNA, 21 bp, Artificial sequence
  SiRNA target sequence
aaaggctgaatattttaatac

SEQ ID NO: 198624 - DNA, 21 bp, Artificial sequence
  SiRNA target sequence
aaggctgaatattttaatact

SEQ ID NO: 198625 - DNA, 21 bp, Artificial sequence
  SiRNA target sequence
aggctgaatattttaatactt

SEQ ID NO: 198626 - DNA, 21 bp, Artificial sequence
  SiRNA target sequence
ggctgaatattttaatacttt

SEQ ID NO: 198627 - DNA, 21 bp, Artificial sequence
  SiRNA target sequence
gctgaatattttaatactttt

SEQ ID NO: 198628 - DNA, 21 bp, Artificial sequence
  SiRNA target sequence
ctgaatattttaatactttta

SEQ ID NO: 198629 - DNA, 21 bp, Artificial sequence
  SiRNA target sequence
tgaatattttaatacttttat

SEQ ID NO: 198630 - DNA, 21 bp, Artificial sequence
  SiRNA target sequence
gaatattttaatacttttatg

SEQ ID NO: 198631 - DNA, 21 bp, Artificial sequence
  SiRNA target sequence
aatattttaatacttttatga

SEQ ID NO: 198632 - DNA, 21 bp, Artificial sequence
  SiRNA target sequence
atattttaatacttttatgaa

SEQ ID NO: 198633 - DNA, 21 bp, Artificial sequence
  SiRNA target sequence
tattttaatacttttatgaat

SEQ ID NO: 198634 - DNA, 21 bp, Artificial sequence
  SiRNA target sequence
attttaatacttttatgaatg

SEQ ID NO: 198635 - DNA, 21 bp, Artificial sequence
  SiRNA target sequence
ttttaatacttttatgaatgc

SEQ ID NO: 198636 - DNA, 21 bp, Artificial sequence
  SiRNA target sequence
tttaatacttttatgaatgct

SEQ ID NO: 198637 - DNA, 21 bp, Artificial sequence
  SiRNA target sequence
ttaatacttttatgaatgcta

SEQ ID NO: 198638 - DNA, 21 bp, Artificial sequence
  SiRNA target sequence
taatacttttatgaatgctaa

SEQ ID NO: 198639 - DNA, 21 bp, Artificial sequence
  SiRNA target sequence
aatacttttatgaatgctaaa

SEQ ID NO: 198640 - DNA, 21 bp, Artificial sequence
  SiRNA target sequence
atacttttatgaatgctaaaa

SEQ ID NO: 198641 - DNA, 21 bp, Artificial sequence
  SiRNA target sequence
tacttttatgaatgctaaaaa

SEQ ID NO: 198642 - DNA, 21 bp, Artificial sequence
  SiRNA target sequence
acttttatgaatgctaaaaag

SEQ ID NO: 198643 - DNA, 21 bp, Artificial sequence
  SiRNA target sequence
cttttatgaatgctaaaaaga

SEQ ID NO: 198644 - DNA, 21 bp, Artificial sequence
  SiRNA target sequence
ttttatgaatgctaaaaagaa

SEQ ID NO: 198645 - DNA, 21 bp, Artificial sequence
  SiRNA target sequence
tttatgaatgctaaaaagaac

SEQ ID NO: 198646 - DNA, 21 bp, Artificial sequence
  SiRNA target sequence
ttatgaatgctaaaaagaaca

SEQ ID NO: 198647 - DNA, 21 bp, Artificial sequence
  SiRNA target sequence
tatgaatgctaaaaagaacat

SEQ ID NO: 198648 - DNA, 21 bp, Artificial sequence
  SiRNA target sequence
atgaatgctaaaaagaacatt

SEQ ID NO: 198649 - DNA, 21 bp, Artificial sequence
  SiRNA target sequence
tgaatgctaaaaagaacattc

SEQ ID NO: 198650 - DNA, 21 bp, Artificial sequence
  SiRNA target sequence
gaatgctaaaaagaacattcc

SEQ ID NO: 198651 - DNA, 21 bp, Artificial sequence
  SiRNA target sequence
aatgctaaaaagaacattcca

SEQ ID NO: 198652 - DNA, 21 bp, Artificial sequence
  SiRNA target sequence
atgctaaaaagaacattccac

SEQ ID NO: 198653 - DNA, 21 bp, Artificial sequence
  SiRNA target sequence
tgctaaaaagaacattccact

SEQ ID NO: 198654 - DNA, 21 bp, Artificial sequence
  SiRNA target sequence
gctaaaaagaacattccactg

SEQ ID NO: 198655 - DNA, 21 bp, Artificial sequence
  SiRNA target sequence
ctaaaaagaacattccactgt

SEQ ID NO: 198656 - DNA, 21 bp, Artificial sequence
  SiRNA target sequence
taaaaagaacattccactgta

SEQ ID NO: 198657 - DNA, 21 bp, Artificial sequence
  SiRNA target sequence
aaaaagaacattccactgtaa

SEQ ID NO: 198658 - DNA, 21 bp, Artificial sequence
  SiRNA target sequence
aaaagaacattccactgtaat

SEQ ID NO: 198659 - DNA, 21 bp, Artificial sequence
  SiRNA target sequence
aaagaacattccactgtaatt

SEQ ID NO: 198660 - DNA, 21 bp, Artificial sequence
  SiRNA target sequence
aagaacattccactgtaattt

SEQ ID NO: 198661 - DNA, 21 bp, Artificial sequence
  SiRNA target sequence
agaacattccactgtaatttt

SEQ ID NO: 198662 - DNA, 21 bp, Artificial sequence
  SiRNA target sequence
gaacattccactgtaattttc

SEQ ID NO: 198663 - DNA, 21 bp, Artificial sequence
  SiRNA target sequence
aacattccactgtaattttcg

SEQ ID NO: 198664 - DNA, 21 bp, Artificial sequence
  SiRNA target sequence
acattccactgtaattttcga

SEQ ID NO: 198665 - DNA, 21 bp, Artificial sequence
  SiRNA target sequence
cattccactgtaattttcgat

SEQ ID NO: 198666 - DNA, 21 bp, Artificial sequence
  SiRNA target sequence
attccactgtaattttcgatc

SEQ ID NO: 198667 - DNA, 21 bp, Artificial sequence
  SiRNA target sequence
ttccactgtaattttcgatcg

SEQ ID NO: 198668 - DNA, 21 bp, Artificial sequence
  SiRNA target sequence
tccactgtaattttcgatcgt

SEQ ID NO: 198669 - DNA, 21 bp, Artificial sequence
  SiRNA target sequence
ccactgtaattttcgatcgta

SEQ ID NO: 198670 - DNA, 21 bp, Artificial sequence
  SiRNA target sequence
cactgtaattttcgatcgtat

SEQ ID NO: 198671 - DNA, 21 bp, Artificial sequence
  SiRNA target sequence
actgtaattttcgatcgtata

SEQ ID NO: 198672 - DNA, 21 bp, Artificial sequence
  SiRNA target sequence
ctgtaattttcgatcgtataa

SEQ ID NO: 198673 - DNA, 21 bp, Artificial sequence
  SiRNA target sequence
tgtaattttcgatcgtataaa

SEQ ID NO: 198674 - DNA, 21 bp, Artificial sequence
  SiRNA target sequence
gtaattttcgatcgtataaat

SEQ ID NO: 198675 - DNA, 21 bp, Artificial sequence
  SiRNA target sequence
taattttcgatcgtataaatg

SEQ ID NO: 198676 - DNA, 21 bp, Artificial sequence
  SiRNA target sequence
aattttcgatcgtataaatgt

SEQ ID NO: 198677 - DNA, 21 bp, Artificial sequence
  SiRNA target sequence
attttcgatcgtataaatgta

SEQ ID NO: 198678 - DNA, 21 bp, Artificial sequence
  SiRNA target sequence
ttttcgatcgtataaatgtac

SEQ ID NO: 198679 - DNA, 21 bp, Artificial sequence
  SiRNA target sequence
tttcgatcgtataaatgtacg

SEQ ID NO: 198680 - DNA, 21 bp, Artificial sequence
  SiRNA target sequence
ttcgatcgtataaatgtacga

SEQ ID NO: 198681 - DNA, 21 bp, Artificial sequence
  SiRNA target sequence
tcgatcgtataaatgtacgac

SEQ ID NO: 198682 - DNA, 21 bp, Artificial sequence
  SiRNA target sequence
cgatcgtataaatgtacgaca

SEQ ID NO: 198683 - DNA, 21 bp, Artificial sequence
  SiRNA target sequence
gatcgtataaatgtacgacat

SEQ ID NO: 198684 - DNA, 21 bp, Artificial sequence
  SiRNA target sequence
atcgtataaatgtacgacatt

SEQ ID NO: 198685 - DNA, 21 bp, Artificial sequence
  SiRNA target sequence
tcgtataaatgtacgacattt

SEQ ID NO: 198686 - DNA, 21 bp, Artificial sequence
  SiRNA target sequence
cgtataaatgtacgacatttt

SEQ ID NO: 198687 - DNA, 21 bp, Artificial sequence
  SiRNA target sequence
gtataaatgtacgacattttt

SEQ ID NO: 198688 - DNA, 21 bp, Artificial sequence
  SiRNA target sequence
tataaatgtacgacatttttt

SEQ ID NO: 198689 - DNA, 21 bp, Artificial sequence
  SiRNA target sequence
ataaatgtacgacattttttt

SEQ ID NO: 198690 - DNA, 21 bp, Artificial sequence
  SiRNA target sequence
taaatgtacgacattttttta

SEQ ID NO: 198691 - DNA, 21 bp, Artificial sequence
  SiRNA target sequence
aaatgtacgacatttttttaa

SEQ ID NO: 198692 - DNA, 21 bp, Artificial sequence
  SiRNA target sequence
aatgtacgacatttttttaaa

SEQ ID NO: 198693 - DNA, 21 bp, Artificial sequence
  SiRNA target sequence
atgtacgacatttttttaaaa

SEQ ID NO: 198694 - DNA, 21 bp, Artificial sequence
  SiRNA target sequence
tgtacgacatttttttaaaaa

SEQ ID NO: 198695 - DNA, 21 bp, Artificial sequence
  SiRNA target sequence
gtacgacatttttttaaaaaa

SEQ ID NO: 198696 - DNA, 21 bp, Artificial sequence
  SiRNA target sequence
tacgacatttttttaaaaaat

SEQ ID NO: 198697 - DNA, 21 bp, Artificial sequence
  SiRNA target sequence
acgacatttttttaaaaaata

SEQ ID NO: 198698 - DNA, 21 bp, Artificial sequence
  SiRNA target sequence
cgacatttttttaaaaaatac

SEQ ID NO: 198699 - DNA, 21 bp, Artificial sequence
  SiRNA target sequence
gacatttttttaaaaaataca

SEQ ID NO: 198700 - DNA, 21 bp, Artificial sequence
  SiRNA target sequence
acatttttttaaaaaatacag

SEQ ID NO: 198701 - DNA, 21 bp, Artificial sequence
  SiRNA target sequence
catttttttaaaaaatacaga

SEQ ID NO: 198702 - DNA, 21 bp, Artificial sequence
  SiRNA target sequence
atttttttaaaaaatacagaa

SEQ ID NO: 198703 - DNA, 21 bp, Artificial sequence
  SiRNA target sequence
tttttttaaaaaatacagaaa

SEQ ID NO: 198704 - DNA, 21 bp, Artificial sequence
  SiRNA target sequence
ttttttaaaaaatacagaaat

SEQ ID NO: 198705 - DNA, 21 bp, Artificial sequence
  SiRNA target sequence
tttttaaaaaatacagaaatc

SEQ ID NO: 198706 - DNA, 21 bp, Artificial sequence
  SiRNA target sequence
ttttaaaaaatacagaaatcc

SEQ ID NO: 198707 - DNA, 21 bp, Artificial sequence
  SiRNA target sequence
tttaaaaaatacagaaatcca

SEQ ID NO: 198708 - DNA, 21 bp, Artificial sequence
  SiRNA target sequence
ttaaaaaatacagaaatccat

SEQ ID NO: 198709 - DNA, 21 bp, Artificial sequence
  SiRNA target sequence
taaaaaatacagaaatccatg

SEQ ID NO: 198710 - DNA, 21 bp, Artificial sequence
  SiRNA target sequence
aaaaaatacagaaatccatga

SEQ ID NO: 198711 - DNA, 21 bp, Artificial sequence
  SiRNA target sequence
aaaaatacagaaatccatgaa

SEQ ID NO: 198712 - DNA, 21 bp, Artificial sequence
  SiRNA target sequence
aaaatacagaaatccatgaaa

SEQ ID NO: 198713 - DNA, 21 bp, Artificial sequence
  SiRNA target sequence
aaatacagaaatccatgaaaa

SEQ ID NO: 198714 - DNA, 21 bp, Artificial sequence
  SiRNA target sequence
aatacagaaatccatgaaaaa

SEQ ID NO: 198715 - DNA, 21 bp, Artificial sequence
  SiRNA target sequence
atacagaaatccatgaaaaag

SEQ ID NO: 198716 - DNA, 21 bp, Artificial sequence
  SiRNA target sequence
tacagaaatccatgaaaaagc

SEQ ID NO: 198717 - DNA, 21 bp, Artificial sequence
  SiRNA target sequence
acagaaatccatgaaaaagca

SEQ ID NO: 198718 - DNA, 21 bp, Artificial sequence
  SiRNA target sequence
cagaaatccatgaaaaagcaa

SEQ ID NO: 198719 - DNA, 21 bp, Artificial sequence
  SiRNA target sequence
agaaatccatgaaaaagcaag

SEQ ID NO: 198720 - DNA, 21 bp, Artificial sequence
  SiRNA target sequence
gaaatccatgaaaaagcaagt

SEQ ID NO: 198721 - DNA, 21 bp, Artificial sequence
  SiRNA target sequence
aaatccatgaaaaagcaagtc

SEQ ID NO: 198722 - DNA, 21 bp, Artificial sequence
  SiRNA target sequence
aatccatgaaaaagcaagtcc

SEQ ID NO: 198723 - DNA, 21 bp, Artificial sequence
  SiRNA target sequence
atccatgaaaaagcaagtcct

SEQ ID NO: 198724 - DNA, 21 bp, Artificial sequence
  SiRNA target sequence
tccatgaaaaagcaagtcctt

SEQ ID NO: 198725 - DNA, 21 bp, Artificial sequence
  SiRNA target sequence
ccatgaaaaagcaagtccttc

SEQ ID NO: 198726 - DNA, 21 bp, Artificial sequence
  SiRNA target sequence
catgaaaaagcaagtccttca

SEQ ID NO: 198727 - DNA, 21 bp, Artificial sequence
  SiRNA target sequence
atgaaaaagcaagtccttcaa

SEQ ID NO: 198728 - DNA, 21 bp, Artificial sequence
  SiRNA target sequence
tgaaaaagcaagtccttcaat

SEQ ID NO: 198729 - DNA, 21 bp, Artificial sequence
  SiRNA target sequence
gaaaaagcaagtccttcaatg

SEQ ID NO: 198730 - DNA, 21 bp, Artificial sequence
  SiRNA target sequence
aaaaagcaagtccttcaatgg

SEQ ID NO: 198731 - DNA, 21 bp, Artificial sequence
  SiRNA target sequence
aaaagcaagtccttcaatggc

SEQ ID NO: 198732 - DNA, 21 bp, Artificial sequence
  SiRNA target sequence
aaagcaagtccttcaatggca

SEQ ID NO: 198733 - DNA, 21 bp, Artificial sequence
  SiRNA target sequence
aagcaagtccttcaatggcag

SEQ ID NO: 198734 - DNA, 21 bp, Artificial sequence
  SiRNA target sequence
agcaagtccttcaatggcaga

SEQ ID NO: 198735 - DNA, 21 bp, Artificial sequence
  SiRNA target sequence
gcaagtccttcaatggcagaa

SEQ ID NO: 198736 - DNA, 21 bp, Artificial sequence
  SiRNA target sequence
caagtccttcaatggcagaat

SEQ ID NO: 198737 - DNA, 21 bp, Artificial sequence
  SiRNA target sequence
aagtccttcaatggcagaatt

SEQ ID NO: 198738 - DNA, 21 bp, Artificial sequence
  SiRNA target sequence
agtccttcaatggcagaattg

SEQ ID NO: 198739 - DNA, 21 bp, Artificial sequence
  SiRNA target sequence
gtccttcaatggcagaattgt

SEQ ID NO: 198740 - DNA, 21 bp, Artificial sequence
  SiRNA target sequence
tccttcaatggcagaattgta

SEQ ID NO: 198741 - DNA, 21 bp, Artificial sequence
  SiRNA target sequence
ccttcaatggcagaattgtag

SEQ ID NO: 198742 - DNA, 21 bp, Artificial sequence
  SiRNA target sequence
cttcaatggcagaattgtaga

SEQ ID NO: 198743 - DNA, 21 bp, Artificial sequence
  SiRNA target sequence
ttcaatggcagaattgtagat

SEQ ID NO: 198744 - DNA, 21 bp, Artificial sequence
  SiRNA target sequence
tcaatggcagaattgtagatt

SEQ ID NO: 198745 - DNA, 21 bp, Artificial sequence
  SiRNA target sequence
caatggcagaattgtagattg

SEQ ID NO: 198746 - DNA, 21 bp, Artificial sequence
  SiRNA target sequence
aatggcagaattgtagattga

SEQ ID NO: 198747 - DNA, 21 bp, Artificial sequence
  SiRNA target sequence
atggcagaattgtagattgat

SEQ ID NO: 198748 - DNA, 21 bp, Artificial sequence
  SiRNA target sequence
tggcagaattgtagattgatg

SEQ ID NO: 198749 - DNA, 21 bp, Artificial sequence
  SiRNA target sequence
ggcagaattgtagattgatgc

SEQ ID NO: 198750 - DNA, 21 bp, Artificial sequence
  SiRNA target sequence
gcagaattgtagattgatgct

SEQ ID NO: 198751 - DNA, 21 bp, Artificial sequence
  SiRNA target sequence
cagaattgtagattgatgctc

SEQ ID NO: 198752 - DNA, 21 bp, Artificial sequence
  SiRNA target sequence
agaattgtagattgatgctcc

SEQ ID NO: 198753 - DNA, 21 bp, Artificial sequence
  SiRNA target sequence
gaattgtagattgatgctccc

SEQ ID NO: 198754 - DNA, 21 bp, Artificial sequence
  SiRNA target sequence
aattgtagattgatgctccca

SEQ ID NO: 198755 - DNA, 21 bp, Artificial sequence
  SiRNA target sequence
attgtagattgatgctcccat

SEQ ID NO: 198756 - DNA, 21 bp, Artificial sequence
  SiRNA target sequence
ttgtagattgatgctcccata

SEQ ID NO: 198757 - DNA, 21 bp, Artificial sequence
  SiRNA target sequence
tgtagattgatgctcccataa

SEQ ID NO: 198758 - DNA, 21 bp, Artificial sequence
  SiRNA target sequence
gtagattgatgctcccataac

SEQ ID NO: 198759 - DNA, 21 bp, Artificial sequence
  SiRNA target sequence
tagattgatgctcccataacg

SEQ ID NO: 198760 - DNA, 21 bp, Artificial sequence
  SiRNA target sequence
agattgatgctcccataacga

SEQ ID NO: 198761 - DNA, 21 bp, Artificial sequence
  SiRNA target sequence
gattgatgctcccataacgat

SEQ ID NO: 198762 - DNA, 21 bp, Artificial sequence
  SiRNA target sequence
attgatgctcccataacgatt

SEQ ID NO: 198763 - DNA, 21 bp, Artificial sequence
  SiRNA target sequence
ttgatgctcccataacgatta

SEQ ID NO: 198764 - DNA, 21 bp, Artificial sequence
  SiRNA target sequence
tgatgctcccataacgattat

SEQ ID NO: 198765 - DNA, 21 bp, Artificial sequence
  SiRNA target sequence
gatgctcccataacgattatt

SEQ ID NO: 198766 - DNA, 21 bp, Artificial sequence
  SiRNA target sequence
atgctcccataacgattattg

SEQ ID NO: 198767 - DNA, 21 bp, Artificial sequence
  SiRNA target sequence
tgctcccataacgattattga

SEQ ID NO: 198768 - DNA, 21 bp, Artificial sequence
  SiRNA target sequence
gctcccataacgattattgac

SEQ ID NO: 198769 - DNA, 21 bp, Artificial sequence
  SiRNA target sequence
ctcccataacgattattgacc

SEQ ID NO: 198770 - DNA, 21 bp, Artificial sequence
  SiRNA target sequence
tcccataacgattattgaccc

SEQ ID NO: 198771 - DNA, 21 bp, Artificial sequence
  SiRNA target sequence
cccataacgattattgacccc

SEQ ID NO: 198772 - DNA, 21 bp, Artificial sequence
  SiRNA target sequence
ccataacgattattgacccca

SEQ ID NO: 198773 - DNA, 21 bp, Artificial sequence
  SiRNA target sequence
cataacgattattgaccccaa

SEQ ID NO: 198774 - DNA, 21 bp, Artificial sequence
  SiRNA target sequence
ataacgattattgaccccaac

SEQ ID NO: 198775 - DNA, 21 bp, Artificial sequence
  SiRNA target sequence
taacgattattgaccccaaca

SEQ ID NO: 198776 - DNA, 21 bp, Artificial sequence
  SiRNA target sequence
aacgattattgaccccaacaa

SEQ ID NO: 198777 - DNA, 21 bp, Artificial sequence
  SiRNA target sequence
acgattattgaccccaacaac

SEQ ID NO: 198778 - DNA, 21 bp, Artificial sequence
  SiRNA target sequence
cgattattgaccccaacaaca

SEQ ID NO: 198779 - DNA, 21 bp, Artificial sequence
  SiRNA target sequence
gattattgaccccaacaacaa

SEQ ID NO: 198780 - DNA, 21 bp, Artificial sequence
  SiRNA target sequence
attattgaccccaacaacaag

SEQ ID NO: 198781 - DNA, 21 bp, Artificial sequence
  SiRNA target sequence
ttattgaccccaacaacaaga

SEQ ID NO: 198782 - DNA, 21 bp, Artificial sequence
  SiRNA target sequence
tattgaccccaacaacaagaa

SEQ ID NO: 198783 - DNA, 21 bp, Artificial sequence
  SiRNA target sequence
attgaccccaacaacaagaat

SEQ ID NO: 198784 - DNA, 21 bp, Artificial sequence
  SiRNA target sequence
ttgaccccaacaacaagaata

SEQ ID NO: 198785 - DNA, 21 bp, Artificial sequence
  SiRNA target sequence
tgaccccaacaacaagaataa

SEQ ID NO: 198786 - DNA, 21 bp, Artificial sequence
  SiRNA target sequence
gaccccaacaacaagaataaa

SEQ ID NO: 198787 - DNA, 21 bp, Artificial sequence
  SiRNA target sequence
accccaacaacaagaataaag

SEQ ID NO: 198788 - DNA, 21 bp, Artificial sequence
  SiRNA target sequence
ccccaacaacaagaataaagg

SEQ ID NO: 198789 - DNA, 21 bp, Artificial sequence
  SiRNA target sequence
cccaacaacaagaataaaggt

SEQ ID NO: 198790 - DNA, 21 bp, Artificial sequence
  SiRNA target sequence
ccaacaacaagaataaaggtg

SEQ ID NO: 198791 - DNA, 21 bp, Artificial sequence
  SiRNA target sequence
caacaacaagaataaaggtgt

SEQ ID NO: 198792 - DNA, 21 bp, Artificial sequence
  SiRNA target sequence
aacaacaagaataaaggtgtt

SEQ ID NO: 198793 - DNA, 21 bp, Artificial sequence
  SiRNA target sequence
acaacaagaataaaggtgtta

SEQ ID NO: 198794 - DNA, 21 bp, Artificial sequence
  SiRNA target sequence
caacaagaataaaggtgttaa

SEQ ID NO: 198795 - DNA, 21 bp, Artificial sequence
  SiRNA target sequence
aacaagaataaaggtgttaag

SEQ ID NO: 198796 - DNA, 21 bp, Artificial sequence
  SiRNA target sequence
acaagaataaaggtgttaaga

SEQ ID NO: 198797 - DNA, 21 bp, Artificial sequence
  SiRNA target sequence
caagaataaaggtgttaagag

SEQ ID NO: 198798 - DNA, 21 bp, Artificial sequence
  SiRNA target sequence
aagaataaaggtgttaagagt

SEQ ID NO: 198799 - DNA, 21 bp, Artificial sequence
  SiRNA target sequence
agaataaaggtgttaagagtc

SEQ ID NO: 198800 - DNA, 21 bp, Artificial sequence
  SiRNA target sequence
gaataaaggtgttaagagtcc

SEQ ID NO: 198801 - DNA, 21 bp, Artificial sequence
  SiRNA target sequence
aataaaggtgttaagagtccc

SEQ ID NO: 198802 - DNA, 21 bp, Artificial sequence
  SiRNA target sequence
ataaaggtgttaagagtccca

SEQ ID NO: 198803 - DNA, 21 bp, Artificial sequence
  SiRNA target sequence
taaaggtgttaagagtcccat

SEQ ID NO: 198804 - DNA, 21 bp, Artificial sequence
  SiRNA target sequence
aaaggtgttaagagtcccata

SEQ ID NO: 198805 - DNA, 21 bp, Artificial sequence
  SiRNA target sequence
aaggtgttaagagtcccatag

SEQ ID NO: 198806 - DNA, 21 bp, Artificial sequence
  SiRNA target sequence
aggtgttaagagtcccatagt

SEQ ID NO: 198807 - DNA, 21 bp, Artificial sequence
  SiRNA target sequence
ggtgttaagagtcccatagta

SEQ ID NO: 198808 - DNA, 21 bp, Artificial sequence
  SiRNA target sequence
gtgttaagagtcccatagtaa

SEQ ID NO: 198809 - DNA, 21 bp, Artificial sequence
  SiRNA target sequence
tgttaagagtcccatagtaat

SEQ ID NO: 198810 - DNA, 21 bp, Artificial sequence
  SiRNA target sequence
gttaagagtcccatagtaatc

SEQ ID NO: 198811 - DNA, 21 bp, Artificial sequence
  SiRNA target sequence
ttaagagtcccatagtaatcc

SEQ ID NO: 198812 - DNA, 21 bp, Artificial sequence
  SiRNA target sequence
taagagtcccatagtaatcca

SEQ ID NO: 198813 - DNA, 21 bp, Artificial sequence
  SiRNA target sequence
aagagtcccatagtaatccat

SEQ ID NO: 198814 - DNA, 21 bp, Artificial sequence
  SiRNA target sequence
agagtcccatagtaatccatc

SEQ ID NO: 198815 - DNA, 21 bp, Artificial sequence
  SiRNA target sequence
gagtcccatagtaatccatcc

SEQ ID NO: 198816 - DNA, 21 bp, Artificial sequence
  SiRNA target sequence
agtcccatagtaatccatcca

SEQ ID NO: 198817 - DNA, 21 bp, Artificial sequence
  SiRNA target sequence
gtcccatagtaatccatccac

SEQ ID NO: 198818 - DNA, 21 bp, Artificial sequence
  SiRNA target sequence
tcccatagtaatccatccact

SEQ ID NO: 198819 - DNA, 21 bp, Artificial sequence
  SiRNA target sequence
cccatagtaatccatccacta

SEQ ID NO: 198820 - DNA, 21 bp, Artificial sequence
  SiRNA target sequence
ccatagtaatccatccactac

SEQ ID NO: 198821 - DNA, 21 bp, Artificial sequence
  SiRNA target sequence
catagtaatccatccactact

SEQ ID NO: 198822 - DNA, 21 bp, Artificial sequence
  SiRNA target sequence
atagtaatccatccactactt

SEQ ID NO: 198823 - DNA, 21 bp, Artificial sequence
  SiRNA target sequence
tagtaatccatccactacttt

SEQ ID NO: 198824 - DNA, 21 bp, Artificial sequence
  SiRNA target sequence
agtaatccatccactactttc

SEQ ID NO: 198825 - DNA, 21 bp, Artificial sequence
  SiRNA target sequence
gtaatccatccactactttct

SEQ ID NO: 198826 - DNA, 21 bp, Artificial sequence
  SiRNA target sequence
taatccatccactactttcta

SEQ ID NO: 198827 - DNA, 21 bp, Artificial sequence
  SiRNA target sequence
aatccatccactactttctac

SEQ ID NO: 198828 - DNA, 21 bp, Artificial sequence
  SiRNA target sequence
atccatccactactttctact

SEQ ID NO: 198829 - DNA, 21 bp, Artificial sequence
  SiRNA target sequence
tccatccactactttctacta

SEQ ID NO: 198830 - DNA, 21 bp, Artificial sequence
  SiRNA target sequence
ccatccactactttctactaa

SEQ ID NO: 198831 - DNA, 21 bp, Artificial sequence
  SiRNA target sequence
catccactactttctactaaa

SEQ ID NO: 198832 - DNA, 21 bp, Artificial sequence
  SiRNA target sequence
atccactactttctactaaag

SEQ ID NO: 198833 - DNA, 21 bp, Artificial sequence
  SiRNA target sequence
tccactactttctactaaagt

SEQ ID NO: 198834 - DNA, 21 bp, Artificial sequence
  SiRNA target sequence
ccactactttctactaaagta

SEQ ID NO: 198835 - DNA, 21 bp, Artificial sequence
  SiRNA target sequence
cactactttctactaaagtag

SEQ ID NO: 198836 - DNA, 21 bp, Artificial sequence
  SiRNA target sequence
actactttctactaaagtaga

SEQ ID NO: 198837 - DNA, 21 bp, Artificial sequence
  SiRNA target sequence
ctactttctactaaagtagaa

SEQ ID NO: 198838 - DNA, 21 bp, Artificial sequence
  SiRNA target sequence
tactttctactaaagtagaaa

SEQ ID NO: 198839 - DNA, 21 bp, Artificial sequence
  SiRNA target sequence
actttctactaaagtagaaaa

SEQ ID NO: 198840 - DNA, 21 bp, Artificial sequence
  SiRNA target sequence
ctttctactaaagtagaaaat

SEQ ID NO: 198841 - DNA, 21 bp, Artificial sequence
  SiRNA target sequence
tttctactaaagtagaaaatg

SEQ ID NO: 198842 - DNA, 21 bp, Artificial sequence
  SiRNA target sequence
ttctactaaagtagaaaatgc

SEQ ID NO: 198843 - DNA, 21 bp, Artificial sequence
  SiRNA target sequence
tctactaaagtagaaaatgct

SEQ ID NO: 198844 - DNA, 21 bp, Artificial sequence
  SiRNA target sequence
ctactaaagtagaaaatgctg

SEQ ID NO: 198845 - DNA, 21 bp, Artificial sequence
  SiRNA target sequence
tactaaagtagaaaatgctga

SEQ ID NO: 198846 - DNA, 21 bp, Artificial sequence
  SiRNA target sequence
actaaagtagaaaatgctgac

SEQ ID NO: 198847 - DNA, 21 bp, Artificial sequence
  SiRNA target sequence
ctaaagtagaaaatgctgaca

SEQ ID NO: 198848 - DNA, 21 bp, Artificial sequence
  SiRNA target sequence
taaagtagaaaatgctgacaa

SEQ ID NO: 198849 - DNA, 21 bp, Artificial sequence
  SiRNA target sequence
aaagtagaaaatgctgacaaa

SEQ ID NO: 198850 - DNA, 21 bp, Artificial sequence
  SiRNA target sequence
aagtagaaaatgctgacaaat

SEQ ID NO: 198851 - DNA, 21 bp, Artificial sequence
  SiRNA target sequence
agtagaaaatgctgacaaatt

SEQ ID NO: 198852 - DNA, 21 bp, Artificial sequence
  SiRNA target sequence
gtagaaaatgctgacaaatta

SEQ ID NO: 198853 - DNA, 21 bp, Artificial sequence
  SiRNA target sequence
tagaaaatgctgacaaattaa

SEQ ID NO: 198854 - DNA, 21 bp, Artificial sequence
  SiRNA target sequence
agaaaatgctgacaaattaag

SEQ ID NO: 198855 - DNA, 21 bp, Artificial sequence
  SiRNA target sequence
gaaaatgctgacaaattaagt

SEQ ID NO: 198856 - DNA, 21 bp, Artificial sequence
  SiRNA target sequence
aaaatgctgacaaattaagtg

SEQ ID NO: 198857 - DNA, 21 bp, Artificial sequence
  SiRNA target sequence
aaatgctgacaaattaagtgt

SEQ ID NO: 198858 - DNA, 21 bp, Artificial sequence
  SiRNA target sequence
aatgctgacaaattaagtgtt

SEQ ID NO: 198859 - DNA, 21 bp, Artificial sequence
  SiRNA target sequence
atgctgacaaattaagtgtta

SEQ ID NO: 198860 - DNA, 21 bp, Artificial sequence
  SiRNA target sequence
tgctgacaaattaagtgttat

SEQ ID NO: 198861 - DNA, 21 bp, Artificial sequence
  SiRNA target sequence
gctgacaaattaagtgttatt

SEQ ID NO: 198862 - DNA, 21 bp, Artificial sequence
  SiRNA target sequence
ctgacaaattaagtgttatta

SEQ ID NO: 198863 - DNA, 21 bp, Artificial sequence
  SiRNA target sequence
tgacaaattaagtgttattac

SEQ ID NO: 198864 - DNA, 21 bp, Artificial sequence
  SiRNA target sequence
gacaaattaagtgttattaca

SEQ ID NO: 198865 - DNA, 21 bp, Artificial sequence
  SiRNA target sequence
acaaattaagtgttattacag

SEQ ID NO: 198866 - DNA, 21 bp, Artificial sequence
  SiRNA target sequence
caaattaagtgttattacagt

SEQ ID NO: 198867 - DNA, 21 bp, Artificial sequence
  SiRNA target sequence
aaattaagtgttattacagta

SEQ ID NO: 198868 - DNA, 21 bp, Artificial sequence
  SiRNA target sequence
aattaagtgttattacagtaa

SEQ ID NO: 198869 - DNA, 21 bp, Artificial sequence
  SiRNA target sequence
attaagtgttattacagtaac

SEQ ID NO: 198870 - DNA, 21 bp, Artificial sequence
  SiRNA target sequence
ttaagtgttattacagtaact

SEQ ID NO: 198871 - DNA, 21 bp, Artificial sequence
  SiRNA target sequence
taagtgttattacagtaactg

SEQ ID NO: 198872 - DNA, 21 bp, Artificial sequence
  SiRNA target sequence
aagtgttattacagtaactgc

SEQ ID NO: 198873 - DNA, 21 bp, Artificial sequence
  SiRNA target sequence
agtgttattacagtaactgct

SEQ ID NO: 198874 - DNA, 21 bp, Artificial sequence
  SiRNA target sequence
gtgttattacagtaactgcta

SEQ ID NO: 198875 - DNA, 21 bp, Artificial sequence
  SiRNA target sequence
tgttattacagtaactgctac

SEQ ID NO: 198876 - DNA, 21 bp, Artificial sequence
  SiRNA target sequence
gttattacagtaactgctacc

SEQ ID NO: 198877 - DNA, 21 bp, Artificial sequence
  SiRNA target sequence
ttattacagtaactgctacca

SEQ ID NO: 198878 - DNA, 21 bp, Artificial sequence
  SiRNA target sequence
tattacagtaactgctaccaa

SEQ ID NO: 198879 - DNA, 21 bp, Artificial sequence
  SiRNA target sequence
attacagtaactgctaccaat

SEQ ID NO: 198880 - DNA, 21 bp, Artificial sequence
  SiRNA target sequence
ttacagtaactgctaccaata

SEQ ID NO: 198881 - DNA, 21 bp, Artificial sequence
  SiRNA target sequence
tacagtaactgctaccaatat

SEQ ID NO: 198882 - DNA, 21 bp, Artificial sequence
  SiRNA target sequence
acagtaactgctaccaatatt

SEQ ID NO: 198883 - DNA, 21 bp, Artificial sequence
  SiRNA target sequence
cagtaactgctaccaatattt

SEQ ID NO: 198884 - DNA, 21 bp, Artificial sequence
  SiRNA target sequence
agtaactgctaccaatatttg

SEQ ID NO: 198885 - DNA, 21 bp, Artificial sequence
  SiRNA target sequence
gtaactgctaccaatatttga

SEQ ID NO: 198886 - DNA, 21 bp, Artificial sequence
  SiRNA target sequence
taactgctaccaatatttgat

SEQ ID NO: 198887 - DNA, 21 bp, Artificial sequence
  SiRNA target sequence
aactgctaccaatatttgatc

SEQ ID NO: 198888 - DNA, 21 bp, Artificial sequence
  SiRNA target sequence
actgctaccaatatttgatct

SEQ ID NO: 198889 - DNA, 21 bp, Artificial sequence
  SiRNA target sequence
ctgctaccaatatttgatcta

SEQ ID NO: 198890 - DNA, 21 bp, Artificial sequence
  SiRNA target sequence
tgctaccaatatttgatctat

SEQ ID NO: 198891 - DNA, 21 bp, Artificial sequence
  SiRNA target sequence
gctaccaatatttgatctatt

SEQ ID NO: 198892 - DNA, 21 bp, Artificial sequence
  SiRNA target sequence
ctaccaatatttgatctattg

SEQ ID NO: 198893 - DNA, 21 bp, Artificial sequence
  SiRNA target sequence
taccaatatttgatctattgt

SEQ ID NO: 198894 - DNA, 21 bp, Artificial sequence
  SiRNA target sequence
accaatatttgatctattgta

SEQ ID NO: 198895 - DNA, 21 bp, Artificial sequence
  SiRNA target sequence
ccaatatttgatctattgtat

SEQ ID NO: 198896 - DNA, 21 bp, Artificial sequence
  SiRNA target sequence
caatatttgatctattgtatt

SEQ ID NO: 198897 - DNA, 21 bp, Artificial sequence
  SiRNA target sequence
aatatttgatctattgtatta

SEQ ID NO: 198898 - DNA, 21 bp, Artificial sequence
  SiRNA target sequence
atatttgatctattgtattaa

SEQ ID NO: 198899 - DNA, 21 bp, Artificial sequence
  SiRNA target sequence
tatttgatctattgtattaaa

SEQ ID NO: 198900 - DNA, 21 bp, Artificial sequence
  SiRNA target sequence
atttgatctattgtattaaat

SEQ ID NO: 198901 - DNA, 21 bp, Artificial sequence
  SiRNA target sequence
tttgatctattgtattaaatt

SEQ ID NO: 198902 - DNA, 21 bp, Artificial sequence
  SiRNA target sequence
ttgatctattgtattaaattt

SEQ ID NO: 198903 - DNA, 21 bp, Artificial sequence
  SiRNA target sequence
tgatctattgtattaaatttg

SEQ ID NO: 198904 - DNA, 21 bp, Artificial sequence
  SiRNA target sequence
gatctattgtattaaatttgc

SEQ ID NO: 198905 - DNA, 21 bp, Artificial sequence
  SiRNA target sequence
atctattgtattaaatttgcc

SEQ ID NO: 198906 - DNA, 21 bp, Artificial sequence
  SiRNA target sequence
tctattgtattaaatttgccg

SEQ ID NO: 198907 - DNA, 21 bp, Artificial sequence
  SiRNA target sequence
ctattgtattaaatttgccgg

SEQ ID NO: 198908 - DNA, 21 bp, Artificial sequence
  SiRNA target sequence
tattgtattaaatttgccgga

SEQ ID NO: 198909 - DNA, 21 bp, Artificial sequence
  SiRNA target sequence
attgtattaaatttgccggag

SEQ ID NO: 198910 - DNA, 21 bp, Artificial sequence
  SiRNA target sequence
ttgtattaaatttgccggagt

SEQ ID NO: 198911 - DNA, 21 bp, Artificial sequence
  SiRNA target sequence
tgtattaaatttgccggagta

SEQ ID NO: 198912 - DNA, 21 bp, Artificial sequence
  SiRNA target sequence
gtattaaatttgccggagtat

SEQ ID NO: 198913 - DNA, 21 bp, Artificial sequence
  SiRNA target sequence
tattaaatttgccggagtatt

SEQ ID NO: 198914 - DNA, 21 bp, Artificial sequence
  SiRNA target sequence
attaaatttgccggagtattc

SEQ ID NO: 198915 - DNA, 21 bp, Artificial sequence
  SiRNA target sequence
ttaaatttgccggagtattct

SEQ ID NO: 198916 - DNA, 21 bp, Artificial sequence
  SiRNA target sequence
taaatttgccggagtattctc

SEQ ID NO: 198917 - DNA, 21 bp, Artificial sequence
  SiRNA target sequence
aaatttgccggagtattctcc

SEQ ID NO: 198918 - DNA, 21 bp, Artificial sequence
  SiRNA target sequence
aatttgccggagtattctcct

SEQ ID NO: 198919 - DNA, 21 bp, Artificial sequence
  SiRNA target sequence
atttgccggagtattctccta

SEQ ID NO: 198920 - DNA, 21 bp, Artificial sequence
  SiRNA target sequence
tttgccggagtattctcctac

SEQ ID NO: 198921 - DNA, 21 bp, Artificial sequence
  SiRNA target sequence
ttgccggagtattctcctacc

SEQ ID NO: 198922 - DNA, 21 bp, Artificial sequence
  SiRNA target sequence
tgccggagtattctcctacct

SEQ ID NO: 198923 - DNA, 21 bp, Artificial sequence
  SiRNA target sequence
gccggagtattctcctacctc

SEQ ID NO: 198924 - DNA, 21 bp, Artificial sequence
  SiRNA target sequence
ccggagtattctcctacctct

SEQ ID NO: 198925 - DNA, 21 bp, Artificial sequence
  SiRNA target sequence
cggagtattctcctacctcta

SEQ ID NO: 198926 - DNA, 21 bp, Artificial sequence
  SiRNA target sequence
ggagtattctcctacctctaa

SEQ ID NO: 198927 - DNA, 21 bp, Artificial sequence
  SiRNA target sequence
gagtattctcctacctctaat

SEQ ID NO: 198928 - DNA, 21 bp, Artificial sequence
  SiRNA target sequence
agtattctcctacctctaatc

SEQ ID NO: 198929 - DNA, 21 bp, Artificial sequence
  SiRNA target sequence
gtattctcctacctctaatcc

SEQ ID NO: 198930 - DNA, 21 bp, Artificial sequence
  SiRNA target sequence
tattctcctacctctaatcct

SEQ ID NO: 198931 - DNA, 21 bp, Artificial sequence
  SiRNA target sequence
attctcctacctctaatccta

SEQ ID NO: 198932 - DNA, 21 bp, Artificial sequence
  SiRNA target sequence
ttctcctacctctaatcctaa

SEQ ID NO: 198933 - DNA, 21 bp, Artificial sequence
  SiRNA target sequence
tctcctacctctaatcctaaa

SEQ ID NO: 198934 - DNA, 21 bp, Artificial sequence
  SiRNA target sequence
ctcctacctctaatcctaaac

SEQ ID NO: 198935 - DNA, 21 bp, Artificial sequence
  SiRNA target sequence
tcctacctctaatcctaaact

SEQ ID NO: 198936 - DNA, 21 bp, Artificial sequence
  SiRNA target sequence
cctacctctaatcctaaactt

SEQ ID NO: 198937 - DNA, 21 bp, Artificial sequence
  SiRNA target sequence
ctacctctaatcctaaacttt

SEQ ID NO: 198938 - DNA, 21 bp, Artificial sequence
  SiRNA target sequence
tacctctaatcctaaactttt

SEQ ID NO: 198939 - DNA, 21 bp, Artificial sequence
  SiRNA target sequence
acctctaatcctaaacttttt

SEQ ID NO: 198940 - DNA, 21 bp, Artificial sequence
  SiRNA target sequence
cctctaatcctaaactttttg

SEQ ID NO: 198941 - DNA, 21 bp, Artificial sequence
  SiRNA target sequence
ctctaatcctaaactttttga

SEQ ID NO: 198942 - DNA, 21 bp, Artificial sequence
  SiRNA target sequence
tctaatcctaaactttttgac

SEQ ID NO: 198943 - DNA, 21 bp, Artificial sequence
  SiRNA target sequence
ctaatcctaaactttttgacg

SEQ ID NO: 198944 - DNA, 21 bp, Artificial sequence
  SiRNA target sequence
taatcctaaactttttgacgc

SEQ ID NO: 198945 - DNA, 21 bp, Artificial sequence
  SiRNA target sequence
aatcctaaactttttgacgca

SEQ ID NO: 198946 - DNA, 21 bp, Artificial sequence
  SiRNA target sequence
atcctaaactttttgacgcag

SEQ ID NO: 198947 - DNA, 21 bp, Artificial sequence
  SiRNA target sequence
tcctaaactttttgacgcagc

SEQ ID NO: 198948 - DNA, 21 bp, Artificial sequence
  SiRNA target sequence
cctaaactttttgacgcagct

SEQ ID NO: 198949 - DNA, 21 bp, Artificial sequence
  SiRNA target sequence
ctaaactttttgacgcagctt

SEQ ID NO: 198950 - DNA, 21 bp, Artificial sequence
  SiRNA target sequence
taaactttttgacgcagcttt

SEQ ID NO: 198951 - DNA, 21 bp, Artificial sequence
  SiRNA target sequence
aaactttttgacgcagcttta

SEQ ID NO: 198952 - DNA, 21 bp, Artificial sequence
  SiRNA target sequence
aactttttgacgcagctttaa

SEQ ID NO: 198953 - DNA, 21 bp, Artificial sequence
  SiRNA target sequence
actttttgacgcagctttaat

SEQ ID NO: 198954 - DNA, 21 bp, Artificial sequence
  SiRNA target sequence
ctttttgacgcagctttaatt

SEQ ID NO: 198955 - DNA, 21 bp, Artificial sequence
  SiRNA target sequence
tttttgacgcagctttaattc

SEQ ID NO: 198956 - DNA, 21 bp, Artificial sequence
  SiRNA target sequence
ttttgacgcagctttaattcc

SEQ ID NO: 198957 - DNA, 21 bp, Artificial sequence
  SiRNA target sequence
tttgacgcagctttaattcct

SEQ ID NO: 198958 - DNA, 21 bp, Artificial sequence
  SiRNA target sequence
ttgacgcagctttaattcctg

SEQ ID NO: 198959 - DNA, 21 bp, Artificial sequence
  SiRNA target sequence
tgacgcagctttaattcctgc

SEQ ID NO: 198960 - DNA, 21 bp, Artificial sequence
  SiRNA target sequence
gacgcagctttaattcctgct

SEQ ID NO: 198961 - DNA, 21 bp, Artificial sequence
  SiRNA target sequence
acgcagctttaattcctgctt

SEQ ID NO: 198962 - DNA, 21 bp, Artificial sequence
  SiRNA target sequence
cgcagctttaattcctgcttt

SEQ ID NO: 198963 - DNA, 21 bp, Artificial sequence
  SiRNA target sequence
gcagctttaattcctgcttta

SEQ ID NO: 198964 - DNA, 21 bp, Artificial sequence
  SiRNA target sequence
cagctttaattcctgctttat

SEQ ID NO: 198965 - DNA, 21 bp, Artificial sequence
  SiRNA target sequence
agctttaattcctgctttata

SEQ ID NO: 198966 - DNA, 21 bp, Artificial sequence
  SiRNA target sequence
gctttaattcctgctttatag

SEQ ID NO: 198967 - DNA, 21 bp, Artificial sequence
  SiRNA target sequence
ctttaattcctgctttataga

SEQ ID NO: 198968 - DNA, 21 bp, Artificial sequence
  SiRNA target sequence
tttaattcctgctttatagac

SEQ ID NO: 198969 - DNA, 21 bp, Artificial sequence
  SiRNA target sequence
ttaattcctgctttatagaca

SEQ ID NO: 198970 - DNA, 21 bp, Artificial sequence
  SiRNA target sequence
taattcctgctttatagacag

SEQ ID NO: 198971 - DNA, 21 bp, Artificial sequence
  SiRNA target sequence
aattcctgctttatagacaga

SEQ ID NO: 198972 - DNA, 21 bp, Artificial sequence
  SiRNA target sequence
attcctgctttatagacagat

SEQ ID NO: 198973 - DNA, 21 bp, Artificial sequence
  SiRNA target sequence
ttcctgctttatagacagatt

SEQ ID NO: 198974 - DNA, 21 bp, Artificial sequence
  SiRNA target sequence
tcctgctttatagacagattc

SEQ ID NO: 198975 - DNA, 21 bp, Artificial sequence
  SiRNA target sequence
cctgctttatagacagattca

SEQ ID NO: 198976 - DNA, 21 bp, Artificial sequence
  SiRNA target sequence
ctgctttatagacagattcaa

SEQ ID NO: 198977 - DNA, 21 bp, Artificial sequence
  SiRNA target sequence
tgctttatagacagattcaat

SEQ ID NO: 198978 - DNA, 21 bp, Artificial sequence
  SiRNA target sequence
gctttatagacagattcaatt

SEQ ID NO: 198979 - DNA, 21 bp, Artificial sequence
  SiRNA target sequence
ctttatagacagattcaatta

SEQ ID NO: 198980 - DNA, 21 bp, Artificial sequence
  SiRNA target sequence
tttatagacagattcaattaa

SEQ ID NO: 198981 - DNA, 21 bp, Artificial sequence
  SiRNA target sequence
ttatagacagattcaattaaa

SEQ ID NO: 198982 - DNA, 21 bp, Artificial sequence
  SiRNA target sequence
tatagacagattcaattaaat

SEQ ID NO: 198983 - DNA, 21 bp, Artificial sequence
  SiRNA target sequence
atagacagattcaattaaatt

SEQ ID NO: 198984 - DNA, 21 bp, Artificial sequence
  SiRNA target sequence
tagacagattcaattaaatta

SEQ ID NO: 198985 - DNA, 21 bp, Artificial sequence
  SiRNA target sequence
agacagattcaattaaattaa

SEQ ID NO: 198986 - DNA, 21 bp, Artificial sequence
  SiRNA target sequence
gacagattcaattaaattaaa

SEQ ID NO: 198987 - DNA, 21 bp, Artificial sequence
  SiRNA target sequence
acagattcaattaaattaaat

SEQ ID NO: 198988 - DNA, 21 bp, Artificial sequence
  SiRNA target sequence
cagattcaattaaattaaatg

SEQ ID NO: 198989 - DNA, 21 bp, Artificial sequence
  SiRNA target sequence
agattcaattaaattaaatgt

SEQ ID NO: 198990 - DNA, 21 bp, Artificial sequence
  SiRNA target sequence
gattcaattaaattaaatgtt

SEQ ID NO: 198991 - DNA, 21 bp, Artificial sequence
  SiRNA target sequence
attcaattaaattaaatgtta

SEQ ID NO: 198992 - DNA, 21 bp, Artificial sequence
  SiRNA target sequence
ttcaattaaattaaatgttat

SEQ ID NO: 198993 - DNA, 21 bp, Artificial sequence
  SiRNA target sequence
tcaattaaattaaatgttata

SEQ ID NO: 198994 - DNA, 21 bp, Artificial sequence
  SiRNA target sequence
caattaaattaaatgttatat

SEQ ID NO: 198995 - DNA, 21 bp, Artificial sequence
  SiRNA target sequence
aattaaattaaatgttatatt

SEQ ID NO: 198996 - DNA, 21 bp, Artificial sequence
  SiRNA target sequence
attaaattaaatgttatattg

SEQ ID NO: 198997 - DNA, 21 bp, Artificial sequence
  SiRNA target sequence
ttaaattaaatgttatattgt

SEQ ID NO: 198998 - DNA, 21 bp, Artificial sequence
  SiRNA target sequence
taaattaaatgttatattgta

SEQ ID NO: 198999 - DNA, 21 bp, Artificial sequence
  SiRNA target sequence
aaattaaatgttatattgtaa

SEQ ID NO: 199000 - DNA, 21 bp, Artificial sequence
  SiRNA target sequence
aattaaatgttatattgtaaa

SEQ ID NO: 199001 - DNA, 21 bp, Artificial sequence
  SiRNA target sequence
attaaatgttatattgtaaaa

SEQ ID NO: 199002 - DNA, 21 bp, Artificial sequence
  SiRNA target sequence
ttaaatgttatattgtaaaaa

SEQ ID NO: 199003 - DNA, 21 bp, Artificial sequence
  SiRNA target sequence
taaatgttatattgtaaaaaa

SEQ ID NO: 199004 - DNA, 21 bp, Artificial sequence
  SiRNA target sequence
aaatgttatattgtaaaaaaa

SEQ ID NO: 199005 - DNA, 21 bp, Artificial sequence
  SiRNA target sequence
aatgttatattgtaaaaaaag

SEQ ID NO: 199006 - DNA, 21 bp, Artificial sequence
  SiRNA target sequence
atgttatattgtaaaaaaaga

SEQ ID NO: 199007 - DNA, 21 bp, Artificial sequence
  SiRNA target sequence
tgttatattgtaaaaaaagac

SEQ ID NO: 199008 - DNA, 21 bp, Artificial sequence
  SiRNA target sequence
gttatattgtaaaaaaagact

SEQ ID NO: 199009 - DNA, 21 bp, Artificial sequence
  SiRNA target sequence
ttatattgtaaaaaaagacta

SEQ ID NO: 199010 - DNA, 21 bp, Artificial sequence
  SiRNA target sequence
tatattgtaaaaaaagactat

SEQ ID NO: 199011 - DNA, 21 bp, Artificial sequence
  SiRNA target sequence
atattgtaaaaaaagactatt

SEQ ID NO: 199012 - DNA, 21 bp, Artificial sequence
  SiRNA target sequence
tattgtaaaaaaagactatta

SEQ ID NO: 199013 - DNA, 21 bp, Artificial sequence
  SiRNA target sequence
attgtaaaaaaagactattat

SEQ ID NO: 199014 - DNA, 21 bp, Artificial sequence
  SiRNA target sequence
ttgtaaaaaaagactattata

SEQ ID NO: 199015 - DNA, 21 bp, Artificial sequence
  SiRNA target sequence
tgtaaaaaaagactattatac

SEQ ID NO: 199016 - DNA, 21 bp, Artificial sequence
  SiRNA target sequence
gtaaaaaaagactattataca

SEQ ID NO: 199017 - DNA, 21 bp, Artificial sequence
  SiRNA target sequence
taaaaaaagactattatacaa

SEQ ID NO: 199018 - DNA, 21 bp, Artificial sequence
  SiRNA target sequence
aaaaaaagactattatacaaa

SEQ ID NO: 199019 - DNA, 21 bp, Artificial sequence
  SiRNA target sequence
aaaaaagactattatacaaag

SEQ ID NO: 199020 - DNA, 21 bp, Artificial sequence
  SiRNA target sequence
aaaaagactattatacaaagt

SEQ ID NO: 199021 - DNA, 21 bp, Artificial sequence
  SiRNA target sequence
aaaagactattatacaaagtg

SEQ ID NO: 199022 - DNA, 21 bp, Artificial sequence
  SiRNA target sequence
aaagactattatacaaagtga

SEQ ID NO: 199023 - DNA, 21 bp, Artificial sequence
  SiRNA target sequence
aagactattatacaaagtgac

SEQ ID NO: 199024 - DNA, 21 bp, Artificial sequence
  SiRNA target sequence
agactattatacaaagtgaca

SEQ ID NO: 199025 - DNA, 21 bp, Artificial sequence
  SiRNA target sequence
gactattatacaaagtgacat

SEQ ID NO: 199026 - DNA, 21 bp, Artificial sequence
  SiRNA target sequence
actattatacaaagtgacatt

SEQ ID NO: 199027 - DNA, 21 bp, Artificial sequence
  SiRNA target sequence
ctattatacaaagtgacatta

SEQ ID NO: 199028 - DNA, 21 bp, Artificial sequence
  SiRNA target sequence
tattatacaaagtgacattaa

SEQ ID NO: 199029 - DNA, 21 bp, Artificial sequence
  SiRNA target sequence
attatacaaagtgacattaat

SEQ ID NO: 199030 - DNA, 21 bp, Artificial sequence
  SiRNA target sequence
ttatacaaagtgacattaata

SEQ ID NO: 199031 - DNA, 21 bp, Artificial sequence
  SiRNA target sequence
tatacaaagtgacattaataa

SEQ ID NO: 199032 - DNA, 21 bp, Artificial sequence
  SiRNA target sequence
atacaaagtgacattaataat

SEQ ID NO: 199033 - DNA, 21 bp, Artificial sequence
  SiRNA target sequence
tacaaagtgacattaataatt

SEQ ID NO: 199034 - DNA, 21 bp, Artificial sequence
  SiRNA target sequence
acaaagtgacattaataattt

SEQ ID NO: 199035 - DNA, 21 bp, Artificial sequence
  SiRNA target sequence
caaagtgacattaataatttt

SEQ ID NO: 199036 - DNA, 21 bp, Artificial sequence
  SiRNA target sequence
aaagtgacattaataattttg

SEQ ID NO: 199037 - DNA, 21 bp, Artificial sequence
  SiRNA target sequence
aagtgacattaataattttga

SEQ ID NO: 199038 - DNA, 21 bp, Artificial sequence
  SiRNA target sequence
agtgacattaataattttgat

SEQ ID NO: 199039 - DNA, 21 bp, Artificial sequence
  SiRNA target sequence
gtgacattaataattttgatt

SEQ ID NO: 199040 - DNA, 21 bp, Artificial sequence
  SiRNA target sequence
tgacattaataattttgattt

SEQ ID NO: 199041 - DNA, 21 bp, Artificial sequence
  SiRNA target sequence
gacattaataattttgatttc

SEQ ID NO: 199042 - DNA, 21 bp, Artificial sequence
  SiRNA target sequence
acattaataattttgatttca

SEQ ID NO: 199043 - DNA, 21 bp, Artificial sequence
  SiRNA target sequence
cattaataattttgatttcat

SEQ ID NO: 199044 - DNA, 21 bp, Artificial sequence
  SiRNA target sequence
attaataattttgatttcatc

SEQ ID NO: 199045 - DNA, 21 bp, Artificial sequence
  SiRNA target sequence
ttaataattttgatttcatca

SEQ ID NO: 199046 - DNA, 21 bp, Artificial sequence
  SiRNA target sequence
taataattttgatttcatcat

SEQ ID NO: 199047 - DNA, 21 bp, Artificial sequence
  SiRNA target sequence
aataattttgatttcatcatt

SEQ ID NO: 199048 - DNA, 21 bp, Artificial sequence
  SiRNA target sequence
ataattttgatttcatcatta

SEQ ID NO: 199049 - DNA, 21 bp, Artificial sequence
  SiRNA target sequence
taattttgatttcatcattat

SEQ ID NO: 199050 - DNA, 21 bp, Artificial sequence
  SiRNA target sequence
aattttgatttcatcattata

SEQ ID NO: 199051 - DNA, 21 bp, Artificial sequence
  SiRNA target sequence
attttgatttcatcattatac

SEQ ID NO: 199052 - DNA, 21 bp, Artificial sequence
  SiRNA target sequence
ttttgatttcatcattatact

SEQ ID NO: 199053 - DNA, 21 bp, Artificial sequence
  SiRNA target sequence
tttgatttcatcattatacta

SEQ ID NO: 199054 - DNA, 21 bp, Artificial sequence
  SiRNA target sequence
ttgatttcatcattatactaa

SEQ ID NO: 199055 - DNA, 21 bp, Artificial sequence
  SiRNA target sequence
tgatttcatcattatactaat

SEQ ID NO: 199056 - DNA, 21 bp, Artificial sequence
  SiRNA target sequence
gatttcatcattatactaata

SEQ ID NO: 199057 - DNA, 21 bp, Artificial sequence
  SiRNA target sequence
atttcatcattatactaatac

SEQ ID NO: 199058 - DNA, 21 bp, Artificial sequence
  SiRNA target sequence
tttcatcattatactaatacc

SEQ ID NO: 199059 - DNA, 21 bp, Artificial sequence
  SiRNA target sequence
ttcatcattatactaatacct

SEQ ID NO: 199060 - DNA, 21 bp, Artificial sequence
  SiRNA target sequence
tcatcattatactaatacctt

SEQ ID NO: 199061 - DNA, 21 bp, Artificial sequence
  SiRNA target sequence
catcattatactaataccttc

SEQ ID NO: 199062 - DNA, 21 bp, Artificial sequence
  SiRNA target sequence
atcattatactaataccttcg

SEQ ID NO: 199063 - DNA, 21 bp, Artificial sequence
  SiRNA target sequence
tcattatactaataccttcgg

SEQ ID NO: 199064 - DNA, 21 bp, Artificial sequence
  SiRNA target sequence
cattatactaataccttcgga

SEQ ID NO: 199065 - DNA, 21 bp, Artificial sequence
  SiRNA target sequence
attatactaataccttcggag

SEQ ID NO: 199066 - DNA, 21 bp, Artificial sequence
  SiRNA target sequence
ttatactaataccttcggaga

SEQ ID NO: 199067 - DNA, 21 bp, Artificial sequence
  SiRNA target sequence
tatactaataccttcggagaa

SEQ ID NO: 199068 - DNA, 21 bp, Artificial sequence
  SiRNA target sequence
atactaataccttcggagaaa

SEQ ID NO: 199069 - DNA, 21 bp, Artificial sequence
  SiRNA target sequence
tactaataccttcggagaaac

SEQ ID NO: 199070 - DNA, 21 bp, Artificial sequence
  SiRNA target sequence
actaataccttcggagaaacc

SEQ ID NO: 199071 - DNA, 21 bp, Artificial sequence
  SiRNA target sequence
ctaataccttcggagaaacct

SEQ ID NO: 199072 - DNA, 21 bp, Artificial sequence
  SiRNA target sequence
taataccttcggagaaaccta

SEQ ID NO: 199073 - DNA, 21 bp, Artificial sequence
  SiRNA target sequence
aataccttcggagaaacctac

SEQ ID NO: 199074 - DNA, 21 bp, Artificial sequence
  SiRNA target sequence
ataccttcggagaaacctaca

SEQ ID NO: 199075 - DNA, 21 bp, Artificial sequence
  SiRNA target sequence
taccttcggagaaacctacac

SEQ ID NO: 199076 - DNA, 21 bp, Artificial sequence
  SiRNA target sequence
accttcggagaaacctacact

SEQ ID NO: 199077 - DNA, 21 bp, Artificial sequence
  SiRNA target sequence
ccttcggagaaacctacacta

SEQ ID NO: 199078 - DNA, 21 bp, Artificial sequence
  SiRNA target sequence
cttcggagaaacctacactaa

SEQ ID NO: 199079 - DNA, 21 bp, Artificial sequence
  SiRNA target sequence
ttcggagaaacctacactaac

SEQ ID NO: 199080 - DNA, 21 bp, Artificial sequence
  SiRNA target sequence
tcggagaaacctacactaact

SEQ ID NO: 199081 - DNA, 21 bp, Artificial sequence
  SiRNA target sequence
cggagaaacctacactaactt

SEQ ID NO: 199082 - DNA, 21 bp, Artificial sequence
  SiRNA target sequence
ggagaaacctacactaacttt

SEQ ID NO: 199083 - DNA, 21 bp, Artificial sequence
  SiRNA target sequence
gagaaacctacactaactttt

SEQ ID NO: 199084 - DNA, 21 bp, Artificial sequence
  SiRNA target sequence
agaaacctacactaacttttt

SEQ ID NO: 199085 - DNA, 21 bp, Artificial sequence
  SiRNA target sequence
gaaacctacactaactttttg

SEQ ID NO: 199086 - DNA, 21 bp, Artificial sequence
  SiRNA target sequence
aaacctacactaactttttgt

SEQ ID NO: 199087 - DNA, 21 bp, Artificial sequence
  SiRNA target sequence
aacctacactaactttttgtt

SEQ ID NO: 199088 - DNA, 21 bp, Artificial sequence
  SiRNA target sequence
acctacactaactttttgttt

SEQ ID NO: 199089 - DNA, 21 bp, Artificial sequence
  SiRNA target sequence
cctacactaactttttgtttc

SEQ ID NO: 199090 - DNA, 21 bp, Artificial sequence
  SiRNA target sequence
ctacactaactttttgtttct

SEQ ID NO: 199091 - DNA, 21 bp, Artificial sequence
  SiRNA target sequence
tacactaactttttgtttctt

SEQ ID NO: 199092 - DNA, 21 bp, Artificial sequence
  SiRNA target sequence
acactaactttttgtttcttt

SEQ ID NO: 199093 - DNA, 21 bp, Artificial sequence
  SiRNA target sequence
cactaactttttgtttctttt

SEQ ID NO: 199094 - DNA, 21 bp, Artificial sequence
  SiRNA target sequence
actaactttttgtttcttttt

SEQ ID NO: 199095 - DNA, 21 bp, Artificial sequence
  SiRNA target sequence
ctaactttttgtttctttttt

SEQ ID NO: 199096 - DNA, 21 bp, Artificial sequence
  SiRNA target sequence
taactttttgtttctttttta

SEQ ID NO: 199097 - DNA, 21 bp, Artificial sequence
  SiRNA target sequence
aactttttgtttcttttttat

SEQ ID NO: 199098 - DNA, 21 bp, Artificial sequence
  SiRNA target sequence
actttttgtttcttttttatc

SEQ ID NO: 199099 - DNA, 21 bp, Artificial sequence
  SiRNA target sequence
ctttttgtttcttttttatcg

SEQ ID NO: 199100 - DNA, 21 bp, Artificial sequence
  SiRNA target sequence
tttttgtttcttttttatcgt

SEQ ID NO: 199101 - DNA, 21 bp, Artificial sequence
  SiRNA target sequence
ttttgtttcttttttatcgta

SEQ ID NO: 199102 - DNA, 21 bp, Artificial sequence
  SiRNA target sequence
tttgtttcttttttatcgtat

SEQ ID NO: 199103 - DNA, 21 bp, Artificial sequence
  SiRNA target sequence
ttgtttcttttttatcgtatt

SEQ ID NO: 199104 - DNA, 21 bp, Artificial sequence
  SiRNA target sequence
tgtttcttttttatcgtatta

SEQ ID NO: 199105 - DNA, 21 bp, Artificial sequence
  SiRNA target sequence
gtttcttttttatcgtattag

SEQ ID NO: 199106 - DNA, 21 bp, Artificial sequence
  SiRNA target sequence
tttcttttttatcgtattaga

SEQ ID NO: 199107 - DNA, 21 bp, Artificial sequence
  SiRNA target sequence
ttcttttttatcgtattagaa

SEQ ID NO: 199108 - DNA, 21 bp, Artificial sequence
  SiRNA target sequence
tcttttttatcgtattagaag

SEQ ID NO: 199109 - DNA, 21 bp, Artificial sequence
  SiRNA target sequence
cttttttatcgtattagaagg

SEQ ID NO: 199110 - DNA, 21 bp, Artificial sequence
  SiRNA target sequence
ttttttatcgtattagaaggt

SEQ ID NO: 199111 - DNA, 21 bp, Artificial sequence
  SiRNA target sequence
tttttatcgtattagaaggta

SEQ ID NO: 199112 - DNA, 21 bp, Artificial sequence
  SiRNA target sequence
ttttatcgtattagaaggtat

SEQ ID NO: 199113 - DNA, 21 bp, Artificial sequence
  SiRNA target sequence
tttatcgtattagaaggtata

SEQ ID NO: 199114 - DNA, 21 bp, Artificial sequence
  SiRNA target sequence
ttatcgtattagaaggtataa

SEQ ID NO: 199115 - DNA, 21 bp, Artificial sequence
  SiRNA target sequence
tatcgtattagaaggtataaa

SEQ ID NO: 199116 - DNA, 21 bp, Artificial sequence
  SiRNA target sequence
atcgtattagaaggtataaat

SEQ ID NO: 199117 - DNA, 21 bp, Artificial sequence
  SiRNA target sequence
tcgtattagaaggtataaata

SEQ ID NO: 199118 - DNA, 21 bp, Artificial sequence
  SiRNA target sequence
cgtattagaaggtataaatat

SEQ ID NO: 199119 - DNA, 21 bp, Artificial sequence
  SiRNA target sequence
gtattagaaggtataaatatt

SEQ ID NO: 199120 - DNA, 21 bp, Artificial sequence
  SiRNA target sequence
tattagaaggtataaatattg

SEQ ID NO: 199121 - DNA, 21 bp, Artificial sequence
  SiRNA target sequence
attagaaggtataaatattgg

SEQ ID NO: 199122 - DNA, 21 bp, Artificial sequence
  SiRNA target sequence
ttagaaggtataaatattggt

SEQ ID NO: 199123 - DNA, 21 bp, Artificial sequence
  SiRNA target sequence
tagaaggtataaatattggta

SEQ ID NO: 199124 - DNA, 21 bp, Artificial sequence
  SiRNA target sequence
agaaggtataaatattggtac

SEQ ID NO: 199125 - DNA, 21 bp, Artificial sequence
  SiRNA target sequence
gaaggtataaatattggtaca

SEQ ID NO: 199126 - DNA, 21 bp, Artificial sequence
  SiRNA target sequence
aaggtataaatattggtacac

SEQ ID NO: 199127 - DNA, 21 bp, Artificial sequence
  SiRNA target sequence
aggtataaatattggtacact

SEQ ID NO: 199128 - DNA, 21 bp, Artificial sequence
  SiRNA target sequence
ggtataaatattggtacactc

SEQ ID NO: 199129 - DNA, 21 bp, Artificial sequence
  SiRNA target sequence
gtataaatattggtacactca

SEQ ID NO: 199130 - DNA, 21 bp, Artificial sequence
  SiRNA target sequence
tataaatattggtacactcat

SEQ ID NO: 199131 - DNA, 21 bp, Artificial sequence
  SiRNA target sequence
ataaatattggtacactcatt

SEQ ID NO: 199132 - DNA, 21 bp, Artificial sequence
  SiRNA target sequence
taaatattggtacactcatta

SEQ ID NO: 199133 - DNA, 21 bp, Artificial sequence
  SiRNA target sequence
aaatattggtacactcattat

SEQ ID NO: 199134 - DNA, 21 bp, Artificial sequence
  SiRNA target sequence
aatattggtacactcattatt

SEQ ID NO: 199135 - DNA, 21 bp, Artificial sequence
  SiRNA target sequence
atattggtacactcattattt

SEQ ID NO: 199136 - DNA, 21 bp, Artificial sequence
  SiRNA target sequence
tattggtacactcattatttt

SEQ ID NO: 199137 - DNA, 21 bp, Artificial sequence
  SiRNA target sequence
attggtacactcattatttta

SEQ ID NO: 199138 - DNA, 21 bp, Artificial sequence
  SiRNA target sequence
ttggtacactcattattttat

SEQ ID NO: 199139 - DNA, 21 bp, Artificial sequence
  SiRNA target sequence
tggtacactcattattttatt

SEQ ID NO: 199140 - DNA, 21 bp, Artificial sequence
  SiRNA target sequence
ggtacactcattattttattc

SEQ ID NO: 199141 - DNA, 21 bp, Artificial sequence
  SiRNA target sequence
gtacactcattattttattct

SEQ ID NO: 199142 - DNA, 21 bp, Artificial sequence
  SiRNA target sequence
tacactcattattttattctc

SEQ ID NO: 199143 - DNA, 21 bp, Artificial sequence
  SiRNA target sequence
acactcattattttattctcg

SEQ ID NO: 199144 - DNA, 21 bp, Artificial sequence
  SiRNA target sequence
cactcattattttattctcga

SEQ ID NO: 199145 - DNA, 21 bp, Artificial sequence
  SiRNA target sequence
actcattattttattctcgaa

SEQ ID NO: 199146 - DNA, 21 bp, Artificial sequence
  SiRNA target sequence
ctcattattttattctcgaaa

SEQ ID NO: 199147 - DNA, 21 bp, Artificial sequence
  SiRNA target sequence
tcattattttattctcgaaat

SEQ ID NO: 199148 - DNA, 21 bp, Artificial sequence
  SiRNA target sequence
cattattttattctcgaaata

SEQ ID NO: 199149 - DNA, 21 bp, Artificial sequence
  SiRNA target sequence
attattttattctcgaaataa

SEQ ID NO: 199150 - DNA, 21 bp, Artificial sequence
  SiRNA target sequence
ttattttattctcgaaataat

SEQ ID NO: 199151 - DNA, 21 bp, Artificial sequence
  SiRNA target sequence
tattttattctcgaaataata

SEQ ID NO: 199152 - DNA, 21 bp, Artificial sequence
  SiRNA target sequence
attttattctcgaaataatat

SEQ ID NO: 199153 - DNA, 21 bp, Artificial sequence
  SiRNA target sequence
ttttattctcgaaataatatt

SEQ ID NO: 199154 - DNA, 21 bp, Artificial sequence
  SiRNA target sequence
tttattctcgaaataatattt

SEQ ID NO: 199155 - DNA, 21 bp, Artificial sequence
  SiRNA target sequence
ttattctcgaaataatatttc

SEQ ID NO: 199156 - DNA, 21 bp, Artificial sequence
  SiRNA target sequence
tattctcgaaataatatttca

SEQ ID NO: 199157 - DNA, 21 bp, Artificial sequence
  SiRNA target sequence
attctcgaaataatatttcat

SEQ ID NO: 199158 - DNA, 21 bp, Artificial sequence
  SiRNA target sequence
ttctcgaaataatatttcatg

SEQ ID NO: 199159 - DNA, 21 bp, Artificial sequence
  SiRNA target sequence
tctcgaaataatatttcatgt

SEQ ID NO: 199160 - DNA, 21 bp, Artificial sequence
  SiRNA target sequence
ctcgaaataatatttcatgta

SEQ ID NO: 199161 - DNA, 21 bp, Artificial sequence
  SiRNA target sequence
tcgaaataatatttcatgtac

SEQ ID NO: 199162 - DNA, 21 bp, Artificial sequence
  SiRNA target sequence
cgaaataatatttcatgtaca

SEQ ID NO: 199163 - DNA, 21 bp, Artificial sequence
  SiRNA target sequence
gaaataatatttcatgtacat

SEQ ID NO: 199164 - DNA, 21 bp, Artificial sequence
  SiRNA target sequence
aaataatatttcatgtacatt

SEQ ID NO: 199165 - DNA, 21 bp, Artificial sequence
  SiRNA target sequence
aataatatttcatgtacatta

SEQ ID NO: 199166 - DNA, 21 bp, Artificial sequence
  SiRNA target sequence
ataatatttcatgtacattaa

SEQ ID NO: 199167 - DNA, 21 bp, Artificial sequence
  SiRNA target sequence
taatatttcatgtacattaat

SEQ ID NO: 199168 - DNA, 21 bp, Artificial sequence
  SiRNA target sequence
aatatttcatgtacattaata

SEQ ID NO: 199169 - DNA, 21 bp, Artificial sequence
  SiRNA target sequence
atatttcatgtacattaatat

SEQ ID NO: 199170 - DNA, 21 bp, Artificial sequence
  SiRNA target sequence
tatttcatgtacattaatatt

SEQ ID NO: 199171 - DNA, 21 bp, Artificial sequence
  SiRNA target sequence
atttcatgtacattaatatta

SEQ ID NO: 199172 - DNA, 21 bp, Artificial sequence
  SiRNA target sequence
tttcatgtacattaatattag

SEQ ID NO: 199173 - DNA, 21 bp, Artificial sequence
  SiRNA target sequence
ttcatgtacattaatattaga

SEQ ID NO: 199174 - DNA, 21 bp, Artificial sequence
  SiRNA target sequence
tcatgtacattaatattagac

SEQ ID NO: 199175 - DNA, 21 bp, Artificial sequence
  SiRNA target sequence
catgtacattaatattagaca

SEQ ID NO: 199176 - DNA, 21 bp, Artificial sequence
  SiRNA target sequence
atgtacattaatattagacat

SEQ ID NO: 199177 - DNA, 21 bp, Artificial sequence
  SiRNA target sequence
tgtacattaatattagacata

SEQ ID NO: 199178 - DNA, 21 bp, Artificial sequence
  SiRNA target sequence
gtacattaatattagacatat

SEQ ID NO: 199179 - DNA, 21 bp, Artificial sequence
  SiRNA target sequence
tacattaatattagacatata

SEQ ID NO: 199180 - DNA, 21 bp, Artificial sequence
  SiRNA target sequence
acattaatattagacatatac

SEQ ID NO: 199181 - DNA, 21 bp, Artificial sequence
  SiRNA target sequence
cattaatattagacatatacc

SEQ ID NO: 199182 - DNA, 21 bp, Artificial sequence
  SiRNA target sequence
attaatattagacatataccg

SEQ ID NO: 199183 - DNA, 21 bp, Artificial sequence
  SiRNA target sequence
ttaatattagacatataccgc

SEQ ID NO: 199184 - DNA, 21 bp, Artificial sequence
  SiRNA target sequence
taatattagacatataccgcc

SEQ ID NO: 199185 - DNA, 21 bp, Artificial sequence
  SiRNA target sequence
aatattagacatataccgccc

SEQ ID NO: 199186 - DNA, 21 bp, Artificial sequence
  SiRNA target sequence
atattagacatataccgccca

SEQ ID NO: 199187 - DNA, 21 bp, Artificial sequence
  SiRNA target sequence
tattagacatataccgcccat

SEQ ID NO: 199188 - DNA, 21 bp, Artificial sequence
  SiRNA target sequence
attagacatataccgcccatg

SEQ ID NO: 199189 - DNA, 21 bp, Artificial sequence
  SiRNA target sequence
ttagacatataccgcccatgg

SEQ ID NO: 199190 - DNA, 21 bp, Artificial sequence
  SiRNA target sequence
tagacatataccgcccatggc

SEQ ID NO: 199191 - DNA, 21 bp, Artificial sequence
  SiRNA target sequence
agacatataccgcccatggca

SEQ ID NO: 199192 - DNA, 21 bp, Artificial sequence
  SiRNA target sequence
gacatataccgcccatggcaa

SEQ ID NO: 199193 - DNA, 21 bp, Artificial sequence
  SiRNA target sequence
acatataccgcccatggcaat

SEQ ID NO: 199194 - DNA, 21 bp, Artificial sequence
  SiRNA target sequence
catataccgcccatggcaata

SEQ ID NO: 199195 - DNA, 21 bp, Artificial sequence
  SiRNA target sequence
atataccgcccatggcaataa

SEQ ID NO: 199196 - DNA, 21 bp, Artificial sequence
  SiRNA target sequence
tataccgcccatggcaataaa

SEQ ID NO: 199197 - DNA, 21 bp, Artificial sequence
  SiRNA target sequence
ataccgcccatggcaataaaa

SEQ ID NO: 199198 - DNA, 21 bp, Artificial sequence
  SiRNA target sequence
taccgcccatggcaataaaaa

SEQ ID NO: 199199 - DNA, 21 bp, Artificial sequence
  SiRNA target sequence
accgcccatggcaataaaaac

SEQ ID NO: 199200 - DNA, 21 bp, Artificial sequence
  SiRNA target sequence
ccgcccatggcaataaaaacc

SEQ ID NO: 199201 - DNA, 21 bp, Artificial sequence
  SiRNA target sequence
cgcccatggcaataaaaaccg

SEQ ID NO: 199202 - DNA, 21 bp, Artificial sequence
  SiRNA target sequence
gcccatggcaataaaaaccga

SEQ ID NO: 199203 - DNA, 21 bp, Artificial sequence
  SiRNA target sequence
cccatggcaataaaaaccgaa

SEQ ID NO: 199204 - DNA, 21 bp, Artificial sequence
  SiRNA target sequence
ccatggcaataaaaaccgaag

SEQ ID NO: 199205 - DNA, 21 bp, Artificial sequence
  SiRNA target sequence
catggcaataaaaaccgaaga

SEQ ID NO: 199206 - DNA, 21 bp, Artificial sequence
  SiRNA target sequence
atggcaataaaaaccgaagaa

SEQ ID NO: 199207 - DNA, 21 bp, Artificial sequence
  SiRNA target sequence
tggcaataaaaaccgaagaat

SEQ ID NO: 199208 - DNA, 21 bp, Artificial sequence
  SiRNA target sequence
ggcaataaaaaccgaagaata

SEQ ID NO: 199209 - DNA, 21 bp, Artificial sequence
  SiRNA target sequence
gcaataaaaaccgaagaatat

SEQ ID NO: 199210 - DNA, 21 bp, Artificial sequence
  SiRNA target sequence
caataaaaaccgaagaatata

SEQ ID NO: 199211 - DNA, 21 bp, Artificial sequence
  SiRNA target sequence
aataaaaaccgaagaatataa

SEQ ID NO: 199212 - DNA, 21 bp, Artificial sequence
  SiRNA target sequence
ataaaaaccgaagaatataat

SEQ ID NO: 199213 - DNA, 21 bp, Artificial sequence
  SiRNA target sequence
taaaaaccgaagaatataata

SEQ ID NO: 199214 - DNA, 21 bp, Artificial sequence
  SiRNA target sequence
aaaaaccgaagaatataataa

SEQ ID NO: 199215 - DNA, 21 bp, Artificial sequence
  SiRNA target sequence
aaaaccgaagaatataataac

SEQ ID NO: 199216 - DNA, 21 bp, Artificial sequence
  SiRNA target sequence
aaaccgaagaatataataact

SEQ ID NO: 199217 - DNA, 21 bp, Artificial sequence
  SiRNA target sequence
aaccgaagaatataataactg

SEQ ID NO: 199218 - DNA, 21 bp, Artificial sequence
  SiRNA target sequence
accgaagaatataataactga

SEQ ID NO: 199219 - DNA, 21 bp, Artificial sequence
  SiRNA target sequence
ccgaagaatataataactgat

SEQ ID NO: 199220 - DNA, 21 bp, Artificial sequence
  SiRNA target sequence
cgaagaatataataactgatt

SEQ ID NO: 199221 - DNA, 21 bp, Artificial sequence
  SiRNA target sequence
gaagaatataataactgattt

SEQ ID NO: 199222 - DNA, 21 bp, Artificial sequence
  SiRNA target sequence
aagaatataataactgatttt

SEQ ID NO: 199223 - DNA, 21 bp, Artificial sequence
  SiRNA target sequence
agaatataataactgattttg

SEQ ID NO: 199224 - DNA, 21 bp, Artificial sequence
  SiRNA target sequence
gaatataataactgattttgc

SEQ ID NO: 199225 - DNA, 21 bp, Artificial sequence
  SiRNA target sequence
aatataataactgattttgct

SEQ ID NO: 199226 - DNA, 21 bp, Artificial sequence
  SiRNA target sequence
atataataactgattttgctc

SEQ ID NO: 199227 - DNA, 21 bp, Artificial sequence
  SiRNA target sequence
tataataactgattttgctca

SEQ ID NO: 199228 - DNA, 21 bp, Artificial sequence
  SiRNA target sequence
ataataactgattttgctcat

SEQ ID NO: 199229 - DNA, 21 bp, Artificial sequence
  SiRNA target sequence
taataactgattttgctcata

SEQ ID NO: 199230 - DNA, 21 bp, Artificial sequence
  SiRNA target sequence
aataactgattttgctcatag

SEQ ID NO: 199231 - DNA, 21 bp, Artificial sequence
  SiRNA target sequence
ataactgattttgctcatagc

SEQ ID NO: 199232 - DNA, 21 bp, Artificial sequence
  SiRNA target sequence
taactgattttgctcatagct

SEQ ID NO: 199233 - DNA, 21 bp, Artificial sequence
  SiRNA target sequence
aactgattttgctcatagcta

SEQ ID NO: 199234 - DNA, 21 bp, Artificial sequence
  SiRNA target sequence
actgattttgctcatagctaa

SEQ ID NO: 199235 - DNA, 21 bp, Artificial sequence
  SiRNA target sequence
ctgattttgctcatagctaaa

SEQ ID NO: 199236 - DNA, 21 bp, Artificial sequence
  SiRNA target sequence
tgattttgctcatagctaaat

SEQ ID NO: 199237 - DNA, 21 bp, Artificial sequence
  SiRNA target sequence
gattttgctcatagctaaatc

SEQ ID NO: 199238 - DNA, 21 bp, Artificial sequence
  SiRNA target sequence
attttgctcatagctaaatcc

SEQ ID NO: 199239 - DNA, 21 bp, Artificial sequence
  SiRNA target sequence
ttttgctcatagctaaatcct

SEQ ID NO: 199240 - DNA, 21 bp, Artificial sequence
  SiRNA target sequence
tttgctcatagctaaatcctt

SEQ ID NO: 199241 - DNA, 21 bp, Artificial sequence
  SiRNA target sequence
ttgctcatagctaaatccttt

SEQ ID NO: 199242 - DNA, 21 bp, Artificial sequence
  SiRNA target sequence
tgctcatagctaaatcctttt

SEQ ID NO: 199243 - DNA, 21 bp, Artificial sequence
  SiRNA target sequence
gctcatagctaaatccttttc

SEQ ID NO: 199244 - DNA, 21 bp, Artificial sequence
  SiRNA target sequence
ctcatagctaaatccttttcg

SEQ ID NO: 199245 - DNA, 21 bp, Artificial sequence
  SiRNA target sequence
tcatagctaaatccttttcgc

SEQ ID NO: 199246 - DNA, 21 bp, Artificial sequence
  SiRNA target sequence
catagctaaatccttttcgca

SEQ ID NO: 199247 - DNA, 21 bp, Artificial sequence
  SiRNA target sequence
atagctaaatccttttcgcaa

SEQ ID NO: 199248 - DNA, 21 bp, Artificial sequence
  SiRNA target sequence
tagctaaatccttttcgcaat

SEQ ID NO: 199249 - DNA, 21 bp, Artificial sequence
  SiRNA target sequence
agctaaatccttttcgcaatt

SEQ ID NO: 199250 - DNA, 21 bp, Artificial sequence
  SiRNA target sequence
gctaaatccttttcgcaattc

SEQ ID NO: 199251 - DNA, 21 bp, Artificial sequence
  SiRNA target sequence
ctaaatccttttcgcaattct

SEQ ID NO: 199252 - DNA, 21 bp, Artificial sequence
  SiRNA target sequence
taaatccttttcgcaattctc

SEQ ID NO: 199253 - DNA, 21 bp, Artificial sequence
  SiRNA target sequence
aaatccttttcgcaattctct

SEQ ID NO: 199254 - DNA, 21 bp, Artificial sequence
  SiRNA target sequence
aatccttttcgcaattctctg

SEQ ID NO: 199255 - DNA, 21 bp, Artificial sequence
  SiRNA target sequence
atccttttcgcaattctctga

SEQ ID NO: 199256 - DNA, 21 bp, Artificial sequence
  SiRNA target sequence
tccttttcgcaattctctgaa

SEQ ID NO: 199257 - DNA, 21 bp, Artificial sequence
  SiRNA target sequence
ccttttcgcaattctctgaaa

SEQ ID NO: 199258 - DNA, 21 bp, Artificial sequence
  SiRNA target sequence
cttttcgcaattctctgaaag

SEQ ID NO: 199259 - DNA, 21 bp, Artificial sequence
  SiRNA target sequence
ttttcgcaattctctgaaaga

SEQ ID NO: 199260 - DNA, 21 bp, Artificial sequence
  SiRNA target sequence
tttcgcaattctctgaaagaa

SEQ ID NO: 199261 - DNA, 21 bp, Artificial sequence
  SiRNA target sequence
ttcgcaattctctgaaagaac

SEQ ID NO: 199262 - DNA, 21 bp, Artificial sequence
  SiRNA target sequence
tcgcaattctctgaaagaact

SEQ ID NO: 199263 - DNA, 21 bp, Artificial sequence
  SiRNA target sequence
cgcaattctctgaaagaacta

SEQ ID NO: 199264 - DNA, 21 bp, Artificial sequence
  SiRNA target sequence
gcaattctctgaaagaactac

SEQ ID NO: 199265 - DNA, 21 bp, Artificial sequence
  SiRNA target sequence
caattctctgaaagaactact

SEQ ID NO: 199266 - DNA, 21 bp, Artificial sequence
  SiRNA target sequence
aattctctgaaagaactactg

SEQ ID NO: 199267 - DNA, 21 bp, Artificial sequence
  SiRNA target sequence
attctctgaaagaactactgg

SEQ ID NO: 199268 - DNA, 21 bp, Artificial sequence
  SiRNA target sequence
ttctctgaaagaactactggc

SEQ ID NO: 199269 - DNA, 21 bp, Artificial sequence
  SiRNA target sequence
tctctgaaagaactactggct

SEQ ID NO: 199270 - DNA, 21 bp, Artificial sequence
  SiRNA target sequence
ctctgaaagaactactggcta

SEQ ID NO: 199271 - DNA, 21 bp, Artificial sequence
  SiRNA target sequence
tctgaaagaactactggctaa

SEQ ID NO: 199272 - DNA, 21 bp, Artificial sequence
  SiRNA target sequence
ctgaaagaactactggctaat

SEQ ID NO: 199273 - DNA, 21 bp, Artificial sequence
  SiRNA target sequence
tgaaagaactactggctaatc

SEQ ID NO: 199274 - DNA, 21 bp, Artificial sequence
  SiRNA target sequence
gaaagaactactggctaatcc

SEQ ID NO: 199275 - DNA, 21 bp, Artificial sequence
  SiRNA target sequence
aaagaactactggctaatcca

SEQ ID NO: 199276 - DNA, 21 bp, Artificial sequence
  SiRNA target sequence
aagaactactggctaatccag

SEQ ID NO: 199277 - DNA, 21 bp, Artificial sequence
  SiRNA target sequence
agaactactggctaatccaga

SEQ ID NO: 199278 - DNA, 21 bp, Artificial sequence
  SiRNA target sequence
gaactactggctaatccagat

SEQ ID NO: 199279 - DNA, 21 bp, Artificial sequence
  SiRNA target sequence
aactactggctaatccagata

SEQ ID NO: 199280 - DNA, 21 bp, Artificial sequence
  SiRNA target sequence
actactggctaatccagatac

SEQ ID NO: 199281 - DNA, 21 bp, Artificial sequence
  SiRNA target sequence
ctactggctaatccagatact

SEQ ID NO: 199282 - DNA, 21 bp, Artificial sequence
  SiRNA target sequence
tactggctaatccagatacta

SEQ ID NO: 199283 - DNA, 21 bp, Artificial sequence
  SiRNA target sequence
actggctaatccagatactag

SEQ ID NO: 199284 - DNA, 21 bp, Artificial sequence
  SiRNA target sequence
ctggctaatccagatactagt

SEQ ID NO: 199285 - DNA, 21 bp, Artificial sequence
  SiRNA target sequence
tggctaatccagatactagta

SEQ ID NO: 199286 - DNA, 21 bp, Artificial sequence
  SiRNA target sequence
ggctaatccagatactagtaa

SEQ ID NO: 199287 - DNA, 21 bp, Artificial sequence
  SiRNA target sequence
gctaatccagatactagtaaa

SEQ ID NO: 199288 - DNA, 21 bp, Artificial sequence
  SiRNA target sequence
ctaatccagatactagtaaag

SEQ ID NO: 199289 - DNA, 21 bp, Artificial sequence
  SiRNA target sequence
taatccagatactagtaaagc

SEQ ID NO: 199290 - DNA, 21 bp, Artificial sequence
  SiRNA target sequence
aatccagatactagtaaagct

SEQ ID NO: 199291 - DNA, 21 bp, Artificial sequence
  SiRNA target sequence
atccagatactagtaaagcta

SEQ ID NO: 199292 - DNA, 21 bp, Artificial sequence
  SiRNA target sequence
tccagatactagtaaagctaa

SEQ ID NO: 199293 - DNA, 21 bp, Artificial sequence
  SiRNA target sequence
ccagatactagtaaagctaaa

SEQ ID NO: 199294 - DNA, 21 bp, Artificial sequence
  SiRNA target sequence
cagatactagtaaagctaaat

SEQ ID NO: 199295 - DNA, 21 bp, Artificial sequence
  SiRNA target sequence
agatactagtaaagctaaatt

SEQ ID NO: 199296 - DNA, 21 bp, Artificial sequence
  SiRNA target sequence
gatactagtaaagctaaattt

SEQ ID NO: 199297 - DNA, 21 bp, Artificial sequence
  SiRNA target sequence
atactagtaaagctaaatttg

SEQ ID NO: 199298 - DNA, 21 bp, Artificial sequence
  SiRNA target sequence
tactagtaaagctaaatttgc

SEQ ID NO: 199299 - DNA, 21 bp, Artificial sequence
  SiRNA target sequence
actagtaaagctaaatttgct

SEQ ID NO: 199300 - DNA, 21 bp, Artificial sequence
  SiRNA target sequence
ctagtaaagctaaatttgcta

SEQ ID NO: 199301 - DNA, 21 bp, Artificial sequence
  SiRNA target sequence
tagtaaagctaaatttgctat

SEQ ID NO: 199302 - DNA, 21 bp, Artificial sequence
  SiRNA target sequence
agtaaagctaaatttgctatt

SEQ ID NO: 199303 - DNA, 21 bp, Artificial sequence
  SiRNA target sequence
gtaaagctaaatttgctatta

SEQ ID NO: 199304 - DNA, 21 bp, Artificial sequence
  SiRNA target sequence
taaagctaaatttgctattat

SEQ ID NO: 199305 - DNA, 21 bp, Artificial sequence
  SiRNA target sequence
aaagctaaatttgctattatg

SEQ ID NO: 199306 - DNA, 21 bp, Artificial sequence
  SiRNA target sequence
aagctaaatttgctattatgt

SEQ ID NO: 199307 - DNA, 21 bp, Artificial sequence
  SiRNA target sequence
agctaaatttgctattatgta

SEQ ID NO: 199308 - DNA, 21 bp, Artificial sequence
  SiRNA target sequence
gctaaatttgctattatgtaa

SEQ ID NO: 199309 - DNA, 21 bp, Artificial sequence
  SiRNA target sequence
ctaaatttgctattatgtaaa

SEQ ID NO: 199310 - DNA, 21 bp, Artificial sequence
  SiRNA target sequence
taaatttgctattatgtaaaa

SEQ ID NO: 199311 - DNA, 21 bp, Artificial sequence
  SiRNA target sequence
aaatttgctattatgtaaaaa

SEQ ID NO: 199312 - DNA, 21 bp, Artificial sequence
  SiRNA target sequence
aatttgctattatgtaaaaag

SEQ ID NO: 199313 - DNA, 21 bp, Artificial sequence
  SiRNA target sequence
atttgctattatgtaaaaagg

SEQ ID NO: 199314 - DNA, 21 bp, Artificial sequence
  SiRNA target sequence
tttgctattatgtaaaaaggt

SEQ ID NO: 199315 - DNA, 21 bp, Artificial sequence
  SiRNA target sequence
ttgctattatgtaaaaaggtg

SEQ ID NO: 199316 - DNA, 21 bp, Artificial sequence
  SiRNA target sequence
tgctattatgtaaaaaggtgg

SEQ ID NO: 199317 - DNA, 21 bp, Artificial sequence
  SiRNA target sequence
gctattatgtaaaaaggtggt

SEQ ID NO: 199318 - DNA, 21 bp, Artificial sequence
  SiRNA target sequence
ctattatgtaaaaaggtggta

SEQ ID NO: 199319 - DNA, 21 bp, Artificial sequence
  SiRNA target sequence
tattatgtaaaaaggtggtaa

SEQ ID NO: 199320 - DNA, 21 bp, Artificial sequence
  SiRNA target sequence
attatgtaaaaaggtggtaaa

SEQ ID NO: 199321 - DNA, 21 bp, Artificial sequence
  SiRNA target sequence
ttatgtaaaaaggtggtaaaa

SEQ ID NO: 199322 - DNA, 21 bp, Artificial sequence
  SiRNA target sequence
tatgtaaaaaggtggtaaaaa

SEQ ID NO: 199323 - DNA, 21 bp, Artificial sequence
  SiRNA target sequence
atgtaaaaaggtggtaaaaat

SEQ ID NO: 199324 - DNA, 21 bp, Artificial sequence
  SiRNA target sequence
tgtaaaaaggtggtaaaaatc

SEQ ID NO: 199325 - DNA, 21 bp, Artificial sequence
  SiRNA target sequence
gtaaaaaggtggtaaaaatct

SEQ ID NO: 199326 - DNA, 21 bp, Artificial sequence
  SiRNA target sequence
taaaaaggtggtaaaaatctt

SEQ ID NO: 199327 - DNA, 21 bp, Artificial sequence
  SiRNA target sequence
aaaaaggtggtaaaaatcttg

SEQ ID NO: 199328 - DNA, 21 bp, Artificial sequence
  SiRNA target sequence
aaaaggtggtaaaaatcttgt

SEQ ID NO: 199329 - DNA, 21 bp, Artificial sequence
  SiRNA target sequence
aaaggtggtaaaaatcttgta

SEQ ID NO: 199330 - DNA, 21 bp, Artificial sequence
  SiRNA target sequence
aaggtggtaaaaatcttgtaa

SEQ ID NO: 199331 - DNA, 21 bp, Artificial sequence
  SiRNA target sequence
aggtggtaaaaatcttgtaaa

SEQ ID NO: 199332 - DNA, 21 bp, Artificial sequence
  SiRNA target sequence
ggtggtaaaaatcttgtaaac

SEQ ID NO: 199333 - DNA, 21 bp, Artificial sequence
  SiRNA target sequence
gtggtaaaaatcttgtaaact

SEQ ID NO: 199334 - DNA, 21 bp, Artificial sequence
  SiRNA target sequence
tggtaaaaatcttgtaaactg

SEQ ID NO: 199335 - DNA, 21 bp, Artificial sequence
  SiRNA target sequence
ggtaaaaatcttgtaaactgt

SEQ ID NO: 199336 - DNA, 21 bp, Artificial sequence
  SiRNA target sequence
gtaaaaatcttgtaaactgtc

SEQ ID NO: 199337 - DNA, 21 bp, Artificial sequence
  SiRNA target sequence
taaaaatcttgtaaactgtct

SEQ ID NO: 199338 - DNA, 21 bp, Artificial sequence
  SiRNA target sequence
aaaaatcttgtaaactgtctg

SEQ ID NO: 199339 - DNA, 21 bp, Artificial sequence
  SiRNA target sequence
aaaatcttgtaaactgtctga

SEQ ID NO: 199340 - DNA, 21 bp, Artificial sequence
  SiRNA target sequence
aaatcttgtaaactgtctgat

SEQ ID NO: 199341 - DNA, 21 bp, Artificial sequence
  SiRNA target sequence
aatcttgtaaactgtctgata

SEQ ID NO: 199342 - DNA, 21 bp, Artificial sequence
  SiRNA target sequence
atcttgtaaactgtctgatag

SEQ ID NO: 199343 - DNA, 21 bp, Artificial sequence
  SiRNA target sequence
tcttgtaaactgtctgatagt

SEQ ID NO: 199344 - DNA, 21 bp, Artificial sequence
  SiRNA target sequence
cttgtaaactgtctgatagta

SEQ ID NO: 199345 - DNA, 21 bp, Artificial sequence
  SiRNA target sequence
ttgtaaactgtctgatagtac

SEQ ID NO: 199346 - DNA, 21 bp, Artificial sequence
  SiRNA target sequence
tgtaaactgtctgatagtaca

SEQ ID NO: 199347 - DNA, 21 bp, Artificial sequence
  SiRNA target sequence
gtaaactgtctgatagtacaa

SEQ ID NO: 199348 - DNA, 21 bp, Artificial sequence
  SiRNA target sequence
taaactgtctgatagtacaac

SEQ ID NO: 199349 - DNA, 21 bp, Artificial sequence
  SiRNA target sequence
aaactgtctgatagtacaact

SEQ ID NO: 199350 - DNA, 21 bp, Artificial sequence
  SiRNA target sequence
aactgtctgatagtacaactt

SEQ ID NO: 199351 - DNA, 21 bp, Artificial sequence
  SiRNA target sequence
actgtctgatagtacaacttt

SEQ ID NO: 199352 - DNA, 21 bp, Artificial sequence
  SiRNA target sequence
ctgtctgatagtacaactttc

SEQ ID NO: 199353 - DNA, 21 bp, Artificial sequence
  SiRNA target sequence
tgtctgatagtacaactttca

SEQ ID NO: 199354 - DNA, 21 bp, Artificial sequence
  SiRNA target sequence
gtctgatagtacaactttcat

SEQ ID NO: 199355 - DNA, 21 bp, Artificial sequence
  SiRNA target sequence
tctgatagtacaactttcatt

SEQ ID NO: 199356 - DNA, 21 bp, Artificial sequence
  SiRNA target sequence
ctgatagtacaactttcattt

SEQ ID NO: 199357 - DNA, 21 bp, Artificial sequence
  SiRNA target sequence
tgatagtacaactttcattta

SEQ ID NO: 199358 - DNA, 21 bp, Artificial sequence
  SiRNA target sequence
gatagtacaactttcatttaa

SEQ ID NO: 199359 - DNA, 21 bp, Artificial sequence
  SiRNA target sequence
atagtacaactttcatttaaa

SEQ ID NO: 199360 - DNA, 21 bp, Artificial sequence
  SiRNA target sequence
tagtacaactttcatttaaaa

SEQ ID NO: 199361 - DNA, 21 bp, Artificial sequence
  SiRNA target sequence
agtacaactttcatttaaaaa

SEQ ID NO: 199362 - DNA, 21 bp, Artificial sequence
  SiRNA target sequence
gtacaactttcatttaaaaaa

SEQ ID NO: 199363 - DNA, 21 bp, Artificial sequence
  SiRNA target sequence
tacaactttcatttaaaaaac

SEQ ID NO: 199364 - DNA, 21 bp, Artificial sequence
  SiRNA target sequence
acaactttcatttaaaaaact

SEQ ID NO: 199365 - DNA, 21 bp, Artificial sequence
  SiRNA target sequence
caactttcatttaaaaaactc

SEQ ID NO: 199366 - DNA, 21 bp, Artificial sequence
  SiRNA target sequence
aactttcatttaaaaaactca

SEQ ID NO: 199367 - DNA, 21 bp, Artificial sequence
  SiRNA target sequence
actttcatttaaaaaactcat

SEQ ID NO: 199368 - DNA, 21 bp, Artificial sequence
  SiRNA target sequence
ctttcatttaaaaaactcatg

SEQ ID NO: 199369 - DNA, 21 bp, Artificial sequence
  SiRNA target sequence
tttcatttaaaaaactcatgt

SEQ ID NO: 199370 - DNA, 21 bp, Artificial sequence
  SiRNA target sequence
ttcatttaaaaaactcatgta

SEQ ID NO: 199371 - DNA, 21 bp, Artificial sequence
  SiRNA target sequence
tcatttaaaaaactcatgtat

SEQ ID NO: 199372 - DNA, 21 bp, Artificial sequence
  SiRNA target sequence
catttaaaaaactcatgtata

SEQ ID NO: 199373 - DNA, 21 bp, Artificial sequence
  SiRNA target sequence
atttaaaaaactcatgtataa

SEQ ID NO: 199374 - DNA, 21 bp, Artificial sequence
  SiRNA target sequence
tttaaaaaactcatgtataaa

SEQ ID NO: 199375 - DNA, 21 bp, Artificial sequence
  SiRNA target sequence
ttaaaaaactcatgtataaat

SEQ ID NO: 199376 - DNA, 21 bp, Artificial sequence
  SiRNA target sequence
taaaaaactcatgtataaata

SEQ ID NO: 199377 - DNA, 21 bp, Artificial sequence
  SiRNA target sequence
aaaaaactcatgtataaataa

SEQ ID NO: 199378 - DNA, 21 bp, Artificial sequence
  SiRNA target sequence
aaaaactcatgtataaataag

SEQ ID NO: 199379 - DNA, 21 bp, Artificial sequence
  SiRNA target sequence
aaaactcatgtataaataagc

SEQ ID NO: 199380 - DNA, 21 bp, Artificial sequence
  SiRNA target sequence
aaactcatgtataaataagcc

SEQ ID NO: 199381 - DNA, 21 bp, Artificial sequence
  SiRNA target sequence
aactcatgtataaataagcca

SEQ ID NO: 199382 - DNA, 21 bp, Artificial sequence
  SiRNA target sequence
actcatgtataaataagccat

SEQ ID NO: 199383 - DNA, 21 bp, Artificial sequence
  SiRNA target sequence
ctcatgtataaataagccata

SEQ ID NO: 199384 - DNA, 21 bp, Artificial sequence
  SiRNA target sequence
tcatgtataaataagccataa

SEQ ID NO: 199385 - DNA, 21 bp, Artificial sequence
  SiRNA target sequence
catgtataaataagccataag

SEQ ID NO: 199386 - DNA, 21 bp, Artificial sequence
  SiRNA target sequence
atgtataaataagccataagt

SEQ ID NO: 199387 - DNA, 21 bp, Artificial sequence
  SiRNA target sequence
tgtataaataagccataagta

SEQ ID NO: 199388 - DNA, 21 bp, Artificial sequence
  SiRNA target sequence
gtataaataagccataagtaa

SEQ ID NO: 199389 - DNA, 21 bp, Artificial sequence
  SiRNA target sequence
tataaataagccataagtaaa

SEQ ID NO: 199390 - DNA, 21 bp, Artificial sequence
  SiRNA target sequence
ataaataagccataagtaaac

SEQ ID NO: 199391 - DNA, 21 bp, Artificial sequence
  SiRNA target sequence
taaataagccataagtaaact

SEQ ID NO: 199392 - DNA, 21 bp, Artificial sequence
  SiRNA target sequence
aaataagccataagtaaactg

SEQ ID NO: 199393 - DNA, 21 bp, Artificial sequence
  SiRNA target sequence
aataagccataagtaaactgc

SEQ ID NO: 199394 - DNA, 21 bp, Artificial sequence
  SiRNA target sequence
ataagccataagtaaactgcc

SEQ ID NO: 199395 - DNA, 21 bp, Artificial sequence
  SiRNA target sequence
taagccataagtaaactgccc

SEQ ID NO: 199396 - DNA, 21 bp, Artificial sequence
  SiRNA target sequence
aagccataagtaaactgcccc

SEQ ID NO: 199397 - DNA, 21 bp, Artificial sequence
  SiRNA target sequence
agccataagtaaactgcccca

SEQ ID NO: 199398 - DNA, 21 bp, Artificial sequence
  SiRNA target sequence
gccataagtaaactgccccac

SEQ ID NO: 199399 - DNA, 21 bp, Artificial sequence
  SiRNA target sequence
ccataagtaaactgccccaca

SEQ ID NO: 199400 - DNA, 21 bp, Artificial sequence
  SiRNA target sequence
cataagtaaactgccccacat

SEQ ID NO: 199401 - DNA, 21 bp, Artificial sequence
  SiRNA target sequence
ataagtaaactgccccacatt

SEQ ID NO: 199402 - DNA, 21 bp, Artificial sequence
  SiRNA target sequence
taagtaaactgccccacattt

SEQ ID NO: 199403 - DNA, 21 bp, Artificial sequence
  SiRNA target sequence
aagtaaactgccccacatttc

SEQ ID NO: 199404 - DNA, 21 bp, Artificial sequence
  SiRNA target sequence
agtaaactgccccacatttct

SEQ ID NO: 199405 - DNA, 21 bp, Artificial sequence
  SiRNA target sequence
gtaaactgccccacatttctg

SEQ ID NO: 199406 - DNA, 21 bp, Artificial sequence
  SiRNA target sequence
taaactgccccacatttctgc

SEQ ID NO: 199407 - DNA, 21 bp, Artificial sequence
  SiRNA target sequence
aaactgccccacatttctgct

SEQ ID NO: 199408 - DNA, 21 bp, Artificial sequence
  SiRNA target sequence
aactgccccacatttctgcta

SEQ ID NO: 199409 - DNA, 21 bp, Artificial sequence
  SiRNA target sequence
actgccccacatttctgctat

SEQ ID NO: 199410 - DNA, 21 bp, Artificial sequence
  SiRNA target sequence
ctgccccacatttctgctatt

SEQ ID NO: 199411 - DNA, 21 bp, Artificial sequence
  SiRNA target sequence
tgccccacatttctgctatta

SEQ ID NO: 199412 - DNA, 21 bp, Artificial sequence
  SiRNA target sequence
gccccacatttctgctattat

SEQ ID NO: 199413 - DNA, 21 bp, Artificial sequence
  SiRNA target sequence
ccccacatttctgctattata

SEQ ID NO: 199414 - DNA, 21 bp, Artificial sequence
  SiRNA target sequence
cccacatttctgctattataa

SEQ ID NO: 199415 - DNA, 21 bp, Artificial sequence
  SiRNA target sequence
ccacatttctgctattataaa

SEQ ID NO: 199416 - DNA, 21 bp, Artificial sequence
  SiRNA target sequence
cacatttctgctattataaaa

SEQ ID NO: 199417 - DNA, 21 bp, Artificial sequence
  SiRNA target sequence
acatttctgctattataaaaa

SEQ ID NO: 199418 - DNA, 21 bp, Artificial sequence
  SiRNA target sequence
catttctgctattataaaaat

SEQ ID NO: 199419 - DNA, 21 bp, Artificial sequence
  SiRNA target sequence
atttctgctattataaaaata

SEQ ID NO: 199420 - DNA, 21 bp, Artificial sequence
  SiRNA target sequence
tttctgctattataaaaatac

SEQ ID NO: 199421 - DNA, 21 bp, Artificial sequence
  SiRNA target sequence
ttctgctattataaaaataca

SEQ ID NO: 199422 - DNA, 21 bp, Artificial sequence
  SiRNA target sequence
tctgctattataaaaatacaa

SEQ ID NO: 199423 - DNA, 21 bp, Artificial sequence
  SiRNA target sequence
ctgctattataaaaatacaag

SEQ ID NO: 199424 - DNA, 21 bp, Artificial sequence
  SiRNA target sequence
tgctattataaaaatacaagt

SEQ ID NO: 199425 - DNA, 21 bp, Artificial sequence
  SiRNA target sequence
gctattataaaaatacaagtt

SEQ ID NO: 199426 - DNA, 21 bp, Artificial sequence
  SiRNA target sequence
ctattataaaaatacaagttg

SEQ ID NO: 199427 - DNA, 21 bp, Artificial sequence
  SiRNA target sequence
tattataaaaatacaagttga

SEQ ID NO: 199428 - DNA, 21 bp, Artificial sequence
  SiRNA target sequence
attataaaaatacaagttgaa

SEQ ID NO: 199429 - DNA, 21 bp, Artificial sequence
  SiRNA target sequence
ttataaaaatacaagttgaaa

SEQ ID NO: 199430 - DNA, 21 bp, Artificial sequence
  SiRNA target sequence
tataaaaatacaagttgaaac

SEQ ID NO: 199431 - DNA, 21 bp, Artificial sequence
  SiRNA target sequence
ataaaaatacaagttgaaacg

SEQ ID NO: 199432 - DNA, 21 bp, Artificial sequence
  SiRNA target sequence
taaaaatacaagttgaaacgg

SEQ ID NO: 199433 - DNA, 21 bp, Artificial sequence
  SiRNA target sequence
aaaaatacaagttgaaacggg

SEQ ID NO: 199434 - DNA, 21 bp, Artificial sequence
  SiRNA target sequence
aaaatacaagttgaaacgggc

SEQ ID NO: 199435 - DNA, 21 bp, Artificial sequence
  SiRNA target sequence
aaatacaagttgaaacgggct

SEQ ID NO: 199436 - DNA, 21 bp, Artificial sequence
  SiRNA target sequence
aatacaagttgaaacgggctc

SEQ ID NO: 199437 - DNA, 21 bp, Artificial sequence
  SiRNA target sequence
atacaagttgaaacgggctcg

SEQ ID NO: 199438 - DNA, 21 bp, Artificial sequence
  SiRNA target sequence
tacaagttgaaacgggctcgt

SEQ ID NO: 199439 - DNA, 21 bp, Artificial sequence
  SiRNA target sequence
acaagttgaaacgggctcgtt

SEQ ID NO: 199440 - DNA, 21 bp, Artificial sequence
  SiRNA target sequence
caagttgaaacgggctcgtta

SEQ ID NO: 199441 - DNA, 21 bp, Artificial sequence
  SiRNA target sequence
aagttgaaacgggctcgttag

SEQ ID NO: 199442 - DNA, 21 bp, Artificial sequence
  SiRNA target sequence
agttgaaacgggctcgttagc

SEQ ID NO: 199443 - DNA, 21 bp, Artificial sequence
  SiRNA target sequence
gttgaaacgggctcgttagct

SEQ ID NO: 199444 - DNA, 21 bp, Artificial sequence
  SiRNA target sequence
ttgaaacgggctcgttagctg

SEQ ID NO: 199445 - DNA, 21 bp, Artificial sequence
  SiRNA target sequence
tgaaacgggctcgttagctgt

SEQ ID NO: 199446 - DNA, 21 bp, Artificial sequence
  SiRNA target sequence
gaaacgggctcgttagctgta

SEQ ID NO: 199447 - DNA, 21 bp, Artificial sequence
  SiRNA target sequence
aaacgggctcgttagctgtaa

SEQ ID NO: 199448 - DNA, 21 bp, Artificial sequence
  SiRNA target sequence
aacgggctcgttagctgtaat

SEQ ID NO: 199449 - DNA, 21 bp, Artificial sequence
  SiRNA target sequence
acgggctcgttagctgtaatt

SEQ ID NO: 199450 - DNA, 21 bp, Artificial sequence
  SiRNA target sequence
cgggctcgttagctgtaatta

SEQ ID NO: 199451 - DNA, 21 bp, Artificial sequence
  SiRNA target sequence
gggctcgttagctgtaattaa

SEQ ID NO: 199452 - DNA, 21 bp, Artificial sequence
  SiRNA target sequence
ggctcgttagctgtaattaaa

SEQ ID NO: 199453 - DNA, 21 bp, Artificial sequence
  SiRNA target sequence
gctcgttagctgtaattaaaa

SEQ ID NO: 199454 - DNA, 21 bp, Artificial sequence
  SiRNA target sequence
ctcgttagctgtaattaaaaa

SEQ ID NO: 199455 - DNA, 21 bp, Artificial sequence
  SiRNA target sequence
tcgttagctgtaattaaaaaa

SEQ ID NO: 199456 - DNA, 21 bp, Artificial sequence
  SiRNA target sequence
cgttagctgtaattaaaaaat

SEQ ID NO: 199457 - DNA, 21 bp, Artificial sequence
  SiRNA target sequence
gttagctgtaattaaaaaata

SEQ ID NO: 199458 - DNA, 21 bp, Artificial sequence
  SiRNA target sequence
ttagctgtaattaaaaaatat

SEQ ID NO: 199459 - DNA, 21 bp, Artificial sequence
  SiRNA target sequence
tagctgtaattaaaaaatatt

SEQ ID NO: 199460 - DNA, 21 bp, Artificial sequence
  SiRNA target sequence
agctgtaattaaaaaatattt

SEQ ID NO: 199461 - DNA, 21 bp, Artificial sequence
  SiRNA target sequence
gctgtaattaaaaaatatttt

SEQ ID NO: 199462 - DNA, 21 bp, Artificial sequence
  SiRNA target sequence
ctgtaattaaaaaatatttta

SEQ ID NO: 199463 - DNA, 21 bp, Artificial sequence
  SiRNA target sequence
tgtaattaaaaaatattttat

SEQ ID NO: 199464 - DNA, 21 bp, Artificial sequence
  SiRNA target sequence
gtaattaaaaaatattttata

SEQ ID NO: 199465 - DNA, 21 bp, Artificial sequence
  SiRNA target sequence
taattaaaaaatattttataa

SEQ ID NO: 199466 - DNA, 21 bp, Artificial sequence
  SiRNA target sequence
aattaaaaaatattttataaa

SEQ ID NO: 199467 - DNA, 21 bp, Artificial sequence
  SiRNA target sequence
attaaaaaatattttataaag

SEQ ID NO: 199468 - DNA, 21 bp, Artificial sequence
  SiRNA target sequence
ttaaaaaatattttataaagt

SEQ ID NO: 199469 - DNA, 21 bp, Artificial sequence
  SiRNA target sequence
taaaaaatattttataaagtt

SEQ ID NO: 199470 - DNA, 21 bp, Artificial sequence
  SiRNA target sequence
aaaaaatattttataaagttc

SEQ ID NO: 199471 - DNA, 21 bp, Artificial sequence
  SiRNA target sequence
aaaaatattttataaagttca

SEQ ID NO: 199472 - DNA, 21 bp, Artificial sequence
  SiRNA target sequence
aaaatattttataaagttcaa

SEQ ID NO: 199473 - DNA, 21 bp, Artificial sequence
  SiRNA target sequence
aaatattttataaagttcaat

SEQ ID NO: 199474 - DNA, 21 bp, Artificial sequence
  SiRNA target sequence
aatattttataaagttcaatc

SEQ ID NO: 199475 - DNA, 21 bp, Artificial sequence
  SiRNA target sequence
atattttataaagttcaatcc

SEQ ID NO: 199476 - DNA, 21 bp, Artificial sequence
  SiRNA target sequence
tattttataaagttcaatccc

SEQ ID NO: 199477 - DNA, 21 bp, Artificial sequence
  SiRNA target sequence
attttataaagttcaatccct

SEQ ID NO: 199478 - DNA, 21 bp, Artificial sequence
  SiRNA target sequence
ttttataaagttcaatccctt

SEQ ID NO: 199479 - DNA, 21 bp, Artificial sequence
  SiRNA target sequence
tttataaagttcaatcccttc

SEQ ID NO: 199480 - DNA, 21 bp, Artificial sequence
  SiRNA target sequence
ttataaagttcaatcccttca

SEQ ID NO: 199481 - DNA, 21 bp, Artificial sequence
  SiRNA target sequence
tataaagttcaatcccttcaa

SEQ ID NO: 199482 - DNA, 21 bp, Artificial sequence
  SiRNA target sequence
ataaagttcaatcccttcaat

SEQ ID NO: 199483 - DNA, 21 bp, Artificial sequence
  SiRNA target sequence
taaagttcaatcccttcaatg

SEQ ID NO: 199484 - DNA, 21 bp, Artificial sequence
  SiRNA target sequence
aaagttcaatcccttcaatgc

SEQ ID NO: 199485 - DNA, 21 bp, Artificial sequence
  SiRNA target sequence
aagttcaatcccttcaatgca

SEQ ID NO: 199486 - DNA, 21 bp, Artificial sequence
  SiRNA target sequence
agttcaatcccttcaatgcac

SEQ ID NO: 199487 - DNA, 21 bp, Artificial sequence
  SiRNA target sequence
gttcaatcccttcaatgcacc

SEQ ID NO: 199488 - DNA, 21 bp, Artificial sequence
  SiRNA target sequence
ttcaatcccttcaatgcacct

SEQ ID NO: 199489 - DNA, 21 bp, Artificial sequence
  SiRNA target sequence
tcaatcccttcaatgcacctt

SEQ ID NO: 199490 - DNA, 21 bp, Artificial sequence
  SiRNA target sequence
caatcccttcaatgcaccttt

SEQ ID NO: 199491 - DNA, 21 bp, Artificial sequence
  SiRNA target sequence
aatcccttcaatgcacctttg

SEQ ID NO: 199492 - DNA, 21 bp, Artificial sequence
  SiRNA target sequence
atcccttcaatgcacctttgt

SEQ ID NO: 199493 - DNA, 21 bp, Artificial sequence
  SiRNA target sequence
tcccttcaatgcacctttgtt

SEQ ID NO: 199494 - DNA, 21 bp, Artificial sequence
  SiRNA target sequence
cccttcaatgcacctttgtta

SEQ ID NO: 199495 - DNA, 21 bp, Artificial sequence
  SiRNA target sequence
ccttcaatgcacctttgttat

SEQ ID NO: 199496 - DNA, 21 bp, Artificial sequence
  SiRNA target sequence
cttcaatgcacctttgttatc

SEQ ID NO: 199497 - DNA, 21 bp, Artificial sequence
  SiRNA target sequence
ttcaatgcacctttgttatca

SEQ ID NO: 199498 - DNA, 21 bp, Artificial sequence
  SiRNA target sequence
tcaatgcacctttgttatcag

SEQ ID NO: 199499 - DNA, 21 bp, Artificial sequence
  SiRNA target sequence
caatgcacctttgttatcagc

SEQ ID NO: 199500 - DNA, 21 bp, Artificial sequence
  SiRNA target sequence
aatgcacctttgttatcagcg

SEQ ID NO: 199501 - DNA, 21 bp, Artificial sequence
  SiRNA target sequence
atgcacctttgttatcagcga

SEQ ID NO: 199502 - DNA, 21 bp, Artificial sequence
  SiRNA target sequence
tgcacctttgttatcagcgaa

SEQ ID NO: 199503 - DNA, 21 bp, Artificial sequence
  SiRNA target sequence
gcacctttgttatcagcgaaa

SEQ ID NO: 199504 - DNA, 21 bp, Artificial sequence
  SiRNA target sequence
cacctttgttatcagcgaaaa

SEQ ID NO: 199505 - DNA, 21 bp, Artificial sequence
  SiRNA target sequence
acctttgttatcagcgaaaat

SEQ ID NO: 199506 - DNA, 21 bp, Artificial sequence
  SiRNA target sequence
cctttgttatcagcgaaaata

SEQ ID NO: 199507 - DNA, 21 bp, Artificial sequence
  SiRNA target sequence
ctttgttatcagcgaaaatat

SEQ ID NO: 199508 - DNA, 21 bp, Artificial sequence
  SiRNA target sequence
tttgttatcagcgaaaatatc

SEQ ID NO: 199509 - DNA, 21 bp, Artificial sequence
  SiRNA target sequence
ttgttatcagcgaaaatatct

SEQ ID NO: 199510 - DNA, 21 bp, Artificial sequence
  SiRNA target sequence
tgttatcagcgaaaatatctc

SEQ ID NO: 199511 - DNA, 21 bp, Artificial sequence
  SiRNA target sequence
gttatcagcgaaaatatctct

SEQ ID NO: 199512 - DNA, 21 bp, Artificial sequence
  SiRNA target sequence
ttatcagcgaaaatatctcta

SEQ ID NO: 199513 - DNA, 21 bp, Artificial sequence
  SiRNA target sequence
tatcagcgaaaatatctctaa

SEQ ID NO: 199514 - DNA, 21 bp, Artificial sequence
  SiRNA target sequence
atcagcgaaaatatctctaaa

SEQ ID NO: 199515 - DNA, 21 bp, Artificial sequence
  SiRNA target sequence
tcagcgaaaatatctctaaat

SEQ ID NO: 199516 - DNA, 21 bp, Artificial sequence
  SiRNA target sequence
cagcgaaaatatctctaaata

SEQ ID NO: 199517 - DNA, 21 bp, Artificial sequence
  SiRNA target sequence
agcgaaaatatctctaaataa

SEQ ID NO: 199518 - DNA, 21 bp, Artificial sequence
  SiRNA target sequence
gcgaaaatatctctaaataaa

SEQ ID NO: 199519 - DNA, 21 bp, Artificial sequence
  SiRNA target sequence
cgaaaatatctctaaataaaa

SEQ ID NO: 199520 - DNA, 21 bp, Artificial sequence
  SiRNA target sequence
gaaaatatctctaaataaaaa

SEQ ID NO: 199521 - DNA, 21 bp, Artificial sequence
  SiRNA target sequence
aaaatatctctaaataaaaag

SEQ ID NO: 199522 - DNA, 21 bp, Artificial sequence
  SiRNA target sequence
aaatatctctaaataaaaagc

SEQ ID NO: 199523 - DNA, 21 bp, Artificial sequence
  SiRNA target sequence
aatatctctaaataaaaagct

SEQ ID NO: 199524 - DNA, 21 bp, Artificial sequence
  SiRNA target sequence
atatctctaaataaaaagcta

SEQ ID NO: 199525 - DNA, 21 bp, Artificial sequence
  SiRNA target sequence
tatctctaaataaaaagctag

SEQ ID NO: 199526 - DNA, 21 bp, Artificial sequence
  SiRNA target sequence
atctctaaataaaaagctaga

SEQ ID NO: 199527 - DNA, 21 bp, Artificial sequence
  SiRNA target sequence
tctctaaataaaaagctagat

SEQ ID NO: 199528 - DNA, 21 bp, Artificial sequence
  SiRNA target sequence
ctctaaataaaaagctagatg

SEQ ID NO: 199529 - DNA, 21 bp, Artificial sequence
  SiRNA target sequence
tctaaataaaaagctagatgg

SEQ ID NO: 199530 - DNA, 21 bp, Artificial sequence
  SiRNA target sequence
ctaaataaaaagctagatggt

SEQ ID NO: 199531 - DNA, 21 bp, Artificial sequence
  SiRNA target sequence
taaataaaaagctagatggtg

SEQ ID NO: 199532 - DNA, 21 bp, Artificial sequence
  SiRNA target sequence
aaataaaaagctagatggtgt

SEQ ID NO: 199533 - DNA, 21 bp, Artificial sequence
  SiRNA target sequence
aataaaaagctagatggtgtt

SEQ ID NO: 199534 - DNA, 21 bp, Artificial sequence
  SiRNA target sequence
ataaaaagctagatggtgtta

SEQ ID NO: 199535 - DNA, 21 bp, Artificial sequence
  SiRNA target sequence
taaaaagctagatggtgttac

SEQ ID NO: 199536 - DNA, 21 bp, Artificial sequence
  SiRNA target sequence
aaaaagctagatggtgttact

SEQ ID NO: 199537 - DNA, 21 bp, Artificial sequence
  SiRNA target sequence
aaaagctagatggtgttactt

SEQ ID NO: 199538 - DNA, 21 bp, Artificial sequence
  SiRNA target sequence
aaagctagatggtgttacttt

SEQ ID NO: 199539 - DNA, 21 bp, Artificial sequence
  SiRNA target sequence
aagctagatggtgttactttc

SEQ ID NO: 199540 - DNA, 21 bp, Artificial sequence
  SiRNA target sequence
agctagatggtgttactttct

SEQ ID NO: 199541 - DNA, 21 bp, Artificial sequence
  SiRNA target sequence
gctagatggtgttactttctc

SEQ ID NO: 199542 - DNA, 21 bp, Artificial sequence
  SiRNA target sequence
ctagatggtgttactttctct

SEQ ID NO: 199543 - DNA, 21 bp, Artificial sequence
  SiRNA target sequence
tagatggtgttactttctctt

SEQ ID NO: 199544 - DNA, 21 bp, Artificial sequence
  SiRNA target sequence
agatggtgttactttctcttc

SEQ ID NO: 199545 - DNA, 21 bp, Artificial sequence
  SiRNA target sequence
gatggtgttactttctcttca

SEQ ID NO: 199546 - DNA, 21 bp, Artificial sequence
  SiRNA target sequence
atggtgttactttctcttcaa

SEQ ID NO: 199547 - DNA, 21 bp, Artificial sequence
  SiRNA target sequence
tggtgttactttctcttcaaa

SEQ ID NO: 199548 - DNA, 21 bp, Artificial sequence
  SiRNA target sequence
ggtgttactttctcttcaaac

SEQ ID NO: 199549 - DNA, 21 bp, Artificial sequence
  SiRNA target sequence
gtgttactttctcttcaaaca

SEQ ID NO: 199550 - DNA, 21 bp, Artificial sequence
  SiRNA target sequence
tgttactttctcttcaaacaa

SEQ ID NO: 199551 - DNA, 21 bp, Artificial sequence
  SiRNA target sequence
gttactttctcttcaaacaaa

SEQ ID NO: 199552 - DNA, 21 bp, Artificial sequence
  SiRNA target sequence
ttactttctcttcaaacaaaa

SEQ ID NO: 199553 - DNA, 21 bp, Artificial sequence
  SiRNA target sequence
tactttctcttcaaacaaaaa

SEQ ID NO: 199554 - DNA, 21 bp, Artificial sequence
  SiRNA target sequence
actttctcttcaaacaaaaag

SEQ ID NO: 199555 - DNA, 21 bp, Artificial sequence
  SiRNA target sequence
ctttctcttcaaacaaaaaga

SEQ ID NO: 199556 - DNA, 21 bp, Artificial sequence
  SiRNA target sequence
tttctcttcaaacaaaaagat

SEQ ID NO: 199557 - DNA, 21 bp, Artificial sequence
  SiRNA target sequence
ttctcttcaaacaaaaagatt

SEQ ID NO: 199558 - DNA, 21 bp, Artificial sequence
  SiRNA target sequence
tctcttcaaacaaaaagattg

SEQ ID NO: 199559 - DNA, 21 bp, Artificial sequence
  SiRNA target sequence
ctcttcaaacaaaaagattgc

SEQ ID NO: 199560 - DNA, 21 bp, Artificial sequence
  SiRNA target sequence
tcttcaaacaaaaagattgcc

SEQ ID NO: 199561 - DNA, 21 bp, Artificial sequence
  SiRNA target sequence
cttcaaacaaaaagattgccc

SEQ ID NO: 199562 - DNA, 21 bp, Artificial sequence
  SiRNA target sequence
ttcaaacaaaaagattgcccc

SEQ ID NO: 199563 - DNA, 21 bp, Artificial sequence
  SiRNA target sequence
tcaaacaaaaagattgcccct

SEQ ID NO: 199564 - DNA, 21 bp, Artificial sequence
  SiRNA target sequence
caaacaaaaagattgccccta

SEQ ID NO: 199565 - DNA, 21 bp, Artificial sequence
  SiRNA target sequence
aaacaaaaagattgcccctag

SEQ ID NO: 199566 - DNA, 21 bp, Artificial sequence
  SiRNA target sequence
aacaaaaagattgcccctagt

SEQ ID NO: 199567 - DNA, 21 bp, Artificial sequence
  SiRNA target sequence
acaaaaagattgcccctagtc

SEQ ID NO: 199568 - DNA, 21 bp, Artificial sequence
  SiRNA target sequence
caaaaagattgcccctagtcc

SEQ ID NO: 199569 - DNA, 21 bp, Artificial sequence
  SiRNA target sequence
aaaaagattgcccctagtccg

SEQ ID NO: 199570 - DNA, 21 bp, Artificial sequence
  SiRNA target sequence
aaaagattgcccctagtccga

SEQ ID NO: 199571 - DNA, 21 bp, Artificial sequence
  SiRNA target sequence
aaagattgcccctagtccgaa

SEQ ID NO: 199572 - DNA, 21 bp, Artificial sequence
  SiRNA target sequence
aagattgcccctagtccgaag

SEQ ID NO: 199573 - DNA, 21 bp, Artificial sequence
  SiRNA target sequence
agattgcccctagtccgaaga

SEQ ID NO: 199574 - DNA, 21 bp, Artificial sequence
  SiRNA target sequence
gattgcccctagtccgaagaa

SEQ ID NO: 199575 - DNA, 21 bp, Artificial sequence
  SiRNA target sequence
attgcccctagtccgaagaaa

SEQ ID NO: 199576 - DNA, 21 bp, Artificial sequence
  SiRNA target sequence
ttgcccctagtccgaagaaaa

SEQ ID NO: 199577 - DNA, 21 bp, Artificial sequence
  SiRNA target sequence
tgcccctagtccgaagaaaaa

SEQ ID NO: 199578 - DNA, 21 bp, Artificial sequence
  SiRNA target sequence
gcccctagtccgaagaaaaat

SEQ ID NO: 199579 - DNA, 21 bp, Artificial sequence
  SiRNA target sequence
cccctagtccgaagaaaaatg

SEQ ID NO: 199580 - DNA, 21 bp, Artificial sequence
  SiRNA target sequence
ccctagtccgaagaaaaatgc

SEQ ID NO: 199581 - DNA, 21 bp, Artificial sequence
  SiRNA target sequence
cctagtccgaagaaaaatgca

SEQ ID NO: 199582 - DNA, 21 bp, Artificial sequence
  SiRNA target sequence
ctagtccgaagaaaaatgcag

SEQ ID NO: 199583 - DNA, 21 bp, Artificial sequence
  SiRNA target sequence
tagtccgaagaaaaatgcagt

SEQ ID NO: 199584 - DNA, 21 bp, Artificial sequence
  SiRNA target sequence
agtccgaagaaaaatgcagta

SEQ ID NO: 199585 - DNA, 21 bp, Artificial sequence
  SiRNA target sequence
gtccgaagaaaaatgcagtaa

SEQ ID NO: 199586 - DNA, 21 bp, Artificial sequence
  SiRNA target sequence
tccgaagaaaaatgcagtaaa

SEQ ID NO: 199587 - DNA, 21 bp, Artificial sequence
  SiRNA target sequence
ccgaagaaaaatgcagtaaaa

SEQ ID NO: 199588 - DNA, 21 bp, Artificial sequence
  SiRNA target sequence
cgaagaaaaatgcagtaaaaa

SEQ ID NO: 199589 - DNA, 21 bp, Artificial sequence
  SiRNA target sequence
gaagaaaaatgcagtaaaaat

SEQ ID NO: 199590 - DNA, 21 bp, Artificial sequence
  SiRNA target sequence
aagaaaaatgcagtaaaaatt

SEQ ID NO: 199591 - DNA, 21 bp, Artificial sequence
  SiRNA target sequence
agaaaaatgcagtaaaaatta

SEQ ID NO: 199592 - DNA, 21 bp, Artificial sequence
  SiRNA target sequence
gaaaaatgcagtaaaaattat

SEQ ID NO: 199593 - DNA, 21 bp, Artificial sequence
  SiRNA target sequence
aaaaatgcagtaaaaattatt

SEQ ID NO: 199594 - DNA, 21 bp, Artificial sequence
  SiRNA target sequence
aaaatgcagtaaaaattatta

SEQ ID NO: 199595 - DNA, 21 bp, Artificial sequence
  SiRNA target sequence
aaatgcagtaaaaattattag

SEQ ID NO: 199596 - DNA, 21 bp, Artificial sequence
  SiRNA target sequence
aatgcagtaaaaattattaga

SEQ ID NO: 199597 - DNA, 21 bp, Artificial sequence
  SiRNA target sequence
atgcagtaaaaattattagaa

SEQ ID NO: 199598 - DNA, 21 bp, Artificial sequence
  SiRNA target sequence
tgcagtaaaaattattagaaa

SEQ ID NO: 199599 - DNA, 21 bp, Artificial sequence
  SiRNA target sequence
gcagtaaaaattattagaaat

SEQ ID NO: 199600 - DNA, 21 bp, Artificial sequence
  SiRNA target sequence
cagtaaaaattattagaaata

SEQ ID NO: 199601 - DNA, 21 bp, Artificial sequence
  SiRNA target sequence
agtaaaaattattagaaatag

SEQ ID NO: 199602 - DNA, 21 bp, Artificial sequence
  SiRNA target sequence
gtaaaaattattagaaataga

SEQ ID NO: 199603 - DNA, 21 bp, Artificial sequence
  SiRNA target sequence
taaaaattattagaaatagat

SEQ ID NO: 199604 - DNA, 21 bp, Artificial sequence
  SiRNA target sequence
aaaaattattagaaatagatt

SEQ ID NO: 199605 - DNA, 21 bp, Artificial sequence
  SiRNA target sequence
aaaattattagaaatagatta

SEQ ID NO: 199606 - DNA, 21 bp, Artificial sequence
  SiRNA target sequence
aaattattagaaatagattaa

SEQ ID NO: 199607 - DNA, 21 bp, Artificial sequence
  SiRNA target sequence
aattattagaaatagattaaa

SEQ ID NO: 199608 - DNA, 21 bp, Artificial sequence
  SiRNA target sequence
attattagaaatagattaaaa

SEQ ID NO: 199609 - DNA, 21 bp, Artificial sequence
  SiRNA target sequence
ttattagaaatagattaaaaa

SEQ ID NO: 199610 - DNA, 21 bp, Artificial sequence
  SiRNA target sequence
tattagaaatagattaaaaat

SEQ ID NO: 199611 - DNA, 21 bp, Artificial sequence
  SiRNA target sequence
attagaaatagattaaaaatc

SEQ ID NO: 199612 - DNA, 21 bp, Artificial sequence
  SiRNA target sequence
ttagaaatagattaaaaatcg

SEQ ID NO: 199613 - DNA, 21 bp, Artificial sequence
  SiRNA target sequence
tagaaatagattaaaaatcga

SEQ ID NO: 199614 - DNA, 21 bp, Artificial sequence
  SiRNA target sequence
agaaatagattaaaaatcgat

SEQ ID NO: 199615 - DNA, 21 bp, Artificial sequence
  SiRNA target sequence
gaaatagattaaaaatcgatg

SEQ ID NO: 199616 - DNA, 21 bp, Artificial sequence
  SiRNA target sequence
aaatagattaaaaatcgatga

SEQ ID NO: 199617 - DNA, 21 bp, Artificial sequence
  SiRNA target sequence
aatagattaaaaatcgatgat

SEQ ID NO: 199618 - DNA, 21 bp, Artificial sequence
  SiRNA target sequence
atagattaaaaatcgatgata

SEQ ID NO: 199619 - DNA, 21 bp, Artificial sequence
  SiRNA target sequence
tagattaaaaatcgatgatac

SEQ ID NO: 199620 - DNA, 21 bp, Artificial sequence
  SiRNA target sequence
agattaaaaatcgatgataca

SEQ ID NO: 199621 - DNA, 21 bp, Artificial sequence
  SiRNA target sequence
gattaaaaatcgatgatacag

SEQ ID NO: 199622 - DNA, 21 bp, Artificial sequence
  SiRNA target sequence
attaaaaatcgatgatacagg

SEQ ID NO: 199623 - DNA, 21 bp, Artificial sequence
  SiRNA target sequence
ttaaaaatcgatgatacaggt

SEQ ID NO: 199624 - DNA, 21 bp, Artificial sequence
  SiRNA target sequence
taaaaatcgatgatacaggtt

SEQ ID NO: 199625 - DNA, 21 bp, Artificial sequence
  SiRNA target sequence
aaaaatcgatgatacaggttt

SEQ ID NO: 199626 - DNA, 21 bp, Artificial sequence
  SiRNA target sequence
aaaatcgatgatacaggttta

SEQ ID NO: 199627 - DNA, 21 bp, Artificial sequence
  SiRNA target sequence
aaatcgatgatacaggtttat

SEQ ID NO: 199628 - DNA, 21 bp, Artificial sequence
  SiRNA target sequence
aatcgatgatacaggtttatt

SEQ ID NO: 199629 - DNA, 21 bp, Artificial sequence
  SiRNA target sequence
atcgatgatacaggtttattt

SEQ ID NO: 199630 - DNA, 21 bp, Artificial sequence
  SiRNA target sequence
tcgatgatacaggtttatttt

SEQ ID NO: 199631 - DNA, 21 bp, Artificial sequence
  SiRNA target sequence
cgatgatacaggtttattttg

SEQ ID NO: 199632 - DNA, 21 bp, Artificial sequence
  SiRNA target sequence
gatgatacaggtttattttgc

SEQ ID NO: 199633 - DNA, 21 bp, Artificial sequence
  SiRNA target sequence
atgatacaggtttattttgca

SEQ ID NO: 199634 - DNA, 21 bp, Artificial sequence
  SiRNA target sequence
tgatacaggtttattttgcat

SEQ ID NO: 199635 - DNA, 21 bp, Artificial sequence
  SiRNA target sequence
gatacaggtttattttgcata

SEQ ID NO: 199636 - DNA, 21 bp, Artificial sequence
  SiRNA target sequence
atacaggtttattttgcataa

SEQ ID NO: 199637 - DNA, 21 bp, Artificial sequence
  SiRNA target sequence
tacaggtttattttgcataag

SEQ ID NO: 199638 - DNA, 21 bp, Artificial sequence
  SiRNA target sequence
acaggtttattttgcataagc

SEQ ID NO: 199639 - DNA, 21 bp, Artificial sequence
  SiRNA target sequence
caggtttattttgcataagcc

SEQ ID NO: 199640 - DNA, 21 bp, Artificial sequence
  SiRNA target sequence
aggtttattttgcataagcca

SEQ ID NO: 199641 - DNA, 21 bp, Artificial sequence
  SiRNA target sequence
ggtttattttgcataagccac

SEQ ID NO: 199642 - DNA, 21 bp, Artificial sequence
  SiRNA target sequence
gtttattttgcataagccact

SEQ ID NO: 199643 - DNA, 21 bp, Artificial sequence
  SiRNA target sequence
tttattttgcataagccactg

SEQ ID NO: 199644 - DNA, 21 bp, Artificial sequence
  SiRNA target sequence
ttattttgcataagccactgt

SEQ ID NO: 199645 - DNA, 21 bp, Artificial sequence
  SiRNA target sequence
tattttgcataagccactgta

SEQ ID NO: 199646 - DNA, 21 bp, Artificial sequence
  SiRNA target sequence
attttgcataagccactgtat

SEQ ID NO: 199647 - DNA, 21 bp, Artificial sequence
  SiRNA target sequence
ttttgcataagccactgtatt

SEQ ID NO: 199648 - DNA, 21 bp, Artificial sequence
  SiRNA target sequence
tttgcataagccactgtatta

SEQ ID NO: 199649 - DNA, 21 bp, Artificial sequence
  SiRNA target sequence
ttgcataagccactgtattaa

SEQ ID NO: 199650 - DNA, 21 bp, Artificial sequence
  SiRNA target sequence
tgcataagccactgtattaaa

SEQ ID NO: 199651 - DNA, 21 bp, Artificial sequence
  SiRNA target sequence
gcataagccactgtattaaaa

SEQ ID NO: 199652 - DNA, 21 bp, Artificial sequence
  SiRNA target sequence
cataagccactgtattaaaat

SEQ ID NO: 199653 - DNA, 21 bp, Artificial sequence
  SiRNA target sequence
ataagccactgtattaaaatt

SEQ ID NO: 199654 - DNA, 21 bp, Artificial sequence
  SiRNA target sequence
taagccactgtattaaaatta

SEQ ID NO: 199655 - DNA, 21 bp, Artificial sequence
  SiRNA target sequence
aagccactgtattaaaattac

SEQ ID NO: 199656 - DNA, 21 bp, Artificial sequence
  SiRNA target sequence
agccactgtattaaaattaca

SEQ ID NO: 199657 - DNA, 21 bp, Artificial sequence
  SiRNA target sequence
gccactgtattaaaattacag

SEQ ID NO: 199658 - DNA, 21 bp, Artificial sequence
  SiRNA target sequence
ccactgtattaaaattacaga

SEQ ID NO: 199659 - DNA, 21 bp, Artificial sequence
  SiRNA target sequence
cactgtattaaaattacagat

SEQ ID NO: 199660 - DNA, 21 bp, Artificial sequence
  SiRNA target sequence
actgtattaaaattacagatg

SEQ ID NO: 199661 - DNA, 21 bp, Artificial sequence
  SiRNA target sequence
ctgtattaaaattacagatgc

SEQ ID NO: 199662 - DNA, 21 bp, Artificial sequence
  SiRNA target sequence
tgtattaaaattacagatgca

SEQ ID NO: 199663 - DNA, 21 bp, Artificial sequence
  SiRNA target sequence
gtattaaaattacagatgcaa

SEQ ID NO: 199664 - DNA, 21 bp, Artificial sequence
  SiRNA target sequence
tattaaaattacagatgcaaa

SEQ ID NO: 199665 - DNA, 21 bp, Artificial sequence
  SiRNA target sequence
attaaaattacagatgcaaaa

SEQ ID NO: 199666 - DNA, 21 bp, Artificial sequence
  SiRNA target sequence
ttaaaattacagatgcaaaag

SEQ ID NO: 199667 - DNA, 21 bp, Artificial sequence
  SiRNA target sequence
taaaattacagatgcaaaaga

SEQ ID NO: 199668 - DNA, 21 bp, Artificial sequence
  SiRNA target sequence
aaaattacagatgcaaaagat

SEQ ID NO: 199669 - DNA, 21 bp, Artificial sequence
  SiRNA target sequence
aaattacagatgcaaaagata

SEQ ID NO: 199670 - DNA, 21 bp, Artificial sequence
  SiRNA target sequence
aattacagatgcaaaagatat

SEQ ID NO: 199671 - DNA, 21 bp, Artificial sequence
  SiRNA target sequence
attacagatgcaaaagatata

SEQ ID NO: 199672 - DNA, 21 bp, Artificial sequence
  SiRNA target sequence
ttacagatgcaaaagatatag

SEQ ID NO: 199673 - DNA, 21 bp, Artificial sequence
  SiRNA target sequence
tacagatgcaaaagatatagg

SEQ ID NO: 199674 - DNA, 21 bp, Artificial sequence
  SiRNA target sequence
acagatgcaaaagatatagga

SEQ ID NO: 199675 - DNA, 21 bp, Artificial sequence
  SiRNA target sequence
cagatgcaaaagatataggaa

SEQ ID NO: 199676 - DNA, 21 bp, Artificial sequence
  SiRNA target sequence
agatgcaaaagatataggaag

SEQ ID NO: 199677 - DNA, 21 bp, Artificial sequence
  SiRNA target sequence
gatgcaaaagatataggaaga

SEQ ID NO: 199678 - DNA, 21 bp, Artificial sequence
  SiRNA target sequence
atgcaaaagatataggaagaa

SEQ ID NO: 199679 - DNA, 21 bp, Artificial sequence
  SiRNA target sequence
tgcaaaagatataggaagaac

SEQ ID NO: 199680 - DNA, 21 bp, Artificial sequence
  SiRNA target sequence
gcaaaagatataggaagaaca

SEQ ID NO: 199681 - DNA, 21 bp, Artificial sequence
  SiRNA target sequence
caaaagatataggaagaacat

SEQ ID NO: 199682 - DNA, 21 bp, Artificial sequence
  SiRNA target sequence
aaaagatataggaagaacata

SEQ ID NO: 199683 - DNA, 21 bp, Artificial sequence
  SiRNA target sequence
aaagatataggaagaacataa

SEQ ID NO: 199684 - DNA, 21 bp, Artificial sequence
  SiRNA target sequence
aagatataggaagaacataaa

SEQ ID NO: 199685 - DNA, 21 bp, Artificial sequence
  SiRNA target sequence
agatataggaagaacataaaa

SEQ ID NO: 199686 - DNA, 21 bp, Artificial sequence
  SiRNA target sequence
gatataggaagaacataaaaa

SEQ ID NO: 199687 - DNA, 21 bp, Artificial sequence
  SiRNA target sequence
atataggaagaacataaaaaa

SEQ ID NO: 199688 - DNA, 21 bp, Artificial sequence
  SiRNA target sequence
tataggaagaacataaaaaat

SEQ ID NO: 199689 - DNA, 21 bp, Artificial sequence
  SiRNA target sequence
ataggaagaacataaaaaatt

SEQ ID NO: 199690 - DNA, 21 bp, Artificial sequence
  SiRNA target sequence
taggaagaacataaaaaattt

SEQ ID NO: 199691 - DNA, 21 bp, Artificial sequence
  SiRNA target sequence
aggaagaacataaaaaatttt

SEQ ID NO: 199692 - DNA, 21 bp, Artificial sequence
  SiRNA target sequence
ggaagaacataaaaaattttc

SEQ ID NO: 199693 - DNA, 21 bp, Artificial sequence
  SiRNA target sequence
gaagaacataaaaaattttca

SEQ ID NO: 199694 - DNA, 21 bp, Artificial sequence
  SiRNA target sequence
aagaacataaaaaattttcat

SEQ ID NO: 199695 - DNA, 21 bp, Artificial sequence
  SiRNA target sequence
agaacataaaaaattttcata

SEQ ID NO: 199696 - DNA, 21 bp, Artificial sequence
  SiRNA target sequence
gaacataaaaaattttcataa

SEQ ID NO: 199697 - DNA, 21 bp, Artificial sequence
  SiRNA target sequence
aacataaaaaattttcataaa

SEQ ID NO: 199698 - DNA, 21 bp, Artificial sequence
  SiRNA target sequence
acataaaaaattttcataaac

SEQ ID NO: 199699 - DNA, 21 bp, Artificial sequence
  SiRNA target sequence
cataaaaaattttcataaaca

SEQ ID NO: 199700 - DNA, 21 bp, Artificial sequence
  SiRNA target sequence
ataaaaaattttcataaacat

SEQ ID NO: 199701 - DNA, 21 bp, Artificial sequence
  SiRNA target sequence
taaaaaattttcataaacata

SEQ ID NO: 199702 - DNA, 21 bp, Artificial sequence
  SiRNA target sequence
aaaaaattttcataaacataa

SEQ ID NO: 199703 - DNA, 21 bp, Artificial sequence
  SiRNA target sequence
aaaaattttcataaacataat

SEQ ID NO: 199704 - DNA, 21 bp, Artificial sequence
  SiRNA target sequence
aaaattttcataaacataatt

SEQ ID NO: 199705 - DNA, 21 bp, Artificial sequence
  SiRNA target sequence
aaattttcataaacataattg

SEQ ID NO: 199706 - DNA, 21 bp, Artificial sequence
  SiRNA target sequence
aattttcataaacataattga

SEQ ID NO: 199707 - DNA, 21 bp, Artificial sequence
  SiRNA target sequence
attttcataaacataattgaa

SEQ ID NO: 199708 - DNA, 21 bp, Artificial sequence
  SiRNA target sequence
ttttcataaacataattgaat

SEQ ID NO: 199709 - DNA, 21 bp, Artificial sequence
  SiRNA target sequence
tttcataaacataattgaatt

SEQ ID NO: 199710 - DNA, 21 bp, Artificial sequence
  SiRNA target sequence
ttcataaacataattgaattc

SEQ ID NO: 199711 - DNA, 21 bp, Artificial sequence
  SiRNA target sequence
tcataaacataattgaattct

SEQ ID NO: 199712 - DNA, 21 bp, Artificial sequence
  SiRNA target sequence
cataaacataattgaattctg

SEQ ID NO: 199713 - DNA, 21 bp, Artificial sequence
  SiRNA target sequence
ataaacataattgaattctga

SEQ ID NO: 199714 - DNA, 21 bp, Artificial sequence
  SiRNA target sequence
taaacataattgaattctgat

SEQ ID NO: 199715 - DNA, 21 bp, Artificial sequence
  SiRNA target sequence
aaacataattgaattctgatc

SEQ ID NO: 199716 - DNA, 21 bp, Artificial sequence
  SiRNA target sequence
aacataattgaattctgatct

SEQ ID NO: 199717 - DNA, 21 bp, Artificial sequence
  SiRNA target sequence
acataattgaattctgatctt

SEQ ID NO: 199718 - DNA, 21 bp, Artificial sequence
  SiRNA target sequence
cataattgaattctgatcttg

SEQ ID NO: 199719 - DNA, 21 bp, Artificial sequence
  SiRNA target sequence
ataattgaattctgatcttgc

SEQ ID NO: 199720 - DNA, 21 bp, Artificial sequence
  SiRNA target sequence
taattgaattctgatcttgcc

SEQ ID NO: 199721 - DNA, 21 bp, Artificial sequence
  SiRNA target sequence
aattgaattctgatcttgcct

SEQ ID NO: 199722 - DNA, 21 bp, Artificial sequence
  SiRNA target sequence
attgaattctgatcttgcctt

SEQ ID NO: 199723 - DNA, 21 bp, Artificial sequence
  SiRNA target sequence
ttgaattctgatcttgcctta

SEQ ID NO: 199724 - DNA, 21 bp, Artificial sequence
  SiRNA target sequence
tgaattctgatcttgccttac

SEQ ID NO: 199725 - DNA, 21 bp, Artificial sequence
  SiRNA target sequence
gaattctgatcttgccttacc

SEQ ID NO: 199726 - DNA, 21 bp, Artificial sequence
  SiRNA target sequence
aattctgatcttgccttacca

SEQ ID NO: 199727 - DNA, 21 bp, Artificial sequence
  SiRNA target sequence
attctgatcttgccttaccat

SEQ ID NO: 199728 - DNA, 21 bp, Artificial sequence
  SiRNA target sequence
ttctgatcttgccttaccatc

SEQ ID NO: 199729 - DNA, 21 bp, Artificial sequence
  SiRNA target sequence
tctgatcttgccttaccatca

SEQ ID NO: 199730 - DNA, 21 bp, Artificial sequence
  SiRNA target sequence
ctgatcttgccttaccatcac

SEQ ID NO: 199731 - DNA, 21 bp, Artificial sequence
  SiRNA target sequence
tgatcttgccttaccatcaca

SEQ ID NO: 199732 - DNA, 21 bp, Artificial sequence
  SiRNA target sequence
gatcttgccttaccatcacaa

SEQ ID NO: 199733 - DNA, 21 bp, Artificial sequence
  SiRNA target sequence
atcttgccttaccatcacaaa

SEQ ID NO: 199734 - DNA, 21 bp, Artificial sequence
  SiRNA target sequence
tcttgccttaccatcacaaat

SEQ ID NO: 199735 - DNA, 21 bp, Artificial sequence
  SiRNA target sequence
cttgccttaccatcacaaata

SEQ ID NO: 199736 - DNA, 21 bp, Artificial sequence
  SiRNA target sequence
ttgccttaccatcacaaataa

SEQ ID NO: 199737 - DNA, 21 bp, Artificial sequence
  SiRNA target sequence
tgccttaccatcacaaataaa

SEQ ID NO: 199738 - DNA, 21 bp, Artificial sequence
  SiRNA target sequence
gccttaccatcacaaataaat

SEQ ID NO: 199739 - DNA, 21 bp, Artificial sequence
  SiRNA target sequence
ccttaccatcacaaataaatc

SEQ ID NO: 199740 - DNA, 21 bp, Artificial sequence
  SiRNA target sequence
cttaccatcacaaataaatct

SEQ ID NO: 199741 - DNA, 21 bp, Artificial sequence
  SiRNA target sequence
ttaccatcacaaataaatctt

SEQ ID NO: 199742 - DNA, 21 bp, Artificial sequence
  SiRNA target sequence
taccatcacaaataaatcttt

SEQ ID NO: 199743 - DNA, 21 bp, Artificial sequence
  SiRNA target sequence
accatcacaaataaatctttt

SEQ ID NO: 199744 - DNA, 21 bp, Artificial sequence
  SiRNA target sequence
ccatcacaaataaatctttta

SEQ ID NO: 199745 - DNA, 21 bp, Artificial sequence
  SiRNA target sequence
catcacaaataaatcttttaa

SEQ ID NO: 199746 - DNA, 21 bp, Artificial sequence
  SiRNA target sequence
atcacaaataaatcttttaaa

SEQ ID NO: 199747 - DNA, 21 bp, Artificial sequence
  SiRNA target sequence
tcacaaataaatcttttaaaa

SEQ ID NO: 199748 - DNA, 21 bp, Artificial sequence
  SiRNA target sequence
cacaaataaatcttttaaaat

SEQ ID NO: 199749 - DNA, 21 bp, Artificial sequence
  SiRNA target sequence
acaaataaatcttttaaaatt

SEQ ID NO: 199750 - DNA, 21 bp, Artificial sequence
  SiRNA target sequence
caaataaatcttttaaaattc

SEQ ID NO: 199751 - DNA, 21 bp, Artificial sequence
  SiRNA target sequence
aaataaatcttttaaaattct

SEQ ID NO: 199752 - DNA, 21 bp, Artificial sequence
  SiRNA target sequence
aataaatcttttaaaattctt

SEQ ID NO: 199753 - DNA, 21 bp, Artificial sequence
  SiRNA target sequence
ataaatcttttaaaattctta

SEQ ID NO: 199754 - DNA, 21 bp, Artificial sequence
  SiRNA target sequence
taaatcttttaaaattcttaa

SEQ ID NO: 199755 - DNA, 21 bp, Artificial sequence
  SiRNA target sequence
aaatcttttaaaattcttaaa

SEQ ID NO: 199756 - DNA, 21 bp, Artificial sequence
  SiRNA target sequence
aatcttttaaaattcttaaaa

SEQ ID NO: 199757 - DNA, 21 bp, Artificial sequence
  SiRNA target sequence
atcttttaaaattcttaaaaa

SEQ ID NO: 199758 - DNA, 21 bp, Artificial sequence
  SiRNA target sequence
tcttttaaaattcttaaaaat

SEQ ID NO: 199759 - DNA, 21 bp, Artificial sequence
  SiRNA target sequence
cttttaaaattcttaaaaatg

SEQ ID NO: 199760 - DNA, 21 bp, Artificial sequence
  SiRNA target sequence
ttttaaaattcttaaaaatga

SEQ ID NO: 199761 - DNA, 21 bp, Artificial sequence
  SiRNA target sequence
tttaaaattcttaaaaatgaa

SEQ ID NO: 199762 - DNA, 21 bp, Artificial sequence
  SiRNA target sequence
ttaaaattcttaaaaatgaat

SEQ ID NO: 199763 - DNA, 21 bp, Artificial sequence
  SiRNA target sequence
taaaattcttaaaaatgaata

SEQ ID NO: 199764 - DNA, 21 bp, Artificial sequence
  SiRNA target sequence
aaaattcttaaaaatgaatac

SEQ ID NO: 199765 - DNA, 21 bp, Artificial sequence
  SiRNA target sequence
aaattcttaaaaatgaataca

SEQ ID NO: 199766 - DNA, 21 bp, Artificial sequence
  SiRNA target sequence
aattcttaaaaatgaatacac

SEQ ID NO: 199767 - DNA, 21 bp, Artificial sequence
  SiRNA target sequence
attcttaaaaatgaatacaca

SEQ ID NO: 199768 - DNA, 21 bp, Artificial sequence
  SiRNA target sequence
ttcttaaaaatgaatacacaa

SEQ ID NO: 199769 - DNA, 21 bp, Artificial sequence
  SiRNA target sequence
tcttaaaaatgaatacacaaa

SEQ ID NO: 199770 - DNA, 21 bp, Artificial sequence
  SiRNA target sequence
cttaaaaatgaatacacaaag

SEQ ID NO: 199771 - DNA, 21 bp, Artificial sequence
  SiRNA target sequence
ttaaaaatgaatacacaaagt

SEQ ID NO: 199772 - DNA, 21 bp, Artificial sequence
  SiRNA target sequence
taaaaatgaatacacaaagtt

SEQ ID NO: 199773 - DNA, 21 bp, Artificial sequence
  SiRNA target sequence
aaaaatgaatacacaaagtta

SEQ ID NO: 199774 - DNA, 21 bp, Artificial sequence
  SiRNA target sequence
aaaatgaatacacaaagttaa

SEQ ID NO: 199775 - DNA, 21 bp, Artificial sequence
  SiRNA target sequence
aaatgaatacacaaagttaat

SEQ ID NO: 199776 - DNA, 21 bp, Artificial sequence
  SiRNA target sequence
aatgaatacacaaagttaatt

SEQ ID NO: 199777 - DNA, 21 bp, Artificial sequence
  SiRNA target sequence
atgaatacacaaagttaatta

SEQ ID NO: 199778 - DNA, 21 bp, Artificial sequence
  SiRNA target sequence
tgaatacacaaagttaattaa

SEQ ID NO: 199779 - DNA, 21 bp, Artificial sequence
  SiRNA target sequence
gaatacacaaagttaattaat

SEQ ID NO: 199780 - DNA, 21 bp, Artificial sequence
  SiRNA target sequence
aatacacaaagttaattaatc

SEQ ID NO: 199781 - DNA, 21 bp, Artificial sequence
  SiRNA target sequence
atacacaaagttaattaatcc

SEQ ID NO: 199782 - DNA, 21 bp, Artificial sequence
  SiRNA target sequence
tacacaaagttaattaatcca

SEQ ID NO: 199783 - DNA, 21 bp, Artificial sequence
  SiRNA target sequence
acacaaagttaattaatccaa

SEQ ID NO: 199784 - DNA, 21 bp, Artificial sequence
  SiRNA target sequence
cacaaagttaattaatccaaa

SEQ ID NO: 199785 - DNA, 21 bp, Artificial sequence
  SiRNA target sequence
acaaagttaattaatccaaac

SEQ ID NO: 199786 - DNA, 21 bp, Artificial sequence
  SiRNA target sequence
caaagttaattaatccaaaca

SEQ ID NO: 199787 - DNA, 21 bp, Artificial sequence
  SiRNA target sequence
aaagttaattaatccaaacat

SEQ ID NO: 199788 - DNA, 21 bp, Artificial sequence
  SiRNA target sequence
aagttaattaatccaaacata

SEQ ID NO: 199789 - DNA, 21 bp, Artificial sequence
  SiRNA target sequence
agttaattaatccaaacataa

SEQ ID NO: 199790 - DNA, 21 bp, Artificial sequence
  SiRNA target sequence
gttaattaatccaaacataat

SEQ ID NO: 199791 - DNA, 21 bp, Artificial sequence
  SiRNA target sequence
ttaattaatccaaacataata

SEQ ID NO: 199792 - DNA, 21 bp, Artificial sequence
  SiRNA target sequence
taattaatccaaacataatac

SEQ ID NO: 199793 - DNA, 21 bp, Artificial sequence
  SiRNA target sequence
aattaatccaaacataatacc

SEQ ID NO: 199794 - DNA, 21 bp, Artificial sequence
  SiRNA target sequence
attaatccaaacataatacca

SEQ ID NO: 199795 - DNA, 21 bp, Artificial sequence
  SiRNA target sequence
ttaatccaaacataataccaa

SEQ ID NO: 199796 - DNA, 21 bp, Artificial sequence
  SiRNA target sequence
taatccaaacataataccaag

SEQ ID NO: 199797 - DNA, 21 bp, Artificial sequence
  SiRNA target sequence
aatccaaacataataccaagt

SEQ ID NO: 199798 - DNA, 21 bp, Artificial sequence
  SiRNA target sequence
atccaaacataataccaagta

SEQ ID NO: 199799 - DNA, 21 bp, Artificial sequence
  SiRNA target sequence
tccaaacataataccaagtat

SEQ ID NO: 199800 - DNA, 21 bp, Artificial sequence
  SiRNA target sequence
ccaaacataataccaagtata

SEQ ID NO: 199801 - DNA, 21 bp, Artificial sequence
  SiRNA target sequence
caaacataataccaagtataa

SEQ ID NO: 199802 - DNA, 21 bp, Artificial sequence
  SiRNA target sequence
aaacataataccaagtataaa

SEQ ID NO: 199803 - DNA, 21 bp, Artificial sequence
  SiRNA target sequence
aacataataccaagtataaaa

SEQ ID NO: 199804 - DNA, 21 bp, Artificial sequence
  SiRNA target sequence
acataataccaagtataaaaa

SEQ ID NO: 199805 - DNA, 21 bp, Artificial sequence
  SiRNA target sequence
cataataccaagtataaaaaa

SEQ ID NO: 199806 - DNA, 21 bp, Artificial sequence
  SiRNA target sequence
ataataccaagtataaaaaat

SEQ ID NO: 199807 - DNA, 21 bp, Artificial sequence
  SiRNA target sequence
taataccaagtataaaaaatt

SEQ ID NO: 199808 - DNA, 21 bp, Artificial sequence
  SiRNA target sequence
aataccaagtataaaaaattt

SEQ ID NO: 199809 - DNA, 21 bp, Artificial sequence
  SiRNA target sequence
ataccaagtataaaaaattta

SEQ ID NO: 199810 - DNA, 21 bp, Artificial sequence
  SiRNA target sequence
taccaagtataaaaaatttag

SEQ ID NO: 199811 - DNA, 21 bp, Artificial sequence
  SiRNA target sequence
accaagtataaaaaatttagg

SEQ ID NO: 199812 - DNA, 21 bp, Artificial sequence
  SiRNA target sequence
ccaagtataaaaaatttaggc

SEQ ID NO: 199813 - DNA, 21 bp, Artificial sequence
  SiRNA target sequence
caagtataaaaaatttaggca

SEQ ID NO: 199814 - DNA, 21 bp, Artificial sequence
  SiRNA target sequence
aagtataaaaaatttaggcat

SEQ ID NO: 199815 - DNA, 21 bp, Artificial sequence
  SiRNA target sequence
agtataaaaaatttaggcatt

SEQ ID NO: 199816 - DNA, 21 bp, Artificial sequence
  SiRNA target sequence
gtataaaaaatttaggcattt

SEQ ID NO: 199817 - DNA, 21 bp, Artificial sequence
  SiRNA target sequence
tataaaaaatttaggcatttc

SEQ ID NO: 199818 - DNA, 21 bp, Artificial sequence
  SiRNA target sequence
ataaaaaatttaggcatttca

SEQ ID NO: 199819 - DNA, 21 bp, Artificial sequence
  SiRNA target sequence
taaaaaatttaggcatttcaa

SEQ ID NO: 199820 - DNA, 21 bp, Artificial sequence
  SiRNA target sequence
aaaaaatttaggcatttcaac

SEQ ID NO: 199821 - DNA, 21 bp, Artificial sequence
  SiRNA target sequence
aaaaatttaggcatttcaacc

SEQ ID NO: 199822 - DNA, 21 bp, Artificial sequence
  SiRNA target sequence
aaaatttaggcatttcaacct

SEQ ID NO: 199823 - DNA, 21 bp, Artificial sequence
  SiRNA target sequence
aaatttaggcatttcaacctt

SEQ ID NO: 199824 - DNA, 21 bp, Artificial sequence
  SiRNA target sequence
aatttaggcatttcaacctta

SEQ ID NO: 199825 - DNA, 21 bp, Artificial sequence
  SiRNA target sequence
atttaggcatttcaaccttag

SEQ ID NO: 199826 - DNA, 21 bp, Artificial sequence
  SiRNA target sequence
tttaggcatttcaaccttagc

SEQ ID NO: 199827 - DNA, 21 bp, Artificial sequence
  SiRNA target sequence
ttaggcatttcaaccttagca

SEQ ID NO: 199828 - DNA, 21 bp, Artificial sequence
  SiRNA target sequence
taggcatttcaaccttagcaa

SEQ ID NO: 199829 - DNA, 21 bp, Artificial sequence
  SiRNA target sequence
aggcatttcaaccttagcaac

SEQ ID NO: 199830 - DNA, 21 bp, Artificial sequence
  SiRNA target sequence
ggcatttcaaccttagcaact

SEQ ID NO: 199831 - DNA, 21 bp, Artificial sequence
  SiRNA target sequence
gcatttcaaccttagcaactt

SEQ ID NO: 199832 - DNA, 21 bp, Artificial sequence
  SiRNA target sequence
catttcaaccttagcaacttt

SEQ ID NO: 199833 - DNA, 21 bp, Artificial sequence
  SiRNA target sequence
atttcaaccttagcaacttta

SEQ ID NO: 199834 - DNA, 21 bp, Artificial sequence
  SiRNA target sequence
tttcaaccttagcaactttaa

SEQ ID NO: 199835 - DNA, 21 bp, Artificial sequence
  SiRNA target sequence
ttcaaccttagcaactttaaa

SEQ ID NO: 199836 - DNA, 21 bp, Artificial sequence
  SiRNA target sequence
tcaaccttagcaactttaaaa

SEQ ID NO: 199837 - DNA, 21 bp, Artificial sequence
  SiRNA target sequence
caaccttagcaactttaaaat

SEQ ID NO: 199838 - DNA, 21 bp, Artificial sequence
  SiRNA target sequence
aaccttagcaactttaaaata

SEQ ID NO: 199839 - DNA, 21 bp, Artificial sequence
  SiRNA target sequence
accttagcaactttaaaataa

SEQ ID NO: 199840 - DNA, 21 bp, Artificial sequence
  SiRNA target sequence
ccttagcaactttaaaataac

SEQ ID NO: 199841 - DNA, 21 bp, Artificial sequence
  SiRNA target sequence
cttagcaactttaaaataact

SEQ ID NO: 199842 - DNA, 21 bp, Artificial sequence
  SiRNA target sequence
ttagcaactttaaaataactc

SEQ ID NO: 199843 - DNA, 21 bp, Artificial sequence
  SiRNA target sequence
tagcaactttaaaataactca

SEQ ID NO: 199844 - DNA, 21 bp, Artificial sequence
  SiRNA target sequence
agcaactttaaaataactcag

SEQ ID NO: 199845 - DNA, 21 bp, Artificial sequence
  SiRNA target sequence
gcaactttaaaataactcagt

SEQ ID NO: 199846 - DNA, 21 bp, Artificial sequence
  SiRNA target sequence
caactttaaaataactcagta

SEQ ID NO: 199847 - DNA, 21 bp, Artificial sequence
  SiRNA target sequence
aactttaaaataactcagtaa

SEQ ID NO: 199848 - DNA, 21 bp, Artificial sequence
  SiRNA target sequence
actttaaaataactcagtaat

SEQ ID NO: 199849 - DNA, 21 bp, Artificial sequence
  SiRNA target sequence
ctttaaaataactcagtaatc

SEQ ID NO: 199850 - DNA, 21 bp, Artificial sequence
  SiRNA target sequence
tttaaaataactcagtaatcc

SEQ ID NO: 199851 - DNA, 21 bp, Artificial sequence
  SiRNA target sequence
ttaaaataactcagtaatcct

SEQ ID NO: 199852 - DNA, 21 bp, Artificial sequence
  SiRNA target sequence
taaaataactcagtaatcctg

SEQ ID NO: 199853 - DNA, 21 bp, Artificial sequence
  SiRNA target sequence
aaaataactcagtaatcctgt

SEQ ID NO: 199854 - DNA, 21 bp, Artificial sequence
  SiRNA target sequence
aaataactcagtaatcctgtt

SEQ ID NO: 199855 - DNA, 21 bp, Artificial sequence
  SiRNA target sequence
aataactcagtaatcctgttc

SEQ ID NO: 199856 - DNA, 21 bp, Artificial sequence
  SiRNA target sequence
ataactcagtaatcctgttct

SEQ ID NO: 199857 - DNA, 21 bp, Artificial sequence
  SiRNA target sequence
taactcagtaatcctgttctt

SEQ ID NO: 199858 - DNA, 21 bp, Artificial sequence
  SiRNA target sequence
aactcagtaatcctgttcttg

SEQ ID NO: 199859 - DNA, 21 bp, Artificial sequence
  SiRNA target sequence
actcagtaatcctgttcttga

SEQ ID NO: 199860 - DNA, 21 bp, Artificial sequence
  SiRNA target sequence
ctcagtaatcctgttcttgaa

SEQ ID NO: 199861 - DNA, 21 bp, Artificial sequence
  SiRNA target sequence
tcagtaatcctgttcttgaat

SEQ ID NO: 199862 - DNA, 21 bp, Artificial sequence
  SiRNA target sequence
cagtaatcctgttcttgaatt

SEQ ID NO: 199863 - DNA, 21 bp, Artificial sequence
  SiRNA target sequence
agtaatcctgttcttgaattt

SEQ ID NO: 199864 - DNA, 21 bp, Artificial sequence
  SiRNA target sequence
gtaatcctgttcttgaatttg

SEQ ID NO: 199865 - DNA, 21 bp, Artificial sequence
  SiRNA target sequence
taatcctgttcttgaatttgc

SEQ ID NO: 199866 - DNA, 21 bp, Artificial sequence
  SiRNA target sequence
aatcctgttcttgaatttgct

SEQ ID NO: 199867 - DNA, 21 bp, Artificial sequence
  SiRNA target sequence
atcctgttcttgaatttgcta

SEQ ID NO: 199868 - DNA, 21 bp, Artificial sequence
  SiRNA target sequence
tcctgttcttgaatttgctaa

SEQ ID NO: 199869 - DNA, 21 bp, Artificial sequence
  SiRNA target sequence
cctgttcttgaatttgctaat

SEQ ID NO: 199870 - DNA, 21 bp, Artificial sequence
  SiRNA target sequence
ctgttcttgaatttgctaatt

SEQ ID NO: 199871 - DNA, 21 bp, Artificial sequence
  SiRNA target sequence
tgttcttgaatttgctaattg

SEQ ID NO: 199872 - DNA, 21 bp, Artificial sequence
  SiRNA target sequence
gttcttgaatttgctaattga

SEQ ID NO: 199873 - DNA, 21 bp, Artificial sequence
  SiRNA target sequence
ttcttgaatttgctaattgat

SEQ ID NO: 199874 - DNA, 21 bp, Artificial sequence
  SiRNA target sequence
tcttgaatttgctaattgatc

SEQ ID NO: 199875 - DNA, 21 bp, Artificial sequence
  SiRNA target sequence
cttgaatttgctaattgatca

SEQ ID NO: 199876 - DNA, 21 bp, Artificial sequence
  SiRNA target sequence
ttgaatttgctaattgatcaa

SEQ ID NO: 199877 - DNA, 21 bp, Artificial sequence
  SiRNA target sequence
tgaatttgctaattgatcaat

SEQ ID NO: 199878 - DNA, 21 bp, Artificial sequence
  SiRNA target sequence
gaatttgctaattgatcaatc

SEQ ID NO: 199879 - DNA, 21 bp, Artificial sequence
  SiRNA target sequence
aatttgctaattgatcaatct

SEQ ID NO: 199880 - DNA, 21 bp, Artificial sequence
  SiRNA target sequence
atttgctaattgatcaatctc

SEQ ID NO: 199881 - DNA, 21 bp, Artificial sequence
  SiRNA target sequence
tttgctaattgatcaatctca

SEQ ID NO: 199882 - DNA, 21 bp, Artificial sequence
  SiRNA target sequence
ttgctaattgatcaatctcat

SEQ ID NO: 199883 - DNA, 21 bp, Artificial sequence
  SiRNA target sequence
tgctaattgatcaatctcatc

SEQ ID NO: 199884 - DNA, 21 bp, Artificial sequence
  SiRNA target sequence
gctaattgatcaatctcatct

SEQ ID NO: 199885 - DNA, 21 bp, Artificial sequence
  SiRNA target sequence
ctaattgatcaatctcatctt

SEQ ID NO: 199886 - DNA, 21 bp, Artificial sequence
  SiRNA target sequence
taattgatcaatctcatcttc

SEQ ID NO: 199887 - DNA, 21 bp, Artificial sequence
  SiRNA target sequence
aattgatcaatctcatcttcc

SEQ ID NO: 199888 - DNA, 21 bp, Artificial sequence
  SiRNA target sequence
attgatcaatctcatcttccg

SEQ ID NO: 199889 - DNA, 21 bp, Artificial sequence
  SiRNA target sequence
ttgatcaatctcatcttccgt

SEQ ID NO: 199890 - DNA, 21 bp, Artificial sequence
  SiRNA target sequence
tgatcaatctcatcttccgta

SEQ ID NO: 199891 - DNA, 21 bp, Artificial sequence
  SiRNA target sequence
gatcaatctcatcttccgtag

SEQ ID NO: 199892 - DNA, 21 bp, Artificial sequence
  SiRNA target sequence
atcaatctcatcttccgtagg

SEQ ID NO: 199893 - DNA, 21 bp, Artificial sequence
  SiRNA target sequence
tcaatctcatcttccgtaggt

SEQ ID NO: 199894 - DNA, 21 bp, Artificial sequence
  SiRNA target sequence
caatctcatcttccgtaggta

SEQ ID NO: 199895 - DNA, 21 bp, Artificial sequence
  SiRNA target sequence
aatctcatcttccgtaggtaa

SEQ ID NO: 199896 - DNA, 21 bp, Artificial sequence
  SiRNA target sequence
atctcatcttccgtaggtaag

SEQ ID NO: 199897 - DNA, 21 bp, Artificial sequence
  SiRNA target sequence
tctcatcttccgtaggtaagt

SEQ ID NO: 199898 - DNA, 21 bp, Artificial sequence
  SiRNA target sequence
ctcatcttccgtaggtaagtt

SEQ ID NO: 199899 - DNA, 21 bp, Artificial sequence
  SiRNA target sequence
tcatcttccgtaggtaagttg

SEQ ID NO: 199900 - DNA, 21 bp, Artificial sequence
  SiRNA target sequence
catcttccgtaggtaagttgt

SEQ ID NO: 199901 - DNA, 21 bp, Artificial sequence
  SiRNA target sequence
atcttccgtaggtaagttgtt

SEQ ID NO: 199902 - DNA, 21 bp, Artificial sequence
  SiRNA target sequence
tcttccgtaggtaagttgttt

SEQ ID NO: 199903 - DNA, 21 bp, Artificial sequence
  SiRNA target sequence
cttccgtaggtaagttgtttt

SEQ ID NO: 199904 - DNA, 21 bp, Artificial sequence
  SiRNA target sequence
ttccgtaggtaagttgttttc

SEQ ID NO: 199905 - DNA, 21 bp, Artificial sequence
  SiRNA target sequence
tccgtaggtaagttgttttca

SEQ ID NO: 199906 - DNA, 21 bp, Artificial sequence
  SiRNA target sequence
ccgtaggtaagttgttttcag

SEQ ID NO: 199907 - DNA, 21 bp, Artificial sequence
  SiRNA target sequence
cgtaggtaagttgttttcagg

SEQ ID NO: 199908 - DNA, 21 bp, Artificial sequence
  SiRNA target sequence
gtaggtaagttgttttcaggt

SEQ ID NO: 199909 - DNA, 21 bp, Artificial sequence
  SiRNA target sequence
taggtaagttgttttcaggtg

SEQ ID NO: 199910 - DNA, 21 bp, Artificial sequence
  SiRNA target sequence
aggtaagttgttttcaggtgt

SEQ ID NO: 199911 - DNA, 21 bp, Artificial sequence
  SiRNA target sequence
ggtaagttgttttcaggtgtt

SEQ ID NO: 199912 - DNA, 21 bp, Artificial sequence
  SiRNA target sequence
gtaagttgttttcaggtgttt

SEQ ID NO: 199913 - DNA, 21 bp, Artificial sequence
  SiRNA target sequence
taagttgttttcaggtgtttc

SEQ ID NO: 199914 - DNA, 21 bp, Artificial sequence
  SiRNA target sequence
aagttgttttcaggtgtttca

SEQ ID NO: 199915 - DNA, 21 bp, Artificial sequence
  SiRNA target sequence
agttgttttcaggtgtttcat

SEQ ID NO: 199916 - DNA, 21 bp, Artificial sequence
  SiRNA target sequence
gttgttttcaggtgtttcatt

SEQ ID NO: 199917 - DNA, 21 bp, Artificial sequence
  SiRNA target sequence
ttgttttcaggtgtttcattt

SEQ ID NO: 199918 - DNA, 21 bp, Artificial sequence
  SiRNA target sequence
tgttttcaggtgtttcattta

SEQ ID NO: 199919 - DNA, 21 bp, Artificial sequence
  SiRNA target sequence
gttttcaggtgtttcatttat

SEQ ID NO: 199920 - DNA, 21 bp, Artificial sequence
  SiRNA target sequence
ttttcaggtgtttcatttatt

SEQ ID NO: 199921 - DNA, 21 bp, Artificial sequence
  SiRNA target sequence
tttcaggtgtttcatttatta

SEQ ID NO: 199922 - DNA, 21 bp, Artificial sequence
  SiRNA target sequence
ttcaggtgtttcatttattac

SEQ ID NO: 199923 - DNA, 21 bp, Artificial sequence
  SiRNA target sequence
tcaggtgtttcatttattaca

SEQ ID NO: 199924 - DNA, 21 bp, Artificial sequence
  SiRNA target sequence
caggtgtttcatttattacac

SEQ ID NO: 199925 - DNA, 21 bp, Artificial sequence
  SiRNA target sequence
aggtgtttcatttattacact

SEQ ID NO: 199926 - DNA, 21 bp, Artificial sequence
  SiRNA target sequence
ggtgtttcatttattacactc

SEQ ID NO: 199927 - DNA, 21 bp, Artificial sequence
  SiRNA target sequence
gtgtttcatttattacactca

SEQ ID NO: 199928 - DNA, 21 bp, Artificial sequence
  SiRNA target sequence
tgtttcatttattacactcat

SEQ ID NO: 199929 - DNA, 22 bp, Artificial sequence
  SiRNA target sequence
ttattctgcgttttcttttttg

SEQ ID NO: 199930 - DNA, 22 bp, Artificial sequence
  SiRNA target sequence
tattctgcgttttcttttttgt

SEQ ID NO: 199931 - DNA, 22 bp, Artificial sequence
  SiRNA target sequence
attctgcgttttcttttttgtc

SEQ ID NO: 199932 - DNA, 22 bp, Artificial sequence
  SiRNA target sequence
ttctgcgttttcttttttgtcg

SEQ ID NO: 199933 - DNA, 22 bp, Artificial sequence
  SiRNA target sequence
tctgcgttttcttttttgtcgt

SEQ ID NO: 199934 - DNA, 22 bp, Artificial sequence
  SiRNA target sequence
ctgcgttttcttttttgtcgtc

SEQ ID NO: 199935 - DNA, 22 bp, Artificial sequence
  SiRNA target sequence
tgcgttttcttttttgtcgtct

SEQ ID NO: 199936 - DNA, 22 bp, Artificial sequence
  SiRNA target sequence
gcgttttcttttttgtcgtctt

SEQ ID NO: 199937 - DNA, 22 bp, Artificial sequence
  SiRNA target sequence
cgttttcttttttgtcgtcttt

SEQ ID NO: 199938 - DNA, 22 bp, Artificial sequence
  SiRNA target sequence
gttttcttttttgtcgtctttt

SEQ ID NO: 199939 - DNA, 22 bp, Artificial sequence
  SiRNA target sequence
ttttcttttttgtcgtctttta

SEQ ID NO: 199940 - DNA, 22 bp, Artificial sequence
  SiRNA target sequence
tttcttttttgtcgtcttttat

SEQ ID NO: 199941 - DNA, 22 bp, Artificial sequence
  SiRNA target sequence
ttcttttttgtcgtcttttatt

SEQ ID NO: 199942 - DNA, 22 bp, Artificial sequence
  SiRNA target sequence
tcttttttgtcgtcttttatta

SEQ ID NO: 199943 - DNA, 22 bp, Artificial sequence
  SiRNA target sequence
cttttttgtcgtcttttattaa

SEQ ID NO: 199944 - DNA, 22 bp, Artificial sequence
  SiRNA target sequence
ttttttgtcgtcttttattaaa

SEQ ID NO: 199945 - DNA, 22 bp, Artificial sequence
  SiRNA target sequence
tttttgtcgtcttttattaaat

SEQ ID NO: 199946 - DNA, 22 bp, Artificial sequence
  SiRNA target sequence
ttttgtcgtcttttattaaatc

SEQ ID NO: 199947 - DNA, 22 bp, Artificial sequence
  SiRNA target sequence
tttgtcgtcttttattaaatct

SEQ ID NO: 199948 - DNA, 22 bp, Artificial sequence
  SiRNA target sequence
ttgtcgtcttttattaaatcta

SEQ ID NO: 199949 - DNA, 22 bp, Artificial sequence
  SiRNA target sequence
tgtcgtcttttattaaatctat

SEQ ID NO: 199950 - DNA, 22 bp, Artificial sequence
  SiRNA target sequence
gtcgtcttttattaaatctatg

SEQ ID NO: 199951 - DNA, 22 bp, Artificial sequence
  SiRNA target sequence
tcgtcttttattaaatctatgt

SEQ ID NO: 199952 - DNA, 22 bp, Artificial sequence
  SiRNA target sequence
cgtcttttattaaatctatgtc

SEQ ID NO: 199953 - DNA, 22 bp, Artificial sequence
  SiRNA target sequence
gtcttttattaaatctatgtct

SEQ ID NO: 199954 - DNA, 22 bp, Artificial sequence
  SiRNA target sequence
tcttttattaaatctatgtcta

SEQ ID NO: 199955 - DNA, 22 bp, Artificial sequence
  SiRNA target sequence
cttttattaaatctatgtctac

SEQ ID NO: 199956 - DNA, 22 bp, Artificial sequence
  SiRNA target sequence
ttttattaaatctatgtctaca

SEQ ID NO: 199957 - DNA, 22 bp, Artificial sequence
  SiRNA target sequence
tttattaaatctatgtctacac

SEQ ID NO: 199958 - DNA, 22 bp, Artificial sequence
  SiRNA target sequence
ttattaaatctatgtctacact

SEQ ID NO: 199959 - DNA, 22 bp, Artificial sequence
  SiRNA target sequence
tattaaatctatgtctacactt

SEQ ID NO: 199960 - DNA, 22 bp, Artificial sequence
  SiRNA target sequence
attaaatctatgtctacacttg

SEQ ID NO: 199961 - DNA, 22 bp, Artificial sequence
  SiRNA target sequence
ttaaatctatgtctacacttgt

SEQ ID NO: 199962 - DNA, 22 bp, Artificial sequence
  SiRNA target sequence
taaatctatgtctacacttgta

SEQ ID NO: 199963 - DNA, 22 bp, Artificial sequence
  SiRNA target sequence
aaatctatgtctacacttgtat

SEQ ID NO: 199964 - DNA, 22 bp, Artificial sequence
  SiRNA target sequence
aatctatgtctacacttgtatt

SEQ ID NO: 199965 - DNA, 22 bp, Artificial sequence
  SiRNA target sequence
atctatgtctacacttgtatta

SEQ ID NO: 199966 - DNA, 22 bp, Artificial sequence
  SiRNA target sequence
tctatgtctacacttgtattat

SEQ ID NO: 199967 - DNA, 22 bp, Artificial sequence
  SiRNA target sequence
ctatgtctacacttgtattatt

SEQ ID NO: 199968 - DNA, 22 bp, Artificial sequence
  SiRNA target sequence
tatgtctacacttgtattattt

SEQ ID NO: 199969 - DNA, 22 bp, Artificial sequence
  SiRNA target sequence
atgtctacacttgtattatttt

SEQ ID NO: 199970 - DNA, 22 bp, Artificial sequence
  SiRNA target sequence
tgtctacacttgtattattttt

SEQ ID NO: 199971 - DNA, 22 bp, Artificial sequence
  SiRNA target sequence
gtctacacttgtattattttta

SEQ ID NO: 199972 - DNA, 22 bp, Artificial sequence
  SiRNA target sequence
tctacacttgtattatttttaa

SEQ ID NO: 199973 - DNA, 22 bp, Artificial sequence
  SiRNA target sequence
ctacacttgtattatttttaat

SEQ ID NO: 199974 - DNA, 22 bp, Artificial sequence
  SiRNA target sequence
tacacttgtattatttttaatt

SEQ ID NO: 199975 - DNA, 22 bp, Artificial sequence
  SiRNA target sequence
acacttgtattatttttaattg

SEQ ID NO: 199976 - DNA, 22 bp, Artificial sequence
  SiRNA target sequence
cacttgtattatttttaattga

SEQ ID NO: 199977 - DNA, 22 bp, Artificial sequence
  SiRNA target sequence
acttgtattatttttaattgaa

SEQ ID NO: 199978 - DNA, 22 bp, Artificial sequence
  SiRNA target sequence
cttgtattatttttaattgaaa

SEQ ID NO: 199979 - DNA, 22 bp, Artificial sequence
  SiRNA target sequence
ttgtattatttttaattgaaac

SEQ ID NO: 199980 - DNA, 22 bp, Artificial sequence
  SiRNA target sequence
tgtattatttttaattgaaacg

SEQ ID NO: 199981 - DNA, 22 bp, Artificial sequence
  SiRNA target sequence
gtattatttttaattgaaacgt

SEQ ID NO: 199982 - DNA, 22 bp, Artificial sequence
  SiRNA target sequence
tattatttttaattgaaacgtt

SEQ ID NO: 199983 - DNA, 22 bp, Artificial sequence
  SiRNA target sequence
attatttttaattgaaacgtta

SEQ ID NO: 199984 - DNA, 22 bp, Artificial sequence
  SiRNA target sequence
ttatttttaattgaaacgttat

SEQ ID NO: 199985 - DNA, 22 bp, Artificial sequence
  SiRNA target sequence
tatttttaattgaaacgttata

SEQ ID NO: 199986 - DNA, 22 bp, Artificial sequence
  SiRNA target sequence
atttttaattgaaacgttatat

SEQ ID NO: 199987 - DNA, 22 bp, Artificial sequence
  SiRNA target sequence
tttttaattgaaacgttatatg

SEQ ID NO: 199988 - DNA, 22 bp, Artificial sequence
  SiRNA target sequence
ttttaattgaaacgttatatgc

SEQ ID NO: 199989 - DNA, 22 bp, Artificial sequence
  SiRNA target sequence
tttaattgaaacgttatatgca

SEQ ID NO: 199990 - DNA, 22 bp, Artificial sequence
  SiRNA target sequence
ttaattgaaacgttatatgcac

SEQ ID NO: 199991 - DNA, 22 bp, Artificial sequence
  SiRNA target sequence
taattgaaacgttatatgcacc

SEQ ID NO: 199992 - DNA, 22 bp, Artificial sequence
  SiRNA target sequence
aattgaaacgttatatgcaccc

SEQ ID NO: 199993 - DNA, 22 bp, Artificial sequence
  SiRNA target sequence
attgaaacgttatatgcacccg

SEQ ID NO: 199994 - DNA, 22 bp, Artificial sequence
  SiRNA target sequence
ttgaaacgttatatgcacccgc

SEQ ID NO: 199995 - DNA, 22 bp, Artificial sequence
  SiRNA target sequence
tgaaacgttatatgcacccgct

SEQ ID NO: 199996 - DNA, 22 bp, Artificial sequence
  SiRNA target sequence
gaaacgttatatgcacccgcta

SEQ ID NO: 199997 - DNA, 22 bp, Artificial sequence
  SiRNA target sequence
aaacgttatatgcacccgctaa

SEQ ID NO: 199998 - DNA, 22 bp, Artificial sequence
  SiRNA target sequence
aacgttatatgcacccgctaaa

SEQ ID NO: 199999 - DNA, 22 bp, Artificial sequence
  SiRNA target sequence
acgttatatgcacccgctaaat

SEQ ID NO: 200000 - DNA, 22 bp, Artificial sequence
  SiRNA target sequence
cgttatatgcacccgctaaata

SEQ ID NO: 200001 - DNA, 22 bp, Artificial sequence
  SiRNA target sequence
gttatatgcacccgctaaatag

SEQ ID NO: 200002 - DNA, 22 bp, Artificial sequence
  SiRNA target sequence
ttatatgcacccgctaaataga

SEQ ID NO: 200003 - DNA, 22 bp, Artificial sequence
  SiRNA target sequence
tatatgcacccgctaaatagat

SEQ ID NO: 200004 - DNA, 22 bp, Artificial sequence
  SiRNA target sequence
atatgcacccgctaaatagatt

SEQ ID NO: 200005 - DNA, 22 bp, Artificial sequence
  SiRNA target sequence
tatgcacccgctaaatagatta

SEQ ID NO: 200006 - DNA, 22 bp, Artificial sequence
  SiRNA target sequence
atgcacccgctaaatagattat

SEQ ID NO: 200007 - DNA, 22 bp, Artificial sequence
  SiRNA target sequence
tgcacccgctaaatagattata

SEQ ID NO: 200008 - DNA, 22 bp, Artificial sequence
  SiRNA target sequence
gcacccgctaaatagattatag

SEQ ID NO: 200009 - DNA, 22 bp, Artificial sequence
  SiRNA target sequence
cacccgctaaatagattatagc

SEQ ID NO: 200010 - DNA, 22 bp, Artificial sequence
  SiRNA target sequence
acccgctaaatagattatagct

SEQ ID NO: 200011 - DNA, 22 bp, Artificial sequence
  SiRNA target sequence
cccgctaaatagattatagctc

SEQ ID NO: 200012 - DNA, 22 bp, Artificial sequence
  SiRNA target sequence
ccgctaaatagattatagctct

SEQ ID NO: 200013 - DNA, 22 bp, Artificial sequence
  SiRNA target sequence
cgctaaatagattatagctcta

SEQ ID NO: 200014 - DNA, 22 bp, Artificial sequence
  SiRNA target sequence
gctaaatagattatagctctaa

SEQ ID NO: 200015 - DNA, 22 bp, Artificial sequence
  SiRNA target sequence
ctaaatagattatagctctaat

SEQ ID NO: 200016 - DNA, 22 bp, Artificial sequence
  SiRNA target sequence
taaatagattatagctctaatc

SEQ ID NO: 200017 - DNA, 22 bp, Artificial sequence
  SiRNA target sequence
aaatagattatagctctaatcc

SEQ ID NO: 200018 - DNA, 22 bp, Artificial sequence
  SiRNA target sequence
aatagattatagctctaatcca

SEQ ID NO: 200019 - DNA, 22 bp, Artificial sequence
  SiRNA target sequence
atagattatagctctaatccaa

SEQ ID NO: 200020 - DNA, 22 bp, Artificial sequence
  SiRNA target sequence
tagattatagctctaatccaaa

SEQ ID NO: 200021 - DNA, 22 bp, Artificial sequence
  SiRNA target sequence
agattatagctctaatccaaat

SEQ ID NO: 200022 - DNA, 22 bp, Artificial sequence
  SiRNA target sequence
gattatagctctaatccaaata

SEQ ID NO: 200023 - DNA, 22 bp, Artificial sequence
  SiRNA target sequence
attatagctctaatccaaatat

SEQ ID NO: 200024 - DNA, 22 bp, Artificial sequence
  SiRNA target sequence
ttatagctctaatccaaatata

SEQ ID NO: 200025 - DNA, 22 bp, Artificial sequence
  SiRNA target sequence
tatagctctaatccaaatataa

SEQ ID NO: 200026 - DNA, 22 bp, Artificial sequence
  SiRNA target sequence
atagctctaatccaaatataaa

SEQ ID NO: 200027 - DNA, 22 bp, Artificial sequence
  SiRNA target sequence
tagctctaatccaaatataaat

SEQ ID NO: 200028 - DNA, 22 bp, Artificial sequence
  SiRNA target sequence
agctctaatccaaatataaatc

SEQ ID NO: 200029 - DNA, 22 bp, Artificial sequence
  SiRNA target sequence
gctctaatccaaatataaatca

SEQ ID NO: 200030 - DNA, 22 bp, Artificial sequence
  SiRNA target sequence
ctctaatccaaatataaatcaa

SEQ ID NO: 200031 - DNA, 22 bp, Artificial sequence
  SiRNA target sequence
tctaatccaaatataaatcaat

SEQ ID NO: 200032 - DNA, 22 bp, Artificial sequence
  SiRNA target sequence
ctaatccaaatataaatcaata

SEQ ID NO: 200033 - DNA, 22 bp, Artificial sequence
  SiRNA target sequence
taatccaaatataaatcaatat

SEQ ID NO: 200034 - DNA, 22 bp, Artificial sequence
  SiRNA target sequence
aatccaaatataaatcaatatt

SEQ ID NO: 200035 - DNA, 22 bp, Artificial sequence
  SiRNA target sequence
atccaaatataaatcaatatta

SEQ ID NO: 200036 - DNA, 22 bp, Artificial sequence
  SiRNA target sequence
tccaaatataaatcaatattat

SEQ ID NO: 200037 - DNA, 22 bp, Artificial sequence
  SiRNA target sequence
ccaaatataaatcaatattatt

SEQ ID NO: 200038 - DNA, 22 bp, Artificial sequence
  SiRNA target sequence
caaatataaatcaatattattg

SEQ ID NO: 200039 - DNA, 22 bp, Artificial sequence
  SiRNA target sequence
aaatataaatcaatattattgc

SEQ ID NO: 200040 - DNA, 22 bp, Artificial sequence
  SiRNA target sequence
aatataaatcaatattattgca

SEQ ID NO: 200041 - DNA, 22 bp, Artificial sequence
  SiRNA target sequence
atataaatcaatattattgcaa

SEQ ID NO: 200042 - DNA, 22 bp, Artificial sequence
  SiRNA target sequence
tataaatcaatattattgcaat

SEQ ID NO: 200043 - DNA, 22 bp, Artificial sequence
  SiRNA target sequence
ataaatcaatattattgcaatc

SEQ ID NO: 200044 - DNA, 22 bp, Artificial sequence
  SiRNA target sequence
taaatcaatattattgcaatcg

SEQ ID NO: 200045 - DNA, 22 bp, Artificial sequence
  SiRNA target sequence
aaatcaatattattgcaatcgt

SEQ ID NO: 200046 - DNA, 22 bp, Artificial sequence
  SiRNA target sequence
aatcaatattattgcaatcgtt

SEQ ID NO: 200047 - DNA, 22 bp, Artificial sequence
  SiRNA target sequence
atcaatattattgcaatcgtta

SEQ ID NO: 200048 - DNA, 22 bp, Artificial sequence
  SiRNA target sequence
tcaatattattgcaatcgttaa

SEQ ID NO: 200049 - DNA, 22 bp, Artificial sequence
  SiRNA target sequence
caatattattgcaatcgttaat

SEQ ID NO: 200050 - DNA, 22 bp, Artificial sequence
  SiRNA target sequence
aatattattgcaatcgttaatg

SEQ ID NO: 200051 - DNA, 22 bp, Artificial sequence
  SiRNA target sequence
atattattgcaatcgttaatgt

SEQ ID NO: 200052 - DNA, 22 bp, Artificial sequence
  SiRNA target sequence
tattattgcaatcgttaatgtg

SEQ ID NO: 200053 - DNA, 22 bp, Artificial sequence
  SiRNA target sequence
attattgcaatcgttaatgtga

SEQ ID NO: 200054 - DNA, 22 bp, Artificial sequence
  SiRNA target sequence
ttattgcaatcgttaatgtgat

SEQ ID NO: 200055 - DNA, 22 bp, Artificial sequence
  SiRNA target sequence
tattgcaatcgttaatgtgatt

SEQ ID NO: 200056 - DNA, 22 bp, Artificial sequence
  SiRNA target sequence
attgcaatcgttaatgtgattg

SEQ ID NO: 200057 - DNA, 22 bp, Artificial sequence
  SiRNA target sequence
ttgcaatcgttaatgtgattgg

SEQ ID NO: 200058 - DNA, 22 bp, Artificial sequence
  SiRNA target sequence
tgcaatcgttaatgtgattgga

SEQ ID NO: 200059 - DNA, 22 bp, Artificial sequence
  SiRNA target sequence
gcaatcgttaatgtgattggac

SEQ ID NO: 200060 - DNA, 22 bp, Artificial sequence
  SiRNA target sequence
caatcgttaatgtgattggact

SEQ ID NO: 200061 - DNA, 22 bp, Artificial sequence
  SiRNA target sequence
aatcgttaatgtgattggacta

SEQ ID NO: 200062 - DNA, 22 bp, Artificial sequence
  SiRNA target sequence
atcgttaatgtgattggactac

SEQ ID NO: 200063 - DNA, 22 bp, Artificial sequence
  SiRNA target sequence
tcgttaatgtgattggactacc

SEQ ID NO: 200064 - DNA, 22 bp, Artificial sequence
  SiRNA target sequence
cgttaatgtgattggactaccc

SEQ ID NO: 200065 - DNA, 22 bp, Artificial sequence
  SiRNA target sequence
gttaatgtgattggactaccct

SEQ ID NO: 200066 - DNA, 22 bp, Artificial sequence
  SiRNA target sequence
ttaatgtgattggactaccctt

SEQ ID NO: 200067 - DNA, 22 bp, Artificial sequence
  SiRNA target sequence
taatgtgattggactacccttc

SEQ ID NO: 200068 - DNA, 22 bp, Artificial sequence
  SiRNA target sequence
aatgtgattggactacccttcc

SEQ ID NO: 200069 - DNA, 22 bp, Artificial sequence
  SiRNA target sequence
atgtgattggactacccttcct

SEQ ID NO: 200070 - DNA, 22 bp, Artificial sequence
  SiRNA target sequence
tgtgattggactacccttcctt

SEQ ID NO: 200071 - DNA, 22 bp, Artificial sequence
  SiRNA target sequence
gtgattggactacccttcctta

SEQ ID NO: 200072 - DNA, 22 bp, Artificial sequence
  SiRNA target sequence
tgattggactacccttccttac

SEQ ID NO: 200073 - DNA, 22 bp, Artificial sequence
  SiRNA target sequence
gattggactacccttccttaca

SEQ ID NO: 200074 - DNA, 22 bp, Artificial sequence
  SiRNA target sequence
attggactacccttccttacat

SEQ ID NO: 200075 - DNA, 22 bp, Artificial sequence
  SiRNA target sequence
ttggactacccttccttacatt

SEQ ID NO: 200076 - DNA, 22 bp, Artificial sequence
  SiRNA target sequence
tggactacccttccttacatta

SEQ ID NO: 200077 - DNA, 22 bp, Artificial sequence
  SiRNA target sequence
ggactacccttccttacattat

SEQ ID NO: 200078 - DNA, 22 bp, Artificial sequence
  SiRNA target sequence
gactacccttccttacattatc

SEQ ID NO: 200079 - DNA, 22 bp, Artificial sequence
  SiRNA target sequence
actacccttccttacattatca

SEQ ID NO: 200080 - DNA, 22 bp, Artificial sequence
  SiRNA target sequence
ctacccttccttacattatcag

SEQ ID NO: 200081 - DNA, 22 bp, Artificial sequence
  SiRNA target sequence
tacccttccttacattatcagt

SEQ ID NO: 200082 - DNA, 22 bp, Artificial sequence
  SiRNA target sequence
acccttccttacattatcagta

SEQ ID NO: 200083 - DNA, 22 bp, Artificial sequence
  SiRNA target sequence
cccttccttacattatcagtat

SEQ ID NO: 200084 - DNA, 22 bp, Artificial sequence
  SiRNA target sequence
ccttccttacattatcagtatc

SEQ ID NO: 200085 - DNA, 22 bp, Artificial sequence
  SiRNA target sequence
cttccttacattatcagtatca

SEQ ID NO: 200086 - DNA, 22 bp, Artificial sequence
  SiRNA target sequence
ttccttacattatcagtatcaa

SEQ ID NO: 200087 - DNA, 22 bp, Artificial sequence
  SiRNA target sequence
tccttacattatcagtatcaag

SEQ ID NO: 200088 - DNA, 22 bp, Artificial sequence
  SiRNA target sequence
ccttacattatcagtatcaagt

SEQ ID NO: 200089 - DNA, 22 bp, Artificial sequence
  SiRNA target sequence
cttacattatcagtatcaagtg

SEQ ID NO: 200090 - DNA, 22 bp, Artificial sequence
  SiRNA target sequence
ttacattatcagtatcaagtgc

SEQ ID NO: 200091 - DNA, 22 bp, Artificial sequence
  SiRNA target sequence
tacattatcagtatcaagtgct

SEQ ID NO: 200092 - DNA, 22 bp, Artificial sequence
  SiRNA target sequence
acattatcagtatcaagtgcta

SEQ ID NO: 200093 - DNA, 22 bp, Artificial sequence
  SiRNA target sequence
cattatcagtatcaagtgctac

SEQ ID NO: 200094 - DNA, 22 bp, Artificial sequence
  SiRNA target sequence
attatcagtatcaagtgctact

SEQ ID NO: 200095 - DNA, 22 bp, Artificial sequence
  SiRNA target sequence
ttatcagtatcaagtgctacta

SEQ ID NO: 200096 - DNA, 22 bp, Artificial sequence
  SiRNA target sequence
tatcagtatcaagtgctactaa

SEQ ID NO: 200097 - DNA, 22 bp, Artificial sequence
  SiRNA target sequence
atcagtatcaagtgctactaat

SEQ ID NO: 200098 - DNA, 22 bp, Artificial sequence
  SiRNA target sequence
tcagtatcaagtgctactaata

SEQ ID NO: 200099 - DNA, 22 bp, Artificial sequence
  SiRNA target sequence
cagtatcaagtgctactaatat

SEQ ID NO: 200100 - DNA, 22 bp, Artificial sequence
  SiRNA target sequence
agtatcaagtgctactaatatg

SEQ ID NO: 200101 - DNA, 22 bp, Artificial sequence
  SiRNA target sequence
gtatcaagtgctactaatatgg

SEQ ID NO: 200102 - DNA, 22 bp, Artificial sequence
  SiRNA target sequence
tatcaagtgctactaatatggc

SEQ ID NO: 200103 - DNA, 22 bp, Artificial sequence
  SiRNA target sequence
atcaagtgctactaatatggct

SEQ ID NO: 200104 - DNA, 22 bp, Artificial sequence
  SiRNA target sequence
tcaagtgctactaatatggcta

SEQ ID NO: 200105 - DNA, 22 bp, Artificial sequence
  SiRNA target sequence
caagtgctactaatatggctag

SEQ ID NO: 200106 - DNA, 22 bp, Artificial sequence
  SiRNA target sequence
aagtgctactaatatggctagt

SEQ ID NO: 200107 - DNA, 22 bp, Artificial sequence
  SiRNA target sequence
agtgctactaatatggctagtc

SEQ ID NO: 200108 - DNA, 22 bp, Artificial sequence
  SiRNA target sequence
gtgctactaatatggctagtcc

SEQ ID NO: 200109 - DNA, 22 bp, Artificial sequence
  SiRNA target sequence
tgctactaatatggctagtcca

SEQ ID NO: 200110 - DNA, 22 bp, Artificial sequence
  SiRNA target sequence
gctactaatatggctagtccat

SEQ ID NO: 200111 - DNA, 22 bp, Artificial sequence
  SiRNA target sequence
ctactaatatggctagtccata

SEQ ID NO: 200112 - DNA, 22 bp, Artificial sequence
  SiRNA target sequence
tactaatatggctagtccatat

SEQ ID NO: 200113 - DNA, 22 bp, Artificial sequence
  SiRNA target sequence
actaatatggctagtccatata

SEQ ID NO: 200114 - DNA, 22 bp, Artificial sequence
  SiRNA target sequence
ctaatatggctagtccatataa

SEQ ID NO: 200115 - DNA, 22 bp, Artificial sequence
  SiRNA target sequence
taatatggctagtccatataat

SEQ ID NO: 200116 - DNA, 22 bp, Artificial sequence
  SiRNA target sequence
aatatggctagtccatataatg

SEQ ID NO: 200117 - DNA, 22 bp, Artificial sequence
  SiRNA target sequence
atatggctagtccatataatga

SEQ ID NO: 200118 - DNA, 22 bp, Artificial sequence
  SiRNA target sequence
tatggctagtccatataatgaa

SEQ ID NO: 200119 - DNA, 22 bp, Artificial sequence
  SiRNA target sequence
atggctagtccatataatgaac

SEQ ID NO: 200120 - DNA, 22 bp, Artificial sequence
  SiRNA target sequence
tggctagtccatataatgaacc

SEQ ID NO: 200121 - DNA, 22 bp, Artificial sequence
  SiRNA target sequence
ggctagtccatataatgaacca

SEQ ID NO: 200122 - DNA, 22 bp, Artificial sequence
  SiRNA target sequence
gctagtccatataatgaaccaa

SEQ ID NO: 200123 - DNA, 22 bp, Artificial sequence
  SiRNA target sequence
ctagtccatataatgaaccaat

SEQ ID NO: 200124 - DNA, 22 bp, Artificial sequence
  SiRNA target sequence
tagtccatataatgaaccaata

SEQ ID NO: 200125 - DNA, 22 bp, Artificial sequence
  SiRNA target sequence
agtccatataatgaaccaatag

SEQ ID NO: 200126 - DNA, 22 bp, Artificial sequence
  SiRNA target sequence
gtccatataatgaaccaataga

SEQ ID NO: 200127 - DNA, 22 bp, Artificial sequence
  SiRNA target sequence
tccatataatgaaccaatagat

SEQ ID NO: 200128 - DNA, 22 bp, Artificial sequence
  SiRNA target sequence
ccatataatgaaccaatagatt

SEQ ID NO: 200129 - DNA, 22 bp, Artificial sequence
  SiRNA target sequence
catataatgaaccaatagattt

SEQ ID NO: 200130 - DNA, 22 bp, Artificial sequence
  SiRNA target sequence
atataatgaaccaatagatttt

SEQ ID NO: 200131 - DNA, 22 bp, Artificial sequence
  SiRNA target sequence
tataatgaaccaatagattttc

SEQ ID NO: 200132 - DNA, 22 bp, Artificial sequence
  SiRNA target sequence
ataatgaaccaatagattttcc

SEQ ID NO: 200133 - DNA, 22 bp, Artificial sequence
  SiRNA target sequence
taatgaaccaatagattttcct

SEQ ID NO: 200134 - DNA, 22 bp, Artificial sequence
  SiRNA target sequence
aatgaaccaatagattttccta

SEQ ID NO: 200135 - DNA, 22 bp, Artificial sequence
  SiRNA target sequence
atgaaccaatagattttcctaa

SEQ ID NO: 200136 - DNA, 22 bp, Artificial sequence
  SiRNA target sequence
tgaaccaatagattttcctaat

SEQ ID NO: 200137 - DNA, 22 bp, Artificial sequence
  SiRNA target sequence
gaaccaatagattttcctaatt

SEQ ID NO: 200138 - DNA, 22 bp, Artificial sequence
  SiRNA target sequence
aaccaatagattttcctaattt

SEQ ID NO: 200139 - DNA, 22 bp, Artificial sequence
  SiRNA target sequence
accaatagattttcctaattta

SEQ ID NO: 200140 - DNA, 22 bp, Artificial sequence
  SiRNA target sequence
ccaatagattttcctaatttat

SEQ ID NO: 200141 - DNA, 22 bp, Artificial sequence
  SiRNA target sequence
caatagattttcctaatttatt

SEQ ID NO: 200142 - DNA, 22 bp, Artificial sequence
  SiRNA target sequence
aatagattttcctaatttatta

SEQ ID NO: 200143 - DNA, 22 bp, Artificial sequence
  SiRNA target sequence
atagattttcctaatttattaa

SEQ ID NO: 200144 - DNA, 22 bp, Artificial sequence
  SiRNA target sequence
tagattttcctaatttattaaa

SEQ ID NO: 200145 - DNA, 22 bp, Artificial sequence
  SiRNA target sequence
agattttcctaatttattaaaa

SEQ ID NO: 200146 - DNA, 22 bp, Artificial sequence
  SiRNA target sequence
gattttcctaatttattaaaaa

SEQ ID NO: 200147 - DNA, 22 bp, Artificial sequence
  SiRNA target sequence
attttcctaatttattaaaaat

SEQ ID NO: 200148 - DNA, 22 bp, Artificial sequence
  SiRNA target sequence
ttttcctaatttattaaaaata

SEQ ID NO: 200149 - DNA, 22 bp, Artificial sequence
  SiRNA target sequence
tttcctaatttattaaaaatac

SEQ ID NO: 200150 - DNA, 22 bp, Artificial sequence
  SiRNA target sequence
ttcctaatttattaaaaatacc

SEQ ID NO: 200151 - DNA, 22 bp, Artificial sequence
  SiRNA target sequence
tcctaatttattaaaaatacca

SEQ ID NO: 200152 - DNA, 22 bp, Artificial sequence
  SiRNA target sequence
cctaatttattaaaaataccat

SEQ ID NO: 200153 - DNA, 22 bp, Artificial sequence
  SiRNA target sequence
ctaatttattaaaaataccatc

SEQ ID NO: 200154 - DNA, 22 bp, Artificial sequence
  SiRNA target sequence
taatttattaaaaataccatca

SEQ ID NO: 200155 - DNA, 22 bp, Artificial sequence
  SiRNA target sequence
aatttattaaaaataccatcat

SEQ ID NO: 200156 - DNA, 22 bp, Artificial sequence
  SiRNA target sequence
atttattaaaaataccatcata

SEQ ID NO: 200157 - DNA, 22 bp, Artificial sequence
  SiRNA target sequence
tttattaaaaataccatcataa

SEQ ID NO: 200158 - DNA, 22 bp, Artificial sequence
  SiRNA target sequence
ttattaaaaataccatcataaa

SEQ ID NO: 200159 - DNA, 22 bp, Artificial sequence
  SiRNA target sequence
tattaaaaataccatcataaac

SEQ ID NO: 200160 - DNA, 22 bp, Artificial sequence
  SiRNA target sequence
attaaaaataccatcataaaca

SEQ ID NO: 200161 - DNA, 22 bp, Artificial sequence
  SiRNA target sequence
ttaaaaataccatcataaacac

SEQ ID NO: 200162 - DNA, 22 bp, Artificial sequence
  SiRNA target sequence
taaaaataccatcataaacact

SEQ ID NO: 200163 - DNA, 22 bp, Artificial sequence
  SiRNA target sequence
aaaaataccatcataaacactt

SEQ ID NO: 200164 - DNA, 22 bp, Artificial sequence
  SiRNA target sequence
aaaataccatcataaacacttt

SEQ ID NO: 200165 - DNA, 22 bp, Artificial sequence
  SiRNA target sequence
aaataccatcataaacactttt

SEQ ID NO: 200166 - DNA, 22 bp, Artificial sequence
  SiRNA target sequence
aataccatcataaacactttta

SEQ ID NO: 200167 - DNA, 22 bp, Artificial sequence
  SiRNA target sequence
ataccatcataaacacttttaa

SEQ ID NO: 200168 - DNA, 22 bp, Artificial sequence
  SiRNA target sequence
taccatcataaacacttttaaa

SEQ ID NO: 200169 - DNA, 22 bp, Artificial sequence
  SiRNA target sequence
accatcataaacacttttaaac

SEQ ID NO: 200170 - DNA, 22 bp, Artificial sequence
  SiRNA target sequence
ccatcataaacacttttaaacc

SEQ ID NO: 200171 - DNA, 22 bp, Artificial sequence
  SiRNA target sequence
catcataaacacttttaaaccg

SEQ ID NO: 200172 - DNA, 22 bp, Artificial sequence
  SiRNA target sequence
atcataaacacttttaaaccgt

SEQ ID NO: 200173 - DNA, 22 bp, Artificial sequence
  SiRNA target sequence
tcataaacacttttaaaccgtg

SEQ ID NO: 200174 - DNA, 22 bp, Artificial sequence
  SiRNA target sequence
cataaacacttttaaaccgtgc

SEQ ID NO: 200175 - DNA, 22 bp, Artificial sequence
  SiRNA target sequence
ataaacacttttaaaccgtgcc

SEQ ID NO: 200176 - DNA, 22 bp, Artificial sequence
  SiRNA target sequence
taaacacttttaaaccgtgccc

SEQ ID NO: 200177 - DNA, 22 bp, Artificial sequence
  SiRNA target sequence
aaacacttttaaaccgtgccct

SEQ ID NO: 200178 - DNA, 22 bp, Artificial sequence
  SiRNA target sequence
aacacttttaaaccgtgccctg

SEQ ID NO: 200179 - DNA, 22 bp, Artificial sequence
  SiRNA target sequence
acacttttaaaccgtgccctgt

SEQ ID NO: 200180 - DNA, 22 bp, Artificial sequence
  SiRNA target sequence
cacttttaaaccgtgccctgtg

SEQ ID NO: 200181 - DNA, 22 bp, Artificial sequence
  SiRNA target sequence
acttttaaaccgtgccctgtgt

SEQ ID NO: 200182 - DNA, 22 bp, Artificial sequence
  SiRNA target sequence
cttttaaaccgtgccctgtgtg

SEQ ID NO: 200183 - DNA, 22 bp, Artificial sequence
  SiRNA target sequence
ttttaaaccgtgccctgtgtgc

SEQ ID NO: 200184 - DNA, 22 bp, Artificial sequence
  SiRNA target sequence
tttaaaccgtgccctgtgtgca

SEQ ID NO: 200185 - DNA, 22 bp, Artificial sequence
  SiRNA target sequence
ttaaaccgtgccctgtgtgcag

SEQ ID NO: 200186 - DNA, 22 bp, Artificial sequence
  SiRNA target sequence
taaaccgtgccctgtgtgcagg

SEQ ID NO: 200187 - DNA, 22 bp, Artificial sequence
  SiRNA target sequence
aaaccgtgccctgtgtgcagga

SEQ ID NO: 200188 - DNA, 22 bp, Artificial sequence
  SiRNA target sequence
aaccgtgccctgtgtgcaggat

SEQ ID NO: 200189 - DNA, 22 bp, Artificial sequence
  SiRNA target sequence
accgtgccctgtgtgcaggatc

SEQ ID NO: 200190 - DNA, 22 bp, Artificial sequence
  SiRNA target sequence
ccgtgccctgtgtgcaggatcg

SEQ ID NO: 200191 - DNA, 22 bp, Artificial sequence
  SiRNA target sequence
cgtgccctgtgtgcaggatcga

SEQ ID NO: 200192 - DNA, 22 bp, Artificial sequence
  SiRNA target sequence
gtgccctgtgtgcaggatcgat

SEQ ID NO: 200193 - DNA, 22 bp, Artificial sequence
  SiRNA target sequence
tgccctgtgtgcaggatcgatt

SEQ ID NO: 200194 - DNA, 22 bp, Artificial sequence
  SiRNA target sequence
gccctgtgtgcaggatcgattc

SEQ ID NO: 200195 - DNA, 22 bp, Artificial sequence
  SiRNA target sequence
ccctgtgtgcaggatcgattct

SEQ ID NO: 200196 - DNA, 22 bp, Artificial sequence
  SiRNA target sequence
cctgtgtgcaggatcgattctc

SEQ ID NO: 200197 - DNA, 22 bp, Artificial sequence
  SiRNA target sequence
ctgtgtgcaggatcgattctca

SEQ ID NO: 200198 - DNA, 22 bp, Artificial sequence
  SiRNA target sequence
tgtgtgcaggatcgattctcat

SEQ ID NO: 200199 - DNA, 22 bp, Artificial sequence
  SiRNA target sequence
gtgtgcaggatcgattctcata

SEQ ID NO: 200200 - DNA, 22 bp, Artificial sequence
  SiRNA target sequence
tgtgcaggatcgattctcatac

SEQ ID NO: 200201 - DNA, 22 bp, Artificial sequence
  SiRNA target sequence
gtgcaggatcgattctcatacc

SEQ ID NO: 200202 - DNA, 22 bp, Artificial sequence
  SiRNA target sequence
tgcaggatcgattctcataccc

SEQ ID NO: 200203 - DNA, 22 bp, Artificial sequence
  SiRNA target sequence
gcaggatcgattctcataccca

SEQ ID NO: 200204 - DNA, 22 bp, Artificial sequence
  SiRNA target sequence
caggatcgattctcatacccat

SEQ ID NO: 200205 - DNA, 22 bp, Artificial sequence
  SiRNA target sequence
aggatcgattctcatacccatt

SEQ ID NO: 200206 - DNA, 22 bp, Artificial sequence
  SiRNA target sequence
ggatcgattctcatacccattt

SEQ ID NO: 200207 - DNA, 22 bp, Artificial sequence
  SiRNA target sequence
gatcgattctcatacccatttt

SEQ ID NO: 200208 - DNA, 22 bp, Artificial sequence
  SiRNA target sequence
atcgattctcatacccattttc

SEQ ID NO: 200209 - DNA, 22 bp, Artificial sequence
  SiRNA target sequence
tcgattctcatacccattttct

SEQ ID NO: 200210 - DNA, 22 bp, Artificial sequence
  SiRNA target sequence
cgattctcatacccattttctc

SEQ ID NO: 200211 - DNA, 22 bp, Artificial sequence
  SiRNA target sequence
gattctcatacccattttctct

SEQ ID NO: 200212 - DNA, 22 bp, Artificial sequence
  SiRNA target sequence
attctcatacccattttctctt

SEQ ID NO: 200213 - DNA, 22 bp, Artificial sequence
  SiRNA target sequence
ttctcatacccattttctcttt

SEQ ID NO: 200214 - DNA, 22 bp, Artificial sequence
  SiRNA target sequence
tctcatacccattttctcttta

SEQ ID NO: 200215 - DNA, 22 bp, Artificial sequence
  SiRNA target sequence
ctcatacccattttctctttac

SEQ ID NO: 200216 - DNA, 22 bp, Artificial sequence
  SiRNA target sequence
tcatacccattttctctttaca

SEQ ID NO: 200217 - DNA, 22 bp, Artificial sequence
  SiRNA target sequence
catacccattttctctttacaa

SEQ ID NO: 200218 - DNA, 22 bp, Artificial sequence
  SiRNA target sequence
atacccattttctctttacaaa

SEQ ID NO: 200219 - DNA, 22 bp, Artificial sequence
  SiRNA target sequence
tacccattttctctttacaaat

SEQ ID NO: 200220 - DNA, 22 bp, Artificial sequence
  SiRNA target sequence
acccattttctctttacaaata

SEQ ID NO: 200221 - DNA, 22 bp, Artificial sequence
  SiRNA target sequence
cccattttctctttacaaatat

SEQ ID NO: 200222 - DNA, 22 bp, Artificial sequence
  SiRNA target sequence
ccattttctctttacaaatatc

SEQ ID NO: 200223 - DNA, 22 bp, Artificial sequence
  SiRNA target sequence
cattttctctttacaaatatca

SEQ ID NO: 200224 - DNA, 22 bp, Artificial sequence
  SiRNA target sequence
attttctctttacaaatatcaa

SEQ ID NO: 200225 - DNA, 22 bp, Artificial sequence
  SiRNA target sequence
ttttctctttacaaatatcaaa

SEQ ID NO: 200226 - DNA, 22 bp, Artificial sequence
  SiRNA target sequence
tttctctttacaaatatcaaag

SEQ ID NO: 200227 - DNA, 22 bp, Artificial sequence
  SiRNA target sequence
ttctctttacaaatatcaaagg

SEQ ID NO: 200228 - DNA, 22 bp, Artificial sequence
  SiRNA target sequence
tctctttacaaatatcaaaggc

SEQ ID NO: 200229 - DNA, 22 bp, Artificial sequence
  SiRNA target sequence
ctctttacaaatatcaaaggct

SEQ ID NO: 200230 - DNA, 22 bp, Artificial sequence
  SiRNA target sequence
tctttacaaatatcaaaggctg

SEQ ID NO: 200231 - DNA, 22 bp, Artificial sequence
  SiRNA target sequence
ctttacaaatatcaaaggctga

SEQ ID NO: 200232 - DNA, 22 bp, Artificial sequence
  SiRNA target sequence
tttacaaatatcaaaggctgaa

SEQ ID NO: 200233 - DNA, 22 bp, Artificial sequence
  SiRNA target sequence
ttacaaatatcaaaggctgaat

SEQ ID NO: 200234 - DNA, 22 bp, Artificial sequence
  SiRNA target sequence
tacaaatatcaaaggctgaata

SEQ ID NO: 200235 - DNA, 22 bp, Artificial sequence
  SiRNA target sequence
acaaatatcaaaggctgaatat

SEQ ID NO: 200236 - DNA, 22 bp, Artificial sequence
  SiRNA target sequence
caaatatcaaaggctgaatatt

SEQ ID NO: 200237 - DNA, 22 bp, Artificial sequence
  SiRNA target sequence
aaatatcaaaggctgaatattt

SEQ ID NO: 200238 - DNA, 22 bp, Artificial sequence
  SiRNA target sequence
aatatcaaaggctgaatatttt

SEQ ID NO: 200239 - DNA, 22 bp, Artificial sequence
  SiRNA target sequence
atatcaaaggctgaatatttta

SEQ ID NO: 200240 - DNA, 22 bp, Artificial sequence
  SiRNA target sequence
tatcaaaggctgaatattttaa

SEQ ID NO: 200241 - DNA, 22 bp, Artificial sequence
  SiRNA target sequence
atcaaaggctgaatattttaat

SEQ ID NO: 200242 - DNA, 22 bp, Artificial sequence
  SiRNA target sequence
tcaaaggctgaatattttaata

SEQ ID NO: 200243 - DNA, 22 bp, Artificial sequence
  SiRNA target sequence
caaaggctgaatattttaatac

SEQ ID NO: 200244 - DNA, 22 bp, Artificial sequence
  SiRNA target sequence
aaaggctgaatattttaatact

SEQ ID NO: 200245 - DNA, 22 bp, Artificial sequence
  SiRNA target sequence
aaggctgaatattttaatactt

SEQ ID NO: 200246 - DNA, 22 bp, Artificial sequence
  SiRNA target sequence
aggctgaatattttaatacttt

SEQ ID NO: 200247 - DNA, 22 bp, Artificial sequence
  SiRNA target sequence
ggctgaatattttaatactttt

SEQ ID NO: 200248 - DNA, 22 bp, Artificial sequence
  SiRNA target sequence
gctgaatattttaatactttta

SEQ ID NO: 200249 - DNA, 22 bp, Artificial sequence
  SiRNA target sequence
ctgaatattttaatacttttat

SEQ ID NO: 200250 - DNA, 22 bp, Artificial sequence
  SiRNA target sequence
tgaatattttaatacttttatg

SEQ ID NO: 200251 - DNA, 22 bp, Artificial sequence
  SiRNA target sequence
gaatattttaatacttttatga

SEQ ID NO: 200252 - DNA, 22 bp, Artificial sequence
  SiRNA target sequence
aatattttaatacttttatgaa

SEQ ID NO: 200253 - DNA, 22 bp, Artificial sequence
  SiRNA target sequence
atattttaatacttttatgaat

SEQ ID NO: 200254 - DNA, 22 bp, Artificial sequence
  SiRNA target sequence
tattttaatacttttatgaatg

SEQ ID NO: 200255 - DNA, 22 bp, Artificial sequence
  SiRNA target sequence
attttaatacttttatgaatgc

SEQ ID NO: 200256 - DNA, 22 bp, Artificial sequence
  SiRNA target sequence
ttttaatacttttatgaatgct

SEQ ID NO: 200257 - DNA, 22 bp, Artificial sequence
  SiRNA target sequence
tttaatacttttatgaatgcta

SEQ ID NO: 200258 - DNA, 22 bp, Artificial sequence
  SiRNA target sequence
ttaatacttttatgaatgctaa

SEQ ID NO: 200259 - DNA, 22 bp, Artificial sequence
  SiRNA target sequence
taatacttttatgaatgctaaa

SEQ ID NO: 200260 - DNA, 22 bp, Artificial sequence
  SiRNA target sequence
aatacttttatgaatgctaaaa

SEQ ID NO: 200261 - DNA, 22 bp, Artificial sequence
  SiRNA target sequence
atacttttatgaatgctaaaaa

SEQ ID NO: 200262 - DNA, 22 bp, Artificial sequence
  SiRNA target sequence
tacttttatgaatgctaaaaag

SEQ ID NO: 200263 - DNA, 22 bp, Artificial sequence
  SiRNA target sequence
acttttatgaatgctaaaaaga

SEQ ID NO: 200264 - DNA, 22 bp, Artificial sequence
  SiRNA target sequence
cttttatgaatgctaaaaagaa

SEQ ID NO: 200265 - DNA, 22 bp, Artificial sequence
  SiRNA target sequence
ttttatgaatgctaaaaagaac

SEQ ID NO: 200266 - DNA, 22 bp, Artificial sequence
  SiRNA target sequence
tttatgaatgctaaaaagaaca

SEQ ID NO: 200267 - DNA, 22 bp, Artificial sequence
  SiRNA target sequence
ttatgaatgctaaaaagaacat

SEQ ID NO: 200268 - DNA, 22 bp, Artificial sequence
  SiRNA target sequence
tatgaatgctaaaaagaacatt

SEQ ID NO: 200269 - DNA, 22 bp, Artificial sequence
  SiRNA target sequence
atgaatgctaaaaagaacattc

SEQ ID NO: 200270 - DNA, 22 bp, Artificial sequence
  SiRNA target sequence
tgaatgctaaaaagaacattcc

SEQ ID NO: 200271 - DNA, 22 bp, Artificial sequence
  SiRNA target sequence
gaatgctaaaaagaacattcca

SEQ ID NO: 200272 - DNA, 22 bp, Artificial sequence
  SiRNA target sequence
aatgctaaaaagaacattccac

SEQ ID NO: 200273 - DNA, 22 bp, Artificial sequence
  SiRNA target sequence
atgctaaaaagaacattccact

SEQ ID NO: 200274 - DNA, 22 bp, Artificial sequence
  SiRNA target sequence
tgctaaaaagaacattccactg

SEQ ID NO: 200275 - DNA, 22 bp, Artificial sequence
  SiRNA target sequence
gctaaaaagaacattccactgt

SEQ ID NO: 200276 - DNA, 22 bp, Artificial sequence
  SiRNA target sequence
ctaaaaagaacattccactgta

SEQ ID NO: 200277 - DNA, 22 bp, Artificial sequence
  SiRNA target sequence
taaaaagaacattccactgtaa

SEQ ID NO: 200278 - DNA, 22 bp, Artificial sequence
  SiRNA target sequence
aaaaagaacattccactgtaat

SEQ ID NO: 200279 - DNA, 22 bp, Artificial sequence
  SiRNA target sequence
aaaagaacattccactgtaatt

SEQ ID NO: 200280 - DNA, 22 bp, Artificial sequence
  SiRNA target sequence
aaagaacattccactgtaattt

SEQ ID NO: 200281 - DNA, 22 bp, Artificial sequence
  SiRNA target sequence
aagaacattccactgtaatttt

SEQ ID NO: 200282 - DNA, 22 bp, Artificial sequence
  SiRNA target sequence
agaacattccactgtaattttc

SEQ ID NO: 200283 - DNA, 22 bp, Artificial sequence
  SiRNA target sequence
gaacattccactgtaattttcg

SEQ ID NO: 200284 - DNA, 22 bp, Artificial sequence
  SiRNA target sequence
aacattccactgtaattttcga

SEQ ID NO: 200285 - DNA, 22 bp, Artificial sequence
  SiRNA target sequence
acattccactgtaattttcgat

SEQ ID NO: 200286 - DNA, 22 bp, Artificial sequence
  SiRNA target sequence
cattccactgtaattttcgatc

SEQ ID NO: 200287 - DNA, 22 bp, Artificial sequence
  SiRNA target sequence
attccactgtaattttcgatcg

SEQ ID NO: 200288 - DNA, 22 bp, Artificial sequence
  SiRNA target sequence
ttccactgtaattttcgatcgt

SEQ ID NO: 200289 - DNA, 22 bp, Artificial sequence
  SiRNA target sequence
tccactgtaattttcgatcgta

SEQ ID NO: 200290 - DNA, 22 bp, Artificial sequence
  SiRNA target sequence
ccactgtaattttcgatcgtat

SEQ ID NO: 200291 - DNA, 22 bp, Artificial sequence
  SiRNA target sequence
cactgtaattttcgatcgtata

SEQ ID NO: 200292 - DNA, 22 bp, Artificial sequence
  SiRNA target sequence
actgtaattttcgatcgtataa

SEQ ID NO: 200293 - DNA, 22 bp, Artificial sequence
  SiRNA target sequence
ctgtaattttcgatcgtataaa

SEQ ID NO: 200294 - DNA, 22 bp, Artificial sequence
  SiRNA target sequence
tgtaattttcgatcgtataaat

SEQ ID NO: 200295 - DNA, 22 bp, Artificial sequence
  SiRNA target sequence
gtaattttcgatcgtataaatg

SEQ ID NO: 200296 - DNA, 22 bp, Artificial sequence
  SiRNA target sequence
taattttcgatcgtataaatgt

SEQ ID NO: 200297 - DNA, 22 bp, Artificial sequence
  SiRNA target sequence
aattttcgatcgtataaatgta

SEQ ID NO: 200298 - DNA, 22 bp, Artificial sequence
  SiRNA target sequence
attttcgatcgtataaatgtac

SEQ ID NO: 200299 - DNA, 22 bp, Artificial sequence
  SiRNA target sequence
ttttcgatcgtataaatgtacg

SEQ ID NO: 200300 - DNA, 22 bp, Artificial sequence
  SiRNA target sequence
tttcgatcgtataaatgtacga

SEQ ID NO: 200301 - DNA, 22 bp, Artificial sequence
  SiRNA target sequence
ttcgatcgtataaatgtacgac

SEQ ID NO: 200302 - DNA, 22 bp, Artificial sequence
  SiRNA target sequence
tcgatcgtataaatgtacgaca

SEQ ID NO: 200303 - DNA, 22 bp, Artificial sequence
  SiRNA target sequence
cgatcgtataaatgtacgacat

SEQ ID NO: 200304 - DNA, 22 bp, Artificial sequence
  SiRNA target sequence
gatcgtataaatgtacgacatt

SEQ ID NO: 200305 - DNA, 22 bp, Artificial sequence
  SiRNA target sequence
atcgtataaatgtacgacattt

SEQ ID NO: 200306 - DNA, 22 bp, Artificial sequence
  SiRNA target sequence
tcgtataaatgtacgacatttt

SEQ ID NO: 200307 - DNA, 22 bp, Artificial sequence
  SiRNA target sequence
cgtataaatgtacgacattttt

SEQ ID NO: 200308 - DNA, 22 bp, Artificial sequence
  SiRNA target sequence
gtataaatgtacgacatttttt

SEQ ID NO: 200309 - DNA, 22 bp, Artificial sequence
  SiRNA target sequence
tataaatgtacgacattttttt

SEQ ID NO: 200310 - DNA, 22 bp, Artificial sequence
  SiRNA target sequence
ataaatgtacgacattttttta

SEQ ID NO: 200311 - DNA, 22 bp, Artificial sequence
  SiRNA target sequence
taaatgtacgacatttttttaa

SEQ ID NO: 200312 - DNA, 22 bp, Artificial sequence
  SiRNA target sequence
aaatgtacgacatttttttaaa

SEQ ID NO: 200313 - DNA, 22 bp, Artificial sequence
  SiRNA target sequence
aatgtacgacatttttttaaaa

SEQ ID NO: 200314 - DNA, 22 bp, Artificial sequence
  SiRNA target sequence
atgtacgacatttttttaaaaa

SEQ ID NO: 200315 - DNA, 22 bp, Artificial sequence
  SiRNA target sequence
tgtacgacatttttttaaaaaa

SEQ ID NO: 200316 - DNA, 22 bp, Artificial sequence
  SiRNA target sequence
gtacgacatttttttaaaaaat

SEQ ID NO: 200317 - DNA, 22 bp, Artificial sequence
  SiRNA target sequence
tacgacatttttttaaaaaata

SEQ ID NO: 200318 - DNA, 22 bp, Artificial sequence
  SiRNA target sequence
acgacatttttttaaaaaatac

SEQ ID NO: 200319 - DNA, 22 bp, Artificial sequence
  SiRNA target sequence
cgacatttttttaaaaaataca

SEQ ID NO: 200320 - DNA, 22 bp, Artificial sequence
  SiRNA target sequence
gacatttttttaaaaaatacag

SEQ ID NO: 200321 - DNA, 22 bp, Artificial sequence
  SiRNA target sequence
acatttttttaaaaaatacaga

SEQ ID NO: 200322 - DNA, 22 bp, Artificial sequence
  SiRNA target sequence
catttttttaaaaaatacagaa

SEQ ID NO: 200323 - DNA, 22 bp, Artificial sequence
  SiRNA target sequence
atttttttaaaaaatacagaaa

SEQ ID NO: 200324 - DNA, 22 bp, Artificial sequence
  SiRNA target sequence
tttttttaaaaaatacagaaat

SEQ ID NO: 200325 - DNA, 22 bp, Artificial sequence
  SiRNA target sequence
ttttttaaaaaatacagaaatc

SEQ ID NO: 200326 - DNA, 22 bp, Artificial sequence
  SiRNA target sequence
tttttaaaaaatacagaaatcc

SEQ ID NO: 200327 - DNA, 22 bp, Artificial sequence
  SiRNA target sequence
ttttaaaaaatacagaaatcca

SEQ ID NO: 200328 - DNA, 22 bp, Artificial sequence
  SiRNA target sequence
tttaaaaaatacagaaatccat

SEQ ID NO: 200329 - DNA, 22 bp, Artificial sequence
  SiRNA target sequence
ttaaaaaatacagaaatccatg

SEQ ID NO: 200330 - DNA, 22 bp, Artificial sequence
  SiRNA target sequence
taaaaaatacagaaatccatga

SEQ ID NO: 200331 - DNA, 22 bp, Artificial sequence
  SiRNA target sequence
aaaaaatacagaaatccatgaa

SEQ ID NO: 200332 - DNA, 22 bp, Artificial sequence
  SiRNA target sequence
aaaaatacagaaatccatgaaa

SEQ ID NO: 200333 - DNA, 22 bp, Artificial sequence
  SiRNA target sequence
aaaatacagaaatccatgaaaa

SEQ ID NO: 200334 - DNA, 22 bp, Artificial sequence
  SiRNA target sequence
aaatacagaaatccatgaaaaa

SEQ ID NO: 200335 - DNA, 22 bp, Artificial sequence
  SiRNA target sequence
aatacagaaatccatgaaaaag

SEQ ID NO: 200336 - DNA, 22 bp, Artificial sequence
  SiRNA target sequence
atacagaaatccatgaaaaagc

SEQ ID NO: 200337 - DNA, 22 bp, Artificial sequence
  SiRNA target sequence
tacagaaatccatgaaaaagca

SEQ ID NO: 200338 - DNA, 22 bp, Artificial sequence
  SiRNA target sequence
acagaaatccatgaaaaagcaa

SEQ ID NO: 200339 - DNA, 22 bp, Artificial sequence
  SiRNA target sequence
cagaaatccatgaaaaagcaag

SEQ ID NO: 200340 - DNA, 22 bp, Artificial sequence
  SiRNA target sequence
agaaatccatgaaaaagcaagt

SEQ ID NO: 200341 - DNA, 22 bp, Artificial sequence
  SiRNA target sequence
gaaatccatgaaaaagcaagtc

SEQ ID NO: 200342 - DNA, 22 bp, Artificial sequence
  SiRNA target sequence
aaatccatgaaaaagcaagtcc

SEQ ID NO: 200343 - DNA, 22 bp, Artificial sequence
  SiRNA target sequence
aatccatgaaaaagcaagtcct

SEQ ID NO: 200344 - DNA, 22 bp, Artificial sequence
  SiRNA target sequence
atccatgaaaaagcaagtcctt

SEQ ID NO: 200345 - DNA, 22 bp, Artificial sequence
  SiRNA target sequence
tccatgaaaaagcaagtccttc

SEQ ID NO: 200346 - DNA, 22 bp, Artificial sequence
  SiRNA target sequence
ccatgaaaaagcaagtccttca

SEQ ID NO: 200347 - DNA, 22 bp, Artificial sequence
  SiRNA target sequence
catgaaaaagcaagtccttcaa

SEQ ID NO: 200348 - DNA, 22 bp, Artificial sequence
  SiRNA target sequence
atgaaaaagcaagtccttcaat

SEQ ID NO: 200349 - DNA, 22 bp, Artificial sequence
  SiRNA target sequence
tgaaaaagcaagtccttcaatg

SEQ ID NO: 200350 - DNA, 22 bp, Artificial sequence
  SiRNA target sequence
gaaaaagcaagtccttcaatgg

SEQ ID NO: 200351 - DNA, 22 bp, Artificial sequence
  SiRNA target sequence
aaaaagcaagtccttcaatggc

SEQ ID NO: 200352 - DNA, 22 bp, Artificial sequence
  SiRNA target sequence
aaaagcaagtccttcaatggca

SEQ ID NO: 200353 - DNA, 22 bp, Artificial sequence
  SiRNA target sequence
aaagcaagtccttcaatggcag

SEQ ID NO: 200354 - DNA, 22 bp, Artificial sequence
  SiRNA target sequence
aagcaagtccttcaatggcaga

SEQ ID NO: 200355 - DNA, 22 bp, Artificial sequence
  SiRNA target sequence
agcaagtccttcaatggcagaa

SEQ ID NO: 200356 - DNA, 22 bp, Artificial sequence
  SiRNA target sequence
gcaagtccttcaatggcagaat

SEQ ID NO: 200357 - DNA, 22 bp, Artificial sequence
  SiRNA target sequence
caagtccttcaatggcagaatt

SEQ ID NO: 200358 - DNA, 22 bp, Artificial sequence
  SiRNA target sequence
aagtccttcaatggcagaattg

SEQ ID NO: 200359 - DNA, 22 bp, Artificial sequence
  SiRNA target sequence
agtccttcaatggcagaattgt

SEQ ID NO: 200360 - DNA, 22 bp, Artificial sequence
  SiRNA target sequence
gtccttcaatggcagaattgta

SEQ ID NO: 200361 - DNA, 22 bp, Artificial sequence
  SiRNA target sequence
tccttcaatggcagaattgtag

SEQ ID NO: 200362 - DNA, 22 bp, Artificial sequence
  SiRNA target sequence
ccttcaatggcagaattgtaga

SEQ ID NO: 200363 - DNA, 22 bp, Artificial sequence
  SiRNA target sequence
cttcaatggcagaattgtagat

SEQ ID NO: 200364 - DNA, 22 bp, Artificial sequence
  SiRNA target sequence
ttcaatggcagaattgtagatt

SEQ ID NO: 200365 - DNA, 22 bp, Artificial sequence
  SiRNA target sequence
tcaatggcagaattgtagattg

SEQ ID NO: 200366 - DNA, 22 bp, Artificial sequence
  SiRNA target sequence
caatggcagaattgtagattga

SEQ ID NO: 200367 - DNA, 22 bp, Artificial sequence
  SiRNA target sequence
aatggcagaattgtagattgat

SEQ ID NO: 200368 - DNA, 22 bp, Artificial sequence
  SiRNA target sequence
atggcagaattgtagattgatg

SEQ ID NO: 200369 - DNA, 22 bp, Artificial sequence
  SiRNA target sequence
tggcagaattgtagattgatgc

SEQ ID NO: 200370 - DNA, 22 bp, Artificial sequence
  SiRNA target sequence
ggcagaattgtagattgatgct

SEQ ID NO: 200371 - DNA, 22 bp, Artificial sequence
  SiRNA target sequence
gcagaattgtagattgatgctc

SEQ ID NO: 200372 - DNA, 22 bp, Artificial sequence
  SiRNA target sequence
cagaattgtagattgatgctcc

SEQ ID NO: 200373 - DNA, 22 bp, Artificial sequence
  SiRNA target sequence
agaattgtagattgatgctccc

SEQ ID NO: 200374 - DNA, 22 bp, Artificial sequence
  SiRNA target sequence
gaattgtagattgatgctccca

SEQ ID NO: 200375 - DNA, 22 bp, Artificial sequence
  SiRNA target sequence
aattgtagattgatgctcccat

SEQ ID NO: 200376 - DNA, 22 bp, Artificial sequence
  SiRNA target sequence
attgtagattgatgctcccata

SEQ ID NO: 200377 - DNA, 22 bp, Artificial sequence
  SiRNA target sequence
ttgtagattgatgctcccataa

SEQ ID NO: 200378 - DNA, 22 bp, Artificial sequence
  SiRNA target sequence
tgtagattgatgctcccataac

SEQ ID NO: 200379 - DNA, 22 bp, Artificial sequence
  SiRNA target sequence
gtagattgatgctcccataacg

SEQ ID NO: 200380 - DNA, 22 bp, Artificial sequence
  SiRNA target sequence
tagattgatgctcccataacga

SEQ ID NO: 200381 - DNA, 22 bp, Artificial sequence
  SiRNA target sequence
agattgatgctcccataacgat

SEQ ID NO: 200382 - DNA, 22 bp, Artificial sequence
  SiRNA target sequence
gattgatgctcccataacgatt

SEQ ID NO: 200383 - DNA, 22 bp, Artificial sequence
  SiRNA target sequence
attgatgctcccataacgatta

SEQ ID NO: 200384 - DNA, 22 bp, Artificial sequence
  SiRNA target sequence
ttgatgctcccataacgattat

SEQ ID NO: 200385 - DNA, 22 bp, Artificial sequence
  SiRNA target sequence
tgatgctcccataacgattatt

SEQ ID NO: 200386 - DNA, 22 bp, Artificial sequence
  SiRNA target sequence
gatgctcccataacgattattg

SEQ ID NO: 200387 - DNA, 22 bp, Artificial sequence
  SiRNA target sequence
atgctcccataacgattattga

SEQ ID NO: 200388 - DNA, 22 bp, Artificial sequence
  SiRNA target sequence
tgctcccataacgattattgac

SEQ ID NO: 200389 - DNA, 22 bp, Artificial sequence
  SiRNA target sequence
gctcccataacgattattgacc

SEQ ID NO: 200390 - DNA, 22 bp, Artificial sequence
  SiRNA target sequence
ctcccataacgattattgaccc

SEQ ID NO: 200391 - DNA, 22 bp, Artificial sequence
  SiRNA target sequence
tcccataacgattattgacccc

SEQ ID NO: 200392 - DNA, 22 bp, Artificial sequence
  SiRNA target sequence
cccataacgattattgacccca

SEQ ID NO: 200393 - DNA, 22 bp, Artificial sequence
  SiRNA target sequence
ccataacgattattgaccccaa

SEQ ID NO: 200394 - DNA, 22 bp, Artificial sequence
  SiRNA target sequence
cataacgattattgaccccaac

SEQ ID NO: 200395 - DNA, 22 bp, Artificial sequence
  SiRNA target sequence
ataacgattattgaccccaaca

SEQ ID NO: 200396 - DNA, 22 bp, Artificial sequence
  SiRNA target sequence
taacgattattgaccccaacaa

SEQ ID NO: 200397 - DNA, 22 bp, Artificial sequence
  SiRNA target sequence
aacgattattgaccccaacaac

SEQ ID NO: 200398 - DNA, 22 bp, Artificial sequence
  SiRNA target sequence
acgattattgaccccaacaaca

SEQ ID NO: 200399 - DNA, 22 bp, Artificial sequence
  SiRNA target sequence
cgattattgaccccaacaacaa

SEQ ID NO: 200400 - DNA, 22 bp, Artificial sequence
  SiRNA target sequence
gattattgaccccaacaacaag

SEQ ID NO: 200401 - DNA, 22 bp, Artificial sequence
  SiRNA target sequence
attattgaccccaacaacaaga

SEQ ID NO: 200402 - DNA, 22 bp, Artificial sequence
  SiRNA target sequence
ttattgaccccaacaacaagaa

SEQ ID NO: 200403 - DNA, 22 bp, Artificial sequence
  SiRNA target sequence
tattgaccccaacaacaagaat

SEQ ID NO: 200404 - DNA, 22 bp, Artificial sequence
  SiRNA target sequence
attgaccccaacaacaagaata

SEQ ID NO: 200405 - DNA, 22 bp, Artificial sequence
  SiRNA target sequence
ttgaccccaacaacaagaataa

SEQ ID NO: 200406 - DNA, 22 bp, Artificial sequence
  SiRNA target sequence
tgaccccaacaacaagaataaa

SEQ ID NO: 200407 - DNA, 22 bp, Artificial sequence
  SiRNA target sequence
gaccccaacaacaagaataaag

SEQ ID NO: 200408 - DNA, 22 bp, Artificial sequence
  SiRNA target sequence
accccaacaacaagaataaagg

SEQ ID NO: 200409 - DNA, 22 bp, Artificial sequence
  SiRNA target sequence
ccccaacaacaagaataaaggt

SEQ ID NO: 200410 - DNA, 22 bp, Artificial sequence
  SiRNA target sequence
cccaacaacaagaataaaggtg

SEQ ID NO: 200411 - DNA, 22 bp, Artificial sequence
  SiRNA target sequence
ccaacaacaagaataaaggtgt

SEQ ID NO: 200412 - DNA, 22 bp, Artificial sequence
  SiRNA target sequence
caacaacaagaataaaggtgtt

SEQ ID NO: 200413 - DNA, 22 bp, Artificial sequence
  SiRNA target sequence
aacaacaagaataaaggtgtta

SEQ ID NO: 200414 - DNA, 22 bp, Artificial sequence
  SiRNA target sequence
acaacaagaataaaggtgttaa

SEQ ID NO: 200415 - DNA, 22 bp, Artificial sequence
  SiRNA target sequence
caacaagaataaaggtgttaag

SEQ ID NO: 200416 - DNA, 22 bp, Artificial sequence
  SiRNA target sequence
aacaagaataaaggtgttaaga

SEQ ID NO: 200417 - DNA, 22 bp, Artificial sequence
  SiRNA target sequence
acaagaataaaggtgttaagag

SEQ ID NO: 200418 - DNA, 22 bp, Artificial sequence
  SiRNA target sequence
caagaataaaggtgttaagagt

SEQ ID NO: 200419 - DNA, 22 bp, Artificial sequence
  SiRNA target sequence
aagaataaaggtgttaagagtc

SEQ ID NO: 200420 - DNA, 22 bp, Artificial sequence
  SiRNA target sequence
agaataaaggtgttaagagtcc

SEQ ID NO: 200421 - DNA, 22 bp, Artificial sequence
  SiRNA target sequence
gaataaaggtgttaagagtccc

SEQ ID NO: 200422 - DNA, 22 bp, Artificial sequence
  SiRNA target sequence
aataaaggtgttaagagtccca

SEQ ID NO: 200423 - DNA, 22 bp, Artificial sequence
  SiRNA target sequence
ataaaggtgttaagagtcccat

SEQ ID NO: 200424 - DNA, 22 bp, Artificial sequence
  SiRNA target sequence
taaaggtgttaagagtcccata

SEQ ID NO: 200425 - DNA, 22 bp, Artificial sequence
  SiRNA target sequence
aaaggtgttaagagtcccatag

SEQ ID NO: 200426 - DNA, 22 bp, Artificial sequence
  SiRNA target sequence
aaggtgttaagagtcccatagt

SEQ ID NO: 200427 - DNA, 22 bp, Artificial sequence
  SiRNA target sequence
aggtgttaagagtcccatagta

SEQ ID NO: 200428 - DNA, 22 bp, Artificial sequence
  SiRNA target sequence
ggtgttaagagtcccatagtaa

SEQ ID NO: 200429 - DNA, 22 bp, Artificial sequence
  SiRNA target sequence
gtgttaagagtcccatagtaat

SEQ ID NO: 200430 - DNA, 22 bp, Artificial sequence
  SiRNA target sequence
tgttaagagtcccatagtaatc

SEQ ID NO: 200431 - DNA, 22 bp, Artificial sequence
  SiRNA target sequence
gttaagagtcccatagtaatcc

SEQ ID NO: 200432 - DNA, 22 bp, Artificial sequence
  SiRNA target sequence
ttaagagtcccatagtaatcca

SEQ ID NO: 200433 - DNA, 22 bp, Artificial sequence
  SiRNA target sequence
taagagtcccatagtaatccat

SEQ ID NO: 200434 - DNA, 22 bp, Artificial sequence
  SiRNA target sequence
aagagtcccatagtaatccatc

SEQ ID NO: 200435 - DNA, 22 bp, Artificial sequence
  SiRNA target sequence
agagtcccatagtaatccatcc

SEQ ID NO: 200436 - DNA, 22 bp, Artificial sequence
  SiRNA target sequence
gagtcccatagtaatccatcca

SEQ ID NO: 200437 - DNA, 22 bp, Artificial sequence
  SiRNA target sequence
agtcccatagtaatccatccac

SEQ ID NO: 200438 - DNA, 22 bp, Artificial sequence
  SiRNA target sequence
gtcccatagtaatccatccact

SEQ ID NO: 200439 - DNA, 22 bp, Artificial sequence
  SiRNA target sequence
tcccatagtaatccatccacta

SEQ ID NO: 200440 - DNA, 22 bp, Artificial sequence
  SiRNA target sequence
cccatagtaatccatccactac

SEQ ID NO: 200441 - DNA, 22 bp, Artificial sequence
  SiRNA target sequence
ccatagtaatccatccactact

SEQ ID NO: 200442 - DNA, 22 bp, Artificial sequence
  SiRNA target sequence
catagtaatccatccactactt

SEQ ID NO: 200443 - DNA, 22 bp, Artificial sequence
  SiRNA target sequence
atagtaatccatccactacttt

SEQ ID NO: 200444 - DNA, 22 bp, Artificial sequence
  SiRNA target sequence
tagtaatccatccactactttc

SEQ ID NO: 200445 - DNA, 22 bp, Artificial sequence
  SiRNA target sequence
agtaatccatccactactttct

SEQ ID NO: 200446 - DNA, 22 bp, Artificial sequence
  SiRNA target sequence
gtaatccatccactactttcta

SEQ ID NO: 200447 - DNA, 22 bp, Artificial sequence
  SiRNA target sequence
taatccatccactactttctac

SEQ ID NO: 200448 - DNA, 22 bp, Artificial sequence
  SiRNA target sequence
aatccatccactactttctact

SEQ ID NO: 200449 - DNA, 22 bp, Artificial sequence
  SiRNA target sequence
atccatccactactttctacta

SEQ ID NO: 200450 - DNA, 22 bp, Artificial sequence
  SiRNA target sequence
tccatccactactttctactaa

SEQ ID NO: 200451 - DNA, 22 bp, Artificial sequence
  SiRNA target sequence
ccatccactactttctactaaa

SEQ ID NO: 200452 - DNA, 22 bp, Artificial sequence
  SiRNA target sequence
catccactactttctactaaag

SEQ ID NO: 200453 - DNA, 22 bp, Artificial sequence
  SiRNA target sequence
atccactactttctactaaagt

SEQ ID NO: 200454 - DNA, 22 bp, Artificial sequence
  SiRNA target sequence
tccactactttctactaaagta

SEQ ID NO: 200455 - DNA, 22 bp, Artificial sequence
  SiRNA target sequence
ccactactttctactaaagtag

SEQ ID NO: 200456 - DNA, 22 bp, Artificial sequence
  SiRNA target sequence
cactactttctactaaagtaga

SEQ ID NO: 200457 - DNA, 22 bp, Artificial sequence
  SiRNA target sequence
actactttctactaaagtagaa

SEQ ID NO: 200458 - DNA, 22 bp, Artificial sequence
  SiRNA target sequence
ctactttctactaaagtagaaa

SEQ ID NO: 200459 - DNA, 22 bp, Artificial sequence
  SiRNA target sequence
tactttctactaaagtagaaaa

SEQ ID NO: 200460 - DNA, 22 bp, Artificial sequence
  SiRNA target sequence
actttctactaaagtagaaaat

SEQ ID NO: 200461 - DNA, 22 bp, Artificial sequence
  SiRNA target sequence
ctttctactaaagtagaaaatg

SEQ ID NO: 200462 - DNA, 22 bp, Artificial sequence
  SiRNA target sequence
tttctactaaagtagaaaatgc

SEQ ID NO: 200463 - DNA, 22 bp, Artificial sequence
  SiRNA target sequence
ttctactaaagtagaaaatgct

SEQ ID NO: 200464 - DNA, 22 bp, Artificial sequence
  SiRNA target sequence
tctactaaagtagaaaatgctg

SEQ ID NO: 200465 - DNA, 22 bp, Artificial sequence
  SiRNA target sequence
ctactaaagtagaaaatgctga

SEQ ID NO: 200466 - DNA, 22 bp, Artificial sequence
  SiRNA target sequence
tactaaagtagaaaatgctgac

SEQ ID NO: 200467 - DNA, 22 bp, Artificial sequence
  SiRNA target sequence
actaaagtagaaaatgctgaca

SEQ ID NO: 200468 - DNA, 22 bp, Artificial sequence
  SiRNA target sequence
ctaaagtagaaaatgctgacaa

SEQ ID NO: 200469 - DNA, 22 bp, Artificial sequence
  SiRNA target sequence
taaagtagaaaatgctgacaaa

SEQ ID NO: 200470 - DNA, 22 bp, Artificial sequence
  SiRNA target sequence
aaagtagaaaatgctgacaaat

SEQ ID NO: 200471 - DNA, 22 bp, Artificial sequence
  SiRNA target sequence
aagtagaaaatgctgacaaatt

SEQ ID NO: 200472 - DNA, 22 bp, Artificial sequence
  SiRNA target sequence
agtagaaaatgctgacaaatta

SEQ ID NO: 200473 - DNA, 22 bp, Artificial sequence
  SiRNA target sequence
gtagaaaatgctgacaaattaa

SEQ ID NO: 200474 - DNA, 22 bp, Artificial sequence
  SiRNA target sequence
tagaaaatgctgacaaattaag

SEQ ID NO: 200475 - DNA, 22 bp, Artificial sequence
  SiRNA target sequence
agaaaatgctgacaaattaagt

SEQ ID NO: 200476 - DNA, 22 bp, Artificial sequence
  SiRNA target sequence
gaaaatgctgacaaattaagtg

SEQ ID NO: 200477 - DNA, 22 bp, Artificial sequence
  SiRNA target sequence
aaaatgctgacaaattaagtgt

SEQ ID NO: 200478 - DNA, 22 bp, Artificial sequence
  SiRNA target sequence
aaatgctgacaaattaagtgtt

SEQ ID NO: 200479 - DNA, 22 bp, Artificial sequence
  SiRNA target sequence
aatgctgacaaattaagtgtta

SEQ ID NO: 200480 - DNA, 22 bp, Artificial sequence
  SiRNA target sequence
atgctgacaaattaagtgttat

SEQ ID NO: 200481 - DNA, 22 bp, Artificial sequence
  SiRNA target sequence
tgctgacaaattaagtgttatt

SEQ ID NO: 200482 - DNA, 22 bp, Artificial sequence
  SiRNA target sequence
gctgacaaattaagtgttatta

SEQ ID NO: 200483 - DNA, 22 bp, Artificial sequence
  SiRNA target sequence
ctgacaaattaagtgttattac

SEQ ID NO: 200484 - DNA, 22 bp, Artificial sequence
  SiRNA target sequence
tgacaaattaagtgttattaca

SEQ ID NO: 200485 - DNA, 22 bp, Artificial sequence
  SiRNA target sequence
gacaaattaagtgttattacag

SEQ ID NO: 200486 - DNA, 22 bp, Artificial sequence
  SiRNA target sequence
acaaattaagtgttattacagt

SEQ ID NO: 200487 - DNA, 22 bp, Artificial sequence
  SiRNA target sequence
caaattaagtgttattacagta

SEQ ID NO: 200488 - DNA, 22 bp, Artificial sequence
  SiRNA target sequence
aaattaagtgttattacagtaa

SEQ ID NO: 200489 - DNA, 22 bp, Artificial sequence
  SiRNA target sequence
aattaagtgttattacagtaac

SEQ ID NO: 200490 - DNA, 22 bp, Artificial sequence
  SiRNA target sequence
attaagtgttattacagtaact

SEQ ID NO: 200491 - DNA, 22 bp, Artificial sequence
  SiRNA target sequence
ttaagtgttattacagtaactg

SEQ ID NO: 200492 - DNA, 22 bp, Artificial sequence
  SiRNA target sequence
taagtgttattacagtaactgc

SEQ ID NO: 200493 - DNA, 22 bp, Artificial sequence
  SiRNA target sequence
aagtgttattacagtaactgct

SEQ ID NO: 200494 - DNA, 22 bp, Artificial sequence
  SiRNA target sequence
agtgttattacagtaactgcta

SEQ ID NO: 200495 - DNA, 22 bp, Artificial sequence
  SiRNA target sequence
gtgttattacagtaactgctac

SEQ ID NO: 200496 - DNA, 22 bp, Artificial sequence
  SiRNA target sequence
tgttattacagtaactgctacc

SEQ ID NO: 200497 - DNA, 22 bp, Artificial sequence
  SiRNA target sequence
gttattacagtaactgctacca

SEQ ID NO: 200498 - DNA, 22 bp, Artificial sequence
  SiRNA target sequence
ttattacagtaactgctaccaa

SEQ ID NO: 200499 - DNA, 22 bp, Artificial sequence
  SiRNA target sequence
tattacagtaactgctaccaat

SEQ ID NO: 200500 - DNA, 22 bp, Artificial sequence
  SiRNA target sequence
attacagtaactgctaccaata

SEQ ID NO: 200501 - DNA, 22 bp, Artificial sequence
  SiRNA target sequence
ttacagtaactgctaccaatat

SEQ ID NO: 200502 - DNA, 22 bp, Artificial sequence
  SiRNA target sequence
tacagtaactgctaccaatatt

SEQ ID NO: 200503 - DNA, 22 bp, Artificial sequence
  SiRNA target sequence
acagtaactgctaccaatattt

SEQ ID NO: 200504 - DNA, 22 bp, Artificial sequence
  SiRNA target sequence
cagtaactgctaccaatatttg

SEQ ID NO: 200505 - DNA, 22 bp, Artificial sequence
  SiRNA target sequence
agtaactgctaccaatatttga

SEQ ID NO: 200506 - DNA, 22 bp, Artificial sequence
  SiRNA target sequence
gtaactgctaccaatatttgat

SEQ ID NO: 200507 - DNA, 22 bp, Artificial sequence
  SiRNA target sequence
taactgctaccaatatttgatc

SEQ ID NO: 200508 - DNA, 22 bp, Artificial sequence
  SiRNA target sequence
aactgctaccaatatttgatct

SEQ ID NO: 200509 - DNA, 22 bp, Artificial sequence
  SiRNA target sequence
actgctaccaatatttgatcta

SEQ ID NO: 200510 - DNA, 22 bp, Artificial sequence
  SiRNA target sequence
ctgctaccaatatttgatctat

SEQ ID NO: 200511 - DNA, 22 bp, Artificial sequence
  SiRNA target sequence
tgctaccaatatttgatctatt

SEQ ID NO: 200512 - DNA, 22 bp, Artificial sequence
  SiRNA target sequence
gctaccaatatttgatctattg

SEQ ID NO: 200513 - DNA, 22 bp, Artificial sequence
  SiRNA target sequence
ctaccaatatttgatctattgt

SEQ ID NO: 200514 - DNA, 22 bp, Artificial sequence
  SiRNA target sequence
taccaatatttgatctattgta

SEQ ID NO: 200515 - DNA, 22 bp, Artificial sequence
  SiRNA target sequence
accaatatttgatctattgtat

SEQ ID NO: 200516 - DNA, 22 bp, Artificial sequence
  SiRNA target sequence
ccaatatttgatctattgtatt

SEQ ID NO: 200517 - DNA, 22 bp, Artificial sequence
  SiRNA target sequence
caatatttgatctattgtatta

SEQ ID NO: 200518 - DNA, 22 bp, Artificial sequence
  SiRNA target sequence
aatatttgatctattgtattaa

SEQ ID NO: 200519 - DNA, 22 bp, Artificial sequence
  SiRNA target sequence
atatttgatctattgtattaaa

SEQ ID NO: 200520 - DNA, 22 bp, Artificial sequence
  SiRNA target sequence
tatttgatctattgtattaaat

SEQ ID NO: 200521 - DNA, 22 bp, Artificial sequence
  SiRNA target sequence
atttgatctattgtattaaatt

SEQ ID NO: 200522 - DNA, 22 bp, Artificial sequence
  SiRNA target sequence
tttgatctattgtattaaattt

SEQ ID NO: 200523 - DNA, 22 bp, Artificial sequence
  SiRNA target sequence
ttgatctattgtattaaatttg

SEQ ID NO: 200524 - DNA, 22 bp, Artificial sequence
  SiRNA target sequence
tgatctattgtattaaatttgc

SEQ ID NO: 200525 - DNA, 22 bp, Artificial sequence
  SiRNA target sequence
gatctattgtattaaatttgcc

SEQ ID NO: 200526 - DNA, 22 bp, Artificial sequence
  SiRNA target sequence
atctattgtattaaatttgccg

SEQ ID NO: 200527 - DNA, 22 bp, Artificial sequence
  SiRNA target sequence
tctattgtattaaatttgccgg

SEQ ID NO: 200528 - DNA, 22 bp, Artificial sequence
  SiRNA target sequence
ctattgtattaaatttgccgga

SEQ ID NO: 200529 - DNA, 22 bp, Artificial sequence
  SiRNA target sequence
tattgtattaaatttgccggag

SEQ ID NO: 200530 - DNA, 22 bp, Artificial sequence
  SiRNA target sequence
attgtattaaatttgccggagt

SEQ ID NO: 200531 - DNA, 22 bp, Artificial sequence
  SiRNA target sequence
ttgtattaaatttgccggagta

SEQ ID NO: 200532 - DNA, 22 bp, Artificial sequence
  SiRNA target sequence
tgtattaaatttgccggagtat

SEQ ID NO: 200533 - DNA, 22 bp, Artificial sequence
  SiRNA target sequence
gtattaaatttgccggagtatt

SEQ ID NO: 200534 - DNA, 22 bp, Artificial sequence
  SiRNA target sequence
tattaaatttgccggagtattc

SEQ ID NO: 200535 - DNA, 22 bp, Artificial sequence
  SiRNA target sequence
attaaatttgccggagtattct

SEQ ID NO: 200536 - DNA, 22 bp, Artificial sequence
  SiRNA target sequence
ttaaatttgccggagtattctc

SEQ ID NO: 200537 - DNA, 22 bp, Artificial sequence
  SiRNA target sequence
taaatttgccggagtattctcc

SEQ ID NO: 200538 - DNA, 22 bp, Artificial sequence
  SiRNA target sequence
aaatttgccggagtattctcct

SEQ ID NO: 200539 - DNA, 22 bp, Artificial sequence
  SiRNA target sequence
aatttgccggagtattctccta

SEQ ID NO: 200540 - DNA, 22 bp, Artificial sequence
  SiRNA target sequence
atttgccggagtattctcctac

SEQ ID NO: 200541 - DNA, 22 bp, Artificial sequence
  SiRNA target sequence
tttgccggagtattctcctacc

SEQ ID NO: 200542 - DNA, 22 bp, Artificial sequence
  SiRNA target sequence
ttgccggagtattctcctacct

SEQ ID NO: 200543 - DNA, 22 bp, Artificial sequence
  SiRNA target sequence
tgccggagtattctcctacctc

SEQ ID NO: 200544 - DNA, 22 bp, Artificial sequence
  SiRNA target sequence
gccggagtattctcctacctct

SEQ ID NO: 200545 - DNA, 22 bp, Artificial sequence
  SiRNA target sequence
ccggagtattctcctacctcta

SEQ ID NO: 200546 - DNA, 22 bp, Artificial sequence
  SiRNA target sequence
cggagtattctcctacctctaa

SEQ ID NO: 200547 - DNA, 22 bp, Artificial sequence
  SiRNA target sequence
ggagtattctcctacctctaat

SEQ ID NO: 200548 - DNA, 22 bp, Artificial sequence
  SiRNA target sequence
gagtattctcctacctctaatc

SEQ ID NO: 200549 - DNA, 22 bp, Artificial sequence
  SiRNA target sequence
agtattctcctacctctaatcc

SEQ ID NO: 200550 - DNA, 22 bp, Artificial sequence
  SiRNA target sequence
gtattctcctacctctaatcct

SEQ ID NO: 200551 - DNA, 22 bp, Artificial sequence
  SiRNA target sequence
tattctcctacctctaatccta

SEQ ID NO: 200552 - DNA, 22 bp, Artificial sequence
  SiRNA target sequence
attctcctacctctaatcctaa

SEQ ID NO: 200553 - DNA, 22 bp, Artificial sequence
  SiRNA target sequence
ttctcctacctctaatcctaaa

SEQ ID NO: 200554 - DNA, 22 bp, Artificial sequence
  SiRNA target sequence
tctcctacctctaatcctaaac

SEQ ID NO: 200555 - DNA, 22 bp, Artificial sequence
  SiRNA target sequence
ctcctacctctaatcctaaact

SEQ ID NO: 200556 - DNA, 22 bp, Artificial sequence
  SiRNA target sequence
tcctacctctaatcctaaactt

SEQ ID NO: 200557 - DNA, 22 bp, Artificial sequence
  SiRNA target sequence
cctacctctaatcctaaacttt

SEQ ID NO: 200558 - DNA, 22 bp, Artificial sequence
  SiRNA target sequence
ctacctctaatcctaaactttt

SEQ ID NO: 200559 - DNA, 22 bp, Artificial sequence
  SiRNA target sequence
tacctctaatcctaaacttttt

SEQ ID NO: 200560 - DNA, 22 bp, Artificial sequence
  SiRNA target sequence
acctctaatcctaaactttttg

SEQ ID NO: 200561 - DNA, 22 bp, Artificial sequence
  SiRNA target sequence
cctctaatcctaaactttttga

SEQ ID NO: 200562 - DNA, 22 bp, Artificial sequence
  SiRNA target sequence
ctctaatcctaaactttttgac

SEQ ID NO: 200563 - DNA, 22 bp, Artificial sequence
  SiRNA target sequence
tctaatcctaaactttttgacg

SEQ ID NO: 200564 - DNA, 22 bp, Artificial sequence
  SiRNA target sequence
ctaatcctaaactttttgacgc

SEQ ID NO: 200565 - DNA, 22 bp, Artificial sequence
  SiRNA target sequence
taatcctaaactttttgacgca

SEQ ID NO: 200566 - DNA, 22 bp, Artificial sequence
  SiRNA target sequence
aatcctaaactttttgacgcag

SEQ ID NO: 200567 - DNA, 22 bp, Artificial sequence
  SiRNA target sequence
atcctaaactttttgacgcagc

SEQ ID NO: 200568 - DNA, 22 bp, Artificial sequence
  SiRNA target sequence
tcctaaactttttgacgcagct

SEQ ID NO: 200569 - DNA, 22 bp, Artificial sequence
  SiRNA target sequence
cctaaactttttgacgcagctt

SEQ ID NO: 200570 - DNA, 22 bp, Artificial sequence
  SiRNA target sequence
ctaaactttttgacgcagcttt

SEQ ID NO: 200571 - DNA, 22 bp, Artificial sequence
  SiRNA target sequence
taaactttttgacgcagcttta

SEQ ID NO: 200572 - DNA, 22 bp, Artificial sequence
  SiRNA target sequence
aaactttttgacgcagctttaa

SEQ ID NO: 200573 - DNA, 22 bp, Artificial sequence
  SiRNA target sequence
aactttttgacgcagctttaat

SEQ ID NO: 200574 - DNA, 22 bp, Artificial sequence
  SiRNA target sequence
actttttgacgcagctttaatt

SEQ ID NO: 200575 - DNA, 22 bp, Artificial sequence
  SiRNA target sequence
ctttttgacgcagctttaattc

SEQ ID NO: 200576 - DNA, 22 bp, Artificial sequence
  SiRNA target sequence
tttttgacgcagctttaattcc

SEQ ID NO: 200577 - DNA, 22 bp, Artificial sequence
  SiRNA target sequence
ttttgacgcagctttaattcct

SEQ ID NO: 200578 - DNA, 22 bp, Artificial sequence
  SiRNA target sequence
tttgacgcagctttaattcctg

SEQ ID NO: 200579 - DNA, 22 bp, Artificial sequence
  SiRNA target sequence
ttgacgcagctttaattcctgc

SEQ ID NO: 200580 - DNA, 22 bp, Artificial sequence
  SiRNA target sequence
tgacgcagctttaattcctgct

SEQ ID NO: 200581 - DNA, 22 bp, Artificial sequence
  SiRNA target sequence
gacgcagctttaattcctgctt

SEQ ID NO: 200582 - DNA, 22 bp, Artificial sequence
  SiRNA target sequence
acgcagctttaattcctgcttt

SEQ ID NO: 200583 - DNA, 22 bp, Artificial sequence
  SiRNA target sequence
cgcagctttaattcctgcttta

SEQ ID NO: 200584 - DNA, 22 bp, Artificial sequence
  SiRNA target sequence
gcagctttaattcctgctttat

SEQ ID NO: 200585 - DNA, 22 bp, Artificial sequence
  SiRNA target sequence
cagctttaattcctgctttata

SEQ ID NO: 200586 - DNA, 22 bp, Artificial sequence
  SiRNA target sequence
agctttaattcctgctttatag

SEQ ID NO: 200587 - DNA, 22 bp, Artificial sequence
  SiRNA target sequence
gctttaattcctgctttataga

SEQ ID NO: 200588 - DNA, 22 bp, Artificial sequence
  SiRNA target sequence
ctttaattcctgctttatagac

SEQ ID NO: 200589 - DNA, 22 bp, Artificial sequence
  SiRNA target sequence
tttaattcctgctttatagaca

SEQ ID NO: 200590 - DNA, 22 bp, Artificial sequence
  SiRNA target sequence
ttaattcctgctttatagacag

SEQ ID NO: 200591 - DNA, 22 bp, Artificial sequence
  SiRNA target sequence
taattcctgctttatagacaga

SEQ ID NO: 200592 - DNA, 22 bp, Artificial sequence
  SiRNA target sequence
aattcctgctttatagacagat

SEQ ID NO: 200593 - DNA, 22 bp, Artificial sequence
  SiRNA target sequence
attcctgctttatagacagatt

SEQ ID NO: 200594 - DNA, 22 bp, Artificial sequence
  SiRNA target sequence
ttcctgctttatagacagattc

SEQ ID NO: 200595 - DNA, 22 bp, Artificial sequence
  SiRNA target sequence
tcctgctttatagacagattca

SEQ ID NO: 200596 - DNA, 22 bp, Artificial sequence
  SiRNA target sequence
cctgctttatagacagattcaa

SEQ ID NO: 200597 - DNA, 22 bp, Artificial sequence
  SiRNA target sequence
ctgctttatagacagattcaat

SEQ ID NO: 200598 - DNA, 22 bp, Artificial sequence
  SiRNA target sequence
tgctttatagacagattcaatt

SEQ ID NO: 200599 - DNA, 22 bp, Artificial sequence
  SiRNA target sequence
gctttatagacagattcaatta

SEQ ID NO: 200600 - DNA, 22 bp, Artificial sequence
  SiRNA target sequence
ctttatagacagattcaattaa

SEQ ID NO: 200601 - DNA, 22 bp, Artificial sequence
  SiRNA target sequence
tttatagacagattcaattaaa

SEQ ID NO: 200602 - DNA, 22 bp, Artificial sequence
  SiRNA target sequence
ttatagacagattcaattaaat

SEQ ID NO: 200603 - DNA, 22 bp, Artificial sequence
  SiRNA target sequence
tatagacagattcaattaaatt

SEQ ID NO: 200604 - DNA, 22 bp, Artificial sequence
  SiRNA target sequence
atagacagattcaattaaatta

SEQ ID NO: 200605 - DNA, 22 bp, Artificial sequence
  SiRNA target sequence
tagacagattcaattaaattaa

SEQ ID NO: 200606 - DNA, 22 bp, Artificial sequence
  SiRNA target sequence
agacagattcaattaaattaaa

SEQ ID NO: 200607 - DNA, 22 bp, Artificial sequence
  SiRNA target sequence
gacagattcaattaaattaaat

SEQ ID NO: 200608 - DNA, 22 bp, Artificial sequence
  SiRNA target sequence
acagattcaattaaattaaatg

SEQ ID NO: 200609 - DNA, 22 bp, Artificial sequence
  SiRNA target sequence
cagattcaattaaattaaatgt

SEQ ID NO: 200610 - DNA, 22 bp, Artificial sequence
  SiRNA target sequence
agattcaattaaattaaatgtt

SEQ ID NO: 200611 - DNA, 22 bp, Artificial sequence
  SiRNA target sequence
gattcaattaaattaaatgtta

SEQ ID NO: 200612 - DNA, 22 bp, Artificial sequence
  SiRNA target sequence
attcaattaaattaaatgttat

SEQ ID NO: 200613 - DNA, 22 bp, Artificial sequence
  SiRNA target sequence
ttcaattaaattaaatgttata

SEQ ID NO: 200614 - DNA, 22 bp, Artificial sequence
  SiRNA target sequence
tcaattaaattaaatgttatat

SEQ ID NO: 200615 - DNA, 22 bp, Artificial sequence
  SiRNA target sequence
caattaaattaaatgttatatt

SEQ ID NO: 200616 - DNA, 22 bp, Artificial sequence
  SiRNA target sequence
aattaaattaaatgttatattg

SEQ ID NO: 200617 - DNA, 22 bp, Artificial sequence
  SiRNA target sequence
attaaattaaatgttatattgt

SEQ ID NO: 200618 - DNA, 22 bp, Artificial sequence
  SiRNA target sequence
ttaaattaaatgttatattgta

SEQ ID NO: 200619 - DNA, 22 bp, Artificial sequence
  SiRNA target sequence
taaattaaatgttatattgtaa

SEQ ID NO: 200620 - DNA, 22 bp, Artificial sequence
  SiRNA target sequence
aaattaaatgttatattgtaaa

SEQ ID NO: 200621 - DNA, 22 bp, Artificial sequence
  SiRNA target sequence
aattaaatgttatattgtaaaa

SEQ ID NO: 200622 - DNA, 22 bp, Artificial sequence
  SiRNA target sequence
attaaatgttatattgtaaaaa

SEQ ID NO: 200623 - DNA, 22 bp, Artificial sequence
  SiRNA target sequence
ttaaatgttatattgtaaaaaa

SEQ ID NO: 200624 - DNA, 22 bp, Artificial sequence
  SiRNA target sequence
taaatgttatattgtaaaaaaa

SEQ ID NO: 200625 - DNA, 22 bp, Artificial sequence
  SiRNA target sequence
aaatgttatattgtaaaaaaag

SEQ ID NO: 200626 - DNA, 22 bp, Artificial sequence
  SiRNA target sequence
aatgttatattgtaaaaaaaga

SEQ ID NO: 200627 - DNA, 22 bp, Artificial sequence
  SiRNA target sequence
atgttatattgtaaaaaaagac

SEQ ID NO: 200628 - DNA, 22 bp, Artificial sequence
  SiRNA target sequence
tgttatattgtaaaaaaagact

SEQ ID NO: 200629 - DNA, 22 bp, Artificial sequence
  SiRNA target sequence
gttatattgtaaaaaaagacta

SEQ ID NO: 200630 - DNA, 22 bp, Artificial sequence
  SiRNA target sequence
ttatattgtaaaaaaagactat

SEQ ID NO: 200631 - DNA, 22 bp, Artificial sequence
  SiRNA target sequence
tatattgtaaaaaaagactatt

SEQ ID NO: 200632 - DNA, 22 bp, Artificial sequence
  SiRNA target sequence
atattgtaaaaaaagactatta

SEQ ID NO: 200633 - DNA, 22 bp, Artificial sequence
  SiRNA target sequence
tattgtaaaaaaagactattat

SEQ ID NO: 200634 - DNA, 22 bp, Artificial sequence
  SiRNA target sequence
attgtaaaaaaagactattata

SEQ ID NO: 200635 - DNA, 22 bp, Artificial sequence
  SiRNA target sequence
ttgtaaaaaaagactattatac

SEQ ID NO: 200636 - DNA, 22 bp, Artificial sequence
  SiRNA target sequence
tgtaaaaaaagactattataca

SEQ ID NO: 200637 - DNA, 22 bp, Artificial sequence
  SiRNA target sequence
gtaaaaaaagactattatacaa

SEQ ID NO: 200638 - DNA, 22 bp, Artificial sequence
  SiRNA target sequence
taaaaaaagactattatacaaa

SEQ ID NO: 200639 - DNA, 22 bp, Artificial sequence
  SiRNA target sequence
aaaaaaagactattatacaaag

SEQ ID NO: 200640 - DNA, 22 bp, Artificial sequence
  SiRNA target sequence
aaaaaagactattatacaaagt

SEQ ID NO: 200641 - DNA, 22 bp, Artificial sequence
  SiRNA target sequence
aaaaagactattatacaaagtg

SEQ ID NO: 200642 - DNA, 22 bp, Artificial sequence
  SiRNA target sequence
aaaagactattatacaaagtga

SEQ ID NO: 200643 - DNA, 22 bp, Artificial sequence
  SiRNA target sequence
aaagactattatacaaagtgac

SEQ ID NO: 200644 - DNA, 22 bp, Artificial sequence
  SiRNA target sequence
aagactattatacaaagtgaca

SEQ ID NO: 200645 - DNA, 22 bp, Artificial sequence
  SiRNA target sequence
agactattatacaaagtgacat

SEQ ID NO: 200646 - DNA, 22 bp, Artificial sequence
  SiRNA target sequence
gactattatacaaagtgacatt

SEQ ID NO: 200647 - DNA, 22 bp, Artificial sequence
  SiRNA target sequence
actattatacaaagtgacatta

SEQ ID NO: 200648 - DNA, 22 bp, Artificial sequence
  SiRNA target sequence
ctattatacaaagtgacattaa

SEQ ID NO: 200649 - DNA, 22 bp, Artificial sequence
  SiRNA target sequence
tattatacaaagtgacattaat

SEQ ID NO: 200650 - DNA, 22 bp, Artificial sequence
  SiRNA target sequence
attatacaaagtgacattaata

SEQ ID NO: 200651 - DNA, 22 bp, Artificial sequence
  SiRNA target sequence
ttatacaaagtgacattaataa

SEQ ID NO: 200652 - DNA, 22 bp, Artificial sequence
  SiRNA target sequence
tatacaaagtgacattaataat

SEQ ID NO: 200653 - DNA, 22 bp, Artificial sequence
  SiRNA target sequence
atacaaagtgacattaataatt

SEQ ID NO: 200654 - DNA, 22 bp, Artificial sequence
  SiRNA target sequence
tacaaagtgacattaataattt

SEQ ID NO: 200655 - DNA, 22 bp, Artificial sequence
  SiRNA target sequence
acaaagtgacattaataatttt

SEQ ID NO: 200656 - DNA, 22 bp, Artificial sequence
  SiRNA target sequence
caaagtgacattaataattttg

SEQ ID NO: 200657 - DNA, 22 bp, Artificial sequence
  SiRNA target sequence
aaagtgacattaataattttga

SEQ ID NO: 200658 - DNA, 22 bp, Artificial sequence
  SiRNA target sequence
aagtgacattaataattttgat

SEQ ID NO: 200659 - DNA, 22 bp, Artificial sequence
  SiRNA target sequence
agtgacattaataattttgatt

SEQ ID NO: 200660 - DNA, 22 bp, Artificial sequence
  SiRNA target sequence
gtgacattaataattttgattt

SEQ ID NO: 200661 - DNA, 22 bp, Artificial sequence
  SiRNA target sequence
tgacattaataattttgatttc

SEQ ID NO: 200662 - DNA, 22 bp, Artificial sequence
  SiRNA target sequence
gacattaataattttgatttca

SEQ ID NO: 200663 - DNA, 22 bp, Artificial sequence
  SiRNA target sequence
acattaataattttgatttcat

SEQ ID NO: 200664 - DNA, 22 bp, Artificial sequence
  SiRNA target sequence
cattaataattttgatttcatc

SEQ ID NO: 200665 - DNA, 22 bp, Artificial sequence
  SiRNA target sequence
attaataattttgatttcatca

SEQ ID NO: 200666 - DNA, 22 bp, Artificial sequence
  SiRNA target sequence
ttaataattttgatttcatcat

SEQ ID NO: 200667 - DNA, 22 bp, Artificial sequence
  SiRNA target sequence
taataattttgatttcatcatt

SEQ ID NO: 200668 - DNA, 22 bp, Artificial sequence
  SiRNA target sequence
aataattttgatttcatcatta

SEQ ID NO: 200669 - DNA, 22 bp, Artificial sequence
  SiRNA target sequence
ataattttgatttcatcattat

SEQ ID NO: 200670 - DNA, 22 bp, Artificial sequence
  SiRNA target sequence
taattttgatttcatcattata

SEQ ID NO: 200671 - DNA, 22 bp, Artificial sequence
  SiRNA target sequence
aattttgatttcatcattatac

SEQ ID NO: 200672 - DNA, 22 bp, Artificial sequence
  SiRNA target sequence
attttgatttcatcattatact

SEQ ID NO: 200673 - DNA, 22 bp, Artificial sequence
  SiRNA target sequence
ttttgatttcatcattatacta

SEQ ID NO: 200674 - DNA, 22 bp, Artificial sequence
  SiRNA target sequence
tttgatttcatcattatactaa

SEQ ID NO: 200675 - DNA, 22 bp, Artificial sequence
  SiRNA target sequence
ttgatttcatcattatactaat

SEQ ID NO: 200676 - DNA, 22 bp, Artificial sequence
  SiRNA target sequence
tgatttcatcattatactaata

SEQ ID NO: 200677 - DNA, 22 bp, Artificial sequence
  SiRNA target sequence
gatttcatcattatactaatac

SEQ ID NO: 200678 - DNA, 22 bp, Artificial sequence
  SiRNA target sequence
atttcatcattatactaatacc

SEQ ID NO: 200679 - DNA, 22 bp, Artificial sequence
  SiRNA target sequence
tttcatcattatactaatacct

SEQ ID NO: 200680 - DNA, 22 bp, Artificial sequence
  SiRNA target sequence
ttcatcattatactaatacctt

SEQ ID NO: 200681 - DNA, 22 bp, Artificial sequence
  SiRNA target sequence
tcatcattatactaataccttc

SEQ ID NO: 200682 - DNA, 22 bp, Artificial sequence
  SiRNA target sequence
catcattatactaataccttcg

SEQ ID NO: 200683 - DNA, 22 bp, Artificial sequence
  SiRNA target sequence
atcattatactaataccttcgg

SEQ ID NO: 200684 - DNA, 22 bp, Artificial sequence
  SiRNA target sequence
tcattatactaataccttcgga

SEQ ID NO: 200685 - DNA, 22 bp, Artificial sequence
  SiRNA target sequence
cattatactaataccttcggag

SEQ ID NO: 200686 - DNA, 22 bp, Artificial sequence
  SiRNA target sequence
attatactaataccttcggaga

SEQ ID NO: 200687 - DNA, 22 bp, Artificial sequence
  SiRNA target sequence
ttatactaataccttcggagaa

SEQ ID NO: 200688 - DNA, 22 bp, Artificial sequence
  SiRNA target sequence
tatactaataccttcggagaaa

SEQ ID NO: 200689 - DNA, 22 bp, Artificial sequence
  SiRNA target sequence
atactaataccttcggagaaac

SEQ ID NO: 200690 - DNA, 22 bp, Artificial sequence
  SiRNA target sequence
tactaataccttcggagaaacc

SEQ ID NO: 200691 - DNA, 22 bp, Artificial sequence
  SiRNA target sequence
actaataccttcggagaaacct

SEQ ID NO: 200692 - DNA, 22 bp, Artificial sequence
  SiRNA target sequence
ctaataccttcggagaaaccta

SEQ ID NO: 200693 - DNA, 22 bp, Artificial sequence
  SiRNA target sequence
taataccttcggagaaacctac

SEQ ID NO: 200694 - DNA, 22 bp, Artificial sequence
  SiRNA target sequence
aataccttcggagaaacctaca

SEQ ID NO: 200695 - DNA, 22 bp, Artificial sequence
  SiRNA target sequence
ataccttcggagaaacctacac

SEQ ID NO: 200696 - DNA, 22 bp, Artificial sequence
  SiRNA target sequence
taccttcggagaaacctacact

SEQ ID NO: 200697 - DNA, 22 bp, Artificial sequence
  SiRNA target sequence
accttcggagaaacctacacta

SEQ ID NO: 200698 - DNA, 22 bp, Artificial sequence
  SiRNA target sequence
ccttcggagaaacctacactaa

SEQ ID NO: 200699 - DNA, 22 bp, Artificial sequence
  SiRNA target sequence
cttcggagaaacctacactaac

SEQ ID NO: 200700 - DNA, 22 bp, Artificial sequence
  SiRNA target sequence
ttcggagaaacctacactaact

SEQ ID NO: 200701 - DNA, 22 bp, Artificial sequence
  SiRNA target sequence
tcggagaaacctacactaactt

SEQ ID NO: 200702 - DNA, 22 bp, Artificial sequence
  SiRNA target sequence
cggagaaacctacactaacttt

SEQ ID NO: 200703 - DNA, 22 bp, Artificial sequence
  SiRNA target sequence
ggagaaacctacactaactttt

SEQ ID NO: 200704 - DNA, 22 bp, Artificial sequence
  SiRNA target sequence
gagaaacctacactaacttttt

SEQ ID NO: 200705 - DNA, 22 bp, Artificial sequence
  SiRNA target sequence
agaaacctacactaactttttg

SEQ ID NO: 200706 - DNA, 22 bp, Artificial sequence
  SiRNA target sequence
gaaacctacactaactttttgt

SEQ ID NO: 200707 - DNA, 22 bp, Artificial sequence
  SiRNA target sequence
aaacctacactaactttttgtt

SEQ ID NO: 200708 - DNA, 22 bp, Artificial sequence
  SiRNA target sequence
aacctacactaactttttgttt

SEQ ID NO: 200709 - DNA, 22 bp, Artificial sequence
  SiRNA target sequence
acctacactaactttttgtttc

SEQ ID NO: 200710 - DNA, 22 bp, Artificial sequence
  SiRNA target sequence
cctacactaactttttgtttct

SEQ ID NO: 200711 - DNA, 22 bp, Artificial sequence
  SiRNA target sequence
ctacactaactttttgtttctt

SEQ ID NO: 200712 - DNA, 22 bp, Artificial sequence
  SiRNA target sequence
tacactaactttttgtttcttt

SEQ ID NO: 200713 - DNA, 22 bp, Artificial sequence
  SiRNA target sequence
acactaactttttgtttctttt

SEQ ID NO: 200714 - DNA, 22 bp, Artificial sequence
  SiRNA target sequence
cactaactttttgtttcttttt

SEQ ID NO: 200715 - DNA, 22 bp, Artificial sequence
  SiRNA target sequence
actaactttttgtttctttttt

SEQ ID NO: 200716 - DNA, 22 bp, Artificial sequence
  SiRNA target sequence
ctaactttttgtttctttttta

SEQ ID NO: 200717 - DNA, 22 bp, Artificial sequence
  SiRNA target sequence
taactttttgtttcttttttat

SEQ ID NO: 200718 - DNA, 22 bp, Artificial sequence
  SiRNA target sequence
aactttttgtttcttttttatc

SEQ ID NO: 200719 - DNA, 22 bp, Artificial sequence
  SiRNA target sequence
actttttgtttcttttttatcg

SEQ ID NO: 200720 - DNA, 22 bp, Artificial sequence
  SiRNA target sequence
ctttttgtttcttttttatcgt

SEQ ID NO: 200721 - DNA, 22 bp, Artificial sequence
  SiRNA target sequence
tttttgtttcttttttatcgta

SEQ ID NO: 200722 - DNA, 22 bp, Artificial sequence
  SiRNA target sequence
ttttgtttcttttttatcgtat

SEQ ID NO: 200723 - DNA, 22 bp, Artificial sequence
  SiRNA target sequence
tttgtttcttttttatcgtatt

SEQ ID NO: 200724 - DNA, 22 bp, Artificial sequence
  SiRNA target sequence
ttgtttcttttttatcgtatta

SEQ ID NO: 200725 - DNA, 22 bp, Artificial sequence
  SiRNA target sequence
tgtttcttttttatcgtattag

SEQ ID NO: 200726 - DNA, 22 bp, Artificial sequence
  SiRNA target sequence
gtttcttttttatcgtattaga

SEQ ID NO: 200727 - DNA, 22 bp, Artificial sequence
  SiRNA target sequence
tttcttttttatcgtattagaa

SEQ ID NO: 200728 - DNA, 22 bp, Artificial sequence
  SiRNA target sequence
ttcttttttatcgtattagaag

SEQ ID NO: 200729 - DNA, 22 bp, Artificial sequence
  SiRNA target sequence
tcttttttatcgtattagaagg

SEQ ID NO: 200730 - DNA, 22 bp, Artificial sequence
  SiRNA target sequence
cttttttatcgtattagaaggt

SEQ ID NO: 200731 - DNA, 22 bp, Artificial sequence
  SiRNA target sequence
ttttttatcgtattagaaggta

SEQ ID NO: 200732 - DNA, 22 bp, Artificial sequence
  SiRNA target sequence
tttttatcgtattagaaggtat

SEQ ID NO: 200733 - DNA, 22 bp, Artificial sequence
  SiRNA target sequence
ttttatcgtattagaaggtata

SEQ ID NO: 200734 - DNA, 22 bp, Artificial sequence
  SiRNA target sequence
tttatcgtattagaaggtataa

SEQ ID NO: 200735 - DNA, 22 bp, Artificial sequence
  SiRNA target sequence
ttatcgtattagaaggtataaa

SEQ ID NO: 200736 - DNA, 22 bp, Artificial sequence
  SiRNA target sequence
tatcgtattagaaggtataaat

SEQ ID NO: 200737 - DNA, 22 bp, Artificial sequence
  SiRNA target sequence
atcgtattagaaggtataaata

SEQ ID NO: 200738 - DNA, 22 bp, Artificial sequence
  SiRNA target sequence
tcgtattagaaggtataaatat

SEQ ID NO: 200739 - DNA, 22 bp, Artificial sequence
  SiRNA target sequence
cgtattagaaggtataaatatt

SEQ ID NO: 200740 - DNA, 22 bp, Artificial sequence
  SiRNA target sequence
gtattagaaggtataaatattg

SEQ ID NO: 200741 - DNA, 22 bp, Artificial sequence
  SiRNA target sequence
tattagaaggtataaatattgg

SEQ ID NO: 200742 - DNA, 22 bp, Artificial sequence
  SiRNA target sequence
attagaaggtataaatattggt

SEQ ID NO: 200743 - DNA, 22 bp, Artificial sequence
  SiRNA target sequence
ttagaaggtataaatattggta

SEQ ID NO: 200744 - DNA, 22 bp, Artificial sequence
  SiRNA target sequence
tagaaggtataaatattggtac

SEQ ID NO: 200745 - DNA, 22 bp, Artificial sequence
  SiRNA target sequence
agaaggtataaatattggtaca

SEQ ID NO: 200746 - DNA, 22 bp, Artificial sequence
  SiRNA target sequence
gaaggtataaatattggtacac

SEQ ID NO: 200747 - DNA, 22 bp, Artificial sequence
  SiRNA target sequence
aaggtataaatattggtacact

SEQ ID NO: 200748 - DNA, 22 bp, Artificial sequence
  SiRNA target sequence
aggtataaatattggtacactc

SEQ ID NO: 200749 - DNA, 22 bp, Artificial sequence
  SiRNA target sequence
ggtataaatattggtacactca

SEQ ID NO: 200750 - DNA, 22 bp, Artificial sequence
  SiRNA target sequence
gtataaatattggtacactcat

SEQ ID NO: 200751 - DNA, 22 bp, Artificial sequence
  SiRNA target sequence
tataaatattggtacactcatt

SEQ ID NO: 200752 - DNA, 22 bp, Artificial sequence
  SiRNA target sequence
ataaatattggtacactcatta

SEQ ID NO: 200753 - DNA, 22 bp, Artificial sequence
  SiRNA target sequence
taaatattggtacactcattat

SEQ ID NO: 200754 - DNA, 22 bp, Artificial sequence
  SiRNA target sequence
aaatattggtacactcattatt

SEQ ID NO: 200755 - DNA, 22 bp, Artificial sequence
  SiRNA target sequence
aatattggtacactcattattt

SEQ ID NO: 200756 - DNA, 22 bp, Artificial sequence
  SiRNA target sequence
atattggtacactcattatttt

SEQ ID NO: 200757 - DNA, 22 bp, Artificial sequence
  SiRNA target sequence
tattggtacactcattatttta

SEQ ID NO: 200758 - DNA, 22 bp, Artificial sequence
  SiRNA target sequence
attggtacactcattattttat

SEQ ID NO: 200759 - DNA, 22 bp, Artificial sequence
  SiRNA target sequence
ttggtacactcattattttatt

SEQ ID NO: 200760 - DNA, 22 bp, Artificial sequence
  SiRNA target sequence
tggtacactcattattttattc

SEQ ID NO: 200761 - DNA, 22 bp, Artificial sequence
  SiRNA target sequence
ggtacactcattattttattct

SEQ ID NO: 200762 - DNA, 22 bp, Artificial sequence
  SiRNA target sequence
gtacactcattattttattctc

SEQ ID NO: 200763 - DNA, 22 bp, Artificial sequence
  SiRNA target sequence
tacactcattattttattctcg

SEQ ID NO: 200764 - DNA, 22 bp, Artificial sequence
  SiRNA target sequence
acactcattattttattctcga

SEQ ID NO: 200765 - DNA, 22 bp, Artificial sequence
  SiRNA target sequence
cactcattattttattctcgaa

SEQ ID NO: 200766 - DNA, 22 bp, Artificial sequence
  SiRNA target sequence
actcattattttattctcgaaa

SEQ ID NO: 200767 - DNA, 22 bp, Artificial sequence
  SiRNA target sequence
ctcattattttattctcgaaat

SEQ ID NO: 200768 - DNA, 22 bp, Artificial sequence
  SiRNA target sequence
tcattattttattctcgaaata

SEQ ID NO: 200769 - DNA, 22 bp, Artificial sequence
  SiRNA target sequence
cattattttattctcgaaataa

SEQ ID NO: 200770 - DNA, 22 bp, Artificial sequence
  SiRNA target sequence
attattttattctcgaaataat

SEQ ID NO: 200771 - DNA, 22 bp, Artificial sequence
  SiRNA target sequence
ttattttattctcgaaataata

SEQ ID NO: 200772 - DNA, 22 bp, Artificial sequence
  SiRNA target sequence
tattttattctcgaaataatat

SEQ ID NO: 200773 - DNA, 22 bp, Artificial sequence
  SiRNA target sequence
attttattctcgaaataatatt

SEQ ID NO: 200774 - DNA, 22 bp, Artificial sequence
  SiRNA target sequence
ttttattctcgaaataatattt

SEQ ID NO: 200775 - DNA, 22 bp, Artificial sequence
  SiRNA target sequence
tttattctcgaaataatatttc

SEQ ID NO: 200776 - DNA, 22 bp, Artificial sequence
  SiRNA target sequence
ttattctcgaaataatatttca

SEQ ID NO: 200777 - DNA, 22 bp, Artificial sequence
  SiRNA target sequence
tattctcgaaataatatttcat

SEQ ID NO: 200778 - DNA, 22 bp, Artificial sequence
  SiRNA target sequence
attctcgaaataatatttcatg

SEQ ID NO: 200779 - DNA, 22 bp, Artificial sequence
  SiRNA target sequence
ttctcgaaataatatttcatgt

SEQ ID NO: 200780 - DNA, 22 bp, Artificial sequence
  SiRNA target sequence
tctcgaaataatatttcatgta

SEQ ID NO: 200781 - DNA, 22 bp, Artificial sequence
  SiRNA target sequence
ctcgaaataatatttcatgtac

SEQ ID NO: 200782 - DNA, 22 bp, Artificial sequence
  SiRNA target sequence
tcgaaataatatttcatgtaca

SEQ ID NO: 200783 - DNA, 22 bp, Artificial sequence
  SiRNA target sequence
cgaaataatatttcatgtacat

SEQ ID NO: 200784 - DNA, 22 bp, Artificial sequence
  SiRNA target sequence
gaaataatatttcatgtacatt

SEQ ID NO: 200785 - DNA, 22 bp, Artificial sequence
  SiRNA target sequence
aaataatatttcatgtacatta

SEQ ID NO: 200786 - DNA, 22 bp, Artificial sequence
  SiRNA target sequence
aataatatttcatgtacattaa

SEQ ID NO: 200787 - DNA, 22 bp, Artificial sequence
  SiRNA target sequence
ataatatttcatgtacattaat

SEQ ID NO: 200788 - DNA, 22 bp, Artificial sequence
  SiRNA target sequence
taatatttcatgtacattaata

SEQ ID NO: 200789 - DNA, 22 bp, Artificial sequence
  SiRNA target sequence
aatatttcatgtacattaatat

SEQ ID NO: 200790 - DNA, 22 bp, Artificial sequence
  SiRNA target sequence
atatttcatgtacattaatatt

SEQ ID NO: 200791 - DNA, 22 bp, Artificial sequence
  SiRNA target sequence
tatttcatgtacattaatatta

SEQ ID NO: 200792 - DNA, 22 bp, Artificial sequence
  SiRNA target sequence
atttcatgtacattaatattag

SEQ ID NO: 200793 - DNA, 22 bp, Artificial sequence
  SiRNA target sequence
tttcatgtacattaatattaga

SEQ ID NO: 200794 - DNA, 22 bp, Artificial sequence
  SiRNA target sequence
ttcatgtacattaatattagac

SEQ ID NO: 200795 - DNA, 22 bp, Artificial sequence
  SiRNA target sequence
tcatgtacattaatattagaca

SEQ ID NO: 200796 - DNA, 22 bp, Artificial sequence
  SiRNA target sequence
catgtacattaatattagacat

SEQ ID NO: 200797 - DNA, 22 bp, Artificial sequence
  SiRNA target sequence
atgtacattaatattagacata

SEQ ID NO: 200798 - DNA, 22 bp, Artificial sequence
  SiRNA target sequence
tgtacattaatattagacatat

SEQ ID NO: 200799 - DNA, 22 bp, Artificial sequence
  SiRNA target sequence
gtacattaatattagacatata

SEQ ID NO: 200800 - DNA, 22 bp, Artificial sequence
  SiRNA target sequence
tacattaatattagacatatac

SEQ ID NO: 200801 - DNA, 22 bp, Artificial sequence
  SiRNA target sequence
acattaatattagacatatacc

SEQ ID NO: 200802 - DNA, 22 bp, Artificial sequence
  SiRNA target sequence
cattaatattagacatataccg

SEQ ID NO: 200803 - DNA, 22 bp, Artificial sequence
  SiRNA target sequence
attaatattagacatataccgc

SEQ ID NO: 200804 - DNA, 22 bp, Artificial sequence
  SiRNA target sequence
ttaatattagacatataccgcc

SEQ ID NO: 200805 - DNA, 22 bp, Artificial sequence
  SiRNA target sequence
taatattagacatataccgccc

SEQ ID NO: 200806 - DNA, 22 bp, Artificial sequence
  SiRNA target sequence
aatattagacatataccgccca

SEQ ID NO: 200807 - DNA, 22 bp, Artificial sequence
  SiRNA target sequence
atattagacatataccgcccat

SEQ ID NO: 200808 - DNA, 22 bp, Artificial sequence
  SiRNA target sequence
tattagacatataccgcccatg

SEQ ID NO: 200809 - DNA, 22 bp, Artificial sequence
  SiRNA target sequence
attagacatataccgcccatgg

SEQ ID NO: 200810 - DNA, 22 bp, Artificial sequence
  SiRNA target sequence
ttagacatataccgcccatggc

SEQ ID NO: 200811 - DNA, 22 bp, Artificial sequence
  SiRNA target sequence
tagacatataccgcccatggca

SEQ ID NO: 200812 - DNA, 22 bp, Artificial sequence
  SiRNA target sequence
agacatataccgcccatggcaa

SEQ ID NO: 200813 - DNA, 22 bp, Artificial sequence
  SiRNA target sequence
gacatataccgcccatggcaat

SEQ ID NO: 200814 - DNA, 22 bp, Artificial sequence
  SiRNA target sequence
acatataccgcccatggcaata

SEQ ID NO: 200815 - DNA, 22 bp, Artificial sequence
  SiRNA target sequence
catataccgcccatggcaataa

SEQ ID NO: 200816 - DNA, 22 bp, Artificial sequence
  SiRNA target sequence
atataccgcccatggcaataaa

SEQ ID NO: 200817 - DNA, 22 bp, Artificial sequence
  SiRNA target sequence
tataccgcccatggcaataaaa

SEQ ID NO: 200818 - DNA, 22 bp, Artificial sequence
  SiRNA target sequence
ataccgcccatggcaataaaaa

SEQ ID NO: 200819 - DNA, 22 bp, Artificial sequence
  SiRNA target sequence
taccgcccatggcaataaaaac

SEQ ID NO: 200820 - DNA, 22 bp, Artificial sequence
  SiRNA target sequence
accgcccatggcaataaaaacc

SEQ ID NO: 200821 - DNA, 22 bp, Artificial sequence
  SiRNA target sequence
ccgcccatggcaataaaaaccg

SEQ ID NO: 200822 - DNA, 22 bp, Artificial sequence
  SiRNA target sequence
cgcccatggcaataaaaaccga

SEQ ID NO: 200823 - DNA, 22 bp, Artificial sequence
  SiRNA target sequence
gcccatggcaataaaaaccgaa

SEQ ID NO: 200824 - DNA, 22 bp, Artificial sequence
  SiRNA target sequence
cccatggcaataaaaaccgaag

SEQ ID NO: 200825 - DNA, 22 bp, Artificial sequence
  SiRNA target sequence
ccatggcaataaaaaccgaaga

SEQ ID NO: 200826 - DNA, 22 bp, Artificial sequence
  SiRNA target sequence
catggcaataaaaaccgaagaa

SEQ ID NO: 200827 - DNA, 22 bp, Artificial sequence
  SiRNA target sequence
atggcaataaaaaccgaagaat

SEQ ID NO: 200828 - DNA, 22 bp, Artificial sequence
  SiRNA target sequence
tggcaataaaaaccgaagaata

SEQ ID NO: 200829 - DNA, 22 bp, Artificial sequence
  SiRNA target sequence
ggcaataaaaaccgaagaatat

SEQ ID NO: 200830 - DNA, 22 bp, Artificial sequence
  SiRNA target sequence
gcaataaaaaccgaagaatata

SEQ ID NO: 200831 - DNA, 22 bp, Artificial sequence
  SiRNA target sequence
caataaaaaccgaagaatataa

SEQ ID NO: 200832 - DNA, 22 bp, Artificial sequence
  SiRNA target sequence
aataaaaaccgaagaatataat

SEQ ID NO: 200833 - DNA, 22 bp, Artificial sequence
  SiRNA target sequence
ataaaaaccgaagaatataata

SEQ ID NO: 200834 - DNA, 22 bp, Artificial sequence
  SiRNA target sequence
taaaaaccgaagaatataataa

SEQ ID NO: 200835 - DNA, 22 bp, Artificial sequence
  SiRNA target sequence
aaaaaccgaagaatataataac

SEQ ID NO: 200836 - DNA, 22 bp, Artificial sequence
  SiRNA target sequence
aaaaccgaagaatataataact

SEQ ID NO: 200837 - DNA, 22 bp, Artificial sequence
  SiRNA target sequence
aaaccgaagaatataataactg

SEQ ID NO: 200838 - DNA, 22 bp, Artificial sequence
  SiRNA target sequence
aaccgaagaatataataactga

SEQ ID NO: 200839 - DNA, 22 bp, Artificial sequence
  SiRNA target sequence
accgaagaatataataactgat

SEQ ID NO: 200840 - DNA, 22 bp, Artificial sequence
  SiRNA target sequence
ccgaagaatataataactgatt

SEQ ID NO: 200841 - DNA, 22 bp, Artificial sequence
  SiRNA target sequence
cgaagaatataataactgattt

SEQ ID NO: 200842 - DNA, 22 bp, Artificial sequence
  SiRNA target sequence
gaagaatataataactgatttt

SEQ ID NO: 200843 - DNA, 22 bp, Artificial sequence
  SiRNA target sequence
aagaatataataactgattttg

SEQ ID NO: 200844 - DNA, 22 bp, Artificial sequence
  SiRNA target sequence
agaatataataactgattttgc

SEQ ID NO: 200845 - DNA, 22 bp, Artificial sequence
  SiRNA target sequence
gaatataataactgattttgct

SEQ ID NO: 200846 - DNA, 22 bp, Artificial sequence
  SiRNA target sequence
aatataataactgattttgctc

SEQ ID NO: 200847 - DNA, 22 bp, Artificial sequence
  SiRNA target sequence
atataataactgattttgctca

SEQ ID NO: 200848 - DNA, 22 bp, Artificial sequence
  SiRNA target sequence
tataataactgattttgctcat

SEQ ID NO: 200849 - DNA, 22 bp, Artificial sequence
  SiRNA target sequence
ataataactgattttgctcata

SEQ ID NO: 200850 - DNA, 22 bp, Artificial sequence
  SiRNA target sequence
taataactgattttgctcatag

SEQ ID NO: 200851 - DNA, 22 bp, Artificial sequence
  SiRNA target sequence
aataactgattttgctcatagc

SEQ ID NO: 200852 - DNA, 22 bp, Artificial sequence
  SiRNA target sequence
ataactgattttgctcatagct

SEQ ID NO: 200853 - DNA, 22 bp, Artificial sequence
  SiRNA target sequence
taactgattttgctcatagcta

SEQ ID NO: 200854 - DNA, 22 bp, Artificial sequence
  SiRNA target sequence
aactgattttgctcatagctaa

SEQ ID NO: 200855 - DNA, 22 bp, Artificial sequence
  SiRNA target sequence
actgattttgctcatagctaaa

SEQ ID NO: 200856 - DNA, 22 bp, Artificial sequence
  SiRNA target sequence
ctgattttgctcatagctaaat

SEQ ID NO: 200857 - DNA, 22 bp, Artificial sequence
  SiRNA target sequence
tgattttgctcatagctaaatc

SEQ ID NO: 200858 - DNA, 22 bp, Artificial sequence
  SiRNA target sequence
gattttgctcatagctaaatcc

SEQ ID NO: 200859 - DNA, 22 bp, Artificial sequence
  SiRNA target sequence
attttgctcatagctaaatcct

SEQ ID NO: 200860 - DNA, 22 bp, Artificial sequence
  SiRNA target sequence
ttttgctcatagctaaatcctt

SEQ ID NO: 200861 - DNA, 22 bp, Artificial sequence
  SiRNA target sequence
tttgctcatagctaaatccttt

SEQ ID NO: 200862 - DNA, 22 bp, Artificial sequence
  SiRNA target sequence
ttgctcatagctaaatcctttt

SEQ ID NO: 200863 - DNA, 22 bp, Artificial sequence
  SiRNA target sequence
tgctcatagctaaatccttttc

SEQ ID NO: 200864 - DNA, 22 bp, Artificial sequence
  SiRNA target sequence
gctcatagctaaatccttttcg

SEQ ID NO: 200865 - DNA, 22 bp, Artificial sequence
  SiRNA target sequence
ctcatagctaaatccttttcgc

SEQ ID NO: 200866 - DNA, 22 bp, Artificial sequence
  SiRNA target sequence
tcatagctaaatccttttcgca

SEQ ID NO: 200867 - DNA, 22 bp, Artificial sequence
  SiRNA target sequence
catagctaaatccttttcgcaa

SEQ ID NO: 200868 - DNA, 22 bp, Artificial sequence
  SiRNA target sequence
atagctaaatccttttcgcaat

SEQ ID NO: 200869 - DNA, 22 bp, Artificial sequence
  SiRNA target sequence
tagctaaatccttttcgcaatt

SEQ ID NO: 200870 - DNA, 22 bp, Artificial sequence
  SiRNA target sequence
agctaaatccttttcgcaattc

SEQ ID NO: 200871 - DNA, 22 bp, Artificial sequence
  SiRNA target sequence
gctaaatccttttcgcaattct

SEQ ID NO: 200872 - DNA, 22 bp, Artificial sequence
  SiRNA target sequence
ctaaatccttttcgcaattctc

SEQ ID NO: 200873 - DNA, 22 bp, Artificial sequence
  SiRNA target sequence
taaatccttttcgcaattctct

SEQ ID NO: 200874 - DNA, 22 bp, Artificial sequence
  SiRNA target sequence
aaatccttttcgcaattctctg

SEQ ID NO: 200875 - DNA, 22 bp, Artificial sequence
  SiRNA target sequence
aatccttttcgcaattctctga

SEQ ID NO: 200876 - DNA, 22 bp, Artificial sequence
  SiRNA target sequence
atccttttcgcaattctctgaa

SEQ ID NO: 200877 - DNA, 22 bp, Artificial sequence
  SiRNA target sequence
tccttttcgcaattctctgaaa

SEQ ID NO: 200878 - DNA, 22 bp, Artificial sequence
  SiRNA target sequence
ccttttcgcaattctctgaaag

SEQ ID NO: 200879 - DNA, 22 bp, Artificial sequence
  SiRNA target sequence
cttttcgcaattctctgaaaga

SEQ ID NO: 200880 - DNA, 22 bp, Artificial sequence
  SiRNA target sequence
ttttcgcaattctctgaaagaa

SEQ ID NO: 200881 - DNA, 22 bp, Artificial sequence
  SiRNA target sequence
tttcgcaattctctgaaagaac

SEQ ID NO: 200882 - DNA, 22 bp, Artificial sequence
  SiRNA target sequence
ttcgcaattctctgaaagaact

SEQ ID NO: 200883 - DNA, 22 bp, Artificial sequence
  SiRNA target sequence
tcgcaattctctgaaagaacta

SEQ ID NO: 200884 - DNA, 22 bp, Artificial sequence
  SiRNA target sequence
cgcaattctctgaaagaactac

SEQ ID NO: 200885 - DNA, 22 bp, Artificial sequence
  SiRNA target sequence
gcaattctctgaaagaactact

SEQ ID NO: 200886 - DNA, 22 bp, Artificial sequence
  SiRNA target sequence
caattctctgaaagaactactg

SEQ ID NO: 200887 - DNA, 22 bp, Artificial sequence
  SiRNA target sequence
aattctctgaaagaactactgg

SEQ ID NO: 200888 - DNA, 22 bp, Artificial sequence
  SiRNA target sequence
attctctgaaagaactactggc

SEQ ID NO: 200889 - DNA, 22 bp, Artificial sequence
  SiRNA target sequence
ttctctgaaagaactactggct

SEQ ID NO: 200890 - DNA, 22 bp, Artificial sequence
  SiRNA target sequence
tctctgaaagaactactggcta

SEQ ID NO: 200891 - DNA, 22 bp, Artificial sequence
  SiRNA target sequence
ctctgaaagaactactggctaa

SEQ ID NO: 200892 - DNA, 22 bp, Artificial sequence
  SiRNA target sequence
tctgaaagaactactggctaat

SEQ ID NO: 200893 - DNA, 22 bp, Artificial sequence
  SiRNA target sequence
ctgaaagaactactggctaatc

SEQ ID NO: 200894 - DNA, 22 bp, Artificial sequence
  SiRNA target sequence
tgaaagaactactggctaatcc

SEQ ID NO: 200895 - DNA, 22 bp, Artificial sequence
  SiRNA target sequence
gaaagaactactggctaatcca

SEQ ID NO: 200896 - DNA, 22 bp, Artificial sequence
  SiRNA target sequence
aaagaactactggctaatccag

SEQ ID NO: 200897 - DNA, 22 bp, Artificial sequence
  SiRNA target sequence
aagaactactggctaatccaga

SEQ ID NO: 200898 - DNA, 22 bp, Artificial sequence
  SiRNA target sequence
agaactactggctaatccagat

SEQ ID NO: 200899 - DNA, 22 bp, Artificial sequence
  SiRNA target sequence
gaactactggctaatccagata

SEQ ID NO: 200900 - DNA, 22 bp, Artificial sequence
  SiRNA target sequence
aactactggctaatccagatac

SEQ ID NO: 200901 - DNA, 22 bp, Artificial sequence
  SiRNA target sequence
actactggctaatccagatact

SEQ ID NO: 200902 - DNA, 22 bp, Artificial sequence
  SiRNA target sequence
ctactggctaatccagatacta

SEQ ID NO: 200903 - DNA, 22 bp, Artificial sequence
  SiRNA target sequence
tactggctaatccagatactag

SEQ ID NO: 200904 - DNA, 22 bp, Artificial sequence
  SiRNA target sequence
actggctaatccagatactagt

SEQ ID NO: 200905 - DNA, 22 bp, Artificial sequence
  SiRNA target sequence
ctggctaatccagatactagta

SEQ ID NO: 200906 - DNA, 22 bp, Artificial sequence
  SiRNA target sequence
tggctaatccagatactagtaa

SEQ ID NO: 200907 - DNA, 22 bp, Artificial sequence
  SiRNA target sequence
ggctaatccagatactagtaaa

SEQ ID NO: 200908 - DNA, 22 bp, Artificial sequence
  SiRNA target sequence
gctaatccagatactagtaaag

SEQ ID NO: 200909 - DNA, 22 bp, Artificial sequence
  SiRNA target sequence
ctaatccagatactagtaaagc

SEQ ID NO: 200910 - DNA, 22 bp, Artificial sequence
  SiRNA target sequence
taatccagatactagtaaagct

SEQ ID NO: 200911 - DNA, 22 bp, Artificial sequence
  SiRNA target sequence
aatccagatactagtaaagcta

SEQ ID NO: 200912 - DNA, 22 bp, Artificial sequence
  SiRNA target sequence
atccagatactagtaaagctaa

SEQ ID NO: 200913 - DNA, 22 bp, Artificial sequence
  SiRNA target sequence
tccagatactagtaaagctaaa

SEQ ID NO: 200914 - DNA, 22 bp, Artificial sequence
  SiRNA target sequence
ccagatactagtaaagctaaat

SEQ ID NO: 200915 - DNA, 22 bp, Artificial sequence
  SiRNA target sequence
cagatactagtaaagctaaatt

SEQ ID NO: 200916 - DNA, 22 bp, Artificial sequence
  SiRNA target sequence
agatactagtaaagctaaattt

SEQ ID NO: 200917 - DNA, 22 bp, Artificial sequence
  SiRNA target sequence
gatactagtaaagctaaatttg

SEQ ID NO: 200918 - DNA, 22 bp, Artificial sequence
  SiRNA target sequence
atactagtaaagctaaatttgc

SEQ ID NO: 200919 - DNA, 22 bp, Artificial sequence
  SiRNA target sequence
tactagtaaagctaaatttgct

SEQ ID NO: 200920 - DNA, 22 bp, Artificial sequence
  SiRNA target sequence
actagtaaagctaaatttgcta

SEQ ID NO: 200921 - DNA, 22 bp, Artificial sequence
  SiRNA target sequence
ctagtaaagctaaatttgctat

SEQ ID NO: 200922 - DNA, 22 bp, Artificial sequence
  SiRNA target sequence
tagtaaagctaaatttgctatt

SEQ ID NO: 200923 - DNA, 22 bp, Artificial sequence
  SiRNA target sequence
agtaaagctaaatttgctatta

SEQ ID NO: 200924 - DNA, 22 bp, Artificial sequence
  SiRNA target sequence
gtaaagctaaatttgctattat

SEQ ID NO: 200925 - DNA, 22 bp, Artificial sequence
  SiRNA target sequence
taaagctaaatttgctattatg

SEQ ID NO: 200926 - DNA, 22 bp, Artificial sequence
  SiRNA target sequence
aaagctaaatttgctattatgt

SEQ ID NO: 200927 - DNA, 22 bp, Artificial sequence
  SiRNA target sequence
aagctaaatttgctattatgta

SEQ ID NO: 200928 - DNA, 22 bp, Artificial sequence
  SiRNA target sequence
agctaaatttgctattatgtaa

SEQ ID NO: 200929 - DNA, 22 bp, Artificial sequence
  SiRNA target sequence
gctaaatttgctattatgtaaa

SEQ ID NO: 200930 - DNA, 22 bp, Artificial sequence
  SiRNA target sequence
ctaaatttgctattatgtaaaa

SEQ ID NO: 200931 - DNA, 22 bp, Artificial sequence
  SiRNA target sequence
taaatttgctattatgtaaaaa

SEQ ID NO: 200932 - DNA, 22 bp, Artificial sequence
  SiRNA target sequence
aaatttgctattatgtaaaaag

SEQ ID NO: 200933 - DNA, 22 bp, Artificial sequence
  SiRNA target sequence
aatttgctattatgtaaaaagg

SEQ ID NO: 200934 - DNA, 22 bp, Artificial sequence
  SiRNA target sequence
atttgctattatgtaaaaaggt

SEQ ID NO: 200935 - DNA, 22 bp, Artificial sequence
  SiRNA target sequence
tttgctattatgtaaaaaggtg

SEQ ID NO: 200936 - DNA, 22 bp, Artificial sequence
  SiRNA target sequence
ttgctattatgtaaaaaggtgg

SEQ ID NO: 200937 - DNA, 22 bp, Artificial sequence
  SiRNA target sequence
tgctattatgtaaaaaggtggt

SEQ ID NO: 200938 - DNA, 22 bp, Artificial sequence
  SiRNA target sequence
gctattatgtaaaaaggtggta

SEQ ID NO: 200939 - DNA, 22 bp, Artificial sequence
  SiRNA target sequence
ctattatgtaaaaaggtggtaa

SEQ ID NO: 200940 - DNA, 22 bp, Artificial sequence
  SiRNA target sequence
tattatgtaaaaaggtggtaaa

SEQ ID NO: 200941 - DNA, 22 bp, Artificial sequence
  SiRNA target sequence
attatgtaaaaaggtggtaaaa

SEQ ID NO: 200942 - DNA, 22 bp, Artificial sequence
  SiRNA target sequence
ttatgtaaaaaggtggtaaaaa

SEQ ID NO: 200943 - DNA, 22 bp, Artificial sequence
  SiRNA target sequence
tatgtaaaaaggtggtaaaaat

SEQ ID NO: 200944 - DNA, 22 bp, Artificial sequence
  SiRNA target sequence
atgtaaaaaggtggtaaaaatc

SEQ ID NO: 200945 - DNA, 22 bp, Artificial sequence
  SiRNA target sequence
tgtaaaaaggtggtaaaaatct

SEQ ID NO: 200946 - DNA, 22 bp, Artificial sequence
  SiRNA target sequence
gtaaaaaggtggtaaaaatctt

SEQ ID NO: 200947 - DNA, 22 bp, Artificial sequence
  SiRNA target sequence
taaaaaggtggtaaaaatcttg

SEQ ID NO: 200948 - DNA, 22 bp, Artificial sequence
  SiRNA target sequence
aaaaaggtggtaaaaatcttgt

SEQ ID NO: 200949 - DNA, 22 bp, Artificial sequence
  SiRNA target sequence
aaaaggtggtaaaaatcttgta

SEQ ID NO: 200950 - DNA, 22 bp, Artificial sequence
  SiRNA target sequence
aaaggtggtaaaaatcttgtaa

SEQ ID NO: 200951 - DNA, 22 bp, Artificial sequence
  SiRNA target sequence
aaggtggtaaaaatcttgtaaa

SEQ ID NO: 200952 - DNA, 22 bp, Artificial sequence
  SiRNA target sequence
aggtggtaaaaatcttgtaaac

SEQ ID NO: 200953 - DNA, 22 bp, Artificial sequence
  SiRNA target sequence
ggtggtaaaaatcttgtaaact

SEQ ID NO: 200954 - DNA, 22 bp, Artificial sequence
  SiRNA target sequence
gtggtaaaaatcttgtaaactg

SEQ ID NO: 200955 - DNA, 22 bp, Artificial sequence
  SiRNA target sequence
tggtaaaaatcttgtaaactgt

SEQ ID NO: 200956 - DNA, 22 bp, Artificial sequence
  SiRNA target sequence
ggtaaaaatcttgtaaactgtc

SEQ ID NO: 200957 - DNA, 22 bp, Artificial sequence
  SiRNA target sequence
gtaaaaatcttgtaaactgtct

SEQ ID NO: 200958 - DNA, 22 bp, Artificial sequence
  SiRNA target sequence
taaaaatcttgtaaactgtctg

SEQ ID NO: 200959 - DNA, 22 bp, Artificial sequence
  SiRNA target sequence
aaaaatcttgtaaactgtctga

SEQ ID NO: 200960 - DNA, 22 bp, Artificial sequence
  SiRNA target sequence
aaaatcttgtaaactgtctgat

SEQ ID NO: 200961 - DNA, 22 bp, Artificial sequence
  SiRNA target sequence
aaatcttgtaaactgtctgata

SEQ ID NO: 200962 - DNA, 22 bp, Artificial sequence
  SiRNA target sequence
aatcttgtaaactgtctgatag

SEQ ID NO: 200963 - DNA, 22 bp, Artificial sequence
  SiRNA target sequence
atcttgtaaactgtctgatagt

SEQ ID NO: 200964 - DNA, 22 bp, Artificial sequence
  SiRNA target sequence
tcttgtaaactgtctgatagta

SEQ ID NO: 200965 - DNA, 22 bp, Artificial sequence
  SiRNA target sequence
cttgtaaactgtctgatagtac

SEQ ID NO: 200966 - DNA, 22 bp, Artificial sequence
  SiRNA target sequence
ttgtaaactgtctgatagtaca

SEQ ID NO: 200967 - DNA, 22 bp, Artificial sequence
  SiRNA target sequence
tgtaaactgtctgatagtacaa

SEQ ID NO: 200968 - DNA, 22 bp, Artificial sequence
  SiRNA target sequence
gtaaactgtctgatagtacaac

SEQ ID NO: 200969 - DNA, 22 bp, Artificial sequence
  SiRNA target sequence
taaactgtctgatagtacaact

SEQ ID NO: 200970 - DNA, 22 bp, Artificial sequence
  SiRNA target sequence
aaactgtctgatagtacaactt

SEQ ID NO: 200971 - DNA, 22 bp, Artificial sequence
  SiRNA target sequence
aactgtctgatagtacaacttt

SEQ ID NO: 200972 - DNA, 22 bp, Artificial sequence
  SiRNA target sequence
actgtctgatagtacaactttc

SEQ ID NO: 200973 - DNA, 22 bp, Artificial sequence
  SiRNA target sequence
ctgtctgatagtacaactttca

SEQ ID NO: 200974 - DNA, 22 bp, Artificial sequence
  SiRNA target sequence
tgtctgatagtacaactttcat

SEQ ID NO: 200975 - DNA, 22 bp, Artificial sequence
  SiRNA target sequence
gtctgatagtacaactttcatt

SEQ ID NO: 200976 - DNA, 22 bp, Artificial sequence
  SiRNA target sequence
tctgatagtacaactttcattt

SEQ ID NO: 200977 - DNA, 22 bp, Artificial sequence
  SiRNA target sequence
ctgatagtacaactttcattta

SEQ ID NO: 200978 - DNA, 22 bp, Artificial sequence
  SiRNA target sequence
tgatagtacaactttcatttaa

SEQ ID NO: 200979 - DNA, 22 bp, Artificial sequence
  SiRNA target sequence
gatagtacaactttcatttaaa

SEQ ID NO: 200980 - DNA, 22 bp, Artificial sequence
  SiRNA target sequence
atagtacaactttcatttaaaa

SEQ ID NO: 200981 - DNA, 22 bp, Artificial sequence
  SiRNA target sequence
tagtacaactttcatttaaaaa

SEQ ID NO: 200982 - DNA, 22 bp, Artificial sequence
  SiRNA target sequence
agtacaactttcatttaaaaaa

SEQ ID NO: 200983 - DNA, 22 bp, Artificial sequence
  SiRNA target sequence
gtacaactttcatttaaaaaac

SEQ ID NO: 200984 - DNA, 22 bp, Artificial sequence
  SiRNA target sequence
tacaactttcatttaaaaaact

SEQ ID NO: 200985 - DNA, 22 bp, Artificial sequence
  SiRNA target sequence
acaactttcatttaaaaaactc

SEQ ID NO: 200986 - DNA, 22 bp, Artificial sequence
  SiRNA target sequence
caactttcatttaaaaaactca

SEQ ID NO: 200987 - DNA, 22 bp, Artificial sequence
  SiRNA target sequence
aactttcatttaaaaaactcat

SEQ ID NO: 200988 - DNA, 22 bp, Artificial sequence
  SiRNA target sequence
actttcatttaaaaaactcatg

SEQ ID NO: 200989 - DNA, 22 bp, Artificial sequence
  SiRNA target sequence
ctttcatttaaaaaactcatgt

SEQ ID NO: 200990 - DNA, 22 bp, Artificial sequence
  SiRNA target sequence
tttcatttaaaaaactcatgta

SEQ ID NO: 200991 - DNA, 22 bp, Artificial sequence
  SiRNA target sequence
ttcatttaaaaaactcatgtat

SEQ ID NO: 200992 - DNA, 22 bp, Artificial sequence
  SiRNA target sequence
tcatttaaaaaactcatgtata

SEQ ID NO: 200993 - DNA, 22 bp, Artificial sequence
  SiRNA target sequence
catttaaaaaactcatgtataa

SEQ ID NO: 200994 - DNA, 22 bp, Artificial sequence
  SiRNA target sequence
atttaaaaaactcatgtataaa

SEQ ID NO: 200995 - DNA, 22 bp, Artificial sequence
  SiRNA target sequence
tttaaaaaactcatgtataaat

SEQ ID NO: 200996 - DNA, 22 bp, Artificial sequence
  SiRNA target sequence
ttaaaaaactcatgtataaata

SEQ ID NO: 200997 - DNA, 22 bp, Artificial sequence
  SiRNA target sequence
taaaaaactcatgtataaataa

SEQ ID NO: 200998 - DNA, 22 bp, Artificial sequence
  SiRNA target sequence
aaaaaactcatgtataaataag

SEQ ID NO: 200999 - DNA, 22 bp, Artificial sequence
  SiRNA target sequence
aaaaactcatgtataaataagc

SEQ ID NO: 201000 - DNA, 22 bp, Artificial sequence
  SiRNA target sequence
aaaactcatgtataaataagcc

SEQ ID NO: 201001 - DNA, 22 bp, Artificial sequence
  SiRNA target sequence
aaactcatgtataaataagcca

SEQ ID NO: 201002 - DNA, 22 bp, Artificial sequence
  SiRNA target sequence
aactcatgtataaataagccat

SEQ ID NO: 201003 - DNA, 22 bp, Artificial sequence
  SiRNA target sequence
actcatgtataaataagccata

SEQ ID NO: 201004 - DNA, 22 bp, Artificial sequence
  SiRNA target sequence
ctcatgtataaataagccataa

SEQ ID NO: 201005 - DNA, 22 bp, Artificial sequence
  SiRNA target sequence
tcatgtataaataagccataag

SEQ ID NO: 201006 - DNA, 22 bp, Artificial sequence
  SiRNA target sequence
catgtataaataagccataagt

SEQ ID NO: 201007 - DNA, 22 bp, Artificial sequence
  SiRNA target sequence
atgtataaataagccataagta

SEQ ID NO: 201008 - DNA, 22 bp, Artificial sequence
  SiRNA target sequence
tgtataaataagccataagtaa

SEQ ID NO: 201009 - DNA, 22 bp, Artificial sequence
  SiRNA target sequence
gtataaataagccataagtaaa

SEQ ID NO: 201010 - DNA, 22 bp, Artificial sequence
  SiRNA target sequence
tataaataagccataagtaaac

SEQ ID NO: 201011 - DNA, 22 bp, Artificial sequence
  SiRNA target sequence
ataaataagccataagtaaact

SEQ ID NO: 201012 - DNA, 22 bp, Artificial sequence
  SiRNA target sequence
taaataagccataagtaaactg

SEQ ID NO: 201013 - DNA, 22 bp, Artificial sequence
  SiRNA target sequence
aaataagccataagtaaactgc

SEQ ID NO: 201014 - DNA, 22 bp, Artificial sequence
  SiRNA target sequence
aataagccataagtaaactgcc

SEQ ID NO: 201015 - DNA, 22 bp, Artificial sequence
  SiRNA target sequence
ataagccataagtaaactgccc

SEQ ID NO: 201016 - DNA, 22 bp, Artificial sequence
  SiRNA target sequence
taagccataagtaaactgcccc

SEQ ID NO: 201017 - DNA, 22 bp, Artificial sequence
  SiRNA target sequence
aagccataagtaaactgcccca

SEQ ID NO: 201018 - DNA, 22 bp, Artificial sequence
  SiRNA target sequence
agccataagtaaactgccccac

SEQ ID NO: 201019 - DNA, 22 bp, Artificial sequence
  SiRNA target sequence
gccataagtaaactgccccaca

SEQ ID NO: 201020 - DNA, 22 bp, Artificial sequence
  SiRNA target sequence
ccataagtaaactgccccacat

SEQ ID NO: 201021 - DNA, 22 bp, Artificial sequence
  SiRNA target sequence
cataagtaaactgccccacatt

SEQ ID NO: 201022 - DNA, 22 bp, Artificial sequence
  SiRNA target sequence
ataagtaaactgccccacattt

SEQ ID NO: 201023 - DNA, 22 bp, Artificial sequence
  SiRNA target sequence
taagtaaactgccccacatttc

SEQ ID NO: 201024 - DNA, 22 bp, Artificial sequence
  SiRNA target sequence
aagtaaactgccccacatttct

SEQ ID NO: 201025 - DNA, 22 bp, Artificial sequence
  SiRNA target sequence
agtaaactgccccacatttctg

SEQ ID NO: 201026 - DNA, 22 bp, Artificial sequence
  SiRNA target sequence
gtaaactgccccacatttctgc

SEQ ID NO: 201027 - DNA, 22 bp, Artificial sequence
  SiRNA target sequence
taaactgccccacatttctgct

SEQ ID NO: 201028 - DNA, 22 bp, Artificial sequence
  SiRNA target sequence
aaactgccccacatttctgcta

SEQ ID NO: 201029 - DNA, 22 bp, Artificial sequence
  SiRNA target sequence
aactgccccacatttctgctat

SEQ ID NO: 201030 - DNA, 22 bp, Artificial sequence
  SiRNA target sequence
actgccccacatttctgctatt

SEQ ID NO: 201031 - DNA, 22 bp, Artificial sequence
  SiRNA target sequence
ctgccccacatttctgctatta

SEQ ID NO: 201032 - DNA, 22 bp, Artificial sequence
  SiRNA target sequence
tgccccacatttctgctattat

SEQ ID NO: 201033 - DNA, 22 bp, Artificial sequence
  SiRNA target sequence
gccccacatttctgctattata

SEQ ID NO: 201034 - DNA, 22 bp, Artificial sequence
  SiRNA target sequence
ccccacatttctgctattataa

SEQ ID NO: 201035 - DNA, 22 bp, Artificial sequence
  SiRNA target sequence
cccacatttctgctattataaa

SEQ ID NO: 201036 - DNA, 22 bp, Artificial sequence
  SiRNA target sequence
ccacatttctgctattataaaa

SEQ ID NO: 201037 - DNA, 22 bp, Artificial sequence
  SiRNA target sequence
cacatttctgctattataaaaa

SEQ ID NO: 201038 - DNA, 22 bp, Artificial sequence
  SiRNA target sequence
acatttctgctattataaaaat

SEQ ID NO: 201039 - DNA, 22 bp, Artificial sequence
  SiRNA target sequence
catttctgctattataaaaata

SEQ ID NO: 201040 - DNA, 22 bp, Artificial sequence
  SiRNA target sequence
atttctgctattataaaaatac

SEQ ID NO: 201041 - DNA, 22 bp, Artificial sequence
  SiRNA target sequence
tttctgctattataaaaataca

SEQ ID NO: 201042 - DNA, 22 bp, Artificial sequence
  SiRNA target sequence
ttctgctattataaaaatacaa

SEQ ID NO: 201043 - DNA, 22 bp, Artificial sequence
  SiRNA target sequence
tctgctattataaaaatacaag

SEQ ID NO: 201044 - DNA, 22 bp, Artificial sequence
  SiRNA target sequence
ctgctattataaaaatacaagt

SEQ ID NO: 201045 - DNA, 22 bp, Artificial sequence
  SiRNA target sequence
tgctattataaaaatacaagtt

SEQ ID NO: 201046 - DNA, 22 bp, Artificial sequence
  SiRNA target sequence
gctattataaaaatacaagttg

SEQ ID NO: 201047 - DNA, 22 bp, Artificial sequence
  SiRNA target sequence
ctattataaaaatacaagttga

SEQ ID NO: 201048 - DNA, 22 bp, Artificial sequence
  SiRNA target sequence
tattataaaaatacaagttgaa

SEQ ID NO: 201049 - DNA, 22 bp, Artificial sequence
  SiRNA target sequence
attataaaaatacaagttgaaa

SEQ ID NO: 201050 - DNA, 22 bp, Artificial sequence
  SiRNA target sequence
ttataaaaatacaagttgaaac

SEQ ID NO: 201051 - DNA, 22 bp, Artificial sequence
  SiRNA target sequence
tataaaaatacaagttgaaacg

SEQ ID NO: 201052 - DNA, 22 bp, Artificial sequence
  SiRNA target sequence
ataaaaatacaagttgaaacgg

SEQ ID NO: 201053 - DNA, 22 bp, Artificial sequence
  SiRNA target sequence
taaaaatacaagttgaaacggg

SEQ ID NO: 201054 - DNA, 22 bp, Artificial sequence
  SiRNA target sequence
aaaaatacaagttgaaacgggc

SEQ ID NO: 201055 - DNA, 22 bp, Artificial sequence
  SiRNA target sequence
aaaatacaagttgaaacgggct

SEQ ID NO: 201056 - DNA, 22 bp, Artificial sequence
  SiRNA target sequence
aaatacaagttgaaacgggctc

SEQ ID NO: 201057 - DNA, 22 bp, Artificial sequence
  SiRNA target sequence
aatacaagttgaaacgggctcg

SEQ ID NO: 201058 - DNA, 22 bp, Artificial sequence
  SiRNA target sequence
atacaagttgaaacgggctcgt

SEQ ID NO: 201059 - DNA, 22 bp, Artificial sequence
  SiRNA target sequence
tacaagttgaaacgggctcgtt

SEQ ID NO: 201060 - DNA, 22 bp, Artificial sequence
  SiRNA target sequence
acaagttgaaacgggctcgtta

SEQ ID NO: 201061 - DNA, 22 bp, Artificial sequence
  SiRNA target sequence
caagttgaaacgggctcgttag

SEQ ID NO: 201062 - DNA, 22 bp, Artificial sequence
  SiRNA target sequence
aagttgaaacgggctcgttagc

SEQ ID NO: 201063 - DNA, 22 bp, Artificial sequence
  SiRNA target sequence
agttgaaacgggctcgttagct

SEQ ID NO: 201064 - DNA, 22 bp, Artificial sequence
  SiRNA target sequence
gttgaaacgggctcgttagctg

SEQ ID NO: 201065 - DNA, 22 bp, Artificial sequence
  SiRNA target sequence
ttgaaacgggctcgttagctgt

SEQ ID NO: 201066 - DNA, 22 bp, Artificial sequence
  SiRNA target sequence
tgaaacgggctcgttagctgta

SEQ ID NO: 201067 - DNA, 22 bp, Artificial sequence
  SiRNA target sequence
gaaacgggctcgttagctgtaa

SEQ ID NO: 201068 - DNA, 22 bp, Artificial sequence
  SiRNA target sequence
aaacgggctcgttagctgtaat

SEQ ID NO: 201069 - DNA, 22 bp, Artificial sequence
  SiRNA target sequence
aacgggctcgttagctgtaatt

SEQ ID NO: 201070 - DNA, 22 bp, Artificial sequence
  SiRNA target sequence
acgggctcgttagctgtaatta

SEQ ID NO: 201071 - DNA, 22 bp, Artificial sequence
  SiRNA target sequence
cgggctcgttagctgtaattaa

SEQ ID NO: 201072 - DNA, 22 bp, Artificial sequence
  SiRNA target sequence
gggctcgttagctgtaattaaa

SEQ ID NO: 201073 - DNA, 22 bp, Artificial sequence
  SiRNA target sequence
ggctcgttagctgtaattaaaa

SEQ ID NO: 201074 - DNA, 22 bp, Artificial sequence
  SiRNA target sequence
gctcgttagctgtaattaaaaa

SEQ ID NO: 201075 - DNA, 22 bp, Artificial sequence
  SiRNA target sequence
ctcgttagctgtaattaaaaaa

SEQ ID NO: 201076 - DNA, 22 bp, Artificial sequence
  SiRNA target sequence
tcgttagctgtaattaaaaaat

SEQ ID NO: 201077 - DNA, 22 bp, Artificial sequence
  SiRNA target sequence
cgttagctgtaattaaaaaata

SEQ ID NO: 201078 - DNA, 22 bp, Artificial sequence
  SiRNA target sequence
gttagctgtaattaaaaaatat

SEQ ID NO: 201079 - DNA, 22 bp, Artificial sequence
  SiRNA target sequence
ttagctgtaattaaaaaatatt

SEQ ID NO: 201080 - DNA, 22 bp, Artificial sequence
  SiRNA target sequence
tagctgtaattaaaaaatattt

SEQ ID NO: 201081 - DNA, 22 bp, Artificial sequence
  SiRNA target sequence
agctgtaattaaaaaatatttt

SEQ ID NO: 201082 - DNA, 22 bp, Artificial sequence
  SiRNA target sequence
gctgtaattaaaaaatatttta

SEQ ID NO: 201083 - DNA, 22 bp, Artificial sequence
  SiRNA target sequence
ctgtaattaaaaaatattttat

SEQ ID NO: 201084 - DNA, 22 bp, Artificial sequence
  SiRNA target sequence
tgtaattaaaaaatattttata

SEQ ID NO: 201085 - DNA, 22 bp, Artificial sequence
  SiRNA target sequence
gtaattaaaaaatattttataa

SEQ ID NO: 201086 - DNA, 22 bp, Artificial sequence
  SiRNA target sequence
taattaaaaaatattttataaa

SEQ ID NO: 201087 - DNA, 22 bp, Artificial sequence
  SiRNA target sequence
aattaaaaaatattttataaag

SEQ ID NO: 201088 - DNA, 22 bp, Artificial sequence
  SiRNA target sequence
attaaaaaatattttataaagt

SEQ ID NO: 201089 - DNA, 22 bp, Artificial sequence
  SiRNA target sequence
ttaaaaaatattttataaagtt

SEQ ID NO: 201090 - DNA, 22 bp, Artificial sequence
  SiRNA target sequence
taaaaaatattttataaagttc

SEQ ID NO: 201091 - DNA, 22 bp, Artificial sequence
  SiRNA target sequence
aaaaaatattttataaagttca

SEQ ID NO: 201092 - DNA, 22 bp, Artificial sequence
  SiRNA target sequence
aaaaatattttataaagttcaa

SEQ ID NO: 201093 - DNA, 22 bp, Artificial sequence
  SiRNA target sequence
aaaatattttataaagttcaat

SEQ ID NO: 201094 - DNA, 22 bp, Artificial sequence
  SiRNA target sequence
aaatattttataaagttcaatc

SEQ ID NO: 201095 - DNA, 22 bp, Artificial sequence
  SiRNA target sequence
aatattttataaagttcaatcc

SEQ ID NO: 201096 - DNA, 22 bp, Artificial sequence
  SiRNA target sequence
atattttataaagttcaatccc

SEQ ID NO: 201097 - DNA, 22 bp, Artificial sequence
  SiRNA target sequence
tattttataaagttcaatccct

SEQ ID NO: 201098 - DNA, 22 bp, Artificial sequence
  SiRNA target sequence
attttataaagttcaatccctt

SEQ ID NO: 201099 - DNA, 22 bp, Artificial sequence
  SiRNA target sequence
ttttataaagttcaatcccttc

SEQ ID NO: 201100 - DNA, 22 bp, Artificial sequence
  SiRNA target sequence
tttataaagttcaatcccttca

SEQ ID NO: 201101 - DNA, 22 bp, Artificial sequence
  SiRNA target sequence
ttataaagttcaatcccttcaa

SEQ ID NO: 201102 - DNA, 22 bp, Artificial sequence
  SiRNA target sequence
tataaagttcaatcccttcaat

SEQ ID NO: 201103 - DNA, 22 bp, Artificial sequence
  SiRNA target sequence
ataaagttcaatcccttcaatg

SEQ ID NO: 201104 - DNA, 22 bp, Artificial sequence
  SiRNA target sequence
taaagttcaatcccttcaatgc

SEQ ID NO: 201105 - DNA, 22 bp, Artificial sequence
  SiRNA target sequence
aaagttcaatcccttcaatgca

SEQ ID NO: 201106 - DNA, 22 bp, Artificial sequence
  SiRNA target sequence
aagttcaatcccttcaatgcac

SEQ ID NO: 201107 - DNA, 22 bp, Artificial sequence
  SiRNA target sequence
agttcaatcccttcaatgcacc

SEQ ID NO: 201108 - DNA, 22 bp, Artificial sequence
  SiRNA target sequence
gttcaatcccttcaatgcacct

SEQ ID NO: 201109 - DNA, 22 bp, Artificial sequence
  SiRNA target sequence
ttcaatcccttcaatgcacctt

SEQ ID NO: 201110 - DNA, 22 bp, Artificial sequence
  SiRNA target sequence
tcaatcccttcaatgcaccttt

SEQ ID NO: 201111 - DNA, 22 bp, Artificial sequence
  SiRNA target sequence
caatcccttcaatgcacctttg

SEQ ID NO: 201112 - DNA, 22 bp, Artificial sequence
  SiRNA target sequence
aatcccttcaatgcacctttgt

SEQ ID NO: 201113 - DNA, 22 bp, Artificial sequence
  SiRNA target sequence
atcccttcaatgcacctttgtt

SEQ ID NO: 201114 - DNA, 22 bp, Artificial sequence
  SiRNA target sequence
tcccttcaatgcacctttgtta

SEQ ID NO: 201115 - DNA, 22 bp, Artificial sequence
  SiRNA target sequence
cccttcaatgcacctttgttat

SEQ ID NO: 201116 - DNA, 22 bp, Artificial sequence
  SiRNA target sequence
ccttcaatgcacctttgttatc

SEQ ID NO: 201117 - DNA, 22 bp, Artificial sequence
  SiRNA target sequence
cttcaatgcacctttgttatca

SEQ ID NO: 201118 - DNA, 22 bp, Artificial sequence
  SiRNA target sequence
ttcaatgcacctttgttatcag

SEQ ID NO: 201119 - DNA, 22 bp, Artificial sequence
  SiRNA target sequence
tcaatgcacctttgttatcagc

SEQ ID NO: 201120 - DNA, 22 bp, Artificial sequence
  SiRNA target sequence
caatgcacctttgttatcagcg

SEQ ID NO: 201121 - DNA, 22 bp, Artificial sequence
  SiRNA target sequence
aatgcacctttgttatcagcga

SEQ ID NO: 201122 - DNA, 22 bp, Artificial sequence
  SiRNA target sequence
atgcacctttgttatcagcgaa

SEQ ID NO: 201123 - DNA, 22 bp, Artificial sequence
  SiRNA target sequence
tgcacctttgttatcagcgaaa

SEQ ID NO: 201124 - DNA, 22 bp, Artificial sequence
  SiRNA target sequence
gcacctttgttatcagcgaaaa

SEQ ID NO: 201125 - DNA, 22 bp, Artificial sequence
  SiRNA target sequence
cacctttgttatcagcgaaaat

SEQ ID NO: 201126 - DNA, 22 bp, Artificial sequence
  SiRNA target sequence
acctttgttatcagcgaaaata

SEQ ID NO: 201127 - DNA, 22 bp, Artificial sequence
  SiRNA target sequence
cctttgttatcagcgaaaatat

SEQ ID NO: 201128 - DNA, 22 bp, Artificial sequence
  SiRNA target sequence
ctttgttatcagcgaaaatatc

SEQ ID NO: 201129 - DNA, 22 bp, Artificial sequence
  SiRNA target sequence
tttgttatcagcgaaaatatct

SEQ ID NO: 201130 - DNA, 22 bp, Artificial sequence
  SiRNA target sequence
ttgttatcagcgaaaatatctc

SEQ ID NO: 201131 - DNA, 22 bp, Artificial sequence
  SiRNA target sequence
tgttatcagcgaaaatatctct

SEQ ID NO: 201132 - DNA, 22 bp, Artificial sequence
  SiRNA target sequence
gttatcagcgaaaatatctcta

SEQ ID NO: 201133 - DNA, 22 bp, Artificial sequence
  SiRNA target sequence
ttatcagcgaaaatatctctaa

SEQ ID NO: 201134 - DNA, 22 bp, Artificial sequence
  SiRNA target sequence
tatcagcgaaaatatctctaaa

SEQ ID NO: 201135 - DNA, 22 bp, Artificial sequence
  SiRNA target sequence
atcagcgaaaatatctctaaat

SEQ ID NO: 201136 - DNA, 22 bp, Artificial sequence
  SiRNA target sequence
tcagcgaaaatatctctaaata

SEQ ID NO: 201137 - DNA, 22 bp, Artificial sequence
  SiRNA target sequence
cagcgaaaatatctctaaataa

SEQ ID NO: 201138 - DNA, 22 bp, Artificial sequence
  SiRNA target sequence
agcgaaaatatctctaaataaa

SEQ ID NO: 201139 - DNA, 22 bp, Artificial sequence
  SiRNA target sequence
gcgaaaatatctctaaataaaa

SEQ ID NO: 201140 - DNA, 22 bp, Artificial sequence
  SiRNA target sequence
cgaaaatatctctaaataaaaa

SEQ ID NO: 201141 - DNA, 22 bp, Artificial sequence
  SiRNA target sequence
gaaaatatctctaaataaaaag

SEQ ID NO: 201142 - DNA, 22 bp, Artificial sequence
  SiRNA target sequence
aaaatatctctaaataaaaagc

SEQ ID NO: 201143 - DNA, 22 bp, Artificial sequence
  SiRNA target sequence
aaatatctctaaataaaaagct

SEQ ID NO: 201144 - DNA, 22 bp, Artificial sequence
  SiRNA target sequence
aatatctctaaataaaaagcta

SEQ ID NO: 201145 - DNA, 22 bp, Artificial sequence
  SiRNA target sequence
atatctctaaataaaaagctag

SEQ ID NO: 201146 - DNA, 22 bp, Artificial sequence
  SiRNA target sequence
tatctctaaataaaaagctaga

SEQ ID NO: 201147 - DNA, 22 bp, Artificial sequence
  SiRNA target sequence
atctctaaataaaaagctagat

SEQ ID NO: 201148 - DNA, 22 bp, Artificial sequence
  SiRNA target sequence
tctctaaataaaaagctagatg

SEQ ID NO: 201149 - DNA, 22 bp, Artificial sequence
  SiRNA target sequence
ctctaaataaaaagctagatgg

SEQ ID NO: 201150 - DNA, 22 bp, Artificial sequence
  SiRNA target sequence
tctaaataaaaagctagatggt

SEQ ID NO: 201151 - DNA, 22 bp, Artificial sequence
  SiRNA target sequence
ctaaataaaaagctagatggtg

SEQ ID NO: 201152 - DNA, 22 bp, Artificial sequence
  SiRNA target sequence
taaataaaaagctagatggtgt

SEQ ID NO: 201153 - DNA, 22 bp, Artificial sequence
  SiRNA target sequence
aaataaaaagctagatggtgtt

SEQ ID NO: 201154 - DNA, 22 bp, Artificial sequence
  SiRNA target sequence
aataaaaagctagatggtgtta

SEQ ID NO: 201155 - DNA, 22 bp, Artificial sequence
  SiRNA target sequence
ataaaaagctagatggtgttac

SEQ ID NO: 201156 - DNA, 22 bp, Artificial sequence
  SiRNA target sequence
taaaaagctagatggtgttact

SEQ ID NO: 201157 - DNA, 22 bp, Artificial sequence
  SiRNA target sequence
aaaaagctagatggtgttactt

SEQ ID NO: 201158 - DNA, 22 bp, Artificial sequence
  SiRNA target sequence
aaaagctagatggtgttacttt

SEQ ID NO: 201159 - DNA, 22 bp, Artificial sequence
  SiRNA target sequence
aaagctagatggtgttactttc

SEQ ID NO: 201160 - DNA, 22 bp, Artificial sequence
  SiRNA target sequence
aagctagatggtgttactttct

SEQ ID NO: 201161 - DNA, 22 bp, Artificial sequence
  SiRNA target sequence
agctagatggtgttactttctc

SEQ ID NO: 201162 - DNA, 22 bp, Artificial sequence
  SiRNA target sequence
gctagatggtgttactttctct

SEQ ID NO: 201163 - DNA, 22 bp, Artificial sequence
  SiRNA target sequence
ctagatggtgttactttctctt

SEQ ID NO: 201164 - DNA, 22 bp, Artificial sequence
  SiRNA target sequence
tagatggtgttactttctcttc

SEQ ID NO: 201165 - DNA, 22 bp, Artificial sequence
  SiRNA target sequence
agatggtgttactttctcttca

SEQ ID NO: 201166 - DNA, 22 bp, Artificial sequence
  SiRNA target sequence
gatggtgttactttctcttcaa

SEQ ID NO: 201167 - DNA, 22 bp, Artificial sequence
  SiRNA target sequence
atggtgttactttctcttcaaa

SEQ ID NO: 201168 - DNA, 22 bp, Artificial sequence
  SiRNA target sequence
tggtgttactttctcttcaaac

SEQ ID NO: 201169 - DNA, 22 bp, Artificial sequence
  SiRNA target sequence
ggtgttactttctcttcaaaca

SEQ ID NO: 201170 - DNA, 22 bp, Artificial sequence
  SiRNA target sequence
gtgttactttctcttcaaacaa

SEQ ID NO: 201171 - DNA, 22 bp, Artificial sequence
  SiRNA target sequence
tgttactttctcttcaaacaaa

SEQ ID NO: 201172 - DNA, 22 bp, Artificial sequence
  SiRNA target sequence
gttactttctcttcaaacaaaa

SEQ ID NO: 201173 - DNA, 22 bp, Artificial sequence
  SiRNA target sequence
ttactttctcttcaaacaaaaa

SEQ ID NO: 201174 - DNA, 22 bp, Artificial sequence
  SiRNA target sequence
tactttctcttcaaacaaaaag

SEQ ID NO: 201175 - DNA, 22 bp, Artificial sequence
  SiRNA target sequence
actttctcttcaaacaaaaaga

SEQ ID NO: 201176 - DNA, 22 bp, Artificial sequence
  SiRNA target sequence
ctttctcttcaaacaaaaagat

SEQ ID NO: 201177 - DNA, 22 bp, Artificial sequence
  SiRNA target sequence
tttctcttcaaacaaaaagatt

SEQ ID NO: 201178 - DNA, 22 bp, Artificial sequence
  SiRNA target sequence
ttctcttcaaacaaaaagattg

SEQ ID NO: 201179 - DNA, 22 bp, Artificial sequence
  SiRNA target sequence
tctcttcaaacaaaaagattgc

SEQ ID NO: 201180 - DNA, 22 bp, Artificial sequence
  SiRNA target sequence
ctcttcaaacaaaaagattgcc

SEQ ID NO: 201181 - DNA, 22 bp, Artificial sequence
  SiRNA target sequence
tcttcaaacaaaaagattgccc

SEQ ID NO: 201182 - DNA, 22 bp, Artificial sequence
  SiRNA target sequence
cttcaaacaaaaagattgcccc

SEQ ID NO: 201183 - DNA, 22 bp, Artificial sequence
  SiRNA target sequence
ttcaaacaaaaagattgcccct

SEQ ID NO: 201184 - DNA, 22 bp, Artificial sequence
  SiRNA target sequence
tcaaacaaaaagattgccccta

SEQ ID NO: 201185 - DNA, 22 bp, Artificial sequence
  SiRNA target sequence
caaacaaaaagattgcccctag

SEQ ID NO: 201186 - DNA, 22 bp, Artificial sequence
  SiRNA target sequence
aaacaaaaagattgcccctagt

SEQ ID NO: 201187 - DNA, 22 bp, Artificial sequence
  SiRNA target sequence
aacaaaaagattgcccctagtc

SEQ ID NO: 201188 - DNA, 22 bp, Artificial sequence
  SiRNA target sequence
acaaaaagattgcccctagtcc

SEQ ID NO: 201189 - DNA, 22 bp, Artificial sequence
  SiRNA target sequence
caaaaagattgcccctagtccg

SEQ ID NO: 201190 - DNA, 22 bp, Artificial sequence
  SiRNA target sequence
aaaaagattgcccctagtccga

SEQ ID NO: 201191 - DNA, 22 bp, Artificial sequence
  SiRNA target sequence
aaaagattgcccctagtccgaa

SEQ ID NO: 201192 - DNA, 22 bp, Artificial sequence
  SiRNA target sequence
aaagattgcccctagtccgaag

SEQ ID NO: 201193 - DNA, 22 bp, Artificial sequence
  SiRNA target sequence
aagattgcccctagtccgaaga

SEQ ID NO: 201194 - DNA, 22 bp, Artificial sequence
  SiRNA target sequence
agattgcccctagtccgaagaa

SEQ ID NO: 201195 - DNA, 22 bp, Artificial sequence
  SiRNA target sequence
gattgcccctagtccgaagaaa

SEQ ID NO: 201196 - DNA, 22 bp, Artificial sequence
  SiRNA target sequence
attgcccctagtccgaagaaaa

SEQ ID NO: 201197 - DNA, 22 bp, Artificial sequence
  SiRNA target sequence
ttgcccctagtccgaagaaaaa

SEQ ID NO: 201198 - DNA, 22 bp, Artificial sequence
  SiRNA target sequence
tgcccctagtccgaagaaaaat

SEQ ID NO: 201199 - DNA, 22 bp, Artificial sequence
  SiRNA target sequence
gcccctagtccgaagaaaaatg

SEQ ID NO: 201200 - DNA, 22 bp, Artificial sequence
  SiRNA target sequence
cccctagtccgaagaaaaatgc

SEQ ID NO: 201201 - DNA, 22 bp, Artificial sequence
  SiRNA target sequence
ccctagtccgaagaaaaatgca

SEQ ID NO: 201202 - DNA, 22 bp, Artificial sequence
  SiRNA target sequence
cctagtccgaagaaaaatgcag

SEQ ID NO: 201203 - DNA, 22 bp, Artificial sequence
  SiRNA target sequence
ctagtccgaagaaaaatgcagt

SEQ ID NO: 201204 - DNA, 22 bp, Artificial sequence
  SiRNA target sequence
tagtccgaagaaaaatgcagta

SEQ ID NO: 201205 - DNA, 22 bp, Artificial sequence
  SiRNA target sequence
agtccgaagaaaaatgcagtaa

SEQ ID NO: 201206 - DNA, 22 bp, Artificial sequence
  SiRNA target sequence
gtccgaagaaaaatgcagtaaa

SEQ ID NO: 201207 - DNA, 22 bp, Artificial sequence
  SiRNA target sequence
tccgaagaaaaatgcagtaaaa

SEQ ID NO: 201208 - DNA, 22 bp, Artificial sequence
  SiRNA target sequence
ccgaagaaaaatgcagtaaaaa

SEQ ID NO: 201209 - DNA, 22 bp, Artificial sequence
  SiRNA target sequence
cgaagaaaaatgcagtaaaaat

SEQ ID NO: 201210 - DNA, 22 bp, Artificial sequence
  SiRNA target sequence
gaagaaaaatgcagtaaaaatt

SEQ ID NO: 201211 - DNA, 22 bp, Artificial sequence
  SiRNA target sequence
aagaaaaatgcagtaaaaatta

SEQ ID NO: 201212 - DNA, 22 bp, Artificial sequence
  SiRNA target sequence
agaaaaatgcagtaaaaattat

SEQ ID NO: 201213 - DNA, 22 bp, Artificial sequence
  SiRNA target sequence
gaaaaatgcagtaaaaattatt

SEQ ID NO: 201214 - DNA, 22 bp, Artificial sequence
  SiRNA target sequence
aaaaatgcagtaaaaattatta

SEQ ID NO: 201215 - DNA, 22 bp, Artificial sequence
  SiRNA target sequence
aaaatgcagtaaaaattattag

SEQ ID NO: 201216 - DNA, 22 bp, Artificial sequence
  SiRNA target sequence
aaatgcagtaaaaattattaga

SEQ ID NO: 201217 - DNA, 22 bp, Artificial sequence
  SiRNA target sequence
aatgcagtaaaaattattagaa

SEQ ID NO: 201218 - DNA, 22 bp, Artificial sequence
  SiRNA target sequence
atgcagtaaaaattattagaaa

SEQ ID NO: 201219 - DNA, 22 bp, Artificial sequence
  SiRNA target sequence
tgcagtaaaaattattagaaat

SEQ ID NO: 201220 - DNA, 22 bp, Artificial sequence
  SiRNA target sequence
gcagtaaaaattattagaaata

SEQ ID NO: 201221 - DNA, 22 bp, Artificial sequence
  SiRNA target sequence
cagtaaaaattattagaaatag

SEQ ID NO: 201222 - DNA, 22 bp, Artificial sequence
  SiRNA target sequence
agtaaaaattattagaaataga

SEQ ID NO: 201223 - DNA, 22 bp, Artificial sequence
  SiRNA target sequence
gtaaaaattattagaaatagat

SEQ ID NO: 201224 - DNA, 22 bp, Artificial sequence
  SiRNA target sequence
taaaaattattagaaatagatt

SEQ ID NO: 201225 - DNA, 22 bp, Artificial sequence
  SiRNA target sequence
aaaaattattagaaatagatta

SEQ ID NO: 201226 - DNA, 22 bp, Artificial sequence
  SiRNA target sequence
aaaattattagaaatagattaa

SEQ ID NO: 201227 - DNA, 22 bp, Artificial sequence
  SiRNA target sequence
aaattattagaaatagattaaa

SEQ ID NO: 201228 - DNA, 22 bp, Artificial sequence
  SiRNA target sequence
aattattagaaatagattaaaa

SEQ ID NO: 201229 - DNA, 22 bp, Artificial sequence
  SiRNA target sequence
attattagaaatagattaaaaa

SEQ ID NO: 201230 - DNA, 22 bp, Artificial sequence
  SiRNA target sequence
ttattagaaatagattaaaaat

SEQ ID NO: 201231 - DNA, 22 bp, Artificial sequence
  SiRNA target sequence
tattagaaatagattaaaaatc

SEQ ID NO: 201232 - DNA, 22 bp, Artificial sequence
  SiRNA target sequence
attagaaatagattaaaaatcg

SEQ ID NO: 201233 - DNA, 22 bp, Artificial sequence
  SiRNA target sequence
ttagaaatagattaaaaatcga

SEQ ID NO: 201234 - DNA, 22 bp, Artificial sequence
  SiRNA target sequence
tagaaatagattaaaaatcgat

SEQ ID NO: 201235 - DNA, 22 bp, Artificial sequence
  SiRNA target sequence
agaaatagattaaaaatcgatg

SEQ ID NO: 201236 - DNA, 22 bp, Artificial sequence
  SiRNA target sequence
gaaatagattaaaaatcgatga

SEQ ID NO: 201237 - DNA, 22 bp, Artificial sequence
  SiRNA target sequence
aaatagattaaaaatcgatgat

SEQ ID NO: 201238 - DNA, 22 bp, Artificial sequence
  SiRNA target sequence
aatagattaaaaatcgatgata

SEQ ID NO: 201239 - DNA, 22 bp, Artificial sequence
  SiRNA target sequence
atagattaaaaatcgatgatac

SEQ ID NO: 201240 - DNA, 22 bp, Artificial sequence
  SiRNA target sequence
tagattaaaaatcgatgataca

SEQ ID NO: 201241 - DNA, 22 bp, Artificial sequence
  SiRNA target sequence
agattaaaaatcgatgatacag

SEQ ID NO: 201242 - DNA, 22 bp, Artificial sequence
  SiRNA target sequence
gattaaaaatcgatgatacagg

SEQ ID NO: 201243 - DNA, 22 bp, Artificial sequence
  SiRNA target sequence
attaaaaatcgatgatacaggt

SEQ ID NO: 201244 - DNA, 22 bp, Artificial sequence
  SiRNA target sequence
ttaaaaatcgatgatacaggtt

SEQ ID NO: 201245 - DNA, 22 bp, Artificial sequence
  SiRNA target sequence
taaaaatcgatgatacaggttt

SEQ ID NO: 201246 - DNA, 22 bp, Artificial sequence
  SiRNA target sequence
aaaaatcgatgatacaggttta

SEQ ID NO: 201247 - DNA, 22 bp, Artificial sequence
  SiRNA target sequence
aaaatcgatgatacaggtttat

SEQ ID NO: 201248 - DNA, 22 bp, Artificial sequence
  SiRNA target sequence
aaatcgatgatacaggtttatt

SEQ ID NO: 201249 - DNA, 22 bp, Artificial sequence
  SiRNA target sequence
aatcgatgatacaggtttattt

SEQ ID NO: 201250 - DNA, 22 bp, Artificial sequence
  SiRNA target sequence
atcgatgatacaggtttatttt

SEQ ID NO: 201251 - DNA, 22 bp, Artificial sequence
  SiRNA target sequence
tcgatgatacaggtttattttg

SEQ ID NO: 201252 - DNA, 22 bp, Artificial sequence
  SiRNA target sequence
cgatgatacaggtttattttgc

SEQ ID NO: 201253 - DNA, 22 bp, Artificial sequence
  SiRNA target sequence
gatgatacaggtttattttgca

SEQ ID NO: 201254 - DNA, 22 bp, Artificial sequence
  SiRNA target sequence
atgatacaggtttattttgcat

SEQ ID NO: 201255 - DNA, 22 bp, Artificial sequence
  SiRNA target sequence
tgatacaggtttattttgcata

SEQ ID NO: 201256 - DNA, 22 bp, Artificial sequence
  SiRNA target sequence
gatacaggtttattttgcataa

SEQ ID NO: 201257 - DNA, 22 bp, Artificial sequence
  SiRNA target sequence
atacaggtttattttgcataag

SEQ ID NO: 201258 - DNA, 22 bp, Artificial sequence
  SiRNA target sequence
tacaggtttattttgcataagc

SEQ ID NO: 201259 - DNA, 22 bp, Artificial sequence
  SiRNA target sequence
acaggtttattttgcataagcc

SEQ ID NO: 201260 - DNA, 22 bp, Artificial sequence
  SiRNA target sequence
caggtttattttgcataagcca

SEQ ID NO: 201261 - DNA, 22 bp, Artificial sequence
  SiRNA target sequence
aggtttattttgcataagccac

SEQ ID NO: 201262 - DNA, 22 bp, Artificial sequence
  SiRNA target sequence
ggtttattttgcataagccact

SEQ ID NO: 201263 - DNA, 22 bp, Artificial sequence
  SiRNA target sequence
gtttattttgcataagccactg

SEQ ID NO: 201264 - DNA, 22 bp, Artificial sequence
  SiRNA target sequence
tttattttgcataagccactgt

SEQ ID NO: 201265 - DNA, 22 bp, Artificial sequence
  SiRNA target sequence
ttattttgcataagccactgta

SEQ ID NO: 201266 - DNA, 22 bp, Artificial sequence
  SiRNA target sequence
tattttgcataagccactgtat

SEQ ID NO: 201267 - DNA, 22 bp, Artificial sequence
  SiRNA target sequence
attttgcataagccactgtatt

SEQ ID NO: 201268 - DNA, 22 bp, Artificial sequence
  SiRNA target sequence
ttttgcataagccactgtatta

SEQ ID NO: 201269 - DNA, 22 bp, Artificial sequence
  SiRNA target sequence
tttgcataagccactgtattaa

SEQ ID NO: 201270 - DNA, 22 bp, Artificial sequence
  SiRNA target sequence
ttgcataagccactgtattaaa

SEQ ID NO: 201271 - DNA, 22 bp, Artificial sequence
  SiRNA target sequence
tgcataagccactgtattaaaa

SEQ ID NO: 201272 - DNA, 22 bp, Artificial sequence
  SiRNA target sequence
gcataagccactgtattaaaat

SEQ ID NO: 201273 - DNA, 22 bp, Artificial sequence
  SiRNA target sequence
cataagccactgtattaaaatt

SEQ ID NO: 201274 - DNA, 22 bp, Artificial sequence
  SiRNA target sequence
ataagccactgtattaaaatta

SEQ ID NO: 201275 - DNA, 22 bp, Artificial sequence
  SiRNA target sequence
taagccactgtattaaaattac

SEQ ID NO: 201276 - DNA, 22 bp, Artificial sequence
  SiRNA target sequence
aagccactgtattaaaattaca

SEQ ID NO: 201277 - DNA, 22 bp, Artificial sequence
  SiRNA target sequence
agccactgtattaaaattacag

SEQ ID NO: 201278 - DNA, 22 bp, Artificial sequence
  SiRNA target sequence
gccactgtattaaaattacaga

SEQ ID NO: 201279 - DNA, 22 bp, Artificial sequence
  SiRNA target sequence
ccactgtattaaaattacagat

SEQ ID NO: 201280 - DNA, 22 bp, Artificial sequence
  SiRNA target sequence
cactgtattaaaattacagatg

SEQ ID NO: 201281 - DNA, 22 bp, Artificial sequence
  SiRNA target sequence
actgtattaaaattacagatgc

SEQ ID NO: 201282 - DNA, 22 bp, Artificial sequence
  SiRNA target sequence
ctgtattaaaattacagatgca

SEQ ID NO: 201283 - DNA, 22 bp, Artificial sequence
  SiRNA target sequence
tgtattaaaattacagatgcaa

SEQ ID NO: 201284 - DNA, 22 bp, Artificial sequence
  SiRNA target sequence
gtattaaaattacagatgcaaa

SEQ ID NO: 201285 - DNA, 22 bp, Artificial sequence
  SiRNA target sequence
tattaaaattacagatgcaaaa

SEQ ID NO: 201286 - DNA, 22 bp, Artificial sequence
  SiRNA target sequence
attaaaattacagatgcaaaag

SEQ ID NO: 201287 - DNA, 22 bp, Artificial sequence
  SiRNA target sequence
ttaaaattacagatgcaaaaga

SEQ ID NO: 201288 - DNA, 22 bp, Artificial sequence
  SiRNA target sequence
taaaattacagatgcaaaagat

SEQ ID NO: 201289 - DNA, 22 bp, Artificial sequence
  SiRNA target sequence
aaaattacagatgcaaaagata

SEQ ID NO: 201290 - DNA, 22 bp, Artificial sequence
  SiRNA target sequence
aaattacagatgcaaaagatat

SEQ ID NO: 201291 - DNA, 22 bp, Artificial sequence
  SiRNA target sequence
aattacagatgcaaaagatata

SEQ ID NO: 201292 - DNA, 22 bp, Artificial sequence
  SiRNA target sequence
attacagatgcaaaagatatag

SEQ ID NO: 201293 - DNA, 22 bp, Artificial sequence
  SiRNA target sequence
ttacagatgcaaaagatatagg

SEQ ID NO: 201294 - DNA, 22 bp, Artificial sequence
  SiRNA target sequence
tacagatgcaaaagatatagga

SEQ ID NO: 201295 - DNA, 22 bp, Artificial sequence
  SiRNA target sequence
acagatgcaaaagatataggaa

SEQ ID NO: 201296 - DNA, 22 bp, Artificial sequence
  SiRNA target sequence
cagatgcaaaagatataggaag

SEQ ID NO: 201297 - DNA, 22 bp, Artificial sequence
  SiRNA target sequence
agatgcaaaagatataggaaga

SEQ ID NO: 201298 - DNA, 22 bp, Artificial sequence
  SiRNA target sequence
gatgcaaaagatataggaagaa

SEQ ID NO: 201299 - DNA, 22 bp, Artificial sequence
  SiRNA target sequence
atgcaaaagatataggaagaac

SEQ ID NO: 201300 - DNA, 22 bp, Artificial sequence
  SiRNA target sequence
tgcaaaagatataggaagaaca

SEQ ID NO: 201301 - DNA, 22 bp, Artificial sequence
  SiRNA target sequence
gcaaaagatataggaagaacat

SEQ ID NO: 201302 - DNA, 22 bp, Artificial sequence
  SiRNA target sequence
caaaagatataggaagaacata

SEQ ID NO: 201303 - DNA, 22 bp, Artificial sequence
  SiRNA target sequence
aaaagatataggaagaacataa

SEQ ID NO: 201304 - DNA, 22 bp, Artificial sequence
  SiRNA target sequence
aaagatataggaagaacataaa

SEQ ID NO: 201305 - DNA, 22 bp, Artificial sequence
  SiRNA target sequence
aagatataggaagaacataaaa

SEQ ID NO: 201306 - DNA, 22 bp, Artificial sequence
  SiRNA target sequence
agatataggaagaacataaaaa

SEQ ID NO: 201307 - DNA, 22 bp, Artificial sequence
  SiRNA target sequence
gatataggaagaacataaaaaa

SEQ ID NO: 201308 - DNA, 22 bp, Artificial sequence
  SiRNA target sequence
atataggaagaacataaaaaat

SEQ ID NO: 201309 - DNA, 22 bp, Artificial sequence
  SiRNA target sequence
tataggaagaacataaaaaatt

SEQ ID NO: 201310 - DNA, 22 bp, Artificial sequence
  SiRNA target sequence
ataggaagaacataaaaaattt

SEQ ID NO: 201311 - DNA, 22 bp, Artificial sequence
  SiRNA target sequence
taggaagaacataaaaaatttt

SEQ ID NO: 201312 - DNA, 22 bp, Artificial sequence
  SiRNA target sequence
aggaagaacataaaaaattttc

SEQ ID NO: 201313 - DNA, 22 bp, Artificial sequence
  SiRNA target sequence
ggaagaacataaaaaattttca

SEQ ID NO: 201314 - DNA, 22 bp, Artificial sequence
  SiRNA target sequence
gaagaacataaaaaattttcat

SEQ ID NO: 201315 - DNA, 22 bp, Artificial sequence
  SiRNA target sequence
aagaacataaaaaattttcata

SEQ ID NO: 201316 - DNA, 22 bp, Artificial sequence
  SiRNA target sequence
agaacataaaaaattttcataa

SEQ ID NO: 201317 - DNA, 22 bp, Artificial sequence
  SiRNA target sequence
gaacataaaaaattttcataaa

SEQ ID NO: 201318 - DNA, 22 bp, Artificial sequence
  SiRNA target sequence
aacataaaaaattttcataaac

SEQ ID NO: 201319 - DNA, 22 bp, Artificial sequence
  SiRNA target sequence
acataaaaaattttcataaaca

SEQ ID NO: 201320 - DNA, 22 bp, Artificial sequence
  SiRNA target sequence
cataaaaaattttcataaacat

SEQ ID NO: 201321 - DNA, 22 bp, Artificial sequence
  SiRNA target sequence
ataaaaaattttcataaacata

SEQ ID NO: 201322 - DNA, 22 bp, Artificial sequence
  SiRNA target sequence
taaaaaattttcataaacataa

SEQ ID NO: 201323 - DNA, 22 bp, Artificial sequence
  SiRNA target sequence
aaaaaattttcataaacataat

SEQ ID NO: 201324 - DNA, 22 bp, Artificial sequence
  SiRNA target sequence
aaaaattttcataaacataatt

SEQ ID NO: 201325 - DNA, 22 bp, Artificial sequence
  SiRNA target sequence
aaaattttcataaacataattg

SEQ ID NO: 201326 - DNA, 22 bp, Artificial sequence
  SiRNA target sequence
aaattttcataaacataattga

SEQ ID NO: 201327 - DNA, 22 bp, Artificial sequence
  SiRNA target sequence
aattttcataaacataattgaa

SEQ ID NO: 201328 - DNA, 22 bp, Artificial sequence
  SiRNA target sequence
attttcataaacataattgaat

SEQ ID NO: 201329 - DNA, 22 bp, Artificial sequence
  SiRNA target sequence
ttttcataaacataattgaatt

SEQ ID NO: 201330 - DNA, 22 bp, Artificial sequence
  SiRNA target sequence
tttcataaacataattgaattc

SEQ ID NO: 201331 - DNA, 22 bp, Artificial sequence
  SiRNA target sequence
ttcataaacataattgaattct

SEQ ID NO: 201332 - DNA, 22 bp, Artificial sequence
  SiRNA target sequence
tcataaacataattgaattctg

SEQ ID NO: 201333 - DNA, 22 bp, Artificial sequence
  SiRNA target sequence
cataaacataattgaattctga

SEQ ID NO: 201334 - DNA, 22 bp, Artificial sequence
  SiRNA target sequence
ataaacataattgaattctgat

SEQ ID NO: 201335 - DNA, 22 bp, Artificial sequence
  SiRNA target sequence
taaacataattgaattctgatc

SEQ ID NO: 201336 - DNA, 22 bp, Artificial sequence
  SiRNA target sequence
aaacataattgaattctgatct

SEQ ID NO: 201337 - DNA, 22 bp, Artificial sequence
  SiRNA target sequence
aacataattgaattctgatctt

SEQ ID NO: 201338 - DNA, 22 bp, Artificial sequence
  SiRNA target sequence
acataattgaattctgatcttg

SEQ ID NO: 201339 - DNA, 22 bp, Artificial sequence
  SiRNA target sequence
cataattgaattctgatcttgc

SEQ ID NO: 201340 - DNA, 22 bp, Artificial sequence
  SiRNA target sequence
ataattgaattctgatcttgcc

SEQ ID NO: 201341 - DNA, 22 bp, Artificial sequence
  SiRNA target sequence
taattgaattctgatcttgcct

SEQ ID NO: 201342 - DNA, 22 bp, Artificial sequence
  SiRNA target sequence
aattgaattctgatcttgcctt

SEQ ID NO: 201343 - DNA, 22 bp, Artificial sequence
  SiRNA target sequence
attgaattctgatcttgcctta

SEQ ID NO: 201344 - DNA, 22 bp, Artificial sequence
  SiRNA target sequence
ttgaattctgatcttgccttac

SEQ ID NO: 201345 - DNA, 22 bp, Artificial sequence
  SiRNA target sequence
tgaattctgatcttgccttacc

SEQ ID NO: 201346 - DNA, 22 bp, Artificial sequence
  SiRNA target sequence
gaattctgatcttgccttacca

SEQ ID NO: 201347 - DNA, 22 bp, Artificial sequence
  SiRNA target sequence
aattctgatcttgccttaccat

SEQ ID NO: 201348 - DNA, 22 bp, Artificial sequence
  SiRNA target sequence
attctgatcttgccttaccatc

SEQ ID NO: 201349 - DNA, 22 bp, Artificial sequence
  SiRNA target sequence
ttctgatcttgccttaccatca

SEQ ID NO: 201350 - DNA, 22 bp, Artificial sequence
  SiRNA target sequence
tctgatcttgccttaccatcac

SEQ ID NO: 201351 - DNA, 22 bp, Artificial sequence
  SiRNA target sequence
ctgatcttgccttaccatcaca

SEQ ID NO: 201352 - DNA, 22 bp, Artificial sequence
  SiRNA target sequence
tgatcttgccttaccatcacaa

SEQ ID NO: 201353 - DNA, 22 bp, Artificial sequence
  SiRNA target sequence
gatcttgccttaccatcacaaa

SEQ ID NO: 201354 - DNA, 22 bp, Artificial sequence
  SiRNA target sequence
atcttgccttaccatcacaaat

SEQ ID NO: 201355 - DNA, 22 bp, Artificial sequence
  SiRNA target sequence
tcttgccttaccatcacaaata

SEQ ID NO: 201356 - DNA, 22 bp, Artificial sequence
  SiRNA target sequence
cttgccttaccatcacaaataa

SEQ ID NO: 201357 - DNA, 22 bp, Artificial sequence
  SiRNA target sequence
ttgccttaccatcacaaataaa

SEQ ID NO: 201358 - DNA, 22 bp, Artificial sequence
  SiRNA target sequence
tgccttaccatcacaaataaat

SEQ ID NO: 201359 - DNA, 22 bp, Artificial sequence
  SiRNA target sequence
gccttaccatcacaaataaatc

SEQ ID NO: 201360 - DNA, 22 bp, Artificial sequence
  SiRNA target sequence
ccttaccatcacaaataaatct

SEQ ID NO: 201361 - DNA, 22 bp, Artificial sequence
  SiRNA target sequence
cttaccatcacaaataaatctt

SEQ ID NO: 201362 - DNA, 22 bp, Artificial sequence
  SiRNA target sequence
ttaccatcacaaataaatcttt

SEQ ID NO: 201363 - DNA, 22 bp, Artificial sequence
  SiRNA target sequence
taccatcacaaataaatctttt

SEQ ID NO: 201364 - DNA, 22 bp, Artificial sequence
  SiRNA target sequence
accatcacaaataaatctttta

SEQ ID NO: 201365 - DNA, 22 bp, Artificial sequence
  SiRNA target sequence
ccatcacaaataaatcttttaa

SEQ ID NO: 201366 - DNA, 22 bp, Artificial sequence
  SiRNA target sequence
catcacaaataaatcttttaaa

SEQ ID NO: 201367 - DNA, 22 bp, Artificial sequence
  SiRNA target sequence
atcacaaataaatcttttaaaa

SEQ ID NO: 201368 - DNA, 22 bp, Artificial sequence
  SiRNA target sequence
tcacaaataaatcttttaaaat

SEQ ID NO: 201369 - DNA, 22 bp, Artificial sequence
  SiRNA target sequence
cacaaataaatcttttaaaatt

SEQ ID NO: 201370 - DNA, 22 bp, Artificial sequence
  SiRNA target sequence
acaaataaatcttttaaaattc

SEQ ID NO: 201371 - DNA, 22 bp, Artificial sequence
  SiRNA target sequence
caaataaatcttttaaaattct

SEQ ID NO: 201372 - DNA, 22 bp, Artificial sequence
  SiRNA target sequence
aaataaatcttttaaaattctt

SEQ ID NO: 201373 - DNA, 22 bp, Artificial sequence
  SiRNA target sequence
aataaatcttttaaaattctta

SEQ ID NO: 201374 - DNA, 22 bp, Artificial sequence
  SiRNA target sequence
ataaatcttttaaaattcttaa

SEQ ID NO: 201375 - DNA, 22 bp, Artificial sequence
  SiRNA target sequence
taaatcttttaaaattcttaaa

SEQ ID NO: 201376 - DNA, 22 bp, Artificial sequence
  SiRNA target sequence
aaatcttttaaaattcttaaaa

SEQ ID NO: 201377 - DNA, 22 bp, Artificial sequence
  SiRNA target sequence
aatcttttaaaattcttaaaaa

SEQ ID NO: 201378 - DNA, 22 bp, Artificial sequence
  SiRNA target sequence
atcttttaaaattcttaaaaat

SEQ ID NO: 201379 - DNA, 22 bp, Artificial sequence
  SiRNA target sequence
tcttttaaaattcttaaaaatg

SEQ ID NO: 201380 - DNA, 22 bp, Artificial sequence
  SiRNA target sequence
cttttaaaattcttaaaaatga

SEQ ID NO: 201381 - DNA, 22 bp, Artificial sequence
  SiRNA target sequence
ttttaaaattcttaaaaatgaa

SEQ ID NO: 201382 - DNA, 22 bp, Artificial sequence
  SiRNA target sequence
tttaaaattcttaaaaatgaat

SEQ ID NO: 201383 - DNA, 22 bp, Artificial sequence
  SiRNA target sequence
ttaaaattcttaaaaatgaata

SEQ ID NO: 201384 - DNA, 22 bp, Artificial sequence
  SiRNA target sequence
taaaattcttaaaaatgaatac

SEQ ID NO: 201385 - DNA, 22 bp, Artificial sequence
  SiRNA target sequence
aaaattcttaaaaatgaataca

SEQ ID NO: 201386 - DNA, 22 bp, Artificial sequence
  SiRNA target sequence
aaattcttaaaaatgaatacac

SEQ ID NO: 201387 - DNA, 22 bp, Artificial sequence
  SiRNA target sequence
aattcttaaaaatgaatacaca

SEQ ID NO: 201388 - DNA, 22 bp, Artificial sequence
  SiRNA target sequence
attcttaaaaatgaatacacaa

SEQ ID NO: 201389 - DNA, 22 bp, Artificial sequence
  SiRNA target sequence
ttcttaaaaatgaatacacaaa

SEQ ID NO: 201390 - DNA, 22 bp, Artificial sequence
  SiRNA target sequence
tcttaaaaatgaatacacaaag

SEQ ID NO: 201391 - DNA, 22 bp, Artificial sequence
  SiRNA target sequence
cttaaaaatgaatacacaaagt

SEQ ID NO: 201392 - DNA, 22 bp, Artificial sequence
  SiRNA target sequence
ttaaaaatgaatacacaaagtt

SEQ ID NO: 201393 - DNA, 22 bp, Artificial sequence
  SiRNA target sequence
taaaaatgaatacacaaagtta

SEQ ID NO: 201394 - DNA, 22 bp, Artificial sequence
  SiRNA target sequence
aaaaatgaatacacaaagttaa

SEQ ID NO: 201395 - DNA, 22 bp, Artificial sequence
  SiRNA target sequence
aaaatgaatacacaaagttaat

SEQ ID NO: 201396 - DNA, 22 bp, Artificial sequence
  SiRNA target sequence
aaatgaatacacaaagttaatt

SEQ ID NO: 201397 - DNA, 22 bp, Artificial sequence
  SiRNA target sequence
aatgaatacacaaagttaatta

SEQ ID NO: 201398 - DNA, 22 bp, Artificial sequence
  SiRNA target sequence
atgaatacacaaagttaattaa

SEQ ID NO: 201399 - DNA, 22 bp, Artificial sequence
  SiRNA target sequence
tgaatacacaaagttaattaat

SEQ ID NO: 201400 - DNA, 22 bp, Artificial sequence
  SiRNA target sequence
gaatacacaaagttaattaatc

SEQ ID NO: 201401 - DNA, 22 bp, Artificial sequence
  SiRNA target sequence
aatacacaaagttaattaatcc

SEQ ID NO: 201402 - DNA, 22 bp, Artificial sequence
  SiRNA target sequence
atacacaaagttaattaatcca

SEQ ID NO: 201403 - DNA, 22 bp, Artificial sequence
  SiRNA target sequence
tacacaaagttaattaatccaa

SEQ ID NO: 201404 - DNA, 22 bp, Artificial sequence
  SiRNA target sequence
acacaaagttaattaatccaaa

SEQ ID NO: 201405 - DNA, 22 bp, Artificial sequence
  SiRNA target sequence
cacaaagttaattaatccaaac

SEQ ID NO: 201406 - DNA, 22 bp, Artificial sequence
  SiRNA target sequence
acaaagttaattaatccaaaca

SEQ ID NO: 201407 - DNA, 22 bp, Artificial sequence
  SiRNA target sequence
caaagttaattaatccaaacat

SEQ ID NO: 201408 - DNA, 22 bp, Artificial sequence
  SiRNA target sequence
aaagttaattaatccaaacata

SEQ ID NO: 201409 - DNA, 22 bp, Artificial sequence
  SiRNA target sequence
aagttaattaatccaaacataa

SEQ ID NO: 201410 - DNA, 22 bp, Artificial sequence
  SiRNA target sequence
agttaattaatccaaacataat

SEQ ID NO: 201411 - DNA, 22 bp, Artificial sequence
  SiRNA target sequence
gttaattaatccaaacataata

SEQ ID NO: 201412 - DNA, 22 bp, Artificial sequence
  SiRNA target sequence
ttaattaatccaaacataatac

SEQ ID NO: 201413 - DNA, 22 bp, Artificial sequence
  SiRNA target sequence
taattaatccaaacataatacc

SEQ ID NO: 201414 - DNA, 22 bp, Artificial sequence
  SiRNA target sequence
aattaatccaaacataatacca

SEQ ID NO: 201415 - DNA, 22 bp, Artificial sequence
  SiRNA target sequence
attaatccaaacataataccaa

SEQ ID NO: 201416 - DNA, 22 bp, Artificial sequence
  SiRNA target sequence
ttaatccaaacataataccaag

SEQ ID NO: 201417 - DNA, 22 bp, Artificial sequence
  SiRNA target sequence
taatccaaacataataccaagt

SEQ ID NO: 201418 - DNA, 22 bp, Artificial sequence
  SiRNA target sequence
aatccaaacataataccaagta

SEQ ID NO: 201419 - DNA, 22 bp, Artificial sequence
  SiRNA target sequence
atccaaacataataccaagtat

SEQ ID NO: 201420 - DNA, 22 bp, Artificial sequence
  SiRNA target sequence
tccaaacataataccaagtata

SEQ ID NO: 201421 - DNA, 22 bp, Artificial sequence
  SiRNA target sequence
ccaaacataataccaagtataa

SEQ ID NO: 201422 - DNA, 22 bp, Artificial sequence
  SiRNA target sequence
caaacataataccaagtataaa

SEQ ID NO: 201423 - DNA, 22 bp, Artificial sequence
  SiRNA target sequence
aaacataataccaagtataaaa

SEQ ID NO: 201424 - DNA, 22 bp, Artificial sequence
  SiRNA target sequence
aacataataccaagtataaaaa

SEQ ID NO: 201425 - DNA, 22 bp, Artificial sequence
  SiRNA target sequence
acataataccaagtataaaaaa

SEQ ID NO: 201426 - DNA, 22 bp, Artificial sequence
  SiRNA target sequence
cataataccaagtataaaaaat

SEQ ID NO: 201427 - DNA, 22 bp, Artificial sequence
  SiRNA target sequence
ataataccaagtataaaaaatt

SEQ ID NO: 201428 - DNA, 22 bp, Artificial sequence
  SiRNA target sequence
taataccaagtataaaaaattt

SEQ ID NO: 201429 - DNA, 22 bp, Artificial sequence
  SiRNA target sequence
aataccaagtataaaaaattta

SEQ ID NO: 201430 - DNA, 22 bp, Artificial sequence
  SiRNA target sequence
ataccaagtataaaaaatttag

SEQ ID NO: 201431 - DNA, 22 bp, Artificial sequence
  SiRNA target sequence
taccaagtataaaaaatttagg

SEQ ID NO: 201432 - DNA, 22 bp, Artificial sequence
  SiRNA target sequence
accaagtataaaaaatttaggc

SEQ ID NO: 201433 - DNA, 22 bp, Artificial sequence
  SiRNA target sequence
ccaagtataaaaaatttaggca

SEQ ID NO: 201434 - DNA, 22 bp, Artificial sequence
  SiRNA target sequence
caagtataaaaaatttaggcat

SEQ ID NO: 201435 - DNA, 22 bp, Artificial sequence
  SiRNA target sequence
aagtataaaaaatttaggcatt

SEQ ID NO: 201436 - DNA, 22 bp, Artificial sequence
  SiRNA target sequence
agtataaaaaatttaggcattt

SEQ ID NO: 201437 - DNA, 22 bp, Artificial sequence
  SiRNA target sequence
gtataaaaaatttaggcatttc

SEQ ID NO: 201438 - DNA, 22 bp, Artificial sequence
  SiRNA target sequence
tataaaaaatttaggcatttca

SEQ ID NO: 201439 - DNA, 22 bp, Artificial sequence
  SiRNA target sequence
ataaaaaatttaggcatttcaa

SEQ ID NO: 201440 - DNA, 22 bp, Artificial sequence
  SiRNA target sequence
taaaaaatttaggcatttcaac

SEQ ID NO: 201441 - DNA, 22 bp, Artificial sequence
  SiRNA target sequence
aaaaaatttaggcatttcaacc

SEQ ID NO: 201442 - DNA, 22 bp, Artificial sequence
  SiRNA target sequence
aaaaatttaggcatttcaacct

SEQ ID NO: 201443 - DNA, 22 bp, Artificial sequence
  SiRNA target sequence
aaaatttaggcatttcaacctt

SEQ ID NO: 201444 - DNA, 22 bp, Artificial sequence
  SiRNA target sequence
aaatttaggcatttcaacctta

SEQ ID NO: 201445 - DNA, 22 bp, Artificial sequence
  SiRNA target sequence
aatttaggcatttcaaccttag

SEQ ID NO: 201446 - DNA, 22 bp, Artificial sequence
  SiRNA target sequence
atttaggcatttcaaccttagc

SEQ ID NO: 201447 - DNA, 22 bp, Artificial sequence
  SiRNA target sequence
tttaggcatttcaaccttagca

SEQ ID NO: 201448 - DNA, 22 bp, Artificial sequence
  SiRNA target sequence
ttaggcatttcaaccttagcaa

SEQ ID NO: 201449 - DNA, 22 bp, Artificial sequence
  SiRNA target sequence
taggcatttcaaccttagcaac

SEQ ID NO: 201450 - DNA, 22 bp, Artificial sequence
  SiRNA target sequence
aggcatttcaaccttagcaact

SEQ ID NO: 201451 - DNA, 22 bp, Artificial sequence
  SiRNA target sequence
ggcatttcaaccttagcaactt

SEQ ID NO: 201452 - DNA, 22 bp, Artificial sequence
  SiRNA target sequence
gcatttcaaccttagcaacttt

SEQ ID NO: 201453 - DNA, 22 bp, Artificial sequence
  SiRNA target sequence
catttcaaccttagcaacttta

SEQ ID NO: 201454 - DNA, 22 bp, Artificial sequence
  SiRNA target sequence
atttcaaccttagcaactttaa

SEQ ID NO: 201455 - DNA, 22 bp, Artificial sequence
  SiRNA target sequence
tttcaaccttagcaactttaaa

SEQ ID NO: 201456 - DNA, 22 bp, Artificial sequence
  SiRNA target sequence
ttcaaccttagcaactttaaaa

SEQ ID NO: 201457 - DNA, 22 bp, Artificial sequence
  SiRNA target sequence
tcaaccttagcaactttaaaat

SEQ ID NO: 201458 - DNA, 22 bp, Artificial sequence
  SiRNA target sequence
caaccttagcaactttaaaata

SEQ ID NO: 201459 - DNA, 22 bp, Artificial sequence
  SiRNA target sequence
aaccttagcaactttaaaataa

SEQ ID NO: 201460 - DNA, 22 bp, Artificial sequence
  SiRNA target sequence
accttagcaactttaaaataac

SEQ ID NO: 201461 - DNA, 22 bp, Artificial sequence
  SiRNA target sequence
ccttagcaactttaaaataact

SEQ ID NO: 201462 - DNA, 22 bp, Artificial sequence
  SiRNA target sequence
cttagcaactttaaaataactc

SEQ ID NO: 201463 - DNA, 22 bp, Artificial sequence
  SiRNA target sequence
ttagcaactttaaaataactca

SEQ ID NO: 201464 - DNA, 22 bp, Artificial sequence
  SiRNA target sequence
tagcaactttaaaataactcag

SEQ ID NO: 201465 - DNA, 22 bp, Artificial sequence
  SiRNA target sequence
agcaactttaaaataactcagt

SEQ ID NO: 201466 - DNA, 22 bp, Artificial sequence
  SiRNA target sequence
gcaactttaaaataactcagta

SEQ ID NO: 201467 - DNA, 22 bp, Artificial sequence
  SiRNA target sequence
caactttaaaataactcagtaa

SEQ ID NO: 201468 - DNA, 22 bp, Artificial sequence
  SiRNA target sequence
aactttaaaataactcagtaat

SEQ ID NO: 201469 - DNA, 22 bp, Artificial sequence
  SiRNA target sequence
actttaaaataactcagtaatc

SEQ ID NO: 201470 - DNA, 22 bp, Artificial sequence
  SiRNA target sequence
ctttaaaataactcagtaatcc

SEQ ID NO: 201471 - DNA, 22 bp, Artificial sequence
  SiRNA target sequence
tttaaaataactcagtaatcct

SEQ ID NO: 201472 - DNA, 22 bp, Artificial sequence
  SiRNA target sequence
ttaaaataactcagtaatcctg

SEQ ID NO: 201473 - DNA, 22 bp, Artificial sequence
  SiRNA target sequence
taaaataactcagtaatcctgt

SEQ ID NO: 201474 - DNA, 22 bp, Artificial sequence
  SiRNA target sequence
aaaataactcagtaatcctgtt

SEQ ID NO: 201475 - DNA, 22 bp, Artificial sequence
  SiRNA target sequence
aaataactcagtaatcctgttc

SEQ ID NO: 201476 - DNA, 22 bp, Artificial sequence
  SiRNA target sequence
aataactcagtaatcctgttct

SEQ ID NO: 201477 - DNA, 22 bp, Artificial sequence
  SiRNA target sequence
ataactcagtaatcctgttctt

SEQ ID NO: 201478 - DNA, 22 bp, Artificial sequence
  SiRNA target sequence
taactcagtaatcctgttcttg

SEQ ID NO: 201479 - DNA, 22 bp, Artificial sequence
  SiRNA target sequence
aactcagtaatcctgttcttga

SEQ ID NO: 201480 - DNA, 22 bp, Artificial sequence
  SiRNA target sequence
actcagtaatcctgttcttgaa

SEQ ID NO: 201481 - DNA, 22 bp, Artificial sequence
  SiRNA target sequence
ctcagtaatcctgttcttgaat

SEQ ID NO: 201482 - DNA, 22 bp, Artificial sequence
  SiRNA target sequence
tcagtaatcctgttcttgaatt

SEQ ID NO: 201483 - DNA, 22 bp, Artificial sequence
  SiRNA target sequence
cagtaatcctgttcttgaattt

SEQ ID NO: 201484 - DNA, 22 bp, Artificial sequence
  SiRNA target sequence
agtaatcctgttcttgaatttg

SEQ ID NO: 201485 - DNA, 22 bp, Artificial sequence
  SiRNA target sequence
gtaatcctgttcttgaatttgc

SEQ ID NO: 201486 - DNA, 22 bp, Artificial sequence
  SiRNA target sequence
taatcctgttcttgaatttgct

SEQ ID NO: 201487 - DNA, 22 bp, Artificial sequence
  SiRNA target sequence
aatcctgttcttgaatttgcta

SEQ ID NO: 201488 - DNA, 22 bp, Artificial sequence
  SiRNA target sequence
atcctgttcttgaatttgctaa

SEQ ID NO: 201489 - DNA, 22 bp, Artificial sequence
  SiRNA target sequence
tcctgttcttgaatttgctaat

SEQ ID NO: 201490 - DNA, 22 bp, Artificial sequence
  SiRNA target sequence
cctgttcttgaatttgctaatt

SEQ ID NO: 201491 - DNA, 22 bp, Artificial sequence
  SiRNA target sequence
ctgttcttgaatttgctaattg

SEQ ID NO: 201492 - DNA, 22 bp, Artificial sequence
  SiRNA target sequence
tgttcttgaatttgctaattga

SEQ ID NO: 201493 - DNA, 22 bp, Artificial sequence
  SiRNA target sequence
gttcttgaatttgctaattgat

SEQ ID NO: 201494 - DNA, 22 bp, Artificial sequence
  SiRNA target sequence
ttcttgaatttgctaattgatc

SEQ ID NO: 201495 - DNA, 22 bp, Artificial sequence
  SiRNA target sequence
tcttgaatttgctaattgatca

SEQ ID NO: 201496 - DNA, 22 bp, Artificial sequence
  SiRNA target sequence
cttgaatttgctaattgatcaa

SEQ ID NO: 201497 - DNA, 22 bp, Artificial sequence
  SiRNA target sequence
ttgaatttgctaattgatcaat

SEQ ID NO: 201498 - DNA, 22 bp, Artificial sequence
  SiRNA target sequence
tgaatttgctaattgatcaatc

SEQ ID NO: 201499 - DNA, 22 bp, Artificial sequence
  SiRNA target sequence
gaatttgctaattgatcaatct

SEQ ID NO: 201500 - DNA, 22 bp, Artificial sequence
  SiRNA target sequence
aatttgctaattgatcaatctc

SEQ ID NO: 201501 - DNA, 22 bp, Artificial sequence
  SiRNA target sequence
atttgctaattgatcaatctca

SEQ ID NO: 201502 - DNA, 22 bp, Artificial sequence
  SiRNA target sequence
tttgctaattgatcaatctcat

SEQ ID NO: 201503 - DNA, 22 bp, Artificial sequence
  SiRNA target sequence
ttgctaattgatcaatctcatc

SEQ ID NO: 201504 - DNA, 22 bp, Artificial sequence
  SiRNA target sequence
tgctaattgatcaatctcatct

SEQ ID NO: 201505 - DNA, 22 bp, Artificial sequence
  SiRNA target sequence
gctaattgatcaatctcatctt

SEQ ID NO: 201506 - DNA, 22 bp, Artificial sequence
  SiRNA target sequence
ctaattgatcaatctcatcttc

SEQ ID NO: 201507 - DNA, 22 bp, Artificial sequence
  SiRNA target sequence
taattgatcaatctcatcttcc

SEQ ID NO: 201508 - DNA, 22 bp, Artificial sequence
  SiRNA target sequence
aattgatcaatctcatcttccg

SEQ ID NO: 201509 - DNA, 22 bp, Artificial sequence
  SiRNA target sequence
attgatcaatctcatcttccgt

SEQ ID NO: 201510 - DNA, 22 bp, Artificial sequence
  SiRNA target sequence
ttgatcaatctcatcttccgta

SEQ ID NO: 201511 - DNA, 22 bp, Artificial sequence
  SiRNA target sequence
tgatcaatctcatcttccgtag

SEQ ID NO: 201512 - DNA, 22 bp, Artificial sequence
  SiRNA target sequence
gatcaatctcatcttccgtagg

SEQ ID NO: 201513 - DNA, 22 bp, Artificial sequence
  SiRNA target sequence
atcaatctcatcttccgtaggt

SEQ ID NO: 201514 - DNA, 22 bp, Artificial sequence
  SiRNA target sequence
tcaatctcatcttccgtaggta

SEQ ID NO: 201515 - DNA, 22 bp, Artificial sequence
  SiRNA target sequence
caatctcatcttccgtaggtaa

SEQ ID NO: 201516 - DNA, 22 bp, Artificial sequence
  SiRNA target sequence
aatctcatcttccgtaggtaag

SEQ ID NO: 201517 - DNA, 22 bp, Artificial sequence
  SiRNA target sequence
atctcatcttccgtaggtaagt

SEQ ID NO: 201518 - DNA, 22 bp, Artificial sequence
  SiRNA target sequence
tctcatcttccgtaggtaagtt

SEQ ID NO: 201519 - DNA, 22 bp, Artificial sequence
  SiRNA target sequence
ctcatcttccgtaggtaagttg

SEQ ID NO: 201520 - DNA, 22 bp, Artificial sequence
  SiRNA target sequence
tcatcttccgtaggtaagttgt

SEQ ID NO: 201521 - DNA, 22 bp, Artificial sequence
  SiRNA target sequence
catcttccgtaggtaagttgtt

SEQ ID NO: 201522 - DNA, 22 bp, Artificial sequence
  SiRNA target sequence
atcttccgtaggtaagttgttt

SEQ ID NO: 201523 - DNA, 22 bp, Artificial sequence
  SiRNA target sequence
tcttccgtaggtaagttgtttt

SEQ ID NO: 201524 - DNA, 22 bp, Artificial sequence
  SiRNA target sequence
cttccgtaggtaagttgttttc

SEQ ID NO: 201525 - DNA, 22 bp, Artificial sequence
  SiRNA target sequence
ttccgtaggtaagttgttttca

SEQ ID NO: 201526 - DNA, 22 bp, Artificial sequence
  SiRNA target sequence
tccgtaggtaagttgttttcag

SEQ ID NO: 201527 - DNA, 22 bp, Artificial sequence
  SiRNA target sequence
ccgtaggtaagttgttttcagg

SEQ ID NO: 201528 - DNA, 22 bp, Artificial sequence
  SiRNA target sequence
cgtaggtaagttgttttcaggt

SEQ ID NO: 201529 - DNA, 22 bp, Artificial sequence
  SiRNA target sequence
gtaggtaagttgttttcaggtg

SEQ ID NO: 201530 - DNA, 22 bp, Artificial sequence
  SiRNA target sequence
taggtaagttgttttcaggtgt

SEQ ID NO: 201531 - DNA, 22 bp, Artificial sequence
  SiRNA target sequence
aggtaagttgttttcaggtgtt

SEQ ID NO: 201532 - DNA, 22 bp, Artificial sequence
  SiRNA target sequence
ggtaagttgttttcaggtgttt

SEQ ID NO: 201533 - DNA, 22 bp, Artificial sequence
  SiRNA target sequence
gtaagttgttttcaggtgtttc

SEQ ID NO: 201534 - DNA, 22 bp, Artificial sequence
  SiRNA target sequence
taagttgttttcaggtgtttca

SEQ ID NO: 201535 - DNA, 22 bp, Artificial sequence
  SiRNA target sequence
aagttgttttcaggtgtttcat

SEQ ID NO: 201536 - DNA, 22 bp, Artificial sequence
  SiRNA target sequence
agttgttttcaggtgtttcatt

SEQ ID NO: 201537 - DNA, 22 bp, Artificial sequence
  SiRNA target sequence
gttgttttcaggtgtttcattt

SEQ ID NO: 201538 - DNA, 22 bp, Artificial sequence
  SiRNA target sequence
ttgttttcaggtgtttcattta

SEQ ID NO: 201539 - DNA, 22 bp, Artificial sequence
  SiRNA target sequence
tgttttcaggtgtttcatttat

SEQ ID NO: 201540 - DNA, 22 bp, Artificial sequence
  SiRNA target sequence
gttttcaggtgtttcatttatt

SEQ ID NO: 201541 - DNA, 22 bp, Artificial sequence
  SiRNA target sequence
ttttcaggtgtttcatttatta

SEQ ID NO: 201542 - DNA, 22 bp, Artificial sequence
  SiRNA target sequence
tttcaggtgtttcatttattac

SEQ ID NO: 201543 - DNA, 22 bp, Artificial sequence
  SiRNA target sequence
ttcaggtgtttcatttattaca

SEQ ID NO: 201544 - DNA, 22 bp, Artificial sequence
  SiRNA target sequence
tcaggtgtttcatttattacac

SEQ ID NO: 201545 - DNA, 22 bp, Artificial sequence
  SiRNA target sequence
caggtgtttcatttattacact

SEQ ID NO: 201546 - DNA, 22 bp, Artificial sequence
  SiRNA target sequence
aggtgtttcatttattacactc

SEQ ID NO: 201547 - DNA, 22 bp, Artificial sequence
  SiRNA target sequence
ggtgtttcatttattacactca

SEQ ID NO: 201548 - DNA, 22 bp, Artificial sequence
  SiRNA target sequence
gtgtttcatttattacactcat

SEQ ID NO: 201549 - DNA, 23 bp, Artificial sequence
  SiRNA target sequence
ttattctgcgttttcttttttgt

SEQ ID NO: 201550 - DNA, 23 bp, Artificial sequence
  SiRNA target sequence
tattctgcgttttcttttttgtc

SEQ ID NO: 201551 - DNA, 23 bp, Artificial sequence
  SiRNA target sequence
attctgcgttttcttttttgtcg

SEQ ID NO: 201552 - DNA, 23 bp, Artificial sequence
  SiRNA target sequence
ttctgcgttttcttttttgtcgt

SEQ ID NO: 201553 - DNA, 23 bp, Artificial sequence
  SiRNA target sequence
tctgcgttttcttttttgtcgtc

SEQ ID NO: 201554 - DNA, 23 bp, Artificial sequence
  SiRNA target sequence
ctgcgttttcttttttgtcgtct

SEQ ID NO: 201555 - DNA, 23 bp, Artificial sequence
  SiRNA target sequence
tgcgttttcttttttgtcgtctt

SEQ ID NO: 201556 - DNA, 23 bp, Artificial sequence
  SiRNA target sequence
gcgttttcttttttgtcgtcttt

SEQ ID NO: 201557 - DNA, 23 bp, Artificial sequence
  SiRNA target sequence
cgttttcttttttgtcgtctttt

SEQ ID NO: 201558 - DNA, 23 bp, Artificial sequence
  SiRNA target sequence
gttttcttttttgtcgtctttta

SEQ ID NO: 201559 - DNA, 23 bp, Artificial sequence
  SiRNA target sequence
ttttcttttttgtcgtcttttat

SEQ ID NO: 201560 - DNA, 23 bp, Artificial sequence
  SiRNA target sequence
tttcttttttgtcgtcttttatt

SEQ ID NO: 201561 - DNA, 23 bp, Artificial sequence
  SiRNA target sequence
ttcttttttgtcgtcttttatta

SEQ ID NO: 201562 - DNA, 23 bp, Artificial sequence
  SiRNA target sequence
tcttttttgtcgtcttttattaa

SEQ ID NO: 201563 - DNA, 23 bp, Artificial sequence
  SiRNA target sequence
cttttttgtcgtcttttattaaa

SEQ ID NO: 201564 - DNA, 23 bp, Artificial sequence
  SiRNA target sequence
ttttttgtcgtcttttattaaat

SEQ ID NO: 201565 - DNA, 23 bp, Artificial sequence
  SiRNA target sequence
tttttgtcgtcttttattaaatc

SEQ ID NO: 201566 - DNA, 23 bp, Artificial sequence
  SiRNA target sequence
ttttgtcgtcttttattaaatct

SEQ ID NO: 201567 - DNA, 23 bp, Artificial sequence
  SiRNA target sequence
tttgtcgtcttttattaaatcta

SEQ ID NO: 201568 - DNA, 23 bp, Artificial sequence
  SiRNA target sequence
ttgtcgtcttttattaaatctat

SEQ ID NO: 201569 - DNA, 23 bp, Artificial sequence
  SiRNA target sequence
tgtcgtcttttattaaatctatg

SEQ ID NO: 201570 - DNA, 23 bp, Artificial sequence
  SiRNA target sequence
gtcgtcttttattaaatctatgt

SEQ ID NO: 201571 - DNA, 23 bp, Artificial sequence
  SiRNA target sequence
tcgtcttttattaaatctatgtc

SEQ ID NO: 201572 - DNA, 23 bp, Artificial sequence
  SiRNA target sequence
cgtcttttattaaatctatgtct

SEQ ID NO: 201573 - DNA, 23 bp, Artificial sequence
  SiRNA target sequence
gtcttttattaaatctatgtcta

SEQ ID NO: 201574 - DNA, 23 bp, Artificial sequence
  SiRNA target sequence
tcttttattaaatctatgtctac

SEQ ID NO: 201575 - DNA, 23 bp, Artificial sequence
  SiRNA target sequence
cttttattaaatctatgtctaca

SEQ ID NO: 201576 - DNA, 23 bp, Artificial sequence
  SiRNA target sequence
ttttattaaatctatgtctacac

SEQ ID NO: 201577 - DNA, 23 bp, Artificial sequence
  SiRNA target sequence
tttattaaatctatgtctacact

SEQ ID NO: 201578 - DNA, 23 bp, Artificial sequence
  SiRNA target sequence
ttattaaatctatgtctacactt

SEQ ID NO: 201579 - DNA, 23 bp, Artificial sequence
  SiRNA target sequence
tattaaatctatgtctacacttg

SEQ ID NO: 201580 - DNA, 23 bp, Artificial sequence
  SiRNA target sequence
attaaatctatgtctacacttgt

SEQ ID NO: 201581 - DNA, 23 bp, Artificial sequence
  SiRNA target sequence
ttaaatctatgtctacacttgta

SEQ ID NO: 201582 - DNA, 23 bp, Artificial sequence
  SiRNA target sequence
taaatctatgtctacacttgtat

SEQ ID NO: 201583 - DNA, 23 bp, Artificial sequence
  SiRNA target sequence
aaatctatgtctacacttgtatt

SEQ ID NO: 201584 - DNA, 23 bp, Artificial sequence
  SiRNA target sequence
aatctatgtctacacttgtatta

SEQ ID NO: 201585 - DNA, 23 bp, Artificial sequence
  SiRNA target sequence
atctatgtctacacttgtattat

SEQ ID NO: 201586 - DNA, 23 bp, Artificial sequence
  SiRNA target sequence
tctatgtctacacttgtattatt

SEQ ID NO: 201587 - DNA, 23 bp, Artificial sequence
  SiRNA target sequence
ctatgtctacacttgtattattt

SEQ ID NO: 201588 - DNA, 23 bp, Artificial sequence
  SiRNA target sequence
tatgtctacacttgtattatttt

SEQ ID NO: 201589 - DNA, 23 bp, Artificial sequence
  SiRNA target sequence
atgtctacacttgtattattttt

SEQ ID NO: 201590 - DNA, 23 bp, Artificial sequence
  SiRNA target sequence
tgtctacacttgtattattttta

SEQ ID NO: 201591 - DNA, 23 bp, Artificial sequence
  SiRNA target sequence
gtctacacttgtattatttttaa

SEQ ID NO: 201592 - DNA, 23 bp, Artificial sequence
  SiRNA target sequence
tctacacttgtattatttttaat

SEQ ID NO: 201593 - DNA, 23 bp, Artificial sequence
  SiRNA target sequence
ctacacttgtattatttttaatt

SEQ ID NO: 201594 - DNA, 23 bp, Artificial sequence
  SiRNA target sequence
tacacttgtattatttttaattg

SEQ ID NO: 201595 - DNA, 23 bp, Artificial sequence
  SiRNA target sequence
acacttgtattatttttaattga

SEQ ID NO: 201596 - DNA, 23 bp, Artificial sequence
  SiRNA target sequence
cacttgtattatttttaattgaa

SEQ ID NO: 201597 - DNA, 23 bp, Artificial sequence
  SiRNA target sequence
acttgtattatttttaattgaaa

SEQ ID NO: 201598 - DNA, 23 bp, Artificial sequence
  SiRNA target sequence
cttgtattatttttaattgaaac

SEQ ID NO: 201599 - DNA, 23 bp, Artificial sequence
  SiRNA target sequence
ttgtattatttttaattgaaacg

SEQ ID NO: 201600 - DNA, 23 bp, Artificial sequence
  SiRNA target sequence
tgtattatttttaattgaaacgt

SEQ ID NO: 201601 - DNA, 23 bp, Artificial sequence
  SiRNA target sequence
gtattatttttaattgaaacgtt

SEQ ID NO: 201602 - DNA, 23 bp, Artificial sequence
  SiRNA target sequence
tattatttttaattgaaacgtta

SEQ ID NO: 201603 - DNA, 23 bp, Artificial sequence
  SiRNA target sequence
attatttttaattgaaacgttat

SEQ ID NO: 201604 - DNA, 23 bp, Artificial sequence
  SiRNA target sequence
ttatttttaattgaaacgttata

SEQ ID NO: 201605 - DNA, 23 bp, Artificial sequence
  SiRNA target sequence
tatttttaattgaaacgttatat

SEQ ID NO: 201606 - DNA, 23 bp, Artificial sequence
  SiRNA target sequence
atttttaattgaaacgttatatg

SEQ ID NO: 201607 - DNA, 23 bp, Artificial sequence
  SiRNA target sequence
tttttaattgaaacgttatatgc

SEQ ID NO: 201608 - DNA, 23 bp, Artificial sequence
  SiRNA target sequence
ttttaattgaaacgttatatgca

SEQ ID NO: 201609 - DNA, 23 bp, Artificial sequence
  SiRNA target sequence
tttaattgaaacgttatatgcac

SEQ ID NO: 201610 - DNA, 23 bp, Artificial sequence
  SiRNA target sequence
ttaattgaaacgttatatgcacc

SEQ ID NO: 201611 - DNA, 23 bp, Artificial sequence
  SiRNA target sequence
taattgaaacgttatatgcaccc

SEQ ID NO: 201612 - DNA, 23 bp, Artificial sequence
  SiRNA target sequence
aattgaaacgttatatgcacccg

SEQ ID NO: 201613 - DNA, 23 bp, Artificial sequence
  SiRNA target sequence
attgaaacgttatatgcacccgc

SEQ ID NO: 201614 - DNA, 23 bp, Artificial sequence
  SiRNA target sequence
ttgaaacgttatatgcacccgct

SEQ ID NO: 201615 - DNA, 23 bp, Artificial sequence
  SiRNA target sequence
tgaaacgttatatgcacccgcta

SEQ ID NO: 201616 - DNA, 23 bp, Artificial sequence
  SiRNA target sequence
gaaacgttatatgcacccgctaa

SEQ ID NO: 201617 - DNA, 23 bp, Artificial sequence
  SiRNA target sequence
aaacgttatatgcacccgctaaa

SEQ ID NO: 201618 - DNA, 23 bp, Artificial sequence
  SiRNA target sequence
aacgttatatgcacccgctaaat

SEQ ID NO: 201619 - DNA, 23 bp, Artificial sequence
  SiRNA target sequence
acgttatatgcacccgctaaata

SEQ ID NO: 201620 - DNA, 23 bp, Artificial sequence
  SiRNA target sequence
cgttatatgcacccgctaaatag

SEQ ID NO: 201621 - DNA, 23 bp, Artificial sequence
  SiRNA target sequence
gttatatgcacccgctaaataga

SEQ ID NO: 201622 - DNA, 23 bp, Artificial sequence
  SiRNA target sequence
ttatatgcacccgctaaatagat

SEQ ID NO: 201623 - DNA, 23 bp, Artificial sequence
  SiRNA target sequence
tatatgcacccgctaaatagatt

SEQ ID NO: 201624 - DNA, 23 bp, Artificial sequence
  SiRNA target sequence
atatgcacccgctaaatagatta

SEQ ID NO: 201625 - DNA, 23 bp, Artificial sequence
  SiRNA target sequence
tatgcacccgctaaatagattat

SEQ ID NO: 201626 - DNA, 23 bp, Artificial sequence
  SiRNA target sequence
atgcacccgctaaatagattata

SEQ ID NO: 201627 - DNA, 23 bp, Artificial sequence
  SiRNA target sequence
tgcacccgctaaatagattatag

SEQ ID NO: 201628 - DNA, 23 bp, Artificial sequence
  SiRNA target sequence
gcacccgctaaatagattatagc

SEQ ID NO: 201629 - DNA, 23 bp, Artificial sequence
  SiRNA target sequence
cacccgctaaatagattatagct

SEQ ID NO: 201630 - DNA, 23 bp, Artificial sequence
  SiRNA target sequence
acccgctaaatagattatagctc

SEQ ID NO: 201631 - DNA, 23 bp, Artificial sequence
  SiRNA target sequence
cccgctaaatagattatagctct

SEQ ID NO: 201632 - DNA, 23 bp, Artificial sequence
  SiRNA target sequence
ccgctaaatagattatagctcta

SEQ ID NO: 201633 - DNA, 23 bp, Artificial sequence
  SiRNA target sequence
cgctaaatagattatagctctaa

SEQ ID NO: 201634 - DNA, 23 bp, Artificial sequence
  SiRNA target sequence
gctaaatagattatagctctaat

SEQ ID NO: 201635 - DNA, 23 bp, Artificial sequence
  SiRNA target sequence
ctaaatagattatagctctaatc

SEQ ID NO: 201636 - DNA, 23 bp, Artificial sequence
  SiRNA target sequence
taaatagattatagctctaatcc

SEQ ID NO: 201637 - DNA, 23 bp, Artificial sequence
  SiRNA target sequence
aaatagattatagctctaatcca

SEQ ID NO: 201638 - DNA, 23 bp, Artificial sequence
  SiRNA target sequence
aatagattatagctctaatccaa

SEQ ID NO: 201639 - DNA, 23 bp, Artificial sequence
  SiRNA target sequence
atagattatagctctaatccaaa

SEQ ID NO: 201640 - DNA, 23 bp, Artificial sequence
  SiRNA target sequence
tagattatagctctaatccaaat

SEQ ID NO: 201641 - DNA, 23 bp, Artificial sequence
  SiRNA target sequence
agattatagctctaatccaaata

SEQ ID NO: 201642 - DNA, 23 bp, Artificial sequence
  SiRNA target sequence
gattatagctctaatccaaatat

SEQ ID NO: 201643 - DNA, 23 bp, Artificial sequence
  SiRNA target sequence
attatagctctaatccaaatata

SEQ ID NO: 201644 - DNA, 23 bp, Artificial sequence
  SiRNA target sequence
ttatagctctaatccaaatataa

SEQ ID NO: 201645 - DNA, 23 bp, Artificial sequence
  SiRNA target sequence
tatagctctaatccaaatataaa

SEQ ID NO: 201646 - DNA, 23 bp, Artificial sequence
  SiRNA target sequence
atagctctaatccaaatataaat

SEQ ID NO: 201647 - DNA, 23 bp, Artificial sequence
  SiRNA target sequence
tagctctaatccaaatataaatc

SEQ ID NO: 201648 - DNA, 23 bp, Artificial sequence
  SiRNA target sequence
agctctaatccaaatataaatca

SEQ ID NO: 201649 - DNA, 23 bp, Artificial sequence
  SiRNA target sequence
gctctaatccaaatataaatcaa

SEQ ID NO: 201650 - DNA, 23 bp, Artificial sequence
  SiRNA target sequence
ctctaatccaaatataaatcaat

SEQ ID NO: 201651 - DNA, 23 bp, Artificial sequence
  SiRNA target sequence
tctaatccaaatataaatcaata

SEQ ID NO: 201652 - DNA, 23 bp, Artificial sequence
  SiRNA target sequence
ctaatccaaatataaatcaatat

SEQ ID NO: 201653 - DNA, 23 bp, Artificial sequence
  SiRNA target sequence
taatccaaatataaatcaatatt

SEQ ID NO: 201654 - DNA, 23 bp, Artificial sequence
  SiRNA target sequence
aatccaaatataaatcaatatta

SEQ ID NO: 201655 - DNA, 23 bp, Artificial sequence
  SiRNA target sequence
atccaaatataaatcaatattat

SEQ ID NO: 201656 - DNA, 23 bp, Artificial sequence
  SiRNA target sequence
tccaaatataaatcaatattatt

SEQ ID NO: 201657 - DNA, 23 bp, Artificial sequence
  SiRNA target sequence
ccaaatataaatcaatattattg

SEQ ID NO: 201658 - DNA, 23 bp, Artificial sequence
  SiRNA target sequence
caaatataaatcaatattattgc

SEQ ID NO: 201659 - DNA, 23 bp, Artificial sequence
  SiRNA target sequence
aaatataaatcaatattattgca

SEQ ID NO: 201660 - DNA, 23 bp, Artificial sequence
  SiRNA target sequence
aatataaatcaatattattgcaa

SEQ ID NO: 201661 - DNA, 23 bp, Artificial sequence
  SiRNA target sequence
atataaatcaatattattgcaat

SEQ ID NO: 201662 - DNA, 23 bp, Artificial sequence
  SiRNA target sequence
tataaatcaatattattgcaatc

SEQ ID NO: 201663 - DNA, 23 bp, Artificial sequence
  SiRNA target sequence
ataaatcaatattattgcaatcg

SEQ ID NO: 201664 - DNA, 23 bp, Artificial sequence
  SiRNA target sequence
taaatcaatattattgcaatcgt

SEQ ID NO: 201665 - DNA, 23 bp, Artificial sequence
  SiRNA target sequence
aaatcaatattattgcaatcgtt

SEQ ID NO: 201666 - DNA, 23 bp, Artificial sequence
  SiRNA target sequence
aatcaatattattgcaatcgtta

SEQ ID NO: 201667 - DNA, 23 bp, Artificial sequence
  SiRNA target sequence
atcaatattattgcaatcgttaa

SEQ ID NO: 201668 - DNA, 23 bp, Artificial sequence
  SiRNA target sequence
tcaatattattgcaatcgttaat

SEQ ID NO: 201669 - DNA, 23 bp, Artificial sequence
  SiRNA target sequence
caatattattgcaatcgttaatg

SEQ ID NO: 201670 - DNA, 23 bp, Artificial sequence
  SiRNA target sequence
aatattattgcaatcgttaatgt

SEQ ID NO: 201671 - DNA, 23 bp, Artificial sequence
  SiRNA target sequence
atattattgcaatcgttaatgtg

SEQ ID NO: 201672 - DNA, 23 bp, Artificial sequence
  SiRNA target sequence
tattattgcaatcgttaatgtga

SEQ ID NO: 201673 - DNA, 23 bp, Artificial sequence
  SiRNA target sequence
attattgcaatcgttaatgtgat

SEQ ID NO: 201674 - DNA, 23 bp, Artificial sequence
  SiRNA target sequence
ttattgcaatcgttaatgtgatt

SEQ ID NO: 201675 - DNA, 23 bp, Artificial sequence
  SiRNA target sequence
tattgcaatcgttaatgtgattg

SEQ ID NO: 201676 - DNA, 23 bp, Artificial sequence
  SiRNA target sequence
attgcaatcgttaatgtgattgg

SEQ ID NO: 201677 - DNA, 23 bp, Artificial sequence
  SiRNA target sequence
ttgcaatcgttaatgtgattgga

SEQ ID NO: 201678 - DNA, 23 bp, Artificial sequence
  SiRNA target sequence
tgcaatcgttaatgtgattggac

SEQ ID NO: 201679 - DNA, 23 bp, Artificial sequence
  SiRNA target sequence
gcaatcgttaatgtgattggact

SEQ ID NO: 201680 - DNA, 23 bp, Artificial sequence
  SiRNA target sequence
caatcgttaatgtgattggacta

SEQ ID NO: 201681 - DNA, 23 bp, Artificial sequence
  SiRNA target sequence
aatcgttaatgtgattggactac

SEQ ID NO: 201682 - DNA, 23 bp, Artificial sequence
  SiRNA target sequence
atcgttaatgtgattggactacc

SEQ ID NO: 201683 - DNA, 23 bp, Artificial sequence
  SiRNA target sequence
tcgttaatgtgattggactaccc

SEQ ID NO: 201684 - DNA, 23 bp, Artificial sequence
  SiRNA target sequence
cgttaatgtgattggactaccct

SEQ ID NO: 201685 - DNA, 23 bp, Artificial sequence
  SiRNA target sequence
gttaatgtgattggactaccctt

SEQ ID NO: 201686 - DNA, 23 bp, Artificial sequence
  SiRNA target sequence
ttaatgtgattggactacccttc

SEQ ID NO: 201687 - DNA, 23 bp, Artificial sequence
  SiRNA target sequence
taatgtgattggactacccttcc

SEQ ID NO: 201688 - DNA, 23 bp, Artificial sequence
  SiRNA target sequence
aatgtgattggactacccttcct

SEQ ID NO: 201689 - DNA, 23 bp, Artificial sequence
  SiRNA target sequence
atgtgattggactacccttcctt

SEQ ID NO: 201690 - DNA, 23 bp, Artificial sequence
  SiRNA target sequence
tgtgattggactacccttcctta

SEQ ID NO: 201691 - DNA, 23 bp, Artificial sequence
  SiRNA target sequence
gtgattggactacccttccttac

SEQ ID NO: 201692 - DNA, 23 bp, Artificial sequence
  SiRNA target sequence
tgattggactacccttccttaca

SEQ ID NO: 201693 - DNA, 23 bp, Artificial sequence
  SiRNA target sequence
gattggactacccttccttacat

SEQ ID NO: 201694 - DNA, 23 bp, Artificial sequence
  SiRNA target sequence
attggactacccttccttacatt

SEQ ID NO: 201695 - DNA, 23 bp, Artificial sequence
  SiRNA target sequence
ttggactacccttccttacatta

SEQ ID NO: 201696 - DNA, 23 bp, Artificial sequence
  SiRNA target sequence
tggactacccttccttacattat

SEQ ID NO: 201697 - DNA, 23 bp, Artificial sequence
  SiRNA target sequence
ggactacccttccttacattatc

SEQ ID NO: 201698 - DNA, 23 bp, Artificial sequence
  SiRNA target sequence
gactacccttccttacattatca

SEQ ID NO: 201699 - DNA, 23 bp, Artificial sequence
  SiRNA target sequence
actacccttccttacattatcag

SEQ ID NO: 201700 - DNA, 23 bp, Artificial sequence
  SiRNA target sequence
ctacccttccttacattatcagt

SEQ ID NO: 201701 - DNA, 23 bp, Artificial sequence
  SiRNA target sequence
tacccttccttacattatcagta

SEQ ID NO: 201702 - DNA, 23 bp, Artificial sequence
  SiRNA target sequence
acccttccttacattatcagtat

SEQ ID NO: 201703 - DNA, 23 bp, Artificial sequence
  SiRNA target sequence
cccttccttacattatcagtatc

SEQ ID NO: 201704 - DNA, 23 bp, Artificial sequence
  SiRNA target sequence
ccttccttacattatcagtatca

SEQ ID NO: 201705 - DNA, 23 bp, Artificial sequence
  SiRNA target sequence
cttccttacattatcagtatcaa

SEQ ID NO: 201706 - DNA, 23 bp, Artificial sequence
  SiRNA target sequence
ttccttacattatcagtatcaag

SEQ ID NO: 201707 - DNA, 23 bp, Artificial sequence
  SiRNA target sequence
tccttacattatcagtatcaagt

SEQ ID NO: 201708 - DNA, 23 bp, Artificial sequence
  SiRNA target sequence
ccttacattatcagtatcaagtg

SEQ ID NO: 201709 - DNA, 23 bp, Artificial sequence
  SiRNA target sequence
cttacattatcagtatcaagtgc

SEQ ID NO: 201710 - DNA, 23 bp, Artificial sequence
  SiRNA target sequence
ttacattatcagtatcaagtgct

SEQ ID NO: 201711 - DNA, 23 bp, Artificial sequence
  SiRNA target sequence
tacattatcagtatcaagtgcta

SEQ ID NO: 201712 - DNA, 23 bp, Artificial sequence
  SiRNA target sequence
acattatcagtatcaagtgctac

SEQ ID NO: 201713 - DNA, 23 bp, Artificial sequence
  SiRNA target sequence
cattatcagtatcaagtgctact

SEQ ID NO: 201714 - DNA, 23 bp, Artificial sequence
  SiRNA target sequence
attatcagtatcaagtgctacta

SEQ ID NO: 201715 - DNA, 23 bp, Artificial sequence
  SiRNA target sequence
ttatcagtatcaagtgctactaa

SEQ ID NO: 201716 - DNA, 23 bp, Artificial sequence
  SiRNA target sequence
tatcagtatcaagtgctactaat

SEQ ID NO: 201717 - DNA, 23 bp, Artificial sequence
  SiRNA target sequence
atcagtatcaagtgctactaata

SEQ ID NO: 201718 - DNA, 23 bp, Artificial sequence
  SiRNA target sequence
tcagtatcaagtgctactaatat

SEQ ID NO: 201719 - DNA, 23 bp, Artificial sequence
  SiRNA target sequence
cagtatcaagtgctactaatatg

SEQ ID NO: 201720 - DNA, 23 bp, Artificial sequence
  SiRNA target sequence
agtatcaagtgctactaatatgg

SEQ ID NO: 201721 - DNA, 23 bp, Artificial sequence
  SiRNA target sequence
gtatcaagtgctactaatatggc

SEQ ID NO: 201722 - DNA, 23 bp, Artificial sequence
  SiRNA target sequence
tatcaagtgctactaatatggct

SEQ ID NO: 201723 - DNA, 23 bp, Artificial sequence
  SiRNA target sequence
atcaagtgctactaatatggcta

SEQ ID NO: 201724 - DNA, 23 bp, Artificial sequence
  SiRNA target sequence
tcaagtgctactaatatggctag

SEQ ID NO: 201725 - DNA, 23 bp, Artificial sequence
  SiRNA target sequence
caagtgctactaatatggctagt

SEQ ID NO: 201726 - DNA, 23 bp, Artificial sequence
  SiRNA target sequence
aagtgctactaatatggctagtc

SEQ ID NO: 201727 - DNA, 23 bp, Artificial sequence
  SiRNA target sequence
agtgctactaatatggctagtcc

SEQ ID NO: 201728 - DNA, 23 bp, Artificial sequence
  SiRNA target sequence
gtgctactaatatggctagtcca

SEQ ID NO: 201729 - DNA, 23 bp, Artificial sequence
  SiRNA target sequence
tgctactaatatggctagtccat

SEQ ID NO: 201730 - DNA, 23 bp, Artificial sequence
  SiRNA target sequence
gctactaatatggctagtccata

SEQ ID NO: 201731 - DNA, 23 bp, Artificial sequence
  SiRNA target sequence
ctactaatatggctagtccatat

SEQ ID NO: 201732 - DNA, 23 bp, Artificial sequence
  SiRNA target sequence
tactaatatggctagtccatata

SEQ ID NO: 201733 - DNA, 23 bp, Artificial sequence
  SiRNA target sequence
actaatatggctagtccatataa

SEQ ID NO: 201734 - DNA, 23 bp, Artificial sequence
  SiRNA target sequence
ctaatatggctagtccatataat

SEQ ID NO: 201735 - DNA, 23 bp, Artificial sequence
  SiRNA target sequence
taatatggctagtccatataatg

SEQ ID NO: 201736 - DNA, 23 bp, Artificial sequence
  SiRNA target sequence
aatatggctagtccatataatga

SEQ ID NO: 201737 - DNA, 23 bp, Artificial sequence
  SiRNA target sequence
atatggctagtccatataatgaa

SEQ ID NO: 201738 - DNA, 23 bp, Artificial sequence
  SiRNA target sequence
tatggctagtccatataatgaac

SEQ ID NO: 201739 - DNA, 23 bp, Artificial sequence
  SiRNA target sequence
atggctagtccatataatgaacc

SEQ ID NO: 201740 - DNA, 23 bp, Artificial sequence
  SiRNA target sequence
tggctagtccatataatgaacca

SEQ ID NO: 201741 - DNA, 23 bp, Artificial sequence
  SiRNA target sequence
ggctagtccatataatgaaccaa

SEQ ID NO: 201742 - DNA, 23 bp, Artificial sequence
  SiRNA target sequence
gctagtccatataatgaaccaat

SEQ ID NO: 201743 - DNA, 23 bp, Artificial sequence
  SiRNA target sequence
ctagtccatataatgaaccaata

SEQ ID NO: 201744 - DNA, 23 bp, Artificial sequence
  SiRNA target sequence
tagtccatataatgaaccaatag

SEQ ID NO: 201745 - DNA, 23 bp, Artificial sequence
  SiRNA target sequence
agtccatataatgaaccaataga

SEQ ID NO: 201746 - DNA, 23 bp, Artificial sequence
  SiRNA target sequence
gtccatataatgaaccaatagat

SEQ ID NO: 201747 - DNA, 23 bp, Artificial sequence
  SiRNA target sequence
tccatataatgaaccaatagatt

SEQ ID NO: 201748 - DNA, 23 bp, Artificial sequence
  SiRNA target sequence
ccatataatgaaccaatagattt

SEQ ID NO: 201749 - DNA, 23 bp, Artificial sequence
  SiRNA target sequence
catataatgaaccaatagatttt

SEQ ID NO: 201750 - DNA, 23 bp, Artificial sequence
  SiRNA target sequence
atataatgaaccaatagattttc

SEQ ID NO: 201751 - DNA, 23 bp, Artificial sequence
  SiRNA target sequence
tataatgaaccaatagattttcc

SEQ ID NO: 201752 - DNA, 23 bp, Artificial sequence
  SiRNA target sequence
ataatgaaccaatagattttcct

SEQ ID NO: 201753 - DNA, 23 bp, Artificial sequence
  SiRNA target sequence
taatgaaccaatagattttccta

SEQ ID NO: 201754 - DNA, 23 bp, Artificial sequence
  SiRNA target sequence
aatgaaccaatagattttcctaa

SEQ ID NO: 201755 - DNA, 23 bp, Artificial sequence
  SiRNA target sequence
atgaaccaatagattttcctaat

SEQ ID NO: 201756 - DNA, 23 bp, Artificial sequence
  SiRNA target sequence
tgaaccaatagattttcctaatt

SEQ ID NO: 201757 - DNA, 23 bp, Artificial sequence
  SiRNA target sequence
gaaccaatagattttcctaattt

SEQ ID NO: 201758 - DNA, 23 bp, Artificial sequence
  SiRNA target sequence
aaccaatagattttcctaattta

SEQ ID NO: 201759 - DNA, 23 bp, Artificial sequence
  SiRNA target sequence
accaatagattttcctaatttat

SEQ ID NO: 201760 - DNA, 23 bp, Artificial sequence
  SiRNA target sequence
ccaatagattttcctaatttatt

SEQ ID NO: 201761 - DNA, 23 bp, Artificial sequence
  SiRNA target sequence
caatagattttcctaatttatta

SEQ ID NO: 201762 - DNA, 23 bp, Artificial sequence
  SiRNA target sequence
aatagattttcctaatttattaa

SEQ ID NO: 201763 - DNA, 23 bp, Artificial sequence
  SiRNA target sequence
atagattttcctaatttattaaa

SEQ ID NO: 201764 - DNA, 23 bp, Artificial sequence
  SiRNA target sequence
tagattttcctaatttattaaaa

SEQ ID NO: 201765 - DNA, 23 bp, Artificial sequence
  SiRNA target sequence
agattttcctaatttattaaaaa

SEQ ID NO: 201766 - DNA, 23 bp, Artificial sequence
  SiRNA target sequence
gattttcctaatttattaaaaat

SEQ ID NO: 201767 - DNA, 23 bp, Artificial sequence
  SiRNA target sequence
attttcctaatttattaaaaata

SEQ ID NO: 201768 - DNA, 23 bp, Artificial sequence
  SiRNA target sequence
ttttcctaatttattaaaaatac

SEQ ID NO: 201769 - DNA, 23 bp, Artificial sequence
  SiRNA target sequence
tttcctaatttattaaaaatacc

SEQ ID NO: 201770 - DNA, 23 bp, Artificial sequence
  SiRNA target sequence
ttcctaatttattaaaaatacca

SEQ ID NO: 201771 - DNA, 23 bp, Artificial sequence
  SiRNA target sequence
tcctaatttattaaaaataccat

SEQ ID NO: 201772 - DNA, 23 bp, Artificial sequence
  SiRNA target sequence
cctaatttattaaaaataccatc

SEQ ID NO: 201773 - DNA, 23 bp, Artificial sequence
  SiRNA target sequence
ctaatttattaaaaataccatca

SEQ ID NO: 201774 - DNA, 23 bp, Artificial sequence
  SiRNA target sequence
taatttattaaaaataccatcat

SEQ ID NO: 201775 - DNA, 23 bp, Artificial sequence
  SiRNA target sequence
aatttattaaaaataccatcata

SEQ ID NO: 201776 - DNA, 23 bp, Artificial sequence
  SiRNA target sequence
atttattaaaaataccatcataa

SEQ ID NO: 201777 - DNA, 23 bp, Artificial sequence
  SiRNA target sequence
tttattaaaaataccatcataaa

SEQ ID NO: 201778 - DNA, 23 bp, Artificial sequence
  SiRNA target sequence
ttattaaaaataccatcataaac

SEQ ID NO: 201779 - DNA, 23 bp, Artificial sequence
  SiRNA target sequence
tattaaaaataccatcataaaca

SEQ ID NO: 201780 - DNA, 23 bp, Artificial sequence
  SiRNA target sequence
attaaaaataccatcataaacac

SEQ ID NO: 201781 - DNA, 23 bp, Artificial sequence
  SiRNA target sequence
ttaaaaataccatcataaacact

SEQ ID NO: 201782 - DNA, 23 bp, Artificial sequence
  SiRNA target sequence
taaaaataccatcataaacactt

SEQ ID NO: 201783 - DNA, 23 bp, Artificial sequence
  SiRNA target sequence
aaaaataccatcataaacacttt

SEQ ID NO: 201784 - DNA, 23 bp, Artificial sequence
  SiRNA target sequence
aaaataccatcataaacactttt

SEQ ID NO: 201785 - DNA, 23 bp, Artificial sequence
  SiRNA target sequence
aaataccatcataaacactttta

SEQ ID NO: 201786 - DNA, 23 bp, Artificial sequence
  SiRNA target sequence
aataccatcataaacacttttaa

SEQ ID NO: 201787 - DNA, 23 bp, Artificial sequence
  SiRNA target sequence
ataccatcataaacacttttaaa

SEQ ID NO: 201788 - DNA, 23 bp, Artificial sequence
  SiRNA target sequence
taccatcataaacacttttaaac

SEQ ID NO: 201789 - DNA, 23 bp, Artificial sequence
  SiRNA target sequence
accatcataaacacttttaaacc

SEQ ID NO: 201790 - DNA, 23 bp, Artificial sequence
  SiRNA target sequence
ccatcataaacacttttaaaccg

SEQ ID NO: 201791 - DNA, 23 bp, Artificial sequence
  SiRNA target sequence
catcataaacacttttaaaccgt

SEQ ID NO: 201792 - DNA, 23 bp, Artificial sequence
  SiRNA target sequence
atcataaacacttttaaaccgtg

SEQ ID NO: 201793 - DNA, 23 bp, Artificial sequence
  SiRNA target sequence
tcataaacacttttaaaccgtgc

SEQ ID NO: 201794 - DNA, 23 bp, Artificial sequence
  SiRNA target sequence
cataaacacttttaaaccgtgcc

SEQ ID NO: 201795 - DNA, 23 bp, Artificial sequence
  SiRNA target sequence
ataaacacttttaaaccgtgccc

SEQ ID NO: 201796 - DNA, 23 bp, Artificial sequence
  SiRNA target sequence
taaacacttttaaaccgtgccct

SEQ ID NO: 201797 - DNA, 23 bp, Artificial sequence
  SiRNA target sequence
aaacacttttaaaccgtgccctg

SEQ ID NO: 201798 - DNA, 23 bp, Artificial sequence
  SiRNA target sequence
aacacttttaaaccgtgccctgt

SEQ ID NO: 201799 - DNA, 23 bp, Artificial sequence
  SiRNA target sequence
acacttttaaaccgtgccctgtg

SEQ ID NO: 201800 - DNA, 23 bp, Artificial sequence
  SiRNA target sequence
cacttttaaaccgtgccctgtgt

SEQ ID NO: 201801 - DNA, 23 bp, Artificial sequence
  SiRNA target sequence
acttttaaaccgtgccctgtgtg

SEQ ID NO: 201802 - DNA, 23 bp, Artificial sequence
  SiRNA target sequence
cttttaaaccgtgccctgtgtgc

SEQ ID NO: 201803 - DNA, 23 bp, Artificial sequence
  SiRNA target sequence
ttttaaaccgtgccctgtgtgca

SEQ ID NO: 201804 - DNA, 23 bp, Artificial sequence
  SiRNA target sequence
tttaaaccgtgccctgtgtgcag

SEQ ID NO: 201805 - DNA, 23 bp, Artificial sequence
  SiRNA target sequence
ttaaaccgtgccctgtgtgcagg

SEQ ID NO: 201806 - DNA, 23 bp, Artificial sequence
  SiRNA target sequence
taaaccgtgccctgtgtgcagga

SEQ ID NO: 201807 - DNA, 23 bp, Artificial sequence
  SiRNA target sequence
aaaccgtgccctgtgtgcaggat

SEQ ID NO: 201808 - DNA, 23 bp, Artificial sequence
  SiRNA target sequence
aaccgtgccctgtgtgcaggatc

SEQ ID NO: 201809 - DNA, 23 bp, Artificial sequence
  SiRNA target sequence
accgtgccctgtgtgcaggatcg

SEQ ID NO: 201810 - DNA, 23 bp, Artificial sequence
  SiRNA target sequence
ccgtgccctgtgtgcaggatcga

SEQ ID NO: 201811 - DNA, 23 bp, Artificial sequence
  SiRNA target sequence
cgtgccctgtgtgcaggatcgat

SEQ ID NO: 201812 - DNA, 23 bp, Artificial sequence
  SiRNA target sequence
gtgccctgtgtgcaggatcgatt

SEQ ID NO: 201813 - DNA, 23 bp, Artificial sequence
  SiRNA target sequence
tgccctgtgtgcaggatcgattc

SEQ ID NO: 201814 - DNA, 23 bp, Artificial sequence
  SiRNA target sequence
gccctgtgtgcaggatcgattct

SEQ ID NO: 201815 - DNA, 23 bp, Artificial sequence
  SiRNA target sequence
ccctgtgtgcaggatcgattctc

SEQ ID NO: 201816 - DNA, 23 bp, Artificial sequence
  SiRNA target sequence
cctgtgtgcaggatcgattctca

SEQ ID NO: 201817 - DNA, 23 bp, Artificial sequence
  SiRNA target sequence
ctgtgtgcaggatcgattctcat

SEQ ID NO: 201818 - DNA, 23 bp, Artificial sequence
  SiRNA target sequence
tgtgtgcaggatcgattctcata

SEQ ID NO: 201819 - DNA, 23 bp, Artificial sequence
  SiRNA target sequence
gtgtgcaggatcgattctcatac

SEQ ID NO: 201820 - DNA, 23 bp, Artificial sequence
  SiRNA target sequence
tgtgcaggatcgattctcatacc

SEQ ID NO: 201821 - DNA, 23 bp, Artificial sequence
  SiRNA target sequence
gtgcaggatcgattctcataccc

SEQ ID NO: 201822 - DNA, 23 bp, Artificial sequence
  SiRNA target sequence
tgcaggatcgattctcataccca

SEQ ID NO: 201823 - DNA, 23 bp, Artificial sequence
  SiRNA target sequence
gcaggatcgattctcatacccat

SEQ ID NO: 201824 - DNA, 23 bp, Artificial sequence
  SiRNA target sequence
caggatcgattctcatacccatt

SEQ ID NO: 201825 - DNA, 23 bp, Artificial sequence
  SiRNA target sequence
aggatcgattctcatacccattt

SEQ ID NO: 201826 - DNA, 23 bp, Artificial sequence
  SiRNA target sequence
ggatcgattctcatacccatttt

SEQ ID NO: 201827 - DNA, 23 bp, Artificial sequence
  SiRNA target sequence
gatcgattctcatacccattttc

SEQ ID NO: 201828 - DNA, 23 bp, Artificial sequence
  SiRNA target sequence
atcgattctcatacccattttct

SEQ ID NO: 201829 - DNA, 23 bp, Artificial sequence
  SiRNA target sequence
tcgattctcatacccattttctc

SEQ ID NO: 201830 - DNA, 23 bp, Artificial sequence
  SiRNA target sequence
cgattctcatacccattttctct

SEQ ID NO: 201831 - DNA, 23 bp, Artificial sequence
  SiRNA target sequence
gattctcatacccattttctctt

SEQ ID NO: 201832 - DNA, 23 bp, Artificial sequence
  SiRNA target sequence
attctcatacccattttctcttt

SEQ ID NO: 201833 - DNA, 23 bp, Artificial sequence
  SiRNA target sequence
ttctcatacccattttctcttta

SEQ ID NO: 201834 - DNA, 23 bp, Artificial sequence
  SiRNA target sequence
tctcatacccattttctctttac

SEQ ID NO: 201835 - DNA, 23 bp, Artificial sequence
  SiRNA target sequence
ctcatacccattttctctttaca

SEQ ID NO: 201836 - DNA, 23 bp, Artificial sequence
  SiRNA target sequence
tcatacccattttctctttacaa

SEQ ID NO: 201837 - DNA, 23 bp, Artificial sequence
  SiRNA target sequence
catacccattttctctttacaaa

SEQ ID NO: 201838 - DNA, 23 bp, Artificial sequence
  SiRNA target sequence
atacccattttctctttacaaat

SEQ ID NO: 201839 - DNA, 23 bp, Artificial sequence
  SiRNA target sequence
tacccattttctctttacaaata

SEQ ID NO: 201840 - DNA, 23 bp, Artificial sequence
  SiRNA target sequence
acccattttctctttacaaatat

SEQ ID NO: 201841 - DNA, 23 bp, Artificial sequence
  SiRNA target sequence
cccattttctctttacaaatatc

SEQ ID NO: 201842 - DNA, 23 bp, Artificial sequence
  SiRNA target sequence
ccattttctctttacaaatatca

SEQ ID NO: 201843 - DNA, 23 bp, Artificial sequence
  SiRNA target sequence
cattttctctttacaaatatcaa

SEQ ID NO: 201844 - DNA, 23 bp, Artificial sequence
  SiRNA target sequence
attttctctttacaaatatcaaa

SEQ ID NO: 201845 - DNA, 23 bp, Artificial sequence
  SiRNA target sequence
ttttctctttacaaatatcaaag

SEQ ID NO: 201846 - DNA, 23 bp, Artificial sequence
  SiRNA target sequence
tttctctttacaaatatcaaagg

SEQ ID NO: 201847 - DNA, 23 bp, Artificial sequence
  SiRNA target sequence
ttctctttacaaatatcaaaggc

SEQ ID NO: 201848 - DNA, 23 bp, Artificial sequence
  SiRNA target sequence
tctctttacaaatatcaaaggct

SEQ ID NO: 201849 - DNA, 23 bp, Artificial sequence
  SiRNA target sequence
ctctttacaaatatcaaaggctg

SEQ ID NO: 201850 - DNA, 23 bp, Artificial sequence
  SiRNA target sequence
tctttacaaatatcaaaggctga

SEQ ID NO: 201851 - DNA, 23 bp, Artificial sequence
  SiRNA target sequence
ctttacaaatatcaaaggctgaa

SEQ ID NO: 201852 - DNA, 23 bp, Artificial sequence
  SiRNA target sequence
tttacaaatatcaaaggctgaat

SEQ ID NO: 201853 - DNA, 23 bp, Artificial sequence
  SiRNA target sequence
ttacaaatatcaaaggctgaata

SEQ ID NO: 201854 - DNA, 23 bp, Artificial sequence
  SiRNA target sequence
tacaaatatcaaaggctgaatat

SEQ ID NO: 201855 - DNA, 23 bp, Artificial sequence
  SiRNA target sequence
acaaatatcaaaggctgaatatt

SEQ ID NO: 201856 - DNA, 23 bp, Artificial sequence
  SiRNA target sequence
caaatatcaaaggctgaatattt

SEQ ID NO: 201857 - DNA, 23 bp, Artificial sequence
  SiRNA target sequence
aaatatcaaaggctgaatatttt

SEQ ID NO: 201858 - DNA, 23 bp, Artificial sequence
  SiRNA target sequence
aatatcaaaggctgaatatttta

SEQ ID NO: 201859 - DNA, 23 bp, Artificial sequence
  SiRNA target sequence
atatcaaaggctgaatattttaa

SEQ ID NO: 201860 - DNA, 23 bp, Artificial sequence
  SiRNA target sequence
tatcaaaggctgaatattttaat

SEQ ID NO: 201861 - DNA, 23 bp, Artificial sequence
  SiRNA target sequence
atcaaaggctgaatattttaata

SEQ ID NO: 201862 - DNA, 23 bp, Artificial sequence
  SiRNA target sequence
tcaaaggctgaatattttaatac

SEQ ID NO: 201863 - DNA, 23 bp, Artificial sequence
  SiRNA target sequence
caaaggctgaatattttaatact

SEQ ID NO: 201864 - DNA, 23 bp, Artificial sequence
  SiRNA target sequence
aaaggctgaatattttaatactt

SEQ ID NO: 201865 - DNA, 23 bp, Artificial sequence
  SiRNA target sequence
aaggctgaatattttaatacttt

SEQ ID NO: 201866 - DNA, 23 bp, Artificial sequence
  SiRNA target sequence
aggctgaatattttaatactttt

SEQ ID NO: 201867 - DNA, 23 bp, Artificial sequence
  SiRNA target sequence
ggctgaatattttaatactttta

SEQ ID NO: 201868 - DNA, 23 bp, Artificial sequence
  SiRNA target sequence
gctgaatattttaatacttttat

SEQ ID NO: 201869 - DNA, 23 bp, Artificial sequence
  SiRNA target sequence
ctgaatattttaatacttttatg

SEQ ID NO: 201870 - DNA, 23 bp, Artificial sequence
  SiRNA target sequence
tgaatattttaatacttttatga

SEQ ID NO: 201871 - DNA, 23 bp, Artificial sequence
  SiRNA target sequence
gaatattttaatacttttatgaa

SEQ ID NO: 201872 - DNA, 23 bp, Artificial sequence
  SiRNA target sequence
aatattttaatacttttatgaat

SEQ ID NO: 201873 - DNA, 23 bp, Artificial sequence
  SiRNA target sequence
atattttaatacttttatgaatg

SEQ ID NO: 201874 - DNA, 23 bp, Artificial sequence
  SiRNA target sequence
tattttaatacttttatgaatgc

SEQ ID NO: 201875 - DNA, 23 bp, Artificial sequence
  SiRNA target sequence
attttaatacttttatgaatgct

SEQ ID NO: 201876 - DNA, 23 bp, Artificial sequence
  SiRNA target sequence
ttttaatacttttatgaatgcta

SEQ ID NO: 201877 - DNA, 23 bp, Artificial sequence
  SiRNA target sequence
tttaatacttttatgaatgctaa

SEQ ID NO: 201878 - DNA, 23 bp, Artificial sequence
  SiRNA target sequence
ttaatacttttatgaatgctaaa

SEQ ID NO: 201879 - DNA, 23 bp, Artificial sequence
  SiRNA target sequence
taatacttttatgaatgctaaaa

SEQ ID NO: 201880 - DNA, 23 bp, Artificial sequence
  SiRNA target sequence
aatacttttatgaatgctaaaaa

SEQ ID NO: 201881 - DNA, 23 bp, Artificial sequence
  SiRNA target sequence
atacttttatgaatgctaaaaag

SEQ ID NO: 201882 - DNA, 23 bp, Artificial sequence
  SiRNA target sequence
tacttttatgaatgctaaaaaga

SEQ ID NO: 201883 - DNA, 23 bp, Artificial sequence
  SiRNA target sequence
acttttatgaatgctaaaaagaa

SEQ ID NO: 201884 - DNA, 23 bp, Artificial sequence
  SiRNA target sequence
cttttatgaatgctaaaaagaac

SEQ ID NO: 201885 - DNA, 23 bp, Artificial sequence
  SiRNA target sequence
ttttatgaatgctaaaaagaaca

SEQ ID NO: 201886 - DNA, 23 bp, Artificial sequence
  SiRNA target sequence
tttatgaatgctaaaaagaacat

SEQ ID NO: 201887 - DNA, 23 bp, Artificial sequence
  SiRNA target sequence
ttatgaatgctaaaaagaacatt

SEQ ID NO: 201888 - DNA, 23 bp, Artificial sequence
  SiRNA target sequence
tatgaatgctaaaaagaacattc

SEQ ID NO: 201889 - DNA, 23 bp, Artificial sequence
  SiRNA target sequence
atgaatgctaaaaagaacattcc

SEQ ID NO: 201890 - DNA, 23 bp, Artificial sequence
  SiRNA target sequence
tgaatgctaaaaagaacattcca

SEQ ID NO: 201891 - DNA, 23 bp, Artificial sequence
  SiRNA target sequence
gaatgctaaaaagaacattccac

SEQ ID NO: 201892 - DNA, 23 bp, Artificial sequence
  SiRNA target sequence
aatgctaaaaagaacattccact

SEQ ID NO: 201893 - DNA, 23 bp, Artificial sequence
  SiRNA target sequence
atgctaaaaagaacattccactg

SEQ ID NO: 201894 - DNA, 23 bp, Artificial sequence
  SiRNA target sequence
tgctaaaaagaacattccactgt

SEQ ID NO: 201895 - DNA, 23 bp, Artificial sequence
  SiRNA target sequence
gctaaaaagaacattccactgta

SEQ ID NO: 201896 - DNA, 23 bp, Artificial sequence
  SiRNA target sequence
ctaaaaagaacattccactgtaa

SEQ ID NO: 201897 - DNA, 23 bp, Artificial sequence
  SiRNA target sequence
taaaaagaacattccactgtaat

SEQ ID NO: 201898 - DNA, 23 bp, Artificial sequence
  SiRNA target sequence
aaaaagaacattccactgtaatt

SEQ ID NO: 201899 - DNA, 23 bp, Artificial sequence
  SiRNA target sequence
aaaagaacattccactgtaattt

SEQ ID NO: 201900 - DNA, 23 bp, Artificial sequence
  SiRNA target sequence
aaagaacattccactgtaatttt

SEQ ID NO: 201901 - DNA, 23 bp, Artificial sequence
  SiRNA target sequence
aagaacattccactgtaattttc

SEQ ID NO: 201902 - DNA, 23 bp, Artificial sequence
  SiRNA target sequence
agaacattccactgtaattttcg

SEQ ID NO: 201903 - DNA, 23 bp, Artificial sequence
  SiRNA target sequence
gaacattccactgtaattttcga

SEQ ID NO: 201904 - DNA, 23 bp, Artificial sequence
  SiRNA target sequence
aacattccactgtaattttcgat

SEQ ID NO: 201905 - DNA, 23 bp, Artificial sequence
  SiRNA target sequence
acattccactgtaattttcgatc

SEQ ID NO: 201906 - DNA, 23 bp, Artificial sequence
  SiRNA target sequence
cattccactgtaattttcgatcg

SEQ ID NO: 201907 - DNA, 23 bp, Artificial sequence
  SiRNA target sequence
attccactgtaattttcgatcgt

SEQ ID NO: 201908 - DNA, 23 bp, Artificial sequence
  SiRNA target sequence
ttccactgtaattttcgatcgta

SEQ ID NO: 201909 - DNA, 23 bp, Artificial sequence
  SiRNA target sequence
tccactgtaattttcgatcgtat

SEQ ID NO: 201910 - DNA, 23 bp, Artificial sequence
  SiRNA target sequence
ccactgtaattttcgatcgtata

SEQ ID NO: 201911 - DNA, 23 bp, Artificial sequence
  SiRNA target sequence
cactgtaattttcgatcgtataa

SEQ ID NO: 201912 - DNA, 23 bp, Artificial sequence
  SiRNA target sequence
actgtaattttcgatcgtataaa

SEQ ID NO: 201913 - DNA, 23 bp, Artificial sequence
  SiRNA target sequence
ctgtaattttcgatcgtataaat

SEQ ID NO: 201914 - DNA, 23 bp, Artificial sequence
  SiRNA target sequence
tgtaattttcgatcgtataaatg

SEQ ID NO: 201915 - DNA, 23 bp, Artificial sequence
  SiRNA target sequence
gtaattttcgatcgtataaatgt

SEQ ID NO: 201916 - DNA, 23 bp, Artificial sequence
  SiRNA target sequence
taattttcgatcgtataaatgta

SEQ ID NO: 201917 - DNA, 23 bp, Artificial sequence
  SiRNA target sequence
aattttcgatcgtataaatgtac

SEQ ID NO: 201918 - DNA, 23 bp, Artificial sequence
  SiRNA target sequence
attttcgatcgtataaatgtacg

SEQ ID NO: 201919 - DNA, 23 bp, Artificial sequence
  SiRNA target sequence
ttttcgatcgtataaatgtacga

SEQ ID NO: 201920 - DNA, 23 bp, Artificial sequence
  SiRNA target sequence
tttcgatcgtataaatgtacgac

SEQ ID NO: 201921 - DNA, 23 bp, Artificial sequence
  SiRNA target sequence
ttcgatcgtataaatgtacgaca

SEQ ID NO: 201922 - DNA, 23 bp, Artificial sequence
  SiRNA target sequence
tcgatcgtataaatgtacgacat

SEQ ID NO: 201923 - DNA, 23 bp, Artificial sequence
  SiRNA target sequence
cgatcgtataaatgtacgacatt

SEQ ID NO: 201924 - DNA, 23 bp, Artificial sequence
  SiRNA target sequence
gatcgtataaatgtacgacattt

SEQ ID NO: 201925 - DNA, 23 bp, Artificial sequence
  SiRNA target sequence
atcgtataaatgtacgacatttt

SEQ ID NO: 201926 - DNA, 23 bp, Artificial sequence
  SiRNA target sequence
tcgtataaatgtacgacattttt

SEQ ID NO: 201927 - DNA, 23 bp, Artificial sequence
  SiRNA target sequence
cgtataaatgtacgacatttttt

SEQ ID NO: 201928 - DNA, 23 bp, Artificial sequence
  SiRNA target sequence
gtataaatgtacgacattttttt

SEQ ID NO: 201929 - DNA, 23 bp, Artificial sequence
  SiRNA target sequence
tataaatgtacgacattttttta

SEQ ID NO: 201930 - DNA, 23 bp, Artificial sequence
  SiRNA target sequence
ataaatgtacgacatttttttaa

SEQ ID NO: 201931 - DNA, 23 bp, Artificial sequence
  SiRNA target sequence
taaatgtacgacatttttttaaa

SEQ ID NO: 201932 - DNA, 23 bp, Artificial sequence
  SiRNA target sequence
aaatgtacgacatttttttaaaa

SEQ ID NO: 201933 - DNA, 23 bp, Artificial sequence
  SiRNA target sequence
aatgtacgacatttttttaaaaa

SEQ ID NO: 201934 - DNA, 23 bp, Artificial sequence
  SiRNA target sequence
atgtacgacatttttttaaaaaa

SEQ ID NO: 201935 - DNA, 23 bp, Artificial sequence
  SiRNA target sequence
tgtacgacatttttttaaaaaat

SEQ ID NO: 201936 - DNA, 23 bp, Artificial sequence
  SiRNA target sequence
gtacgacatttttttaaaaaata

SEQ ID NO: 201937 - DNA, 23 bp, Artificial sequence
  SiRNA target sequence
tacgacatttttttaaaaaatac

SEQ ID NO: 201938 - DNA, 23 bp, Artificial sequence
  SiRNA target sequence
acgacatttttttaaaaaataca

SEQ ID NO: 201939 - DNA, 23 bp, Artificial sequence
  SiRNA target sequence
cgacatttttttaaaaaatacag

SEQ ID NO: 201940 - DNA, 23 bp, Artificial sequence
  SiRNA target sequence
gacatttttttaaaaaatacaga

SEQ ID NO: 201941 - DNA, 23 bp, Artificial sequence
  SiRNA target sequence
acatttttttaaaaaatacagaa

SEQ ID NO: 201942 - DNA, 23 bp, Artificial sequence
  SiRNA target sequence
catttttttaaaaaatacagaaa

SEQ ID NO: 201943 - DNA, 23 bp, Artificial sequence
  SiRNA target sequence
atttttttaaaaaatacagaaat

SEQ ID NO: 201944 - DNA, 23 bp, Artificial sequence
  SiRNA target sequence
tttttttaaaaaatacagaaatc

SEQ ID NO: 201945 - DNA, 23 bp, Artificial sequence
  SiRNA target sequence
ttttttaaaaaatacagaaatcc

SEQ ID NO: 201946 - DNA, 23 bp, Artificial sequence
  SiRNA target sequence
tttttaaaaaatacagaaatcca

SEQ ID NO: 201947 - DNA, 23 bp, Artificial sequence
  SiRNA target sequence
ttttaaaaaatacagaaatccat

SEQ ID NO: 201948 - DNA, 23 bp, Artificial sequence
  SiRNA target sequence
tttaaaaaatacagaaatccatg

SEQ ID NO: 201949 - DNA, 23 bp, Artificial sequence
  SiRNA target sequence
ttaaaaaatacagaaatccatga

SEQ ID NO: 201950 - DNA, 23 bp, Artificial sequence
  SiRNA target sequence
taaaaaatacagaaatccatgaa

SEQ ID NO: 201951 - DNA, 23 bp, Artificial sequence
  SiRNA target sequence
aaaaaatacagaaatccatgaaa

SEQ ID NO: 201952 - DNA, 23 bp, Artificial sequence
  SiRNA target sequence
aaaaatacagaaatccatgaaaa

SEQ ID NO: 201953 - DNA, 23 bp, Artificial sequence
  SiRNA target sequence
aaaatacagaaatccatgaaaaa

SEQ ID NO: 201954 - DNA, 23 bp, Artificial sequence
  SiRNA target sequence
aaatacagaaatccatgaaaaag

SEQ ID NO: 201955 - DNA, 23 bp, Artificial sequence
  SiRNA target sequence
aatacagaaatccatgaaaaagc

SEQ ID NO: 201956 - DNA, 23 bp, Artificial sequence
  SiRNA target sequence
atacagaaatccatgaaaaagca

SEQ ID NO: 201957 - DNA, 23 bp, Artificial sequence
  SiRNA target sequence
tacagaaatccatgaaaaagcaa

SEQ ID NO: 201958 - DNA, 23 bp, Artificial sequence
  SiRNA target sequence
acagaaatccatgaaaaagcaag

SEQ ID NO: 201959 - DNA, 23 bp, Artificial sequence
  SiRNA target sequence
cagaaatccatgaaaaagcaagt

SEQ ID NO: 201960 - DNA, 23 bp, Artificial sequence
  SiRNA target sequence
agaaatccatgaaaaagcaagtc

SEQ ID NO: 201961 - DNA, 23 bp, Artificial sequence
  SiRNA target sequence
gaaatccatgaaaaagcaagtcc

SEQ ID NO: 201962 - DNA, 23 bp, Artificial sequence
  SiRNA target sequence
aaatccatgaaaaagcaagtcct

SEQ ID NO: 201963 - DNA, 23 bp, Artificial sequence
  SiRNA target sequence
aatccatgaaaaagcaagtcctt

SEQ ID NO: 201964 - DNA, 23 bp, Artificial sequence
  SiRNA target sequence
atccatgaaaaagcaagtccttc

SEQ ID NO: 201965 - DNA, 23 bp, Artificial sequence
  SiRNA target sequence
tccatgaaaaagcaagtccttca

SEQ ID NO: 201966 - DNA, 23 bp, Artificial sequence
  SiRNA target sequence
ccatgaaaaagcaagtccttcaa

SEQ ID NO: 201967 - DNA, 23 bp, Artificial sequence
  SiRNA target sequence
catgaaaaagcaagtccttcaat

SEQ ID NO: 201968 - DNA, 23 bp, Artificial sequence
  SiRNA target sequence
atgaaaaagcaagtccttcaatg

SEQ ID NO: 201969 - DNA, 23 bp, Artificial sequence
  SiRNA target sequence
tgaaaaagcaagtccttcaatgg

SEQ ID NO: 201970 - DNA, 23 bp, Artificial sequence
  SiRNA target sequence
gaaaaagcaagtccttcaatggc

SEQ ID NO: 201971 - DNA, 23 bp, Artificial sequence
  SiRNA target sequence
aaaaagcaagtccttcaatggca

SEQ ID NO: 201972 - DNA, 23 bp, Artificial sequence
  SiRNA target sequence
aaaagcaagtccttcaatggcag

SEQ ID NO: 201973 - DNA, 23 bp, Artificial sequence
  SiRNA target sequence
aaagcaagtccttcaatggcaga

SEQ ID NO: 201974 - DNA, 23 bp, Artificial sequence
  SiRNA target sequence
aagcaagtccttcaatggcagaa

SEQ ID NO: 201975 - DNA, 23 bp, Artificial sequence
  SiRNA target sequence
agcaagtccttcaatggcagaat

SEQ ID NO: 201976 - DNA, 23 bp, Artificial sequence
  SiRNA target sequence
gcaagtccttcaatggcagaatt

SEQ ID NO: 201977 - DNA, 23 bp, Artificial sequence
  SiRNA target sequence
caagtccttcaatggcagaattg

SEQ ID NO: 201978 - DNA, 23 bp, Artificial sequence
  SiRNA target sequence
aagtccttcaatggcagaattgt

SEQ ID NO: 201979 - DNA, 23 bp, Artificial sequence
  SiRNA target sequence
agtccttcaatggcagaattgta

SEQ ID NO: 201980 - DNA, 23 bp, Artificial sequence
  SiRNA target sequence
gtccttcaatggcagaattgtag

SEQ ID NO: 201981 - DNA, 23 bp, Artificial sequence
  SiRNA target sequence
tccttcaatggcagaattgtaga

SEQ ID NO: 201982 - DNA, 23 bp, Artificial sequence
  SiRNA target sequence
ccttcaatggcagaattgtagat

SEQ ID NO: 201983 - DNA, 23 bp, Artificial sequence
  SiRNA target sequence
cttcaatggcagaattgtagatt

SEQ ID NO: 201984 - DNA, 23 bp, Artificial sequence
  SiRNA target sequence
ttcaatggcagaattgtagattg

SEQ ID NO: 201985 - DNA, 23 bp, Artificial sequence
  SiRNA target sequence
tcaatggcagaattgtagattga

SEQ ID NO: 201986 - DNA, 23 bp, Artificial sequence
  SiRNA target sequence
caatggcagaattgtagattgat

SEQ ID NO: 201987 - DNA, 23 bp, Artificial sequence
  SiRNA target sequence
aatggcagaattgtagattgatg

SEQ ID NO: 201988 - DNA, 23 bp, Artificial sequence
  SiRNA target sequence
atggcagaattgtagattgatgc

SEQ ID NO: 201989 - DNA, 23 bp, Artificial sequence
  SiRNA target sequence
tggcagaattgtagattgatgct

SEQ ID NO: 201990 - DNA, 23 bp, Artificial sequence
  SiRNA target sequence
ggcagaattgtagattgatgctc

SEQ ID NO: 201991 - DNA, 23 bp, Artificial sequence
  SiRNA target sequence
gcagaattgtagattgatgctcc

SEQ ID NO: 201992 - DNA, 23 bp, Artificial sequence
  SiRNA target sequence
cagaattgtagattgatgctccc

SEQ ID NO: 201993 - DNA, 23 bp, Artificial sequence
  SiRNA target sequence
agaattgtagattgatgctccca

SEQ ID NO: 201994 - DNA, 23 bp, Artificial sequence
  SiRNA target sequence
gaattgtagattgatgctcccat

SEQ ID NO: 201995 - DNA, 23 bp, Artificial sequence
  SiRNA target sequence
aattgtagattgatgctcccata

SEQ ID NO: 201996 - DNA, 23 bp, Artificial sequence
  SiRNA target sequence
attgtagattgatgctcccataa

SEQ ID NO: 201997 - DNA, 23 bp, Artificial sequence
  SiRNA target sequence
ttgtagattgatgctcccataac

SEQ ID NO: 201998 - DNA, 23 bp, Artificial sequence
  SiRNA target sequence
tgtagattgatgctcccataacg

SEQ ID NO: 201999 - DNA, 23 bp, Artificial sequence
  SiRNA target sequence
gtagattgatgctcccataacga

SEQ ID NO: 202000 - DNA, 23 bp, Artificial sequence
  SiRNA target sequence
tagattgatgctcccataacgat

SEQ ID NO: 202001 - DNA, 23 bp, Artificial sequence
  SiRNA target sequence
agattgatgctcccataacgatt

SEQ ID NO: 202002 - DNA, 23 bp, Artificial sequence
  SiRNA target sequence
gattgatgctcccataacgatta

SEQ ID NO: 202003 - DNA, 23 bp, Artificial sequence
  SiRNA target sequence
attgatgctcccataacgattat

SEQ ID NO: 202004 - DNA, 23 bp, Artificial sequence
  SiRNA target sequence
ttgatgctcccataacgattatt

SEQ ID NO: 202005 - DNA, 23 bp, Artificial sequence
  SiRNA target sequence
tgatgctcccataacgattattg

SEQ ID NO: 202006 - DNA, 23 bp, Artificial sequence
  SiRNA target sequence
gatgctcccataacgattattga

SEQ ID NO: 202007 - DNA, 23 bp, Artificial sequence
  SiRNA target sequence
atgctcccataacgattattgac

SEQ ID NO: 202008 - DNA, 23 bp, Artificial sequence
  SiRNA target sequence
tgctcccataacgattattgacc

SEQ ID NO: 202009 - DNA, 23 bp, Artificial sequence
  SiRNA target sequence
gctcccataacgattattgaccc

SEQ ID NO: 202010 - DNA, 23 bp, Artificial sequence
  SiRNA target sequence
ctcccataacgattattgacccc

SEQ ID NO: 202011 - DNA, 23 bp, Artificial sequence
  SiRNA target sequence
tcccataacgattattgacccca

SEQ ID NO: 202012 - DNA, 23 bp, Artificial sequence
  SiRNA target sequence
cccataacgattattgaccccaa

SEQ ID NO: 202013 - DNA, 23 bp, Artificial sequence
  SiRNA target sequence
ccataacgattattgaccccaac

SEQ ID NO: 202014 - DNA, 23 bp, Artificial sequence
  SiRNA target sequence
cataacgattattgaccccaaca

SEQ ID NO: 202015 - DNA, 23 bp, Artificial sequence
  SiRNA target sequence
ataacgattattgaccccaacaa

SEQ ID NO: 202016 - DNA, 23 bp, Artificial sequence
  SiRNA target sequence
taacgattattgaccccaacaac

SEQ ID NO: 202017 - DNA, 23 bp, Artificial sequence
  SiRNA target sequence
aacgattattgaccccaacaaca

SEQ ID NO: 202018 - DNA, 23 bp, Artificial sequence
  SiRNA target sequence
acgattattgaccccaacaacaa

SEQ ID NO: 202019 - DNA, 23 bp, Artificial sequence
  SiRNA target sequence
cgattattgaccccaacaacaag

SEQ ID NO: 202020 - DNA, 23 bp, Artificial sequence
  SiRNA target sequence
gattattgaccccaacaacaaga

SEQ ID NO: 202021 - DNA, 23 bp, Artificial sequence
  SiRNA target sequence
attattgaccccaacaacaagaa

SEQ ID NO: 202022 - DNA, 23 bp, Artificial sequence
  SiRNA target sequence
ttattgaccccaacaacaagaat

SEQ ID NO: 202023 - DNA, 23 bp, Artificial sequence
  SiRNA target sequence
tattgaccccaacaacaagaata

SEQ ID NO: 202024 - DNA, 23 bp, Artificial sequence
  SiRNA target sequence
attgaccccaacaacaagaataa

SEQ ID NO: 202025 - DNA, 23 bp, Artificial sequence
  SiRNA target sequence
ttgaccccaacaacaagaataaa

SEQ ID NO: 202026 - DNA, 23 bp, Artificial sequence
  SiRNA target sequence
tgaccccaacaacaagaataaag

SEQ ID NO: 202027 - DNA, 23 bp, Artificial sequence
  SiRNA target sequence
gaccccaacaacaagaataaagg

SEQ ID NO: 202028 - DNA, 23 bp, Artificial sequence
  SiRNA target sequence
accccaacaacaagaataaaggt

SEQ ID NO: 202029 - DNA, 23 bp, Artificial sequence
  SiRNA target sequence
ccccaacaacaagaataaaggtg

SEQ ID NO: 202030 - DNA, 23 bp, Artificial sequence
  SiRNA target sequence
cccaacaacaagaataaaggtgt

SEQ ID NO: 202031 - DNA, 23 bp, Artificial sequence
  SiRNA target sequence
ccaacaacaagaataaaggtgtt

SEQ ID NO: 202032 - DNA, 23 bp, Artificial sequence
  SiRNA target sequence
caacaacaagaataaaggtgtta

SEQ ID NO: 202033 - DNA, 23 bp, Artificial sequence
  SiRNA target sequence
aacaacaagaataaaggtgttaa

SEQ ID NO: 202034 - DNA, 23 bp, Artificial sequence
  SiRNA target sequence
acaacaagaataaaggtgttaag

SEQ ID NO: 202035 - DNA, 23 bp, Artificial sequence
  SiRNA target sequence
caacaagaataaaggtgttaaga

SEQ ID NO: 202036 - DNA, 23 bp, Artificial sequence
  SiRNA target sequence
aacaagaataaaggtgttaagag

SEQ ID NO: 202037 - DNA, 23 bp, Artificial sequence
  SiRNA target sequence
acaagaataaaggtgttaagagt

SEQ ID NO: 202038 - DNA, 23 bp, Artificial sequence
  SiRNA target sequence
caagaataaaggtgttaagagtc

SEQ ID NO: 202039 - DNA, 23 bp, Artificial sequence
  SiRNA target sequence
aagaataaaggtgttaagagtcc

SEQ ID NO: 202040 - DNA, 23 bp, Artificial sequence
  SiRNA target sequence
agaataaaggtgttaagagtccc

SEQ ID NO: 202041 - DNA, 23 bp, Artificial sequence
  SiRNA target sequence
gaataaaggtgttaagagtccca

SEQ ID NO: 202042 - DNA, 23 bp, Artificial sequence
  SiRNA target sequence
aataaaggtgttaagagtcccat

SEQ ID NO: 202043 - DNA, 23 bp, Artificial sequence
  SiRNA target sequence
ataaaggtgttaagagtcccata

SEQ ID NO: 202044 - DNA, 23 bp, Artificial sequence
  SiRNA target sequence
taaaggtgttaagagtcccatag

SEQ ID NO: 202045 - DNA, 23 bp, Artificial sequence
  SiRNA target sequence
aaaggtgttaagagtcccatagt

SEQ ID NO: 202046 - DNA, 23 bp, Artificial sequence
  SiRNA target sequence
aaggtgttaagagtcccatagta

SEQ ID NO: 202047 - DNA, 23 bp, Artificial sequence
  SiRNA target sequence
aggtgttaagagtcccatagtaa

SEQ ID NO: 202048 - DNA, 23 bp, Artificial sequence
  SiRNA target sequence
ggtgttaagagtcccatagtaat

SEQ ID NO: 202049 - DNA, 23 bp, Artificial sequence
  SiRNA target sequence
gtgttaagagtcccatagtaatc

SEQ ID NO: 202050 - DNA, 23 bp, Artificial sequence
  SiRNA target sequence
tgttaagagtcccatagtaatcc

SEQ ID NO: 202051 - DNA, 23 bp, Artificial sequence
  SiRNA target sequence
gttaagagtcccatagtaatcca

SEQ ID NO: 202052 - DNA, 23 bp, Artificial sequence
  SiRNA target sequence
ttaagagtcccatagtaatccat

SEQ ID NO: 202053 - DNA, 23 bp, Artificial sequence
  SiRNA target sequence
taagagtcccatagtaatccatc

SEQ ID NO: 202054 - DNA, 23 bp, Artificial sequence
  SiRNA target sequence
aagagtcccatagtaatccatcc

SEQ ID NO: 202055 - DNA, 23 bp, Artificial sequence
  SiRNA target sequence
agagtcccatagtaatccatcca

SEQ ID NO: 202056 - DNA, 23 bp, Artificial sequence
  SiRNA target sequence
gagtcccatagtaatccatccac

SEQ ID NO: 202057 - DNA, 23 bp, Artificial sequence
  SiRNA target sequence
agtcccatagtaatccatccact

SEQ ID NO: 202058 - DNA, 23 bp, Artificial sequence
  SiRNA target sequence
gtcccatagtaatccatccacta

SEQ ID NO: 202059 - DNA, 23 bp, Artificial sequence
  SiRNA target sequence
tcccatagtaatccatccactac

SEQ ID NO: 202060 - DNA, 23 bp, Artificial sequence
  SiRNA target sequence
cccatagtaatccatccactact

SEQ ID NO: 202061 - DNA, 23 bp, Artificial sequence
  SiRNA target sequence
ccatagtaatccatccactactt

SEQ ID NO: 202062 - DNA, 23 bp, Artificial sequence
  SiRNA target sequence
catagtaatccatccactacttt

SEQ ID NO: 202063 - DNA, 23 bp, Artificial sequence
  SiRNA target sequence
atagtaatccatccactactttc

SEQ ID NO: 202064 - DNA, 23 bp, Artificial sequence
  SiRNA target sequence
tagtaatccatccactactttct

SEQ ID NO: 202065 - DNA, 23 bp, Artificial sequence
  SiRNA target sequence
agtaatccatccactactttcta

SEQ ID NO: 202066 - DNA, 23 bp, Artificial sequence
  SiRNA target sequence
gtaatccatccactactttctac

SEQ ID NO: 202067 - DNA, 23 bp, Artificial sequence
  SiRNA target sequence
taatccatccactactttctact

SEQ ID NO: 202068 - DNA, 23 bp, Artificial sequence
  SiRNA target sequence
aatccatccactactttctacta

SEQ ID NO: 202069 - DNA, 23 bp, Artificial sequence
  SiRNA target sequence
atccatccactactttctactaa

SEQ ID NO: 202070 - DNA, 23 bp, Artificial sequence
  SiRNA target sequence
tccatccactactttctactaaa

SEQ ID NO: 202071 - DNA, 23 bp, Artificial sequence
  SiRNA target sequence
ccatccactactttctactaaag

SEQ ID NO: 202072 - DNA, 23 bp, Artificial sequence
  SiRNA target sequence
catccactactttctactaaagt

SEQ ID NO: 202073 - DNA, 23 bp, Artificial sequence
  SiRNA target sequence
atccactactttctactaaagta

SEQ ID NO: 202074 - DNA, 23 bp, Artificial sequence
  SiRNA target sequence
tccactactttctactaaagtag

SEQ ID NO: 202075 - DNA, 23 bp, Artificial sequence
  SiRNA target sequence
ccactactttctactaaagtaga

SEQ ID NO: 202076 - DNA, 23 bp, Artificial sequence
  SiRNA target sequence
cactactttctactaaagtagaa

SEQ ID NO: 202077 - DNA, 23 bp, Artificial sequence
  SiRNA target sequence
actactttctactaaagtagaaa

SEQ ID NO: 202078 - DNA, 23 bp, Artificial sequence
  SiRNA target sequence
ctactttctactaaagtagaaaa

SEQ ID NO: 202079 - DNA, 23 bp, Artificial sequence
  SiRNA target sequence
tactttctactaaagtagaaaat

SEQ ID NO: 202080 - DNA, 23 bp, Artificial sequence
  SiRNA target sequence
actttctactaaagtagaaaatg

SEQ ID NO: 202081 - DNA, 23 bp, Artificial sequence
  SiRNA target sequence
ctttctactaaagtagaaaatgc

SEQ ID NO: 202082 - DNA, 23 bp, Artificial sequence
  SiRNA target sequence
tttctactaaagtagaaaatgct

SEQ ID NO: 202083 - DNA, 23 bp, Artificial sequence
  SiRNA target sequence
ttctactaaagtagaaaatgctg

SEQ ID NO: 202084 - DNA, 23 bp, Artificial sequence
  SiRNA target sequence
tctactaaagtagaaaatgctga

SEQ ID NO: 202085 - DNA, 23 bp, Artificial sequence
  SiRNA target sequence
ctactaaagtagaaaatgctgac

SEQ ID NO: 202086 - DNA, 23 bp, Artificial sequence
  SiRNA target sequence
tactaaagtagaaaatgctgaca

SEQ ID NO: 202087 - DNA, 23 bp, Artificial sequence
  SiRNA target sequence
actaaagtagaaaatgctgacaa

SEQ ID NO: 202088 - DNA, 23 bp, Artificial sequence
  SiRNA target sequence
ctaaagtagaaaatgctgacaaa

SEQ ID NO: 202089 - DNA, 23 bp, Artificial sequence
  SiRNA target sequence
taaagtagaaaatgctgacaaat

SEQ ID NO: 202090 - DNA, 23 bp, Artificial sequence
  SiRNA target sequence
aaagtagaaaatgctgacaaatt

SEQ ID NO: 202091 - DNA, 23 bp, Artificial sequence
  SiRNA target sequence
aagtagaaaatgctgacaaatta

SEQ ID NO: 202092 - DNA, 23 bp, Artificial sequence
  SiRNA target sequence
agtagaaaatgctgacaaattaa

SEQ ID NO: 202093 - DNA, 23 bp, Artificial sequence
  SiRNA target sequence
gtagaaaatgctgacaaattaag

SEQ ID NO: 202094 - DNA, 23 bp, Artificial sequence
  SiRNA target sequence
tagaaaatgctgacaaattaagt

SEQ ID NO: 202095 - DNA, 23 bp, Artificial sequence
  SiRNA target sequence
agaaaatgctgacaaattaagtg

SEQ ID NO: 202096 - DNA, 23 bp, Artificial sequence
  SiRNA target sequence
gaaaatgctgacaaattaagtgt

SEQ ID NO: 202097 - DNA, 23 bp, Artificial sequence
  SiRNA target sequence
aaaatgctgacaaattaagtgtt

SEQ ID NO: 202098 - DNA, 23 bp, Artificial sequence
  SiRNA target sequence
aaatgctgacaaattaagtgtta

SEQ ID NO: 202099 - DNA, 23 bp, Artificial sequence
  SiRNA target sequence
aatgctgacaaattaagtgttat

SEQ ID NO: 202100 - DNA, 23 bp, Artificial sequence
  SiRNA target sequence
atgctgacaaattaagtgttatt

SEQ ID NO: 202101 - DNA, 23 bp, Artificial sequence
  SiRNA target sequence
tgctgacaaattaagtgttatta

SEQ ID NO: 202102 - DNA, 23 bp, Artificial sequence
  SiRNA target sequence
gctgacaaattaagtgttattac

SEQ ID NO: 202103 - DNA, 23 bp, Artificial sequence
  SiRNA target sequence
ctgacaaattaagtgttattaca

SEQ ID NO: 202104 - DNA, 23 bp, Artificial sequence
  SiRNA target sequence
tgacaaattaagtgttattacag

SEQ ID NO: 202105 - DNA, 23 bp, Artificial sequence
  SiRNA target sequence
gacaaattaagtgttattacagt

SEQ ID NO: 202106 - DNA, 23 bp, Artificial sequence
  SiRNA target sequence
acaaattaagtgttattacagta

SEQ ID NO: 202107 - DNA, 23 bp, Artificial sequence
  SiRNA target sequence
caaattaagtgttattacagtaa

SEQ ID NO: 202108 - DNA, 23 bp, Artificial sequence
  SiRNA target sequence
aaattaagtgttattacagtaac

SEQ ID NO: 202109 - DNA, 23 bp, Artificial sequence
  SiRNA target sequence
aattaagtgttattacagtaact

SEQ ID NO: 202110 - DNA, 23 bp, Artificial sequence
  SiRNA target sequence
attaagtgttattacagtaactg

SEQ ID NO: 202111 - DNA, 23 bp, Artificial sequence
  SiRNA target sequence
ttaagtgttattacagtaactgc

SEQ ID NO: 202112 - DNA, 23 bp, Artificial sequence
  SiRNA target sequence
taagtgttattacagtaactgct

SEQ ID NO: 202113 - DNA, 23 bp, Artificial sequence
  SiRNA target sequence
aagtgttattacagtaactgcta

SEQ ID NO: 202114 - DNA, 23 bp, Artificial sequence
  SiRNA target sequence
agtgttattacagtaactgctac

SEQ ID NO: 202115 - DNA, 23 bp, Artificial sequence
  SiRNA target sequence
gtgttattacagtaactgctacc

SEQ ID NO: 202116 - DNA, 23 bp, Artificial sequence
  SiRNA target sequence
tgttattacagtaactgctacca

SEQ ID NO: 202117 - DNA, 23 bp, Artificial sequence
  SiRNA target sequence
gttattacagtaactgctaccaa

SEQ ID NO: 202118 - DNA, 23 bp, Artificial sequence
  SiRNA target sequence
ttattacagtaactgctaccaat

SEQ ID NO: 202119 - DNA, 23 bp, Artificial sequence
  SiRNA target sequence
tattacagtaactgctaccaata

SEQ ID NO: 202120 - DNA, 23 bp, Artificial sequence
  SiRNA target sequence
attacagtaactgctaccaatat

SEQ ID NO: 202121 - DNA, 23 bp, Artificial sequence
  SiRNA target sequence
ttacagtaactgctaccaatatt

SEQ ID NO: 202122 - DNA, 23 bp, Artificial sequence
  SiRNA target sequence
tacagtaactgctaccaatattt

SEQ ID NO: 202123 - DNA, 23 bp, Artificial sequence
  SiRNA target sequence
acagtaactgctaccaatatttg

SEQ ID NO: 202124 - DNA, 23 bp, Artificial sequence
  SiRNA target sequence
cagtaactgctaccaatatttga

SEQ ID NO: 202125 - DNA, 23 bp, Artificial sequence
  SiRNA target sequence
agtaactgctaccaatatttgat

SEQ ID NO: 202126 - DNA, 23 bp, Artificial sequence
  SiRNA target sequence
gtaactgctaccaatatttgatc

SEQ ID NO: 202127 - DNA, 23 bp, Artificial sequence
  SiRNA target sequence
taactgctaccaatatttgatct

SEQ ID NO: 202128 - DNA, 23 bp, Artificial sequence
  SiRNA target sequence
aactgctaccaatatttgatcta

SEQ ID NO: 202129 - DNA, 23 bp, Artificial sequence
  SiRNA target sequence
actgctaccaatatttgatctat

SEQ ID NO: 202130 - DNA, 23 bp, Artificial sequence
  SiRNA target sequence
ctgctaccaatatttgatctatt

SEQ ID NO: 202131 - DNA, 23 bp, Artificial sequence
  SiRNA target sequence
tgctaccaatatttgatctattg

SEQ ID NO: 202132 - DNA, 23 bp, Artificial sequence
  SiRNA target sequence
gctaccaatatttgatctattgt

SEQ ID NO: 202133 - DNA, 23 bp, Artificial sequence
  SiRNA target sequence
ctaccaatatttgatctattgta

SEQ ID NO: 202134 - DNA, 23 bp, Artificial sequence
  SiRNA target sequence
taccaatatttgatctattgtat

SEQ ID NO: 202135 - DNA, 23 bp, Artificial sequence
  SiRNA target sequence
accaatatttgatctattgtatt

SEQ ID NO: 202136 - DNA, 23 bp, Artificial sequence
  SiRNA target sequence
ccaatatttgatctattgtatta

SEQ ID NO: 202137 - DNA, 23 bp, Artificial sequence
  SiRNA target sequence
caatatttgatctattgtattaa

SEQ ID NO: 202138 - DNA, 23 bp, Artificial sequence
  SiRNA target sequence
aatatttgatctattgtattaaa

SEQ ID NO: 202139 - DNA, 23 bp, Artificial sequence
  SiRNA target sequence
atatttgatctattgtattaaat

SEQ ID NO: 202140 - DNA, 23 bp, Artificial sequence
  SiRNA target sequence
tatttgatctattgtattaaatt

SEQ ID NO: 202141 - DNA, 23 bp, Artificial sequence
  SiRNA target sequence
atttgatctattgtattaaattt

SEQ ID NO: 202142 - DNA, 23 bp, Artificial sequence
  SiRNA target sequence
tttgatctattgtattaaatttg

SEQ ID NO: 202143 - DNA, 23 bp, Artificial sequence
  SiRNA target sequence
ttgatctattgtattaaatttgc

SEQ ID NO: 202144 - DNA, 23 bp, Artificial sequence
  SiRNA target sequence
tgatctattgtattaaatttgcc

SEQ ID NO: 202145 - DNA, 23 bp, Artificial sequence
  SiRNA target sequence
gatctattgtattaaatttgccg

SEQ ID NO: 202146 - DNA, 23 bp, Artificial sequence
  SiRNA target sequence
atctattgtattaaatttgccgg

SEQ ID NO: 202147 - DNA, 23 bp, Artificial sequence
  SiRNA target sequence
tctattgtattaaatttgccgga

SEQ ID NO: 202148 - DNA, 23 bp, Artificial sequence
  SiRNA target sequence
ctattgtattaaatttgccggag

SEQ ID NO: 202149 - DNA, 23 bp, Artificial sequence
  SiRNA target sequence
tattgtattaaatttgccggagt

SEQ ID NO: 202150 - DNA, 23 bp, Artificial sequence
  SiRNA target sequence
attgtattaaatttgccggagta

SEQ ID NO: 202151 - DNA, 23 bp, Artificial sequence
  SiRNA target sequence
ttgtattaaatttgccggagtat

SEQ ID NO: 202152 - DNA, 23 bp, Artificial sequence
  SiRNA target sequence
tgtattaaatttgccggagtatt

SEQ ID NO: 202153 - DNA, 23 bp, Artificial sequence
  SiRNA target sequence
gtattaaatttgccggagtattc

SEQ ID NO: 202154 - DNA, 23 bp, Artificial sequence
  SiRNA target sequence
tattaaatttgccggagtattct

SEQ ID NO: 202155 - DNA, 23 bp, Artificial sequence
  SiRNA target sequence
attaaatttgccggagtattctc

SEQ ID NO: 202156 - DNA, 23 bp, Artificial sequence
  SiRNA target sequence
ttaaatttgccggagtattctcc

SEQ ID NO: 202157 - DNA, 23 bp, Artificial sequence
  SiRNA target sequence
taaatttgccggagtattctcct

SEQ ID NO: 202158 - DNA, 23 bp, Artificial sequence
  SiRNA target sequence
aaatttgccggagtattctccta

SEQ ID NO: 202159 - DNA, 23 bp, Artificial sequence
  SiRNA target sequence
aatttgccggagtattctcctac

SEQ ID NO: 202160 - DNA, 23 bp, Artificial sequence
  SiRNA target sequence
atttgccggagtattctcctacc

SEQ ID NO: 202161 - DNA, 23 bp, Artificial sequence
  SiRNA target sequence
tttgccggagtattctcctacct

SEQ ID NO: 202162 - DNA, 23 bp, Artificial sequence
  SiRNA target sequence
ttgccggagtattctcctacctc

SEQ ID NO: 202163 - DNA, 23 bp, Artificial sequence
  SiRNA target sequence
tgccggagtattctcctacctct

SEQ ID NO: 202164 - DNA, 23 bp, Artificial sequence
  SiRNA target sequence
gccggagtattctcctacctcta

SEQ ID NO: 202165 - DNA, 23 bp, Artificial sequence
  SiRNA target sequence
ccggagtattctcctacctctaa

SEQ ID NO: 202166 - DNA, 23 bp, Artificial sequence
  SiRNA target sequence
cggagtattctcctacctctaat

SEQ ID NO: 202167 - DNA, 23 bp, Artificial sequence
  SiRNA target sequence
ggagtattctcctacctctaatc

SEQ ID NO: 202168 - DNA, 23 bp, Artificial sequence
  SiRNA target sequence
gagtattctcctacctctaatcc

SEQ ID NO: 202169 - DNA, 23 bp, Artificial sequence
  SiRNA target sequence
agtattctcctacctctaatcct

SEQ ID NO: 202170 - DNA, 23 bp, Artificial sequence
  SiRNA target sequence
gtattctcctacctctaatccta

SEQ ID NO: 202171 - DNA, 23 bp, Artificial sequence
  SiRNA target sequence
tattctcctacctctaatcctaa

SEQ ID NO: 202172 - DNA, 23 bp, Artificial sequence
  SiRNA target sequence
attctcctacctctaatcctaaa

SEQ ID NO: 202173 - DNA, 23 bp, Artificial sequence
  SiRNA target sequence
ttctcctacctctaatcctaaac

SEQ ID NO: 202174 - DNA, 23 bp, Artificial sequence
  SiRNA target sequence
tctcctacctctaatcctaaact

SEQ ID NO: 202175 - DNA, 23 bp, Artificial sequence
  SiRNA target sequence
ctcctacctctaatcctaaactt

SEQ ID NO: 202176 - DNA, 23 bp, Artificial sequence
  SiRNA target sequence
tcctacctctaatcctaaacttt

SEQ ID NO: 202177 - DNA, 23 bp, Artificial sequence
  SiRNA target sequence
cctacctctaatcctaaactttt

SEQ ID NO: 202178 - DNA, 23 bp, Artificial sequence
  SiRNA target sequence
ctacctctaatcctaaacttttt

SEQ ID NO: 202179 - DNA, 23 bp, Artificial sequence
  SiRNA target sequence
tacctctaatcctaaactttttg

SEQ ID NO: 202180 - DNA, 23 bp, Artificial sequence
  SiRNA target sequence
acctctaatcctaaactttttga

SEQ ID NO: 202181 - DNA, 23 bp, Artificial sequence
  SiRNA target sequence
cctctaatcctaaactttttgac

SEQ ID NO: 202182 - DNA, 23 bp, Artificial sequence
  SiRNA target sequence
ctctaatcctaaactttttgacg

SEQ ID NO: 202183 - DNA, 23 bp, Artificial sequence
  SiRNA target sequence
tctaatcctaaactttttgacgc

SEQ ID NO: 202184 - DNA, 23 bp, Artificial sequence
  SiRNA target sequence
ctaatcctaaactttttgacgca

SEQ ID NO: 202185 - DNA, 23 bp, Artificial sequence
  SiRNA target sequence
taatcctaaactttttgacgcag

SEQ ID NO: 202186 - DNA, 23 bp, Artificial sequence
  SiRNA target sequence
aatcctaaactttttgacgcagc

SEQ ID NO: 202187 - DNA, 23 bp, Artificial sequence
  SiRNA target sequence
atcctaaactttttgacgcagct

SEQ ID NO: 202188 - DNA, 23 bp, Artificial sequence
  SiRNA target sequence
tcctaaactttttgacgcagctt

SEQ ID NO: 202189 - DNA, 23 bp, Artificial sequence
  SiRNA target sequence
cctaaactttttgacgcagcttt

SEQ ID NO: 202190 - DNA, 23 bp, Artificial sequence
  SiRNA target sequence
ctaaactttttgacgcagcttta

SEQ ID NO: 202191 - DNA, 23 bp, Artificial sequence
  SiRNA target sequence
taaactttttgacgcagctttaa

SEQ ID NO: 202192 - DNA, 23 bp, Artificial sequence
  SiRNA target sequence
aaactttttgacgcagctttaat

SEQ ID NO: 202193 - DNA, 23 bp, Artificial sequence
  SiRNA target sequence
aactttttgacgcagctttaatt

SEQ ID NO: 202194 - DNA, 23 bp, Artificial sequence
  SiRNA target sequence
actttttgacgcagctttaattc

SEQ ID NO: 202195 - DNA, 23 bp, Artificial sequence
  SiRNA target sequence
ctttttgacgcagctttaattcc

SEQ ID NO: 202196 - DNA, 23 bp, Artificial sequence
  SiRNA target sequence
tttttgacgcagctttaattcct

SEQ ID NO: 202197 - DNA, 23 bp, Artificial sequence
  SiRNA target sequence
ttttgacgcagctttaattcctg

SEQ ID NO: 202198 - DNA, 23 bp, Artificial sequence
  SiRNA target sequence
tttgacgcagctttaattcctgc

SEQ ID NO: 202199 - DNA, 23 bp, Artificial sequence
  SiRNA target sequence
ttgacgcagctttaattcctgct

SEQ ID NO: 202200 - DNA, 23 bp, Artificial sequence
  SiRNA target sequence
tgacgcagctttaattcctgctt

SEQ ID NO: 202201 - DNA, 23 bp, Artificial sequence
  SiRNA target sequence
gacgcagctttaattcctgcttt

SEQ ID NO: 202202 - DNA, 23 bp, Artificial sequence
  SiRNA target sequence
acgcagctttaattcctgcttta

SEQ ID NO: 202203 - DNA, 23 bp, Artificial sequence
  SiRNA target sequence
cgcagctttaattcctgctttat

SEQ ID NO: 202204 - DNA, 23 bp, Artificial sequence
  SiRNA target sequence
gcagctttaattcctgctttata

SEQ ID NO: 202205 - DNA, 23 bp, Artificial sequence
  SiRNA target sequence
cagctttaattcctgctttatag

SEQ ID NO: 202206 - DNA, 23 bp, Artificial sequence
  SiRNA target sequence
agctttaattcctgctttataga

SEQ ID NO: 202207 - DNA, 23 bp, Artificial sequence
  SiRNA target sequence
gctttaattcctgctttatagac

SEQ ID NO: 202208 - DNA, 23 bp, Artificial sequence
  SiRNA target sequence
ctttaattcctgctttatagaca

SEQ ID NO: 202209 - DNA, 23 bp, Artificial sequence
  SiRNA target sequence
tttaattcctgctttatagacag

SEQ ID NO: 202210 - DNA, 23 bp, Artificial sequence
  SiRNA target sequence
ttaattcctgctttatagacaga

SEQ ID NO: 202211 - DNA, 23 bp, Artificial sequence
  SiRNA target sequence
taattcctgctttatagacagat

SEQ ID NO: 202212 - DNA, 23 bp, Artificial sequence
  SiRNA target sequence
aattcctgctttatagacagatt

SEQ ID NO: 202213 - DNA, 23 bp, Artificial sequence
  SiRNA target sequence
attcctgctttatagacagattc

SEQ ID NO: 202214 - DNA, 23 bp, Artificial sequence
  SiRNA target sequence
ttcctgctttatagacagattca

SEQ ID NO: 202215 - DNA, 23 bp, Artificial sequence
  SiRNA target sequence
tcctgctttatagacagattcaa

SEQ ID NO: 202216 - DNA, 23 bp, Artificial sequence
  SiRNA target sequence
cctgctttatagacagattcaat

SEQ ID NO: 202217 - DNA, 23 bp, Artificial sequence
  SiRNA target sequence
ctgctttatagacagattcaatt

SEQ ID NO: 202218 - DNA, 23 bp, Artificial sequence
  SiRNA target sequence
tgctttatagacagattcaatta

SEQ ID NO: 202219 - DNA, 23 bp, Artificial sequence
  SiRNA target sequence
gctttatagacagattcaattaa

SEQ ID NO: 202220 - DNA, 23 bp, Artificial sequence
  SiRNA target sequence
ctttatagacagattcaattaaa

SEQ ID NO: 202221 - DNA, 23 bp, Artificial sequence
  SiRNA target sequence
tttatagacagattcaattaaat

SEQ ID NO: 202222 - DNA, 23 bp, Artificial sequence
  SiRNA target sequence
ttatagacagattcaattaaatt

SEQ ID NO: 202223 - DNA, 23 bp, Artificial sequence
  SiRNA target sequence
tatagacagattcaattaaatta

SEQ ID NO: 202224 - DNA, 23 bp, Artificial sequence
  SiRNA target sequence
atagacagattcaattaaattaa

SEQ ID NO: 202225 - DNA, 23 bp, Artificial sequence
  SiRNA target sequence
tagacagattcaattaaattaaa

SEQ ID NO: 202226 - DNA, 23 bp, Artificial sequence
  SiRNA target sequence
agacagattcaattaaattaaat

SEQ ID NO: 202227 - DNA, 23 bp, Artificial sequence
  SiRNA target sequence
gacagattcaattaaattaaatg

SEQ ID NO: 202228 - DNA, 23 bp, Artificial sequence
  SiRNA target sequence
acagattcaattaaattaaatgt

SEQ ID NO: 202229 - DNA, 23 bp, Artificial sequence
  SiRNA target sequence
cagattcaattaaattaaatgtt

SEQ ID NO: 202230 - DNA, 23 bp, Artificial sequence
  SiRNA target sequence
agattcaattaaattaaatgtta

SEQ ID NO: 202231 - DNA, 23 bp, Artificial sequence
  SiRNA target sequence
gattcaattaaattaaatgttat

SEQ ID NO: 202232 - DNA, 23 bp, Artificial sequence
  SiRNA target sequence
attcaattaaattaaatgttata

SEQ ID NO: 202233 - DNA, 23 bp, Artificial sequence
  SiRNA target sequence
ttcaattaaattaaatgttatat

SEQ ID NO: 202234 - DNA, 23 bp, Artificial sequence
  SiRNA target sequence
tcaattaaattaaatgttatatt

SEQ ID NO: 202235 - DNA, 23 bp, Artificial sequence
  SiRNA target sequence
caattaaattaaatgttatattg

SEQ ID NO: 202236 - DNA, 23 bp, Artificial sequence
  SiRNA target sequence
aattaaattaaatgttatattgt

SEQ ID NO: 202237 - DNA, 23 bp, Artificial sequence
  SiRNA target sequence
attaaattaaatgttatattgta

SEQ ID NO: 202238 - DNA, 23 bp, Artificial sequence
  SiRNA target sequence
ttaaattaaatgttatattgtaa

SEQ ID NO: 202239 - DNA, 23 bp, Artificial sequence
  SiRNA target sequence
taaattaaatgttatattgtaaa

SEQ ID NO: 202240 - DNA, 23 bp, Artificial sequence
  SiRNA target sequence
aaattaaatgttatattgtaaaa

SEQ ID NO: 202241 - DNA, 23 bp, Artificial sequence
  SiRNA target sequence
aattaaatgttatattgtaaaaa

SEQ ID NO: 202242 - DNA, 23 bp, Artificial sequence
  SiRNA target sequence
attaaatgttatattgtaaaaaa

SEQ ID NO: 202243 - DNA, 23 bp, Artificial sequence
  SiRNA target sequence
ttaaatgttatattgtaaaaaaa

SEQ ID NO: 202244 - DNA, 23 bp, Artificial sequence
  SiRNA target sequence
taaatgttatattgtaaaaaaag

SEQ ID NO: 202245 - DNA, 23 bp, Artificial sequence
  SiRNA target sequence
aaatgttatattgtaaaaaaaga

SEQ ID NO: 202246 - DNA, 23 bp, Artificial sequence
  SiRNA target sequence
aatgttatattgtaaaaaaagac

SEQ ID NO: 202247 - DNA, 23 bp, Artificial sequence
  SiRNA target sequence
atgttatattgtaaaaaaagact

SEQ ID NO: 202248 - DNA, 23 bp, Artificial sequence
  SiRNA target sequence
tgttatattgtaaaaaaagacta

SEQ ID NO: 202249 - DNA, 23 bp, Artificial sequence
  SiRNA target sequence
gttatattgtaaaaaaagactat

SEQ ID NO: 202250 - DNA, 23 bp, Artificial sequence
  SiRNA target sequence
ttatattgtaaaaaaagactatt

SEQ ID NO: 202251 - DNA, 23 bp, Artificial sequence
  SiRNA target sequence
tatattgtaaaaaaagactatta

SEQ ID NO: 202252 - DNA, 23 bp, Artificial sequence
  SiRNA target sequence
atattgtaaaaaaagactattat

SEQ ID NO: 202253 - DNA, 23 bp, Artificial sequence
  SiRNA target sequence
tattgtaaaaaaagactattata

SEQ ID NO: 202254 - DNA, 23 bp, Artificial sequence
  SiRNA target sequence
attgtaaaaaaagactattatac

SEQ ID NO: 202255 - DNA, 23 bp, Artificial sequence
  SiRNA target sequence
ttgtaaaaaaagactattataca

SEQ ID NO: 202256 - DNA, 23 bp, Artificial sequence
  SiRNA target sequence
tgtaaaaaaagactattatacaa

SEQ ID NO: 202257 - DNA, 23 bp, Artificial sequence
  SiRNA target sequence
gtaaaaaaagactattatacaaa

SEQ ID NO: 202258 - DNA, 23 bp, Artificial sequence
  SiRNA target sequence
taaaaaaagactattatacaaag

SEQ ID NO: 202259 - DNA, 23 bp, Artificial sequence
  SiRNA target sequence
aaaaaaagactattatacaaagt

SEQ ID NO: 202260 - DNA, 23 bp, Artificial sequence
  SiRNA target sequence
aaaaaagactattatacaaagtg

SEQ ID NO: 202261 - DNA, 23 bp, Artificial sequence
  SiRNA target sequence
aaaaagactattatacaaagtga

SEQ ID NO: 202262 - DNA, 23 bp, Artificial sequence
  SiRNA target sequence
aaaagactattatacaaagtgac

SEQ ID NO: 202263 - DNA, 23 bp, Artificial sequence
  SiRNA target sequence
aaagactattatacaaagtgaca

SEQ ID NO: 202264 - DNA, 23 bp, Artificial sequence
  SiRNA target sequence
aagactattatacaaagtgacat

SEQ ID NO: 202265 - DNA, 23 bp, Artificial sequence
  SiRNA target sequence
agactattatacaaagtgacatt

SEQ ID NO: 202266 - DNA, 23 bp, Artificial sequence
  SiRNA target sequence
gactattatacaaagtgacatta

SEQ ID NO: 202267 - DNA, 23 bp, Artificial sequence
  SiRNA target sequence
actattatacaaagtgacattaa

SEQ ID NO: 202268 - DNA, 23 bp, Artificial sequence
  SiRNA target sequence
ctattatacaaagtgacattaat

SEQ ID NO: 202269 - DNA, 23 bp, Artificial sequence
  SiRNA target sequence
tattatacaaagtgacattaata

SEQ ID NO: 202270 - DNA, 23 bp, Artificial sequence
  SiRNA target sequence
attatacaaagtgacattaataa

SEQ ID NO: 202271 - DNA, 23 bp, Artificial sequence
  SiRNA target sequence
ttatacaaagtgacattaataat

SEQ ID NO: 202272 - DNA, 23 bp, Artificial sequence
  SiRNA target sequence
tatacaaagtgacattaataatt

SEQ ID NO: 202273 - DNA, 23 bp, Artificial sequence
  SiRNA target sequence
atacaaagtgacattaataattt

SEQ ID NO: 202274 - DNA, 23 bp, Artificial sequence
  SiRNA target sequence
tacaaagtgacattaataatttt

SEQ ID NO: 202275 - DNA, 23 bp, Artificial sequence
  SiRNA target sequence
acaaagtgacattaataattttg

SEQ ID NO: 202276 - DNA, 23 bp, Artificial sequence
  SiRNA target sequence
caaagtgacattaataattttga

SEQ ID NO: 202277 - DNA, 23 bp, Artificial sequence
  SiRNA target sequence
aaagtgacattaataattttgat

SEQ ID NO: 202278 - DNA, 23 bp, Artificial sequence
  SiRNA target sequence
aagtgacattaataattttgatt

SEQ ID NO: 202279 - DNA, 23 bp, Artificial sequence
  SiRNA target sequence
agtgacattaataattttgattt

SEQ ID NO: 202280 - DNA, 23 bp, Artificial sequence
  SiRNA target sequence
gtgacattaataattttgatttc

SEQ ID NO: 202281 - DNA, 23 bp, Artificial sequence
  SiRNA target sequence
tgacattaataattttgatttca

SEQ ID NO: 202282 - DNA, 23 bp, Artificial sequence
  SiRNA target sequence
gacattaataattttgatttcat

SEQ ID NO: 202283 - DNA, 23 bp, Artificial sequence
  SiRNA target sequence
acattaataattttgatttcatc

SEQ ID NO: 202284 - DNA, 23 bp, Artificial sequence
  SiRNA target sequence
cattaataattttgatttcatca

SEQ ID NO: 202285 - DNA, 23 bp, Artificial sequence
  SiRNA target sequence
attaataattttgatttcatcat

SEQ ID NO: 202286 - DNA, 23 bp, Artificial sequence
  SiRNA target sequence
ttaataattttgatttcatcatt

SEQ ID NO: 202287 - DNA, 23 bp, Artificial sequence
  SiRNA target sequence
taataattttgatttcatcatta

SEQ ID NO: 202288 - DNA, 23 bp, Artificial sequence
  SiRNA target sequence
aataattttgatttcatcattat

SEQ ID NO: 202289 - DNA, 23 bp, Artificial sequence
  SiRNA target sequence
ataattttgatttcatcattata

SEQ ID NO: 202290 - DNA, 23 bp, Artificial sequence
  SiRNA target sequence
taattttgatttcatcattatac

SEQ ID NO: 202291 - DNA, 23 bp, Artificial sequence
  SiRNA target sequence
aattttgatttcatcattatact

SEQ ID NO: 202292 - DNA, 23 bp, Artificial sequence
  SiRNA target sequence
attttgatttcatcattatacta

SEQ ID NO: 202293 - DNA, 23 bp, Artificial sequence
  SiRNA target sequence
ttttgatttcatcattatactaa

SEQ ID NO: 202294 - DNA, 23 bp, Artificial sequence
  SiRNA target sequence
tttgatttcatcattatactaat

SEQ ID NO: 202295 - DNA, 23 bp, Artificial sequence
  SiRNA target sequence
ttgatttcatcattatactaata

SEQ ID NO: 202296 - DNA, 23 bp, Artificial sequence
  SiRNA target sequence
tgatttcatcattatactaatac

SEQ ID NO: 202297 - DNA, 23 bp, Artificial sequence
  SiRNA target sequence
gatttcatcattatactaatacc

SEQ ID NO: 202298 - DNA, 23 bp, Artificial sequence
  SiRNA target sequence
atttcatcattatactaatacct

SEQ ID NO: 202299 - DNA, 23 bp, Artificial sequence
  SiRNA target sequence
tttcatcattatactaatacctt

SEQ ID NO: 202300 - DNA, 23 bp, Artificial sequence
  SiRNA target sequence
ttcatcattatactaataccttc

SEQ ID NO: 202301 - DNA, 23 bp, Artificial sequence
  SiRNA target sequence
tcatcattatactaataccttcg

SEQ ID NO: 202302 - DNA, 23 bp, Artificial sequence
  SiRNA target sequence
catcattatactaataccttcgg

SEQ ID NO: 202303 - DNA, 23 bp, Artificial sequence
  SiRNA target sequence
atcattatactaataccttcgga

SEQ ID NO: 202304 - DNA, 23 bp, Artificial sequence
  SiRNA target sequence
tcattatactaataccttcggag

SEQ ID NO: 202305 - DNA, 23 bp, Artificial sequence
  SiRNA target sequence
cattatactaataccttcggaga

SEQ ID NO: 202306 - DNA, 23 bp, Artificial sequence
  SiRNA target sequence
attatactaataccttcggagaa

SEQ ID NO: 202307 - DNA, 23 bp, Artificial sequence
  SiRNA target sequence
ttatactaataccttcggagaaa

SEQ ID NO: 202308 - DNA, 23 bp, Artificial sequence
  SiRNA target sequence
tatactaataccttcggagaaac

SEQ ID NO: 202309 - DNA, 23 bp, Artificial sequence
  SiRNA target sequence
atactaataccttcggagaaacc

SEQ ID NO: 202310 - DNA, 23 bp, Artificial sequence
  SiRNA target sequence
tactaataccttcggagaaacct

SEQ ID NO: 202311 - DNA, 23 bp, Artificial sequence
  SiRNA target sequence
actaataccttcggagaaaccta

SEQ ID NO: 202312 - DNA, 23 bp, Artificial sequence
  SiRNA target sequence
ctaataccttcggagaaacctac

SEQ ID NO: 202313 - DNA, 23 bp, Artificial sequence
  SiRNA target sequence
taataccttcggagaaacctaca

SEQ ID NO: 202314 - DNA, 23 bp, Artificial sequence
  SiRNA target sequence
aataccttcggagaaacctacac

SEQ ID NO: 202315 - DNA, 23 bp, Artificial sequence
  SiRNA target sequence
ataccttcggagaaacctacact

SEQ ID NO: 202316 - DNA, 23 bp, Artificial sequence
  SiRNA target sequence
taccttcggagaaacctacacta

SEQ ID NO: 202317 - DNA, 23 bp, Artificial sequence
  SiRNA target sequence
accttcggagaaacctacactaa

SEQ ID NO: 202318 - DNA, 23 bp, Artificial sequence
  SiRNA target sequence
ccttcggagaaacctacactaac

SEQ ID NO: 202319 - DNA, 23 bp, Artificial sequence
  SiRNA target sequence
cttcggagaaacctacactaact

SEQ ID NO: 202320 - DNA, 23 bp, Artificial sequence
  SiRNA target sequence
ttcggagaaacctacactaactt

SEQ ID NO: 202321 - DNA, 23 bp, Artificial sequence
  SiRNA target sequence
tcggagaaacctacactaacttt

SEQ ID NO: 202322 - DNA, 23 bp, Artificial sequence
  SiRNA target sequence
cggagaaacctacactaactttt

SEQ ID NO: 202323 - DNA, 23 bp, Artificial sequence
  SiRNA target sequence
ggagaaacctacactaacttttt

SEQ ID NO: 202324 - DNA, 23 bp, Artificial sequence
  SiRNA target sequence
gagaaacctacactaactttttg

SEQ ID NO: 202325 - DNA, 23 bp, Artificial sequence
  SiRNA target sequence
agaaacctacactaactttttgt

SEQ ID NO: 202326 - DNA, 23 bp, Artificial sequence
  SiRNA target sequence
gaaacctacactaactttttgtt

SEQ ID NO: 202327 - DNA, 23 bp, Artificial sequence
  SiRNA target sequence
aaacctacactaactttttgttt

SEQ ID NO: 202328 - DNA, 23 bp, Artificial sequence
  SiRNA target sequence
aacctacactaactttttgtttc

SEQ ID NO: 202329 - DNA, 23 bp, Artificial sequence
  SiRNA target sequence
acctacactaactttttgtttct

SEQ ID NO: 202330 - DNA, 23 bp, Artificial sequence
  SiRNA target sequence
cctacactaactttttgtttctt

SEQ ID NO: 202331 - DNA, 23 bp, Artificial sequence
  SiRNA target sequence
ctacactaactttttgtttcttt

SEQ ID NO: 202332 - DNA, 23 bp, Artificial sequence
  SiRNA target sequence
tacactaactttttgtttctttt

SEQ ID NO: 202333 - DNA, 23 bp, Artificial sequence
  SiRNA target sequence
acactaactttttgtttcttttt

SEQ ID NO: 202334 - DNA, 23 bp, Artificial sequence
  SiRNA target sequence
cactaactttttgtttctttttt

SEQ ID NO: 202335 - DNA, 23 bp, Artificial sequence
  SiRNA target sequence
actaactttttgtttctttttta

SEQ ID NO: 202336 - DNA, 23 bp, Artificial sequence
  SiRNA target sequence
ctaactttttgtttcttttttat

SEQ ID NO: 202337 - DNA, 23 bp, Artificial sequence
  SiRNA target sequence
taactttttgtttcttttttatc

SEQ ID NO: 202338 - DNA, 23 bp, Artificial sequence
  SiRNA target sequence
aactttttgtttcttttttatcg

SEQ ID NO: 202339 - DNA, 23 bp, Artificial sequence
  SiRNA target sequence
actttttgtttcttttttatcgt

SEQ ID NO: 202340 - DNA, 23 bp, Artificial sequence
  SiRNA target sequence
ctttttgtttcttttttatcgta

SEQ ID NO: 202341 - DNA, 23 bp, Artificial sequence
  SiRNA target sequence
tttttgtttcttttttatcgtat

SEQ ID NO: 202342 - DNA, 23 bp, Artificial sequence
  SiRNA target sequence
ttttgtttcttttttatcgtatt

SEQ ID NO: 202343 - DNA, 23 bp, Artificial sequence
  SiRNA target sequence
tttgtttcttttttatcgtatta

SEQ ID NO: 202344 - DNA, 23 bp, Artificial sequence
  SiRNA target sequence
ttgtttcttttttatcgtattag

SEQ ID NO: 202345 - DNA, 23 bp, Artificial sequence
  SiRNA target sequence
tgtttcttttttatcgtattaga

SEQ ID NO: 202346 - DNA, 23 bp, Artificial sequence
  SiRNA target sequence
gtttcttttttatcgtattagaa

SEQ ID NO: 202347 - DNA, 23 bp, Artificial sequence
  SiRNA target sequence
tttcttttttatcgtattagaag

SEQ ID NO: 202348 - DNA, 23 bp, Artificial sequence
  SiRNA target sequence
ttcttttttatcgtattagaagg

SEQ ID NO: 202349 - DNA, 23 bp, Artificial sequence
  SiRNA target sequence
tcttttttatcgtattagaaggt

SEQ ID NO: 202350 - DNA, 23 bp, Artificial sequence
  SiRNA target sequence
cttttttatcgtattagaaggta

SEQ ID NO: 202351 - DNA, 23 bp, Artificial sequence
  SiRNA target sequence
ttttttatcgtattagaaggtat

SEQ ID NO: 202352 - DNA, 23 bp, Artificial sequence
  SiRNA target sequence
tttttatcgtattagaaggtata

SEQ ID NO: 202353 - DNA, 23 bp, Artificial sequence
  SiRNA target sequence
ttttatcgtattagaaggtataa

SEQ ID NO: 202354 - DNA, 23 bp, Artificial sequence
  SiRNA target sequence
tttatcgtattagaaggtataaa

SEQ ID NO: 202355 - DNA, 23 bp, Artificial sequence
  SiRNA target sequence
ttatcgtattagaaggtataaat

SEQ ID NO: 202356 - DNA, 23 bp, Artificial sequence
  SiRNA target sequence
tatcgtattagaaggtataaata

SEQ ID NO: 202357 - DNA, 23 bp, Artificial sequence
  SiRNA target sequence
atcgtattagaaggtataaatat

SEQ ID NO: 202358 - DNA, 23 bp, Artificial sequence
  SiRNA target sequence
tcgtattagaaggtataaatatt

SEQ ID NO: 202359 - DNA, 23 bp, Artificial sequence
  SiRNA target sequence
cgtattagaaggtataaatattg

SEQ ID NO: 202360 - DNA, 23 bp, Artificial sequence
  SiRNA target sequence
gtattagaaggtataaatattgg

SEQ ID NO: 202361 - DNA, 23 bp, Artificial sequence
  SiRNA target sequence
tattagaaggtataaatattggt

SEQ ID NO: 202362 - DNA, 23 bp, Artificial sequence
  SiRNA target sequence
attagaaggtataaatattggta

SEQ ID NO: 202363 - DNA, 23 bp, Artificial sequence
  SiRNA target sequence
ttagaaggtataaatattggtac

SEQ ID NO: 202364 - DNA, 23 bp, Artificial sequence
  SiRNA target sequence
tagaaggtataaatattggtaca

SEQ ID NO: 202365 - DNA, 23 bp, Artificial sequence
  SiRNA target sequence
agaaggtataaatattggtacac

SEQ ID NO: 202366 - DNA, 23 bp, Artificial sequence
  SiRNA target sequence
gaaggtataaatattggtacact

SEQ ID NO: 202367 - DNA, 23 bp, Artificial sequence
  SiRNA target sequence
aaggtataaatattggtacactc

SEQ ID NO: 202368 - DNA, 23 bp, Artificial sequence
  SiRNA target sequence
aggtataaatattggtacactca

SEQ ID NO: 202369 - DNA, 23 bp, Artificial sequence
  SiRNA target sequence
ggtataaatattggtacactcat

SEQ ID NO: 202370 - DNA, 23 bp, Artificial sequence
  SiRNA target sequence
gtataaatattggtacactcatt

SEQ ID NO: 202371 - DNA, 23 bp, Artificial sequence
  SiRNA target sequence
tataaatattggtacactcatta

SEQ ID NO: 202372 - DNA, 23 bp, Artificial sequence
  SiRNA target sequence
ataaatattggtacactcattat

SEQ ID NO: 202373 - DNA, 23 bp, Artificial sequence
  SiRNA target sequence
taaatattggtacactcattatt

SEQ ID NO: 202374 - DNA, 23 bp, Artificial sequence
  SiRNA target sequence
aaatattggtacactcattattt

SEQ ID NO: 202375 - DNA, 23 bp, Artificial sequence
  SiRNA target sequence
aatattggtacactcattatttt

SEQ ID NO: 202376 - DNA, 23 bp, Artificial sequence
  SiRNA target sequence
atattggtacactcattatttta

SEQ ID NO: 202377 - DNA, 23 bp, Artificial sequence
  SiRNA target sequence
tattggtacactcattattttat

SEQ ID NO: 202378 - DNA, 23 bp, Artificial sequence
  SiRNA target sequence
attggtacactcattattttatt

SEQ ID NO: 202379 - DNA, 23 bp, Artificial sequence
  SiRNA target sequence
ttggtacactcattattttattc

SEQ ID NO: 202380 - DNA, 23 bp, Artificial sequence
  SiRNA target sequence
tggtacactcattattttattct

SEQ ID NO: 202381 - DNA, 23 bp, Artificial sequence
  SiRNA target sequence
ggtacactcattattttattctc

SEQ ID NO: 202382 - DNA, 23 bp, Artificial sequence
  SiRNA target sequence
gtacactcattattttattctcg

SEQ ID NO: 202383 - DNA, 23 bp, Artificial sequence
  SiRNA target sequence
tacactcattattttattctcga

SEQ ID NO: 202384 - DNA, 23 bp, Artificial sequence
  SiRNA target sequence
acactcattattttattctcgaa

SEQ ID NO: 202385 - DNA, 23 bp, Artificial sequence
  SiRNA target sequence
cactcattattttattctcgaaa

SEQ ID NO: 202386 - DNA, 23 bp, Artificial sequence
  SiRNA target sequence
actcattattttattctcgaaat

SEQ ID NO: 202387 - DNA, 23 bp, Artificial sequence
  SiRNA target sequence
ctcattattttattctcgaaata

SEQ ID NO: 202388 - DNA, 23 bp, Artificial sequence
  SiRNA target sequence
tcattattttattctcgaaataa

SEQ ID NO: 202389 - DNA, 23 bp, Artificial sequence
  SiRNA target sequence
cattattttattctcgaaataat

SEQ ID NO: 202390 - DNA, 23 bp, Artificial sequence
  SiRNA target sequence
attattttattctcgaaataata

SEQ ID NO: 202391 - DNA, 23 bp, Artificial sequence
  SiRNA target sequence
ttattttattctcgaaataatat

SEQ ID NO: 202392 - DNA, 23 bp, Artificial sequence
  SiRNA target sequence
tattttattctcgaaataatatt

SEQ ID NO: 202393 - DNA, 23 bp, Artificial sequence
  SiRNA target sequence
attttattctcgaaataatattt

SEQ ID NO: 202394 - DNA, 23 bp, Artificial sequence
  SiRNA target sequence
ttttattctcgaaataatatttc

SEQ ID NO: 202395 - DNA, 23 bp, Artificial sequence
  SiRNA target sequence
tttattctcgaaataatatttca

SEQ ID NO: 202396 - DNA, 23 bp, Artificial sequence
  SiRNA target sequence
ttattctcgaaataatatttcat

SEQ ID NO: 202397 - DNA, 23 bp, Artificial sequence
  SiRNA target sequence
tattctcgaaataatatttcatg

SEQ ID NO: 202398 - DNA, 23 bp, Artificial sequence
  SiRNA target sequence
attctcgaaataatatttcatgt

SEQ ID NO: 202399 - DNA, 23 bp, Artificial sequence
  SiRNA target sequence
ttctcgaaataatatttcatgta

SEQ ID NO: 202400 - DNA, 23 bp, Artificial sequence
  SiRNA target sequence
tctcgaaataatatttcatgtac

SEQ ID NO: 202401 - DNA, 23 bp, Artificial sequence
  SiRNA target sequence
ctcgaaataatatttcatgtaca

SEQ ID NO: 202402 - DNA, 23 bp, Artificial sequence
  SiRNA target sequence
tcgaaataatatttcatgtacat

SEQ ID NO: 202403 - DNA, 23 bp, Artificial sequence
  SiRNA target sequence
cgaaataatatttcatgtacatt

SEQ ID NO: 202404 - DNA, 23 bp, Artificial sequence
  SiRNA target sequence
gaaataatatttcatgtacatta

SEQ ID NO: 202405 - DNA, 23 bp, Artificial sequence
  SiRNA target sequence
aaataatatttcatgtacattaa

SEQ ID NO: 202406 - DNA, 23 bp, Artificial sequence
  SiRNA target sequence
aataatatttcatgtacattaat

SEQ ID NO: 202407 - DNA, 23 bp, Artificial sequence
  SiRNA target sequence
ataatatttcatgtacattaata

SEQ ID NO: 202408 - DNA, 23 bp, Artificial sequence
  SiRNA target sequence
taatatttcatgtacattaatat

SEQ ID NO: 202409 - DNA, 23 bp, Artificial sequence
  SiRNA target sequence
aatatttcatgtacattaatatt

SEQ ID NO: 202410 - DNA, 23 bp, Artificial sequence
  SiRNA target sequence
atatttcatgtacattaatatta

SEQ ID NO: 202411 - DNA, 23 bp, Artificial sequence
  SiRNA target sequence
tatttcatgtacattaatattag

SEQ ID NO: 202412 - DNA, 23 bp, Artificial sequence
  SiRNA target sequence
atttcatgtacattaatattaga

SEQ ID NO: 202413 - DNA, 23 bp, Artificial sequence
  SiRNA target sequence
tttcatgtacattaatattagac

SEQ ID NO: 202414 - DNA, 23 bp, Artificial sequence
  SiRNA target sequence
ttcatgtacattaatattagaca

SEQ ID NO: 202415 - DNA, 23 bp, Artificial sequence
  SiRNA target sequence
tcatgtacattaatattagacat

SEQ ID NO: 202416 - DNA, 23 bp, Artificial sequence
  SiRNA target sequence
catgtacattaatattagacata

SEQ ID NO: 202417 - DNA, 23 bp, Artificial sequence
  SiRNA target sequence
atgtacattaatattagacatat

SEQ ID NO: 202418 - DNA, 23 bp, Artificial sequence
  SiRNA target sequence
tgtacattaatattagacatata

SEQ ID NO: 202419 - DNA, 23 bp, Artificial sequence
  SiRNA target sequence
gtacattaatattagacatatac

SEQ ID NO: 202420 - DNA, 23 bp, Artificial sequence
  SiRNA target sequence
tacattaatattagacatatacc

SEQ ID NO: 202421 - DNA, 23 bp, Artificial sequence
  SiRNA target sequence
acattaatattagacatataccg

SEQ ID NO: 202422 - DNA, 23 bp, Artificial sequence
  SiRNA target sequence
cattaatattagacatataccgc

SEQ ID NO: 202423 - DNA, 23 bp, Artificial sequence
  SiRNA target sequence
attaatattagacatataccgcc

SEQ ID NO: 202424 - DNA, 23 bp, Artificial sequence
  SiRNA target sequence
ttaatattagacatataccgccc

SEQ ID NO: 202425 - DNA, 23 bp, Artificial sequence
  SiRNA target sequence
taatattagacatataccgccca

SEQ ID NO: 202426 - DNA, 23 bp, Artificial sequence
  SiRNA target sequence
aatattagacatataccgcccat

SEQ ID NO: 202427 - DNA, 23 bp, Artificial sequence
  SiRNA target sequence
atattagacatataccgcccatg

SEQ ID NO: 202428 - DNA, 23 bp, Artificial sequence
  SiRNA target sequence
tattagacatataccgcccatgg

SEQ ID NO: 202429 - DNA, 23 bp, Artificial sequence
  SiRNA target sequence
attagacatataccgcccatggc

SEQ ID NO: 202430 - DNA, 23 bp, Artificial sequence
  SiRNA target sequence
ttagacatataccgcccatggca

SEQ ID NO: 202431 - DNA, 23 bp, Artificial sequence
  SiRNA target sequence
tagacatataccgcccatggcaa

SEQ ID NO: 202432 - DNA, 23 bp, Artificial sequence
  SiRNA target sequence
agacatataccgcccatggcaat

SEQ ID NO: 202433 - DNA, 23 bp, Artificial sequence
  SiRNA target sequence
gacatataccgcccatggcaata

SEQ ID NO: 202434 - DNA, 23 bp, Artificial sequence
  SiRNA target sequence
acatataccgcccatggcaataa

SEQ ID NO: 202435 - DNA, 23 bp, Artificial sequence
  SiRNA target sequence
catataccgcccatggcaataaa

SEQ ID NO: 202436 - DNA, 23 bp, Artificial sequence
  SiRNA target sequence
atataccgcccatggcaataaaa

SEQ ID NO: 202437 - DNA, 23 bp, Artificial sequence
  SiRNA target sequence
tataccgcccatggcaataaaaa

SEQ ID NO: 202438 - DNA, 23 bp, Artificial sequence
  SiRNA target sequence
ataccgcccatggcaataaaaac

SEQ ID NO: 202439 - DNA, 23 bp, Artificial sequence
  SiRNA target sequence
taccgcccatggcaataaaaacc

SEQ ID NO: 202440 - DNA, 23 bp, Artificial sequence
  SiRNA target sequence
accgcccatggcaataaaaaccg

SEQ ID NO: 202441 - DNA, 23 bp, Artificial sequence
  SiRNA target sequence
ccgcccatggcaataaaaaccga

SEQ ID NO: 202442 - DNA, 23 bp, Artificial sequence
  SiRNA target sequence
cgcccatggcaataaaaaccgaa

SEQ ID NO: 202443 - DNA, 23 bp, Artificial sequence
  SiRNA target sequence
gcccatggcaataaaaaccgaag

SEQ ID NO: 202444 - DNA, 23 bp, Artificial sequence
  SiRNA target sequence
cccatggcaataaaaaccgaaga

SEQ ID NO: 202445 - DNA, 23 bp, Artificial sequence
  SiRNA target sequence
ccatggcaataaaaaccgaagaa

SEQ ID NO: 202446 - DNA, 23 bp, Artificial sequence
  SiRNA target sequence
catggcaataaaaaccgaagaat

SEQ ID NO: 202447 - DNA, 23 bp, Artificial sequence
  SiRNA target sequence
atggcaataaaaaccgaagaata

SEQ ID NO: 202448 - DNA, 23 bp, Artificial sequence
  SiRNA target sequence
tggcaataaaaaccgaagaatat

SEQ ID NO: 202449 - DNA, 23 bp, Artificial sequence
  SiRNA target sequence
ggcaataaaaaccgaagaatata

SEQ ID NO: 202450 - DNA, 23 bp, Artificial sequence
  SiRNA target sequence
gcaataaaaaccgaagaatataa

SEQ ID NO: 202451 - DNA, 23 bp, Artificial sequence
  SiRNA target sequence
caataaaaaccgaagaatataat

SEQ ID NO: 202452 - DNA, 23 bp, Artificial sequence
  SiRNA target sequence
aataaaaaccgaagaatataata

SEQ ID NO: 202453 - DNA, 23 bp, Artificial sequence
  SiRNA target sequence
ataaaaaccgaagaatataataa

SEQ ID NO: 202454 - DNA, 23 bp, Artificial sequence
  SiRNA target sequence
taaaaaccgaagaatataataac

SEQ ID NO: 202455 - DNA, 23 bp, Artificial sequence
  SiRNA target sequence
aaaaaccgaagaatataataact

SEQ ID NO: 202456 - DNA, 23 bp, Artificial sequence
  SiRNA target sequence
aaaaccgaagaatataataactg

SEQ ID NO: 202457 - DNA, 23 bp, Artificial sequence
  SiRNA target sequence
aaaccgaagaatataataactga

SEQ ID NO: 202458 - DNA, 23 bp, Artificial sequence
  SiRNA target sequence
aaccgaagaatataataactgat

SEQ ID NO: 202459 - DNA, 23 bp, Artificial sequence
  SiRNA target sequence
accgaagaatataataactgatt

SEQ ID NO: 202460 - DNA, 23 bp, Artificial sequence
  SiRNA target sequence
ccgaagaatataataactgattt

SEQ ID NO: 202461 - DNA, 23 bp, Artificial sequence
  SiRNA target sequence
cgaagaatataataactgatttt

SEQ ID NO: 202462 - DNA, 23 bp, Artificial sequence
  SiRNA target sequence
gaagaatataataactgattttg

SEQ ID NO: 202463 - DNA, 23 bp, Artificial sequence
  SiRNA target sequence
aagaatataataactgattttgc

SEQ ID NO: 202464 - DNA, 23 bp, Artificial sequence
  SiRNA target sequence
agaatataataactgattttgct

SEQ ID NO: 202465 - DNA, 23 bp, Artificial sequence
  SiRNA target sequence
gaatataataactgattttgctc

SEQ ID NO: 202466 - DNA, 23 bp, Artificial sequence
  SiRNA target sequence
aatataataactgattttgctca

SEQ ID NO: 202467 - DNA, 23 bp, Artificial sequence
  SiRNA target sequence
atataataactgattttgctcat

SEQ ID NO: 202468 - DNA, 23 bp, Artificial sequence
  SiRNA target sequence
tataataactgattttgctcata

SEQ ID NO: 202469 - DNA, 23 bp, Artificial sequence
  SiRNA target sequence
ataataactgattttgctcatag

SEQ ID NO: 202470 - DNA, 23 bp, Artificial sequence
  SiRNA target sequence
taataactgattttgctcatagc

SEQ ID NO: 202471 - DNA, 23 bp, Artificial sequence
  SiRNA target sequence
aataactgattttgctcatagct

SEQ ID NO: 202472 - DNA, 23 bp, Artificial sequence
  SiRNA target sequence
ataactgattttgctcatagcta

SEQ ID NO: 202473 - DNA, 23 bp, Artificial sequence
  SiRNA target sequence
taactgattttgctcatagctaa

SEQ ID NO: 202474 - DNA, 23 bp, Artificial sequence
  SiRNA target sequence
aactgattttgctcatagctaaa

SEQ ID NO: 202475 - DNA, 23 bp, Artificial sequence
  SiRNA target sequence
actgattttgctcatagctaaat

SEQ ID NO: 202476 - DNA, 23 bp, Artificial sequence
  SiRNA target sequence
ctgattttgctcatagctaaatc

SEQ ID NO: 202477 - DNA, 23 bp, Artificial sequence
  SiRNA target sequence
tgattttgctcatagctaaatcc

SEQ ID NO: 202478 - DNA, 23 bp, Artificial sequence
  SiRNA target sequence
gattttgctcatagctaaatcct

SEQ ID NO: 202479 - DNA, 23 bp, Artificial sequence
  SiRNA target sequence
attttgctcatagctaaatcctt

SEQ ID NO: 202480 - DNA, 23 bp, Artificial sequence
  SiRNA target sequence
ttttgctcatagctaaatccttt

SEQ ID NO: 202481 - DNA, 23 bp, Artificial sequence
  SiRNA target sequence
tttgctcatagctaaatcctttt

SEQ ID NO: 202482 - DNA, 23 bp, Artificial sequence
  SiRNA target sequence
ttgctcatagctaaatccttttc

SEQ ID NO: 202483 - DNA, 23 bp, Artificial sequence
  SiRNA target sequence
tgctcatagctaaatccttttcg

SEQ ID NO: 202484 - DNA, 23 bp, Artificial sequence
  SiRNA target sequence
gctcatagctaaatccttttcgc

SEQ ID NO: 202485 - DNA, 23 bp, Artificial sequence
  SiRNA target sequence
ctcatagctaaatccttttcgca

SEQ ID NO: 202486 - DNA, 23 bp, Artificial sequence
  SiRNA target sequence
tcatagctaaatccttttcgcaa

SEQ ID NO: 202487 - DNA, 23 bp, Artificial sequence
  SiRNA target sequence
catagctaaatccttttcgcaat

SEQ ID NO: 202488 - DNA, 23 bp, Artificial sequence
  SiRNA target sequence
atagctaaatccttttcgcaatt

SEQ ID NO: 202489 - DNA, 23 bp, Artificial sequence
  SiRNA target sequence
tagctaaatccttttcgcaattc

SEQ ID NO: 202490 - DNA, 23 bp, Artificial sequence
  SiRNA target sequence
agctaaatccttttcgcaattct

SEQ ID NO: 202491 - DNA, 23 bp, Artificial sequence
  SiRNA target sequence
gctaaatccttttcgcaattctc

SEQ ID NO: 202492 - DNA, 23 bp, Artificial sequence
  SiRNA target sequence
ctaaatccttttcgcaattctct

SEQ ID NO: 202493 - DNA, 23 bp, Artificial sequence
  SiRNA target sequence
taaatccttttcgcaattctctg

SEQ ID NO: 202494 - DNA, 23 bp, Artificial sequence
  SiRNA target sequence
aaatccttttcgcaattctctga

SEQ ID NO: 202495 - DNA, 23 bp, Artificial sequence
  SiRNA target sequence
aatccttttcgcaattctctgaa

SEQ ID NO: 202496 - DNA, 23 bp, Artificial sequence
  SiRNA target sequence
atccttttcgcaattctctgaaa

SEQ ID NO: 202497 - DNA, 23 bp, Artificial sequence
  SiRNA target sequence
tccttttcgcaattctctgaaag

SEQ ID NO: 202498 - DNA, 23 bp, Artificial sequence
  SiRNA target sequence
ccttttcgcaattctctgaaaga

SEQ ID NO: 202499 - DNA, 23 bp, Artificial sequence
  SiRNA target sequence
cttttcgcaattctctgaaagaa

SEQ ID NO: 202500 - DNA, 23 bp, Artificial sequence
  SiRNA target sequence
ttttcgcaattctctgaaagaac

SEQ ID NO: 202501 - DNA, 23 bp, Artificial sequence
  SiRNA target sequence
tttcgcaattctctgaaagaact

SEQ ID NO: 202502 - DNA, 23 bp, Artificial sequence
  SiRNA target sequence
ttcgcaattctctgaaagaacta

SEQ ID NO: 202503 - DNA, 23 bp, Artificial sequence
  SiRNA target sequence
tcgcaattctctgaaagaactac

SEQ ID NO: 202504 - DNA, 23 bp, Artificial sequence
  SiRNA target sequence
cgcaattctctgaaagaactact

SEQ ID NO: 202505 - DNA, 23 bp, Artificial sequence
  SiRNA target sequence
gcaattctctgaaagaactactg

SEQ ID NO: 202506 - DNA, 23 bp, Artificial sequence
  SiRNA target sequence
caattctctgaaagaactactgg

SEQ ID NO: 202507 - DNA, 23 bp, Artificial sequence
  SiRNA target sequence
aattctctgaaagaactactggc

SEQ ID NO: 202508 - DNA, 23 bp, Artificial sequence
  SiRNA target sequence
attctctgaaagaactactggct

SEQ ID NO: 202509 - DNA, 23 bp, Artificial sequence
  SiRNA target sequence
ttctctgaaagaactactggcta

SEQ ID NO: 202510 - DNA, 23 bp, Artificial sequence
  SiRNA target sequence
tctctgaaagaactactggctaa

SEQ ID NO: 202511 - DNA, 23 bp, Artificial sequence
  SiRNA target sequence
ctctgaaagaactactggctaat

SEQ ID NO: 202512 - DNA, 23 bp, Artificial sequence
  SiRNA target sequence
tctgaaagaactactggctaatc

SEQ ID NO: 202513 - DNA, 23 bp, Artificial sequence
  SiRNA target sequence
ctgaaagaactactggctaatcc

SEQ ID NO: 202514 - DNA, 23 bp, Artificial sequence
  SiRNA target sequence
tgaaagaactactggctaatcca

SEQ ID NO: 202515 - DNA, 23 bp, Artificial sequence
  SiRNA target sequence
gaaagaactactggctaatccag

SEQ ID NO: 202516 - DNA, 23 bp, Artificial sequence
  SiRNA target sequence
aaagaactactggctaatccaga

SEQ ID NO: 202517 - DNA, 23 bp, Artificial sequence
  SiRNA target sequence
aagaactactggctaatccagat

SEQ ID NO: 202518 - DNA, 23 bp, Artificial sequence
  SiRNA target sequence
agaactactggctaatccagata

SEQ ID NO: 202519 - DNA, 23 bp, Artificial sequence
  SiRNA target sequence
gaactactggctaatccagatac

SEQ ID NO: 202520 - DNA, 23 bp, Artificial sequence
  SiRNA target sequence
aactactggctaatccagatact

SEQ ID NO: 202521 - DNA, 23 bp, Artificial sequence
  SiRNA target sequence
actactggctaatccagatacta

SEQ ID NO: 202522 - DNA, 23 bp, Artificial sequence
  SiRNA target sequence
ctactggctaatccagatactag

SEQ ID NO: 202523 - DNA, 23 bp, Artificial sequence
  SiRNA target sequence
tactggctaatccagatactagt

SEQ ID NO: 202524 - DNA, 23 bp, Artificial sequence
  SiRNA target sequence
actggctaatccagatactagta

SEQ ID NO: 202525 - DNA, 23 bp, Artificial sequence
  SiRNA target sequence
ctggctaatccagatactagtaa

SEQ ID NO: 202526 - DNA, 23 bp, Artificial sequence
  SiRNA target sequence
tggctaatccagatactagtaaa

SEQ ID NO: 202527 - DNA, 23 bp, Artificial sequence
  SiRNA target sequence
ggctaatccagatactagtaaag

SEQ ID NO: 202528 - DNA, 23 bp, Artificial sequence
  SiRNA target sequence
gctaatccagatactagtaaagc

SEQ ID NO: 202529 - DNA, 23 bp, Artificial sequence
  SiRNA target sequence
ctaatccagatactagtaaagct

SEQ ID NO: 202530 - DNA, 23 bp, Artificial sequence
  SiRNA target sequence
taatccagatactagtaaagcta

SEQ ID NO: 202531 - DNA, 23 bp, Artificial sequence
  SiRNA target sequence
aatccagatactagtaaagctaa

SEQ ID NO: 202532 - DNA, 23 bp, Artificial sequence
  SiRNA target sequence
atccagatactagtaaagctaaa

SEQ ID NO: 202533 - DNA, 23 bp, Artificial sequence
  SiRNA target sequence
tccagatactagtaaagctaaat

SEQ ID NO: 202534 - DNA, 23 bp, Artificial sequence
  SiRNA target sequence
ccagatactagtaaagctaaatt

SEQ ID NO: 202535 - DNA, 23 bp, Artificial sequence
  SiRNA target sequence
cagatactagtaaagctaaattt

SEQ ID NO: 202536 - DNA, 23 bp, Artificial sequence
  SiRNA target sequence
agatactagtaaagctaaatttg

SEQ ID NO: 202537 - DNA, 23 bp, Artificial sequence
  SiRNA target sequence
gatactagtaaagctaaatttgc

SEQ ID NO: 202538 - DNA, 23 bp, Artificial sequence
  SiRNA target sequence
atactagtaaagctaaatttgct

SEQ ID NO: 202539 - DNA, 23 bp, Artificial sequence
  SiRNA target sequence
tactagtaaagctaaatttgcta

SEQ ID NO: 202540 - DNA, 23 bp, Artificial sequence
  SiRNA target sequence
actagtaaagctaaatttgctat

SEQ ID NO: 202541 - DNA, 23 bp, Artificial sequence
  SiRNA target sequence
ctagtaaagctaaatttgctatt

SEQ ID NO: 202542 - DNA, 23 bp, Artificial sequence
  SiRNA target sequence
tagtaaagctaaatttgctatta

SEQ ID NO: 202543 - DNA, 23 bp, Artificial sequence
  SiRNA target sequence
agtaaagctaaatttgctattat

SEQ ID NO: 202544 - DNA, 23 bp, Artificial sequence
  SiRNA target sequence
gtaaagctaaatttgctattatg

SEQ ID NO: 202545 - DNA, 23 bp, Artificial sequence
  SiRNA target sequence
taaagctaaatttgctattatgt

SEQ ID NO: 202546 - DNA, 23 bp, Artificial sequence
  SiRNA target sequence
aaagctaaatttgctattatgta

SEQ ID NO: 202547 - DNA, 23 bp, Artificial sequence
  SiRNA target sequence
aagctaaatttgctattatgtaa

SEQ ID NO: 202548 - DNA, 23 bp, Artificial sequence
  SiRNA target sequence
agctaaatttgctattatgtaaa

SEQ ID NO: 202549 - DNA, 23 bp, Artificial sequence
  SiRNA target sequence
gctaaatttgctattatgtaaaa

SEQ ID NO: 202550 - DNA, 23 bp, Artificial sequence
  SiRNA target sequence
ctaaatttgctattatgtaaaaa

SEQ ID NO: 202551 - DNA, 23 bp, Artificial sequence
  SiRNA target sequence
taaatttgctattatgtaaaaag

SEQ ID NO: 202552 - DNA, 23 bp, Artificial sequence
  SiRNA target sequence
aaatttgctattatgtaaaaagg

SEQ ID NO: 202553 - DNA, 23 bp, Artificial sequence
  SiRNA target sequence
aatttgctattatgtaaaaaggt

SEQ ID NO: 202554 - DNA, 23 bp, Artificial sequence
  SiRNA target sequence
atttgctattatgtaaaaaggtg

SEQ ID NO: 202555 - DNA, 23 bp, Artificial sequence
  SiRNA target sequence
tttgctattatgtaaaaaggtgg

SEQ ID NO: 202556 - DNA, 23 bp, Artificial sequence
  SiRNA target sequence
ttgctattatgtaaaaaggtggt

SEQ ID NO: 202557 - DNA, 23 bp, Artificial sequence
  SiRNA target sequence
tgctattatgtaaaaaggtggta

SEQ ID NO: 202558 - DNA, 23 bp, Artificial sequence
  SiRNA target sequence
gctattatgtaaaaaggtggtaa

SEQ ID NO: 202559 - DNA, 23 bp, Artificial sequence
  SiRNA target sequence
ctattatgtaaaaaggtggtaaa

SEQ ID NO: 202560 - DNA, 23 bp, Artificial sequence
  SiRNA target sequence
tattatgtaaaaaggtggtaaaa

SEQ ID NO: 202561 - DNA, 23 bp, Artificial sequence
  SiRNA target sequence
attatgtaaaaaggtggtaaaaa

SEQ ID NO: 202562 - DNA, 23 bp, Artificial sequence
  SiRNA target sequence
ttatgtaaaaaggtggtaaaaat

SEQ ID NO: 202563 - DNA, 23 bp, Artificial sequence
  SiRNA target sequence
tatgtaaaaaggtggtaaaaatc

SEQ ID NO: 202564 - DNA, 23 bp, Artificial sequence
  SiRNA target sequence
atgtaaaaaggtggtaaaaatct

SEQ ID NO: 202565 - DNA, 23 bp, Artificial sequence
  SiRNA target sequence
tgtaaaaaggtggtaaaaatctt

SEQ ID NO: 202566 - DNA, 23 bp, Artificial sequence
  SiRNA target sequence
gtaaaaaggtggtaaaaatcttg

SEQ ID NO: 202567 - DNA, 23 bp, Artificial sequence
  SiRNA target sequence
taaaaaggtggtaaaaatcttgt

SEQ ID NO: 202568 - DNA, 23 bp, Artificial sequence
  SiRNA target sequence
aaaaaggtggtaaaaatcttgta

SEQ ID NO: 202569 - DNA, 23 bp, Artificial sequence
  SiRNA target sequence
aaaaggtggtaaaaatcttgtaa

SEQ ID NO: 202570 - DNA, 23 bp, Artificial sequence
  SiRNA target sequence
aaaggtggtaaaaatcttgtaaa

SEQ ID NO: 202571 - DNA, 23 bp, Artificial sequence
  SiRNA target sequence
aaggtggtaaaaatcttgtaaac

SEQ ID NO: 202572 - DNA, 23 bp, Artificial sequence
  SiRNA target sequence
aggtggtaaaaatcttgtaaact

SEQ ID NO: 202573 - DNA, 23 bp, Artificial sequence
  SiRNA target sequence
ggtggtaaaaatcttgtaaactg

SEQ ID NO: 202574 - DNA, 23 bp, Artificial sequence
  SiRNA target sequence
gtggtaaaaatcttgtaaactgt

SEQ ID NO: 202575 - DNA, 23 bp, Artificial sequence
  SiRNA target sequence
tggtaaaaatcttgtaaactgtc

SEQ ID NO: 202576 - DNA, 23 bp, Artificial sequence
  SiRNA target sequence
ggtaaaaatcttgtaaactgtct

SEQ ID NO: 202577 - DNA, 23 bp, Artificial sequence
  SiRNA target sequence
gtaaaaatcttgtaaactgtctg

SEQ ID NO: 202578 - DNA, 23 bp, Artificial sequence
  SiRNA target sequence
taaaaatcttgtaaactgtctga

SEQ ID NO: 202579 - DNA, 23 bp, Artificial sequence
  SiRNA target sequence
aaaaatcttgtaaactgtctgat

SEQ ID NO: 202580 - DNA, 23 bp, Artificial sequence
  SiRNA target sequence
aaaatcttgtaaactgtctgata

SEQ ID NO: 202581 - DNA, 23 bp, Artificial sequence
  SiRNA target sequence
aaatcttgtaaactgtctgatag

SEQ ID NO: 202582 - DNA, 23 bp, Artificial sequence
  SiRNA target sequence
aatcttgtaaactgtctgatagt

SEQ ID NO: 202583 - DNA, 23 bp, Artificial sequence
  SiRNA target sequence
atcttgtaaactgtctgatagta

SEQ ID NO: 202584 - DNA, 23 bp, Artificial sequence
  SiRNA target sequence
tcttgtaaactgtctgatagtac

SEQ ID NO: 202585 - DNA, 23 bp, Artificial sequence
  SiRNA target sequence
cttgtaaactgtctgatagtaca

SEQ ID NO: 202586 - DNA, 23 bp, Artificial sequence
  SiRNA target sequence
ttgtaaactgtctgatagtacaa

SEQ ID NO: 202587 - DNA, 23 bp, Artificial sequence
  SiRNA target sequence
tgtaaactgtctgatagtacaac

SEQ ID NO: 202588 - DNA, 23 bp, Artificial sequence
  SiRNA target sequence
gtaaactgtctgatagtacaact

SEQ ID NO: 202589 - DNA, 23 bp, Artificial sequence
  SiRNA target sequence
taaactgtctgatagtacaactt

SEQ ID NO: 202590 - DNA, 23 bp, Artificial sequence
  SiRNA target sequence
aaactgtctgatagtacaacttt

SEQ ID NO: 202591 - DNA, 23 bp, Artificial sequence
  SiRNA target sequence
aactgtctgatagtacaactttc

SEQ ID NO: 202592 - DNA, 23 bp, Artificial sequence
  SiRNA target sequence
actgtctgatagtacaactttca

SEQ ID NO: 202593 - DNA, 23 bp, Artificial sequence
  SiRNA target sequence
ctgtctgatagtacaactttcat

SEQ ID NO: 202594 - DNA, 23 bp, Artificial sequence
  SiRNA target sequence
tgtctgatagtacaactttcatt

SEQ ID NO: 202595 - DNA, 23 bp, Artificial sequence
  SiRNA target sequence
gtctgatagtacaactttcattt

SEQ ID NO: 202596 - DNA, 23 bp, Artificial sequence
  SiRNA target sequence
tctgatagtacaactttcattta

SEQ ID NO: 202597 - DNA, 23 bp, Artificial sequence
  SiRNA target sequence
ctgatagtacaactttcatttaa

SEQ ID NO: 202598 - DNA, 23 bp, Artificial sequence
  SiRNA target sequence
tgatagtacaactttcatttaaa

SEQ ID NO: 202599 - DNA, 23 bp, Artificial sequence
  SiRNA target sequence
gatagtacaactttcatttaaaa

SEQ ID NO: 202600 - DNA, 23 bp, Artificial sequence
  SiRNA target sequence
atagtacaactttcatttaaaaa

SEQ ID NO: 202601 - DNA, 23 bp, Artificial sequence
  SiRNA target sequence
tagtacaactttcatttaaaaaa

SEQ ID NO: 202602 - DNA, 23 bp, Artificial sequence
  SiRNA target sequence
agtacaactttcatttaaaaaac

SEQ ID NO: 202603 - DNA, 23 bp, Artificial sequence
  SiRNA target sequence
gtacaactttcatttaaaaaact

SEQ ID NO: 202604 - DNA, 23 bp, Artificial sequence
  SiRNA target sequence
tacaactttcatttaaaaaactc

SEQ ID NO: 202605 - DNA, 23 bp, Artificial sequence
  SiRNA target sequence
acaactttcatttaaaaaactca

SEQ ID NO: 202606 - DNA, 23 bp, Artificial sequence
  SiRNA target sequence
caactttcatttaaaaaactcat

SEQ ID NO: 202607 - DNA, 23 bp, Artificial sequence
  SiRNA target sequence
aactttcatttaaaaaactcatg

SEQ ID NO: 202608 - DNA, 23 bp, Artificial sequence
  SiRNA target sequence
actttcatttaaaaaactcatgt

SEQ ID NO: 202609 - DNA, 23 bp, Artificial sequence
  SiRNA target sequence
ctttcatttaaaaaactcatgta

SEQ ID NO: 202610 - DNA, 23 bp, Artificial sequence
  SiRNA target sequence
tttcatttaaaaaactcatgtat

SEQ ID NO: 202611 - DNA, 23 bp, Artificial sequence
  SiRNA target sequence
ttcatttaaaaaactcatgtata

SEQ ID NO: 202612 - DNA, 23 bp, Artificial sequence
  SiRNA target sequence
tcatttaaaaaactcatgtataa

SEQ ID NO: 202613 - DNA, 23 bp, Artificial sequence
  SiRNA target sequence
catttaaaaaactcatgtataaa

SEQ ID NO: 202614 - DNA, 23 bp, Artificial sequence
  SiRNA target sequence
atttaaaaaactcatgtataaat

SEQ ID NO: 202615 - DNA, 23 bp, Artificial sequence
  SiRNA target sequence
tttaaaaaactcatgtataaata

SEQ ID NO: 202616 - DNA, 23 bp, Artificial sequence
  SiRNA target sequence
ttaaaaaactcatgtataaataa

SEQ ID NO: 202617 - DNA, 23 bp, Artificial sequence
  SiRNA target sequence
taaaaaactcatgtataaataag

SEQ ID NO: 202618 - DNA, 23 bp, Artificial sequence
  SiRNA target sequence
aaaaaactcatgtataaataagc

SEQ ID NO: 202619 - DNA, 23 bp, Artificial sequence
  SiRNA target sequence
aaaaactcatgtataaataagcc

SEQ ID NO: 202620 - DNA, 23 bp, Artificial sequence
  SiRNA target sequence
aaaactcatgtataaataagcca

SEQ ID NO: 202621 - DNA, 23 bp, Artificial sequence
  SiRNA target sequence
aaactcatgtataaataagccat

SEQ ID NO: 202622 - DNA, 23 bp, Artificial sequence
  SiRNA target sequence
aactcatgtataaataagccata

SEQ ID NO: 202623 - DNA, 23 bp, Artificial sequence
  SiRNA target sequence
actcatgtataaataagccataa

SEQ ID NO: 202624 - DNA, 23 bp, Artificial sequence
  SiRNA target sequence
ctcatgtataaataagccataag

SEQ ID NO: 202625 - DNA, 23 bp, Artificial sequence
  SiRNA target sequence
tcatgtataaataagccataagt

SEQ ID NO: 202626 - DNA, 23 bp, Artificial sequence
  SiRNA target sequence
catgtataaataagccataagta

SEQ ID NO: 202627 - DNA, 23 bp, Artificial sequence
  SiRNA target sequence
atgtataaataagccataagtaa

SEQ ID NO: 202628 - DNA, 23 bp, Artificial sequence
  SiRNA target sequence
tgtataaataagccataagtaaa

SEQ ID NO: 202629 - DNA, 23 bp, Artificial sequence
  SiRNA target sequence
gtataaataagccataagtaaac

SEQ ID NO: 202630 - DNA, 23 bp, Artificial sequence
  SiRNA target sequence
tataaataagccataagtaaact

SEQ ID NO: 202631 - DNA, 23 bp, Artificial sequence
  SiRNA target sequence
ataaataagccataagtaaactg

SEQ ID NO: 202632 - DNA, 23 bp, Artificial sequence
  SiRNA target sequence
taaataagccataagtaaactgc

SEQ ID NO: 202633 - DNA, 23 bp, Artificial sequence
  SiRNA target sequence
aaataagccataagtaaactgcc

SEQ ID NO: 202634 - DNA, 23 bp, Artificial sequence
  SiRNA target sequence
aataagccataagtaaactgccc

SEQ ID NO: 202635 - DNA, 23 bp, Artificial sequence
  SiRNA target sequence
ataagccataagtaaactgcccc

SEQ ID NO: 202636 - DNA, 23 bp, Artificial sequence
  SiRNA target sequence
taagccataagtaaactgcccca

SEQ ID NO: 202637 - DNA, 23 bp, Artificial sequence
  SiRNA target sequence
aagccataagtaaactgccccac

SEQ ID NO: 202638 - DNA, 23 bp, Artificial sequence
  SiRNA target sequence
agccataagtaaactgccccaca

SEQ ID NO: 202639 - DNA, 23 bp, Artificial sequence
  SiRNA target sequence
gccataagtaaactgccccacat

SEQ ID NO: 202640 - DNA, 23 bp, Artificial sequence
  SiRNA target sequence
ccataagtaaactgccccacatt

SEQ ID NO: 202641 - DNA, 23 bp, Artificial sequence
  SiRNA target sequence
cataagtaaactgccccacattt

SEQ ID NO: 202642 - DNA, 23 bp, Artificial sequence
  SiRNA target sequence
ataagtaaactgccccacatttc

SEQ ID NO: 202643 - DNA, 23 bp, Artificial sequence
  SiRNA target sequence
taagtaaactgccccacatttct

SEQ ID NO: 202644 - DNA, 23 bp, Artificial sequence
  SiRNA target sequence
aagtaaactgccccacatttctg

SEQ ID NO: 202645 - DNA, 23 bp, Artificial sequence
  SiRNA target sequence
agtaaactgccccacatttctgc

SEQ ID NO: 202646 - DNA, 23 bp, Artificial sequence
  SiRNA target sequence
gtaaactgccccacatttctgct

SEQ ID NO: 202647 - DNA, 23 bp, Artificial sequence
  SiRNA target sequence
taaactgccccacatttctgcta

SEQ ID NO: 202648 - DNA, 23 bp, Artificial sequence
  SiRNA target sequence
aaactgccccacatttctgctat

SEQ ID NO: 202649 - DNA, 23 bp, Artificial sequence
  SiRNA target sequence
aactgccccacatttctgctatt

SEQ ID NO: 202650 - DNA, 23 bp, Artificial sequence
  SiRNA target sequence
actgccccacatttctgctatta

SEQ ID NO: 202651 - DNA, 23 bp, Artificial sequence
  SiRNA target sequence
ctgccccacatttctgctattat

SEQ ID NO: 202652 - DNA, 23 bp, Artificial sequence
  SiRNA target sequence
tgccccacatttctgctattata

SEQ ID NO: 202653 - DNA, 23 bp, Artificial sequence
  SiRNA target sequence
gccccacatttctgctattataa

SEQ ID NO: 202654 - DNA, 23 bp, Artificial sequence
  SiRNA target sequence
ccccacatttctgctattataaa

SEQ ID NO: 202655 - DNA, 23 bp, Artificial sequence
  SiRNA target sequence
cccacatttctgctattataaaa

SEQ ID NO: 202656 - DNA, 23 bp, Artificial sequence
  SiRNA target sequence
ccacatttctgctattataaaaa

SEQ ID NO: 202657 - DNA, 23 bp, Artificial sequence
  SiRNA target sequence
cacatttctgctattataaaaat

SEQ ID NO: 202658 - DNA, 23 bp, Artificial sequence
  SiRNA target sequence
acatttctgctattataaaaata

SEQ ID NO: 202659 - DNA, 23 bp, Artificial sequence
  SiRNA target sequence
catttctgctattataaaaatac

SEQ ID NO: 202660 - DNA, 23 bp, Artificial sequence
  SiRNA target sequence
atttctgctattataaaaataca

SEQ ID NO: 202661 - DNA, 23 bp, Artificial sequence
  SiRNA target sequence
tttctgctattataaaaatacaa

SEQ ID NO: 202662 - DNA, 23 bp, Artificial sequence
  SiRNA target sequence
ttctgctattataaaaatacaag

SEQ ID NO: 202663 - DNA, 23 bp, Artificial sequence
  SiRNA target sequence
tctgctattataaaaatacaagt

SEQ ID NO: 202664 - DNA, 23 bp, Artificial sequence
  SiRNA target sequence
ctgctattataaaaatacaagtt

SEQ ID NO: 202665 - DNA, 23 bp, Artificial sequence
  SiRNA target sequence
tgctattataaaaatacaagttg

SEQ ID NO: 202666 - DNA, 23 bp, Artificial sequence
  SiRNA target sequence
gctattataaaaatacaagttga

SEQ ID NO: 202667 - DNA, 23 bp, Artificial sequence
  SiRNA target sequence
ctattataaaaatacaagttgaa

SEQ ID NO: 202668 - DNA, 23 bp, Artificial sequence
  SiRNA target sequence
tattataaaaatacaagttgaaa

SEQ ID NO: 202669 - DNA, 23 bp, Artificial sequence
  SiRNA target sequence
attataaaaatacaagttgaaac

SEQ ID NO: 202670 - DNA, 23 bp, Artificial sequence
  SiRNA target sequence
ttataaaaatacaagttgaaacg

SEQ ID NO: 202671 - DNA, 23 bp, Artificial sequence
  SiRNA target sequence
tataaaaatacaagttgaaacgg

SEQ ID NO: 202672 - DNA, 23 bp, Artificial sequence
  SiRNA target sequence
ataaaaatacaagttgaaacggg

SEQ ID NO: 202673 - DNA, 23 bp, Artificial sequence
  SiRNA target sequence
taaaaatacaagttgaaacgggc

SEQ ID NO: 202674 - DNA, 23 bp, Artificial sequence
  SiRNA target sequence
aaaaatacaagttgaaacgggct

SEQ ID NO: 202675 - DNA, 23 bp, Artificial sequence
  SiRNA target sequence
aaaatacaagttgaaacgggctc

SEQ ID NO: 202676 - DNA, 23 bp, Artificial sequence
  SiRNA target sequence
aaatacaagttgaaacgggctcg

SEQ ID NO: 202677 - DNA, 23 bp, Artificial sequence
  SiRNA target sequence
aatacaagttgaaacgggctcgt

SEQ ID NO: 202678 - DNA, 23 bp, Artificial sequence
  SiRNA target sequence
atacaagttgaaacgggctcgtt

SEQ ID NO: 202679 - DNA, 23 bp, Artificial sequence
  SiRNA target sequence
tacaagttgaaacgggctcgtta

SEQ ID NO: 202680 - DNA, 23 bp, Artificial sequence
  SiRNA target sequence
acaagttgaaacgggctcgttag

SEQ ID NO: 202681 - DNA, 23 bp, Artificial sequence
  SiRNA target sequence
caagttgaaacgggctcgttagc

SEQ ID NO: 202682 - DNA, 23 bp, Artificial sequence
  SiRNA target sequence
aagttgaaacgggctcgttagct

SEQ ID NO: 202683 - DNA, 23 bp, Artificial sequence
  SiRNA target sequence
agttgaaacgggctcgttagctg

SEQ ID NO: 202684 - DNA, 23 bp, Artificial sequence
  SiRNA target sequence
gttgaaacgggctcgttagctgt

SEQ ID NO: 202685 - DNA, 23 bp, Artificial sequence
  SiRNA target sequence
ttgaaacgggctcgttagctgta

SEQ ID NO: 202686 - DNA, 23 bp, Artificial sequence
  SiRNA target sequence
tgaaacgggctcgttagctgtaa

SEQ ID NO: 202687 - DNA, 23 bp, Artificial sequence
  SiRNA target sequence
gaaacgggctcgttagctgtaat

SEQ ID NO: 202688 - DNA, 23 bp, Artificial sequence
  SiRNA target sequence
aaacgggctcgttagctgtaatt

SEQ ID NO: 202689 - DNA, 23 bp, Artificial sequence
  SiRNA target sequence
aacgggctcgttagctgtaatta

SEQ ID NO: 202690 - DNA, 23 bp, Artificial sequence
  SiRNA target sequence
acgggctcgttagctgtaattaa

SEQ ID NO: 202691 - DNA, 23 bp, Artificial sequence
  SiRNA target sequence
cgggctcgttagctgtaattaaa

SEQ ID NO: 202692 - DNA, 23 bp, Artificial sequence
  SiRNA target sequence
gggctcgttagctgtaattaaaa

SEQ ID NO: 202693 - DNA, 23 bp, Artificial sequence
  SiRNA target sequence
ggctcgttagctgtaattaaaaa

SEQ ID NO: 202694 - DNA, 23 bp, Artificial sequence
  SiRNA target sequence
gctcgttagctgtaattaaaaaa

SEQ ID NO: 202695 - DNA, 23 bp, Artificial sequence
  SiRNA target sequence
ctcgttagctgtaattaaaaaat

SEQ ID NO: 202696 - DNA, 23 bp, Artificial sequence
  SiRNA target sequence
tcgttagctgtaattaaaaaata

SEQ ID NO: 202697 - DNA, 23 bp, Artificial sequence
  SiRNA target sequence
cgttagctgtaattaaaaaatat

SEQ ID NO: 202698 - DNA, 23 bp, Artificial sequence
  SiRNA target sequence
gttagctgtaattaaaaaatatt

SEQ ID NO: 202699 - DNA, 23 bp, Artificial sequence
  SiRNA target sequence
ttagctgtaattaaaaaatattt

SEQ ID NO: 202700 - DNA, 23 bp, Artificial sequence
  SiRNA target sequence
tagctgtaattaaaaaatatttt

SEQ ID NO: 202701 - DNA, 23 bp, Artificial sequence
  SiRNA target sequence
agctgtaattaaaaaatatttta

SEQ ID NO: 202702 - DNA, 23 bp, Artificial sequence
  SiRNA target sequence
gctgtaattaaaaaatattttat

SEQ ID NO: 202703 - DNA, 23 bp, Artificial sequence
  SiRNA target sequence
ctgtaattaaaaaatattttata

SEQ ID NO: 202704 - DNA, 23 bp, Artificial sequence
  SiRNA target sequence
tgtaattaaaaaatattttataa

SEQ ID NO: 202705 - DNA, 23 bp, Artificial sequence
  SiRNA target sequence
gtaattaaaaaatattttataaa

SEQ ID NO: 202706 - DNA, 23 bp, Artificial sequence
  SiRNA target sequence
taattaaaaaatattttataaag

SEQ ID NO: 202707 - DNA, 23 bp, Artificial sequence
  SiRNA target sequence
aattaaaaaatattttataaagt

SEQ ID NO: 202708 - DNA, 23 bp, Artificial sequence
  SiRNA target sequence
attaaaaaatattttataaagtt

SEQ ID NO: 202709 - DNA, 23 bp, Artificial sequence
  SiRNA target sequence
ttaaaaaatattttataaagttc

SEQ ID NO: 202710 - DNA, 23 bp, Artificial sequence
  SiRNA target sequence
taaaaaatattttataaagttca

SEQ ID NO: 202711 - DNA, 23 bp, Artificial sequence
  SiRNA target sequence
aaaaaatattttataaagttcaa

SEQ ID NO: 202712 - DNA, 23 bp, Artificial sequence
  SiRNA target sequence
aaaaatattttataaagttcaat

SEQ ID NO: 202713 - DNA, 23 bp, Artificial sequence
  SiRNA target sequence
aaaatattttataaagttcaatc

SEQ ID NO: 202714 - DNA, 23 bp, Artificial sequence
  SiRNA target sequence
aaatattttataaagttcaatcc

SEQ ID NO: 202715 - DNA, 23 bp, Artificial sequence
  SiRNA target sequence
aatattttataaagttcaatccc

SEQ ID NO: 202716 - DNA, 23 bp, Artificial sequence
  SiRNA target sequence
atattttataaagttcaatccct

SEQ ID NO: 202717 - DNA, 23 bp, Artificial sequence
  SiRNA target sequence
tattttataaagttcaatccctt

SEQ ID NO: 202718 - DNA, 23 bp, Artificial sequence
  SiRNA target sequence
attttataaagttcaatcccttc

SEQ ID NO: 202719 - DNA, 23 bp, Artificial sequence
  SiRNA target sequence
ttttataaagttcaatcccttca

SEQ ID NO: 202720 - DNA, 23 bp, Artificial sequence
  SiRNA target sequence
tttataaagttcaatcccttcaa

SEQ ID NO: 202721 - DNA, 23 bp, Artificial sequence
  SiRNA target sequence
ttataaagttcaatcccttcaat

SEQ ID NO: 202722 - DNA, 23 bp, Artificial sequence
  SiRNA target sequence
tataaagttcaatcccttcaatg

SEQ ID NO: 202723 - DNA, 23 bp, Artificial sequence
  SiRNA target sequence
ataaagttcaatcccttcaatgc

SEQ ID NO: 202724 - DNA, 23 bp, Artificial sequence
  SiRNA target sequence
taaagttcaatcccttcaatgca

SEQ ID NO: 202725 - DNA, 23 bp, Artificial sequence
  SiRNA target sequence
aaagttcaatcccttcaatgcac

SEQ ID NO: 202726 - DNA, 23 bp, Artificial sequence
  SiRNA target sequence
aagttcaatcccttcaatgcacc

SEQ ID NO: 202727 - DNA, 23 bp, Artificial sequence
  SiRNA target sequence
agttcaatcccttcaatgcacct

SEQ ID NO: 202728 - DNA, 23 bp, Artificial sequence
  SiRNA target sequence
gttcaatcccttcaatgcacctt

SEQ ID NO: 202729 - DNA, 23 bp, Artificial sequence
  SiRNA target sequence
ttcaatcccttcaatgcaccttt

SEQ ID NO: 202730 - DNA, 23 bp, Artificial sequence
  SiRNA target sequence
tcaatcccttcaatgcacctttg

SEQ ID NO: 202731 - DNA, 23 bp, Artificial sequence
  SiRNA target sequence
caatcccttcaatgcacctttgt

SEQ ID NO: 202732 - DNA, 23 bp, Artificial sequence
  SiRNA target sequence
aatcccttcaatgcacctttgtt

SEQ ID NO: 202733 - DNA, 23 bp, Artificial sequence
  SiRNA target sequence
atcccttcaatgcacctttgtta

SEQ ID NO: 202734 - DNA, 23 bp, Artificial sequence
  SiRNA target sequence
tcccttcaatgcacctttgttat

SEQ ID NO: 202735 - DNA, 23 bp, Artificial sequence
  SiRNA target sequence
cccttcaatgcacctttgttatc

SEQ ID NO: 202736 - DNA, 23 bp, Artificial sequence
  SiRNA target sequence
ccttcaatgcacctttgttatca

SEQ ID NO: 202737 - DNA, 23 bp, Artificial sequence
  SiRNA target sequence
cttcaatgcacctttgttatcag

SEQ ID NO: 202738 - DNA, 23 bp, Artificial sequence
  SiRNA target sequence
ttcaatgcacctttgttatcagc

SEQ ID NO: 202739 - DNA, 23 bp, Artificial sequence
  SiRNA target sequence
tcaatgcacctttgttatcagcg

SEQ ID NO: 202740 - DNA, 23 bp, Artificial sequence
  SiRNA target sequence
caatgcacctttgttatcagcga

SEQ ID NO: 202741 - DNA, 23 bp, Artificial sequence
  SiRNA target sequence
aatgcacctttgttatcagcgaa

SEQ ID NO: 202742 - DNA, 23 bp, Artificial sequence
  SiRNA target sequence
atgcacctttgttatcagcgaaa

SEQ ID NO: 202743 - DNA, 23 bp, Artificial sequence
  SiRNA target sequence
tgcacctttgttatcagcgaaaa

SEQ ID NO: 202744 - DNA, 23 bp, Artificial sequence
  SiRNA target sequence
gcacctttgttatcagcgaaaat

SEQ ID NO: 202745 - DNA, 23 bp, Artificial sequence
  SiRNA target sequence
cacctttgttatcagcgaaaata

SEQ ID NO: 202746 - DNA, 23 bp, Artificial sequence
  SiRNA target sequence
acctttgttatcagcgaaaatat

SEQ ID NO: 202747 - DNA, 23 bp, Artificial sequence
  SiRNA target sequence
cctttgttatcagcgaaaatatc

SEQ ID NO: 202748 - DNA, 23 bp, Artificial sequence
  SiRNA target sequence
ctttgttatcagcgaaaatatct

SEQ ID NO: 202749 - DNA, 23 bp, Artificial sequence
  SiRNA target sequence
tttgttatcagcgaaaatatctc

SEQ ID NO: 202750 - DNA, 23 bp, Artificial sequence
  SiRNA target sequence
ttgttatcagcgaaaatatctct

SEQ ID NO: 202751 - DNA, 23 bp, Artificial sequence
  SiRNA target sequence
tgttatcagcgaaaatatctcta

SEQ ID NO: 202752 - DNA, 23 bp, Artificial sequence
  SiRNA target sequence
gttatcagcgaaaatatctctaa

SEQ ID NO: 202753 - DNA, 23 bp, Artificial sequence
  SiRNA target sequence
ttatcagcgaaaatatctctaaa

SEQ ID NO: 202754 - DNA, 23 bp, Artificial sequence
  SiRNA target sequence
tatcagcgaaaatatctctaaat

SEQ ID NO: 202755 - DNA, 23 bp, Artificial sequence
  SiRNA target sequence
atcagcgaaaatatctctaaata

SEQ ID NO: 202756 - DNA, 23 bp, Artificial sequence
  SiRNA target sequence
tcagcgaaaatatctctaaataa

SEQ ID NO: 202757 - DNA, 23 bp, Artificial sequence
  SiRNA target sequence
cagcgaaaatatctctaaataaa

SEQ ID NO: 202758 - DNA, 23 bp, Artificial sequence
  SiRNA target sequence
agcgaaaatatctctaaataaaa

SEQ ID NO: 202759 - DNA, 23 bp, Artificial sequence
  SiRNA target sequence
gcgaaaatatctctaaataaaaa

SEQ ID NO: 202760 - DNA, 23 bp, Artificial sequence
  SiRNA target sequence
cgaaaatatctctaaataaaaag

SEQ ID NO: 202761 - DNA, 23 bp, Artificial sequence
  SiRNA target sequence
gaaaatatctctaaataaaaagc

SEQ ID NO: 202762 - DNA, 23 bp, Artificial sequence
  SiRNA target sequence
aaaatatctctaaataaaaagct

SEQ ID NO: 202763 - DNA, 23 bp, Artificial sequence
  SiRNA target sequence
aaatatctctaaataaaaagcta

SEQ ID NO: 202764 - DNA, 23 bp, Artificial sequence
  SiRNA target sequence
aatatctctaaataaaaagctag

SEQ ID NO: 202765 - DNA, 23 bp, Artificial sequence
  SiRNA target sequence
atatctctaaataaaaagctaga

SEQ ID NO: 202766 - DNA, 23 bp, Artificial sequence
  SiRNA target sequence
tatctctaaataaaaagctagat

SEQ ID NO: 202767 - DNA, 23 bp, Artificial sequence
  SiRNA target sequence
atctctaaataaaaagctagatg

SEQ ID NO: 202768 - DNA, 23 bp, Artificial sequence
  SiRNA target sequence
tctctaaataaaaagctagatgg

SEQ ID NO: 202769 - DNA, 23 bp, Artificial sequence
  SiRNA target sequence
ctctaaataaaaagctagatggt

SEQ ID NO: 202770 - DNA, 23 bp, Artificial sequence
  SiRNA target sequence
tctaaataaaaagctagatggtg

SEQ ID NO: 202771 - DNA, 23 bp, Artificial sequence
  SiRNA target sequence
ctaaataaaaagctagatggtgt

SEQ ID NO: 202772 - DNA, 23 bp, Artificial sequence
  SiRNA target sequence
taaataaaaagctagatggtgtt

SEQ ID NO: 202773 - DNA, 23 bp, Artificial sequence
  SiRNA target sequence
aaataaaaagctagatggtgtta

SEQ ID NO: 202774 - DNA, 23 bp, Artificial sequence
  SiRNA target sequence
aataaaaagctagatggtgttac

SEQ ID NO: 202775 - DNA, 23 bp, Artificial sequence
  SiRNA target sequence
ataaaaagctagatggtgttact

SEQ ID NO: 202776 - DNA, 23 bp, Artificial sequence
  SiRNA target sequence
taaaaagctagatggtgttactt

SEQ ID NO: 202777 - DNA, 23 bp, Artificial sequence
  SiRNA target sequence
aaaaagctagatggtgttacttt

SEQ ID NO: 202778 - DNA, 23 bp, Artificial sequence
  SiRNA target sequence
aaaagctagatggtgttactttc

SEQ ID NO: 202779 - DNA, 23 bp, Artificial sequence
  SiRNA target sequence
aaagctagatggtgttactttct

SEQ ID NO: 202780 - DNA, 23 bp, Artificial sequence
  SiRNA target sequence
aagctagatggtgttactttctc

SEQ ID NO: 202781 - DNA, 23 bp, Artificial sequence
  SiRNA target sequence
agctagatggtgttactttctct

SEQ ID NO: 202782 - DNA, 23 bp, Artificial sequence
  SiRNA target sequence
gctagatggtgttactttctctt

SEQ ID NO: 202783 - DNA, 23 bp, Artificial sequence
  SiRNA target sequence
ctagatggtgttactttctcttc

SEQ ID NO: 202784 - DNA, 23 bp, Artificial sequence
  SiRNA target sequence
tagatggtgttactttctcttca

SEQ ID NO: 202785 - DNA, 23 bp, Artificial sequence
  SiRNA target sequence
agatggtgttactttctcttcaa

SEQ ID NO: 202786 - DNA, 23 bp, Artificial sequence
  SiRNA target sequence
gatggtgttactttctcttcaaa

SEQ ID NO: 202787 - DNA, 23 bp, Artificial sequence
  SiRNA target sequence
atggtgttactttctcttcaaac

SEQ ID NO: 202788 - DNA, 23 bp, Artificial sequence
  SiRNA target sequence
tggtgttactttctcttcaaaca

SEQ ID NO: 202789 - DNA, 23 bp, Artificial sequence
  SiRNA target sequence
ggtgttactttctcttcaaacaa

SEQ ID NO: 202790 - DNA, 23 bp, Artificial sequence
  SiRNA target sequence
gtgttactttctcttcaaacaaa

SEQ ID NO: 202791 - DNA, 23 bp, Artificial sequence
  SiRNA target sequence
tgttactttctcttcaaacaaaa

SEQ ID NO: 202792 - DNA, 23 bp, Artificial sequence
  SiRNA target sequence
gttactttctcttcaaacaaaaa

SEQ ID NO: 202793 - DNA, 23 bp, Artificial sequence
  SiRNA target sequence
ttactttctcttcaaacaaaaag

SEQ ID NO: 202794 - DNA, 23 bp, Artificial sequence
  SiRNA target sequence
tactttctcttcaaacaaaaaga

SEQ ID NO: 202795 - DNA, 23 bp, Artificial sequence
  SiRNA target sequence
actttctcttcaaacaaaaagat

SEQ ID NO: 202796 - DNA, 23 bp, Artificial sequence
  SiRNA target sequence
ctttctcttcaaacaaaaagatt

SEQ ID NO: 202797 - DNA, 23 bp, Artificial sequence
  SiRNA target sequence
tttctcttcaaacaaaaagattg

SEQ ID NO: 202798 - DNA, 23 bp, Artificial sequence
  SiRNA target sequence
ttctcttcaaacaaaaagattgc

SEQ ID NO: 202799 - DNA, 23 bp, Artificial sequence
  SiRNA target sequence
tctcttcaaacaaaaagattgcc

SEQ ID NO: 202800 - DNA, 23 bp, Artificial sequence
  SiRNA target sequence
ctcttcaaacaaaaagattgccc

SEQ ID NO: 202801 - DNA, 23 bp, Artificial sequence
  SiRNA target sequence
tcttcaaacaaaaagattgcccc

SEQ ID NO: 202802 - DNA, 23 bp, Artificial sequence
  SiRNA target sequence
cttcaaacaaaaagattgcccct

SEQ ID NO: 202803 - DNA, 23 bp, Artificial sequence
  SiRNA target sequence
ttcaaacaaaaagattgccccta

SEQ ID NO: 202804 - DNA, 23 bp, Artificial sequence
  SiRNA target sequence
tcaaacaaaaagattgcccctag

SEQ ID NO: 202805 - DNA, 23 bp, Artificial sequence
  SiRNA target sequence
caaacaaaaagattgcccctagt

SEQ ID NO: 202806 - DNA, 23 bp, Artificial sequence
  SiRNA target sequence
aaacaaaaagattgcccctagtc

SEQ ID NO: 202807 - DNA, 23 bp, Artificial sequence
  SiRNA target sequence
aacaaaaagattgcccctagtcc

SEQ ID NO: 202808 - DNA, 23 bp, Artificial sequence
  SiRNA target sequence
acaaaaagattgcccctagtccg

SEQ ID NO: 202809 - DNA, 23 bp, Artificial sequence
  SiRNA target sequence
caaaaagattgcccctagtccga

SEQ ID NO: 202810 - DNA, 23 bp, Artificial sequence
  SiRNA target sequence
aaaaagattgcccctagtccgaa

SEQ ID NO: 202811 - DNA, 23 bp, Artificial sequence
  SiRNA target sequence
aaaagattgcccctagtccgaag

SEQ ID NO: 202812 - DNA, 23 bp, Artificial sequence
  SiRNA target sequence
aaagattgcccctagtccgaaga

SEQ ID NO: 202813 - DNA, 23 bp, Artificial sequence
  SiRNA target sequence
aagattgcccctagtccgaagaa

SEQ ID NO: 202814 - DNA, 23 bp, Artificial sequence
  SiRNA target sequence
agattgcccctagtccgaagaaa

SEQ ID NO: 202815 - DNA, 23 bp, Artificial sequence
  SiRNA target sequence
gattgcccctagtccgaagaaaa

SEQ ID NO: 202816 - DNA, 23 bp, Artificial sequence
  SiRNA target sequence
attgcccctagtccgaagaaaaa

SEQ ID NO: 202817 - DNA, 23 bp, Artificial sequence
  SiRNA target sequence
ttgcccctagtccgaagaaaaat

SEQ ID NO: 202818 - DNA, 23 bp, Artificial sequence
  SiRNA target sequence
tgcccctagtccgaagaaaaatg

SEQ ID NO: 202819 - DNA, 23 bp, Artificial sequence
  SiRNA target sequence
gcccctagtccgaagaaaaatgc

SEQ ID NO: 202820 - DNA, 23 bp, Artificial sequence
  SiRNA target sequence
cccctagtccgaagaaaaatgca

SEQ ID NO: 202821 - DNA, 23 bp, Artificial sequence
  SiRNA target sequence
ccctagtccgaagaaaaatgcag

SEQ ID NO: 202822 - DNA, 23 bp, Artificial sequence
  SiRNA target sequence
cctagtccgaagaaaaatgcagt

SEQ ID NO: 202823 - DNA, 23 bp, Artificial sequence
  SiRNA target sequence
ctagtccgaagaaaaatgcagta

SEQ ID NO: 202824 - DNA, 23 bp, Artificial sequence
  SiRNA target sequence
tagtccgaagaaaaatgcagtaa

SEQ ID NO: 202825 - DNA, 23 bp, Artificial sequence
  SiRNA target sequence
agtccgaagaaaaatgcagtaaa

SEQ ID NO: 202826 - DNA, 23 bp, Artificial sequence
  SiRNA target sequence
gtccgaagaaaaatgcagtaaaa

SEQ ID NO: 202827 - DNA, 23 bp, Artificial sequence
  SiRNA target sequence
tccgaagaaaaatgcagtaaaaa

SEQ ID NO: 202828 - DNA, 23 bp, Artificial sequence
  SiRNA target sequence
ccgaagaaaaatgcagtaaaaat

SEQ ID NO: 202829 - DNA, 23 bp, Artificial sequence
  SiRNA target sequence
cgaagaaaaatgcagtaaaaatt

SEQ ID NO: 202830 - DNA, 23 bp, Artificial sequence
  SiRNA target sequence
gaagaaaaatgcagtaaaaatta

SEQ ID NO: 202831 - DNA, 23 bp, Artificial sequence
  SiRNA target sequence
aagaaaaatgcagtaaaaattat

SEQ ID NO: 202832 - DNA, 23 bp, Artificial sequence
  SiRNA target sequence
agaaaaatgcagtaaaaattatt

SEQ ID NO: 202833 - DNA, 23 bp, Artificial sequence
  SiRNA target sequence
gaaaaatgcagtaaaaattatta

SEQ ID NO: 202834 - DNA, 23 bp, Artificial sequence
  SiRNA target sequence
aaaaatgcagtaaaaattattag

SEQ ID NO: 202835 - DNA, 23 bp, Artificial sequence
  SiRNA target sequence
aaaatgcagtaaaaattattaga

SEQ ID NO: 202836 - DNA, 23 bp, Artificial sequence
  SiRNA target sequence
aaatgcagtaaaaattattagaa

SEQ ID NO: 202837 - DNA, 23 bp, Artificial sequence
  SiRNA target sequence
aatgcagtaaaaattattagaaa

SEQ ID NO: 202838 - DNA, 23 bp, Artificial sequence
  SiRNA target sequence
atgcagtaaaaattattagaaat

SEQ ID NO: 202839 - DNA, 23 bp, Artificial sequence
  SiRNA target sequence
tgcagtaaaaattattagaaata

SEQ ID NO: 202840 - DNA, 23 bp, Artificial sequence
  SiRNA target sequence
gcagtaaaaattattagaaatag

SEQ ID NO: 202841 - DNA, 23 bp, Artificial sequence
  SiRNA target sequence
cagtaaaaattattagaaataga

SEQ ID NO: 202842 - DNA, 23 bp, Artificial sequence
  SiRNA target sequence
agtaaaaattattagaaatagat

SEQ ID NO: 202843 - DNA, 23 bp, Artificial sequence
  SiRNA target sequence
gtaaaaattattagaaatagatt

SEQ ID NO: 202844 - DNA, 23 bp, Artificial sequence
  SiRNA target sequence
taaaaattattagaaatagatta

SEQ ID NO: 202845 - DNA, 23 bp, Artificial sequence
  SiRNA target sequence
aaaaattattagaaatagattaa

SEQ ID NO: 202846 - DNA, 23 bp, Artificial sequence
  SiRNA target sequence
aaaattattagaaatagattaaa

SEQ ID NO: 202847 - DNA, 23 bp, Artificial sequence
  SiRNA target sequence
aaattattagaaatagattaaaa

SEQ ID NO: 202848 - DNA, 23 bp, Artificial sequence
  SiRNA target sequence
aattattagaaatagattaaaaa

SEQ ID NO: 202849 - DNA, 23 bp, Artificial sequence
  SiRNA target sequence
attattagaaatagattaaaaat

SEQ ID NO: 202850 - DNA, 23 bp, Artificial sequence
  SiRNA target sequence
ttattagaaatagattaaaaatc

SEQ ID NO: 202851 - DNA, 23 bp, Artificial sequence
  SiRNA target sequence
tattagaaatagattaaaaatcg

SEQ ID NO: 202852 - DNA, 23 bp, Artificial sequence
  SiRNA target sequence
attagaaatagattaaaaatcga

SEQ ID NO: 202853 - DNA, 23 bp, Artificial sequence
  SiRNA target sequence
ttagaaatagattaaaaatcgat

SEQ ID NO: 202854 - DNA, 23 bp, Artificial sequence
  SiRNA target sequence
tagaaatagattaaaaatcgatg

SEQ ID NO: 202855 - DNA, 23 bp, Artificial sequence
  SiRNA target sequence
agaaatagattaaaaatcgatga

SEQ ID NO: 202856 - DNA, 23 bp, Artificial sequence
  SiRNA target sequence
gaaatagattaaaaatcgatgat

SEQ ID NO: 202857 - DNA, 23 bp, Artificial sequence
  SiRNA target sequence
aaatagattaaaaatcgatgata

SEQ ID NO: 202858 - DNA, 23 bp, Artificial sequence
  SiRNA target sequence
aatagattaaaaatcgatgatac

SEQ ID NO: 202859 - DNA, 23 bp, Artificial sequence
  SiRNA target sequence
atagattaaaaatcgatgataca

SEQ ID NO: 202860 - DNA, 23 bp, Artificial sequence
  SiRNA target sequence
tagattaaaaatcgatgatacag

SEQ ID NO: 202861 - DNA, 23 bp, Artificial sequence
  SiRNA target sequence
agattaaaaatcgatgatacagg

SEQ ID NO: 202862 - DNA, 23 bp, Artificial sequence
  SiRNA target sequence
gattaaaaatcgatgatacaggt

SEQ ID NO: 202863 - DNA, 23 bp, Artificial sequence
  SiRNA target sequence
attaaaaatcgatgatacaggtt

SEQ ID NO: 202864 - DNA, 23 bp, Artificial sequence
  SiRNA target sequence
ttaaaaatcgatgatacaggttt

SEQ ID NO: 202865 - DNA, 23 bp, Artificial sequence
  SiRNA target sequence
taaaaatcgatgatacaggttta

SEQ ID NO: 202866 - DNA, 23 bp, Artificial sequence
  SiRNA target sequence
aaaaatcgatgatacaggtttat

SEQ ID NO: 202867 - DNA, 23 bp, Artificial sequence
  SiRNA target sequence
aaaatcgatgatacaggtttatt

SEQ ID NO: 202868 - DNA, 23 bp, Artificial sequence
  SiRNA target sequence
aaatcgatgatacaggtttattt

SEQ ID NO: 202869 - DNA, 23 bp, Artificial sequence
  SiRNA target sequence
aatcgatgatacaggtttatttt

SEQ ID NO: 202870 - DNA, 23 bp, Artificial sequence
  SiRNA target sequence
atcgatgatacaggtttattttg

SEQ ID NO: 202871 - DNA, 23 bp, Artificial sequence
  SiRNA target sequence
tcgatgatacaggtttattttgc

SEQ ID NO: 202872 - DNA, 23 bp, Artificial sequence
  SiRNA target sequence
cgatgatacaggtttattttgca

SEQ ID NO: 202873 - DNA, 23 bp, Artificial sequence
  SiRNA target sequence
gatgatacaggtttattttgcat

SEQ ID NO: 202874 - DNA, 23 bp, Artificial sequence
  SiRNA target sequence
atgatacaggtttattttgcata

SEQ ID NO: 202875 - DNA, 23 bp, Artificial sequence
  SiRNA target sequence
tgatacaggtttattttgcataa

SEQ ID NO: 202876 - DNA, 23 bp, Artificial sequence
  SiRNA target sequence
gatacaggtttattttgcataag

SEQ ID NO: 202877 - DNA, 23 bp, Artificial sequence
  SiRNA target sequence
atacaggtttattttgcataagc

SEQ ID NO: 202878 - DNA, 23 bp, Artificial sequence
  SiRNA target sequence
tacaggtttattttgcataagcc

SEQ ID NO: 202879 - DNA, 23 bp, Artificial sequence
  SiRNA target sequence
acaggtttattttgcataagcca

SEQ ID NO: 202880 - DNA, 23 bp, Artificial sequence
  SiRNA target sequence
caggtttattttgcataagccac

SEQ ID NO: 202881 - DNA, 23 bp, Artificial sequence
  SiRNA target sequence
aggtttattttgcataagccact

SEQ ID NO: 202882 - DNA, 23 bp, Artificial sequence
  SiRNA target sequence
ggtttattttgcataagccactg

SEQ ID NO: 202883 - DNA, 23 bp, Artificial sequence
  SiRNA target sequence
gtttattttgcataagccactgt

SEQ ID NO: 202884 - DNA, 23 bp, Artificial sequence
  SiRNA target sequence
tttattttgcataagccactgta

SEQ ID NO: 202885 - DNA, 23 bp, Artificial sequence
  SiRNA target sequence
ttattttgcataagccactgtat

SEQ ID NO: 202886 - DNA, 23 bp, Artificial sequence
  SiRNA target sequence
tattttgcataagccactgtatt

SEQ ID NO: 202887 - DNA, 23 bp, Artificial sequence
  SiRNA target sequence
attttgcataagccactgtatta

SEQ ID NO: 202888 - DNA, 23 bp, Artificial sequence
  SiRNA target sequence
ttttgcataagccactgtattaa

SEQ ID NO: 202889 - DNA, 23 bp, Artificial sequence
  SiRNA target sequence
tttgcataagccactgtattaaa

SEQ ID NO: 202890 - DNA, 23 bp, Artificial sequence
  SiRNA target sequence
ttgcataagccactgtattaaaa

SEQ ID NO: 202891 - DNA, 23 bp, Artificial sequence
  SiRNA target sequence
tgcataagccactgtattaaaat

SEQ ID NO: 202892 - DNA, 23 bp, Artificial sequence
  SiRNA target sequence
gcataagccactgtattaaaatt

SEQ ID NO: 202893 - DNA, 23 bp, Artificial sequence
  SiRNA target sequence
cataagccactgtattaaaatta

SEQ ID NO: 202894 - DNA, 23 bp, Artificial sequence
  SiRNA target sequence
ataagccactgtattaaaattac

SEQ ID NO: 202895 - DNA, 23 bp, Artificial sequence
  SiRNA target sequence
taagccactgtattaaaattaca

SEQ ID NO: 202896 - DNA, 23 bp, Artificial sequence
  SiRNA target sequence
aagccactgtattaaaattacag

SEQ ID NO: 202897 - DNA, 23 bp, Artificial sequence
  SiRNA target sequence
agccactgtattaaaattacaga

SEQ ID NO: 202898 - DNA, 23 bp, Artificial sequence
  SiRNA target sequence
gccactgtattaaaattacagat

SEQ ID NO: 202899 - DNA, 23 bp, Artificial sequence
  SiRNA target sequence
ccactgtattaaaattacagatg

SEQ ID NO: 202900 - DNA, 23 bp, Artificial sequence
  SiRNA target sequence
cactgtattaaaattacagatgc

SEQ ID NO: 202901 - DNA, 23 bp, Artificial sequence
  SiRNA target sequence
actgtattaaaattacagatgca

SEQ ID NO: 202902 - DNA, 23 bp, Artificial sequence
  SiRNA target sequence
ctgtattaaaattacagatgcaa

SEQ ID NO: 202903 - DNA, 23 bp, Artificial sequence
  SiRNA target sequence
tgtattaaaattacagatgcaaa

SEQ ID NO: 202904 - DNA, 23 bp, Artificial sequence
  SiRNA target sequence
gtattaaaattacagatgcaaaa

SEQ ID NO: 202905 - DNA, 23 bp, Artificial sequence
  SiRNA target sequence
tattaaaattacagatgcaaaag

SEQ ID NO: 202906 - DNA, 23 bp, Artificial sequence
  SiRNA target sequence
attaaaattacagatgcaaaaga

SEQ ID NO: 202907 - DNA, 23 bp, Artificial sequence
  SiRNA target sequence
ttaaaattacagatgcaaaagat

SEQ ID NO: 202908 - DNA, 23 bp, Artificial sequence
  SiRNA target sequence
taaaattacagatgcaaaagata

SEQ ID NO: 202909 - DNA, 23 bp, Artificial sequence
  SiRNA target sequence
aaaattacagatgcaaaagatat

SEQ ID NO: 202910 - DNA, 23 bp, Artificial sequence
  SiRNA target sequence
aaattacagatgcaaaagatata

SEQ ID NO: 202911 - DNA, 23 bp, Artificial sequence
  SiRNA target sequence
aattacagatgcaaaagatatag

SEQ ID NO: 202912 - DNA, 23 bp, Artificial sequence
  SiRNA target sequence
attacagatgcaaaagatatagg

SEQ ID NO: 202913 - DNA, 23 bp, Artificial sequence
  SiRNA target sequence
ttacagatgcaaaagatatagga

SEQ ID NO: 202914 - DNA, 23 bp, Artificial sequence
  SiRNA target sequence
tacagatgcaaaagatataggaa

SEQ ID NO: 202915 - DNA, 23 bp, Artificial sequence
  SiRNA target sequence
acagatgcaaaagatataggaag

SEQ ID NO: 202916 - DNA, 23 bp, Artificial sequence
  SiRNA target sequence
cagatgcaaaagatataggaaga

SEQ ID NO: 202917 - DNA, 23 bp, Artificial sequence
  SiRNA target sequence
agatgcaaaagatataggaagaa

SEQ ID NO: 202918 - DNA, 23 bp, Artificial sequence
  SiRNA target sequence
gatgcaaaagatataggaagaac

SEQ ID NO: 202919 - DNA, 23 bp, Artificial sequence
  SiRNA target sequence
atgcaaaagatataggaagaaca

SEQ ID NO: 202920 - DNA, 23 bp, Artificial sequence
  SiRNA target sequence
tgcaaaagatataggaagaacat

SEQ ID NO: 202921 - DNA, 23 bp, Artificial sequence
  SiRNA target sequence
gcaaaagatataggaagaacata

SEQ ID NO: 202922 - DNA, 23 bp, Artificial sequence
  SiRNA target sequence
caaaagatataggaagaacataa

SEQ ID NO: 202923 - DNA, 23 bp, Artificial sequence
  SiRNA target sequence
aaaagatataggaagaacataaa

SEQ ID NO: 202924 - DNA, 23 bp, Artificial sequence
  SiRNA target sequence
aaagatataggaagaacataaaa

SEQ ID NO: 202925 - DNA, 23 bp, Artificial sequence
  SiRNA target sequence
aagatataggaagaacataaaaa

SEQ ID NO: 202926 - DNA, 23 bp, Artificial sequence
  SiRNA target sequence
agatataggaagaacataaaaaa

SEQ ID NO: 202927 - DNA, 23 bp, Artificial sequence
  SiRNA target sequence
gatataggaagaacataaaaaat

SEQ ID NO: 202928 - DNA, 23 bp, Artificial sequence
  SiRNA target sequence
atataggaagaacataaaaaatt

SEQ ID NO: 202929 - DNA, 23 bp, Artificial sequence
  SiRNA target sequence
tataggaagaacataaaaaattt

SEQ ID NO: 202930 - DNA, 23 bp, Artificial sequence
  SiRNA target sequence
ataggaagaacataaaaaatttt

SEQ ID NO: 202931 - DNA, 23 bp, Artificial sequence
  SiRNA target sequence
taggaagaacataaaaaattttc

SEQ ID NO: 202932 - DNA, 23 bp, Artificial sequence
  SiRNA target sequence
aggaagaacataaaaaattttca

SEQ ID NO: 202933 - DNA, 23 bp, Artificial sequence
  SiRNA target sequence
ggaagaacataaaaaattttcat

SEQ ID NO: 202934 - DNA, 23 bp, Artificial sequence
  SiRNA target sequence
gaagaacataaaaaattttcata

SEQ ID NO: 202935 - DNA, 23 bp, Artificial sequence
  SiRNA target sequence
aagaacataaaaaattttcataa

SEQ ID NO: 202936 - DNA, 23 bp, Artificial sequence
  SiRNA target sequence
agaacataaaaaattttcataaa

SEQ ID NO: 202937 - DNA, 23 bp, Artificial sequence
  SiRNA target sequence
gaacataaaaaattttcataaac

SEQ ID NO: 202938 - DNA, 23 bp, Artificial sequence
  SiRNA target sequence
aacataaaaaattttcataaaca

SEQ ID NO: 202939 - DNA, 23 bp, Artificial sequence
  SiRNA target sequence
acataaaaaattttcataaacat

SEQ ID NO: 202940 - DNA, 23 bp, Artificial sequence
  SiRNA target sequence
cataaaaaattttcataaacata

SEQ ID NO: 202941 - DNA, 23 bp, Artificial sequence
  SiRNA target sequence
ataaaaaattttcataaacataa

SEQ ID NO: 202942 - DNA, 23 bp, Artificial sequence
  SiRNA target sequence
taaaaaattttcataaacataat

SEQ ID NO: 202943 - DNA, 23 bp, Artificial sequence
  SiRNA target sequence
aaaaaattttcataaacataatt

SEQ ID NO: 202944 - DNA, 23 bp, Artificial sequence
  SiRNA target sequence
aaaaattttcataaacataattg

SEQ ID NO: 202945 - DNA, 23 bp, Artificial sequence
  SiRNA target sequence
aaaattttcataaacataattga

SEQ ID NO: 202946 - DNA, 23 bp, Artificial sequence
  SiRNA target sequence
aaattttcataaacataattgaa

SEQ ID NO: 202947 - DNA, 23 bp, Artificial sequence
  SiRNA target sequence
aattttcataaacataattgaat

SEQ ID NO: 202948 - DNA, 23 bp, Artificial sequence
  SiRNA target sequence
attttcataaacataattgaatt

SEQ ID NO: 202949 - DNA, 23 bp, Artificial sequence
  SiRNA target sequence
ttttcataaacataattgaattc

SEQ ID NO: 202950 - DNA, 23 bp, Artificial sequence
  SiRNA target sequence
tttcataaacataattgaattct

SEQ ID NO: 202951 - DNA, 23 bp, Artificial sequence
  SiRNA target sequence
ttcataaacataattgaattctg

SEQ ID NO: 202952 - DNA, 23 bp, Artificial sequence
  SiRNA target sequence
tcataaacataattgaattctga

SEQ ID NO: 202953 - DNA, 23 bp, Artificial sequence
  SiRNA target sequence
cataaacataattgaattctgat

SEQ ID NO: 202954 - DNA, 23 bp, Artificial sequence
  SiRNA target sequence
ataaacataattgaattctgatc

SEQ ID NO: 202955 - DNA, 23 bp, Artificial sequence
  SiRNA target sequence
taaacataattgaattctgatct

SEQ ID NO: 202956 - DNA, 23 bp, Artificial sequence
  SiRNA target sequence
aaacataattgaattctgatctt

SEQ ID NO: 202957 - DNA, 23 bp, Artificial sequence
  SiRNA target sequence
aacataattgaattctgatcttg

SEQ ID NO: 202958 - DNA, 23 bp, Artificial sequence
  SiRNA target sequence
acataattgaattctgatcttgc

SEQ ID NO: 202959 - DNA, 23 bp, Artificial sequence
  SiRNA target sequence
cataattgaattctgatcttgcc

SEQ ID NO: 202960 - DNA, 23 bp, Artificial sequence
  SiRNA target sequence
ataattgaattctgatcttgcct

SEQ ID NO: 202961 - DNA, 23 bp, Artificial sequence
  SiRNA target sequence
taattgaattctgatcttgcctt

SEQ ID NO: 202962 - DNA, 23 bp, Artificial sequence
  SiRNA target sequence
aattgaattctgatcttgcctta

SEQ ID NO: 202963 - DNA, 23 bp, Artificial sequence
  SiRNA target sequence
attgaattctgatcttgccttac

SEQ ID NO: 202964 - DNA, 23 bp, Artificial sequence
  SiRNA target sequence
ttgaattctgatcttgccttacc

SEQ ID NO: 202965 - DNA, 23 bp, Artificial sequence
  SiRNA target sequence
tgaattctgatcttgccttacca

SEQ ID NO: 202966 - DNA, 23 bp, Artificial sequence
  SiRNA target sequence
gaattctgatcttgccttaccat

SEQ ID NO: 202967 - DNA, 23 bp, Artificial sequence
  SiRNA target sequence
aattctgatcttgccttaccatc

SEQ ID NO: 202968 - DNA, 23 bp, Artificial sequence
  SiRNA target sequence
attctgatcttgccttaccatca

SEQ ID NO: 202969 - DNA, 23 bp, Artificial sequence
  SiRNA target sequence
ttctgatcttgccttaccatcac

SEQ ID NO: 202970 - DNA, 23 bp, Artificial sequence
  SiRNA target sequence
tctgatcttgccttaccatcaca

SEQ ID NO: 202971 - DNA, 23 bp, Artificial sequence
  SiRNA target sequence
ctgatcttgccttaccatcacaa

SEQ ID NO: 202972 - DNA, 23 bp, Artificial sequence
  SiRNA target sequence
tgatcttgccttaccatcacaaa

SEQ ID NO: 202973 - DNA, 23 bp, Artificial sequence
  SiRNA target sequence
gatcttgccttaccatcacaaat

SEQ ID NO: 202974 - DNA, 23 bp, Artificial sequence
  SiRNA target sequence
atcttgccttaccatcacaaata

SEQ ID NO: 202975 - DNA, 23 bp, Artificial sequence
  SiRNA target sequence
tcttgccttaccatcacaaataa

SEQ ID NO: 202976 - DNA, 23 bp, Artificial sequence
  SiRNA target sequence
cttgccttaccatcacaaataaa

SEQ ID NO: 202977 - DNA, 23 bp, Artificial sequence
  SiRNA target sequence
ttgccttaccatcacaaataaat

SEQ ID NO: 202978 - DNA, 23 bp, Artificial sequence
  SiRNA target sequence
tgccttaccatcacaaataaatc

SEQ ID NO: 202979 - DNA, 23 bp, Artificial sequence
  SiRNA target sequence
gccttaccatcacaaataaatct

SEQ ID NO: 202980 - DNA, 23 bp, Artificial sequence
  SiRNA target sequence
ccttaccatcacaaataaatctt

SEQ ID NO: 202981 - DNA, 23 bp, Artificial sequence
  SiRNA target sequence
cttaccatcacaaataaatcttt

SEQ ID NO: 202982 - DNA, 23 bp, Artificial sequence
  SiRNA target sequence
ttaccatcacaaataaatctttt

SEQ ID NO: 202983 - DNA, 23 bp, Artificial sequence
  SiRNA target sequence
taccatcacaaataaatctttta

SEQ ID NO: 202984 - DNA, 23 bp, Artificial sequence
  SiRNA target sequence
accatcacaaataaatcttttaa

SEQ ID NO: 202985 - DNA, 23 bp, Artificial sequence
  SiRNA target sequence
ccatcacaaataaatcttttaaa

SEQ ID NO: 202986 - DNA, 23 bp, Artificial sequence
  SiRNA target sequence
catcacaaataaatcttttaaaa

SEQ ID NO: 202987 - DNA, 23 bp, Artificial sequence
  SiRNA target sequence
atcacaaataaatcttttaaaat

SEQ ID NO: 202988 - DNA, 23 bp, Artificial sequence
  SiRNA target sequence
tcacaaataaatcttttaaaatt

SEQ ID NO: 202989 - DNA, 23 bp, Artificial sequence
  SiRNA target sequence
cacaaataaatcttttaaaattc

SEQ ID NO: 202990 - DNA, 23 bp, Artificial sequence
  SiRNA target sequence
acaaataaatcttttaaaattct

SEQ ID NO: 202991 - DNA, 23 bp, Artificial sequence
  SiRNA target sequence
caaataaatcttttaaaattctt

SEQ ID NO: 202992 - DNA, 23 bp, Artificial sequence
  SiRNA target sequence
aaataaatcttttaaaattctta

SEQ ID NO: 202993 - DNA, 23 bp, Artificial sequence
  SiRNA target sequence
aataaatcttttaaaattcttaa

SEQ ID NO: 202994 - DNA, 23 bp, Artificial sequence
  SiRNA target sequence
ataaatcttttaaaattcttaaa

SEQ ID NO: 202995 - DNA, 23 bp, Artificial sequence
  SiRNA target sequence
taaatcttttaaaattcttaaaa

SEQ ID NO: 202996 - DNA, 23 bp, Artificial sequence
  SiRNA target sequence
aaatcttttaaaattcttaaaaa

SEQ ID NO: 202997 - DNA, 23 bp, Artificial sequence
  SiRNA target sequence
aatcttttaaaattcttaaaaat

SEQ ID NO: 202998 - DNA, 23 bp, Artificial sequence
  SiRNA target sequence
atcttttaaaattcttaaaaatg

SEQ ID NO: 202999 - DNA, 23 bp, Artificial sequence
  SiRNA target sequence
tcttttaaaattcttaaaaatga

SEQ ID NO: 203000 - DNA, 23 bp, Artificial sequence
  SiRNA target sequence
cttttaaaattcttaaaaatgaa

SEQ ID NO: 203001 - DNA, 23 bp, Artificial sequence
  SiRNA target sequence
ttttaaaattcttaaaaatgaat

SEQ ID NO: 203002 - DNA, 23 bp, Artificial sequence
  SiRNA target sequence
tttaaaattcttaaaaatgaata

SEQ ID NO: 203003 - DNA, 23 bp, Artificial sequence
  SiRNA target sequence
ttaaaattcttaaaaatgaatac

SEQ ID NO: 203004 - DNA, 23 bp, Artificial sequence
  SiRNA target sequence
taaaattcttaaaaatgaataca

SEQ ID NO: 203005 - DNA, 23 bp, Artificial sequence
  SiRNA target sequence
aaaattcttaaaaatgaatacac

SEQ ID NO: 203006 - DNA, 23 bp, Artificial sequence
  SiRNA target sequence
aaattcttaaaaatgaatacaca

SEQ ID NO: 203007 - DNA, 23 bp, Artificial sequence
  SiRNA target sequence
aattcttaaaaatgaatacacaa

SEQ ID NO: 203008 - DNA, 23 bp, Artificial sequence
  SiRNA target sequence
attcttaaaaatgaatacacaaa

SEQ ID NO: 203009 - DNA, 23 bp, Artificial sequence
  SiRNA target sequence
ttcttaaaaatgaatacacaaag

SEQ ID NO: 203010 - DNA, 23 bp, Artificial sequence
  SiRNA target sequence
tcttaaaaatgaatacacaaagt

SEQ ID NO: 203011 - DNA, 23 bp, Artificial sequence
  SiRNA target sequence
cttaaaaatgaatacacaaagtt

SEQ ID NO: 203012 - DNA, 23 bp, Artificial sequence
  SiRNA target sequence
ttaaaaatgaatacacaaagtta

SEQ ID NO: 203013 - DNA, 23 bp, Artificial sequence
  SiRNA target sequence
taaaaatgaatacacaaagttaa

SEQ ID NO: 203014 - DNA, 23 bp, Artificial sequence
  SiRNA target sequence
aaaaatgaatacacaaagttaat

SEQ ID NO: 203015 - DNA, 23 bp, Artificial sequence
  SiRNA target sequence
aaaatgaatacacaaagttaatt

SEQ ID NO: 203016 - DNA, 23 bp, Artificial sequence
  SiRNA target sequence
aaatgaatacacaaagttaatta

SEQ ID NO: 203017 - DNA, 23 bp, Artificial sequence
  SiRNA target sequence
aatgaatacacaaagttaattaa

SEQ ID NO: 203018 - DNA, 23 bp, Artificial sequence
  SiRNA target sequence
atgaatacacaaagttaattaat

SEQ ID NO: 203019 - DNA, 23 bp, Artificial sequence
  SiRNA target sequence
tgaatacacaaagttaattaatc

SEQ ID NO: 203020 - DNA, 23 bp, Artificial sequence
  SiRNA target sequence
gaatacacaaagttaattaatcc

SEQ ID NO: 203021 - DNA, 23 bp, Artificial sequence
  SiRNA target sequence
aatacacaaagttaattaatcca

SEQ ID NO: 203022 - DNA, 23 bp, Artificial sequence
  SiRNA target sequence
atacacaaagttaattaatccaa

SEQ ID NO: 203023 - DNA, 23 bp, Artificial sequence
  SiRNA target sequence
tacacaaagttaattaatccaaa

SEQ ID NO: 203024 - DNA, 23 bp, Artificial sequence
  SiRNA target sequence
acacaaagttaattaatccaaac

SEQ ID NO: 203025 - DNA, 23 bp, Artificial sequence
  SiRNA target sequence
cacaaagttaattaatccaaaca

SEQ ID NO: 203026 - DNA, 23 bp, Artificial sequence
  SiRNA target sequence
acaaagttaattaatccaaacat

SEQ ID NO: 203027 - DNA, 23 bp, Artificial sequence
  SiRNA target sequence
caaagttaattaatccaaacata

SEQ ID NO: 203028 - DNA, 23 bp, Artificial sequence
  SiRNA target sequence
aaagttaattaatccaaacataa

SEQ ID NO: 203029 - DNA, 23 bp, Artificial sequence
  SiRNA target sequence
aagttaattaatccaaacataat

SEQ ID NO: 203030 - DNA, 23 bp, Artificial sequence
  SiRNA target sequence
agttaattaatccaaacataata

SEQ ID NO: 203031 - DNA, 23 bp, Artificial sequence
  SiRNA target sequence
gttaattaatccaaacataatac

SEQ ID NO: 203032 - DNA, 23 bp, Artificial sequence
  SiRNA target sequence
ttaattaatccaaacataatacc

SEQ ID NO: 203033 - DNA, 23 bp, Artificial sequence
  SiRNA target sequence
taattaatccaaacataatacca

SEQ ID NO: 203034 - DNA, 23 bp, Artificial sequence
  SiRNA target sequence
aattaatccaaacataataccaa

SEQ ID NO: 203035 - DNA, 23 bp, Artificial sequence
  SiRNA target sequence
attaatccaaacataataccaag

SEQ ID NO: 203036 - DNA, 23 bp, Artificial sequence
  SiRNA target sequence
ttaatccaaacataataccaagt

SEQ ID NO: 203037 - DNA, 23 bp, Artificial sequence
  SiRNA target sequence
taatccaaacataataccaagta

SEQ ID NO: 203038 - DNA, 23 bp, Artificial sequence
  SiRNA target sequence
aatccaaacataataccaagtat

SEQ ID NO: 203039 - DNA, 23 bp, Artificial sequence
  SiRNA target sequence
atccaaacataataccaagtata

SEQ ID NO: 203040 - DNA, 23 bp, Artificial sequence
  SiRNA target sequence
tccaaacataataccaagtataa

SEQ ID NO: 203041 - DNA, 23 bp, Artificial sequence
  SiRNA target sequence
ccaaacataataccaagtataaa

SEQ ID NO: 203042 - DNA, 23 bp, Artificial sequence
  SiRNA target sequence
caaacataataccaagtataaaa

SEQ ID NO: 203043 - DNA, 23 bp, Artificial sequence
  SiRNA target sequence
aaacataataccaagtataaaaa

SEQ ID NO: 203044 - DNA, 23 bp, Artificial sequence
  SiRNA target sequence
aacataataccaagtataaaaaa

SEQ ID NO: 203045 - DNA, 23 bp, Artificial sequence
  SiRNA target sequence
acataataccaagtataaaaaat

SEQ ID NO: 203046 - DNA, 23 bp, Artificial sequence
  SiRNA target sequence
cataataccaagtataaaaaatt

SEQ ID NO: 203047 - DNA, 23 bp, Artificial sequence
  SiRNA target sequence
ataataccaagtataaaaaattt

SEQ ID NO: 203048 - DNA, 23 bp, Artificial sequence
  SiRNA target sequence
taataccaagtataaaaaattta

SEQ ID NO: 203049 - DNA, 23 bp, Artificial sequence
  SiRNA target sequence
aataccaagtataaaaaatttag

SEQ ID NO: 203050 - DNA, 23 bp, Artificial sequence
  SiRNA target sequence
ataccaagtataaaaaatttagg

SEQ ID NO: 203051 - DNA, 23 bp, Artificial sequence
  SiRNA target sequence
taccaagtataaaaaatttaggc

SEQ ID NO: 203052 - DNA, 23 bp, Artificial sequence
  SiRNA target sequence
accaagtataaaaaatttaggca

SEQ ID NO: 203053 - DNA, 23 bp, Artificial sequence
  SiRNA target sequence
ccaagtataaaaaatttaggcat

SEQ ID NO: 203054 - DNA, 23 bp, Artificial sequence
  SiRNA target sequence
caagtataaaaaatttaggcatt

SEQ ID NO: 203055 - DNA, 23 bp, Artificial sequence
  SiRNA target sequence
aagtataaaaaatttaggcattt

SEQ ID NO: 203056 - DNA, 23 bp, Artificial sequence
  SiRNA target sequence
agtataaaaaatttaggcatttc

SEQ ID NO: 203057 - DNA, 23 bp, Artificial sequence
  SiRNA target sequence
gtataaaaaatttaggcatttca

SEQ ID NO: 203058 - DNA, 23 bp, Artificial sequence
  SiRNA target sequence
tataaaaaatttaggcatttcaa

SEQ ID NO: 203059 - DNA, 23 bp, Artificial sequence
  SiRNA target sequence
ataaaaaatttaggcatttcaac

SEQ ID NO: 203060 - DNA, 23 bp, Artificial sequence
  SiRNA target sequence
taaaaaatttaggcatttcaacc

SEQ ID NO: 203061 - DNA, 23 bp, Artificial sequence
  SiRNA target sequence
aaaaaatttaggcatttcaacct

SEQ ID NO: 203062 - DNA, 23 bp, Artificial sequence
  SiRNA target sequence
aaaaatttaggcatttcaacctt

SEQ ID NO: 203063 - DNA, 23 bp, Artificial sequence
  SiRNA target sequence
aaaatttaggcatttcaacctta

SEQ ID NO: 203064 - DNA, 23 bp, Artificial sequence
  SiRNA target sequence
aaatttaggcatttcaaccttag

SEQ ID NO: 203065 - DNA, 23 bp, Artificial sequence
  SiRNA target sequence
aatttaggcatttcaaccttagc

SEQ ID NO: 203066 - DNA, 23 bp, Artificial sequence
  SiRNA target sequence
atttaggcatttcaaccttagca

SEQ ID NO: 203067 - DNA, 23 bp, Artificial sequence
  SiRNA target sequence
tttaggcatttcaaccttagcaa

SEQ ID NO: 203068 - DNA, 23 bp, Artificial sequence
  SiRNA target sequence
ttaggcatttcaaccttagcaac

SEQ ID NO: 203069 - DNA, 23 bp, Artificial sequence
  SiRNA target sequence
taggcatttcaaccttagcaact

SEQ ID NO: 203070 - DNA, 23 bp, Artificial sequence
  SiRNA target sequence
aggcatttcaaccttagcaactt

SEQ ID NO: 203071 - DNA, 23 bp, Artificial sequence
  SiRNA target sequence
ggcatttcaaccttagcaacttt

SEQ ID NO: 203072 - DNA, 23 bp, Artificial sequence
  SiRNA target sequence
gcatttcaaccttagcaacttta

SEQ ID NO: 203073 - DNA, 23 bp, Artificial sequence
  SiRNA target sequence
catttcaaccttagcaactttaa

SEQ ID NO: 203074 - DNA, 23 bp, Artificial sequence
  SiRNA target sequence
atttcaaccttagcaactttaaa

SEQ ID NO: 203075 - DNA, 23 bp, Artificial sequence
  SiRNA target sequence
tttcaaccttagcaactttaaaa

SEQ ID NO: 203076 - DNA, 23 bp, Artificial sequence
  SiRNA target sequence
ttcaaccttagcaactttaaaat

SEQ ID NO: 203077 - DNA, 23 bp, Artificial sequence
  SiRNA target sequence
tcaaccttagcaactttaaaata

SEQ ID NO: 203078 - DNA, 23 bp, Artificial sequence
  SiRNA target sequence
caaccttagcaactttaaaataa

SEQ ID NO: 203079 - DNA, 23 bp, Artificial sequence
  SiRNA target sequence
aaccttagcaactttaaaataac

SEQ ID NO: 203080 - DNA, 23 bp, Artificial sequence
  SiRNA target sequence
accttagcaactttaaaataact

SEQ ID NO: 203081 - DNA, 23 bp, Artificial sequence
  SiRNA target sequence
ccttagcaactttaaaataactc

SEQ ID NO: 203082 - DNA, 23 bp, Artificial sequence
  SiRNA target sequence
cttagcaactttaaaataactca

SEQ ID NO: 203083 - DNA, 23 bp, Artificial sequence
  SiRNA target sequence
ttagcaactttaaaataactcag

SEQ ID NO: 203084 - DNA, 23 bp, Artificial sequence
  SiRNA target sequence
tagcaactttaaaataactcagt

SEQ ID NO: 203085 - DNA, 23 bp, Artificial sequence
  SiRNA target sequence
agcaactttaaaataactcagta

SEQ ID NO: 203086 - DNA, 23 bp, Artificial sequence
  SiRNA target sequence
gcaactttaaaataactcagtaa

SEQ ID NO: 203087 - DNA, 23 bp, Artificial sequence
  SiRNA target sequence
caactttaaaataactcagtaat

SEQ ID NO: 203088 - DNA, 23 bp, Artificial sequence
  SiRNA target sequence
aactttaaaataactcagtaatc

SEQ ID NO: 203089 - DNA, 23 bp, Artificial sequence
  SiRNA target sequence
actttaaaataactcagtaatcc

SEQ ID NO: 203090 - DNA, 23 bp, Artificial sequence
  SiRNA target sequence
ctttaaaataactcagtaatcct

SEQ ID NO: 203091 - DNA, 23 bp, Artificial sequence
  SiRNA target sequence
tttaaaataactcagtaatcctg

SEQ ID NO: 203092 - DNA, 23 bp, Artificial sequence
  SiRNA target sequence
ttaaaataactcagtaatcctgt

SEQ ID NO: 203093 - DNA, 23 bp, Artificial sequence
  SiRNA target sequence
taaaataactcagtaatcctgtt

SEQ ID NO: 203094 - DNA, 23 bp, Artificial sequence
  SiRNA target sequence
aaaataactcagtaatcctgttc

SEQ ID NO: 203095 - DNA, 23 bp, Artificial sequence
  SiRNA target sequence
aaataactcagtaatcctgttct

SEQ ID NO: 203096 - DNA, 23 bp, Artificial sequence
  SiRNA target sequence
aataactcagtaatcctgttctt

SEQ ID NO: 203097 - DNA, 23 bp, Artificial sequence
  SiRNA target sequence
ataactcagtaatcctgttcttg

SEQ ID NO: 203098 - DNA, 23 bp, Artificial sequence
  SiRNA target sequence
taactcagtaatcctgttcttga

SEQ ID NO: 203099 - DNA, 23 bp, Artificial sequence
  SiRNA target sequence
aactcagtaatcctgttcttgaa

SEQ ID NO: 203100 - DNA, 23 bp, Artificial sequence
  SiRNA target sequence
actcagtaatcctgttcttgaat

SEQ ID NO: 203101 - DNA, 23 bp, Artificial sequence
  SiRNA target sequence
ctcagtaatcctgttcttgaatt

SEQ ID NO: 203102 - DNA, 23 bp, Artificial sequence
  SiRNA target sequence
tcagtaatcctgttcttgaattt

SEQ ID NO: 203103 - DNA, 23 bp, Artificial sequence
  SiRNA target sequence
cagtaatcctgttcttgaatttg

SEQ ID NO: 203104 - DNA, 23 bp, Artificial sequence
  SiRNA target sequence
agtaatcctgttcttgaatttgc

SEQ ID NO: 203105 - DNA, 23 bp, Artificial sequence
  SiRNA target sequence
gtaatcctgttcttgaatttgct

SEQ ID NO: 203106 - DNA, 23 bp, Artificial sequence
  SiRNA target sequence
taatcctgttcttgaatttgcta

SEQ ID NO: 203107 - DNA, 23 bp, Artificial sequence
  SiRNA target sequence
aatcctgttcttgaatttgctaa

SEQ ID NO: 203108 - DNA, 23 bp, Artificial sequence
  SiRNA target sequence
atcctgttcttgaatttgctaat

SEQ ID NO: 203109 - DNA, 23 bp, Artificial sequence
  SiRNA target sequence
tcctgttcttgaatttgctaatt

SEQ ID NO: 203110 - DNA, 23 bp, Artificial sequence
  SiRNA target sequence
cctgttcttgaatttgctaattg

SEQ ID NO: 203111 - DNA, 23 bp, Artificial sequence
  SiRNA target sequence
ctgttcttgaatttgctaattga

SEQ ID NO: 203112 - DNA, 23 bp, Artificial sequence
  SiRNA target sequence
tgttcttgaatttgctaattgat

SEQ ID NO: 203113 - DNA, 23 bp, Artificial sequence
  SiRNA target sequence
gttcttgaatttgctaattgatc

SEQ ID NO: 203114 - DNA, 23 bp, Artificial sequence
  SiRNA target sequence
ttcttgaatttgctaattgatca

SEQ ID NO: 203115 - DNA, 23 bp, Artificial sequence
  SiRNA target sequence
tcttgaatttgctaattgatcaa

SEQ ID NO: 203116 - DNA, 23 bp, Artificial sequence
  SiRNA target sequence
cttgaatttgctaattgatcaat

SEQ ID NO: 203117 - DNA, 23 bp, Artificial sequence
  SiRNA target sequence
ttgaatttgctaattgatcaatc

SEQ ID NO: 203118 - DNA, 23 bp, Artificial sequence
  SiRNA target sequence
tgaatttgctaattgatcaatct

SEQ ID NO: 203119 - DNA, 23 bp, Artificial sequence
  SiRNA target sequence
gaatttgctaattgatcaatctc

SEQ ID NO: 203120 - DNA, 23 bp, Artificial sequence
  SiRNA target sequence
aatttgctaattgatcaatctca

SEQ ID NO: 203121 - DNA, 23 bp, Artificial sequence
  SiRNA target sequence
atttgctaattgatcaatctcat

SEQ ID NO: 203122 - DNA, 23 bp, Artificial sequence
  SiRNA target sequence
tttgctaattgatcaatctcatc

SEQ ID NO: 203123 - DNA, 23 bp, Artificial sequence
  SiRNA target sequence
ttgctaattgatcaatctcatct

SEQ ID NO: 203124 - DNA, 23 bp, Artificial sequence
  SiRNA target sequence
tgctaattgatcaatctcatctt

SEQ ID NO: 203125 - DNA, 23 bp, Artificial sequence
  SiRNA target sequence
gctaattgatcaatctcatcttc

SEQ ID NO: 203126 - DNA, 23 bp, Artificial sequence
  SiRNA target sequence
ctaattgatcaatctcatcttcc

SEQ ID NO: 203127 - DNA, 23 bp, Artificial sequence
  SiRNA target sequence
taattgatcaatctcatcttccg

SEQ ID NO: 203128 - DNA, 23 bp, Artificial sequence
  SiRNA target sequence
aattgatcaatctcatcttccgt

SEQ ID NO: 203129 - DNA, 23 bp, Artificial sequence
  SiRNA target sequence
attgatcaatctcatcttccgta

SEQ ID NO: 203130 - DNA, 23 bp, Artificial sequence
  SiRNA target sequence
ttgatcaatctcatcttccgtag

SEQ ID NO: 203131 - DNA, 23 bp, Artificial sequence
  SiRNA target sequence
tgatcaatctcatcttccgtagg

SEQ ID NO: 203132 - DNA, 23 bp, Artificial sequence
  SiRNA target sequence
gatcaatctcatcttccgtaggt

SEQ ID NO: 203133 - DNA, 23 bp, Artificial sequence
  SiRNA target sequence
atcaatctcatcttccgtaggta

SEQ ID NO: 203134 - DNA, 23 bp, Artificial sequence
  SiRNA target sequence
tcaatctcatcttccgtaggtaa

SEQ ID NO: 203135 - DNA, 23 bp, Artificial sequence
  SiRNA target sequence
caatctcatcttccgtaggtaag

SEQ ID NO: 203136 - DNA, 23 bp, Artificial sequence
  SiRNA target sequence
aatctcatcttccgtaggtaagt

SEQ ID NO: 203137 - DNA, 23 bp, Artificial sequence
  SiRNA target sequence
atctcatcttccgtaggtaagtt

SEQ ID NO: 203138 - DNA, 23 bp, Artificial sequence
  SiRNA target sequence
tctcatcttccgtaggtaagttg

SEQ ID NO: 203139 - DNA, 23 bp, Artificial sequence
  SiRNA target sequence
ctcatcttccgtaggtaagttgt

SEQ ID NO: 203140 - DNA, 23 bp, Artificial sequence
  SiRNA target sequence
tcatcttccgtaggtaagttgtt

SEQ ID NO: 203141 - DNA, 23 bp, Artificial sequence
  SiRNA target sequence
catcttccgtaggtaagttgttt

SEQ ID NO: 203142 - DNA, 23 bp, Artificial sequence
  SiRNA target sequence
atcttccgtaggtaagttgtttt

SEQ ID NO: 203143 - DNA, 23 bp, Artificial sequence
  SiRNA target sequence
tcttccgtaggtaagttgttttc

SEQ ID NO: 203144 - DNA, 23 bp, Artificial sequence
  SiRNA target sequence
cttccgtaggtaagttgttttca

SEQ ID NO: 203145 - DNA, 23 bp, Artificial sequence
  SiRNA target sequence
ttccgtaggtaagttgttttcag

SEQ ID NO: 203146 - DNA, 23 bp, Artificial sequence
  SiRNA target sequence
tccgtaggtaagttgttttcagg

SEQ ID NO: 203147 - DNA, 23 bp, Artificial sequence
  SiRNA target sequence
ccgtaggtaagttgttttcaggt

SEQ ID NO: 203148 - DNA, 23 bp, Artificial sequence
  SiRNA target sequence
cgtaggtaagttgttttcaggtg

SEQ ID NO: 203149 - DNA, 23 bp, Artificial sequence
  SiRNA target sequence
gtaggtaagttgttttcaggtgt

SEQ ID NO: 203150 - DNA, 23 bp, Artificial sequence
  SiRNA target sequence
taggtaagttgttttcaggtgtt

SEQ ID NO: 203151 - DNA, 23 bp, Artificial sequence
  SiRNA target sequence
aggtaagttgttttcaggtgttt

SEQ ID NO: 203152 - DNA, 23 bp, Artificial sequence
  SiRNA target sequence
ggtaagttgttttcaggtgtttc

SEQ ID NO: 203153 - DNA, 23 bp, Artificial sequence
  SiRNA target sequence
gtaagttgttttcaggtgtttca

SEQ ID NO: 203154 - DNA, 23 bp, Artificial sequence
  SiRNA target sequence
taagttgttttcaggtgtttcat

SEQ ID NO: 203155 - DNA, 23 bp, Artificial sequence
  SiRNA target sequence
aagttgttttcaggtgtttcatt

SEQ ID NO: 203156 - DNA, 23 bp, Artificial sequence
  SiRNA target sequence
agttgttttcaggtgtttcattt

SEQ ID NO: 203157 - DNA, 23 bp, Artificial sequence
  SiRNA target sequence
gttgttttcaggtgtttcattta

SEQ ID NO: 203158 - DNA, 23 bp, Artificial sequence
  SiRNA target sequence
ttgttttcaggtgtttcatttat

SEQ ID NO: 203159 - DNA, 23 bp, Artificial sequence
  SiRNA target sequence
tgttttcaggtgtttcatttatt

SEQ ID NO: 203160 - DNA, 23 bp, Artificial sequence
  SiRNA target sequence
gttttcaggtgtttcatttatta

SEQ ID NO: 203161 - DNA, 23 bp, Artificial sequence
  SiRNA target sequence
ttttcaggtgtttcatttattac

SEQ ID NO: 203162 - DNA, 23 bp, Artificial sequence
  SiRNA target sequence
tttcaggtgtttcatttattaca

SEQ ID NO: 203163 - DNA, 23 bp, Artificial sequence
  SiRNA target sequence
ttcaggtgtttcatttattacac

SEQ ID NO: 203164 - DNA, 23 bp, Artificial sequence
  SiRNA target sequence
tcaggtgtttcatttattacact

SEQ ID NO: 203165 - DNA, 23 bp, Artificial sequence
  SiRNA target sequence
caggtgtttcatttattacactc

SEQ ID NO: 203166 - DNA, 23 bp, Artificial sequence
  SiRNA target sequence
aggtgtttcatttattacactca

SEQ ID NO: 203167 - DNA, 23 bp, Artificial sequence
  SiRNA target sequence
ggtgtttcatttattacactcat

SEQ ID NO: 203168 - DNA, 24 bp, Artificial sequence
  SiRNA target sequence
ttattctgcgttttcttttttgtc

SEQ ID NO: 203169 - DNA, 24 bp, Artificial sequence
  SiRNA target sequence
tattctgcgttttcttttttgtcg

SEQ ID NO: 203170 - DNA, 24 bp, Artificial sequence
  SiRNA target sequence
attctgcgttttcttttttgtcgt

SEQ ID NO: 203171 - DNA, 24 bp, Artificial sequence
  SiRNA target sequence
ttctgcgttttcttttttgtcgtc

SEQ ID NO: 203172 - DNA, 24 bp, Artificial sequence
  SiRNA target sequence
tctgcgttttcttttttgtcgtct

SEQ ID NO: 203173 - DNA, 24 bp, Artificial sequence
  SiRNA target sequence
ctgcgttttcttttttgtcgtctt

SEQ ID NO: 203174 - DNA, 24 bp, Artificial sequence
  SiRNA target sequence
tgcgttttcttttttgtcgtcttt

SEQ ID NO: 203175 - DNA, 24 bp, Artificial sequence
  SiRNA target sequence
gcgttttcttttttgtcgtctttt

SEQ ID NO: 203176 - DNA, 24 bp, Artificial sequence
  SiRNA target sequence
cgttttcttttttgtcgtctttta

SEQ ID NO: 203177 - DNA, 24 bp, Artificial sequence
  SiRNA target sequence
gttttcttttttgtcgtcttttat

SEQ ID NO: 203178 - DNA, 24 bp, Artificial sequence
  SiRNA target sequence
ttttcttttttgtcgtcttttatt

SEQ ID NO: 203179 - DNA, 24 bp, Artificial sequence
  SiRNA target sequence
tttcttttttgtcgtcttttatta

SEQ ID NO: 203180 - DNA, 24 bp, Artificial sequence
  SiRNA target sequence
ttcttttttgtcgtcttttattaa

SEQ ID NO: 203181 - DNA, 24 bp, Artificial sequence
  SiRNA target sequence
tcttttttgtcgtcttttattaaa

SEQ ID NO: 203182 - DNA, 24 bp, Artificial sequence
  SiRNA target sequence
cttttttgtcgtcttttattaaat

SEQ ID NO: 203183 - DNA, 24 bp, Artificial sequence
  SiRNA target sequence
ttttttgtcgtcttttattaaatc

SEQ ID NO: 203184 - DNA, 24 bp, Artificial sequence
  SiRNA target sequence
tttttgtcgtcttttattaaatct

SEQ ID NO: 203185 - DNA, 24 bp, Artificial sequence
  SiRNA target sequence
ttttgtcgtcttttattaaatcta

SEQ ID NO: 203186 - DNA, 24 bp, Artificial sequence
  SiRNA target sequence
tttgtcgtcttttattaaatctat

SEQ ID NO: 203187 - DNA, 24 bp, Artificial sequence
  SiRNA target sequence
ttgtcgtcttttattaaatctatg

SEQ ID NO: 203188 - DNA, 24 bp, Artificial sequence
  SiRNA target sequence
tgtcgtcttttattaaatctatgt

SEQ ID NO: 203189 - DNA, 24 bp, Artificial sequence
  SiRNA target sequence
gtcgtcttttattaaatctatgtc

SEQ ID NO: 203190 - DNA, 24 bp, Artificial sequence
  SiRNA target sequence
tcgtcttttattaaatctatgtct

SEQ ID NO: 203191 - DNA, 24 bp, Artificial sequence
  SiRNA target sequence
cgtcttttattaaatctatgtcta

SEQ ID NO: 203192 - DNA, 24 bp, Artificial sequence
  SiRNA target sequence
gtcttttattaaatctatgtctac

SEQ ID NO: 203193 - DNA, 24 bp, Artificial sequence
  SiRNA target sequence
tcttttattaaatctatgtctaca

SEQ ID NO: 203194 - DNA, 24 bp, Artificial sequence
  SiRNA target sequence
cttttattaaatctatgtctacac

SEQ ID NO: 203195 - DNA, 24 bp, Artificial sequence
  SiRNA target sequence
ttttattaaatctatgtctacact

SEQ ID NO: 203196 - DNA, 24 bp, Artificial sequence
  SiRNA target sequence
tttattaaatctatgtctacactt

SEQ ID NO: 203197 - DNA, 24 bp, Artificial sequence
  SiRNA target sequence
ttattaaatctatgtctacacttg

SEQ ID NO: 203198 - DNA, 24 bp, Artificial sequence
  SiRNA target sequence
tattaaatctatgtctacacttgt

SEQ ID NO: 203199 - DNA, 24 bp, Artificial sequence
  SiRNA target sequence
attaaatctatgtctacacttgta

SEQ ID NO: 203200 - DNA, 24 bp, Artificial sequence
  SiRNA target sequence
ttaaatctatgtctacacttgtat

SEQ ID NO: 203201 - DNA, 24 bp, Artificial sequence
  SiRNA target sequence
taaatctatgtctacacttgtatt

SEQ ID NO: 203202 - DNA, 24 bp, Artificial sequence
  SiRNA target sequence
aaatctatgtctacacttgtatta

SEQ ID NO: 203203 - DNA, 24 bp, Artificial sequence
  SiRNA target sequence
aatctatgtctacacttgtattat

SEQ ID NO: 203204 - DNA, 24 bp, Artificial sequence
  SiRNA target sequence
atctatgtctacacttgtattatt

SEQ ID NO: 203205 - DNA, 24 bp, Artificial sequence
  SiRNA target sequence
tctatgtctacacttgtattattt

SEQ ID NO: 203206 - DNA, 24 bp, Artificial sequence
  SiRNA target sequence
ctatgtctacacttgtattatttt

SEQ ID NO: 203207 - DNA, 24 bp, Artificial sequence
  SiRNA target sequence
tatgtctacacttgtattattttt

SEQ ID NO: 203208 - DNA, 24 bp, Artificial sequence
  SiRNA target sequence
atgtctacacttgtattattttta

SEQ ID NO: 203209 - DNA, 24 bp, Artificial sequence
  SiRNA target sequence
tgtctacacttgtattatttttaa

SEQ ID NO: 203210 - DNA, 24 bp, Artificial sequence
  SiRNA target sequence
gtctacacttgtattatttttaat

SEQ ID NO: 203211 - DNA, 24 bp, Artificial sequence
  SiRNA target sequence
tctacacttgtattatttttaatt

SEQ ID NO: 203212 - DNA, 24 bp, Artificial sequence
  SiRNA target sequence
ctacacttgtattatttttaattg

SEQ ID NO: 203213 - DNA, 24 bp, Artificial sequence
  SiRNA target sequence
tacacttgtattatttttaattga

SEQ ID NO: 203214 - DNA, 24 bp, Artificial sequence
  SiRNA target sequence
acacttgtattatttttaattgaa

SEQ ID NO: 203215 - DNA, 24 bp, Artificial sequence
  SiRNA target sequence
cacttgtattatttttaattgaaa

SEQ ID NO: 203216 - DNA, 24 bp, Artificial sequence
  SiRNA target sequence
acttgtattatttttaattgaaac

SEQ ID NO: 203217 - DNA, 24 bp, Artificial sequence
  SiRNA target sequence
cttgtattatttttaattgaaacg

SEQ ID NO: 203218 - DNA, 24 bp, Artificial sequence
  SiRNA target sequence
ttgtattatttttaattgaaacgt

SEQ ID NO: 203219 - DNA, 24 bp, Artificial sequence
  SiRNA target sequence
tgtattatttttaattgaaacgtt

SEQ ID NO: 203220 - DNA, 24 bp, Artificial sequence
  SiRNA target sequence
gtattatttttaattgaaacgtta

SEQ ID NO: 203221 - DNA, 24 bp, Artificial sequence
  SiRNA target sequence
tattatttttaattgaaacgttat

SEQ ID NO: 203222 - DNA, 24 bp, Artificial sequence
  SiRNA target sequence
attatttttaattgaaacgttata

SEQ ID NO: 203223 - DNA, 24 bp, Artificial sequence
  SiRNA target sequence
ttatttttaattgaaacgttatat

SEQ ID NO: 203224 - DNA, 24 bp, Artificial sequence
  SiRNA target sequence
tatttttaattgaaacgttatatg

SEQ ID NO: 203225 - DNA, 24 bp, Artificial sequence
  SiRNA target sequence
atttttaattgaaacgttatatgc

SEQ ID NO: 203226 - DNA, 24 bp, Artificial sequence
  SiRNA target sequence
tttttaattgaaacgttatatgca

SEQ ID NO: 203227 - DNA, 24 bp, Artificial sequence
  SiRNA target sequence
ttttaattgaaacgttatatgcac

SEQ ID NO: 203228 - DNA, 24 bp, Artificial sequence
  SiRNA target sequence
tttaattgaaacgttatatgcacc

SEQ ID NO: 203229 - DNA, 24 bp, Artificial sequence
  SiRNA target sequence
ttaattgaaacgttatatgcaccc

SEQ ID NO: 203230 - DNA, 24 bp, Artificial sequence
  SiRNA target sequence
taattgaaacgttatatgcacccg

SEQ ID NO: 203231 - DNA, 24 bp, Artificial sequence
  SiRNA target sequence
aattgaaacgttatatgcacccgc

SEQ ID NO: 203232 - DNA, 24 bp, Artificial sequence
  SiRNA target sequence
attgaaacgttatatgcacccgct

SEQ ID NO: 203233 - DNA, 24 bp, Artificial sequence
  SiRNA target sequence
ttgaaacgttatatgcacccgcta

SEQ ID NO: 203234 - DNA, 24 bp, Artificial sequence
  SiRNA target sequence
tgaaacgttatatgcacccgctaa

SEQ ID NO: 203235 - DNA, 24 bp, Artificial sequence
  SiRNA target sequence
gaaacgttatatgcacccgctaaa

SEQ ID NO: 203236 - DNA, 24 bp, Artificial sequence
  SiRNA target sequence
aaacgttatatgcacccgctaaat

SEQ ID NO: 203237 - DNA, 24 bp, Artificial sequence
  SiRNA target sequence
aacgttatatgcacccgctaaata

SEQ ID NO: 203238 - DNA, 24 bp, Artificial sequence
  SiRNA target sequence
acgttatatgcacccgctaaatag

SEQ ID NO: 203239 - DNA, 24 bp, Artificial sequence
  SiRNA target sequence
cgttatatgcacccgctaaataga

SEQ ID NO: 203240 - DNA, 24 bp, Artificial sequence
  SiRNA target sequence
gttatatgcacccgctaaatagat

SEQ ID NO: 203241 - DNA, 24 bp, Artificial sequence
  SiRNA target sequence
ttatatgcacccgctaaatagatt

SEQ ID NO: 203242 - DNA, 24 bp, Artificial sequence
  SiRNA target sequence
tatatgcacccgctaaatagatta

SEQ ID NO: 203243 - DNA, 24 bp, Artificial sequence
  SiRNA target sequence
atatgcacccgctaaatagattat

SEQ ID NO: 203244 - DNA, 24 bp, Artificial sequence
  SiRNA target sequence
tatgcacccgctaaatagattata

SEQ ID NO: 203245 - DNA, 24 bp, Artificial sequence
  SiRNA target sequence
atgcacccgctaaatagattatag

SEQ ID NO: 203246 - DNA, 24 bp, Artificial sequence
  SiRNA target sequence
tgcacccgctaaatagattatagc

SEQ ID NO: 203247 - DNA, 24 bp, Artificial sequence
  SiRNA target sequence
gcacccgctaaatagattatagct

SEQ ID NO: 203248 - DNA, 24 bp, Artificial sequence
  SiRNA target sequence
cacccgctaaatagattatagctc

SEQ ID NO: 203249 - DNA, 24 bp, Artificial sequence
  SiRNA target sequence
acccgctaaatagattatagctct

SEQ ID NO: 203250 - DNA, 24 bp, Artificial sequence
  SiRNA target sequence
cccgctaaatagattatagctcta

SEQ ID NO: 203251 - DNA, 24 bp, Artificial sequence
  SiRNA target sequence
ccgctaaatagattatagctctaa

SEQ ID NO: 203252 - DNA, 24 bp, Artificial sequence
  SiRNA target sequence
cgctaaatagattatagctctaat

SEQ ID NO: 203253 - DNA, 24 bp, Artificial sequence
  SiRNA target sequence
gctaaatagattatagctctaatc

SEQ ID NO: 203254 - DNA, 24 bp, Artificial sequence
  SiRNA target sequence
ctaaatagattatagctctaatcc

SEQ ID NO: 203255 - DNA, 24 bp, Artificial sequence
  SiRNA target sequence
taaatagattatagctctaatcca

SEQ ID NO: 203256 - DNA, 24 bp, Artificial sequence
  SiRNA target sequence
aaatagattatagctctaatccaa

SEQ ID NO: 203257 - DNA, 24 bp, Artificial sequence
  SiRNA target sequence
aatagattatagctctaatccaaa

SEQ ID NO: 203258 - DNA, 24 bp, Artificial sequence
  SiRNA target sequence
atagattatagctctaatccaaat

SEQ ID NO: 203259 - DNA, 24 bp, Artificial sequence
  SiRNA target sequence
tagattatagctctaatccaaata

SEQ ID NO: 203260 - DNA, 24 bp, Artificial sequence
  SiRNA target sequence
agattatagctctaatccaaatat

SEQ ID NO: 203261 - DNA, 24 bp, Artificial sequence
  SiRNA target sequence
gattatagctctaatccaaatata

SEQ ID NO: 203262 - DNA, 24 bp, Artificial sequence
  SiRNA target sequence
attatagctctaatccaaatataa

SEQ ID NO: 203263 - DNA, 24 bp, Artificial sequence
  SiRNA target sequence
ttatagctctaatccaaatataaa

SEQ ID NO: 203264 - DNA, 24 bp, Artificial sequence
  SiRNA target sequence
tatagctctaatccaaatataaat

SEQ ID NO: 203265 - DNA, 24 bp, Artificial sequence
  SiRNA target sequence
atagctctaatccaaatataaatc

SEQ ID NO: 203266 - DNA, 24 bp, Artificial sequence
  SiRNA target sequence
tagctctaatccaaatataaatca

SEQ ID NO: 203267 - DNA, 24 bp, Artificial sequence
  SiRNA target sequence
agctctaatccaaatataaatcaa

SEQ ID NO: 203268 - DNA, 24 bp, Artificial sequence
  SiRNA target sequence
gctctaatccaaatataaatcaat

SEQ ID NO: 203269 - DNA, 24 bp, Artificial sequence
  SiRNA target sequence
ctctaatccaaatataaatcaata

SEQ ID NO: 203270 - DNA, 24 bp, Artificial sequence
  SiRNA target sequence
tctaatccaaatataaatcaatat

SEQ ID NO: 203271 - DNA, 24 bp, Artificial sequence
  SiRNA target sequence
ctaatccaaatataaatcaatatt

SEQ ID NO: 203272 - DNA, 24 bp, Artificial sequence
  SiRNA target sequence
taatccaaatataaatcaatatta

SEQ ID NO: 203273 - DNA, 24 bp, Artificial sequence
  SiRNA target sequence
aatccaaatataaatcaatattat

SEQ ID NO: 203274 - DNA, 24 bp, Artificial sequence
  SiRNA target sequence
atccaaatataaatcaatattatt

SEQ ID NO: 203275 - DNA, 24 bp, Artificial sequence
  SiRNA target sequence
tccaaatataaatcaatattattg

SEQ ID NO: 203276 - DNA, 24 bp, Artificial sequence
  SiRNA target sequence
ccaaatataaatcaatattattgc

SEQ ID NO: 203277 - DNA, 24 bp, Artificial sequence
  SiRNA target sequence
caaatataaatcaatattattgca

SEQ ID NO: 203278 - DNA, 24 bp, Artificial sequence
  SiRNA target sequence
aaatataaatcaatattattgcaa

SEQ ID NO: 203279 - DNA, 24 bp, Artificial sequence
  SiRNA target sequence
aatataaatcaatattattgcaat

SEQ ID NO: 203280 - DNA, 24 bp, Artificial sequence
  SiRNA target sequence
atataaatcaatattattgcaatc

SEQ ID NO: 203281 - DNA, 24 bp, Artificial sequence
  SiRNA target sequence
tataaatcaatattattgcaatcg

SEQ ID NO: 203282 - DNA, 24 bp, Artificial sequence
  SiRNA target sequence
ataaatcaatattattgcaatcgt

SEQ ID NO: 203283 - DNA, 24 bp, Artificial sequence
  SiRNA target sequence
taaatcaatattattgcaatcgtt

SEQ ID NO: 203284 - DNA, 24 bp, Artificial sequence
  SiRNA target sequence
aaatcaatattattgcaatcgtta

SEQ ID NO: 203285 - DNA, 24 bp, Artificial sequence
  SiRNA target sequence
aatcaatattattgcaatcgttaa

SEQ ID NO: 203286 - DNA, 24 bp, Artificial sequence
  SiRNA target sequence
atcaatattattgcaatcgttaat

SEQ ID NO: 203287 - DNA, 24 bp, Artificial sequence
  SiRNA target sequence
tcaatattattgcaatcgttaatg

SEQ ID NO: 203288 - DNA, 24 bp, Artificial sequence
  SiRNA target sequence
caatattattgcaatcgttaatgt

SEQ ID NO: 203289 - DNA, 24 bp, Artificial sequence
  SiRNA target sequence
aatattattgcaatcgttaatgtg

SEQ ID NO: 203290 - DNA, 24 bp, Artificial sequence
  SiRNA target sequence
atattattgcaatcgttaatgtga

SEQ ID NO: 203291 - DNA, 24 bp, Artificial sequence
  SiRNA target sequence
tattattgcaatcgttaatgtgat

SEQ ID NO: 203292 - DNA, 24 bp, Artificial sequence
  SiRNA target sequence
attattgcaatcgttaatgtgatt

SEQ ID NO: 203293 - DNA, 24 bp, Artificial sequence
  SiRNA target sequence
ttattgcaatcgttaatgtgattg

SEQ ID NO: 203294 - DNA, 24 bp, Artificial sequence
  SiRNA target sequence
tattgcaatcgttaatgtgattgg

SEQ ID NO: 203295 - DNA, 24 bp, Artificial sequence
  SiRNA target sequence
attgcaatcgttaatgtgattgga

SEQ ID NO: 203296 - DNA, 24 bp, Artificial sequence
  SiRNA target sequence
ttgcaatcgttaatgtgattggac

SEQ ID NO: 203297 - DNA, 24 bp, Artificial sequence
  SiRNA target sequence
tgcaatcgttaatgtgattggact

SEQ ID NO: 203298 - DNA, 24 bp, Artificial sequence
  SiRNA target sequence
gcaatcgttaatgtgattggacta

SEQ ID NO: 203299 - DNA, 24 bp, Artificial sequence
  SiRNA target sequence
caatcgttaatgtgattggactac

SEQ ID NO: 203300 - DNA, 24 bp, Artificial sequence
  SiRNA target sequence
aatcgttaatgtgattggactacc

SEQ ID NO: 203301 - DNA, 24 bp, Artificial sequence
  SiRNA target sequence
atcgttaatgtgattggactaccc

SEQ ID NO: 203302 - DNA, 24 bp, Artificial sequence
  SiRNA target sequence
tcgttaatgtgattggactaccct

SEQ ID NO: 203303 - DNA, 24 bp, Artificial sequence
  SiRNA target sequence
cgttaatgtgattggactaccctt

SEQ ID NO: 203304 - DNA, 24 bp, Artificial sequence
  SiRNA target sequence
gttaatgtgattggactacccttc

SEQ ID NO: 203305 - DNA, 24 bp, Artificial sequence
  SiRNA target sequence
ttaatgtgattggactacccttcc

SEQ ID NO: 203306 - DNA, 24 bp, Artificial sequence
  SiRNA target sequence
taatgtgattggactacccttcct

SEQ ID NO: 203307 - DNA, 24 bp, Artificial sequence
  SiRNA target sequence
aatgtgattggactacccttcctt

SEQ ID NO: 203308 - DNA, 24 bp, Artificial sequence
  SiRNA target sequence
atgtgattggactacccttcctta

SEQ ID NO: 203309 - DNA, 24 bp, Artificial sequence
  SiRNA target sequence
tgtgattggactacccttccttac

SEQ ID NO: 203310 - DNA, 24 bp, Artificial sequence
  SiRNA target sequence
gtgattggactacccttccttaca

SEQ ID NO: 203311 - DNA, 24 bp, Artificial sequence
  SiRNA target sequence
tgattggactacccttccttacat

SEQ ID NO: 203312 - DNA, 24 bp, Artificial sequence
  SiRNA target sequence
gattggactacccttccttacatt

SEQ ID NO: 203313 - DNA, 24 bp, Artificial sequence
  SiRNA target sequence
attggactacccttccttacatta

SEQ ID NO: 203314 - DNA, 24 bp, Artificial sequence
  SiRNA target sequence
ttggactacccttccttacattat

SEQ ID NO: 203315 - DNA, 24 bp, Artificial sequence
  SiRNA target sequence
tggactacccttccttacattatc

SEQ ID NO: 203316 - DNA, 24 bp, Artificial sequence
  SiRNA target sequence
ggactacccttccttacattatca

SEQ ID NO: 203317 - DNA, 24 bp, Artificial sequence
  SiRNA target sequence
gactacccttccttacattatcag

SEQ ID NO: 203318 - DNA, 24 bp, Artificial sequence
  SiRNA target sequence
actacccttccttacattatcagt

SEQ ID NO: 203319 - DNA, 24 bp, Artificial sequence
  SiRNA target sequence
ctacccttccttacattatcagta

SEQ ID NO: 203320 - DNA, 24 bp, Artificial sequence
  SiRNA target sequence
tacccttccttacattatcagtat

SEQ ID NO: 203321 - DNA, 24 bp, Artificial sequence
  SiRNA target sequence
acccttccttacattatcagtatc

SEQ ID NO: 203322 - DNA, 24 bp, Artificial sequence
  SiRNA target sequence
cccttccttacattatcagtatca

SEQ ID NO: 203323 - DNA, 24 bp, Artificial sequence
  SiRNA target sequence
ccttccttacattatcagtatcaa

SEQ ID NO: 203324 - DNA, 24 bp, Artificial sequence
  SiRNA target sequence
cttccttacattatcagtatcaag

SEQ ID NO: 203325 - DNA, 24 bp, Artificial sequence
  SiRNA target sequence
ttccttacattatcagtatcaagt

SEQ ID NO: 203326 - DNA, 24 bp, Artificial sequence
  SiRNA target sequence
tccttacattatcagtatcaagtg

SEQ ID NO: 203327 - DNA, 24 bp, Artificial sequence
  SiRNA target sequence
ccttacattatcagtatcaagtgc

SEQ ID NO: 203328 - DNA, 24 bp, Artificial sequence
  SiRNA target sequence
cttacattatcagtatcaagtgct

SEQ ID NO: 203329 - DNA, 24 bp, Artificial sequence
  SiRNA target sequence
ttacattatcagtatcaagtgcta

SEQ ID NO: 203330 - DNA, 24 bp, Artificial sequence
  SiRNA target sequence
tacattatcagtatcaagtgctac

SEQ ID NO: 203331 - DNA, 24 bp, Artificial sequence
  SiRNA target sequence
acattatcagtatcaagtgctact

SEQ ID NO: 203332 - DNA, 24 bp, Artificial sequence
  SiRNA target sequence
cattatcagtatcaagtgctacta

SEQ ID NO: 203333 - DNA, 24 bp, Artificial sequence
  SiRNA target sequence
attatcagtatcaagtgctactaa

SEQ ID NO: 203334 - DNA, 24 bp, Artificial sequence
  SiRNA target sequence
ttatcagtatcaagtgctactaat

SEQ ID NO: 203335 - DNA, 24 bp, Artificial sequence
  SiRNA target sequence
tatcagtatcaagtgctactaata

SEQ ID NO: 203336 - DNA, 24 bp, Artificial sequence
  SiRNA target sequence
atcagtatcaagtgctactaatat

SEQ ID NO: 203337 - DNA, 24 bp, Artificial sequence
  SiRNA target sequence
tcagtatcaagtgctactaatatg

SEQ ID NO: 203338 - DNA, 24 bp, Artificial sequence
  SiRNA target sequence
cagtatcaagtgctactaatatgg

SEQ ID NO: 203339 - DNA, 24 bp, Artificial sequence
  SiRNA target sequence
agtatcaagtgctactaatatggc

SEQ ID NO: 203340 - DNA, 24 bp, Artificial sequence
  SiRNA target sequence
gtatcaagtgctactaatatggct

SEQ ID NO: 203341 - DNA, 24 bp, Artificial sequence
  SiRNA target sequence
tatcaagtgctactaatatggcta

SEQ ID NO: 203342 - DNA, 24 bp, Artificial sequence
  SiRNA target sequence
atcaagtgctactaatatggctag

SEQ ID NO: 203343 - DNA, 24 bp, Artificial sequence
  SiRNA target sequence
tcaagtgctactaatatggctagt

SEQ ID NO: 203344 - DNA, 24 bp, Artificial sequence
  SiRNA target sequence
caagtgctactaatatggctagtc

SEQ ID NO: 203345 - DNA, 24 bp, Artificial sequence
  SiRNA target sequence
aagtgctactaatatggctagtcc

SEQ ID NO: 203346 - DNA, 24 bp, Artificial sequence
  SiRNA target sequence
agtgctactaatatggctagtcca

SEQ ID NO: 203347 - DNA, 24 bp, Artificial sequence
  SiRNA target sequence
gtgctactaatatggctagtccat

SEQ ID NO: 203348 - DNA, 24 bp, Artificial sequence
  SiRNA target sequence
tgctactaatatggctagtccata

SEQ ID NO: 203349 - DNA, 24 bp, Artificial sequence
  SiRNA target sequence
gctactaatatggctagtccatat

SEQ ID NO: 203350 - DNA, 24 bp, Artificial sequence
  SiRNA target sequence
ctactaatatggctagtccatata

SEQ ID NO: 203351 - DNA, 24 bp, Artificial sequence
  SiRNA target sequence
tactaatatggctagtccatataa

SEQ ID NO: 203352 - DNA, 24 bp, Artificial sequence
  SiRNA target sequence
actaatatggctagtccatataat

SEQ ID NO: 203353 - DNA, 24 bp, Artificial sequence
  SiRNA target sequence
ctaatatggctagtccatataatg

SEQ ID NO: 203354 - DNA, 24 bp, Artificial sequence
  SiRNA target sequence
taatatggctagtccatataatga

SEQ ID NO: 203355 - DNA, 24 bp, Artificial sequence
  SiRNA target sequence
aatatggctagtccatataatgaa

SEQ ID NO: 203356 - DNA, 24 bp, Artificial sequence
  SiRNA target sequence
atatggctagtccatataatgaac

SEQ ID NO: 203357 - DNA, 24 bp, Artificial sequence
  SiRNA target sequence
tatggctagtccatataatgaacc

SEQ ID NO: 203358 - DNA, 24 bp, Artificial sequence
  SiRNA target sequence
atggctagtccatataatgaacca

SEQ ID NO: 203359 - DNA, 24 bp, Artificial sequence
  SiRNA target sequence
tggctagtccatataatgaaccaa

SEQ ID NO: 203360 - DNA, 24 bp, Artificial sequence
  SiRNA target sequence
ggctagtccatataatgaaccaat

SEQ ID NO: 203361 - DNA, 24 bp, Artificial sequence
  SiRNA target sequence
gctagtccatataatgaaccaata

SEQ ID NO: 203362 - DNA, 24 bp, Artificial sequence
  SiRNA target sequence
ctagtccatataatgaaccaatag

SEQ ID NO: 203363 - DNA, 24 bp, Artificial sequence
  SiRNA target sequence
tagtccatataatgaaccaataga

SEQ ID NO: 203364 - DNA, 24 bp, Artificial sequence
  SiRNA target sequence
agtccatataatgaaccaatagat

SEQ ID NO: 203365 - DNA, 24 bp, Artificial sequence
  SiRNA target sequence
gtccatataatgaaccaatagatt

SEQ ID NO: 203366 - DNA, 24 bp, Artificial sequence
  SiRNA target sequence
tccatataatgaaccaatagattt

SEQ ID NO: 203367 - DNA, 24 bp, Artificial sequence
  SiRNA target sequence
ccatataatgaaccaatagatttt

SEQ ID NO: 203368 - DNA, 24 bp, Artificial sequence
  SiRNA target sequence
catataatgaaccaatagattttc

SEQ ID NO: 203369 - DNA, 24 bp, Artificial sequence
  SiRNA target sequence
atataatgaaccaatagattttcc

SEQ ID NO: 203370 - DNA, 24 bp, Artificial sequence
  SiRNA target sequence
tataatgaaccaatagattttcct

SEQ ID NO: 203371 - DNA, 24 bp, Artificial sequence
  SiRNA target sequence
ataatgaaccaatagattttccta

SEQ ID NO: 203372 - DNA, 24 bp, Artificial sequence
  SiRNA target sequence
taatgaaccaatagattttcctaa

SEQ ID NO: 203373 - DNA, 24 bp, Artificial sequence
  SiRNA target sequence
aatgaaccaatagattttcctaat

SEQ ID NO: 203374 - DNA, 24 bp, Artificial sequence
  SiRNA target sequence
atgaaccaatagattttcctaatt

SEQ ID NO: 203375 - DNA, 24 bp, Artificial sequence
  SiRNA target sequence
tgaaccaatagattttcctaattt

SEQ ID NO: 203376 - DNA, 24 bp, Artificial sequence
  SiRNA target sequence
gaaccaatagattttcctaattta

SEQ ID NO: 203377 - DNA, 24 bp, Artificial sequence
  SiRNA target sequence
aaccaatagattttcctaatttat

SEQ ID NO: 203378 - DNA, 24 bp, Artificial sequence
  SiRNA target sequence
accaatagattttcctaatttatt

SEQ ID NO: 203379 - DNA, 24 bp, Artificial sequence
  SiRNA target sequence
ccaatagattttcctaatttatta

SEQ ID NO: 203380 - DNA, 24 bp, Artificial sequence
  SiRNA target sequence
caatagattttcctaatttattaa

SEQ ID NO: 203381 - DNA, 24 bp, Artificial sequence
  SiRNA target sequence
aatagattttcctaatttattaaa

SEQ ID NO: 203382 - DNA, 24 bp, Artificial sequence
  SiRNA target sequence
atagattttcctaatttattaaaa

SEQ ID NO: 203383 - DNA, 24 bp, Artificial sequence
  SiRNA target sequence
tagattttcctaatttattaaaaa

SEQ ID NO: 203384 - DNA, 24 bp, Artificial sequence
  SiRNA target sequence
agattttcctaatttattaaaaat

SEQ ID NO: 203385 - DNA, 24 bp, Artificial sequence
  SiRNA target sequence
gattttcctaatttattaaaaata

SEQ ID NO: 203386 - DNA, 24 bp, Artificial sequence
  SiRNA target sequence
attttcctaatttattaaaaatac

SEQ ID NO: 203387 - DNA, 24 bp, Artificial sequence
  SiRNA target sequence
ttttcctaatttattaaaaatacc

SEQ ID NO: 203388 - DNA, 24 bp, Artificial sequence
  SiRNA target sequence
tttcctaatttattaaaaatacca

SEQ ID NO: 203389 - DNA, 24 bp, Artificial sequence
  SiRNA target sequence
ttcctaatttattaaaaataccat

SEQ ID NO: 203390 - DNA, 24 bp, Artificial sequence
  SiRNA target sequence
tcctaatttattaaaaataccatc

SEQ ID NO: 203391 - DNA, 24 bp, Artificial sequence
  SiRNA target sequence
cctaatttattaaaaataccatca

SEQ ID NO: 203392 - DNA, 24 bp, Artificial sequence
  SiRNA target sequence
ctaatttattaaaaataccatcat

SEQ ID NO: 203393 - DNA, 24 bp, Artificial sequence
  SiRNA target sequence
taatttattaaaaataccatcata

SEQ ID NO: 203394 - DNA, 24 bp, Artificial sequence
  SiRNA target sequence
aatttattaaaaataccatcataa

SEQ ID NO: 203395 - DNA, 24 bp, Artificial sequence
  SiRNA target sequence
atttattaaaaataccatcataaa

SEQ ID NO: 203396 - DNA, 24 bp, Artificial sequence
  SiRNA target sequence
tttattaaaaataccatcataaac

SEQ ID NO: 203397 - DNA, 24 bp, Artificial sequence
  SiRNA target sequence
ttattaaaaataccatcataaaca

SEQ ID NO: 203398 - DNA, 24 bp, Artificial sequence
  SiRNA target sequence
tattaaaaataccatcataaacac

SEQ ID NO: 203399 - DNA, 24 bp, Artificial sequence
  SiRNA target sequence
attaaaaataccatcataaacact

SEQ ID NO: 203400 - DNA, 24 bp, Artificial sequence
  SiRNA target sequence
ttaaaaataccatcataaacactt

SEQ ID NO: 203401 - DNA, 24 bp, Artificial sequence
  SiRNA target sequence
taaaaataccatcataaacacttt

SEQ ID NO: 203402 - DNA, 24 bp, Artificial sequence
  SiRNA target sequence
aaaaataccatcataaacactttt

SEQ ID NO: 203403 - DNA, 24 bp, Artificial sequence
  SiRNA target sequence
aaaataccatcataaacactttta

SEQ ID NO: 203404 - DNA, 24 bp, Artificial sequence
  SiRNA target sequence
aaataccatcataaacacttttaa

SEQ ID NO: 203405 - DNA, 24 bp, Artificial sequence
  SiRNA target sequence
aataccatcataaacacttttaaa

SEQ ID NO: 203406 - DNA, 24 bp, Artificial sequence
  SiRNA target sequence
ataccatcataaacacttttaaac

SEQ ID NO: 203407 - DNA, 24 bp, Artificial sequence
  SiRNA target sequence
taccatcataaacacttttaaacc

SEQ ID NO: 203408 - DNA, 24 bp, Artificial sequence
  SiRNA target sequence
accatcataaacacttttaaaccg

SEQ ID NO: 203409 - DNA, 24 bp, Artificial sequence
  SiRNA target sequence
ccatcataaacacttttaaaccgt

SEQ ID NO: 203410 - DNA, 24 bp, Artificial sequence
  SiRNA target sequence
catcataaacacttttaaaccgtg

SEQ ID NO: 203411 - DNA, 24 bp, Artificial sequence
  SiRNA target sequence
atcataaacacttttaaaccgtgc

SEQ ID NO: 203412 - DNA, 24 bp, Artificial sequence
  SiRNA target sequence
tcataaacacttttaaaccgtgcc

SEQ ID NO: 203413 - DNA, 24 bp, Artificial sequence
  SiRNA target sequence
cataaacacttttaaaccgtgccc

SEQ ID NO: 203414 - DNA, 24 bp, Artificial sequence
  SiRNA target sequence
ataaacacttttaaaccgtgccct

SEQ ID NO: 203415 - DNA, 24 bp, Artificial sequence
  SiRNA target sequence
taaacacttttaaaccgtgccctg

SEQ ID NO: 203416 - DNA, 24 bp, Artificial sequence
  SiRNA target sequence
aaacacttttaaaccgtgccctgt

SEQ ID NO: 203417 - DNA, 24 bp, Artificial sequence
  SiRNA target sequence
aacacttttaaaccgtgccctgtg

SEQ ID NO: 203418 - DNA, 24 bp, Artificial sequence
  SiRNA target sequence
acacttttaaaccgtgccctgtgt

SEQ ID NO: 203419 - DNA, 24 bp, Artificial sequence
  SiRNA target sequence
cacttttaaaccgtgccctgtgtg

SEQ ID NO: 203420 - DNA, 24 bp, Artificial sequence
  SiRNA target sequence
acttttaaaccgtgccctgtgtgc

SEQ ID NO: 203421 - DNA, 24 bp, Artificial sequence
  SiRNA target sequence
cttttaaaccgtgccctgtgtgca

SEQ ID NO: 203422 - DNA, 24 bp, Artificial sequence
  SiRNA target sequence
ttttaaaccgtgccctgtgtgcag

SEQ ID NO: 203423 - DNA, 24 bp, Artificial sequence
  SiRNA target sequence
tttaaaccgtgccctgtgtgcagg

SEQ ID NO: 203424 - DNA, 24 bp, Artificial sequence
  SiRNA target sequence
ttaaaccgtgccctgtgtgcagga

SEQ ID NO: 203425 - DNA, 24 bp, Artificial sequence
  SiRNA target sequence
taaaccgtgccctgtgtgcaggat

SEQ ID NO: 203426 - DNA, 24 bp, Artificial sequence
  SiRNA target sequence
aaaccgtgccctgtgtgcaggatc

SEQ ID NO: 203427 - DNA, 24 bp, Artificial sequence
  SiRNA target sequence
aaccgtgccctgtgtgcaggatcg

SEQ ID NO: 203428 - DNA, 24 bp, Artificial sequence
  SiRNA target sequence
accgtgccctgtgtgcaggatcga

SEQ ID NO: 203429 - DNA, 24 bp, Artificial sequence
  SiRNA target sequence
ccgtgccctgtgtgcaggatcgat

SEQ ID NO: 203430 - DNA, 24 bp, Artificial sequence
  SiRNA target sequence
cgtgccctgtgtgcaggatcgatt

SEQ ID NO: 203431 - DNA, 24 bp, Artificial sequence
  SiRNA target sequence
gtgccctgtgtgcaggatcgattc

SEQ ID NO: 203432 - DNA, 24 bp, Artificial sequence
  SiRNA target sequence
tgccctgtgtgcaggatcgattct

SEQ ID NO: 203433 - DNA, 24 bp, Artificial sequence
  SiRNA target sequence
gccctgtgtgcaggatcgattctc

SEQ ID NO: 203434 - DNA, 24 bp, Artificial sequence
  SiRNA target sequence
ccctgtgtgcaggatcgattctca

SEQ ID NO: 203435 - DNA, 24 bp, Artificial sequence
  SiRNA target sequence
cctgtgtgcaggatcgattctcat

SEQ ID NO: 203436 - DNA, 24 bp, Artificial sequence
  SiRNA target sequence
ctgtgtgcaggatcgattctcata

SEQ ID NO: 203437 - DNA, 24 bp, Artificial sequence
  SiRNA target sequence
tgtgtgcaggatcgattctcatac

SEQ ID NO: 203438 - DNA, 24 bp, Artificial sequence
  SiRNA target sequence
gtgtgcaggatcgattctcatacc

SEQ ID NO: 203439 - DNA, 24 bp, Artificial sequence
  SiRNA target sequence
tgtgcaggatcgattctcataccc

SEQ ID NO: 203440 - DNA, 24 bp, Artificial sequence
  SiRNA target sequence
gtgcaggatcgattctcataccca

SEQ ID NO: 203441 - DNA, 24 bp, Artificial sequence
  SiRNA target sequence
tgcaggatcgattctcatacccat

SEQ ID NO: 203442 - DNA, 24 bp, Artificial sequence
  SiRNA target sequence
gcaggatcgattctcatacccatt

SEQ ID NO: 203443 - DNA, 24 bp, Artificial sequence
  SiRNA target sequence
caggatcgattctcatacccattt

SEQ ID NO: 203444 - DNA, 24 bp, Artificial sequence
  SiRNA target sequence
aggatcgattctcatacccatttt

SEQ ID NO: 203445 - DNA, 24 bp, Artificial sequence
  SiRNA target sequence
ggatcgattctcatacccattttc

SEQ ID NO: 203446 - DNA, 24 bp, Artificial sequence
  SiRNA target sequence
gatcgattctcatacccattttct

SEQ ID NO: 203447 - DNA, 24 bp, Artificial sequence
  SiRNA target sequence
atcgattctcatacccattttctc

SEQ ID NO: 203448 - DNA, 24 bp, Artificial sequence
  SiRNA target sequence
tcgattctcatacccattttctct

SEQ ID NO: 203449 - DNA, 24 bp, Artificial sequence
  SiRNA target sequence
cgattctcatacccattttctctt

SEQ ID NO: 203450 - DNA, 24 bp, Artificial sequence
  SiRNA target sequence
gattctcatacccattttctcttt

SEQ ID NO: 203451 - DNA, 24 bp, Artificial sequence
  SiRNA target sequence
attctcatacccattttctcttta

SEQ ID NO: 203452 - DNA, 24 bp, Artificial sequence
  SiRNA target sequence
ttctcatacccattttctctttac

SEQ ID NO: 203453 - DNA, 24 bp, Artificial sequence
  SiRNA target sequence
tctcatacccattttctctttaca

SEQ ID NO: 203454 - DNA, 24 bp, Artificial sequence
  SiRNA target sequence
ctcatacccattttctctttacaa

SEQ ID NO: 203455 - DNA, 24 bp, Artificial sequence
  SiRNA target sequence
tcatacccattttctctttacaaa

SEQ ID NO: 203456 - DNA, 24 bp, Artificial sequence
  SiRNA target sequence
catacccattttctctttacaaat

SEQ ID NO: 203457 - DNA, 24 bp, Artificial sequence
  SiRNA target sequence
atacccattttctctttacaaata

SEQ ID NO: 203458 - DNA, 24 bp, Artificial sequence
  SiRNA target sequence
tacccattttctctttacaaatat

SEQ ID NO: 203459 - DNA, 24 bp, Artificial sequence
  SiRNA target sequence
acccattttctctttacaaatatc

SEQ ID NO: 203460 - DNA, 24 bp, Artificial sequence
  SiRNA target sequence
cccattttctctttacaaatatca

SEQ ID NO: 203461 - DNA, 24 bp, Artificial sequence
  SiRNA target sequence
ccattttctctttacaaatatcaa

SEQ ID NO: 203462 - DNA, 24 bp, Artificial sequence
  SiRNA target sequence
cattttctctttacaaatatcaaa

SEQ ID NO: 203463 - DNA, 24 bp, Artificial sequence
  SiRNA target sequence
attttctctttacaaatatcaaag

SEQ ID NO: 203464 - DNA, 24 bp, Artificial sequence
  SiRNA target sequence
ttttctctttacaaatatcaaagg

SEQ ID NO: 203465 - DNA, 24 bp, Artificial sequence
  SiRNA target sequence
tttctctttacaaatatcaaaggc

SEQ ID NO: 203466 - DNA, 24 bp, Artificial sequence
  SiRNA target sequence
ttctctttacaaatatcaaaggct

SEQ ID NO: 203467 - DNA, 24 bp, Artificial sequence
  SiRNA target sequence
tctctttacaaatatcaaaggctg

SEQ ID NO: 203468 - DNA, 24 bp, Artificial sequence
  SiRNA target sequence
ctctttacaaatatcaaaggctga

SEQ ID NO: 203469 - DNA, 24 bp, Artificial sequence
  SiRNA target sequence
tctttacaaatatcaaaggctgaa

SEQ ID NO: 203470 - DNA, 24 bp, Artificial sequence
  SiRNA target sequence
ctttacaaatatcaaaggctgaat

SEQ ID NO: 203471 - DNA, 24 bp, Artificial sequence
  SiRNA target sequence
tttacaaatatcaaaggctgaata

SEQ ID NO: 203472 - DNA, 24 bp, Artificial sequence
  SiRNA target sequence
ttacaaatatcaaaggctgaatat

SEQ ID NO: 203473 - DNA, 24 bp, Artificial sequence
  SiRNA target sequence
tacaaatatcaaaggctgaatatt

SEQ ID NO: 203474 - DNA, 24 bp, Artificial sequence
  SiRNA target sequence
acaaatatcaaaggctgaatattt

SEQ ID NO: 203475 - DNA, 24 bp, Artificial sequence
  SiRNA target sequence
caaatatcaaaggctgaatatttt

SEQ ID NO: 203476 - DNA, 24 bp, Artificial sequence
  SiRNA target sequence
aaatatcaaaggctgaatatttta

SEQ ID NO: 203477 - DNA, 24 bp, Artificial sequence
  SiRNA target sequence
aatatcaaaggctgaatattttaa

SEQ ID NO: 203478 - DNA, 24 bp, Artificial sequence
  SiRNA target sequence
atatcaaaggctgaatattttaat

SEQ ID NO: 203479 - DNA, 24 bp, Artificial sequence
  SiRNA target sequence
tatcaaaggctgaatattttaata

SEQ ID NO: 203480 - DNA, 24 bp, Artificial sequence
  SiRNA target sequence
atcaaaggctgaatattttaatac

SEQ ID NO: 203481 - DNA, 24 bp, Artificial sequence
  SiRNA target sequence
tcaaaggctgaatattttaatact

SEQ ID NO: 203482 - DNA, 24 bp, Artificial sequence
  SiRNA target sequence
caaaggctgaatattttaatactt

SEQ ID NO: 203483 - DNA, 24 bp, Artificial sequence
  SiRNA target sequence
aaaggctgaatattttaatacttt

SEQ ID NO: 203484 - DNA, 24 bp, Artificial sequence
  SiRNA target sequence
aaggctgaatattttaatactttt

SEQ ID NO: 203485 - DNA, 24 bp, Artificial sequence
  SiRNA target sequence
aggctgaatattttaatactttta

SEQ ID NO: 203486 - DNA, 24 bp, Artificial sequence
  SiRNA target sequence
ggctgaatattttaatacttttat

SEQ ID NO: 203487 - DNA, 24 bp, Artificial sequence
  SiRNA target sequence
gctgaatattttaatacttttatg

SEQ ID NO: 203488 - DNA, 24 bp, Artificial sequence
  SiRNA target sequence
ctgaatattttaatacttttatga

SEQ ID NO: 203489 - DNA, 24 bp, Artificial sequence
  SiRNA target sequence
tgaatattttaatacttttatgaa

SEQ ID NO: 203490 - DNA, 24 bp, Artificial sequence
  SiRNA target sequence
gaatattttaatacttttatgaat

SEQ ID NO: 203491 - DNA, 24 bp, Artificial sequence
  SiRNA target sequence
aatattttaatacttttatgaatg

SEQ ID NO: 203492 - DNA, 24 bp, Artificial sequence
  SiRNA target sequence
atattttaatacttttatgaatgc

SEQ ID NO: 203493 - DNA, 24 bp, Artificial sequence
  SiRNA target sequence
tattttaatacttttatgaatgct

SEQ ID NO: 203494 - DNA, 24 bp, Artificial sequence
  SiRNA target sequence
attttaatacttttatgaatgcta

SEQ ID NO: 203495 - DNA, 24 bp, Artificial sequence
  SiRNA target sequence
ttttaatacttttatgaatgctaa

SEQ ID NO: 203496 - DNA, 24 bp, Artificial sequence
  SiRNA target sequence
tttaatacttttatgaatgctaaa

SEQ ID NO: 203497 - DNA, 24 bp, Artificial sequence
  SiRNA target sequence
ttaatacttttatgaatgctaaaa

SEQ ID NO: 203498 - DNA, 24 bp, Artificial sequence
  SiRNA target sequence
taatacttttatgaatgctaaaaa

SEQ ID NO: 203499 - DNA, 24 bp, Artificial sequence
  SiRNA target sequence
aatacttttatgaatgctaaaaag

SEQ ID NO: 203500 - DNA, 24 bp, Artificial sequence
  SiRNA target sequence
atacttttatgaatgctaaaaaga

SEQ ID NO: 203501 - DNA, 24 bp, Artificial sequence
  SiRNA target sequence
tacttttatgaatgctaaaaagaa

SEQ ID NO: 203502 - DNA, 24 bp, Artificial sequence
  SiRNA target sequence
acttttatgaatgctaaaaagaac

SEQ ID NO: 203503 - DNA, 24 bp, Artificial sequence
  SiRNA target sequence
cttttatgaatgctaaaaagaaca

SEQ ID NO: 203504 - DNA, 24 bp, Artificial sequence
  SiRNA target sequence
ttttatgaatgctaaaaagaacat

SEQ ID NO: 203505 - DNA, 24 bp, Artificial sequence
  SiRNA target sequence
tttatgaatgctaaaaagaacatt

SEQ ID NO: 203506 - DNA, 24 bp, Artificial sequence
  SiRNA target sequence
ttatgaatgctaaaaagaacattc

SEQ ID NO: 203507 - DNA, 24 bp, Artificial sequence
  SiRNA target sequence
tatgaatgctaaaaagaacattcc

SEQ ID NO: 203508 - DNA, 24 bp, Artificial sequence
  SiRNA target sequence
atgaatgctaaaaagaacattcca

SEQ ID NO: 203509 - DNA, 24 bp, Artificial sequence
  SiRNA target sequence
tgaatgctaaaaagaacattccac

SEQ ID NO: 203510 - DNA, 24 bp, Artificial sequence
  SiRNA target sequence
gaatgctaaaaagaacattccact

SEQ ID NO: 203511 - DNA, 24 bp, Artificial sequence
  SiRNA target sequence
aatgctaaaaagaacattccactg

SEQ ID NO: 203512 - DNA, 24 bp, Artificial sequence
  SiRNA target sequence
atgctaaaaagaacattccactgt

SEQ ID NO: 203513 - DNA, 24 bp, Artificial sequence
  SiRNA target sequence
tgctaaaaagaacattccactgta

SEQ ID NO: 203514 - DNA, 24 bp, Artificial sequence
  SiRNA target sequence
gctaaaaagaacattccactgtaa

SEQ ID NO: 203515 - DNA, 24 bp, Artificial sequence
  SiRNA target sequence
ctaaaaagaacattccactgtaat

SEQ ID NO: 203516 - DNA, 24 bp, Artificial sequence
  SiRNA target sequence
taaaaagaacattccactgtaatt

SEQ ID NO: 203517 - DNA, 24 bp, Artificial sequence
  SiRNA target sequence
aaaaagaacattccactgtaattt

SEQ ID NO: 203518 - DNA, 24 bp, Artificial sequence
  SiRNA target sequence
aaaagaacattccactgtaatttt

SEQ ID NO: 203519 - DNA, 24 bp, Artificial sequence
  SiRNA target sequence
aaagaacattccactgtaattttc

SEQ ID NO: 203520 - DNA, 24 bp, Artificial sequence
  SiRNA target sequence
aagaacattccactgtaattttcg

SEQ ID NO: 203521 - DNA, 24 bp, Artificial sequence
  SiRNA target sequence
agaacattccactgtaattttcga

SEQ ID NO: 203522 - DNA, 24 bp, Artificial sequence
  SiRNA target sequence
gaacattccactgtaattttcgat

SEQ ID NO: 203523 - DNA, 24 bp, Artificial sequence
  SiRNA target sequence
aacattccactgtaattttcgatc

SEQ ID NO: 203524 - DNA, 24 bp, Artificial sequence
  SiRNA target sequence
acattccactgtaattttcgatcg

SEQ ID NO: 203525 - DNA, 24 bp, Artificial sequence
  SiRNA target sequence
cattccactgtaattttcgatcgt

SEQ ID NO: 203526 - DNA, 24 bp, Artificial sequence
  SiRNA target sequence
attccactgtaattttcgatcgta

SEQ ID NO: 203527 - DNA, 24 bp, Artificial sequence
  SiRNA target sequence
ttccactgtaattttcgatcgtat

SEQ ID NO: 203528 - DNA, 24 bp, Artificial sequence
  SiRNA target sequence
tccactgtaattttcgatcgtata

SEQ ID NO: 203529 - DNA, 24 bp, Artificial sequence
  SiRNA target sequence
ccactgtaattttcgatcgtataa

SEQ ID NO: 203530 - DNA, 24 bp, Artificial sequence
  SiRNA target sequence
cactgtaattttcgatcgtataaa

SEQ ID NO: 203531 - DNA, 24 bp, Artificial sequence
  SiRNA target sequence
actgtaattttcgatcgtataaat

SEQ ID NO: 203532 - DNA, 24 bp, Artificial sequence
  SiRNA target sequence
ctgtaattttcgatcgtataaatg

SEQ ID NO: 203533 - DNA, 24 bp, Artificial sequence
  SiRNA target sequence
tgtaattttcgatcgtataaatgt

SEQ ID NO: 203534 - DNA, 24 bp, Artificial sequence
  SiRNA target sequence
gtaattttcgatcgtataaatgta

SEQ ID NO: 203535 - DNA, 24 bp, Artificial sequence
  SiRNA target sequence
taattttcgatcgtataaatgtac

SEQ ID NO: 203536 - DNA, 24 bp, Artificial sequence
  SiRNA target sequence
aattttcgatcgtataaatgtacg

SEQ ID NO: 203537 - DNA, 24 bp, Artificial sequence
  SiRNA target sequence
attttcgatcgtataaatgtacga

SEQ ID NO: 203538 - DNA, 24 bp, Artificial sequence
  SiRNA target sequence
ttttcgatcgtataaatgtacgac

SEQ ID NO: 203539 - DNA, 24 bp, Artificial sequence
  SiRNA target sequence
tttcgatcgtataaatgtacgaca

SEQ ID NO: 203540 - DNA, 24 bp, Artificial sequence
  SiRNA target sequence
ttcgatcgtataaatgtacgacat

SEQ ID NO: 203541 - DNA, 24 bp, Artificial sequence
  SiRNA target sequence
tcgatcgtataaatgtacgacatt

SEQ ID NO: 203542 - DNA, 24 bp, Artificial sequence
  SiRNA target sequence
cgatcgtataaatgtacgacattt

SEQ ID NO: 203543 - DNA, 24 bp, Artificial sequence
  SiRNA target sequence
gatcgtataaatgtacgacatttt

SEQ ID NO: 203544 - DNA, 24 bp, Artificial sequence
  SiRNA target sequence
atcgtataaatgtacgacattttt

SEQ ID NO: 203545 - DNA, 24 bp, Artificial sequence
  SiRNA target sequence
tcgtataaatgtacgacatttttt

SEQ ID NO: 203546 - DNA, 24 bp, Artificial sequence
  SiRNA target sequence
cgtataaatgtacgacattttttt

SEQ ID NO: 203547 - DNA, 24 bp, Artificial sequence
  SiRNA target sequence
gtataaatgtacgacattttttta

SEQ ID NO: 203548 - DNA, 24 bp, Artificial sequence
  SiRNA target sequence
tataaatgtacgacatttttttaa

SEQ ID NO: 203549 - DNA, 24 bp, Artificial sequence
  SiRNA target sequence
ataaatgtacgacatttttttaaa

SEQ ID NO: 203550 - DNA, 24 bp, Artificial sequence
  SiRNA target sequence
taaatgtacgacatttttttaaaa

SEQ ID NO: 203551 - DNA, 24 bp, Artificial sequence
  SiRNA target sequence
aaatgtacgacatttttttaaaaa

SEQ ID NO: 203552 - DNA, 24 bp, Artificial sequence
  SiRNA target sequence
aatgtacgacatttttttaaaaaa

SEQ ID NO: 203553 - DNA, 24 bp, Artificial sequence
  SiRNA target sequence
atgtacgacatttttttaaaaaat

SEQ ID NO: 203554 - DNA, 24 bp, Artificial sequence
  SiRNA target sequence
tgtacgacatttttttaaaaaata

SEQ ID NO: 203555 - DNA, 24 bp, Artificial sequence
  SiRNA target sequence
gtacgacatttttttaaaaaatac

SEQ ID NO: 203556 - DNA, 24 bp, Artificial sequence
  SiRNA target sequence
tacgacatttttttaaaaaataca

SEQ ID NO: 203557 - DNA, 24 bp, Artificial sequence
  SiRNA target sequence
acgacatttttttaaaaaatacag

SEQ ID NO: 203558 - DNA, 24 bp, Artificial sequence
  SiRNA target sequence
cgacatttttttaaaaaatacaga

SEQ ID NO: 203559 - DNA, 24 bp, Artificial sequence
  SiRNA target sequence
gacatttttttaaaaaatacagaa

SEQ ID NO: 203560 - DNA, 24 bp, Artificial sequence
  SiRNA target sequence
acatttttttaaaaaatacagaaa

SEQ ID NO: 203561 - DNA, 24 bp, Artificial sequence
  SiRNA target sequence
catttttttaaaaaatacagaaat

SEQ ID NO: 203562 - DNA, 24 bp, Artificial sequence
  SiRNA target sequence
atttttttaaaaaatacagaaatc

SEQ ID NO: 203563 - DNA, 24 bp, Artificial sequence
  SiRNA target sequence
tttttttaaaaaatacagaaatcc

SEQ ID NO: 203564 - DNA, 24 bp, Artificial sequence
  SiRNA target sequence
ttttttaaaaaatacagaaatcca

SEQ ID NO: 203565 - DNA, 24 bp, Artificial sequence
  SiRNA target sequence
tttttaaaaaatacagaaatccat

SEQ ID NO: 203566 - DNA, 24 bp, Artificial sequence
  SiRNA target sequence
ttttaaaaaatacagaaatccatg

SEQ ID NO: 203567 - DNA, 24 bp, Artificial sequence
  SiRNA target sequence
tttaaaaaatacagaaatccatga

SEQ ID NO: 203568 - DNA, 24 bp, Artificial sequence
  SiRNA target sequence
ttaaaaaatacagaaatccatgaa

SEQ ID NO: 203569 - DNA, 24 bp, Artificial sequence
  SiRNA target sequence
taaaaaatacagaaatccatgaaa

SEQ ID NO: 203570 - DNA, 24 bp, Artificial sequence
  SiRNA target sequence
aaaaaatacagaaatccatgaaaa

SEQ ID NO: 203571 - DNA, 24 bp, Artificial sequence
  SiRNA target sequence
aaaaatacagaaatccatgaaaaa

SEQ ID NO: 203572 - DNA, 24 bp, Artificial sequence
  SiRNA target sequence
aaaatacagaaatccatgaaaaag

SEQ ID NO: 203573 - DNA, 24 bp, Artificial sequence
  SiRNA target sequence
aaatacagaaatccatgaaaaagc

SEQ ID NO: 203574 - DNA, 24 bp, Artificial sequence
  SiRNA target sequence
aatacagaaatccatgaaaaagca

SEQ ID NO: 203575 - DNA, 24 bp, Artificial sequence
  SiRNA target sequence
atacagaaatccatgaaaaagcaa

SEQ ID NO: 203576 - DNA, 24 bp, Artificial sequence
  SiRNA target sequence
tacagaaatccatgaaaaagcaag

SEQ ID NO: 203577 - DNA, 24 bp, Artificial sequence
  SiRNA target sequence
acagaaatccatgaaaaagcaagt

SEQ ID NO: 203578 - DNA, 24 bp, Artificial sequence
  SiRNA target sequence
cagaaatccatgaaaaagcaagtc

SEQ ID NO: 203579 - DNA, 24 bp, Artificial sequence
  SiRNA target sequence
agaaatccatgaaaaagcaagtcc

SEQ ID NO: 203580 - DNA, 24 bp, Artificial sequence
  SiRNA target sequence
gaaatccatgaaaaagcaagtcct

SEQ ID NO: 203581 - DNA, 24 bp, Artificial sequence
  SiRNA target sequence
aaatccatgaaaaagcaagtcctt

SEQ ID NO: 203582 - DNA, 24 bp, Artificial sequence
  SiRNA target sequence
aatccatgaaaaagcaagtccttc

SEQ ID NO: 203583 - DNA, 24 bp, Artificial sequence
  SiRNA target sequence
atccatgaaaaagcaagtccttca

SEQ ID NO: 203584 - DNA, 24 bp, Artificial sequence
  SiRNA target sequence
tccatgaaaaagcaagtccttcaa

SEQ ID NO: 203585 - DNA, 24 bp, Artificial sequence
  SiRNA target sequence
ccatgaaaaagcaagtccttcaat

SEQ ID NO: 203586 - DNA, 24 bp, Artificial sequence
  SiRNA target sequence
catgaaaaagcaagtccttcaatg

SEQ ID NO: 203587 - DNA, 24 bp, Artificial sequence
  SiRNA target sequence
atgaaaaagcaagtccttcaatgg

SEQ ID NO: 203588 - DNA, 24 bp, Artificial sequence
  SiRNA target sequence
tgaaaaagcaagtccttcaatggc

SEQ ID NO: 203589 - DNA, 24 bp, Artificial sequence
  SiRNA target sequence
gaaaaagcaagtccttcaatggca

SEQ ID NO: 203590 - DNA, 24 bp, Artificial sequence
  SiRNA target sequence
aaaaagcaagtccttcaatggcag

SEQ ID NO: 203591 - DNA, 24 bp, Artificial sequence
  SiRNA target sequence
aaaagcaagtccttcaatggcaga

SEQ ID NO: 203592 - DNA, 24 bp, Artificial sequence
  SiRNA target sequence
aaagcaagtccttcaatggcagaa

SEQ ID NO: 203593 - DNA, 24 bp, Artificial sequence
  SiRNA target sequence
aagcaagtccttcaatggcagaat

SEQ ID NO: 203594 - DNA, 24 bp, Artificial sequence
  SiRNA target sequence
agcaagtccttcaatggcagaatt

SEQ ID NO: 203595 - DNA, 24 bp, Artificial sequence
  SiRNA target sequence
gcaagtccttcaatggcagaattg

SEQ ID NO: 203596 - DNA, 24 bp, Artificial sequence
  SiRNA target sequence
caagtccttcaatggcagaattgt

SEQ ID NO: 203597 - DNA, 24 bp, Artificial sequence
  SiRNA target sequence
aagtccttcaatggcagaattgta

SEQ ID NO: 203598 - DNA, 24 bp, Artificial sequence
  SiRNA target sequence
agtccttcaatggcagaattgtag

SEQ ID NO: 203599 - DNA, 24 bp, Artificial sequence
  SiRNA target sequence
gtccttcaatggcagaattgtaga

SEQ ID NO: 203600 - DNA, 24 bp, Artificial sequence
  SiRNA target sequence
tccttcaatggcagaattgtagat

SEQ ID NO: 203601 - DNA, 24 bp, Artificial sequence
  SiRNA target sequence
ccttcaatggcagaattgtagatt

SEQ ID NO: 203602 - DNA, 24 bp, Artificial sequence
  SiRNA target sequence
cttcaatggcagaattgtagattg

SEQ ID NO: 203603 - DNA, 24 bp, Artificial sequence
  SiRNA target sequence
ttcaatggcagaattgtagattga

SEQ ID NO: 203604 - DNA, 24 bp, Artificial sequence
  SiRNA target sequence
tcaatggcagaattgtagattgat

SEQ ID NO: 203605 - DNA, 24 bp, Artificial sequence
  SiRNA target sequence
caatggcagaattgtagattgatg

SEQ ID NO: 203606 - DNA, 24 bp, Artificial sequence
  SiRNA target sequence
aatggcagaattgtagattgatgc

SEQ ID NO: 203607 - DNA, 24 bp, Artificial sequence
  SiRNA target sequence
atggcagaattgtagattgatgct

SEQ ID NO: 203608 - DNA, 24 bp, Artificial sequence
  SiRNA target sequence
tggcagaattgtagattgatgctc

SEQ ID NO: 203609 - DNA, 24 bp, Artificial sequence
  SiRNA target sequence
ggcagaattgtagattgatgctcc

SEQ ID NO: 203610 - DNA, 24 bp, Artificial sequence
  SiRNA target sequence
gcagaattgtagattgatgctccc

SEQ ID NO: 203611 - DNA, 24 bp, Artificial sequence
  SiRNA target sequence
cagaattgtagattgatgctccca

SEQ ID NO: 203612 - DNA, 24 bp, Artificial sequence
  SiRNA target sequence
agaattgtagattgatgctcccat

SEQ ID NO: 203613 - DNA, 24 bp, Artificial sequence
  SiRNA target sequence
gaattgtagattgatgctcccata

SEQ ID NO: 203614 - DNA, 24 bp, Artificial sequence
  SiRNA target sequence
aattgtagattgatgctcccataa

SEQ ID NO: 203615 - DNA, 24 bp, Artificial sequence
  SiRNA target sequence
attgtagattgatgctcccataac

SEQ ID NO: 203616 - DNA, 24 bp, Artificial sequence
  SiRNA target sequence
ttgtagattgatgctcccataacg

SEQ ID NO: 203617 - DNA, 24 bp, Artificial sequence
  SiRNA target sequence
tgtagattgatgctcccataacga

SEQ ID NO: 203618 - DNA, 24 bp, Artificial sequence
  SiRNA target sequence
gtagattgatgctcccataacgat

SEQ ID NO: 203619 - DNA, 24 bp, Artificial sequence
  SiRNA target sequence
tagattgatgctcccataacgatt

SEQ ID NO: 203620 - DNA, 24 bp, Artificial sequence
  SiRNA target sequence
agattgatgctcccataacgatta

SEQ ID NO: 203621 - DNA, 24 bp, Artificial sequence
  SiRNA target sequence
gattgatgctcccataacgattat

SEQ ID NO: 203622 - DNA, 24 bp, Artificial sequence
  SiRNA target sequence
attgatgctcccataacgattatt

SEQ ID NO: 203623 - DNA, 24 bp, Artificial sequence
  SiRNA target sequence
ttgatgctcccataacgattattg

SEQ ID NO: 203624 - DNA, 24 bp, Artificial sequence
  SiRNA target sequence
tgatgctcccataacgattattga

SEQ ID NO: 203625 - DNA, 24 bp, Artificial sequence
  SiRNA target sequence
gatgctcccataacgattattgac

SEQ ID NO: 203626 - DNA, 24 bp, Artificial sequence
  SiRNA target sequence
atgctcccataacgattattgacc

SEQ ID NO: 203627 - DNA, 24 bp, Artificial sequence
  SiRNA target sequence
tgctcccataacgattattgaccc

SEQ ID NO: 203628 - DNA, 24 bp, Artificial sequence
  SiRNA target sequence
gctcccataacgattattgacccc

SEQ ID NO: 203629 - DNA, 24 bp, Artificial sequence
  SiRNA target sequence
ctcccataacgattattgacccca

SEQ ID NO: 203630 - DNA, 24 bp, Artificial sequence
  SiRNA target sequence
tcccataacgattattgaccccaa

SEQ ID NO: 203631 - DNA, 24 bp, Artificial sequence
  SiRNA target sequence
cccataacgattattgaccccaac

SEQ ID NO: 203632 - DNA, 24 bp, Artificial sequence
  SiRNA target sequence
ccataacgattattgaccccaaca

SEQ ID NO: 203633 - DNA, 24 bp, Artificial sequence
  SiRNA target sequence
cataacgattattgaccccaacaa

SEQ ID NO: 203634 - DNA, 24 bp, Artificial sequence
  SiRNA target sequence
ataacgattattgaccccaacaac

SEQ ID NO: 203635 - DNA, 24 bp, Artificial sequence
  SiRNA target sequence
taacgattattgaccccaacaaca

SEQ ID NO: 203636 - DNA, 24 bp, Artificial sequence
  SiRNA target sequence
aacgattattgaccccaacaacaa

SEQ ID NO: 203637 - DNA, 24 bp, Artificial sequence
  SiRNA target sequence
acgattattgaccccaacaacaag

SEQ ID NO: 203638 - DNA, 24 bp, Artificial sequence
  SiRNA target sequence
cgattattgaccccaacaacaaga

SEQ ID NO: 203639 - DNA, 24 bp, Artificial sequence
  SiRNA target sequence
gattattgaccccaacaacaagaa

SEQ ID NO: 203640 - DNA, 24 bp, Artificial sequence
  SiRNA target sequence
attattgaccccaacaacaagaat

SEQ ID NO: 203641 - DNA, 24 bp, Artificial sequence
  SiRNA target sequence
ttattgaccccaacaacaagaata

SEQ ID NO: 203642 - DNA, 24 bp, Artificial sequence
  SiRNA target sequence
tattgaccccaacaacaagaataa

SEQ ID NO: 203643 - DNA, 24 bp, Artificial sequence
  SiRNA target sequence
attgaccccaacaacaagaataaa

SEQ ID NO: 203644 - DNA, 24 bp, Artificial sequence
  SiRNA target sequence
ttgaccccaacaacaagaataaag

SEQ ID NO: 203645 - DNA, 24 bp, Artificial sequence
  SiRNA target sequence
tgaccccaacaacaagaataaagg

SEQ ID NO: 203646 - DNA, 24 bp, Artificial sequence
  SiRNA target sequence
gaccccaacaacaagaataaaggt

SEQ ID NO: 203647 - DNA, 24 bp, Artificial sequence
  SiRNA target sequence
accccaacaacaagaataaaggtg

SEQ ID NO: 203648 - DNA, 24 bp, Artificial sequence
  SiRNA target sequence
ccccaacaacaagaataaaggtgt

SEQ ID NO: 203649 - DNA, 24 bp, Artificial sequence
  SiRNA target sequence
cccaacaacaagaataaaggtgtt

SEQ ID NO: 203650 - DNA, 24 bp, Artificial sequence
  SiRNA target sequence
ccaacaacaagaataaaggtgtta

SEQ ID NO: 203651 - DNA, 24 bp, Artificial sequence
  SiRNA target sequence
caacaacaagaataaaggtgttaa

SEQ ID NO: 203652 - DNA, 24 bp, Artificial sequence
  SiRNA target sequence
aacaacaagaataaaggtgttaag

SEQ ID NO: 203653 - DNA, 24 bp, Artificial sequence
  SiRNA target sequence
acaacaagaataaaggtgttaaga

SEQ ID NO: 203654 - DNA, 24 bp, Artificial sequence
  SiRNA target sequence
caacaagaataaaggtgttaagag

SEQ ID NO: 203655 - DNA, 24 bp, Artificial sequence
  SiRNA target sequence
aacaagaataaaggtgttaagagt

SEQ ID NO: 203656 - DNA, 24 bp, Artificial sequence
  SiRNA target sequence
acaagaataaaggtgttaagagtc

SEQ ID NO: 203657 - DNA, 24 bp, Artificial sequence
  SiRNA target sequence
caagaataaaggtgttaagagtcc

SEQ ID NO: 203658 - DNA, 24 bp, Artificial sequence
  SiRNA target sequence
aagaataaaggtgttaagagtccc

SEQ ID NO: 203659 - DNA, 24 bp, Artificial sequence
  SiRNA target sequence
agaataaaggtgttaagagtccca

SEQ ID NO: 203660 - DNA, 24 bp, Artificial sequence
  SiRNA target sequence
gaataaaggtgttaagagtcccat

SEQ ID NO: 203661 - DNA, 24 bp, Artificial sequence
  SiRNA target sequence
aataaaggtgttaagagtcccata

SEQ ID NO: 203662 - DNA, 24 bp, Artificial sequence
  SiRNA target sequence
ataaaggtgttaagagtcccatag

SEQ ID NO: 203663 - DNA, 24 bp, Artificial sequence
  SiRNA target sequence
taaaggtgttaagagtcccatagt

SEQ ID NO: 203664 - DNA, 24 bp, Artificial sequence
  SiRNA target sequence
aaaggtgttaagagtcccatagta

SEQ ID NO: 203665 - DNA, 24 bp, Artificial sequence
  SiRNA target sequence
aaggtgttaagagtcccatagtaa

SEQ ID NO: 203666 - DNA, 24 bp, Artificial sequence
  SiRNA target sequence
aggtgttaagagtcccatagtaat

SEQ ID NO: 203667 - DNA, 24 bp, Artificial sequence
  SiRNA target sequence
ggtgttaagagtcccatagtaatc

SEQ ID NO: 203668 - DNA, 24 bp, Artificial sequence
  SiRNA target sequence
gtgttaagagtcccatagtaatcc

SEQ ID NO: 203669 - DNA, 24 bp, Artificial sequence
  SiRNA target sequence
tgttaagagtcccatagtaatcca

SEQ ID NO: 203670 - DNA, 24 bp, Artificial sequence
  SiRNA target sequence
gttaagagtcccatagtaatccat

SEQ ID NO: 203671 - DNA, 24 bp, Artificial sequence
  SiRNA target sequence
ttaagagtcccatagtaatccatc

SEQ ID NO: 203672 - DNA, 24 bp, Artificial sequence
  SiRNA target sequence
taagagtcccatagtaatccatcc

SEQ ID NO: 203673 - DNA, 24 bp, Artificial sequence
  SiRNA target sequence
aagagtcccatagtaatccatcca

SEQ ID NO: 203674 - DNA, 24 bp, Artificial sequence
  SiRNA target sequence
agagtcccatagtaatccatccac

SEQ ID NO: 203675 - DNA, 24 bp, Artificial sequence
  SiRNA target sequence
gagtcccatagtaatccatccact

SEQ ID NO: 203676 - DNA, 24 bp, Artificial sequence
  SiRNA target sequence
agtcccatagtaatccatccacta

SEQ ID NO: 203677 - DNA, 24 bp, Artificial sequence
  SiRNA target sequence
gtcccatagtaatccatccactac

SEQ ID NO: 203678 - DNA, 24 bp, Artificial sequence
  SiRNA target sequence
tcccatagtaatccatccactact

SEQ ID NO: 203679 - DNA, 24 bp, Artificial sequence
  SiRNA target sequence
cccatagtaatccatccactactt

SEQ ID NO: 203680 - DNA, 24 bp, Artificial sequence
  SiRNA target sequence
ccatagtaatccatccactacttt

SEQ ID NO: 203681 - DNA, 24 bp, Artificial sequence
  SiRNA target sequence
catagtaatccatccactactttc

SEQ ID NO: 203682 - DNA, 24 bp, Artificial sequence
  SiRNA target sequence
atagtaatccatccactactttct

SEQ ID NO: 203683 - DNA, 24 bp, Artificial sequence
  SiRNA target sequence
tagtaatccatccactactttcta

SEQ ID NO: 203684 - DNA, 24 bp, Artificial sequence
  SiRNA target sequence
agtaatccatccactactttctac

SEQ ID NO: 203685 - DNA, 24 bp, Artificial sequence
  SiRNA target sequence
gtaatccatccactactttctact

SEQ ID NO: 203686 - DNA, 24 bp, Artificial sequence
  SiRNA target sequence
taatccatccactactttctacta

SEQ ID NO: 203687 - DNA, 24 bp, Artificial sequence
  SiRNA target sequence
aatccatccactactttctactaa

SEQ ID NO: 203688 - DNA, 24 bp, Artificial sequence
  SiRNA target sequence
atccatccactactttctactaaa

SEQ ID NO: 203689 - DNA, 24 bp, Artificial sequence
  SiRNA target sequence
tccatccactactttctactaaag

SEQ ID NO: 203690 - DNA, 24 bp, Artificial sequence
  SiRNA target sequence
ccatccactactttctactaaagt

SEQ ID NO: 203691 - DNA, 24 bp, Artificial sequence
  SiRNA target sequence
catccactactttctactaaagta

SEQ ID NO: 203692 - DNA, 24 bp, Artificial sequence
  SiRNA target sequence
atccactactttctactaaagtag

SEQ ID NO: 203693 - DNA, 24 bp, Artificial sequence
  SiRNA target sequence
tccactactttctactaaagtaga

SEQ ID NO: 203694 - DNA, 24 bp, Artificial sequence
  SiRNA target sequence
ccactactttctactaaagtagaa

SEQ ID NO: 203695 - DNA, 24 bp, Artificial sequence
  SiRNA target sequence
cactactttctactaaagtagaaa

SEQ ID NO: 203696 - DNA, 24 bp, Artificial sequence
  SiRNA target sequence
actactttctactaaagtagaaaa

SEQ ID NO: 203697 - DNA, 24 bp, Artificial sequence
  SiRNA target sequence
ctactttctactaaagtagaaaat

SEQ ID NO: 203698 - DNA, 24 bp, Artificial sequence
  SiRNA target sequence
tactttctactaaagtagaaaatg

SEQ ID NO: 203699 - DNA, 24 bp, Artificial sequence
  SiRNA target sequence
actttctactaaagtagaaaatgc

SEQ ID NO: 203700 - DNA, 24 bp, Artificial sequence
  SiRNA target sequence
ctttctactaaagtagaaaatgct

SEQ ID NO: 203701 - DNA, 24 bp, Artificial sequence
  SiRNA target sequence
tttctactaaagtagaaaatgctg

SEQ ID NO: 203702 - DNA, 24 bp, Artificial sequence
  SiRNA target sequence
ttctactaaagtagaaaatgctga

SEQ ID NO: 203703 - DNA, 24 bp, Artificial sequence
  SiRNA target sequence
tctactaaagtagaaaatgctgac

SEQ ID NO: 203704 - DNA, 24 bp, Artificial sequence
  SiRNA target sequence
ctactaaagtagaaaatgctgaca

SEQ ID NO: 203705 - DNA, 24 bp, Artificial sequence
  SiRNA target sequence
tactaaagtagaaaatgctgacaa

SEQ ID NO: 203706 - DNA, 24 bp, Artificial sequence
  SiRNA target sequence
actaaagtagaaaatgctgacaaa

SEQ ID NO: 203707 - DNA, 24 bp, Artificial sequence
  SiRNA target sequence
ctaaagtagaaaatgctgacaaat

SEQ ID NO: 203708 - DNA, 24 bp, Artificial sequence
  SiRNA target sequence
taaagtagaaaatgctgacaaatt

SEQ ID NO: 203709 - DNA, 24 bp, Artificial sequence
  SiRNA target sequence
aaagtagaaaatgctgacaaatta

SEQ ID NO: 203710 - DNA, 24 bp, Artificial sequence
  SiRNA target sequence
aagtagaaaatgctgacaaattaa

SEQ ID NO: 203711 - DNA, 24 bp, Artificial sequence
  SiRNA target sequence
agtagaaaatgctgacaaattaag

SEQ ID NO: 203712 - DNA, 24 bp, Artificial sequence
  SiRNA target sequence
gtagaaaatgctgacaaattaagt

SEQ ID NO: 203713 - DNA, 24 bp, Artificial sequence
  SiRNA target sequence
tagaaaatgctgacaaattaagtg

SEQ ID NO: 203714 - DNA, 24 bp, Artificial sequence
  SiRNA target sequence
agaaaatgctgacaaattaagtgt

SEQ ID NO: 203715 - DNA, 24 bp, Artificial sequence
  SiRNA target sequence
gaaaatgctgacaaattaagtgtt

SEQ ID NO: 203716 - DNA, 24 bp, Artificial sequence
  SiRNA target sequence
aaaatgctgacaaattaagtgtta

SEQ ID NO: 203717 - DNA, 24 bp, Artificial sequence
  SiRNA target sequence
aaatgctgacaaattaagtgttat

SEQ ID NO: 203718 - DNA, 24 bp, Artificial sequence
  SiRNA target sequence
aatgctgacaaattaagtgttatt

SEQ ID NO: 203719 - DNA, 24 bp, Artificial sequence
  SiRNA target sequence
atgctgacaaattaagtgttatta

SEQ ID NO: 203720 - DNA, 24 bp, Artificial sequence
  SiRNA target sequence
tgctgacaaattaagtgttattac

SEQ ID NO: 203721 - DNA, 24 bp, Artificial sequence
  SiRNA target sequence
gctgacaaattaagtgttattaca

SEQ ID NO: 203722 - DNA, 24 bp, Artificial sequence
  SiRNA target sequence
ctgacaaattaagtgttattacag

SEQ ID NO: 203723 - DNA, 24 bp, Artificial sequence
  SiRNA target sequence
tgacaaattaagtgttattacagt

SEQ ID NO: 203724 - DNA, 24 bp, Artificial sequence
  SiRNA target sequence
gacaaattaagtgttattacagta

SEQ ID NO: 203725 - DNA, 24 bp, Artificial sequence
  SiRNA target sequence
acaaattaagtgttattacagtaa

SEQ ID NO: 203726 - DNA, 24 bp, Artificial sequence
  SiRNA target sequence
caaattaagtgttattacagtaac

SEQ ID NO: 203727 - DNA, 24 bp, Artificial sequence
  SiRNA target sequence
aaattaagtgttattacagtaact

SEQ ID NO: 203728 - DNA, 24 bp, Artificial sequence
  SiRNA target sequence
aattaagtgttattacagtaactg

SEQ ID NO: 203729 - DNA, 24 bp, Artificial sequence
  SiRNA target sequence
attaagtgttattacagtaactgc

SEQ ID NO: 203730 - DNA, 24 bp, Artificial sequence
  SiRNA target sequence
ttaagtgttattacagtaactgct

SEQ ID NO: 203731 - DNA, 24 bp, Artificial sequence
  SiRNA target sequence
taagtgttattacagtaactgcta

SEQ ID NO: 203732 - DNA, 24 bp, Artificial sequence
  SiRNA target sequence
aagtgttattacagtaactgctac

SEQ ID NO: 203733 - DNA, 24 bp, Artificial sequence
  SiRNA target sequence
agtgttattacagtaactgctacc

SEQ ID NO: 203734 - DNA, 24 bp, Artificial sequence
  SiRNA target sequence
gtgttattacagtaactgctacca

SEQ ID NO: 203735 - DNA, 24 bp, Artificial sequence
  SiRNA target sequence
tgttattacagtaactgctaccaa

SEQ ID NO: 203736 - DNA, 24 bp, Artificial sequence
  SiRNA target sequence
gttattacagtaactgctaccaat

SEQ ID NO: 203737 - DNA, 24 bp, Artificial sequence
  SiRNA target sequence
ttattacagtaactgctaccaata

SEQ ID NO: 203738 - DNA, 24 bp, Artificial sequence
  SiRNA target sequence
tattacagtaactgctaccaatat

SEQ ID NO: 203739 - DNA, 24 bp, Artificial sequence
  SiRNA target sequence
attacagtaactgctaccaatatt

SEQ ID NO: 203740 - DNA, 24 bp, Artificial sequence
  SiRNA target sequence
ttacagtaactgctaccaatattt

SEQ ID NO: 203741 - DNA, 24 bp, Artificial sequence
  SiRNA target sequence
tacagtaactgctaccaatatttg

SEQ ID NO: 203742 - DNA, 24 bp, Artificial sequence
  SiRNA target sequence
acagtaactgctaccaatatttga

SEQ ID NO: 203743 - DNA, 24 bp, Artificial sequence
  SiRNA target sequence
cagtaactgctaccaatatttgat

SEQ ID NO: 203744 - DNA, 24 bp, Artificial sequence
  SiRNA target sequence
agtaactgctaccaatatttgatc

SEQ ID NO: 203745 - DNA, 24 bp, Artificial sequence
  SiRNA target sequence
gtaactgctaccaatatttgatct

SEQ ID NO: 203746 - DNA, 24 bp, Artificial sequence
  SiRNA target sequence
taactgctaccaatatttgatcta

SEQ ID NO: 203747 - DNA, 24 bp, Artificial sequence
  SiRNA target sequence
aactgctaccaatatttgatctat

SEQ ID NO: 203748 - DNA, 24 bp, Artificial sequence
  SiRNA target sequence
actgctaccaatatttgatctatt

SEQ ID NO: 203749 - DNA, 24 bp, Artificial sequence
  SiRNA target sequence
ctgctaccaatatttgatctattg

SEQ ID NO: 203750 - DNA, 24 bp, Artificial sequence
  SiRNA target sequence
tgctaccaatatttgatctattgt

SEQ ID NO: 203751 - DNA, 24 bp, Artificial sequence
  SiRNA target sequence
gctaccaatatttgatctattgta

SEQ ID NO: 203752 - DNA, 24 bp, Artificial sequence
  SiRNA target sequence
ctaccaatatttgatctattgtat

SEQ ID NO: 203753 - DNA, 24 bp, Artificial sequence
  SiRNA target sequence
taccaatatttgatctattgtatt

SEQ ID NO: 203754 - DNA, 24 bp, Artificial sequence
  SiRNA target sequence
accaatatttgatctattgtatta

SEQ ID NO: 203755 - DNA, 24 bp, Artificial sequence
  SiRNA target sequence
ccaatatttgatctattgtattaa

SEQ ID NO: 203756 - DNA, 24 bp, Artificial sequence
  SiRNA target sequence
caatatttgatctattgtattaaa

SEQ ID NO: 203757 - DNA, 24 bp, Artificial sequence
  SiRNA target sequence
aatatttgatctattgtattaaat

SEQ ID NO: 203758 - DNA, 24 bp, Artificial sequence
  SiRNA target sequence
atatttgatctattgtattaaatt

SEQ ID NO: 203759 - DNA, 24 bp, Artificial sequence
  SiRNA target sequence
tatttgatctattgtattaaattt

SEQ ID NO: 203760 - DNA, 24 bp, Artificial sequence
  SiRNA target sequence
atttgatctattgtattaaatttg

SEQ ID NO: 203761 - DNA, 24 bp, Artificial sequence
  SiRNA target sequence
tttgatctattgtattaaatttgc

SEQ ID NO: 203762 - DNA, 24 bp, Artificial sequence
  SiRNA target sequence
ttgatctattgtattaaatttgcc

SEQ ID NO: 203763 - DNA, 24 bp, Artificial sequence
  SiRNA target sequence
tgatctattgtattaaatttgccg

SEQ ID NO: 203764 - DNA, 24 bp, Artificial sequence
  SiRNA target sequence
gatctattgtattaaatttgccgg

SEQ ID NO: 203765 - DNA, 24 bp, Artificial sequence
  SiRNA target sequence
atctattgtattaaatttgccgga

SEQ ID NO: 203766 - DNA, 24 bp, Artificial sequence
  SiRNA target sequence
tctattgtattaaatttgccggag

SEQ ID NO: 203767 - DNA, 24 bp, Artificial sequence
  SiRNA target sequence
ctattgtattaaatttgccggagt

SEQ ID NO: 203768 - DNA, 24 bp, Artificial sequence
  SiRNA target sequence
tattgtattaaatttgccggagta

SEQ ID NO: 203769 - DNA, 24 bp, Artificial sequence
  SiRNA target sequence
attgtattaaatttgccggagtat

SEQ ID NO: 203770 - DNA, 24 bp, Artificial sequence
  SiRNA target sequence
ttgtattaaatttgccggagtatt

SEQ ID NO: 203771 - DNA, 24 bp, Artificial sequence
  SiRNA target sequence
tgtattaaatttgccggagtattc

SEQ ID NO: 203772 - DNA, 24 bp, Artificial sequence
  SiRNA target sequence
gtattaaatttgccggagtattct

SEQ ID NO: 203773 - DNA, 24 bp, Artificial sequence
  SiRNA target sequence
tattaaatttgccggagtattctc

SEQ ID NO: 203774 - DNA, 24 bp, Artificial sequence
  SiRNA target sequence
attaaatttgccggagtattctcc

SEQ ID NO: 203775 - DNA, 24 bp, Artificial sequence
  SiRNA target sequence
ttaaatttgccggagtattctcct

SEQ ID NO: 203776 - DNA, 24 bp, Artificial sequence
  SiRNA target sequence
taaatttgccggagtattctccta

SEQ ID NO: 203777 - DNA, 24 bp, Artificial sequence
  SiRNA target sequence
aaatttgccggagtattctcctac

SEQ ID NO: 203778 - DNA, 24 bp, Artificial sequence
  SiRNA target sequence
aatttgccggagtattctcctacc

SEQ ID NO: 203779 - DNA, 24 bp, Artificial sequence
  SiRNA target sequence
atttgccggagtattctcctacct

SEQ ID NO: 203780 - DNA, 24 bp, Artificial sequence
  SiRNA target sequence
tttgccggagtattctcctacctc

SEQ ID NO: 203781 - DNA, 24 bp, Artificial sequence
  SiRNA target sequence
ttgccggagtattctcctacctct

SEQ ID NO: 203782 - DNA, 24 bp, Artificial sequence
  SiRNA target sequence
tgccggagtattctcctacctcta

SEQ ID NO: 203783 - DNA, 24 bp, Artificial sequence
  SiRNA target sequence
gccggagtattctcctacctctaa

SEQ ID NO: 203784 - DNA, 24 bp, Artificial sequence
  SiRNA target sequence
ccggagtattctcctacctctaat

SEQ ID NO: 203785 - DNA, 24 bp, Artificial sequence
  SiRNA target sequence
cggagtattctcctacctctaatc

SEQ ID NO: 203786 - DNA, 24 bp, Artificial sequence
  SiRNA target sequence
ggagtattctcctacctctaatcc

SEQ ID NO: 203787 - DNA, 24 bp, Artificial sequence
  SiRNA target sequence
gagtattctcctacctctaatcct

SEQ ID NO: 203788 - DNA, 24 bp, Artificial sequence
  SiRNA target sequence
agtattctcctacctctaatccta

SEQ ID NO: 203789 - DNA, 24 bp, Artificial sequence
  SiRNA target sequence
gtattctcctacctctaatcctaa

SEQ ID NO: 203790 - DNA, 24 bp, Artificial sequence
  SiRNA target sequence
tattctcctacctctaatcctaaa

SEQ ID NO: 203791 - DNA, 24 bp, Artificial sequence
  SiRNA target sequence
attctcctacctctaatcctaaac

SEQ ID NO: 203792 - DNA, 24 bp, Artificial sequence
  SiRNA target sequence
ttctcctacctctaatcctaaact

SEQ ID NO: 203793 - DNA, 24 bp, Artificial sequence
  SiRNA target sequence
tctcctacctctaatcctaaactt

SEQ ID NO: 203794 - DNA, 24 bp, Artificial sequence
  SiRNA target sequence
ctcctacctctaatcctaaacttt

SEQ ID NO: 203795 - DNA, 24 bp, Artificial sequence
  SiRNA target sequence
tcctacctctaatcctaaactttt

SEQ ID NO: 203796 - DNA, 24 bp, Artificial sequence
  SiRNA target sequence
cctacctctaatcctaaacttttt

SEQ ID NO: 203797 - DNA, 24 bp, Artificial sequence
  SiRNA target sequence
ctacctctaatcctaaactttttg

SEQ ID NO: 203798 - DNA, 24 bp, Artificial sequence
  SiRNA target sequence
tacctctaatcctaaactttttga

SEQ ID NO: 203799 - DNA, 24 bp, Artificial sequence
  SiRNA target sequence
acctctaatcctaaactttttgac

SEQ ID NO: 203800 - DNA, 24 bp, Artificial sequence
  SiRNA target sequence
cctctaatcctaaactttttgacg

SEQ ID NO: 203801 - DNA, 24 bp, Artificial sequence
  SiRNA target sequence
ctctaatcctaaactttttgacgc

SEQ ID NO: 203802 - DNA, 24 bp, Artificial sequence
  SiRNA target sequence
tctaatcctaaactttttgacgca

SEQ ID NO: 203803 - DNA, 24 bp, Artificial sequence
  SiRNA target sequence
ctaatcctaaactttttgacgcag

SEQ ID NO: 203804 - DNA, 24 bp, Artificial sequence
  SiRNA target sequence
taatcctaaactttttgacgcagc

SEQ ID NO: 203805 - DNA, 24 bp, Artificial sequence
  SiRNA target sequence
aatcctaaactttttgacgcagct

SEQ ID NO: 203806 - DNA, 24 bp, Artificial sequence
  SiRNA target sequence
atcctaaactttttgacgcagctt

SEQ ID NO: 203807 - DNA, 24 bp, Artificial sequence
  SiRNA target sequence
tcctaaactttttgacgcagcttt

SEQ ID NO: 203808 - DNA, 24 bp, Artificial sequence
  SiRNA target sequence
cctaaactttttgacgcagcttta

SEQ ID NO: 203809 - DNA, 24 bp, Artificial sequence
  SiRNA target sequence
ctaaactttttgacgcagctttaa

SEQ ID NO: 203810 - DNA, 24 bp, Artificial sequence
  SiRNA target sequence
taaactttttgacgcagctttaat

SEQ ID NO: 203811 - DNA, 24 bp, Artificial sequence
  SiRNA target sequence
aaactttttgacgcagctttaatt

SEQ ID NO: 203812 - DNA, 24 bp, Artificial sequence
  SiRNA target sequence
aactttttgacgcagctttaattc

SEQ ID NO: 203813 - DNA, 24 bp, Artificial sequence
  SiRNA target sequence
actttttgacgcagctttaattcc

SEQ ID NO: 203814 - DNA, 24 bp, Artificial sequence
  SiRNA target sequence
ctttttgacgcagctttaattcct

SEQ ID NO: 203815 - DNA, 24 bp, Artificial sequence
  SiRNA target sequence
tttttgacgcagctttaattcctg

SEQ ID NO: 203816 - DNA, 24 bp, Artificial sequence
  SiRNA target sequence
ttttgacgcagctttaattcctgc

SEQ ID NO: 203817 - DNA, 24 bp, Artificial sequence
  SiRNA target sequence
tttgacgcagctttaattcctgct

SEQ ID NO: 203818 - DNA, 24 bp, Artificial sequence
  SiRNA target sequence
ttgacgcagctttaattcctgctt

SEQ ID NO: 203819 - DNA, 24 bp, Artificial sequence
  SiRNA target sequence
tgacgcagctttaattcctgcttt

SEQ ID NO: 203820 - DNA, 24 bp, Artificial sequence
  SiRNA target sequence
gacgcagctttaattcctgcttta

SEQ ID NO: 203821 - DNA, 24 bp, Artificial sequence
  SiRNA target sequence
acgcagctttaattcctgctttat

SEQ ID NO: 203822 - DNA, 24 bp, Artificial sequence
  SiRNA target sequence
cgcagctttaattcctgctttata

SEQ ID NO: 203823 - DNA, 24 bp, Artificial sequence
  SiRNA target sequence
gcagctttaattcctgctttatag

SEQ ID NO: 203824 - DNA, 24 bp, Artificial sequence
  SiRNA target sequence
cagctttaattcctgctttataga

SEQ ID NO: 203825 - DNA, 24 bp, Artificial sequence
  SiRNA target sequence
agctttaattcctgctttatagac

SEQ ID NO: 203826 - DNA, 24 bp, Artificial sequence
  SiRNA target sequence
gctttaattcctgctttatagaca

SEQ ID NO: 203827 - DNA, 24 bp, Artificial sequence
  SiRNA target sequence
ctttaattcctgctttatagacag

SEQ ID NO: 203828 - DNA, 24 bp, Artificial sequence
  SiRNA target sequence
tttaattcctgctttatagacaga

SEQ ID NO: 203829 - DNA, 24 bp, Artificial sequence
  SiRNA target sequence
ttaattcctgctttatagacagat

SEQ ID NO: 203830 - DNA, 24 bp, Artificial sequence
  SiRNA target sequence
taattcctgctttatagacagatt

SEQ ID NO: 203831 - DNA, 24 bp, Artificial sequence
  SiRNA target sequence
aattcctgctttatagacagattc

SEQ ID NO: 203832 - DNA, 24 bp, Artificial sequence
  SiRNA target sequence
attcctgctttatagacagattca

SEQ ID NO: 203833 - DNA, 24 bp, Artificial sequence
  SiRNA target sequence
ttcctgctttatagacagattcaa

SEQ ID NO: 203834 - DNA, 24 bp, Artificial sequence
  SiRNA target sequence
tcctgctttatagacagattcaat

SEQ ID NO: 203835 - DNA, 24 bp, Artificial sequence
  SiRNA target sequence
cctgctttatagacagattcaatt

SEQ ID NO: 203836 - DNA, 24 bp, Artificial sequence
  SiRNA target sequence
ctgctttatagacagattcaatta

SEQ ID NO: 203837 - DNA, 24 bp, Artificial sequence
  SiRNA target sequence
tgctttatagacagattcaattaa

SEQ ID NO: 203838 - DNA, 24 bp, Artificial sequence
  SiRNA target sequence
gctttatagacagattcaattaaa

SEQ ID NO: 203839 - DNA, 24 bp, Artificial sequence
  SiRNA target sequence
ctttatagacagattcaattaaat

SEQ ID NO: 203840 - DNA, 24 bp, Artificial sequence
  SiRNA target sequence
tttatagacagattcaattaaatt

SEQ ID NO: 203841 - DNA, 24 bp, Artificial sequence
  SiRNA target sequence
ttatagacagattcaattaaatta

SEQ ID NO: 203842 - DNA, 24 bp, Artificial sequence
  SiRNA target sequence
tatagacagattcaattaaattaa

SEQ ID NO: 203843 - DNA, 24 bp, Artificial sequence
  SiRNA target sequence
atagacagattcaattaaattaaa

SEQ ID NO: 203844 - DNA, 24 bp, Artificial sequence
  SiRNA target sequence
tagacagattcaattaaattaaat

SEQ ID NO: 203845 - DNA, 24 bp, Artificial sequence
  SiRNA target sequence
agacagattcaattaaattaaatg

SEQ ID NO: 203846 - DNA, 24 bp, Artificial sequence
  SiRNA target sequence
gacagattcaattaaattaaatgt

SEQ ID NO: 203847 - DNA, 24 bp, Artificial sequence
  SiRNA target sequence
acagattcaattaaattaaatgtt

SEQ ID NO: 203848 - DNA, 24 bp, Artificial sequence
  SiRNA target sequence
cagattcaattaaattaaatgtta

SEQ ID NO: 203849 - DNA, 24 bp, Artificial sequence
  SiRNA target sequence
agattcaattaaattaaatgttat

SEQ ID NO: 203850 - DNA, 24 bp, Artificial sequence
  SiRNA target sequence
gattcaattaaattaaatgttata

SEQ ID NO: 203851 - DNA, 24 bp, Artificial sequence
  SiRNA target sequence
attcaattaaattaaatgttatat

SEQ ID NO: 203852 - DNA, 24 bp, Artificial sequence
  SiRNA target sequence
ttcaattaaattaaatgttatatt

SEQ ID NO: 203853 - DNA, 24 bp, Artificial sequence
  SiRNA target sequence
tcaattaaattaaatgttatattg

SEQ ID NO: 203854 - DNA, 24 bp, Artificial sequence
  SiRNA target sequence
caattaaattaaatgttatattgt

SEQ ID NO: 203855 - DNA, 24 bp, Artificial sequence
  SiRNA target sequence
aattaaattaaatgttatattgta

SEQ ID NO: 203856 - DNA, 24 bp, Artificial sequence
  SiRNA target sequence
attaaattaaatgttatattgtaa

SEQ ID NO: 203857 - DNA, 24 bp, Artificial sequence
  SiRNA target sequence
ttaaattaaatgttatattgtaaa

SEQ ID NO: 203858 - DNA, 24 bp, Artificial sequence
  SiRNA target sequence
taaattaaatgttatattgtaaaa

SEQ ID NO: 203859 - DNA, 24 bp, Artificial sequence
  SiRNA target sequence
aaattaaatgttatattgtaaaaa

SEQ ID NO: 203860 - DNA, 24 bp, Artificial sequence
  SiRNA target sequence
aattaaatgttatattgtaaaaaa

SEQ ID NO: 203861 - DNA, 24 bp, Artificial sequence
  SiRNA target sequence
attaaatgttatattgtaaaaaaa

SEQ ID NO: 203862 - DNA, 24 bp, Artificial sequence
  SiRNA target sequence
ttaaatgttatattgtaaaaaaag

SEQ ID NO: 203863 - DNA, 24 bp, Artificial sequence
  SiRNA target sequence
taaatgttatattgtaaaaaaaga

SEQ ID NO: 203864 - DNA, 24 bp, Artificial sequence
  SiRNA target sequence
aaatgttatattgtaaaaaaagac

SEQ ID NO: 203865 - DNA, 24 bp, Artificial sequence
  SiRNA target sequence
aatgttatattgtaaaaaaagact

SEQ ID NO: 203866 - DNA, 24 bp, Artificial sequence
  SiRNA target sequence
atgttatattgtaaaaaaagacta

SEQ ID NO: 203867 - DNA, 24 bp, Artificial sequence
  SiRNA target sequence
tgttatattgtaaaaaaagactat

SEQ ID NO: 203868 - DNA, 24 bp, Artificial sequence
  SiRNA target sequence
gttatattgtaaaaaaagactatt

SEQ ID NO: 203869 - DNA, 24 bp, Artificial sequence
  SiRNA target sequence
ttatattgtaaaaaaagactatta

SEQ ID NO: 203870 - DNA, 24 bp, Artificial sequence
  SiRNA target sequence
tatattgtaaaaaaagactattat

SEQ ID NO: 203871 - DNA, 24 bp, Artificial sequence
  SiRNA target sequence
atattgtaaaaaaagactattata

SEQ ID NO: 203872 - DNA, 24 bp, Artificial sequence
  SiRNA target sequence
tattgtaaaaaaagactattatac

SEQ ID NO: 203873 - DNA, 24 bp, Artificial sequence
  SiRNA target sequence
attgtaaaaaaagactattataca

SEQ ID NO: 203874 - DNA, 24 bp, Artificial sequence
  SiRNA target sequence
ttgtaaaaaaagactattatacaa

SEQ ID NO: 203875 - DNA, 24 bp, Artificial sequence
  SiRNA target sequence
tgtaaaaaaagactattatacaaa

SEQ ID NO: 203876 - DNA, 24 bp, Artificial sequence
  SiRNA target sequence
gtaaaaaaagactattatacaaag

SEQ ID NO: 203877 - DNA, 24 bp, Artificial sequence
  SiRNA target sequence
taaaaaaagactattatacaaagt

SEQ ID NO: 203878 - DNA, 24 bp, Artificial sequence
  SiRNA target sequence
aaaaaaagactattatacaaagtg

SEQ ID NO: 203879 - DNA, 24 bp, Artificial sequence
  SiRNA target sequence
aaaaaagactattatacaaagtga

SEQ ID NO: 203880 - DNA, 24 bp, Artificial sequence
  SiRNA target sequence
aaaaagactattatacaaagtgac

SEQ ID NO: 203881 - DNA, 24 bp, Artificial sequence
  SiRNA target sequence
aaaagactattatacaaagtgaca

SEQ ID NO: 203882 - DNA, 24 bp, Artificial sequence
  SiRNA target sequence
aaagactattatacaaagtgacat

SEQ ID NO: 203883 - DNA, 24 bp, Artificial sequence
  SiRNA target sequence
aagactattatacaaagtgacatt

SEQ ID NO: 203884 - DNA, 24 bp, Artificial sequence
  SiRNA target sequence
agactattatacaaagtgacatta

SEQ ID NO: 203885 - DNA, 24 bp, Artificial sequence
  SiRNA target sequence
gactattatacaaagtgacattaa

SEQ ID NO: 203886 - DNA, 24 bp, Artificial sequence
  SiRNA target sequence
actattatacaaagtgacattaat

SEQ ID NO: 203887 - DNA, 24 bp, Artificial sequence
  SiRNA target sequence
ctattatacaaagtgacattaata

SEQ ID NO: 203888 - DNA, 24 bp, Artificial sequence
  SiRNA target sequence
tattatacaaagtgacattaataa

SEQ ID NO: 203889 - DNA, 24 bp, Artificial sequence
  SiRNA target sequence
attatacaaagtgacattaataat

SEQ ID NO: 203890 - DNA, 24 bp, Artificial sequence
  SiRNA target sequence
ttatacaaagtgacattaataatt

SEQ ID NO: 203891 - DNA, 24 bp, Artificial sequence
  SiRNA target sequence
tatacaaagtgacattaataattt

SEQ ID NO: 203892 - DNA, 24 bp, Artificial sequence
  SiRNA target sequence
atacaaagtgacattaataatttt

SEQ ID NO: 203893 - DNA, 24 bp, Artificial sequence
  SiRNA target sequence
tacaaagtgacattaataattttg

SEQ ID NO: 203894 - DNA, 24 bp, Artificial sequence
  SiRNA target sequence
acaaagtgacattaataattttga

SEQ ID NO: 203895 - DNA, 24 bp, Artificial sequence
  SiRNA target sequence
caaagtgacattaataattttgat

SEQ ID NO: 203896 - DNA, 24 bp, Artificial sequence
  SiRNA target sequence
aaagtgacattaataattttgatt

SEQ ID NO: 203897 - DNA, 24 bp, Artificial sequence
  SiRNA target sequence
aagtgacattaataattttgattt

SEQ ID NO: 203898 - DNA, 24 bp, Artificial sequence
  SiRNA target sequence
agtgacattaataattttgatttc

SEQ ID NO: 203899 - DNA, 24 bp, Artificial sequence
  SiRNA target sequence
gtgacattaataattttgatttca

SEQ ID NO: 203900 - DNA, 24 bp, Artificial sequence
  SiRNA target sequence
tgacattaataattttgatttcat

SEQ ID NO: 203901 - DNA, 24 bp, Artificial sequence
  SiRNA target sequence
gacattaataattttgatttcatc

SEQ ID NO: 203902 - DNA, 24 bp, Artificial sequence
  SiRNA target sequence
acattaataattttgatttcatca

SEQ ID NO: 203903 - DNA, 24 bp, Artificial sequence
  SiRNA target sequence
cattaataattttgatttcatcat

SEQ ID NO: 203904 - DNA, 24 bp, Artificial sequence
  SiRNA target sequence
attaataattttgatttcatcatt

SEQ ID NO: 203905 - DNA, 24 bp, Artificial sequence
  SiRNA target sequence
ttaataattttgatttcatcatta

SEQ ID NO: 203906 - DNA, 24 bp, Artificial sequence
  SiRNA target sequence
taataattttgatttcatcattat

SEQ ID NO: 203907 - DNA, 24 bp, Artificial sequence
  SiRNA target sequence
aataattttgatttcatcattata

SEQ ID NO: 203908 - DNA, 24 bp, Artificial sequence
  SiRNA target sequence
ataattttgatttcatcattatac

SEQ ID NO: 203909 - DNA, 24 bp, Artificial sequence
  SiRNA target sequence
taattttgatttcatcattatact

SEQ ID NO: 203910 - DNA, 24 bp, Artificial sequence
  SiRNA target sequence
aattttgatttcatcattatacta

SEQ ID NO: 203911 - DNA, 24 bp, Artificial sequence
  SiRNA target sequence
attttgatttcatcattatactaa

SEQ ID NO: 203912 - DNA, 24 bp, Artificial sequence
  SiRNA target sequence
ttttgatttcatcattatactaat

SEQ ID NO: 203913 - DNA, 24 bp, Artificial sequence
  SiRNA target sequence
tttgatttcatcattatactaata

SEQ ID NO: 203914 - DNA, 24 bp, Artificial sequence
  SiRNA target sequence
ttgatttcatcattatactaatac

SEQ ID NO: 203915 - DNA, 24 bp, Artificial sequence
  SiRNA target sequence
tgatttcatcattatactaatacc

SEQ ID NO: 203916 - DNA, 24 bp, Artificial sequence
  SiRNA target sequence
gatttcatcattatactaatacct

SEQ ID NO: 203917 - DNA, 24 bp, Artificial sequence
  SiRNA target sequence
atttcatcattatactaatacctt

SEQ ID NO: 203918 - DNA, 24 bp, Artificial sequence
  SiRNA target sequence
tttcatcattatactaataccttc

SEQ ID NO: 203919 - DNA, 24 bp, Artificial sequence
  SiRNA target sequence
ttcatcattatactaataccttcg

SEQ ID NO: 203920 - DNA, 24 bp, Artificial sequence
  SiRNA target sequence
tcatcattatactaataccttcgg

SEQ ID NO: 203921 - DNA, 24 bp, Artificial sequence
  SiRNA target sequence
catcattatactaataccttcgga

SEQ ID NO: 203922 - DNA, 24 bp, Artificial sequence
  SiRNA target sequence
atcattatactaataccttcggag

SEQ ID NO: 203923 - DNA, 24 bp, Artificial sequence
  SiRNA target sequence
tcattatactaataccttcggaga

SEQ ID NO: 203924 - DNA, 24 bp, Artificial sequence
  SiRNA target sequence
cattatactaataccttcggagaa

SEQ ID NO: 203925 - DNA, 24 bp, Artificial sequence
  SiRNA target sequence
attatactaataccttcggagaaa

SEQ ID NO: 203926 - DNA, 24 bp, Artificial sequence
  SiRNA target sequence
ttatactaataccttcggagaaac

SEQ ID NO: 203927 - DNA, 24 bp, Artificial sequence
  SiRNA target sequence
tatactaataccttcggagaaacc

SEQ ID NO: 203928 - DNA, 24 bp, Artificial sequence
  SiRNA target sequence
atactaataccttcggagaaacct

SEQ ID NO: 203929 - DNA, 24 bp, Artificial sequence
  SiRNA target sequence
tactaataccttcggagaaaccta

SEQ ID NO: 203930 - DNA, 24 bp, Artificial sequence
  SiRNA target sequence
actaataccttcggagaaacctac

SEQ ID NO: 203931 - DNA, 24 bp, Artificial sequence
  SiRNA target sequence
ctaataccttcggagaaacctaca

SEQ ID NO: 203932 - DNA, 24 bp, Artificial sequence
  SiRNA target sequence
taataccttcggagaaacctacac

SEQ ID NO: 203933 - DNA, 24 bp, Artificial sequence
  SiRNA target sequence
aataccttcggagaaacctacact

SEQ ID NO: 203934 - DNA, 24 bp, Artificial sequence
  SiRNA target sequence
ataccttcggagaaacctacacta

SEQ ID NO: 203935 - DNA, 24 bp, Artificial sequence
  SiRNA target sequence
taccttcggagaaacctacactaa

SEQ ID NO: 203936 - DNA, 24 bp, Artificial sequence
  SiRNA target sequence
accttcggagaaacctacactaac

SEQ ID NO: 203937 - DNA, 24 bp, Artificial sequence
  SiRNA target sequence
ccttcggagaaacctacactaact

SEQ ID NO: 203938 - DNA, 24 bp, Artificial sequence
  SiRNA target sequence
cttcggagaaacctacactaactt

SEQ ID NO: 203939 - DNA, 24 bp, Artificial sequence
  SiRNA target sequence
ttcggagaaacctacactaacttt

SEQ ID NO: 203940 - DNA, 24 bp, Artificial sequence
  SiRNA target sequence
tcggagaaacctacactaactttt

SEQ ID NO: 203941 - DNA, 24 bp, Artificial sequence
  SiRNA target sequence
cggagaaacctacactaacttttt

SEQ ID NO: 203942 - DNA, 24 bp, Artificial sequence
  SiRNA target sequence
ggagaaacctacactaactttttg

SEQ ID NO: 203943 - DNA, 24 bp, Artificial sequence
  SiRNA target sequence
gagaaacctacactaactttttgt

SEQ ID NO: 203944 - DNA, 24 bp, Artificial sequence
  SiRNA target sequence
agaaacctacactaactttttgtt

SEQ ID NO: 203945 - DNA, 24 bp, Artificial sequence
  SiRNA target sequence
gaaacctacactaactttttgttt

SEQ ID NO: 203946 - DNA, 24 bp, Artificial sequence
  SiRNA target sequence
aaacctacactaactttttgtttc

SEQ ID NO: 203947 - DNA, 24 bp, Artificial sequence
  SiRNA target sequence
aacctacactaactttttgtttct

SEQ ID NO: 203948 - DNA, 24 bp, Artificial sequence
  SiRNA target sequence
acctacactaactttttgtttctt

SEQ ID NO: 203949 - DNA, 24 bp, Artificial sequence
  SiRNA target sequence
cctacactaactttttgtttcttt

SEQ ID NO: 203950 - DNA, 24 bp, Artificial sequence
  SiRNA target sequence
ctacactaactttttgtttctttt

SEQ ID NO: 203951 - DNA, 24 bp, Artificial sequence
  SiRNA target sequence
tacactaactttttgtttcttttt

SEQ ID NO: 203952 - DNA, 24 bp, Artificial sequence
  SiRNA target sequence
acactaactttttgtttctttttt

SEQ ID NO: 203953 - DNA, 24 bp, Artificial sequence
  SiRNA target sequence
cactaactttttgtttctttttta

SEQ ID NO: 203954 - DNA, 24 bp, Artificial sequence
  SiRNA target sequence
actaactttttgtttcttttttat

SEQ ID NO: 203955 - DNA, 24 bp, Artificial sequence
  SiRNA target sequence
ctaactttttgtttcttttttatc

SEQ ID NO: 203956 - DNA, 24 bp, Artificial sequence
  SiRNA target sequence
taactttttgtttcttttttatcg

SEQ ID NO: 203957 - DNA, 24 bp, Artificial sequence
  SiRNA target sequence
aactttttgtttcttttttatcgt

SEQ ID NO: 203958 - DNA, 24 bp, Artificial sequence
  SiRNA target sequence
actttttgtttcttttttatcgta

SEQ ID NO: 203959 - DNA, 24 bp, Artificial sequence
  SiRNA target sequence
ctttttgtttcttttttatcgtat

SEQ ID NO: 203960 - DNA, 24 bp, Artificial sequence
  SiRNA target sequence
tttttgtttcttttttatcgtatt

SEQ ID NO: 203961 - DNA, 24 bp, Artificial sequence
  SiRNA target sequence
ttttgtttcttttttatcgtatta

SEQ ID NO: 203962 - DNA, 24 bp, Artificial sequence
  SiRNA target sequence
tttgtttcttttttatcgtattag

SEQ ID NO: 203963 - DNA, 24 bp, Artificial sequence
  SiRNA target sequence
ttgtttcttttttatcgtattaga

SEQ ID NO: 203964 - DNA, 24 bp, Artificial sequence
  SiRNA target sequence
tgtttcttttttatcgtattagaa

SEQ ID NO: 203965 - DNA, 24 bp, Artificial sequence
  SiRNA target sequence
gtttcttttttatcgtattagaag

SEQ ID NO: 203966 - DNA, 24 bp, Artificial sequence
  SiRNA target sequence
tttcttttttatcgtattagaagg

SEQ ID NO: 203967 - DNA, 24 bp, Artificial sequence
  SiRNA target sequence
ttcttttttatcgtattagaaggt

SEQ ID NO: 203968 - DNA, 24 bp, Artificial sequence
  SiRNA target sequence
tcttttttatcgtattagaaggta

SEQ ID NO: 203969 - DNA, 24 bp, Artificial sequence
  SiRNA target sequence
cttttttatcgtattagaaggtat

SEQ ID NO: 203970 - DNA, 24 bp, Artificial sequence
  SiRNA target sequence
ttttttatcgtattagaaggtata

SEQ ID NO: 203971 - DNA, 24 bp, Artificial sequence
  SiRNA target sequence
tttttatcgtattagaaggtataa

SEQ ID NO: 203972 - DNA, 24 bp, Artificial sequence
  SiRNA target sequence
ttttatcgtattagaaggtataaa

SEQ ID NO: 203973 - DNA, 24 bp, Artificial sequence
  SiRNA target sequence
tttatcgtattagaaggtataaat

SEQ ID NO: 203974 - DNA, 24 bp, Artificial sequence
  SiRNA target sequence
ttatcgtattagaaggtataaata

SEQ ID NO: 203975 - DNA, 24 bp, Artificial sequence
  SiRNA target sequence
tatcgtattagaaggtataaatat

SEQ ID NO: 203976 - DNA, 24 bp, Artificial sequence
  SiRNA target sequence
atcgtattagaaggtataaatatt

SEQ ID NO: 203977 - DNA, 24 bp, Artificial sequence
  SiRNA target sequence
tcgtattagaaggtataaatattg

SEQ ID NO: 203978 - DNA, 24 bp, Artificial sequence
  SiRNA target sequence
cgtattagaaggtataaatattgg

SEQ ID NO: 203979 - DNA, 24 bp, Artificial sequence
  SiRNA target sequence
gtattagaaggtataaatattggt

SEQ ID NO: 203980 - DNA, 24 bp, Artificial sequence
  SiRNA target sequence
tattagaaggtataaatattggta

SEQ ID NO: 203981 - DNA, 24 bp, Artificial sequence
  SiRNA target sequence
attagaaggtataaatattggtac

SEQ ID NO: 203982 - DNA, 24 bp, Artificial sequence
  SiRNA target sequence
ttagaaggtataaatattggtaca

SEQ ID NO: 203983 - DNA, 24 bp, Artificial sequence
  SiRNA target sequence
tagaaggtataaatattggtacac

SEQ ID NO: 203984 - DNA, 24 bp, Artificial sequence
  SiRNA target sequence
agaaggtataaatattggtacact

SEQ ID NO: 203985 - DNA, 24 bp, Artificial sequence
  SiRNA target sequence
gaaggtataaatattggtacactc

SEQ ID NO: 203986 - DNA, 24 bp, Artificial sequence
  SiRNA target sequence
aaggtataaatattggtacactca

SEQ ID NO: 203987 - DNA, 24 bp, Artificial sequence
  SiRNA target sequence
aggtataaatattggtacactcat

SEQ ID NO: 203988 - DNA, 24 bp, Artificial sequence
  SiRNA target sequence
ggtataaatattggtacactcatt

SEQ ID NO: 203989 - DNA, 24 bp, Artificial sequence
  SiRNA target sequence
gtataaatattggtacactcatta

SEQ ID NO: 203990 - DNA, 24 bp, Artificial sequence
  SiRNA target sequence
tataaatattggtacactcattat

SEQ ID NO: 203991 - DNA, 24 bp, Artificial sequence
  SiRNA target sequence
ataaatattggtacactcattatt

SEQ ID NO: 203992 - DNA, 24 bp, Artificial sequence
  SiRNA target sequence
taaatattggtacactcattattt

SEQ ID NO: 203993 - DNA, 24 bp, Artificial sequence
  SiRNA target sequence
aaatattggtacactcattatttt

SEQ ID NO: 203994 - DNA, 24 bp, Artificial sequence
  SiRNA target sequence
aatattggtacactcattatttta

SEQ ID NO: 203995 - DNA, 24 bp, Artificial sequence
  SiRNA target sequence
atattggtacactcattattttat

SEQ ID NO: 203996 - DNA, 24 bp, Artificial sequence
  SiRNA target sequence
tattggtacactcattattttatt

SEQ ID NO: 203997 - DNA, 24 bp, Artificial sequence
  SiRNA target sequence
attggtacactcattattttattc

SEQ ID NO: 203998 - DNA, 24 bp, Artificial sequence
  SiRNA target sequence
ttggtacactcattattttattct

SEQ ID NO: 203999 - DNA, 24 bp, Artificial sequence
  SiRNA target sequence
tggtacactcattattttattctc

SEQ ID NO: 204000 - DNA, 24 bp, Artificial sequence
  SiRNA target sequence
ggtacactcattattttattctcg

SEQ ID NO: 204001 - DNA, 24 bp, Artificial sequence
  SiRNA target sequence
gtacactcattattttattctcga

SEQ ID NO: 204002 - DNA, 24 bp, Artificial sequence
  SiRNA target sequence
tacactcattattttattctcgaa

SEQ ID NO: 204003 - DNA, 24 bp, Artificial sequence
  SiRNA target sequence
acactcattattttattctcgaaa

SEQ ID NO: 204004 - DNA, 24 bp, Artificial sequence
  SiRNA target sequence
cactcattattttattctcgaaat

SEQ ID NO: 204005 - DNA, 24 bp, Artificial sequence
  SiRNA target sequence
actcattattttattctcgaaata

SEQ ID NO: 204006 - DNA, 24 bp, Artificial sequence
  SiRNA target sequence
ctcattattttattctcgaaataa

SEQ ID NO: 204007 - DNA, 24 bp, Artificial sequence
  SiRNA target sequence
tcattattttattctcgaaataat

SEQ ID NO: 204008 - DNA, 24 bp, Artificial sequence
  SiRNA target sequence
cattattttattctcgaaataata

SEQ ID NO: 204009 - DNA, 24 bp, Artificial sequence
  SiRNA target sequence
attattttattctcgaaataatat

SEQ ID NO: 204010 - DNA, 24 bp, Artificial sequence
  SiRNA target sequence
ttattttattctcgaaataatatt

SEQ ID NO: 204011 - DNA, 24 bp, Artificial sequence
  SiRNA target sequence
tattttattctcgaaataatattt

SEQ ID NO: 204012 - DNA, 24 bp, Artificial sequence
  SiRNA target sequence
attttattctcgaaataatatttc

SEQ ID NO: 204013 - DNA, 24 bp, Artificial sequence
  SiRNA target sequence
ttttattctcgaaataatatttca

SEQ ID NO: 204014 - DNA, 24 bp, Artificial sequence
  SiRNA target sequence
tttattctcgaaataatatttcat

SEQ ID NO: 204015 - DNA, 24 bp, Artificial sequence
  SiRNA target sequence
ttattctcgaaataatatttcatg

SEQ ID NO: 204016 - DNA, 24 bp, Artificial sequence
  SiRNA target sequence
tattctcgaaataatatttcatgt

SEQ ID NO: 204017 - DNA, 24 bp, Artificial sequence
  SiRNA target sequence
attctcgaaataatatttcatgta

SEQ ID NO: 204018 - DNA, 24 bp, Artificial sequence
  SiRNA target sequence
ttctcgaaataatatttcatgtac

SEQ ID NO: 204019 - DNA, 24 bp, Artificial sequence
  SiRNA target sequence
tctcgaaataatatttcatgtaca

SEQ ID NO: 204020 - DNA, 24 bp, Artificial sequence
  SiRNA target sequence
ctcgaaataatatttcatgtacat

SEQ ID NO: 204021 - DNA, 24 bp, Artificial sequence
  SiRNA target sequence
tcgaaataatatttcatgtacatt

SEQ ID NO: 204022 - DNA, 24 bp, Artificial sequence
  SiRNA target sequence
cgaaataatatttcatgtacatta

SEQ ID NO: 204023 - DNA, 24 bp, Artificial sequence
  SiRNA target sequence
gaaataatatttcatgtacattaa

SEQ ID NO: 204024 - DNA, 24 bp, Artificial sequence
  SiRNA target sequence
aaataatatttcatgtacattaat

SEQ ID NO: 204025 - DNA, 24 bp, Artificial sequence
  SiRNA target sequence
aataatatttcatgtacattaata

SEQ ID NO: 204026 - DNA, 24 bp, Artificial sequence
  SiRNA target sequence
ataatatttcatgtacattaatat

SEQ ID NO: 204027 - DNA, 24 bp, Artificial sequence
  SiRNA target sequence
taatatttcatgtacattaatatt

SEQ ID NO: 204028 - DNA, 24 bp, Artificial sequence
  SiRNA target sequence
aatatttcatgtacattaatatta

SEQ ID NO: 204029 - DNA, 24 bp, Artificial sequence
  SiRNA target sequence
atatttcatgtacattaatattag

SEQ ID NO: 204030 - DNA, 24 bp, Artificial sequence
  SiRNA target sequence
tatttcatgtacattaatattaga

SEQ ID NO: 204031 - DNA, 24 bp, Artificial sequence
  SiRNA target sequence
atttcatgtacattaatattagac

SEQ ID NO: 204032 - DNA, 24 bp, Artificial sequence
  SiRNA target sequence
tttcatgtacattaatattagaca

SEQ ID NO: 204033 - DNA, 24 bp, Artificial sequence
  SiRNA target sequence
ttcatgtacattaatattagacat

SEQ ID NO: 204034 - DNA, 24 bp, Artificial sequence
  SiRNA target sequence
tcatgtacattaatattagacata

SEQ ID NO: 204035 - DNA, 24 bp, Artificial sequence
  SiRNA target sequence
catgtacattaatattagacatat

SEQ ID NO: 204036 - DNA, 24 bp, Artificial sequence
  SiRNA target sequence
atgtacattaatattagacatata

SEQ ID NO: 204037 - DNA, 24 bp, Artificial sequence
  SiRNA target sequence
tgtacattaatattagacatatac

SEQ ID NO: 204038 - DNA, 24 bp, Artificial sequence
  SiRNA target sequence
gtacattaatattagacatatacc

SEQ ID NO: 204039 - DNA, 24 bp, Artificial sequence
  SiRNA target sequence
tacattaatattagacatataccg

SEQ ID NO: 204040 - DNA, 24 bp, Artificial sequence
  SiRNA target sequence
acattaatattagacatataccgc

SEQ ID NO: 204041 - DNA, 24 bp, Artificial sequence
  SiRNA target sequence
cattaatattagacatataccgcc

SEQ ID NO: 204042 - DNA, 24 bp, Artificial sequence
  SiRNA target sequence
attaatattagacatataccgccc

SEQ ID NO: 204043 - DNA, 24 bp, Artificial sequence
  SiRNA target sequence
ttaatattagacatataccgccca

SEQ ID NO: 204044 - DNA, 24 bp, Artificial sequence
  SiRNA target sequence
taatattagacatataccgcccat

SEQ ID NO: 204045 - DNA, 24 bp, Artificial sequence
  SiRNA target sequence
aatattagacatataccgcccatg

SEQ ID NO: 204046 - DNA, 24 bp, Artificial sequence
  SiRNA target sequence
atattagacatataccgcccatgg

SEQ ID NO: 204047 - DNA, 24 bp, Artificial sequence
  SiRNA target sequence
tattagacatataccgcccatggc

SEQ ID NO: 204048 - DNA, 24 bp, Artificial sequence
  SiRNA target sequence
attagacatataccgcccatggca

SEQ ID NO: 204049 - DNA, 24 bp, Artificial sequence
  SiRNA target sequence
ttagacatataccgcccatggcaa

SEQ ID NO: 204050 - DNA, 24 bp, Artificial sequence
  SiRNA target sequence
tagacatataccgcccatggcaat

SEQ ID NO: 204051 - DNA, 24 bp, Artificial sequence
  SiRNA target sequence
agacatataccgcccatggcaata

SEQ ID NO: 204052 - DNA, 24 bp, Artificial sequence
  SiRNA target sequence
gacatataccgcccatggcaataa

SEQ ID NO: 204053 - DNA, 24 bp, Artificial sequence
  SiRNA target sequence
acatataccgcccatggcaataaa

SEQ ID NO: 204054 - DNA, 24 bp, Artificial sequence
  SiRNA target sequence
catataccgcccatggcaataaaa

SEQ ID NO: 204055 - DNA, 24 bp, Artificial sequence
  SiRNA target sequence
atataccgcccatggcaataaaaa

SEQ ID NO: 204056 - DNA, 24 bp, Artificial sequence
  SiRNA target sequence
tataccgcccatggcaataaaaac

SEQ ID NO: 204057 - DNA, 24 bp, Artificial sequence
  SiRNA target sequence
ataccgcccatggcaataaaaacc

SEQ ID NO: 204058 - DNA, 24 bp, Artificial sequence
  SiRNA target sequence
taccgcccatggcaataaaaaccg

SEQ ID NO: 204059 - DNA, 24 bp, Artificial sequence
  SiRNA target sequence
accgcccatggcaataaaaaccga

SEQ ID NO: 204060 - DNA, 24 bp, Artificial sequence
  SiRNA target sequence
ccgcccatggcaataaaaaccgaa

SEQ ID NO: 204061 - DNA, 24 bp, Artificial sequence
  SiRNA target sequence
cgcccatggcaataaaaaccgaag

SEQ ID NO: 204062 - DNA, 24 bp, Artificial sequence
  SiRNA target sequence
gcccatggcaataaaaaccgaaga

SEQ ID NO: 204063 - DNA, 24 bp, Artificial sequence
  SiRNA target sequence
cccatggcaataaaaaccgaagaa

SEQ ID NO: 204064 - DNA, 24 bp, Artificial sequence
  SiRNA target sequence
ccatggcaataaaaaccgaagaat

SEQ ID NO: 204065 - DNA, 24 bp, Artificial sequence
  SiRNA target sequence
catggcaataaaaaccgaagaata

SEQ ID NO: 204066 - DNA, 24 bp, Artificial sequence
  SiRNA target sequence
atggcaataaaaaccgaagaatat

SEQ ID NO: 204067 - DNA, 24 bp, Artificial sequence
  SiRNA target sequence
tggcaataaaaaccgaagaatata

SEQ ID NO: 204068 - DNA, 24 bp, Artificial sequence
  SiRNA target sequence
ggcaataaaaaccgaagaatataa

SEQ ID NO: 204069 - DNA, 24 bp, Artificial sequence
  SiRNA target sequence
gcaataaaaaccgaagaatataat

SEQ ID NO: 204070 - DNA, 24 bp, Artificial sequence
  SiRNA target sequence
caataaaaaccgaagaatataata

SEQ ID NO: 204071 - DNA, 24 bp, Artificial sequence
  SiRNA target sequence
aataaaaaccgaagaatataataa

SEQ ID NO: 204072 - DNA, 24 bp, Artificial sequence
  SiRNA target sequence
ataaaaaccgaagaatataataac

SEQ ID NO: 204073 - DNA, 24 bp, Artificial sequence
  SiRNA target sequence
taaaaaccgaagaatataataact

SEQ ID NO: 204074 - DNA, 24 bp, Artificial sequence
  SiRNA target sequence
aaaaaccgaagaatataataactg

SEQ ID NO: 204075 - DNA, 24 bp, Artificial sequence
  SiRNA target sequence
aaaaccgaagaatataataactga

SEQ ID NO: 204076 - DNA, 24 bp, Artificial sequence
  SiRNA target sequence
aaaccgaagaatataataactgat

SEQ ID NO: 204077 - DNA, 24 bp, Artificial sequence
  SiRNA target sequence
aaccgaagaatataataactgatt

SEQ ID NO: 204078 - DNA, 24 bp, Artificial sequence
  SiRNA target sequence
accgaagaatataataactgattt

SEQ ID NO: 204079 - DNA, 24 bp, Artificial sequence
  SiRNA target sequence
ccgaagaatataataactgatttt

SEQ ID NO: 204080 - DNA, 24 bp, Artificial sequence
  SiRNA target sequence
cgaagaatataataactgattttg

SEQ ID NO: 204081 - DNA, 24 bp, Artificial sequence
  SiRNA target sequence
gaagaatataataactgattttgc

SEQ ID NO: 204082 - DNA, 24 bp, Artificial sequence
  SiRNA target sequence
aagaatataataactgattttgct

SEQ ID NO: 204083 - DNA, 24 bp, Artificial sequence
  SiRNA target sequence
agaatataataactgattttgctc

SEQ ID NO: 204084 - DNA, 24 bp, Artificial sequence
  SiRNA target sequence
gaatataataactgattttgctca

SEQ ID NO: 204085 - DNA, 24 bp, Artificial sequence
  SiRNA target sequence
aatataataactgattttgctcat

SEQ ID NO: 204086 - DNA, 24 bp, Artificial sequence
  SiRNA target sequence
atataataactgattttgctcata

SEQ ID NO: 204087 - DNA, 24 bp, Artificial sequence
  SiRNA target sequence
tataataactgattttgctcatag

SEQ ID NO: 204088 - DNA, 24 bp, Artificial sequence
  SiRNA target sequence
ataataactgattttgctcatagc

SEQ ID NO: 204089 - DNA, 24 bp, Artificial sequence
  SiRNA target sequence
taataactgattttgctcatagct

SEQ ID NO: 204090 - DNA, 24 bp, Artificial sequence
  SiRNA target sequence
aataactgattttgctcatagcta

SEQ ID NO: 204091 - DNA, 24 bp, Artificial sequence
  SiRNA target sequence
ataactgattttgctcatagctaa

SEQ ID NO: 204092 - DNA, 24 bp, Artificial sequence
  SiRNA target sequence
taactgattttgctcatagctaaa

SEQ ID NO: 204093 - DNA, 24 bp, Artificial sequence
  SiRNA target sequence
aactgattttgctcatagctaaat

SEQ ID NO: 204094 - DNA, 24 bp, Artificial sequence
  SiRNA target sequence
actgattttgctcatagctaaatc

SEQ ID NO: 204095 - DNA, 24 bp, Artificial sequence
  SiRNA target sequence
ctgattttgctcatagctaaatcc

SEQ ID NO: 204096 - DNA, 24 bp, Artificial sequence
  SiRNA target sequence
tgattttgctcatagctaaatcct

SEQ ID NO: 204097 - DNA, 24 bp, Artificial sequence
  SiRNA target sequence
gattttgctcatagctaaatcctt

SEQ ID NO: 204098 - DNA, 24 bp, Artificial sequence
  SiRNA target sequence
attttgctcatagctaaatccttt

SEQ ID NO: 204099 - DNA, 24 bp, Artificial sequence
  SiRNA target sequence
ttttgctcatagctaaatcctttt

SEQ ID NO: 204100 - DNA, 24 bp, Artificial sequence
  SiRNA target sequence
tttgctcatagctaaatccttttc

SEQ ID NO: 204101 - DNA, 24 bp, Artificial sequence
  SiRNA target sequence
ttgctcatagctaaatccttttcg

SEQ ID NO: 204102 - DNA, 24 bp, Artificial sequence
  SiRNA target sequence
tgctcatagctaaatccttttcgc

SEQ ID NO: 204103 - DNA, 24 bp, Artificial sequence
  SiRNA target sequence
gctcatagctaaatccttttcgca

SEQ ID NO: 204104 - DNA, 24 bp, Artificial sequence
  SiRNA target sequence
ctcatagctaaatccttttcgcaa

SEQ ID NO: 204105 - DNA, 24 bp, Artificial sequence
  SiRNA target sequence
tcatagctaaatccttttcgcaat

SEQ ID NO: 204106 - DNA, 24 bp, Artificial sequence
  SiRNA target sequence
catagctaaatccttttcgcaatt

SEQ ID NO: 204107 - DNA, 24 bp, Artificial sequence
  SiRNA target sequence
atagctaaatccttttcgcaattc

SEQ ID NO: 204108 - DNA, 24 bp, Artificial sequence
  SiRNA target sequence
tagctaaatccttttcgcaattct

SEQ ID NO: 204109 - DNA, 24 bp, Artificial sequence
  SiRNA target sequence
agctaaatccttttcgcaattctc

SEQ ID NO: 204110 - DNA, 24 bp, Artificial sequence
  SiRNA target sequence
gctaaatccttttcgcaattctct

SEQ ID NO: 204111 - DNA, 24 bp, Artificial sequence
  SiRNA target sequence
ctaaatccttttcgcaattctctg

SEQ ID NO: 204112 - DNA, 24 bp, Artificial sequence
  SiRNA target sequence
taaatccttttcgcaattctctga

SEQ ID NO: 204113 - DNA, 24 bp, Artificial sequence
  SiRNA target sequence
aaatccttttcgcaattctctgaa

SEQ ID NO: 204114 - DNA, 24 bp, Artificial sequence
  SiRNA target sequence
aatccttttcgcaattctctgaaa

SEQ ID NO: 204115 - DNA, 24 bp, Artificial sequence
  SiRNA target sequence
atccttttcgcaattctctgaaag

SEQ ID NO: 204116 - DNA, 24 bp, Artificial sequence
  SiRNA target sequence
tccttttcgcaattctctgaaaga

SEQ ID NO: 204117 - DNA, 24 bp, Artificial sequence
  SiRNA target sequence
ccttttcgcaattctctgaaagaa

SEQ ID NO: 204118 - DNA, 24 bp, Artificial sequence
  SiRNA target sequence
cttttcgcaattctctgaaagaac

SEQ ID NO: 204119 - DNA, 24 bp, Artificial sequence
  SiRNA target sequence
ttttcgcaattctctgaaagaact

SEQ ID NO: 204120 - DNA, 24 bp, Artificial sequence
  SiRNA target sequence
tttcgcaattctctgaaagaacta

SEQ ID NO: 204121 - DNA, 24 bp, Artificial sequence
  SiRNA target sequence
ttcgcaattctctgaaagaactac

SEQ ID NO: 204122 - DNA, 24 bp, Artificial sequence
  SiRNA target sequence
tcgcaattctctgaaagaactact

SEQ ID NO: 204123 - DNA, 24 bp, Artificial sequence
  SiRNA target sequence
cgcaattctctgaaagaactactg

SEQ ID NO: 204124 - DNA, 24 bp, Artificial sequence
  SiRNA target sequence
gcaattctctgaaagaactactgg

SEQ ID NO: 204125 - DNA, 24 bp, Artificial sequence
  SiRNA target sequence
caattctctgaaagaactactggc

SEQ ID NO: 204126 - DNA, 24 bp, Artificial sequence
  SiRNA target sequence
aattctctgaaagaactactggct

SEQ ID NO: 204127 - DNA, 24 bp, Artificial sequence
  SiRNA target sequence
attctctgaaagaactactggcta

SEQ ID NO: 204128 - DNA, 24 bp, Artificial sequence
  SiRNA target sequence
ttctctgaaagaactactggctaa

SEQ ID NO: 204129 - DNA, 24 bp, Artificial sequence
  SiRNA target sequence
tctctgaaagaactactggctaat

SEQ ID NO: 204130 - DNA, 24 bp, Artificial sequence
  SiRNA target sequence
ctctgaaagaactactggctaatc

SEQ ID NO: 204131 - DNA, 24 bp, Artificial sequence
  SiRNA target sequence
tctgaaagaactactggctaatcc

SEQ ID NO: 204132 - DNA, 24 bp, Artificial sequence
  SiRNA target sequence
ctgaaagaactactggctaatcca

SEQ ID NO: 204133 - DNA, 24 bp, Artificial sequence
  SiRNA target sequence
tgaaagaactactggctaatccag

SEQ ID NO: 204134 - DNA, 24 bp, Artificial sequence
  SiRNA target sequence
gaaagaactactggctaatccaga

SEQ ID NO: 204135 - DNA, 24 bp, Artificial sequence
  SiRNA target sequence
aaagaactactggctaatccagat

SEQ ID NO: 204136 - DNA, 24 bp, Artificial sequence
  SiRNA target sequence
aagaactactggctaatccagata

SEQ ID NO: 204137 - DNA, 24 bp, Artificial sequence
  SiRNA target sequence
agaactactggctaatccagatac

SEQ ID NO: 204138 - DNA, 24 bp, Artificial sequence
  SiRNA target sequence
gaactactggctaatccagatact

SEQ ID NO: 204139 - DNA, 24 bp, Artificial sequence
  SiRNA target sequence
aactactggctaatccagatacta

SEQ ID NO: 204140 - DNA, 24 bp, Artificial sequence
  SiRNA target sequence
actactggctaatccagatactag

SEQ ID NO: 204141 - DNA, 24 bp, Artificial sequence
  SiRNA target sequence
ctactggctaatccagatactagt

SEQ ID NO: 204142 - DNA, 24 bp, Artificial sequence
  SiRNA target sequence
tactggctaatccagatactagta

SEQ ID NO: 204143 - DNA, 24 bp, Artificial sequence
  SiRNA target sequence
actggctaatccagatactagtaa

SEQ ID NO: 204144 - DNA, 24 bp, Artificial sequence
  SiRNA target sequence
ctggctaatccagatactagtaaa

SEQ ID NO: 204145 - DNA, 24 bp, Artificial sequence
  SiRNA target sequence
tggctaatccagatactagtaaag

SEQ ID NO: 204146 - DNA, 24 bp, Artificial sequence
  SiRNA target sequence
ggctaatccagatactagtaaagc

SEQ ID NO: 204147 - DNA, 24 bp, Artificial sequence
  SiRNA target sequence
gctaatccagatactagtaaagct

SEQ ID NO: 204148 - DNA, 24 bp, Artificial sequence
  SiRNA target sequence
ctaatccagatactagtaaagcta

SEQ ID NO: 204149 - DNA, 24 bp, Artificial sequence
  SiRNA target sequence
taatccagatactagtaaagctaa

SEQ ID NO: 204150 - DNA, 24 bp, Artificial sequence
  SiRNA target sequence
aatccagatactagtaaagctaaa

SEQ ID NO: 204151 - DNA, 24 bp, Artificial sequence
  SiRNA target sequence
atccagatactagtaaagctaaat

SEQ ID NO: 204152 - DNA, 24 bp, Artificial sequence
  SiRNA target sequence
tccagatactagtaaagctaaatt

SEQ ID NO: 204153 - DNA, 24 bp, Artificial sequence
  SiRNA target sequence
ccagatactagtaaagctaaattt

SEQ ID NO: 204154 - DNA, 24 bp, Artificial sequence
  SiRNA target sequence
cagatactagtaaagctaaatttg

SEQ ID NO: 204155 - DNA, 24 bp, Artificial sequence
  SiRNA target sequence
agatactagtaaagctaaatttgc

SEQ ID NO: 204156 - DNA, 24 bp, Artificial sequence
  SiRNA target sequence
gatactagtaaagctaaatttgct

SEQ ID NO: 204157 - DNA, 24 bp, Artificial sequence
  SiRNA target sequence
atactagtaaagctaaatttgcta

SEQ ID NO: 204158 - DNA, 24 bp, Artificial sequence
  SiRNA target sequence
tactagtaaagctaaatttgctat

SEQ ID NO: 204159 - DNA, 24 bp, Artificial sequence
  SiRNA target sequence
actagtaaagctaaatttgctatt

SEQ ID NO: 204160 - DNA, 24 bp, Artificial sequence
  SiRNA target sequence
ctagtaaagctaaatttgctatta

SEQ ID NO: 204161 - DNA, 24 bp, Artificial sequence
  SiRNA target sequence
tagtaaagctaaatttgctattat

SEQ ID NO: 204162 - DNA, 24 bp, Artificial sequence
  SiRNA target sequence
agtaaagctaaatttgctattatg

SEQ ID NO: 204163 - DNA, 24 bp, Artificial sequence
  SiRNA target sequence
gtaaagctaaatttgctattatgt

SEQ ID NO: 204164 - DNA, 24 bp, Artificial sequence
  SiRNA target sequence
taaagctaaatttgctattatgta

SEQ ID NO: 204165 - DNA, 24 bp, Artificial sequence
  SiRNA target sequence
aaagctaaatttgctattatgtaa

SEQ ID NO: 204166 - DNA, 24 bp, Artificial sequence
  SiRNA target sequence
aagctaaatttgctattatgtaaa

SEQ ID NO: 204167 - DNA, 24 bp, Artificial sequence
  SiRNA target sequence
agctaaatttgctattatgtaaaa

SEQ ID NO: 204168 - DNA, 24 bp, Artificial sequence
  SiRNA target sequence
gctaaatttgctattatgtaaaaa

SEQ ID NO: 204169 - DNA, 24 bp, Artificial sequence
  SiRNA target sequence
ctaaatttgctattatgtaaaaag

SEQ ID NO: 204170 - DNA, 24 bp, Artificial sequence
  SiRNA target sequence
taaatttgctattatgtaaaaagg

SEQ ID NO: 204171 - DNA, 24 bp, Artificial sequence
  SiRNA target sequence
aaatttgctattatgtaaaaaggt

SEQ ID NO: 204172 - DNA, 24 bp, Artificial sequence
  SiRNA target sequence
aatttgctattatgtaaaaaggtg

SEQ ID NO: 204173 - DNA, 24 bp, Artificial sequence
  SiRNA target sequence
atttgctattatgtaaaaaggtgg

SEQ ID NO: 204174 - DNA, 24 bp, Artificial sequence
  SiRNA target sequence
tttgctattatgtaaaaaggtggt

SEQ ID NO: 204175 - DNA, 24 bp, Artificial sequence
  SiRNA target sequence
ttgctattatgtaaaaaggtggta

SEQ ID NO: 204176 - DNA, 24 bp, Artificial sequence
  SiRNA target sequence
tgctattatgtaaaaaggtggtaa

SEQ ID NO: 204177 - DNA, 24 bp, Artificial sequence
  SiRNA target sequence
gctattatgtaaaaaggtggtaaa

SEQ ID NO: 204178 - DNA, 24 bp, Artificial sequence
  SiRNA target sequence
ctattatgtaaaaaggtggtaaaa

SEQ ID NO: 204179 - DNA, 24 bp, Artificial sequence
  SiRNA target sequence
tattatgtaaaaaggtggtaaaaa

SEQ ID NO: 204180 - DNA, 24 bp, Artificial sequence
  SiRNA target sequence
attatgtaaaaaggtggtaaaaat

SEQ ID NO: 204181 - DNA, 24 bp, Artificial sequence
  SiRNA target sequence
ttatgtaaaaaggtggtaaaaatc

SEQ ID NO: 204182 - DNA, 24 bp, Artificial sequence
  SiRNA target sequence
tatgtaaaaaggtggtaaaaatct

SEQ ID NO: 204183 - DNA, 24 bp, Artificial sequence
  SiRNA target sequence
atgtaaaaaggtggtaaaaatctt

SEQ ID NO: 204184 - DNA, 24 bp, Artificial sequence
  SiRNA target sequence
tgtaaaaaggtggtaaaaatcttg

SEQ ID NO: 204185 - DNA, 24 bp, Artificial sequence
  SiRNA target sequence
gtaaaaaggtggtaaaaatcttgt

SEQ ID NO: 204186 - DNA, 24 bp, Artificial sequence
  SiRNA target sequence
taaaaaggtggtaaaaatcttgta

SEQ ID NO: 204187 - DNA, 24 bp, Artificial sequence
  SiRNA target sequence
aaaaaggtggtaaaaatcttgtaa

SEQ ID NO: 204188 - DNA, 24 bp, Artificial sequence
  SiRNA target sequence
aaaaggtggtaaaaatcttgtaaa

SEQ ID NO: 204189 - DNA, 24 bp, Artificial sequence
  SiRNA target sequence
aaaggtggtaaaaatcttgtaaac

SEQ ID NO: 204190 - DNA, 24 bp, Artificial sequence
  SiRNA target sequence
aaggtggtaaaaatcttgtaaact

SEQ ID NO: 204191 - DNA, 24 bp, Artificial sequence
  SiRNA target sequence
aggtggtaaaaatcttgtaaactg

SEQ ID NO: 204192 - DNA, 24 bp, Artificial sequence
  SiRNA target sequence
ggtggtaaaaatcttgtaaactgt

SEQ ID NO: 204193 - DNA, 24 bp, Artificial sequence
  SiRNA target sequence
gtggtaaaaatcttgtaaactgtc

SEQ ID NO: 204194 - DNA, 24 bp, Artificial sequence
  SiRNA target sequence
tggtaaaaatcttgtaaactgtct

SEQ ID NO: 204195 - DNA, 24 bp, Artificial sequence
  SiRNA target sequence
ggtaaaaatcttgtaaactgtctg

SEQ ID NO: 204196 - DNA, 24 bp, Artificial sequence
  SiRNA target sequence
gtaaaaatcttgtaaactgtctga

SEQ ID NO: 204197 - DNA, 24 bp, Artificial sequence
  SiRNA target sequence
taaaaatcttgtaaactgtctgat

SEQ ID NO: 204198 - DNA, 24 bp, Artificial sequence
  SiRNA target sequence
aaaaatcttgtaaactgtctgata

SEQ ID NO: 204199 - DNA, 24 bp, Artificial sequence
  SiRNA target sequence
aaaatcttgtaaactgtctgatag

SEQ ID NO: 204200 - DNA, 24 bp, Artificial sequence
  SiRNA target sequence
aaatcttgtaaactgtctgatagt

SEQ ID NO: 204201 - DNA, 24 bp, Artificial sequence
  SiRNA target sequence
aatcttgtaaactgtctgatagta

SEQ ID NO: 204202 - DNA, 24 bp, Artificial sequence
  SiRNA target sequence
atcttgtaaactgtctgatagtac

SEQ ID NO: 204203 - DNA, 24 bp, Artificial sequence
  SiRNA target sequence
tcttgtaaactgtctgatagtaca

SEQ ID NO: 204204 - DNA, 24 bp, Artificial sequence
  SiRNA target sequence
cttgtaaactgtctgatagtacaa

SEQ ID NO: 204205 - DNA, 24 bp, Artificial sequence
  SiRNA target sequence
ttgtaaactgtctgatagtacaac

SEQ ID NO: 204206 - DNA, 24 bp, Artificial sequence
  SiRNA target sequence
tgtaaactgtctgatagtacaact

SEQ ID NO: 204207 - DNA, 24 bp, Artificial sequence
  SiRNA target sequence
gtaaactgtctgatagtacaactt

SEQ ID NO: 204208 - DNA, 24 bp, Artificial sequence
  SiRNA target sequence
taaactgtctgatagtacaacttt

SEQ ID NO: 204209 - DNA, 24 bp, Artificial sequence
  SiRNA target sequence
aaactgtctgatagtacaactttc

SEQ ID NO: 204210 - DNA, 24 bp, Artificial sequence
  SiRNA target sequence
aactgtctgatagtacaactttca

SEQ ID NO: 204211 - DNA, 24 bp, Artificial sequence
  SiRNA target sequence
actgtctgatagtacaactttcat

SEQ ID NO: 204212 - DNA, 24 bp, Artificial sequence
  SiRNA target sequence
ctgtctgatagtacaactttcatt

SEQ ID NO: 204213 - DNA, 24 bp, Artificial sequence
  SiRNA target sequence
tgtctgatagtacaactttcattt

SEQ ID NO: 204214 - DNA, 24 bp, Artificial sequence
  SiRNA target sequence
gtctgatagtacaactttcattta

SEQ ID NO: 204215 - DNA, 24 bp, Artificial sequence
  SiRNA target sequence
tctgatagtacaactttcatttaa

SEQ ID NO: 204216 - DNA, 24 bp, Artificial sequence
  SiRNA target sequence
ctgatagtacaactttcatttaaa

SEQ ID NO: 204217 - DNA, 24 bp, Artificial sequence
  SiRNA target sequence
tgatagtacaactttcatttaaaa

SEQ ID NO: 204218 - DNA, 24 bp, Artificial sequence
  SiRNA target sequence
gatagtacaactttcatttaaaaa

SEQ ID NO: 204219 - DNA, 24 bp, Artificial sequence
  SiRNA target sequence
atagtacaactttcatttaaaaaa

SEQ ID NO: 204220 - DNA, 24 bp, Artificial sequence
  SiRNA target sequence
tagtacaactttcatttaaaaaac

SEQ ID NO: 204221 - DNA, 24 bp, Artificial sequence
  SiRNA target sequence
agtacaactttcatttaaaaaact

SEQ ID NO: 204222 - DNA, 24 bp, Artificial sequence
  SiRNA target sequence
gtacaactttcatttaaaaaactc

SEQ ID NO: 204223 - DNA, 24 bp, Artificial sequence
  SiRNA target sequence
tacaactttcatttaaaaaactca

SEQ ID NO: 204224 - DNA, 24 bp, Artificial sequence
  SiRNA target sequence
acaactttcatttaaaaaactcat

SEQ ID NO: 204225 - DNA, 24 bp, Artificial sequence
  SiRNA target sequence
caactttcatttaaaaaactcatg

SEQ ID NO: 204226 - DNA, 24 bp, Artificial sequence
  SiRNA target sequence
aactttcatttaaaaaactcatgt

SEQ ID NO: 204227 - DNA, 24 bp, Artificial sequence
  SiRNA target sequence
actttcatttaaaaaactcatgta

SEQ ID NO: 204228 - DNA, 24 bp, Artificial sequence
  SiRNA target sequence
ctttcatttaaaaaactcatgtat

SEQ ID NO: 204229 - DNA, 24 bp, Artificial sequence
  SiRNA target sequence
tttcatttaaaaaactcatgtata

SEQ ID NO: 204230 - DNA, 24 bp, Artificial sequence
  SiRNA target sequence
ttcatttaaaaaactcatgtataa

SEQ ID NO: 204231 - DNA, 24 bp, Artificial sequence
  SiRNA target sequence
tcatttaaaaaactcatgtataaa

SEQ ID NO: 204232 - DNA, 24 bp, Artificial sequence
  SiRNA target sequence
catttaaaaaactcatgtataaat

SEQ ID NO: 204233 - DNA, 24 bp, Artificial sequence
  SiRNA target sequence
atttaaaaaactcatgtataaata

SEQ ID NO: 204234 - DNA, 24 bp, Artificial sequence
  SiRNA target sequence
tttaaaaaactcatgtataaataa

SEQ ID NO: 204235 - DNA, 24 bp, Artificial sequence
  SiRNA target sequence
ttaaaaaactcatgtataaataag

SEQ ID NO: 204236 - DNA, 24 bp, Artificial sequence
  SiRNA target sequence
taaaaaactcatgtataaataagc

SEQ ID NO: 204237 - DNA, 24 bp, Artificial sequence
  SiRNA target sequence
aaaaaactcatgtataaataagcc

SEQ ID NO: 204238 - DNA, 24 bp, Artificial sequence
  SiRNA target sequence
aaaaactcatgtataaataagcca

SEQ ID NO: 204239 - DNA, 24 bp, Artificial sequence
  SiRNA target sequence
aaaactcatgtataaataagccat

SEQ ID NO: 204240 - DNA, 24 bp, Artificial sequence
  SiRNA target sequence
aaactcatgtataaataagccata

SEQ ID NO: 204241 - DNA, 24 bp, Artificial sequence
  SiRNA target sequence
aactcatgtataaataagccataa

SEQ ID NO: 204242 - DNA, 24 bp, Artificial sequence
  SiRNA target sequence
actcatgtataaataagccataag

SEQ ID NO: 204243 - DNA, 24 bp, Artificial sequence
  SiRNA target sequence
ctcatgtataaataagccataagt

SEQ ID NO: 204244 - DNA, 24 bp, Artificial sequence
  SiRNA target sequence
tcatgtataaataagccataagta

SEQ ID NO: 204245 - DNA, 24 bp, Artificial sequence
  SiRNA target sequence
catgtataaataagccataagtaa

SEQ ID NO: 204246 - DNA, 24 bp, Artificial sequence
  SiRNA target sequence
atgtataaataagccataagtaaa

SEQ ID NO: 204247 - DNA, 24 bp, Artificial sequence
  SiRNA target sequence
tgtataaataagccataagtaaac

SEQ ID NO: 204248 - DNA, 24 bp, Artificial sequence
  SiRNA target sequence
gtataaataagccataagtaaact

SEQ ID NO: 204249 - DNA, 24 bp, Artificial sequence
  SiRNA target sequence
tataaataagccataagtaaactg

SEQ ID NO: 204250 - DNA, 24 bp, Artificial sequence
  SiRNA target sequence
ataaataagccataagtaaactgc

SEQ ID NO: 204251 - DNA, 24 bp, Artificial sequence
  SiRNA target sequence
taaataagccataagtaaactgcc

SEQ ID NO: 204252 - DNA, 24 bp, Artificial sequence
  SiRNA target sequence
aaataagccataagtaaactgccc

SEQ ID NO: 204253 - DNA, 24 bp, Artificial sequence
  SiRNA target sequence
aataagccataagtaaactgcccc

SEQ ID NO: 204254 - DNA, 24 bp, Artificial sequence
  SiRNA target sequence
ataagccataagtaaactgcccca

SEQ ID NO: 204255 - DNA, 24 bp, Artificial sequence
  SiRNA target sequence
taagccataagtaaactgccccac

SEQ ID NO: 204256 - DNA, 24 bp, Artificial sequence
  SiRNA target sequence
aagccataagtaaactgccccaca

SEQ ID NO: 204257 - DNA, 24 bp, Artificial sequence
  SiRNA target sequence
agccataagtaaactgccccacat

SEQ ID NO: 204258 - DNA, 24 bp, Artificial sequence
  SiRNA target sequence
gccataagtaaactgccccacatt

SEQ ID NO: 204259 - DNA, 24 bp, Artificial sequence
  SiRNA target sequence
ccataagtaaactgccccacattt

SEQ ID NO: 204260 - DNA, 24 bp, Artificial sequence
  SiRNA target sequence
cataagtaaactgccccacatttc

SEQ ID NO: 204261 - DNA, 24 bp, Artificial sequence
  SiRNA target sequence
ataagtaaactgccccacatttct

SEQ ID NO: 204262 - DNA, 24 bp, Artificial sequence
  SiRNA target sequence
taagtaaactgccccacatttctg

SEQ ID NO: 204263 - DNA, 24 bp, Artificial sequence
  SiRNA target sequence
aagtaaactgccccacatttctgc

SEQ ID NO: 204264 - DNA, 24 bp, Artificial sequence
  SiRNA target sequence
agtaaactgccccacatttctgct

SEQ ID NO: 204265 - DNA, 24 bp, Artificial sequence
  SiRNA target sequence
gtaaactgccccacatttctgcta

SEQ ID NO: 204266 - DNA, 24 bp, Artificial sequence
  SiRNA target sequence
taaactgccccacatttctgctat

SEQ ID NO: 204267 - DNA, 24 bp, Artificial sequence
  SiRNA target sequence
aaactgccccacatttctgctatt

SEQ ID NO: 204268 - DNA, 24 bp, Artificial sequence
  SiRNA target sequence
aactgccccacatttctgctatta

SEQ ID NO: 204269 - DNA, 24 bp, Artificial sequence
  SiRNA target sequence
actgccccacatttctgctattat

SEQ ID NO: 204270 - DNA, 24 bp, Artificial sequence
  SiRNA target sequence
ctgccccacatttctgctattata

SEQ ID NO: 204271 - DNA, 24 bp, Artificial sequence
  SiRNA target sequence
tgccccacatttctgctattataa

SEQ ID NO: 204272 - DNA, 24 bp, Artificial sequence
  SiRNA target sequence
gccccacatttctgctattataaa

SEQ ID NO: 204273 - DNA, 24 bp, Artificial sequence
  SiRNA target sequence
ccccacatttctgctattataaaa

SEQ ID NO: 204274 - DNA, 24 bp, Artificial sequence
  SiRNA target sequence
cccacatttctgctattataaaaa

SEQ ID NO: 204275 - DNA, 24 bp, Artificial sequence
  SiRNA target sequence
ccacatttctgctattataaaaat

SEQ ID NO: 204276 - DNA, 24 bp, Artificial sequence
  SiRNA target sequence
cacatttctgctattataaaaata

SEQ ID NO: 204277 - DNA, 24 bp, Artificial sequence
  SiRNA target sequence
acatttctgctattataaaaatac

SEQ ID NO: 204278 - DNA, 24 bp, Artificial sequence
  SiRNA target sequence
catttctgctattataaaaataca

SEQ ID NO: 204279 - DNA, 24 bp, Artificial sequence
  SiRNA target sequence
atttctgctattataaaaatacaa

SEQ ID NO: 204280 - DNA, 24 bp, Artificial sequence
  SiRNA target sequence
tttctgctattataaaaatacaag

SEQ ID NO: 204281 - DNA, 24 bp, Artificial sequence
  SiRNA target sequence
ttctgctattataaaaatacaagt

SEQ ID NO: 204282 - DNA, 24 bp, Artificial sequence
  SiRNA target sequence
tctgctattataaaaatacaagtt

SEQ ID NO: 204283 - DNA, 24 bp, Artificial sequence
  SiRNA target sequence
ctgctattataaaaatacaagttg

SEQ ID NO: 204284 - DNA, 24 bp, Artificial sequence
  SiRNA target sequence
tgctattataaaaatacaagttga

SEQ ID NO: 204285 - DNA, 24 bp, Artificial sequence
  SiRNA target sequence
gctattataaaaatacaagttgaa

SEQ ID NO: 204286 - DNA, 24 bp, Artificial sequence
  SiRNA target sequence
ctattataaaaatacaagttgaaa

SEQ ID NO: 204287 - DNA, 24 bp, Artificial sequence
  SiRNA target sequence
tattataaaaatacaagttgaaac

SEQ ID NO: 204288 - DNA, 24 bp, Artificial sequence
  SiRNA target sequence
attataaaaatacaagttgaaacg

SEQ ID NO: 204289 - DNA, 24 bp, Artificial sequence
  SiRNA target sequence
ttataaaaatacaagttgaaacgg

SEQ ID NO: 204290 - DNA, 24 bp, Artificial sequence
  SiRNA target sequence
tataaaaatacaagttgaaacggg

SEQ ID NO: 204291 - DNA, 24 bp, Artificial sequence
  SiRNA target sequence
ataaaaatacaagttgaaacgggc

SEQ ID NO: 204292 - DNA, 24 bp, Artificial sequence
  SiRNA target sequence
taaaaatacaagttgaaacgggct

SEQ ID NO: 204293 - DNA, 24 bp, Artificial sequence
  SiRNA target sequence
aaaaatacaagttgaaacgggctc

SEQ ID NO: 204294 - DNA, 24 bp, Artificial sequence
  SiRNA target sequence
aaaatacaagttgaaacgggctcg

SEQ ID NO: 204295 - DNA, 24 bp, Artificial sequence
  SiRNA target sequence
aaatacaagttgaaacgggctcgt

SEQ ID NO: 204296 - DNA, 24 bp, Artificial sequence
  SiRNA target sequence
aatacaagttgaaacgggctcgtt

SEQ ID NO: 204297 - DNA, 24 bp, Artificial sequence
  SiRNA target sequence
atacaagttgaaacgggctcgtta

SEQ ID NO: 204298 - DNA, 24 bp, Artificial sequence
  SiRNA target sequence
tacaagttgaaacgggctcgttag

SEQ ID NO: 204299 - DNA, 24 bp, Artificial sequence
  SiRNA target sequence
acaagttgaaacgggctcgttagc

SEQ ID NO: 204300 - DNA, 24 bp, Artificial sequence
  SiRNA target sequence
caagttgaaacgggctcgttagct

SEQ ID NO: 204301 - DNA, 24 bp, Artificial sequence
  SiRNA target sequence
aagttgaaacgggctcgttagctg

SEQ ID NO: 204302 - DNA, 24 bp, Artificial sequence
  SiRNA target sequence
agttgaaacgggctcgttagctgt

SEQ ID NO: 204303 - DNA, 24 bp, Artificial sequence
  SiRNA target sequence
gttgaaacgggctcgttagctgta

SEQ ID NO: 204304 - DNA, 24 bp, Artificial sequence
  SiRNA target sequence
ttgaaacgggctcgttagctgtaa

SEQ ID NO: 204305 - DNA, 24 bp, Artificial sequence
  SiRNA target sequence
tgaaacgggctcgttagctgtaat

SEQ ID NO: 204306 - DNA, 24 bp, Artificial sequence
  SiRNA target sequence
gaaacgggctcgttagctgtaatt

SEQ ID NO: 204307 - DNA, 24 bp, Artificial sequence
  SiRNA target sequence
aaacgggctcgttagctgtaatta

SEQ ID NO: 204308 - DNA, 24 bp, Artificial sequence
  SiRNA target sequence
aacgggctcgttagctgtaattaa

SEQ ID NO: 204309 - DNA, 24 bp, Artificial sequence
  SiRNA target sequence
acgggctcgttagctgtaattaaa

SEQ ID NO: 204310 - DNA, 24 bp, Artificial sequence
  SiRNA target sequence
cgggctcgttagctgtaattaaaa

SEQ ID NO: 204311 - DNA, 24 bp, Artificial sequence
  SiRNA target sequence
gggctcgttagctgtaattaaaaa

SEQ ID NO: 204312 - DNA, 24 bp, Artificial sequence
  SiRNA target sequence
ggctcgttagctgtaattaaaaaa

SEQ ID NO: 204313 - DNA, 24 bp, Artificial sequence
  SiRNA target sequence
gctcgttagctgtaattaaaaaat

SEQ ID NO: 204314 - DNA, 24 bp, Artificial sequence
  SiRNA target sequence
ctcgttagctgtaattaaaaaata

SEQ ID NO: 204315 - DNA, 24 bp, Artificial sequence
  SiRNA target sequence
tcgttagctgtaattaaaaaatat

SEQ ID NO: 204316 - DNA, 24 bp, Artificial sequence
  SiRNA target sequence
cgttagctgtaattaaaaaatatt

SEQ ID NO: 204317 - DNA, 24 bp, Artificial sequence
  SiRNA target sequence
gttagctgtaattaaaaaatattt

SEQ ID NO: 204318 - DNA, 24 bp, Artificial sequence
  SiRNA target sequence
ttagctgtaattaaaaaatatttt

SEQ ID NO: 204319 - DNA, 24 bp, Artificial sequence
  SiRNA target sequence
tagctgtaattaaaaaatatttta

SEQ ID NO: 204320 - DNA, 24 bp, Artificial sequence
  SiRNA target sequence
agctgtaattaaaaaatattttat

SEQ ID NO: 204321 - DNA, 24 bp, Artificial sequence
  SiRNA target sequence
gctgtaattaaaaaatattttata

SEQ ID NO: 204322 - DNA, 24 bp, Artificial sequence
  SiRNA target sequence
ctgtaattaaaaaatattttataa

SEQ ID NO: 204323 - DNA, 24 bp, Artificial sequence
  SiRNA target sequence
tgtaattaaaaaatattttataaa

SEQ ID NO: 204324 - DNA, 24 bp, Artificial sequence
  SiRNA target sequence
gtaattaaaaaatattttataaag

SEQ ID NO: 204325 - DNA, 24 bp, Artificial sequence
  SiRNA target sequence
taattaaaaaatattttataaagt

SEQ ID NO: 204326 - DNA, 24 bp, Artificial sequence
  SiRNA target sequence
aattaaaaaatattttataaagtt

SEQ ID NO: 204327 - DNA, 24 bp, Artificial sequence
  SiRNA target sequence
attaaaaaatattttataaagttc

SEQ ID NO: 204328 - DNA, 24 bp, Artificial sequence
  SiRNA target sequence
ttaaaaaatattttataaagttca

SEQ ID NO: 204329 - DNA, 24 bp, Artificial sequence
  SiRNA target sequence
taaaaaatattttataaagttcaa

SEQ ID NO: 204330 - DNA, 24 bp, Artificial sequence
  SiRNA target sequence
aaaaaatattttataaagttcaat

SEQ ID NO: 204331 - DNA, 24 bp, Artificial sequence
  SiRNA target sequence
aaaaatattttataaagttcaatc

SEQ ID NO: 204332 - DNA, 24 bp, Artificial sequence
  SiRNA target sequence
aaaatattttataaagttcaatcc

SEQ ID NO: 204333 - DNA, 24 bp, Artificial sequence
  SiRNA target sequence
aaatattttataaagttcaatccc

SEQ ID NO: 204334 - DNA, 24 bp, Artificial sequence
  SiRNA target sequence
aatattttataaagttcaatccct

SEQ ID NO: 204335 - DNA, 24 bp, Artificial sequence
  SiRNA target sequence
atattttataaagttcaatccctt

SEQ ID NO: 204336 - DNA, 24 bp, Artificial sequence
  SiRNA target sequence
tattttataaagttcaatcccttc

SEQ ID NO: 204337 - DNA, 24 bp, Artificial sequence
  SiRNA target sequence
attttataaagttcaatcccttca

SEQ ID NO: 204338 - DNA, 24 bp, Artificial sequence
  SiRNA target sequence
ttttataaagttcaatcccttcaa

SEQ ID NO: 204339 - DNA, 24 bp, Artificial sequence
  SiRNA target sequence
tttataaagttcaatcccttcaat

SEQ ID NO: 204340 - DNA, 24 bp, Artificial sequence
  SiRNA target sequence
ttataaagttcaatcccttcaatg

SEQ ID NO: 204341 - DNA, 24 bp, Artificial sequence
  SiRNA target sequence
tataaagttcaatcccttcaatgc

SEQ ID NO: 204342 - DNA, 24 bp, Artificial sequence
  SiRNA target sequence
ataaagttcaatcccttcaatgca

SEQ ID NO: 204343 - DNA, 24 bp, Artificial sequence
  SiRNA target sequence
taaagttcaatcccttcaatgcac

SEQ ID NO: 204344 - DNA, 24 bp, Artificial sequence
  SiRNA target sequence
aaagttcaatcccttcaatgcacc

SEQ ID NO: 204345 - DNA, 24 bp, Artificial sequence
  SiRNA target sequence
aagttcaatcccttcaatgcacct

SEQ ID NO: 204346 - DNA, 24 bp, Artificial sequence
  SiRNA target sequence
agttcaatcccttcaatgcacctt

SEQ ID NO: 204347 - DNA, 24 bp, Artificial sequence
  SiRNA target sequence
gttcaatcccttcaatgcaccttt

SEQ ID NO: 204348 - DNA, 24 bp, Artificial sequence
  SiRNA target sequence
ttcaatcccttcaatgcacctttg

SEQ ID NO: 204349 - DNA, 24 bp, Artificial sequence
  SiRNA target sequence
tcaatcccttcaatgcacctttgt

SEQ ID NO: 204350 - DNA, 24 bp, Artificial sequence
  SiRNA target sequence
caatcccttcaatgcacctttgtt

SEQ ID NO: 204351 - DNA, 24 bp, Artificial sequence
  SiRNA target sequence
aatcccttcaatgcacctttgtta

SEQ ID NO: 204352 - DNA, 24 bp, Artificial sequence
  SiRNA target sequence
atcccttcaatgcacctttgttat

SEQ ID NO: 204353 - DNA, 24 bp, Artificial sequence
  SiRNA target sequence
tcccttcaatgcacctttgttatc

SEQ ID NO: 204354 - DNA, 24 bp, Artificial sequence
  SiRNA target sequence
cccttcaatgcacctttgttatca

SEQ ID NO: 204355 - DNA, 24 bp, Artificial sequence
  SiRNA target sequence
ccttcaatgcacctttgttatcag

SEQ ID NO: 204356 - DNA, 24 bp, Artificial sequence
  SiRNA target sequence
cttcaatgcacctttgttatcagc

SEQ ID NO: 204357 - DNA, 24 bp, Artificial sequence
  SiRNA target sequence
ttcaatgcacctttgttatcagcg

SEQ ID NO: 204358 - DNA, 24 bp, Artificial sequence
  SiRNA target sequence
tcaatgcacctttgttatcagcga

SEQ ID NO: 204359 - DNA, 24 bp, Artificial sequence
  SiRNA target sequence
caatgcacctttgttatcagcgaa

SEQ ID NO: 204360 - DNA, 24 bp, Artificial sequence
  SiRNA target sequence
aatgcacctttgttatcagcgaaa

SEQ ID NO: 204361 - DNA, 24 bp, Artificial sequence
  SiRNA target sequence
atgcacctttgttatcagcgaaaa

SEQ ID NO: 204362 - DNA, 24 bp, Artificial sequence
  SiRNA target sequence
tgcacctttgttatcagcgaaaat

SEQ ID NO: 204363 - DNA, 24 bp, Artificial sequence
  SiRNA target sequence
gcacctttgttatcagcgaaaata

SEQ ID NO: 204364 - DNA, 24 bp, Artificial sequence
  SiRNA target sequence
cacctttgttatcagcgaaaatat

SEQ ID NO: 204365 - DNA, 24 bp, Artificial sequence
  SiRNA target sequence
acctttgttatcagcgaaaatatc

SEQ ID NO: 204366 - DNA, 24 bp, Artificial sequence
  SiRNA target sequence
cctttgttatcagcgaaaatatct

SEQ ID NO: 204367 - DNA, 24 bp, Artificial sequence
  SiRNA target sequence
ctttgttatcagcgaaaatatctc

SEQ ID NO: 204368 - DNA, 24 bp, Artificial sequence
  SiRNA target sequence
tttgttatcagcgaaaatatctct

SEQ ID NO: 204369 - DNA, 24 bp, Artificial sequence
  SiRNA target sequence
ttgttatcagcgaaaatatctcta

SEQ ID NO: 204370 - DNA, 24 bp, Artificial sequence
  SiRNA target sequence
tgttatcagcgaaaatatctctaa

SEQ ID NO: 204371 - DNA, 24 bp, Artificial sequence
  SiRNA target sequence
gttatcagcgaaaatatctctaaa

SEQ ID NO: 204372 - DNA, 24 bp, Artificial sequence
  SiRNA target sequence
ttatcagcgaaaatatctctaaat

SEQ ID NO: 204373 - DNA, 24 bp, Artificial sequence
  SiRNA target sequence
tatcagcgaaaatatctctaaata

SEQ ID NO: 204374 - DNA, 24 bp, Artificial sequence
  SiRNA target sequence
atcagcgaaaatatctctaaataa

SEQ ID NO: 204375 - DNA, 24 bp, Artificial sequence
  SiRNA target sequence
tcagcgaaaatatctctaaataaa

SEQ ID NO: 204376 - DNA, 24 bp, Artificial sequence
  SiRNA target sequence
cagcgaaaatatctctaaataaaa

SEQ ID NO: 204377 - DNA, 24 bp, Artificial sequence
  SiRNA target sequence
agcgaaaatatctctaaataaaaa

SEQ ID NO: 204378 - DNA, 24 bp, Artificial sequence
  SiRNA target sequence
gcgaaaatatctctaaataaaaag

SEQ ID NO: 204379 - DNA, 24 bp, Artificial sequence
  SiRNA target sequence
cgaaaatatctctaaataaaaagc

SEQ ID NO: 204380 - DNA, 24 bp, Artificial sequence
  SiRNA target sequence
gaaaatatctctaaataaaaagct

SEQ ID NO: 204381 - DNA, 24 bp, Artificial sequence
  SiRNA target sequence
aaaatatctctaaataaaaagcta

SEQ ID NO: 204382 - DNA, 24 bp, Artificial sequence
  SiRNA target sequence
aaatatctctaaataaaaagctag

SEQ ID NO: 204383 - DNA, 24 bp, Artificial sequence
  SiRNA target sequence
aatatctctaaataaaaagctaga

SEQ ID NO: 204384 - DNA, 24 bp, Artificial sequence
  SiRNA target sequence
atatctctaaataaaaagctagat

SEQ ID NO: 204385 - DNA, 24 bp, Artificial sequence
  SiRNA target sequence
tatctctaaataaaaagctagatg

SEQ ID NO: 204386 - DNA, 24 bp, Artificial sequence
  SiRNA target sequence
atctctaaataaaaagctagatgg

SEQ ID NO: 204387 - DNA, 24 bp, Artificial sequence
  SiRNA target sequence
tctctaaataaaaagctagatggt

SEQ ID NO: 204388 - DNA, 24 bp, Artificial sequence
  SiRNA target sequence
ctctaaataaaaagctagatggtg

SEQ ID NO: 204389 - DNA, 24 bp, Artificial sequence
  SiRNA target sequence
tctaaataaaaagctagatggtgt

SEQ ID NO: 204390 - DNA, 24 bp, Artificial sequence
  SiRNA target sequence
ctaaataaaaagctagatggtgtt

SEQ ID NO: 204391 - DNA, 24 bp, Artificial sequence
  SiRNA target sequence
taaataaaaagctagatggtgtta

SEQ ID NO: 204392 - DNA, 24 bp, Artificial sequence
  SiRNA target sequence
aaataaaaagctagatggtgttac

SEQ ID NO: 204393 - DNA, 24 bp, Artificial sequence
  SiRNA target sequence
aataaaaagctagatggtgttact

SEQ ID NO: 204394 - DNA, 24 bp, Artificial sequence
  SiRNA target sequence
ataaaaagctagatggtgttactt

SEQ ID NO: 204395 - DNA, 24 bp, Artificial sequence
  SiRNA target sequence
taaaaagctagatggtgttacttt

SEQ ID NO: 204396 - DNA, 24 bp, Artificial sequence
  SiRNA target sequence
aaaaagctagatggtgttactttc

SEQ ID NO: 204397 - DNA, 24 bp, Artificial sequence
  SiRNA target sequence
aaaagctagatggtgttactttct

SEQ ID NO: 204398 - DNA, 24 bp, Artificial sequence
  SiRNA target sequence
aaagctagatggtgttactttctc

SEQ ID NO: 204399 - DNA, 24 bp, Artificial sequence
  SiRNA target sequence
aagctagatggtgttactttctct

SEQ ID NO: 204400 - DNA, 24 bp, Artificial sequence
  SiRNA target sequence
agctagatggtgttactttctctt

SEQ ID NO: 204401 - DNA, 24 bp, Artificial sequence
  SiRNA target sequence
gctagatggtgttactttctcttc

SEQ ID NO: 204402 - DNA, 24 bp, Artificial sequence
  SiRNA target sequence
ctagatggtgttactttctcttca

SEQ ID NO: 204403 - DNA, 24 bp, Artificial sequence
  SiRNA target sequence
tagatggtgttactttctcttcaa

SEQ ID NO: 204404 - DNA, 24 bp, Artificial sequence
  SiRNA target sequence
agatggtgttactttctcttcaaa

SEQ ID NO: 204405 - DNA, 24 bp, Artificial sequence
  SiRNA target sequence
gatggtgttactttctcttcaaac

SEQ ID NO: 204406 - DNA, 24 bp, Artificial sequence
  SiRNA target sequence
atggtgttactttctcttcaaaca

SEQ ID NO: 204407 - DNA, 24 bp, Artificial sequence
  SiRNA target sequence
tggtgttactttctcttcaaacaa

SEQ ID NO: 204408 - DNA, 24 bp, Artificial sequence
  SiRNA target sequence
ggtgttactttctcttcaaacaaa

SEQ ID NO: 204409 - DNA, 24 bp, Artificial sequence
  SiRNA target sequence
gtgttactttctcttcaaacaaaa

SEQ ID NO: 204410 - DNA, 24 bp, Artificial sequence
  SiRNA target sequence
tgttactttctcttcaaacaaaaa

SEQ ID NO: 204411 - DNA, 24 bp, Artificial sequence
  SiRNA target sequence
gttactttctcttcaaacaaaaag

SEQ ID NO: 204412 - DNA, 24 bp, Artificial sequence
  SiRNA target sequence
ttactttctcttcaaacaaaaaga

SEQ ID NO: 204413 - DNA, 24 bp, Artificial sequence
  SiRNA target sequence
tactttctcttcaaacaaaaagat

SEQ ID NO: 204414 - DNA, 24 bp, Artificial sequence
  SiRNA target sequence
actttctcttcaaacaaaaagatt

SEQ ID NO: 204415 - DNA, 24 bp, Artificial sequence
  SiRNA target sequence
ctttctcttcaaacaaaaagattg

SEQ ID NO: 204416 - DNA, 24 bp, Artificial sequence
  SiRNA target sequence
tttctcttcaaacaaaaagattgc

SEQ ID NO: 204417 - DNA, 24 bp, Artificial sequence
  SiRNA target sequence
ttctcttcaaacaaaaagattgcc

SEQ ID NO: 204418 - DNA, 24 bp, Artificial sequence
  SiRNA target sequence
tctcttcaaacaaaaagattgccc

SEQ ID NO: 204419 - DNA, 24 bp, Artificial sequence
  SiRNA target sequence
ctcttcaaacaaaaagattgcccc

SEQ ID NO: 204420 - DNA, 24 bp, Artificial sequence
  SiRNA target sequence
tcttcaaacaaaaagattgcccct

SEQ ID NO: 204421 - DNA, 24 bp, Artificial sequence
  SiRNA target sequence
cttcaaacaaaaagattgccccta

SEQ ID NO: 204422 - DNA, 24 bp, Artificial sequence
  SiRNA target sequence
ttcaaacaaaaagattgcccctag

SEQ ID NO: 204423 - DNA, 24 bp, Artificial sequence
  SiRNA target sequence
tcaaacaaaaagattgcccctagt

SEQ ID NO: 204424 - DNA, 24 bp, Artificial sequence
  SiRNA target sequence
caaacaaaaagattgcccctagtc

SEQ ID NO: 204425 - DNA, 24 bp, Artificial sequence
  SiRNA target sequence
aaacaaaaagattgcccctagtcc

SEQ ID NO: 204426 - DNA, 24 bp, Artificial sequence
  SiRNA target sequence
aacaaaaagattgcccctagtccg

SEQ ID NO: 204427 - DNA, 24 bp, Artificial sequence
  SiRNA target sequence
acaaaaagattgcccctagtccga

SEQ ID NO: 204428 - DNA, 24 bp, Artificial sequence
  SiRNA target sequence
caaaaagattgcccctagtccgaa

SEQ ID NO: 204429 - DNA, 24 bp, Artificial sequence
  SiRNA target sequence
aaaaagattgcccctagtccgaag

SEQ ID NO: 204430 - DNA, 24 bp, Artificial sequence
  SiRNA target sequence
aaaagattgcccctagtccgaaga

SEQ ID NO: 204431 - DNA, 24 bp, Artificial sequence
  SiRNA target sequence
aaagattgcccctagtccgaagaa

SEQ ID NO: 204432 - DNA, 24 bp, Artificial sequence
  SiRNA target sequence
aagattgcccctagtccgaagaaa

SEQ ID NO: 204433 - DNA, 24 bp, Artificial sequence
  SiRNA target sequence
agattgcccctagtccgaagaaaa

SEQ ID NO: 204434 - DNA, 24 bp, Artificial sequence
  SiRNA target sequence
gattgcccctagtccgaagaaaaa

SEQ ID NO: 204435 - DNA, 24 bp, Artificial sequence
  SiRNA target sequence
attgcccctagtccgaagaaaaat

SEQ ID NO: 204436 - DNA, 24 bp, Artificial sequence
  SiRNA target sequence
ttgcccctagtccgaagaaaaatg

SEQ ID NO: 204437 - DNA, 24 bp, Artificial sequence
  SiRNA target sequence
tgcccctagtccgaagaaaaatgc

SEQ ID NO: 204438 - DNA, 24 bp, Artificial sequence
  SiRNA target sequence
gcccctagtccgaagaaaaatgca

SEQ ID NO: 204439 - DNA, 24 bp, Artificial sequence
  SiRNA target sequence
cccctagtccgaagaaaaatgcag

SEQ ID NO: 204440 - DNA, 24 bp, Artificial sequence
  SiRNA target sequence
ccctagtccgaagaaaaatgcagt

SEQ ID NO: 204441 - DNA, 24 bp, Artificial sequence
  SiRNA target sequence
cctagtccgaagaaaaatgcagta

SEQ ID NO: 204442 - DNA, 24 bp, Artificial sequence
  SiRNA target sequence
ctagtccgaagaaaaatgcagtaa

SEQ ID NO: 204443 - DNA, 24 bp, Artificial sequence
  SiRNA target sequence
tagtccgaagaaaaatgcagtaaa

SEQ ID NO: 204444 - DNA, 24 bp, Artificial sequence
  SiRNA target sequence
agtccgaagaaaaatgcagtaaaa

SEQ ID NO: 204445 - DNA, 24 bp, Artificial sequence
  SiRNA target sequence
gtccgaagaaaaatgcagtaaaaa

SEQ ID NO: 204446 - DNA, 24 bp, Artificial sequence
  SiRNA target sequence
tccgaagaaaaatgcagtaaaaat

SEQ ID NO: 204447 - DNA, 24 bp, Artificial sequence
  SiRNA target sequence
ccgaagaaaaatgcagtaaaaatt

SEQ ID NO: 204448 - DNA, 24 bp, Artificial sequence
  SiRNA target sequence
cgaagaaaaatgcagtaaaaatta

SEQ ID NO: 204449 - DNA, 24 bp, Artificial sequence
  SiRNA target sequence
gaagaaaaatgcagtaaaaattat

SEQ ID NO: 204450 - DNA, 24 bp, Artificial sequence
  SiRNA target sequence
aagaaaaatgcagtaaaaattatt

SEQ ID NO: 204451 - DNA, 24 bp, Artificial sequence
  SiRNA target sequence
agaaaaatgcagtaaaaattatta

SEQ ID NO: 204452 - DNA, 24 bp, Artificial sequence
  SiRNA target sequence
gaaaaatgcagtaaaaattattag

SEQ ID NO: 204453 - DNA, 24 bp, Artificial sequence
  SiRNA target sequence
aaaaatgcagtaaaaattattaga

SEQ ID NO: 204454 - DNA, 24 bp, Artificial sequence
  SiRNA target sequence
aaaatgcagtaaaaattattagaa

SEQ ID NO: 204455 - DNA, 24 bp, Artificial sequence
  SiRNA target sequence
aaatgcagtaaaaattattagaaa

SEQ ID NO: 204456 - DNA, 24 bp, Artificial sequence
  SiRNA target sequence
aatgcagtaaaaattattagaaat

SEQ ID NO: 204457 - DNA, 24 bp, Artificial sequence
  SiRNA target sequence
atgcagtaaaaattattagaaata

SEQ ID NO: 204458 - DNA, 24 bp, Artificial sequence
  SiRNA target sequence
tgcagtaaaaattattagaaatag

SEQ ID NO: 204459 - DNA, 24 bp, Artificial sequence
  SiRNA target sequence
gcagtaaaaattattagaaataga

SEQ ID NO: 204460 - DNA, 24 bp, Artificial sequence
  SiRNA target sequence
cagtaaaaattattagaaatagat

SEQ ID NO: 204461 - DNA, 24 bp, Artificial sequence
  SiRNA target sequence
agtaaaaattattagaaatagatt

SEQ ID NO: 204462 - DNA, 24 bp, Artificial sequence
  SiRNA target sequence
gtaaaaattattagaaatagatta

SEQ ID NO: 204463 - DNA, 24 bp, Artificial sequence
  SiRNA target sequence
taaaaattattagaaatagattaa

SEQ ID NO: 204464 - DNA, 24 bp, Artificial sequence
  SiRNA target sequence
aaaaattattagaaatagattaaa

SEQ ID NO: 204465 - DNA, 24 bp, Artificial sequence
  SiRNA target sequence
aaaattattagaaatagattaaaa

SEQ ID NO: 204466 - DNA, 24 bp, Artificial sequence
  SiRNA target sequence
aaattattagaaatagattaaaaa

SEQ ID NO: 204467 - DNA, 24 bp, Artificial sequence
  SiRNA target sequence
aattattagaaatagattaaaaat

SEQ ID NO: 204468 - DNA, 24 bp, Artificial sequence
  SiRNA target sequence
attattagaaatagattaaaaatc

SEQ ID NO: 204469 - DNA, 24 bp, Artificial sequence
  SiRNA target sequence
ttattagaaatagattaaaaatcg

SEQ ID NO: 204470 - DNA, 24 bp, Artificial sequence
  SiRNA target sequence
tattagaaatagattaaaaatcga

SEQ ID NO: 204471 - DNA, 24 bp, Artificial sequence
  SiRNA target sequence
attagaaatagattaaaaatcgat

SEQ ID NO: 204472 - DNA, 24 bp, Artificial sequence
  SiRNA target sequence
ttagaaatagattaaaaatcgatg

SEQ ID NO: 204473 - DNA, 24 bp, Artificial sequence
  SiRNA target sequence
tagaaatagattaaaaatcgatga

SEQ ID NO: 204474 - DNA, 24 bp, Artificial sequence
  SiRNA target sequence
agaaatagattaaaaatcgatgat

SEQ ID NO: 204475 - DNA, 24 bp, Artificial sequence
  SiRNA target sequence
gaaatagattaaaaatcgatgata

SEQ ID NO: 204476 - DNA, 24 bp, Artificial sequence
  SiRNA target sequence
aaatagattaaaaatcgatgatac

SEQ ID NO: 204477 - DNA, 24 bp, Artificial sequence
  SiRNA target sequence
aatagattaaaaatcgatgataca

SEQ ID NO: 204478 - DNA, 24 bp, Artificial sequence
  SiRNA target sequence
atagattaaaaatcgatgatacag

SEQ ID NO: 204479 - DNA, 24 bp, Artificial sequence
  SiRNA target sequence
tagattaaaaatcgatgatacagg

SEQ ID NO: 204480 - DNA, 24 bp, Artificial sequence
  SiRNA target sequence
agattaaaaatcgatgatacaggt

SEQ ID NO: 204481 - DNA, 24 bp, Artificial sequence
  SiRNA target sequence
gattaaaaatcgatgatacaggtt

SEQ ID NO: 204482 - DNA, 24 bp, Artificial sequence
  SiRNA target sequence
attaaaaatcgatgatacaggttt

SEQ ID NO: 204483 - DNA, 24 bp, Artificial sequence
  SiRNA target sequence
ttaaaaatcgatgatacaggttta

SEQ ID NO: 204484 - DNA, 24 bp, Artificial sequence
  SiRNA target sequence
taaaaatcgatgatacaggtttat

SEQ ID NO: 204485 - DNA, 24 bp, Artificial sequence
  SiRNA target sequence
aaaaatcgatgatacaggtttatt

SEQ ID NO: 204486 - DNA, 24 bp, Artificial sequence
  SiRNA target sequence
aaaatcgatgatacaggtttattt

SEQ ID NO: 204487 - DNA, 24 bp, Artificial sequence
  SiRNA target sequence
aaatcgatgatacaggtttatttt

SEQ ID NO: 204488 - DNA, 24 bp, Artificial sequence
  SiRNA target sequence
aatcgatgatacaggtttattttg

SEQ ID NO: 204489 - DNA, 24 bp, Artificial sequence
  SiRNA target sequence
atcgatgatacaggtttattttgc

SEQ ID NO: 204490 - DNA, 24 bp, Artificial sequence
  SiRNA target sequence
tcgatgatacaggtttattttgca

SEQ ID NO: 204491 - DNA, 24 bp, Artificial sequence
  SiRNA target sequence
cgatgatacaggtttattttgcat

SEQ ID NO: 204492 - DNA, 24 bp, Artificial sequence
  SiRNA target sequence
gatgatacaggtttattttgcata

SEQ ID NO: 204493 - DNA, 24 bp, Artificial sequence
  SiRNA target sequence
atgatacaggtttattttgcataa

SEQ ID NO: 204494 - DNA, 24 bp, Artificial sequence
  SiRNA target sequence
tgatacaggtttattttgcataag

SEQ ID NO: 204495 - DNA, 24 bp, Artificial sequence
  SiRNA target sequence
gatacaggtttattttgcataagc

SEQ ID NO: 204496 - DNA, 24 bp, Artificial sequence
  SiRNA target sequence
atacaggtttattttgcataagcc

SEQ ID NO: 204497 - DNA, 24 bp, Artificial sequence
  SiRNA target sequence
tacaggtttattttgcataagcca

SEQ ID NO: 204498 - DNA, 24 bp, Artificial sequence
  SiRNA target sequence
acaggtttattttgcataagccac

SEQ ID NO: 204499 - DNA, 24 bp, Artificial sequence
  SiRNA target sequence
caggtttattttgcataagccact

SEQ ID NO: 204500 - DNA, 24 bp, Artificial sequence
  SiRNA target sequence
aggtttattttgcataagccactg

SEQ ID NO: 204501 - DNA, 24 bp, Artificial sequence
  SiRNA target sequence
ggtttattttgcataagccactgt

SEQ ID NO: 204502 - DNA, 24 bp, Artificial sequence
  SiRNA target sequence
gtttattttgcataagccactgta

SEQ ID NO: 204503 - DNA, 24 bp, Artificial sequence
  SiRNA target sequence
tttattttgcataagccactgtat

SEQ ID NO: 204504 - DNA, 24 bp, Artificial sequence
  SiRNA target sequence
ttattttgcataagccactgtatt

SEQ ID NO: 204505 - DNA, 24 bp, Artificial sequence
  SiRNA target sequence
tattttgcataagccactgtatta

SEQ ID NO: 204506 - DNA, 24 bp, Artificial sequence
  SiRNA target sequence
attttgcataagccactgtattaa

SEQ ID NO: 204507 - DNA, 24 bp, Artificial sequence
  SiRNA target sequence
ttttgcataagccactgtattaaa

SEQ ID NO: 204508 - DNA, 24 bp, Artificial sequence
  SiRNA target sequence
tttgcataagccactgtattaaaa

SEQ ID NO: 204509 - DNA, 24 bp, Artificial sequence
  SiRNA target sequence
ttgcataagccactgtattaaaat

SEQ ID NO: 204510 - DNA, 24 bp, Artificial sequence
  SiRNA target sequence
tgcataagccactgtattaaaatt

SEQ ID NO: 204511 - DNA, 24 bp, Artificial sequence
  SiRNA target sequence
gcataagccactgtattaaaatta

SEQ ID NO: 204512 - DNA, 24 bp, Artificial sequence
  SiRNA target sequence
cataagccactgtattaaaattac

SEQ ID NO: 204513 - DNA, 24 bp, Artificial sequence
  SiRNA target sequence
ataagccactgtattaaaattaca

SEQ ID NO: 204514 - DNA, 24 bp, Artificial sequence
  SiRNA target sequence
taagccactgtattaaaattacag

SEQ ID NO: 204515 - DNA, 24 bp, Artificial sequence
  SiRNA target sequence
aagccactgtattaaaattacaga

SEQ ID NO: 204516 - DNA, 24 bp, Artificial sequence
  SiRNA target sequence
agccactgtattaaaattacagat

SEQ ID NO: 204517 - DNA, 24 bp, Artificial sequence
  SiRNA target sequence
gccactgtattaaaattacagatg

SEQ ID NO: 204518 - DNA, 24 bp, Artificial sequence
  SiRNA target sequence
ccactgtattaaaattacagatgc

SEQ ID NO: 204519 - DNA, 24 bp, Artificial sequence
  SiRNA target sequence
cactgtattaaaattacagatgca

SEQ ID NO: 204520 - DNA, 24 bp, Artificial sequence
  SiRNA target sequence
actgtattaaaattacagatgcaa

SEQ ID NO: 204521 - DNA, 24 bp, Artificial sequence
  SiRNA target sequence
ctgtattaaaattacagatgcaaa

SEQ ID NO: 204522 - DNA, 24 bp, Artificial sequence
  SiRNA target sequence
tgtattaaaattacagatgcaaaa

SEQ ID NO: 204523 - DNA, 24 bp, Artificial sequence
  SiRNA target sequence
gtattaaaattacagatgcaaaag

SEQ ID NO: 204524 - DNA, 24 bp, Artificial sequence
  SiRNA target sequence
tattaaaattacagatgcaaaaga

SEQ ID NO: 204525 - DNA, 24 bp, Artificial sequence
  SiRNA target sequence
attaaaattacagatgcaaaagat

SEQ ID NO: 204526 - DNA, 24 bp, Artificial sequence
  SiRNA target sequence
ttaaaattacagatgcaaaagata

SEQ ID NO: 204527 - DNA, 24 bp, Artificial sequence
  SiRNA target sequence
taaaattacagatgcaaaagatat

SEQ ID NO: 204528 - DNA, 24 bp, Artificial sequence
  SiRNA target sequence
aaaattacagatgcaaaagatata

SEQ ID NO: 204529 - DNA, 24 bp, Artificial sequence
  SiRNA target sequence
aaattacagatgcaaaagatatag

SEQ ID NO: 204530 - DNA, 24 bp, Artificial sequence
  SiRNA target sequence
aattacagatgcaaaagatatagg

SEQ ID NO: 204531 - DNA, 24 bp, Artificial sequence
  SiRNA target sequence
attacagatgcaaaagatatagga

SEQ ID NO: 204532 - DNA, 24 bp, Artificial sequence
  SiRNA target sequence
ttacagatgcaaaagatataggaa

SEQ ID NO: 204533 - DNA, 24 bp, Artificial sequence
  SiRNA target sequence
tacagatgcaaaagatataggaag

SEQ ID NO: 204534 - DNA, 24 bp, Artificial sequence
  SiRNA target sequence
acagatgcaaaagatataggaaga

SEQ ID NO: 204535 - DNA, 24 bp, Artificial sequence
  SiRNA target sequence
cagatgcaaaagatataggaagaa

SEQ ID NO: 204536 - DNA, 24 bp, Artificial sequence
  SiRNA target sequence
agatgcaaaagatataggaagaac

SEQ ID NO: 204537 - DNA, 24 bp, Artificial sequence
  SiRNA target sequence
gatgcaaaagatataggaagaaca

SEQ ID NO: 204538 - DNA, 24 bp, Artificial sequence
  SiRNA target sequence
atgcaaaagatataggaagaacat

SEQ ID NO: 204539 - DNA, 24 bp, Artificial sequence
  SiRNA target sequence
tgcaaaagatataggaagaacata

SEQ ID NO: 204540 - DNA, 24 bp, Artificial sequence
  SiRNA target sequence
gcaaaagatataggaagaacataa

SEQ ID NO: 204541 - DNA, 24 bp, Artificial sequence
  SiRNA target sequence
caaaagatataggaagaacataaa

SEQ ID NO: 204542 - DNA, 24 bp, Artificial sequence
  SiRNA target sequence
aaaagatataggaagaacataaaa

SEQ ID NO: 204543 - DNA, 24 bp, Artificial sequence
  SiRNA target sequence
aaagatataggaagaacataaaaa

SEQ ID NO: 204544 - DNA, 24 bp, Artificial sequence
  SiRNA target sequence
aagatataggaagaacataaaaaa

SEQ ID NO: 204545 - DNA, 24 bp, Artificial sequence
  SiRNA target sequence
agatataggaagaacataaaaaat

SEQ ID NO: 204546 - DNA, 24 bp, Artificial sequence
  SiRNA target sequence
gatataggaagaacataaaaaatt

SEQ ID NO: 204547 - DNA, 24 bp, Artificial sequence
  SiRNA target sequence
atataggaagaacataaaaaattt

SEQ ID NO: 204548 - DNA, 24 bp, Artificial sequence
  SiRNA target sequence
tataggaagaacataaaaaatttt

SEQ ID NO: 204549 - DNA, 24 bp, Artificial sequence
  SiRNA target sequence
ataggaagaacataaaaaattttc

SEQ ID NO: 204550 - DNA, 24 bp, Artificial sequence
  SiRNA target sequence
taggaagaacataaaaaattttca

SEQ ID NO: 204551 - DNA, 24 bp, Artificial sequence
  SiRNA target sequence
aggaagaacataaaaaattttcat

SEQ ID NO: 204552 - DNA, 24 bp, Artificial sequence
  SiRNA target sequence
ggaagaacataaaaaattttcata

SEQ ID NO: 204553 - DNA, 24 bp, Artificial sequence
  SiRNA target sequence
gaagaacataaaaaattttcataa

SEQ ID NO: 204554 - DNA, 24 bp, Artificial sequence
  SiRNA target sequence
aagaacataaaaaattttcataaa

SEQ ID NO: 204555 - DNA, 24 bp, Artificial sequence
  SiRNA target sequence
agaacataaaaaattttcataaac

SEQ ID NO: 204556 - DNA, 24 bp, Artificial sequence
  SiRNA target sequence
gaacataaaaaattttcataaaca

SEQ ID NO: 204557 - DNA, 24 bp, Artificial sequence
  SiRNA target sequence
aacataaaaaattttcataaacat

SEQ ID NO: 204558 - DNA, 24 bp, Artificial sequence
  SiRNA target sequence
acataaaaaattttcataaacata

SEQ ID NO: 204559 - DNA, 24 bp, Artificial sequence
  SiRNA target sequence
cataaaaaattttcataaacataa

SEQ ID NO: 204560 - DNA, 24 bp, Artificial sequence
  SiRNA target sequence
ataaaaaattttcataaacataat

SEQ ID NO: 204561 - DNA, 24 bp, Artificial sequence
  SiRNA target sequence
taaaaaattttcataaacataatt

SEQ ID NO: 204562 - DNA, 24 bp, Artificial sequence
  SiRNA target sequence
aaaaaattttcataaacataattg

SEQ ID NO: 204563 - DNA, 24 bp, Artificial sequence
  SiRNA target sequence
aaaaattttcataaacataattga

SEQ ID NO: 204564 - DNA, 24 bp, Artificial sequence
  SiRNA target sequence
aaaattttcataaacataattgaa

SEQ ID NO: 204565 - DNA, 24 bp, Artificial sequence
  SiRNA target sequence
aaattttcataaacataattgaat

SEQ ID NO: 204566 - DNA, 24 bp, Artificial sequence
  SiRNA target sequence
aattttcataaacataattgaatt

SEQ ID NO: 204567 - DNA, 24 bp, Artificial sequence
  SiRNA target sequence
attttcataaacataattgaattc

SEQ ID NO: 204568 - DNA, 24 bp, Artificial sequence
  SiRNA target sequence
ttttcataaacataattgaattct

SEQ ID NO: 204569 - DNA, 24 bp, Artificial sequence
  SiRNA target sequence
tttcataaacataattgaattctg

SEQ ID NO: 204570 - DNA, 24 bp, Artificial sequence
  SiRNA target sequence
ttcataaacataattgaattctga

SEQ ID NO: 204571 - DNA, 24 bp, Artificial sequence
  SiRNA target sequence
tcataaacataattgaattctgat

SEQ ID NO: 204572 - DNA, 24 bp, Artificial sequence
  SiRNA target sequence
cataaacataattgaattctgatc

SEQ ID NO: 204573 - DNA, 24 bp, Artificial sequence
  SiRNA target sequence
ataaacataattgaattctgatct

SEQ ID NO: 204574 - DNA, 24 bp, Artificial sequence
  SiRNA target sequence
taaacataattgaattctgatctt

SEQ ID NO: 204575 - DNA, 24 bp, Artificial sequence
  SiRNA target sequence
aaacataattgaattctgatcttg

SEQ ID NO: 204576 - DNA, 24 bp, Artificial sequence
  SiRNA target sequence
aacataattgaattctgatcttgc

SEQ ID NO: 204577 - DNA, 24 bp, Artificial sequence
  SiRNA target sequence
acataattgaattctgatcttgcc

SEQ ID NO: 204578 - DNA, 24 bp, Artificial sequence
  SiRNA target sequence
cataattgaattctgatcttgcct

SEQ ID NO: 204579 - DNA, 24 bp, Artificial sequence
  SiRNA target sequence
ataattgaattctgatcttgcctt

SEQ ID NO: 204580 - DNA, 24 bp, Artificial sequence
  SiRNA target sequence
taattgaattctgatcttgcctta

SEQ ID NO: 204581 - DNA, 24 bp, Artificial sequence
  SiRNA target sequence
aattgaattctgatcttgccttac

SEQ ID NO: 204582 - DNA, 24 bp, Artificial sequence
  SiRNA target sequence
attgaattctgatcttgccttacc

SEQ ID NO: 204583 - DNA, 24 bp, Artificial sequence
  SiRNA target sequence
ttgaattctgatcttgccttacca

SEQ ID NO: 204584 - DNA, 24 bp, Artificial sequence
  SiRNA target sequence
tgaattctgatcttgccttaccat

SEQ ID NO: 204585 - DNA, 24 bp, Artificial sequence
  SiRNA target sequence
gaattctgatcttgccttaccatc

SEQ ID NO: 204586 - DNA, 24 bp, Artificial sequence
  SiRNA target sequence
aattctgatcttgccttaccatca

SEQ ID NO: 204587 - DNA, 24 bp, Artificial sequence
  SiRNA target sequence
attctgatcttgccttaccatcac

SEQ ID NO: 204588 - DNA, 24 bp, Artificial sequence
  SiRNA target sequence
ttctgatcttgccttaccatcaca

SEQ ID NO: 204589 - DNA, 24 bp, Artificial sequence
  SiRNA target sequence
tctgatcttgccttaccatcacaa

SEQ ID NO: 204590 - DNA, 24 bp, Artificial sequence
  SiRNA target sequence
ctgatcttgccttaccatcacaaa

SEQ ID NO: 204591 - DNA, 24 bp, Artificial sequence
  SiRNA target sequence
tgatcttgccttaccatcacaaat

SEQ ID NO: 204592 - DNA, 24 bp, Artificial sequence
  SiRNA target sequence
gatcttgccttaccatcacaaata

SEQ ID NO: 204593 - DNA, 24 bp, Artificial sequence
  SiRNA target sequence
atcttgccttaccatcacaaataa

SEQ ID NO: 204594 - DNA, 24 bp, Artificial sequence
  SiRNA target sequence
tcttgccttaccatcacaaataaa

SEQ ID NO: 204595 - DNA, 24 bp, Artificial sequence
  SiRNA target sequence
cttgccttaccatcacaaataaat

SEQ ID NO: 204596 - DNA, 24 bp, Artificial sequence
  SiRNA target sequence
ttgccttaccatcacaaataaatc

SEQ ID NO: 204597 - DNA, 24 bp, Artificial sequence
  SiRNA target sequence
tgccttaccatcacaaataaatct

SEQ ID NO: 204598 - DNA, 24 bp, Artificial sequence
  SiRNA target sequence
gccttaccatcacaaataaatctt

SEQ ID NO: 204599 - DNA, 24 bp, Artificial sequence
  SiRNA target sequence
ccttaccatcacaaataaatcttt

SEQ ID NO: 204600 - DNA, 24 bp, Artificial sequence
  SiRNA target sequence
cttaccatcacaaataaatctttt

SEQ ID NO: 204601 - DNA, 24 bp, Artificial sequence
  SiRNA target sequence
ttaccatcacaaataaatctttta

SEQ ID NO: 204602 - DNA, 24 bp, Artificial sequence
  SiRNA target sequence
taccatcacaaataaatcttttaa

SEQ ID NO: 204603 - DNA, 24 bp, Artificial sequence
  SiRNA target sequence
accatcacaaataaatcttttaaa

SEQ ID NO: 204604 - DNA, 24 bp, Artificial sequence
  SiRNA target sequence
ccatcacaaataaatcttttaaaa

SEQ ID NO: 204605 - DNA, 24 bp, Artificial sequence
  SiRNA target sequence
catcacaaataaatcttttaaaat

SEQ ID NO: 204606 - DNA, 24 bp, Artificial sequence
  SiRNA target sequence
atcacaaataaatcttttaaaatt

SEQ ID NO: 204607 - DNA, 24 bp, Artificial sequence
  SiRNA target sequence
tcacaaataaatcttttaaaattc

SEQ ID NO: 204608 - DNA, 24 bp, Artificial sequence
  SiRNA target sequence
cacaaataaatcttttaaaattct

SEQ ID NO: 204609 - DNA, 24 bp, Artificial sequence
  SiRNA target sequence
acaaataaatcttttaaaattctt

SEQ ID NO: 204610 - DNA, 24 bp, Artificial sequence
  SiRNA target sequence
caaataaatcttttaaaattctta

SEQ ID NO: 204611 - DNA, 24 bp, Artificial sequence
  SiRNA target sequence
aaataaatcttttaaaattcttaa

SEQ ID NO: 204612 - DNA, 24 bp, Artificial sequence
  SiRNA target sequence
aataaatcttttaaaattcttaaa

SEQ ID NO: 204613 - DNA, 24 bp, Artificial sequence
  SiRNA target sequence
ataaatcttttaaaattcttaaaa

SEQ ID NO: 204614 - DNA, 24 bp, Artificial sequence
  SiRNA target sequence
taaatcttttaaaattcttaaaaa

SEQ ID NO: 204615 - DNA, 24 bp, Artificial sequence
  SiRNA target sequence
aaatcttttaaaattcttaaaaat

SEQ ID NO: 204616 - DNA, 24 bp, Artificial sequence
  SiRNA target sequence
aatcttttaaaattcttaaaaatg

SEQ ID NO: 204617 - DNA, 24 bp, Artificial sequence
  SiRNA target sequence
atcttttaaaattcttaaaaatga

SEQ ID NO: 204618 - DNA, 24 bp, Artificial sequence
  SiRNA target sequence
tcttttaaaattcttaaaaatgaa

SEQ ID NO: 204619 - DNA, 24 bp, Artificial sequence
  SiRNA target sequence
cttttaaaattcttaaaaatgaat

SEQ ID NO: 204620 - DNA, 24 bp, Artificial sequence
  SiRNA target sequence
ttttaaaattcttaaaaatgaata

SEQ ID NO: 204621 - DNA, 24 bp, Artificial sequence
  SiRNA target sequence
tttaaaattcttaaaaatgaatac

SEQ ID NO: 204622 - DNA, 24 bp, Artificial sequence
  SiRNA target sequence
ttaaaattcttaaaaatgaataca

SEQ ID NO: 204623 - DNA, 24 bp, Artificial sequence
  SiRNA target sequence
taaaattcttaaaaatgaatacac

SEQ ID NO: 204624 - DNA, 24 bp, Artificial sequence
  SiRNA target sequence
aaaattcttaaaaatgaatacaca

SEQ ID NO: 204625 - DNA, 24 bp, Artificial sequence
  SiRNA target sequence
aaattcttaaaaatgaatacacaa

SEQ ID NO: 204626 - DNA, 24 bp, Artificial sequence
  SiRNA target sequence
aattcttaaaaatgaatacacaaa

SEQ ID NO: 204627 - DNA, 24 bp, Artificial sequence
  SiRNA target sequence
attcttaaaaatgaatacacaaag

SEQ ID NO: 204628 - DNA, 24 bp, Artificial sequence
  SiRNA target sequence
ttcttaaaaatgaatacacaaagt

SEQ ID NO: 204629 - DNA, 24 bp, Artificial sequence
  SiRNA target sequence
tcttaaaaatgaatacacaaagtt

SEQ ID NO: 204630 - DNA, 24 bp, Artificial sequence
  SiRNA target sequence
cttaaaaatgaatacacaaagtta

SEQ ID NO: 204631 - DNA, 24 bp, Artificial sequence
  SiRNA target sequence
ttaaaaatgaatacacaaagttaa

SEQ ID NO: 204632 - DNA, 24 bp, Artificial sequence
  SiRNA target sequence
taaaaatgaatacacaaagttaat

SEQ ID NO: 204633 - DNA, 24 bp, Artificial sequence
  SiRNA target sequence
aaaaatgaatacacaaagttaatt

SEQ ID NO: 204634 - DNA, 24 bp, Artificial sequence
  SiRNA target sequence
aaaatgaatacacaaagttaatta

SEQ ID NO: 204635 - DNA, 24 bp, Artificial sequence
  SiRNA target sequence
aaatgaatacacaaagttaattaa

SEQ ID NO: 204636 - DNA, 24 bp, Artificial sequence
  SiRNA target sequence
aatgaatacacaaagttaattaat

SEQ ID NO: 204637 - DNA, 24 bp, Artificial sequence
  SiRNA target sequence
atgaatacacaaagttaattaatc

SEQ ID NO: 204638 - DNA, 24 bp, Artificial sequence
  SiRNA target sequence
tgaatacacaaagttaattaatcc

SEQ ID NO: 204639 - DNA, 24 bp, Artificial sequence
  SiRNA target sequence
gaatacacaaagttaattaatcca

SEQ ID NO: 204640 - DNA, 24 bp, Artificial sequence
  SiRNA target sequence
aatacacaaagttaattaatccaa

SEQ ID NO: 204641 - DNA, 24 bp, Artificial sequence
  SiRNA target sequence
atacacaaagttaattaatccaaa

SEQ ID NO: 204642 - DNA, 24 bp, Artificial sequence
  SiRNA target sequence
tacacaaagttaattaatccaaac

SEQ ID NO: 204643 - DNA, 24 bp, Artificial sequence
  SiRNA target sequence
acacaaagttaattaatccaaaca

SEQ ID NO: 204644 - DNA, 24 bp, Artificial sequence
  SiRNA target sequence
cacaaagttaattaatccaaacat

SEQ ID NO: 204645 - DNA, 24 bp, Artificial sequence
  SiRNA target sequence
acaaagttaattaatccaaacata

SEQ ID NO: 204646 - DNA, 24 bp, Artificial sequence
  SiRNA target sequence
caaagttaattaatccaaacataa

SEQ ID NO: 204647 - DNA, 24 bp, Artificial sequence
  SiRNA target sequence
aaagttaattaatccaaacataat

SEQ ID NO: 204648 - DNA, 24 bp, Artificial sequence
  SiRNA target sequence
aagttaattaatccaaacataata

SEQ ID NO: 204649 - DNA, 24 bp, Artificial sequence
  SiRNA target sequence
agttaattaatccaaacataatac

SEQ ID NO: 204650 - DNA, 24 bp, Artificial sequence
  SiRNA target sequence
gttaattaatccaaacataatacc

SEQ ID NO: 204651 - DNA, 24 bp, Artificial sequence
  SiRNA target sequence
ttaattaatccaaacataatacca

SEQ ID NO: 204652 - DNA, 24 bp, Artificial sequence
  SiRNA target sequence
taattaatccaaacataataccaa

SEQ ID NO: 204653 - DNA, 24 bp, Artificial sequence
  SiRNA target sequence
aattaatccaaacataataccaag

SEQ ID NO: 204654 - DNA, 24 bp, Artificial sequence
  SiRNA target sequence
attaatccaaacataataccaagt

SEQ ID NO: 204655 - DNA, 24 bp, Artificial sequence
  SiRNA target sequence
ttaatccaaacataataccaagta

SEQ ID NO: 204656 - DNA, 24 bp, Artificial sequence
  SiRNA target sequence
taatccaaacataataccaagtat

SEQ ID NO: 204657 - DNA, 24 bp, Artificial sequence
  SiRNA target sequence
aatccaaacataataccaagtata

SEQ ID NO: 204658 - DNA, 24 bp, Artificial sequence
  SiRNA target sequence
atccaaacataataccaagtataa

SEQ ID NO: 204659 - DNA, 24 bp, Artificial sequence
  SiRNA target sequence
tccaaacataataccaagtataaa

SEQ ID NO: 204660 - DNA, 24 bp, Artificial sequence
  SiRNA target sequence
ccaaacataataccaagtataaaa

SEQ ID NO: 204661 - DNA, 24 bp, Artificial sequence
  SiRNA target sequence
caaacataataccaagtataaaaa

SEQ ID NO: 204662 - DNA, 24 bp, Artificial sequence
  SiRNA target sequence
aaacataataccaagtataaaaaa

SEQ ID NO: 204663 - DNA, 24 bp, Artificial sequence
  SiRNA target sequence
aacataataccaagtataaaaaat

SEQ ID NO: 204664 - DNA, 24 bp, Artificial sequence
  SiRNA target sequence
acataataccaagtataaaaaatt

SEQ ID NO: 204665 - DNA, 24 bp, Artificial sequence
  SiRNA target sequence
cataataccaagtataaaaaattt

SEQ ID NO: 204666 - DNA, 24 bp, Artificial sequence
  SiRNA target sequence
ataataccaagtataaaaaattta

SEQ ID NO: 204667 - DNA, 24 bp, Artificial sequence
  SiRNA target sequence
taataccaagtataaaaaatttag

SEQ ID NO: 204668 - DNA, 24 bp, Artificial sequence
  SiRNA target sequence
aataccaagtataaaaaatttagg

SEQ ID NO: 204669 - DNA, 24 bp, Artificial sequence
  SiRNA target sequence
ataccaagtataaaaaatttaggc

SEQ ID NO: 204670 - DNA, 24 bp, Artificial sequence
  SiRNA target sequence
taccaagtataaaaaatttaggca

SEQ ID NO: 204671 - DNA, 24 bp, Artificial sequence
  SiRNA target sequence
accaagtataaaaaatttaggcat

SEQ ID NO: 204672 - DNA, 24 bp, Artificial sequence
  SiRNA target sequence
ccaagtataaaaaatttaggcatt

SEQ ID NO: 204673 - DNA, 24 bp, Artificial sequence
  SiRNA target sequence
caagtataaaaaatttaggcattt

SEQ ID NO: 204674 - DNA, 24 bp, Artificial sequence
  SiRNA target sequence
aagtataaaaaatttaggcatttc

SEQ ID NO: 204675 - DNA, 24 bp, Artificial sequence
  SiRNA target sequence
agtataaaaaatttaggcatttca

SEQ ID NO: 204676 - DNA, 24 bp, Artificial sequence
  SiRNA target sequence
gtataaaaaatttaggcatttcaa

SEQ ID NO: 204677 - DNA, 24 bp, Artificial sequence
  SiRNA target sequence
tataaaaaatttaggcatttcaac

SEQ ID NO: 204678 - DNA, 24 bp, Artificial sequence
  SiRNA target sequence
ataaaaaatttaggcatttcaacc

SEQ ID NO: 204679 - DNA, 24 bp, Artificial sequence
  SiRNA target sequence
taaaaaatttaggcatttcaacct

SEQ ID NO: 204680 - DNA, 24 bp, Artificial sequence
  SiRNA target sequence
aaaaaatttaggcatttcaacctt

SEQ ID NO: 204681 - DNA, 24 bp, Artificial sequence
  SiRNA target sequence
aaaaatttaggcatttcaacctta

SEQ ID NO: 204682 - DNA, 24 bp, Artificial sequence
  SiRNA target sequence
aaaatttaggcatttcaaccttag

SEQ ID NO: 204683 - DNA, 24 bp, Artificial sequence
  SiRNA target sequence
aaatttaggcatttcaaccttagc

SEQ ID NO: 204684 - DNA, 24 bp, Artificial sequence
  SiRNA target sequence
aatttaggcatttcaaccttagca

SEQ ID NO: 204685 - DNA, 24 bp, Artificial sequence
  SiRNA target sequence
atttaggcatttcaaccttagcaa

SEQ ID NO: 204686 - DNA, 24 bp, Artificial sequence
  SiRNA target sequence
tttaggcatttcaaccttagcaac

SEQ ID NO: 204687 - DNA, 24 bp, Artificial sequence
  SiRNA target sequence
ttaggcatttcaaccttagcaact

SEQ ID NO: 204688 - DNA, 24 bp, Artificial sequence
  SiRNA target sequence
taggcatttcaaccttagcaactt

SEQ ID NO: 204689 - DNA, 24 bp, Artificial sequence
  SiRNA target sequence
aggcatttcaaccttagcaacttt

SEQ ID NO: 204690 - DNA, 24 bp, Artificial sequence
  SiRNA target sequence
ggcatttcaaccttagcaacttta

SEQ ID NO: 204691 - DNA, 24 bp, Artificial sequence
  SiRNA target sequence
gcatttcaaccttagcaactttaa

SEQ ID NO: 204692 - DNA, 24 bp, Artificial sequence
  SiRNA target sequence
catttcaaccttagcaactttaaa

SEQ ID NO: 204693 - DNA, 24 bp, Artificial sequence
  SiRNA target sequence
atttcaaccttagcaactttaaaa

SEQ ID NO: 204694 - DNA, 24 bp, Artificial sequence
  SiRNA target sequence
tttcaaccttagcaactttaaaat

SEQ ID NO: 204695 - DNA, 24 bp, Artificial sequence
  SiRNA target sequence
ttcaaccttagcaactttaaaata

SEQ ID NO: 204696 - DNA, 24 bp, Artificial sequence
  SiRNA target sequence
tcaaccttagcaactttaaaataa

SEQ ID NO: 204697 - DNA, 24 bp, Artificial sequence
  SiRNA target sequence
caaccttagcaactttaaaataac

SEQ ID NO: 204698 - DNA, 24 bp, Artificial sequence
  SiRNA target sequence
aaccttagcaactttaaaataact

SEQ ID NO: 204699 - DNA, 24 bp, Artificial sequence
  SiRNA target sequence
accttagcaactttaaaataactc

SEQ ID NO: 204700 - DNA, 24 bp, Artificial sequence
  SiRNA target sequence
ccttagcaactttaaaataactca

SEQ ID NO: 204701 - DNA, 24 bp, Artificial sequence
  SiRNA target sequence
cttagcaactttaaaataactcag

SEQ ID NO: 204702 - DNA, 24 bp, Artificial sequence
  SiRNA target sequence
ttagcaactttaaaataactcagt

SEQ ID NO: 204703 - DNA, 24 bp, Artificial sequence
  SiRNA target sequence
tagcaactttaaaataactcagta

SEQ ID NO: 204704 - DNA, 24 bp, Artificial sequence
  SiRNA target sequence
agcaactttaaaataactcagtaa

SEQ ID NO: 204705 - DNA, 24 bp, Artificial sequence
  SiRNA target sequence
gcaactttaaaataactcagtaat

SEQ ID NO: 204706 - DNA, 24 bp, Artificial sequence
  SiRNA target sequence
caactttaaaataactcagtaatc

SEQ ID NO: 204707 - DNA, 24 bp, Artificial sequence
  SiRNA target sequence
aactttaaaataactcagtaatcc

SEQ ID NO: 204708 - DNA, 24 bp, Artificial sequence
  SiRNA target sequence
actttaaaataactcagtaatcct

SEQ ID NO: 204709 - DNA, 24 bp, Artificial sequence
  SiRNA target sequence
ctttaaaataactcagtaatcctg

SEQ ID NO: 204710 - DNA, 24 bp, Artificial sequence
  SiRNA target sequence
tttaaaataactcagtaatcctgt

SEQ ID NO: 204711 - DNA, 24 bp, Artificial sequence
  SiRNA target sequence
ttaaaataactcagtaatcctgtt

SEQ ID NO: 204712 - DNA, 24 bp, Artificial sequence
  SiRNA target sequence
taaaataactcagtaatcctgttc

SEQ ID NO: 204713 - DNA, 24 bp, Artificial sequence
  SiRNA target sequence
aaaataactcagtaatcctgttct

SEQ ID NO: 204714 - DNA, 24 bp, Artificial sequence
  SiRNA target sequence
aaataactcagtaatcctgttctt

SEQ ID NO: 204715 - DNA, 24 bp, Artificial sequence
  SiRNA target sequence
aataactcagtaatcctgttcttg

SEQ ID NO: 204716 - DNA, 24 bp, Artificial sequence
  SiRNA target sequence
ataactcagtaatcctgttcttga

SEQ ID NO: 204717 - DNA, 24 bp, Artificial sequence
  SiRNA target sequence
taactcagtaatcctgttcttgaa

SEQ ID NO: 204718 - DNA, 24 bp, Artificial sequence
  SiRNA target sequence
aactcagtaatcctgttcttgaat

SEQ ID NO: 204719 - DNA, 24 bp, Artificial sequence
  SiRNA target sequence
actcagtaatcctgttcttgaatt

SEQ ID NO: 204720 - DNA, 24 bp, Artificial sequence
  SiRNA target sequence
ctcagtaatcctgttcttgaattt

SEQ ID NO: 204721 - DNA, 24 bp, Artificial sequence
  SiRNA target sequence
tcagtaatcctgttcttgaatttg

SEQ ID NO: 204722 - DNA, 24 bp, Artificial sequence
  SiRNA target sequence
cagtaatcctgttcttgaatttgc

SEQ ID NO: 204723 - DNA, 24 bp, Artificial sequence
  SiRNA target sequence
agtaatcctgttcttgaatttgct

SEQ ID NO: 204724 - DNA, 24 bp, Artificial sequence
  SiRNA target sequence
gtaatcctgttcttgaatttgcta

SEQ ID NO: 204725 - DNA, 24 bp, Artificial sequence
  SiRNA target sequence
taatcctgttcttgaatttgctaa

SEQ ID NO: 204726 - DNA, 24 bp, Artificial sequence
  SiRNA target sequence
aatcctgttcttgaatttgctaat

SEQ ID NO: 204727 - DNA, 24 bp, Artificial sequence
  SiRNA target sequence
atcctgttcttgaatttgctaatt

SEQ ID NO: 204728 - DNA, 24 bp, Artificial sequence
  SiRNA target sequence
tcctgttcttgaatttgctaattg

SEQ ID NO: 204729 - DNA, 24 bp, Artificial sequence
  SiRNA target sequence
cctgttcttgaatttgctaattga

SEQ ID NO: 204730 - DNA, 24 bp, Artificial sequence
  SiRNA target sequence
ctgttcttgaatttgctaattgat

SEQ ID NO: 204731 - DNA, 24 bp, Artificial sequence
  SiRNA target sequence
tgttcttgaatttgctaattgatc

SEQ ID NO: 204732 - DNA, 24 bp, Artificial sequence
  SiRNA target sequence
gttcttgaatttgctaattgatca

SEQ ID NO: 204733 - DNA, 24 bp, Artificial sequence
  SiRNA target sequence
ttcttgaatttgctaattgatcaa

SEQ ID NO: 204734 - DNA, 24 bp, Artificial sequence
  SiRNA target sequence
tcttgaatttgctaattgatcaat

SEQ ID NO: 204735 - DNA, 24 bp, Artificial sequence
  SiRNA target sequence
cttgaatttgctaattgatcaatc

SEQ ID NO: 204736 - DNA, 24 bp, Artificial sequence
  SiRNA target sequence
ttgaatttgctaattgatcaatct

SEQ ID NO: 204737 - DNA, 24 bp, Artificial sequence
  SiRNA target sequence
tgaatttgctaattgatcaatctc

SEQ ID NO: 204738 - DNA, 24 bp, Artificial sequence
  SiRNA target sequence
gaatttgctaattgatcaatctca

SEQ ID NO: 204739 - DNA, 24 bp, Artificial sequence
  SiRNA target sequence
aatttgctaattgatcaatctcat

SEQ ID NO: 204740 - DNA, 24 bp, Artificial sequence
  SiRNA target sequence
atttgctaattgatcaatctcatc

SEQ ID NO: 204741 - DNA, 24 bp, Artificial sequence
  SiRNA target sequence
tttgctaattgatcaatctcatct

SEQ ID NO: 204742 - DNA, 24 bp, Artificial sequence
  SiRNA target sequence
ttgctaattgatcaatctcatctt

SEQ ID NO: 204743 - DNA, 24 bp, Artificial sequence
  SiRNA target sequence
tgctaattgatcaatctcatcttc

SEQ ID NO: 204744 - DNA, 24 bp, Artificial sequence
  SiRNA target sequence
gctaattgatcaatctcatcttcc

SEQ ID NO: 204745 - DNA, 24 bp, Artificial sequence
  SiRNA target sequence
ctaattgatcaatctcatcttccg

SEQ ID NO: 204746 - DNA, 24 bp, Artificial sequence
  SiRNA target sequence
taattgatcaatctcatcttccgt

SEQ ID NO: 204747 - DNA, 24 bp, Artificial sequence
  SiRNA target sequence
aattgatcaatctcatcttccgta

SEQ ID NO: 204748 - DNA, 24 bp, Artificial sequence
  SiRNA target sequence
attgatcaatctcatcttccgtag

SEQ ID NO: 204749 - DNA, 24 bp, Artificial sequence
  SiRNA target sequence
ttgatcaatctcatcttccgtagg

SEQ ID NO: 204750 - DNA, 24 bp, Artificial sequence
  SiRNA target sequence
tgatcaatctcatcttccgtaggt

SEQ ID NO: 204751 - DNA, 24 bp, Artificial sequence
  SiRNA target sequence
gatcaatctcatcttccgtaggta

SEQ ID NO: 204752 - DNA, 24 bp, Artificial sequence
  SiRNA target sequence
atcaatctcatcttccgtaggtaa

SEQ ID NO: 204753 - DNA, 24 bp, Artificial sequence
  SiRNA target sequence
tcaatctcatcttccgtaggtaag

SEQ ID NO: 204754 - DNA, 24 bp, Artificial sequence
  SiRNA target sequence
caatctcatcttccgtaggtaagt

SEQ ID NO: 204755 - DNA, 24 bp, Artificial sequence
  SiRNA target sequence
aatctcatcttccgtaggtaagtt

SEQ ID NO: 204756 - DNA, 24 bp, Artificial sequence
  SiRNA target sequence
atctcatcttccgtaggtaagttg

SEQ ID NO: 204757 - DNA, 24 bp, Artificial sequence
  SiRNA target sequence
tctcatcttccgtaggtaagttgt

SEQ ID NO: 204758 - DNA, 24 bp, Artificial sequence
  SiRNA target sequence
ctcatcttccgtaggtaagttgtt

SEQ ID NO: 204759 - DNA, 24 bp, Artificial sequence
  SiRNA target sequence
tcatcttccgtaggtaagttgttt

SEQ ID NO: 204760 - DNA, 24 bp, Artificial sequence
  SiRNA target sequence
catcttccgtaggtaagttgtttt

SEQ ID NO: 204761 - DNA, 24 bp, Artificial sequence
  SiRNA target sequence
atcttccgtaggtaagttgttttc

SEQ ID NO: 204762 - DNA, 24 bp, Artificial sequence
  SiRNA target sequence
tcttccgtaggtaagttgttttca

SEQ ID NO: 204763 - DNA, 24 bp, Artificial sequence
  SiRNA target sequence
cttccgtaggtaagttgttttcag

SEQ ID NO: 204764 - DNA, 24 bp, Artificial sequence
  SiRNA target sequence
ttccgtaggtaagttgttttcagg

SEQ ID NO: 204765 - DNA, 24 bp, Artificial sequence
  SiRNA target sequence
tccgtaggtaagttgttttcaggt

SEQ ID NO: 204766 - DNA, 24 bp, Artificial sequence
  SiRNA target sequence
ccgtaggtaagttgttttcaggtg

SEQ ID NO: 204767 - DNA, 24 bp, Artificial sequence
  SiRNA target sequence
cgtaggtaagttgttttcaggtgt

SEQ ID NO: 204768 - DNA, 24 bp, Artificial sequence
  SiRNA target sequence
gtaggtaagttgttttcaggtgtt

SEQ ID NO: 204769 - DNA, 24 bp, Artificial sequence
  SiRNA target sequence
taggtaagttgttttcaggtgttt

SEQ ID NO: 204770 - DNA, 24 bp, Artificial sequence
  SiRNA target sequence
aggtaagttgttttcaggtgtttc

SEQ ID NO: 204771 - DNA, 24 bp, Artificial sequence
  SiRNA target sequence
ggtaagttgttttcaggtgtttca

SEQ ID NO: 204772 - DNA, 24 bp, Artificial sequence
  SiRNA target sequence
gtaagttgttttcaggtgtttcat

SEQ ID NO: 204773 - DNA, 24 bp, Artificial sequence
  SiRNA target sequence
taagttgttttcaggtgtttcatt

SEQ ID NO: 204774 - DNA, 24 bp, Artificial sequence
  SiRNA target sequence
aagttgttttcaggtgtttcattt

SEQ ID NO: 204775 - DNA, 24 bp, Artificial sequence
  SiRNA target sequence
agttgttttcaggtgtttcattta

SEQ ID NO: 204776 - DNA, 24 bp, Artificial sequence
  SiRNA target sequence
gttgttttcaggtgtttcatttat

SEQ ID NO: 204777 - DNA, 24 bp, Artificial sequence
  SiRNA target sequence
ttgttttcaggtgtttcatttatt

SEQ ID NO: 204778 - DNA, 24 bp, Artificial sequence
  SiRNA target sequence
tgttttcaggtgtttcatttatta

SEQ ID NO: 204779 - DNA, 24 bp, Artificial sequence
  SiRNA target sequence
gttttcaggtgtttcatttattac

SEQ ID NO: 204780 - DNA, 24 bp, Artificial sequence
  SiRNA target sequence
ttttcaggtgtttcatttattaca

SEQ ID NO: 204781 - DNA, 24 bp, Artificial sequence
  SiRNA target sequence
tttcaggtgtttcatttattacac

SEQ ID NO: 204782 - DNA, 24 bp, Artificial sequence
  SiRNA target sequence
ttcaggtgtttcatttattacact

SEQ ID NO: 204783 - DNA, 24 bp, Artificial sequence
  SiRNA target sequence
tcaggtgtttcatttattacactc

SEQ ID NO: 204784 - DNA, 24 bp, Artificial sequence
  SiRNA target sequence
caggtgtttcatttattacactca

SEQ ID NO: 204785 - DNA, 24 bp, Artificial sequence
  SiRNA target sequence
aggtgtttcatttattacactcat

SEQ ID NO: 204786 - DNA, 25 bp, Artificial sequence
  SiRNA target sequence
ttattctgcgttttcttttttgtcg

SEQ ID NO: 204787 - DNA, 25 bp, Artificial sequence
  SiRNA target sequence
tattctgcgttttcttttttgtcgt

SEQ ID NO: 204788 - DNA, 25 bp, Artificial sequence
  SiRNA target sequence
attctgcgttttcttttttgtcgtc

SEQ ID NO: 204789 - DNA, 25 bp, Artificial sequence
  SiRNA target sequence
ttctgcgttttcttttttgtcgtct

SEQ ID NO: 204790 - DNA, 25 bp, Artificial sequence
  SiRNA target sequence
tctgcgttttcttttttgtcgtctt

SEQ ID NO: 204791 - DNA, 25 bp, Artificial sequence
  SiRNA target sequence
ctgcgttttcttttttgtcgtcttt

SEQ ID NO: 204792 - DNA, 25 bp, Artificial sequence
  SiRNA target sequence
tgcgttttcttttttgtcgtctttt

SEQ ID NO: 204793 - DNA, 25 bp, Artificial sequence
  SiRNA target sequence
gcgttttcttttttgtcgtctttta

SEQ ID NO: 204794 - DNA, 25 bp, Artificial sequence
  SiRNA target sequence
cgttttcttttttgtcgtcttttat

SEQ ID NO: 204795 - DNA, 25 bp, Artificial sequence
  SiRNA target sequence
gttttcttttttgtcgtcttttatt

SEQ ID NO: 204796 - DNA, 25 bp, Artificial sequence
  SiRNA target sequence
ttttcttttttgtcgtcttttatta

SEQ ID NO: 204797 - DNA, 25 bp, Artificial sequence
  SiRNA target sequence
tttcttttttgtcgtcttttattaa

SEQ ID NO: 204798 - DNA, 25 bp, Artificial sequence
  SiRNA target sequence
ttcttttttgtcgtcttttattaaa

SEQ ID NO: 204799 - DNA, 25 bp, Artificial sequence
  SiRNA target sequence
tcttttttgtcgtcttttattaaat

SEQ ID NO: 204800 - DNA, 25 bp, Artificial sequence
  SiRNA target sequence
cttttttgtcgtcttttattaaatc

SEQ ID NO: 204801 - DNA, 25 bp, Artificial sequence
  SiRNA target sequence
ttttttgtcgtcttttattaaatct

SEQ ID NO: 204802 - DNA, 25 bp, Artificial sequence
  SiRNA target sequence
tttttgtcgtcttttattaaatcta

SEQ ID NO: 204803 - DNA, 25 bp, Artificial sequence
  SiRNA target sequence
ttttgtcgtcttttattaaatctat

SEQ ID NO: 204804 - DNA, 25 bp, Artificial sequence
  SiRNA target sequence
tttgtcgtcttttattaaatctatg

SEQ ID NO: 204805 - DNA, 25 bp, Artificial sequence
  SiRNA target sequence
ttgtcgtcttttattaaatctatgt

SEQ ID NO: 204806 - DNA, 25 bp, Artificial sequence
  SiRNA target sequence
tgtcgtcttttattaaatctatgtc

SEQ ID NO: 204807 - DNA, 25 bp, Artificial sequence
  SiRNA target sequence
gtcgtcttttattaaatctatgtct

SEQ ID NO: 204808 - DNA, 25 bp, Artificial sequence
  SiRNA target sequence
tcgtcttttattaaatctatgtcta

SEQ ID NO: 204809 - DNA, 25 bp, Artificial sequence
  SiRNA target sequence
cgtcttttattaaatctatgtctac

SEQ ID NO: 204810 - DNA, 25 bp, Artificial sequence
  SiRNA target sequence
gtcttttattaaatctatgtctaca

SEQ ID NO: 204811 - DNA, 25 bp, Artificial sequence
  SiRNA target sequence
tcttttattaaatctatgtctacac

SEQ ID NO: 204812 - DNA, 25 bp, Artificial sequence
  SiRNA target sequence
cttttattaaatctatgtctacact

SEQ ID NO: 204813 - DNA, 25 bp, Artificial sequence
  SiRNA target sequence
ttttattaaatctatgtctacactt

SEQ ID NO: 204814 - DNA, 25 bp, Artificial sequence
  SiRNA target sequence
tttattaaatctatgtctacacttg

SEQ ID NO: 204815 - DNA, 25 bp, Artificial sequence
  SiRNA target sequence
ttattaaatctatgtctacacttgt

SEQ ID NO: 204816 - DNA, 25 bp, Artificial sequence
  SiRNA target sequence
tattaaatctatgtctacacttgta

SEQ ID NO: 204817 - DNA, 25 bp, Artificial sequence
  SiRNA target sequence
attaaatctatgtctacacttgtat

SEQ ID NO: 204818 - DNA, 25 bp, Artificial sequence
  SiRNA target sequence
ttaaatctatgtctacacttgtatt

SEQ ID NO: 204819 - DNA, 25 bp, Artificial sequence
  SiRNA target sequence
taaatctatgtctacacttgtatta

SEQ ID NO: 204820 - DNA, 25 bp, Artificial sequence
  SiRNA target sequence
aaatctatgtctacacttgtattat

SEQ ID NO: 204821 - DNA, 25 bp, Artificial sequence
  SiRNA target sequence
aatctatgtctacacttgtattatt

SEQ ID NO: 204822 - DNA, 25 bp, Artificial sequence
  SiRNA target sequence
atctatgtctacacttgtattattt

SEQ ID NO: 204823 - DNA, 25 bp, Artificial sequence
  SiRNA target sequence
tctatgtctacacttgtattatttt

SEQ ID NO: 204824 - DNA, 25 bp, Artificial sequence
  SiRNA target sequence
ctatgtctacacttgtattattttt

SEQ ID NO: 204825 - DNA, 25 bp, Artificial sequence
  SiRNA target sequence
tatgtctacacttgtattattttta

SEQ ID NO: 204826 - DNA, 25 bp, Artificial sequence
  SiRNA target sequence
atgtctacacttgtattatttttaa

SEQ ID NO: 204827 - DNA, 25 bp, Artificial sequence
  SiRNA target sequence
tgtctacacttgtattatttttaat

SEQ ID NO: 204828 - DNA, 25 bp, Artificial sequence
  SiRNA target sequence
gtctacacttgtattatttttaatt

SEQ ID NO: 204829 - DNA, 25 bp, Artificial sequence
  SiRNA target sequence
tctacacttgtattatttttaattg

SEQ ID NO: 204830 - DNA, 25 bp, Artificial sequence
  SiRNA target sequence
ctacacttgtattatttttaattga

SEQ ID NO: 204831 - DNA, 25 bp, Artificial sequence
  SiRNA target sequence
tacacttgtattatttttaattgaa

SEQ ID NO: 204832 - DNA, 25 bp, Artificial sequence
  SiRNA target sequence
acacttgtattatttttaattgaaa

SEQ ID NO: 204833 - DNA, 25 bp, Artificial sequence
  SiRNA target sequence
cacttgtattatttttaattgaaac

SEQ ID NO: 204834 - DNA, 25 bp, Artificial sequence
  SiRNA target sequence
acttgtattatttttaattgaaacg

SEQ ID NO: 204835 - DNA, 25 bp, Artificial sequence
  SiRNA target sequence
cttgtattatttttaattgaaacgt

SEQ ID NO: 204836 - DNA, 25 bp, Artificial sequence
  SiRNA target sequence
ttgtattatttttaattgaaacgtt

SEQ ID NO: 204837 - DNA, 25 bp, Artificial sequence
  SiRNA target sequence
tgtattatttttaattgaaacgtta

SEQ ID NO: 204838 - DNA, 25 bp, Artificial sequence
  SiRNA target sequence
gtattatttttaattgaaacgttat

SEQ ID NO: 204839 - DNA, 25 bp, Artificial sequence
  SiRNA target sequence
tattatttttaattgaaacgttata

SEQ ID NO: 204840 - DNA, 25 bp, Artificial sequence
  SiRNA target sequence
attatttttaattgaaacgttatat

SEQ ID NO: 204841 - DNA, 25 bp, Artificial sequence
  SiRNA target sequence
ttatttttaattgaaacgttatatg

SEQ ID NO: 204842 - DNA, 25 bp, Artificial sequence
  SiRNA target sequence
tatttttaattgaaacgttatatgc

SEQ ID NO: 204843 - DNA, 25 bp, Artificial sequence
  SiRNA target sequence
atttttaattgaaacgttatatgca

SEQ ID NO: 204844 - DNA, 25 bp, Artificial sequence
  SiRNA target sequence
tttttaattgaaacgttatatgcac

SEQ ID NO: 204845 - DNA, 25 bp, Artificial sequence
  SiRNA target sequence
ttttaattgaaacgttatatgcacc

SEQ ID NO: 204846 - DNA, 25 bp, Artificial sequence
  SiRNA target sequence
tttaattgaaacgttatatgcaccc

SEQ ID NO: 204847 - DNA, 25 bp, Artificial sequence
  SiRNA target sequence
ttaattgaaacgttatatgcacccg

SEQ ID NO: 204848 - DNA, 25 bp, Artificial sequence
  SiRNA target sequence
taattgaaacgttatatgcacccgc

SEQ ID NO: 204849 - DNA, 25 bp, Artificial sequence
  SiRNA target sequence
aattgaaacgttatatgcacccgct

SEQ ID NO: 204850 - DNA, 25 bp, Artificial sequence
  SiRNA target sequence
attgaaacgttatatgcacccgcta

SEQ ID NO: 204851 - DNA, 25 bp, Artificial sequence
  SiRNA target sequence
ttgaaacgttatatgcacccgctaa

SEQ ID NO: 204852 - DNA, 25 bp, Artificial sequence
  SiRNA target sequence
tgaaacgttatatgcacccgctaaa

SEQ ID NO: 204853 - DNA, 25 bp, Artificial sequence
  SiRNA target sequence
gaaacgttatatgcacccgctaaat

SEQ ID NO: 204854 - DNA, 25 bp, Artificial sequence
  SiRNA target sequence
aaacgttatatgcacccgctaaata

SEQ ID NO: 204855 - DNA, 25 bp, Artificial sequence
  SiRNA target sequence
aacgttatatgcacccgctaaatag

SEQ ID NO: 204856 - DNA, 25 bp, Artificial sequence
  SiRNA target sequence
acgttatatgcacccgctaaataga

SEQ ID NO: 204857 - DNA, 25 bp, Artificial sequence
  SiRNA target sequence
cgttatatgcacccgctaaatagat

SEQ ID NO: 204858 - DNA, 25 bp, Artificial sequence
  SiRNA target sequence
gttatatgcacccgctaaatagatt

SEQ ID NO: 204859 - DNA, 25 bp, Artificial sequence
  SiRNA target sequence
ttatatgcacccgctaaatagatta

SEQ ID NO: 204860 - DNA, 25 bp, Artificial sequence
  SiRNA target sequence
tatatgcacccgctaaatagattat

SEQ ID NO: 204861 - DNA, 25 bp, Artificial sequence
  SiRNA target sequence
atatgcacccgctaaatagattata

SEQ ID NO: 204862 - DNA, 25 bp, Artificial sequence
  SiRNA target sequence
tatgcacccgctaaatagattatag

SEQ ID NO: 204863 - DNA, 25 bp, Artificial sequence
  SiRNA target sequence
atgcacccgctaaatagattatagc

SEQ ID NO: 204864 - DNA, 25 bp, Artificial sequence
  SiRNA target sequence
tgcacccgctaaatagattatagct

SEQ ID NO: 204865 - DNA, 25 bp, Artificial sequence
  SiRNA target sequence
gcacccgctaaatagattatagctc

SEQ ID NO: 204866 - DNA, 25 bp, Artificial sequence
  SiRNA target sequence
cacccgctaaatagattatagctct

SEQ ID NO: 204867 - DNA, 25 bp, Artificial sequence
  SiRNA target sequence
acccgctaaatagattatagctcta

SEQ ID NO: 204868 - DNA, 25 bp, Artificial sequence
  SiRNA target sequence
cccgctaaatagattatagctctaa

SEQ ID NO: 204869 - DNA, 25 bp, Artificial sequence
  SiRNA target sequence
ccgctaaatagattatagctctaat

SEQ ID NO: 204870 - DNA, 25 bp, Artificial sequence
  SiRNA target sequence
cgctaaatagattatagctctaatc

SEQ ID NO: 204871 - DNA, 25 bp, Artificial sequence
  SiRNA target sequence
gctaaatagattatagctctaatcc

SEQ ID NO: 204872 - DNA, 25 bp, Artificial sequence
  SiRNA target sequence
ctaaatagattatagctctaatcca

SEQ ID NO: 204873 - DNA, 25 bp, Artificial sequence
  SiRNA target sequence
taaatagattatagctctaatccaa

SEQ ID NO: 204874 - DNA, 25 bp, Artificial sequence
  SiRNA target sequence
aaatagattatagctctaatccaaa

SEQ ID NO: 204875 - DNA, 25 bp, Artificial sequence
  SiRNA target sequence
aatagattatagctctaatccaaat

SEQ ID NO: 204876 - DNA, 25 bp, Artificial sequence
  SiRNA target sequence
atagattatagctctaatccaaata

SEQ ID NO: 204877 - DNA, 25 bp, Artificial sequence
  SiRNA target sequence
tagattatagctctaatccaaatat

SEQ ID NO: 204878 - DNA, 25 bp, Artificial sequence
  SiRNA target sequence
agattatagctctaatccaaatata

SEQ ID NO: 204879 - DNA, 25 bp, Artificial sequence
  SiRNA target sequence
gattatagctctaatccaaatataa

SEQ ID NO: 204880 - DNA, 25 bp, Artificial sequence
  SiRNA target sequence
attatagctctaatccaaatataaa

SEQ ID NO: 204881 - DNA, 25 bp, Artificial sequence
  SiRNA target sequence
ttatagctctaatccaaatataaat

SEQ ID NO: 204882 - DNA, 25 bp, Artificial sequence
  SiRNA target sequence
tatagctctaatccaaatataaatc

SEQ ID NO: 204883 - DNA, 25 bp, Artificial sequence
  SiRNA target sequence
atagctctaatccaaatataaatca

SEQ ID NO: 204884 - DNA, 25 bp, Artificial sequence
  SiRNA target sequence
tagctctaatccaaatataaatcaa

SEQ ID NO: 204885 - DNA, 25 bp, Artificial sequence
  SiRNA target sequence
agctctaatccaaatataaatcaat

SEQ ID NO: 204886 - DNA, 25 bp, Artificial sequence
  SiRNA target sequence
gctctaatccaaatataaatcaata

SEQ ID NO: 204887 - DNA, 25 bp, Artificial sequence
  SiRNA target sequence
ctctaatccaaatataaatcaatat

SEQ ID NO: 204888 - DNA, 25 bp, Artificial sequence
  SiRNA target sequence
tctaatccaaatataaatcaatatt

SEQ ID NO: 204889 - DNA, 25 bp, Artificial sequence
  SiRNA target sequence
ctaatccaaatataaatcaatatta

SEQ ID NO: 204890 - DNA, 25 bp, Artificial sequence
  SiRNA target sequence
taatccaaatataaatcaatattat

SEQ ID NO: 204891 - DNA, 25 bp, Artificial sequence
  SiRNA target sequence
aatccaaatataaatcaatattatt

SEQ ID NO: 204892 - DNA, 25 bp, Artificial sequence
  SiRNA target sequence
atccaaatataaatcaatattattg

SEQ ID NO: 204893 - DNA, 25 bp, Artificial sequence
  SiRNA target sequence
tccaaatataaatcaatattattgc

SEQ ID NO: 204894 - DNA, 25 bp, Artificial sequence
  SiRNA target sequence
ccaaatataaatcaatattattgca

SEQ ID NO: 204895 - DNA, 25 bp, Artificial sequence
  SiRNA target sequence
caaatataaatcaatattattgcaa

SEQ ID NO: 204896 - DNA, 25 bp, Artificial sequence
  SiRNA target sequence
aaatataaatcaatattattgcaat

SEQ ID NO: 204897 - DNA, 25 bp, Artificial sequence
  SiRNA target sequence
aatataaatcaatattattgcaatc

SEQ ID NO: 204898 - DNA, 25 bp, Artificial sequence
  SiRNA target sequence
atataaatcaatattattgcaatcg

SEQ ID NO: 204899 - DNA, 25 bp, Artificial sequence
  SiRNA target sequence
tataaatcaatattattgcaatcgt

SEQ ID NO: 204900 - DNA, 25 bp, Artificial sequence
  SiRNA target sequence
ataaatcaatattattgcaatcgtt

SEQ ID NO: 204901 - DNA, 25 bp, Artificial sequence
  SiRNA target sequence
taaatcaatattattgcaatcgtta

SEQ ID NO: 204902 - DNA, 25 bp, Artificial sequence
  SiRNA target sequence
aaatcaatattattgcaatcgttaa

SEQ ID NO: 204903 - DNA, 25 bp, Artificial sequence
  SiRNA target sequence
aatcaatattattgcaatcgttaat

SEQ ID NO: 204904 - DNA, 25 bp, Artificial sequence
  SiRNA target sequence
atcaatattattgcaatcgttaatg

SEQ ID NO: 204905 - DNA, 25 bp, Artificial sequence
  SiRNA target sequence
tcaatattattgcaatcgttaatgt

SEQ ID NO: 204906 - DNA, 25 bp, Artificial sequence
  SiRNA target sequence
caatattattgcaatcgttaatgtg

SEQ ID NO: 204907 - DNA, 25 bp, Artificial sequence
  SiRNA target sequence
aatattattgcaatcgttaatgtga

SEQ ID NO: 204908 - DNA, 25 bp, Artificial sequence
  SiRNA target sequence
atattattgcaatcgttaatgtgat

SEQ ID NO: 204909 - DNA, 25 bp, Artificial sequence
  SiRNA target sequence
tattattgcaatcgttaatgtgatt

SEQ ID NO: 204910 - DNA, 25 bp, Artificial sequence
  SiRNA target sequence
attattgcaatcgttaatgtgattg

SEQ ID NO: 204911 - DNA, 25 bp, Artificial sequence
  SiRNA target sequence
ttattgcaatcgttaatgtgattgg

SEQ ID NO: 204912 - DNA, 25 bp, Artificial sequence
  SiRNA target sequence
tattgcaatcgttaatgtgattgga

SEQ ID NO: 204913 - DNA, 25 bp, Artificial sequence
  SiRNA target sequence
attgcaatcgttaatgtgattggac

SEQ ID NO: 204914 - DNA, 25 bp, Artificial sequence
  SiRNA target sequence
ttgcaatcgttaatgtgattggact

SEQ ID NO: 204915 - DNA, 25 bp, Artificial sequence
  SiRNA target sequence
tgcaatcgttaatgtgattggacta

SEQ ID NO: 204916 - DNA, 25 bp, Artificial sequence
  SiRNA target sequence
gcaatcgttaatgtgattggactac

SEQ ID NO: 204917 - DNA, 25 bp, Artificial sequence
  SiRNA target sequence
caatcgttaatgtgattggactacc

SEQ ID NO: 204918 - DNA, 25 bp, Artificial sequence
  SiRNA target sequence
aatcgttaatgtgattggactaccc

SEQ ID NO: 204919 - DNA, 25 bp, Artificial sequence
  SiRNA target sequence
atcgttaatgtgattggactaccct

SEQ ID NO: 204920 - DNA, 25 bp, Artificial sequence
  SiRNA target sequence
tcgttaatgtgattggactaccctt

SEQ ID NO: 204921 - DNA, 25 bp, Artificial sequence
  SiRNA target sequence
cgttaatgtgattggactacccttc

SEQ ID NO: 204922 - DNA, 25 bp, Artificial sequence
  SiRNA target sequence
gttaatgtgattggactacccttcc

SEQ ID NO: 204923 - DNA, 25 bp, Artificial sequence
  SiRNA target sequence
ttaatgtgattggactacccttcct

SEQ ID NO: 204924 - DNA, 25 bp, Artificial sequence
  SiRNA target sequence
taatgtgattggactacccttcctt

SEQ ID NO: 204925 - DNA, 25 bp, Artificial sequence
  SiRNA target sequence
aatgtgattggactacccttcctta

SEQ ID NO: 204926 - DNA, 25 bp, Artificial sequence
  SiRNA target sequence
atgtgattggactacccttccttac

SEQ ID NO: 204927 - DNA, 25 bp, Artificial sequence
  SiRNA target sequence
tgtgattggactacccttccttaca

SEQ ID NO: 204928 - DNA, 25 bp, Artificial sequence
  SiRNA target sequence
gtgattggactacccttccttacat

SEQ ID NO: 204929 - DNA, 25 bp, Artificial sequence
  SiRNA target sequence
tgattggactacccttccttacatt

SEQ ID NO: 204930 - DNA, 25 bp, Artificial sequence
  SiRNA target sequence
gattggactacccttccttacatta

SEQ ID NO: 204931 - DNA, 25 bp, Artificial sequence
  SiRNA target sequence
attggactacccttccttacattat

SEQ ID NO: 204932 - DNA, 25 bp, Artificial sequence
  SiRNA target sequence
ttggactacccttccttacattatc

SEQ ID NO: 204933 - DNA, 25 bp, Artificial sequence
  SiRNA target sequence
tggactacccttccttacattatca

SEQ ID NO: 204934 - DNA, 25 bp, Artificial sequence
  SiRNA target sequence
ggactacccttccttacattatcag

SEQ ID NO: 204935 - DNA, 25 bp, Artificial sequence
  SiRNA target sequence
gactacccttccttacattatcagt

SEQ ID NO: 204936 - DNA, 25 bp, Artificial sequence
  SiRNA target sequence
actacccttccttacattatcagta

SEQ ID NO: 204937 - DNA, 25 bp, Artificial sequence
  SiRNA target sequence
ctacccttccttacattatcagtat

SEQ ID NO: 204938 - DNA, 25 bp, Artificial sequence
  SiRNA target sequence
tacccttccttacattatcagtatc

SEQ ID NO: 204939 - DNA, 25 bp, Artificial sequence
  SiRNA target sequence
acccttccttacattatcagtatca

SEQ ID NO: 204940 - DNA, 25 bp, Artificial sequence
  SiRNA target sequence
cccttccttacattatcagtatcaa

SEQ ID NO: 204941 - DNA, 25 bp, Artificial sequence
  SiRNA target sequence
ccttccttacattatcagtatcaag

SEQ ID NO: 204942 - DNA, 25 bp, Artificial sequence
  SiRNA target sequence
cttccttacattatcagtatcaagt

SEQ ID NO: 204943 - DNA, 25 bp, Artificial sequence
  SiRNA target sequence
ttccttacattatcagtatcaagtg

SEQ ID NO: 204944 - DNA, 25 bp, Artificial sequence
  SiRNA target sequence
tccttacattatcagtatcaagtgc

SEQ ID NO: 204945 - DNA, 25 bp, Artificial sequence
  SiRNA target sequence
ccttacattatcagtatcaagtgct

SEQ ID NO: 204946 - DNA, 25 bp, Artificial sequence
  SiRNA target sequence
cttacattatcagtatcaagtgcta

SEQ ID NO: 204947 - DNA, 25 bp, Artificial sequence
  SiRNA target sequence
ttacattatcagtatcaagtgctac

SEQ ID NO: 204948 - DNA, 25 bp, Artificial sequence
  SiRNA target sequence
tacattatcagtatcaagtgctact

SEQ ID NO: 204949 - DNA, 25 bp, Artificial sequence
  SiRNA target sequence
acattatcagtatcaagtgctacta

SEQ ID NO: 204950 - DNA, 25 bp, Artificial sequence
  SiRNA target sequence
cattatcagtatcaagtgctactaa

SEQ ID NO: 204951 - DNA, 25 bp, Artificial sequence
  SiRNA target sequence
attatcagtatcaagtgctactaat

SEQ ID NO: 204952 - DNA, 25 bp, Artificial sequence
  SiRNA target sequence
ttatcagtatcaagtgctactaata

SEQ ID NO: 204953 - DNA, 25 bp, Artificial sequence
  SiRNA target sequence
tatcagtatcaagtgctactaatat

SEQ ID NO: 204954 - DNA, 25 bp, Artificial sequence
  SiRNA target sequence
atcagtatcaagtgctactaatatg

SEQ ID NO: 204955 - DNA, 25 bp, Artificial sequence
  SiRNA target sequence
tcagtatcaagtgctactaatatgg

SEQ ID NO: 204956 - DNA, 25 bp, Artificial sequence
  SiRNA target sequence
cagtatcaagtgctactaatatggc

SEQ ID NO: 204957 - DNA, 25 bp, Artificial sequence
  SiRNA target sequence
agtatcaagtgctactaatatggct

SEQ ID NO: 204958 - DNA, 25 bp, Artificial sequence
  SiRNA target sequence
gtatcaagtgctactaatatggcta

SEQ ID NO: 204959 - DNA, 25 bp, Artificial sequence
  SiRNA target sequence
tatcaagtgctactaatatggctag

SEQ ID NO: 204960 - DNA, 25 bp, Artificial sequence
  SiRNA target sequence
atcaagtgctactaatatggctagt

SEQ ID NO: 204961 - DNA, 25 bp, Artificial sequence
  SiRNA target sequence
tcaagtgctactaatatggctagtc

SEQ ID NO: 204962 - DNA, 25 bp, Artificial sequence
  SiRNA target sequence
caagtgctactaatatggctagtcc

SEQ ID NO: 204963 - DNA, 25 bp, Artificial sequence
  SiRNA target sequence
aagtgctactaatatggctagtcca

SEQ ID NO: 204964 - DNA, 25 bp, Artificial sequence
  SiRNA target sequence
agtgctactaatatggctagtccat

SEQ ID NO: 204965 - DNA, 25 bp, Artificial sequence
  SiRNA target sequence
gtgctactaatatggctagtccata

SEQ ID NO: 204966 - DNA, 25 bp, Artificial sequence
  SiRNA target sequence
tgctactaatatggctagtccatat

SEQ ID NO: 204967 - DNA, 25 bp, Artificial sequence
  SiRNA target sequence
gctactaatatggctagtccatata

SEQ ID NO: 204968 - DNA, 25 bp, Artificial sequence
  SiRNA target sequence
ctactaatatggctagtccatataa

SEQ ID NO: 204969 - DNA, 25 bp, Artificial sequence
  SiRNA target sequence
tactaatatggctagtccatataat

SEQ ID NO: 204970 - DNA, 25 bp, Artificial sequence
  SiRNA target sequence
actaatatggctagtccatataatg

SEQ ID NO: 204971 - DNA, 25 bp, Artificial sequence
  SiRNA target sequence
ctaatatggctagtccatataatga

SEQ ID NO: 204972 - DNA, 25 bp, Artificial sequence
  SiRNA target sequence
taatatggctagtccatataatgaa

SEQ ID NO: 204973 - DNA, 25 bp, Artificial sequence
  SiRNA target sequence
aatatggctagtccatataatgaac

SEQ ID NO: 204974 - DNA, 25 bp, Artificial sequence
  SiRNA target sequence
atatggctagtccatataatgaacc

SEQ ID NO: 204975 - DNA, 25 bp, Artificial sequence
  SiRNA target sequence
tatggctagtccatataatgaacca

SEQ ID NO: 204976 - DNA, 25 bp, Artificial sequence
  SiRNA target sequence
atggctagtccatataatgaaccaa

SEQ ID NO: 204977 - DNA, 25 bp, Artificial sequence
  SiRNA target sequence
tggctagtccatataatgaaccaat

SEQ ID NO: 204978 - DNA, 25 bp, Artificial sequence
  SiRNA target sequence
ggctagtccatataatgaaccaata

SEQ ID NO: 204979 - DNA, 25 bp, Artificial sequence
  SiRNA target sequence
gctagtccatataatgaaccaatag

SEQ ID NO: 204980 - DNA, 25 bp, Artificial sequence
  SiRNA target sequence
ctagtccatataatgaaccaataga

SEQ ID NO: 204981 - DNA, 25 bp, Artificial sequence
  SiRNA target sequence
tagtccatataatgaaccaatagat

SEQ ID NO: 204982 - DNA, 25 bp, Artificial sequence
  SiRNA target sequence
agtccatataatgaaccaatagatt

SEQ ID NO: 204983 - DNA, 25 bp, Artificial sequence
  SiRNA target sequence
gtccatataatgaaccaatagattt

SEQ ID NO: 204984 - DNA, 25 bp, Artificial sequence
  SiRNA target sequence
tccatataatgaaccaatagatttt

SEQ ID NO: 204985 - DNA, 25 bp, Artificial sequence
  SiRNA target sequence
ccatataatgaaccaatagattttc

SEQ ID NO: 204986 - DNA, 25 bp, Artificial sequence
  SiRNA target sequence
catataatgaaccaatagattttcc

SEQ ID NO: 204987 - DNA, 25 bp, Artificial sequence
  SiRNA target sequence
atataatgaaccaatagattttcct

SEQ ID NO: 204988 - DNA, 25 bp, Artificial sequence
  SiRNA target sequence
tataatgaaccaatagattttccta

SEQ ID NO: 204989 - DNA, 25 bp, Artificial sequence
  SiRNA target sequence
ataatgaaccaatagattttcctaa

SEQ ID NO: 204990 - DNA, 25 bp, Artificial sequence
  SiRNA target sequence
taatgaaccaatagattttcctaat

SEQ ID NO: 204991 - DNA, 25 bp, Artificial sequence
  SiRNA target sequence
aatgaaccaatagattttcctaatt

SEQ ID NO: 204992 - DNA, 25 bp, Artificial sequence
  SiRNA target sequence
atgaaccaatagattttcctaattt

SEQ ID NO: 204993 - DNA, 25 bp, Artificial sequence
  SiRNA target sequence
tgaaccaatagattttcctaattta

SEQ ID NO: 204994 - DNA, 25 bp, Artificial sequence
  SiRNA target sequence
gaaccaatagattttcctaatttat

SEQ ID NO: 204995 - DNA, 25 bp, Artificial sequence
  SiRNA target sequence
aaccaatagattttcctaatttatt

SEQ ID NO: 204996 - DNA, 25 bp, Artificial sequence
  SiRNA target sequence
accaatagattttcctaatttatta

SEQ ID NO: 204997 - DNA, 25 bp, Artificial sequence
  SiRNA target sequence
ccaatagattttcctaatttattaa

SEQ ID NO: 204998 - DNA, 25 bp, Artificial sequence
  SiRNA target sequence
caatagattttcctaatttattaaa

SEQ ID NO: 204999 - DNA, 25 bp, Artificial sequence
  SiRNA target sequence
aatagattttcctaatttattaaaa

SEQ ID NO: 205000 - DNA, 25 bp, Artificial sequence
  SiRNA target sequence
atagattttcctaatttattaaaaa

SEQ ID NO: 205001 - DNA, 25 bp, Artificial sequence
  SiRNA target sequence
tagattttcctaatttattaaaaat

SEQ ID NO: 205002 - DNA, 25 bp, Artificial sequence
  SiRNA target sequence
agattttcctaatttattaaaaata

SEQ ID NO: 205003 - DNA, 25 bp, Artificial sequence
  SiRNA target sequence
gattttcctaatttattaaaaatac

SEQ ID NO: 205004 - DNA, 25 bp, Artificial sequence
  SiRNA target sequence
attttcctaatttattaaaaatacc

SEQ ID NO: 205005 - DNA, 25 bp, Artificial sequence
  SiRNA target sequence
ttttcctaatttattaaaaatacca

SEQ ID NO: 205006 - DNA, 25 bp, Artificial sequence
  SiRNA target sequence
tttcctaatttattaaaaataccat

SEQ ID NO: 205007 - DNA, 25 bp, Artificial sequence
  SiRNA target sequence
ttcctaatttattaaaaataccatc

SEQ ID NO: 205008 - DNA, 25 bp, Artificial sequence
  SiRNA target sequence
tcctaatttattaaaaataccatca

SEQ ID NO: 205009 - DNA, 25 bp, Artificial sequence
  SiRNA target sequence
cctaatttattaaaaataccatcat

SEQ ID NO: 205010 - DNA, 25 bp, Artificial sequence
  SiRNA target sequence
ctaatttattaaaaataccatcata

SEQ ID NO: 205011 - DNA, 25 bp, Artificial sequence
  SiRNA target sequence
taatttattaaaaataccatcataa

SEQ ID NO: 205012 - DNA, 25 bp, Artificial sequence
  SiRNA target sequence
aatttattaaaaataccatcataaa

SEQ ID NO: 205013 - DNA, 25 bp, Artificial sequence
  SiRNA target sequence
atttattaaaaataccatcataaac

SEQ ID NO: 205014 - DNA, 25 bp, Artificial sequence
  SiRNA target sequence
tttattaaaaataccatcataaaca

SEQ ID NO: 205015 - DNA, 25 bp, Artificial sequence
  SiRNA target sequence
ttattaaaaataccatcataaacac

SEQ ID NO: 205016 - DNA, 25 bp, Artificial sequence
  SiRNA target sequence
tattaaaaataccatcataaacact

SEQ ID NO: 205017 - DNA, 25 bp, Artificial sequence
  SiRNA target sequence
attaaaaataccatcataaacactt

SEQ ID NO: 205018 - DNA, 25 bp, Artificial sequence
  SiRNA target sequence
ttaaaaataccatcataaacacttt

SEQ ID NO: 205019 - DNA, 25 bp, Artificial sequence
  SiRNA target sequence
taaaaataccatcataaacactttt

SEQ ID NO: 205020 - DNA, 25 bp, Artificial sequence
  SiRNA target sequence
aaaaataccatcataaacactttta

SEQ ID NO: 205021 - DNA, 25 bp, Artificial sequence
  SiRNA target sequence
aaaataccatcataaacacttttaa

SEQ ID NO: 205022 - DNA, 25 bp, Artificial sequence
  SiRNA target sequence
aaataccatcataaacacttttaaa

SEQ ID NO: 205023 - DNA, 25 bp, Artificial sequence
  SiRNA target sequence
aataccatcataaacacttttaaac

SEQ ID NO: 205024 - DNA, 25 bp, Artificial sequence
  SiRNA target sequence
ataccatcataaacacttttaaacc

SEQ ID NO: 205025 - DNA, 25 bp, Artificial sequence
  SiRNA target sequence
taccatcataaacacttttaaaccg

SEQ ID NO: 205026 - DNA, 25 bp, Artificial sequence
  SiRNA target sequence
accatcataaacacttttaaaccgt

SEQ ID NO: 205027 - DNA, 25 bp, Artificial sequence
  SiRNA target sequence
ccatcataaacacttttaaaccgtg

SEQ ID NO: 205028 - DNA, 25 bp, Artificial sequence
  SiRNA target sequence
catcataaacacttttaaaccgtgc

SEQ ID NO: 205029 - DNA, 25 bp, Artificial sequence
  SiRNA target sequence
atcataaacacttttaaaccgtgcc

SEQ ID NO: 205030 - DNA, 25 bp, Artificial sequence
  SiRNA target sequence
tcataaacacttttaaaccgtgccc

SEQ ID NO: 205031 - DNA, 25 bp, Artificial sequence
  SiRNA target sequence
cataaacacttttaaaccgtgccct

SEQ ID NO: 205032 - DNA, 25 bp, Artificial sequence
  SiRNA target sequence
ataaacacttttaaaccgtgccctg

SEQ ID NO: 205033 - DNA, 25 bp, Artificial sequence
  SiRNA target sequence
taaacacttttaaaccgtgccctgt

SEQ ID NO: 205034 - DNA, 25 bp, Artificial sequence
  SiRNA target sequence
aaacacttttaaaccgtgccctgtg

SEQ ID NO: 205035 - DNA, 25 bp, Artificial sequence
  SiRNA target sequence
aacacttttaaaccgtgccctgtgt

SEQ ID NO: 205036 - DNA, 25 bp, Artificial sequence
  SiRNA target sequence
acacttttaaaccgtgccctgtgtg

SEQ ID NO: 205037 - DNA, 25 bp, Artificial sequence
  SiRNA target sequence
cacttttaaaccgtgccctgtgtgc

SEQ ID NO: 205038 - DNA, 25 bp, Artificial sequence
  SiRNA target sequence
acttttaaaccgtgccctgtgtgca

SEQ ID NO: 205039 - DNA, 25 bp, Artificial sequence
  SiRNA target sequence
cttttaaaccgtgccctgtgtgcag

SEQ ID NO: 205040 - DNA, 25 bp, Artificial sequence
  SiRNA target sequence
ttttaaaccgtgccctgtgtgcagg

SEQ ID NO: 205041 - DNA, 25 bp, Artificial sequence
  SiRNA target sequence
tttaaaccgtgccctgtgtgcagga

SEQ ID NO: 205042 - DNA, 25 bp, Artificial sequence
  SiRNA target sequence
ttaaaccgtgccctgtgtgcaggat

SEQ ID NO: 205043 - DNA, 25 bp, Artificial sequence
  SiRNA target sequence
taaaccgtgccctgtgtgcaggatc

SEQ ID NO: 205044 - DNA, 25 bp, Artificial sequence
  SiRNA target sequence
aaaccgtgccctgtgtgcaggatcg

SEQ ID NO: 205045 - DNA, 25 bp, Artificial sequence
  SiRNA target sequence
aaccgtgccctgtgtgcaggatcga

SEQ ID NO: 205046 - DNA, 25 bp, Artificial sequence
  SiRNA target sequence
accgtgccctgtgtgcaggatcgat

SEQ ID NO: 205047 - DNA, 25 bp, Artificial sequence
  SiRNA target sequence
ccgtgccctgtgtgcaggatcgatt

SEQ ID NO: 205048 - DNA, 25 bp, Artificial sequence
  SiRNA target sequence
cgtgccctgtgtgcaggatcgattc

SEQ ID NO: 205049 - DNA, 25 bp, Artificial sequence
  SiRNA target sequence
gtgccctgtgtgcaggatcgattct

SEQ ID NO: 205050 - DNA, 25 bp, Artificial sequence
  SiRNA target sequence
tgccctgtgtgcaggatcgattctc

SEQ ID NO: 205051 - DNA, 25 bp, Artificial sequence
  SiRNA target sequence
gccctgtgtgcaggatcgattctca

SEQ ID NO: 205052 - DNA, 25 bp, Artificial sequence
  SiRNA target sequence
ccctgtgtgcaggatcgattctcat

SEQ ID NO: 205053 - DNA, 25 bp, Artificial sequence
  SiRNA target sequence
cctgtgtgcaggatcgattctcata

SEQ ID NO: 205054 - DNA, 25 bp, Artificial sequence
  SiRNA target sequence
ctgtgtgcaggatcgattctcatac

SEQ ID NO: 205055 - DNA, 25 bp, Artificial sequence
  SiRNA target sequence
tgtgtgcaggatcgattctcatacc

SEQ ID NO: 205056 - DNA, 25 bp, Artificial sequence
  SiRNA target sequence
gtgtgcaggatcgattctcataccc

SEQ ID NO: 205057 - DNA, 25 bp, Artificial sequence
  SiRNA target sequence
tgtgcaggatcgattctcataccca

SEQ ID NO: 205058 - DNA, 25 bp, Artificial sequence
  SiRNA target sequence
gtgcaggatcgattctcatacccat

SEQ ID NO: 205059 - DNA, 25 bp, Artificial sequence
  SiRNA target sequence
tgcaggatcgattctcatacccatt

SEQ ID NO: 205060 - DNA, 25 bp, Artificial sequence
  SiRNA target sequence
gcaggatcgattctcatacccattt

SEQ ID NO: 205061 - DNA, 25 bp, Artificial sequence
  SiRNA target sequence
caggatcgattctcatacccatttt

SEQ ID NO: 205062 - DNA, 25 bp, Artificial sequence
  SiRNA target sequence
aggatcgattctcatacccattttc

SEQ ID NO: 205063 - DNA, 25 bp, Artificial sequence
  SiRNA target sequence
ggatcgattctcatacccattttct

SEQ ID NO: 205064 - DNA, 25 bp, Artificial sequence
  SiRNA target sequence
gatcgattctcatacccattttctc

SEQ ID NO: 205065 - DNA, 25 bp, Artificial sequence
  SiRNA target sequence
atcgattctcatacccattttctct

SEQ ID NO: 205066 - DNA, 25 bp, Artificial sequence
  SiRNA target sequence
tcgattctcatacccattttctctt

SEQ ID NO: 205067 - DNA, 25 bp, Artificial sequence
  SiRNA target sequence
cgattctcatacccattttctcttt

SEQ ID NO: 205068 - DNA, 25 bp, Artificial sequence
  SiRNA target sequence
gattctcatacccattttctcttta

SEQ ID NO: 205069 - DNA, 25 bp, Artificial sequence
  SiRNA target sequence
attctcatacccattttctctttac

SEQ ID NO: 205070 - DNA, 25 bp, Artificial sequence
  SiRNA target sequence
ttctcatacccattttctctttaca

SEQ ID NO: 205071 - DNA, 25 bp, Artificial sequence
  SiRNA target sequence
tctcatacccattttctctttacaa

SEQ ID NO: 205072 - DNA, 25 bp, Artificial sequence
  SiRNA target sequence
ctcatacccattttctctttacaaa

SEQ ID NO: 205073 - DNA, 25 bp, Artificial sequence
  SiRNA target sequence
tcatacccattttctctttacaaat

SEQ ID NO: 205074 - DNA, 25 bp, Artificial sequence
  SiRNA target sequence
catacccattttctctttacaaata

SEQ ID NO: 205075 - DNA, 25 bp, Artificial sequence
  SiRNA target sequence
atacccattttctctttacaaatat

SEQ ID NO: 205076 - DNA, 25 bp, Artificial sequence
  SiRNA target sequence
tacccattttctctttacaaatatc

SEQ ID NO: 205077 - DNA, 25 bp, Artificial sequence
  SiRNA target sequence
acccattttctctttacaaatatca

SEQ ID NO: 205078 - DNA, 25 bp, Artificial sequence
  SiRNA target sequence
cccattttctctttacaaatatcaa

SEQ ID NO: 205079 - DNA, 25 bp, Artificial sequence
  SiRNA target sequence
ccattttctctttacaaatatcaaa

SEQ ID NO: 205080 - DNA, 25 bp, Artificial sequence
  SiRNA target sequence
cattttctctttacaaatatcaaag

SEQ ID NO: 205081 - DNA, 25 bp, Artificial sequence
  SiRNA target sequence
attttctctttacaaatatcaaagg

SEQ ID NO: 205082 - DNA, 25 bp, Artificial sequence
  SiRNA target sequence
ttttctctttacaaatatcaaaggc

SEQ ID NO: 205083 - DNA, 25 bp, Artificial sequence
  SiRNA target sequence
tttctctttacaaatatcaaaggct

SEQ ID NO: 205084 - DNA, 25 bp, Artificial sequence
  SiRNA target sequence
ttctctttacaaatatcaaaggctg

SEQ ID NO: 205085 - DNA, 25 bp, Artificial sequence
  SiRNA target sequence
tctctttacaaatatcaaaggctga

SEQ ID NO: 205086 - DNA, 25 bp, Artificial sequence
  SiRNA target sequence
ctctttacaaatatcaaaggctgaa

SEQ ID NO: 205087 - DNA, 25 bp, Artificial sequence
  SiRNA target sequence
tctttacaaatatcaaaggctgaat

SEQ ID NO: 205088 - DNA, 25 bp, Artificial sequence
  SiRNA target sequence
ctttacaaatatcaaaggctgaata

SEQ ID NO: 205089 - DNA, 25 bp, Artificial sequence
  SiRNA target sequence
tttacaaatatcaaaggctgaatat

SEQ ID NO: 205090 - DNA, 25 bp, Artificial sequence
  SiRNA target sequence
ttacaaatatcaaaggctgaatatt

SEQ ID NO: 205091 - DNA, 25 bp, Artificial sequence
  SiRNA target sequence
tacaaatatcaaaggctgaatattt

SEQ ID NO: 205092 - DNA, 25 bp, Artificial sequence
  SiRNA target sequence
acaaatatcaaaggctgaatatttt

SEQ ID NO: 205093 - DNA, 25 bp, Artificial sequence
  SiRNA target sequence
caaatatcaaaggctgaatatttta

SEQ ID NO: 205094 - DNA, 25 bp, Artificial sequence
  SiRNA target sequence
aaatatcaaaggctgaatattttaa

SEQ ID NO: 205095 - DNA, 25 bp, Artificial sequence
  SiRNA target sequence
aatatcaaaggctgaatattttaat

SEQ ID NO: 205096 - DNA, 25 bp, Artificial sequence
  SiRNA target sequence
atatcaaaggctgaatattttaata

SEQ ID NO: 205097 - DNA, 25 bp, Artificial sequence
  SiRNA target sequence
tatcaaaggctgaatattttaatac

SEQ ID NO: 205098 - DNA, 25 bp, Artificial sequence
  SiRNA target sequence
atcaaaggctgaatattttaatact

SEQ ID NO: 205099 - DNA, 25 bp, Artificial sequence
  SiRNA target sequence
tcaaaggctgaatattttaatactt

SEQ ID NO: 205100 - DNA, 25 bp, Artificial sequence
  SiRNA target sequence
caaaggctgaatattttaatacttt

SEQ ID NO: 205101 - DNA, 25 bp, Artificial sequence
  SiRNA target sequence
aaaggctgaatattttaatactttt

SEQ ID NO: 205102 - DNA, 25 bp, Artificial sequence
  SiRNA target sequence
aaggctgaatattttaatactttta

SEQ ID NO: 205103 - DNA, 25 bp, Artificial sequence
  SiRNA target sequence
aggctgaatattttaatacttttat

SEQ ID NO: 205104 - DNA, 25 bp, Artificial sequence
  SiRNA target sequence
ggctgaatattttaatacttttatg

SEQ ID NO: 205105 - DNA, 25 bp, Artificial sequence
  SiRNA target sequence
gctgaatattttaatacttttatga

SEQ ID NO: 205106 - DNA, 25 bp, Artificial sequence
  SiRNA target sequence
ctgaatattttaatacttttatgaa

SEQ ID NO: 205107 - DNA, 25 bp, Artificial sequence
  SiRNA target sequence
tgaatattttaatacttttatgaat

SEQ ID NO: 205108 - DNA, 25 bp, Artificial sequence
  SiRNA target sequence
gaatattttaatacttttatgaatg

SEQ ID NO: 205109 - DNA, 25 bp, Artificial sequence
  SiRNA target sequence
aatattttaatacttttatgaatgc

SEQ ID NO: 205110 - DNA, 25 bp, Artificial sequence
  SiRNA target sequence
atattttaatacttttatgaatgct

SEQ ID NO: 205111 - DNA, 25 bp, Artificial sequence
  SiRNA target sequence
tattttaatacttttatgaatgcta

SEQ ID NO: 205112 - DNA, 25 bp, Artificial sequence
  SiRNA target sequence
attttaatacttttatgaatgctaa

SEQ ID NO: 205113 - DNA, 25 bp, Artificial sequence
  SiRNA target sequence
ttttaatacttttatgaatgctaaa

SEQ ID NO: 205114 - DNA, 25 bp, Artificial sequence
  SiRNA target sequence
tttaatacttttatgaatgctaaaa

SEQ ID NO: 205115 - DNA, 25 bp, Artificial sequence
  SiRNA target sequence
ttaatacttttatgaatgctaaaaa

SEQ ID NO: 205116 - DNA, 25 bp, Artificial sequence
  SiRNA target sequence
taatacttttatgaatgctaaaaag

SEQ ID NO: 205117 - DNA, 25 bp, Artificial sequence
  SiRNA target sequence
aatacttttatgaatgctaaaaaga

SEQ ID NO: 205118 - DNA, 25 bp, Artificial sequence
  SiRNA target sequence
atacttttatgaatgctaaaaagaa

SEQ ID NO: 205119 - DNA, 25 bp, Artificial sequence
  SiRNA target sequence
tacttttatgaatgctaaaaagaac

SEQ ID NO: 205120 - DNA, 25 bp, Artificial sequence
  SiRNA target sequence
acttttatgaatgctaaaaagaaca

SEQ ID NO: 205121 - DNA, 25 bp, Artificial sequence
  SiRNA target sequence
cttttatgaatgctaaaaagaacat

SEQ ID NO: 205122 - DNA, 25 bp, Artificial sequence
  SiRNA target sequence
ttttatgaatgctaaaaagaacatt

SEQ ID NO: 205123 - DNA, 25 bp, Artificial sequence
  SiRNA target sequence
tttatgaatgctaaaaagaacattc

SEQ ID NO: 205124 - DNA, 25 bp, Artificial sequence
  SiRNA target sequence
ttatgaatgctaaaaagaacattcc

SEQ ID NO: 205125 - DNA, 25 bp, Artificial sequence
  SiRNA target sequence
tatgaatgctaaaaagaacattcca

SEQ ID NO: 205126 - DNA, 25 bp, Artificial sequence
  SiRNA target sequence
atgaatgctaaaaagaacattccac

SEQ ID NO: 205127 - DNA, 25 bp, Artificial sequence
  SiRNA target sequence
tgaatgctaaaaagaacattccact

SEQ ID NO: 205128 - DNA, 25 bp, Artificial sequence
  SiRNA target sequence
gaatgctaaaaagaacattccactg

SEQ ID NO: 205129 - DNA, 25 bp, Artificial sequence
  SiRNA target sequence
aatgctaaaaagaacattccactgt

SEQ ID NO: 205130 - DNA, 25 bp, Artificial sequence
  SiRNA target sequence
atgctaaaaagaacattccactgta

SEQ ID NO: 205131 - DNA, 25 bp, Artificial sequence
  SiRNA target sequence
tgctaaaaagaacattccactgtaa

SEQ ID NO: 205132 - DNA, 25 bp, Artificial sequence
  SiRNA target sequence
gctaaaaagaacattccactgtaat

SEQ ID NO: 205133 - DNA, 25 bp, Artificial sequence
  SiRNA target sequence
ctaaaaagaacattccactgtaatt

SEQ ID NO: 205134 - DNA, 25 bp, Artificial sequence
  SiRNA target sequence
taaaaagaacattccactgtaattt

SEQ ID NO: 205135 - DNA, 25 bp, Artificial sequence
  SiRNA target sequence
aaaaagaacattccactgtaatttt

SEQ ID NO: 205136 - DNA, 25 bp, Artificial sequence
  SiRNA target sequence
aaaagaacattccactgtaattttc

SEQ ID NO: 205137 - DNA, 25 bp, Artificial sequence
  SiRNA target sequence
aaagaacattccactgtaattttcg

SEQ ID NO: 205138 - DNA, 25 bp, Artificial sequence
  SiRNA target sequence
aagaacattccactgtaattttcga

SEQ ID NO: 205139 - DNA, 25 bp, Artificial sequence
  SiRNA target sequence
agaacattccactgtaattttcgat

SEQ ID NO: 205140 - DNA, 25 bp, Artificial sequence
  SiRNA target sequence
gaacattccactgtaattttcgatc

SEQ ID NO: 205141 - DNA, 25 bp, Artificial sequence
  SiRNA target sequence
aacattccactgtaattttcgatcg

SEQ ID NO: 205142 - DNA, 25 bp, Artificial sequence
  SiRNA target sequence
acattccactgtaattttcgatcgt

SEQ ID NO: 205143 - DNA, 25 bp, Artificial sequence
  SiRNA target sequence
cattccactgtaattttcgatcgta

SEQ ID NO: 205144 - DNA, 25 bp, Artificial sequence
  SiRNA target sequence
attccactgtaattttcgatcgtat

SEQ ID NO: 205145 - DNA, 25 bp, Artificial sequence
  SiRNA target sequence
ttccactgtaattttcgatcgtata

SEQ ID NO: 205146 - DNA, 25 bp, Artificial sequence
  SiRNA target sequence
tccactgtaattttcgatcgtataa

SEQ ID NO: 205147 - DNA, 25 bp, Artificial sequence
  SiRNA target sequence
ccactgtaattttcgatcgtataaa

SEQ ID NO: 205148 - DNA, 25 bp, Artificial sequence
  SiRNA target sequence
cactgtaattttcgatcgtataaat

SEQ ID NO: 205149 - DNA, 25 bp, Artificial sequence
  SiRNA target sequence
actgtaattttcgatcgtataaatg

SEQ ID NO: 205150 - DNA, 25 bp, Artificial sequence
  SiRNA target sequence
ctgtaattttcgatcgtataaatgt

SEQ ID NO: 205151 - DNA, 25 bp, Artificial sequence
  SiRNA target sequence
tgtaattttcgatcgtataaatgta

SEQ ID NO: 205152 - DNA, 25 bp, Artificial sequence
  SiRNA target sequence
gtaattttcgatcgtataaatgtac

SEQ ID NO: 205153 - DNA, 25 bp, Artificial sequence
  SiRNA target sequence
taattttcgatcgtataaatgtacg

SEQ ID NO: 205154 - DNA, 25 bp, Artificial sequence
  SiRNA target sequence
aattttcgatcgtataaatgtacga

SEQ ID NO: 205155 - DNA, 25 bp, Artificial sequence
  SiRNA target sequence
attttcgatcgtataaatgtacgac

SEQ ID NO: 205156 - DNA, 25 bp, Artificial sequence
  SiRNA target sequence
ttttcgatcgtataaatgtacgaca

SEQ ID NO: 205157 - DNA, 25 bp, Artificial sequence
  SiRNA target sequence
tttcgatcgtataaatgtacgacat

SEQ ID NO: 205158 - DNA, 25 bp, Artificial sequence
  SiRNA target sequence
ttcgatcgtataaatgtacgacatt

SEQ ID NO: 205159 - DNA, 25 bp, Artificial sequence
  SiRNA target sequence
tcgatcgtataaatgtacgacattt

SEQ ID NO: 205160 - DNA, 25 bp, Artificial sequence
  SiRNA target sequence
cgatcgtataaatgtacgacatttt

SEQ ID NO: 205161 - DNA, 25 bp, Artificial sequence
  SiRNA target sequence
gatcgtataaatgtacgacattttt

SEQ ID NO: 205162 - DNA, 25 bp, Artificial sequence
  SiRNA target sequence
atcgtataaatgtacgacatttttt

SEQ ID NO: 205163 - DNA, 25 bp, Artificial sequence
  SiRNA target sequence
tcgtataaatgtacgacattttttt

SEQ ID NO: 205164 - DNA, 25 bp, Artificial sequence
  SiRNA target sequence
cgtataaatgtacgacattttttta

SEQ ID NO: 205165 - DNA, 25 bp, Artificial sequence
  SiRNA target sequence
gtataaatgtacgacatttttttaa

SEQ ID NO: 205166 - DNA, 25 bp, Artificial sequence
  SiRNA target sequence
tataaatgtacgacatttttttaaa

SEQ ID NO: 205167 - DNA, 25 bp, Artificial sequence
  SiRNA target sequence
ataaatgtacgacatttttttaaaa

SEQ ID NO: 205168 - DNA, 25 bp, Artificial sequence
  SiRNA target sequence
taaatgtacgacatttttttaaaaa

SEQ ID NO: 205169 - DNA, 25 bp, Artificial sequence
  SiRNA target sequence
aaatgtacgacatttttttaaaaaa

SEQ ID NO: 205170 - DNA, 25 bp, Artificial sequence
  SiRNA target sequence
aatgtacgacatttttttaaaaaat

SEQ ID NO: 205171 - DNA, 25 bp, Artificial sequence
  SiRNA target sequence
atgtacgacatttttttaaaaaata

SEQ ID NO: 205172 - DNA, 25 bp, Artificial sequence
  SiRNA target sequence
tgtacgacatttttttaaaaaatac

SEQ ID NO: 205173 - DNA, 25 bp, Artificial sequence
  SiRNA target sequence
gtacgacatttttttaaaaaataca

SEQ ID NO: 205174 - DNA, 25 bp, Artificial sequence
  SiRNA target sequence
tacgacatttttttaaaaaatacag

SEQ ID NO: 205175 - DNA, 25 bp, Artificial sequence
  SiRNA target sequence
acgacatttttttaaaaaatacaga

SEQ ID NO: 205176 - DNA, 25 bp, Artificial sequence
  SiRNA target sequence
cgacatttttttaaaaaatacagaa

SEQ ID NO: 205177 - DNA, 25 bp, Artificial sequence
  SiRNA target sequence
gacatttttttaaaaaatacagaaa

SEQ ID NO: 205178 - DNA, 25 bp, Artificial sequence
  SiRNA target sequence
acatttttttaaaaaatacagaaat

SEQ ID NO: 205179 - DNA, 25 bp, Artificial sequence
  SiRNA target sequence
catttttttaaaaaatacagaaatc

SEQ ID NO: 205180 - DNA, 25 bp, Artificial sequence
  SiRNA target sequence
atttttttaaaaaatacagaaatcc

SEQ ID NO: 205181 - DNA, 25 bp, Artificial sequence
  SiRNA target sequence
tttttttaaaaaatacagaaatcca

SEQ ID NO: 205182 - DNA, 25 bp, Artificial sequence
  SiRNA target sequence
ttttttaaaaaatacagaaatccat

SEQ ID NO: 205183 - DNA, 25 bp, Artificial sequence
  SiRNA target sequence
tttttaaaaaatacagaaatccatg

SEQ ID NO: 205184 - DNA, 25 bp, Artificial sequence
  SiRNA target sequence
ttttaaaaaatacagaaatccatga

SEQ ID NO: 205185 - DNA, 25 bp, Artificial sequence
  SiRNA target sequence
tttaaaaaatacagaaatccatgaa

SEQ ID NO: 205186 - DNA, 25 bp, Artificial sequence
  SiRNA target sequence
ttaaaaaatacagaaatccatgaaa

SEQ ID NO: 205187 - DNA, 25 bp, Artificial sequence
  SiRNA target sequence
taaaaaatacagaaatccatgaaaa

SEQ ID NO: 205188 - DNA, 25 bp, Artificial sequence
  SiRNA target sequence
aaaaaatacagaaatccatgaaaaa

SEQ ID NO: 205189 - DNA, 25 bp, Artificial sequence
  SiRNA target sequence
aaaaatacagaaatccatgaaaaag

SEQ ID NO: 205190 - DNA, 25 bp, Artificial sequence
  SiRNA target sequence
aaaatacagaaatccatgaaaaagc

SEQ ID NO: 205191 - DNA, 25 bp, Artificial sequence
  SiRNA target sequence
aaatacagaaatccatgaaaaagca

SEQ ID NO: 205192 - DNA, 25 bp, Artificial sequence
  SiRNA target sequence
aatacagaaatccatgaaaaagcaa

SEQ ID NO: 205193 - DNA, 25 bp, Artificial sequence
  SiRNA target sequence
atacagaaatccatgaaaaagcaag

SEQ ID NO: 205194 - DNA, 25 bp, Artificial sequence
  SiRNA target sequence
tacagaaatccatgaaaaagcaagt

SEQ ID NO: 205195 - DNA, 25 bp, Artificial sequence
  SiRNA target sequence
acagaaatccatgaaaaagcaagtc

SEQ ID NO: 205196 - DNA, 25 bp, Artificial sequence
  SiRNA target sequence
cagaaatccatgaaaaagcaagtcc

SEQ ID NO: 205197 - DNA, 25 bp, Artificial sequence
  SiRNA target sequence
agaaatccatgaaaaagcaagtcct

SEQ ID NO: 205198 - DNA, 25 bp, Artificial sequence
  SiRNA target sequence
gaaatccatgaaaaagcaagtcctt

SEQ ID NO: 205199 - DNA, 25 bp, Artificial sequence
  SiRNA target sequence
aaatccatgaaaaagcaagtccttc

SEQ ID NO: 205200 - DNA, 25 bp, Artificial sequence
  SiRNA target sequence
aatccatgaaaaagcaagtccttca

SEQ ID NO: 205201 - DNA, 25 bp, Artificial sequence
  SiRNA target sequence
atccatgaaaaagcaagtccttcaa

SEQ ID NO: 205202 - DNA, 25 bp, Artificial sequence
  SiRNA target sequence
tccatgaaaaagcaagtccttcaat

SEQ ID NO: 205203 - DNA, 25 bp, Artificial sequence
  SiRNA target sequence
ccatgaaaaagcaagtccttcaatg

SEQ ID NO: 205204 - DNA, 25 bp, Artificial sequence
  SiRNA target sequence
catgaaaaagcaagtccttcaatgg

SEQ ID NO: 205205 - DNA, 25 bp, Artificial sequence
  SiRNA target sequence
atgaaaaagcaagtccttcaatggc

SEQ ID NO: 205206 - DNA, 25 bp, Artificial sequence
  SiRNA target sequence
tgaaaaagcaagtccttcaatggca

SEQ ID NO: 205207 - DNA, 25 bp, Artificial sequence
  SiRNA target sequence
gaaaaagcaagtccttcaatggcag

SEQ ID NO: 205208 - DNA, 25 bp, Artificial sequence
  SiRNA target sequence
aaaaagcaagtccttcaatggcaga

SEQ ID NO: 205209 - DNA, 25 bp, Artificial sequence
  SiRNA target sequence
aaaagcaagtccttcaatggcagaa

SEQ ID NO: 205210 - DNA, 25 bp, Artificial sequence
  SiRNA target sequence
aaagcaagtccttcaatggcagaat

SEQ ID NO: 205211 - DNA, 25 bp, Artificial sequence
  SiRNA target sequence
aagcaagtccttcaatggcagaatt

SEQ ID NO: 205212 - DNA, 25 bp, Artificial sequence
  SiRNA target sequence
agcaagtccttcaatggcagaattg

SEQ ID NO: 205213 - DNA, 25 bp, Artificial sequence
  SiRNA target sequence
gcaagtccttcaatggcagaattgt

SEQ ID NO: 205214 - DNA, 25 bp, Artificial sequence
  SiRNA target sequence
caagtccttcaatggcagaattgta

SEQ ID NO: 205215 - DNA, 25 bp, Artificial sequence
  SiRNA target sequence
aagtccttcaatggcagaattgtag

SEQ ID NO: 205216 - DNA, 25 bp, Artificial sequence
  SiRNA target sequence
agtccttcaatggcagaattgtaga

SEQ ID NO: 205217 - DNA, 25 bp, Artificial sequence
  SiRNA target sequence
gtccttcaatggcagaattgtagat

SEQ ID NO: 205218 - DNA, 25 bp, Artificial sequence
  SiRNA target sequence
tccttcaatggcagaattgtagatt

SEQ ID NO: 205219 - DNA, 25 bp, Artificial sequence
  SiRNA target sequence
ccttcaatggcagaattgtagattg

SEQ ID NO: 205220 - DNA, 25 bp, Artificial sequence
  SiRNA target sequence
cttcaatggcagaattgtagattga

SEQ ID NO: 205221 - DNA, 25 bp, Artificial sequence
  SiRNA target sequence
ttcaatggcagaattgtagattgat

SEQ ID NO: 205222 - DNA, 25 bp, Artificial sequence
  SiRNA target sequence
tcaatggcagaattgtagattgatg

SEQ ID NO: 205223 - DNA, 25 bp, Artificial sequence
  SiRNA target sequence
caatggcagaattgtagattgatgc

SEQ ID NO: 205224 - DNA, 25 bp, Artificial sequence
  SiRNA target sequence
aatggcagaattgtagattgatgct

SEQ ID NO: 205225 - DNA, 25 bp, Artificial sequence
  SiRNA target sequence
atggcagaattgtagattgatgctc

SEQ ID NO: 205226 - DNA, 25 bp, Artificial sequence
  SiRNA target sequence
tggcagaattgtagattgatgctcc

SEQ ID NO: 205227 - DNA, 25 bp, Artificial sequence
  SiRNA target sequence
ggcagaattgtagattgatgctccc

SEQ ID NO: 205228 - DNA, 25 bp, Artificial sequence
  SiRNA target sequence
gcagaattgtagattgatgctccca

SEQ ID NO: 205229 - DNA, 25 bp, Artificial sequence
  SiRNA target sequence
cagaattgtagattgatgctcccat

SEQ ID NO: 205230 - DNA, 25 bp, Artificial sequence
  SiRNA target sequence
agaattgtagattgatgctcccata

SEQ ID NO: 205231 - DNA, 25 bp, Artificial sequence
  SiRNA target sequence
gaattgtagattgatgctcccataa

SEQ ID NO: 205232 - DNA, 25 bp, Artificial sequence
  SiRNA target sequence
aattgtagattgatgctcccataac

SEQ ID NO: 205233 - DNA, 25 bp, Artificial sequence
  SiRNA target sequence
attgtagattgatgctcccataacg

SEQ ID NO: 205234 - DNA, 25 bp, Artificial sequence
  SiRNA target sequence
ttgtagattgatgctcccataacga

SEQ ID NO: 205235 - DNA, 25 bp, Artificial sequence
  SiRNA target sequence
tgtagattgatgctcccataacgat

SEQ ID NO: 205236 - DNA, 25 bp, Artificial sequence
  SiRNA target sequence
gtagattgatgctcccataacgatt

SEQ ID NO: 205237 - DNA, 25 bp, Artificial sequence
  SiRNA target sequence
tagattgatgctcccataacgatta

SEQ ID NO: 205238 - DNA, 25 bp, Artificial sequence
  SiRNA target sequence
agattgatgctcccataacgattat

SEQ ID NO: 205239 - DNA, 25 bp, Artificial sequence
  SiRNA target sequence
gattgatgctcccataacgattatt

SEQ ID NO: 205240 - DNA, 25 bp, Artificial sequence
  SiRNA target sequence
attgatgctcccataacgattattg

SEQ ID NO: 205241 - DNA, 25 bp, Artificial sequence
  SiRNA target sequence
ttgatgctcccataacgattattga

SEQ ID NO: 205242 - DNA, 25 bp, Artificial sequence
  SiRNA target sequence
tgatgctcccataacgattattgac

SEQ ID NO: 205243 - DNA, 25 bp, Artificial sequence
  SiRNA target sequence
gatgctcccataacgattattgacc

SEQ ID NO: 205244 - DNA, 25 bp, Artificial sequence
  SiRNA target sequence
atgctcccataacgattattgaccc

SEQ ID NO: 205245 - DNA, 25 bp, Artificial sequence
  SiRNA target sequence
tgctcccataacgattattgacccc

SEQ ID NO: 205246 - DNA, 25 bp, Artificial sequence
  SiRNA target sequence
gctcccataacgattattgacccca

SEQ ID NO: 205247 - DNA, 25 bp, Artificial sequence
  SiRNA target sequence
ctcccataacgattattgaccccaa

SEQ ID NO: 205248 - DNA, 25 bp, Artificial sequence
  SiRNA target sequence
tcccataacgattattgaccccaac

SEQ ID NO: 205249 - DNA, 25 bp, Artificial sequence
  SiRNA target sequence
cccataacgattattgaccccaaca

SEQ ID NO: 205250 - DNA, 25 bp, Artificial sequence
  SiRNA target sequence
ccataacgattattgaccccaacaa

SEQ ID NO: 205251 - DNA, 25 bp, Artificial sequence
  SiRNA target sequence
cataacgattattgaccccaacaac

SEQ ID NO: 205252 - DNA, 25 bp, Artificial sequence
  SiRNA target sequence
ataacgattattgaccccaacaaca

SEQ ID NO: 205253 - DNA, 25 bp, Artificial sequence
  SiRNA target sequence
taacgattattgaccccaacaacaa

SEQ ID NO: 205254 - DNA, 25 bp, Artificial sequence
  SiRNA target sequence
aacgattattgaccccaacaacaag

SEQ ID NO: 205255 - DNA, 25 bp, Artificial sequence
  SiRNA target sequence
acgattattgaccccaacaacaaga

SEQ ID NO: 205256 - DNA, 25 bp, Artificial sequence
  SiRNA target sequence
cgattattgaccccaacaacaagaa

SEQ ID NO: 205257 - DNA, 25 bp, Artificial sequence
  SiRNA target sequence
gattattgaccccaacaacaagaat

SEQ ID NO: 205258 - DNA, 25 bp, Artificial sequence
  SiRNA target sequence
attattgaccccaacaacaagaata

SEQ ID NO: 205259 - DNA, 25 bp, Artificial sequence
  SiRNA target sequence
ttattgaccccaacaacaagaataa

SEQ ID NO: 205260 - DNA, 25 bp, Artificial sequence
  SiRNA target sequence
tattgaccccaacaacaagaataaa

SEQ ID NO: 205261 - DNA, 25 bp, Artificial sequence
  SiRNA target sequence
attgaccccaacaacaagaataaag

SEQ ID NO: 205262 - DNA, 25 bp, Artificial sequence
  SiRNA target sequence
ttgaccccaacaacaagaataaagg

SEQ ID NO: 205263 - DNA, 25 bp, Artificial sequence
  SiRNA target sequence
tgaccccaacaacaagaataaaggt

SEQ ID NO: 205264 - DNA, 25 bp, Artificial sequence
  SiRNA target sequence
gaccccaacaacaagaataaaggtg

SEQ ID NO: 205265 - DNA, 25 bp, Artificial sequence
  SiRNA target sequence
accccaacaacaagaataaaggtgt

SEQ ID NO: 205266 - DNA, 25 bp, Artificial sequence
  SiRNA target sequence
ccccaacaacaagaataaaggtgtt

SEQ ID NO: 205267 - DNA, 25 bp, Artificial sequence
  SiRNA target sequence
cccaacaacaagaataaaggtgtta

SEQ ID NO: 205268 - DNA, 25 bp, Artificial sequence
  SiRNA target sequence
ccaacaacaagaataaaggtgttaa

SEQ ID NO: 205269 - DNA, 25 bp, Artificial sequence
  SiRNA target sequence
caacaacaagaataaaggtgttaag

SEQ ID NO: 205270 - DNA, 25 bp, Artificial sequence
  SiRNA target sequence
aacaacaagaataaaggtgttaaga

SEQ ID NO: 205271 - DNA, 25 bp, Artificial sequence
  SiRNA target sequence
acaacaagaataaaggtgttaagag

SEQ ID NO: 205272 - DNA, 25 bp, Artificial sequence
  SiRNA target sequence
caacaagaataaaggtgttaagagt

SEQ ID NO: 205273 - DNA, 25 bp, Artificial sequence
  SiRNA target sequence
aacaagaataaaggtgttaagagtc

SEQ ID NO: 205274 - DNA, 25 bp, Artificial sequence
  SiRNA target sequence
acaagaataaaggtgttaagagtcc

SEQ ID NO: 205275 - DNA, 25 bp, Artificial sequence
  SiRNA target sequence
caagaataaaggtgttaagagtccc

SEQ ID NO: 205276 - DNA, 25 bp, Artificial sequence
  SiRNA target sequence
aagaataaaggtgttaagagtccca

SEQ ID NO: 205277 - DNA, 25 bp, Artificial sequence
  SiRNA target sequence
agaataaaggtgttaagagtcccat

SEQ ID NO: 205278 - DNA, 25 bp, Artificial sequence
  SiRNA target sequence
gaataaaggtgttaagagtcccata

SEQ ID NO: 205279 - DNA, 25 bp, Artificial sequence
  SiRNA target sequence
aataaaggtgttaagagtcccatag

SEQ ID NO: 205280 - DNA, 25 bp, Artificial sequence
  SiRNA target sequence
ataaaggtgttaagagtcccatagt

SEQ ID NO: 205281 - DNA, 25 bp, Artificial sequence
  SiRNA target sequence
taaaggtgttaagagtcccatagta

SEQ ID NO: 205282 - DNA, 25 bp, Artificial sequence
  SiRNA target sequence
aaaggtgttaagagtcccatagtaa

SEQ ID NO: 205283 - DNA, 25 bp, Artificial sequence
  SiRNA target sequence
aaggtgttaagagtcccatagtaat

SEQ ID NO: 205284 - DNA, 25 bp, Artificial sequence
  SiRNA target sequence
aggtgttaagagtcccatagtaatc

SEQ ID NO: 205285 - DNA, 25 bp, Artificial sequence
  SiRNA target sequence
ggtgttaagagtcccatagtaatcc

SEQ ID NO: 205286 - DNA, 25 bp, Artificial sequence
  SiRNA target sequence
gtgttaagagtcccatagtaatcca

SEQ ID NO: 205287 - DNA, 25 bp, Artificial sequence
  SiRNA target sequence
tgttaagagtcccatagtaatccat

SEQ ID NO: 205288 - DNA, 25 bp, Artificial sequence
  SiRNA target sequence
gttaagagtcccatagtaatccatc

SEQ ID NO: 205289 - DNA, 25 bp, Artificial sequence
  SiRNA target sequence
ttaagagtcccatagtaatccatcc

SEQ ID NO: 205290 - DNA, 25 bp, Artificial sequence
  SiRNA target sequence
taagagtcccatagtaatccatcca

SEQ ID NO: 205291 - DNA, 25 bp, Artificial sequence
  SiRNA target sequence
aagagtcccatagtaatccatccac

SEQ ID NO: 205292 - DNA, 25 bp, Artificial sequence
  SiRNA target sequence
agagtcccatagtaatccatccact

SEQ ID NO: 205293 - DNA, 25 bp, Artificial sequence
  SiRNA target sequence
gagtcccatagtaatccatccacta

SEQ ID NO: 205294 - DNA, 25 bp, Artificial sequence
  SiRNA target sequence
agtcccatagtaatccatccactac

SEQ ID NO: 205295 - DNA, 25 bp, Artificial sequence
  SiRNA target sequence
gtcccatagtaatccatccactact

SEQ ID NO: 205296 - DNA, 25 bp, Artificial sequence
  SiRNA target sequence
tcccatagtaatccatccactactt

SEQ ID NO: 205297 - DNA, 25 bp, Artificial sequence
  SiRNA target sequence
cccatagtaatccatccactacttt

SEQ ID NO: 205298 - DNA, 25 bp, Artificial sequence
  SiRNA target sequence
ccatagtaatccatccactactttc

SEQ ID NO: 205299 - DNA, 25 bp, Artificial sequence
  SiRNA target sequence
catagtaatccatccactactttct

SEQ ID NO: 205300 - DNA, 25 bp, Artificial sequence
  SiRNA target sequence
atagtaatccatccactactttcta

SEQ ID NO: 205301 - DNA, 25 bp, Artificial sequence
  SiRNA target sequence
tagtaatccatccactactttctac

SEQ ID NO: 205302 - DNA, 25 bp, Artificial sequence
  SiRNA target sequence
agtaatccatccactactttctact

SEQ ID NO: 205303 - DNA, 25 bp, Artificial sequence
  SiRNA target sequence
gtaatccatccactactttctacta

SEQ ID NO: 205304 - DNA, 25 bp, Artificial sequence
  SiRNA target sequence
taatccatccactactttctactaa

SEQ ID NO: 205305 - DNA, 25 bp, Artificial sequence
  SiRNA target sequence
aatccatccactactttctactaaa

SEQ ID NO: 205306 - DNA, 25 bp, Artificial sequence
  SiRNA target sequence
atccatccactactttctactaaag

SEQ ID NO: 205307 - DNA, 25 bp, Artificial sequence
  SiRNA target sequence
tccatccactactttctactaaagt

SEQ ID NO: 205308 - DNA, 25 bp, Artificial sequence
  SiRNA target sequence
ccatccactactttctactaaagta

SEQ ID NO: 205309 - DNA, 25 bp, Artificial sequence
  SiRNA target sequence
catccactactttctactaaagtag

SEQ ID NO: 205310 - DNA, 25 bp, Artificial sequence
  SiRNA target sequence
atccactactttctactaaagtaga

SEQ ID NO: 205311 - DNA, 25 bp, Artificial sequence
  SiRNA target sequence
tccactactttctactaaagtagaa

SEQ ID NO: 205312 - DNA, 25 bp, Artificial sequence
  SiRNA target sequence
ccactactttctactaaagtagaaa

SEQ ID NO: 205313 - DNA, 25 bp, Artificial sequence
  SiRNA target sequence
cactactttctactaaagtagaaaa

SEQ ID NO: 205314 - DNA, 25 bp, Artificial sequence
  SiRNA target sequence
actactttctactaaagtagaaaat

SEQ ID NO: 205315 - DNA, 25 bp, Artificial sequence
  SiRNA target sequence
ctactttctactaaagtagaaaatg

SEQ ID NO: 205316 - DNA, 25 bp, Artificial sequence
  SiRNA target sequence
tactttctactaaagtagaaaatgc

SEQ ID NO: 205317 - DNA, 25 bp, Artificial sequence
  SiRNA target sequence
actttctactaaagtagaaaatgct

SEQ ID NO: 205318 - DNA, 25 bp, Artificial sequence
  SiRNA target sequence
ctttctactaaagtagaaaatgctg

SEQ ID NO: 205319 - DNA, 25 bp, Artificial sequence
  SiRNA target sequence
tttctactaaagtagaaaatgctga

SEQ ID NO: 205320 - DNA, 25 bp, Artificial sequence
  SiRNA target sequence
ttctactaaagtagaaaatgctgac

SEQ ID NO: 205321 - DNA, 25 bp, Artificial sequence
  SiRNA target sequence
tctactaaagtagaaaatgctgaca

SEQ ID NO: 205322 - DNA, 25 bp, Artificial sequence
  SiRNA target sequence
ctactaaagtagaaaatgctgacaa

SEQ ID NO: 205323 - DNA, 25 bp, Artificial sequence
  SiRNA target sequence
tactaaagtagaaaatgctgacaaa

SEQ ID NO: 205324 - DNA, 25 bp, Artificial sequence
  SiRNA target sequence
actaaagtagaaaatgctgacaaat

SEQ ID NO: 205325 - DNA, 25 bp, Artificial sequence
  SiRNA target sequence
ctaaagtagaaaatgctgacaaatt

SEQ ID NO: 205326 - DNA, 25 bp, Artificial sequence
  SiRNA target sequence
taaagtagaaaatgctgacaaatta

SEQ ID NO: 205327 - DNA, 25 bp, Artificial sequence
  SiRNA target sequence
aaagtagaaaatgctgacaaattaa

SEQ ID NO: 205328 - DNA, 25 bp, Artificial sequence
  SiRNA target sequence
aagtagaaaatgctgacaaattaag

SEQ ID NO: 205329 - DNA, 25 bp, Artificial sequence
  SiRNA target sequence
agtagaaaatgctgacaaattaagt

SEQ ID NO: 205330 - DNA, 25 bp, Artificial sequence
  SiRNA target sequence
gtagaaaatgctgacaaattaagtg

SEQ ID NO: 205331 - DNA, 25 bp, Artificial sequence
  SiRNA target sequence
tagaaaatgctgacaaattaagtgt

SEQ ID NO: 205332 - DNA, 25 bp, Artificial sequence
  SiRNA target sequence
agaaaatgctgacaaattaagtgtt

SEQ ID NO: 205333 - DNA, 25 bp, Artificial sequence
  SiRNA target sequence
gaaaatgctgacaaattaagtgtta

SEQ ID NO: 205334 - DNA, 25 bp, Artificial sequence
  SiRNA target sequence
aaaatgctgacaaattaagtgttat

SEQ ID NO: 205335 - DNA, 25 bp, Artificial sequence
  SiRNA target sequence
aaatgctgacaaattaagtgttatt

SEQ ID NO: 205336 - DNA, 25 bp, Artificial sequence
  SiRNA target sequence
aatgctgacaaattaagtgttatta

SEQ ID NO: 205337 - DNA, 25 bp, Artificial sequence
  SiRNA target sequence
atgctgacaaattaagtgttattac

SEQ ID NO: 205338 - DNA, 25 bp, Artificial sequence
  SiRNA target sequence
tgctgacaaattaagtgttattaca

SEQ ID NO: 205339 - DNA, 25 bp, Artificial sequence
  SiRNA target sequence
gctgacaaattaagtgttattacag

SEQ ID NO: 205340 - DNA, 25 bp, Artificial sequence
  SiRNA target sequence
ctgacaaattaagtgttattacagt

SEQ ID NO: 205341 - DNA, 25 bp, Artificial sequence
  SiRNA target sequence
tgacaaattaagtgttattacagta

SEQ ID NO: 205342 - DNA, 25 bp, Artificial sequence
  SiRNA target sequence
gacaaattaagtgttattacagtaa

SEQ ID NO: 205343 - DNA, 25 bp, Artificial sequence
  SiRNA target sequence
acaaattaagtgttattacagtaac

SEQ ID NO: 205344 - DNA, 25 bp, Artificial sequence
  SiRNA target sequence
caaattaagtgttattacagtaact

SEQ ID NO: 205345 - DNA, 25 bp, Artificial sequence
  SiRNA target sequence
aaattaagtgttattacagtaactg

SEQ ID NO: 205346 - DNA, 25 bp, Artificial sequence
  SiRNA target sequence
aattaagtgttattacagtaactgc

SEQ ID NO: 205347 - DNA, 25 bp, Artificial sequence
  SiRNA target sequence
attaagtgttattacagtaactgct

SEQ ID NO: 205348 - DNA, 25 bp, Artificial sequence
  SiRNA target sequence
ttaagtgttattacagtaactgcta

SEQ ID NO: 205349 - DNA, 25 bp, Artificial sequence
  SiRNA target sequence
taagtgttattacagtaactgctac

SEQ ID NO: 205350 - DNA, 25 bp, Artificial sequence
  SiRNA target sequence
aagtgttattacagtaactgctacc

SEQ ID NO: 205351 - DNA, 25 bp, Artificial sequence
  SiRNA target sequence
agtgttattacagtaactgctacca

SEQ ID NO: 205352 - DNA, 25 bp, Artificial sequence
  SiRNA target sequence
gtgttattacagtaactgctaccaa

SEQ ID NO: 205353 - DNA, 25 bp, Artificial sequence
  SiRNA target sequence
tgttattacagtaactgctaccaat

SEQ ID NO: 205354 - DNA, 25 bp, Artificial sequence
  SiRNA target sequence
gttattacagtaactgctaccaata

SEQ ID NO: 205355 - DNA, 25 bp, Artificial sequence
  SiRNA target sequence
ttattacagtaactgctaccaatat

SEQ ID NO: 205356 - DNA, 25 bp, Artificial sequence
  SiRNA target sequence
tattacagtaactgctaccaatatt

SEQ ID NO: 205357 - DNA, 25 bp, Artificial sequence
  SiRNA target sequence
attacagtaactgctaccaatattt

SEQ ID NO: 205358 - DNA, 25 bp, Artificial sequence
  SiRNA target sequence
ttacagtaactgctaccaatatttg

SEQ ID NO: 205359 - DNA, 25 bp, Artificial sequence
  SiRNA target sequence
tacagtaactgctaccaatatttga

SEQ ID NO: 205360 - DNA, 25 bp, Artificial sequence
  SiRNA target sequence
acagtaactgctaccaatatttgat

SEQ ID NO: 205361 - DNA, 25 bp, Artificial sequence
  SiRNA target sequence
cagtaactgctaccaatatttgatc

SEQ ID NO: 205362 - DNA, 25 bp, Artificial sequence
  SiRNA target sequence
agtaactgctaccaatatttgatct

SEQ ID NO: 205363 - DNA, 25 bp, Artificial sequence
  SiRNA target sequence
gtaactgctaccaatatttgatcta

SEQ ID NO: 205364 - DNA, 25 bp, Artificial sequence
  SiRNA target sequence
taactgctaccaatatttgatctat

SEQ ID NO: 205365 - DNA, 25 bp, Artificial sequence
  SiRNA target sequence
aactgctaccaatatttgatctatt

SEQ ID NO: 205366 - DNA, 25 bp, Artificial sequence
  SiRNA target sequence
actgctaccaatatttgatctattg

SEQ ID NO: 205367 - DNA, 25 bp, Artificial sequence
  SiRNA target sequence
ctgctaccaatatttgatctattgt

SEQ ID NO: 205368 - DNA, 25 bp, Artificial sequence
  SiRNA target sequence
tgctaccaatatttgatctattgta

SEQ ID NO: 205369 - DNA, 25 bp, Artificial sequence
  SiRNA target sequence
gctaccaatatttgatctattgtat

SEQ ID NO: 205370 - DNA, 25 bp, Artificial sequence
  SiRNA target sequence
ctaccaatatttgatctattgtatt

SEQ ID NO: 205371 - DNA, 25 bp, Artificial sequence
  SiRNA target sequence
taccaatatttgatctattgtatta

SEQ ID NO: 205372 - DNA, 25 bp, Artificial sequence
  SiRNA target sequence
accaatatttgatctattgtattaa

SEQ ID NO: 205373 - DNA, 25 bp, Artificial sequence
  SiRNA target sequence
ccaatatttgatctattgtattaaa

SEQ ID NO: 205374 - DNA, 25 bp, Artificial sequence
  SiRNA target sequence
caatatttgatctattgtattaaat

SEQ ID NO: 205375 - DNA, 25 bp, Artificial sequence
  SiRNA target sequence
aatatttgatctattgtattaaatt

SEQ ID NO: 205376 - DNA, 25 bp, Artificial sequence
  SiRNA target sequence
atatttgatctattgtattaaattt

SEQ ID NO: 205377 - DNA, 25 bp, Artificial sequence
  SiRNA target sequence
tatttgatctattgtattaaatttg

SEQ ID NO: 205378 - DNA, 25 bp, Artificial sequence
  SiRNA target sequence
atttgatctattgtattaaatttgc

SEQ ID NO: 205379 - DNA, 25 bp, Artificial sequence
  SiRNA target sequence
tttgatctattgtattaaatttgcc

SEQ ID NO: 205380 - DNA, 25 bp, Artificial sequence
  SiRNA target sequence
ttgatctattgtattaaatttgccg

SEQ ID NO: 205381 - DNA, 25 bp, Artificial sequence
  SiRNA target sequence
tgatctattgtattaaatttgccgg

SEQ ID NO: 205382 - DNA, 25 bp, Artificial sequence
  SiRNA target sequence
gatctattgtattaaatttgccgga

SEQ ID NO: 205383 - DNA, 25 bp, Artificial sequence
  SiRNA target sequence
atctattgtattaaatttgccggag

SEQ ID NO: 205384 - DNA, 25 bp, Artificial sequence
  SiRNA target sequence
tctattgtattaaatttgccggagt

SEQ ID NO: 205385 - DNA, 25 bp, Artificial sequence
  SiRNA target sequence
ctattgtattaaatttgccggagta

SEQ ID NO: 205386 - DNA, 25 bp, Artificial sequence
  SiRNA target sequence
tattgtattaaatttgccggagtat

SEQ ID NO: 205387 - DNA, 25 bp, Artificial sequence
  SiRNA target sequence
attgtattaaatttgccggagtatt

SEQ ID NO: 205388 - DNA, 25 bp, Artificial sequence
  SiRNA target sequence
ttgtattaaatttgccggagtattc

SEQ ID NO: 205389 - DNA, 25 bp, Artificial sequence
  SiRNA target sequence
tgtattaaatttgccggagtattct

SEQ ID NO: 205390 - DNA, 25 bp, Artificial sequence
  SiRNA target sequence
gtattaaatttgccggagtattctc

SEQ ID NO: 205391 - DNA, 25 bp, Artificial sequence
  SiRNA target sequence
tattaaatttgccggagtattctcc

SEQ ID NO: 205392 - DNA, 25 bp, Artificial sequence
  SiRNA target sequence
attaaatttgccggagtattctcct

SEQ ID NO: 205393 - DNA, 25 bp, Artificial sequence
  SiRNA target sequence
ttaaatttgccggagtattctccta

SEQ ID NO: 205394 - DNA, 25 bp, Artificial sequence
  SiRNA target sequence
taaatttgccggagtattctcctac

SEQ ID NO: 205395 - DNA, 25 bp, Artificial sequence
  SiRNA target sequence
aaatttgccggagtattctcctacc

SEQ ID NO: 205396 - DNA, 25 bp, Artificial sequence
  SiRNA target sequence
aatttgccggagtattctcctacct

SEQ ID NO: 205397 - DNA, 25 bp, Artificial sequence
  SiRNA target sequence
atttgccggagtattctcctacctc

SEQ ID NO: 205398 - DNA, 25 bp, Artificial sequence
  SiRNA target sequence
tttgccggagtattctcctacctct

SEQ ID NO: 205399 - DNA, 25 bp, Artificial sequence
  SiRNA target sequence
ttgccggagtattctcctacctcta

SEQ ID NO: 205400 - DNA, 25 bp, Artificial sequence
  SiRNA target sequence
tgccggagtattctcctacctctaa

SEQ ID NO: 205401 - DNA, 25 bp, Artificial sequence
  SiRNA target sequence
gccggagtattctcctacctctaat

SEQ ID NO: 205402 - DNA, 25 bp, Artificial sequence
  SiRNA target sequence
ccggagtattctcctacctctaatc

SEQ ID NO: 205403 - DNA, 25 bp, Artificial sequence
  SiRNA target sequence
cggagtattctcctacctctaatcc

SEQ ID NO: 205404 - DNA, 25 bp, Artificial sequence
  SiRNA target sequence
ggagtattctcctacctctaatcct

SEQ ID NO: 205405 - DNA, 25 bp, Artificial sequence
  SiRNA target sequence
gagtattctcctacctctaatccta

SEQ ID NO: 205406 - DNA, 25 bp, Artificial sequence
  SiRNA target sequence
agtattctcctacctctaatcctaa

SEQ ID NO: 205407 - DNA, 25 bp, Artificial sequence
  SiRNA target sequence
gtattctcctacctctaatcctaaa

SEQ ID NO: 205408 - DNA, 25 bp, Artificial sequence
  SiRNA target sequence
tattctcctacctctaatcctaaac

SEQ ID NO: 205409 - DNA, 25 bp, Artificial sequence
  SiRNA target sequence
attctcctacctctaatcctaaact

SEQ ID NO: 205410 - DNA, 25 bp, Artificial sequence
  SiRNA target sequence
ttctcctacctctaatcctaaactt

SEQ ID NO: 205411 - DNA, 25 bp, Artificial sequence
  SiRNA target sequence
tctcctacctctaatcctaaacttt

SEQ ID NO: 205412 - DNA, 25 bp, Artificial sequence
  SiRNA target sequence
ctcctacctctaatcctaaactttt

SEQ ID NO: 205413 - DNA, 25 bp, Artificial sequence
  SiRNA target sequence
tcctacctctaatcctaaacttttt

SEQ ID NO: 205414 - DNA, 25 bp, Artificial sequence
  SiRNA target sequence
cctacctctaatcctaaactttttg

SEQ ID NO: 205415 - DNA, 25 bp, Artificial sequence
  SiRNA target sequence
ctacctctaatcctaaactttttga

SEQ ID NO: 205416 - DNA, 25 bp, Artificial sequence
  SiRNA target sequence
tacctctaatcctaaactttttgac

SEQ ID NO: 205417 - DNA, 25 bp, Artificial sequence
  SiRNA target sequence
acctctaatcctaaactttttgacg

SEQ ID NO: 205418 - DNA, 25 bp, Artificial sequence
  SiRNA target sequence
cctctaatcctaaactttttgacgc

SEQ ID NO: 205419 - DNA, 25 bp, Artificial sequence
  SiRNA target sequence
ctctaatcctaaactttttgacgca

SEQ ID NO: 205420 - DNA, 25 bp, Artificial sequence
  SiRNA target sequence
tctaatcctaaactttttgacgcag

SEQ ID NO: 205421 - DNA, 25 bp, Artificial sequence
  SiRNA target sequence
ctaatcctaaactttttgacgcagc

SEQ ID NO: 205422 - DNA, 25 bp, Artificial sequence
  SiRNA target sequence
taatcctaaactttttgacgcagct

SEQ ID NO: 205423 - DNA, 25 bp, Artificial sequence
  SiRNA target sequence
aatcctaaactttttgacgcagctt

SEQ ID NO: 205424 - DNA, 25 bp, Artificial sequence
  SiRNA target sequence
atcctaaactttttgacgcagcttt

SEQ ID NO: 205425 - DNA, 25 bp, Artificial sequence
  SiRNA target sequence
tcctaaactttttgacgcagcttta

SEQ ID NO: 205426 - DNA, 25 bp, Artificial sequence
  SiRNA target sequence
cctaaactttttgacgcagctttaa

SEQ ID NO: 205427 - DNA, 25 bp, Artificial sequence
  SiRNA target sequence
ctaaactttttgacgcagctttaat

SEQ ID NO: 205428 - DNA, 25 bp, Artificial sequence
  SiRNA target sequence
taaactttttgacgcagctttaatt

SEQ ID NO: 205429 - DNA, 25 bp, Artificial sequence
  SiRNA target sequence
aaactttttgacgcagctttaattc

SEQ ID NO: 205430 - DNA, 25 bp, Artificial sequence
  SiRNA target sequence
aactttttgacgcagctttaattcc

SEQ ID NO: 205431 - DNA, 25 bp, Artificial sequence
  SiRNA target sequence
actttttgacgcagctttaattcct

SEQ ID NO: 205432 - DNA, 25 bp, Artificial sequence
  SiRNA target sequence
ctttttgacgcagctttaattcctg

SEQ ID NO: 205433 - DNA, 25 bp, Artificial sequence
  SiRNA target sequence
tttttgacgcagctttaattcctgc

SEQ ID NO: 205434 - DNA, 25 bp, Artificial sequence
  SiRNA target sequence
ttttgacgcagctttaattcctgct

SEQ ID NO: 205435 - DNA, 25 bp, Artificial sequence
  SiRNA target sequence
tttgacgcagctttaattcctgctt

SEQ ID NO: 205436 - DNA, 25 bp, Artificial sequence
  SiRNA target sequence
ttgacgcagctttaattcctgcttt

SEQ ID NO: 205437 - DNA, 25 bp, Artificial sequence
  SiRNA target sequence
tgacgcagctttaattcctgcttta

SEQ ID NO: 205438 - DNA, 25 bp, Artificial sequence
  SiRNA target sequence
gacgcagctttaattcctgctttat

SEQ ID NO: 205439 - DNA, 25 bp, Artificial sequence
  SiRNA target sequence
acgcagctttaattcctgctttata

SEQ ID NO: 205440 - DNA, 25 bp, Artificial sequence
  SiRNA target sequence
cgcagctttaattcctgctttatag

SEQ ID NO: 205441 - DNA, 25 bp, Artificial sequence
  SiRNA target sequence
gcagctttaattcctgctttataga

SEQ ID NO: 205442 - DNA, 25 bp, Artificial sequence
  SiRNA target sequence
cagctttaattcctgctttatagac

SEQ ID NO: 205443 - DNA, 25 bp, Artificial sequence
  SiRNA target sequence
agctttaattcctgctttatagaca

SEQ ID NO: 205444 - DNA, 25 bp, Artificial sequence
  SiRNA target sequence
gctttaattcctgctttatagacag

SEQ ID NO: 205445 - DNA, 25 bp, Artificial sequence
  SiRNA target sequence
ctttaattcctgctttatagacaga

SEQ ID NO: 205446 - DNA, 25 bp, Artificial sequence
  SiRNA target sequence
tttaattcctgctttatagacagat

SEQ ID NO: 205447 - DNA, 25 bp, Artificial sequence
  SiRNA target sequence
ttaattcctgctttatagacagatt

SEQ ID NO: 205448 - DNA, 25 bp, Artificial sequence
  SiRNA target sequence
taattcctgctttatagacagattc

SEQ ID NO: 205449 - DNA, 25 bp, Artificial sequence
  SiRNA target sequence
aattcctgctttatagacagattca

SEQ ID NO: 205450 - DNA, 25 bp, Artificial sequence
  SiRNA target sequence
attcctgctttatagacagattcaa

SEQ ID NO: 205451 - DNA, 25 bp, Artificial sequence
  SiRNA target sequence
ttcctgctttatagacagattcaat

SEQ ID NO: 205452 - DNA, 25 bp, Artificial sequence
  SiRNA target sequence
tcctgctttatagacagattcaatt

SEQ ID NO: 205453 - DNA, 25 bp, Artificial sequence
  SiRNA target sequence
cctgctttatagacagattcaatta

SEQ ID NO: 205454 - DNA, 25 bp, Artificial sequence
  SiRNA target sequence
ctgctttatagacagattcaattaa

SEQ ID NO: 205455 - DNA, 25 bp, Artificial sequence
  SiRNA target sequence
tgctttatagacagattcaattaaa

SEQ ID NO: 205456 - DNA, 25 bp, Artificial sequence
  SiRNA target sequence
gctttatagacagattcaattaaat

SEQ ID NO: 205457 - DNA, 25 bp, Artificial sequence
  SiRNA target sequence
ctttatagacagattcaattaaatt

SEQ ID NO: 205458 - DNA, 25 bp, Artificial sequence
  SiRNA target sequence
tttatagacagattcaattaaatta

SEQ ID NO: 205459 - DNA, 25 bp, Artificial sequence
  SiRNA target sequence
ttatagacagattcaattaaattaa

SEQ ID NO: 205460 - DNA, 25 bp, Artificial sequence
  SiRNA target sequence
tatagacagattcaattaaattaaa

SEQ ID NO: 205461 - DNA, 25 bp, Artificial sequence
  SiRNA target sequence
atagacagattcaattaaattaaat

SEQ ID NO: 205462 - DNA, 25 bp, Artificial sequence
  SiRNA target sequence
tagacagattcaattaaattaaatg

SEQ ID NO: 205463 - DNA, 25 bp, Artificial sequence
  SiRNA target sequence
agacagattcaattaaattaaatgt

SEQ ID NO: 205464 - DNA, 25 bp, Artificial sequence
  SiRNA target sequence
gacagattcaattaaattaaatgtt

SEQ ID NO: 205465 - DNA, 25 bp, Artificial sequence
  SiRNA target sequence
acagattcaattaaattaaatgtta

SEQ ID NO: 205466 - DNA, 25 bp, Artificial sequence
  SiRNA target sequence
cagattcaattaaattaaatgttat

SEQ ID NO: 205467 - DNA, 25 bp, Artificial sequence
  SiRNA target sequence
agattcaattaaattaaatgttata

SEQ ID NO: 205468 - DNA, 25 bp, Artificial sequence
  SiRNA target sequence
gattcaattaaattaaatgttatat

SEQ ID NO: 205469 - DNA, 25 bp, Artificial sequence
  SiRNA target sequence
attcaattaaattaaatgttatatt

SEQ ID NO: 205470 - DNA, 25 bp, Artificial sequence
  SiRNA target sequence
ttcaattaaattaaatgttatattg

SEQ ID NO: 205471 - DNA, 25 bp, Artificial sequence
  SiRNA target sequence
tcaattaaattaaatgttatattgt

SEQ ID NO: 205472 - DNA, 25 bp, Artificial sequence
  SiRNA target sequence
caattaaattaaatgttatattgta

SEQ ID NO: 205473 - DNA, 25 bp, Artificial sequence
  SiRNA target sequence
aattaaattaaatgttatattgtaa

SEQ ID NO: 205474 - DNA, 25 bp, Artificial sequence
  SiRNA target sequence
attaaattaaatgttatattgtaaa

SEQ ID NO: 205475 - DNA, 25 bp, Artificial sequence
  SiRNA target sequence
ttaaattaaatgttatattgtaaaa

SEQ ID NO: 205476 - DNA, 25 bp, Artificial sequence
  SiRNA target sequence
taaattaaatgttatattgtaaaaa

SEQ ID NO: 205477 - DNA, 25 bp, Artificial sequence
  SiRNA target sequence
aaattaaatgttatattgtaaaaaa

SEQ ID NO: 205478 - DNA, 25 bp, Artificial sequence
  SiRNA target sequence
aattaaatgttatattgtaaaaaaa

SEQ ID NO: 205479 - DNA, 25 bp, Artificial sequence
  SiRNA target sequence
attaaatgttatattgtaaaaaaag

SEQ ID NO: 205480 - DNA, 25 bp, Artificial sequence
  SiRNA target sequence
ttaaatgttatattgtaaaaaaaga

SEQ ID NO: 205481 - DNA, 25 bp, Artificial sequence
  SiRNA target sequence
taaatgttatattgtaaaaaaagac

SEQ ID NO: 205482 - DNA, 25 bp, Artificial sequence
  SiRNA target sequence
aaatgttatattgtaaaaaaagact

SEQ ID NO: 205483 - DNA, 25 bp, Artificial sequence
  SiRNA target sequence
aatgttatattgtaaaaaaagacta

SEQ ID NO: 205484 - DNA, 25 bp, Artificial sequence
  SiRNA target sequence
atgttatattgtaaaaaaagactat

SEQ ID NO: 205485 - DNA, 25 bp, Artificial sequence
  SiRNA target sequence
tgttatattgtaaaaaaagactatt

SEQ ID NO: 205486 - DNA, 25 bp, Artificial sequence
  SiRNA target sequence
gttatattgtaaaaaaagactatta

SEQ ID NO: 205487 - DNA, 25 bp, Artificial sequence
  SiRNA target sequence
ttatattgtaaaaaaagactattat

SEQ ID NO: 205488 - DNA, 25 bp, Artificial sequence
  SiRNA target sequence
tatattgtaaaaaaagactattata

SEQ ID NO: 205489 - DNA, 25 bp, Artificial sequence
  SiRNA target sequence
atattgtaaaaaaagactattatac

SEQ ID NO: 205490 - DNA, 25 bp, Artificial sequence
  SiRNA target sequence
tattgtaaaaaaagactattataca

SEQ ID NO: 205491 - DNA, 25 bp, Artificial sequence
  SiRNA target sequence
attgtaaaaaaagactattatacaa

SEQ ID NO: 205492 - DNA, 25 bp, Artificial sequence
  SiRNA target sequence
ttgtaaaaaaagactattatacaaa

SEQ ID NO: 205493 - DNA, 25 bp, Artificial sequence
  SiRNA target sequence
tgtaaaaaaagactattatacaaag

SEQ ID NO: 205494 - DNA, 25 bp, Artificial sequence
  SiRNA target sequence
gtaaaaaaagactattatacaaagt

SEQ ID NO: 205495 - DNA, 25 bp, Artificial sequence
  SiRNA target sequence
taaaaaaagactattatacaaagtg

SEQ ID NO: 205496 - DNA, 25 bp, Artificial sequence
  SiRNA target sequence
aaaaaaagactattatacaaagtga

SEQ ID NO: 205497 - DNA, 25 bp, Artificial sequence
  SiRNA target sequence
aaaaaagactattatacaaagtgac

SEQ ID NO: 205498 - DNA, 25 bp, Artificial sequence
  SiRNA target sequence
aaaaagactattatacaaagtgaca

SEQ ID NO: 205499 - DNA, 25 bp, Artificial sequence
  SiRNA target sequence
aaaagactattatacaaagtgacat

SEQ ID NO: 205500 - DNA, 25 bp, Artificial sequence
  SiRNA target sequence
aaagactattatacaaagtgacatt

SEQ ID NO: 205501 - DNA, 25 bp, Artificial sequence
  SiRNA target sequence
aagactattatacaaagtgacatta

SEQ ID NO: 205502 - DNA, 25 bp, Artificial sequence
  SiRNA target sequence
agactattatacaaagtgacattaa

SEQ ID NO: 205503 - DNA, 25 bp, Artificial sequence
  SiRNA target sequence
gactattatacaaagtgacattaat

SEQ ID NO: 205504 - DNA, 25 bp, Artificial sequence
  SiRNA target sequence
actattatacaaagtgacattaata

SEQ ID NO: 205505 - DNA, 25 bp, Artificial sequence
  SiRNA target sequence
ctattatacaaagtgacattaataa

SEQ ID NO: 205506 - DNA, 25 bp, Artificial sequence
  SiRNA target sequence
tattatacaaagtgacattaataat

SEQ ID NO: 205507 - DNA, 25 bp, Artificial sequence
  SiRNA target sequence
attatacaaagtgacattaataatt

SEQ ID NO: 205508 - DNA, 25 bp, Artificial sequence
  SiRNA target sequence
ttatacaaagtgacattaataattt

SEQ ID NO: 205509 - DNA, 25 bp, Artificial sequence
  SiRNA target sequence
tatacaaagtgacattaataatttt

SEQ ID NO: 205510 - DNA, 25 bp, Artificial sequence
  SiRNA target sequence
atacaaagtgacattaataattttg

SEQ ID NO: 205511 - DNA, 25 bp, Artificial sequence
  SiRNA target sequence
tacaaagtgacattaataattttga

SEQ ID NO: 205512 - DNA, 25 bp, Artificial sequence
  SiRNA target sequence
acaaagtgacattaataattttgat

SEQ ID NO: 205513 - DNA, 25 bp, Artificial sequence
  SiRNA target sequence
caaagtgacattaataattttgatt

SEQ ID NO: 205514 - DNA, 25 bp, Artificial sequence
  SiRNA target sequence
aaagtgacattaataattttgattt

SEQ ID NO: 205515 - DNA, 25 bp, Artificial sequence
  SiRNA target sequence
aagtgacattaataattttgatttc

SEQ ID NO: 205516 - DNA, 25 bp, Artificial sequence
  SiRNA target sequence
agtgacattaataattttgatttca

SEQ ID NO: 205517 - DNA, 25 bp, Artificial sequence
  SiRNA target sequence
gtgacattaataattttgatttcat

SEQ ID NO: 205518 - DNA, 25 bp, Artificial sequence
  SiRNA target sequence
tgacattaataattttgatttcatc

SEQ ID NO: 205519 - DNA, 25 bp, Artificial sequence
  SiRNA target sequence
gacattaataattttgatttcatca

SEQ ID NO: 205520 - DNA, 25 bp, Artificial sequence
  SiRNA target sequence
acattaataattttgatttcatcat

SEQ ID NO: 205521 - DNA, 25 bp, Artificial sequence
  SiRNA target sequence
cattaataattttgatttcatcatt

SEQ ID NO: 205522 - DNA, 25 bp, Artificial sequence
  SiRNA target sequence
attaataattttgatttcatcatta

SEQ ID NO: 205523 - DNA, 25 bp, Artificial sequence
  SiRNA target sequence
ttaataattttgatttcatcattat

SEQ ID NO: 205524 - DNA, 25 bp, Artificial sequence
  SiRNA target sequence
taataattttgatttcatcattata

SEQ ID NO: 205525 - DNA, 25 bp, Artificial sequence
  SiRNA target sequence
aataattttgatttcatcattatac

SEQ ID NO: 205526 - DNA, 25 bp, Artificial sequence
  SiRNA target sequence
ataattttgatttcatcattatact

SEQ ID NO: 205527 - DNA, 25 bp, Artificial sequence
  SiRNA target sequence
taattttgatttcatcattatacta

SEQ ID NO: 205528 - DNA, 25 bp, Artificial sequence
  SiRNA target sequence
aattttgatttcatcattatactaa

SEQ ID NO: 205529 - DNA, 25 bp, Artificial sequence
  SiRNA target sequence
attttgatttcatcattatactaat

SEQ ID NO: 205530 - DNA, 25 bp, Artificial sequence
  SiRNA target sequence
ttttgatttcatcattatactaata

SEQ ID NO: 205531 - DNA, 25 bp, Artificial sequence
  SiRNA target sequence
tttgatttcatcattatactaatac

SEQ ID NO: 205532 - DNA, 25 bp, Artificial sequence
  SiRNA target sequence
ttgatttcatcattatactaatacc

SEQ ID NO: 205533 - DNA, 25 bp, Artificial sequence
  SiRNA target sequence
tgatttcatcattatactaatacct

SEQ ID NO: 205534 - DNA, 25 bp, Artificial sequence
  SiRNA target sequence
gatttcatcattatactaatacctt

SEQ ID NO: 205535 - DNA, 25 bp, Artificial sequence
  SiRNA target sequence
atttcatcattatactaataccttc

SEQ ID NO: 205536 - DNA, 25 bp, Artificial sequence
  SiRNA target sequence
tttcatcattatactaataccttcg

SEQ ID NO: 205537 - DNA, 25 bp, Artificial sequence
  SiRNA target sequence
ttcatcattatactaataccttcgg

SEQ ID NO: 205538 - DNA, 25 bp, Artificial sequence
  SiRNA target sequence
tcatcattatactaataccttcgga

SEQ ID NO: 205539 - DNA, 25 bp, Artificial sequence
  SiRNA target sequence
catcattatactaataccttcggag

SEQ ID NO: 205540 - DNA, 25 bp, Artificial sequence
  SiRNA target sequence
atcattatactaataccttcggaga

SEQ ID NO: 205541 - DNA, 25 bp, Artificial sequence
  SiRNA target sequence
tcattatactaataccttcggagaa

SEQ ID NO: 205542 - DNA, 25 bp, Artificial sequence
  SiRNA target sequence
cattatactaataccttcggagaaa

SEQ ID NO: 205543 - DNA, 25 bp, Artificial sequence
  SiRNA target sequence
attatactaataccttcggagaaac

SEQ ID NO: 205544 - DNA, 25 bp, Artificial sequence
  SiRNA target sequence
ttatactaataccttcggagaaacc

SEQ ID NO: 205545 - DNA, 25 bp, Artificial sequence
  SiRNA target sequence
tatactaataccttcggagaaacct

SEQ ID NO: 205546 - DNA, 25 bp, Artificial sequence
  SiRNA target sequence
atactaataccttcggagaaaccta

SEQ ID NO: 205547 - DNA, 25 bp, Artificial sequence
  SiRNA target sequence
tactaataccttcggagaaacctac

SEQ ID NO: 205548 - DNA, 25 bp, Artificial sequence
  SiRNA target sequence
actaataccttcggagaaacctaca

SEQ ID NO: 205549 - DNA, 25 bp, Artificial sequence
  SiRNA target sequence
ctaataccttcggagaaacctacac

SEQ ID NO: 205550 - DNA, 25 bp, Artificial sequence
  SiRNA target sequence
taataccttcggagaaacctacact

SEQ ID NO: 205551 - DNA, 25 bp, Artificial sequence
  SiRNA target sequence
aataccttcggagaaacctacacta

SEQ ID NO: 205552 - DNA, 25 bp, Artificial sequence
  SiRNA target sequence
ataccttcggagaaacctacactaa

SEQ ID NO: 205553 - DNA, 25 bp, Artificial sequence
  SiRNA target sequence
taccttcggagaaacctacactaac

SEQ ID NO: 205554 - DNA, 25 bp, Artificial sequence
  SiRNA target sequence
accttcggagaaacctacactaact

SEQ ID NO: 205555 - DNA, 25 bp, Artificial sequence
  SiRNA target sequence
ccttcggagaaacctacactaactt

SEQ ID NO: 205556 - DNA, 25 bp, Artificial sequence
  SiRNA target sequence
cttcggagaaacctacactaacttt

SEQ ID NO: 205557 - DNA, 25 bp, Artificial sequence
  SiRNA target sequence
ttcggagaaacctacactaactttt

SEQ ID NO: 205558 - DNA, 25 bp, Artificial sequence
  SiRNA target sequence
tcggagaaacctacactaacttttt

SEQ ID NO: 205559 - DNA, 25 bp, Artificial sequence
  SiRNA target sequence
cggagaaacctacactaactttttg

SEQ ID NO: 205560 - DNA, 25 bp, Artificial sequence
  SiRNA target sequence
ggagaaacctacactaactttttgt

SEQ ID NO: 205561 - DNA, 25 bp, Artificial sequence
  SiRNA target sequence
gagaaacctacactaactttttgtt

SEQ ID NO: 205562 - DNA, 25 bp, Artificial sequence
  SiRNA target sequence
agaaacctacactaactttttgttt

SEQ ID NO: 205563 - DNA, 25 bp, Artificial sequence
  SiRNA target sequence
gaaacctacactaactttttgtttc

SEQ ID NO: 205564 - DNA, 25 bp, Artificial sequence
  SiRNA target sequence
aaacctacactaactttttgtttct

SEQ ID NO: 205565 - DNA, 25 bp, Artificial sequence
  SiRNA target sequence
aacctacactaactttttgtttctt

SEQ ID NO: 205566 - DNA, 25 bp, Artificial sequence
  SiRNA target sequence
acctacactaactttttgtttcttt

SEQ ID NO: 205567 - DNA, 25 bp, Artificial sequence
  SiRNA target sequence
cctacactaactttttgtttctttt

SEQ ID NO: 205568 - DNA, 25 bp, Artificial sequence
  SiRNA target sequence
ctacactaactttttgtttcttttt

SEQ ID NO: 205569 - DNA, 25 bp, Artificial sequence
  SiRNA target sequence
tacactaactttttgtttctttttt

SEQ ID NO: 205570 - DNA, 25 bp, Artificial sequence
  SiRNA target sequence
acactaactttttgtttctttttta

SEQ ID NO: 205571 - DNA, 25 bp, Artificial sequence
  SiRNA target sequence
cactaactttttgtttcttttttat

SEQ ID NO: 205572 - DNA, 25 bp, Artificial sequence
  SiRNA target sequence
actaactttttgtttcttttttatc

SEQ ID NO: 205573 - DNA, 25 bp, Artificial sequence
  SiRNA target sequence
ctaactttttgtttcttttttatcg

SEQ ID NO: 205574 - DNA, 25 bp, Artificial sequence
  SiRNA target sequence
taactttttgtttcttttttatcgt

SEQ ID NO: 205575 - DNA, 25 bp, Artificial sequence
  SiRNA target sequence
aactttttgtttcttttttatcgta

SEQ ID NO: 205576 - DNA, 25 bp, Artificial sequence
  SiRNA target sequence
actttttgtttcttttttatcgtat

SEQ ID NO: 205577 - DNA, 25 bp, Artificial sequence
  SiRNA target sequence
ctttttgtttcttttttatcgtatt

SEQ ID NO: 205578 - DNA, 25 bp, Artificial sequence
  SiRNA target sequence
tttttgtttcttttttatcgtatta

SEQ ID NO: 205579 - DNA, 25 bp, Artificial sequence
  SiRNA target sequence
ttttgtttcttttttatcgtattag

SEQ ID NO: 205580 - DNA, 25 bp, Artificial sequence
  SiRNA target sequence
tttgtttcttttttatcgtattaga

SEQ ID NO: 205581 - DNA, 25 bp, Artificial sequence
  SiRNA target sequence
ttgtttcttttttatcgtattagaa

SEQ ID NO: 205582 - DNA, 25 bp, Artificial sequence
  SiRNA target sequence
tgtttcttttttatcgtattagaag

SEQ ID NO: 205583 - DNA, 25 bp, Artificial sequence
  SiRNA target sequence
gtttcttttttatcgtattagaagg

SEQ ID NO: 205584 - DNA, 25 bp, Artificial sequence
  SiRNA target sequence
tttcttttttatcgtattagaaggt

SEQ ID NO: 205585 - DNA, 25 bp, Artificial sequence
  SiRNA target sequence
ttcttttttatcgtattagaaggta

SEQ ID NO: 205586 - DNA, 25 bp, Artificial sequence
  SiRNA target sequence
tcttttttatcgtattagaaggtat

SEQ ID NO: 205587 - DNA, 25 bp, Artificial sequence
  SiRNA target sequence
cttttttatcgtattagaaggtata

SEQ ID NO: 205588 - DNA, 25 bp, Artificial sequence
  SiRNA target sequence
ttttttatcgtattagaaggtataa

SEQ ID NO: 205589 - DNA, 25 bp, Artificial sequence
  SiRNA target sequence
tttttatcgtattagaaggtataaa

SEQ ID NO: 205590 - DNA, 25 bp, Artificial sequence
  SiRNA target sequence
ttttatcgtattagaaggtataaat

SEQ ID NO: 205591 - DNA, 25 bp, Artificial sequence
  SiRNA target sequence
tttatcgtattagaaggtataaata

SEQ ID NO: 205592 - DNA, 25 bp, Artificial sequence
  SiRNA target sequence
ttatcgtattagaaggtataaatat

SEQ ID NO: 205593 - DNA, 25 bp, Artificial sequence
  SiRNA target sequence
tatcgtattagaaggtataaatatt

SEQ ID NO: 205594 - DNA, 25 bp, Artificial sequence
  SiRNA target sequence
atcgtattagaaggtataaatattg

SEQ ID NO: 205595 - DNA, 25 bp, Artificial sequence
  SiRNA target sequence
tcgtattagaaggtataaatattgg

SEQ ID NO: 205596 - DNA, 25 bp, Artificial sequence
  SiRNA target sequence
cgtattagaaggtataaatattggt

SEQ ID NO: 205597 - DNA, 25 bp, Artificial sequence
  SiRNA target sequence
gtattagaaggtataaatattggta

SEQ ID NO: 205598 - DNA, 25 bp, Artificial sequence
  SiRNA target sequence
tattagaaggtataaatattggtac

SEQ ID NO: 205599 - DNA, 25 bp, Artificial sequence
  SiRNA target sequence
attagaaggtataaatattggtaca

SEQ ID NO: 205600 - DNA, 25 bp, Artificial sequence
  SiRNA target sequence
ttagaaggtataaatattggtacac

SEQ ID NO: 205601 - DNA, 25 bp, Artificial sequence
  SiRNA target sequence
tagaaggtataaatattggtacact

SEQ ID NO: 205602 - DNA, 25 bp, Artificial sequence
  SiRNA target sequence
agaaggtataaatattggtacactc

SEQ ID NO: 205603 - DNA, 25 bp, Artificial sequence
  SiRNA target sequence
gaaggtataaatattggtacactca

SEQ ID NO: 205604 - DNA, 25 bp, Artificial sequence
  SiRNA target sequence
aaggtataaatattggtacactcat

SEQ ID NO: 205605 - DNA, 25 bp, Artificial sequence
  SiRNA target sequence
aggtataaatattggtacactcatt

SEQ ID NO: 205606 - DNA, 25 bp, Artificial sequence
  SiRNA target sequence
ggtataaatattggtacactcatta

SEQ ID NO: 205607 - DNA, 25 bp, Artificial sequence
  SiRNA target sequence
gtataaatattggtacactcattat

SEQ ID NO: 205608 - DNA, 25 bp, Artificial sequence
  SiRNA target sequence
tataaatattggtacactcattatt

SEQ ID NO: 205609 - DNA, 25 bp, Artificial sequence
  SiRNA target sequence
ataaatattggtacactcattattt

SEQ ID NO: 205610 - DNA, 25 bp, Artificial sequence
  SiRNA target sequence
taaatattggtacactcattatttt

SEQ ID NO: 205611 - DNA, 25 bp, Artificial sequence
  SiRNA target sequence
aaatattggtacactcattatttta

SEQ ID NO: 205612 - DNA, 25 bp, Artificial sequence
  SiRNA target sequence
aatattggtacactcattattttat

SEQ ID NO: 205613 - DNA, 25 bp, Artificial sequence
  SiRNA target sequence
atattggtacactcattattttatt

SEQ ID NO: 205614 - DNA, 25 bp, Artificial sequence
  SiRNA target sequence
tattggtacactcattattttattc

SEQ ID NO: 205615 - DNA, 25 bp, Artificial sequence
  SiRNA target sequence
attggtacactcattattttattct

SEQ ID NO: 205616 - DNA, 25 bp, Artificial sequence
  SiRNA target sequence
ttggtacactcattattttattctc

SEQ ID NO: 205617 - DNA, 25 bp, Artificial sequence
  SiRNA target sequence
tggtacactcattattttattctcg

SEQ ID NO: 205618 - DNA, 25 bp, Artificial sequence
  SiRNA target sequence
ggtacactcattattttattctcga

SEQ ID NO: 205619 - DNA, 25 bp, Artificial sequence
  SiRNA target sequence
gtacactcattattttattctcgaa

SEQ ID NO: 205620 - DNA, 25 bp, Artificial sequence
  SiRNA target sequence
tacactcattattttattctcgaaa

SEQ ID NO: 205621 - DNA, 25 bp, Artificial sequence
  SiRNA target sequence
acactcattattttattctcgaaat

SEQ ID NO: 205622 - DNA, 25 bp, Artificial sequence
  SiRNA target sequence
cactcattattttattctcgaaata

SEQ ID NO: 205623 - DNA, 25 bp, Artificial sequence
  SiRNA target sequence
actcattattttattctcgaaataa

SEQ ID NO: 205624 - DNA, 25 bp, Artificial sequence
  SiRNA target sequence
ctcattattttattctcgaaataat

SEQ ID NO: 205625 - DNA, 25 bp, Artificial sequence
  SiRNA target sequence
tcattattttattctcgaaataata

SEQ ID NO: 205626 - DNA, 25 bp, Artificial sequence
  SiRNA target sequence
cattattttattctcgaaataatat

SEQ ID NO: 205627 - DNA, 25 bp, Artificial sequence
  SiRNA target sequence
attattttattctcgaaataatatt

SEQ ID NO: 205628 - DNA, 25 bp, Artificial sequence
  SiRNA target sequence
ttattttattctcgaaataatattt

SEQ ID NO: 205629 - DNA, 25 bp, Artificial sequence
  SiRNA target sequence
tattttattctcgaaataatatttc

SEQ ID NO: 205630 - DNA, 25 bp, Artificial sequence
  SiRNA target sequence
attttattctcgaaataatatttca

SEQ ID NO: 205631 - DNA, 25 bp, Artificial sequence
  SiRNA target sequence
ttttattctcgaaataatatttcat

SEQ ID NO: 205632 - DNA, 25 bp, Artificial sequence
  SiRNA target sequence
tttattctcgaaataatatttcatg

SEQ ID NO: 205633 - DNA, 25 bp, Artificial sequence
  SiRNA target sequence
ttattctcgaaataatatttcatgt

SEQ ID NO: 205634 - DNA, 25 bp, Artificial sequence
  SiRNA target sequence
tattctcgaaataatatttcatgta

SEQ ID NO: 205635 - DNA, 25 bp, Artificial sequence
  SiRNA target sequence
attctcgaaataatatttcatgtac

SEQ ID NO: 205636 - DNA, 25 bp, Artificial sequence
  SiRNA target sequence
ttctcgaaataatatttcatgtaca

SEQ ID NO: 205637 - DNA, 25 bp, Artificial sequence
  SiRNA target sequence
tctcgaaataatatttcatgtacat

SEQ ID NO: 205638 - DNA, 25 bp, Artificial sequence
  SiRNA target sequence
ctcgaaataatatttcatgtacatt

SEQ ID NO: 205639 - DNA, 25 bp, Artificial sequence
  SiRNA target sequence
tcgaaataatatttcatgtacatta

SEQ ID NO: 205640 - DNA, 25 bp, Artificial sequence
  SiRNA target sequence
cgaaataatatttcatgtacattaa

SEQ ID NO: 205641 - DNA, 25 bp, Artificial sequence
  SiRNA target sequence
gaaataatatttcatgtacattaat

SEQ ID NO: 205642 - DNA, 25 bp, Artificial sequence
  SiRNA target sequence
aaataatatttcatgtacattaata

SEQ ID NO: 205643 - DNA, 25 bp, Artificial sequence
  SiRNA target sequence
aataatatttcatgtacattaatat

SEQ ID NO: 205644 - DNA, 25 bp, Artificial sequence
  SiRNA target sequence
ataatatttcatgtacattaatatt

SEQ ID NO: 205645 - DNA, 25 bp, Artificial sequence
  SiRNA target sequence
taatatttcatgtacattaatatta

SEQ ID NO: 205646 - DNA, 25 bp, Artificial sequence
  SiRNA target sequence
aatatttcatgtacattaatattag

SEQ ID NO: 205647 - DNA, 25 bp, Artificial sequence
  SiRNA target sequence
atatttcatgtacattaatattaga

SEQ ID NO: 205648 - DNA, 25 bp, Artificial sequence
  SiRNA target sequence
tatttcatgtacattaatattagac

SEQ ID NO: 205649 - DNA, 25 bp, Artificial sequence
  SiRNA target sequence
atttcatgtacattaatattagaca

SEQ ID NO: 205650 - DNA, 25 bp, Artificial sequence
  SiRNA target sequence
tttcatgtacattaatattagacat

SEQ ID NO: 205651 - DNA, 25 bp, Artificial sequence
  SiRNA target sequence
ttcatgtacattaatattagacata

SEQ ID NO: 205652 - DNA, 25 bp, Artificial sequence
  SiRNA target sequence
tcatgtacattaatattagacatat

SEQ ID NO: 205653 - DNA, 25 bp, Artificial sequence
  SiRNA target sequence
catgtacattaatattagacatata

SEQ ID NO: 205654 - DNA, 25 bp, Artificial sequence
  SiRNA target sequence
atgtacattaatattagacatatac

SEQ ID NO: 205655 - DNA, 25 bp, Artificial sequence
  SiRNA target sequence
tgtacattaatattagacatatacc

SEQ ID NO: 205656 - DNA, 25 bp, Artificial sequence
  SiRNA target sequence
gtacattaatattagacatataccg

SEQ ID NO: 205657 - DNA, 25 bp, Artificial sequence
  SiRNA target sequence
tacattaatattagacatataccgc

SEQ ID NO: 205658 - DNA, 25 bp, Artificial sequence
  SiRNA target sequence
acattaatattagacatataccgcc

SEQ ID NO: 205659 - DNA, 25 bp, Artificial sequence
  SiRNA target sequence
cattaatattagacatataccgccc

SEQ ID NO: 205660 - DNA, 25 bp, Artificial sequence
  SiRNA target sequence
attaatattagacatataccgccca

SEQ ID NO: 205661 - DNA, 25 bp, Artificial sequence
  SiRNA target sequence
ttaatattagacatataccgcccat

SEQ ID NO: 205662 - DNA, 25 bp, Artificial sequence
  SiRNA target sequence
taatattagacatataccgcccatg

SEQ ID NO: 205663 - DNA, 25 bp, Artificial sequence
  SiRNA target sequence
aatattagacatataccgcccatgg

SEQ ID NO: 205664 - DNA, 25 bp, Artificial sequence
  SiRNA target sequence
atattagacatataccgcccatggc

SEQ ID NO: 205665 - DNA, 25 bp, Artificial sequence
  SiRNA target sequence
tattagacatataccgcccatggca

SEQ ID NO: 205666 - DNA, 25 bp, Artificial sequence
  SiRNA target sequence
attagacatataccgcccatggcaa

SEQ ID NO: 205667 - DNA, 25 bp, Artificial sequence
  SiRNA target sequence
ttagacatataccgcccatggcaat

SEQ ID NO: 205668 - DNA, 25 bp, Artificial sequence
  SiRNA target sequence
tagacatataccgcccatggcaata

SEQ ID NO: 205669 - DNA, 25 bp, Artificial sequence
  SiRNA target sequence
agacatataccgcccatggcaataa

SEQ ID NO: 205670 - DNA, 25 bp, Artificial sequence
  SiRNA target sequence
gacatataccgcccatggcaataaa

SEQ ID NO: 205671 - DNA, 25 bp, Artificial sequence
  SiRNA target sequence
acatataccgcccatggcaataaaa

SEQ ID NO: 205672 - DNA, 25 bp, Artificial sequence
  SiRNA target sequence
catataccgcccatggcaataaaaa

SEQ ID NO: 205673 - DNA, 25 bp, Artificial sequence
  SiRNA target sequence
atataccgcccatggcaataaaaac

SEQ ID NO: 205674 - DNA, 25 bp, Artificial sequence
  SiRNA target sequence
tataccgcccatggcaataaaaacc

SEQ ID NO: 205675 - DNA, 25 bp, Artificial sequence
  SiRNA target sequence
ataccgcccatggcaataaaaaccg

SEQ ID NO: 205676 - DNA, 25 bp, Artificial sequence
  SiRNA target sequence
taccgcccatggcaataaaaaccga

SEQ ID NO: 205677 - DNA, 25 bp, Artificial sequence
  SiRNA target sequence
accgcccatggcaataaaaaccgaa

SEQ ID NO: 205678 - DNA, 25 bp, Artificial sequence
  SiRNA target sequence
ccgcccatggcaataaaaaccgaag

SEQ ID NO: 205679 - DNA, 25 bp, Artificial sequence
  SiRNA target sequence
cgcccatggcaataaaaaccgaaga

SEQ ID NO: 205680 - DNA, 25 bp, Artificial sequence
  SiRNA target sequence
gcccatggcaataaaaaccgaagaa

SEQ ID NO: 205681 - DNA, 25 bp, Artificial sequence
  SiRNA target sequence
cccatggcaataaaaaccgaagaat

SEQ ID NO: 205682 - DNA, 25 bp, Artificial sequence
  SiRNA target sequence
ccatggcaataaaaaccgaagaata

SEQ ID NO: 205683 - DNA, 25 bp, Artificial sequence
  SiRNA target sequence
catggcaataaaaaccgaagaatat

SEQ ID NO: 205684 - DNA, 25 bp, Artificial sequence
  SiRNA target sequence
atggcaataaaaaccgaagaatata

SEQ ID NO: 205685 - DNA, 25 bp, Artificial sequence
  SiRNA target sequence
tggcaataaaaaccgaagaatataa

SEQ ID NO: 205686 - DNA, 25 bp, Artificial sequence
  SiRNA target sequence
ggcaataaaaaccgaagaatataat

SEQ ID NO: 205687 - DNA, 25 bp, Artificial sequence
  SiRNA target sequence
gcaataaaaaccgaagaatataata

SEQ ID NO: 205688 - DNA, 25 bp, Artificial sequence
  SiRNA target sequence
caataaaaaccgaagaatataataa

SEQ ID NO: 205689 - DNA, 25 bp, Artificial sequence
  SiRNA target sequence
aataaaaaccgaagaatataataac

SEQ ID NO: 205690 - DNA, 25 bp, Artificial sequence
  SiRNA target sequence
ataaaaaccgaagaatataataact

SEQ ID NO: 205691 - DNA, 25 bp, Artificial sequence
  SiRNA target sequence
taaaaaccgaagaatataataactg

SEQ ID NO: 205692 - DNA, 25 bp, Artificial sequence
  SiRNA target sequence
aaaaaccgaagaatataataactga

SEQ ID NO: 205693 - DNA, 25 bp, Artificial sequence
  SiRNA target sequence
aaaaccgaagaatataataactgat

SEQ ID NO: 205694 - DNA, 25 bp, Artificial sequence
  SiRNA target sequence
aaaccgaagaatataataactgatt

SEQ ID NO: 205695 - DNA, 25 bp, Artificial sequence
  SiRNA target sequence
aaccgaagaatataataactgattt

SEQ ID NO: 205696 - DNA, 25 bp, Artificial sequence
  SiRNA target sequence
accgaagaatataataactgatttt

SEQ ID NO: 205697 - DNA, 25 bp, Artificial sequence
  SiRNA target sequence
ccgaagaatataataactgattttg

SEQ ID NO: 205698 - DNA, 25 bp, Artificial sequence
  SiRNA target sequence
cgaagaatataataactgattttgc

SEQ ID NO: 205699 - DNA, 25 bp, Artificial sequence
  SiRNA target sequence
gaagaatataataactgattttgct

SEQ ID NO: 205700 - DNA, 25 bp, Artificial sequence
  SiRNA target sequence
aagaatataataactgattttgctc

SEQ ID NO: 205701 - DNA, 25 bp, Artificial sequence
  SiRNA target sequence
agaatataataactgattttgctca

SEQ ID NO: 205702 - DNA, 25 bp, Artificial sequence
  SiRNA target sequence
gaatataataactgattttgctcat

SEQ ID NO: 205703 - DNA, 25 bp, Artificial sequence
  SiRNA target sequence
aatataataactgattttgctcata

SEQ ID NO: 205704 - DNA, 25 bp, Artificial sequence
  SiRNA target sequence
atataataactgattttgctcatag

SEQ ID NO: 205705 - DNA, 25 bp, Artificial sequence
  SiRNA target sequence
tataataactgattttgctcatagc

SEQ ID NO: 205706 - DNA, 25 bp, Artificial sequence
  SiRNA target sequence
ataataactgattttgctcatagct

SEQ ID NO: 205707 - DNA, 25 bp, Artificial sequence
  SiRNA target sequence
taataactgattttgctcatagcta

SEQ ID NO: 205708 - DNA, 25 bp, Artificial sequence
  SiRNA target sequence
aataactgattttgctcatagctaa

SEQ ID NO: 205709 - DNA, 25 bp, Artificial sequence
  SiRNA target sequence
ataactgattttgctcatagctaaa

SEQ ID NO: 205710 - DNA, 25 bp, Artificial sequence
  SiRNA target sequence
taactgattttgctcatagctaaat

SEQ ID NO: 205711 - DNA, 25 bp, Artificial sequence
  SiRNA target sequence
aactgattttgctcatagctaaatc

SEQ ID NO: 205712 - DNA, 25 bp, Artificial sequence
  SiRNA target sequence
actgattttgctcatagctaaatcc

SEQ ID NO: 205713 - DNA, 25 bp, Artificial sequence
  SiRNA target sequence
ctgattttgctcatagctaaatcct

SEQ ID NO: 205714 - DNA, 25 bp, Artificial sequence
  SiRNA target sequence
tgattttgctcatagctaaatcctt

SEQ ID NO: 205715 - DNA, 25 bp, Artificial sequence
  SiRNA target sequence
gattttgctcatagctaaatccttt

SEQ ID NO: 205716 - DNA, 25 bp, Artificial sequence
  SiRNA target sequence
attttgctcatagctaaatcctttt

SEQ ID NO: 205717 - DNA, 25 bp, Artificial sequence
  SiRNA target sequence
ttttgctcatagctaaatccttttc

SEQ ID NO: 205718 - DNA, 25 bp, Artificial sequence
  SiRNA target sequence
tttgctcatagctaaatccttttcg

SEQ ID NO: 205719 - DNA, 25 bp, Artificial sequence
  SiRNA target sequence
ttgctcatagctaaatccttttcgc

SEQ ID NO: 205720 - DNA, 25 bp, Artificial sequence
  SiRNA target sequence
tgctcatagctaaatccttttcgca

SEQ ID NO: 205721 - DNA, 25 bp, Artificial sequence
  SiRNA target sequence
gctcatagctaaatccttttcgcaa

SEQ ID NO: 205722 - DNA, 25 bp, Artificial sequence
  SiRNA target sequence
ctcatagctaaatccttttcgcaat

SEQ ID NO: 205723 - DNA, 25 bp, Artificial sequence
  SiRNA target sequence
tcatagctaaatccttttcgcaatt

SEQ ID NO: 205724 - DNA, 25 bp, Artificial sequence
  SiRNA target sequence
catagctaaatccttttcgcaattc

SEQ ID NO: 205725 - DNA, 25 bp, Artificial sequence
  SiRNA target sequence
atagctaaatccttttcgcaattct

SEQ ID NO: 205726 - DNA, 25 bp, Artificial sequence
  SiRNA target sequence
tagctaaatccttttcgcaattctc

SEQ ID NO: 205727 - DNA, 25 bp, Artificial sequence
  SiRNA target sequence
agctaaatccttttcgcaattctct

SEQ ID NO: 205728 - DNA, 25 bp, Artificial sequence
  SiRNA target sequence
gctaaatccttttcgcaattctctg

SEQ ID NO: 205729 - DNA, 25 bp, Artificial sequence
  SiRNA target sequence
ctaaatccttttcgcaattctctga

SEQ ID NO: 205730 - DNA, 25 bp, Artificial sequence
  SiRNA target sequence
taaatccttttcgcaattctctgaa

SEQ ID NO: 205731 - DNA, 25 bp, Artificial sequence
  SiRNA target sequence
aaatccttttcgcaattctctgaaa

SEQ ID NO: 205732 - DNA, 25 bp, Artificial sequence
  SiRNA target sequence
aatccttttcgcaattctctgaaag

SEQ ID NO: 205733 - DNA, 25 bp, Artificial sequence
  SiRNA target sequence
atccttttcgcaattctctgaaaga

SEQ ID NO: 205734 - DNA, 25 bp, Artificial sequence
  SiRNA target sequence
tccttttcgcaattctctgaaagaa

SEQ ID NO: 205735 - DNA, 25 bp, Artificial sequence
  SiRNA target sequence
ccttttcgcaattctctgaaagaac

SEQ ID NO: 205736 - DNA, 25 bp, Artificial sequence
  SiRNA target sequence
cttttcgcaattctctgaaagaact

SEQ ID NO: 205737 - DNA, 25 bp, Artificial sequence
  SiRNA target sequence
ttttcgcaattctctgaaagaacta

SEQ ID NO: 205738 - DNA, 25 bp, Artificial sequence
  SiRNA target sequence
tttcgcaattctctgaaagaactac

SEQ ID NO: 205739 - DNA, 25 bp, Artificial sequence
  SiRNA target sequence
ttcgcaattctctgaaagaactact

SEQ ID NO: 205740 - DNA, 25 bp, Artificial sequence
  SiRNA target sequence
tcgcaattctctgaaagaactactg

SEQ ID NO: 205741 - DNA, 25 bp, Artificial sequence
  SiRNA target sequence
cgcaattctctgaaagaactactgg

SEQ ID NO: 205742 - DNA, 25 bp, Artificial sequence
  SiRNA target sequence
gcaattctctgaaagaactactggc

SEQ ID NO: 205743 - DNA, 25 bp, Artificial sequence
  SiRNA target sequence
caattctctgaaagaactactggct

SEQ ID NO: 205744 - DNA, 25 bp, Artificial sequence
  SiRNA target sequence
aattctctgaaagaactactggcta

SEQ ID NO: 205745 - DNA, 25 bp, Artificial sequence
  SiRNA target sequence
attctctgaaagaactactggctaa

SEQ ID NO: 205746 - DNA, 25 bp, Artificial sequence
  SiRNA target sequence
ttctctgaaagaactactggctaat

SEQ ID NO: 205747 - DNA, 25 bp, Artificial sequence
  SiRNA target sequence
tctctgaaagaactactggctaatc

SEQ ID NO: 205748 - DNA, 25 bp, Artificial sequence
  SiRNA target sequence
ctctgaaagaactactggctaatcc

SEQ ID NO: 205749 - DNA, 25 bp, Artificial sequence
  SiRNA target sequence
tctgaaagaactactggctaatcca

SEQ ID NO: 205750 - DNA, 25 bp, Artificial sequence
  SiRNA target sequence
ctgaaagaactactggctaatccag

SEQ ID NO: 205751 - DNA, 25 bp, Artificial sequence
  SiRNA target sequence
tgaaagaactactggctaatccaga

SEQ ID NO: 205752 - DNA, 25 bp, Artificial sequence
  SiRNA target sequence
gaaagaactactggctaatccagat

SEQ ID NO: 205753 - DNA, 25 bp, Artificial sequence
  SiRNA target sequence
aaagaactactggctaatccagata

SEQ ID NO: 205754 - DNA, 25 bp, Artificial sequence
  SiRNA target sequence
aagaactactggctaatccagatac

SEQ ID NO: 205755 - DNA, 25 bp, Artificial sequence
  SiRNA target sequence
agaactactggctaatccagatact

SEQ ID NO: 205756 - DNA, 25 bp, Artificial sequence
  SiRNA target sequence
gaactactggctaatccagatacta

SEQ ID NO: 205757 - DNA, 25 bp, Artificial sequence
  SiRNA target sequence
aactactggctaatccagatactag

SEQ ID NO: 205758 - DNA, 25 bp, Artificial sequence
  SiRNA target sequence
actactggctaatccagatactagt

SEQ ID NO: 205759 - DNA, 25 bp, Artificial sequence
  SiRNA target sequence
ctactggctaatccagatactagta

SEQ ID NO: 205760 - DNA, 25 bp, Artificial sequence
  SiRNA target sequence
tactggctaatccagatactagtaa

SEQ ID NO: 205761 - DNA, 25 bp, Artificial sequence
  SiRNA target sequence
actggctaatccagatactagtaaa

SEQ ID NO: 205762 - DNA, 25 bp, Artificial sequence
  SiRNA target sequence
ctggctaatccagatactagtaaag

SEQ ID NO: 205763 - DNA, 25 bp, Artificial sequence
  SiRNA target sequence
tggctaatccagatactagtaaagc

SEQ ID NO: 205764 - DNA, 25 bp, Artificial sequence
  SiRNA target sequence
ggctaatccagatactagtaaagct

SEQ ID NO: 205765 - DNA, 25 bp, Artificial sequence
  SiRNA target sequence
gctaatccagatactagtaaagcta

SEQ ID NO: 205766 - DNA, 25 bp, Artificial sequence
  SiRNA target sequence
ctaatccagatactagtaaagctaa

SEQ ID NO: 205767 - DNA, 25 bp, Artificial sequence
  SiRNA target sequence
taatccagatactagtaaagctaaa

SEQ ID NO: 205768 - DNA, 25 bp, Artificial sequence
  SiRNA target sequence
aatccagatactagtaaagctaaat

SEQ ID NO: 205769 - DNA, 25 bp, Artificial sequence
  SiRNA target sequence
atccagatactagtaaagctaaatt

SEQ ID NO: 205770 - DNA, 25 bp, Artificial sequence
  SiRNA target sequence
tccagatactagtaaagctaaattt

SEQ ID NO: 205771 - DNA, 25 bp, Artificial sequence
  SiRNA target sequence
ccagatactagtaaagctaaatttg

SEQ ID NO: 205772 - DNA, 25 bp, Artificial sequence
  SiRNA target sequence
cagatactagtaaagctaaatttgc

SEQ ID NO: 205773 - DNA, 25 bp, Artificial sequence
  SiRNA target sequence
agatactagtaaagctaaatttgct

SEQ ID NO: 205774 - DNA, 25 bp, Artificial sequence
  SiRNA target sequence
gatactagtaaagctaaatttgcta

SEQ ID NO: 205775 - DNA, 25 bp, Artificial sequence
  SiRNA target sequence
atactagtaaagctaaatttgctat

SEQ ID NO: 205776 - DNA, 25 bp, Artificial sequence
  SiRNA target sequence
tactagtaaagctaaatttgctatt

SEQ ID NO: 205777 - DNA, 25 bp, Artificial sequence
  SiRNA target sequence
actagtaaagctaaatttgctatta

SEQ ID NO: 205778 - DNA, 25 bp, Artificial sequence
  SiRNA target sequence
ctagtaaagctaaatttgctattat

SEQ ID NO: 205779 - DNA, 25 bp, Artificial sequence
  SiRNA target sequence
tagtaaagctaaatttgctattatg

SEQ ID NO: 205780 - DNA, 25 bp, Artificial sequence
  SiRNA target sequence
agtaaagctaaatttgctattatgt

SEQ ID NO: 205781 - DNA, 25 bp, Artificial sequence
  SiRNA target sequence
gtaaagctaaatttgctattatgta

SEQ ID NO: 205782 - DNA, 25 bp, Artificial sequence
  SiRNA target sequence
taaagctaaatttgctattatgtaa

SEQ ID NO: 205783 - DNA, 25 bp, Artificial sequence
  SiRNA target sequence
aaagctaaatttgctattatgtaaa

SEQ ID NO: 205784 - DNA, 25 bp, Artificial sequence
  SiRNA target sequence
aagctaaatttgctattatgtaaaa

SEQ ID NO: 205785 - DNA, 25 bp, Artificial sequence
  SiRNA target sequence
agctaaatttgctattatgtaaaaa

SEQ ID NO: 205786 - DNA, 25 bp, Artificial sequence
  SiRNA target sequence
gctaaatttgctattatgtaaaaag

SEQ ID NO: 205787 - DNA, 25 bp, Artificial sequence
  SiRNA target sequence
ctaaatttgctattatgtaaaaagg

SEQ ID NO: 205788 - DNA, 25 bp, Artificial sequence
  SiRNA target sequence
taaatttgctattatgtaaaaaggt

SEQ ID NO: 205789 - DNA, 25 bp, Artificial sequence
  SiRNA target sequence
aaatttgctattatgtaaaaaggtg

SEQ ID NO: 205790 - DNA, 25 bp, Artificial sequence
  SiRNA target sequence
aatttgctattatgtaaaaaggtgg

SEQ ID NO: 205791 - DNA, 25 bp, Artificial sequence
  SiRNA target sequence
atttgctattatgtaaaaaggtggt

SEQ ID NO: 205792 - DNA, 25 bp, Artificial sequence
  SiRNA target sequence
tttgctattatgtaaaaaggtggta

SEQ ID NO: 205793 - DNA, 25 bp, Artificial sequence
  SiRNA target sequence
ttgctattatgtaaaaaggtggtaa

SEQ ID NO: 205794 - DNA, 25 bp, Artificial sequence
  SiRNA target sequence
tgctattatgtaaaaaggtggtaaa

SEQ ID NO: 205795 - DNA, 25 bp, Artificial sequence
  SiRNA target sequence
gctattatgtaaaaaggtggtaaaa

SEQ ID NO: 205796 - DNA, 25 bp, Artificial sequence
  SiRNA target sequence
ctattatgtaaaaaggtggtaaaaa

SEQ ID NO: 205797 - DNA, 25 bp, Artificial sequence
  SiRNA target sequence
tattatgtaaaaaggtggtaaaaat

SEQ ID NO: 205798 - DNA, 25 bp, Artificial sequence
  SiRNA target sequence
attatgtaaaaaggtggtaaaaatc

SEQ ID NO: 205799 - DNA, 25 bp, Artificial sequence
  SiRNA target sequence
ttatgtaaaaaggtggtaaaaatct

SEQ ID NO: 205800 - DNA, 25 bp, Artificial sequence
  SiRNA target sequence
tatgtaaaaaggtggtaaaaatctt

SEQ ID NO: 205801 - DNA, 25 bp, Artificial sequence
  SiRNA target sequence
atgtaaaaaggtggtaaaaatcttg

SEQ ID NO: 205802 - DNA, 25 bp, Artificial sequence
  SiRNA target sequence
tgtaaaaaggtggtaaaaatcttgt

SEQ ID NO: 205803 - DNA, 25 bp, Artificial sequence
  SiRNA target sequence
gtaaaaaggtggtaaaaatcttgta

SEQ ID NO: 205804 - DNA, 25 bp, Artificial sequence
  SiRNA target sequence
taaaaaggtggtaaaaatcttgtaa

SEQ ID NO: 205805 - DNA, 25 bp, Artificial sequence
  SiRNA target sequence
aaaaaggtggtaaaaatcttgtaaa

SEQ ID NO: 205806 - DNA, 25 bp, Artificial sequence
  SiRNA target sequence
aaaaggtggtaaaaatcttgtaaac

SEQ ID NO: 205807 - DNA, 25 bp, Artificial sequence
  SiRNA target sequence
aaaggtggtaaaaatcttgtaaact

SEQ ID NO: 205808 - DNA, 25 bp, Artificial sequence
  SiRNA target sequence
aaggtggtaaaaatcttgtaaactg

SEQ ID NO: 205809 - DNA, 25 bp, Artificial sequence
  SiRNA target sequence
aggtggtaaaaatcttgtaaactgt

SEQ ID NO: 205810 - DNA, 25 bp, Artificial sequence
  SiRNA target sequence
ggtggtaaaaatcttgtaaactgtc

SEQ ID NO: 205811 - DNA, 25 bp, Artificial sequence
  SiRNA target sequence
gtggtaaaaatcttgtaaactgtct

SEQ ID NO: 205812 - DNA, 25 bp, Artificial sequence
  SiRNA target sequence
tggtaaaaatcttgtaaactgtctg

SEQ ID NO: 205813 - DNA, 25 bp, Artificial sequence
  SiRNA target sequence
ggtaaaaatcttgtaaactgtctga

SEQ ID NO: 205814 - DNA, 25 bp, Artificial sequence
  SiRNA target sequence
gtaaaaatcttgtaaactgtctgat

SEQ ID NO: 205815 - DNA, 25 bp, Artificial sequence
  SiRNA target sequence
taaaaatcttgtaaactgtctgata

SEQ ID NO: 205816 - DNA, 25 bp, Artificial sequence
  SiRNA target sequence
aaaaatcttgtaaactgtctgatag

SEQ ID NO: 205817 - DNA, 25 bp, Artificial sequence
  SiRNA target sequence
aaaatcttgtaaactgtctgatagt

SEQ ID NO: 205818 - DNA, 25 bp, Artificial sequence
  SiRNA target sequence
aaatcttgtaaactgtctgatagta

SEQ ID NO: 205819 - DNA, 25 bp, Artificial sequence
  SiRNA target sequence
aatcttgtaaactgtctgatagtac

SEQ ID NO: 205820 - DNA, 25 bp, Artificial sequence
  SiRNA target sequence
atcttgtaaactgtctgatagtaca

SEQ ID NO: 205821 - DNA, 25 bp, Artificial sequence
  SiRNA target sequence
tcttgtaaactgtctgatagtacaa

SEQ ID NO: 205822 - DNA, 25 bp, Artificial sequence
  SiRNA target sequence
cttgtaaactgtctgatagtacaac

SEQ ID NO: 205823 - DNA, 25 bp, Artificial sequence
  SiRNA target sequence
ttgtaaactgtctgatagtacaact

SEQ ID NO: 205824 - DNA, 25 bp, Artificial sequence
  SiRNA target sequence
tgtaaactgtctgatagtacaactt

SEQ ID NO: 205825 - DNA, 25 bp, Artificial sequence
  SiRNA target sequence
gtaaactgtctgatagtacaacttt

SEQ ID NO: 205826 - DNA, 25 bp, Artificial sequence
  SiRNA target sequence
taaactgtctgatagtacaactttc

SEQ ID NO: 205827 - DNA, 25 bp, Artificial sequence
  SiRNA target sequence
aaactgtctgatagtacaactttca

SEQ ID NO: 205828 - DNA, 25 bp, Artificial sequence
  SiRNA target sequence
aactgtctgatagtacaactttcat

SEQ ID NO: 205829 - DNA, 25 bp, Artificial sequence
  SiRNA target sequence
actgtctgatagtacaactttcatt

SEQ ID NO: 205830 - DNA, 25 bp, Artificial sequence
  SiRNA target sequence
ctgtctgatagtacaactttcattt

SEQ ID NO: 205831 - DNA, 25 bp, Artificial sequence
  SiRNA target sequence
tgtctgatagtacaactttcattta

SEQ ID NO: 205832 - DNA, 25 bp, Artificial sequence
  SiRNA target sequence
gtctgatagtacaactttcatttaa

SEQ ID NO: 205833 - DNA, 25 bp, Artificial sequence
  SiRNA target sequence
tctgatagtacaactttcatttaaa

SEQ ID NO: 205834 - DNA, 25 bp, Artificial sequence
  SiRNA target sequence
ctgatagtacaactttcatttaaaa

SEQ ID NO: 205835 - DNA, 25 bp, Artificial sequence
  SiRNA target sequence
tgatagtacaactttcatttaaaaa

SEQ ID NO: 205836 - DNA, 25 bp, Artificial sequence
  SiRNA target sequence
gatagtacaactttcatttaaaaaa

SEQ ID NO: 205837 - DNA, 25 bp, Artificial sequence
  SiRNA target sequence
atagtacaactttcatttaaaaaac

SEQ ID NO: 205838 - DNA, 25 bp, Artificial sequence
  SiRNA target sequence
tagtacaactttcatttaaaaaact

SEQ ID NO: 205839 - DNA, 25 bp, Artificial sequence
  SiRNA target sequence
agtacaactttcatttaaaaaactc

SEQ ID NO: 205840 - DNA, 25 bp, Artificial sequence
  SiRNA target sequence
gtacaactttcatttaaaaaactca

SEQ ID NO: 205841 - DNA, 25 bp, Artificial sequence
  SiRNA target sequence
tacaactttcatttaaaaaactcat

SEQ ID NO: 205842 - DNA, 25 bp, Artificial sequence
  SiRNA target sequence
acaactttcatttaaaaaactcatg

SEQ ID NO: 205843 - DNA, 25 bp, Artificial sequence
  SiRNA target sequence
caactttcatttaaaaaactcatgt

SEQ ID NO: 205844 - DNA, 25 bp, Artificial sequence
  SiRNA target sequence
aactttcatttaaaaaactcatgta

SEQ ID NO: 205845 - DNA, 25 bp, Artificial sequence
  SiRNA target sequence
actttcatttaaaaaactcatgtat

SEQ ID NO: 205846 - DNA, 25 bp, Artificial sequence
  SiRNA target sequence
ctttcatttaaaaaactcatgtata

SEQ ID NO: 205847 - DNA, 25 bp, Artificial sequence
  SiRNA target sequence
tttcatttaaaaaactcatgtataa

SEQ ID NO: 205848 - DNA, 25 bp, Artificial sequence
  SiRNA target sequence
ttcatttaaaaaactcatgtataaa

SEQ ID NO: 205849 - DNA, 25 bp, Artificial sequence
  SiRNA target sequence
tcatttaaaaaactcatgtataaat

SEQ ID NO: 205850 - DNA, 25 bp, Artificial sequence
  SiRNA target sequence
catttaaaaaactcatgtataaata

SEQ ID NO: 205851 - DNA, 25 bp, Artificial sequence
  SiRNA target sequence
atttaaaaaactcatgtataaataa

SEQ ID NO: 205852 - DNA, 25 bp, Artificial sequence
  SiRNA target sequence
tttaaaaaactcatgtataaataag

SEQ ID NO: 205853 - DNA, 25 bp, Artificial sequence
  SiRNA target sequence
ttaaaaaactcatgtataaataagc

SEQ ID NO: 205854 - DNA, 25 bp, Artificial sequence
  SiRNA target sequence
taaaaaactcatgtataaataagcc

SEQ ID NO: 205855 - DNA, 25 bp, Artificial sequence
  SiRNA target sequence
aaaaaactcatgtataaataagcca

SEQ ID NO: 205856 - DNA, 25 bp, Artificial sequence
  SiRNA target sequence
aaaaactcatgtataaataagccat

SEQ ID NO: 205857 - DNA, 25 bp, Artificial sequence
  SiRNA target sequence
aaaactcatgtataaataagccata

SEQ ID NO: 205858 - DNA, 25 bp, Artificial sequence
  SiRNA target sequence
aaactcatgtataaataagccataa

SEQ ID NO: 205859 - DNA, 25 bp, Artificial sequence
  SiRNA target sequence
aactcatgtataaataagccataag

SEQ ID NO: 205860 - DNA, 25 bp, Artificial sequence
  SiRNA target sequence
actcatgtataaataagccataagt

SEQ ID NO: 205861 - DNA, 25 bp, Artificial sequence
  SiRNA target sequence
ctcatgtataaataagccataagta

SEQ ID NO: 205862 - DNA, 25 bp, Artificial sequence
  SiRNA target sequence
tcatgtataaataagccataagtaa

SEQ ID NO: 205863 - DNA, 25 bp, Artificial sequence
  SiRNA target sequence
catgtataaataagccataagtaaa

SEQ ID NO: 205864 - DNA, 25 bp, Artificial sequence
  SiRNA target sequence
atgtataaataagccataagtaaac

SEQ ID NO: 205865 - DNA, 25 bp, Artificial sequence
  SiRNA target sequence
tgtataaataagccataagtaaact

SEQ ID NO: 205866 - DNA, 25 bp, Artificial sequence
  SiRNA target sequence
gtataaataagccataagtaaactg

SEQ ID NO: 205867 - DNA, 25 bp, Artificial sequence
  SiRNA target sequence
tataaataagccataagtaaactgc

SEQ ID NO: 205868 - DNA, 25 bp, Artificial sequence
  SiRNA target sequence
ataaataagccataagtaaactgcc

SEQ ID NO: 205869 - DNA, 25 bp, Artificial sequence
  SiRNA target sequence
taaataagccataagtaaactgccc

SEQ ID NO: 205870 - DNA, 25 bp, Artificial sequence
  SiRNA target sequence
aaataagccataagtaaactgcccc

SEQ ID NO: 205871 - DNA, 25 bp, Artificial sequence
  SiRNA target sequence
aataagccataagtaaactgcccca

SEQ ID NO: 205872 - DNA, 25 bp, Artificial sequence
  SiRNA target sequence
ataagccataagtaaactgccccac

SEQ ID NO: 205873 - DNA, 25 bp, Artificial sequence
  SiRNA target sequence
taagccataagtaaactgccccaca

SEQ ID NO: 205874 - DNA, 25 bp, Artificial sequence
  SiRNA target sequence
aagccataagtaaactgccccacat

SEQ ID NO: 205875 - DNA, 25 bp, Artificial sequence
  SiRNA target sequence
agccataagtaaactgccccacatt

SEQ ID NO: 205876 - DNA, 25 bp, Artificial sequence
  SiRNA target sequence
gccataagtaaactgccccacattt

SEQ ID NO: 205877 - DNA, 25 bp, Artificial sequence
  SiRNA target sequence
ccataagtaaactgccccacatttc

SEQ ID NO: 205878 - DNA, 25 bp, Artificial sequence
  SiRNA target sequence
cataagtaaactgccccacatttct

SEQ ID NO: 205879 - DNA, 25 bp, Artificial sequence
  SiRNA target sequence
ataagtaaactgccccacatttctg

SEQ ID NO: 205880 - DNA, 25 bp, Artificial sequence
  SiRNA target sequence
taagtaaactgccccacatttctgc

SEQ ID NO: 205881 - DNA, 25 bp, Artificial sequence
  SiRNA target sequence
aagtaaactgccccacatttctgct

SEQ ID NO: 205882 - DNA, 25 bp, Artificial sequence
  SiRNA target sequence
agtaaactgccccacatttctgcta

SEQ ID NO: 205883 - DNA, 25 bp, Artificial sequence
  SiRNA target sequence
gtaaactgccccacatttctgctat

SEQ ID NO: 205884 - DNA, 25 bp, Artificial sequence
  SiRNA target sequence
taaactgccccacatttctgctatt

SEQ ID NO: 205885 - DNA, 25 bp, Artificial sequence
  SiRNA target sequence
aaactgccccacatttctgctatta

SEQ ID NO: 205886 - DNA, 25 bp, Artificial sequence
  SiRNA target sequence
aactgccccacatttctgctattat

SEQ ID NO: 205887 - DNA, 25 bp, Artificial sequence
  SiRNA target sequence
actgccccacatttctgctattata

SEQ ID NO: 205888 - DNA, 25 bp, Artificial sequence
  SiRNA target sequence
ctgccccacatttctgctattataa

SEQ ID NO: 205889 - DNA, 25 bp, Artificial sequence
  SiRNA target sequence
tgccccacatttctgctattataaa

SEQ ID NO: 205890 - DNA, 25 bp, Artificial sequence
  SiRNA target sequence
gccccacatttctgctattataaaa

SEQ ID NO: 205891 - DNA, 25 bp, Artificial sequence
  SiRNA target sequence
ccccacatttctgctattataaaaa

SEQ ID NO: 205892 - DNA, 25 bp, Artificial sequence
  SiRNA target sequence
cccacatttctgctattataaaaat

SEQ ID NO: 205893 - DNA, 25 bp, Artificial sequence
  SiRNA target sequence
ccacatttctgctattataaaaata

SEQ ID NO: 205894 - DNA, 25 bp, Artificial sequence
  SiRNA target sequence
cacatttctgctattataaaaatac

SEQ ID NO: 205895 - DNA, 25 bp, Artificial sequence
  SiRNA target sequence
acatttctgctattataaaaataca

SEQ ID NO: 205896 - DNA, 25 bp, Artificial sequence
  SiRNA target sequence
catttctgctattataaaaatacaa

SEQ ID NO: 205897 - DNA, 25 bp, Artificial sequence
  SiRNA target sequence
atttctgctattataaaaatacaag

SEQ ID NO: 205898 - DNA, 25 bp, Artificial sequence
  SiRNA target sequence
tttctgctattataaaaatacaagt

SEQ ID NO: 205899 - DNA, 25 bp, Artificial sequence
  SiRNA target sequence
ttctgctattataaaaatacaagtt

SEQ ID NO: 205900 - DNA, 25 bp, Artificial sequence
  SiRNA target sequence
tctgctattataaaaatacaagttg

SEQ ID NO: 205901 - DNA, 25 bp, Artificial sequence
  SiRNA target sequence
ctgctattataaaaatacaagttga

SEQ ID NO: 205902 - DNA, 25 bp, Artificial sequence
  SiRNA target sequence
tgctattataaaaatacaagttgaa

SEQ ID NO: 205903 - DNA, 25 bp, Artificial sequence
  SiRNA target sequence
gctattataaaaatacaagttgaaa

SEQ ID NO: 205904 - DNA, 25 bp, Artificial sequence
  SiRNA target sequence
ctattataaaaatacaagttgaaac

SEQ ID NO: 205905 - DNA, 25 bp, Artificial sequence
  SiRNA target sequence
tattataaaaatacaagttgaaacg

SEQ ID NO: 205906 - DNA, 25 bp, Artificial sequence
  SiRNA target sequence
attataaaaatacaagttgaaacgg

SEQ ID NO: 205907 - DNA, 25 bp, Artificial sequence
  SiRNA target sequence
ttataaaaatacaagttgaaacggg

SEQ ID NO: 205908 - DNA, 25 bp, Artificial sequence
  SiRNA target sequence
tataaaaatacaagttgaaacgggc

SEQ ID NO: 205909 - DNA, 25 bp, Artificial sequence
  SiRNA target sequence
ataaaaatacaagttgaaacgggct

SEQ ID NO: 205910 - DNA, 25 bp, Artificial sequence
  SiRNA target sequence
taaaaatacaagttgaaacgggctc

SEQ ID NO: 205911 - DNA, 25 bp, Artificial sequence
  SiRNA target sequence
aaaaatacaagttgaaacgggctcg

SEQ ID NO: 205912 - DNA, 25 bp, Artificial sequence
  SiRNA target sequence
aaaatacaagttgaaacgggctcgt

SEQ ID NO: 205913 - DNA, 25 bp, Artificial sequence
  SiRNA target sequence
aaatacaagttgaaacgggctcgtt

SEQ ID NO: 205914 - DNA, 25 bp, Artificial sequence
  SiRNA target sequence
aatacaagttgaaacgggctcgtta

SEQ ID NO: 205915 - DNA, 25 bp, Artificial sequence
  SiRNA target sequence
atacaagttgaaacgggctcgttag

SEQ ID NO: 205916 - DNA, 25 bp, Artificial sequence
  SiRNA target sequence
tacaagttgaaacgggctcgttagc

SEQ ID NO: 205917 - DNA, 25 bp, Artificial sequence
  SiRNA target sequence
acaagttgaaacgggctcgttagct

SEQ ID NO: 205918 - DNA, 25 bp, Artificial sequence
  SiRNA target sequence
caagttgaaacgggctcgttagctg

SEQ ID NO: 205919 - DNA, 25 bp, Artificial sequence
  SiRNA target sequence
aagttgaaacgggctcgttagctgt

SEQ ID NO: 205920 - DNA, 25 bp, Artificial sequence
  SiRNA target sequence
agttgaaacgggctcgttagctgta

SEQ ID NO: 205921 - DNA, 25 bp, Artificial sequence
  SiRNA target sequence
gttgaaacgggctcgttagctgtaa

SEQ ID NO: 205922 - DNA, 25 bp, Artificial sequence
  SiRNA target sequence
ttgaaacgggctcgttagctgtaat

SEQ ID NO: 205923 - DNA, 25 bp, Artificial sequence
  SiRNA target sequence
tgaaacgggctcgttagctgtaatt

SEQ ID NO: 205924 - DNA, 25 bp, Artificial sequence
  SiRNA target sequence
gaaacgggctcgttagctgtaatta

SEQ ID NO: 205925 - DNA, 25 bp, Artificial sequence
  SiRNA target sequence
aaacgggctcgttagctgtaattaa

SEQ ID NO: 205926 - DNA, 25 bp, Artificial sequence
  SiRNA target sequence
aacgggctcgttagctgtaattaaa

SEQ ID NO: 205927 - DNA, 25 bp, Artificial sequence
  SiRNA target sequence
acgggctcgttagctgtaattaaaa

SEQ ID NO: 205928 - DNA, 25 bp, Artificial sequence
  SiRNA target sequence
cgggctcgttagctgtaattaaaaa

SEQ ID NO: 205929 - DNA, 25 bp, Artificial sequence
  SiRNA target sequence
gggctcgttagctgtaattaaaaaa

SEQ ID NO: 205930 - DNA, 25 bp, Artificial sequence
  SiRNA target sequence
ggctcgttagctgtaattaaaaaat

SEQ ID NO: 205931 - DNA, 25 bp, Artificial sequence
  SiRNA target sequence
gctcgttagctgtaattaaaaaata

SEQ ID NO: 205932 - DNA, 25 bp, Artificial sequence
  SiRNA target sequence
ctcgttagctgtaattaaaaaatat

SEQ ID NO: 205933 - DNA, 25 bp, Artificial sequence
  SiRNA target sequence
tcgttagctgtaattaaaaaatatt

SEQ ID NO: 205934 - DNA, 25 bp, Artificial sequence
  SiRNA target sequence
cgttagctgtaattaaaaaatattt

SEQ ID NO: 205935 - DNA, 25 bp, Artificial sequence
  SiRNA target sequence
gttagctgtaattaaaaaatatttt

SEQ ID NO: 205936 - DNA, 25 bp, Artificial sequence
  SiRNA target sequence
ttagctgtaattaaaaaatatttta

SEQ ID NO: 205937 - DNA, 25 bp, Artificial sequence
  SiRNA target sequence
tagctgtaattaaaaaatattttat

SEQ ID NO: 205938 - DNA, 25 bp, Artificial sequence
  SiRNA target sequence
agctgtaattaaaaaatattttata

SEQ ID NO: 205939 - DNA, 25 bp, Artificial sequence
  SiRNA target sequence
gctgtaattaaaaaatattttataa

SEQ ID NO: 205940 - DNA, 25 bp, Artificial sequence
  SiRNA target sequence
ctgtaattaaaaaatattttataaa

SEQ ID NO: 205941 - DNA, 25 bp, Artificial sequence
  SiRNA target sequence
tgtaattaaaaaatattttataaag

SEQ ID NO: 205942 - DNA, 25 bp, Artificial sequence
  SiRNA target sequence
gtaattaaaaaatattttataaagt

SEQ ID NO: 205943 - DNA, 25 bp, Artificial sequence
  SiRNA target sequence
taattaaaaaatattttataaagtt

SEQ ID NO: 205944 - DNA, 25 bp, Artificial sequence
  SiRNA target sequence
aattaaaaaatattttataaagttc

SEQ ID NO: 205945 - DNA, 25 bp, Artificial sequence
  SiRNA target sequence
attaaaaaatattttataaagttca

SEQ ID NO: 205946 - DNA, 25 bp, Artificial sequence
  SiRNA target sequence
ttaaaaaatattttataaagttcaa

SEQ ID NO: 205947 - DNA, 25 bp, Artificial sequence
  SiRNA target sequence
taaaaaatattttataaagttcaat

SEQ ID NO: 205948 - DNA, 25 bp, Artificial sequence
  SiRNA target sequence
aaaaaatattttataaagttcaatc

SEQ ID NO: 205949 - DNA, 25 bp, Artificial sequence
  SiRNA target sequence
aaaaatattttataaagttcaatcc

SEQ ID NO: 205950 - DNA, 25 bp, Artificial sequence
  SiRNA target sequence
aaaatattttataaagttcaatccc

SEQ ID NO: 205951 - DNA, 25 bp, Artificial sequence
  SiRNA target sequence
aaatattttataaagttcaatccct

SEQ ID NO: 205952 - DNA, 25 bp, Artificial sequence
  SiRNA target sequence
aatattttataaagttcaatccctt

SEQ ID NO: 205953 - DNA, 25 bp, Artificial sequence
  SiRNA target sequence
atattttataaagttcaatcccttc

SEQ ID NO: 205954 - DNA, 25 bp, Artificial sequence
  SiRNA target sequence
tattttataaagttcaatcccttca

SEQ ID NO: 205955 - DNA, 25 bp, Artificial sequence
  SiRNA target sequence
attttataaagttcaatcccttcaa

SEQ ID NO: 205956 - DNA, 25 bp, Artificial sequence
  SiRNA target sequence
ttttataaagttcaatcccttcaat

SEQ ID NO: 205957 - DNA, 25 bp, Artificial sequence
  SiRNA target sequence
tttataaagttcaatcccttcaatg

SEQ ID NO: 205958 - DNA, 25 bp, Artificial sequence
  SiRNA target sequence
ttataaagttcaatcccttcaatgc

SEQ ID NO: 205959 - DNA, 25 bp, Artificial sequence
  SiRNA target sequence
tataaagttcaatcccttcaatgca

SEQ ID NO: 205960 - DNA, 25 bp, Artificial sequence
  SiRNA target sequence
ataaagttcaatcccttcaatgcac

SEQ ID NO: 205961 - DNA, 25 bp, Artificial sequence
  SiRNA target sequence
taaagttcaatcccttcaatgcacc

SEQ ID NO: 205962 - DNA, 25 bp, Artificial sequence
  SiRNA target sequence
aaagttcaatcccttcaatgcacct

SEQ ID NO: 205963 - DNA, 25 bp, Artificial sequence
  SiRNA target sequence
aagttcaatcccttcaatgcacctt

SEQ ID NO: 205964 - DNA, 25 bp, Artificial sequence
  SiRNA target sequence
agttcaatcccttcaatgcaccttt

SEQ ID NO: 205965 - DNA, 25 bp, Artificial sequence
  SiRNA target sequence
gttcaatcccttcaatgcacctttg

SEQ ID NO: 205966 - DNA, 25 bp, Artificial sequence
  SiRNA target sequence
ttcaatcccttcaatgcacctttgt

SEQ ID NO: 205967 - DNA, 25 bp, Artificial sequence
  SiRNA target sequence
tcaatcccttcaatgcacctttgtt

SEQ ID NO: 205968 - DNA, 25 bp, Artificial sequence
  SiRNA target sequence
caatcccttcaatgcacctttgtta

SEQ ID NO: 205969 - DNA, 25 bp, Artificial sequence
  SiRNA target sequence
aatcccttcaatgcacctttgttat

SEQ ID NO: 205970 - DNA, 25 bp, Artificial sequence
  SiRNA target sequence
atcccttcaatgcacctttgttatc

SEQ ID NO: 205971 - DNA, 25 bp, Artificial sequence
  SiRNA target sequence
tcccttcaatgcacctttgttatca

SEQ ID NO: 205972 - DNA, 25 bp, Artificial sequence
  SiRNA target sequence
cccttcaatgcacctttgttatcag

SEQ ID NO: 205973 - DNA, 25 bp, Artificial sequence
  SiRNA target sequence
ccttcaatgcacctttgttatcagc

SEQ ID NO: 205974 - DNA, 25 bp, Artificial sequence
  SiRNA target sequence
cttcaatgcacctttgttatcagcg

SEQ ID NO: 205975 - DNA, 25 bp, Artificial sequence
  SiRNA target sequence
ttcaatgcacctttgttatcagcga

SEQ ID NO: 205976 - DNA, 25 bp, Artificial sequence
  SiRNA target sequence
tcaatgcacctttgttatcagcgaa

SEQ ID NO: 205977 - DNA, 25 bp, Artificial sequence
  SiRNA target sequence
caatgcacctttgttatcagcgaaa

SEQ ID NO: 205978 - DNA, 25 bp, Artificial sequence
  SiRNA target sequence
aatgcacctttgttatcagcgaaaa

SEQ ID NO: 205979 - DNA, 25 bp, Artificial sequence
  SiRNA target sequence
atgcacctttgttatcagcgaaaat

SEQ ID NO: 205980 - DNA, 25 bp, Artificial sequence
  SiRNA target sequence
tgcacctttgttatcagcgaaaata

SEQ ID NO: 205981 - DNA, 25 bp, Artificial sequence
  SiRNA target sequence
gcacctttgttatcagcgaaaatat

SEQ ID NO: 205982 - DNA, 25 bp, Artificial sequence
  SiRNA target sequence
cacctttgttatcagcgaaaatatc

SEQ ID NO: 205983 - DNA, 25 bp, Artificial sequence
  SiRNA target sequence
acctttgttatcagcgaaaatatct

SEQ ID NO: 205984 - DNA, 25 bp, Artificial sequence
  SiRNA target sequence
cctttgttatcagcgaaaatatctc

SEQ ID NO: 205985 - DNA, 25 bp, Artificial sequence
  SiRNA target sequence
ctttgttatcagcgaaaatatctct

SEQ ID NO: 205986 - DNA, 25 bp, Artificial sequence
  SiRNA target sequence
tttgttatcagcgaaaatatctcta

SEQ ID NO: 205987 - DNA, 25 bp, Artificial sequence
  SiRNA target sequence
ttgttatcagcgaaaatatctctaa

SEQ ID NO: 205988 - DNA, 25 bp, Artificial sequence
  SiRNA target sequence
tgttatcagcgaaaatatctctaaa

SEQ ID NO: 205989 - DNA, 25 bp, Artificial sequence
  SiRNA target sequence
gttatcagcgaaaatatctctaaat

SEQ ID NO: 205990 - DNA, 25 bp, Artificial sequence
  SiRNA target sequence
ttatcagcgaaaatatctctaaata

SEQ ID NO: 205991 - DNA, 25 bp, Artificial sequence
  SiRNA target sequence
tatcagcgaaaatatctctaaataa

SEQ ID NO: 205992 - DNA, 25 bp, Artificial sequence
  SiRNA target sequence
atcagcgaaaatatctctaaataaa

SEQ ID NO: 205993 - DNA, 25 bp, Artificial sequence
  SiRNA target sequence
tcagcgaaaatatctctaaataaaa

SEQ ID NO: 205994 - DNA, 25 bp, Artificial sequence
  SiRNA target sequence
cagcgaaaatatctctaaataaaaa

SEQ ID NO: 205995 - DNA, 25 bp, Artificial sequence
  SiRNA target sequence
agcgaaaatatctctaaataaaaag

SEQ ID NO: 205996 - DNA, 25 bp, Artificial sequence
  SiRNA target sequence
gcgaaaatatctctaaataaaaagc

SEQ ID NO: 205997 - DNA, 25 bp, Artificial sequence
  SiRNA target sequence
cgaaaatatctctaaataaaaagct

SEQ ID NO: 205998 - DNA, 25 bp, Artificial sequence
  SiRNA target sequence
gaaaatatctctaaataaaaagcta

SEQ ID NO: 205999 - DNA, 25 bp, Artificial sequence
  SiRNA target sequence
aaaatatctctaaataaaaagctag

SEQ ID NO: 206000 - DNA, 25 bp, Artificial sequence
  SiRNA target sequence
aaatatctctaaataaaaagctaga

SEQ ID NO: 206001 - DNA, 25 bp, Artificial sequence
  SiRNA target sequence
aatatctctaaataaaaagctagat

SEQ ID NO: 206002 - DNA, 25 bp, Artificial sequence
  SiRNA target sequence
atatctctaaataaaaagctagatg

SEQ ID NO: 206003 - DNA, 25 bp, Artificial sequence
  SiRNA target sequence
tatctctaaataaaaagctagatgg

SEQ ID NO: 206004 - DNA, 25 bp, Artificial sequence
  SiRNA target sequence
atctctaaataaaaagctagatggt

SEQ ID NO: 206005 - DNA, 25 bp, Artificial sequence
  SiRNA target sequence
tctctaaataaaaagctagatggtg

SEQ ID NO: 206006 - DNA, 25 bp, Artificial sequence
  SiRNA target sequence
ctctaaataaaaagctagatggtgt

SEQ ID NO: 206007 - DNA, 25 bp, Artificial sequence
  SiRNA target sequence
tctaaataaaaagctagatggtgtt

SEQ ID NO: 206008 - DNA, 25 bp, Artificial sequence
  SiRNA target sequence
ctaaataaaaagctagatggtgtta

SEQ ID NO: 206009 - DNA, 25 bp, Artificial sequence
  SiRNA target sequence
taaataaaaagctagatggtgttac

SEQ ID NO: 206010 - DNA, 25 bp, Artificial sequence
  SiRNA target sequence
aaataaaaagctagatggtgttact

SEQ ID NO: 206011 - DNA, 25 bp, Artificial sequence
  SiRNA target sequence
aataaaaagctagatggtgttactt

SEQ ID NO: 206012 - DNA, 25 bp, Artificial sequence
  SiRNA target sequence
ataaaaagctagatggtgttacttt

SEQ ID NO: 206013 - DNA, 25 bp, Artificial sequence
  SiRNA target sequence
taaaaagctagatggtgttactttc

SEQ ID NO: 206014 - DNA, 25 bp, Artificial sequence
  SiRNA target sequence
aaaaagctagatggtgttactttct

SEQ ID NO: 206015 - DNA, 25 bp, Artificial sequence
  SiRNA target sequence
aaaagctagatggtgttactttctc

SEQ ID NO: 206016 - DNA, 25 bp, Artificial sequence
  SiRNA target sequence
aaagctagatggtgttactttctct

SEQ ID NO: 206017 - DNA, 25 bp, Artificial sequence
  SiRNA target sequence
aagctagatggtgttactttctctt

SEQ ID NO: 206018 - DNA, 25 bp, Artificial sequence
  SiRNA target sequence
agctagatggtgttactttctcttc

SEQ ID NO: 206019 - DNA, 25 bp, Artificial sequence
  SiRNA target sequence
gctagatggtgttactttctcttca

SEQ ID NO: 206020 - DNA, 25 bp, Artificial sequence
  SiRNA target sequence
ctagatggtgttactttctcttcaa

SEQ ID NO: 206021 - DNA, 25 bp, Artificial sequence
  SiRNA target sequence
tagatggtgttactttctcttcaaa

SEQ ID NO: 206022 - DNA, 25 bp, Artificial sequence
  SiRNA target sequence
agatggtgttactttctcttcaaac

SEQ ID NO: 206023 - DNA, 25 bp, Artificial sequence
  SiRNA target sequence
gatggtgttactttctcttcaaaca

SEQ ID NO: 206024 - DNA, 25 bp, Artificial sequence
  SiRNA target sequence
atggtgttactttctcttcaaacaa

SEQ ID NO: 206025 - DNA, 25 bp, Artificial sequence
  SiRNA target sequence
tggtgttactttctcttcaaacaaa

SEQ ID NO: 206026 - DNA, 25 bp, Artificial sequence
  SiRNA target sequence
ggtgttactttctcttcaaacaaaa

SEQ ID NO: 206027 - DNA, 25 bp, Artificial sequence
  SiRNA target sequence
gtgttactttctcttcaaacaaaaa

SEQ ID NO: 206028 - DNA, 25 bp, Artificial sequence
  SiRNA target sequence
tgttactttctcttcaaacaaaaag

SEQ ID NO: 206029 - DNA, 25 bp, Artificial sequence
  SiRNA target sequence
gttactttctcttcaaacaaaaaga

SEQ ID NO: 206030 - DNA, 25 bp, Artificial sequence
  SiRNA target sequence
ttactttctcttcaaacaaaaagat

SEQ ID NO: 206031 - DNA, 25 bp, Artificial sequence
  SiRNA target sequence
tactttctcttcaaacaaaaagatt

SEQ ID NO: 206032 - DNA, 25 bp, Artificial sequence
  SiRNA target sequence
actttctcttcaaacaaaaagattg

SEQ ID NO: 206033 - DNA, 25 bp, Artificial sequence
  SiRNA target sequence
ctttctcttcaaacaaaaagattgc

SEQ ID NO: 206034 - DNA, 25 bp, Artificial sequence
  SiRNA target sequence
tttctcttcaaacaaaaagattgcc

SEQ ID NO: 206035 - DNA, 25 bp, Artificial sequence
  SiRNA target sequence
ttctcttcaaacaaaaagattgccc

SEQ ID NO: 206036 - DNA, 25 bp, Artificial sequence
  SiRNA target sequence
tctcttcaaacaaaaagattgcccc

SEQ ID NO: 206037 - DNA, 25 bp, Artificial sequence
  SiRNA target sequence
ctcttcaaacaaaaagattgcccct

SEQ ID NO: 206038 - DNA, 25 bp, Artificial sequence
  SiRNA target sequence
tcttcaaacaaaaagattgccccta

SEQ ID NO: 206039 - DNA, 25 bp, Artificial sequence
  SiRNA target sequence
cttcaaacaaaaagattgcccctag

SEQ ID NO: 206040 - DNA, 25 bp, Artificial sequence
  SiRNA target sequence
ttcaaacaaaaagattgcccctagt

SEQ ID NO: 206041 - DNA, 25 bp, Artificial sequence
  SiRNA target sequence
tcaaacaaaaagattgcccctagtc

SEQ ID NO: 206042 - DNA, 25 bp, Artificial sequence
  SiRNA target sequence
caaacaaaaagattgcccctagtcc

SEQ ID NO: 206043 - DNA, 25 bp, Artificial sequence
  SiRNA target sequence
aaacaaaaagattgcccctagtccg

SEQ ID NO: 206044 - DNA, 25 bp, Artificial sequence
  SiRNA target sequence
aacaaaaagattgcccctagtccga

SEQ ID NO: 206045 - DNA, 25 bp, Artificial sequence
  SiRNA target sequence
acaaaaagattgcccctagtccgaa

SEQ ID NO: 206046 - DNA, 25 bp, Artificial sequence
  SiRNA target sequence
caaaaagattgcccctagtccgaag

SEQ ID NO: 206047 - DNA, 25 bp, Artificial sequence
  SiRNA target sequence
aaaaagattgcccctagtccgaaga

SEQ ID NO: 206048 - DNA, 25 bp, Artificial sequence
  SiRNA target sequence
aaaagattgcccctagtccgaagaa

SEQ ID NO: 206049 - DNA, 25 bp, Artificial sequence
  SiRNA target sequence
aaagattgcccctagtccgaagaaa

SEQ ID NO: 206050 - DNA, 25 bp, Artificial sequence
  SiRNA target sequence
aagattgcccctagtccgaagaaaa

SEQ ID NO: 206051 - DNA, 25 bp, Artificial sequence
  SiRNA target sequence
agattgcccctagtccgaagaaaaa

SEQ ID NO: 206052 - DNA, 25 bp, Artificial sequence
  SiRNA target sequence
gattgcccctagtccgaagaaaaat

SEQ ID NO: 206053 - DNA, 25 bp, Artificial sequence
  SiRNA target sequence
attgcccctagtccgaagaaaaatg

SEQ ID NO: 206054 - DNA, 25 bp, Artificial sequence
  SiRNA target sequence
ttgcccctagtccgaagaaaaatgc

SEQ ID NO: 206055 - DNA, 25 bp, Artificial sequence
  SiRNA target sequence
tgcccctagtccgaagaaaaatgca

SEQ ID NO: 206056 - DNA, 25 bp, Artificial sequence
  SiRNA target sequence
gcccctagtccgaagaaaaatgcag

SEQ ID NO: 206057 - DNA, 25 bp, Artificial sequence
  SiRNA target sequence
cccctagtccgaagaaaaatgcagt

SEQ ID NO: 206058 - DNA, 25 bp, Artificial sequence
  SiRNA target sequence
ccctagtccgaagaaaaatgcagta

SEQ ID NO: 206059 - DNA, 25 bp, Artificial sequence
  SiRNA target sequence
cctagtccgaagaaaaatgcagtaa

SEQ ID NO: 206060 - DNA, 25 bp, Artificial sequence
  SiRNA target sequence
ctagtccgaagaaaaatgcagtaaa

SEQ ID NO: 206061 - DNA, 25 bp, Artificial sequence
  SiRNA target sequence
tagtccgaagaaaaatgcagtaaaa

SEQ ID NO: 206062 - DNA, 25 bp, Artificial sequence
  SiRNA target sequence
agtccgaagaaaaatgcagtaaaaa

SEQ ID NO: 206063 - DNA, 25 bp, Artificial sequence
  SiRNA target sequence
gtccgaagaaaaatgcagtaaaaat

SEQ ID NO: 206064 - DNA, 25 bp, Artificial sequence
  SiRNA target sequence
tccgaagaaaaatgcagtaaaaatt

SEQ ID NO: 206065 - DNA, 25 bp, Artificial sequence
  SiRNA target sequence
ccgaagaaaaatgcagtaaaaatta

SEQ ID NO: 206066 - DNA, 25 bp, Artificial sequence
  SiRNA target sequence
cgaagaaaaatgcagtaaaaattat

SEQ ID NO: 206067 - DNA, 25 bp, Artificial sequence
  SiRNA target sequence
gaagaaaaatgcagtaaaaattatt

SEQ ID NO: 206068 - DNA, 25 bp, Artificial sequence
  SiRNA target sequence
aagaaaaatgcagtaaaaattatta

SEQ ID NO: 206069 - DNA, 25 bp, Artificial sequence
  SiRNA target sequence
agaaaaatgcagtaaaaattattag

SEQ ID NO: 206070 - DNA, 25 bp, Artificial sequence
  SiRNA target sequence
gaaaaatgcagtaaaaattattaga

SEQ ID NO: 206071 - DNA, 25 bp, Artificial sequence
  SiRNA target sequence
aaaaatgcagtaaaaattattagaa

SEQ ID NO: 206072 - DNA, 25 bp, Artificial sequence
  SiRNA target sequence
aaaatgcagtaaaaattattagaaa

SEQ ID NO: 206073 - DNA, 25 bp, Artificial sequence
  SiRNA target sequence
aaatgcagtaaaaattattagaaat

SEQ ID NO: 206074 - DNA, 25 bp, Artificial sequence
  SiRNA target sequence
aatgcagtaaaaattattagaaata

SEQ ID NO: 206075 - DNA, 25 bp, Artificial sequence
  SiRNA target sequence
atgcagtaaaaattattagaaatag

SEQ ID NO: 206076 - DNA, 25 bp, Artificial sequence
  SiRNA target sequence
tgcagtaaaaattattagaaataga

SEQ ID NO: 206077 - DNA, 25 bp, Artificial sequence
  SiRNA target sequence
gcagtaaaaattattagaaatagat

SEQ ID NO: 206078 - DNA, 25 bp, Artificial sequence
  SiRNA target sequence
cagtaaaaattattagaaatagatt

SEQ ID NO: 206079 - DNA, 25 bp, Artificial sequence
  SiRNA target sequence
agtaaaaattattagaaatagatta

SEQ ID NO: 206080 - DNA, 25 bp, Artificial sequence
  SiRNA target sequence
gtaaaaattattagaaatagattaa

SEQ ID NO: 206081 - DNA, 25 bp, Artificial sequence
  SiRNA target sequence
taaaaattattagaaatagattaaa

SEQ ID NO: 206082 - DNA, 25 bp, Artificial sequence
  SiRNA target sequence
aaaaattattagaaatagattaaaa

SEQ ID NO: 206083 - DNA, 25 bp, Artificial sequence
  SiRNA target sequence
aaaattattagaaatagattaaaaa

SEQ ID NO: 206084 - DNA, 25 bp, Artificial sequence
  SiRNA target sequence
aaattattagaaatagattaaaaat

SEQ ID NO: 206085 - DNA, 25 bp, Artificial sequence
  SiRNA target sequence
aattattagaaatagattaaaaatc

SEQ ID NO: 206086 - DNA, 25 bp, Artificial sequence
  SiRNA target sequence
attattagaaatagattaaaaatcg

SEQ ID NO: 206087 - DNA, 25 bp, Artificial sequence
  SiRNA target sequence
ttattagaaatagattaaaaatcga

SEQ ID NO: 206088 - DNA, 25 bp, Artificial sequence
  SiRNA target sequence
tattagaaatagattaaaaatcgat

SEQ ID NO: 206089 - DNA, 25 bp, Artificial sequence
  SiRNA target sequence
attagaaatagattaaaaatcgatg

SEQ ID NO: 206090 - DNA, 25 bp, Artificial sequence
  SiRNA target sequence
ttagaaatagattaaaaatcgatga

SEQ ID NO: 206091 - DNA, 25 bp, Artificial sequence
  SiRNA target sequence
tagaaatagattaaaaatcgatgat

SEQ ID NO: 206092 - DNA, 25 bp, Artificial sequence
  SiRNA target sequence
agaaatagattaaaaatcgatgata

SEQ ID NO: 206093 - DNA, 25 bp, Artificial sequence
  SiRNA target sequence
gaaatagattaaaaatcgatgatac

SEQ ID NO: 206094 - DNA, 25 bp, Artificial sequence
  SiRNA target sequence
aaatagattaaaaatcgatgataca

SEQ ID NO: 206095 - DNA, 25 bp, Artificial sequence
  SiRNA target sequence
aatagattaaaaatcgatgatacag

SEQ ID NO: 206096 - DNA, 25 bp, Artificial sequence
  SiRNA target sequence
atagattaaaaatcgatgatacagg

SEQ ID NO: 206097 - DNA, 25 bp, Artificial sequence
  SiRNA target sequence
tagattaaaaatcgatgatacaggt

SEQ ID NO: 206098 - DNA, 25 bp, Artificial sequence
  SiRNA target sequence
agattaaaaatcgatgatacaggtt

SEQ ID NO: 206099 - DNA, 25 bp, Artificial sequence
  SiRNA target sequence
gattaaaaatcgatgatacaggttt

SEQ ID NO: 206100 - DNA, 25 bp, Artificial sequence
  SiRNA target sequence
attaaaaatcgatgatacaggttta

SEQ ID NO: 206101 - DNA, 25 bp, Artificial sequence
  SiRNA target sequence
ttaaaaatcgatgatacaggtttat

SEQ ID NO: 206102 - DNA, 25 bp, Artificial sequence
  SiRNA target sequence
taaaaatcgatgatacaggtttatt

SEQ ID NO: 206103 - DNA, 25 bp, Artificial sequence
  SiRNA target sequence
aaaaatcgatgatacaggtttattt

SEQ ID NO: 206104 - DNA, 25 bp, Artificial sequence
  SiRNA target sequence
aaaatcgatgatacaggtttatttt

SEQ ID NO: 206105 - DNA, 25 bp, Artificial sequence
  SiRNA target sequence
aaatcgatgatacaggtttattttg

SEQ ID NO: 206106 - DNA, 25 bp, Artificial sequence
  SiRNA target sequence
aatcgatgatacaggtttattttgc

SEQ ID NO: 206107 - DNA, 25 bp, Artificial sequence
  SiRNA target sequence
atcgatgatacaggtttattttgca

SEQ ID NO: 206108 - DNA, 25 bp, Artificial sequence
  SiRNA target sequence
tcgatgatacaggtttattttgcat

SEQ ID NO: 206109 - DNA, 25 bp, Artificial sequence
  SiRNA target sequence
cgatgatacaggtttattttgcata

SEQ ID NO: 206110 - DNA, 25 bp, Artificial sequence
  SiRNA target sequence
gatgatacaggtttattttgcataa

SEQ ID NO: 206111 - DNA, 25 bp, Artificial sequence
  SiRNA target sequence
atgatacaggtttattttgcataag

SEQ ID NO: 206112 - DNA, 25 bp, Artificial sequence
  SiRNA target sequence
tgatacaggtttattttgcataagc

SEQ ID NO: 206113 - DNA, 25 bp, Artificial sequence
  SiRNA target sequence
gatacaggtttattttgcataagcc

SEQ ID NO: 206114 - DNA, 25 bp, Artificial sequence
  SiRNA target sequence
atacaggtttattttgcataagcca

SEQ ID NO: 206115 - DNA, 25 bp, Artificial sequence
  SiRNA target sequence
tacaggtttattttgcataagccac

SEQ ID NO: 206116 - DNA, 25 bp, Artificial sequence
  SiRNA target sequence
acaggtttattttgcataagccact

SEQ ID NO: 206117 - DNA, 25 bp, Artificial sequence
  SiRNA target sequence
caggtttattttgcataagccactg

SEQ ID NO: 206118 - DNA, 25 bp, Artificial sequence
  SiRNA target sequence
aggtttattttgcataagccactgt

SEQ ID NO: 206119 - DNA, 25 bp, Artificial sequence
  SiRNA target sequence
ggtttattttgcataagccactgta

SEQ ID NO: 206120 - DNA, 25 bp, Artificial sequence
  SiRNA target sequence
gtttattttgcataagccactgtat

SEQ ID NO: 206121 - DNA, 25 bp, Artificial sequence
  SiRNA target sequence
tttattttgcataagccactgtatt

SEQ ID NO: 206122 - DNA, 25 bp, Artificial sequence
  SiRNA target sequence
ttattttgcataagccactgtatta

SEQ ID NO: 206123 - DNA, 25 bp, Artificial sequence
  SiRNA target sequence
tattttgcataagccactgtattaa

SEQ ID NO: 206124 - DNA, 25 bp, Artificial sequence
  SiRNA target sequence
attttgcataagccactgtattaaa

SEQ ID NO: 206125 - DNA, 25 bp, Artificial sequence
  SiRNA target sequence
ttttgcataagccactgtattaaaa

SEQ ID NO: 206126 - DNA, 25 bp, Artificial sequence
  SiRNA target sequence
tttgcataagccactgtattaaaat

SEQ ID NO: 206127 - DNA, 25 bp, Artificial sequence
  SiRNA target sequence
ttgcataagccactgtattaaaatt

SEQ ID NO: 206128 - DNA, 25 bp, Artificial sequence
  SiRNA target sequence
tgcataagccactgtattaaaatta

SEQ ID NO: 206129 - DNA, 25 bp, Artificial sequence
  SiRNA target sequence
gcataagccactgtattaaaattac

SEQ ID NO: 206130 - DNA, 25 bp, Artificial sequence
  SiRNA target sequence
cataagccactgtattaaaattaca

SEQ ID NO: 206131 - DNA, 25 bp, Artificial sequence
  SiRNA target sequence
ataagccactgtattaaaattacag

SEQ ID NO: 206132 - DNA, 25 bp, Artificial sequence
  SiRNA target sequence
taagccactgtattaaaattacaga

SEQ ID NO: 206133 - DNA, 25 bp, Artificial sequence
  SiRNA target sequence
aagccactgtattaaaattacagat

SEQ ID NO: 206134 - DNA, 25 bp, Artificial sequence
  SiRNA target sequence
agccactgtattaaaattacagatg

SEQ ID NO: 206135 - DNA, 25 bp, Artificial sequence
  SiRNA target sequence
gccactgtattaaaattacagatgc

SEQ ID NO: 206136 - DNA, 25 bp, Artificial sequence
  SiRNA target sequence
ccactgtattaaaattacagatgca

SEQ ID NO: 206137 - DNA, 25 bp, Artificial sequence
  SiRNA target sequence
cactgtattaaaattacagatgcaa

SEQ ID NO: 206138 - DNA, 25 bp, Artificial sequence
  SiRNA target sequence
actgtattaaaattacagatgcaaa

SEQ ID NO: 206139 - DNA, 25 bp, Artificial sequence
  SiRNA target sequence
ctgtattaaaattacagatgcaaaa

SEQ ID NO: 206140 - DNA, 25 bp, Artificial sequence
  SiRNA target sequence
tgtattaaaattacagatgcaaaag

SEQ ID NO: 206141 - DNA, 25 bp, Artificial sequence
  SiRNA target sequence
gtattaaaattacagatgcaaaaga

SEQ ID NO: 206142 - DNA, 25 bp, Artificial sequence
  SiRNA target sequence
tattaaaattacagatgcaaaagat

SEQ ID NO: 206143 - DNA, 25 bp, Artificial sequence
  SiRNA target sequence
attaaaattacagatgcaaaagata

SEQ ID NO: 206144 - DNA, 25 bp, Artificial sequence
  SiRNA target sequence
ttaaaattacagatgcaaaagatat

SEQ ID NO: 206145 - DNA, 25 bp, Artificial sequence
  SiRNA target sequence
taaaattacagatgcaaaagatata

SEQ ID NO: 206146 - DNA, 25 bp, Artificial sequence
  SiRNA target sequence
aaaattacagatgcaaaagatatag

SEQ ID NO: 206147 - DNA, 25 bp, Artificial sequence
  SiRNA target sequence
aaattacagatgcaaaagatatagg

SEQ ID NO: 206148 - DNA, 25 bp, Artificial sequence
  SiRNA target sequence
aattacagatgcaaaagatatagga

SEQ ID NO: 206149 - DNA, 25 bp, Artificial sequence
  SiRNA target sequence
attacagatgcaaaagatataggaa

SEQ ID NO: 206150 - DNA, 25 bp, Artificial sequence
  SiRNA target sequence
ttacagatgcaaaagatataggaag

SEQ ID NO: 206151 - DNA, 25 bp, Artificial sequence
  SiRNA target sequence
tacagatgcaaaagatataggaaga

SEQ ID NO: 206152 - DNA, 25 bp, Artificial sequence
  SiRNA target sequence
acagatgcaaaagatataggaagaa

SEQ ID NO: 206153 - DNA, 25 bp, Artificial sequence
  SiRNA target sequence
cagatgcaaaagatataggaagaac

SEQ ID NO: 206154 - DNA, 25 bp, Artificial sequence
  SiRNA target sequence
agatgcaaaagatataggaagaaca

SEQ ID NO: 206155 - DNA, 25 bp, Artificial sequence
  SiRNA target sequence
gatgcaaaagatataggaagaacat

SEQ ID NO: 206156 - DNA, 25 bp, Artificial sequence
  SiRNA target sequence
atgcaaaagatataggaagaacata

SEQ ID NO: 206157 - DNA, 25 bp, Artificial sequence
  SiRNA target sequence
tgcaaaagatataggaagaacataa

SEQ ID NO: 206158 - DNA, 25 bp, Artificial sequence
  SiRNA target sequence
gcaaaagatataggaagaacataaa

SEQ ID NO: 206159 - DNA, 25 bp, Artificial sequence
  SiRNA target sequence
caaaagatataggaagaacataaaa

SEQ ID NO: 206160 - DNA, 25 bp, Artificial sequence
  SiRNA target sequence
aaaagatataggaagaacataaaaa

SEQ ID NO: 206161 - DNA, 25 bp, Artificial sequence
  SiRNA target sequence
aaagatataggaagaacataaaaaa

SEQ ID NO: 206162 - DNA, 25 bp, Artificial sequence
  SiRNA target sequence
aagatataggaagaacataaaaaat

SEQ ID NO: 206163 - DNA, 25 bp, Artificial sequence
  SiRNA target sequence
agatataggaagaacataaaaaatt

SEQ ID NO: 206164 - DNA, 25 bp, Artificial sequence
  SiRNA target sequence
gatataggaagaacataaaaaattt

SEQ ID NO: 206165 - DNA, 25 bp, Artificial sequence
  SiRNA target sequence
atataggaagaacataaaaaatttt

SEQ ID NO: 206166 - DNA, 25 bp, Artificial sequence
  SiRNA target sequence
tataggaagaacataaaaaattttc

SEQ ID NO: 206167 - DNA, 25 bp, Artificial sequence
  SiRNA target sequence
ataggaagaacataaaaaattttca

SEQ ID NO: 206168 - DNA, 25 bp, Artificial sequence
  SiRNA target sequence
taggaagaacataaaaaattttcat

SEQ ID NO: 206169 - DNA, 25 bp, Artificial sequence
  SiRNA target sequence
aggaagaacataaaaaattttcata

SEQ ID NO: 206170 - DNA, 25 bp, Artificial sequence
  SiRNA target sequence
ggaagaacataaaaaattttcataa

SEQ ID NO: 206171 - DNA, 25 bp, Artificial sequence
  SiRNA target sequence
gaagaacataaaaaattttcataaa

SEQ ID NO: 206172 - DNA, 25 bp, Artificial sequence
  SiRNA target sequence
aagaacataaaaaattttcataaac

SEQ ID NO: 206173 - DNA, 25 bp, Artificial sequence
  SiRNA target sequence
agaacataaaaaattttcataaaca

SEQ ID NO: 206174 - DNA, 25 bp, Artificial sequence
  SiRNA target sequence
gaacataaaaaattttcataaacat

SEQ ID NO: 206175 - DNA, 25 bp, Artificial sequence
  SiRNA target sequence
aacataaaaaattttcataaacata

SEQ ID NO: 206176 - DNA, 25 bp, Artificial sequence
  SiRNA target sequence
acataaaaaattttcataaacataa

SEQ ID NO: 206177 - DNA, 25 bp, Artificial sequence
  SiRNA target sequence
cataaaaaattttcataaacataat

SEQ ID NO: 206178 - DNA, 25 bp, Artificial sequence
  SiRNA target sequence
ataaaaaattttcataaacataatt

SEQ ID NO: 206179 - DNA, 25 bp, Artificial sequence
  SiRNA target sequence
taaaaaattttcataaacataattg

SEQ ID NO: 206180 - DNA, 25 bp, Artificial sequence
  SiRNA target sequence
aaaaaattttcataaacataattga

SEQ ID NO: 206181 - DNA, 25 bp, Artificial sequence
  SiRNA target sequence
aaaaattttcataaacataattgaa

SEQ ID NO: 206182 - DNA, 25 bp, Artificial sequence
  SiRNA target sequence
aaaattttcataaacataattgaat

SEQ ID NO: 206183 - DNA, 25 bp, Artificial sequence
  SiRNA target sequence
aaattttcataaacataattgaatt

SEQ ID NO: 206184 - DNA, 25 bp, Artificial sequence
  SiRNA target sequence
aattttcataaacataattgaattc

SEQ ID NO: 206185 - DNA, 25 bp, Artificial sequence
  SiRNA target sequence
attttcataaacataattgaattct

SEQ ID NO: 206186 - DNA, 25 bp, Artificial sequence
  SiRNA target sequence
ttttcataaacataattgaattctg

SEQ ID NO: 206187 - DNA, 25 bp, Artificial sequence
  SiRNA target sequence
tttcataaacataattgaattctga

SEQ ID NO: 206188 - DNA, 25 bp, Artificial sequence
  SiRNA target sequence
ttcataaacataattgaattctgat

SEQ ID NO: 206189 - DNA, 25 bp, Artificial sequence
  SiRNA target sequence
tcataaacataattgaattctgatc

SEQ ID NO: 206190 - DNA, 25 bp, Artificial sequence
  SiRNA target sequence
cataaacataattgaattctgatct

SEQ ID NO: 206191 - DNA, 25 bp, Artificial sequence
  SiRNA target sequence
ataaacataattgaattctgatctt

SEQ ID NO: 206192 - DNA, 25 bp, Artificial sequence
  SiRNA target sequence
taaacataattgaattctgatcttg

SEQ ID NO: 206193 - DNA, 25 bp, Artificial sequence
  SiRNA target sequence
aaacataattgaattctgatcttgc

SEQ ID NO: 206194 - DNA, 25 bp, Artificial sequence
  SiRNA target sequence
aacataattgaattctgatcttgcc

SEQ ID NO: 206195 - DNA, 25 bp, Artificial sequence
  SiRNA target sequence
acataattgaattctgatcttgcct

SEQ ID NO: 206196 - DNA, 25 bp, Artificial sequence
  SiRNA target sequence
cataattgaattctgatcttgcctt

SEQ ID NO: 206197 - DNA, 25 bp, Artificial sequence
  SiRNA target sequence
ataattgaattctgatcttgcctta

SEQ ID NO: 206198 - DNA, 25 bp, Artificial sequence
  SiRNA target sequence
taattgaattctgatcttgccttac

SEQ ID NO: 206199 - DNA, 25 bp, Artificial sequence
  SiRNA target sequence
aattgaattctgatcttgccttacc

SEQ ID NO: 206200 - DNA, 25 bp, Artificial sequence
  SiRNA target sequence
attgaattctgatcttgccttacca

SEQ ID NO: 206201 - DNA, 25 bp, Artificial sequence
  SiRNA target sequence
ttgaattctgatcttgccttaccat

SEQ ID NO: 206202 - DNA, 25 bp, Artificial sequence
  SiRNA target sequence
tgaattctgatcttgccttaccatc

SEQ ID NO: 206203 - DNA, 25 bp, Artificial sequence
  SiRNA target sequence
gaattctgatcttgccttaccatca

SEQ ID NO: 206204 - DNA, 25 bp, Artificial sequence
  SiRNA target sequence
aattctgatcttgccttaccatcac

SEQ ID NO: 206205 - DNA, 25 bp, Artificial sequence
  SiRNA target sequence
attctgatcttgccttaccatcaca

SEQ ID NO: 206206 - DNA, 25 bp, Artificial sequence
  SiRNA target sequence
ttctgatcttgccttaccatcacaa

SEQ ID NO: 206207 - DNA, 25 bp, Artificial sequence
  SiRNA target sequence
tctgatcttgccttaccatcacaaa

SEQ ID NO: 206208 - DNA, 25 bp, Artificial sequence
  SiRNA target sequence
ctgatcttgccttaccatcacaaat

SEQ ID NO: 206209 - DNA, 25 bp, Artificial sequence
  SiRNA target sequence
tgatcttgccttaccatcacaaata

SEQ ID NO: 206210 - DNA, 25 bp, Artificial sequence
  SiRNA target sequence
gatcttgccttaccatcacaaataa

SEQ ID NO: 206211 - DNA, 25 bp, Artificial sequence
  SiRNA target sequence
atcttgccttaccatcacaaataaa

SEQ ID NO: 206212 - DNA, 25 bp, Artificial sequence
  SiRNA target sequence
tcttgccttaccatcacaaataaat

SEQ ID NO: 206213 - DNA, 25 bp, Artificial sequence
  SiRNA target sequence
cttgccttaccatcacaaataaatc

SEQ ID NO: 206214 - DNA, 25 bp, Artificial sequence
  SiRNA target sequence
ttgccttaccatcacaaataaatct

SEQ ID NO: 206215 - DNA, 25 bp, Artificial sequence
  SiRNA target sequence
tgccttaccatcacaaataaatctt

SEQ ID NO: 206216 - DNA, 25 bp, Artificial sequence
  SiRNA target sequence
gccttaccatcacaaataaatcttt

SEQ ID NO: 206217 - DNA, 25 bp, Artificial sequence
  SiRNA target sequence
ccttaccatcacaaataaatctttt

SEQ ID NO: 206218 - DNA, 25 bp, Artificial sequence
  SiRNA target sequence
cttaccatcacaaataaatctttta

SEQ ID NO: 206219 - DNA, 25 bp, Artificial sequence
  SiRNA target sequence
ttaccatcacaaataaatcttttaa

SEQ ID NO: 206220 - DNA, 25 bp, Artificial sequence
  SiRNA target sequence
taccatcacaaataaatcttttaaa

SEQ ID NO: 206221 - DNA, 25 bp, Artificial sequence
  SiRNA target sequence
accatcacaaataaatcttttaaaa

SEQ ID NO: 206222 - DNA, 25 bp, Artificial sequence
  SiRNA target sequence
ccatcacaaataaatcttttaaaat

SEQ ID NO: 206223 - DNA, 25 bp, Artificial sequence
  SiRNA target sequence
catcacaaataaatcttttaaaatt

SEQ ID NO: 206224 - DNA, 25 bp, Artificial sequence
  SiRNA target sequence
atcacaaataaatcttttaaaattc

SEQ ID NO: 206225 - DNA, 25 bp, Artificial sequence
  SiRNA target sequence
tcacaaataaatcttttaaaattct

SEQ ID NO: 206226 - DNA, 25 bp, Artificial sequence
  SiRNA target sequence
cacaaataaatcttttaaaattctt

SEQ ID NO: 206227 - DNA, 25 bp, Artificial sequence
  SiRNA target sequence
acaaataaatcttttaaaattctta

SEQ ID NO: 206228 - DNA, 25 bp, Artificial sequence
  SiRNA target sequence
caaataaatcttttaaaattcttaa

SEQ ID NO: 206229 - DNA, 25 bp, Artificial sequence
  SiRNA target sequence
aaataaatcttttaaaattcttaaa

SEQ ID NO: 206230 - DNA, 25 bp, Artificial sequence
  SiRNA target sequence
aataaatcttttaaaattcttaaaa

SEQ ID NO: 206231 - DNA, 25 bp, Artificial sequence
  SiRNA target sequence
ataaatcttttaaaattcttaaaaa

SEQ ID NO: 206232 - DNA, 25 bp, Artificial sequence
  SiRNA target sequence
taaatcttttaaaattcttaaaaat

SEQ ID NO: 206233 - DNA, 25 bp, Artificial sequence
  SiRNA target sequence
aaatcttttaaaattcttaaaaatg

SEQ ID NO: 206234 - DNA, 25 bp, Artificial sequence
  SiRNA target sequence
aatcttttaaaattcttaaaaatga

SEQ ID NO: 206235 - DNA, 25 bp, Artificial sequence
  SiRNA target sequence
atcttttaaaattcttaaaaatgaa

SEQ ID NO: 206236 - DNA, 25 bp, Artificial sequence
  SiRNA target sequence
tcttttaaaattcttaaaaatgaat

SEQ ID NO: 206237 - DNA, 25 bp, Artificial sequence
  SiRNA target sequence
cttttaaaattcttaaaaatgaata

SEQ ID NO: 206238 - DNA, 25 bp, Artificial sequence
  SiRNA target sequence
ttttaaaattcttaaaaatgaatac

SEQ ID NO: 206239 - DNA, 25 bp, Artificial sequence
  SiRNA target sequence
tttaaaattcttaaaaatgaataca

SEQ ID NO: 206240 - DNA, 25 bp, Artificial sequence
  SiRNA target sequence
ttaaaattcttaaaaatgaatacac

SEQ ID NO: 206241 - DNA, 25 bp, Artificial sequence
  SiRNA target sequence
taaaattcttaaaaatgaatacaca

SEQ ID NO: 206242 - DNA, 25 bp, Artificial sequence
  SiRNA target sequence
aaaattcttaaaaatgaatacacaa

SEQ ID NO: 206243 - DNA, 25 bp, Artificial sequence
  SiRNA target sequence
aaattcttaaaaatgaatacacaaa

SEQ ID NO: 206244 - DNA, 25 bp, Artificial sequence
  SiRNA target sequence
aattcttaaaaatgaatacacaaag

SEQ ID NO: 206245 - DNA, 25 bp, Artificial sequence
  SiRNA target sequence
attcttaaaaatgaatacacaaagt

SEQ ID NO: 206246 - DNA, 25 bp, Artificial sequence
  SiRNA target sequence
ttcttaaaaatgaatacacaaagtt

SEQ ID NO: 206247 - DNA, 25 bp, Artificial sequence
  SiRNA target sequence
tcttaaaaatgaatacacaaagtta

SEQ ID NO: 206248 - DNA, 25 bp, Artificial sequence
  SiRNA target sequence
cttaaaaatgaatacacaaagttaa

SEQ ID NO: 206249 - DNA, 25 bp, Artificial sequence
  SiRNA target sequence
ttaaaaatgaatacacaaagttaat

SEQ ID NO: 206250 - DNA, 25 bp, Artificial sequence
  SiRNA target sequence
taaaaatgaatacacaaagttaatt

SEQ ID NO: 206251 - DNA, 25 bp, Artificial sequence
  SiRNA target sequence
aaaaatgaatacacaaagttaatta

SEQ ID NO: 206252 - DNA, 25 bp, Artificial sequence
  SiRNA target sequence
aaaatgaatacacaaagttaattaa

SEQ ID NO: 206253 - DNA, 25 bp, Artificial sequence
  SiRNA target sequence
aaatgaatacacaaagttaattaat

SEQ ID NO: 206254 - DNA, 25 bp, Artificial sequence
  SiRNA target sequence
aatgaatacacaaagttaattaatc

SEQ ID NO: 206255 - DNA, 25 bp, Artificial sequence
  SiRNA target sequence
atgaatacacaaagttaattaatcc

SEQ ID NO: 206256 - DNA, 25 bp, Artificial sequence
  SiRNA target sequence
tgaatacacaaagttaattaatcca

SEQ ID NO: 206257 - DNA, 25 bp, Artificial sequence
  SiRNA target sequence
gaatacacaaagttaattaatccaa

SEQ ID NO: 206258 - DNA, 25 bp, Artificial sequence
  SiRNA target sequence
aatacacaaagttaattaatccaaa

SEQ ID NO: 206259 - DNA, 25 bp, Artificial sequence
  SiRNA target sequence
atacacaaagttaattaatccaaac

SEQ ID NO: 206260 - DNA, 25 bp, Artificial sequence
  SiRNA target sequence
tacacaaagttaattaatccaaaca

SEQ ID NO: 206261 - DNA, 25 bp, Artificial sequence
  SiRNA target sequence
acacaaagttaattaatccaaacat

SEQ ID NO: 206262 - DNA, 25 bp, Artificial sequence
  SiRNA target sequence
cacaaagttaattaatccaaacata

SEQ ID NO: 206263 - DNA, 25 bp, Artificial sequence
  SiRNA target sequence
acaaagttaattaatccaaacataa

SEQ ID NO: 206264 - DNA, 25 bp, Artificial sequence
  SiRNA target sequence
caaagttaattaatccaaacataat

SEQ ID NO: 206265 - DNA, 25 bp, Artificial sequence
  SiRNA target sequence
aaagttaattaatccaaacataata

SEQ ID NO: 206266 - DNA, 25 bp, Artificial sequence
  SiRNA target sequence
aagttaattaatccaaacataatac

SEQ ID NO: 206267 - DNA, 25 bp, Artificial sequence
  SiRNA target sequence
agttaattaatccaaacataatacc

SEQ ID NO: 206268 - DNA, 25 bp, Artificial sequence
  SiRNA target sequence
gttaattaatccaaacataatacca

SEQ ID NO: 206269 - DNA, 25 bp, Artificial sequence
  SiRNA target sequence
ttaattaatccaaacataataccaa

SEQ ID NO: 206270 - DNA, 25 bp, Artificial sequence
  SiRNA target sequence
taattaatccaaacataataccaag

SEQ ID NO: 206271 - DNA, 25 bp, Artificial sequence
  SiRNA target sequence
aattaatccaaacataataccaagt

SEQ ID NO: 206272 - DNA, 25 bp, Artificial sequence
  SiRNA target sequence
attaatccaaacataataccaagta

SEQ ID NO: 206273 - DNA, 25 bp, Artificial sequence
  SiRNA target sequence
ttaatccaaacataataccaagtat

SEQ ID NO: 206274 - DNA, 25 bp, Artificial sequence
  SiRNA target sequence
taatccaaacataataccaagtata

SEQ ID NO: 206275 - DNA, 25 bp, Artificial sequence
  SiRNA target sequence
aatccaaacataataccaagtataa

SEQ ID NO: 206276 - DNA, 25 bp, Artificial sequence
  SiRNA target sequence
atccaaacataataccaagtataaa

SEQ ID NO: 206277 - DNA, 25 bp, Artificial sequence
  SiRNA target sequence
tccaaacataataccaagtataaaa

SEQ ID NO: 206278 - DNA, 25 bp, Artificial sequence
  SiRNA target sequence
ccaaacataataccaagtataaaaa

SEQ ID NO: 206279 - DNA, 25 bp, Artificial sequence
  SiRNA target sequence
caaacataataccaagtataaaaaa

SEQ ID NO: 206280 - DNA, 25 bp, Artificial sequence
  SiRNA target sequence
aaacataataccaagtataaaaaat

SEQ ID NO: 206281 - DNA, 25 bp, Artificial sequence
  SiRNA target sequence
aacataataccaagtataaaaaatt

SEQ ID NO: 206282 - DNA, 25 bp, Artificial sequence
  SiRNA target sequence
acataataccaagtataaaaaattt

SEQ ID NO: 206283 - DNA, 25 bp, Artificial sequence
  SiRNA target sequence
cataataccaagtataaaaaattta

SEQ ID NO: 206284 - DNA, 25 bp, Artificial sequence
  SiRNA target sequence
ataataccaagtataaaaaatttag

SEQ ID NO: 206285 - DNA, 25 bp, Artificial sequence
  SiRNA target sequence
taataccaagtataaaaaatttagg

SEQ ID NO: 206286 - DNA, 25 bp, Artificial sequence
  SiRNA target sequence
aataccaagtataaaaaatttaggc

SEQ ID NO: 206287 - DNA, 25 bp, Artificial sequence
  SiRNA target sequence
ataccaagtataaaaaatttaggca

SEQ ID NO: 206288 - DNA, 25 bp, Artificial sequence
  SiRNA target sequence
taccaagtataaaaaatttaggcat

SEQ ID NO: 206289 - DNA, 25 bp, Artificial sequence
  SiRNA target sequence
accaagtataaaaaatttaggcatt

SEQ ID NO: 206290 - DNA, 25 bp, Artificial sequence
  SiRNA target sequence
ccaagtataaaaaatttaggcattt

SEQ ID NO: 206291 - DNA, 25 bp, Artificial sequence
  SiRNA target sequence
caagtataaaaaatttaggcatttc

SEQ ID NO: 206292 - DNA, 25 bp, Artificial sequence
  SiRNA target sequence
aagtataaaaaatttaggcatttca

SEQ ID NO: 206293 - DNA, 25 bp, Artificial sequence
  SiRNA target sequence
agtataaaaaatttaggcatttcaa

SEQ ID NO: 206294 - DNA, 25 bp, Artificial sequence
  SiRNA target sequence
gtataaaaaatttaggcatttcaac

SEQ ID NO: 206295 - DNA, 25 bp, Artificial sequence
  SiRNA target sequence
tataaaaaatttaggcatttcaacc

SEQ ID NO: 206296 - DNA, 25 bp, Artificial sequence
  SiRNA target sequence
ataaaaaatttaggcatttcaacct

SEQ ID NO: 206297 - DNA, 25 bp, Artificial sequence
  SiRNA target sequence
taaaaaatttaggcatttcaacctt

SEQ ID NO: 206298 - DNA, 25 bp, Artificial sequence
  SiRNA target sequence
aaaaaatttaggcatttcaacctta

SEQ ID NO: 206299 - DNA, 25 bp, Artificial sequence
  SiRNA target sequence
aaaaatttaggcatttcaaccttag

SEQ ID NO: 206300 - DNA, 25 bp, Artificial sequence
  SiRNA target sequence
aaaatttaggcatttcaaccttagc

SEQ ID NO: 206301 - DNA, 25 bp, Artificial sequence
  SiRNA target sequence
aaatttaggcatttcaaccttagca

SEQ ID NO: 206302 - DNA, 25 bp, Artificial sequence
  SiRNA target sequence
aatttaggcatttcaaccttagcaa

SEQ ID NO: 206303 - DNA, 25 bp, Artificial sequence
  SiRNA target sequence
atttaggcatttcaaccttagcaac

SEQ ID NO: 206304 - DNA, 25 bp, Artificial sequence
  SiRNA target sequence
tttaggcatttcaaccttagcaact

SEQ ID NO: 206305 - DNA, 25 bp, Artificial sequence
  SiRNA target sequence
ttaggcatttcaaccttagcaactt

SEQ ID NO: 206306 - DNA, 25 bp, Artificial sequence
  SiRNA target sequence
taggcatttcaaccttagcaacttt

SEQ ID NO: 206307 - DNA, 25 bp, Artificial sequence
  SiRNA target sequence
aggcatttcaaccttagcaacttta

SEQ ID NO: 206308 - DNA, 25 bp, Artificial sequence
  SiRNA target sequence
ggcatttcaaccttagcaactttaa

SEQ ID NO: 206309 - DNA, 25 bp, Artificial sequence
  SiRNA target sequence
gcatttcaaccttagcaactttaaa

SEQ ID NO: 206310 - DNA, 25 bp, Artificial sequence
  SiRNA target sequence
catttcaaccttagcaactttaaaa

SEQ ID NO: 206311 - DNA, 25 bp, Artificial sequence
  SiRNA target sequence
atttcaaccttagcaactttaaaat

SEQ ID NO: 206312 - DNA, 25 bp, Artificial sequence
  SiRNA target sequence
tttcaaccttagcaactttaaaata

SEQ ID NO: 206313 - DNA, 25 bp, Artificial sequence
  SiRNA target sequence
ttcaaccttagcaactttaaaataa

SEQ ID NO: 206314 - DNA, 25 bp, Artificial sequence
  SiRNA target sequence
tcaaccttagcaactttaaaataac

SEQ ID NO: 206315 - DNA, 25 bp, Artificial sequence
  SiRNA target sequence
caaccttagcaactttaaaataact

SEQ ID NO: 206316 - DNA, 25 bp, Artificial sequence
  SiRNA target sequence
aaccttagcaactttaaaataactc

SEQ ID NO: 206317 - DNA, 25 bp, Artificial sequence
  SiRNA target sequence
accttagcaactttaaaataactca

SEQ ID NO: 206318 - DNA, 25 bp, Artificial sequence
  SiRNA target sequence
ccttagcaactttaaaataactcag

SEQ ID NO: 206319 - DNA, 25 bp, Artificial sequence
  SiRNA target sequence
cttagcaactttaaaataactcagt

SEQ ID NO: 206320 - DNA, 25 bp, Artificial sequence
  SiRNA target sequence
ttagcaactttaaaataactcagta

SEQ ID NO: 206321 - DNA, 25 bp, Artificial sequence
  SiRNA target sequence
tagcaactttaaaataactcagtaa

SEQ ID NO: 206322 - DNA, 25 bp, Artificial sequence
  SiRNA target sequence
agcaactttaaaataactcagtaat

SEQ ID NO: 206323 - DNA, 25 bp, Artificial sequence
  SiRNA target sequence
gcaactttaaaataactcagtaatc

SEQ ID NO: 206324 - DNA, 25 bp, Artificial sequence
  SiRNA target sequence
caactttaaaataactcagtaatcc

SEQ ID NO: 206325 - DNA, 25 bp, Artificial sequence
  SiRNA target sequence
aactttaaaataactcagtaatcct

SEQ ID NO: 206326 - DNA, 25 bp, Artificial sequence
  SiRNA target sequence
actttaaaataactcagtaatcctg

SEQ ID NO: 206327 - DNA, 25 bp, Artificial sequence
  SiRNA target sequence
ctttaaaataactcagtaatcctgt

SEQ ID NO: 206328 - DNA, 25 bp, Artificial sequence
  SiRNA target sequence
tttaaaataactcagtaatcctgtt

SEQ ID NO: 206329 - DNA, 25 bp, Artificial sequence
  SiRNA target sequence
ttaaaataactcagtaatcctgttc

SEQ ID NO: 206330 - DNA, 25 bp, Artificial sequence
  SiRNA target sequence
taaaataactcagtaatcctgttct

SEQ ID NO: 206331 - DNA, 25 bp, Artificial sequence
  SiRNA target sequence
aaaataactcagtaatcctgttctt

SEQ ID NO: 206332 - DNA, 25 bp, Artificial sequence
  SiRNA target sequence
aaataactcagtaatcctgttcttg

SEQ ID NO: 206333 - DNA, 25 bp, Artificial sequence
  SiRNA target sequence
aataactcagtaatcctgttcttga

SEQ ID NO: 206334 - DNA, 25 bp, Artificial sequence
  SiRNA target sequence
ataactcagtaatcctgttcttgaa

SEQ ID NO: 206335 - DNA, 25 bp, Artificial sequence
  SiRNA target sequence
taactcagtaatcctgttcttgaat

SEQ ID NO: 206336 - DNA, 25 bp, Artificial sequence
  SiRNA target sequence
aactcagtaatcctgttcttgaatt

SEQ ID NO: 206337 - DNA, 25 bp, Artificial sequence
  SiRNA target sequence
actcagtaatcctgttcttgaattt

SEQ ID NO: 206338 - DNA, 25 bp, Artificial sequence
  SiRNA target sequence
ctcagtaatcctgttcttgaatttg

SEQ ID NO: 206339 - DNA, 25 bp, Artificial sequence
  SiRNA target sequence
tcagtaatcctgttcttgaatttgc

SEQ ID NO: 206340 - DNA, 25 bp, Artificial sequence
  SiRNA target sequence
cagtaatcctgttcttgaatttgct

SEQ ID NO: 206341 - DNA, 25 bp, Artificial sequence
  SiRNA target sequence
agtaatcctgttcttgaatttgcta

SEQ ID NO: 206342 - DNA, 25 bp, Artificial sequence
  SiRNA target sequence
gtaatcctgttcttgaatttgctaa

SEQ ID NO: 206343 - DNA, 25 bp, Artificial sequence
  SiRNA target sequence
taatcctgttcttgaatttgctaat

SEQ ID NO: 206344 - DNA, 25 bp, Artificial sequence
  SiRNA target sequence
aatcctgttcttgaatttgctaatt

SEQ ID NO: 206345 - DNA, 25 bp, Artificial sequence
  SiRNA target sequence
atcctgttcttgaatttgctaattg

SEQ ID NO: 206346 - DNA, 25 bp, Artificial sequence
  SiRNA target sequence
tcctgttcttgaatttgctaattga

SEQ ID NO: 206347 - DNA, 25 bp, Artificial sequence
  SiRNA target sequence
cctgttcttgaatttgctaattgat

SEQ ID NO: 206348 - DNA, 25 bp, Artificial sequence
  SiRNA target sequence
ctgttcttgaatttgctaattgatc

SEQ ID NO: 206349 - DNA, 25 bp, Artificial sequence
  SiRNA target sequence
tgttcttgaatttgctaattgatca

SEQ ID NO: 206350 - DNA, 25 bp, Artificial sequence
  SiRNA target sequence
gttcttgaatttgctaattgatcaa

SEQ ID NO: 206351 - DNA, 25 bp, Artificial sequence
  SiRNA target sequence
ttcttgaatttgctaattgatcaat

SEQ ID NO: 206352 - DNA, 25 bp, Artificial sequence
  SiRNA target sequence
tcttgaatttgctaattgatcaatc

SEQ ID NO: 206353 - DNA, 25 bp, Artificial sequence
  SiRNA target sequence
cttgaatttgctaattgatcaatct

SEQ ID NO: 206354 - DNA, 25 bp, Artificial sequence
  SiRNA target sequence
ttgaatttgctaattgatcaatctc

SEQ ID NO: 206355 - DNA, 25 bp, Artificial sequence
  SiRNA target sequence
tgaatttgctaattgatcaatctca

SEQ ID NO: 206356 - DNA, 25 bp, Artificial sequence
  SiRNA target sequence
gaatttgctaattgatcaatctcat

SEQ ID NO: 206357 - DNA, 25 bp, Artificial sequence
  SiRNA target sequence
aatttgctaattgatcaatctcatc

SEQ ID NO: 206358 - DNA, 25 bp, Artificial sequence
  SiRNA target sequence
atttgctaattgatcaatctcatct

SEQ ID NO: 206359 - DNA, 25 bp, Artificial sequence
  SiRNA target sequence
tttgctaattgatcaatctcatctt

SEQ ID NO: 206360 - DNA, 25 bp, Artificial sequence
  SiRNA target sequence
ttgctaattgatcaatctcatcttc

SEQ ID NO: 206361 - DNA, 25 bp, Artificial sequence
  SiRNA target sequence
tgctaattgatcaatctcatcttcc

SEQ ID NO: 206362 - DNA, 25 bp, Artificial sequence
  SiRNA target sequence
gctaattgatcaatctcatcttccg

SEQ ID NO: 206363 - DNA, 25 bp, Artificial sequence
  SiRNA target sequence
ctaattgatcaatctcatcttccgt

SEQ ID NO: 206364 - DNA, 25 bp, Artificial sequence
  SiRNA target sequence
taattgatcaatctcatcttccgta

SEQ ID NO: 206365 - DNA, 25 bp, Artificial sequence
  SiRNA target sequence
aattgatcaatctcatcttccgtag

SEQ ID NO: 206366 - DNA, 25 bp, Artificial sequence
  SiRNA target sequence
attgatcaatctcatcttccgtagg

SEQ ID NO: 206367 - DNA, 25 bp, Artificial sequence
  SiRNA target sequence
ttgatcaatctcatcttccgtaggt

SEQ ID NO: 206368 - DNA, 25 bp, Artificial sequence
  SiRNA target sequence
tgatcaatctcatcttccgtaggta

SEQ ID NO: 206369 - DNA, 25 bp, Artificial sequence
  SiRNA target sequence
gatcaatctcatcttccgtaggtaa

SEQ ID NO: 206370 - DNA, 25 bp, Artificial sequence
  SiRNA target sequence
atcaatctcatcttccgtaggtaag

SEQ ID NO: 206371 - DNA, 25 bp, Artificial sequence
  SiRNA target sequence
tcaatctcatcttccgtaggtaagt

SEQ ID NO: 206372 - DNA, 25 bp, Artificial sequence
  SiRNA target sequence
caatctcatcttccgtaggtaagtt

SEQ ID NO: 206373 - DNA, 25 bp, Artificial sequence
  SiRNA target sequence
aatctcatcttccgtaggtaagttg

SEQ ID NO: 206374 - DNA, 25 bp, Artificial sequence
  SiRNA target sequence
atctcatcttccgtaggtaagttgt

SEQ ID NO: 206375 - DNA, 25 bp, Artificial sequence
  SiRNA target sequence
tctcatcttccgtaggtaagttgtt

SEQ ID NO: 206376 - DNA, 25 bp, Artificial sequence
  SiRNA target sequence
ctcatcttccgtaggtaagttgttt

SEQ ID NO: 206377 - DNA, 25 bp, Artificial sequence
  SiRNA target sequence
tcatcttccgtaggtaagttgtttt

SEQ ID NO: 206378 - DNA, 25 bp, Artificial sequence
  SiRNA target sequence
catcttccgtaggtaagttgttttc

SEQ ID NO: 206379 - DNA, 25 bp, Artificial sequence
  SiRNA target sequence
atcttccgtaggtaagttgttttca

SEQ ID NO: 206380 - DNA, 25 bp, Artificial sequence
  SiRNA target sequence
tcttccgtaggtaagttgttttcag

SEQ ID NO: 206381 - DNA, 25 bp, Artificial sequence
  SiRNA target sequence
cttccgtaggtaagttgttttcagg

SEQ ID NO: 206382 - DNA, 25 bp, Artificial sequence
  SiRNA target sequence
ttccgtaggtaagttgttttcaggt

SEQ ID NO: 206383 - DNA, 25 bp, Artificial sequence
  SiRNA target sequence
tccgtaggtaagttgttttcaggtg

SEQ ID NO: 206384 - DNA, 25 bp, Artificial sequence
  SiRNA target sequence
ccgtaggtaagttgttttcaggtgt

SEQ ID NO: 206385 - DNA, 25 bp, Artificial sequence
  SiRNA target sequence
cgtaggtaagttgttttcaggtgtt

SEQ ID NO: 206386 - DNA, 25 bp, Artificial sequence
  SiRNA target sequence
gtaggtaagttgttttcaggtgttt

SEQ ID NO: 206387 - DNA, 25 bp, Artificial sequence
  SiRNA target sequence
taggtaagttgttttcaggtgtttc

SEQ ID NO: 206388 - DNA, 25 bp, Artificial sequence
  SiRNA target sequence
aggtaagttgttttcaggtgtttca

SEQ ID NO: 206389 - DNA, 25 bp, Artificial sequence
  SiRNA target sequence
ggtaagttgttttcaggtgtttcat

SEQ ID NO: 206390 - DNA, 25 bp, Artificial sequence
  SiRNA target sequence
gtaagttgttttcaggtgtttcatt

SEQ ID NO: 206391 - DNA, 25 bp, Artificial sequence
  SiRNA target sequence
taagttgttttcaggtgtttcattt

SEQ ID NO: 206392 - DNA, 25 bp, Artificial sequence
  SiRNA target sequence
aagttgttttcaggtgtttcattta

SEQ ID NO: 206393 - DNA, 25 bp, Artificial sequence
  SiRNA target sequence
agttgttttcaggtgtttcatttat

SEQ ID NO: 206394 - DNA, 25 bp, Artificial sequence
  SiRNA target sequence
gttgttttcaggtgtttcatttatt

SEQ ID NO: 206395 - DNA, 25 bp, Artificial sequence
  SiRNA target sequence
ttgttttcaggtgtttcatttatta

SEQ ID NO: 206396 - DNA, 25 bp, Artificial sequence
  SiRNA target sequence
tgttttcaggtgtttcatttattac

SEQ ID NO: 206397 - DNA, 25 bp, Artificial sequence
  SiRNA target sequence
gttttcaggtgtttcatttattaca

SEQ ID NO: 206398 - DNA, 25 bp, Artificial sequence
  SiRNA target sequence
ttttcaggtgtttcatttattacac

SEQ ID NO: 206399 - DNA, 25 bp, Artificial sequence
  SiRNA target sequence
tttcaggtgtttcatttattacact

SEQ ID NO: 206400 - DNA, 25 bp, Artificial sequence
  SiRNA target sequence
ttcaggtgtttcatttattacactc

SEQ ID NO: 206401 - DNA, 25 bp, Artificial sequence
  SiRNA target sequence
tcaggtgtttcatttattacactca

SEQ ID NO: 206402 - DNA, 25 bp, Artificial sequence
  SiRNA target sequence
caggtgtttcatttattacactcat

SEQ ID NO: 206403 - DNA, 26 bp, Artificial sequence
  SiRNA target sequence
ttattctgcgttttcttttttgtcgt

SEQ ID NO: 206404 - DNA, 26 bp, Artificial sequence
  SiRNA target sequence
tattctgcgttttcttttttgtcgtc

SEQ ID NO: 206405 - DNA, 26 bp, Artificial sequence
  SiRNA target sequence
attctgcgttttcttttttgtcgtct

SEQ ID NO: 206406 - DNA, 26 bp, Artificial sequence
  SiRNA target sequence
ttctgcgttttcttttttgtcgtctt

SEQ ID NO: 206407 - DNA, 26 bp, Artificial sequence
  SiRNA target sequence
tctgcgttttcttttttgtcgtcttt

SEQ ID NO: 206408 - DNA, 26 bp, Artificial sequence
  SiRNA target sequence
ctgcgttttcttttttgtcgtctttt

SEQ ID NO: 206409 - DNA, 26 bp, Artificial sequence
  SiRNA target sequence
tgcgttttcttttttgtcgtctttta

SEQ ID NO: 206410 - DNA, 26 bp, Artificial sequence
  SiRNA target sequence
gcgttttcttttttgtcgtcttttat

SEQ ID NO: 206411 - DNA, 26 bp, Artificial sequence
  SiRNA target sequence
cgttttcttttttgtcgtcttttatt

SEQ ID NO: 206412 - DNA, 26 bp, Artificial sequence
  SiRNA target sequence
gttttcttttttgtcgtcttttatta

SEQ ID NO: 206413 - DNA, 26 bp, Artificial sequence
  SiRNA target sequence
ttttcttttttgtcgtcttttattaa

SEQ ID NO: 206414 - DNA, 26 bp, Artificial sequence
  SiRNA target sequence
tttcttttttgtcgtcttttattaaa

SEQ ID NO: 206415 - DNA, 26 bp, Artificial sequence
  SiRNA target sequence
ttcttttttgtcgtcttttattaaat

SEQ ID NO: 206416 - DNA, 26 bp, Artificial sequence
  SiRNA target sequence
tcttttttgtcgtcttttattaaatc

SEQ ID NO: 206417 - DNA, 26 bp, Artificial sequence
  SiRNA target sequence
cttttttgtcgtcttttattaaatct

SEQ ID NO: 206418 - DNA, 26 bp, Artificial sequence
  SiRNA target sequence
ttttttgtcgtcttttattaaatcta

SEQ ID NO: 206419 - DNA, 26 bp, Artificial sequence
  SiRNA target sequence
tttttgtcgtcttttattaaatctat

SEQ ID NO: 206420 - DNA, 26 bp, Artificial sequence
  SiRNA target sequence
ttttgtcgtcttttattaaatctatg

SEQ ID NO: 206421 - DNA, 26 bp, Artificial sequence
  SiRNA target sequence
tttgtcgtcttttattaaatctatgt

SEQ ID NO: 206422 - DNA, 26 bp, Artificial sequence
  SiRNA target sequence
ttgtcgtcttttattaaatctatgtc

SEQ ID NO: 206423 - DNA, 26 bp, Artificial sequence
  SiRNA target sequence
tgtcgtcttttattaaatctatgtct

SEQ ID NO: 206424 - DNA, 26 bp, Artificial sequence
  SiRNA target sequence
gtcgtcttttattaaatctatgtcta

SEQ ID NO: 206425 - DNA, 26 bp, Artificial sequence
  SiRNA target sequence
tcgtcttttattaaatctatgtctac

SEQ ID NO: 206426 - DNA, 26 bp, Artificial sequence
  SiRNA target sequence
cgtcttttattaaatctatgtctaca

SEQ ID NO: 206427 - DNA, 26 bp, Artificial sequence
  SiRNA target sequence
gtcttttattaaatctatgtctacac

SEQ ID NO: 206428 - DNA, 26 bp, Artificial sequence
  SiRNA target sequence
tcttttattaaatctatgtctacact

SEQ ID NO: 206429 - DNA, 26 bp, Artificial sequence
  SiRNA target sequence
cttttattaaatctatgtctacactt

SEQ ID NO: 206430 - DNA, 26 bp, Artificial sequence
  SiRNA target sequence
ttttattaaatctatgtctacacttg

SEQ ID NO: 206431 - DNA, 26 bp, Artificial sequence
  SiRNA target sequence
tttattaaatctatgtctacacttgt

SEQ ID NO: 206432 - DNA, 26 bp, Artificial sequence
  SiRNA target sequence
ttattaaatctatgtctacacttgta

SEQ ID NO: 206433 - DNA, 26 bp, Artificial sequence
  SiRNA target sequence
tattaaatctatgtctacacttgtat

SEQ ID NO: 206434 - DNA, 26 bp, Artificial sequence
  SiRNA target sequence
attaaatctatgtctacacttgtatt

SEQ ID NO: 206435 - DNA, 26 bp, Artificial sequence
  SiRNA target sequence
ttaaatctatgtctacacttgtatta

SEQ ID NO: 206436 - DNA, 26 bp, Artificial sequence
  SiRNA target sequence
taaatctatgtctacacttgtattat

SEQ ID NO: 206437 - DNA, 26 bp, Artificial sequence
  SiRNA target sequence
aaatctatgtctacacttgtattatt

SEQ ID NO: 206438 - DNA, 26 bp, Artificial sequence
  SiRNA target sequence
aatctatgtctacacttgtattattt

SEQ ID NO: 206439 - DNA, 26 bp, Artificial sequence
  SiRNA target sequence
atctatgtctacacttgtattatttt

SEQ ID NO: 206440 - DNA, 26 bp, Artificial sequence
  SiRNA target sequence
tctatgtctacacttgtattattttt

SEQ ID NO: 206441 - DNA, 26 bp, Artificial sequence
  SiRNA target sequence
ctatgtctacacttgtattattttta

SEQ ID NO: 206442 - DNA, 26 bp, Artificial sequence
  SiRNA target sequence
tatgtctacacttgtattatttttaa

SEQ ID NO: 206443 - DNA, 26 bp, Artificial sequence
  SiRNA target sequence
atgtctacacttgtattatttttaat

SEQ ID NO: 206444 - DNA, 26 bp, Artificial sequence
  SiRNA target sequence
tgtctacacttgtattatttttaatt

SEQ ID NO: 206445 - DNA, 26 bp, Artificial sequence
  SiRNA target sequence
gtctacacttgtattatttttaattg

SEQ ID NO: 206446 - DNA, 26 bp, Artificial sequence
  SiRNA target sequence
tctacacttgtattatttttaattga

SEQ ID NO: 206447 - DNA, 26 bp, Artificial sequence
  SiRNA target sequence
ctacacttgtattatttttaattgaa

SEQ ID NO: 206448 - DNA, 26 bp, Artificial sequence
  SiRNA target sequence
tacacttgtattatttttaattgaaa

SEQ ID NO: 206449 - DNA, 26 bp, Artificial sequence
  SiRNA target sequence
acacttgtattatttttaattgaaac

SEQ ID NO: 206450 - DNA, 26 bp, Artificial sequence
  SiRNA target sequence
cacttgtattatttttaattgaaacg

SEQ ID NO: 206451 - DNA, 26 bp, Artificial sequence
  SiRNA target sequence
acttgtattatttttaattgaaacgt

SEQ ID NO: 206452 - DNA, 26 bp, Artificial sequence
  SiRNA target sequence
cttgtattatttttaattgaaacgtt

SEQ ID NO: 206453 - DNA, 26 bp, Artificial sequence
  SiRNA target sequence
ttgtattatttttaattgaaacgtta

SEQ ID NO: 206454 - DNA, 26 bp, Artificial sequence
  SiRNA target sequence
tgtattatttttaattgaaacgttat

SEQ ID NO: 206455 - DNA, 26 bp, Artificial sequence
  SiRNA target sequence
gtattatttttaattgaaacgttata

SEQ ID NO: 206456 - DNA, 26 bp, Artificial sequence
  SiRNA target sequence
tattatttttaattgaaacgttatat

SEQ ID NO: 206457 - DNA, 26 bp, Artificial sequence
  SiRNA target sequence
attatttttaattgaaacgttatatg

SEQ ID NO: 206458 - DNA, 26 bp, Artificial sequence
  SiRNA target sequence
ttatttttaattgaaacgttatatgc

SEQ ID NO: 206459 - DNA, 26 bp, Artificial sequence
  SiRNA target sequence
tatttttaattgaaacgttatatgca

SEQ ID NO: 206460 - DNA, 26 bp, Artificial sequence
  SiRNA target sequence
atttttaattgaaacgttatatgcac

SEQ ID NO: 206461 - DNA, 26 bp, Artificial sequence
  SiRNA target sequence
tttttaattgaaacgttatatgcacc

SEQ ID NO: 206462 - DNA, 26 bp, Artificial sequence
  SiRNA target sequence
ttttaattgaaacgttatatgcaccc

SEQ ID NO: 206463 - DNA, 26 bp, Artificial sequence
  SiRNA target sequence
tttaattgaaacgttatatgcacccg

SEQ ID NO: 206464 - DNA, 26 bp, Artificial sequence
  SiRNA target sequence
ttaattgaaacgttatatgcacccgc

SEQ ID NO: 206465 - DNA, 26 bp, Artificial sequence
  SiRNA target sequence
taattgaaacgttatatgcacccgct

SEQ ID NO: 206466 - DNA, 26 bp, Artificial sequence
  SiRNA target sequence
aattgaaacgttatatgcacccgcta

SEQ ID NO: 206467 - DNA, 26 bp, Artificial sequence
  SiRNA target sequence
attgaaacgttatatgcacccgctaa

SEQ ID NO: 206468 - DNA, 26 bp, Artificial sequence
  SiRNA target sequence
ttgaaacgttatatgcacccgctaaa

SEQ ID NO: 206469 - DNA, 26 bp, Artificial sequence
  SiRNA target sequence
tgaaacgttatatgcacccgctaaat

SEQ ID NO: 206470 - DNA, 26 bp, Artificial sequence
  SiRNA target sequence
gaaacgttatatgcacccgctaaata

SEQ ID NO: 206471 - DNA, 26 bp, Artificial sequence
  SiRNA target sequence
aaacgttatatgcacccgctaaatag

SEQ ID NO: 206472 - DNA, 26 bp, Artificial sequence
  SiRNA target sequence
aacgttatatgcacccgctaaataga

SEQ ID NO: 206473 - DNA, 26 bp, Artificial sequence
  SiRNA target sequence
acgttatatgcacccgctaaatagat

SEQ ID NO: 206474 - DNA, 26 bp, Artificial sequence
  SiRNA target sequence
cgttatatgcacccgctaaatagatt

SEQ ID NO: 206475 - DNA, 26 bp, Artificial sequence
  SiRNA target sequence
gttatatgcacccgctaaatagatta

SEQ ID NO: 206476 - DNA, 26 bp, Artificial sequence
  SiRNA target sequence
ttatatgcacccgctaaatagattat

SEQ ID NO: 206477 - DNA, 26 bp, Artificial sequence
  SiRNA target sequence
tatatgcacccgctaaatagattata

SEQ ID NO: 206478 - DNA, 26 bp, Artificial sequence
  SiRNA target sequence
atatgcacccgctaaatagattatag

SEQ ID NO: 206479 - DNA, 26 bp, Artificial sequence
  SiRNA target sequence
tatgcacccgctaaatagattatagc

SEQ ID NO: 206480 - DNA, 26 bp, Artificial sequence
  SiRNA target sequence
atgcacccgctaaatagattatagct

SEQ ID NO: 206481 - DNA, 26 bp, Artificial sequence
  SiRNA target sequence
tgcacccgctaaatagattatagctc

SEQ ID NO: 206482 - DNA, 26 bp, Artificial sequence
  SiRNA target sequence
gcacccgctaaatagattatagctct

SEQ ID NO: 206483 - DNA, 26 bp, Artificial sequence
  SiRNA target sequence
cacccgctaaatagattatagctcta

SEQ ID NO: 206484 - DNA, 26 bp, Artificial sequence
  SiRNA target sequence
acccgctaaatagattatagctctaa

SEQ ID NO: 206485 - DNA, 26 bp, Artificial sequence
  SiRNA target sequence
cccgctaaatagattatagctctaat

SEQ ID NO: 206486 - DNA, 26 bp, Artificial sequence
  SiRNA target sequence
ccgctaaatagattatagctctaatc

SEQ ID NO: 206487 - DNA, 26 bp, Artificial sequence
  SiRNA target sequence
cgctaaatagattatagctctaatcc

SEQ ID NO: 206488 - DNA, 26 bp, Artificial sequence
  SiRNA target sequence
gctaaatagattatagctctaatcca

SEQ ID NO: 206489 - DNA, 26 bp, Artificial sequence
  SiRNA target sequence
ctaaatagattatagctctaatccaa

SEQ ID NO: 206490 - DNA, 26 bp, Artificial sequence
  SiRNA target sequence
taaatagattatagctctaatccaaa

SEQ ID NO: 206491 - DNA, 26 bp, Artificial sequence
  SiRNA target sequence
aaatagattatagctctaatccaaat

SEQ ID NO: 206492 - DNA, 26 bp, Artificial sequence
  SiRNA target sequence
aatagattatagctctaatccaaata

SEQ ID NO: 206493 - DNA, 26 bp, Artificial sequence
  SiRNA target sequence
atagattatagctctaatccaaatat

SEQ ID NO: 206494 - DNA, 26 bp, Artificial sequence
  SiRNA target sequence
tagattatagctctaatccaaatata

SEQ ID NO: 206495 - DNA, 26 bp, Artificial sequence
  SiRNA target sequence
agattatagctctaatccaaatataa

SEQ ID NO: 206496 - DNA, 26 bp, Artificial sequence
  SiRNA target sequence
gattatagctctaatccaaatataaa

SEQ ID NO: 206497 - DNA, 26 bp, Artificial sequence
  SiRNA target sequence
attatagctctaatccaaatataaat

SEQ ID NO: 206498 - DNA, 26 bp, Artificial sequence
  SiRNA target sequence
ttatagctctaatccaaatataaatc

SEQ ID NO: 206499 - DNA, 26 bp, Artificial sequence
  SiRNA target sequence
tatagctctaatccaaatataaatca

SEQ ID NO: 206500 - DNA, 26 bp, Artificial sequence
  SiRNA target sequence
atagctctaatccaaatataaatcaa

SEQ ID NO: 206501 - DNA, 26 bp, Artificial sequence
  SiRNA target sequence
tagctctaatccaaatataaatcaat

SEQ ID NO: 206502 - DNA, 26 bp, Artificial sequence
  SiRNA target sequence
agctctaatccaaatataaatcaata

SEQ ID NO: 206503 - DNA, 26 bp, Artificial sequence
  SiRNA target sequence
gctctaatccaaatataaatcaatat

SEQ ID NO: 206504 - DNA, 26 bp, Artificial sequence
  SiRNA target sequence
ctctaatccaaatataaatcaatatt

SEQ ID NO: 206505 - DNA, 26 bp, Artificial sequence
  SiRNA target sequence
tctaatccaaatataaatcaatatta

SEQ ID NO: 206506 - DNA, 26 bp, Artificial sequence
  SiRNA target sequence
ctaatccaaatataaatcaatattat

SEQ ID NO: 206507 - DNA, 26 bp, Artificial sequence
  SiRNA target sequence
taatccaaatataaatcaatattatt

SEQ ID NO: 206508 - DNA, 26 bp, Artificial sequence
  SiRNA target sequence
aatccaaatataaatcaatattattg

SEQ ID NO: 206509 - DNA, 26 bp, Artificial sequence
  SiRNA target sequence
atccaaatataaatcaatattattgc

SEQ ID NO: 206510 - DNA, 26 bp, Artificial sequence
  SiRNA target sequence
tccaaatataaatcaatattattgca

SEQ ID NO: 206511 - DNA, 26 bp, Artificial sequence
  SiRNA target sequence
ccaaatataaatcaatattattgcaa

SEQ ID NO: 206512 - DNA, 26 bp, Artificial sequence
  SiRNA target sequence
caaatataaatcaatattattgcaat

SEQ ID NO: 206513 - DNA, 26 bp, Artificial sequence
  SiRNA target sequence
aaatataaatcaatattattgcaatc

SEQ ID NO: 206514 - DNA, 26 bp, Artificial sequence
  SiRNA target sequence
aatataaatcaatattattgcaatcg

SEQ ID NO: 206515 - DNA, 26 bp, Artificial sequence
  SiRNA target sequence
atataaatcaatattattgcaatcgt

SEQ ID NO: 206516 - DNA, 26 bp, Artificial sequence
  SiRNA target sequence
tataaatcaatattattgcaatcgtt

SEQ ID NO: 206517 - DNA, 26 bp, Artificial sequence
  SiRNA target sequence
ataaatcaatattattgcaatcgtta

SEQ ID NO: 206518 - DNA, 26 bp, Artificial sequence
  SiRNA target sequence
taaatcaatattattgcaatcgttaa

SEQ ID NO: 206519 - DNA, 26 bp, Artificial sequence
  SiRNA target sequence
aaatcaatattattgcaatcgttaat

SEQ ID NO: 206520 - DNA, 26 bp, Artificial sequence
  SiRNA target sequence
aatcaatattattgcaatcgttaatg

SEQ ID NO: 206521 - DNA, 26 bp, Artificial sequence
  SiRNA target sequence
atcaatattattgcaatcgttaatgt

SEQ ID NO: 206522 - DNA, 26 bp, Artificial sequence
  SiRNA target sequence
tcaatattattgcaatcgttaatgtg

SEQ ID NO: 206523 - DNA, 26 bp, Artificial sequence
  SiRNA target sequence
caatattattgcaatcgttaatgtga

SEQ ID NO: 206524 - DNA, 26 bp, Artificial sequence
  SiRNA target sequence
aatattattgcaatcgttaatgtgat

SEQ ID NO: 206525 - DNA, 26 bp, Artificial sequence
  SiRNA target sequence
atattattgcaatcgttaatgtgatt

SEQ ID NO: 206526 - DNA, 26 bp, Artificial sequence
  SiRNA target sequence
tattattgcaatcgttaatgtgattg

SEQ ID NO: 206527 - DNA, 26 bp, Artificial sequence
  SiRNA target sequence
attattgcaatcgttaatgtgattgg

SEQ ID NO: 206528 - DNA, 26 bp, Artificial sequence
  SiRNA target sequence
ttattgcaatcgttaatgtgattgga

SEQ ID NO: 206529 - DNA, 26 bp, Artificial sequence
  SiRNA target sequence
tattgcaatcgttaatgtgattggac

SEQ ID NO: 206530 - DNA, 26 bp, Artificial sequence
  SiRNA target sequence
attgcaatcgttaatgtgattggact

SEQ ID NO: 206531 - DNA, 26 bp, Artificial sequence
  SiRNA target sequence
ttgcaatcgttaatgtgattggacta

SEQ ID NO: 206532 - DNA, 26 bp, Artificial sequence
  SiRNA target sequence
tgcaatcgttaatgtgattggactac

SEQ ID NO: 206533 - DNA, 26 bp, Artificial sequence
  SiRNA target sequence
gcaatcgttaatgtgattggactacc

SEQ ID NO: 206534 - DNA, 26 bp, Artificial sequence
  SiRNA target sequence
caatcgttaatgtgattggactaccc

SEQ ID NO: 206535 - DNA, 26 bp, Artificial sequence
  SiRNA target sequence
aatcgttaatgtgattggactaccct

SEQ ID NO: 206536 - DNA, 26 bp, Artificial sequence
  SiRNA target sequence
atcgttaatgtgattggactaccctt

SEQ ID NO: 206537 - DNA, 26 bp, Artificial sequence
  SiRNA target sequence
tcgttaatgtgattggactacccttc

SEQ ID NO: 206538 - DNA, 26 bp, Artificial sequence
  SiRNA target sequence
cgttaatgtgattggactacccttcc

SEQ ID NO: 206539 - DNA, 26 bp, Artificial sequence
  SiRNA target sequence
gttaatgtgattggactacccttcct

SEQ ID NO: 206540 - DNA, 26 bp, Artificial sequence
  SiRNA target sequence
ttaatgtgattggactacccttcctt

SEQ ID NO: 206541 - DNA, 26 bp, Artificial sequence
  SiRNA target sequence
taatgtgattggactacccttcctta

SEQ ID NO: 206542 - DNA, 26 bp, Artificial sequence
  SiRNA target sequence
aatgtgattggactacccttccttac

SEQ ID NO: 206543 - DNA, 26 bp, Artificial sequence
  SiRNA target sequence
atgtgattggactacccttccttaca

SEQ ID NO: 206544 - DNA, 26 bp, Artificial sequence
  SiRNA target sequence
tgtgattggactacccttccttacat

SEQ ID NO: 206545 - DNA, 26 bp, Artificial sequence
  SiRNA target sequence
gtgattggactacccttccttacatt

SEQ ID NO: 206546 - DNA, 26 bp, Artificial sequence
  SiRNA target sequence
tgattggactacccttccttacatta

SEQ ID NO: 206547 - DNA, 26 bp, Artificial sequence
  SiRNA target sequence
gattggactacccttccttacattat

SEQ ID NO: 206548 - DNA, 26 bp, Artificial sequence
  SiRNA target sequence
attggactacccttccttacattatc

SEQ ID NO: 206549 - DNA, 26 bp, Artificial sequence
  SiRNA target sequence
ttggactacccttccttacattatca

SEQ ID NO: 206550 - DNA, 26 bp, Artificial sequence
  SiRNA target sequence
tggactacccttccttacattatcag

SEQ ID NO: 206551 - DNA, 26 bp, Artificial sequence
  SiRNA target sequence
ggactacccttccttacattatcagt

SEQ ID NO: 206552 - DNA, 26 bp, Artificial sequence
  SiRNA target sequence
gactacccttccttacattatcagta

SEQ ID NO: 206553 - DNA, 26 bp, Artificial sequence
  SiRNA target sequence
actacccttccttacattatcagtat

SEQ ID NO: 206554 - DNA, 26 bp, Artificial sequence
  SiRNA target sequence
ctacccttccttacattatcagtatc

SEQ ID NO: 206555 - DNA, 26 bp, Artificial sequence
  SiRNA target sequence
tacccttccttacattatcagtatca

SEQ ID NO: 206556 - DNA, 26 bp, Artificial sequence
  SiRNA target sequence
acccttccttacattatcagtatcaa

SEQ ID NO: 206557 - DNA, 26 bp, Artificial sequence
  SiRNA target sequence
cccttccttacattatcagtatcaag

SEQ ID NO: 206558 - DNA, 26 bp, Artificial sequence
  SiRNA target sequence
ccttccttacattatcagtatcaagt

SEQ ID NO: 206559 - DNA, 26 bp, Artificial sequence
  SiRNA target sequence
cttccttacattatcagtatcaagtg

SEQ ID NO: 206560 - DNA, 26 bp, Artificial sequence
  SiRNA target sequence
ttccttacattatcagtatcaagtgc

SEQ ID NO: 206561 - DNA, 26 bp, Artificial sequence
  SiRNA target sequence
tccttacattatcagtatcaagtgct

SEQ ID NO: 206562 - DNA, 26 bp, Artificial sequence
  SiRNA target sequence
ccttacattatcagtatcaagtgcta

SEQ ID NO: 206563 - DNA, 26 bp, Artificial sequence
  SiRNA target sequence
cttacattatcagtatcaagtgctac

SEQ ID NO: 206564 - DNA, 26 bp, Artificial sequence
  SiRNA target sequence
ttacattatcagtatcaagtgctact

SEQ ID NO: 206565 - DNA, 26 bp, Artificial sequence
  SiRNA target sequence
tacattatcagtatcaagtgctacta

SEQ ID NO: 206566 - DNA, 26 bp, Artificial sequence
  SiRNA target sequence
acattatcagtatcaagtgctactaa

SEQ ID NO: 206567 - DNA, 26 bp, Artificial sequence
  SiRNA target sequence
cattatcagtatcaagtgctactaat

SEQ ID NO: 206568 - DNA, 26 bp, Artificial sequence
  SiRNA target sequence
attatcagtatcaagtgctactaata

SEQ ID NO: 206569 - DNA, 26 bp, Artificial sequence
  SiRNA target sequence
ttatcagtatcaagtgctactaatat

SEQ ID NO: 206570 - DNA, 26 bp, Artificial sequence
  SiRNA target sequence
tatcagtatcaagtgctactaatatg

SEQ ID NO: 206571 - DNA, 26 bp, Artificial sequence
  SiRNA target sequence
atcagtatcaagtgctactaatatgg

SEQ ID NO: 206572 - DNA, 26 bp, Artificial sequence
  SiRNA target sequence
tcagtatcaagtgctactaatatggc

SEQ ID NO: 206573 - DNA, 26 bp, Artificial sequence
  SiRNA target sequence
cagtatcaagtgctactaatatggct

SEQ ID NO: 206574 - DNA, 26 bp, Artificial sequence
  SiRNA target sequence
agtatcaagtgctactaatatggcta

SEQ ID NO: 206575 - DNA, 26 bp, Artificial sequence
  SiRNA target sequence
gtatcaagtgctactaatatggctag

SEQ ID NO: 206576 - DNA, 26 bp, Artificial sequence
  SiRNA target sequence
tatcaagtgctactaatatggctagt

SEQ ID NO: 206577 - DNA, 26 bp, Artificial sequence
  SiRNA target sequence
atcaagtgctactaatatggctagtc

SEQ ID NO: 206578 - DNA, 26 bp, Artificial sequence
  SiRNA target sequence
tcaagtgctactaatatggctagtcc

SEQ ID NO: 206579 - DNA, 26 bp, Artificial sequence
  SiRNA target sequence
caagtgctactaatatggctagtcca

SEQ ID NO: 206580 - DNA, 26 bp, Artificial sequence
  SiRNA target sequence
aagtgctactaatatggctagtccat

SEQ ID NO: 206581 - DNA, 26 bp, Artificial sequence
  SiRNA target sequence
agtgctactaatatggctagtccata

SEQ ID NO: 206582 - DNA, 26 bp, Artificial sequence
  SiRNA target sequence
gtgctactaatatggctagtccatat

SEQ ID NO: 206583 - DNA, 26 bp, Artificial sequence
  SiRNA target sequence
tgctactaatatggctagtccatata

SEQ ID NO: 206584 - DNA, 26 bp, Artificial sequence
  SiRNA target sequence
gctactaatatggctagtccatataa

SEQ ID NO: 206585 - DNA, 26 bp, Artificial sequence
  SiRNA target sequence
ctactaatatggctagtccatataat

SEQ ID NO: 206586 - DNA, 26 bp, Artificial sequence
  SiRNA target sequence
tactaatatggctagtccatataatg

SEQ ID NO: 206587 - DNA, 26 bp, Artificial sequence
  SiRNA target sequence
actaatatggctagtccatataatga

SEQ ID NO: 206588 - DNA, 26 bp, Artificial sequence
  SiRNA target sequence
ctaatatggctagtccatataatgaa

SEQ ID NO: 206589 - DNA, 26 bp, Artificial sequence
  SiRNA target sequence
taatatggctagtccatataatgaac

SEQ ID NO: 206590 - DNA, 26 bp, Artificial sequence
  SiRNA target sequence
aatatggctagtccatataatgaacc

SEQ ID NO: 206591 - DNA, 26 bp, Artificial sequence
  SiRNA target sequence
atatggctagtccatataatgaacca

SEQ ID NO: 206592 - DNA, 26 bp, Artificial sequence
  SiRNA target sequence
tatggctagtccatataatgaaccaa

SEQ ID NO: 206593 - DNA, 26 bp, Artificial sequence
  SiRNA target sequence
atggctagtccatataatgaaccaat

SEQ ID NO: 206594 - DNA, 26 bp, Artificial sequence
  SiRNA target sequence
tggctagtccatataatgaaccaata

SEQ ID NO: 206595 - DNA, 26 bp, Artificial sequence
  SiRNA target sequence
ggctagtccatataatgaaccaatag

SEQ ID NO: 206596 - DNA, 26 bp, Artificial sequence
  SiRNA target sequence
gctagtccatataatgaaccaataga

SEQ ID NO: 206597 - DNA, 26 bp, Artificial sequence
  SiRNA target sequence
ctagtccatataatgaaccaatagat

SEQ ID NO: 206598 - DNA, 26 bp, Artificial sequence
  SiRNA target sequence
tagtccatataatgaaccaatagatt

SEQ ID NO: 206599 - DNA, 26 bp, Artificial sequence
  SiRNA target sequence
agtccatataatgaaccaatagattt

SEQ ID NO: 206600 - DNA, 26 bp, Artificial sequence
  SiRNA target sequence
gtccatataatgaaccaatagatttt

SEQ ID NO: 206601 - DNA, 26 bp, Artificial sequence
  SiRNA target sequence
tccatataatgaaccaatagattttc

SEQ ID NO: 206602 - DNA, 26 bp, Artificial sequence
  SiRNA target sequence
ccatataatgaaccaatagattttcc

SEQ ID NO: 206603 - DNA, 26 bp, Artificial sequence
  SiRNA target sequence
catataatgaaccaatagattttcct

SEQ ID NO: 206604 - DNA, 26 bp, Artificial sequence
  SiRNA target sequence
atataatgaaccaatagattttccta

SEQ ID NO: 206605 - DNA, 26 bp, Artificial sequence
  SiRNA target sequence
tataatgaaccaatagattttcctaa

SEQ ID NO: 206606 - DNA, 26 bp, Artificial sequence
  SiRNA target sequence
ataatgaaccaatagattttcctaat

SEQ ID NO: 206607 - DNA, 26 bp, Artificial sequence
  SiRNA target sequence
taatgaaccaatagattttcctaatt

SEQ ID NO: 206608 - DNA, 26 bp, Artificial sequence
  SiRNA target sequence
aatgaaccaatagattttcctaattt

SEQ ID NO: 206609 - DNA, 26 bp, Artificial sequence
  SiRNA target sequence
atgaaccaatagattttcctaattta

SEQ ID NO: 206610 - DNA, 26 bp, Artificial sequence
  SiRNA target sequence
tgaaccaatagattttcctaatttat

SEQ ID NO: 206611 - DNA, 26 bp, Artificial sequence
  SiRNA target sequence
gaaccaatagattttcctaatttatt

SEQ ID NO: 206612 - DNA, 26 bp, Artificial sequence
  SiRNA target sequence
aaccaatagattttcctaatttatta

SEQ ID NO: 206613 - DNA, 26 bp, Artificial sequence
  SiRNA target sequence
accaatagattttcctaatttattaa

SEQ ID NO: 206614 - DNA, 26 bp, Artificial sequence
  SiRNA target sequence
ccaatagattttcctaatttattaaa

SEQ ID NO: 206615 - DNA, 26 bp, Artificial sequence
  SiRNA target sequence
caatagattttcctaatttattaaaa

SEQ ID NO: 206616 - DNA, 26 bp, Artificial sequence
  SiRNA target sequence
aatagattttcctaatttattaaaaa

SEQ ID NO: 206617 - DNA, 26 bp, Artificial sequence
  SiRNA target sequence
atagattttcctaatttattaaaaat

SEQ ID NO: 206618 - DNA, 26 bp, Artificial sequence
  SiRNA target sequence
tagattttcctaatttattaaaaata

SEQ ID NO: 206619 - DNA, 26 bp, Artificial sequence
  SiRNA target sequence
agattttcctaatttattaaaaatac

SEQ ID NO: 206620 - DNA, 26 bp, Artificial sequence
  SiRNA target sequence
gattttcctaatttattaaaaatacc

SEQ ID NO: 206621 - DNA, 26 bp, Artificial sequence
  SiRNA target sequence
attttcctaatttattaaaaatacca

SEQ ID NO: 206622 - DNA, 26 bp, Artificial sequence
  SiRNA target sequence
ttttcctaatttattaaaaataccat

SEQ ID NO: 206623 - DNA, 26 bp, Artificial sequence
  SiRNA target sequence
tttcctaatttattaaaaataccatc

SEQ ID NO: 206624 - DNA, 26 bp, Artificial sequence
  SiRNA target sequence
ttcctaatttattaaaaataccatca

SEQ ID NO: 206625 - DNA, 26 bp, Artificial sequence
  SiRNA target sequence
tcctaatttattaaaaataccatcat

SEQ ID NO: 206626 - DNA, 26 bp, Artificial sequence
  SiRNA target sequence
cctaatttattaaaaataccatcata

SEQ ID NO: 206627 - DNA, 26 bp, Artificial sequence
  SiRNA target sequence
ctaatttattaaaaataccatcataa

SEQ ID NO: 206628 - DNA, 26 bp, Artificial sequence
  SiRNA target sequence
taatttattaaaaataccatcataaa

SEQ ID NO: 206629 - DNA, 26 bp, Artificial sequence
  SiRNA target sequence
aatttattaaaaataccatcataaac

SEQ ID NO: 206630 - DNA, 26 bp, Artificial sequence
  SiRNA target sequence
atttattaaaaataccatcataaaca

SEQ ID NO: 206631 - DNA, 26 bp, Artificial sequence
  SiRNA target sequence
tttattaaaaataccatcataaacac

SEQ ID NO: 206632 - DNA, 26 bp, Artificial sequence
  SiRNA target sequence
ttattaaaaataccatcataaacact

SEQ ID NO: 206633 - DNA, 26 bp, Artificial sequence
  SiRNA target sequence
tattaaaaataccatcataaacactt

SEQ ID NO: 206634 - DNA, 26 bp, Artificial sequence
  SiRNA target sequence
attaaaaataccatcataaacacttt

SEQ ID NO: 206635 - DNA, 26 bp, Artificial sequence
  SiRNA target sequence
ttaaaaataccatcataaacactttt

SEQ ID NO: 206636 - DNA, 26 bp, Artificial sequence
  SiRNA target sequence
taaaaataccatcataaacactttta

SEQ ID NO: 206637 - DNA, 26 bp, Artificial sequence
  SiRNA target sequence
aaaaataccatcataaacacttttaa

SEQ ID NO: 206638 - DNA, 26 bp, Artificial sequence
  SiRNA target sequence
aaaataccatcataaacacttttaaa

SEQ ID NO: 206639 - DNA, 26 bp, Artificial sequence
  SiRNA target sequence
aaataccatcataaacacttttaaac

SEQ ID NO: 206640 - DNA, 26 bp, Artificial sequence
  SiRNA target sequence
aataccatcataaacacttttaaacc

SEQ ID NO: 206641 - DNA, 26 bp, Artificial sequence
  SiRNA target sequence
ataccatcataaacacttttaaaccg

SEQ ID NO: 206642 - DNA, 26 bp, Artificial sequence
  SiRNA target sequence
taccatcataaacacttttaaaccgt

SEQ ID NO: 206643 - DNA, 26 bp, Artificial sequence
  SiRNA target sequence
accatcataaacacttttaaaccgtg

SEQ ID NO: 206644 - DNA, 26 bp, Artificial sequence
  SiRNA target sequence
ccatcataaacacttttaaaccgtgc

SEQ ID NO: 206645 - DNA, 26 bp, Artificial sequence
  SiRNA target sequence
catcataaacacttttaaaccgtgcc

SEQ ID NO: 206646 - DNA, 26 bp, Artificial sequence
  SiRNA target sequence
atcataaacacttttaaaccgtgccc

SEQ ID NO: 206647 - DNA, 26 bp, Artificial sequence
  SiRNA target sequence
tcataaacacttttaaaccgtgccct

SEQ ID NO: 206648 - DNA, 26 bp, Artificial sequence
  SiRNA target sequence
cataaacacttttaaaccgtgccctg

SEQ ID NO: 206649 - DNA, 26 bp, Artificial sequence
  SiRNA target sequence
ataaacacttttaaaccgtgccctgt

SEQ ID NO: 206650 - DNA, 26 bp, Artificial sequence
  SiRNA target sequence
taaacacttttaaaccgtgccctgtg

SEQ ID NO: 206651 - DNA, 26 bp, Artificial sequence
  SiRNA target sequence
aaacacttttaaaccgtgccctgtgt

SEQ ID NO: 206652 - DNA, 26 bp, Artificial sequence
  SiRNA target sequence
aacacttttaaaccgtgccctgtgtg

SEQ ID NO: 206653 - DNA, 26 bp, Artificial sequence
  SiRNA target sequence
acacttttaaaccgtgccctgtgtgc

SEQ ID NO: 206654 - DNA, 26 bp, Artificial sequence
  SiRNA target sequence
cacttttaaaccgtgccctgtgtgca

SEQ ID NO: 206655 - DNA, 26 bp, Artificial sequence
  SiRNA target sequence
acttttaaaccgtgccctgtgtgcag

SEQ ID NO: 206656 - DNA, 26 bp, Artificial sequence
  SiRNA target sequence
cttttaaaccgtgccctgtgtgcagg

SEQ ID NO: 206657 - DNA, 26 bp, Artificial sequence
  SiRNA target sequence
ttttaaaccgtgccctgtgtgcagga

SEQ ID NO: 206658 - DNA, 26 bp, Artificial sequence
  SiRNA target sequence
tttaaaccgtgccctgtgtgcaggat

SEQ ID NO: 206659 - DNA, 26 bp, Artificial sequence
  SiRNA target sequence
ttaaaccgtgccctgtgtgcaggatc

SEQ ID NO: 206660 - DNA, 26 bp, Artificial sequence
  SiRNA target sequence
taaaccgtgccctgtgtgcaggatcg

SEQ ID NO: 206661 - DNA, 26 bp, Artificial sequence
  SiRNA target sequence
aaaccgtgccctgtgtgcaggatcga

SEQ ID NO: 206662 - DNA, 26 bp, Artificial sequence
  SiRNA target sequence
aaccgtgccctgtgtgcaggatcgat

SEQ ID NO: 206663 - DNA, 26 bp, Artificial sequence
  SiRNA target sequence
accgtgccctgtgtgcaggatcgatt

SEQ ID NO: 206664 - DNA, 26 bp, Artificial sequence
  SiRNA target sequence
ccgtgccctgtgtgcaggatcgattc

SEQ ID NO: 206665 - DNA, 26 bp, Artificial sequence
  SiRNA target sequence
cgtgccctgtgtgcaggatcgattct

SEQ ID NO: 206666 - DNA, 26 bp, Artificial sequence
  SiRNA target sequence
gtgccctgtgtgcaggatcgattctc

SEQ ID NO: 206667 - DNA, 26 bp, Artificial sequence
  SiRNA target sequence
tgccctgtgtgcaggatcgattctca

SEQ ID NO: 206668 - DNA, 26 bp, Artificial sequence
  SiRNA target sequence
gccctgtgtgcaggatcgattctcat

SEQ ID NO: 206669 - DNA, 26 bp, Artificial sequence
  SiRNA target sequence
ccctgtgtgcaggatcgattctcata

SEQ ID NO: 206670 - DNA, 26 bp, Artificial sequence
  SiRNA target sequence
cctgtgtgcaggatcgattctcatac

SEQ ID NO: 206671 - DNA, 26 bp, Artificial sequence
  SiRNA target sequence
ctgtgtgcaggatcgattctcatacc

SEQ ID NO: 206672 - DNA, 26 bp, Artificial sequence
  SiRNA target sequence
tgtgtgcaggatcgattctcataccc

SEQ ID NO: 206673 - DNA, 26 bp, Artificial sequence
  SiRNA target sequence
gtgtgcaggatcgattctcataccca

SEQ ID NO: 206674 - DNA, 26 bp, Artificial sequence
  SiRNA target sequence
tgtgcaggatcgattctcatacccat

SEQ ID NO: 206675 - DNA, 26 bp, Artificial sequence
  SiRNA target sequence
gtgcaggatcgattctcatacccatt

SEQ ID NO: 206676 - DNA, 26 bp, Artificial sequence
  SiRNA target sequence
tgcaggatcgattctcatacccattt

SEQ ID NO: 206677 - DNA, 26 bp, Artificial sequence
  SiRNA target sequence
gcaggatcgattctcatacccatttt

SEQ ID NO: 206678 - DNA, 26 bp, Artificial sequence
  SiRNA target sequence
caggatcgattctcatacccattttc

SEQ ID NO: 206679 - DNA, 26 bp, Artificial sequence
  SiRNA target sequence
aggatcgattctcatacccattttct

SEQ ID NO: 206680 - DNA, 26 bp, Artificial sequence
  SiRNA target sequence
ggatcgattctcatacccattttctc

SEQ ID NO: 206681 - DNA, 26 bp, Artificial sequence
  SiRNA target sequence
gatcgattctcatacccattttctct

SEQ ID NO: 206682 - DNA, 26 bp, Artificial sequence
  SiRNA target sequence
atcgattctcatacccattttctctt

SEQ ID NO: 206683 - DNA, 26 bp, Artificial sequence
  SiRNA target sequence
tcgattctcatacccattttctcttt

SEQ ID NO: 206684 - DNA, 26 bp, Artificial sequence
  SiRNA target sequence
cgattctcatacccattttctcttta

SEQ ID NO: 206685 - DNA, 26 bp, Artificial sequence
  SiRNA target sequence
gattctcatacccattttctctttac

SEQ ID NO: 206686 - DNA, 26 bp, Artificial sequence
  SiRNA target sequence
attctcatacccattttctctttaca

SEQ ID NO: 206687 - DNA, 26 bp, Artificial sequence
  SiRNA target sequence
ttctcatacccattttctctttacaa

SEQ ID NO: 206688 - DNA, 26 bp, Artificial sequence
  SiRNA target sequence
tctcatacccattttctctttacaaa

SEQ ID NO: 206689 - DNA, 26 bp, Artificial sequence
  SiRNA target sequence
ctcatacccattttctctttacaaat

SEQ ID NO: 206690 - DNA, 26 bp, Artificial sequence
  SiRNA target sequence
tcatacccattttctctttacaaata

SEQ ID NO: 206691 - DNA, 26 bp, Artificial sequence
  SiRNA target sequence
catacccattttctctttacaaatat

SEQ ID NO: 206692 - DNA, 26 bp, Artificial sequence
  SiRNA target sequence
atacccattttctctttacaaatatc

SEQ ID NO: 206693 - DNA, 26 bp, Artificial sequence
  SiRNA target sequence
tacccattttctctttacaaatatca

SEQ ID NO: 206694 - DNA, 26 bp, Artificial sequence
  SiRNA target sequence
acccattttctctttacaaatatcaa

SEQ ID NO: 206695 - DNA, 26 bp, Artificial sequence
  SiRNA target sequence
cccattttctctttacaaatatcaaa

SEQ ID NO: 206696 - DNA, 26 bp, Artificial sequence
  SiRNA target sequence
ccattttctctttacaaatatcaaag

SEQ ID NO: 206697 - DNA, 26 bp, Artificial sequence
  SiRNA target sequence
cattttctctttacaaatatcaaagg

SEQ ID NO: 206698 - DNA, 26 bp, Artificial sequence
  SiRNA target sequence
attttctctttacaaatatcaaaggc

SEQ ID NO: 206699 - DNA, 26 bp, Artificial sequence
  SiRNA target sequence
ttttctctttacaaatatcaaaggct

SEQ ID NO: 206700 - DNA, 26 bp, Artificial sequence
  SiRNA target sequence
tttctctttacaaatatcaaaggctg

SEQ ID NO: 206701 - DNA, 26 bp, Artificial sequence
  SiRNA target sequence
ttctctttacaaatatcaaaggctga

SEQ ID NO: 206702 - DNA, 26 bp, Artificial sequence
  SiRNA target sequence
tctctttacaaatatcaaaggctgaa

SEQ ID NO: 206703 - DNA, 26 bp, Artificial sequence
  SiRNA target sequence
ctctttacaaatatcaaaggctgaat

SEQ ID NO: 206704 - DNA, 26 bp, Artificial sequence
  SiRNA target sequence
tctttacaaatatcaaaggctgaata

SEQ ID NO: 206705 - DNA, 26 bp, Artificial sequence
  SiRNA target sequence
ctttacaaatatcaaaggctgaatat

SEQ ID NO: 206706 - DNA, 26 bp, Artificial sequence
  SiRNA target sequence
tttacaaatatcaaaggctgaatatt

SEQ ID NO: 206707 - DNA, 26 bp, Artificial sequence
  SiRNA target sequence
ttacaaatatcaaaggctgaatattt

SEQ ID NO: 206708 - DNA, 26 bp, Artificial sequence
  SiRNA target sequence
tacaaatatcaaaggctgaatatttt

SEQ ID NO: 206709 - DNA, 26 bp, Artificial sequence
  SiRNA target sequence
acaaatatcaaaggctgaatatttta

SEQ ID NO: 206710 - DNA, 26 bp, Artificial sequence
  SiRNA target sequence
caaatatcaaaggctgaatattttaa

SEQ ID NO: 206711 - DNA, 26 bp, Artificial sequence
  SiRNA target sequence
aaatatcaaaggctgaatattttaat

SEQ ID NO: 206712 - DNA, 26 bp, Artificial sequence
  SiRNA target sequence
aatatcaaaggctgaatattttaata

SEQ ID NO: 206713 - DNA, 26 bp, Artificial sequence
  SiRNA target sequence
atatcaaaggctgaatattttaatac

SEQ ID NO: 206714 - DNA, 26 bp, Artificial sequence
  SiRNA target sequence
tatcaaaggctgaatattttaatact

SEQ ID NO: 206715 - DNA, 26 bp, Artificial sequence
  SiRNA target sequence
atcaaaggctgaatattttaatactt

SEQ ID NO: 206716 - DNA, 26 bp, Artificial sequence
  SiRNA target sequence
tcaaaggctgaatattttaatacttt

SEQ ID NO: 206717 - DNA, 26 bp, Artificial sequence
  SiRNA target sequence
caaaggctgaatattttaatactttt

SEQ ID NO: 206718 - DNA, 26 bp, Artificial sequence
  SiRNA target sequence
aaaggctgaatattttaatactttta

SEQ ID NO: 206719 - DNA, 26 bp, Artificial sequence
  SiRNA target sequence
aaggctgaatattttaatacttttat

SEQ ID NO: 206720 - DNA, 26 bp, Artificial sequence
  SiRNA target sequence
aggctgaatattttaatacttttatg

SEQ ID NO: 206721 - DNA, 26 bp, Artificial sequence
  SiRNA target sequence
ggctgaatattttaatacttttatga

SEQ ID NO: 206722 - DNA, 26 bp, Artificial sequence
  SiRNA target sequence
gctgaatattttaatacttttatgaa

SEQ ID NO: 206723 - DNA, 26 bp, Artificial sequence
  SiRNA target sequence
ctgaatattttaatacttttatgaat

SEQ ID NO: 206724 - DNA, 26 bp, Artificial sequence
  SiRNA target sequence
tgaatattttaatacttttatgaatg

SEQ ID NO: 206725 - DNA, 26 bp, Artificial sequence
  SiRNA target sequence
gaatattttaatacttttatgaatgc

SEQ ID NO: 206726 - DNA, 26 bp, Artificial sequence
  SiRNA target sequence
aatattttaatacttttatgaatgct

SEQ ID NO: 206727 - DNA, 26 bp, Artificial sequence
  SiRNA target sequence
atattttaatacttttatgaatgcta

SEQ ID NO: 206728 - DNA, 26 bp, Artificial sequence
  SiRNA target sequence
tattttaatacttttatgaatgctaa

SEQ ID NO: 206729 - DNA, 26 bp, Artificial sequence
  SiRNA target sequence
attttaatacttttatgaatgctaaa

SEQ ID NO: 206730 - DNA, 26 bp, Artificial sequence
  SiRNA target sequence
ttttaatacttttatgaatgctaaaa

SEQ ID NO: 206731 - DNA, 26 bp, Artificial sequence
  SiRNA target sequence
tttaatacttttatgaatgctaaaaa

SEQ ID NO: 206732 - DNA, 26 bp, Artificial sequence
  SiRNA target sequence
ttaatacttttatgaatgctaaaaag

SEQ ID NO: 206733 - DNA, 26 bp, Artificial sequence
  SiRNA target sequence
taatacttttatgaatgctaaaaaga

SEQ ID NO: 206734 - DNA, 26 bp, Artificial sequence
  SiRNA target sequence
aatacttttatgaatgctaaaaagaa

SEQ ID NO: 206735 - DNA, 26 bp, Artificial sequence
  SiRNA target sequence
atacttttatgaatgctaaaaagaac

SEQ ID NO: 206736 - DNA, 26 bp, Artificial sequence
  SiRNA target sequence
tacttttatgaatgctaaaaagaaca

SEQ ID NO: 206737 - DNA, 26 bp, Artificial sequence
  SiRNA target sequence
acttttatgaatgctaaaaagaacat

SEQ ID NO: 206738 - DNA, 26 bp, Artificial sequence
  SiRNA target sequence
cttttatgaatgctaaaaagaacatt

SEQ ID NO: 206739 - DNA, 26 bp, Artificial sequence
  SiRNA target sequence
ttttatgaatgctaaaaagaacattc

SEQ ID NO: 206740 - DNA, 26 bp, Artificial sequence
  SiRNA target sequence
tttatgaatgctaaaaagaacattcc

SEQ ID NO: 206741 - DNA, 26 bp, Artificial sequence
  SiRNA target sequence
ttatgaatgctaaaaagaacattcca

SEQ ID NO: 206742 - DNA, 26 bp, Artificial sequence
  SiRNA target sequence
tatgaatgctaaaaagaacattccac

SEQ ID NO: 206743 - DNA, 26 bp, Artificial sequence
  SiRNA target sequence
atgaatgctaaaaagaacattccact

SEQ ID NO: 206744 - DNA, 26 bp, Artificial sequence
  SiRNA target sequence
tgaatgctaaaaagaacattccactg

SEQ ID NO: 206745 - DNA, 26 bp, Artificial sequence
  SiRNA target sequence
gaatgctaaaaagaacattccactgt

SEQ ID NO: 206746 - DNA, 26 bp, Artificial sequence
  SiRNA target sequence
aatgctaaaaagaacattccactgta

SEQ ID NO: 206747 - DNA, 26 bp, Artificial sequence
  SiRNA target sequence
atgctaaaaagaacattccactgtaa

SEQ ID NO: 206748 - DNA, 26 bp, Artificial sequence
  SiRNA target sequence
tgctaaaaagaacattccactgtaat

SEQ ID NO: 206749 - DNA, 26 bp, Artificial sequence
  SiRNA target sequence
gctaaaaagaacattccactgtaatt

SEQ ID NO: 206750 - DNA, 26 bp, Artificial sequence
  SiRNA target sequence
ctaaaaagaacattccactgtaattt

SEQ ID NO: 206751 - DNA, 26 bp, Artificial sequence
  SiRNA target sequence
taaaaagaacattccactgtaatttt

SEQ ID NO: 206752 - DNA, 26 bp, Artificial sequence
  SiRNA target sequence
aaaaagaacattccactgtaattttc

SEQ ID NO: 206753 - DNA, 26 bp, Artificial sequence
  SiRNA target sequence
aaaagaacattccactgtaattttcg

SEQ ID NO: 206754 - DNA, 26 bp, Artificial sequence
  SiRNA target sequence
aaagaacattccactgtaattttcga

SEQ ID NO: 206755 - DNA, 26 bp, Artificial sequence
  SiRNA target sequence
aagaacattccactgtaattttcgat

SEQ ID NO: 206756 - DNA, 26 bp, Artificial sequence
  SiRNA target sequence
agaacattccactgtaattttcgatc

SEQ ID NO: 206757 - DNA, 26 bp, Artificial sequence
  SiRNA target sequence
gaacattccactgtaattttcgatcg

SEQ ID NO: 206758 - DNA, 26 bp, Artificial sequence
  SiRNA target sequence
aacattccactgtaattttcgatcgt

SEQ ID NO: 206759 - DNA, 26 bp, Artificial sequence
  SiRNA target sequence
acattccactgtaattttcgatcgta

SEQ ID NO: 206760 - DNA, 26 bp, Artificial sequence
  SiRNA target sequence
cattccactgtaattttcgatcgtat

SEQ ID NO: 206761 - DNA, 26 bp, Artificial sequence
  SiRNA target sequence
attccactgtaattttcgatcgtata

SEQ ID NO: 206762 - DNA, 26 bp, Artificial sequence
  SiRNA target sequence
ttccactgtaattttcgatcgtataa

SEQ ID NO: 206763 - DNA, 26 bp, Artificial sequence
  SiRNA target sequence
tccactgtaattttcgatcgtataaa

SEQ ID NO: 206764 - DNA, 26 bp, Artificial sequence
  SiRNA target sequence
ccactgtaattttcgatcgtataaat

SEQ ID NO: 206765 - DNA, 26 bp, Artificial sequence
  SiRNA target sequence
cactgtaattttcgatcgtataaatg

SEQ ID NO: 206766 - DNA, 26 bp, Artificial sequence
  SiRNA target sequence
actgtaattttcgatcgtataaatgt

SEQ ID NO: 206767 - DNA, 26 bp, Artificial sequence
  SiRNA target sequence
ctgtaattttcgatcgtataaatgta

SEQ ID NO: 206768 - DNA, 26 bp, Artificial sequence
  SiRNA target sequence
tgtaattttcgatcgtataaatgtac

SEQ ID NO: 206769 - DNA, 26 bp, Artificial sequence
  SiRNA target sequence
gtaattttcgatcgtataaatgtacg

SEQ ID NO: 206770 - DNA, 26 bp, Artificial sequence
  SiRNA target sequence
taattttcgatcgtataaatgtacga

SEQ ID NO: 206771 - DNA, 26 bp, Artificial sequence
  SiRNA target sequence
aattttcgatcgtataaatgtacgac

SEQ ID NO: 206772 - DNA, 26 bp, Artificial sequence
  SiRNA target sequence
attttcgatcgtataaatgtacgaca

SEQ ID NO: 206773 - DNA, 26 bp, Artificial sequence
  SiRNA target sequence
ttttcgatcgtataaatgtacgacat

SEQ ID NO: 206774 - DNA, 26 bp, Artificial sequence
  SiRNA target sequence
tttcgatcgtataaatgtacgacatt

SEQ ID NO: 206775 - DNA, 26 bp, Artificial sequence
  SiRNA target sequence
ttcgatcgtataaatgtacgacattt

SEQ ID NO: 206776 - DNA, 26 bp, Artificial sequence
  SiRNA target sequence
tcgatcgtataaatgtacgacatttt

SEQ ID NO: 206777 - DNA, 26 bp, Artificial sequence
  SiRNA target sequence
cgatcgtataaatgtacgacattttt

SEQ ID NO: 206778 - DNA, 26 bp, Artificial sequence
  SiRNA target sequence
gatcgtataaatgtacgacatttttt

SEQ ID NO: 206779 - DNA, 26 bp, Artificial sequence
  SiRNA target sequence
atcgtataaatgtacgacattttttt

SEQ ID NO: 206780 - DNA, 26 bp, Artificial sequence
  SiRNA target sequence
tcgtataaatgtacgacattttttta

SEQ ID NO: 206781 - DNA, 26 bp, Artificial sequence
  SiRNA target sequence
cgtataaatgtacgacatttttttaa

SEQ ID NO: 206782 - DNA, 26 bp, Artificial sequence
  SiRNA target sequence
gtataaatgtacgacatttttttaaa

SEQ ID NO: 206783 - DNA, 26 bp, Artificial sequence
  SiRNA target sequence
tataaatgtacgacatttttttaaaa

SEQ ID NO: 206784 - DNA, 26 bp, Artificial sequence
  SiRNA target sequence
ataaatgtacgacatttttttaaaaa

SEQ ID NO: 206785 - DNA, 26 bp, Artificial sequence
  SiRNA target sequence
taaatgtacgacatttttttaaaaaa

SEQ ID NO: 206786 - DNA, 26 bp, Artificial sequence
  SiRNA target sequence
aaatgtacgacatttttttaaaaaat

SEQ ID NO: 206787 - DNA, 26 bp, Artificial sequence
  SiRNA target sequence
aatgtacgacatttttttaaaaaata

SEQ ID NO: 206788 - DNA, 26 bp, Artificial sequence
  SiRNA target sequence
atgtacgacatttttttaaaaaatac

SEQ ID NO: 206789 - DNA, 26 bp, Artificial sequence
  SiRNA target sequence
tgtacgacatttttttaaaaaataca

SEQ ID NO: 206790 - DNA, 26 bp, Artificial sequence
  SiRNA target sequence
gtacgacatttttttaaaaaatacag

SEQ ID NO: 206791 - DNA, 26 bp, Artificial sequence
  SiRNA target sequence
tacgacatttttttaaaaaatacaga

SEQ ID NO: 206792 - DNA, 26 bp, Artificial sequence
  SiRNA target sequence
acgacatttttttaaaaaatacagaa

SEQ ID NO: 206793 - DNA, 26 bp, Artificial sequence
  SiRNA target sequence
cgacatttttttaaaaaatacagaaa

SEQ ID NO: 206794 - DNA, 26 bp, Artificial sequence
  SiRNA target sequence
gacatttttttaaaaaatacagaaat

SEQ ID NO: 206795 - DNA, 26 bp, Artificial sequence
  SiRNA target sequence
acatttttttaaaaaatacagaaatc

SEQ ID NO: 206796 - DNA, 26 bp, Artificial sequence
  SiRNA target sequence
catttttttaaaaaatacagaaatcc

SEQ ID NO: 206797 - DNA, 26 bp, Artificial sequence
  SiRNA target sequence
atttttttaaaaaatacagaaatcca

SEQ ID NO: 206798 - DNA, 26 bp, Artificial sequence
  SiRNA target sequence
tttttttaaaaaatacagaaatccat

SEQ ID NO: 206799 - DNA, 26 bp, Artificial sequence
  SiRNA target sequence
ttttttaaaaaatacagaaatccatg

SEQ ID NO: 206800 - DNA, 26 bp, Artificial sequence
  SiRNA target sequence
tttttaaaaaatacagaaatccatga

SEQ ID NO: 206801 - DNA, 26 bp, Artificial sequence
  SiRNA target sequence
ttttaaaaaatacagaaatccatgaa

SEQ ID NO: 206802 - DNA, 26 bp, Artificial sequence
  SiRNA target sequence
tttaaaaaatacagaaatccatgaaa

SEQ ID NO: 206803 - DNA, 26 bp, Artificial sequence
  SiRNA target sequence
ttaaaaaatacagaaatccatgaaaa

SEQ ID NO: 206804 - DNA, 26 bp, Artificial sequence
  SiRNA target sequence
taaaaaatacagaaatccatgaaaaa

SEQ ID NO: 206805 - DNA, 26 bp, Artificial sequence
  SiRNA target sequence
aaaaaatacagaaatccatgaaaaag

SEQ ID NO: 206806 - DNA, 26 bp, Artificial sequence
  SiRNA target sequence
aaaaatacagaaatccatgaaaaagc

SEQ ID NO: 206807 - DNA, 26 bp, Artificial sequence
  SiRNA target sequence
aaaatacagaaatccatgaaaaagca

SEQ ID NO: 206808 - DNA, 26 bp, Artificial sequence
  SiRNA target sequence
aaatacagaaatccatgaaaaagcaa

SEQ ID NO: 206809 - DNA, 26 bp, Artificial sequence
  SiRNA target sequence
aatacagaaatccatgaaaaagcaag

SEQ ID NO: 206810 - DNA, 26 bp, Artificial sequence
  SiRNA target sequence
atacagaaatccatgaaaaagcaagt

SEQ ID NO: 206811 - DNA, 26 bp, Artificial sequence
  SiRNA target sequence
tacagaaatccatgaaaaagcaagtc

SEQ ID NO: 206812 - DNA, 26 bp, Artificial sequence
  SiRNA target sequence
acagaaatccatgaaaaagcaagtcc

SEQ ID NO: 206813 - DNA, 26 bp, Artificial sequence
  SiRNA target sequence
cagaaatccatgaaaaagcaagtcct

SEQ ID NO: 206814 - DNA, 26 bp, Artificial sequence
  SiRNA target sequence
agaaatccatgaaaaagcaagtcctt

SEQ ID NO: 206815 - DNA, 26 bp, Artificial sequence
  SiRNA target sequence
gaaatccatgaaaaagcaagtccttc

SEQ ID NO: 206816 - DNA, 26 bp, Artificial sequence
  SiRNA target sequence
aaatccatgaaaaagcaagtccttca

SEQ ID NO: 206817 - DNA, 26 bp, Artificial sequence
  SiRNA target sequence
aatccatgaaaaagcaagtccttcaa

SEQ ID NO: 206818 - DNA, 26 bp, Artificial sequence
  SiRNA target sequence
atccatgaaaaagcaagtccttcaat

SEQ ID NO: 206819 - DNA, 26 bp, Artificial sequence
  SiRNA target sequence
tccatgaaaaagcaagtccttcaatg

SEQ ID NO: 206820 - DNA, 26 bp, Artificial sequence
  SiRNA target sequence
ccatgaaaaagcaagtccttcaatgg

SEQ ID NO: 206821 - DNA, 26 bp, Artificial sequence
  SiRNA target sequence
catgaaaaagcaagtccttcaatggc

SEQ ID NO: 206822 - DNA, 26 bp, Artificial sequence
  SiRNA target sequence
atgaaaaagcaagtccttcaatggca

SEQ ID NO: 206823 - DNA, 26 bp, Artificial sequence
  SiRNA target sequence
tgaaaaagcaagtccttcaatggcag

SEQ ID NO: 206824 - DNA, 26 bp, Artificial sequence
  SiRNA target sequence
gaaaaagcaagtccttcaatggcaga

SEQ ID NO: 206825 - DNA, 26 bp, Artificial sequence
  SiRNA target sequence
aaaaagcaagtccttcaatggcagaa

SEQ ID NO: 206826 - DNA, 26 bp, Artificial sequence
  SiRNA target sequence
aaaagcaagtccttcaatggcagaat

SEQ ID NO: 206827 - DNA, 26 bp, Artificial sequence
  SiRNA target sequence
aaagcaagtccttcaatggcagaatt

SEQ ID NO: 206828 - DNA, 26 bp, Artificial sequence
  SiRNA target sequence
aagcaagtccttcaatggcagaattg

SEQ ID NO: 206829 - DNA, 26 bp, Artificial sequence
  SiRNA target sequence
agcaagtccttcaatggcagaattgt

SEQ ID NO: 206830 - DNA, 26 bp, Artificial sequence
  SiRNA target sequence
gcaagtccttcaatggcagaattgta

SEQ ID NO: 206831 - DNA, 26 bp, Artificial sequence
  SiRNA target sequence
caagtccttcaatggcagaattgtag

SEQ ID NO: 206832 - DNA, 26 bp, Artificial sequence
  SiRNA target sequence
aagtccttcaatggcagaattgtaga

SEQ ID NO: 206833 - DNA, 26 bp, Artificial sequence
  SiRNA target sequence
agtccttcaatggcagaattgtagat

SEQ ID NO: 206834 - DNA, 26 bp, Artificial sequence
  SiRNA target sequence
gtccttcaatggcagaattgtagatt

SEQ ID NO: 206835 - DNA, 26 bp, Artificial sequence
  SiRNA target sequence
tccttcaatggcagaattgtagattg

SEQ ID NO: 206836 - DNA, 26 bp, Artificial sequence
  SiRNA target sequence
ccttcaatggcagaattgtagattga

SEQ ID NO: 206837 - DNA, 26 bp, Artificial sequence
  SiRNA target sequence
cttcaatggcagaattgtagattgat

SEQ ID NO: 206838 - DNA, 26 bp, Artificial sequence
  SiRNA target sequence
ttcaatggcagaattgtagattgatg

SEQ ID NO: 206839 - DNA, 26 bp, Artificial sequence
  SiRNA target sequence
tcaatggcagaattgtagattgatgc

SEQ ID NO: 206840 - DNA, 26 bp, Artificial sequence
  SiRNA target sequence
caatggcagaattgtagattgatgct

SEQ ID NO: 206841 - DNA, 26 bp, Artificial sequence
  SiRNA target sequence
aatggcagaattgtagattgatgctc

SEQ ID NO: 206842 - DNA, 26 bp, Artificial sequence
  SiRNA target sequence
atggcagaattgtagattgatgctcc

SEQ ID NO: 206843 - DNA, 26 bp, Artificial sequence
  SiRNA target sequence
tggcagaattgtagattgatgctccc

SEQ ID NO: 206844 - DNA, 26 bp, Artificial sequence
  SiRNA target sequence
ggcagaattgtagattgatgctccca

SEQ ID NO: 206845 - DNA, 26 bp, Artificial sequence
  SiRNA target sequence
gcagaattgtagattgatgctcccat

SEQ ID NO: 206846 - DNA, 26 bp, Artificial sequence
  SiRNA target sequence
cagaattgtagattgatgctcccata

SEQ ID NO: 206847 - DNA, 26 bp, Artificial sequence
  SiRNA target sequence
agaattgtagattgatgctcccataa

SEQ ID NO: 206848 - DNA, 26 bp, Artificial sequence
  SiRNA target sequence
gaattgtagattgatgctcccataac

SEQ ID NO: 206849 - DNA, 26 bp, Artificial sequence
  SiRNA target sequence
aattgtagattgatgctcccataacg

SEQ ID NO: 206850 - DNA, 26 bp, Artificial sequence
  SiRNA target sequence
attgtagattgatgctcccataacga

SEQ ID NO: 206851 - DNA, 26 bp, Artificial sequence
  SiRNA target sequence
ttgtagattgatgctcccataacgat

SEQ ID NO: 206852 - DNA, 26 bp, Artificial sequence
  SiRNA target sequence
tgtagattgatgctcccataacgatt

SEQ ID NO: 206853 - DNA, 26 bp, Artificial sequence
  SiRNA target sequence
gtagattgatgctcccataacgatta

SEQ ID NO: 206854 - DNA, 26 bp, Artificial sequence
  SiRNA target sequence
tagattgatgctcccataacgattat

SEQ ID NO: 206855 - DNA, 26 bp, Artificial sequence
  SiRNA target sequence
agattgatgctcccataacgattatt

SEQ ID NO: 206856 - DNA, 26 bp, Artificial sequence
  SiRNA target sequence
gattgatgctcccataacgattattg

SEQ ID NO: 206857 - DNA, 26 bp, Artificial sequence
  SiRNA target sequence
attgatgctcccataacgattattga

SEQ ID NO: 206858 - DNA, 26 bp, Artificial sequence
  SiRNA target sequence
ttgatgctcccataacgattattgac

SEQ ID NO: 206859 - DNA, 26 bp, Artificial sequence
  SiRNA target sequence
tgatgctcccataacgattattgacc

SEQ ID NO: 206860 - DNA, 26 bp, Artificial sequence
  SiRNA target sequence
gatgctcccataacgattattgaccc

SEQ ID NO: 206861 - DNA, 26 bp, Artificial sequence
  SiRNA target sequence
atgctcccataacgattattgacccc

SEQ ID NO: 206862 - DNA, 26 bp, Artificial sequence
  SiRNA target sequence
tgctcccataacgattattgacccca

SEQ ID NO: 206863 - DNA, 26 bp, Artificial sequence
  SiRNA target sequence
gctcccataacgattattgaccccaa

SEQ ID NO: 206864 - DNA, 26 bp, Artificial sequence
  SiRNA target sequence
ctcccataacgattattgaccccaac

SEQ ID NO: 206865 - DNA, 26 bp, Artificial sequence
  SiRNA target sequence
tcccataacgattattgaccccaaca

SEQ ID NO: 206866 - DNA, 26 bp, Artificial sequence
  SiRNA target sequence
cccataacgattattgaccccaacaa

SEQ ID NO: 206867 - DNA, 26 bp, Artificial sequence
  SiRNA target sequence
ccataacgattattgaccccaacaac

SEQ ID NO: 206868 - DNA, 26 bp, Artificial sequence
  SiRNA target sequence
cataacgattattgaccccaacaaca

SEQ ID NO: 206869 - DNA, 26 bp, Artificial sequence
  SiRNA target sequence
ataacgattattgaccccaacaacaa

SEQ ID NO: 206870 - DNA, 26 bp, Artificial sequence
  SiRNA target sequence
taacgattattgaccccaacaacaag

SEQ ID NO: 206871 - DNA, 26 bp, Artificial sequence
  SiRNA target sequence
aacgattattgaccccaacaacaaga

SEQ ID NO: 206872 - DNA, 26 bp, Artificial sequence
  SiRNA target sequence
acgattattgaccccaacaacaagaa

SEQ ID NO: 206873 - DNA, 26 bp, Artificial sequence
  SiRNA target sequence
cgattattgaccccaacaacaagaat

SEQ ID NO: 206874 - DNA, 26 bp, Artificial sequence
  SiRNA target sequence
gattattgaccccaacaacaagaata

SEQ ID NO: 206875 - DNA, 26 bp, Artificial sequence
  SiRNA target sequence
attattgaccccaacaacaagaataa

SEQ ID NO: 206876 - DNA, 26 bp, Artificial sequence
  SiRNA target sequence
ttattgaccccaacaacaagaataaa

SEQ ID NO: 206877 - DNA, 26 bp, Artificial sequence
  SiRNA target sequence
tattgaccccaacaacaagaataaag

SEQ ID NO: 206878 - DNA, 26 bp, Artificial sequence
  SiRNA target sequence
attgaccccaacaacaagaataaagg

SEQ ID NO: 206879 - DNA, 26 bp, Artificial sequence
  SiRNA target sequence
ttgaccccaacaacaagaataaaggt

SEQ ID NO: 206880 - DNA, 26 bp, Artificial sequence
  SiRNA target sequence
tgaccccaacaacaagaataaaggtg

SEQ ID NO: 206881 - DNA, 26 bp, Artificial sequence
  SiRNA target sequence
gaccccaacaacaagaataaaggtgt

SEQ ID NO: 206882 - DNA, 26 bp, Artificial sequence
  SiRNA target sequence
accccaacaacaagaataaaggtgtt

SEQ ID NO: 206883 - DNA, 26 bp, Artificial sequence
  SiRNA target sequence
ccccaacaacaagaataaaggtgtta

SEQ ID NO: 206884 - DNA, 26 bp, Artificial sequence
  SiRNA target sequence
cccaacaacaagaataaaggtgttaa

SEQ ID NO: 206885 - DNA, 26 bp, Artificial sequence
  SiRNA target sequence
ccaacaacaagaataaaggtgttaag

SEQ ID NO: 206886 - DNA, 26 bp, Artificial sequence
  SiRNA target sequence
caacaacaagaataaaggtgttaaga

SEQ ID NO: 206887 - DNA, 26 bp, Artificial sequence
  SiRNA target sequence
aacaacaagaataaaggtgttaagag

SEQ ID NO: 206888 - DNA, 26 bp, Artificial sequence
  SiRNA target sequence
acaacaagaataaaggtgttaagagt

SEQ ID NO: 206889 - DNA, 26 bp, Artificial sequence
  SiRNA target sequence
caacaagaataaaggtgttaagagtc

SEQ ID NO: 206890 - DNA, 26 bp, Artificial sequence
  SiRNA target sequence
aacaagaataaaggtgttaagagtcc

SEQ ID NO: 206891 - DNA, 26 bp, Artificial sequence
  SiRNA target sequence
acaagaataaaggtgttaagagtccc

SEQ ID NO: 206892 - DNA, 26 bp, Artificial sequence
  SiRNA target sequence
caagaataaaggtgttaagagtccca

SEQ ID NO: 206893 - DNA, 26 bp, Artificial sequence
  SiRNA target sequence
aagaataaaggtgttaagagtcccat

SEQ ID NO: 206894 - DNA, 26 bp, Artificial sequence
  SiRNA target sequence
agaataaaggtgttaagagtcccata

SEQ ID NO: 206895 - DNA, 26 bp, Artificial sequence
  SiRNA target sequence
gaataaaggtgttaagagtcccatag

SEQ ID NO: 206896 - DNA, 26 bp, Artificial sequence
  SiRNA target sequence
aataaaggtgttaagagtcccatagt

SEQ ID NO: 206897 - DNA, 26 bp, Artificial sequence
  SiRNA target sequence
ataaaggtgttaagagtcccatagta

SEQ ID NO: 206898 - DNA, 26 bp, Artificial sequence
  SiRNA target sequence
taaaggtgttaagagtcccatagtaa

SEQ ID NO: 206899 - DNA, 26 bp, Artificial sequence
  SiRNA target sequence
aaaggtgttaagagtcccatagtaat

SEQ ID NO: 206900 - DNA, 26 bp, Artificial sequence
  SiRNA target sequence
aaggtgttaagagtcccatagtaatc

SEQ ID NO: 206901 - DNA, 26 bp, Artificial sequence
  SiRNA target sequence
aggtgttaagagtcccatagtaatcc

SEQ ID NO: 206902 - DNA, 26 bp, Artificial sequence
  SiRNA target sequence
ggtgttaagagtcccatagtaatcca

SEQ ID NO: 206903 - DNA, 26 bp, Artificial sequence
  SiRNA target sequence
gtgttaagagtcccatagtaatccat

SEQ ID NO: 206904 - DNA, 26 bp, Artificial sequence
  SiRNA target sequence
tgttaagagtcccatagtaatccatc

SEQ ID NO: 206905 - DNA, 26 bp, Artificial sequence
  SiRNA target sequence
gttaagagtcccatagtaatccatcc

SEQ ID NO: 206906 - DNA, 26 bp, Artificial sequence
  SiRNA target sequence
ttaagagtcccatagtaatccatcca

SEQ ID NO: 206907 - DNA, 26 bp, Artificial sequence
  SiRNA target sequence
taagagtcccatagtaatccatccac

SEQ ID NO: 206908 - DNA, 26 bp, Artificial sequence
  SiRNA target sequence
aagagtcccatagtaatccatccact

SEQ ID NO: 206909 - DNA, 26 bp, Artificial sequence
  SiRNA target sequence
agagtcccatagtaatccatccacta

SEQ ID NO: 206910 - DNA, 26 bp, Artificial sequence
  SiRNA target sequence
gagtcccatagtaatccatccactac

SEQ ID NO: 206911 - DNA, 26 bp, Artificial sequence
  SiRNA target sequence
agtcccatagtaatccatccactact

SEQ ID NO: 206912 - DNA, 26 bp, Artificial sequence
  SiRNA target sequence
gtcccatagtaatccatccactactt

SEQ ID NO: 206913 - DNA, 26 bp, Artificial sequence
  SiRNA target sequence
tcccatagtaatccatccactacttt

SEQ ID NO: 206914 - DNA, 26 bp, Artificial sequence
  SiRNA target sequence
cccatagtaatccatccactactttc

SEQ ID NO: 206915 - DNA, 26 bp, Artificial sequence
  SiRNA target sequence
ccatagtaatccatccactactttct

SEQ ID NO: 206916 - DNA, 26 bp, Artificial sequence
  SiRNA target sequence
catagtaatccatccactactttcta

SEQ ID NO: 206917 - DNA, 26 bp, Artificial sequence
  SiRNA target sequence
atagtaatccatccactactttctac

SEQ ID NO: 206918 - DNA, 26 bp, Artificial sequence
  SiRNA target sequence
tagtaatccatccactactttctact

SEQ ID NO: 206919 - DNA, 26 bp, Artificial sequence
  SiRNA target sequence
agtaatccatccactactttctacta

SEQ ID NO: 206920 - DNA, 26 bp, Artificial sequence
  SiRNA target sequence
gtaatccatccactactttctactaa

SEQ ID NO: 206921 - DNA, 26 bp, Artificial sequence
  SiRNA target sequence
taatccatccactactttctactaaa

SEQ ID NO: 206922 - DNA, 26 bp, Artificial sequence
  SiRNA target sequence
aatccatccactactttctactaaag

SEQ ID NO: 206923 - DNA, 26 bp, Artificial sequence
  SiRNA target sequence
atccatccactactttctactaaagt

SEQ ID NO: 206924 - DNA, 26 bp, Artificial sequence
  SiRNA target sequence
tccatccactactttctactaaagta

SEQ ID NO: 206925 - DNA, 26 bp, Artificial sequence
  SiRNA target sequence
ccatccactactttctactaaagtag

SEQ ID NO: 206926 - DNA, 26 bp, Artificial sequence
  SiRNA target sequence
catccactactttctactaaagtaga

SEQ ID NO: 206927 - DNA, 26 bp, Artificial sequence
  SiRNA target sequence
atccactactttctactaaagtagaa

SEQ ID NO: 206928 - DNA, 26 bp, Artificial sequence
  SiRNA target sequence
tccactactttctactaaagtagaaa

SEQ ID NO: 206929 - DNA, 26 bp, Artificial sequence
  SiRNA target sequence
ccactactttctactaaagtagaaaa

SEQ ID NO: 206930 - DNA, 26 bp, Artificial sequence
  SiRNA target sequence
cactactttctactaaagtagaaaat

SEQ ID NO: 206931 - DNA, 26 bp, Artificial sequence
  SiRNA target sequence
actactttctactaaagtagaaaatg

SEQ ID NO: 206932 - DNA, 26 bp, Artificial sequence
  SiRNA target sequence
ctactttctactaaagtagaaaatgc

SEQ ID NO: 206933 - DNA, 26 bp, Artificial sequence
  SiRNA target sequence
tactttctactaaagtagaaaatgct

SEQ ID NO: 206934 - DNA, 26 bp, Artificial sequence
  SiRNA target sequence
actttctactaaagtagaaaatgctg

SEQ ID NO: 206935 - DNA, 26 bp, Artificial sequence
  SiRNA target sequence
ctttctactaaagtagaaaatgctga

SEQ ID NO: 206936 - DNA, 26 bp, Artificial sequence
  SiRNA target sequence
tttctactaaagtagaaaatgctgac

SEQ ID NO: 206937 - DNA, 26 bp, Artificial sequence
  SiRNA target sequence
ttctactaaagtagaaaatgctgaca

SEQ ID NO: 206938 - DNA, 26 bp, Artificial sequence
  SiRNA target sequence
tctactaaagtagaaaatgctgacaa

SEQ ID NO: 206939 - DNA, 26 bp, Artificial sequence
  SiRNA target sequence
ctactaaagtagaaaatgctgacaaa

SEQ ID NO: 206940 - DNA, 26 bp, Artificial sequence
  SiRNA target sequence
tactaaagtagaaaatgctgacaaat

SEQ ID NO: 206941 - DNA, 26 bp, Artificial sequence
  SiRNA target sequence
actaaagtagaaaatgctgacaaatt

SEQ ID NO: 206942 - DNA, 26 bp, Artificial sequence
  SiRNA target sequence
ctaaagtagaaaatgctgacaaatta

SEQ ID NO: 206943 - DNA, 26 bp, Artificial sequence
  SiRNA target sequence
taaagtagaaaatgctgacaaattaa

SEQ ID NO: 206944 - DNA, 26 bp, Artificial sequence
  SiRNA target sequence
aaagtagaaaatgctgacaaattaag

SEQ ID NO: 206945 - DNA, 26 bp, Artificial sequence
  SiRNA target sequence
aagtagaaaatgctgacaaattaagt

SEQ ID NO: 206946 - DNA, 26 bp, Artificial sequence
  SiRNA target sequence
agtagaaaatgctgacaaattaagtg

SEQ ID NO: 206947 - DNA, 26 bp, Artificial sequence
  SiRNA target sequence
gtagaaaatgctgacaaattaagtgt

SEQ ID NO: 206948 - DNA, 26 bp, Artificial sequence
  SiRNA target sequence
tagaaaatgctgacaaattaagtgtt

SEQ ID NO: 206949 - DNA, 26 bp, Artificial sequence
  SiRNA target sequence
agaaaatgctgacaaattaagtgtta

SEQ ID NO: 206950 - DNA, 26 bp, Artificial sequence
  SiRNA target sequence
gaaaatgctgacaaattaagtgttat

SEQ ID NO: 206951 - DNA, 26 bp, Artificial sequence
  SiRNA target sequence
aaaatgctgacaaattaagtgttatt

SEQ ID NO: 206952 - DNA, 26 bp, Artificial sequence
  SiRNA target sequence
aaatgctgacaaattaagtgttatta

SEQ ID NO: 206953 - DNA, 26 bp, Artificial sequence
  SiRNA target sequence
aatgctgacaaattaagtgttattac

SEQ ID NO: 206954 - DNA, 26 bp, Artificial sequence
  SiRNA target sequence
atgctgacaaattaagtgttattaca

SEQ ID NO: 206955 - DNA, 26 bp, Artificial sequence
  SiRNA target sequence
tgctgacaaattaagtgttattacag

SEQ ID NO: 206956 - DNA, 26 bp, Artificial sequence
  SiRNA target sequence
gctgacaaattaagtgttattacagt

SEQ ID NO: 206957 - DNA, 26 bp, Artificial sequence
  SiRNA target sequence
ctgacaaattaagtgttattacagta

SEQ ID NO: 206958 - DNA, 26 bp, Artificial sequence
  SiRNA target sequence
tgacaaattaagtgttattacagtaa

SEQ ID NO: 206959 - DNA, 26 bp, Artificial sequence
  SiRNA target sequence
gacaaattaagtgttattacagtaac

SEQ ID NO: 206960 - DNA, 26 bp, Artificial sequence
  SiRNA target sequence
acaaattaagtgttattacagtaact

SEQ ID NO: 206961 - DNA, 26 bp, Artificial sequence
  SiRNA target sequence
caaattaagtgttattacagtaactg

SEQ ID NO: 206962 - DNA, 26 bp, Artificial sequence
  SiRNA target sequence
aaattaagtgttattacagtaactgc

SEQ ID NO: 206963 - DNA, 26 bp, Artificial sequence
  SiRNA target sequence
aattaagtgttattacagtaactgct

SEQ ID NO: 206964 - DNA, 26 bp, Artificial sequence
  SiRNA target sequence
attaagtgttattacagtaactgcta

SEQ ID NO: 206965 - DNA, 26 bp, Artificial sequence
  SiRNA target sequence
ttaagtgttattacagtaactgctac

SEQ ID NO: 206966 - DNA, 26 bp, Artificial sequence
  SiRNA target sequence
taagtgttattacagtaactgctacc

SEQ ID NO: 206967 - DNA, 26 bp, Artificial sequence
  SiRNA target sequence
aagtgttattacagtaactgctacca

SEQ ID NO: 206968 - DNA, 26 bp, Artificial sequence
  SiRNA target sequence
agtgttattacagtaactgctaccaa

SEQ ID NO: 206969 - DNA, 26 bp, Artificial sequence
  SiRNA target sequence
gtgttattacagtaactgctaccaat

SEQ ID NO: 206970 - DNA, 26 bp, Artificial sequence
  SiRNA target sequence
tgttattacagtaactgctaccaata

SEQ ID NO: 206971 - DNA, 26 bp, Artificial sequence
  SiRNA target sequence
gttattacagtaactgctaccaatat

SEQ ID NO: 206972 - DNA, 26 bp, Artificial sequence
  SiRNA target sequence
ttattacagtaactgctaccaatatt

SEQ ID NO: 206973 - DNA, 26 bp, Artificial sequence
  SiRNA target sequence
tattacagtaactgctaccaatattt

SEQ ID NO: 206974 - DNA, 26 bp, Artificial sequence
  SiRNA target sequence
attacagtaactgctaccaatatttg

SEQ ID NO: 206975 - DNA, 26 bp, Artificial sequence
  SiRNA target sequence
ttacagtaactgctaccaatatttga

SEQ ID NO: 206976 - DNA, 26 bp, Artificial sequence
  SiRNA target sequence
tacagtaactgctaccaatatttgat

SEQ ID NO: 206977 - DNA, 26 bp, Artificial sequence
  SiRNA target sequence
acagtaactgctaccaatatttgatc

SEQ ID NO: 206978 - DNA, 26 bp, Artificial sequence
  SiRNA target sequence
cagtaactgctaccaatatttgatct

SEQ ID NO: 206979 - DNA, 26 bp, Artificial sequence
  SiRNA target sequence
agtaactgctaccaatatttgatcta

SEQ ID NO: 206980 - DNA, 26 bp, Artificial sequence
  SiRNA target sequence
gtaactgctaccaatatttgatctat

SEQ ID NO: 206981 - DNA, 26 bp, Artificial sequence
  SiRNA target sequence
taactgctaccaatatttgatctatt

SEQ ID NO: 206982 - DNA, 26 bp, Artificial sequence
  SiRNA target sequence
aactgctaccaatatttgatctattg

SEQ ID NO: 206983 - DNA, 26 bp, Artificial sequence
  SiRNA target sequence
actgctaccaatatttgatctattgt

SEQ ID NO: 206984 - DNA, 26 bp, Artificial sequence
  SiRNA target sequence
ctgctaccaatatttgatctattgta

SEQ ID NO: 206985 - DNA, 26 bp, Artificial sequence
  SiRNA target sequence
tgctaccaatatttgatctattgtat

SEQ ID NO: 206986 - DNA, 26 bp, Artificial sequence
  SiRNA target sequence
gctaccaatatttgatctattgtatt

SEQ ID NO: 206987 - DNA, 26 bp, Artificial sequence
  SiRNA target sequence
ctaccaatatttgatctattgtatta

SEQ ID NO: 206988 - DNA, 26 bp, Artificial sequence
  SiRNA target sequence
taccaatatttgatctattgtattaa

SEQ ID NO: 206989 - DNA, 26 bp, Artificial sequence
  SiRNA target sequence
accaatatttgatctattgtattaaa

SEQ ID NO: 206990 - DNA, 26 bp, Artificial sequence
  SiRNA target sequence
ccaatatttgatctattgtattaaat

SEQ ID NO: 206991 - DNA, 26 bp, Artificial sequence
  SiRNA target sequence
caatatttgatctattgtattaaatt

SEQ ID NO: 206992 - DNA, 26 bp, Artificial sequence
  SiRNA target sequence
aatatttgatctattgtattaaattt

SEQ ID NO: 206993 - DNA, 26 bp, Artificial sequence
  SiRNA target sequence
atatttgatctattgtattaaatttg

SEQ ID NO: 206994 - DNA, 26 bp, Artificial sequence
  SiRNA target sequence
tatttgatctattgtattaaatttgc

SEQ ID NO: 206995 - DNA, 26 bp, Artificial sequence
  SiRNA target sequence
atttgatctattgtattaaatttgcc

SEQ ID NO: 206996 - DNA, 26 bp, Artificial sequence
  SiRNA target sequence
tttgatctattgtattaaatttgccg

SEQ ID NO: 206997 - DNA, 26 bp, Artificial sequence
  SiRNA target sequence
ttgatctattgtattaaatttgccgg

SEQ ID NO: 206998 - DNA, 26 bp, Artificial sequence
  SiRNA target sequence
tgatctattgtattaaatttgccgga

SEQ ID NO: 206999 - DNA, 26 bp, Artificial sequence
  SiRNA target sequence
gatctattgtattaaatttgccggag

SEQ ID NO: 207000 - DNA, 26 bp, Artificial sequence
  SiRNA target sequence
atctattgtattaaatttgccggagt

SEQ ID NO: 207001 - DNA, 26 bp, Artificial sequence
  SiRNA target sequence
tctattgtattaaatttgccggagta

SEQ ID NO: 207002 - DNA, 26 bp, Artificial sequence
  SiRNA target sequence
ctattgtattaaatttgccggagtat

SEQ ID NO: 207003 - DNA, 26 bp, Artificial sequence
  SiRNA target sequence
tattgtattaaatttgccggagtatt

SEQ ID NO: 207004 - DNA, 26 bp, Artificial sequence
  SiRNA target sequence
attgtattaaatttgccggagtattc

SEQ ID NO: 207005 - DNA, 26 bp, Artificial sequence
  SiRNA target sequence
ttgtattaaatttgccggagtattct

SEQ ID NO: 207006 - DNA, 26 bp, Artificial sequence
  SiRNA target sequence
tgtattaaatttgccggagtattctc

SEQ ID NO: 207007 - DNA, 26 bp, Artificial sequence
  SiRNA target sequence
gtattaaatttgccggagtattctcc

SEQ ID NO: 207008 - DNA, 26 bp, Artificial sequence
  SiRNA target sequence
tattaaatttgccggagtattctcct

SEQ ID NO: 207009 - DNA, 26 bp, Artificial sequence
  SiRNA target sequence
attaaatttgccggagtattctccta

SEQ ID NO: 207010 - DNA, 26 bp, Artificial sequence
  SiRNA target sequence
ttaaatttgccggagtattctcctac

SEQ ID NO: 207011 - DNA, 26 bp, Artificial sequence
  SiRNA target sequence
taaatttgccggagtattctcctacc

SEQ ID NO: 207012 - DNA, 26 bp, Artificial sequence
  SiRNA target sequence
aaatttgccggagtattctcctacct

SEQ ID NO: 207013 - DNA, 26 bp, Artificial sequence
  SiRNA target sequence
aatttgccggagtattctcctacctc

SEQ ID NO: 207014 - DNA, 26 bp, Artificial sequence
  SiRNA target sequence
atttgccggagtattctcctacctct

SEQ ID NO: 207015 - DNA, 26 bp, Artificial sequence
  SiRNA target sequence
tttgccggagtattctcctacctcta

SEQ ID NO: 207016 - DNA, 26 bp, Artificial sequence
  SiRNA target sequence
ttgccggagtattctcctacctctaa

SEQ ID NO: 207017 - DNA, 26 bp, Artificial sequence
  SiRNA target sequence
tgccggagtattctcctacctctaat

SEQ ID NO: 207018 - DNA, 26 bp, Artificial sequence
  SiRNA target sequence
gccggagtattctcctacctctaatc

SEQ ID NO: 207019 - DNA, 26 bp, Artificial sequence
  SiRNA target sequence
ccggagtattctcctacctctaatcc

SEQ ID NO: 207020 - DNA, 26 bp, Artificial sequence
  SiRNA target sequence
cggagtattctcctacctctaatcct

SEQ ID NO: 207021 - DNA, 26 bp, Artificial sequence
  SiRNA target sequence
ggagtattctcctacctctaatccta

SEQ ID NO: 207022 - DNA, 26 bp, Artificial sequence
  SiRNA target sequence
gagtattctcctacctctaatcctaa

SEQ ID NO: 207023 - DNA, 26 bp, Artificial sequence
  SiRNA target sequence
agtattctcctacctctaatcctaaa

SEQ ID NO: 207024 - DNA, 26 bp, Artificial sequence
  SiRNA target sequence
gtattctcctacctctaatcctaaac

SEQ ID NO: 207025 - DNA, 26 bp, Artificial sequence
  SiRNA target sequence
tattctcctacctctaatcctaaact

SEQ ID NO: 207026 - DNA, 26 bp, Artificial sequence
  SiRNA target sequence
attctcctacctctaatcctaaactt

SEQ ID NO: 207027 - DNA, 26 bp, Artificial sequence
  SiRNA target sequence
ttctcctacctctaatcctaaacttt

SEQ ID NO: 207028 - DNA, 26 bp, Artificial sequence
  SiRNA target sequence
tctcctacctctaatcctaaactttt

SEQ ID NO: 207029 - DNA, 26 bp, Artificial sequence
  SiRNA target sequence
ctcctacctctaatcctaaacttttt

SEQ ID NO: 207030 - DNA, 26 bp, Artificial sequence
  SiRNA target sequence
tcctacctctaatcctaaactttttg

SEQ ID NO: 207031 - DNA, 26 bp, Artificial sequence
  SiRNA target sequence
cctacctctaatcctaaactttttga

SEQ ID NO: 207032 - DNA, 26 bp, Artificial sequence
  SiRNA target sequence
ctacctctaatcctaaactttttgac

SEQ ID NO: 207033 - DNA, 26 bp, Artificial sequence
  SiRNA target sequence
tacctctaatcctaaactttttgacg

SEQ ID NO: 207034 - DNA, 26 bp, Artificial sequence
  SiRNA target sequence
acctctaatcctaaactttttgacgc

SEQ ID NO: 207035 - DNA, 26 bp, Artificial sequence
  SiRNA target sequence
cctctaatcctaaactttttgacgca

SEQ ID NO: 207036 - DNA, 26 bp, Artificial sequence
  SiRNA target sequence
ctctaatcctaaactttttgacgcag

SEQ ID NO: 207037 - DNA, 26 bp, Artificial sequence
  SiRNA target sequence
tctaatcctaaactttttgacgcagc

SEQ ID NO: 207038 - DNA, 26 bp, Artificial sequence
  SiRNA target sequence
ctaatcctaaactttttgacgcagct

SEQ ID NO: 207039 - DNA, 26 bp, Artificial sequence
  SiRNA target sequence
taatcctaaactttttgacgcagctt

SEQ ID NO: 207040 - DNA, 26 bp, Artificial sequence
  SiRNA target sequence
aatcctaaactttttgacgcagcttt

SEQ ID NO: 207041 - DNA, 26 bp, Artificial sequence
  SiRNA target sequence
atcctaaactttttgacgcagcttta

SEQ ID NO: 207042 - DNA, 26 bp, Artificial sequence
  SiRNA target sequence
tcctaaactttttgacgcagctttaa

SEQ ID NO: 207043 - DNA, 26 bp, Artificial sequence
  SiRNA target sequence
cctaaactttttgacgcagctttaat

SEQ ID NO: 207044 - DNA, 26 bp, Artificial sequence
  SiRNA target sequence
ctaaactttttgacgcagctttaatt

SEQ ID NO: 207045 - DNA, 26 bp, Artificial sequence
  SiRNA target sequence
taaactttttgacgcagctttaattc

SEQ ID NO: 207046 - DNA, 26 bp, Artificial sequence
  SiRNA target sequence
aaactttttgacgcagctttaattcc

SEQ ID NO: 207047 - DNA, 26 bp, Artificial sequence
  SiRNA target sequence
aactttttgacgcagctttaattcct

SEQ ID NO: 207048 - DNA, 26 bp, Artificial sequence
  SiRNA target sequence
actttttgacgcagctttaattcctg

SEQ ID NO: 207049 - DNA, 26 bp, Artificial sequence
  SiRNA target sequence
ctttttgacgcagctttaattcctgc

SEQ ID NO: 207050 - DNA, 26 bp, Artificial sequence
  SiRNA target sequence
tttttgacgcagctttaattcctgct

SEQ ID NO: 207051 - DNA, 26 bp, Artificial sequence
  SiRNA target sequence
ttttgacgcagctttaattcctgctt

SEQ ID NO: 207052 - DNA, 26 bp, Artificial sequence
  SiRNA target sequence
tttgacgcagctttaattcctgcttt

SEQ ID NO: 207053 - DNA, 26 bp, Artificial sequence
  SiRNA target sequence
ttgacgcagctttaattcctgcttta

SEQ ID NO: 207054 - DNA, 26 bp, Artificial sequence
  SiRNA target sequence
tgacgcagctttaattcctgctttat

SEQ ID NO: 207055 - DNA, 26 bp, Artificial sequence
  SiRNA target sequence
gacgcagctttaattcctgctttata

SEQ ID NO: 207056 - DNA, 26 bp, Artificial sequence
  SiRNA target sequence
acgcagctttaattcctgctttatag

SEQ ID NO: 207057 - DNA, 26 bp, Artificial sequence
  SiRNA target sequence
cgcagctttaattcctgctttataga

SEQ ID NO: 207058 - DNA, 26 bp, Artificial sequence
  SiRNA target sequence
gcagctttaattcctgctttatagac

SEQ ID NO: 207059 - DNA, 26 bp, Artificial sequence
  SiRNA target sequence
cagctttaattcctgctttatagaca

SEQ ID NO: 207060 - DNA, 26 bp, Artificial sequence
  SiRNA target sequence
agctttaattcctgctttatagacag

SEQ ID NO: 207061 - DNA, 26 bp, Artificial sequence
  SiRNA target sequence
gctttaattcctgctttatagacaga

SEQ ID NO: 207062 - DNA, 26 bp, Artificial sequence
  SiRNA target sequence
ctttaattcctgctttatagacagat

SEQ ID NO: 207063 - DNA, 26 bp, Artificial sequence
  SiRNA target sequence
tttaattcctgctttatagacagatt

SEQ ID NO: 207064 - DNA, 26 bp, Artificial sequence
  SiRNA target sequence
ttaattcctgctttatagacagattc

SEQ ID NO: 207065 - DNA, 26 bp, Artificial sequence
  SiRNA target sequence
taattcctgctttatagacagattca

SEQ ID NO: 207066 - DNA, 26 bp, Artificial sequence
  SiRNA target sequence
aattcctgctttatagacagattcaa

SEQ ID NO: 207067 - DNA, 26 bp, Artificial sequence
  SiRNA target sequence
attcctgctttatagacagattcaat

SEQ ID NO: 207068 - DNA, 26 bp, Artificial sequence
  SiRNA target sequence
ttcctgctttatagacagattcaatt

SEQ ID NO: 207069 - DNA, 26 bp, Artificial sequence
  SiRNA target sequence
tcctgctttatagacagattcaatta

SEQ ID NO: 207070 - DNA, 26 bp, Artificial sequence
  SiRNA target sequence
cctgctttatagacagattcaattaa

SEQ ID NO: 207071 - DNA, 26 bp, Artificial sequence
  SiRNA target sequence
ctgctttatagacagattcaattaaa

SEQ ID NO: 207072 - DNA, 26 bp, Artificial sequence
  SiRNA target sequence
tgctttatagacagattcaattaaat

SEQ ID NO: 207073 - DNA, 26 bp, Artificial sequence
  SiRNA target sequence
gctttatagacagattcaattaaatt

SEQ ID NO: 207074 - DNA, 26 bp, Artificial sequence
  SiRNA target sequence
ctttatagacagattcaattaaatta

SEQ ID NO: 207075 - DNA, 26 bp, Artificial sequence
  SiRNA target sequence
tttatagacagattcaattaaattaa

SEQ ID NO: 207076 - DNA, 26 bp, Artificial sequence
  SiRNA target sequence
ttatagacagattcaattaaattaaa

SEQ ID NO: 207077 - DNA, 26 bp, Artificial sequence
  SiRNA target sequence
tatagacagattcaattaaattaaat

SEQ ID NO: 207078 - DNA, 26 bp, Artificial sequence
  SiRNA target sequence
atagacagattcaattaaattaaatg

SEQ ID NO: 207079 - DNA, 26 bp, Artificial sequence
  SiRNA target sequence
tagacagattcaattaaattaaatgt

SEQ ID NO: 207080 - DNA, 26 bp, Artificial sequence
  SiRNA target sequence
agacagattcaattaaattaaatgtt

SEQ ID NO: 207081 - DNA, 26 bp, Artificial sequence
  SiRNA target sequence
gacagattcaattaaattaaatgtta

SEQ ID NO: 207082 - DNA, 26 bp, Artificial sequence
  SiRNA target sequence
acagattcaattaaattaaatgttat

SEQ ID NO: 207083 - DNA, 26 bp, Artificial sequence
  SiRNA target sequence
cagattcaattaaattaaatgttata

SEQ ID NO: 207084 - DNA, 26 bp, Artificial sequence
  SiRNA target sequence
agattcaattaaattaaatgttatat

SEQ ID NO: 207085 - DNA, 26 bp, Artificial sequence
  SiRNA target sequence
gattcaattaaattaaatgttatatt

SEQ ID NO: 207086 - DNA, 26 bp, Artificial sequence
  SiRNA target sequence
attcaattaaattaaatgttatattg

SEQ ID NO: 207087 - DNA, 26 bp, Artificial sequence
  SiRNA target sequence
ttcaattaaattaaatgttatattgt

SEQ ID NO: 207088 - DNA, 26 bp, Artificial sequence
  SiRNA target sequence
tcaattaaattaaatgttatattgta

SEQ ID NO: 207089 - DNA, 26 bp, Artificial sequence
  SiRNA target sequence
caattaaattaaatgttatattgtaa

SEQ ID NO: 207090 - DNA, 26 bp, Artificial sequence
  SiRNA target sequence
aattaaattaaatgttatattgtaaa

SEQ ID NO: 207091 - DNA, 26 bp, Artificial sequence
  SiRNA target sequence
attaaattaaatgttatattgtaaaa

SEQ ID NO: 207092 - DNA, 26 bp, Artificial sequence
  SiRNA target sequence
ttaaattaaatgttatattgtaaaaa

SEQ ID NO: 207093 - DNA, 26 bp, Artificial sequence
  SiRNA target sequence
taaattaaatgttatattgtaaaaaa

SEQ ID NO: 207094 - DNA, 26 bp, Artificial sequence
  SiRNA target sequence
aaattaaatgttatattgtaaaaaaa

SEQ ID NO: 207095 - DNA, 26 bp, Artificial sequence
  SiRNA target sequence
aattaaatgttatattgtaaaaaaag

SEQ ID NO: 207096 - DNA, 26 bp, Artificial sequence
  SiRNA target sequence
attaaatgttatattgtaaaaaaaga

SEQ ID NO: 207097 - DNA, 26 bp, Artificial sequence
  SiRNA target sequence
ttaaatgttatattgtaaaaaaagac

SEQ ID NO: 207098 - DNA, 26 bp, Artificial sequence
  SiRNA target sequence
taaatgttatattgtaaaaaaagact

SEQ ID NO: 207099 - DNA, 26 bp, Artificial sequence
  SiRNA target sequence
aaatgttatattgtaaaaaaagacta

SEQ ID NO: 207100 - DNA, 26 bp, Artificial sequence
  SiRNA target sequence
aatgttatattgtaaaaaaagactat

SEQ ID NO: 207101 - DNA, 26 bp, Artificial sequence
  SiRNA target sequence
atgttatattgtaaaaaaagactatt

SEQ ID NO: 207102 - DNA, 26 bp, Artificial sequence
  SiRNA target sequence
tgttatattgtaaaaaaagactatta

SEQ ID NO: 207103 - DNA, 26 bp, Artificial sequence
  SiRNA target sequence
gttatattgtaaaaaaagactattat

SEQ ID NO: 207104 - DNA, 26 bp, Artificial sequence
  SiRNA target sequence
ttatattgtaaaaaaagactattata

SEQ ID NO: 207105 - DNA, 26 bp, Artificial sequence
  SiRNA target sequence
tatattgtaaaaaaagactattatac

SEQ ID NO: 207106 - DNA, 26 bp, Artificial sequence
  SiRNA target sequence
atattgtaaaaaaagactattataca

SEQ ID NO: 207107 - DNA, 26 bp, Artificial sequence
  SiRNA target sequence
tattgtaaaaaaagactattatacaa

SEQ ID NO: 207108 - DNA, 26 bp, Artificial sequence
  SiRNA target sequence
attgtaaaaaaagactattatacaaa

SEQ ID NO: 207109 - DNA, 26 bp, Artificial sequence
  SiRNA target sequence
ttgtaaaaaaagactattatacaaag

SEQ ID NO: 207110 - DNA, 26 bp, Artificial sequence
  SiRNA target sequence
tgtaaaaaaagactattatacaaagt

SEQ ID NO: 207111 - DNA, 26 bp, Artificial sequence
  SiRNA target sequence
gtaaaaaaagactattatacaaagtg

SEQ ID NO: 207112 - DNA, 26 bp, Artificial sequence
  SiRNA target sequence
taaaaaaagactattatacaaagtga

SEQ ID NO: 207113 - DNA, 26 bp, Artificial sequence
  SiRNA target sequence
aaaaaaagactattatacaaagtgac

SEQ ID NO: 207114 - DNA, 26 bp, Artificial sequence
  SiRNA target sequence
aaaaaagactattatacaaagtgaca

SEQ ID NO: 207115 - DNA, 26 bp, Artificial sequence
  SiRNA target sequence
aaaaagactattatacaaagtgacat

SEQ ID NO: 207116 - DNA, 26 bp, Artificial sequence
  SiRNA target sequence
aaaagactattatacaaagtgacatt

SEQ ID NO: 207117 - DNA, 26 bp, Artificial sequence
  SiRNA target sequence
aaagactattatacaaagtgacatta

SEQ ID NO: 207118 - DNA, 26 bp, Artificial sequence
  SiRNA target sequence
aagactattatacaaagtgacattaa

SEQ ID NO: 207119 - DNA, 26 bp, Artificial sequence
  SiRNA target sequence
agactattatacaaagtgacattaat

SEQ ID NO: 207120 - DNA, 26 bp, Artificial sequence
  SiRNA target sequence
gactattatacaaagtgacattaata

SEQ ID NO: 207121 - DNA, 26 bp, Artificial sequence
  SiRNA target sequence
actattatacaaagtgacattaataa

SEQ ID NO: 207122 - DNA, 26 bp, Artificial sequence
  SiRNA target sequence
ctattatacaaagtgacattaataat

SEQ ID NO: 207123 - DNA, 26 bp, Artificial sequence
  SiRNA target sequence
tattatacaaagtgacattaataatt

SEQ ID NO: 207124 - DNA, 26 bp, Artificial sequence
  SiRNA target sequence
attatacaaagtgacattaataattt

SEQ ID NO: 207125 - DNA, 26 bp, Artificial sequence
  SiRNA target sequence
ttatacaaagtgacattaataatttt

SEQ ID NO: 207126 - DNA, 26 bp, Artificial sequence
  SiRNA target sequence
tatacaaagtgacattaataattttg

SEQ ID NO: 207127 - DNA, 26 bp, Artificial sequence
  SiRNA target sequence
atacaaagtgacattaataattttga

SEQ ID NO: 207128 - DNA, 26 bp, Artificial sequence
  SiRNA target sequence
tacaaagtgacattaataattttgat

SEQ ID NO: 207129 - DNA, 26 bp, Artificial sequence
  SiRNA target sequence
acaaagtgacattaataattttgatt

SEQ ID NO: 207130 - DNA, 26 bp, Artificial sequence
  SiRNA target sequence
caaagtgacattaataattttgattt

SEQ ID NO: 207131 - DNA, 26 bp, Artificial sequence
  SiRNA target sequence
aaagtgacattaataattttgatttc

SEQ ID NO: 207132 - DNA, 26 bp, Artificial sequence
  SiRNA target sequence
aagtgacattaataattttgatttca

SEQ ID NO: 207133 - DNA, 26 bp, Artificial sequence
  SiRNA target sequence
agtgacattaataattttgatttcat

SEQ ID NO: 207134 - DNA, 26 bp, Artificial sequence
  SiRNA target sequence
gtgacattaataattttgatttcatc

SEQ ID NO: 207135 - DNA, 26 bp, Artificial sequence
  SiRNA target sequence
tgacattaataattttgatttcatca

SEQ ID NO: 207136 - DNA, 26 bp, Artificial sequence
  SiRNA target sequence
gacattaataattttgatttcatcat

SEQ ID NO: 207137 - DNA, 26 bp, Artificial sequence
  SiRNA target sequence
acattaataattttgatttcatcatt

SEQ ID NO: 207138 - DNA, 26 bp, Artificial sequence
  SiRNA target sequence
cattaataattttgatttcatcatta

SEQ ID NO: 207139 - DNA, 26 bp, Artificial sequence
  SiRNA target sequence
attaataattttgatttcatcattat

SEQ ID NO: 207140 - DNA, 26 bp, Artificial sequence
  SiRNA target sequence
ttaataattttgatttcatcattata

SEQ ID NO: 207141 - DNA, 26 bp, Artificial sequence
  SiRNA target sequence
taataattttgatttcatcattatac

SEQ ID NO: 207142 - DNA, 26 bp, Artificial sequence
  SiRNA target sequence
aataattttgatttcatcattatact

SEQ ID NO: 207143 - DNA, 26 bp, Artificial sequence
  SiRNA target sequence
ataattttgatttcatcattatacta

SEQ ID NO: 207144 - DNA, 26 bp, Artificial sequence
  SiRNA target sequence
taattttgatttcatcattatactaa

SEQ ID NO: 207145 - DNA, 26 bp, Artificial sequence
  SiRNA target sequence
aattttgatttcatcattatactaat

SEQ ID NO: 207146 - DNA, 26 bp, Artificial sequence
  SiRNA target sequence
attttgatttcatcattatactaata

SEQ ID NO: 207147 - DNA, 26 bp, Artificial sequence
  SiRNA target sequence
ttttgatttcatcattatactaatac

SEQ ID NO: 207148 - DNA, 26 bp, Artificial sequence
  SiRNA target sequence
tttgatttcatcattatactaatacc

SEQ ID NO: 207149 - DNA, 26 bp, Artificial sequence
  SiRNA target sequence
ttgatttcatcattatactaatacct

SEQ ID NO: 207150 - DNA, 26 bp, Artificial sequence
  SiRNA target sequence
tgatttcatcattatactaatacctt

SEQ ID NO: 207151 - DNA, 26 bp, Artificial sequence
  SiRNA target sequence
gatttcatcattatactaataccttc

SEQ ID NO: 207152 - DNA, 26 bp, Artificial sequence
  SiRNA target sequence
atttcatcattatactaataccttcg

SEQ ID NO: 207153 - DNA, 26 bp, Artificial sequence
  SiRNA target sequence
tttcatcattatactaataccttcgg

SEQ ID NO: 207154 - DNA, 26 bp, Artificial sequence
  SiRNA target sequence
ttcatcattatactaataccttcgga

SEQ ID NO: 207155 - DNA, 26 bp, Artificial sequence
  SiRNA target sequence
tcatcattatactaataccttcggag

SEQ ID NO: 207156 - DNA, 26 bp, Artificial sequence
  SiRNA target sequence
catcattatactaataccttcggaga

SEQ ID NO: 207157 - DNA, 26 bp, Artificial sequence
  SiRNA target sequence
atcattatactaataccttcggagaa

SEQ ID NO: 207158 - DNA, 26 bp, Artificial sequence
  SiRNA target sequence
tcattatactaataccttcggagaaa

SEQ ID NO: 207159 - DNA, 26 bp, Artificial sequence
  SiRNA target sequence
cattatactaataccttcggagaaac

SEQ ID NO: 207160 - DNA, 26 bp, Artificial sequence
  SiRNA target sequence
attatactaataccttcggagaaacc

SEQ ID NO: 207161 - DNA, 26 bp, Artificial sequence
  SiRNA target sequence
ttatactaataccttcggagaaacct

SEQ ID NO: 207162 - DNA, 26 bp, Artificial sequence
  SiRNA target sequence
tatactaataccttcggagaaaccta

SEQ ID NO: 207163 - DNA, 26 bp, Artificial sequence
  SiRNA target sequence
atactaataccttcggagaaacctac

SEQ ID NO: 207164 - DNA, 26 bp, Artificial sequence
  SiRNA target sequence
tactaataccttcggagaaacctaca

SEQ ID NO: 207165 - DNA, 26 bp, Artificial sequence
  SiRNA target sequence
actaataccttcggagaaacctacac

SEQ ID NO: 207166 - DNA, 26 bp, Artificial sequence
  SiRNA target sequence
ctaataccttcggagaaacctacact

SEQ ID NO: 207167 - DNA, 26 bp, Artificial sequence
  SiRNA target sequence
taataccttcggagaaacctacacta

SEQ ID NO: 207168 - DNA, 26 bp, Artificial sequence
  SiRNA target sequence
aataccttcggagaaacctacactaa

SEQ ID NO: 207169 - DNA, 26 bp, Artificial sequence
  SiRNA target sequence
ataccttcggagaaacctacactaac

SEQ ID NO: 207170 - DNA, 26 bp, Artificial sequence
  SiRNA target sequence
taccttcggagaaacctacactaact

SEQ ID NO: 207171 - DNA, 26 bp, Artificial sequence
  SiRNA target sequence
accttcggagaaacctacactaactt

SEQ ID NO: 207172 - DNA, 26 bp, Artificial sequence
  SiRNA target sequence
ccttcggagaaacctacactaacttt

SEQ ID NO: 207173 - DNA, 26 bp, Artificial sequence
  SiRNA target sequence
cttcggagaaacctacactaactttt

SEQ ID NO: 207174 - DNA, 26 bp, Artificial sequence
  SiRNA target sequence
ttcggagaaacctacactaacttttt

SEQ ID NO: 207175 - DNA, 26 bp, Artificial sequence
  SiRNA target sequence
tcggagaaacctacactaactttttg

SEQ ID NO: 207176 - DNA, 26 bp, Artificial sequence
  SiRNA target sequence
cggagaaacctacactaactttttgt

SEQ ID NO: 207177 - DNA, 26 bp, Artificial sequence
  SiRNA target sequence
ggagaaacctacactaactttttgtt

SEQ ID NO: 207178 - DNA, 26 bp, Artificial sequence
  SiRNA target sequence
gagaaacctacactaactttttgttt

SEQ ID NO: 207179 - DNA, 26 bp, Artificial sequence
  SiRNA target sequence
agaaacctacactaactttttgtttc

SEQ ID NO: 207180 - DNA, 26 bp, Artificial sequence
  SiRNA target sequence
gaaacctacactaactttttgtttct

SEQ ID NO: 207181 - DNA, 26 bp, Artificial sequence
  SiRNA target sequence
aaacctacactaactttttgtttctt

SEQ ID NO: 207182 - DNA, 26 bp, Artificial sequence
  SiRNA target sequence
aacctacactaactttttgtttcttt

SEQ ID NO: 207183 - DNA, 26 bp, Artificial sequence
  SiRNA target sequence
acctacactaactttttgtttctttt

SEQ ID NO: 207184 - DNA, 26 bp, Artificial sequence
  SiRNA target sequence
cctacactaactttttgtttcttttt

SEQ ID NO: 207185 - DNA, 26 bp, Artificial sequence
  SiRNA target sequence
ctacactaactttttgtttctttttt

SEQ ID NO: 207186 - DNA, 26 bp, Artificial sequence
  SiRNA target sequence
tacactaactttttgtttctttttta

SEQ ID NO: 207187 - DNA, 26 bp, Artificial sequence
  SiRNA target sequence
acactaactttttgtttcttttttat

SEQ ID NO: 207188 - DNA, 26 bp, Artificial sequence
  SiRNA target sequence
cactaactttttgtttcttttttatc

SEQ ID NO: 207189 - DNA, 26 bp, Artificial sequence
  SiRNA target sequence
actaactttttgtttcttttttatcg

SEQ ID NO: 207190 - DNA, 26 bp, Artificial sequence
  SiRNA target sequence
ctaactttttgtttcttttttatcgt

SEQ ID NO: 207191 - DNA, 26 bp, Artificial sequence
  SiRNA target sequence
taactttttgtttcttttttatcgta

SEQ ID NO: 207192 - DNA, 26 bp, Artificial sequence
  SiRNA target sequence
aactttttgtttcttttttatcgtat

SEQ ID NO: 207193 - DNA, 26 bp, Artificial sequence
  SiRNA target sequence
actttttgtttcttttttatcgtatt

SEQ ID NO: 207194 - DNA, 26 bp, Artificial sequence
  SiRNA target sequence
ctttttgtttcttttttatcgtatta

SEQ ID NO: 207195 - DNA, 26 bp, Artificial sequence
  SiRNA target sequence
tttttgtttcttttttatcgtattag

SEQ ID NO: 207196 - DNA, 26 bp, Artificial sequence
  SiRNA target sequence
ttttgtttcttttttatcgtattaga

SEQ ID NO: 207197 - DNA, 26 bp, Artificial sequence
  SiRNA target sequence
tttgtttcttttttatcgtattagaa

SEQ ID NO: 207198 - DNA, 26 bp, Artificial sequence
  SiRNA target sequence
ttgtttcttttttatcgtattagaag

SEQ ID NO: 207199 - DNA, 26 bp, Artificial sequence
  SiRNA target sequence
tgtttcttttttatcgtattagaagg

SEQ ID NO: 207200 - DNA, 26 bp, Artificial sequence
  SiRNA target sequence
gtttcttttttatcgtattagaaggt

SEQ ID NO: 207201 - DNA, 26 bp, Artificial sequence
  SiRNA target sequence
tttcttttttatcgtattagaaggta

SEQ ID NO: 207202 - DNA, 26 bp, Artificial sequence
  SiRNA target sequence
ttcttttttatcgtattagaaggtat

SEQ ID NO: 207203 - DNA, 26 bp, Artificial sequence
  SiRNA target sequence
tcttttttatcgtattagaaggtata

SEQ ID NO: 207204 - DNA, 26 bp, Artificial sequence
  SiRNA target sequence
cttttttatcgtattagaaggtataa

SEQ ID NO: 207205 - DNA, 26 bp, Artificial sequence
  SiRNA target sequence
ttttttatcgtattagaaggtataaa

SEQ ID NO: 207206 - DNA, 26 bp, Artificial sequence
  SiRNA target sequence
tttttatcgtattagaaggtataaat

SEQ ID NO: 207207 - DNA, 26 bp, Artificial sequence
  SiRNA target sequence
ttttatcgtattagaaggtataaata

SEQ ID NO: 207208 - DNA, 26 bp, Artificial sequence
  SiRNA target sequence
tttatcgtattagaaggtataaatat

SEQ ID NO: 207209 - DNA, 26 bp, Artificial sequence
  SiRNA target sequence
ttatcgtattagaaggtataaatatt

SEQ ID NO: 207210 - DNA, 26 bp, Artificial sequence
  SiRNA target sequence
tatcgtattagaaggtataaatattg

SEQ ID NO: 207211 - DNA, 26 bp, Artificial sequence
  SiRNA target sequence
atcgtattagaaggtataaatattgg

SEQ ID NO: 207212 - DNA, 26 bp, Artificial sequence
  SiRNA target sequence
tcgtattagaaggtataaatattggt

SEQ ID NO: 207213 - DNA, 26 bp, Artificial sequence
  SiRNA target sequence
cgtattagaaggtataaatattggta

SEQ ID NO: 207214 - DNA, 26 bp, Artificial sequence
  SiRNA target sequence
gtattagaaggtataaatattggtac

SEQ ID NO: 207215 - DNA, 26 bp, Artificial sequence
  SiRNA target sequence
tattagaaggtataaatattggtaca

SEQ ID NO: 207216 - DNA, 26 bp, Artificial sequence
  SiRNA target sequence
attagaaggtataaatattggtacac

SEQ ID NO: 207217 - DNA, 26 bp, Artificial sequence
  SiRNA target sequence
ttagaaggtataaatattggtacact

SEQ ID NO: 207218 - DNA, 26 bp, Artificial sequence
  SiRNA target sequence
tagaaggtataaatattggtacactc

SEQ ID NO: 207219 - DNA, 26 bp, Artificial sequence
  SiRNA target sequence
agaaggtataaatattggtacactca

SEQ ID NO: 207220 - DNA, 26 bp, Artificial sequence
  SiRNA target sequence
gaaggtataaatattggtacactcat

SEQ ID NO: 207221 - DNA, 26 bp, Artificial sequence
  SiRNA target sequence
aaggtataaatattggtacactcatt

SEQ ID NO: 207222 - DNA, 26 bp, Artificial sequence
  SiRNA target sequence
aggtataaatattggtacactcatta

SEQ ID NO: 207223 - DNA, 26 bp, Artificial sequence
  SiRNA target sequence
ggtataaatattggtacactcattat

SEQ ID NO: 207224 - DNA, 26 bp, Artificial sequence
  SiRNA target sequence
gtataaatattggtacactcattatt

SEQ ID NO: 207225 - DNA, 26 bp, Artificial sequence
  SiRNA target sequence
tataaatattggtacactcattattt

SEQ ID NO: 207226 - DNA, 26 bp, Artificial sequence
  SiRNA target sequence
ataaatattggtacactcattatttt

SEQ ID NO: 207227 - DNA, 26 bp, Artificial sequence
  SiRNA target sequence
taaatattggtacactcattatttta

SEQ ID NO: 207228 - DNA, 26 bp, Artificial sequence
  SiRNA target sequence
aaatattggtacactcattattttat

SEQ ID NO: 207229 - DNA, 26 bp, Artificial sequence
  SiRNA target sequence
aatattggtacactcattattttatt

SEQ ID NO: 207230 - DNA, 26 bp, Artificial sequence
  SiRNA target sequence
atattggtacactcattattttattc

SEQ ID NO: 207231 - DNA, 26 bp, Artificial sequence
  SiRNA target sequence
tattggtacactcattattttattct

SEQ ID NO: 207232 - DNA, 26 bp, Artificial sequence
  SiRNA target sequence
attggtacactcattattttattctc

SEQ ID NO: 207233 - DNA, 26 bp, Artificial sequence
  SiRNA target sequence
ttggtacactcattattttattctcg

SEQ ID NO: 207234 - DNA, 26 bp, Artificial sequence
  SiRNA target sequence
tggtacactcattattttattctcga

SEQ ID NO: 207235 - DNA, 26 bp, Artificial sequence
  SiRNA target sequence
ggtacactcattattttattctcgaa

SEQ ID NO: 207236 - DNA, 26 bp, Artificial sequence
  SiRNA target sequence
gtacactcattattttattctcgaaa

SEQ ID NO: 207237 - DNA, 26 bp, Artificial sequence
  SiRNA target sequence
tacactcattattttattctcgaaat

SEQ ID NO: 207238 - DNA, 26 bp, Artificial sequence
  SiRNA target sequence
acactcattattttattctcgaaata

SEQ ID NO: 207239 - DNA, 26 bp, Artificial sequence
  SiRNA target sequence
cactcattattttattctcgaaataa

SEQ ID NO: 207240 - DNA, 26 bp, Artificial sequence
  SiRNA target sequence
actcattattttattctcgaaataat

SEQ ID NO: 207241 - DNA, 26 bp, Artificial sequence
  SiRNA target sequence
ctcattattttattctcgaaataata

SEQ ID NO: 207242 - DNA, 26 bp, Artificial sequence
  SiRNA target sequence
tcattattttattctcgaaataatat

SEQ ID NO: 207243 - DNA, 26 bp, Artificial sequence
  SiRNA target sequence
cattattttattctcgaaataatatt

SEQ ID NO: 207244 - DNA, 26 bp, Artificial sequence
  SiRNA target sequence
attattttattctcgaaataatattt

SEQ ID NO: 207245 - DNA, 26 bp, Artificial sequence
  SiRNA target sequence
ttattttattctcgaaataatatttc

SEQ ID NO: 207246 - DNA, 26 bp, Artificial sequence
  SiRNA target sequence
tattttattctcgaaataatatttca

SEQ ID NO: 207247 - DNA, 26 bp, Artificial sequence
  SiRNA target sequence
attttattctcgaaataatatttcat

SEQ ID NO: 207248 - DNA, 26 bp, Artificial sequence
  SiRNA target sequence
ttttattctcgaaataatatttcatg

SEQ ID NO: 207249 - DNA, 26 bp, Artificial sequence
  SiRNA target sequence
tttattctcgaaataatatttcatgt

SEQ ID NO: 207250 - DNA, 26 bp, Artificial sequence
  SiRNA target sequence
ttattctcgaaataatatttcatgta

SEQ ID NO: 207251 - DNA, 26 bp, Artificial sequence
  SiRNA target sequence
tattctcgaaataatatttcatgtac

SEQ ID NO: 207252 - DNA, 26 bp, Artificial sequence
  SiRNA target sequence
attctcgaaataatatttcatgtaca

SEQ ID NO: 207253 - DNA, 26 bp, Artificial sequence
  SiRNA target sequence
ttctcgaaataatatttcatgtacat

SEQ ID NO: 207254 - DNA, 26 bp, Artificial sequence
  SiRNA target sequence
tctcgaaataatatttcatgtacatt

SEQ ID NO: 207255 - DNA, 26 bp, Artificial sequence
  SiRNA target sequence
ctcgaaataatatttcatgtacatta

SEQ ID NO: 207256 - DNA, 26 bp, Artificial sequence
  SiRNA target sequence
tcgaaataatatttcatgtacattaa

SEQ ID NO: 207257 - DNA, 26 bp, Artificial sequence
  SiRNA target sequence
cgaaataatatttcatgtacattaat

SEQ ID NO: 207258 - DNA, 26 bp, Artificial sequence
  SiRNA target sequence
gaaataatatttcatgtacattaata

SEQ ID NO: 207259 - DNA, 26 bp, Artificial sequence
  SiRNA target sequence
aaataatatttcatgtacattaatat

SEQ ID NO: 207260 - DNA, 26 bp, Artificial sequence
  SiRNA target sequence
aataatatttcatgtacattaatatt

SEQ ID NO: 207261 - DNA, 26 bp, Artificial sequence
  SiRNA target sequence
ataatatttcatgtacattaatatta

SEQ ID NO: 207262 - DNA, 26 bp, Artificial sequence
  SiRNA target sequence
taatatttcatgtacattaatattag

SEQ ID NO: 207263 - DNA, 26 bp, Artificial sequence
  SiRNA target sequence
aatatttcatgtacattaatattaga

SEQ ID NO: 207264 - DNA, 26 bp, Artificial sequence
  SiRNA target sequence
atatttcatgtacattaatattagac

SEQ ID NO: 207265 - DNA, 26 bp, Artificial sequence
  SiRNA target sequence
tatttcatgtacattaatattagaca

SEQ ID NO: 207266 - DNA, 26 bp, Artificial sequence
  SiRNA target sequence
atttcatgtacattaatattagacat

SEQ ID NO: 207267 - DNA, 26 bp, Artificial sequence
  SiRNA target sequence
tttcatgtacattaatattagacata

SEQ ID NO: 207268 - DNA, 26 bp, Artificial sequence
  SiRNA target sequence
ttcatgtacattaatattagacatat

SEQ ID NO: 207269 - DNA, 26 bp, Artificial sequence
  SiRNA target sequence
tcatgtacattaatattagacatata

SEQ ID NO: 207270 - DNA, 26 bp, Artificial sequence
  SiRNA target sequence
catgtacattaatattagacatatac

SEQ ID NO: 207271 - DNA, 26 bp, Artificial sequence
  SiRNA target sequence
atgtacattaatattagacatatacc

SEQ ID NO: 207272 - DNA, 26 bp, Artificial sequence
  SiRNA target sequence
tgtacattaatattagacatataccg

SEQ ID NO: 207273 - DNA, 26 bp, Artificial sequence
  SiRNA target sequence
gtacattaatattagacatataccgc

SEQ ID NO: 207274 - DNA, 26 bp, Artificial sequence
  SiRNA target sequence
tacattaatattagacatataccgcc

SEQ ID NO: 207275 - DNA, 26 bp, Artificial sequence
  SiRNA target sequence
acattaatattagacatataccgccc

SEQ ID NO: 207276 - DNA, 26 bp, Artificial sequence
  SiRNA target sequence
cattaatattagacatataccgccca

SEQ ID NO: 207277 - DNA, 26 bp, Artificial sequence
  SiRNA target sequence
attaatattagacatataccgcccat

SEQ ID NO: 207278 - DNA, 26 bp, Artificial sequence
  SiRNA target sequence
ttaatattagacatataccgcccatg

SEQ ID NO: 207279 - DNA, 26 bp, Artificial sequence
  SiRNA target sequence
taatattagacatataccgcccatgg

SEQ ID NO: 207280 - DNA, 26 bp, Artificial sequence
  SiRNA target sequence
aatattagacatataccgcccatggc

SEQ ID NO: 207281 - DNA, 26 bp, Artificial sequence
  SiRNA target sequence
atattagacatataccgcccatggca

SEQ ID NO: 207282 - DNA, 26 bp, Artificial sequence
  SiRNA target sequence
tattagacatataccgcccatggcaa

SEQ ID NO: 207283 - DNA, 26 bp, Artificial sequence
  SiRNA target sequence
attagacatataccgcccatggcaat

SEQ ID NO: 207284 - DNA, 26 bp, Artificial sequence
  SiRNA target sequence
ttagacatataccgcccatggcaata

SEQ ID NO: 207285 - DNA, 26 bp, Artificial sequence
  SiRNA target sequence
tagacatataccgcccatggcaataa

SEQ ID NO: 207286 - DNA, 26 bp, Artificial sequence
  SiRNA target sequence
agacatataccgcccatggcaataaa

SEQ ID NO: 207287 - DNA, 26 bp, Artificial sequence
  SiRNA target sequence
gacatataccgcccatggcaataaaa

SEQ ID NO: 207288 - DNA, 26 bp, Artificial sequence
  SiRNA target sequence
acatataccgcccatggcaataaaaa

SEQ ID NO: 207289 - DNA, 26 bp, Artificial sequence
  SiRNA target sequence
catataccgcccatggcaataaaaac

SEQ ID NO: 207290 - DNA, 26 bp, Artificial sequence
  SiRNA target sequence
atataccgcccatggcaataaaaacc

SEQ ID NO: 207291 - DNA, 26 bp, Artificial sequence
  SiRNA target sequence
tataccgcccatggcaataaaaaccg

SEQ ID NO: 207292 - DNA, 26 bp, Artificial sequence
  SiRNA target sequence
ataccgcccatggcaataaaaaccga

SEQ ID NO: 207293 - DNA, 26 bp, Artificial sequence
  SiRNA target sequence
taccgcccatggcaataaaaaccgaa

SEQ ID NO: 207294 - DNA, 26 bp, Artificial sequence
  SiRNA target sequence
accgcccatggcaataaaaaccgaag

SEQ ID NO: 207295 - DNA, 26 bp, Artificial sequence
  SiRNA target sequence
ccgcccatggcaataaaaaccgaaga

SEQ ID NO: 207296 - DNA, 26 bp, Artificial sequence
  SiRNA target sequence
cgcccatggcaataaaaaccgaagaa

SEQ ID NO: 207297 - DNA, 26 bp, Artificial sequence
  SiRNA target sequence
gcccatggcaataaaaaccgaagaat

SEQ ID NO: 207298 - DNA, 26 bp, Artificial sequence
  SiRNA target sequence
cccatggcaataaaaaccgaagaata

SEQ ID NO: 207299 - DNA, 26 bp, Artificial sequence
  SiRNA target sequence
ccatggcaataaaaaccgaagaatat

SEQ ID NO: 207300 - DNA, 26 bp, Artificial sequence
  SiRNA target sequence
catggcaataaaaaccgaagaatata

SEQ ID NO: 207301 - DNA, 26 bp, Artificial sequence
  SiRNA target sequence
atggcaataaaaaccgaagaatataa

SEQ ID NO: 207302 - DNA, 26 bp, Artificial sequence
  SiRNA target sequence
tggcaataaaaaccgaagaatataat

SEQ ID NO: 207303 - DNA, 26 bp, Artificial sequence
  SiRNA target sequence
ggcaataaaaaccgaagaatataata

SEQ ID NO: 207304 - DNA, 26 bp, Artificial sequence
  SiRNA target sequence
gcaataaaaaccgaagaatataataa

SEQ ID NO: 207305 - DNA, 26 bp, Artificial sequence
  SiRNA target sequence
caataaaaaccgaagaatataataac

SEQ ID NO: 207306 - DNA, 26 bp, Artificial sequence
  SiRNA target sequence
aataaaaaccgaagaatataataact

SEQ ID NO: 207307 - DNA, 26 bp, Artificial sequence
  SiRNA target sequence
ataaaaaccgaagaatataataactg

SEQ ID NO: 207308 - DNA, 26 bp, Artificial sequence
  SiRNA target sequence
taaaaaccgaagaatataataactga

SEQ ID NO: 207309 - DNA, 26 bp, Artificial sequence
  SiRNA target sequence
aaaaaccgaagaatataataactgat

SEQ ID NO: 207310 - DNA, 26 bp, Artificial sequence
  SiRNA target sequence
aaaaccgaagaatataataactgatt

SEQ ID NO: 207311 - DNA, 26 bp, Artificial sequence
  SiRNA target sequence
aaaccgaagaatataataactgattt

SEQ ID NO: 207312 - DNA, 26 bp, Artificial sequence
  SiRNA target sequence
aaccgaagaatataataactgatttt

SEQ ID NO: 207313 - DNA, 26 bp, Artificial sequence
  SiRNA target sequence
accgaagaatataataactgattttg

SEQ ID NO: 207314 - DNA, 26 bp, Artificial sequence
  SiRNA target sequence
ccgaagaatataataactgattttgc

SEQ ID NO: 207315 - DNA, 26 bp, Artificial sequence
  SiRNA target sequence
cgaagaatataataactgattttgct

SEQ ID NO: 207316 - DNA, 26 bp, Artificial sequence
  SiRNA target sequence
gaagaatataataactgattttgctc

SEQ ID NO: 207317 - DNA, 26 bp, Artificial sequence
  SiRNA target sequence
aagaatataataactgattttgctca

SEQ ID NO: 207318 - DNA, 26 bp, Artificial sequence
  SiRNA target sequence
agaatataataactgattttgctcat

SEQ ID NO: 207319 - DNA, 26 bp, Artificial sequence
  SiRNA target sequence
gaatataataactgattttgctcata

SEQ ID NO: 207320 - DNA, 26 bp, Artificial sequence
  SiRNA target sequence
aatataataactgattttgctcatag

SEQ ID NO: 207321 - DNA, 26 bp, Artificial sequence
  SiRNA target sequence
atataataactgattttgctcatagc

SEQ ID NO: 207322 - DNA, 26 bp, Artificial sequence
  SiRNA target sequence
tataataactgattttgctcatagct

SEQ ID NO: 207323 - DNA, 26 bp, Artificial sequence
  SiRNA target sequence
ataataactgattttgctcatagcta

SEQ ID NO: 207324 - DNA, 26 bp, Artificial sequence
  SiRNA target sequence
taataactgattttgctcatagctaa

SEQ ID NO: 207325 - DNA, 26 bp, Artificial sequence
  SiRNA target sequence
aataactgattttgctcatagctaaa

SEQ ID NO: 207326 - DNA, 26 bp, Artificial sequence
  SiRNA target sequence
ataactgattttgctcatagctaaat

SEQ ID NO: 207327 - DNA, 26 bp, Artificial sequence
  SiRNA target sequence
taactgattttgctcatagctaaatc

SEQ ID NO: 207328 - DNA, 26 bp, Artificial sequence
  SiRNA target sequence
aactgattttgctcatagctaaatcc

SEQ ID NO: 207329 - DNA, 26 bp, Artificial sequence
  SiRNA target sequence
actgattttgctcatagctaaatcct

SEQ ID NO: 207330 - DNA, 26 bp, Artificial sequence
  SiRNA target sequence
ctgattttgctcatagctaaatcctt

SEQ ID NO: 207331 - DNA, 26 bp, Artificial sequence
  SiRNA target sequence
tgattttgctcatagctaaatccttt

SEQ ID NO: 207332 - DNA, 26 bp, Artificial sequence
  SiRNA target sequence
gattttgctcatagctaaatcctttt

SEQ ID NO: 207333 - DNA, 26 bp, Artificial sequence
  SiRNA target sequence
attttgctcatagctaaatccttttc

SEQ ID NO: 207334 - DNA, 26 bp, Artificial sequence
  SiRNA target sequence
ttttgctcatagctaaatccttttcg

SEQ ID NO: 207335 - DNA, 26 bp, Artificial sequence
  SiRNA target sequence
tttgctcatagctaaatccttttcgc

SEQ ID NO: 207336 - DNA, 26 bp, Artificial sequence
  SiRNA target sequence
ttgctcatagctaaatccttttcgca

SEQ ID NO: 207337 - DNA, 26 bp, Artificial sequence
  SiRNA target sequence
tgctcatagctaaatccttttcgcaa

SEQ ID NO: 207338 - DNA, 26 bp, Artificial sequence
  SiRNA target sequence
gctcatagctaaatccttttcgcaat

SEQ ID NO: 207339 - DNA, 26 bp, Artificial sequence
  SiRNA target sequence
ctcatagctaaatccttttcgcaatt

SEQ ID NO: 207340 - DNA, 26 bp, Artificial sequence
  SiRNA target sequence
tcatagctaaatccttttcgcaattc

SEQ ID NO: 207341 - DNA, 26 bp, Artificial sequence
  SiRNA target sequence
catagctaaatccttttcgcaattct

SEQ ID NO: 207342 - DNA, 26 bp, Artificial sequence
  SiRNA target sequence
atagctaaatccttttcgcaattctc

SEQ ID NO: 207343 - DNA, 26 bp, Artificial sequence
  SiRNA target sequence
tagctaaatccttttcgcaattctct

SEQ ID NO: 207344 - DNA, 26 bp, Artificial sequence
  SiRNA target sequence
agctaaatccttttcgcaattctctg

SEQ ID NO: 207345 - DNA, 26 bp, Artificial sequence
  SiRNA target sequence
gctaaatccttttcgcaattctctga

SEQ ID NO: 207346 - DNA, 26 bp, Artificial sequence
  SiRNA target sequence
ctaaatccttttcgcaattctctgaa

SEQ ID NO: 207347 - DNA, 26 bp, Artificial sequence
  SiRNA target sequence
taaatccttttcgcaattctctgaaa

SEQ ID NO: 207348 - DNA, 26 bp, Artificial sequence
  SiRNA target sequence
aaatccttttcgcaattctctgaaag

SEQ ID NO: 207349 - DNA, 26 bp, Artificial sequence
  SiRNA target sequence
aatccttttcgcaattctctgaaaga

SEQ ID NO: 207350 - DNA, 26 bp, Artificial sequence
  SiRNA target sequence
atccttttcgcaattctctgaaagaa

SEQ ID NO: 207351 - DNA, 26 bp, Artificial sequence
  SiRNA target sequence
tccttttcgcaattctctgaaagaac

SEQ ID NO: 207352 - DNA, 26 bp, Artificial sequence
  SiRNA target sequence
ccttttcgcaattctctgaaagaact

SEQ ID NO: 207353 - DNA, 26 bp, Artificial sequence
  SiRNA target sequence
cttttcgcaattctctgaaagaacta

SEQ ID NO: 207354 - DNA, 26 bp, Artificial sequence
  SiRNA target sequence
ttttcgcaattctctgaaagaactac

SEQ ID NO: 207355 - DNA, 26 bp, Artificial sequence
  SiRNA target sequence
tttcgcaattctctgaaagaactact

SEQ ID NO: 207356 - DNA, 26 bp, Artificial sequence
  SiRNA target sequence
ttcgcaattctctgaaagaactactg

SEQ ID NO: 207357 - DNA, 26 bp, Artificial sequence
  SiRNA target sequence
tcgcaattctctgaaagaactactgg

SEQ ID NO: 207358 - DNA, 26 bp, Artificial sequence
  SiRNA target sequence
cgcaattctctgaaagaactactggc

SEQ ID NO: 207359 - DNA, 26 bp, Artificial sequence
  SiRNA target sequence
gcaattctctgaaagaactactggct

SEQ ID NO: 207360 - DNA, 26 bp, Artificial sequence
  SiRNA target sequence
caattctctgaaagaactactggcta

SEQ ID NO: 207361 - DNA, 26 bp, Artificial sequence
  SiRNA target sequence
aattctctgaaagaactactggctaa

SEQ ID NO: 207362 - DNA, 26 bp, Artificial sequence
  SiRNA target sequence
attctctgaaagaactactggctaat

SEQ ID NO: 207363 - DNA, 26 bp, Artificial sequence
  SiRNA target sequence
ttctctgaaagaactactggctaatc

SEQ ID NO: 207364 - DNA, 26 bp, Artificial sequence
  SiRNA target sequence
tctctgaaagaactactggctaatcc

SEQ ID NO: 207365 - DNA, 26 bp, Artificial sequence
  SiRNA target sequence
ctctgaaagaactactggctaatcca

SEQ ID NO: 207366 - DNA, 26 bp, Artificial sequence
  SiRNA target sequence
tctgaaagaactactggctaatccag

SEQ ID NO: 207367 - DNA, 26 bp, Artificial sequence
  SiRNA target sequence
ctgaaagaactactggctaatccaga

SEQ ID NO: 207368 - DNA, 26 bp, Artificial sequence
  SiRNA target sequence
tgaaagaactactggctaatccagat

SEQ ID NO: 207369 - DNA, 26 bp, Artificial sequence
  SiRNA target sequence
gaaagaactactggctaatccagata

SEQ ID NO: 207370 - DNA, 26 bp, Artificial sequence
  SiRNA target sequence
aaagaactactggctaatccagatac

SEQ ID NO: 207371 - DNA, 26 bp, Artificial sequence
  SiRNA target sequence
aagaactactggctaatccagatact

SEQ ID NO: 207372 - DNA, 26 bp, Artificial sequence
  SiRNA target sequence
agaactactggctaatccagatacta

SEQ ID NO: 207373 - DNA, 26 bp, Artificial sequence
  SiRNA target sequence
gaactactggctaatccagatactag

SEQ ID NO: 207374 - DNA, 26 bp, Artificial sequence
  SiRNA target sequence
aactactggctaatccagatactagt

SEQ ID NO: 207375 - DNA, 26 bp, Artificial sequence
  SiRNA target sequence
actactggctaatccagatactagta

SEQ ID NO: 207376 - DNA, 26 bp, Artificial sequence
  SiRNA target sequence
ctactggctaatccagatactagtaa

SEQ ID NO: 207377 - DNA, 26 bp, Artificial sequence
  SiRNA target sequence
tactggctaatccagatactagtaaa

SEQ ID NO: 207378 - DNA, 26 bp, Artificial sequence
  SiRNA target sequence
actggctaatccagatactagtaaag

SEQ ID NO: 207379 - DNA, 26 bp, Artificial sequence
  SiRNA target sequence
ctggctaatccagatactagtaaagc

SEQ ID NO: 207380 - DNA, 26 bp, Artificial sequence
  SiRNA target sequence
tggctaatccagatactagtaaagct

SEQ ID NO: 207381 - DNA, 26 bp, Artificial sequence
  SiRNA target sequence
ggctaatccagatactagtaaagcta

SEQ ID NO: 207382 - DNA, 26 bp, Artificial sequence
  SiRNA target sequence
gctaatccagatactagtaaagctaa

SEQ ID NO: 207383 - DNA, 26 bp, Artificial sequence
  SiRNA target sequence
ctaatccagatactagtaaagctaaa

SEQ ID NO: 207384 - DNA, 26 bp, Artificial sequence
  SiRNA target sequence
taatccagatactagtaaagctaaat

SEQ ID NO: 207385 - DNA, 26 bp, Artificial sequence
  SiRNA target sequence
aatccagatactagtaaagctaaatt

SEQ ID NO: 207386 - DNA, 26 bp, Artificial sequence
  SiRNA target sequence
atccagatactagtaaagctaaattt

SEQ ID NO: 207387 - DNA, 26 bp, Artificial sequence
  SiRNA target sequence
tccagatactagtaaagctaaatttg

SEQ ID NO: 207388 - DNA, 26 bp, Artificial sequence
  SiRNA target sequence
ccagatactagtaaagctaaatttgc

SEQ ID NO: 207389 - DNA, 26 bp, Artificial sequence
  SiRNA target sequence
cagatactagtaaagctaaatttgct

SEQ ID NO: 207390 - DNA, 26 bp, Artificial sequence
  SiRNA target sequence
agatactagtaaagctaaatttgcta

SEQ ID NO: 207391 - DNA, 26 bp, Artificial sequence
  SiRNA target sequence
gatactagtaaagctaaatttgctat

SEQ ID NO: 207392 - DNA, 26 bp, Artificial sequence
  SiRNA target sequence
atactagtaaagctaaatttgctatt

SEQ ID NO: 207393 - DNA, 26 bp, Artificial sequence
  SiRNA target sequence
tactagtaaagctaaatttgctatta

SEQ ID NO: 207394 - DNA, 26 bp, Artificial sequence
  SiRNA target sequence
actagtaaagctaaatttgctattat

SEQ ID NO: 207395 - DNA, 26 bp, Artificial sequence
  SiRNA target sequence
ctagtaaagctaaatttgctattatg

SEQ ID NO: 207396 - DNA, 26 bp, Artificial sequence
  SiRNA target sequence
tagtaaagctaaatttgctattatgt

SEQ ID NO: 207397 - DNA, 26 bp, Artificial sequence
  SiRNA target sequence
agtaaagctaaatttgctattatgta

SEQ ID NO: 207398 - DNA, 26 bp, Artificial sequence
  SiRNA target sequence
gtaaagctaaatttgctattatgtaa

SEQ ID NO: 207399 - DNA, 26 bp, Artificial sequence
  SiRNA target sequence
taaagctaaatttgctattatgtaaa

SEQ ID NO: 207400 - DNA, 26 bp, Artificial sequence
  SiRNA target sequence
aaagctaaatttgctattatgtaaaa

SEQ ID NO: 207401 - DNA, 26 bp, Artificial sequence
  SiRNA target sequence
aagctaaatttgctattatgtaaaaa

SEQ ID NO: 207402 - DNA, 26 bp, Artificial sequence
  SiRNA target sequence
agctaaatttgctattatgtaaaaag

SEQ ID NO: 207403 - DNA, 26 bp, Artificial sequence
  SiRNA target sequence
gctaaatttgctattatgtaaaaagg

SEQ ID NO: 207404 - DNA, 26 bp, Artificial sequence
  SiRNA target sequence
ctaaatttgctattatgtaaaaaggt

SEQ ID NO: 207405 - DNA, 26 bp, Artificial sequence
  SiRNA target sequence
taaatttgctattatgtaaaaaggtg

SEQ ID NO: 207406 - DNA, 26 bp, Artificial sequence
  SiRNA target sequence
aaatttgctattatgtaaaaaggtgg

SEQ ID NO: 207407 - DNA, 26 bp, Artificial sequence
  SiRNA target sequence
aatttgctattatgtaaaaaggtggt

SEQ ID NO: 207408 - DNA, 26 bp, Artificial sequence
  SiRNA target sequence
atttgctattatgtaaaaaggtggta

SEQ ID NO: 207409 - DNA, 26 bp, Artificial sequence
  SiRNA target sequence
tttgctattatgtaaaaaggtggtaa

SEQ ID NO: 207410 - DNA, 26 bp, Artificial sequence
  SiRNA target sequence
ttgctattatgtaaaaaggtggtaaa

SEQ ID NO: 207411 - DNA, 26 bp, Artificial sequence
  SiRNA target sequence
tgctattatgtaaaaaggtggtaaaa

SEQ ID NO: 207412 - DNA, 26 bp, Artificial sequence
  SiRNA target sequence
gctattatgtaaaaaggtggtaaaaa

SEQ ID NO: 207413 - DNA, 26 bp, Artificial sequence
  SiRNA target sequence
ctattatgtaaaaaggtggtaaaaat

SEQ ID NO: 207414 - DNA, 26 bp, Artificial sequence
  SiRNA target sequence
tattatgtaaaaaggtggtaaaaatc

SEQ ID NO: 207415 - DNA, 26 bp, Artificial sequence
  SiRNA target sequence
attatgtaaaaaggtggtaaaaatct

SEQ ID NO: 207416 - DNA, 26 bp, Artificial sequence
  SiRNA target sequence
ttatgtaaaaaggtggtaaaaatctt

SEQ ID NO: 207417 - DNA, 26 bp, Artificial sequence
  SiRNA target sequence
tatgtaaaaaggtggtaaaaatcttg

SEQ ID NO: 207418 - DNA, 26 bp, Artificial sequence
  SiRNA target sequence
atgtaaaaaggtggtaaaaatcttgt

SEQ ID NO: 207419 - DNA, 26 bp, Artificial sequence
  SiRNA target sequence
tgtaaaaaggtggtaaaaatcttgta

SEQ ID NO: 207420 - DNA, 26 bp, Artificial sequence
  SiRNA target sequence
gtaaaaaggtggtaaaaatcttgtaa

SEQ ID NO: 207421 - DNA, 26 bp, Artificial sequence
  SiRNA target sequence
taaaaaggtggtaaaaatcttgtaaa

SEQ ID NO: 207422 - DNA, 26 bp, Artificial sequence
  SiRNA target sequence
aaaaaggtggtaaaaatcttgtaaac

SEQ ID NO: 207423 - DNA, 26 bp, Artificial sequence
  SiRNA target sequence
aaaaggtggtaaaaatcttgtaaact

SEQ ID NO: 207424 - DNA, 26 bp, Artificial sequence
  SiRNA target sequence
aaaggtggtaaaaatcttgtaaactg

SEQ ID NO: 207425 - DNA, 26 bp, Artificial sequence
  SiRNA target sequence
aaggtggtaaaaatcttgtaaactgt

SEQ ID NO: 207426 - DNA, 26 bp, Artificial sequence
  SiRNA target sequence
aggtggtaaaaatcttgtaaactgtc

SEQ ID NO: 207427 - DNA, 26 bp, Artificial sequence
  SiRNA target sequence
ggtggtaaaaatcttgtaaactgtct

SEQ ID NO: 207428 - DNA, 26 bp, Artificial sequence
  SiRNA target sequence
gtggtaaaaatcttgtaaactgtctg

SEQ ID NO: 207429 - DNA, 26 bp, Artificial sequence
  SiRNA target sequence
tggtaaaaatcttgtaaactgtctga

SEQ ID NO: 207430 - DNA, 26 bp, Artificial sequence
  SiRNA target sequence
ggtaaaaatcttgtaaactgtctgat

SEQ ID NO: 207431 - DNA, 26 bp, Artificial sequence
  SiRNA target sequence
gtaaaaatcttgtaaactgtctgata

SEQ ID NO: 207432 - DNA, 26 bp, Artificial sequence
  SiRNA target sequence
taaaaatcttgtaaactgtctgatag

SEQ ID NO: 207433 - DNA, 26 bp, Artificial sequence
  SiRNA target sequence
aaaaatcttgtaaactgtctgatagt

SEQ ID NO: 207434 - DNA, 26 bp, Artificial sequence
  SiRNA target sequence
aaaatcttgtaaactgtctgatagta

SEQ ID NO: 207435 - DNA, 26 bp, Artificial sequence
  SiRNA target sequence
aaatcttgtaaactgtctgatagtac

SEQ ID NO: 207436 - DNA, 26 bp, Artificial sequence
  SiRNA target sequence
aatcttgtaaactgtctgatagtaca

SEQ ID NO: 207437 - DNA, 26 bp, Artificial sequence
  SiRNA target sequence
atcttgtaaactgtctgatagtacaa

SEQ ID NO: 207438 - DNA, 26 bp, Artificial sequence
  SiRNA target sequence
tcttgtaaactgtctgatagtacaac

SEQ ID NO: 207439 - DNA, 26 bp, Artificial sequence
  SiRNA target sequence
cttgtaaactgtctgatagtacaact

SEQ ID NO: 207440 - DNA, 26 bp, Artificial sequence
  SiRNA target sequence
ttgtaaactgtctgatagtacaactt

SEQ ID NO: 207441 - DNA, 26 bp, Artificial sequence
  SiRNA target sequence
tgtaaactgtctgatagtacaacttt

SEQ ID NO: 207442 - DNA, 26 bp, Artificial sequence
  SiRNA target sequence
gtaaactgtctgatagtacaactttc

SEQ ID NO: 207443 - DNA, 26 bp, Artificial sequence
  SiRNA target sequence
taaactgtctgatagtacaactttca

SEQ ID NO: 207444 - DNA, 26 bp, Artificial sequence
  SiRNA target sequence
aaactgtctgatagtacaactttcat

SEQ ID NO: 207445 - DNA, 26 bp, Artificial sequence
  SiRNA target sequence
aactgtctgatagtacaactttcatt

SEQ ID NO: 207446 - DNA, 26 bp, Artificial sequence
  SiRNA target sequence
actgtctgatagtacaactttcattt

SEQ ID NO: 207447 - DNA, 26 bp, Artificial sequence
  SiRNA target sequence
ctgtctgatagtacaactttcattta

SEQ ID NO: 207448 - DNA, 26 bp, Artificial sequence
  SiRNA target sequence
tgtctgatagtacaactttcatttaa

SEQ ID NO: 207449 - DNA, 26 bp, Artificial sequence
  SiRNA target sequence
gtctgatagtacaactttcatttaaa

SEQ ID NO: 207450 - DNA, 26 bp, Artificial sequence
  SiRNA target sequence
tctgatagtacaactttcatttaaaa

SEQ ID NO: 207451 - DNA, 26 bp, Artificial sequence
  SiRNA target sequence
ctgatagtacaactttcatttaaaaa

SEQ ID NO: 207452 - DNA, 26 bp, Artificial sequence
  SiRNA target sequence
tgatagtacaactttcatttaaaaaa

SEQ ID NO: 207453 - DNA, 26 bp, Artificial sequence
  SiRNA target sequence
gatagtacaactttcatttaaaaaac

SEQ ID NO: 207454 - DNA, 26 bp, Artificial sequence
  SiRNA target sequence
atagtacaactttcatttaaaaaact

SEQ ID NO: 207455 - DNA, 26 bp, Artificial sequence
  SiRNA target sequence
tagtacaactttcatttaaaaaactc

SEQ ID NO: 207456 - DNA, 26 bp, Artificial sequence
  SiRNA target sequence
agtacaactttcatttaaaaaactca

SEQ ID NO: 207457 - DNA, 26 bp, Artificial sequence
  SiRNA target sequence
gtacaactttcatttaaaaaactcat

SEQ ID NO: 207458 - DNA, 26 bp, Artificial sequence
  SiRNA target sequence
tacaactttcatttaaaaaactcatg

SEQ ID NO: 207459 - DNA, 26 bp, Artificial sequence
  SiRNA target sequence
acaactttcatttaaaaaactcatgt

SEQ ID NO: 207460 - DNA, 26 bp, Artificial sequence
  SiRNA target sequence
caactttcatttaaaaaactcatgta

SEQ ID NO: 207461 - DNA, 26 bp, Artificial sequence
  SiRNA target sequence
aactttcatttaaaaaactcatgtat

SEQ ID NO: 207462 - DNA, 26 bp, Artificial sequence
  SiRNA target sequence
actttcatttaaaaaactcatgtata

SEQ ID NO: 207463 - DNA, 26 bp, Artificial sequence
  SiRNA target sequence
ctttcatttaaaaaactcatgtataa

SEQ ID NO: 207464 - DNA, 26 bp, Artificial sequence
  SiRNA target sequence
tttcatttaaaaaactcatgtataaa

SEQ ID NO: 207465 - DNA, 26 bp, Artificial sequence
  SiRNA target sequence
ttcatttaaaaaactcatgtataaat

SEQ ID NO: 207466 - DNA, 26 bp, Artificial sequence
  SiRNA target sequence
tcatttaaaaaactcatgtataaata

SEQ ID NO: 207467 - DNA, 26 bp, Artificial sequence
  SiRNA target sequence
catttaaaaaactcatgtataaataa

SEQ ID NO: 207468 - DNA, 26 bp, Artificial sequence
  SiRNA target sequence
atttaaaaaactcatgtataaataag

SEQ ID NO: 207469 - DNA, 26 bp, Artificial sequence
  SiRNA target sequence
tttaaaaaactcatgtataaataagc

SEQ ID NO: 207470 - DNA, 26 bp, Artificial sequence
  SiRNA target sequence
ttaaaaaactcatgtataaataagcc

SEQ ID NO: 207471 - DNA, 26 bp, Artificial sequence
  SiRNA target sequence
taaaaaactcatgtataaataagcca

SEQ ID NO: 207472 - DNA, 26 bp, Artificial sequence
  SiRNA target sequence
aaaaaactcatgtataaataagccat

SEQ ID NO: 207473 - DNA, 26 bp, Artificial sequence
  SiRNA target sequence
aaaaactcatgtataaataagccata

SEQ ID NO: 207474 - DNA, 26 bp, Artificial sequence
  SiRNA target sequence
aaaactcatgtataaataagccataa

SEQ ID NO: 207475 - DNA, 26 bp, Artificial sequence
  SiRNA target sequence
aaactcatgtataaataagccataag

SEQ ID NO: 207476 - DNA, 26 bp, Artificial sequence
  SiRNA target sequence
aactcatgtataaataagccataagt

SEQ ID NO: 207477 - DNA, 26 bp, Artificial sequence
  SiRNA target sequence
actcatgtataaataagccataagta

SEQ ID NO: 207478 - DNA, 26 bp, Artificial sequence
  SiRNA target sequence
ctcatgtataaataagccataagtaa

SEQ ID NO: 207479 - DNA, 26 bp, Artificial sequence
  SiRNA target sequence
tcatgtataaataagccataagtaaa

SEQ ID NO: 207480 - DNA, 26 bp, Artificial sequence
  SiRNA target sequence
catgtataaataagccataagtaaac

SEQ ID NO: 207481 - DNA, 26 bp, Artificial sequence
  SiRNA target sequence
atgtataaataagccataagtaaact

SEQ ID NO: 207482 - DNA, 26 bp, Artificial sequence
  SiRNA target sequence
tgtataaataagccataagtaaactg

SEQ ID NO: 207483 - DNA, 26 bp, Artificial sequence
  SiRNA target sequence
gtataaataagccataagtaaactgc

SEQ ID NO: 207484 - DNA, 26 bp, Artificial sequence
  SiRNA target sequence
tataaataagccataagtaaactgcc

SEQ ID NO: 207485 - DNA, 26 bp, Artificial sequence
  SiRNA target sequence
ataaataagccataagtaaactgccc

SEQ ID NO: 207486 - DNA, 26 bp, Artificial sequence
  SiRNA target sequence
taaataagccataagtaaactgcccc

SEQ ID NO: 207487 - DNA, 26 bp, Artificial sequence
  SiRNA target sequence
aaataagccataagtaaactgcccca

SEQ ID NO: 207488 - DNA, 26 bp, Artificial sequence
  SiRNA target sequence
aataagccataagtaaactgccccac

SEQ ID NO: 207489 - DNA, 26 bp, Artificial sequence
  SiRNA target sequence
ataagccataagtaaactgccccaca

SEQ ID NO: 207490 - DNA, 26 bp, Artificial sequence
  SiRNA target sequence
taagccataagtaaactgccccacat

SEQ ID NO: 207491 - DNA, 26 bp, Artificial sequence
  SiRNA target sequence
aagccataagtaaactgccccacatt

SEQ ID NO: 207492 - DNA, 26 bp, Artificial sequence
  SiRNA target sequence
agccataagtaaactgccccacattt

SEQ ID NO: 207493 - DNA, 26 bp, Artificial sequence
  SiRNA target sequence
gccataagtaaactgccccacatttc

SEQ ID NO: 207494 - DNA, 26 bp, Artificial sequence
  SiRNA target sequence
ccataagtaaactgccccacatttct

SEQ ID NO: 207495 - DNA, 26 bp, Artificial sequence
  SiRNA target sequence
cataagtaaactgccccacatttctg

SEQ ID NO: 207496 - DNA, 26 bp, Artificial sequence
  SiRNA target sequence
ataagtaaactgccccacatttctgc

SEQ ID NO: 207497 - DNA, 26 bp, Artificial sequence
  SiRNA target sequence
taagtaaactgccccacatttctgct

SEQ ID NO: 207498 - DNA, 26 bp, Artificial sequence
  SiRNA target sequence
aagtaaactgccccacatttctgcta

SEQ ID NO: 207499 - DNA, 26 bp, Artificial sequence
  SiRNA target sequence
agtaaactgccccacatttctgctat

SEQ ID NO: 207500 - DNA, 26 bp, Artificial sequence
  SiRNA target sequence
gtaaactgccccacatttctgctatt

SEQ ID NO: 207501 - DNA, 26 bp, Artificial sequence
  SiRNA target sequence
taaactgccccacatttctgctatta

SEQ ID NO: 207502 - DNA, 26 bp, Artificial sequence
  SiRNA target sequence
aaactgccccacatttctgctattat

SEQ ID NO: 207503 - DNA, 26 bp, Artificial sequence
  SiRNA target sequence
aactgccccacatttctgctattata

SEQ ID NO: 207504 - DNA, 26 bp, Artificial sequence
  SiRNA target sequence
actgccccacatttctgctattataa

SEQ ID NO: 207505 - DNA, 26 bp, Artificial sequence
  SiRNA target sequence
ctgccccacatttctgctattataaa

SEQ ID NO: 207506 - DNA, 26 bp, Artificial sequence
  SiRNA target sequence
tgccccacatttctgctattataaaa

SEQ ID NO: 207507 - DNA, 26 bp, Artificial sequence
  SiRNA target sequence
gccccacatttctgctattataaaaa

SEQ ID NO: 207508 - DNA, 26 bp, Artificial sequence
  SiRNA target sequence
ccccacatttctgctattataaaaat

SEQ ID NO: 207509 - DNA, 26 bp, Artificial sequence
  SiRNA target sequence
cccacatttctgctattataaaaata

SEQ ID NO: 207510 - DNA, 26 bp, Artificial sequence
  SiRNA target sequence
ccacatttctgctattataaaaatac

SEQ ID NO: 207511 - DNA, 26 bp, Artificial sequence
  SiRNA target sequence
cacatttctgctattataaaaataca

SEQ ID NO: 207512 - DNA, 26 bp, Artificial sequence
  SiRNA target sequence
acatttctgctattataaaaatacaa

SEQ ID NO: 207513 - DNA, 26 bp, Artificial sequence
  SiRNA target sequence
catttctgctattataaaaatacaag

SEQ ID NO: 207514 - DNA, 26 bp, Artificial sequence
  SiRNA target sequence
atttctgctattataaaaatacaagt

SEQ ID NO: 207515 - DNA, 26 bp, Artificial sequence
  SiRNA target sequence
tttctgctattataaaaatacaagtt

SEQ ID NO: 207516 - DNA, 26 bp, Artificial sequence
  SiRNA target sequence
ttctgctattataaaaatacaagttg

SEQ ID NO: 207517 - DNA, 26 bp, Artificial sequence
  SiRNA target sequence
tctgctattataaaaatacaagttga

SEQ ID NO: 207518 - DNA, 26 bp, Artificial sequence
  SiRNA target sequence
ctgctattataaaaatacaagttgaa

SEQ ID NO: 207519 - DNA, 26 bp, Artificial sequence
  SiRNA target sequence
tgctattataaaaatacaagttgaaa

SEQ ID NO: 207520 - DNA, 26 bp, Artificial sequence
  SiRNA target sequence
gctattataaaaatacaagttgaaac

SEQ ID NO: 207521 - DNA, 26 bp, Artificial sequence
  SiRNA target sequence
ctattataaaaatacaagttgaaacg

SEQ ID NO: 207522 - DNA, 26 bp, Artificial sequence
  SiRNA target sequence
tattataaaaatacaagttgaaacgg

SEQ ID NO: 207523 - DNA, 26 bp, Artificial sequence
  SiRNA target sequence
attataaaaatacaagttgaaacggg

SEQ ID NO: 207524 - DNA, 26 bp, Artificial sequence
  SiRNA target sequence
ttataaaaatacaagttgaaacgggc

SEQ ID NO: 207525 - DNA, 26 bp, Artificial sequence
  SiRNA target sequence
tataaaaatacaagttgaaacgggct

SEQ ID NO: 207526 - DNA, 26 bp, Artificial sequence
  SiRNA target sequence
ataaaaatacaagttgaaacgggctc

SEQ ID NO: 207527 - DNA, 26 bp, Artificial sequence
  SiRNA target sequence
taaaaatacaagttgaaacgggctcg

SEQ ID NO: 207528 - DNA, 26 bp, Artificial sequence
  SiRNA target sequence
aaaaatacaagttgaaacgggctcgt

SEQ ID NO: 207529 - DNA, 26 bp, Artificial sequence
  SiRNA target sequence
aaaatacaagttgaaacgggctcgtt

SEQ ID NO: 207530 - DNA, 26 bp, Artificial sequence
  SiRNA target sequence
aaatacaagttgaaacgggctcgtta

SEQ ID NO: 207531 - DNA, 26 bp, Artificial sequence
  SiRNA target sequence
aatacaagttgaaacgggctcgttag

SEQ ID NO: 207532 - DNA, 26 bp, Artificial sequence
  SiRNA target sequence
atacaagttgaaacgggctcgttagc

SEQ ID NO: 207533 - DNA, 26 bp, Artificial sequence
  SiRNA target sequence
tacaagttgaaacgggctcgttagct

SEQ ID NO: 207534 - DNA, 26 bp, Artificial sequence
  SiRNA target sequence
acaagttgaaacgggctcgttagctg

SEQ ID NO: 207535 - DNA, 26 bp, Artificial sequence
  SiRNA target sequence
caagttgaaacgggctcgttagctgt

SEQ ID NO: 207536 - DNA, 26 bp, Artificial sequence
  SiRNA target sequence
aagttgaaacgggctcgttagctgta

SEQ ID NO: 207537 - DNA, 26 bp, Artificial sequence
  SiRNA target sequence
agttgaaacgggctcgttagctgtaa

SEQ ID NO: 207538 - DNA, 26 bp, Artificial sequence
  SiRNA target sequence
gttgaaacgggctcgttagctgtaat

SEQ ID NO: 207539 - DNA, 26 bp, Artificial sequence
  SiRNA target sequence
ttgaaacgggctcgttagctgtaatt

SEQ ID NO: 207540 - DNA, 26 bp, Artificial sequence
  SiRNA target sequence
tgaaacgggctcgttagctgtaatta

SEQ ID NO: 207541 - DNA, 26 bp, Artificial sequence
  SiRNA target sequence
gaaacgggctcgttagctgtaattaa

SEQ ID NO: 207542 - DNA, 26 bp, Artificial sequence
  SiRNA target sequence
aaacgggctcgttagctgtaattaaa

SEQ ID NO: 207543 - DNA, 26 bp, Artificial sequence
  SiRNA target sequence
aacgggctcgttagctgtaattaaaa

SEQ ID NO: 207544 - DNA, 26 bp, Artificial sequence
  SiRNA target sequence
acgggctcgttagctgtaattaaaaa

SEQ ID NO: 207545 - DNA, 26 bp, Artificial sequence
  SiRNA target sequence
cgggctcgttagctgtaattaaaaaa

SEQ ID NO: 207546 - DNA, 26 bp, Artificial sequence
  SiRNA target sequence
gggctcgttagctgtaattaaaaaat

SEQ ID NO: 207547 - DNA, 26 bp, Artificial sequence
  SiRNA target sequence
ggctcgttagctgtaattaaaaaata

SEQ ID NO: 207548 - DNA, 26 bp, Artificial sequence
  SiRNA target sequence
gctcgttagctgtaattaaaaaatat

SEQ ID NO: 207549 - DNA, 26 bp, Artificial sequence
  SiRNA target sequence
ctcgttagctgtaattaaaaaatatt

SEQ ID NO: 207550 - DNA, 26 bp, Artificial sequence
  SiRNA target sequence
tcgttagctgtaattaaaaaatattt

SEQ ID NO: 207551 - DNA, 26 bp, Artificial sequence
  SiRNA target sequence
cgttagctgtaattaaaaaatatttt

SEQ ID NO: 207552 - DNA, 26 bp, Artificial sequence
  SiRNA target sequence
gttagctgtaattaaaaaatatttta

SEQ ID NO: 207553 - DNA, 26 bp, Artificial sequence
  SiRNA target sequence
ttagctgtaattaaaaaatattttat

SEQ ID NO: 207554 - DNA, 26 bp, Artificial sequence
  SiRNA target sequence
tagctgtaattaaaaaatattttata

SEQ ID NO: 207555 - DNA, 26 bp, Artificial sequence
  SiRNA target sequence
agctgtaattaaaaaatattttataa

SEQ ID NO: 207556 - DNA, 26 bp, Artificial sequence
  SiRNA target sequence
gctgtaattaaaaaatattttataaa

SEQ ID NO: 207557 - DNA, 26 bp, Artificial sequence
  SiRNA target sequence
ctgtaattaaaaaatattttataaag

SEQ ID NO: 207558 - DNA, 26 bp, Artificial sequence
  SiRNA target sequence
tgtaattaaaaaatattttataaagt

SEQ ID NO: 207559 - DNA, 26 bp, Artificial sequence
  SiRNA target sequence
gtaattaaaaaatattttataaagtt

SEQ ID NO: 207560 - DNA, 26 bp, Artificial sequence
  SiRNA target sequence
taattaaaaaatattttataaagttc

SEQ ID NO: 207561 - DNA, 26 bp, Artificial sequence
  SiRNA target sequence
aattaaaaaatattttataaagttca

SEQ ID NO: 207562 - DNA, 26 bp, Artificial sequence
  SiRNA target sequence
attaaaaaatattttataaagttcaa

SEQ ID NO: 207563 - DNA, 26 bp, Artificial sequence
  SiRNA target sequence
ttaaaaaatattttataaagttcaat

SEQ ID NO: 207564 - DNA, 26 bp, Artificial sequence
  SiRNA target sequence
taaaaaatattttataaagttcaatc

SEQ ID NO: 207565 - DNA, 26 bp, Artificial sequence
  SiRNA target sequence
aaaaaatattttataaagttcaatcc

SEQ ID NO: 207566 - DNA, 26 bp, Artificial sequence
  SiRNA target sequence
aaaaatattttataaagttcaatccc

SEQ ID NO: 207567 - DNA, 26 bp, Artificial sequence
  SiRNA target sequence
aaaatattttataaagttcaatccct

SEQ ID NO: 207568 - DNA, 26 bp, Artificial sequence
  SiRNA target sequence
aaatattttataaagttcaatccctt

SEQ ID NO: 207569 - DNA, 26 bp, Artificial sequence
  SiRNA target sequence
aatattttataaagttcaatcccttc

SEQ ID NO: 207570 - DNA, 26 bp, Artificial sequence
  SiRNA target sequence
atattttataaagttcaatcccttca

SEQ ID NO: 207571 - DNA, 26 bp, Artificial sequence
  SiRNA target sequence
tattttataaagttcaatcccttcaa

SEQ ID NO: 207572 - DNA, 26 bp, Artificial sequence
  SiRNA target sequence
attttataaagttcaatcccttcaat

SEQ ID NO: 207573 - DNA, 26 bp, Artificial sequence
  SiRNA target sequence
ttttataaagttcaatcccttcaatg

SEQ ID NO: 207574 - DNA, 26 bp, Artificial sequence
  SiRNA target sequence
tttataaagttcaatcccttcaatgc

SEQ ID NO: 207575 - DNA, 26 bp, Artificial sequence
  SiRNA target sequence
ttataaagttcaatcccttcaatgca

SEQ ID NO: 207576 - DNA, 26 bp, Artificial sequence
  SiRNA target sequence
tataaagttcaatcccttcaatgcac

SEQ ID NO: 207577 - DNA, 26 bp, Artificial sequence
  SiRNA target sequence
ataaagttcaatcccttcaatgcacc

SEQ ID NO: 207578 - DNA, 26 bp, Artificial sequence
  SiRNA target sequence
taaagttcaatcccttcaatgcacct

SEQ ID NO: 207579 - DNA, 26 bp, Artificial sequence
  SiRNA target sequence
aaagttcaatcccttcaatgcacctt

SEQ ID NO: 207580 - DNA, 26 bp, Artificial sequence
  SiRNA target sequence
aagttcaatcccttcaatgcaccttt

SEQ ID NO: 207581 - DNA, 26 bp, Artificial sequence
  SiRNA target sequence
agttcaatcccttcaatgcacctttg

SEQ ID NO: 207582 - DNA, 26 bp, Artificial sequence
  SiRNA target sequence
gttcaatcccttcaatgcacctttgt

SEQ ID NO: 207583 - DNA, 26 bp, Artificial sequence
  SiRNA target sequence
ttcaatcccttcaatgcacctttgtt

SEQ ID NO: 207584 - DNA, 26 bp, Artificial sequence
  SiRNA target sequence
tcaatcccttcaatgcacctttgtta

SEQ ID NO: 207585 - DNA, 26 bp, Artificial sequence
  SiRNA target sequence
caatcccttcaatgcacctttgttat

SEQ ID NO: 207586 - DNA, 26 bp, Artificial sequence
  SiRNA target sequence
aatcccttcaatgcacctttgttatc

SEQ ID NO: 207587 - DNA, 26 bp, Artificial sequence
  SiRNA target sequence
atcccttcaatgcacctttgttatca

SEQ ID NO: 207588 - DNA, 26 bp, Artificial sequence
  SiRNA target sequence
tcccttcaatgcacctttgttatcag

SEQ ID NO: 207589 - DNA, 26 bp, Artificial sequence
  SiRNA target sequence
cccttcaatgcacctttgttatcagc

SEQ ID NO: 207590 - DNA, 26 bp, Artificial sequence
  SiRNA target sequence
ccttcaatgcacctttgttatcagcg

SEQ ID NO: 207591 - DNA, 26 bp, Artificial sequence
  SiRNA target sequence
cttcaatgcacctttgttatcagcga

SEQ ID NO: 207592 - DNA, 26 bp, Artificial sequence
  SiRNA target sequence
ttcaatgcacctttgttatcagcgaa

SEQ ID NO: 207593 - DNA, 26 bp, Artificial sequence
  SiRNA target sequence
tcaatgcacctttgttatcagcgaaa

SEQ ID NO: 207594 - DNA, 26 bp, Artificial sequence
  SiRNA target sequence
caatgcacctttgttatcagcgaaaa

SEQ ID NO: 207595 - DNA, 26 bp, Artificial sequence
  SiRNA target sequence
aatgcacctttgttatcagcgaaaat

SEQ ID NO: 207596 - DNA, 26 bp, Artificial sequence
  SiRNA target sequence
atgcacctttgttatcagcgaaaata

SEQ ID NO: 207597 - DNA, 26 bp, Artificial sequence
  SiRNA target sequence
tgcacctttgttatcagcgaaaatat

SEQ ID NO: 207598 - DNA, 26 bp, Artificial sequence
  SiRNA target sequence
gcacctttgttatcagcgaaaatatc

SEQ ID NO: 207599 - DNA, 26 bp, Artificial sequence
  SiRNA target sequence
cacctttgttatcagcgaaaatatct

SEQ ID NO: 207600 - DNA, 26 bp, Artificial sequence
  SiRNA target sequence
acctttgttatcagcgaaaatatctc

SEQ ID NO: 207601 - DNA, 26 bp, Artificial sequence
  SiRNA target sequence
cctttgttatcagcgaaaatatctct

SEQ ID NO: 207602 - DNA, 26 bp, Artificial sequence
  SiRNA target sequence
ctttgttatcagcgaaaatatctcta

SEQ ID NO: 207603 - DNA, 26 bp, Artificial sequence
  SiRNA target sequence
tttgttatcagcgaaaatatctctaa

SEQ ID NO: 207604 - DNA, 26 bp, Artificial sequence
  SiRNA target sequence
ttgttatcagcgaaaatatctctaaa

SEQ ID NO: 207605 - DNA, 26 bp, Artificial sequence
  SiRNA target sequence
tgttatcagcgaaaatatctctaaat

SEQ ID NO: 207606 - DNA, 26 bp, Artificial sequence
  SiRNA target sequence
gttatcagcgaaaatatctctaaata

SEQ ID NO: 207607 - DNA, 26 bp, Artificial sequence
  SiRNA target sequence
ttatcagcgaaaatatctctaaataa

SEQ ID NO: 207608 - DNA, 26 bp, Artificial sequence
  SiRNA target sequence
tatcagcgaaaatatctctaaataaa

SEQ ID NO: 207609 - DNA, 26 bp, Artificial sequence
  SiRNA target sequence
atcagcgaaaatatctctaaataaaa

SEQ ID NO: 207610 - DNA, 26 bp, Artificial sequence
  SiRNA target sequence
tcagcgaaaatatctctaaataaaaa

SEQ ID NO: 207611 - DNA, 26 bp, Artificial sequence
  SiRNA target sequence
cagcgaaaatatctctaaataaaaag

SEQ ID NO: 207612 - DNA, 26 bp, Artificial sequence
  SiRNA target sequence
agcgaaaatatctctaaataaaaagc

SEQ ID NO: 207613 - DNA, 26 bp, Artificial sequence
  SiRNA target sequence
gcgaaaatatctctaaataaaaagct

SEQ ID NO: 207614 - DNA, 26 bp, Artificial sequence
  SiRNA target sequence
cgaaaatatctctaaataaaaagcta

SEQ ID NO: 207615 - DNA, 26 bp, Artificial sequence
  SiRNA target sequence
gaaaatatctctaaataaaaagctag

SEQ ID NO: 207616 - DNA, 26 bp, Artificial sequence
  SiRNA target sequence
aaaatatctctaaataaaaagctaga

SEQ ID NO: 207617 - DNA, 26 bp, Artificial sequence
  SiRNA target sequence
aaatatctctaaataaaaagctagat

SEQ ID NO: 207618 - DNA, 26 bp, Artificial sequence
  SiRNA target sequence
aatatctctaaataaaaagctagatg

SEQ ID NO: 207619 - DNA, 26 bp, Artificial sequence
  SiRNA target sequence
atatctctaaataaaaagctagatgg

SEQ ID NO: 207620 - DNA, 26 bp, Artificial sequence
  SiRNA target sequence
tatctctaaataaaaagctagatggt

SEQ ID NO: 207621 - DNA, 26 bp, Artificial sequence
  SiRNA target sequence
atctctaaataaaaagctagatggtg

SEQ ID NO: 207622 - DNA, 26 bp, Artificial sequence
  SiRNA target sequence
tctctaaataaaaagctagatggtgt

SEQ ID NO: 207623 - DNA, 26 bp, Artificial sequence
  SiRNA target sequence
ctctaaataaaaagctagatggtgtt

SEQ ID NO: 207624 - DNA, 26 bp, Artificial sequence
  SiRNA target sequence
tctaaataaaaagctagatggtgtta

SEQ ID NO: 207625 - DNA, 26 bp, Artificial sequence
  SiRNA target sequence
ctaaataaaaagctagatggtgttac

SEQ ID NO: 207626 - DNA, 26 bp, Artificial sequence
  SiRNA target sequence
taaataaaaagctagatggtgttact

SEQ ID NO: 207627 - DNA, 26 bp, Artificial sequence
  SiRNA target sequence
aaataaaaagctagatggtgttactt

SEQ ID NO: 207628 - DNA, 26 bp, Artificial sequence
  SiRNA target sequence
aataaaaagctagatggtgttacttt

SEQ ID NO: 207629 - DNA, 26 bp, Artificial sequence
  SiRNA target sequence
ataaaaagctagatggtgttactttc

SEQ ID NO: 207630 - DNA, 26 bp, Artificial sequence
  SiRNA target sequence
taaaaagctagatggtgttactttct

SEQ ID NO: 207631 - DNA, 26 bp, Artificial sequence
  SiRNA target sequence
aaaaagctagatggtgttactttctc

SEQ ID NO: 207632 - DNA, 26 bp, Artificial sequence
  SiRNA target sequence
aaaagctagatggtgttactttctct

SEQ ID NO: 207633 - DNA, 26 bp, Artificial sequence
  SiRNA target sequence
aaagctagatggtgttactttctctt

SEQ ID NO: 207634 - DNA, 26 bp, Artificial sequence
  SiRNA target sequence
aagctagatggtgttactttctcttc

SEQ ID NO: 207635 - DNA, 26 bp, Artificial sequence
  SiRNA target sequence
agctagatggtgttactttctcttca

SEQ ID NO: 207636 - DNA, 26 bp, Artificial sequence
  SiRNA target sequence
gctagatggtgttactttctcttcaa

SEQ ID NO: 207637 - DNA, 26 bp, Artificial sequence
  SiRNA target sequence
ctagatggtgttactttctcttcaaa

SEQ ID NO: 207638 - DNA, 26 bp, Artificial sequence
  SiRNA target sequence
tagatggtgttactttctcttcaaac

SEQ ID NO: 207639 - DNA, 26 bp, Artificial sequence
  SiRNA target sequence
agatggtgttactttctcttcaaaca

SEQ ID NO: 207640 - DNA, 26 bp, Artificial sequence
  SiRNA target sequence
gatggtgttactttctcttcaaacaa

SEQ ID NO: 207641 - DNA, 26 bp, Artificial sequence
  SiRNA target sequence
atggtgttactttctcttcaaacaaa

SEQ ID NO: 207642 - DNA, 26 bp, Artificial sequence
  SiRNA target sequence
tggtgttactttctcttcaaacaaaa

SEQ ID NO: 207643 - DNA, 26 bp, Artificial sequence
  SiRNA target sequence
ggtgttactttctcttcaaacaaaaa

SEQ ID NO: 207644 - DNA, 26 bp, Artificial sequence
  SiRNA target sequence
gtgttactttctcttcaaacaaaaag

SEQ ID NO: 207645 - DNA, 26 bp, Artificial sequence
  SiRNA target sequence
tgttactttctcttcaaacaaaaaga

SEQ ID NO: 207646 - DNA, 26 bp, Artificial sequence
  SiRNA target sequence
gttactttctcttcaaacaaaaagat

SEQ ID NO: 207647 - DNA, 26 bp, Artificial sequence
  SiRNA target sequence
ttactttctcttcaaacaaaaagatt

SEQ ID NO: 207648 - DNA, 26 bp, Artificial sequence
  SiRNA target sequence
tactttctcttcaaacaaaaagattg

SEQ ID NO: 207649 - DNA, 26 bp, Artificial sequence
  SiRNA target sequence
actttctcttcaaacaaaaagattgc

SEQ ID NO: 207650 - DNA, 26 bp, Artificial sequence
  SiRNA target sequence
ctttctcttcaaacaaaaagattgcc

SEQ ID NO: 207651 - DNA, 26 bp, Artificial sequence
  SiRNA target sequence
tttctcttcaaacaaaaagattgccc

SEQ ID NO: 207652 - DNA, 26 bp, Artificial sequence
  SiRNA target sequence
ttctcttcaaacaaaaagattgcccc

SEQ ID NO: 207653 - DNA, 26 bp, Artificial sequence
  SiRNA target sequence
tctcttcaaacaaaaagattgcccct

SEQ ID NO: 207654 - DNA, 26 bp, Artificial sequence
  SiRNA target sequence
ctcttcaaacaaaaagattgccccta

SEQ ID NO: 207655 - DNA, 26 bp, Artificial sequence
  SiRNA target sequence
tcttcaaacaaaaagattgcccctag

SEQ ID NO: 207656 - DNA, 26 bp, Artificial sequence
  SiRNA target sequence
cttcaaacaaaaagattgcccctagt

SEQ ID NO: 207657 - DNA, 26 bp, Artificial sequence
  SiRNA target sequence
ttcaaacaaaaagattgcccctagtc

SEQ ID NO: 207658 - DNA, 26 bp, Artificial sequence
  SiRNA target sequence
tcaaacaaaaagattgcccctagtcc

SEQ ID NO: 207659 - DNA, 26 bp, Artificial sequence
  SiRNA target sequence
caaacaaaaagattgcccctagtccg

SEQ ID NO: 207660 - DNA, 26 bp, Artificial sequence
  SiRNA target sequence
aaacaaaaagattgcccctagtccga

SEQ ID NO: 207661 - DNA, 26 bp, Artificial sequence
  SiRNA target sequence
aacaaaaagattgcccctagtccgaa

SEQ ID NO: 207662 - DNA, 26 bp, Artificial sequence
  SiRNA target sequence
acaaaaagattgcccctagtccgaag

SEQ ID NO: 207663 - DNA, 26 bp, Artificial sequence
  SiRNA target sequence
caaaaagattgcccctagtccgaaga

SEQ ID NO: 207664 - DNA, 26 bp, Artificial sequence
  SiRNA target sequence
aaaaagattgcccctagtccgaagaa

SEQ ID NO: 207665 - DNA, 26 bp, Artificial sequence
  SiRNA target sequence
aaaagattgcccctagtccgaagaaa

SEQ ID NO: 207666 - DNA, 26 bp, Artificial sequence
  SiRNA target sequence
aaagattgcccctagtccgaagaaaa

SEQ ID NO: 207667 - DNA, 26 bp, Artificial sequence
  SiRNA target sequence
aagattgcccctagtccgaagaaaaa

SEQ ID NO: 207668 - DNA, 26 bp, Artificial sequence
  SiRNA target sequence
agattgcccctagtccgaagaaaaat

SEQ ID NO: 207669 - DNA, 26 bp, Artificial sequence
  SiRNA target sequence
gattgcccctagtccgaagaaaaatg

SEQ ID NO: 207670 - DNA, 26 bp, Artificial sequence
  SiRNA target sequence
attgcccctagtccgaagaaaaatgc

SEQ ID NO: 207671 - DNA, 26 bp, Artificial sequence
  SiRNA target sequence
ttgcccctagtccgaagaaaaatgca

SEQ ID NO: 207672 - DNA, 26 bp, Artificial sequence
  SiRNA target sequence
tgcccctagtccgaagaaaaatgcag

SEQ ID NO: 207673 - DNA, 26 bp, Artificial sequence
  SiRNA target sequence
gcccctagtccgaagaaaaatgcagt

SEQ ID NO: 207674 - DNA, 26 bp, Artificial sequence
  SiRNA target sequence
cccctagtccgaagaaaaatgcagta

SEQ ID NO: 207675 - DNA, 26 bp, Artificial sequence
  SiRNA target sequence
ccctagtccgaagaaaaatgcagtaa

SEQ ID NO: 207676 - DNA, 26 bp, Artificial sequence
  SiRNA target sequence
cctagtccgaagaaaaatgcagtaaa

SEQ ID NO: 207677 - DNA, 26 bp, Artificial sequence
  SiRNA target sequence
ctagtccgaagaaaaatgcagtaaaa

SEQ ID NO: 207678 - DNA, 26 bp, Artificial sequence
  SiRNA target sequence
tagtccgaagaaaaatgcagtaaaaa

SEQ ID NO: 207679 - DNA, 26 bp, Artificial sequence
  SiRNA target sequence
agtccgaagaaaaatgcagtaaaaat

SEQ ID NO: 207680 - DNA, 26 bp, Artificial sequence
  SiRNA target sequence
gtccgaagaaaaatgcagtaaaaatt

SEQ ID NO: 207681 - DNA, 26 bp, Artificial sequence
  SiRNA target sequence
tccgaagaaaaatgcagtaaaaatta

SEQ ID NO: 207682 - DNA, 26 bp, Artificial sequence
  SiRNA target sequence
ccgaagaaaaatgcagtaaaaattat

SEQ ID NO: 207683 - DNA, 26 bp, Artificial sequence
  SiRNA target sequence
cgaagaaaaatgcagtaaaaattatt

SEQ ID NO: 207684 - DNA, 26 bp, Artificial sequence
  SiRNA target sequence
gaagaaaaatgcagtaaaaattatta

SEQ ID NO: 207685 - DNA, 26 bp, Artificial sequence
  SiRNA target sequence
aagaaaaatgcagtaaaaattattag

SEQ ID NO: 207686 - DNA, 26 bp, Artificial sequence
  SiRNA target sequence
agaaaaatgcagtaaaaattattaga

SEQ ID NO: 207687 - DNA, 26 bp, Artificial sequence
  SiRNA target sequence
gaaaaatgcagtaaaaattattagaa

SEQ ID NO: 207688 - DNA, 26 bp, Artificial sequence
  SiRNA target sequence
aaaaatgcagtaaaaattattagaaa

SEQ ID NO: 207689 - DNA, 26 bp, Artificial sequence
  SiRNA target sequence
aaaatgcagtaaaaattattagaaat

SEQ ID NO: 207690 - DNA, 26 bp, Artificial sequence
  SiRNA target sequence
aaatgcagtaaaaattattagaaata

SEQ ID NO: 207691 - DNA, 26 bp, Artificial sequence
  SiRNA target sequence
aatgcagtaaaaattattagaaatag

SEQ ID NO: 207692 - DNA, 26 bp, Artificial sequence
  SiRNA target sequence
atgcagtaaaaattattagaaataga

SEQ ID NO: 207693 - DNA, 26 bp, Artificial sequence
  SiRNA target sequence
tgcagtaaaaattattagaaatagat

SEQ ID NO: 207694 - DNA, 26 bp, Artificial sequence
  SiRNA target sequence
gcagtaaaaattattagaaatagatt

SEQ ID NO: 207695 - DNA, 26 bp, Artificial sequence
  SiRNA target sequence
cagtaaaaattattagaaatagatta

SEQ ID NO: 207696 - DNA, 26 bp, Artificial sequence
  SiRNA target sequence
agtaaaaattattagaaatagattaa

SEQ ID NO: 207697 - DNA, 26 bp, Artificial sequence
  SiRNA target sequence
gtaaaaattattagaaatagattaaa

SEQ ID NO: 207698 - DNA, 26 bp, Artificial sequence
  SiRNA target sequence
taaaaattattagaaatagattaaaa

SEQ ID NO: 207699 - DNA, 26 bp, Artificial sequence
  SiRNA target sequence
aaaaattattagaaatagattaaaaa

SEQ ID NO: 207700 - DNA, 26 bp, Artificial sequence
  SiRNA target sequence
aaaattattagaaatagattaaaaat

SEQ ID NO: 207701 - DNA, 26 bp, Artificial sequence
  SiRNA target sequence
aaattattagaaatagattaaaaatc

SEQ ID NO: 207702 - DNA, 26 bp, Artificial sequence
  SiRNA target sequence
aattattagaaatagattaaaaatcg

SEQ ID NO: 207703 - DNA, 26 bp, Artificial sequence
  SiRNA target sequence
attattagaaatagattaaaaatcga

SEQ ID NO: 207704 - DNA, 26 bp, Artificial sequence
  SiRNA target sequence
ttattagaaatagattaaaaatcgat

SEQ ID NO: 207705 - DNA, 26 bp, Artificial sequence
  SiRNA target sequence
tattagaaatagattaaaaatcgatg

SEQ ID NO: 207706 - DNA, 26 bp, Artificial sequence
  SiRNA target sequence
attagaaatagattaaaaatcgatga

SEQ ID NO: 207707 - DNA, 26 bp, Artificial sequence
  SiRNA target sequence
ttagaaatagattaaaaatcgatgat

SEQ ID NO: 207708 - DNA, 26 bp, Artificial sequence
  SiRNA target sequence
tagaaatagattaaaaatcgatgata

SEQ ID NO: 207709 - DNA, 26 bp, Artificial sequence
  SiRNA target sequence
agaaatagattaaaaatcgatgatac

SEQ ID NO: 207710 - DNA, 26 bp, Artificial sequence
  SiRNA target sequence
gaaatagattaaaaatcgatgataca

SEQ ID NO: 207711 - DNA, 26 bp, Artificial sequence
  SiRNA target sequence
aaatagattaaaaatcgatgatacag

SEQ ID NO: 207712 - DNA, 26 bp, Artificial sequence
  SiRNA target sequence
aatagattaaaaatcgatgatacagg

SEQ ID NO: 207713 - DNA, 26 bp, Artificial sequence
  SiRNA target sequence
atagattaaaaatcgatgatacaggt

SEQ ID NO: 207714 - DNA, 26 bp, Artificial sequence
  SiRNA target sequence
tagattaaaaatcgatgatacaggtt

SEQ ID NO: 207715 - DNA, 26 bp, Artificial sequence
  SiRNA target sequence
agattaaaaatcgatgatacaggttt

SEQ ID NO: 207716 - DNA, 26 bp, Artificial sequence
  SiRNA target sequence
gattaaaaatcgatgatacaggttta

SEQ ID NO: 207717 - DNA, 26 bp, Artificial sequence
  SiRNA target sequence
attaaaaatcgatgatacaggtttat

SEQ ID NO: 207718 - DNA, 26 bp, Artificial sequence
  SiRNA target sequence
ttaaaaatcgatgatacaggtttatt

SEQ ID NO: 207719 - DNA, 26 bp, Artificial sequence
  SiRNA target sequence
taaaaatcgatgatacaggtttattt

SEQ ID NO: 207720 - DNA, 26 bp, Artificial sequence
  SiRNA target sequence
aaaaatcgatgatacaggtttatttt

SEQ ID NO: 207721 - DNA, 26 bp, Artificial sequence
  SiRNA target sequence
aaaatcgatgatacaggtttattttg

SEQ ID NO: 207722 - DNA, 26 bp, Artificial sequence
  SiRNA target sequence
aaatcgatgatacaggtttattttgc

SEQ ID NO: 207723 - DNA, 26 bp, Artificial sequence
  SiRNA target sequence
aatcgatgatacaggtttattttgca

SEQ ID NO: 207724 - DNA, 26 bp, Artificial sequence
  SiRNA target sequence
atcgatgatacaggtttattttgcat

SEQ ID NO: 207725 - DNA, 26 bp, Artificial sequence
  SiRNA target sequence
tcgatgatacaggtttattttgcata

SEQ ID NO: 207726 - DNA, 26 bp, Artificial sequence
  SiRNA target sequence
cgatgatacaggtttattttgcataa

SEQ ID NO: 207727 - DNA, 26 bp, Artificial sequence
  SiRNA target sequence
gatgatacaggtttattttgcataag

SEQ ID NO: 207728 - DNA, 26 bp, Artificial sequence
  SiRNA target sequence
atgatacaggtttattttgcataagc

SEQ ID NO: 207729 - DNA, 26 bp, Artificial sequence
  SiRNA target sequence
tgatacaggtttattttgcataagcc

SEQ ID NO: 207730 - DNA, 26 bp, Artificial sequence
  SiRNA target sequence
gatacaggtttattttgcataagcca

SEQ ID NO: 207731 - DNA, 26 bp, Artificial sequence
  SiRNA target sequence
atacaggtttattttgcataagccac

SEQ ID NO: 207732 - DNA, 26 bp, Artificial sequence
  SiRNA target sequence
tacaggtttattttgcataagccact

SEQ ID NO: 207733 - DNA, 26 bp, Artificial sequence
  SiRNA target sequence
acaggtttattttgcataagccactg

SEQ ID NO: 207734 - DNA, 26 bp, Artificial sequence
  SiRNA target sequence
caggtttattttgcataagccactgt

SEQ ID NO: 207735 - DNA, 26 bp, Artificial sequence
  SiRNA target sequence
aggtttattttgcataagccactgta

SEQ ID NO: 207736 - DNA, 26 bp, Artificial sequence
  SiRNA target sequence
ggtttattttgcataagccactgtat

SEQ ID NO: 207737 - DNA, 26 bp, Artificial sequence
  SiRNA target sequence
gtttattttgcataagccactgtatt

SEQ ID NO: 207738 - DNA, 26 bp, Artificial sequence
  SiRNA target sequence
tttattttgcataagccactgtatta

SEQ ID NO: 207739 - DNA, 26 bp, Artificial sequence
  SiRNA target sequence
ttattttgcataagccactgtattaa

SEQ ID NO: 207740 - DNA, 26 bp, Artificial sequence
  SiRNA target sequence
tattttgcataagccactgtattaaa

SEQ ID NO: 207741 - DNA, 26 bp, Artificial sequence
  SiRNA target sequence
attttgcataagccactgtattaaaa

SEQ ID NO: 207742 - DNA, 26 bp, Artificial sequence
  SiRNA target sequence
ttttgcataagccactgtattaaaat

SEQ ID NO: 207743 - DNA, 26 bp, Artificial sequence
  SiRNA target sequence
tttgcataagccactgtattaaaatt

SEQ ID NO: 207744 - DNA, 26 bp, Artificial sequence
  SiRNA target sequence
ttgcataagccactgtattaaaatta

SEQ ID NO: 207745 - DNA, 26 bp, Artificial sequence
  SiRNA target sequence
tgcataagccactgtattaaaattac

SEQ ID NO: 207746 - DNA, 26 bp, Artificial sequence
  SiRNA target sequence
gcataagccactgtattaaaattaca

SEQ ID NO: 207747 - DNA, 26 bp, Artificial sequence
  SiRNA target sequence
cataagccactgtattaaaattacag

SEQ ID NO: 207748 - DNA, 26 bp, Artificial sequence
  SiRNA target sequence
ataagccactgtattaaaattacaga

SEQ ID NO: 207749 - DNA, 26 bp, Artificial sequence
  SiRNA target sequence
taagccactgtattaaaattacagat

SEQ ID NO: 207750 - DNA, 26 bp, Artificial sequence
  SiRNA target sequence
aagccactgtattaaaattacagatg

SEQ ID NO: 207751 - DNA, 26 bp, Artificial sequence
  SiRNA target sequence
agccactgtattaaaattacagatgc

SEQ ID NO: 207752 - DNA, 26 bp, Artificial sequence
  SiRNA target sequence
gccactgtattaaaattacagatgca

SEQ ID NO: 207753 - DNA, 26 bp, Artificial sequence
  SiRNA target sequence
ccactgtattaaaattacagatgcaa

SEQ ID NO: 207754 - DNA, 26 bp, Artificial sequence
  SiRNA target sequence
cactgtattaaaattacagatgcaaa

SEQ ID NO: 207755 - DNA, 26 bp, Artificial sequence
  SiRNA target sequence
actgtattaaaattacagatgcaaaa

SEQ ID NO: 207756 - DNA, 26 bp, Artificial sequence
  SiRNA target sequence
ctgtattaaaattacagatgcaaaag

SEQ ID NO: 207757 - DNA, 26 bp, Artificial sequence
  SiRNA target sequence
tgtattaaaattacagatgcaaaaga

SEQ ID NO: 207758 - DNA, 26 bp, Artificial sequence
  SiRNA target sequence
gtattaaaattacagatgcaaaagat

SEQ ID NO: 207759 - DNA, 26 bp, Artificial sequence
  SiRNA target sequence
tattaaaattacagatgcaaaagata

SEQ ID NO: 207760 - DNA, 26 bp, Artificial sequence
  SiRNA target sequence
attaaaattacagatgcaaaagatat

SEQ ID NO: 207761 - DNA, 26 bp, Artificial sequence
  SiRNA target sequence
ttaaaattacagatgcaaaagatata

SEQ ID NO: 207762 - DNA, 26 bp, Artificial sequence
  SiRNA target sequence
taaaattacagatgcaaaagatatag

SEQ ID NO: 207763 - DNA, 26 bp, Artificial sequence
  SiRNA target sequence
aaaattacagatgcaaaagatatagg

SEQ ID NO: 207764 - DNA, 26 bp, Artificial sequence
  SiRNA target sequence
aaattacagatgcaaaagatatagga

SEQ ID NO: 207765 - DNA, 26 bp, Artificial sequence
  SiRNA target sequence
aattacagatgcaaaagatataggaa

SEQ ID NO: 207766 - DNA, 26 bp, Artificial sequence
  SiRNA target sequence
attacagatgcaaaagatataggaag

SEQ ID NO: 207767 - DNA, 26 bp, Artificial sequence
  SiRNA target sequence
ttacagatgcaaaagatataggaaga

SEQ ID NO: 207768 - DNA, 26 bp, Artificial sequence
  SiRNA target sequence
tacagatgcaaaagatataggaagaa

SEQ ID NO: 207769 - DNA, 26 bp, Artificial sequence
  SiRNA target sequence
acagatgcaaaagatataggaagaac

SEQ ID NO: 207770 - DNA, 26 bp, Artificial sequence
  SiRNA target sequence
cagatgcaaaagatataggaagaaca

SEQ ID NO: 207771 - DNA, 26 bp, Artificial sequence
  SiRNA target sequence
agatgcaaaagatataggaagaacat

SEQ ID NO: 207772 - DNA, 26 bp, Artificial sequence
  SiRNA target sequence
gatgcaaaagatataggaagaacata

SEQ ID NO: 207773 - DNA, 26 bp, Artificial sequence
  SiRNA target sequence
atgcaaaagatataggaagaacataa

SEQ ID NO: 207774 - DNA, 26 bp, Artificial sequence
  SiRNA target sequence
tgcaaaagatataggaagaacataaa

SEQ ID NO: 207775 - DNA, 26 bp, Artificial sequence
  SiRNA target sequence
gcaaaagatataggaagaacataaaa

SEQ ID NO: 207776 - DNA, 26 bp, Artificial sequence
  SiRNA target sequence
caaaagatataggaagaacataaaaa

SEQ ID NO: 207777 - DNA, 26 bp, Artificial sequence
  SiRNA target sequence
aaaagatataggaagaacataaaaaa

SEQ ID NO: 207778 - DNA, 26 bp, Artificial sequence
  SiRNA target sequence
aaagatataggaagaacataaaaaat

SEQ ID NO: 207779 - DNA, 26 bp, Artificial sequence
  SiRNA target sequence
aagatataggaagaacataaaaaatt

SEQ ID NO: 207780 - DNA, 26 bp, Artificial sequence
  SiRNA target sequence
agatataggaagaacataaaaaattt

SEQ ID NO: 207781 - DNA, 26 bp, Artificial sequence
  SiRNA target sequence
gatataggaagaacataaaaaatttt

SEQ ID NO: 207782 - DNA, 26 bp, Artificial sequence
  SiRNA target sequence
atataggaagaacataaaaaattttc

SEQ ID NO: 207783 - DNA, 26 bp, Artificial sequence
  SiRNA target sequence
tataggaagaacataaaaaattttca

SEQ ID NO: 207784 - DNA, 26 bp, Artificial sequence
  SiRNA target sequence
ataggaagaacataaaaaattttcat

SEQ ID NO: 207785 - DNA, 26 bp, Artificial sequence
  SiRNA target sequence
taggaagaacataaaaaattttcata

SEQ ID NO: 207786 - DNA, 26 bp, Artificial sequence
  SiRNA target sequence
aggaagaacataaaaaattttcataa

SEQ ID NO: 207787 - DNA, 26 bp, Artificial sequence
  SiRNA target sequence
ggaagaacataaaaaattttcataaa

SEQ ID NO: 207788 - DNA, 26 bp, Artificial sequence
  SiRNA target sequence
gaagaacataaaaaattttcataaac

SEQ ID NO: 207789 - DNA, 26 bp, Artificial sequence
  SiRNA target sequence
aagaacataaaaaattttcataaaca

SEQ ID NO: 207790 - DNA, 26 bp, Artificial sequence
  SiRNA target sequence
agaacataaaaaattttcataaacat

SEQ ID NO: 207791 - DNA, 26 bp, Artificial sequence
  SiRNA target sequence
gaacataaaaaattttcataaacata

SEQ ID NO: 207792 - DNA, 26 bp, Artificial sequence
  SiRNA target sequence
aacataaaaaattttcataaacataa

SEQ ID NO: 207793 - DNA, 26 bp, Artificial sequence
  SiRNA target sequence
acataaaaaattttcataaacataat

SEQ ID NO: 207794 - DNA, 26 bp, Artificial sequence
  SiRNA target sequence
cataaaaaattttcataaacataatt

SEQ ID NO: 207795 - DNA, 26 bp, Artificial sequence
  SiRNA target sequence
ataaaaaattttcataaacataattg

SEQ ID NO: 207796 - DNA, 26 bp, Artificial sequence
  SiRNA target sequence
taaaaaattttcataaacataattga

SEQ ID NO: 207797 - DNA, 26 bp, Artificial sequence
  SiRNA target sequence
aaaaaattttcataaacataattgaa

SEQ ID NO: 207798 - DNA, 26 bp, Artificial sequence
  SiRNA target sequence
aaaaattttcataaacataattgaat

SEQ ID NO: 207799 - DNA, 26 bp, Artificial sequence
  SiRNA target sequence
aaaattttcataaacataattgaatt

SEQ ID NO: 207800 - DNA, 26 bp, Artificial sequence
  SiRNA target sequence
aaattttcataaacataattgaattc

SEQ ID NO: 207801 - DNA, 26 bp, Artificial sequence
  SiRNA target sequence
aattttcataaacataattgaattct

SEQ ID NO: 207802 - DNA, 26 bp, Artificial sequence
  SiRNA target sequence
attttcataaacataattgaattctg

SEQ ID NO: 207803 - DNA, 26 bp, Artificial sequence
  SiRNA target sequence
ttttcataaacataattgaattctga

SEQ ID NO: 207804 - DNA, 26 bp, Artificial sequence
  SiRNA target sequence
tttcataaacataattgaattctgat

SEQ ID NO: 207805 - DNA, 26 bp, Artificial sequence
  SiRNA target sequence
ttcataaacataattgaattctgatc

SEQ ID NO: 207806 - DNA, 26 bp, Artificial sequence
  SiRNA target sequence
tcataaacataattgaattctgatct

SEQ ID NO: 207807 - DNA, 26 bp, Artificial sequence
  SiRNA target sequence
cataaacataattgaattctgatctt

SEQ ID NO: 207808 - DNA, 26 bp, Artificial sequence
  SiRNA target sequence
ataaacataattgaattctgatcttg

SEQ ID NO: 207809 - DNA, 26 bp, Artificial sequence
  SiRNA target sequence
taaacataattgaattctgatcttgc

SEQ ID NO: 207810 - DNA, 26 bp, Artificial sequence
  SiRNA target sequence
aaacataattgaattctgatcttgcc

SEQ ID NO: 207811 - DNA, 26 bp, Artificial sequence
  SiRNA target sequence
aacataattgaattctgatcttgcct

SEQ ID NO: 207812 - DNA, 26 bp, Artificial sequence
  SiRNA target sequence
acataattgaattctgatcttgcctt

SEQ ID NO: 207813 - DNA, 26 bp, Artificial sequence
  SiRNA target sequence
cataattgaattctgatcttgcctta

SEQ ID NO: 207814 - DNA, 26 bp, Artificial sequence
  SiRNA target sequence
ataattgaattctgatcttgccttac

SEQ ID NO: 207815 - DNA, 26 bp, Artificial sequence
  SiRNA target sequence
taattgaattctgatcttgccttacc

SEQ ID NO: 207816 - DNA, 26 bp, Artificial sequence
  SiRNA target sequence
aattgaattctgatcttgccttacca

SEQ ID NO: 207817 - DNA, 26 bp, Artificial sequence
  SiRNA target sequence
attgaattctgatcttgccttaccat

SEQ ID NO: 207818 - DNA, 26 bp, Artificial sequence
  SiRNA target sequence
ttgaattctgatcttgccttaccatc

SEQ ID NO: 207819 - DNA, 26 bp, Artificial sequence
  SiRNA target sequence
tgaattctgatcttgccttaccatca

SEQ ID NO: 207820 - DNA, 26 bp, Artificial sequence
  SiRNA target sequence
gaattctgatcttgccttaccatcac

SEQ ID NO: 207821 - DNA, 26 bp, Artificial sequence
  SiRNA target sequence
aattctgatcttgccttaccatcaca

SEQ ID NO: 207822 - DNA, 26 bp, Artificial sequence
  SiRNA target sequence
attctgatcttgccttaccatcacaa

SEQ ID NO: 207823 - DNA, 26 bp, Artificial sequence
  SiRNA target sequence
ttctgatcttgccttaccatcacaaa

SEQ ID NO: 207824 - DNA, 26 bp, Artificial sequence
  SiRNA target sequence
tctgatcttgccttaccatcacaaat

SEQ ID NO: 207825 - DNA, 26 bp, Artificial sequence
  SiRNA target sequence
ctgatcttgccttaccatcacaaata

SEQ ID NO: 207826 - DNA, 26 bp, Artificial sequence
  SiRNA target sequence
tgatcttgccttaccatcacaaataa

SEQ ID NO: 207827 - DNA, 26 bp, Artificial sequence
  SiRNA target sequence
gatcttgccttaccatcacaaataaa

SEQ ID NO: 207828 - DNA, 26 bp, Artificial sequence
  SiRNA target sequence
atcttgccttaccatcacaaataaat

SEQ ID NO: 207829 - DNA, 26 bp, Artificial sequence
  SiRNA target sequence
tcttgccttaccatcacaaataaatc

SEQ ID NO: 207830 - DNA, 26 bp, Artificial sequence
  SiRNA target sequence
cttgccttaccatcacaaataaatct

SEQ ID NO: 207831 - DNA, 26 bp, Artificial sequence
  SiRNA target sequence
ttgccttaccatcacaaataaatctt

SEQ ID NO: 207832 - DNA, 26 bp, Artificial sequence
  SiRNA target sequence
tgccttaccatcacaaataaatcttt

SEQ ID NO: 207833 - DNA, 26 bp, Artificial sequence
  SiRNA target sequence
gccttaccatcacaaataaatctttt

SEQ ID NO: 207834 - DNA, 26 bp, Artificial sequence
  SiRNA target sequence
ccttaccatcacaaataaatctttta

SEQ ID NO: 207835 - DNA, 26 bp, Artificial sequence
  SiRNA target sequence
cttaccatcacaaataaatcttttaa

SEQ ID NO: 207836 - DNA, 26 bp, Artificial sequence
  SiRNA target sequence
ttaccatcacaaataaatcttttaaa

SEQ ID NO: 207837 - DNA, 26 bp, Artificial sequence
  SiRNA target sequence
taccatcacaaataaatcttttaaaa

SEQ ID NO: 207838 - DNA, 26 bp, Artificial sequence
  SiRNA target sequence
accatcacaaataaatcttttaaaat

SEQ ID NO: 207839 - DNA, 26 bp, Artificial sequence
  SiRNA target sequence
ccatcacaaataaatcttttaaaatt

SEQ ID NO: 207840 - DNA, 26 bp, Artificial sequence
  SiRNA target sequence
catcacaaataaatcttttaaaattc

SEQ ID NO: 207841 - DNA, 26 bp, Artificial sequence
  SiRNA target sequence
atcacaaataaatcttttaaaattct

SEQ ID NO: 207842 - DNA, 26 bp, Artificial sequence
  SiRNA target sequence
tcacaaataaatcttttaaaattctt

SEQ ID NO: 207843 - DNA, 26 bp, Artificial sequence
  SiRNA target sequence
cacaaataaatcttttaaaattctta

SEQ ID NO: 207844 - DNA, 26 bp, Artificial sequence
  SiRNA target sequence
acaaataaatcttttaaaattcttaa

SEQ ID NO: 207845 - DNA, 26 bp, Artificial sequence
  SiRNA target sequence
caaataaatcttttaaaattcttaaa

SEQ ID NO: 207846 - DNA, 26 bp, Artificial sequence
  SiRNA target sequence
aaataaatcttttaaaattcttaaaa

SEQ ID NO: 207847 - DNA, 26 bp, Artificial sequence
  SiRNA target sequence
aataaatcttttaaaattcttaaaaa

SEQ ID NO: 207848 - DNA, 26 bp, Artificial sequence
  SiRNA target sequence
ataaatcttttaaaattcttaaaaat

SEQ ID NO: 207849 - DNA, 26 bp, Artificial sequence
  SiRNA target sequence
taaatcttttaaaattcttaaaaatg

SEQ ID NO: 207850 - DNA, 26 bp, Artificial sequence
  SiRNA target sequence
aaatcttttaaaattcttaaaaatga

SEQ ID NO: 207851 - DNA, 26 bp, Artificial sequence
  SiRNA target sequence
aatcttttaaaattcttaaaaatgaa

SEQ ID NO: 207852 - DNA, 26 bp, Artificial sequence
  SiRNA target sequence
atcttttaaaattcttaaaaatgaat

SEQ ID NO: 207853 - DNA, 26 bp, Artificial sequence
  SiRNA target sequence
tcttttaaaattcttaaaaatgaata

SEQ ID NO: 207854 - DNA, 26 bp, Artificial sequence
  SiRNA target sequence
cttttaaaattcttaaaaatgaatac

SEQ ID NO: 207855 - DNA, 26 bp, Artificial sequence
  SiRNA target sequence
ttttaaaattcttaaaaatgaataca

SEQ ID NO: 207856 - DNA, 26 bp, Artificial sequence
  SiRNA target sequence
tttaaaattcttaaaaatgaatacac

SEQ ID NO: 207857 - DNA, 26 bp, Artificial sequence
  SiRNA target sequence
ttaaaattcttaaaaatgaatacaca

SEQ ID NO: 207858 - DNA, 26 bp, Artificial sequence
  SiRNA target sequence
taaaattcttaaaaatgaatacacaa

SEQ ID NO: 207859 - DNA, 26 bp, Artificial sequence
  SiRNA target sequence
aaaattcttaaaaatgaatacacaaa

SEQ ID NO: 207860 - DNA, 26 bp, Artificial sequence
  SiRNA target sequence
aaattcttaaaaatgaatacacaaag

SEQ ID NO: 207861 - DNA, 26 bp, Artificial sequence
  SiRNA target sequence
aattcttaaaaatgaatacacaaagt

SEQ ID NO: 207862 - DNA, 26 bp, Artificial sequence
  SiRNA target sequence
attcttaaaaatgaatacacaaagtt

SEQ ID NO: 207863 - DNA, 26 bp, Artificial sequence
  SiRNA target sequence
ttcttaaaaatgaatacacaaagtta

SEQ ID NO: 207864 - DNA, 26 bp, Artificial sequence
  SiRNA target sequence
tcttaaaaatgaatacacaaagttaa

SEQ ID NO: 207865 - DNA, 26 bp, Artificial sequence
  SiRNA target sequence
cttaaaaatgaatacacaaagttaat

SEQ ID NO: 207866 - DNA, 26 bp, Artificial sequence
  SiRNA target sequence
ttaaaaatgaatacacaaagttaatt

SEQ ID NO: 207867 - DNA, 26 bp, Artificial sequence
  SiRNA target sequence
taaaaatgaatacacaaagttaatta

SEQ ID NO: 207868 - DNA, 26 bp, Artificial sequence
  SiRNA target sequence
aaaaatgaatacacaaagttaattaa

SEQ ID NO: 207869 - DNA, 26 bp, Artificial sequence
  SiRNA target sequence
aaaatgaatacacaaagttaattaat

SEQ ID NO: 207870 - DNA, 26 bp, Artificial sequence
  SiRNA target sequence
aaatgaatacacaaagttaattaatc

SEQ ID NO: 207871 - DNA, 26 bp, Artificial sequence
  SiRNA target sequence
aatgaatacacaaagttaattaatcc

SEQ ID NO: 207872 - DNA, 26 bp, Artificial sequence
  SiRNA target sequence
atgaatacacaaagttaattaatcca

SEQ ID NO: 207873 - DNA, 26 bp, Artificial sequence
  SiRNA target sequence
tgaatacacaaagttaattaatccaa

SEQ ID NO: 207874 - DNA, 26 bp, Artificial sequence
  SiRNA target sequence
gaatacacaaagttaattaatccaaa

SEQ ID NO: 207875 - DNA, 26 bp, Artificial sequence
  SiRNA target sequence
aatacacaaagttaattaatccaaac

SEQ ID NO: 207876 - DNA, 26 bp, Artificial sequence
  SiRNA target sequence
atacacaaagttaattaatccaaaca

SEQ ID NO: 207877 - DNA, 26 bp, Artificial sequence
  SiRNA target sequence
tacacaaagttaattaatccaaacat

SEQ ID NO: 207878 - DNA, 26 bp, Artificial sequence
  SiRNA target sequence
acacaaagttaattaatccaaacata

SEQ ID NO: 207879 - DNA, 26 bp, Artificial sequence
  SiRNA target sequence
cacaaagttaattaatccaaacataa

SEQ ID NO: 207880 - DNA, 26 bp, Artificial sequence
  SiRNA target sequence
acaaagttaattaatccaaacataat

SEQ ID NO: 207881 - DNA, 26 bp, Artificial sequence
  SiRNA target sequence
caaagttaattaatccaaacataata

SEQ ID NO: 207882 - DNA, 26 bp, Artificial sequence
  SiRNA target sequence
aaagttaattaatccaaacataatac

SEQ ID NO: 207883 - DNA, 26 bp, Artificial sequence
  SiRNA target sequence
aagttaattaatccaaacataatacc

SEQ ID NO: 207884 - DNA, 26 bp, Artificial sequence
  SiRNA target sequence
agttaattaatccaaacataatacca

SEQ ID NO: 207885 - DNA, 26 bp, Artificial sequence
  SiRNA target sequence
gttaattaatccaaacataataccaa

SEQ ID NO: 207886 - DNA, 26 bp, Artificial sequence
  SiRNA target sequence
ttaattaatccaaacataataccaag

SEQ ID NO: 207887 - DNA, 26 bp, Artificial sequence
  SiRNA target sequence
taattaatccaaacataataccaagt

SEQ ID NO: 207888 - DNA, 26 bp, Artificial sequence
  SiRNA target sequence
aattaatccaaacataataccaagta

SEQ ID NO: 207889 - DNA, 26 bp, Artificial sequence
  SiRNA target sequence
attaatccaaacataataccaagtat

SEQ ID NO: 207890 - DNA, 26 bp, Artificial sequence
  SiRNA target sequence
ttaatccaaacataataccaagtata

SEQ ID NO: 207891 - DNA, 26 bp, Artificial sequence
  SiRNA target sequence
taatccaaacataataccaagtataa

SEQ ID NO: 207892 - DNA, 26 bp, Artificial sequence
  SiRNA target sequence
aatccaaacataataccaagtataaa

SEQ ID NO: 207893 - DNA, 26 bp, Artificial sequence
  SiRNA target sequence
atccaaacataataccaagtataaaa

SEQ ID NO: 207894 - DNA, 26 bp, Artificial sequence
  SiRNA target sequence
tccaaacataataccaagtataaaaa

SEQ ID NO: 207895 - DNA, 26 bp, Artificial sequence
  SiRNA target sequence
ccaaacataataccaagtataaaaaa

SEQ ID NO: 207896 - DNA, 26 bp, Artificial sequence
  SiRNA target sequence
caaacataataccaagtataaaaaat

SEQ ID NO: 207897 - DNA, 26 bp, Artificial sequence
  SiRNA target sequence
aaacataataccaagtataaaaaatt

SEQ ID NO: 207898 - DNA, 26 bp, Artificial sequence
  SiRNA target sequence
aacataataccaagtataaaaaattt

SEQ ID NO: 207899 - DNA, 26 bp, Artificial sequence
  SiRNA target sequence
acataataccaagtataaaaaattta

SEQ ID NO: 207900 - DNA, 26 bp, Artificial sequence
  SiRNA target sequence
cataataccaagtataaaaaatttag

SEQ ID NO: 207901 - DNA, 26 bp, Artificial sequence
  SiRNA target sequence
ataataccaagtataaaaaatttagg

SEQ ID NO: 207902 - DNA, 26 bp, Artificial sequence
  SiRNA target sequence
taataccaagtataaaaaatttaggc

SEQ ID NO: 207903 - DNA, 26 bp, Artificial sequence
  SiRNA target sequence
aataccaagtataaaaaatttaggca

SEQ ID NO: 207904 - DNA, 26 bp, Artificial sequence
  SiRNA target sequence
ataccaagtataaaaaatttaggcat

SEQ ID NO: 207905 - DNA, 26 bp, Artificial sequence
  SiRNA target sequence
taccaagtataaaaaatttaggcatt

SEQ ID NO: 207906 - DNA, 26 bp, Artificial sequence
  SiRNA target sequence
accaagtataaaaaatttaggcattt

SEQ ID NO: 207907 - DNA, 26 bp, Artificial sequence
  SiRNA target sequence
ccaagtataaaaaatttaggcatttc

SEQ ID NO: 207908 - DNA, 26 bp, Artificial sequence
  SiRNA target sequence
caagtataaaaaatttaggcatttca

SEQ ID NO: 207909 - DNA, 26 bp, Artificial sequence
  SiRNA target sequence
aagtataaaaaatttaggcatttcaa

SEQ ID NO: 207910 - DNA, 26 bp, Artificial sequence
  SiRNA target sequence
agtataaaaaatttaggcatttcaac

SEQ ID NO: 207911 - DNA, 26 bp, Artificial sequence
  SiRNA target sequence
gtataaaaaatttaggcatttcaacc

SEQ ID NO: 207912 - DNA, 26 bp, Artificial sequence
  SiRNA target sequence
tataaaaaatttaggcatttcaacct

SEQ ID NO: 207913 - DNA, 26 bp, Artificial sequence
  SiRNA target sequence
ataaaaaatttaggcatttcaacctt

SEQ ID NO: 207914 - DNA, 26 bp, Artificial sequence
  SiRNA target sequence
taaaaaatttaggcatttcaacctta

SEQ ID NO: 207915 - DNA, 26 bp, Artificial sequence
  SiRNA target sequence
aaaaaatttaggcatttcaaccttag

SEQ ID NO: 207916 - DNA, 26 bp, Artificial sequence
  SiRNA target sequence
aaaaatttaggcatttcaaccttagc

SEQ ID NO: 207917 - DNA, 26 bp, Artificial sequence
  SiRNA target sequence
aaaatttaggcatttcaaccttagca

SEQ ID NO: 207918 - DNA, 26 bp, Artificial sequence
  SiRNA target sequence
aaatttaggcatttcaaccttagcaa

SEQ ID NO: 207919 - DNA, 26 bp, Artificial sequence
  SiRNA target sequence
aatttaggcatttcaaccttagcaac

SEQ ID NO: 207920 - DNA, 26 bp, Artificial sequence
  SiRNA target sequence
atttaggcatttcaaccttagcaact

SEQ ID NO: 207921 - DNA, 26 bp, Artificial sequence
  SiRNA target sequence
tttaggcatttcaaccttagcaactt

SEQ ID NO: 207922 - DNA, 26 bp, Artificial sequence
  SiRNA target sequence
ttaggcatttcaaccttagcaacttt

SEQ ID NO: 207923 - DNA, 26 bp, Artificial sequence
  SiRNA target sequence
taggcatttcaaccttagcaacttta

SEQ ID NO: 207924 - DNA, 26 bp, Artificial sequence
  SiRNA target sequence
aggcatttcaaccttagcaactttaa

SEQ ID NO: 207925 - DNA, 26 bp, Artificial sequence
  SiRNA target sequence
ggcatttcaaccttagcaactttaaa

SEQ ID NO: 207926 - DNA, 26 bp, Artificial sequence
  SiRNA target sequence
gcatttcaaccttagcaactttaaaa

SEQ ID NO: 207927 - DNA, 26 bp, Artificial sequence
  SiRNA target sequence
catttcaaccttagcaactttaaaat

SEQ ID NO: 207928 - DNA, 26 bp, Artificial sequence
  SiRNA target sequence
atttcaaccttagcaactttaaaata

SEQ ID NO: 207929 - DNA, 26 bp, Artificial sequence
  SiRNA target sequence
tttcaaccttagcaactttaaaataa

SEQ ID NO: 207930 - DNA, 26 bp, Artificial sequence
  SiRNA target sequence
ttcaaccttagcaactttaaaataac

SEQ ID NO: 207931 - DNA, 26 bp, Artificial sequence
  SiRNA target sequence
tcaaccttagcaactttaaaataact

SEQ ID NO: 207932 - DNA, 26 bp, Artificial sequence
  SiRNA target sequence
caaccttagcaactttaaaataactc

SEQ ID NO: 207933 - DNA, 26 bp, Artificial sequence
  SiRNA target sequence
aaccttagcaactttaaaataactca

SEQ ID NO: 207934 - DNA, 26 bp, Artificial sequence
  SiRNA target sequence
accttagcaactttaaaataactcag

SEQ ID NO: 207935 - DNA, 26 bp, Artificial sequence
  SiRNA target sequence
ccttagcaactttaaaataactcagt

SEQ ID NO: 207936 - DNA, 26 bp, Artificial sequence
  SiRNA target sequence
cttagcaactttaaaataactcagta

SEQ ID NO: 207937 - DNA, 26 bp, Artificial sequence
  SiRNA target sequence
ttagcaactttaaaataactcagtaa

SEQ ID NO: 207938 - DNA, 26 bp, Artificial sequence
  SiRNA target sequence
tagcaactttaaaataactcagtaat

SEQ ID NO: 207939 - DNA, 26 bp, Artificial sequence
  SiRNA target sequence
agcaactttaaaataactcagtaatc

SEQ ID NO: 207940 - DNA, 26 bp, Artificial sequence
  SiRNA target sequence
gcaactttaaaataactcagtaatcc

SEQ ID NO: 207941 - DNA, 26 bp, Artificial sequence
  SiRNA target sequence
caactttaaaataactcagtaatcct

SEQ ID NO: 207942 - DNA, 26 bp, Artificial sequence
  SiRNA target sequence
aactttaaaataactcagtaatcctg

SEQ ID NO: 207943 - DNA, 26 bp, Artificial sequence
  SiRNA target sequence
actttaaaataactcagtaatcctgt

SEQ ID NO: 207944 - DNA, 26 bp, Artificial sequence
  SiRNA target sequence
ctttaaaataactcagtaatcctgtt

SEQ ID NO: 207945 - DNA, 26 bp, Artificial sequence
  SiRNA target sequence
tttaaaataactcagtaatcctgttc

SEQ ID NO: 207946 - DNA, 26 bp, Artificial sequence
  SiRNA target sequence
ttaaaataactcagtaatcctgttct

SEQ ID NO: 207947 - DNA, 26 bp, Artificial sequence
  SiRNA target sequence
taaaataactcagtaatcctgttctt

SEQ ID NO: 207948 - DNA, 26 bp, Artificial sequence
  SiRNA target sequence
aaaataactcagtaatcctgttcttg

SEQ ID NO: 207949 - DNA, 26 bp, Artificial sequence
  SiRNA target sequence
aaataactcagtaatcctgttcttga

SEQ ID NO: 207950 - DNA, 26 bp, Artificial sequence
  SiRNA target sequence
aataactcagtaatcctgttcttgaa

SEQ ID NO: 207951 - DNA, 26 bp, Artificial sequence
  SiRNA target sequence
ataactcagtaatcctgttcttgaat

SEQ ID NO: 207952 - DNA, 26 bp, Artificial sequence
  SiRNA target sequence
taactcagtaatcctgttcttgaatt

SEQ ID NO: 207953 - DNA, 26 bp, Artificial sequence
  SiRNA target sequence
aactcagtaatcctgttcttgaattt

SEQ ID NO: 207954 - DNA, 26 bp, Artificial sequence
  SiRNA target sequence
actcagtaatcctgttcttgaatttg

SEQ ID NO: 207955 - DNA, 26 bp, Artificial sequence
  SiRNA target sequence
ctcagtaatcctgttcttgaatttgc

SEQ ID NO: 207956 - DNA, 26 bp, Artificial sequence
  SiRNA target sequence
tcagtaatcctgttcttgaatttgct

SEQ ID NO: 207957 - DNA, 26 bp, Artificial sequence
  SiRNA target sequence
cagtaatcctgttcttgaatttgcta

SEQ ID NO: 207958 - DNA, 26 bp, Artificial sequence
  SiRNA target sequence
agtaatcctgttcttgaatttgctaa

SEQ ID NO: 207959 - DNA, 26 bp, Artificial sequence
  SiRNA target sequence
gtaatcctgttcttgaatttgctaat

SEQ ID NO: 207960 - DNA, 26 bp, Artificial sequence
  SiRNA target sequence
taatcctgttcttgaatttgctaatt

SEQ ID NO: 207961 - DNA, 26 bp, Artificial sequence
  SiRNA target sequence
aatcctgttcttgaatttgctaattg

SEQ ID NO: 207962 - DNA, 26 bp, Artificial sequence
  SiRNA target sequence
atcctgttcttgaatttgctaattga

SEQ ID NO: 207963 - DNA, 26 bp, Artificial sequence
  SiRNA target sequence
tcctgttcttgaatttgctaattgat

SEQ ID NO: 207964 - DNA, 26 bp, Artificial sequence
  SiRNA target sequence
cctgttcttgaatttgctaattgatc

SEQ ID NO: 207965 - DNA, 26 bp, Artificial sequence
  SiRNA target sequence
ctgttcttgaatttgctaattgatca

SEQ ID NO: 207966 - DNA, 26 bp, Artificial sequence
  SiRNA target sequence
tgttcttgaatttgctaattgatcaa

SEQ ID NO: 207967 - DNA, 26 bp, Artificial sequence
  SiRNA target sequence
gttcttgaatttgctaattgatcaat

SEQ ID NO: 207968 - DNA, 26 bp, Artificial sequence
  SiRNA target sequence
ttcttgaatttgctaattgatcaatc

SEQ ID NO: 207969 - DNA, 26 bp, Artificial sequence
  SiRNA target sequence
tcttgaatttgctaattgatcaatct

SEQ ID NO: 207970 - DNA, 26 bp, Artificial sequence
  SiRNA target sequence
cttgaatttgctaattgatcaatctc

SEQ ID NO: 207971 - DNA, 26 bp, Artificial sequence
  SiRNA target sequence
ttgaatttgctaattgatcaatctca

SEQ ID NO: 207972 - DNA, 26 bp, Artificial sequence
  SiRNA target sequence
tgaatttgctaattgatcaatctcat

SEQ ID NO: 207973 - DNA, 26 bp, Artificial sequence
  SiRNA target sequence
gaatttgctaattgatcaatctcatc

SEQ ID NO: 207974 - DNA, 26 bp, Artificial sequence
  SiRNA target sequence
aatttgctaattgatcaatctcatct

SEQ ID NO: 207975 - DNA, 26 bp, Artificial sequence
  SiRNA target sequence
atttgctaattgatcaatctcatctt

SEQ ID NO: 207976 - DNA, 26 bp, Artificial sequence
  SiRNA target sequence
tttgctaattgatcaatctcatcttc

SEQ ID NO: 207977 - DNA, 26 bp, Artificial sequence
  SiRNA target sequence
ttgctaattgatcaatctcatcttcc

SEQ ID NO: 207978 - DNA, 26 bp, Artificial sequence
  SiRNA target sequence
tgctaattgatcaatctcatcttccg

SEQ ID NO: 207979 - DNA, 26 bp, Artificial sequence
  SiRNA target sequence
gctaattgatcaatctcatcttccgt

SEQ ID NO: 207980 - DNA, 26 bp, Artificial sequence
  SiRNA target sequence
ctaattgatcaatctcatcttccgta

SEQ ID NO: 207981 - DNA, 26 bp, Artificial sequence
  SiRNA target sequence
taattgatcaatctcatcttccgtag

SEQ ID NO: 207982 - DNA, 26 bp, Artificial sequence
  SiRNA target sequence
aattgatcaatctcatcttccgtagg

SEQ ID NO: 207983 - DNA, 26 bp, Artificial sequence
  SiRNA target sequence
attgatcaatctcatcttccgtaggt

SEQ ID NO: 207984 - DNA, 26 bp, Artificial sequence
  SiRNA target sequence
ttgatcaatctcatcttccgtaggta

SEQ ID NO: 207985 - DNA, 26 bp, Artificial sequence
  SiRNA target sequence
tgatcaatctcatcttccgtaggtaa

SEQ ID NO: 207986 - DNA, 26 bp, Artificial sequence
  SiRNA target sequence
gatcaatctcatcttccgtaggtaag

SEQ ID NO: 207987 - DNA, 26 bp, Artificial sequence
  SiRNA target sequence
atcaatctcatcttccgtaggtaagt

SEQ ID NO: 207988 - DNA, 26 bp, Artificial sequence
  SiRNA target sequence
tcaatctcatcttccgtaggtaagtt

SEQ ID NO: 207989 - DNA, 26 bp, Artificial sequence
  SiRNA target sequence
caatctcatcttccgtaggtaagttg

SEQ ID NO: 207990 - DNA, 26 bp, Artificial sequence
  SiRNA target sequence
aatctcatcttccgtaggtaagttgt

SEQ ID NO: 207991 - DNA, 26 bp, Artificial sequence
  SiRNA target sequence
atctcatcttccgtaggtaagttgtt

SEQ ID NO: 207992 - DNA, 26 bp, Artificial sequence
  SiRNA target sequence
tctcatcttccgtaggtaagttgttt

SEQ ID NO: 207993 - DNA, 26 bp, Artificial sequence
  SiRNA target sequence
ctcatcttccgtaggtaagttgtttt

SEQ ID NO: 207994 - DNA, 26 bp, Artificial sequence
  SiRNA target sequence
tcatcttccgtaggtaagttgttttc

SEQ ID NO: 207995 - DNA, 26 bp, Artificial sequence
  SiRNA target sequence
catcttccgtaggtaagttgttttca

SEQ ID NO: 207996 - DNA, 26 bp, Artificial sequence
  SiRNA target sequence
atcttccgtaggtaagttgttttcag

SEQ ID NO: 207997 - DNA, 26 bp, Artificial sequence
  SiRNA target sequence
tcttccgtaggtaagttgttttcagg

SEQ ID NO: 207998 - DNA, 26 bp, Artificial sequence
  SiRNA target sequence
cttccgtaggtaagttgttttcaggt

SEQ ID NO: 207999 - DNA, 26 bp, Artificial sequence
  SiRNA target sequence
ttccgtaggtaagttgttttcaggtg

SEQ ID NO: 208000 - DNA, 26 bp, Artificial sequence
  SiRNA target sequence
tccgtaggtaagttgttttcaggtgt

SEQ ID NO: 208001 - DNA, 26 bp, Artificial sequence
  SiRNA target sequence
ccgtaggtaagttgttttcaggtgtt

SEQ ID NO: 208002 - DNA, 26 bp, Artificial sequence
  SiRNA target sequence
cgtaggtaagttgttttcaggtgttt

SEQ ID NO: 208003 - DNA, 26 bp, Artificial sequence
  SiRNA target sequence
gtaggtaagttgttttcaggtgtttc

SEQ ID NO: 208004 - DNA, 26 bp, Artificial sequence
  SiRNA target sequence
taggtaagttgttttcaggtgtttca

SEQ ID NO: 208005 - DNA, 26 bp, Artificial sequence
  SiRNA target sequence
aggtaagttgttttcaggtgtttcat

SEQ ID NO: 208006 - DNA, 26 bp, Artificial sequence
  SiRNA target sequence
ggtaagttgttttcaggtgtttcatt

SEQ ID NO: 208007 - DNA, 26 bp, Artificial sequence
  SiRNA target sequence
gtaagttgttttcaggtgtttcattt

SEQ ID NO: 208008 - DNA, 26 bp, Artificial sequence
  SiRNA target sequence
taagttgttttcaggtgtttcattta

SEQ ID NO: 208009 - DNA, 26 bp, Artificial sequence
  SiRNA target sequence
aagttgttttcaggtgtttcatttat

SEQ ID NO: 208010 - DNA, 26 bp, Artificial sequence
  SiRNA target sequence
agttgttttcaggtgtttcatttatt

SEQ ID NO: 208011 - DNA, 26 bp, Artificial sequence
  SiRNA target sequence
gttgttttcaggtgtttcatttatta

SEQ ID NO: 208012 - DNA, 26 bp, Artificial sequence
  SiRNA target sequence
ttgttttcaggtgtttcatttattac

SEQ ID NO: 208013 - DNA, 26 bp, Artificial sequence
  SiRNA target sequence
tgttttcaggtgtttcatttattaca

SEQ ID NO: 208014 - DNA, 26 bp, Artificial sequence
  SiRNA target sequence
gttttcaggtgtttcatttattacac

SEQ ID NO: 208015 - DNA, 26 bp, Artificial sequence
  SiRNA target sequence
ttttcaggtgtttcatttattacact

SEQ ID NO: 208016 - DNA, 26 bp, Artificial sequence
  SiRNA target sequence
tttcaggtgtttcatttattacactc

SEQ ID NO: 208017 - DNA, 26 bp, Artificial sequence
  SiRNA target sequence
ttcaggtgtttcatttattacactca

SEQ ID NO: 208018 - DNA, 26 bp, Artificial sequence
  SiRNA target sequence
tcaggtgtttcatttattacactcat

SEQ ID NO: 208019 - DNA, 27 bp, Artificial sequence
  SiRNA target sequence
ttattctgcgttttcttttttgtcgtc

SEQ ID NO: 208020 - DNA, 27 bp, Artificial sequence
  SiRNA target sequence
tattctgcgttttcttttttgtcgtct

SEQ ID NO: 208021 - DNA, 27 bp, Artificial sequence
  SiRNA target sequence
attctgcgttttcttttttgtcgtctt

SEQ ID NO: 208022 - DNA, 27 bp, Artificial sequence
  SiRNA target sequence
ttctgcgttttcttttttgtcgtcttt

SEQ ID NO: 208023 - DNA, 27 bp, Artificial sequence
  SiRNA target sequence
tctgcgttttcttttttgtcgtctttt

SEQ ID NO: 208024 - DNA, 27 bp, Artificial sequence
  SiRNA target sequence
ctgcgttttcttttttgtcgtctttta

SEQ ID NO: 208025 - DNA, 27 bp, Artificial sequence
  SiRNA target sequence
tgcgttttcttttttgtcgtcttttat

SEQ ID NO: 208026 - DNA, 27 bp, Artificial sequence
  SiRNA target sequence
gcgttttcttttttgtcgtcttttatt

SEQ ID NO: 208027 - DNA, 27 bp, Artificial sequence
  SiRNA target sequence
cgttttcttttttgtcgtcttttatta

SEQ ID NO: 208028 - DNA, 27 bp, Artificial sequence
  SiRNA target sequence
gttttcttttttgtcgtcttttattaa

SEQ ID NO: 208029 - DNA, 27 bp, Artificial sequence
  SiRNA target sequence
ttttcttttttgtcgtcttttattaaa

SEQ ID NO: 208030 - DNA, 27 bp, Artificial sequence
  SiRNA target sequence
tttcttttttgtcgtcttttattaaat

SEQ ID NO: 208031 - DNA, 27 bp, Artificial sequence
  SiRNA target sequence
ttcttttttgtcgtcttttattaaatc

SEQ ID NO: 208032 - DNA, 27 bp, Artificial sequence
  SiRNA target sequence
tcttttttgtcgtcttttattaaatct

SEQ ID NO: 208033 - DNA, 27 bp, Artificial sequence
  SiRNA target sequence
cttttttgtcgtcttttattaaatcta

SEQ ID NO: 208034 - DNA, 27 bp, Artificial sequence
  SiRNA target sequence
ttttttgtcgtcttttattaaatctat

SEQ ID NO: 208035 - DNA, 27 bp, Artificial sequence
  SiRNA target sequence
tttttgtcgtcttttattaaatctatg

SEQ ID NO: 208036 - DNA, 27 bp, Artificial sequence
  SiRNA target sequence
ttttgtcgtcttttattaaatctatgt

SEQ ID NO: 208037 - DNA, 27 bp, Artificial sequence
  SiRNA target sequence
tttgtcgtcttttattaaatctatgtc

SEQ ID NO: 208038 - DNA, 27 bp, Artificial sequence
  SiRNA target sequence
ttgtcgtcttttattaaatctatgtct

SEQ ID NO: 208039 - DNA, 27 bp, Artificial sequence
  SiRNA target sequence
tgtcgtcttttattaaatctatgtcta

SEQ ID NO: 208040 - DNA, 27 bp, Artificial sequence
  SiRNA target sequence
gtcgtcttttattaaatctatgtctac

SEQ ID NO: 208041 - DNA, 27 bp, Artificial sequence
  SiRNA target sequence
tcgtcttttattaaatctatgtctaca

SEQ ID NO: 208042 - DNA, 27 bp, Artificial sequence
  SiRNA target sequence
cgtcttttattaaatctatgtctacac

SEQ ID NO: 208043 - DNA, 27 bp, Artificial sequence
  SiRNA target sequence
gtcttttattaaatctatgtctacact

SEQ ID NO: 208044 - DNA, 27 bp, Artificial sequence
  SiRNA target sequence
tcttttattaaatctatgtctacactt

SEQ ID NO: 208045 - DNA, 27 bp, Artificial sequence
  SiRNA target sequence
cttttattaaatctatgtctacacttg

SEQ ID NO: 208046 - DNA, 27 bp, Artificial sequence
  SiRNA target sequence
ttttattaaatctatgtctacacttgt

SEQ ID NO: 208047 - DNA, 27 bp, Artificial sequence
  SiRNA target sequence
tttattaaatctatgtctacacttgta

SEQ ID NO: 208048 - DNA, 27 bp, Artificial sequence
  SiRNA target sequence
ttattaaatctatgtctacacttgtat

SEQ ID NO: 208049 - DNA, 27 bp, Artificial sequence
  SiRNA target sequence
tattaaatctatgtctacacttgtatt

SEQ ID NO: 208050 - DNA, 27 bp, Artificial sequence
  SiRNA target sequence
attaaatctatgtctacacttgtatta

SEQ ID NO: 208051 - DNA, 27 bp, Artificial sequence
  SiRNA target sequence
ttaaatctatgtctacacttgtattat

SEQ ID NO: 208052 - DNA, 27 bp, Artificial sequence
  SiRNA target sequence
taaatctatgtctacacttgtattatt

SEQ ID NO: 208053 - DNA, 27 bp, Artificial sequence
  SiRNA target sequence
aaatctatgtctacacttgtattattt

SEQ ID NO: 208054 - DNA, 27 bp, Artificial sequence
  SiRNA target sequence
aatctatgtctacacttgtattatttt

SEQ ID NO: 208055 - DNA, 27 bp, Artificial sequence
  SiRNA target sequence
atctatgtctacacttgtattattttt

SEQ ID NO: 208056 - DNA, 27 bp, Artificial sequence
  SiRNA target sequence
tctatgtctacacttgtattattttta

SEQ ID NO: 208057 - DNA, 27 bp, Artificial sequence
  SiRNA target sequence
ctatgtctacacttgtattatttttaa

SEQ ID NO: 208058 - DNA, 27 bp, Artificial sequence
  SiRNA target sequence
tatgtctacacttgtattatttttaat

SEQ ID NO: 208059 - DNA, 27 bp, Artificial sequence
  SiRNA target sequence
atgtctacacttgtattatttttaatt

SEQ ID NO: 208060 - DNA, 27 bp, Artificial sequence
  SiRNA target sequence
tgtctacacttgtattatttttaattg

SEQ ID NO: 208061 - DNA, 27 bp, Artificial sequence
  SiRNA target sequence
gtctacacttgtattatttttaattga

SEQ ID NO: 208062 - DNA, 27 bp, Artificial sequence
  SiRNA target sequence
tctacacttgtattatttttaattgaa

SEQ ID NO: 208063 - DNA, 27 bp, Artificial sequence
  SiRNA target sequence
ctacacttgtattatttttaattgaaa

SEQ ID NO: 208064 - DNA, 27 bp, Artificial sequence
  SiRNA target sequence
tacacttgtattatttttaattgaaac

SEQ ID NO: 208065 - DNA, 27 bp, Artificial sequence
  SiRNA target sequence
acacttgtattatttttaattgaaacg

SEQ ID NO: 208066 - DNA, 27 bp, Artificial sequence
  SiRNA target sequence
cacttgtattatttttaattgaaacgt

SEQ ID NO: 208067 - DNA, 27 bp, Artificial sequence
  SiRNA target sequence
acttgtattatttttaattgaaacgtt

SEQ ID NO: 208068 - DNA, 27 bp, Artificial sequence
  SiRNA target sequence
cttgtattatttttaattgaaacgtta

SEQ ID NO: 208069 - DNA, 27 bp, Artificial sequence
  SiRNA target sequence
ttgtattatttttaattgaaacgttat

SEQ ID NO: 208070 - DNA, 27 bp, Artificial sequence
  SiRNA target sequence
tgtattatttttaattgaaacgttata

SEQ ID NO: 208071 - DNA, 27 bp, Artificial sequence
  SiRNA target sequence
gtattatttttaattgaaacgttatat

SEQ ID NO: 208072 - DNA, 27 bp, Artificial sequence
  SiRNA target sequence
tattatttttaattgaaacgttatatg

SEQ ID NO: 208073 - DNA, 27 bp, Artificial sequence
  SiRNA target sequence
attatttttaattgaaacgttatatgc

SEQ ID NO: 208074 - DNA, 27 bp, Artificial sequence
  SiRNA target sequence
ttatttttaattgaaacgttatatgca

SEQ ID NO: 208075 - DNA, 27 bp, Artificial sequence
  SiRNA target sequence
tatttttaattgaaacgttatatgcac

SEQ ID NO: 208076 - DNA, 27 bp, Artificial sequence
  SiRNA target sequence
atttttaattgaaacgttatatgcacc

SEQ ID NO: 208077 - DNA, 27 bp, Artificial sequence
  SiRNA target sequence
tttttaattgaaacgttatatgcaccc

SEQ ID NO: 208078 - DNA, 27 bp, Artificial sequence
  SiRNA target sequence
ttttaattgaaacgttatatgcacccg

SEQ ID NO: 208079 - DNA, 27 bp, Artificial sequence
  SiRNA target sequence
tttaattgaaacgttatatgcacccgc

SEQ ID NO: 208080 - DNA, 27 bp, Artificial sequence
  SiRNA target sequence
ttaattgaaacgttatatgcacccgct

SEQ ID NO: 208081 - DNA, 27 bp, Artificial sequence
  SiRNA target sequence
taattgaaacgttatatgcacccgcta

SEQ ID NO: 208082 - DNA, 27 bp, Artificial sequence
  SiRNA target sequence
aattgaaacgttatatgcacccgctaa

SEQ ID NO: 208083 - DNA, 27 bp, Artificial sequence
  SiRNA target sequence
attgaaacgttatatgcacccgctaaa

SEQ ID NO: 208084 - DNA, 27 bp, Artificial sequence
  SiRNA target sequence
ttgaaacgttatatgcacccgctaaat

SEQ ID NO: 208085 - DNA, 27 bp, Artificial sequence
  SiRNA target sequence
tgaaacgttatatgcacccgctaaata

SEQ ID NO: 208086 - DNA, 27 bp, Artificial sequence
  SiRNA target sequence
gaaacgttatatgcacccgctaaatag

SEQ ID NO: 208087 - DNA, 27 bp, Artificial sequence
  SiRNA target sequence
aaacgttatatgcacccgctaaataga

SEQ ID NO: 208088 - DNA, 27 bp, Artificial sequence
  SiRNA target sequence
aacgttatatgcacccgctaaatagat

SEQ ID NO: 208089 - DNA, 27 bp, Artificial sequence
  SiRNA target sequence
acgttatatgcacccgctaaatagatt

SEQ ID NO: 208090 - DNA, 27 bp, Artificial sequence
  SiRNA target sequence
cgttatatgcacccgctaaatagatta

SEQ ID NO: 208091 - DNA, 27 bp, Artificial sequence
  SiRNA target sequence
gttatatgcacccgctaaatagattat

SEQ ID NO: 208092 - DNA, 27 bp, Artificial sequence
  SiRNA target sequence
ttatatgcacccgctaaatagattata

SEQ ID NO: 208093 - DNA, 27 bp, Artificial sequence
  SiRNA target sequence
tatatgcacccgctaaatagattatag

SEQ ID NO: 208094 - DNA, 27 bp, Artificial sequence
  SiRNA target sequence
atatgcacccgctaaatagattatagc

SEQ ID NO: 208095 - DNA, 27 bp, Artificial sequence
  SiRNA target sequence
tatgcacccgctaaatagattatagct

SEQ ID NO: 208096 - DNA, 27 bp, Artificial sequence
  SiRNA target sequence
atgcacccgctaaatagattatagctc

SEQ ID NO: 208097 - DNA, 27 bp, Artificial sequence
  SiRNA target sequence
tgcacccgctaaatagattatagctct

SEQ ID NO: 208098 - DNA, 27 bp, Artificial sequence
  SiRNA target sequence
gcacccgctaaatagattatagctcta

SEQ ID NO: 208099 - DNA, 27 bp, Artificial sequence
  SiRNA target sequence
cacccgctaaatagattatagctctaa

SEQ ID NO: 208100 - DNA, 27 bp, Artificial sequence
  SiRNA target sequence
acccgctaaatagattatagctctaat

SEQ ID NO: 208101 - DNA, 27 bp, Artificial sequence
  SiRNA target sequence
cccgctaaatagattatagctctaatc

SEQ ID NO: 208102 - DNA, 27 bp, Artificial sequence
  SiRNA target sequence
ccgctaaatagattatagctctaatcc

SEQ ID NO: 208103 - DNA, 27 bp, Artificial sequence
  SiRNA target sequence
cgctaaatagattatagctctaatcca

SEQ ID NO: 208104 - DNA, 27 bp, Artificial sequence
  SiRNA target sequence
gctaaatagattatagctctaatccaa

SEQ ID NO: 208105 - DNA, 27 bp, Artificial sequence
  SiRNA target sequence
ctaaatagattatagctctaatccaaa

SEQ ID NO: 208106 - DNA, 27 bp, Artificial sequence
  SiRNA target sequence
taaatagattatagctctaatccaaat

SEQ ID NO: 208107 - DNA, 27 bp, Artificial sequence
  SiRNA target sequence
aaatagattatagctctaatccaaata

SEQ ID NO: 208108 - DNA, 27 bp, Artificial sequence
  SiRNA target sequence
aatagattatagctctaatccaaatat

SEQ ID NO: 208109 - DNA, 27 bp, Artificial sequence
  SiRNA target sequence
atagattatagctctaatccaaatata

SEQ ID NO: 208110 - DNA, 27 bp, Artificial sequence
  SiRNA target sequence
tagattatagctctaatccaaatataa

SEQ ID NO: 208111 - DNA, 27 bp, Artificial sequence
  SiRNA target sequence
agattatagctctaatccaaatataaa

SEQ ID NO: 208112 - DNA, 27 bp, Artificial sequence
  SiRNA target sequence
gattatagctctaatccaaatataaat

SEQ ID NO: 208113 - DNA, 27 bp, Artificial sequence
  SiRNA target sequence
attatagctctaatccaaatataaatc

SEQ ID NO: 208114 - DNA, 27 bp, Artificial sequence
  SiRNA target sequence
ttatagctctaatccaaatataaatca

SEQ ID NO: 208115 - DNA, 27 bp, Artificial sequence
  SiRNA target sequence
tatagctctaatccaaatataaatcaa

SEQ ID NO: 208116 - DNA, 27 bp, Artificial sequence
  SiRNA target sequence
atagctctaatccaaatataaatcaat

SEQ ID NO: 208117 - DNA, 27 bp, Artificial sequence
  SiRNA target sequence
tagctctaatccaaatataaatcaata

SEQ ID NO: 208118 - DNA, 27 bp, Artificial sequence
  SiRNA target sequence
agctctaatccaaatataaatcaatat

SEQ ID NO: 208119 - DNA, 27 bp, Artificial sequence
  SiRNA target sequence
gctctaatccaaatataaatcaatatt

SEQ ID NO: 208120 - DNA, 27 bp, Artificial sequence
  SiRNA target sequence
ctctaatccaaatataaatcaatatta

SEQ ID NO: 208121 - DNA, 27 bp, Artificial sequence
  SiRNA target sequence
tctaatccaaatataaatcaatattat

SEQ ID NO: 208122 - DNA, 27 bp, Artificial sequence
  SiRNA target sequence
ctaatccaaatataaatcaatattatt

SEQ ID NO: 208123 - DNA, 27 bp, Artificial sequence
  SiRNA target sequence
taatccaaatataaatcaatattattg

SEQ ID NO: 208124 - DNA, 27 bp, Artificial sequence
  SiRNA target sequence
aatccaaatataaatcaatattattgc

SEQ ID NO: 208125 - DNA, 27 bp, Artificial sequence
  SiRNA target sequence
atccaaatataaatcaatattattgca

SEQ ID NO: 208126 - DNA, 27 bp, Artificial sequence
  SiRNA target sequence
tccaaatataaatcaatattattgcaa

SEQ ID NO: 208127 - DNA, 27 bp, Artificial sequence
  SiRNA target sequence
ccaaatataaatcaatattattgcaat

SEQ ID NO: 208128 - DNA, 27 bp, Artificial sequence
  SiRNA target sequence
caaatataaatcaatattattgcaatc

SEQ ID NO: 208129 - DNA, 27 bp, Artificial sequence
  SiRNA target sequence
aaatataaatcaatattattgcaatcg

SEQ ID NO: 208130 - DNA, 27 bp, Artificial sequence
  SiRNA target sequence
aatataaatcaatattattgcaatcgt

SEQ ID NO: 208131 - DNA, 27 bp, Artificial sequence
  SiRNA target sequence
atataaatcaatattattgcaatcgtt

SEQ ID NO: 208132 - DNA, 27 bp, Artificial sequence
  SiRNA target sequence
tataaatcaatattattgcaatcgtta

SEQ ID NO: 208133 - DNA, 27 bp, Artificial sequence
  SiRNA target sequence
ataaatcaatattattgcaatcgttaa

SEQ ID NO: 208134 - DNA, 27 bp, Artificial sequence
  SiRNA target sequence
taaatcaatattattgcaatcgttaat

SEQ ID NO: 208135 - DNA, 27 bp, Artificial sequence
  SiRNA target sequence
aaatcaatattattgcaatcgttaatg

SEQ ID NO: 208136 - DNA, 27 bp, Artificial sequence
  SiRNA target sequence
aatcaatattattgcaatcgttaatgt

SEQ ID NO: 208137 - DNA, 27 bp, Artificial sequence
  SiRNA target sequence
atcaatattattgcaatcgttaatgtg

SEQ ID NO: 208138 - DNA, 27 bp, Artificial sequence
  SiRNA target sequence
tcaatattattgcaatcgttaatgtga

SEQ ID NO: 208139 - DNA, 27 bp, Artificial sequence
  SiRNA target sequence
caatattattgcaatcgttaatgtgat

SEQ ID NO: 208140 - DNA, 27 bp, Artificial sequence
  SiRNA target sequence
aatattattgcaatcgttaatgtgatt

SEQ ID NO: 208141 - DNA, 27 bp, Artificial sequence
  SiRNA target sequence
atattattgcaatcgttaatgtgattg

SEQ ID NO: 208142 - DNA, 27 bp, Artificial sequence
  SiRNA target sequence
tattattgcaatcgttaatgtgattgg

SEQ ID NO: 208143 - DNA, 27 bp, Artificial sequence
  SiRNA target sequence
attattgcaatcgttaatgtgattgga

SEQ ID NO: 208144 - DNA, 27 bp, Artificial sequence
  SiRNA target sequence
ttattgcaatcgttaatgtgattggac

SEQ ID NO: 208145 - DNA, 27 bp, Artificial sequence
  SiRNA target sequence
tattgcaatcgttaatgtgattggact

SEQ ID NO: 208146 - DNA, 27 bp, Artificial sequence
  SiRNA target sequence
attgcaatcgttaatgtgattggacta

SEQ ID NO: 208147 - DNA, 27 bp, Artificial sequence
  SiRNA target sequence
ttgcaatcgttaatgtgattggactac

SEQ ID NO: 208148 - DNA, 27 bp, Artificial sequence
  SiRNA target sequence
tgcaatcgttaatgtgattggactacc

SEQ ID NO: 208149 - DNA, 27 bp, Artificial sequence
  SiRNA target sequence
gcaatcgttaatgtgattggactaccc

SEQ ID NO: 208150 - DNA, 27 bp, Artificial sequence
  SiRNA target sequence
caatcgttaatgtgattggactaccct

SEQ ID NO: 208151 - DNA, 27 bp, Artificial sequence
  SiRNA target sequence
aatcgttaatgtgattggactaccctt

SEQ ID NO: 208152 - DNA, 27 bp, Artificial sequence
  SiRNA target sequence
atcgttaatgtgattggactacccttc

SEQ ID NO: 208153 - DNA, 27 bp, Artificial sequence
  SiRNA target sequence
tcgttaatgtgattggactacccttcc

SEQ ID NO: 208154 - DNA, 27 bp, Artificial sequence
  SiRNA target sequence
cgttaatgtgattggactacccttcct

SEQ ID NO: 208155 - DNA, 27 bp, Artificial sequence
  SiRNA target sequence
gttaatgtgattggactacccttcctt

SEQ ID NO: 208156 - DNA, 27 bp, Artificial sequence
  SiRNA target sequence
ttaatgtgattggactacccttcctta

SEQ ID NO: 208157 - DNA, 27 bp, Artificial sequence
  SiRNA target sequence
taatgtgattggactacccttccttac

SEQ ID NO: 208158 - DNA, 27 bp, Artificial sequence
  SiRNA target sequence
aatgtgattggactacccttccttaca

SEQ ID NO: 208159 - DNA, 27 bp, Artificial sequence
  SiRNA target sequence
atgtgattggactacccttccttacat

SEQ ID NO: 208160 - DNA, 27 bp, Artificial sequence
  SiRNA target sequence
tgtgattggactacccttccttacatt

SEQ ID NO: 208161 - DNA, 27 bp, Artificial sequence
  SiRNA target sequence
gtgattggactacccttccttacatta

SEQ ID NO: 208162 - DNA, 27 bp, Artificial sequence
  SiRNA target sequence
tgattggactacccttccttacattat

SEQ ID NO: 208163 - DNA, 27 bp, Artificial sequence
  SiRNA target sequence
gattggactacccttccttacattatc

SEQ ID NO: 208164 - DNA, 27 bp, Artificial sequence
  SiRNA target sequence
attggactacccttccttacattatca

SEQ ID NO: 208165 - DNA, 27 bp, Artificial sequence
  SiRNA target sequence
ttggactacccttccttacattatcag

SEQ ID NO: 208166 - DNA, 27 bp, Artificial sequence
  SiRNA target sequence
tggactacccttccttacattatcagt

SEQ ID NO: 208167 - DNA, 27 bp, Artificial sequence
  SiRNA target sequence
ggactacccttccttacattatcagta

SEQ ID NO: 208168 - DNA, 27 bp, Artificial sequence
  SiRNA target sequence
gactacccttccttacattatcagtat

SEQ ID NO: 208169 - DNA, 27 bp, Artificial sequence
  SiRNA target sequence
actacccttccttacattatcagtatc

SEQ ID NO: 208170 - DNA, 27 bp, Artificial sequence
  SiRNA target sequence
ctacccttccttacattatcagtatca

SEQ ID NO: 208171 - DNA, 27 bp, Artificial sequence
  SiRNA target sequence
tacccttccttacattatcagtatcaa

SEQ ID NO: 208172 - DNA, 27 bp, Artificial sequence
  SiRNA target sequence
acccttccttacattatcagtatcaag

SEQ ID NO: 208173 - DNA, 27 bp, Artificial sequence
  SiRNA target sequence
cccttccttacattatcagtatcaagt

SEQ ID NO: 208174 - DNA, 27 bp, Artificial sequence
  SiRNA target sequence
ccttccttacattatcagtatcaagtg

SEQ ID NO: 208175 - DNA, 27 bp, Artificial sequence
  SiRNA target sequence
cttccttacattatcagtatcaagtgc

SEQ ID NO: 208176 - DNA, 27 bp, Artificial sequence
  SiRNA target sequence
ttccttacattatcagtatcaagtgct

SEQ ID NO: 208177 - DNA, 27 bp, Artificial sequence
  SiRNA target sequence
tccttacattatcagtatcaagtgcta

SEQ ID NO: 208178 - DNA, 27 bp, Artificial sequence
  SiRNA target sequence
ccttacattatcagtatcaagtgctac

SEQ ID NO: 208179 - DNA, 27 bp, Artificial sequence
  SiRNA target sequence
cttacattatcagtatcaagtgctact

SEQ ID NO: 208180 - DNA, 27 bp, Artificial sequence
  SiRNA target sequence
ttacattatcagtatcaagtgctacta

SEQ ID NO: 208181 - DNA, 27 bp, Artificial sequence
  SiRNA target sequence
tacattatcagtatcaagtgctactaa

SEQ ID NO: 208182 - DNA, 27 bp, Artificial sequence
  SiRNA target sequence
acattatcagtatcaagtgctactaat

SEQ ID NO: 208183 - DNA, 27 bp, Artificial sequence
  SiRNA target sequence
cattatcagtatcaagtgctactaata

SEQ ID NO: 208184 - DNA, 27 bp, Artificial sequence
  SiRNA target sequence
attatcagtatcaagtgctactaatat

SEQ ID NO: 208185 - DNA, 27 bp, Artificial sequence
  SiRNA target sequence
ttatcagtatcaagtgctactaatatg

SEQ ID NO: 208186 - DNA, 27 bp, Artificial sequence
  SiRNA target sequence
tatcagtatcaagtgctactaatatgg

SEQ ID NO: 208187 - DNA, 27 bp, Artificial sequence
  SiRNA target sequence
atcagtatcaagtgctactaatatggc

SEQ ID NO: 208188 - DNA, 27 bp, Artificial sequence
  SiRNA target sequence
tcagtatcaagtgctactaatatggct

SEQ ID NO: 208189 - DNA, 27 bp, Artificial sequence
  SiRNA target sequence
cagtatcaagtgctactaatatggcta

SEQ ID NO: 208190 - DNA, 27 bp, Artificial sequence
  SiRNA target sequence
agtatcaagtgctactaatatggctag

SEQ ID NO: 208191 - DNA, 27 bp, Artificial sequence
  SiRNA target sequence
gtatcaagtgctactaatatggctagt

SEQ ID NO: 208192 - DNA, 27 bp, Artificial sequence
  SiRNA target sequence
tatcaagtgctactaatatggctagtc

SEQ ID NO: 208193 - DNA, 27 bp, Artificial sequence
  SiRNA target sequence
atcaagtgctactaatatggctagtcc

SEQ ID NO: 208194 - DNA, 27 bp, Artificial sequence
  SiRNA target sequence
tcaagtgctactaatatggctagtcca

SEQ ID NO: 208195 - DNA, 27 bp, Artificial sequence
  SiRNA target sequence
caagtgctactaatatggctagtccat

SEQ ID NO: 208196 - DNA, 27 bp, Artificial sequence
  SiRNA target sequence
aagtgctactaatatggctagtccata

SEQ ID NO: 208197 - DNA, 27 bp, Artificial sequence
  SiRNA target sequence
agtgctactaatatggctagtccatat

SEQ ID NO: 208198 - DNA, 27 bp, Artificial sequence
  SiRNA target sequence
gtgctactaatatggctagtccatata

SEQ ID NO: 208199 - DNA, 27 bp, Artificial sequence
  SiRNA target sequence
tgctactaatatggctagtccatataa

SEQ ID NO: 208200 - DNA, 27 bp, Artificial sequence
  SiRNA target sequence
gctactaatatggctagtccatataat

SEQ ID NO: 208201 - DNA, 27 bp, Artificial sequence
  SiRNA target sequence
ctactaatatggctagtccatataatg

SEQ ID NO: 208202 - DNA, 27 bp, Artificial sequence
  SiRNA target sequence
tactaatatggctagtccatataatga

SEQ ID NO: 208203 - DNA, 27 bp, Artificial sequence
  SiRNA target sequence
actaatatggctagtccatataatgaa

SEQ ID NO: 208204 - DNA, 27 bp, Artificial sequence
  SiRNA target sequence
ctaatatggctagtccatataatgaac

SEQ ID NO: 208205 - DNA, 27 bp, Artificial sequence
  SiRNA target sequence
taatatggctagtccatataatgaacc

SEQ ID NO: 208206 - DNA, 27 bp, Artificial sequence
  SiRNA target sequence
aatatggctagtccatataatgaacca

SEQ ID NO: 208207 - DNA, 27 bp, Artificial sequence
  SiRNA target sequence
atatggctagtccatataatgaaccaa

SEQ ID NO: 208208 - DNA, 27 bp, Artificial sequence
  SiRNA target sequence
tatggctagtccatataatgaaccaat

SEQ ID NO: 208209 - DNA, 27 bp, Artificial sequence
  SiRNA target sequence
atggctagtccatataatgaaccaata

SEQ ID NO: 208210 - DNA, 27 bp, Artificial sequence
  SiRNA target sequence
tggctagtccatataatgaaccaatag

SEQ ID NO: 208211 - DNA, 27 bp, Artificial sequence
  SiRNA target sequence
ggctagtccatataatgaaccaataga

SEQ ID NO: 208212 - DNA, 27 bp, Artificial sequence
  SiRNA target sequence
gctagtccatataatgaaccaatagat

SEQ ID NO: 208213 - DNA, 27 bp, Artificial sequence
  SiRNA target sequence
ctagtccatataatgaaccaatagatt

SEQ ID NO: 208214 - DNA, 27 bp, Artificial sequence
  SiRNA target sequence
tagtccatataatgaaccaatagattt

SEQ ID NO: 208215 - DNA, 27 bp, Artificial sequence
  SiRNA target sequence
agtccatataatgaaccaatagatttt

SEQ ID NO: 208216 - DNA, 27 bp, Artificial sequence
  SiRNA target sequence
gtccatataatgaaccaatagattttc

SEQ ID NO: 208217 - DNA, 27 bp, Artificial sequence
  SiRNA target sequence
tccatataatgaaccaatagattttcc

SEQ ID NO: 208218 - DNA, 27 bp, Artificial sequence
  SiRNA target sequence
ccatataatgaaccaatagattttcct

SEQ ID NO: 208219 - DNA, 27 bp, Artificial sequence
  SiRNA target sequence
catataatgaaccaatagattttccta

SEQ ID NO: 208220 - DNA, 27 bp, Artificial sequence
  SiRNA target sequence
atataatgaaccaatagattttcctaa

SEQ ID NO: 208221 - DNA, 27 bp, Artificial sequence
  SiRNA target sequence
tataatgaaccaatagattttcctaat

SEQ ID NO: 208222 - DNA, 27 bp, Artificial sequence
  SiRNA target sequence
ataatgaaccaatagattttcctaatt

SEQ ID NO: 208223 - DNA, 27 bp, Artificial sequence
  SiRNA target sequence
taatgaaccaatagattttcctaattt

SEQ ID NO: 208224 - DNA, 27 bp, Artificial sequence
  SiRNA target sequence
aatgaaccaatagattttcctaattta

SEQ ID NO: 208225 - DNA, 27 bp, Artificial sequence
  SiRNA target sequence
atgaaccaatagattttcctaatttat

SEQ ID NO: 208226 - DNA, 27 bp, Artificial sequence
  SiRNA target sequence
tgaaccaatagattttcctaatttatt

SEQ ID NO: 208227 - DNA, 27 bp, Artificial sequence
  SiRNA target sequence
gaaccaatagattttcctaatttatta

SEQ ID NO: 208228 - DNA, 27 bp, Artificial sequence
  SiRNA target sequence
aaccaatagattttcctaatttattaa

SEQ ID NO: 208229 - DNA, 27 bp, Artificial sequence
  SiRNA target sequence
accaatagattttcctaatttattaaa

SEQ ID NO: 208230 - DNA, 27 bp, Artificial sequence
  SiRNA target sequence
ccaatagattttcctaatttattaaaa

SEQ ID NO: 208231 - DNA, 27 bp, Artificial sequence
  SiRNA target sequence
caatagattttcctaatttattaaaaa

SEQ ID NO: 208232 - DNA, 27 bp, Artificial sequence
  SiRNA target sequence
aatagattttcctaatttattaaaaat

SEQ ID NO: 208233 - DNA, 27 bp, Artificial sequence
  SiRNA target sequence
atagattttcctaatttattaaaaata

SEQ ID NO: 208234 - DNA, 27 bp, Artificial sequence
  SiRNA target sequence
tagattttcctaatttattaaaaatac

SEQ ID NO: 208235 - DNA, 27 bp, Artificial sequence
  SiRNA target sequence
agattttcctaatttattaaaaatacc

SEQ ID NO: 208236 - DNA, 27 bp, Artificial sequence
  SiRNA target sequence
gattttcctaatttattaaaaatacca

SEQ ID NO: 208237 - DNA, 27 bp, Artificial sequence
  SiRNA target sequence
attttcctaatttattaaaaataccat

SEQ ID NO: 208238 - DNA, 27 bp, Artificial sequence
  SiRNA target sequence
ttttcctaatttattaaaaataccatc

SEQ ID NO: 208239 - DNA, 27 bp, Artificial sequence
  SiRNA target sequence
tttcctaatttattaaaaataccatca

SEQ ID NO: 208240 - DNA, 27 bp, Artificial sequence
  SiRNA target sequence
ttcctaatttattaaaaataccatcat

SEQ ID NO: 208241 - DNA, 27 bp, Artificial sequence
  SiRNA target sequence
tcctaatttattaaaaataccatcata

SEQ ID NO: 208242 - DNA, 27 bp, Artificial sequence
  SiRNA target sequence
cctaatttattaaaaataccatcataa

SEQ ID NO: 208243 - DNA, 27 bp, Artificial sequence
  SiRNA target sequence
ctaatttattaaaaataccatcataaa

SEQ ID NO: 208244 - DNA, 27 bp, Artificial sequence
  SiRNA target sequence
taatttattaaaaataccatcataaac

SEQ ID NO: 208245 - DNA, 27 bp, Artificial sequence
  SiRNA target sequence
aatttattaaaaataccatcataaaca

SEQ ID NO: 208246 - DNA, 27 bp, Artificial sequence
  SiRNA target sequence
atttattaaaaataccatcataaacac

SEQ ID NO: 208247 - DNA, 27 bp, Artificial sequence
  SiRNA target sequence
tttattaaaaataccatcataaacact

SEQ ID NO: 208248 - DNA, 27 bp, Artificial sequence
  SiRNA target sequence
ttattaaaaataccatcataaacactt

SEQ ID NO: 208249 - DNA, 27 bp, Artificial sequence
  SiRNA target sequence
tattaaaaataccatcataaacacttt

SEQ ID NO: 208250 - DNA, 27 bp, Artificial sequence
  SiRNA target sequence
attaaaaataccatcataaacactttt

SEQ ID NO: 208251 - DNA, 27 bp, Artificial sequence
  SiRNA target sequence
ttaaaaataccatcataaacactttta

SEQ ID NO: 208252 - DNA, 27 bp, Artificial sequence
  SiRNA target sequence
taaaaataccatcataaacacttttaa

SEQ ID NO: 208253 - DNA, 27 bp, Artificial sequence
  SiRNA target sequence
aaaaataccatcataaacacttttaaa

SEQ ID NO: 208254 - DNA, 27 bp, Artificial sequence
  SiRNA target sequence
aaaataccatcataaacacttttaaac

SEQ ID NO: 208255 - DNA, 27 bp, Artificial sequence
  SiRNA target sequence
aaataccatcataaacacttttaaacc

SEQ ID NO: 208256 - DNA, 27 bp, Artificial sequence
  SiRNA target sequence
aataccatcataaacacttttaaaccg

SEQ ID NO: 208257 - DNA, 27 bp, Artificial sequence
  SiRNA target sequence
ataccatcataaacacttttaaaccgt

SEQ ID NO: 208258 - DNA, 27 bp, Artificial sequence
  SiRNA target sequence
taccatcataaacacttttaaaccgtg

SEQ ID NO: 208259 - DNA, 27 bp, Artificial sequence
  SiRNA target sequence
accatcataaacacttttaaaccgtgc

SEQ ID NO: 208260 - DNA, 27 bp, Artificial sequence
  SiRNA target sequence
ccatcataaacacttttaaaccgtgcc

SEQ ID NO: 208261 - DNA, 27 bp, Artificial sequence
  SiRNA target sequence
catcataaacacttttaaaccgtgccc

SEQ ID NO: 208262 - DNA, 27 bp, Artificial sequence
  SiRNA target sequence
atcataaacacttttaaaccgtgccct

SEQ ID NO: 208263 - DNA, 27 bp, Artificial sequence
  SiRNA target sequence
tcataaacacttttaaaccgtgccctg

SEQ ID NO: 208264 - DNA, 27 bp, Artificial sequence
  SiRNA target sequence
cataaacacttttaaaccgtgccctgt

SEQ ID NO: 208265 - DNA, 27 bp, Artificial sequence
  SiRNA target sequence
ataaacacttttaaaccgtgccctgtg

SEQ ID NO: 208266 - DNA, 27 bp, Artificial sequence
  SiRNA target sequence
taaacacttttaaaccgtgccctgtgt

SEQ ID NO: 208267 - DNA, 27 bp, Artificial sequence
  SiRNA target sequence
aaacacttttaaaccgtgccctgtgtg

SEQ ID NO: 208268 - DNA, 27 bp, Artificial sequence
  SiRNA target sequence
aacacttttaaaccgtgccctgtgtgc

SEQ ID NO: 208269 - DNA, 27 bp, Artificial sequence
  SiRNA target sequence
acacttttaaaccgtgccctgtgtgca

SEQ ID NO: 208270 - DNA, 27 bp, Artificial sequence
  SiRNA target sequence
cacttttaaaccgtgccctgtgtgcag

SEQ ID NO: 208271 - DNA, 27 bp, Artificial sequence
  SiRNA target sequence
acttttaaaccgtgccctgtgtgcagg

SEQ ID NO: 208272 - DNA, 27 bp, Artificial sequence
  SiRNA target sequence
cttttaaaccgtgccctgtgtgcagga

SEQ ID NO: 208273 - DNA, 27 bp, Artificial sequence
  SiRNA target sequence
ttttaaaccgtgccctgtgtgcaggat

SEQ ID NO: 208274 - DNA, 27 bp, Artificial sequence
  SiRNA target sequence
tttaaaccgtgccctgtgtgcaggatc

SEQ ID NO: 208275 - DNA, 27 bp, Artificial sequence
  SiRNA target sequence
ttaaaccgtgccctgtgtgcaggatcg

SEQ ID NO: 208276 - DNA, 27 bp, Artificial sequence
  SiRNA target sequence
taaaccgtgccctgtgtgcaggatcga

SEQ ID NO: 208277 - DNA, 27 bp, Artificial sequence
  SiRNA target sequence
aaaccgtgccctgtgtgcaggatcgat

SEQ ID NO: 208278 - DNA, 27 bp, Artificial sequence
  SiRNA target sequence
aaccgtgccctgtgtgcaggatcgatt

SEQ ID NO: 208279 - DNA, 27 bp, Artificial sequence
  SiRNA target sequence
accgtgccctgtgtgcaggatcgattc

SEQ ID NO: 208280 - DNA, 27 bp, Artificial sequence
  SiRNA target sequence
ccgtgccctgtgtgcaggatcgattct

SEQ ID NO: 208281 - DNA, 27 bp, Artificial sequence
  SiRNA target sequence
cgtgccctgtgtgcaggatcgattctc

SEQ ID NO: 208282 - DNA, 27 bp, Artificial sequence
  SiRNA target sequence
gtgccctgtgtgcaggatcgattctca

SEQ ID NO: 208283 - DNA, 27 bp, Artificial sequence
  SiRNA target sequence
tgccctgtgtgcaggatcgattctcat

SEQ ID NO: 208284 - DNA, 27 bp, Artificial sequence
  SiRNA target sequence
gccctgtgtgcaggatcgattctcata

SEQ ID NO: 208285 - DNA, 27 bp, Artificial sequence
  SiRNA target sequence
ccctgtgtgcaggatcgattctcatac

SEQ ID NO: 208286 - DNA, 27 bp, Artificial sequence
  SiRNA target sequence
cctgtgtgcaggatcgattctcatacc

SEQ ID NO: 208287 - DNA, 27 bp, Artificial sequence
  SiRNA target sequence
ctgtgtgcaggatcgattctcataccc

SEQ ID NO: 208288 - DNA, 27 bp, Artificial sequence
  SiRNA target sequence
tgtgtgcaggatcgattctcataccca

SEQ ID NO: 208289 - DNA, 27 bp, Artificial sequence
  SiRNA target sequence
gtgtgcaggatcgattctcatacccat

SEQ ID NO: 208290 - DNA, 27 bp, Artificial sequence
  SiRNA target sequence
tgtgcaggatcgattctcatacccatt

SEQ ID NO: 208291 - DNA, 27 bp, Artificial sequence
  SiRNA target sequence
gtgcaggatcgattctcatacccattt

SEQ ID NO: 208292 - DNA, 27 bp, Artificial sequence
  SiRNA target sequence
tgcaggatcgattctcatacccatttt

SEQ ID NO: 208293 - DNA, 27 bp, Artificial sequence
  SiRNA target sequence
gcaggatcgattctcatacccattttc

SEQ ID NO: 208294 - DNA, 27 bp, Artificial sequence
  SiRNA target sequence
caggatcgattctcatacccattttct

SEQ ID NO: 208295 - DNA, 27 bp, Artificial sequence
  SiRNA target sequence
aggatcgattctcatacccattttctc

SEQ ID NO: 208296 - DNA, 27 bp, Artificial sequence
  SiRNA target sequence
ggatcgattctcatacccattttctct

SEQ ID NO: 208297 - DNA, 27 bp, Artificial sequence
  SiRNA target sequence
gatcgattctcatacccattttctctt

SEQ ID NO: 208298 - DNA, 27 bp, Artificial sequence
  SiRNA target sequence
atcgattctcatacccattttctcttt

SEQ ID NO: 208299 - DNA, 27 bp, Artificial sequence
  SiRNA target sequence
tcgattctcatacccattttctcttta

SEQ ID NO: 208300 - DNA, 27 bp, Artificial sequence
  SiRNA target sequence
cgattctcatacccattttctctttac

SEQ ID NO: 208301 - DNA, 27 bp, Artificial sequence
  SiRNA target sequence
gattctcatacccattttctctttaca

SEQ ID NO: 208302 - DNA, 27 bp, Artificial sequence
  SiRNA target sequence
attctcatacccattttctctttacaa

SEQ ID NO: 208303 - DNA, 27 bp, Artificial sequence
  SiRNA target sequence
ttctcatacccattttctctttacaaa

SEQ ID NO: 208304 - DNA, 27 bp, Artificial sequence
  SiRNA target sequence
tctcatacccattttctctttacaaat

SEQ ID NO: 208305 - DNA, 27 bp, Artificial sequence
  SiRNA target sequence
ctcatacccattttctctttacaaata

SEQ ID NO: 208306 - DNA, 27 bp, Artificial sequence
  SiRNA target sequence
tcatacccattttctctttacaaatat

SEQ ID NO: 208307 - DNA, 27 bp, Artificial sequence
  SiRNA target sequence
catacccattttctctttacaaatatc

SEQ ID NO: 208308 - DNA, 27 bp, Artificial sequence
  SiRNA target sequence
atacccattttctctttacaaatatca

SEQ ID NO: 208309 - DNA, 27 bp, Artificial sequence
  SiRNA target sequence
tacccattttctctttacaaatatcaa

SEQ ID NO: 208310 - DNA, 27 bp, Artificial sequence
  SiRNA target sequence
acccattttctctttacaaatatcaaa

SEQ ID NO: 208311 - DNA, 27 bp, Artificial sequence
  SiRNA target sequence
cccattttctctttacaaatatcaaag

SEQ ID NO: 208312 - DNA, 27 bp, Artificial sequence
  SiRNA target sequence
ccattttctctttacaaatatcaaagg

SEQ ID NO: 208313 - DNA, 27 bp, Artificial sequence
  SiRNA target sequence
cattttctctttacaaatatcaaaggc

SEQ ID NO: 208314 - DNA, 27 bp, Artificial sequence
  SiRNA target sequence
attttctctttacaaatatcaaaggct

SEQ ID NO: 208315 - DNA, 27 bp, Artificial sequence
  SiRNA target sequence
ttttctctttacaaatatcaaaggctg

SEQ ID NO: 208316 - DNA, 27 bp, Artificial sequence
  SiRNA target sequence
tttctctttacaaatatcaaaggctga

SEQ ID NO: 208317 - DNA, 27 bp, Artificial sequence
  SiRNA target sequence
ttctctttacaaatatcaaaggctgaa

SEQ ID NO: 208318 - DNA, 27 bp, Artificial sequence
  SiRNA target sequence
tctctttacaaatatcaaaggctgaat

SEQ ID NO: 208319 - DNA, 27 bp, Artificial sequence
  SiRNA target sequence
ctctttacaaatatcaaaggctgaata

SEQ ID NO: 208320 - DNA, 27 bp, Artificial sequence
  SiRNA target sequence
tctttacaaatatcaaaggctgaatat

SEQ ID NO: 208321 - DNA, 27 bp, Artificial sequence
  SiRNA target sequence
ctttacaaatatcaaaggctgaatatt

SEQ ID NO: 208322 - DNA, 27 bp, Artificial sequence
  SiRNA target sequence
tttacaaatatcaaaggctgaatattt

SEQ ID NO: 208323 - DNA, 27 bp, Artificial sequence
  SiRNA target sequence
ttacaaatatcaaaggctgaatatttt

SEQ ID NO: 208324 - DNA, 27 bp, Artificial sequence
  SiRNA target sequence
tacaaatatcaaaggctgaatatttta

SEQ ID NO: 208325 - DNA, 27 bp, Artificial sequence
  SiRNA target sequence
acaaatatcaaaggctgaatattttaa

SEQ ID NO: 208326 - DNA, 27 bp, Artificial sequence
  SiRNA target sequence
caaatatcaaaggctgaatattttaat

SEQ ID NO: 208327 - DNA, 27 bp, Artificial sequence
  SiRNA target sequence
aaatatcaaaggctgaatattttaata

SEQ ID NO: 208328 - DNA, 27 bp, Artificial sequence
  SiRNA target sequence
aatatcaaaggctgaatattttaatac

SEQ ID NO: 208329 - DNA, 27 bp, Artificial sequence
  SiRNA target sequence
atatcaaaggctgaatattttaatact

SEQ ID NO: 208330 - DNA, 27 bp, Artificial sequence
  SiRNA target sequence
tatcaaaggctgaatattttaatactt

SEQ ID NO: 208331 - DNA, 27 bp, Artificial sequence
  SiRNA target sequence
atcaaaggctgaatattttaatacttt

SEQ ID NO: 208332 - DNA, 27 bp, Artificial sequence
  SiRNA target sequence
tcaaaggctgaatattttaatactttt

SEQ ID NO: 208333 - DNA, 27 bp, Artificial sequence
  SiRNA target sequence
caaaggctgaatattttaatactttta

SEQ ID NO: 208334 - DNA, 27 bp, Artificial sequence
  SiRNA target sequence
aaaggctgaatattttaatacttttat

SEQ ID NO: 208335 - DNA, 27 bp, Artificial sequence
  SiRNA target sequence
aaggctgaatattttaatacttttatg

SEQ ID NO: 208336 - DNA, 27 bp, Artificial sequence
  SiRNA target sequence
aggctgaatattttaatacttttatga

SEQ ID NO: 208337 - DNA, 27 bp, Artificial sequence
  SiRNA target sequence
ggctgaatattttaatacttttatgaa

SEQ ID NO: 208338 - DNA, 27 bp, Artificial sequence
  SiRNA target sequence
gctgaatattttaatacttttatgaat

SEQ ID NO: 208339 - DNA, 27 bp, Artificial sequence
  SiRNA target sequence
ctgaatattttaatacttttatgaatg

SEQ ID NO: 208340 - DNA, 27 bp, Artificial sequence
  SiRNA target sequence
tgaatattttaatacttttatgaatgc

SEQ ID NO: 208341 - DNA, 27 bp, Artificial sequence
  SiRNA target sequence
gaatattttaatacttttatgaatgct

SEQ ID NO: 208342 - DNA, 27 bp, Artificial sequence
  SiRNA target sequence
aatattttaatacttttatgaatgcta

SEQ ID NO: 208343 - DNA, 27 bp, Artificial sequence
  SiRNA target sequence
atattttaatacttttatgaatgctaa

SEQ ID NO: 208344 - DNA, 27 bp, Artificial sequence
  SiRNA target sequence
tattttaatacttttatgaatgctaaa

SEQ ID NO: 208345 - DNA, 27 bp, Artificial sequence
  SiRNA target sequence
attttaatacttttatgaatgctaaaa

SEQ ID NO: 208346 - DNA, 27 bp, Artificial sequence
  SiRNA target sequence
ttttaatacttttatgaatgctaaaaa

SEQ ID NO: 208347 - DNA, 27 bp, Artificial sequence
  SiRNA target sequence
tttaatacttttatgaatgctaaaaag

SEQ ID NO: 208348 - DNA, 27 bp, Artificial sequence
  SiRNA target sequence
ttaatacttttatgaatgctaaaaaga

SEQ ID NO: 208349 - DNA, 27 bp, Artificial sequence
  SiRNA target sequence
taatacttttatgaatgctaaaaagaa

SEQ ID NO: 208350 - DNA, 27 bp, Artificial sequence
  SiRNA target sequence
aatacttttatgaatgctaaaaagaac

SEQ ID NO: 208351 - DNA, 27 bp, Artificial sequence
  SiRNA target sequence
atacttttatgaatgctaaaaagaaca

SEQ ID NO: 208352 - DNA, 27 bp, Artificial sequence
  SiRNA target sequence
tacttttatgaatgctaaaaagaacat

SEQ ID NO: 208353 - DNA, 27 bp, Artificial sequence
  SiRNA target sequence
acttttatgaatgctaaaaagaacatt

SEQ ID NO: 208354 - DNA, 27 bp, Artificial sequence
  SiRNA target sequence
cttttatgaatgctaaaaagaacattc

SEQ ID NO: 208355 - DNA, 27 bp, Artificial sequence
  SiRNA target sequence
ttttatgaatgctaaaaagaacattcc

SEQ ID NO: 208356 - DNA, 27 bp, Artificial sequence
  SiRNA target sequence
tttatgaatgctaaaaagaacattcca

SEQ ID NO: 208357 - DNA, 27 bp, Artificial sequence
  SiRNA target sequence
ttatgaatgctaaaaagaacattccac

SEQ ID NO: 208358 - DNA, 27 bp, Artificial sequence
  SiRNA target sequence
tatgaatgctaaaaagaacattccact

SEQ ID NO: 208359 - DNA, 27 bp, Artificial sequence
  SiRNA target sequence
atgaatgctaaaaagaacattccactg

SEQ ID NO: 208360 - DNA, 27 bp, Artificial sequence
  SiRNA target sequence
tgaatgctaaaaagaacattccactgt

SEQ ID NO: 208361 - DNA, 27 bp, Artificial sequence
  SiRNA target sequence
gaatgctaaaaagaacattccactgta

SEQ ID NO: 208362 - DNA, 27 bp, Artificial sequence
  SiRNA target sequence
aatgctaaaaagaacattccactgtaa

SEQ ID NO: 208363 - DNA, 27 bp, Artificial sequence
  SiRNA target sequence
atgctaaaaagaacattccactgtaat

SEQ ID NO: 208364 - DNA, 27 bp, Artificial sequence
  SiRNA target sequence
tgctaaaaagaacattccactgtaatt

SEQ ID NO: 208365 - DNA, 27 bp, Artificial sequence
  SiRNA target sequence
gctaaaaagaacattccactgtaattt

SEQ ID NO: 208366 - DNA, 27 bp, Artificial sequence
  SiRNA target sequence
ctaaaaagaacattccactgtaatttt

SEQ ID NO: 208367 - DNA, 27 bp, Artificial sequence
  SiRNA target sequence
taaaaagaacattccactgtaattttc

SEQ ID NO: 208368 - DNA, 27 bp, Artificial sequence
  SiRNA target sequence
aaaaagaacattccactgtaattttcg

SEQ ID NO: 208369 - DNA, 27 bp, Artificial sequence
  SiRNA target sequence
aaaagaacattccactgtaattttcga

SEQ ID NO: 208370 - DNA, 27 bp, Artificial sequence
  SiRNA target sequence
aaagaacattccactgtaattttcgat

SEQ ID NO: 208371 - DNA, 27 bp, Artificial sequence
  SiRNA target sequence
aagaacattccactgtaattttcgatc

SEQ ID NO: 208372 - DNA, 27 bp, Artificial sequence
  SiRNA target sequence
agaacattccactgtaattttcgatcg

SEQ ID NO: 208373 - DNA, 27 bp, Artificial sequence
  SiRNA target sequence
gaacattccactgtaattttcgatcgt

SEQ ID NO: 208374 - DNA, 27 bp, Artificial sequence
  SiRNA target sequence
aacattccactgtaattttcgatcgta

SEQ ID NO: 208375 - DNA, 27 bp, Artificial sequence
  SiRNA target sequence
acattccactgtaattttcgatcgtat

SEQ ID NO: 208376 - DNA, 27 bp, Artificial sequence
  SiRNA target sequence
cattccactgtaattttcgatcgtata

SEQ ID NO: 208377 - DNA, 27 bp, Artificial sequence
  SiRNA target sequence
attccactgtaattttcgatcgtataa

SEQ ID NO: 208378 - DNA, 27 bp, Artificial sequence
  SiRNA target sequence
ttccactgtaattttcgatcgtataaa

SEQ ID NO: 208379 - DNA, 27 bp, Artificial sequence
  SiRNA target sequence
tccactgtaattttcgatcgtataaat

SEQ ID NO: 208380 - DNA, 27 bp, Artificial sequence
  SiRNA target sequence
ccactgtaattttcgatcgtataaatg

SEQ ID NO: 208381 - DNA, 27 bp, Artificial sequence
  SiRNA target sequence
cactgtaattttcgatcgtataaatgt

SEQ ID NO: 208382 - DNA, 27 bp, Artificial sequence
  SiRNA target sequence
actgtaattttcgatcgtataaatgta

SEQ ID NO: 208383 - DNA, 27 bp, Artificial sequence
  SiRNA target sequence
ctgtaattttcgatcgtataaatgtac

SEQ ID NO: 208384 - DNA, 27 bp, Artificial sequence
  SiRNA target sequence
tgtaattttcgatcgtataaatgtacg

SEQ ID NO: 208385 - DNA, 27 bp, Artificial sequence
  SiRNA target sequence
gtaattttcgatcgtataaatgtacga

SEQ ID NO: 208386 - DNA, 27 bp, Artificial sequence
  SiRNA target sequence
taattttcgatcgtataaatgtacgac

SEQ ID NO: 208387 - DNA, 27 bp, Artificial sequence
  SiRNA target sequence
aattttcgatcgtataaatgtacgaca

SEQ ID NO: 208388 - DNA, 27 bp, Artificial sequence
  SiRNA target sequence
attttcgatcgtataaatgtacgacat

SEQ ID NO: 208389 - DNA, 27 bp, Artificial sequence
  SiRNA target sequence
ttttcgatcgtataaatgtacgacatt

SEQ ID NO: 208390 - DNA, 27 bp, Artificial sequence
  SiRNA target sequence
tttcgatcgtataaatgtacgacattt

SEQ ID NO: 208391 - DNA, 27 bp, Artificial sequence
  SiRNA target sequence
ttcgatcgtataaatgtacgacatttt

SEQ ID NO: 208392 - DNA, 27 bp, Artificial sequence
  SiRNA target sequence
tcgatcgtataaatgtacgacattttt

SEQ ID NO: 208393 - DNA, 27 bp, Artificial sequence
  SiRNA target sequence
cgatcgtataaatgtacgacatttttt

SEQ ID NO: 208394 - DNA, 27 bp, Artificial sequence
  SiRNA target sequence
gatcgtataaatgtacgacattttttt

SEQ ID NO: 208395 - DNA, 27 bp, Artificial sequence
  SiRNA target sequence
atcgtataaatgtacgacattttttta

SEQ ID NO: 208396 - DNA, 27 bp, Artificial sequence
  SiRNA target sequence
tcgtataaatgtacgacatttttttaa

SEQ ID NO: 208397 - DNA, 27 bp, Artificial sequence
  SiRNA target sequence
cgtataaatgtacgacatttttttaaa

SEQ ID NO: 208398 - DNA, 27 bp, Artificial sequence
  SiRNA target sequence
gtataaatgtacgacatttttttaaaa

SEQ ID NO: 208399 - DNA, 27 bp, Artificial sequence
  SiRNA target sequence
tataaatgtacgacatttttttaaaaa

SEQ ID NO: 208400 - DNA, 27 bp, Artificial sequence
  SiRNA target sequence
ataaatgtacgacatttttttaaaaaa

SEQ ID NO: 208401 - DNA, 27 bp, Artificial sequence
  SiRNA target sequence
taaatgtacgacatttttttaaaaaat

SEQ ID NO: 208402 - DNA, 27 bp, Artificial sequence
  SiRNA target sequence
aaatgtacgacatttttttaaaaaata

SEQ ID NO: 208403 - DNA, 27 bp, Artificial sequence
  SiRNA target sequence
aatgtacgacatttttttaaaaaatac

SEQ ID NO: 208404 - DNA, 27 bp, Artificial sequence
  SiRNA target sequence
atgtacgacatttttttaaaaaataca

SEQ ID NO: 208405 - DNA, 27 bp, Artificial sequence
  SiRNA target sequence
tgtacgacatttttttaaaaaatacag

SEQ ID NO: 208406 - DNA, 27 bp, Artificial sequence
  SiRNA target sequence
gtacgacatttttttaaaaaatacaga

SEQ ID NO: 208407 - DNA, 27 bp, Artificial sequence
  SiRNA target sequence
tacgacatttttttaaaaaatacagaa

SEQ ID NO: 208408 - DNA, 27 bp, Artificial sequence
  SiRNA target sequence
acgacatttttttaaaaaatacagaaa

SEQ ID NO: 208409 - DNA, 27 bp, Artificial sequence
  SiRNA target sequence
cgacatttttttaaaaaatacagaaat

SEQ ID NO: 208410 - DNA, 27 bp, Artificial sequence
  SiRNA target sequence
gacatttttttaaaaaatacagaaatc

SEQ ID NO: 208411 - DNA, 27 bp, Artificial sequence
  SiRNA target sequence
acatttttttaaaaaatacagaaatcc

SEQ ID NO: 208412 - DNA, 27 bp, Artificial sequence
  SiRNA target sequence
catttttttaaaaaatacagaaatcca

SEQ ID NO: 208413 - DNA, 27 bp, Artificial sequence
  SiRNA target sequence
atttttttaaaaaatacagaaatccat

SEQ ID NO: 208414 - DNA, 27 bp, Artificial sequence
  SiRNA target sequence
tttttttaaaaaatacagaaatccatg

SEQ ID NO: 208415 - DNA, 27 bp, Artificial sequence
  SiRNA target sequence
ttttttaaaaaatacagaaatccatga

SEQ ID NO: 208416 - DNA, 27 bp, Artificial sequence
  SiRNA target sequence
tttttaaaaaatacagaaatccatgaa

SEQ ID NO: 208417 - DNA, 27 bp, Artificial sequence
  SiRNA target sequence
ttttaaaaaatacagaaatccatgaaa

SEQ ID NO: 208418 - DNA, 27 bp, Artificial sequence
  SiRNA target sequence
tttaaaaaatacagaaatccatgaaaa

SEQ ID NO: 208419 - DNA, 27 bp, Artificial sequence
  SiRNA target sequence
ttaaaaaatacagaaatccatgaaaaa

SEQ ID NO: 208420 - DNA, 27 bp, Artificial sequence
  SiRNA target sequence
taaaaaatacagaaatccatgaaaaag

SEQ ID NO: 208421 - DNA, 27 bp, Artificial sequence
  SiRNA target sequence
aaaaaatacagaaatccatgaaaaagc

SEQ ID NO: 208422 - DNA, 27 bp, Artificial sequence
  SiRNA target sequence
aaaaatacagaaatccatgaaaaagca

SEQ ID NO: 208423 - DNA, 27 bp, Artificial sequence
  SiRNA target sequence
aaaatacagaaatccatgaaaaagcaa

SEQ ID NO: 208424 - DNA, 27 bp, Artificial sequence
  SiRNA target sequence
aaatacagaaatccatgaaaaagcaag

SEQ ID NO: 208425 - DNA, 27 bp, Artificial sequence
  SiRNA target sequence
aatacagaaatccatgaaaaagcaagt

SEQ ID NO: 208426 - DNA, 27 bp, Artificial sequence
  SiRNA target sequence
atacagaaatccatgaaaaagcaagtc

SEQ ID NO: 208427 - DNA, 27 bp, Artificial sequence
  SiRNA target sequence
tacagaaatccatgaaaaagcaagtcc

SEQ ID NO: 208428 - DNA, 27 bp, Artificial sequence
  SiRNA target sequence
acagaaatccatgaaaaagcaagtcct

SEQ ID NO: 208429 - DNA, 27 bp, Artificial sequence
  SiRNA target sequence
cagaaatccatgaaaaagcaagtcctt

SEQ ID NO: 208430 - DNA, 27 bp, Artificial sequence
  SiRNA target sequence
agaaatccatgaaaaagcaagtccttc

SEQ ID NO: 208431 - DNA, 27 bp, Artificial sequence
  SiRNA target sequence
gaaatccatgaaaaagcaagtccttca

SEQ ID NO: 208432 - DNA, 27 bp, Artificial sequence
  SiRNA target sequence
aaatccatgaaaaagcaagtccttcaa

SEQ ID NO: 208433 - DNA, 27 bp, Artificial sequence
  SiRNA target sequence
aatccatgaaaaagcaagtccttcaat

SEQ ID NO: 208434 - DNA, 27 bp, Artificial sequence
  SiRNA target sequence
atccatgaaaaagcaagtccttcaatg

SEQ ID NO: 208435 - DNA, 27 bp, Artificial sequence
  SiRNA target sequence
tccatgaaaaagcaagtccttcaatgg

SEQ ID NO: 208436 - DNA, 27 bp, Artificial sequence
  SiRNA target sequence
ccatgaaaaagcaagtccttcaatggc

SEQ ID NO: 208437 - DNA, 27 bp, Artificial sequence
  SiRNA target sequence
catgaaaaagcaagtccttcaatggca

SEQ ID NO: 208438 - DNA, 27 bp, Artificial sequence
  SiRNA target sequence
atgaaaaagcaagtccttcaatggcag

SEQ ID NO: 208439 - DNA, 27 bp, Artificial sequence
  SiRNA target sequence
tgaaaaagcaagtccttcaatggcaga

SEQ ID NO: 208440 - DNA, 27 bp, Artificial sequence
  SiRNA target sequence
gaaaaagcaagtccttcaatggcagaa

SEQ ID NO: 208441 - DNA, 27 bp, Artificial sequence
  SiRNA target sequence
aaaaagcaagtccttcaatggcagaat

SEQ ID NO: 208442 - DNA, 27 bp, Artificial sequence
  SiRNA target sequence
aaaagcaagtccttcaatggcagaatt

SEQ ID NO: 208443 - DNA, 27 bp, Artificial sequence
  SiRNA target sequence
aaagcaagtccttcaatggcagaattg

SEQ ID NO: 208444 - DNA, 27 bp, Artificial sequence
  SiRNA target sequence
aagcaagtccttcaatggcagaattgt

SEQ ID NO: 208445 - DNA, 27 bp, Artificial sequence
  SiRNA target sequence
agcaagtccttcaatggcagaattgta

SEQ ID NO: 208446 - DNA, 27 bp, Artificial sequence
  SiRNA target sequence
gcaagtccttcaatggcagaattgtag

SEQ ID NO: 208447 - DNA, 27 bp, Artificial sequence
  SiRNA target sequence
caagtccttcaatggcagaattgtaga

SEQ ID NO: 208448 - DNA, 27 bp, Artificial sequence
  SiRNA target sequence
aagtccttcaatggcagaattgtagat

SEQ ID NO: 208449 - DNA, 27 bp, Artificial sequence
  SiRNA target sequence
agtccttcaatggcagaattgtagatt

SEQ ID NO: 208450 - DNA, 27 bp, Artificial sequence
  SiRNA target sequence
gtccttcaatggcagaattgtagattg

SEQ ID NO: 208451 - DNA, 27 bp, Artificial sequence
  SiRNA target sequence
tccttcaatggcagaattgtagattga

SEQ ID NO: 208452 - DNA, 27 bp, Artificial sequence
  SiRNA target sequence
ccttcaatggcagaattgtagattgat

SEQ ID NO: 208453 - DNA, 27 bp, Artificial sequence
  SiRNA target sequence
cttcaatggcagaattgtagattgatg

SEQ ID NO: 208454 - DNA, 27 bp, Artificial sequence
  SiRNA target sequence
ttcaatggcagaattgtagattgatgc

SEQ ID NO: 208455 - DNA, 27 bp, Artificial sequence
  SiRNA target sequence
tcaatggcagaattgtagattgatgct

SEQ ID NO: 208456 - DNA, 27 bp, Artificial sequence
  SiRNA target sequence
caatggcagaattgtagattgatgctc

SEQ ID NO: 208457 - DNA, 27 bp, Artificial sequence
  SiRNA target sequence
aatggcagaattgtagattgatgctcc

SEQ ID NO: 208458 - DNA, 27 bp, Artificial sequence
  SiRNA target sequence
atggcagaattgtagattgatgctccc

SEQ ID NO: 208459 - DNA, 27 bp, Artificial sequence
  SiRNA target sequence
tggcagaattgtagattgatgctccca

SEQ ID NO: 208460 - DNA, 27 bp, Artificial sequence
  SiRNA target sequence
ggcagaattgtagattgatgctcccat

SEQ ID NO: 208461 - DNA, 27 bp, Artificial sequence
  SiRNA target sequence
gcagaattgtagattgatgctcccata

SEQ ID NO: 208462 - DNA, 27 bp, Artificial sequence
  SiRNA target sequence
cagaattgtagattgatgctcccataa

SEQ ID NO: 208463 - DNA, 27 bp, Artificial sequence
  SiRNA target sequence
agaattgtagattgatgctcccataac

SEQ ID NO: 208464 - DNA, 27 bp, Artificial sequence
  SiRNA target sequence
gaattgtagattgatgctcccataacg

SEQ ID NO: 208465 - DNA, 27 bp, Artificial sequence
  SiRNA target sequence
aattgtagattgatgctcccataacga

SEQ ID NO: 208466 - DNA, 27 bp, Artificial sequence
  SiRNA target sequence
attgtagattgatgctcccataacgat

SEQ ID NO: 208467 - DNA, 27 bp, Artificial sequence
  SiRNA target sequence
ttgtagattgatgctcccataacgatt

SEQ ID NO: 208468 - DNA, 27 bp, Artificial sequence
  SiRNA target sequence
tgtagattgatgctcccataacgatta

SEQ ID NO: 208469 - DNA, 27 bp, Artificial sequence
  SiRNA target sequence
gtagattgatgctcccataacgattat

SEQ ID NO: 208470 - DNA, 27 bp, Artificial sequence
  SiRNA target sequence
tagattgatgctcccataacgattatt

SEQ ID NO: 208471 - DNA, 27 bp, Artificial sequence
  SiRNA target sequence
agattgatgctcccataacgattattg

SEQ ID NO: 208472 - DNA, 27 bp, Artificial sequence
  SiRNA target sequence
gattgatgctcccataacgattattga

SEQ ID NO: 208473 - DNA, 27 bp, Artificial sequence
  SiRNA target sequence
attgatgctcccataacgattattgac

SEQ ID NO: 208474 - DNA, 27 bp, Artificial sequence
  SiRNA target sequence
ttgatgctcccataacgattattgacc

SEQ ID NO: 208475 - DNA, 27 bp, Artificial sequence
  SiRNA target sequence
tgatgctcccataacgattattgaccc

SEQ ID NO: 208476 - DNA, 27 bp, Artificial sequence
  SiRNA target sequence
gatgctcccataacgattattgacccc

SEQ ID NO: 208477 - DNA, 27 bp, Artificial sequence
  SiRNA target sequence
atgctcccataacgattattgacccca

SEQ ID NO: 208478 - DNA, 27 bp, Artificial sequence
  SiRNA target sequence
tgctcccataacgattattgaccccaa

SEQ ID NO: 208479 - DNA, 27 bp, Artificial sequence
  SiRNA target sequence
gctcccataacgattattgaccccaac

SEQ ID NO: 208480 - DNA, 27 bp, Artificial sequence
  SiRNA target sequence
ctcccataacgattattgaccccaaca

SEQ ID NO: 208481 - DNA, 27 bp, Artificial sequence
  SiRNA target sequence
tcccataacgattattgaccccaacaa

SEQ ID NO: 208482 - DNA, 27 bp, Artificial sequence
  SiRNA target sequence
cccataacgattattgaccccaacaac

SEQ ID NO: 208483 - DNA, 27 bp, Artificial sequence
  SiRNA target sequence
ccataacgattattgaccccaacaaca

SEQ ID NO: 208484 - DNA, 27 bp, Artificial sequence
  SiRNA target sequence
cataacgattattgaccccaacaacaa

SEQ ID NO: 208485 - DNA, 27 bp, Artificial sequence
  SiRNA target sequence
ataacgattattgaccccaacaacaag

SEQ ID NO: 208486 - DNA, 27 bp, Artificial sequence
  SiRNA target sequence
taacgattattgaccccaacaacaaga

SEQ ID NO: 208487 - DNA, 27 bp, Artificial sequence
  SiRNA target sequence
aacgattattgaccccaacaacaagaa

SEQ ID NO: 208488 - DNA, 27 bp, Artificial sequence
  SiRNA target sequence
acgattattgaccccaacaacaagaat

SEQ ID NO: 208489 - DNA, 27 bp, Artificial sequence
  SiRNA target sequence
cgattattgaccccaacaacaagaata

SEQ ID NO: 208490 - DNA, 27 bp, Artificial sequence
  SiRNA target sequence
gattattgaccccaacaacaagaataa

SEQ ID NO: 208491 - DNA, 27 bp, Artificial sequence
  SiRNA target sequence
attattgaccccaacaacaagaataaa

SEQ ID NO: 208492 - DNA, 27 bp, Artificial sequence
  SiRNA target sequence
ttattgaccccaacaacaagaataaag

SEQ ID NO: 208493 - DNA, 27 bp, Artificial sequence
  SiRNA target sequence
tattgaccccaacaacaagaataaagg

SEQ ID NO: 208494 - DNA, 27 bp, Artificial sequence
  SiRNA target sequence
attgaccccaacaacaagaataaaggt

SEQ ID NO: 208495 - DNA, 27 bp, Artificial sequence
  SiRNA target sequence
ttgaccccaacaacaagaataaaggtg

SEQ ID NO: 208496 - DNA, 27 bp, Artificial sequence
  SiRNA target sequence
tgaccccaacaacaagaataaaggtgt

SEQ ID NO: 208497 - DNA, 27 bp, Artificial sequence
  SiRNA target sequence
gaccccaacaacaagaataaaggtgtt

SEQ ID NO: 208498 - DNA, 27 bp, Artificial sequence
  SiRNA target sequence
accccaacaacaagaataaaggtgtta

SEQ ID NO: 208499 - DNA, 27 bp, Artificial sequence
  SiRNA target sequence
ccccaacaacaagaataaaggtgttaa

SEQ ID NO: 208500 - DNA, 27 bp, Artificial sequence
  SiRNA target sequence
cccaacaacaagaataaaggtgttaag

SEQ ID NO: 208501 - DNA, 27 bp, Artificial sequence
  SiRNA target sequence
ccaacaacaagaataaaggtgttaaga

SEQ ID NO: 208502 - DNA, 27 bp, Artificial sequence
  SiRNA target sequence
caacaacaagaataaaggtgttaagag

SEQ ID NO: 208503 - DNA, 27 bp, Artificial sequence
  SiRNA target sequence
aacaacaagaataaaggtgttaagagt

SEQ ID NO: 208504 - DNA, 27 bp, Artificial sequence
  SiRNA target sequence
acaacaagaataaaggtgttaagagtc

SEQ ID NO: 208505 - DNA, 27 bp, Artificial sequence
  SiRNA target sequence
caacaagaataaaggtgttaagagtcc

SEQ ID NO: 208506 - DNA, 27 bp, Artificial sequence
  SiRNA target sequence
aacaagaataaaggtgttaagagtccc

SEQ ID NO: 208507 - DNA, 27 bp, Artificial sequence
  SiRNA target sequence
acaagaataaaggtgttaagagtccca

SEQ ID NO: 208508 - DNA, 27 bp, Artificial sequence
  SiRNA target sequence
caagaataaaggtgttaagagtcccat

SEQ ID NO: 208509 - DNA, 27 bp, Artificial sequence
  SiRNA target sequence
aagaataaaggtgttaagagtcccata

SEQ ID NO: 208510 - DNA, 27 bp, Artificial sequence
  SiRNA target sequence
agaataaaggtgttaagagtcccatag

SEQ ID NO: 208511 - DNA, 27 bp, Artificial sequence
  SiRNA target sequence
gaataaaggtgttaagagtcccatagt

SEQ ID NO: 208512 - DNA, 27 bp, Artificial sequence
  SiRNA target sequence
aataaaggtgttaagagtcccatagta

SEQ ID NO: 208513 - DNA, 27 bp, Artificial sequence
  SiRNA target sequence
ataaaggtgttaagagtcccatagtaa

SEQ ID NO: 208514 - DNA, 27 bp, Artificial sequence
  SiRNA target sequence
taaaggtgttaagagtcccatagtaat

SEQ ID NO: 208515 - DNA, 27 bp, Artificial sequence
  SiRNA target sequence
aaaggtgttaagagtcccatagtaatc

SEQ ID NO: 208516 - DNA, 27 bp, Artificial sequence
  SiRNA target sequence
aaggtgttaagagtcccatagtaatcc

SEQ ID NO: 208517 - DNA, 27 bp, Artificial sequence
  SiRNA target sequence
aggtgttaagagtcccatagtaatcca

SEQ ID NO: 208518 - DNA, 27 bp, Artificial sequence
  SiRNA target sequence
ggtgttaagagtcccatagtaatccat

SEQ ID NO: 208519 - DNA, 27 bp, Artificial sequence
  SiRNA target sequence
gtgttaagagtcccatagtaatccatc

SEQ ID NO: 208520 - DNA, 27 bp, Artificial sequence
  SiRNA target sequence
tgttaagagtcccatagtaatccatcc

SEQ ID NO: 208521 - DNA, 27 bp, Artificial sequence
  SiRNA target sequence
gttaagagtcccatagtaatccatcca

SEQ ID NO: 208522 - DNA, 27 bp, Artificial sequence
  SiRNA target sequence
ttaagagtcccatagtaatccatccac

SEQ ID NO: 208523 - DNA, 27 bp, Artificial sequence
  SiRNA target sequence
taagagtcccatagtaatccatccact

SEQ ID NO: 208524 - DNA, 27 bp, Artificial sequence
  SiRNA target sequence
aagagtcccatagtaatccatccacta

SEQ ID NO: 208525 - DNA, 27 bp, Artificial sequence
  SiRNA target sequence
agagtcccatagtaatccatccactac

SEQ ID NO: 208526 - DNA, 27 bp, Artificial sequence
  SiRNA target sequence
gagtcccatagtaatccatccactact

SEQ ID NO: 208527 - DNA, 27 bp, Artificial sequence
  SiRNA target sequence
agtcccatagtaatccatccactactt

SEQ ID NO: 208528 - DNA, 27 bp, Artificial sequence
  SiRNA target sequence
gtcccatagtaatccatccactacttt

SEQ ID NO: 208529 - DNA, 27 bp, Artificial sequence
  SiRNA target sequence
tcccatagtaatccatccactactttc

SEQ ID NO: 208530 - DNA, 27 bp, Artificial sequence
  SiRNA target sequence
cccatagtaatccatccactactttct

SEQ ID NO: 208531 - DNA, 27 bp, Artificial sequence
  SiRNA target sequence
ccatagtaatccatccactactttcta

SEQ ID NO: 208532 - DNA, 27 bp, Artificial sequence
  SiRNA target sequence
catagtaatccatccactactttctac

SEQ ID NO: 208533 - DNA, 27 bp, Artificial sequence
  SiRNA target sequence
atagtaatccatccactactttctact

SEQ ID NO: 208534 - DNA, 27 bp, Artificial sequence
  SiRNA target sequence
tagtaatccatccactactttctacta

SEQ ID NO: 208535 - DNA, 27 bp, Artificial sequence
  SiRNA target sequence
agtaatccatccactactttctactaa

SEQ ID NO: 208536 - DNA, 27 bp, Artificial sequence
  SiRNA target sequence
gtaatccatccactactttctactaaa

SEQ ID NO: 208537 - DNA, 27 bp, Artificial sequence
  SiRNA target sequence
taatccatccactactttctactaaag

SEQ ID NO: 208538 - DNA, 27 bp, Artificial sequence
  SiRNA target sequence
aatccatccactactttctactaaagt

SEQ ID NO: 208539 - DNA, 27 bp, Artificial sequence
  SiRNA target sequence
atccatccactactttctactaaagta

SEQ ID NO: 208540 - DNA, 27 bp, Artificial sequence
  SiRNA target sequence
tccatccactactttctactaaagtag

SEQ ID NO: 208541 - DNA, 27 bp, Artificial sequence
  SiRNA target sequence
ccatccactactttctactaaagtaga

SEQ ID NO: 208542 - DNA, 27 bp, Artificial sequence
  SiRNA target sequence
catccactactttctactaaagtagaa

SEQ ID NO: 208543 - DNA, 27 bp, Artificial sequence
  SiRNA target sequence
atccactactttctactaaagtagaaa

SEQ ID NO: 208544 - DNA, 27 bp, Artificial sequence
  SiRNA target sequence
tccactactttctactaaagtagaaaa

SEQ ID NO: 208545 - DNA, 27 bp, Artificial sequence
  SiRNA target sequence
ccactactttctactaaagtagaaaat

SEQ ID NO: 208546 - DNA, 27 bp, Artificial sequence
  SiRNA target sequence
cactactttctactaaagtagaaaatg

SEQ ID NO: 208547 - DNA, 27 bp, Artificial sequence
  SiRNA target sequence
actactttctactaaagtagaaaatgc

SEQ ID NO: 208548 - DNA, 27 bp, Artificial sequence
  SiRNA target sequence
ctactttctactaaagtagaaaatgct

SEQ ID NO: 208549 - DNA, 27 bp, Artificial sequence
  SiRNA target sequence
tactttctactaaagtagaaaatgctg

SEQ ID NO: 208550 - DNA, 27 bp, Artificial sequence
  SiRNA target sequence
actttctactaaagtagaaaatgctga

SEQ ID NO: 208551 - DNA, 27 bp, Artificial sequence
  SiRNA target sequence
ctttctactaaagtagaaaatgctgac

SEQ ID NO: 208552 - DNA, 27 bp, Artificial sequence
  SiRNA target sequence
tttctactaaagtagaaaatgctgaca

SEQ ID NO: 208553 - DNA, 27 bp, Artificial sequence
  SiRNA target sequence
ttctactaaagtagaaaatgctgacaa

SEQ ID NO: 208554 - DNA, 27 bp, Artificial sequence
  SiRNA target sequence
tctactaaagtagaaaatgctgacaaa

SEQ ID NO: 208555 - DNA, 27 bp, Artificial sequence
  SiRNA target sequence
ctactaaagtagaaaatgctgacaaat

SEQ ID NO: 208556 - DNA, 27 bp, Artificial sequence
  SiRNA target sequence
tactaaagtagaaaatgctgacaaatt

SEQ ID NO: 208557 - DNA, 27 bp, Artificial sequence
  SiRNA target sequence
actaaagtagaaaatgctgacaaatta

SEQ ID NO: 208558 - DNA, 27 bp, Artificial sequence
  SiRNA target sequence
ctaaagtagaaaatgctgacaaattaa

SEQ ID NO: 208559 - DNA, 27 bp, Artificial sequence
  SiRNA target sequence
taaagtagaaaatgctgacaaattaag

SEQ ID NO: 208560 - DNA, 27 bp, Artificial sequence
  SiRNA target sequence
aaagtagaaaatgctgacaaattaagt

SEQ ID NO: 208561 - DNA, 27 bp, Artificial sequence
  SiRNA target sequence
aagtagaaaatgctgacaaattaagtg

SEQ ID NO: 208562 - DNA, 27 bp, Artificial sequence
  SiRNA target sequence
agtagaaaatgctgacaaattaagtgt

SEQ ID NO: 208563 - DNA, 27 bp, Artificial sequence
  SiRNA target sequence
gtagaaaatgctgacaaattaagtgtt

SEQ ID NO: 208564 - DNA, 27 bp, Artificial sequence
  SiRNA target sequence
tagaaaatgctgacaaattaagtgtta

SEQ ID NO: 208565 - DNA, 27 bp, Artificial sequence
  SiRNA target sequence
agaaaatgctgacaaattaagtgttat

SEQ ID NO: 208566 - DNA, 27 bp, Artificial sequence
  SiRNA target sequence
gaaaatgctgacaaattaagtgttatt

SEQ ID NO: 208567 - DNA, 27 bp, Artificial sequence
  SiRNA target sequence
aaaatgctgacaaattaagtgttatta

SEQ ID NO: 208568 - DNA, 27 bp, Artificial sequence
  SiRNA target sequence
aaatgctgacaaattaagtgttattac

SEQ ID NO: 208569 - DNA, 27 bp, Artificial sequence
  SiRNA target sequence
aatgctgacaaattaagtgttattaca

SEQ ID NO: 208570 - DNA, 27 bp, Artificial sequence
  SiRNA target sequence
atgctgacaaattaagtgttattacag

SEQ ID NO: 208571 - DNA, 27 bp, Artificial sequence
  SiRNA target sequence
tgctgacaaattaagtgttattacagt

SEQ ID NO: 208572 - DNA, 27 bp, Artificial sequence
  SiRNA target sequence
gctgacaaattaagtgttattacagta

SEQ ID NO: 208573 - DNA, 27 bp, Artificial sequence
  SiRNA target sequence
ctgacaaattaagtgttattacagtaa

SEQ ID NO: 208574 - DNA, 27 bp, Artificial sequence
  SiRNA target sequence
tgacaaattaagtgttattacagtaac

SEQ ID NO: 208575 - DNA, 27 bp, Artificial sequence
  SiRNA target sequence
gacaaattaagtgttattacagtaact

SEQ ID NO: 208576 - DNA, 27 bp, Artificial sequence
  SiRNA target sequence
acaaattaagtgttattacagtaactg

SEQ ID NO: 208577 - DNA, 27 bp, Artificial sequence
  SiRNA target sequence
caaattaagtgttattacagtaactgc

SEQ ID NO: 208578 - DNA, 27 bp, Artificial sequence
  SiRNA target sequence
aaattaagtgttattacagtaactgct

SEQ ID NO: 208579 - DNA, 27 bp, Artificial sequence
  SiRNA target sequence
aattaagtgttattacagtaactgcta

SEQ ID NO: 208580 - DNA, 27 bp, Artificial sequence
  SiRNA target sequence
attaagtgttattacagtaactgctac

SEQ ID NO: 208581 - DNA, 27 bp, Artificial sequence
  SiRNA target sequence
ttaagtgttattacagtaactgctacc

SEQ ID NO: 208582 - DNA, 27 bp, Artificial sequence
  SiRNA target sequence
taagtgttattacagtaactgctacca

SEQ ID NO: 208583 - DNA, 27 bp, Artificial sequence
  SiRNA target sequence
aagtgttattacagtaactgctaccaa

SEQ ID NO: 208584 - DNA, 27 bp, Artificial sequence
  SiRNA target sequence
agtgttattacagtaactgctaccaat

SEQ ID NO: 208585 - DNA, 27 bp, Artificial sequence
  SiRNA target sequence
gtgttattacagtaactgctaccaata

SEQ ID NO: 208586 - DNA, 27 bp, Artificial sequence
  SiRNA target sequence
tgttattacagtaactgctaccaatat

SEQ ID NO: 208587 - DNA, 27 bp, Artificial sequence
  SiRNA target sequence
gttattacagtaactgctaccaatatt

SEQ ID NO: 208588 - DNA, 27 bp, Artificial sequence
  SiRNA target sequence
ttattacagtaactgctaccaatattt

SEQ ID NO: 208589 - DNA, 27 bp, Artificial sequence
  SiRNA target sequence
tattacagtaactgctaccaatatttg

SEQ ID NO: 208590 - DNA, 27 bp, Artificial sequence
  SiRNA target sequence
attacagtaactgctaccaatatttga

SEQ ID NO: 208591 - DNA, 27 bp, Artificial sequence
  SiRNA target sequence
ttacagtaactgctaccaatatttgat

SEQ ID NO: 208592 - DNA, 27 bp, Artificial sequence
  SiRNA target sequence
tacagtaactgctaccaatatttgatc

SEQ ID NO: 208593 - DNA, 27 bp, Artificial sequence
  SiRNA target sequence
acagtaactgctaccaatatttgatct

SEQ ID NO: 208594 - DNA, 27 bp, Artificial sequence
  SiRNA target sequence
cagtaactgctaccaatatttgatcta

SEQ ID NO: 208595 - DNA, 27 bp, Artificial sequence
  SiRNA target sequence
agtaactgctaccaatatttgatctat

SEQ ID NO: 208596 - DNA, 27 bp, Artificial sequence
  SiRNA target sequence
gtaactgctaccaatatttgatctatt

SEQ ID NO: 208597 - DNA, 27 bp, Artificial sequence
  SiRNA target sequence
taactgctaccaatatttgatctattg

SEQ ID NO: 208598 - DNA, 27 bp, Artificial sequence
  SiRNA target sequence
aactgctaccaatatttgatctattgt

SEQ ID NO: 208599 - DNA, 27 bp, Artificial sequence
  SiRNA target sequence
actgctaccaatatttgatctattgta

SEQ ID NO: 208600 - DNA, 27 bp, Artificial sequence
  SiRNA target sequence
ctgctaccaatatttgatctattgtat

SEQ ID NO: 208601 - DNA, 27 bp, Artificial sequence
  SiRNA target sequence
tgctaccaatatttgatctattgtatt

SEQ ID NO: 208602 - DNA, 27 bp, Artificial sequence
  SiRNA target sequence
gctaccaatatttgatctattgtatta

SEQ ID NO: 208603 - DNA, 27 bp, Artificial sequence
  SiRNA target sequence
ctaccaatatttgatctattgtattaa

SEQ ID NO: 208604 - DNA, 27 bp, Artificial sequence
  SiRNA target sequence
taccaatatttgatctattgtattaaa

SEQ ID NO: 208605 - DNA, 27 bp, Artificial sequence
  SiRNA target sequence
accaatatttgatctattgtattaaat

SEQ ID NO: 208606 - DNA, 27 bp, Artificial sequence
  SiRNA target sequence
ccaatatttgatctattgtattaaatt

SEQ ID NO: 208607 - DNA, 27 bp, Artificial sequence
  SiRNA target sequence
caatatttgatctattgtattaaattt

SEQ ID NO: 208608 - DNA, 27 bp, Artificial sequence
  SiRNA target sequence
aatatttgatctattgtattaaatttg

SEQ ID NO: 208609 - DNA, 27 bp, Artificial sequence
  SiRNA target sequence
atatttgatctattgtattaaatttgc

SEQ ID NO: 208610 - DNA, 27 bp, Artificial sequence
  SiRNA target sequence
tatttgatctattgtattaaatttgcc

SEQ ID NO: 208611 - DNA, 27 bp, Artificial sequence
  SiRNA target sequence
atttgatctattgtattaaatttgccg

SEQ ID NO: 208612 - DNA, 27 bp, Artificial sequence
  SiRNA target sequence
tttgatctattgtattaaatttgccgg

SEQ ID NO: 208613 - DNA, 27 bp, Artificial sequence
  SiRNA target sequence
ttgatctattgtattaaatttgccgga

SEQ ID NO: 208614 - DNA, 27 bp, Artificial sequence
  SiRNA target sequence
tgatctattgtattaaatttgccggag

SEQ ID NO: 208615 - DNA, 27 bp, Artificial sequence
  SiRNA target sequence
gatctattgtattaaatttgccggagt

SEQ ID NO: 208616 - DNA, 27 bp, Artificial sequence
  SiRNA target sequence
atctattgtattaaatttgccggagta

SEQ ID NO: 208617 - DNA, 27 bp, Artificial sequence
  SiRNA target sequence
tctattgtattaaatttgccggagtat

SEQ ID NO: 208618 - DNA, 27 bp, Artificial sequence
  SiRNA target sequence
ctattgtattaaatttgccggagtatt

SEQ ID NO: 208619 - DNA, 27 bp, Artificial sequence
  SiRNA target sequence
tattgtattaaatttgccggagtattc

SEQ ID NO: 208620 - DNA, 27 bp, Artificial sequence
  SiRNA target sequence
attgtattaaatttgccggagtattct

SEQ ID NO: 208621 - DNA, 27 bp, Artificial sequence
  SiRNA target sequence
ttgtattaaatttgccggagtattctc

SEQ ID NO: 208622 - DNA, 27 bp, Artificial sequence
  SiRNA target sequence
tgtattaaatttgccggagtattctcc

SEQ ID NO: 208623 - DNA, 27 bp, Artificial sequence
  SiRNA target sequence
gtattaaatttgccggagtattctcct

SEQ ID NO: 208624 - DNA, 27 bp, Artificial sequence
  SiRNA target sequence
tattaaatttgccggagtattctccta

SEQ ID NO: 208625 - DNA, 27 bp, Artificial sequence
  SiRNA target sequence
attaaatttgccggagtattctcctac

SEQ ID NO: 208626 - DNA, 27 bp, Artificial sequence
  SiRNA target sequence
ttaaatttgccggagtattctcctacc

SEQ ID NO: 208627 - DNA, 27 bp, Artificial sequence
  SiRNA target sequence
taaatttgccggagtattctcctacct

SEQ ID NO: 208628 - DNA, 27 bp, Artificial sequence
  SiRNA target sequence
aaatttgccggagtattctcctacctc

SEQ ID NO: 208629 - DNA, 27 bp, Artificial sequence
  SiRNA target sequence
aatttgccggagtattctcctacctct

SEQ ID NO: 208630 - DNA, 27 bp, Artificial sequence
  SiRNA target sequence
atttgccggagtattctcctacctcta

SEQ ID NO: 208631 - DNA, 27 bp, Artificial sequence
  SiRNA target sequence
tttgccggagtattctcctacctctaa

SEQ ID NO: 208632 - DNA, 27 bp, Artificial sequence
  SiRNA target sequence
ttgccggagtattctcctacctctaat

SEQ ID NO: 208633 - DNA, 27 bp, Artificial sequence
  SiRNA target sequence
tgccggagtattctcctacctctaatc

SEQ ID NO: 208634 - DNA, 27 bp, Artificial sequence
  SiRNA target sequence
gccggagtattctcctacctctaatcc

SEQ ID NO: 208635 - DNA, 27 bp, Artificial sequence
  SiRNA target sequence
ccggagtattctcctacctctaatcct

SEQ ID NO: 208636 - DNA, 27 bp, Artificial sequence
  SiRNA target sequence
cggagtattctcctacctctaatccta

SEQ ID NO: 208637 - DNA, 27 bp, Artificial sequence
  SiRNA target sequence
ggagtattctcctacctctaatcctaa

SEQ ID NO: 208638 - DNA, 27 bp, Artificial sequence
  SiRNA target sequence
gagtattctcctacctctaatcctaaa

SEQ ID NO: 208639 - DNA, 27 bp, Artificial sequence
  SiRNA target sequence
agtattctcctacctctaatcctaaac

SEQ ID NO: 208640 - DNA, 27 bp, Artificial sequence
  SiRNA target sequence
gtattctcctacctctaatcctaaact

SEQ ID NO: 208641 - DNA, 27 bp, Artificial sequence
  SiRNA target sequence
tattctcctacctctaatcctaaactt

SEQ ID NO: 208642 - DNA, 27 bp, Artificial sequence
  SiRNA target sequence
attctcctacctctaatcctaaacttt

SEQ ID NO: 208643 - DNA, 27 bp, Artificial sequence
  SiRNA target sequence
ttctcctacctctaatcctaaactttt

SEQ ID NO: 208644 - DNA, 27 bp, Artificial sequence
  SiRNA target sequence
tctcctacctctaatcctaaacttttt

SEQ ID NO: 208645 - DNA, 27 bp, Artificial sequence
  SiRNA target sequence
ctcctacctctaatcctaaactttttg

SEQ ID NO: 208646 - DNA, 27 bp, Artificial sequence
  SiRNA target sequence
tcctacctctaatcctaaactttttga

SEQ ID NO: 208647 - DNA, 27 bp, Artificial sequence
  SiRNA target sequence
cctacctctaatcctaaactttttgac

SEQ ID NO: 208648 - DNA, 27 bp, Artificial sequence
  SiRNA target sequence
ctacctctaatcctaaactttttgacg

SEQ ID NO: 208649 - DNA, 27 bp, Artificial sequence
  SiRNA target sequence
tacctctaatcctaaactttttgacgc

SEQ ID NO: 208650 - DNA, 27 bp, Artificial sequence
  SiRNA target sequence
acctctaatcctaaactttttgacgca

SEQ ID NO: 208651 - DNA, 27 bp, Artificial sequence
  SiRNA target sequence
cctctaatcctaaactttttgacgcag

SEQ ID NO: 208652 - DNA, 27 bp, Artificial sequence
  SiRNA target sequence
ctctaatcctaaactttttgacgcagc

SEQ ID NO: 208653 - DNA, 27 bp, Artificial sequence
  SiRNA target sequence
tctaatcctaaactttttgacgcagct

SEQ ID NO: 208654 - DNA, 27 bp, Artificial sequence
  SiRNA target sequence
ctaatcctaaactttttgacgcagctt

SEQ ID NO: 208655 - DNA, 27 bp, Artificial sequence
  SiRNA target sequence
taatcctaaactttttgacgcagcttt

SEQ ID NO: 208656 - DNA, 27 bp, Artificial sequence
  SiRNA target sequence
aatcctaaactttttgacgcagcttta

SEQ ID NO: 208657 - DNA, 27 bp, Artificial sequence
  SiRNA target sequence
atcctaaactttttgacgcagctttaa

SEQ ID NO: 208658 - DNA, 27 bp, Artificial sequence
  SiRNA target sequence
tcctaaactttttgacgcagctttaat

SEQ ID NO: 208659 - DNA, 27 bp, Artificial sequence
  SiRNA target sequence
cctaaactttttgacgcagctttaatt

SEQ ID NO: 208660 - DNA, 27 bp, Artificial sequence
  SiRNA target sequence
ctaaactttttgacgcagctttaattc

SEQ ID NO: 208661 - DNA, 27 bp, Artificial sequence
  SiRNA target sequence
taaactttttgacgcagctttaattcc

SEQ ID NO: 208662 - DNA, 27 bp, Artificial sequence
  SiRNA target sequence
aaactttttgacgcagctttaattcct

SEQ ID NO: 208663 - DNA, 27 bp, Artificial sequence
  SiRNA target sequence
aactttttgacgcagctttaattcctg

SEQ ID NO: 208664 - DNA, 27 bp, Artificial sequence
  SiRNA target sequence
actttttgacgcagctttaattcctgc

SEQ ID NO: 208665 - DNA, 27 bp, Artificial sequence
  SiRNA target sequence
ctttttgacgcagctttaattcctgct

SEQ ID NO: 208666 - DNA, 27 bp, Artificial sequence
  SiRNA target sequence
tttttgacgcagctttaattcctgctt

SEQ ID NO: 208667 - DNA, 27 bp, Artificial sequence
  SiRNA target sequence
ttttgacgcagctttaattcctgcttt

SEQ ID NO: 208668 - DNA, 27 bp, Artificial sequence
  SiRNA target sequence
tttgacgcagctttaattcctgcttta

SEQ ID NO: 208669 - DNA, 27 bp, Artificial sequence
  SiRNA target sequence
ttgacgcagctttaattcctgctttat

SEQ ID NO: 208670 - DNA, 27 bp, Artificial sequence
  SiRNA target sequence
tgacgcagctttaattcctgctttata

SEQ ID NO: 208671 - DNA, 27 bp, Artificial sequence
  SiRNA target sequence
gacgcagctttaattcctgctttatag

SEQ ID NO: 208672 - DNA, 27 bp, Artificial sequence
  SiRNA target sequence
acgcagctttaattcctgctttataga

SEQ ID NO: 208673 - DNA, 27 bp, Artificial sequence
  SiRNA target sequence
cgcagctttaattcctgctttatagac

SEQ ID NO: 208674 - DNA, 27 bp, Artificial sequence
  SiRNA target sequence
gcagctttaattcctgctttatagaca

SEQ ID NO: 208675 - DNA, 27 bp, Artificial sequence
  SiRNA target sequence
cagctttaattcctgctttatagacag

SEQ ID NO: 208676 - DNA, 27 bp, Artificial sequence
  SiRNA target sequence
agctttaattcctgctttatagacaga

SEQ ID NO: 208677 - DNA, 27 bp, Artificial sequence
  SiRNA target sequence
gctttaattcctgctttatagacagat

SEQ ID NO: 208678 - DNA, 27 bp, Artificial sequence
  SiRNA target sequence
ctttaattcctgctttatagacagatt

SEQ ID NO: 208679 - DNA, 27 bp, Artificial sequence
  SiRNA target sequence
tttaattcctgctttatagacagattc

SEQ ID NO: 208680 - DNA, 27 bp, Artificial sequence
  SiRNA target sequence
ttaattcctgctttatagacagattca

SEQ ID NO: 208681 - DNA, 27 bp, Artificial sequence
  SiRNA target sequence
taattcctgctttatagacagattcaa

SEQ ID NO: 208682 - DNA, 27 bp, Artificial sequence
  SiRNA target sequence
aattcctgctttatagacagattcaat

SEQ ID NO: 208683 - DNA, 27 bp, Artificial sequence
  SiRNA target sequence
attcctgctttatagacagattcaatt

SEQ ID NO: 208684 - DNA, 27 bp, Artificial sequence
  SiRNA target sequence
ttcctgctttatagacagattcaatta

SEQ ID NO: 208685 - DNA, 27 bp, Artificial sequence
  SiRNA target sequence
tcctgctttatagacagattcaattaa

SEQ ID NO: 208686 - DNA, 27 bp, Artificial sequence
  SiRNA target sequence
cctgctttatagacagattcaattaaa

SEQ ID NO: 208687 - DNA, 27 bp, Artificial sequence
  SiRNA target sequence
ctgctttatagacagattcaattaaat

SEQ ID NO: 208688 - DNA, 27 bp, Artificial sequence
  SiRNA target sequence
tgctttatagacagattcaattaaatt

SEQ ID NO: 208689 - DNA, 27 bp, Artificial sequence
  SiRNA target sequence
gctttatagacagattcaattaaatta

SEQ ID NO: 208690 - DNA, 27 bp, Artificial sequence
  SiRNA target sequence
ctttatagacagattcaattaaattaa

SEQ ID NO: 208691 - DNA, 27 bp, Artificial sequence
  SiRNA target sequence
tttatagacagattcaattaaattaaa

SEQ ID NO: 208692 - DNA, 27 bp, Artificial sequence
  SiRNA target sequence
ttatagacagattcaattaaattaaat

SEQ ID NO: 208693 - DNA, 27 bp, Artificial sequence
  SiRNA target sequence
tatagacagattcaattaaattaaatg

SEQ ID NO: 208694 - DNA, 27 bp, Artificial sequence
  SiRNA target sequence
atagacagattcaattaaattaaatgt

SEQ ID NO: 208695 - DNA, 27 bp, Artificial sequence
  SiRNA target sequence
tagacagattcaattaaattaaatgtt

SEQ ID NO: 208696 - DNA, 27 bp, Artificial sequence
  SiRNA target sequence
agacagattcaattaaattaaatgtta

SEQ ID NO: 208697 - DNA, 27 bp, Artificial sequence
  SiRNA target sequence
gacagattcaattaaattaaatgttat

SEQ ID NO: 208698 - DNA, 27 bp, Artificial sequence
  SiRNA target sequence
acagattcaattaaattaaatgttata

SEQ ID NO: 208699 - DNA, 27 bp, Artificial sequence
  SiRNA target sequence
cagattcaattaaattaaatgttatat

SEQ ID NO: 208700 - DNA, 27 bp, Artificial sequence
  SiRNA target sequence
agattcaattaaattaaatgttatatt

SEQ ID NO: 208701 - DNA, 27 bp, Artificial sequence
  SiRNA target sequence
gattcaattaaattaaatgttatattg

SEQ ID NO: 208702 - DNA, 27 bp, Artificial sequence
  SiRNA target sequence
attcaattaaattaaatgttatattgt

SEQ ID NO: 208703 - DNA, 27 bp, Artificial sequence
  SiRNA target sequence
ttcaattaaattaaatgttatattgta

SEQ ID NO: 208704 - DNA, 27 bp, Artificial sequence
  SiRNA target sequence
tcaattaaattaaatgttatattgtaa

SEQ ID NO: 208705 - DNA, 27 bp, Artificial sequence
  SiRNA target sequence
caattaaattaaatgttatattgtaaa

SEQ ID NO: 208706 - DNA, 27 bp, Artificial sequence
  SiRNA target sequence
aattaaattaaatgttatattgtaaaa

SEQ ID NO: 208707 - DNA, 27 bp, Artificial sequence
  SiRNA target sequence
attaaattaaatgttatattgtaaaaa

SEQ ID NO: 208708 - DNA, 27 bp, Artificial sequence
  SiRNA target sequence
ttaaattaaatgttatattgtaaaaaa

SEQ ID NO: 208709 - DNA, 27 bp, Artificial sequence
  SiRNA target sequence
taaattaaatgttatattgtaaaaaaa

SEQ ID NO: 208710 - DNA, 27 bp, Artificial sequence
  SiRNA target sequence
aaattaaatgttatattgtaaaaaaag

SEQ ID NO: 208711 - DNA, 27 bp, Artificial sequence
  SiRNA target sequence
aattaaatgttatattgtaaaaaaaga

SEQ ID NO: 208712 - DNA, 27 bp, Artificial sequence
  SiRNA target sequence
attaaatgttatattgtaaaaaaagac

SEQ ID NO: 208713 - DNA, 27 bp, Artificial sequence
  SiRNA target sequence
ttaaatgttatattgtaaaaaaagact

SEQ ID NO: 208714 - DNA, 27 bp, Artificial sequence
  SiRNA target sequence
taaatgttatattgtaaaaaaagacta

SEQ ID NO: 208715 - DNA, 27 bp, Artificial sequence
  SiRNA target sequence
aaatgttatattgtaaaaaaagactat

SEQ ID NO: 208716 - DNA, 27 bp, Artificial sequence
  SiRNA target sequence
aatgttatattgtaaaaaaagactatt

SEQ ID NO: 208717 - DNA, 27 bp, Artificial sequence
  SiRNA target sequence
atgttatattgtaaaaaaagactatta

SEQ ID NO: 208718 - DNA, 27 bp, Artificial sequence
  SiRNA target sequence
tgttatattgtaaaaaaagactattat

SEQ ID NO: 208719 - DNA, 27 bp, Artificial sequence
  SiRNA target sequence
gttatattgtaaaaaaagactattata

SEQ ID NO: 208720 - DNA, 27 bp, Artificial sequence
  SiRNA target sequence
ttatattgtaaaaaaagactattatac

SEQ ID NO: 208721 - DNA, 27 bp, Artificial sequence
  SiRNA target sequence
tatattgtaaaaaaagactattataca

SEQ ID NO: 208722 - DNA, 27 bp, Artificial sequence
  SiRNA target sequence
atattgtaaaaaaagactattatacaa

SEQ ID NO: 208723 - DNA, 27 bp, Artificial sequence
  SiRNA target sequence
tattgtaaaaaaagactattatacaaa

SEQ ID NO: 208724 - DNA, 27 bp, Artificial sequence
  SiRNA target sequence
attgtaaaaaaagactattatacaaag

SEQ ID NO: 208725 - DNA, 27 bp, Artificial sequence
  SiRNA target sequence
ttgtaaaaaaagactattatacaaagt

SEQ ID NO: 208726 - DNA, 27 bp, Artificial sequence
  SiRNA target sequence
tgtaaaaaaagactattatacaaagtg

SEQ ID NO: 208727 - DNA, 27 bp, Artificial sequence
  SiRNA target sequence
gtaaaaaaagactattatacaaagtga

SEQ ID NO: 208728 - DNA, 27 bp, Artificial sequence
  SiRNA target sequence
taaaaaaagactattatacaaagtgac

SEQ ID NO: 208729 - DNA, 27 bp, Artificial sequence
  SiRNA target sequence
aaaaaaagactattatacaaagtgaca

SEQ ID NO: 208730 - DNA, 27 bp, Artificial sequence
  SiRNA target sequence
aaaaaagactattatacaaagtgacat

SEQ ID NO: 208731 - DNA, 27 bp, Artificial sequence
  SiRNA target sequence
aaaaagactattatacaaagtgacatt

SEQ ID NO: 208732 - DNA, 27 bp, Artificial sequence
  SiRNA target sequence
aaaagactattatacaaagtgacatta

SEQ ID NO: 208733 - DNA, 27 bp, Artificial sequence
  SiRNA target sequence
aaagactattatacaaagtgacattaa

SEQ ID NO: 208734 - DNA, 27 bp, Artificial sequence
  SiRNA target sequence
aagactattatacaaagtgacattaat

SEQ ID NO: 208735 - DNA, 27 bp, Artificial sequence
  SiRNA target sequence
agactattatacaaagtgacattaata

SEQ ID NO: 208736 - DNA, 27 bp, Artificial sequence
  SiRNA target sequence
gactattatacaaagtgacattaataa

SEQ ID NO: 208737 - DNA, 27 bp, Artificial sequence
  SiRNA target sequence
actattatacaaagtgacattaataat

SEQ ID NO: 208738 - DNA, 27 bp, Artificial sequence
  SiRNA target sequence
ctattatacaaagtgacattaataatt

SEQ ID NO: 208739 - DNA, 27 bp, Artificial sequence
  SiRNA target sequence
tattatacaaagtgacattaataattt

SEQ ID NO: 208740 - DNA, 27 bp, Artificial sequence
  SiRNA target sequence
attatacaaagtgacattaataatttt

SEQ ID NO: 208741 - DNA, 27 bp, Artificial sequence
  SiRNA target sequence
ttatacaaagtgacattaataattttg

SEQ ID NO: 208742 - DNA, 27 bp, Artificial sequence
  SiRNA target sequence
tatacaaagtgacattaataattttga

SEQ ID NO: 208743 - DNA, 27 bp, Artificial sequence
  SiRNA target sequence
atacaaagtgacattaataattttgat

SEQ ID NO: 208744 - DNA, 27 bp, Artificial sequence
  SiRNA target sequence
tacaaagtgacattaataattttgatt

SEQ ID NO: 208745 - DNA, 27 bp, Artificial sequence
  SiRNA target sequence
acaaagtgacattaataattttgattt

SEQ ID NO: 208746 - DNA, 27 bp, Artificial sequence
  SiRNA target sequence
caaagtgacattaataattttgatttc

SEQ ID NO: 208747 - DNA, 27 bp, Artificial sequence
  SiRNA target sequence
aaagtgacattaataattttgatttca

SEQ ID NO: 208748 - DNA, 27 bp, Artificial sequence
  SiRNA target sequence
aagtgacattaataattttgatttcat

SEQ ID NO: 208749 - DNA, 27 bp, Artificial sequence
  SiRNA target sequence
agtgacattaataattttgatttcatc

SEQ ID NO: 208750 - DNA, 27 bp, Artificial sequence
  SiRNA target sequence
gtgacattaataattttgatttcatca

SEQ ID NO: 208751 - DNA, 27 bp, Artificial sequence
  SiRNA target sequence
tgacattaataattttgatttcatcat

SEQ ID NO: 208752 - DNA, 27 bp, Artificial sequence
  SiRNA target sequence
gacattaataattttgatttcatcatt

SEQ ID NO: 208753 - DNA, 27 bp, Artificial sequence
  SiRNA target sequence
acattaataattttgatttcatcatta

SEQ ID NO: 208754 - DNA, 27 bp, Artificial sequence
  SiRNA target sequence
cattaataattttgatttcatcattat

SEQ ID NO: 208755 - DNA, 27 bp, Artificial sequence
  SiRNA target sequence
attaataattttgatttcatcattata

SEQ ID NO: 208756 - DNA, 27 bp, Artificial sequence
  SiRNA target sequence
ttaataattttgatttcatcattatac

SEQ ID NO: 208757 - DNA, 27 bp, Artificial sequence
  SiRNA target sequence
taataattttgatttcatcattatact

SEQ ID NO: 208758 - DNA, 27 bp, Artificial sequence
  SiRNA target sequence
aataattttgatttcatcattatacta

SEQ ID NO: 208759 - DNA, 27 bp, Artificial sequence
  SiRNA target sequence
ataattttgatttcatcattatactaa

SEQ ID NO: 208760 - DNA, 27 bp, Artificial sequence
  SiRNA target sequence
taattttgatttcatcattatactaat

SEQ ID NO: 208761 - DNA, 27 bp, Artificial sequence
  SiRNA target sequence
aattttgatttcatcattatactaata

SEQ ID NO: 208762 - DNA, 27 bp, Artificial sequence
  SiRNA target sequence
attttgatttcatcattatactaatac

SEQ ID NO: 208763 - DNA, 27 bp, Artificial sequence
  SiRNA target sequence
ttttgatttcatcattatactaatacc

SEQ ID NO: 208764 - DNA, 27 bp, Artificial sequence
  SiRNA target sequence
tttgatttcatcattatactaatacct

SEQ ID NO: 208765 - DNA, 27 bp, Artificial sequence
  SiRNA target sequence
ttgatttcatcattatactaatacctt

SEQ ID NO: 208766 - DNA, 27 bp, Artificial sequence
  SiRNA target sequence
tgatttcatcattatactaataccttc

SEQ ID NO: 208767 - DNA, 27 bp, Artificial sequence
  SiRNA target sequence
gatttcatcattatactaataccttcg

SEQ ID NO: 208768 - DNA, 27 bp, Artificial sequence
  SiRNA target sequence
atttcatcattatactaataccttcgg

SEQ ID NO: 208769 - DNA, 27 bp, Artificial sequence
  SiRNA target sequence
tttcatcattatactaataccttcgga

SEQ ID NO: 208770 - DNA, 27 bp, Artificial sequence
  SiRNA target sequence
ttcatcattatactaataccttcggag

SEQ ID NO: 208771 - DNA, 27 bp, Artificial sequence
  SiRNA target sequence
tcatcattatactaataccttcggaga

SEQ ID NO: 208772 - DNA, 27 bp, Artificial sequence
  SiRNA target sequence
catcattatactaataccttcggagaa

SEQ ID NO: 208773 - DNA, 27 bp, Artificial sequence
  SiRNA target sequence
atcattatactaataccttcggagaaa

SEQ ID NO: 208774 - DNA, 27 bp, Artificial sequence
  SiRNA target sequence
tcattatactaataccttcggagaaac

SEQ ID NO: 208775 - DNA, 27 bp, Artificial sequence
  SiRNA target sequence
cattatactaataccttcggagaaacc

SEQ ID NO: 208776 - DNA, 27 bp, Artificial sequence
  SiRNA target sequence
attatactaataccttcggagaaacct

SEQ ID NO: 208777 - DNA, 27 bp, Artificial sequence
  SiRNA target sequence
ttatactaataccttcggagaaaccta

SEQ ID NO: 208778 - DNA, 27 bp, Artificial sequence
  SiRNA target sequence
tatactaataccttcggagaaacctac

SEQ ID NO: 208779 - DNA, 27 bp, Artificial sequence
  SiRNA target sequence
atactaataccttcggagaaacctaca

SEQ ID NO: 208780 - DNA, 27 bp, Artificial sequence
  SiRNA target sequence
tactaataccttcggagaaacctacac

SEQ ID NO: 208781 - DNA, 27 bp, Artificial sequence
  SiRNA target sequence
actaataccttcggagaaacctacact

SEQ ID NO: 208782 - DNA, 27 bp, Artificial sequence
  SiRNA target sequence
ctaataccttcggagaaacctacacta

SEQ ID NO: 208783 - DNA, 27 bp, Artificial sequence
  SiRNA target sequence
taataccttcggagaaacctacactaa

SEQ ID NO: 208784 - DNA, 27 bp, Artificial sequence
  SiRNA target sequence
aataccttcggagaaacctacactaac

SEQ ID NO: 208785 - DNA, 27 bp, Artificial sequence
  SiRNA target sequence
ataccttcggagaaacctacactaact

SEQ ID NO: 208786 - DNA, 27 bp, Artificial sequence
  SiRNA target sequence
taccttcggagaaacctacactaactt

SEQ ID NO: 208787 - DNA, 27 bp, Artificial sequence
  SiRNA target sequence
accttcggagaaacctacactaacttt

SEQ ID NO: 208788 - DNA, 27 bp, Artificial sequence
  SiRNA target sequence
ccttcggagaaacctacactaactttt

SEQ ID NO: 208789 - DNA, 27 bp, Artificial sequence
  SiRNA target sequence
cttcggagaaacctacactaacttttt

SEQ ID NO: 208790 - DNA, 27 bp, Artificial sequence
  SiRNA target sequence
ttcggagaaacctacactaactttttg

SEQ ID NO: 208791 - DNA, 27 bp, Artificial sequence
  SiRNA target sequence
tcggagaaacctacactaactttttgt

SEQ ID NO: 208792 - DNA, 27 bp, Artificial sequence
  SiRNA target sequence
cggagaaacctacactaactttttgtt

SEQ ID NO: 208793 - DNA, 27 bp, Artificial sequence
  SiRNA target sequence
ggagaaacctacactaactttttgttt

SEQ ID NO: 208794 - DNA, 27 bp, Artificial sequence
  SiRNA target sequence
gagaaacctacactaactttttgtttc

SEQ ID NO: 208795 - DNA, 27 bp, Artificial sequence
  SiRNA target sequence
agaaacctacactaactttttgtttct

SEQ ID NO: 208796 - DNA, 27 bp, Artificial sequence
  SiRNA target sequence
gaaacctacactaactttttgtttctt

SEQ ID NO: 208797 - DNA, 27 bp, Artificial sequence
  SiRNA target sequence
aaacctacactaactttttgtttcttt

SEQ ID NO: 208798 - DNA, 27 bp, Artificial sequence
  SiRNA target sequence
aacctacactaactttttgtttctttt

SEQ ID NO: 208799 - DNA, 27 bp, Artificial sequence
  SiRNA target sequence
acctacactaactttttgtttcttttt

SEQ ID NO: 208800 - DNA, 27 bp, Artificial sequence
  SiRNA target sequence
cctacactaactttttgtttctttttt

SEQ ID NO: 208801 - DNA, 27 bp, Artificial sequence
  SiRNA target sequence
ctacactaactttttgtttctttttta

SEQ ID NO: 208802 - DNA, 27 bp, Artificial sequence
  SiRNA target sequence
tacactaactttttgtttcttttttat

SEQ ID NO: 208803 - DNA, 27 bp, Artificial sequence
  SiRNA target sequence
acactaactttttgtttcttttttatc

SEQ ID NO: 208804 - DNA, 27 bp, Artificial sequence
  SiRNA target sequence
cactaactttttgtttcttttttatcg

SEQ ID NO: 208805 - DNA, 27 bp, Artificial sequence
  SiRNA target sequence
actaactttttgtttcttttttatcgt

SEQ ID NO: 208806 - DNA, 27 bp, Artificial sequence
  SiRNA target sequence
ctaactttttgtttcttttttatcgta

SEQ ID NO: 208807 - DNA, 27 bp, Artificial sequence
  SiRNA target sequence
taactttttgtttcttttttatcgtat

SEQ ID NO: 208808 - DNA, 27 bp, Artificial sequence
  SiRNA target sequence
aactttttgtttcttttttatcgtatt

SEQ ID NO: 208809 - DNA, 27 bp, Artificial sequence
  SiRNA target sequence
actttttgtttcttttttatcgtatta

SEQ ID NO: 208810 - DNA, 27 bp, Artificial sequence
  SiRNA target sequence
ctttttgtttcttttttatcgtattag

SEQ ID NO: 208811 - DNA, 27 bp, Artificial sequence
  SiRNA target sequence
tttttgtttcttttttatcgtattaga

SEQ ID NO: 208812 - DNA, 27 bp, Artificial sequence
  SiRNA target sequence
ttttgtttcttttttatcgtattagaa

SEQ ID NO: 208813 - DNA, 27 bp, Artificial sequence
  SiRNA target sequence
tttgtttcttttttatcgtattagaag

SEQ ID NO: 208814 - DNA, 27 bp, Artificial sequence
  SiRNA target sequence
ttgtttcttttttatcgtattagaagg

SEQ ID NO: 208815 - DNA, 27 bp, Artificial sequence
  SiRNA target sequence
tgtttcttttttatcgtattagaaggt

SEQ ID NO: 208816 - DNA, 27 bp, Artificial sequence
  SiRNA target sequence
gtttcttttttatcgtattagaaggta

SEQ ID NO: 208817 - DNA, 27 bp, Artificial sequence
  SiRNA target sequence
tttcttttttatcgtattagaaggtat

SEQ ID NO: 208818 - DNA, 27 bp, Artificial sequence
  SiRNA target sequence
ttcttttttatcgtattagaaggtata

SEQ ID NO: 208819 - DNA, 27 bp, Artificial sequence
  SiRNA target sequence
tcttttttatcgtattagaaggtataa

SEQ ID NO: 208820 - DNA, 27 bp, Artificial sequence
  SiRNA target sequence
cttttttatcgtattagaaggtataaa

SEQ ID NO: 208821 - DNA, 27 bp, Artificial sequence
  SiRNA target sequence
ttttttatcgtattagaaggtataaat

SEQ ID NO: 208822 - DNA, 27 bp, Artificial sequence
  SiRNA target sequence
tttttatcgtattagaaggtataaata

SEQ ID NO: 208823 - DNA, 27 bp, Artificial sequence
  SiRNA target sequence
ttttatcgtattagaaggtataaatat

SEQ ID NO: 208824 - DNA, 27 bp, Artificial sequence
  SiRNA target sequence
tttatcgtattagaaggtataaatatt

SEQ ID NO: 208825 - DNA, 27 bp, Artificial sequence
  SiRNA target sequence
ttatcgtattagaaggtataaatattg

SEQ ID NO: 208826 - DNA, 27 bp, Artificial sequence
  SiRNA target sequence
tatcgtattagaaggtataaatattgg

SEQ ID NO: 208827 - DNA, 27 bp, Artificial sequence
  SiRNA target sequence
atcgtattagaaggtataaatattggt

SEQ ID NO: 208828 - DNA, 27 bp, Artificial sequence
  SiRNA target sequence
tcgtattagaaggtataaatattggta

SEQ ID NO: 208829 - DNA, 27 bp, Artificial sequence
  SiRNA target sequence
cgtattagaaggtataaatattggtac

SEQ ID NO: 208830 - DNA, 27 bp, Artificial sequence
  SiRNA target sequence
gtattagaaggtataaatattggtaca

SEQ ID NO: 208831 - DNA, 27 bp, Artificial sequence
  SiRNA target sequence
tattagaaggtataaatattggtacac

SEQ ID NO: 208832 - DNA, 27 bp, Artificial sequence
  SiRNA target sequence
attagaaggtataaatattggtacact

SEQ ID NO: 208833 - DNA, 27 bp, Artificial sequence
  SiRNA target sequence
ttagaaggtataaatattggtacactc

SEQ ID NO: 208834 - DNA, 27 bp, Artificial sequence
  SiRNA target sequence
tagaaggtataaatattggtacactca

SEQ ID NO: 208835 - DNA, 27 bp, Artificial sequence
  SiRNA target sequence
agaaggtataaatattggtacactcat

SEQ ID NO: 208836 - DNA, 27 bp, Artificial sequence
  SiRNA target sequence
gaaggtataaatattggtacactcatt

SEQ ID NO: 208837 - DNA, 27 bp, Artificial sequence
  SiRNA target sequence
aaggtataaatattggtacactcatta

SEQ ID NO: 208838 - DNA, 27 bp, Artificial sequence
  SiRNA target sequence
aggtataaatattggtacactcattat

SEQ ID NO: 208839 - DNA, 27 bp, Artificial sequence
  SiRNA target sequence
ggtataaatattggtacactcattatt

SEQ ID NO: 208840 - DNA, 27 bp, Artificial sequence
  SiRNA target sequence
gtataaatattggtacactcattattt

SEQ ID NO: 208841 - DNA, 27 bp, Artificial sequence
  SiRNA target sequence
tataaatattggtacactcattatttt

SEQ ID NO: 208842 - DNA, 27 bp, Artificial sequence
  SiRNA target sequence
ataaatattggtacactcattatttta

SEQ ID NO: 208843 - DNA, 27 bp, Artificial sequence
  SiRNA target sequence
taaatattggtacactcattattttat

SEQ ID NO: 208844 - DNA, 27 bp, Artificial sequence
  SiRNA target sequence
aaatattggtacactcattattttatt

SEQ ID NO: 208845 - DNA, 27 bp, Artificial sequence
  SiRNA target sequence
aatattggtacactcattattttattc

SEQ ID NO: 208846 - DNA, 27 bp, Artificial sequence
  SiRNA target sequence
atattggtacactcattattttattct

SEQ ID NO: 208847 - DNA, 27 bp, Artificial sequence
  SiRNA target sequence
tattggtacactcattattttattctc

SEQ ID NO: 208848 - DNA, 27 bp, Artificial sequence
  SiRNA target sequence
attggtacactcattattttattctcg

SEQ ID NO: 208849 - DNA, 27 bp, Artificial sequence
  SiRNA target sequence
ttggtacactcattattttattctcga

SEQ ID NO: 208850 - DNA, 27 bp, Artificial sequence
  SiRNA target sequence
tggtacactcattattttattctcgaa

SEQ ID NO: 208851 - DNA, 27 bp, Artificial sequence
  SiRNA target sequence
ggtacactcattattttattctcgaaa

SEQ ID NO: 208852 - DNA, 27 bp, Artificial sequence
  SiRNA target sequence
gtacactcattattttattctcgaaat

SEQ ID NO: 208853 - DNA, 27 bp, Artificial sequence
  SiRNA target sequence
tacactcattattttattctcgaaata

SEQ ID NO: 208854 - DNA, 27 bp, Artificial sequence
  SiRNA target sequence
acactcattattttattctcgaaataa

SEQ ID NO: 208855 - DNA, 27 bp, Artificial sequence
  SiRNA target sequence
cactcattattttattctcgaaataat

SEQ ID NO: 208856 - DNA, 27 bp, Artificial sequence
  SiRNA target sequence
actcattattttattctcgaaataata

SEQ ID NO: 208857 - DNA, 27 bp, Artificial sequence
  SiRNA target sequence
ctcattattttattctcgaaataatat

SEQ ID NO: 208858 - DNA, 27 bp, Artificial sequence
  SiRNA target sequence
tcattattttattctcgaaataatatt

SEQ ID NO: 208859 - DNA, 27 bp, Artificial sequence
  SiRNA target sequence
cattattttattctcgaaataatattt

SEQ ID NO: 208860 - DNA, 27 bp, Artificial sequence
  SiRNA target sequence
attattttattctcgaaataatatttc

SEQ ID NO: 208861 - DNA, 27 bp, Artificial sequence
  SiRNA target sequence
ttattttattctcgaaataatatttca

SEQ ID NO: 208862 - DNA, 27 bp, Artificial sequence
  SiRNA target sequence
tattttattctcgaaataatatttcat

SEQ ID NO: 208863 - DNA, 27 bp, Artificial sequence
  SiRNA target sequence
attttattctcgaaataatatttcatg

SEQ ID NO: 208864 - DNA, 27 bp, Artificial sequence
  SiRNA target sequence
ttttattctcgaaataatatttcatgt

SEQ ID NO: 208865 - DNA, 27 bp, Artificial sequence
  SiRNA target sequence
tttattctcgaaataatatttcatgta

SEQ ID NO: 208866 - DNA, 27 bp, Artificial sequence
  SiRNA target sequence
ttattctcgaaataatatttcatgtac

SEQ ID NO: 208867 - DNA, 27 bp, Artificial sequence
  SiRNA target sequence
tattctcgaaataatatttcatgtaca

SEQ ID NO: 208868 - DNA, 27 bp, Artificial sequence
  SiRNA target sequence
attctcgaaataatatttcatgtacat

SEQ ID NO: 208869 - DNA, 27 bp, Artificial sequence
  SiRNA target sequence
ttctcgaaataatatttcatgtacatt

SEQ ID NO: 208870 - DNA, 27 bp, Artificial sequence
  SiRNA target sequence
tctcgaaataatatttcatgtacatta

SEQ ID NO: 208871 - DNA, 27 bp, Artificial sequence
  SiRNA target sequence
ctcgaaataatatttcatgtacattaa

SEQ ID NO: 208872 - DNA, 27 bp, Artificial sequence
  SiRNA target sequence
tcgaaataatatttcatgtacattaat

SEQ ID NO: 208873 - DNA, 27 bp, Artificial sequence
  SiRNA target sequence
cgaaataatatttcatgtacattaata

SEQ ID NO: 208874 - DNA, 27 bp, Artificial sequence
  SiRNA target sequence
gaaataatatttcatgtacattaatat

SEQ ID NO: 208875 - DNA, 27 bp, Artificial sequence
  SiRNA target sequence
aaataatatttcatgtacattaatatt

SEQ ID NO: 208876 - DNA, 27 bp, Artificial sequence
  SiRNA target sequence
aataatatttcatgtacattaatatta

SEQ ID NO: 208877 - DNA, 27 bp, Artificial sequence
  SiRNA target sequence
ataatatttcatgtacattaatattag

SEQ ID NO: 208878 - DNA, 27 bp, Artificial sequence
  SiRNA target sequence
taatatttcatgtacattaatattaga

SEQ ID NO: 208879 - DNA, 27 bp, Artificial sequence
  SiRNA target sequence
aatatttcatgtacattaatattagac

SEQ ID NO: 208880 - DNA, 27 bp, Artificial sequence
  SiRNA target sequence
atatttcatgtacattaatattagaca

SEQ ID NO: 208881 - DNA, 27 bp, Artificial sequence
  SiRNA target sequence
tatttcatgtacattaatattagacat

SEQ ID NO: 208882 - DNA, 27 bp, Artificial sequence
  SiRNA target sequence
atttcatgtacattaatattagacata

SEQ ID NO: 208883 - DNA, 27 bp, Artificial sequence
  SiRNA target sequence
tttcatgtacattaatattagacatat

SEQ ID NO: 208884 - DNA, 27 bp, Artificial sequence
  SiRNA target sequence
ttcatgtacattaatattagacatata

SEQ ID NO: 208885 - DNA, 27 bp, Artificial sequence
  SiRNA target sequence
tcatgtacattaatattagacatatac

SEQ ID NO: 208886 - DNA, 27 bp, Artificial sequence
  SiRNA target sequence
catgtacattaatattagacatatacc

SEQ ID NO: 208887 - DNA, 27 bp, Artificial sequence
  SiRNA target sequence
atgtacattaatattagacatataccg

SEQ ID NO: 208888 - DNA, 27 bp, Artificial sequence
  SiRNA target sequence
tgtacattaatattagacatataccgc

SEQ ID NO: 208889 - DNA, 27 bp, Artificial sequence
  SiRNA target sequence
gtacattaatattagacatataccgcc

SEQ ID NO: 208890 - DNA, 27 bp, Artificial sequence
  SiRNA target sequence
tacattaatattagacatataccgccc

SEQ ID NO: 208891 - DNA, 27 bp, Artificial sequence
  SiRNA target sequence
acattaatattagacatataccgccca

SEQ ID NO: 208892 - DNA, 27 bp, Artificial sequence
  SiRNA target sequence
cattaatattagacatataccgcccat

SEQ ID NO: 208893 - DNA, 27 bp, Artificial sequence
  SiRNA target sequence
attaatattagacatataccgcccatg

SEQ ID NO: 208894 - DNA, 27 bp, Artificial sequence
  SiRNA target sequence
ttaatattagacatataccgcccatgg

SEQ ID NO: 208895 - DNA, 27 bp, Artificial sequence
  SiRNA target sequence
taatattagacatataccgcccatggc

SEQ ID NO: 208896 - DNA, 27 bp, Artificial sequence
  SiRNA target sequence
aatattagacatataccgcccatggca

SEQ ID NO: 208897 - DNA, 27 bp, Artificial sequence
  SiRNA target sequence
atattagacatataccgcccatggcaa

SEQ ID NO: 208898 - DNA, 27 bp, Artificial sequence
  SiRNA target sequence
tattagacatataccgcccatggcaat

SEQ ID NO: 208899 - DNA, 27 bp, Artificial sequence
  SiRNA target sequence
attagacatataccgcccatggcaata

SEQ ID NO: 208900 - DNA, 27 bp, Artificial sequence
  SiRNA target sequence
ttagacatataccgcccatggcaataa

SEQ ID NO: 208901 - DNA, 27 bp, Artificial sequence
  SiRNA target sequence
tagacatataccgcccatggcaataaa

SEQ ID NO: 208902 - DNA, 27 bp, Artificial sequence
  SiRNA target sequence
agacatataccgcccatggcaataaaa

SEQ ID NO: 208903 - DNA, 27 bp, Artificial sequence
  SiRNA target sequence
gacatataccgcccatggcaataaaaa

SEQ ID NO: 208904 - DNA, 27 bp, Artificial sequence
  SiRNA target sequence
acatataccgcccatggcaataaaaac

SEQ ID NO: 208905 - DNA, 27 bp, Artificial sequence
  SiRNA target sequence
catataccgcccatggcaataaaaacc

SEQ ID NO: 208906 - DNA, 27 bp, Artificial sequence
  SiRNA target sequence
atataccgcccatggcaataaaaaccg

SEQ ID NO: 208907 - DNA, 27 bp, Artificial sequence
  SiRNA target sequence
tataccgcccatggcaataaaaaccga

SEQ ID NO: 208908 - DNA, 27 bp, Artificial sequence
  SiRNA target sequence
ataccgcccatggcaataaaaaccgaa

SEQ ID NO: 208909 - DNA, 27 bp, Artificial sequence
  SiRNA target sequence
taccgcccatggcaataaaaaccgaag

SEQ ID NO: 208910 - DNA, 27 bp, Artificial sequence
  SiRNA target sequence
accgcccatggcaataaaaaccgaaga

SEQ ID NO: 208911 - DNA, 27 bp, Artificial sequence
  SiRNA target sequence
ccgcccatggcaataaaaaccgaagaa

SEQ ID NO: 208912 - DNA, 27 bp, Artificial sequence
  SiRNA target sequence
cgcccatggcaataaaaaccgaagaat

SEQ ID NO: 208913 - DNA, 27 bp, Artificial sequence
  SiRNA target sequence
gcccatggcaataaaaaccgaagaata

SEQ ID NO: 208914 - DNA, 27 bp, Artificial sequence
  SiRNA target sequence
cccatggcaataaaaaccgaagaatat

SEQ ID NO: 208915 - DNA, 27 bp, Artificial sequence
  SiRNA target sequence
ccatggcaataaaaaccgaagaatata

SEQ ID NO: 208916 - DNA, 27 bp, Artificial sequence
  SiRNA target sequence
catggcaataaaaaccgaagaatataa

SEQ ID NO: 208917 - DNA, 27 bp, Artificial sequence
  SiRNA target sequence
atggcaataaaaaccgaagaatataat

SEQ ID NO: 208918 - DNA, 27 bp, Artificial sequence
  SiRNA target sequence
tggcaataaaaaccgaagaatataata

SEQ ID NO: 208919 - DNA, 27 bp, Artificial sequence
  SiRNA target sequence
ggcaataaaaaccgaagaatataataa

SEQ ID NO: 208920 - DNA, 27 bp, Artificial sequence
  SiRNA target sequence
gcaataaaaaccgaagaatataataac

SEQ ID NO: 208921 - DNA, 27 bp, Artificial sequence
  SiRNA target sequence
caataaaaaccgaagaatataataact

SEQ ID NO: 208922 - DNA, 27 bp, Artificial sequence
  SiRNA target sequence
aataaaaaccgaagaatataataactg

SEQ ID NO: 208923 - DNA, 27 bp, Artificial sequence
  SiRNA target sequence
ataaaaaccgaagaatataataactga

SEQ ID NO: 208924 - DNA, 27 bp, Artificial sequence
  SiRNA target sequence
taaaaaccgaagaatataataactgat

SEQ ID NO: 208925 - DNA, 27 bp, Artificial sequence
  SiRNA target sequence
aaaaaccgaagaatataataactgatt

SEQ ID NO: 208926 - DNA, 27 bp, Artificial sequence
  SiRNA target sequence
aaaaccgaagaatataataactgattt

SEQ ID NO: 208927 - DNA, 27 bp, Artificial sequence
  SiRNA target sequence
aaaccgaagaatataataactgatttt

SEQ ID NO: 208928 - DNA, 27 bp, Artificial sequence
  SiRNA target sequence
aaccgaagaatataataactgattttg

SEQ ID NO: 208929 - DNA, 27 bp, Artificial sequence
  SiRNA target sequence
accgaagaatataataactgattttgc

SEQ ID NO: 208930 - DNA, 27 bp, Artificial sequence
  SiRNA target sequence
ccgaagaatataataactgattttgct

SEQ ID NO: 208931 - DNA, 27 bp, Artificial sequence
  SiRNA target sequence
cgaagaatataataactgattttgctc

SEQ ID NO: 208932 - DNA, 27 bp, Artificial sequence
  SiRNA target sequence
gaagaatataataactgattttgctca

SEQ ID NO: 208933 - DNA, 27 bp, Artificial sequence
  SiRNA target sequence
aagaatataataactgattttgctcat

SEQ ID NO: 208934 - DNA, 27 bp, Artificial sequence
  SiRNA target sequence
agaatataataactgattttgctcata

SEQ ID NO: 208935 - DNA, 27 bp, Artificial sequence
  SiRNA target sequence
gaatataataactgattttgctcatag

SEQ ID NO: 208936 - DNA, 27 bp, Artificial sequence
  SiRNA target sequence
aatataataactgattttgctcatagc

SEQ ID NO: 208937 - DNA, 27 bp, Artificial sequence
  SiRNA target sequence
atataataactgattttgctcatagct

SEQ ID NO: 208938 - DNA, 27 bp, Artificial sequence
  SiRNA target sequence
tataataactgattttgctcatagcta

SEQ ID NO: 208939 - DNA, 27 bp, Artificial sequence
  SiRNA target sequence
ataataactgattttgctcatagctaa

SEQ ID NO: 208940 - DNA, 27 bp, Artificial sequence
  SiRNA target sequence
taataactgattttgctcatagctaaa

SEQ ID NO: 208941 - DNA, 27 bp, Artificial sequence
  SiRNA target sequence
aataactgattttgctcatagctaaat

SEQ ID NO: 208942 - DNA, 27 bp, Artificial sequence
  SiRNA target sequence
ataactgattttgctcatagctaaatc

SEQ ID NO: 208943 - DNA, 27 bp, Artificial sequence
  SiRNA target sequence
taactgattttgctcatagctaaatcc

SEQ ID NO: 208944 - DNA, 27 bp, Artificial sequence
  SiRNA target sequence
aactgattttgctcatagctaaatcct

SEQ ID NO: 208945 - DNA, 27 bp, Artificial sequence
  SiRNA target sequence
actgattttgctcatagctaaatcctt

SEQ ID NO: 208946 - DNA, 27 bp, Artificial sequence
  SiRNA target sequence
ctgattttgctcatagctaaatccttt

SEQ ID NO: 208947 - DNA, 27 bp, Artificial sequence
  SiRNA target sequence
tgattttgctcatagctaaatcctttt

SEQ ID NO: 208948 - DNA, 27 bp, Artificial sequence
  SiRNA target sequence
gattttgctcatagctaaatccttttc

SEQ ID NO: 208949 - DNA, 27 bp, Artificial sequence
  SiRNA target sequence
attttgctcatagctaaatccttttcg

SEQ ID NO: 208950 - DNA, 27 bp, Artificial sequence
  SiRNA target sequence
ttttgctcatagctaaatccttttcgc

SEQ ID NO: 208951 - DNA, 27 bp, Artificial sequence
  SiRNA target sequence
tttgctcatagctaaatccttttcgca

SEQ ID NO: 208952 - DNA, 27 bp, Artificial sequence
  SiRNA target sequence
ttgctcatagctaaatccttttcgcaa

SEQ ID NO: 208953 - DNA, 27 bp, Artificial sequence
  SiRNA target sequence
tgctcatagctaaatccttttcgcaat

SEQ ID NO: 208954 - DNA, 27 bp, Artificial sequence
  SiRNA target sequence
gctcatagctaaatccttttcgcaatt

SEQ ID NO: 208955 - DNA, 27 bp, Artificial sequence
  SiRNA target sequence
ctcatagctaaatccttttcgcaattc

SEQ ID NO: 208956 - DNA, 27 bp, Artificial sequence
  SiRNA target sequence
tcatagctaaatccttttcgcaattct

SEQ ID NO: 208957 - DNA, 27 bp, Artificial sequence
  SiRNA target sequence
catagctaaatccttttcgcaattctc

SEQ ID NO: 208958 - DNA, 27 bp, Artificial sequence
  SiRNA target sequence
atagctaaatccttttcgcaattctct

SEQ ID NO: 208959 - DNA, 27 bp, Artificial sequence
  SiRNA target sequence
tagctaaatccttttcgcaattctctg

SEQ ID NO: 208960 - DNA, 27 bp, Artificial sequence
  SiRNA target sequence
agctaaatccttttcgcaattctctga

SEQ ID NO: 208961 - DNA, 27 bp, Artificial sequence
  SiRNA target sequence
gctaaatccttttcgcaattctctgaa

SEQ ID NO: 208962 - DNA, 27 bp, Artificial sequence
  SiRNA target sequence
ctaaatccttttcgcaattctctgaaa

SEQ ID NO: 208963 - DNA, 27 bp, Artificial sequence
  SiRNA target sequence
taaatccttttcgcaattctctgaaag

SEQ ID NO: 208964 - DNA, 27 bp, Artificial sequence
  SiRNA target sequence
aaatccttttcgcaattctctgaaaga

SEQ ID NO: 208965 - DNA, 27 bp, Artificial sequence
  SiRNA target sequence
aatccttttcgcaattctctgaaagaa

SEQ ID NO: 208966 - DNA, 27 bp, Artificial sequence
  SiRNA target sequence
atccttttcgcaattctctgaaagaac

SEQ ID NO: 208967 - DNA, 27 bp, Artificial sequence
  SiRNA target sequence
tccttttcgcaattctctgaaagaact

SEQ ID NO: 208968 - DNA, 27 bp, Artificial sequence
  SiRNA target sequence
ccttttcgcaattctctgaaagaacta

SEQ ID NO: 208969 - DNA, 27 bp, Artificial sequence
  SiRNA target sequence
cttttcgcaattctctgaaagaactac

SEQ ID NO: 208970 - DNA, 27 bp, Artificial sequence
  SiRNA target sequence
ttttcgcaattctctgaaagaactact

SEQ ID NO: 208971 - DNA, 27 bp, Artificial sequence
  SiRNA target sequence
tttcgcaattctctgaaagaactactg

SEQ ID NO: 208972 - DNA, 27 bp, Artificial sequence
  SiRNA target sequence
ttcgcaattctctgaaagaactactgg

SEQ ID NO: 208973 - DNA, 27 bp, Artificial sequence
  SiRNA target sequence
tcgcaattctctgaaagaactactggc

SEQ ID NO: 208974 - DNA, 27 bp, Artificial sequence
  SiRNA target sequence
cgcaattctctgaaagaactactggct

SEQ ID NO: 208975 - DNA, 27 bp, Artificial sequence
  SiRNA target sequence
gcaattctctgaaagaactactggcta

SEQ ID NO: 208976 - DNA, 27 bp, Artificial sequence
  SiRNA target sequence
caattctctgaaagaactactggctaa

SEQ ID NO: 208977 - DNA, 27 bp, Artificial sequence
  SiRNA target sequence
aattctctgaaagaactactggctaat

SEQ ID NO: 208978 - DNA, 27 bp, Artificial sequence
  SiRNA target sequence
attctctgaaagaactactggctaatc

SEQ ID NO: 208979 - DNA, 27 bp, Artificial sequence
  SiRNA target sequence
ttctctgaaagaactactggctaatcc

SEQ ID NO: 208980 - DNA, 27 bp, Artificial sequence
  SiRNA target sequence
tctctgaaagaactactggctaatcca

SEQ ID NO: 208981 - DNA, 27 bp, Artificial sequence
  SiRNA target sequence
ctctgaaagaactactggctaatccag

SEQ ID NO: 208982 - DNA, 27 bp, Artificial sequence
  SiRNA target sequence
tctgaaagaactactggctaatccaga

SEQ ID NO: 208983 - DNA, 27 bp, Artificial sequence
  SiRNA target sequence
ctgaaagaactactggctaatccagat

SEQ ID NO: 208984 - DNA, 27 bp, Artificial sequence
  SiRNA target sequence
tgaaagaactactggctaatccagata

SEQ ID NO: 208985 - DNA, 27 bp, Artificial sequence
  SiRNA target sequence
gaaagaactactggctaatccagatac

SEQ ID NO: 208986 - DNA, 27 bp, Artificial sequence
  SiRNA target sequence
aaagaactactggctaatccagatact

SEQ ID NO: 208987 - DNA, 27 bp, Artificial sequence
  SiRNA target sequence
aagaactactggctaatccagatacta

SEQ ID NO: 208988 - DNA, 27 bp, Artificial sequence
  SiRNA target sequence
agaactactggctaatccagatactag

SEQ ID NO: 208989 - DNA, 27 bp, Artificial sequence
  SiRNA target sequence
gaactactggctaatccagatactagt

SEQ ID NO: 208990 - DNA, 27 bp, Artificial sequence
  SiRNA target sequence
aactactggctaatccagatactagta

SEQ ID NO: 208991 - DNA, 27 bp, Artificial sequence
  SiRNA target sequence
actactggctaatccagatactagtaa

SEQ ID NO: 208992 - DNA, 27 bp, Artificial sequence
  SiRNA target sequence
ctactggctaatccagatactagtaaa

SEQ ID NO: 208993 - DNA, 27 bp, Artificial sequence
  SiRNA target sequence
tactggctaatccagatactagtaaag

SEQ ID NO: 208994 - DNA, 27 bp, Artificial sequence
  SiRNA target sequence
actggctaatccagatactagtaaagc

SEQ ID NO: 208995 - DNA, 27 bp, Artificial sequence
  SiRNA target sequence
ctggctaatccagatactagtaaagct

SEQ ID NO: 208996 - DNA, 27 bp, Artificial sequence
  SiRNA target sequence
tggctaatccagatactagtaaagcta

SEQ ID NO: 208997 - DNA, 27 bp, Artificial sequence
  SiRNA target sequence
ggctaatccagatactagtaaagctaa

SEQ ID NO: 208998 - DNA, 27 bp, Artificial sequence
  SiRNA target sequence
gctaatccagatactagtaaagctaaa

SEQ ID NO: 208999 - DNA, 27 bp, Artificial sequence
  SiRNA target sequence
ctaatccagatactagtaaagctaaat

SEQ ID NO: 209000 - DNA, 27 bp, Artificial sequence
  SiRNA target sequence
taatccagatactagtaaagctaaatt

SEQ ID NO: 209001 - DNA, 27 bp, Artificial sequence
  SiRNA target sequence
aatccagatactagtaaagctaaattt

SEQ ID NO: 209002 - DNA, 27 bp, Artificial sequence
  SiRNA target sequence
atccagatactagtaaagctaaatttg

SEQ ID NO: 209003 - DNA, 27 bp, Artificial sequence
  SiRNA target sequence
tccagatactagtaaagctaaatttgc

SEQ ID NO: 209004 - DNA, 27 bp, Artificial sequence
  SiRNA target sequence
ccagatactagtaaagctaaatttgct

SEQ ID NO: 209005 - DNA, 27 bp, Artificial sequence
  SiRNA target sequence
cagatactagtaaagctaaatttgcta

SEQ ID NO: 209006 - DNA, 27 bp, Artificial sequence
  SiRNA target sequence
agatactagtaaagctaaatttgctat

SEQ ID NO: 209007 - DNA, 27 bp, Artificial sequence
  SiRNA target sequence
gatactagtaaagctaaatttgctatt

SEQ ID NO: 209008 - DNA, 27 bp, Artificial sequence
  SiRNA target sequence
atactagtaaagctaaatttgctatta

SEQ ID NO: 209009 - DNA, 27 bp, Artificial sequence
  SiRNA target sequence
tactagtaaagctaaatttgctattat

SEQ ID NO: 209010 - DNA, 27 bp, Artificial sequence
  SiRNA target sequence
actagtaaagctaaatttgctattatg

SEQ ID NO: 209011 - DNA, 27 bp, Artificial sequence
  SiRNA target sequence
ctagtaaagctaaatttgctattatgt

SEQ ID NO: 209012 - DNA, 27 bp, Artificial sequence
  SiRNA target sequence
tagtaaagctaaatttgctattatgta

SEQ ID NO: 209013 - DNA, 27 bp, Artificial sequence
  SiRNA target sequence
agtaaagctaaatttgctattatgtaa

SEQ ID NO: 209014 - DNA, 27 bp, Artificial sequence
  SiRNA target sequence
gtaaagctaaatttgctattatgtaaa

SEQ ID NO: 209015 - DNA, 27 bp, Artificial sequence
  SiRNA target sequence
taaagctaaatttgctattatgtaaaa

SEQ ID NO: 209016 - DNA, 27 bp, Artificial sequence
  SiRNA target sequence
aaagctaaatttgctattatgtaaaaa

SEQ ID NO: 209017 - DNA, 27 bp, Artificial sequence
  SiRNA target sequence
aagctaaatttgctattatgtaaaaag

SEQ ID NO: 209018 - DNA, 27 bp, Artificial sequence
  SiRNA target sequence
agctaaatttgctattatgtaaaaagg

SEQ ID NO: 209019 - DNA, 27 bp, Artificial sequence
  SiRNA target sequence
gctaaatttgctattatgtaaaaaggt

SEQ ID NO: 209020 - DNA, 27 bp, Artificial sequence
  SiRNA target sequence
ctaaatttgctattatgtaaaaaggtg

SEQ ID NO: 209021 - DNA, 27 bp, Artificial sequence
  SiRNA target sequence
taaatttgctattatgtaaaaaggtgg

SEQ ID NO: 209022 - DNA, 27 bp, Artificial sequence
  SiRNA target sequence
aaatttgctattatgtaaaaaggtggt

SEQ ID NO: 209023 - DNA, 27 bp, Artificial sequence
  SiRNA target sequence
aatttgctattatgtaaaaaggtggta

SEQ ID NO: 209024 - DNA, 27 bp, Artificial sequence
  SiRNA target sequence
atttgctattatgtaaaaaggtggtaa

SEQ ID NO: 209025 - DNA, 27 bp, Artificial sequence
  SiRNA target sequence
tttgctattatgtaaaaaggtggtaaa

SEQ ID NO: 209026 - DNA, 27 bp, Artificial sequence
  SiRNA target sequence
ttgctattatgtaaaaaggtggtaaaa

SEQ ID NO: 209027 - DNA, 27 bp, Artificial sequence
  SiRNA target sequence
tgctattatgtaaaaaggtggtaaaaa

SEQ ID NO: 209028 - DNA, 27 bp, Artificial sequence
  SiRNA target sequence
gctattatgtaaaaaggtggtaaaaat

SEQ ID NO: 209029 - DNA, 27 bp, Artificial sequence
  SiRNA target sequence
ctattatgtaaaaaggtggtaaaaatc

SEQ ID NO: 209030 - DNA, 27 bp, Artificial sequence
  SiRNA target sequence
tattatgtaaaaaggtggtaaaaatct

SEQ ID NO: 209031 - DNA, 27 bp, Artificial sequence
  SiRNA target sequence
attatgtaaaaaggtggtaaaaatctt

SEQ ID NO: 209032 - DNA, 27 bp, Artificial sequence
  SiRNA target sequence
ttatgtaaaaaggtggtaaaaatcttg

SEQ ID NO: 209033 - DNA, 27 bp, Artificial sequence
  SiRNA target sequence
tatgtaaaaaggtggtaaaaatcttgt

SEQ ID NO: 209034 - DNA, 27 bp, Artificial sequence
  SiRNA target sequence
atgtaaaaaggtggtaaaaatcttgta

SEQ ID NO: 209035 - DNA, 27 bp, Artificial sequence
  SiRNA target sequence
tgtaaaaaggtggtaaaaatcttgtaa

SEQ ID NO: 209036 - DNA, 27 bp, Artificial sequence
  SiRNA target sequence
gtaaaaaggtggtaaaaatcttgtaaa

SEQ ID NO: 209037 - DNA, 27 bp, Artificial sequence
  SiRNA target sequence
taaaaaggtggtaaaaatcttgtaaac

SEQ ID NO: 209038 - DNA, 27 bp, Artificial sequence
  SiRNA target sequence
aaaaaggtggtaaaaatcttgtaaact

SEQ ID NO: 209039 - DNA, 27 bp, Artificial sequence
  SiRNA target sequence
aaaaggtggtaaaaatcttgtaaactg

SEQ ID NO: 209040 - DNA, 27 bp, Artificial sequence
  SiRNA target sequence
aaaggtggtaaaaatcttgtaaactgt

SEQ ID NO: 209041 - DNA, 27 bp, Artificial sequence
  SiRNA target sequence
aaggtggtaaaaatcttgtaaactgtc

SEQ ID NO: 209042 - DNA, 27 bp, Artificial sequence
  SiRNA target sequence
aggtggtaaaaatcttgtaaactgtct

SEQ ID NO: 209043 - DNA, 27 bp, Artificial sequence
  SiRNA target sequence
ggtggtaaaaatcttgtaaactgtctg

SEQ ID NO: 209044 - DNA, 27 bp, Artificial sequence
  SiRNA target sequence
gtggtaaaaatcttgtaaactgtctga

SEQ ID NO: 209045 - DNA, 27 bp, Artificial sequence
  SiRNA target sequence
tggtaaaaatcttgtaaactgtctgat

SEQ ID NO: 209046 - DNA, 27 bp, Artificial sequence
  SiRNA target sequence
ggtaaaaatcttgtaaactgtctgata

SEQ ID NO: 209047 - DNA, 27 bp, Artificial sequence
  SiRNA target sequence
gtaaaaatcttgtaaactgtctgatag

SEQ ID NO: 209048 - DNA, 27 bp, Artificial sequence
  SiRNA target sequence
taaaaatcttgtaaactgtctgatagt

SEQ ID NO: 209049 - DNA, 27 bp, Artificial sequence
  SiRNA target sequence
aaaaatcttgtaaactgtctgatagta

SEQ ID NO: 209050 - DNA, 27 bp, Artificial sequence
  SiRNA target sequence
aaaatcttgtaaactgtctgatagtac

SEQ ID NO: 209051 - DNA, 27 bp, Artificial sequence
  SiRNA target sequence
aaatcttgtaaactgtctgatagtaca

SEQ ID NO: 209052 - DNA, 27 bp, Artificial sequence
  SiRNA target sequence
aatcttgtaaactgtctgatagtacaa

SEQ ID NO: 209053 - DNA, 27 bp, Artificial sequence
  SiRNA target sequence
atcttgtaaactgtctgatagtacaac

SEQ ID NO: 209054 - DNA, 27 bp, Artificial sequence
  SiRNA target sequence
tcttgtaaactgtctgatagtacaact

SEQ ID NO: 209055 - DNA, 27 bp, Artificial sequence
  SiRNA target sequence
cttgtaaactgtctgatagtacaactt

SEQ ID NO: 209056 - DNA, 27 bp, Artificial sequence
  SiRNA target sequence
ttgtaaactgtctgatagtacaacttt

SEQ ID NO: 209057 - DNA, 27 bp, Artificial sequence
  SiRNA target sequence
tgtaaactgtctgatagtacaactttc

SEQ ID NO: 209058 - DNA, 27 bp, Artificial sequence
  SiRNA target sequence
gtaaactgtctgatagtacaactttca

SEQ ID NO: 209059 - DNA, 27 bp, Artificial sequence
  SiRNA target sequence
taaactgtctgatagtacaactttcat

SEQ ID NO: 209060 - DNA, 27 bp, Artificial sequence
  SiRNA target sequence
aaactgtctgatagtacaactttcatt

SEQ ID NO: 209061 - DNA, 27 bp, Artificial sequence
  SiRNA target sequence
aactgtctgatagtacaactttcattt

SEQ ID NO: 209062 - DNA, 27 bp, Artificial sequence
  SiRNA target sequence
actgtctgatagtacaactttcattta

SEQ ID NO: 209063 - DNA, 27 bp, Artificial sequence
  SiRNA target sequence
ctgtctgatagtacaactttcatttaa

SEQ ID NO: 209064 - DNA, 27 bp, Artificial sequence
  SiRNA target sequence
tgtctgatagtacaactttcatttaaa

SEQ ID NO: 209065 - DNA, 27 bp, Artificial sequence
  SiRNA target sequence
gtctgatagtacaactttcatttaaaa

SEQ ID NO: 209066 - DNA, 27 bp, Artificial sequence
  SiRNA target sequence
tctgatagtacaactttcatttaaaaa

SEQ ID NO: 209067 - DNA, 27 bp, Artificial sequence
  SiRNA target sequence
ctgatagtacaactttcatttaaaaaa

SEQ ID NO: 209068 - DNA, 27 bp, Artificial sequence
  SiRNA target sequence
tgatagtacaactttcatttaaaaaac

SEQ ID NO: 209069 - DNA, 27 bp, Artificial sequence
  SiRNA target sequence
gatagtacaactttcatttaaaaaact

SEQ ID NO: 209070 - DNA, 27 bp, Artificial sequence
  SiRNA target sequence
atagtacaactttcatttaaaaaactc

SEQ ID NO: 209071 - DNA, 27 bp, Artificial sequence
  SiRNA target sequence
tagtacaactttcatttaaaaaactca

SEQ ID NO: 209072 - DNA, 27 bp, Artificial sequence
  SiRNA target sequence
agtacaactttcatttaaaaaactcat

SEQ ID NO: 209073 - DNA, 27 bp, Artificial sequence
  SiRNA target sequence
gtacaactttcatttaaaaaactcatg

SEQ ID NO: 209074 - DNA, 27 bp, Artificial sequence
  SiRNA target sequence
tacaactttcatttaaaaaactcatgt

SEQ ID NO: 209075 - DNA, 27 bp, Artificial sequence
  SiRNA target sequence
acaactttcatttaaaaaactcatgta

SEQ ID NO: 209076 - DNA, 27 bp, Artificial sequence
  SiRNA target sequence
caactttcatttaaaaaactcatgtat

SEQ ID NO: 209077 - DNA, 27 bp, Artificial sequence
  SiRNA target sequence
aactttcatttaaaaaactcatgtata

SEQ ID NO: 209078 - DNA, 27 bp, Artificial sequence
  SiRNA target sequence
actttcatttaaaaaactcatgtataa

SEQ ID NO: 209079 - DNA, 27 bp, Artificial sequence
  SiRNA target sequence
ctttcatttaaaaaactcatgtataaa

SEQ ID NO: 209080 - DNA, 27 bp, Artificial sequence
  SiRNA target sequence
tttcatttaaaaaactcatgtataaat

SEQ ID NO: 209081 - DNA, 27 bp, Artificial sequence
  SiRNA target sequence
ttcatttaaaaaactcatgtataaata

SEQ ID NO: 209082 - DNA, 27 bp, Artificial sequence
  SiRNA target sequence
tcatttaaaaaactcatgtataaataa

SEQ ID NO: 209083 - DNA, 27 bp, Artificial sequence
  SiRNA target sequence
catttaaaaaactcatgtataaataag

SEQ ID NO: 209084 - DNA, 27 bp, Artificial sequence
  SiRNA target sequence
atttaaaaaactcatgtataaataagc

SEQ ID NO: 209085 - DNA, 27 bp, Artificial sequence
  SiRNA target sequence
tttaaaaaactcatgtataaataagcc

SEQ ID NO: 209086 - DNA, 27 bp, Artificial sequence
  SiRNA target sequence
ttaaaaaactcatgtataaataagcca

SEQ ID NO: 209087 - DNA, 27 bp, Artificial sequence
  SiRNA target sequence
taaaaaactcatgtataaataagccat

SEQ ID NO: 209088 - DNA, 27 bp, Artificial sequence
  SiRNA target sequence
aaaaaactcatgtataaataagccata

SEQ ID NO: 209089 - DNA, 27 bp, Artificial sequence
  SiRNA target sequence
aaaaactcatgtataaataagccataa

SEQ ID NO: 209090 - DNA, 27 bp, Artificial sequence
  SiRNA target sequence
aaaactcatgtataaataagccataag

SEQ ID NO: 209091 - DNA, 27 bp, Artificial sequence
  SiRNA target sequence
aaactcatgtataaataagccataagt

SEQ ID NO: 209092 - DNA, 27 bp, Artificial sequence
  SiRNA target sequence
aactcatgtataaataagccataagta

SEQ ID NO: 209093 - DNA, 27 bp, Artificial sequence
  SiRNA target sequence
actcatgtataaataagccataagtaa

SEQ ID NO: 209094 - DNA, 27 bp, Artificial sequence
  SiRNA target sequence
ctcatgtataaataagccataagtaaa

SEQ ID NO: 209095 - DNA, 27 bp, Artificial sequence
  SiRNA target sequence
tcatgtataaataagccataagtaaac

SEQ ID NO: 209096 - DNA, 27 bp, Artificial sequence
  SiRNA target sequence
catgtataaataagccataagtaaact

SEQ ID NO: 209097 - DNA, 27 bp, Artificial sequence
  SiRNA target sequence
atgtataaataagccataagtaaactg

SEQ ID NO: 209098 - DNA, 27 bp, Artificial sequence
  SiRNA target sequence
tgtataaataagccataagtaaactgc

SEQ ID NO: 209099 - DNA, 27 bp, Artificial sequence
  SiRNA target sequence
gtataaataagccataagtaaactgcc

SEQ ID NO: 209100 - DNA, 27 bp, Artificial sequence
  SiRNA target sequence
tataaataagccataagtaaactgccc

SEQ ID NO: 209101 - DNA, 27 bp, Artificial sequence
  SiRNA target sequence
ataaataagccataagtaaactgcccc

SEQ ID NO: 209102 - DNA, 27 bp, Artificial sequence
  SiRNA target sequence
taaataagccataagtaaactgcccca

SEQ ID NO: 209103 - DNA, 27 bp, Artificial sequence
  SiRNA target sequence
aaataagccataagtaaactgccccac

SEQ ID NO: 209104 - DNA, 27 bp, Artificial sequence
  SiRNA target sequence
aataagccataagtaaactgccccaca

SEQ ID NO: 209105 - DNA, 27 bp, Artificial sequence
  SiRNA target sequence
ataagccataagtaaactgccccacat

SEQ ID NO: 209106 - DNA, 27 bp, Artificial sequence
  SiRNA target sequence
taagccataagtaaactgccccacatt

SEQ ID NO: 209107 - DNA, 27 bp, Artificial sequence
  SiRNA target sequence
aagccataagtaaactgccccacattt

SEQ ID NO: 209108 - DNA, 27 bp, Artificial sequence
  SiRNA target sequence
agccataagtaaactgccccacatttc

SEQ ID NO: 209109 - DNA, 27 bp, Artificial sequence
  SiRNA target sequence
gccataagtaaactgccccacatttct

SEQ ID NO: 209110 - DNA, 27 bp, Artificial sequence
  SiRNA target sequence
ccataagtaaactgccccacatttctg

SEQ ID NO: 209111 - DNA, 27 bp, Artificial sequence
  SiRNA target sequence
cataagtaaactgccccacatttctgc

SEQ ID NO: 209112 - DNA, 27 bp, Artificial sequence
  SiRNA target sequence
ataagtaaactgccccacatttctgct

SEQ ID NO: 209113 - DNA, 27 bp, Artificial sequence
  SiRNA target sequence
taagtaaactgccccacatttctgcta

SEQ ID NO: 209114 - DNA, 27 bp, Artificial sequence
  SiRNA target sequence
aagtaaactgccccacatttctgctat

SEQ ID NO: 209115 - DNA, 27 bp, Artificial sequence
  SiRNA target sequence
agtaaactgccccacatttctgctatt

SEQ ID NO: 209116 - DNA, 27 bp, Artificial sequence
  SiRNA target sequence
gtaaactgccccacatttctgctatta

SEQ ID NO: 209117 - DNA, 27 bp, Artificial sequence
  SiRNA target sequence
taaactgccccacatttctgctattat

SEQ ID NO: 209118 - DNA, 27 bp, Artificial sequence
  SiRNA target sequence
aaactgccccacatttctgctattata

SEQ ID NO: 209119 - DNA, 27 bp, Artificial sequence
  SiRNA target sequence
aactgccccacatttctgctattataa

SEQ ID NO: 209120 - DNA, 27 bp, Artificial sequence
  SiRNA target sequence
actgccccacatttctgctattataaa

SEQ ID NO: 209121 - DNA, 27 bp, Artificial sequence
  SiRNA target sequence
ctgccccacatttctgctattataaaa

SEQ ID NO: 209122 - DNA, 27 bp, Artificial sequence
  SiRNA target sequence
tgccccacatttctgctattataaaaa

SEQ ID NO: 209123 - DNA, 27 bp, Artificial sequence
  SiRNA target sequence
gccccacatttctgctattataaaaat

SEQ ID NO: 209124 - DNA, 27 bp, Artificial sequence
  SiRNA target sequence
ccccacatttctgctattataaaaata

SEQ ID NO: 209125 - DNA, 27 bp, Artificial sequence
  SiRNA target sequence
cccacatttctgctattataaaaatac

SEQ ID NO: 209126 - DNA, 27 bp, Artificial sequence
  SiRNA target sequence
ccacatttctgctattataaaaataca

SEQ ID NO: 209127 - DNA, 27 bp, Artificial sequence
  SiRNA target sequence
cacatttctgctattataaaaatacaa

SEQ ID NO: 209128 - DNA, 27 bp, Artificial sequence
  SiRNA target sequence
acatttctgctattataaaaatacaag

SEQ ID NO: 209129 - DNA, 27 bp, Artificial sequence
  SiRNA target sequence
catttctgctattataaaaatacaagt

SEQ ID NO: 209130 - DNA, 27 bp, Artificial sequence
  SiRNA target sequence
atttctgctattataaaaatacaagtt

SEQ ID NO: 209131 - DNA, 27 bp, Artificial sequence
  SiRNA target sequence
tttctgctattataaaaatacaagttg

SEQ ID NO: 209132 - DNA, 27 bp, Artificial sequence
  SiRNA target sequence
ttctgctattataaaaatacaagttga

SEQ ID NO: 209133 - DNA, 27 bp, Artificial sequence
  SiRNA target sequence
tctgctattataaaaatacaagttgaa

SEQ ID NO: 209134 - DNA, 27 bp, Artificial sequence
  SiRNA target sequence
ctgctattataaaaatacaagttgaaa

SEQ ID NO: 209135 - DNA, 27 bp, Artificial sequence
  SiRNA target sequence
tgctattataaaaatacaagttgaaac

SEQ ID NO: 209136 - DNA, 27 bp, Artificial sequence
  SiRNA target sequence
gctattataaaaatacaagttgaaacg

SEQ ID NO: 209137 - DNA, 27 bp, Artificial sequence
  SiRNA target sequence
ctattataaaaatacaagttgaaacgg

SEQ ID NO: 209138 - DNA, 27 bp, Artificial sequence
  SiRNA target sequence
tattataaaaatacaagttgaaacggg

SEQ ID NO: 209139 - DNA, 27 bp, Artificial sequence
  SiRNA target sequence
attataaaaatacaagttgaaacgggc

SEQ ID NO: 209140 - DNA, 27 bp, Artificial sequence
  SiRNA target sequence
ttataaaaatacaagttgaaacgggct

SEQ ID NO: 209141 - DNA, 27 bp, Artificial sequence
  SiRNA target sequence
tataaaaatacaagttgaaacgggctc

SEQ ID NO: 209142 - DNA, 27 bp, Artificial sequence
  SiRNA target sequence
ataaaaatacaagttgaaacgggctcg

SEQ ID NO: 209143 - DNA, 27 bp, Artificial sequence
  SiRNA target sequence
taaaaatacaagttgaaacgggctcgt

SEQ ID NO: 209144 - DNA, 27 bp, Artificial sequence
  SiRNA target sequence
aaaaatacaagttgaaacgggctcgtt

SEQ ID NO: 209145 - DNA, 27 bp, Artificial sequence
  SiRNA target sequence
aaaatacaagttgaaacgggctcgtta

SEQ ID NO: 209146 - DNA, 27 bp, Artificial sequence
  SiRNA target sequence
aaatacaagttgaaacgggctcgttag

SEQ ID NO: 209147 - DNA, 27 bp, Artificial sequence
  SiRNA target sequence
aatacaagttgaaacgggctcgttagc

SEQ ID NO: 209148 - DNA, 27 bp, Artificial sequence
  SiRNA target sequence
atacaagttgaaacgggctcgttagct

SEQ ID NO: 209149 - DNA, 27 bp, Artificial sequence
  SiRNA target sequence
tacaagttgaaacgggctcgttagctg

SEQ ID NO: 209150 - DNA, 27 bp, Artificial sequence
  SiRNA target sequence
acaagttgaaacgggctcgttagctgt

SEQ ID NO: 209151 - DNA, 27 bp, Artificial sequence
  SiRNA target sequence
caagttgaaacgggctcgttagctgta

SEQ ID NO: 209152 - DNA, 27 bp, Artificial sequence
  SiRNA target sequence
aagttgaaacgggctcgttagctgtaa

SEQ ID NO: 209153 - DNA, 27 bp, Artificial sequence
  SiRNA target sequence
agttgaaacgggctcgttagctgtaat

SEQ ID NO: 209154 - DNA, 27 bp, Artificial sequence
  SiRNA target sequence
gttgaaacgggctcgttagctgtaatt

SEQ ID NO: 209155 - DNA, 27 bp, Artificial sequence
  SiRNA target sequence
ttgaaacgggctcgttagctgtaatta

SEQ ID NO: 209156 - DNA, 27 bp, Artificial sequence
  SiRNA target sequence
tgaaacgggctcgttagctgtaattaa

SEQ ID NO: 209157 - DNA, 27 bp, Artificial sequence
  SiRNA target sequence
gaaacgggctcgttagctgtaattaaa

SEQ ID NO: 209158 - DNA, 27 bp, Artificial sequence
  SiRNA target sequence
aaacgggctcgttagctgtaattaaaa

SEQ ID NO: 209159 - DNA, 27 bp, Artificial sequence
  SiRNA target sequence
aacgggctcgttagctgtaattaaaaa

SEQ ID NO: 209160 - DNA, 27 bp, Artificial sequence
  SiRNA target sequence
acgggctcgttagctgtaattaaaaaa

SEQ ID NO: 209161 - DNA, 27 bp, Artificial sequence
  SiRNA target sequence
cgggctcgttagctgtaattaaaaaat

SEQ ID NO: 209162 - DNA, 27 bp, Artificial sequence
  SiRNA target sequence
gggctcgttagctgtaattaaaaaata

SEQ ID NO: 209163 - DNA, 27 bp, Artificial sequence
  SiRNA target sequence
ggctcgttagctgtaattaaaaaatat

SEQ ID NO: 209164 - DNA, 27 bp, Artificial sequence
  SiRNA target sequence
gctcgttagctgtaattaaaaaatatt

SEQ ID NO: 209165 - DNA, 27 bp, Artificial sequence
  SiRNA target sequence
ctcgttagctgtaattaaaaaatattt

SEQ ID NO: 209166 - DNA, 27 bp, Artificial sequence
  SiRNA target sequence
tcgttagctgtaattaaaaaatatttt

SEQ ID NO: 209167 - DNA, 27 bp, Artificial sequence
  SiRNA target sequence
cgttagctgtaattaaaaaatatttta

SEQ ID NO: 209168 - DNA, 27 bp, Artificial sequence
  SiRNA target sequence
gttagctgtaattaaaaaatattttat

SEQ ID NO: 209169 - DNA, 27 bp, Artificial sequence
  SiRNA target sequence
ttagctgtaattaaaaaatattttata

SEQ ID NO: 209170 - DNA, 27 bp, Artificial sequence
  SiRNA target sequence
tagctgtaattaaaaaatattttataa

SEQ ID NO: 209171 - DNA, 27 bp, Artificial sequence
  SiRNA target sequence
agctgtaattaaaaaatattttataaa

SEQ ID NO: 209172 - DNA, 27 bp, Artificial sequence
  SiRNA target sequence
gctgtaattaaaaaatattttataaag

SEQ ID NO: 209173 - DNA, 27 bp, Artificial sequence
  SiRNA target sequence
ctgtaattaaaaaatattttataaagt

SEQ ID NO: 209174 - DNA, 27 bp, Artificial sequence
  SiRNA target sequence
tgtaattaaaaaatattttataaagtt

SEQ ID NO: 209175 - DNA, 27 bp, Artificial sequence
  SiRNA target sequence
gtaattaaaaaatattttataaagttc

SEQ ID NO: 209176 - DNA, 27 bp, Artificial sequence
  SiRNA target sequence
taattaaaaaatattttataaagttca

SEQ ID NO: 209177 - DNA, 27 bp, Artificial sequence
  SiRNA target sequence
aattaaaaaatattttataaagttcaa

SEQ ID NO: 209178 - DNA, 27 bp, Artificial sequence
  SiRNA target sequence
attaaaaaatattttataaagttcaat

SEQ ID NO: 209179 - DNA, 27 bp, Artificial sequence
  SiRNA target sequence
ttaaaaaatattttataaagttcaatc

SEQ ID NO: 209180 - DNA, 27 bp, Artificial sequence
  SiRNA target sequence
taaaaaatattttataaagttcaatcc

SEQ ID NO: 209181 - DNA, 27 bp, Artificial sequence
  SiRNA target sequence
aaaaaatattttataaagttcaatccc

SEQ ID NO: 209182 - DNA, 27 bp, Artificial sequence
  SiRNA target sequence
aaaaatattttataaagttcaatccct

SEQ ID NO: 209183 - DNA, 27 bp, Artificial sequence
  SiRNA target sequence
aaaatattttataaagttcaatccctt

SEQ ID NO: 209184 - DNA, 27 bp, Artificial sequence
  SiRNA target sequence
aaatattttataaagttcaatcccttc

SEQ ID NO: 209185 - DNA, 27 bp, Artificial sequence
  SiRNA target sequence
aatattttataaagttcaatcccttca

SEQ ID NO: 209186 - DNA, 27 bp, Artificial sequence
  SiRNA target sequence
atattttataaagttcaatcccttcaa

SEQ ID NO: 209187 - DNA, 27 bp, Artificial sequence
  SiRNA target sequence
tattttataaagttcaatcccttcaat

SEQ ID NO: 209188 - DNA, 27 bp, Artificial sequence
  SiRNA target sequence
attttataaagttcaatcccttcaatg

SEQ ID NO: 209189 - DNA, 27 bp, Artificial sequence
  SiRNA target sequence
ttttataaagttcaatcccttcaatgc

SEQ ID NO: 209190 - DNA, 27 bp, Artificial sequence
  SiRNA target sequence
tttataaagttcaatcccttcaatgca

SEQ ID NO: 209191 - DNA, 27 bp, Artificial sequence
  SiRNA target sequence
ttataaagttcaatcccttcaatgcac

SEQ ID NO: 209192 - DNA, 27 bp, Artificial sequence
  SiRNA target sequence
tataaagttcaatcccttcaatgcacc

SEQ ID NO: 209193 - DNA, 27 bp, Artificial sequence
  SiRNA target sequence
ataaagttcaatcccttcaatgcacct

SEQ ID NO: 209194 - DNA, 27 bp, Artificial sequence
  SiRNA target sequence
taaagttcaatcccttcaatgcacctt

SEQ ID NO: 209195 - DNA, 27 bp, Artificial sequence
  SiRNA target sequence
aaagttcaatcccttcaatgcaccttt

SEQ ID NO: 209196 - DNA, 27 bp, Artificial sequence
  SiRNA target sequence
aagttcaatcccttcaatgcacctttg

SEQ ID NO: 209197 - DNA, 27 bp, Artificial sequence
  SiRNA target sequence
agttcaatcccttcaatgcacctttgt

SEQ ID NO: 209198 - DNA, 27 bp, Artificial sequence
  SiRNA target sequence
gttcaatcccttcaatgcacctttgtt

SEQ ID NO: 209199 - DNA, 27 bp, Artificial sequence
  SiRNA target sequence
ttcaatcccttcaatgcacctttgtta

SEQ ID NO: 209200 - DNA, 27 bp, Artificial sequence
  SiRNA target sequence
tcaatcccttcaatgcacctttgttat

SEQ ID NO: 209201 - DNA, 27 bp, Artificial sequence
  SiRNA target sequence
caatcccttcaatgcacctttgttatc

SEQ ID NO: 209202 - DNA, 27 bp, Artificial sequence
  SiRNA target sequence
aatcccttcaatgcacctttgttatca

SEQ ID NO: 209203 - DNA, 27 bp, Artificial sequence
  SiRNA target sequence
atcccttcaatgcacctttgttatcag

SEQ ID NO: 209204 - DNA, 27 bp, Artificial sequence
  SiRNA target sequence
tcccttcaatgcacctttgttatcagc

SEQ ID NO: 209205 - DNA, 27 bp, Artificial sequence
  SiRNA target sequence
cccttcaatgcacctttgttatcagcg

SEQ ID NO: 209206 - DNA, 27 bp, Artificial sequence
  SiRNA target sequence
ccttcaatgcacctttgttatcagcga

SEQ ID NO: 209207 - DNA, 27 bp, Artificial sequence
  SiRNA target sequence
cttcaatgcacctttgttatcagcgaa

SEQ ID NO: 209208 - DNA, 27 bp, Artificial sequence
  SiRNA target sequence
ttcaatgcacctttgttatcagcgaaa

SEQ ID NO: 209209 - DNA, 27 bp, Artificial sequence
  SiRNA target sequence
tcaatgcacctttgttatcagcgaaaa

SEQ ID NO: 209210 - DNA, 27 bp, Artificial sequence
  SiRNA target sequence
caatgcacctttgttatcagcgaaaat

SEQ ID NO: 209211 - DNA, 27 bp, Artificial sequence
  SiRNA target sequence
aatgcacctttgttatcagcgaaaata

SEQ ID NO: 209212 - DNA, 27 bp, Artificial sequence
  SiRNA target sequence
atgcacctttgttatcagcgaaaatat

SEQ ID NO: 209213 - DNA, 27 bp, Artificial sequence
  SiRNA target sequence
tgcacctttgttatcagcgaaaatatc

SEQ ID NO: 209214 - DNA, 27 bp, Artificial sequence
  SiRNA target sequence
gcacctttgttatcagcgaaaatatct

SEQ ID NO: 209215 - DNA, 27 bp, Artificial sequence
  SiRNA target sequence
cacctttgttatcagcgaaaatatctc

SEQ ID NO: 209216 - DNA, 27 bp, Artificial sequence
  SiRNA target sequence
acctttgttatcagcgaaaatatctct

SEQ ID NO: 209217 - DNA, 27 bp, Artificial sequence
  SiRNA target sequence
cctttgttatcagcgaaaatatctcta

SEQ ID NO: 209218 - DNA, 27 bp, Artificial sequence
  SiRNA target sequence
ctttgttatcagcgaaaatatctctaa

SEQ ID NO: 209219 - DNA, 27 bp, Artificial sequence
  SiRNA target sequence
tttgttatcagcgaaaatatctctaaa

SEQ ID NO: 209220 - DNA, 27 bp, Artificial sequence
  SiRNA target sequence
ttgttatcagcgaaaatatctctaaat

SEQ ID NO: 209221 - DNA, 27 bp, Artificial sequence
  SiRNA target sequence
tgttatcagcgaaaatatctctaaata

SEQ ID NO: 209222 - DNA, 27 bp, Artificial sequence
  SiRNA target sequence
gttatcagcgaaaatatctctaaataa

SEQ ID NO: 209223 - DNA, 27 bp, Artificial sequence
  SiRNA target sequence
ttatcagcgaaaatatctctaaataaa

SEQ ID NO: 209224 - DNA, 27 bp, Artificial sequence
  SiRNA target sequence
tatcagcgaaaatatctctaaataaaa

SEQ ID NO: 209225 - DNA, 27 bp, Artificial sequence
  SiRNA target sequence
atcagcgaaaatatctctaaataaaaa

SEQ ID NO: 209226 - DNA, 27 bp, Artificial sequence
  SiRNA target sequence
tcagcgaaaatatctctaaataaaaag

SEQ ID NO: 209227 - DNA, 27 bp, Artificial sequence
  SiRNA target sequence
cagcgaaaatatctctaaataaaaagc

SEQ ID NO: 209228 - DNA, 27 bp, Artificial sequence
  SiRNA target sequence
agcgaaaatatctctaaataaaaagct

SEQ ID NO: 209229 - DNA, 27 bp, Artificial sequence
  SiRNA target sequence
gcgaaaatatctctaaataaaaagcta

SEQ ID NO: 209230 - DNA, 27 bp, Artificial sequence
  SiRNA target sequence
cgaaaatatctctaaataaaaagctag

SEQ ID NO: 209231 - DNA, 27 bp, Artificial sequence
  SiRNA target sequence
gaaaatatctctaaataaaaagctaga

SEQ ID NO: 209232 - DNA, 27 bp, Artificial sequence
  SiRNA target sequence
aaaatatctctaaataaaaagctagat

SEQ ID NO: 209233 - DNA, 27 bp, Artificial sequence
  SiRNA target sequence
aaatatctctaaataaaaagctagatg

SEQ ID NO: 209234 - DNA, 27 bp, Artificial sequence
  SiRNA target sequence
aatatctctaaataaaaagctagatgg

SEQ ID NO: 209235 - DNA, 27 bp, Artificial sequence
  SiRNA target sequence
atatctctaaataaaaagctagatggt

SEQ ID NO: 209236 - DNA, 27 bp, Artificial sequence
  SiRNA target sequence
tatctctaaataaaaagctagatggtg

SEQ ID NO: 209237 - DNA, 27 bp, Artificial sequence
  SiRNA target sequence
atctctaaataaaaagctagatggtgt

SEQ ID NO: 209238 - DNA, 27 bp, Artificial sequence
  SiRNA target sequence
tctctaaataaaaagctagatggtgtt

SEQ ID NO: 209239 - DNA, 27 bp, Artificial sequence
  SiRNA target sequence
ctctaaataaaaagctagatggtgtta

SEQ ID NO: 209240 - DNA, 27 bp, Artificial sequence
  SiRNA target sequence
tctaaataaaaagctagatggtgttac

SEQ ID NO: 209241 - DNA, 27 bp, Artificial sequence
  SiRNA target sequence
ctaaataaaaagctagatggtgttact

SEQ ID NO: 209242 - DNA, 27 bp, Artificial sequence
  SiRNA target sequence
taaataaaaagctagatggtgttactt

SEQ ID NO: 209243 - DNA, 27 bp, Artificial sequence
  SiRNA target sequence
aaataaaaagctagatggtgttacttt

SEQ ID NO: 209244 - DNA, 27 bp, Artificial sequence
  SiRNA target sequence
aataaaaagctagatggtgttactttc

SEQ ID NO: 209245 - DNA, 27 bp, Artificial sequence
  SiRNA target sequence
ataaaaagctagatggtgttactttct

SEQ ID NO: 209246 - DNA, 27 bp, Artificial sequence
  SiRNA target sequence
taaaaagctagatggtgttactttctc

SEQ ID NO: 209247 - DNA, 27 bp, Artificial sequence
  SiRNA target sequence
aaaaagctagatggtgttactttctct

SEQ ID NO: 209248 - DNA, 27 bp, Artificial sequence
  SiRNA target sequence
aaaagctagatggtgttactttctctt

SEQ ID NO: 209249 - DNA, 27 bp, Artificial sequence
  SiRNA target sequence
aaagctagatggtgttactttctcttc

SEQ ID NO: 209250 - DNA, 27 bp, Artificial sequence
  SiRNA target sequence
aagctagatggtgttactttctcttca

SEQ ID NO: 209251 - DNA, 27 bp, Artificial sequence
  SiRNA target sequence
agctagatggtgttactttctcttcaa

SEQ ID NO: 209252 - DNA, 27 bp, Artificial sequence
  SiRNA target sequence
gctagatggtgttactttctcttcaaa

SEQ ID NO: 209253 - DNA, 27 bp, Artificial sequence
  SiRNA target sequence
ctagatggtgttactttctcttcaaac

SEQ ID NO: 209254 - DNA, 27 bp, Artificial sequence
  SiRNA target sequence
tagatggtgttactttctcttcaaaca

SEQ ID NO: 209255 - DNA, 27 bp, Artificial sequence
  SiRNA target sequence
agatggtgttactttctcttcaaacaa

SEQ ID NO: 209256 - DNA, 27 bp, Artificial sequence
  SiRNA target sequence
gatggtgttactttctcttcaaacaaa

SEQ ID NO: 209257 - DNA, 27 bp, Artificial sequence
  SiRNA target sequence
atggtgttactttctcttcaaacaaaa

SEQ ID NO: 209258 - DNA, 27 bp, Artificial sequence
  SiRNA target sequence
tggtgttactttctcttcaaacaaaaa

SEQ ID NO: 209259 - DNA, 27 bp, Artificial sequence
  SiRNA target sequence
ggtgttactttctcttcaaacaaaaag

SEQ ID NO: 209260 - DNA, 27 bp, Artificial sequence
  SiRNA target sequence
gtgttactttctcttcaaacaaaaaga

SEQ ID NO: 209261 - DNA, 27 bp, Artificial sequence
  SiRNA target sequence
tgttactttctcttcaaacaaaaagat

SEQ ID NO: 209262 - DNA, 27 bp, Artificial sequence
  SiRNA target sequence
gttactttctcttcaaacaaaaagatt

SEQ ID NO: 209263 - DNA, 27 bp, Artificial sequence
  SiRNA target sequence
ttactttctcttcaaacaaaaagattg

SEQ ID NO: 209264 - DNA, 27 bp, Artificial sequence
  SiRNA target sequence
tactttctcttcaaacaaaaagattgc

SEQ ID NO: 209265 - DNA, 27 bp, Artificial sequence
  SiRNA target sequence
actttctcttcaaacaaaaagattgcc

SEQ ID NO: 209266 - DNA, 27 bp, Artificial sequence
  SiRNA target sequence
ctttctcttcaaacaaaaagattgccc

SEQ ID NO: 209267 - DNA, 27 bp, Artificial sequence
  SiRNA target sequence
tttctcttcaaacaaaaagattgcccc

SEQ ID NO: 209268 - DNA, 27 bp, Artificial sequence
  SiRNA target sequence
ttctcttcaaacaaaaagattgcccct

SEQ ID NO: 209269 - DNA, 27 bp, Artificial sequence
  SiRNA target sequence
tctcttcaaacaaaaagattgccccta

SEQ ID NO: 209270 - DNA, 27 bp, Artificial sequence
  SiRNA target sequence
ctcttcaaacaaaaagattgcccctag

SEQ ID NO: 209271 - DNA, 27 bp, Artificial sequence
  SiRNA target sequence
tcttcaaacaaaaagattgcccctagt

SEQ ID NO: 209272 - DNA, 27 bp, Artificial sequence
  SiRNA target sequence
cttcaaacaaaaagattgcccctagtc

SEQ ID NO: 209273 - DNA, 27 bp, Artificial sequence
  SiRNA target sequence
ttcaaacaaaaagattgcccctagtcc

SEQ ID NO: 209274 - DNA, 27 bp, Artificial sequence
  SiRNA target sequence
tcaaacaaaaagattgcccctagtccg

SEQ ID NO: 209275 - DNA, 27 bp, Artificial sequence
  SiRNA target sequence
caaacaaaaagattgcccctagtccga

SEQ ID NO: 209276 - DNA, 27 bp, Artificial sequence
  SiRNA target sequence
aaacaaaaagattgcccctagtccgaa

SEQ ID NO: 209277 - DNA, 27 bp, Artificial sequence
  SiRNA target sequence
aacaaaaagattgcccctagtccgaag

SEQ ID NO: 209278 - DNA, 27 bp, Artificial sequence
  SiRNA target sequence
acaaaaagattgcccctagtccgaaga

SEQ ID NO: 209279 - DNA, 27 bp, Artificial sequence
  SiRNA target sequence
caaaaagattgcccctagtccgaagaa

SEQ ID NO: 209280 - DNA, 27 bp, Artificial sequence
  SiRNA target sequence
aaaaagattgcccctagtccgaagaaa

SEQ ID NO: 209281 - DNA, 27 bp, Artificial sequence
  SiRNA target sequence
aaaagattgcccctagtccgaagaaaa

SEQ ID NO: 209282 - DNA, 27 bp, Artificial sequence
  SiRNA target sequence
aaagattgcccctagtccgaagaaaaa

SEQ ID NO: 209283 - DNA, 27 bp, Artificial sequence
  SiRNA target sequence
aagattgcccctagtccgaagaaaaat

SEQ ID NO: 209284 - DNA, 27 bp, Artificial sequence
  SiRNA target sequence
agattgcccctagtccgaagaaaaatg

SEQ ID NO: 209285 - DNA, 27 bp, Artificial sequence
  SiRNA target sequence
gattgcccctagtccgaagaaaaatgc

SEQ ID NO: 209286 - DNA, 27 bp, Artificial sequence
  SiRNA target sequence
attgcccctagtccgaagaaaaatgca

SEQ ID NO: 209287 - DNA, 27 bp, Artificial sequence
  SiRNA target sequence
ttgcccctagtccgaagaaaaatgcag

SEQ ID NO: 209288 - DNA, 27 bp, Artificial sequence
  SiRNA target sequence
tgcccctagtccgaagaaaaatgcagt

SEQ ID NO: 209289 - DNA, 27 bp, Artificial sequence
  SiRNA target sequence
gcccctagtccgaagaaaaatgcagta

SEQ ID NO: 209290 - DNA, 27 bp, Artificial sequence
  SiRNA target sequence
cccctagtccgaagaaaaatgcagtaa

SEQ ID NO: 209291 - DNA, 27 bp, Artificial sequence
  SiRNA target sequence
ccctagtccgaagaaaaatgcagtaaa

SEQ ID NO: 209292 - DNA, 27 bp, Artificial sequence
  SiRNA target sequence
cctagtccgaagaaaaatgcagtaaaa

SEQ ID NO: 209293 - DNA, 27 bp, Artificial sequence
  SiRNA target sequence
ctagtccgaagaaaaatgcagtaaaaa

SEQ ID NO: 209294 - DNA, 27 bp, Artificial sequence
  SiRNA target sequence
tagtccgaagaaaaatgcagtaaaaat

SEQ ID NO: 209295 - DNA, 27 bp, Artificial sequence
  SiRNA target sequence
agtccgaagaaaaatgcagtaaaaatt

SEQ ID NO: 209296 - DNA, 27 bp, Artificial sequence
  SiRNA target sequence
gtccgaagaaaaatgcagtaaaaatta

SEQ ID NO: 209297 - DNA, 27 bp, Artificial sequence
  SiRNA target sequence
tccgaagaaaaatgcagtaaaaattat

SEQ ID NO: 209298 - DNA, 27 bp, Artificial sequence
  SiRNA target sequence
ccgaagaaaaatgcagtaaaaattatt

SEQ ID NO: 209299 - DNA, 27 bp, Artificial sequence
  SiRNA target sequence
cgaagaaaaatgcagtaaaaattatta

SEQ ID NO: 209300 - DNA, 27 bp, Artificial sequence
  SiRNA target sequence
gaagaaaaatgcagtaaaaattattag

SEQ ID NO: 209301 - DNA, 27 bp, Artificial sequence
  SiRNA target sequence
aagaaaaatgcagtaaaaattattaga

SEQ ID NO: 209302 - DNA, 27 bp, Artificial sequence
  SiRNA target sequence
agaaaaatgcagtaaaaattattagaa

SEQ ID NO: 209303 - DNA, 27 bp, Artificial sequence
  SiRNA target sequence
gaaaaatgcagtaaaaattattagaaa

SEQ ID NO: 209304 - DNA, 27 bp, Artificial sequence
  SiRNA target sequence
aaaaatgcagtaaaaattattagaaat

SEQ ID NO: 209305 - DNA, 27 bp, Artificial sequence
  SiRNA target sequence
aaaatgcagtaaaaattattagaaata

SEQ ID NO: 209306 - DNA, 27 bp, Artificial sequence
  SiRNA target sequence
aaatgcagtaaaaattattagaaatag

SEQ ID NO: 209307 - DNA, 27 bp, Artificial sequence
  SiRNA target sequence
aatgcagtaaaaattattagaaataga

SEQ ID NO: 209308 - DNA, 27 bp, Artificial sequence
  SiRNA target sequence
atgcagtaaaaattattagaaatagat

SEQ ID NO: 209309 - DNA, 27 bp, Artificial sequence
  SiRNA target sequence
tgcagtaaaaattattagaaatagatt

SEQ ID NO: 209310 - DNA, 27 bp, Artificial sequence
  SiRNA target sequence
gcagtaaaaattattagaaatagatta

SEQ ID NO: 209311 - DNA, 27 bp, Artificial sequence
  SiRNA target sequence
cagtaaaaattattagaaatagattaa

SEQ ID NO: 209312 - DNA, 27 bp, Artificial sequence
  SiRNA target sequence
agtaaaaattattagaaatagattaaa

SEQ ID NO: 209313 - DNA, 27 bp, Artificial sequence
  SiRNA target sequence
gtaaaaattattagaaatagattaaaa

SEQ ID NO: 209314 - DNA, 27 bp, Artificial sequence
  SiRNA target sequence
taaaaattattagaaatagattaaaaa

SEQ ID NO: 209315 - DNA, 27 bp, Artificial sequence
  SiRNA target sequence
aaaaattattagaaatagattaaaaat

SEQ ID NO: 209316 - DNA, 27 bp, Artificial sequence
  SiRNA target sequence
aaaattattagaaatagattaaaaatc

SEQ ID NO: 209317 - DNA, 27 bp, Artificial sequence
  SiRNA target sequence
aaattattagaaatagattaaaaatcg

SEQ ID NO: 209318 - DNA, 27 bp, Artificial sequence
  SiRNA target sequence
aattattagaaatagattaaaaatcga

SEQ ID NO: 209319 - DNA, 27 bp, Artificial sequence
  SiRNA target sequence
attattagaaatagattaaaaatcgat

SEQ ID NO: 209320 - DNA, 27 bp, Artificial sequence
  SiRNA target sequence
ttattagaaatagattaaaaatcgatg

SEQ ID NO: 209321 - DNA, 27 bp, Artificial sequence
  SiRNA target sequence
tattagaaatagattaaaaatcgatga

SEQ ID NO: 209322 - DNA, 27 bp, Artificial sequence
  SiRNA target sequence
attagaaatagattaaaaatcgatgat

SEQ ID NO: 209323 - DNA, 27 bp, Artificial sequence
  SiRNA target sequence
ttagaaatagattaaaaatcgatgata

SEQ ID NO: 209324 - DNA, 27 bp, Artificial sequence
  SiRNA target sequence
tagaaatagattaaaaatcgatgatac

SEQ ID NO: 209325 - DNA, 27 bp, Artificial sequence
  SiRNA target sequence
agaaatagattaaaaatcgatgataca

SEQ ID NO: 209326 - DNA, 27 bp, Artificial sequence
  SiRNA target sequence
gaaatagattaaaaatcgatgatacag

SEQ ID NO: 209327 - DNA, 27 bp, Artificial sequence
  SiRNA target sequence
aaatagattaaaaatcgatgatacagg

SEQ ID NO: 209328 - DNA, 27 bp, Artificial sequence
  SiRNA target sequence
aatagattaaaaatcgatgatacaggt

SEQ ID NO: 209329 - DNA, 27 bp, Artificial sequence
  SiRNA target sequence
atagattaaaaatcgatgatacaggtt

SEQ ID NO: 209330 - DNA, 27 bp, Artificial sequence
  SiRNA target sequence
tagattaaaaatcgatgatacaggttt

SEQ ID NO: 209331 - DNA, 27 bp, Artificial sequence
  SiRNA target sequence
agattaaaaatcgatgatacaggttta

SEQ ID NO: 209332 - DNA, 27 bp, Artificial sequence
  SiRNA target sequence
gattaaaaatcgatgatacaggtttat

SEQ ID NO: 209333 - DNA, 27 bp, Artificial sequence
  SiRNA target sequence
attaaaaatcgatgatacaggtttatt

SEQ ID NO: 209334 - DNA, 27 bp, Artificial sequence
  SiRNA target sequence
ttaaaaatcgatgatacaggtttattt

SEQ ID NO: 209335 - DNA, 27 bp, Artificial sequence
  SiRNA target sequence
taaaaatcgatgatacaggtttatttt

SEQ ID NO: 209336 - DNA, 27 bp, Artificial sequence
  SiRNA target sequence
aaaaatcgatgatacaggtttattttg

SEQ ID NO: 209337 - DNA, 27 bp, Artificial sequence
  SiRNA target sequence
aaaatcgatgatacaggtttattttgc

SEQ ID NO: 209338 - DNA, 27 bp, Artificial sequence
  SiRNA target sequence
aaatcgatgatacaggtttattttgca

SEQ ID NO: 209339 - DNA, 27 bp, Artificial sequence
  SiRNA target sequence
aatcgatgatacaggtttattttgcat

SEQ ID NO: 209340 - DNA, 27 bp, Artificial sequence
  SiRNA target sequence
atcgatgatacaggtttattttgcata

SEQ ID NO: 209341 - DNA, 27 bp, Artificial sequence
  SiRNA target sequence
tcgatgatacaggtttattttgcataa

SEQ ID NO: 209342 - DNA, 27 bp, Artificial sequence
  SiRNA target sequence
cgatgatacaggtttattttgcataag

SEQ ID NO: 209343 - DNA, 27 bp, Artificial sequence
  SiRNA target sequence
gatgatacaggtttattttgcataagc

SEQ ID NO: 209344 - DNA, 27 bp, Artificial sequence
  SiRNA target sequence
atgatacaggtttattttgcataagcc

SEQ ID NO: 209345 - DNA, 27 bp, Artificial sequence
  SiRNA target sequence
tgatacaggtttattttgcataagcca

SEQ ID NO: 209346 - DNA, 27 bp, Artificial sequence
  SiRNA target sequence
gatacaggtttattttgcataagccac

SEQ ID NO: 209347 - DNA, 27 bp, Artificial sequence
  SiRNA target sequence
atacaggtttattttgcataagccact

SEQ ID NO: 209348 - DNA, 27 bp, Artificial sequence
  SiRNA target sequence
tacaggtttattttgcataagccactg

SEQ ID NO: 209349 - DNA, 27 bp, Artificial sequence
  SiRNA target sequence
acaggtttattttgcataagccactgt

SEQ ID NO: 209350 - DNA, 27 bp, Artificial sequence
  SiRNA target sequence
caggtttattttgcataagccactgta

SEQ ID NO: 209351 - DNA, 27 bp, Artificial sequence
  SiRNA target sequence
aggtttattttgcataagccactgtat

SEQ ID NO: 209352 - DNA, 27 bp, Artificial sequence
  SiRNA target sequence
ggtttattttgcataagccactgtatt

SEQ ID NO: 209353 - DNA, 27 bp, Artificial sequence
  SiRNA target sequence
gtttattttgcataagccactgtatta

SEQ ID NO: 209354 - DNA, 27 bp, Artificial sequence
  SiRNA target sequence
tttattttgcataagccactgtattaa

SEQ ID NO: 209355 - DNA, 27 bp, Artificial sequence
  SiRNA target sequence
ttattttgcataagccactgtattaaa

SEQ ID NO: 209356 - DNA, 27 bp, Artificial sequence
  SiRNA target sequence
tattttgcataagccactgtattaaaa

SEQ ID NO: 209357 - DNA, 27 bp, Artificial sequence
  SiRNA target sequence
attttgcataagccactgtattaaaat

SEQ ID NO: 209358 - DNA, 27 bp, Artificial sequence
  SiRNA target sequence
ttttgcataagccactgtattaaaatt

SEQ ID NO: 209359 - DNA, 27 bp, Artificial sequence
  SiRNA target sequence
tttgcataagccactgtattaaaatta

SEQ ID NO: 209360 - DNA, 27 bp, Artificial sequence
  SiRNA target sequence
ttgcataagccactgtattaaaattac

SEQ ID NO: 209361 - DNA, 27 bp, Artificial sequence
  SiRNA target sequence
tgcataagccactgtattaaaattaca

SEQ ID NO: 209362 - DNA, 27 bp, Artificial sequence
  SiRNA target sequence
gcataagccactgtattaaaattacag

SEQ ID NO: 209363 - DNA, 27 bp, Artificial sequence
  SiRNA target sequence
cataagccactgtattaaaattacaga

SEQ ID NO: 209364 - DNA, 27 bp, Artificial sequence
  SiRNA target sequence
ataagccactgtattaaaattacagat

SEQ ID NO: 209365 - DNA, 27 bp, Artificial sequence
  SiRNA target sequence
taagccactgtattaaaattacagatg

SEQ ID NO: 209366 - DNA, 27 bp, Artificial sequence
  SiRNA target sequence
aagccactgtattaaaattacagatgc

SEQ ID NO: 209367 - DNA, 27 bp, Artificial sequence
  SiRNA target sequence
agccactgtattaaaattacagatgca

SEQ ID NO: 209368 - DNA, 27 bp, Artificial sequence
  SiRNA target sequence
gccactgtattaaaattacagatgcaa

SEQ ID NO: 209369 - DNA, 27 bp, Artificial sequence
  SiRNA target sequence
ccactgtattaaaattacagatgcaaa

SEQ ID NO: 209370 - DNA, 27 bp, Artificial sequence
  SiRNA target sequence
cactgtattaaaattacagatgcaaaa

SEQ ID NO: 209371 - DNA, 27 bp, Artificial sequence
  SiRNA target sequence
actgtattaaaattacagatgcaaaag

SEQ ID NO: 209372 - DNA, 27 bp, Artificial sequence
  SiRNA target sequence
ctgtattaaaattacagatgcaaaaga

SEQ ID NO: 209373 - DNA, 27 bp, Artificial sequence
  SiRNA target sequence
tgtattaaaattacagatgcaaaagat

SEQ ID NO: 209374 - DNA, 27 bp, Artificial sequence
  SiRNA target sequence
gtattaaaattacagatgcaaaagata

SEQ ID NO: 209375 - DNA, 27 bp, Artificial sequence
  SiRNA target sequence
tattaaaattacagatgcaaaagatat

SEQ ID NO: 209376 - DNA, 27 bp, Artificial sequence
  SiRNA target sequence
attaaaattacagatgcaaaagatata

SEQ ID NO: 209377 - DNA, 27 bp, Artificial sequence
  SiRNA target sequence
ttaaaattacagatgcaaaagatatag

SEQ ID NO: 209378 - DNA, 27 bp, Artificial sequence
  SiRNA target sequence
taaaattacagatgcaaaagatatagg

SEQ ID NO: 209379 - DNA, 27 bp, Artificial sequence
  SiRNA target sequence
aaaattacagatgcaaaagatatagga

SEQ ID NO: 209380 - DNA, 27 bp, Artificial sequence
  SiRNA target sequence
aaattacagatgcaaaagatataggaa

SEQ ID NO: 209381 - DNA, 27 bp, Artificial sequence
  SiRNA target sequence
aattacagatgcaaaagatataggaag

SEQ ID NO: 209382 - DNA, 27 bp, Artificial sequence
  SiRNA target sequence
attacagatgcaaaagatataggaaga

SEQ ID NO: 209383 - DNA, 27 bp, Artificial sequence
  SiRNA target sequence
ttacagatgcaaaagatataggaagaa

SEQ ID NO: 209384 - DNA, 27 bp, Artificial sequence
  SiRNA target sequence
tacagatgcaaaagatataggaagaac

SEQ ID NO: 209385 - DNA, 27 bp, Artificial sequence
  SiRNA target sequence
acagatgcaaaagatataggaagaaca

SEQ ID NO: 209386 - DNA, 27 bp, Artificial sequence
  SiRNA target sequence
cagatgcaaaagatataggaagaacat

SEQ ID NO: 209387 - DNA, 27 bp, Artificial sequence
  SiRNA target sequence
agatgcaaaagatataggaagaacata

SEQ ID NO: 209388 - DNA, 27 bp, Artificial sequence
  SiRNA target sequence
gatgcaaaagatataggaagaacataa

SEQ ID NO: 209389 - DNA, 27 bp, Artificial sequence
  SiRNA target sequence
atgcaaaagatataggaagaacataaa

SEQ ID NO: 209390 - DNA, 27 bp, Artificial sequence
  SiRNA target sequence
tgcaaaagatataggaagaacataaaa

SEQ ID NO: 209391 - DNA, 27 bp, Artificial sequence
  SiRNA target sequence
gcaaaagatataggaagaacataaaaa

SEQ ID NO: 209392 - DNA, 27 bp, Artificial sequence
  SiRNA target sequence
caaaagatataggaagaacataaaaaa

SEQ ID NO: 209393 - DNA, 27 bp, Artificial sequence
  SiRNA target sequence
aaaagatataggaagaacataaaaaat

SEQ ID NO: 209394 - DNA, 27 bp, Artificial sequence
  SiRNA target sequence
aaagatataggaagaacataaaaaatt

SEQ ID NO: 209395 - DNA, 27 bp, Artificial sequence
  SiRNA target sequence
aagatataggaagaacataaaaaattt

SEQ ID NO: 209396 - DNA, 27 bp, Artificial sequence
  SiRNA target sequence
agatataggaagaacataaaaaatttt

SEQ ID NO: 209397 - DNA, 27 bp, Artificial sequence
  SiRNA target sequence
gatataggaagaacataaaaaattttc

SEQ ID NO: 209398 - DNA, 27 bp, Artificial sequence
  SiRNA target sequence
atataggaagaacataaaaaattttca

SEQ ID NO: 209399 - DNA, 27 bp, Artificial sequence
  SiRNA target sequence
tataggaagaacataaaaaattttcat

SEQ ID NO: 209400 - DNA, 27 bp, Artificial sequence
  SiRNA target sequence
ataggaagaacataaaaaattttcata

SEQ ID NO: 209401 - DNA, 27 bp, Artificial sequence
  SiRNA target sequence
taggaagaacataaaaaattttcataa

SEQ ID NO: 209402 - DNA, 27 bp, Artificial sequence
  SiRNA target sequence
aggaagaacataaaaaattttcataaa

SEQ ID NO: 209403 - DNA, 27 bp, Artificial sequence
  SiRNA target sequence
ggaagaacataaaaaattttcataaac

SEQ ID NO: 209404 - DNA, 27 bp, Artificial sequence
  SiRNA target sequence
gaagaacataaaaaattttcataaaca

SEQ ID NO: 209405 - DNA, 27 bp, Artificial sequence
  SiRNA target sequence
aagaacataaaaaattttcataaacat

SEQ ID NO: 209406 - DNA, 27 bp, Artificial sequence
  SiRNA target sequence
agaacataaaaaattttcataaacata

SEQ ID NO: 209407 - DNA, 27 bp, Artificial sequence
  SiRNA target sequence
gaacataaaaaattttcataaacataa

SEQ ID NO: 209408 - DNA, 27 bp, Artificial sequence
  SiRNA target sequence
aacataaaaaattttcataaacataat

SEQ ID NO: 209409 - DNA, 27 bp, Artificial sequence
  SiRNA target sequence
acataaaaaattttcataaacataatt

SEQ ID NO: 209410 - DNA, 27 bp, Artificial sequence
  SiRNA target sequence
cataaaaaattttcataaacataattg

SEQ ID NO: 209411 - DNA, 27 bp, Artificial sequence
  SiRNA target sequence
ataaaaaattttcataaacataattga

SEQ ID NO: 209412 - DNA, 27 bp, Artificial sequence
  SiRNA target sequence
taaaaaattttcataaacataattgaa

SEQ ID NO: 209413 - DNA, 27 bp, Artificial sequence
  SiRNA target sequence
aaaaaattttcataaacataattgaat

SEQ ID NO: 209414 - DNA, 27 bp, Artificial sequence
  SiRNA target sequence
aaaaattttcataaacataattgaatt

SEQ ID NO: 209415 - DNA, 27 bp, Artificial sequence
  SiRNA target sequence
aaaattttcataaacataattgaattc

SEQ ID NO: 209416 - DNA, 27 bp, Artificial sequence
  SiRNA target sequence
aaattttcataaacataattgaattct

SEQ ID NO: 209417 - DNA, 27 bp, Artificial sequence
  SiRNA target sequence
aattttcataaacataattgaattctg

SEQ ID NO: 209418 - DNA, 27 bp, Artificial sequence
  SiRNA target sequence
attttcataaacataattgaattctga

SEQ ID NO: 209419 - DNA, 27 bp, Artificial sequence
  SiRNA target sequence
ttttcataaacataattgaattctgat

SEQ ID NO: 209420 - DNA, 27 bp, Artificial sequence
  SiRNA target sequence
tttcataaacataattgaattctgatc

SEQ ID NO: 209421 - DNA, 27 bp, Artificial sequence
  SiRNA target sequence
ttcataaacataattgaattctgatct

SEQ ID NO: 209422 - DNA, 27 bp, Artificial sequence
  SiRNA target sequence
tcataaacataattgaattctgatctt

SEQ ID NO: 209423 - DNA, 27 bp, Artificial sequence
  SiRNA target sequence
cataaacataattgaattctgatcttg

SEQ ID NO: 209424 - DNA, 27 bp, Artificial sequence
  SiRNA target sequence
ataaacataattgaattctgatcttgc

SEQ ID NO: 209425 - DNA, 27 bp, Artificial sequence
  SiRNA target sequence
taaacataattgaattctgatcttgcc

SEQ ID NO: 209426 - DNA, 27 bp, Artificial sequence
  SiRNA target sequence
aaacataattgaattctgatcttgcct

SEQ ID NO: 209427 - DNA, 27 bp, Artificial sequence
  SiRNA target sequence
aacataattgaattctgatcttgcctt

SEQ ID NO: 209428 - DNA, 27 bp, Artificial sequence
  SiRNA target sequence
acataattgaattctgatcttgcctta

SEQ ID NO: 209429 - DNA, 27 bp, Artificial sequence
  SiRNA target sequence
cataattgaattctgatcttgccttac

SEQ ID NO: 209430 - DNA, 27 bp, Artificial sequence
  SiRNA target sequence
ataattgaattctgatcttgccttacc

SEQ ID NO: 209431 - DNA, 27 bp, Artificial sequence
  SiRNA target sequence
taattgaattctgatcttgccttacca

SEQ ID NO: 209432 - DNA, 27 bp, Artificial sequence
  SiRNA target sequence
aattgaattctgatcttgccttaccat

SEQ ID NO: 209433 - DNA, 27 bp, Artificial sequence
  SiRNA target sequence
attgaattctgatcttgccttaccatc

SEQ ID NO: 209434 - DNA, 27 bp, Artificial sequence
  SiRNA target sequence
ttgaattctgatcttgccttaccatca

SEQ ID NO: 209435 - DNA, 27 bp, Artificial sequence
  SiRNA target sequence
tgaattctgatcttgccttaccatcac

SEQ ID NO: 209436 - DNA, 27 bp, Artificial sequence
  SiRNA target sequence
gaattctgatcttgccttaccatcaca

SEQ ID NO: 209437 - DNA, 27 bp, Artificial sequence
  SiRNA target sequence
aattctgatcttgccttaccatcacaa

SEQ ID NO: 209438 - DNA, 27 bp, Artificial sequence
  SiRNA target sequence
attctgatcttgccttaccatcacaaa

SEQ ID NO: 209439 - DNA, 27 bp, Artificial sequence
  SiRNA target sequence
ttctgatcttgccttaccatcacaaat

SEQ ID NO: 209440 - DNA, 27 bp, Artificial sequence
  SiRNA target sequence
tctgatcttgccttaccatcacaaata

SEQ ID NO: 209441 - DNA, 27 bp, Artificial sequence
  SiRNA target sequence
ctgatcttgccttaccatcacaaataa

SEQ ID NO: 209442 - DNA, 27 bp, Artificial sequence
  SiRNA target sequence
tgatcttgccttaccatcacaaataaa

SEQ ID NO: 209443 - DNA, 27 bp, Artificial sequence
  SiRNA target sequence
gatcttgccttaccatcacaaataaat

SEQ ID NO: 209444 - DNA, 27 bp, Artificial sequence
  SiRNA target sequence
atcttgccttaccatcacaaataaatc

SEQ ID NO: 209445 - DNA, 27 bp, Artificial sequence
  SiRNA target sequence
tcttgccttaccatcacaaataaatct

SEQ ID NO: 209446 - DNA, 27 bp, Artificial sequence
  SiRNA target sequence
cttgccttaccatcacaaataaatctt

SEQ ID NO: 209447 - DNA, 27 bp, Artificial sequence
  SiRNA target sequence
ttgccttaccatcacaaataaatcttt

SEQ ID NO: 209448 - DNA, 27 bp, Artificial sequence
  SiRNA target sequence
tgccttaccatcacaaataaatctttt

SEQ ID NO: 209449 - DNA, 27 bp, Artificial sequence
  SiRNA target sequence
gccttaccatcacaaataaatctttta

SEQ ID NO: 209450 - DNA, 27 bp, Artificial sequence
  SiRNA target sequence
ccttaccatcacaaataaatcttttaa

SEQ ID NO: 209451 - DNA, 27 bp, Artificial sequence
  SiRNA target sequence
cttaccatcacaaataaatcttttaaa

SEQ ID NO: 209452 - DNA, 27 bp, Artificial sequence
  SiRNA target sequence
ttaccatcacaaataaatcttttaaaa

SEQ ID NO: 209453 - DNA, 27 bp, Artificial sequence
  SiRNA target sequence
taccatcacaaataaatcttttaaaat

SEQ ID NO: 209454 - DNA, 27 bp, Artificial sequence
  SiRNA target sequence
accatcacaaataaatcttttaaaatt

SEQ ID NO: 209455 - DNA, 27 bp, Artificial sequence
  SiRNA target sequence
ccatcacaaataaatcttttaaaattc

SEQ ID NO: 209456 - DNA, 27 bp, Artificial sequence
  SiRNA target sequence
catcacaaataaatcttttaaaattct

SEQ ID NO: 209457 - DNA, 27 bp, Artificial sequence
  SiRNA target sequence
atcacaaataaatcttttaaaattctt

SEQ ID NO: 209458 - DNA, 27 bp, Artificial sequence
  SiRNA target sequence
tcacaaataaatcttttaaaattctta

SEQ ID NO: 209459 - DNA, 27 bp, Artificial sequence
  SiRNA target sequence
cacaaataaatcttttaaaattcttaa

SEQ ID NO: 209460 - DNA, 27 bp, Artificial sequence
  SiRNA target sequence
acaaataaatcttttaaaattcttaaa

SEQ ID NO: 209461 - DNA, 27 bp, Artificial sequence
  SiRNA target sequence
caaataaatcttttaaaattcttaaaa

SEQ ID NO: 209462 - DNA, 27 bp, Artificial sequence
  SiRNA target sequence
aaataaatcttttaaaattcttaaaaa

SEQ ID NO: 209463 - DNA, 27 bp, Artificial sequence
  SiRNA target sequence
aataaatcttttaaaattcttaaaaat

SEQ ID NO: 209464 - DNA, 27 bp, Artificial sequence
  SiRNA target sequence
ataaatcttttaaaattcttaaaaatg

SEQ ID NO: 209465 - DNA, 27 bp, Artificial sequence
  SiRNA target sequence
taaatcttttaaaattcttaaaaatga

SEQ ID NO: 209466 - DNA, 27 bp, Artificial sequence
  SiRNA target sequence
aaatcttttaaaattcttaaaaatgaa

SEQ ID NO: 209467 - DNA, 27 bp, Artificial sequence
  SiRNA target sequence
aatcttttaaaattcttaaaaatgaat

SEQ ID NO: 209468 - DNA, 27 bp, Artificial sequence
  SiRNA target sequence
atcttttaaaattcttaaaaatgaata

SEQ ID NO: 209469 - DNA, 27 bp, Artificial sequence
  SiRNA target sequence
tcttttaaaattcttaaaaatgaatac

SEQ ID NO: 209470 - DNA, 27 bp, Artificial sequence
  SiRNA target sequence
cttttaaaattcttaaaaatgaataca

SEQ ID NO: 209471 - DNA, 27 bp, Artificial sequence
  SiRNA target sequence
ttttaaaattcttaaaaatgaatacac

SEQ ID NO: 209472 - DNA, 27 bp, Artificial sequence
  SiRNA target sequence
tttaaaattcttaaaaatgaatacaca

SEQ ID NO: 209473 - DNA, 27 bp, Artificial sequence
  SiRNA target sequence
ttaaaattcttaaaaatgaatacacaa

SEQ ID NO: 209474 - DNA, 27 bp, Artificial sequence
  SiRNA target sequence
taaaattcttaaaaatgaatacacaaa

SEQ ID NO: 209475 - DNA, 27 bp, Artificial sequence
  SiRNA target sequence
aaaattcttaaaaatgaatacacaaag

SEQ ID NO: 209476 - DNA, 27 bp, Artificial sequence
  SiRNA target sequence
aaattcttaaaaatgaatacacaaagt

SEQ ID NO: 209477 - DNA, 27 bp, Artificial sequence
  SiRNA target sequence
aattcttaaaaatgaatacacaaagtt

SEQ ID NO: 209478 - DNA, 27 bp, Artificial sequence
  SiRNA target sequence
attcttaaaaatgaatacacaaagtta

SEQ ID NO: 209479 - DNA, 27 bp, Artificial sequence
  SiRNA target sequence
ttcttaaaaatgaatacacaaagttaa

SEQ ID NO: 209480 - DNA, 27 bp, Artificial sequence
  SiRNA target sequence
tcttaaaaatgaatacacaaagttaat

SEQ ID NO: 209481 - DNA, 27 bp, Artificial sequence
  SiRNA target sequence
cttaaaaatgaatacacaaagttaatt

SEQ ID NO: 209482 - DNA, 27 bp, Artificial sequence
  SiRNA target sequence
ttaaaaatgaatacacaaagttaatta

SEQ ID NO: 209483 - DNA, 27 bp, Artificial sequence
  SiRNA target sequence
taaaaatgaatacacaaagttaattaa

SEQ ID NO: 209484 - DNA, 27 bp, Artificial sequence
  SiRNA target sequence
aaaaatgaatacacaaagttaattaat

SEQ ID NO: 209485 - DNA, 27 bp, Artificial sequence
  SiRNA target sequence
aaaatgaatacacaaagttaattaatc

SEQ ID NO: 209486 - DNA, 27 bp, Artificial sequence
  SiRNA target sequence
aaatgaatacacaaagttaattaatcc

SEQ ID NO: 209487 - DNA, 27 bp, Artificial sequence
  SiRNA target sequence
aatgaatacacaaagttaattaatcca

SEQ ID NO: 209488 - DNA, 27 bp, Artificial sequence
  SiRNA target sequence
atgaatacacaaagttaattaatccaa

SEQ ID NO: 209489 - DNA, 27 bp, Artificial sequence
  SiRNA target sequence
tgaatacacaaagttaattaatccaaa

SEQ ID NO: 209490 - DNA, 27 bp, Artificial sequence
  SiRNA target sequence
gaatacacaaagttaattaatccaaac

SEQ ID NO: 209491 - DNA, 27 bp, Artificial sequence
  SiRNA target sequence
aatacacaaagttaattaatccaaaca

SEQ ID NO: 209492 - DNA, 27 bp, Artificial sequence
  SiRNA target sequence
atacacaaagttaattaatccaaacat

SEQ ID NO: 209493 - DNA, 27 bp, Artificial sequence
  SiRNA target sequence
tacacaaagttaattaatccaaacata

SEQ ID NO: 209494 - DNA, 27 bp, Artificial sequence
  SiRNA target sequence
acacaaagttaattaatccaaacataa

SEQ ID NO: 209495 - DNA, 27 bp, Artificial sequence
  SiRNA target sequence
cacaaagttaattaatccaaacataat

SEQ ID NO: 209496 - DNA, 27 bp, Artificial sequence
  SiRNA target sequence
acaaagttaattaatccaaacataata

SEQ ID NO: 209497 - DNA, 27 bp, Artificial sequence
  SiRNA target sequence
caaagttaattaatccaaacataatac

SEQ ID NO: 209498 - DNA, 27 bp, Artificial sequence
  SiRNA target sequence
aaagttaattaatccaaacataatacc

SEQ ID NO: 209499 - DNA, 27 bp, Artificial sequence
  SiRNA target sequence
aagttaattaatccaaacataatacca

SEQ ID NO: 209500 - DNA, 27 bp, Artificial sequence
  SiRNA target sequence
agttaattaatccaaacataataccaa

SEQ ID NO: 209501 - DNA, 27 bp, Artificial sequence
  SiRNA target sequence
gttaattaatccaaacataataccaag

SEQ ID NO: 209502 - DNA, 27 bp, Artificial sequence
  SiRNA target sequence
ttaattaatccaaacataataccaagt

SEQ ID NO: 209503 - DNA, 27 bp, Artificial sequence
  SiRNA target sequence
taattaatccaaacataataccaagta

SEQ ID NO: 209504 - DNA, 27 bp, Artificial sequence
  SiRNA target sequence
aattaatccaaacataataccaagtat

SEQ ID NO: 209505 - DNA, 27 bp, Artificial sequence
  SiRNA target sequence
attaatccaaacataataccaagtata

SEQ ID NO: 209506 - DNA, 27 bp, Artificial sequence
  SiRNA target sequence
ttaatccaaacataataccaagtataa

SEQ ID NO: 209507 - DNA, 27 bp, Artificial sequence
  SiRNA target sequence
taatccaaacataataccaagtataaa

SEQ ID NO: 209508 - DNA, 27 bp, Artificial sequence
  SiRNA target sequence
aatccaaacataataccaagtataaaa

SEQ ID NO: 209509 - DNA, 27 bp, Artificial sequence
  SiRNA target sequence
atccaaacataataccaagtataaaaa

SEQ ID NO: 209510 - DNA, 27 bp, Artificial sequence
  SiRNA target sequence
tccaaacataataccaagtataaaaaa

SEQ ID NO: 209511 - DNA, 27 bp, Artificial sequence
  SiRNA target sequence
ccaaacataataccaagtataaaaaat

SEQ ID NO: 209512 - DNA, 27 bp, Artificial sequence
  SiRNA target sequence
caaacataataccaagtataaaaaatt

SEQ ID NO: 209513 - DNA, 27 bp, Artificial sequence
  SiRNA target sequence
aaacataataccaagtataaaaaattt

SEQ ID NO: 209514 - DNA, 27 bp, Artificial sequence
  SiRNA target sequence
aacataataccaagtataaaaaattta

SEQ ID NO: 209515 - DNA, 27 bp, Artificial sequence
  SiRNA target sequence
acataataccaagtataaaaaatttag

SEQ ID NO: 209516 - DNA, 27 bp, Artificial sequence
  SiRNA target sequence
cataataccaagtataaaaaatttagg

SEQ ID NO: 209517 - DNA, 27 bp, Artificial sequence
  SiRNA target sequence
ataataccaagtataaaaaatttaggc

SEQ ID NO: 209518 - DNA, 27 bp, Artificial sequence
  SiRNA target sequence
taataccaagtataaaaaatttaggca

SEQ ID NO: 209519 - DNA, 27 bp, Artificial sequence
  SiRNA target sequence
aataccaagtataaaaaatttaggcat

SEQ ID NO: 209520 - DNA, 27 bp, Artificial sequence
  SiRNA target sequence
ataccaagtataaaaaatttaggcatt

SEQ ID NO: 209521 - DNA, 27 bp, Artificial sequence
  SiRNA target sequence
taccaagtataaaaaatttaggcattt

SEQ ID NO: 209522 - DNA, 27 bp, Artificial sequence
  SiRNA target sequence
accaagtataaaaaatttaggcatttc

SEQ ID NO: 209523 - DNA, 27 bp, Artificial sequence
  SiRNA target sequence
ccaagtataaaaaatttaggcatttca

SEQ ID NO: 209524 - DNA, 27 bp, Artificial sequence
  SiRNA target sequence
caagtataaaaaatttaggcatttcaa

SEQ ID NO: 209525 - DNA, 27 bp, Artificial sequence
  SiRNA target sequence
aagtataaaaaatttaggcatttcaac

SEQ ID NO: 209526 - DNA, 27 bp, Artificial sequence
  SiRNA target sequence
agtataaaaaatttaggcatttcaacc

SEQ ID NO: 209527 - DNA, 27 bp, Artificial sequence
  SiRNA target sequence
gtataaaaaatttaggcatttcaacct

SEQ ID NO: 209528 - DNA, 27 bp, Artificial sequence
  SiRNA target sequence
tataaaaaatttaggcatttcaacctt

SEQ ID NO: 209529 - DNA, 27 bp, Artificial sequence
  SiRNA target sequence
ataaaaaatttaggcatttcaacctta

SEQ ID NO: 209530 - DNA, 27 bp, Artificial sequence
  SiRNA target sequence
taaaaaatttaggcatttcaaccttag

SEQ ID NO: 209531 - DNA, 27 bp, Artificial sequence
  SiRNA target sequence
aaaaaatttaggcatttcaaccttagc

SEQ ID NO: 209532 - DNA, 27 bp, Artificial sequence
  SiRNA target sequence
aaaaatttaggcatttcaaccttagca

SEQ ID NO: 209533 - DNA, 27 bp, Artificial sequence
  SiRNA target sequence
aaaatttaggcatttcaaccttagcaa

SEQ ID NO: 209534 - DNA, 27 bp, Artificial sequence
  SiRNA target sequence
aaatttaggcatttcaaccttagcaac

SEQ ID NO: 209535 - DNA, 27 bp, Artificial sequence
  SiRNA target sequence
aatttaggcatttcaaccttagcaact

SEQ ID NO: 209536 - DNA, 27 bp, Artificial sequence
  SiRNA target sequence
atttaggcatttcaaccttagcaactt

SEQ ID NO: 209537 - DNA, 27 bp, Artificial sequence
  SiRNA target sequence
tttaggcatttcaaccttagcaacttt

SEQ ID NO: 209538 - DNA, 27 bp, Artificial sequence
  SiRNA target sequence
ttaggcatttcaaccttagcaacttta

SEQ ID NO: 209539 - DNA, 27 bp, Artificial sequence
  SiRNA target sequence
taggcatttcaaccttagcaactttaa

SEQ ID NO: 209540 - DNA, 27 bp, Artificial sequence
  SiRNA target sequence
aggcatttcaaccttagcaactttaaa

SEQ ID NO: 209541 - DNA, 27 bp, Artificial sequence
  SiRNA target sequence
ggcatttcaaccttagcaactttaaaa

SEQ ID NO: 209542 - DNA, 27 bp, Artificial sequence
  SiRNA target sequence
gcatttcaaccttagcaactttaaaat

SEQ ID NO: 209543 - DNA, 27 bp, Artificial sequence
  SiRNA target sequence
catttcaaccttagcaactttaaaata

SEQ ID NO: 209544 - DNA, 27 bp, Artificial sequence
  SiRNA target sequence
atttcaaccttagcaactttaaaataa

SEQ ID NO: 209545 - DNA, 27 bp, Artificial sequence
  SiRNA target sequence
tttcaaccttagcaactttaaaataac

SEQ ID NO: 209546 - DNA, 27 bp, Artificial sequence
  SiRNA target sequence
ttcaaccttagcaactttaaaataact

SEQ ID NO: 209547 - DNA, 27 bp, Artificial sequence
  SiRNA target sequence
tcaaccttagcaactttaaaataactc

SEQ ID NO: 209548 - DNA, 27 bp, Artificial sequence
  SiRNA target sequence
caaccttagcaactttaaaataactca

SEQ ID NO: 209549 - DNA, 27 bp, Artificial sequence
  SiRNA target sequence
aaccttagcaactttaaaataactcag

SEQ ID NO: 209550 - DNA, 27 bp, Artificial sequence
  SiRNA target sequence
accttagcaactttaaaataactcagt

SEQ ID NO: 209551 - DNA, 27 bp, Artificial sequence
  SiRNA target sequence
ccttagcaactttaaaataactcagta

SEQ ID NO: 209552 - DNA, 27 bp, Artificial sequence
  SiRNA target sequence
cttagcaactttaaaataactcagtaa

SEQ ID NO: 209553 - DNA, 27 bp, Artificial sequence
  SiRNA target sequence
ttagcaactttaaaataactcagtaat

SEQ ID NO: 209554 - DNA, 27 bp, Artificial sequence
  SiRNA target sequence
tagcaactttaaaataactcagtaatc

SEQ ID NO: 209555 - DNA, 27 bp, Artificial sequence
  SiRNA target sequence
agcaactttaaaataactcagtaatcc

SEQ ID NO: 209556 - DNA, 27 bp, Artificial sequence
  SiRNA target sequence
gcaactttaaaataactcagtaatcct

SEQ ID NO: 209557 - DNA, 27 bp, Artificial sequence
  SiRNA target sequence
caactttaaaataactcagtaatcctg

SEQ ID NO: 209558 - DNA, 27 bp, Artificial sequence
  SiRNA target sequence
aactttaaaataactcagtaatcctgt

SEQ ID NO: 209559 - DNA, 27 bp, Artificial sequence
  SiRNA target sequence
actttaaaataactcagtaatcctgtt

SEQ ID NO: 209560 - DNA, 27 bp, Artificial sequence
  SiRNA target sequence
ctttaaaataactcagtaatcctgttc

SEQ ID NO: 209561 - DNA, 27 bp, Artificial sequence
  SiRNA target sequence
tttaaaataactcagtaatcctgttct

SEQ ID NO: 209562 - DNA, 27 bp, Artificial sequence
  SiRNA target sequence
ttaaaataactcagtaatcctgttctt

SEQ ID NO: 209563 - DNA, 27 bp, Artificial sequence
  SiRNA target sequence
taaaataactcagtaatcctgttcttg

SEQ ID NO: 209564 - DNA, 27 bp, Artificial sequence
  SiRNA target sequence
aaaataactcagtaatcctgttcttga

SEQ ID NO: 209565 - DNA, 27 bp, Artificial sequence
  SiRNA target sequence
aaataactcagtaatcctgttcttgaa

SEQ ID NO: 209566 - DNA, 27 bp, Artificial sequence
  SiRNA target sequence
aataactcagtaatcctgttcttgaat

SEQ ID NO: 209567 - DNA, 27 bp, Artificial sequence
  SiRNA target sequence
ataactcagtaatcctgttcttgaatt

SEQ ID NO: 209568 - DNA, 27 bp, Artificial sequence
  SiRNA target sequence
taactcagtaatcctgttcttgaattt

SEQ ID NO: 209569 - DNA, 27 bp, Artificial sequence
  SiRNA target sequence
aactcagtaatcctgttcttgaatttg

SEQ ID NO: 209570 - DNA, 27 bp, Artificial sequence
  SiRNA target sequence
actcagtaatcctgttcttgaatttgc

SEQ ID NO: 209571 - DNA, 27 bp, Artificial sequence
  SiRNA target sequence
ctcagtaatcctgttcttgaatttgct

SEQ ID NO: 209572 - DNA, 27 bp, Artificial sequence
  SiRNA target sequence
tcagtaatcctgttcttgaatttgcta

SEQ ID NO: 209573 - DNA, 27 bp, Artificial sequence
  SiRNA target sequence
cagtaatcctgttcttgaatttgctaa

SEQ ID NO: 209574 - DNA, 27 bp, Artificial sequence
  SiRNA target sequence
agtaatcctgttcttgaatttgctaat

SEQ ID NO: 209575 - DNA, 27 bp, Artificial sequence
  SiRNA target sequence
gtaatcctgttcttgaatttgctaatt

SEQ ID NO: 209576 - DNA, 27 bp, Artificial sequence
  SiRNA target sequence
taatcctgttcttgaatttgctaattg

SEQ ID NO: 209577 - DNA, 27 bp, Artificial sequence
  SiRNA target sequence
aatcctgttcttgaatttgctaattga

SEQ ID NO: 209578 - DNA, 27 bp, Artificial sequence
  SiRNA target sequence
atcctgttcttgaatttgctaattgat

SEQ ID NO: 209579 - DNA, 27 bp, Artificial sequence
  SiRNA target sequence
tcctgttcttgaatttgctaattgatc

SEQ ID NO: 209580 - DNA, 27 bp, Artificial sequence
  SiRNA target sequence
cctgttcttgaatttgctaattgatca

SEQ ID NO: 209581 - DNA, 27 bp, Artificial sequence
  SiRNA target sequence
ctgttcttgaatttgctaattgatcaa

SEQ ID NO: 209582 - DNA, 27 bp, Artificial sequence
  SiRNA target sequence
tgttcttgaatttgctaattgatcaat

SEQ ID NO: 209583 - DNA, 27 bp, Artificial sequence
  SiRNA target sequence
gttcttgaatttgctaattgatcaatc

SEQ ID NO: 209584 - DNA, 27 bp, Artificial sequence
  SiRNA target sequence
ttcttgaatttgctaattgatcaatct

SEQ ID NO: 209585 - DNA, 27 bp, Artificial sequence
  SiRNA target sequence
tcttgaatttgctaattgatcaatctc

SEQ ID NO: 209586 - DNA, 27 bp, Artificial sequence
  SiRNA target sequence
cttgaatttgctaattgatcaatctca

SEQ ID NO: 209587 - DNA, 27 bp, Artificial sequence
  SiRNA target sequence
ttgaatttgctaattgatcaatctcat

SEQ ID NO: 209588 - DNA, 27 bp, Artificial sequence
  SiRNA target sequence
tgaatttgctaattgatcaatctcatc

SEQ ID NO: 209589 - DNA, 27 bp, Artificial sequence
  SiRNA target sequence
gaatttgctaattgatcaatctcatct

SEQ ID NO: 209590 - DNA, 27 bp, Artificial sequence
  SiRNA target sequence
aatttgctaattgatcaatctcatctt

SEQ ID NO: 209591 - DNA, 27 bp, Artificial sequence
  SiRNA target sequence
atttgctaattgatcaatctcatcttc

SEQ ID NO: 209592 - DNA, 27 bp, Artificial sequence
  SiRNA target sequence
tttgctaattgatcaatctcatcttcc

SEQ ID NO: 209593 - DNA, 27 bp, Artificial sequence
  SiRNA target sequence
ttgctaattgatcaatctcatcttccg

SEQ ID NO: 209594 - DNA, 27 bp, Artificial sequence
  SiRNA target sequence
tgctaattgatcaatctcatcttccgt

SEQ ID NO: 209595 - DNA, 27 bp, Artificial sequence
  SiRNA target sequence
gctaattgatcaatctcatcttccgta

SEQ ID NO: 209596 - DNA, 27 bp, Artificial sequence
  SiRNA target sequence
ctaattgatcaatctcatcttccgtag

SEQ ID NO: 209597 - DNA, 27 bp, Artificial sequence
  SiRNA target sequence
taattgatcaatctcatcttccgtagg

SEQ ID NO: 209598 - DNA, 27 bp, Artificial sequence
  SiRNA target sequence
aattgatcaatctcatcttccgtaggt

SEQ ID NO: 209599 - DNA, 27 bp, Artificial sequence
  SiRNA target sequence
attgatcaatctcatcttccgtaggta

SEQ ID NO: 209600 - DNA, 27 bp, Artificial sequence
  SiRNA target sequence
ttgatcaatctcatcttccgtaggtaa

SEQ ID NO: 209601 - DNA, 27 bp, Artificial sequence
  SiRNA target sequence
tgatcaatctcatcttccgtaggtaag

SEQ ID NO: 209602 - DNA, 27 bp, Artificial sequence
  SiRNA target sequence
gatcaatctcatcttccgtaggtaagt

SEQ ID NO: 209603 - DNA, 27 bp, Artificial sequence
  SiRNA target sequence
atcaatctcatcttccgtaggtaagtt

SEQ ID NO: 209604 - DNA, 27 bp, Artificial sequence
  SiRNA target sequence
tcaatctcatcttccgtaggtaagttg

SEQ ID NO: 209605 - DNA, 27 bp, Artificial sequence
  SiRNA target sequence
caatctcatcttccgtaggtaagttgt

SEQ ID NO: 209606 - DNA, 27 bp, Artificial sequence
  SiRNA target sequence
aatctcatcttccgtaggtaagttgtt

SEQ ID NO: 209607 - DNA, 27 bp, Artificial sequence
  SiRNA target sequence
atctcatcttccgtaggtaagttgttt

SEQ ID NO: 209608 - DNA, 27 bp, Artificial sequence
  SiRNA target sequence
tctcatcttccgtaggtaagttgtttt

SEQ ID NO: 209609 - DNA, 27 bp, Artificial sequence
  SiRNA target sequence
ctcatcttccgtaggtaagttgttttc

SEQ ID NO: 209610 - DNA, 27 bp, Artificial sequence
  SiRNA target sequence
tcatcttccgtaggtaagttgttttca

SEQ ID NO: 209611 - DNA, 27 bp, Artificial sequence
  SiRNA target sequence
catcttccgtaggtaagttgttttcag

SEQ ID NO: 209612 - DNA, 27 bp, Artificial sequence
  SiRNA target sequence
atcttccgtaggtaagttgttttcagg

SEQ ID NO: 209613 - DNA, 27 bp, Artificial sequence
  SiRNA target sequence
tcttccgtaggtaagttgttttcaggt

SEQ ID NO: 209614 - DNA, 27 bp, Artificial sequence
  SiRNA target sequence
cttccgtaggtaagttgttttcaggtg

SEQ ID NO: 209615 - DNA, 27 bp, Artificial sequence
  SiRNA target sequence
ttccgtaggtaagttgttttcaggtgt

SEQ ID NO: 209616 - DNA, 27 bp, Artificial sequence
  SiRNA target sequence
tccgtaggtaagttgttttcaggtgtt

SEQ ID NO: 209617 - DNA, 27 bp, Artificial sequence
  SiRNA target sequence
ccgtaggtaagttgttttcaggtgttt

SEQ ID NO: 209618 - DNA, 27 bp, Artificial sequence
  SiRNA target sequence
cgtaggtaagttgttttcaggtgtttc

SEQ ID NO: 209619 - DNA, 27 bp, Artificial sequence
  SiRNA target sequence
gtaggtaagttgttttcaggtgtttca

SEQ ID NO: 209620 - DNA, 27 bp, Artificial sequence
  SiRNA target sequence
taggtaagttgttttcaggtgtttcat

SEQ ID NO: 209621 - DNA, 27 bp, Artificial sequence
  SiRNA target sequence
aggtaagttgttttcaggtgtttcatt

SEQ ID NO: 209622 - DNA, 27 bp, Artificial sequence
  SiRNA target sequence
ggtaagttgttttcaggtgtttcattt

SEQ ID NO: 209623 - DNA, 27 bp, Artificial sequence
  SiRNA target sequence
gtaagttgttttcaggtgtttcattta

SEQ ID NO: 209624 - DNA, 27 bp, Artificial sequence
  SiRNA target sequence
taagttgttttcaggtgtttcatttat

SEQ ID NO: 209625 - DNA, 27 bp, Artificial sequence
  SiRNA target sequence
aagttgttttcaggtgtttcatttatt

SEQ ID NO: 209626 - DNA, 27 bp, Artificial sequence
  SiRNA target sequence
agttgttttcaggtgtttcatttatta

SEQ ID NO: 209627 - DNA, 27 bp, Artificial sequence
  SiRNA target sequence
gttgttttcaggtgtttcatttattac

SEQ ID NO: 209628 - DNA, 27 bp, Artificial sequence
  SiRNA target sequence
ttgttttcaggtgtttcatttattaca

SEQ ID NO: 209629 - DNA, 27 bp, Artificial sequence
  SiRNA target sequence
tgttttcaggtgtttcatttattacac

SEQ ID NO: 209630 - DNA, 27 bp, Artificial sequence
  SiRNA target sequence
gttttcaggtgtttcatttattacact

SEQ ID NO: 209631 - DNA, 27 bp, Artificial sequence
  SiRNA target sequence
ttttcaggtgtttcatttattacactc

SEQ ID NO: 209632 - DNA, 27 bp, Artificial sequence
  SiRNA target sequence
tttcaggtgtttcatttattacactca

SEQ ID NO: 209633 - DNA, 27 bp, Artificial sequence
  SiRNA target sequence
ttcaggtgtttcatttattacactcat

SEQ ID NO: 209634 - DNA, 19 bp, Artificial sequence
  SiRNA target sequence
atgattgagaggggtatta

SEQ ID NO: 209635 - DNA, 19 bp, Artificial sequence
  SiRNA target sequence
tgattgagaggggtattat

SEQ ID NO: 209636 - DNA, 19 bp, Artificial sequence
  SiRNA target sequence
gattgagaggggtattatg

SEQ ID NO: 209637 - DNA, 19 bp, Artificial sequence
  SiRNA target sequence
attgagaggggtattatgg

SEQ ID NO: 209638 - DNA, 19 bp, Artificial sequence
  SiRNA target sequence
ttgagaggggtattatgga

SEQ ID NO: 209639 - DNA, 19 bp, Artificial sequence
  SiRNA target sequence
tgagaggggtattatggaa

SEQ ID NO: 209640 - DNA, 19 bp, Artificial sequence
  SiRNA target sequence
gagaggggtattatggaaa

SEQ ID NO: 209641 - DNA, 19 bp, Artificial sequence
  SiRNA target sequence
agaggggtattatggaaaa

SEQ ID NO: 209642 - DNA, 19 bp, Artificial sequence
  SiRNA target sequence
gaggggtattatggaaaaa

SEQ ID NO: 209643 - DNA, 19 bp, Artificial sequence
  SiRNA target sequence
aggggtattatggaaaaaa

SEQ ID NO: 209644 - DNA, 19 bp, Artificial sequence
  SiRNA target sequence
ggggtattatggaaaaaat

SEQ ID NO: 209645 - DNA, 19 bp, Artificial sequence
  SiRNA target sequence
gggtattatggaaaaaata

SEQ ID NO: 209646 - DNA, 19 bp, Artificial sequence
  SiRNA target sequence
ggtattatggaaaaaataa

SEQ ID NO: 209647 - DNA, 19 bp, Artificial sequence
  SiRNA target sequence
gtattatggaaaaaataaa

SEQ ID NO: 209648 - DNA, 19 bp, Artificial sequence
  SiRNA target sequence
tattatggaaaaaataaaa

SEQ ID NO: 209649 - DNA, 19 bp, Artificial sequence
  SiRNA target sequence
attatggaaaaaataaaaa

SEQ ID NO: 209650 - DNA, 19 bp, Artificial sequence
  SiRNA target sequence
ttatggaaaaaataaaaaa

SEQ ID NO: 209651 - DNA, 19 bp, Artificial sequence
  SiRNA target sequence
tatggaaaaaataaaaaat

SEQ ID NO: 209652 - DNA, 19 bp, Artificial sequence
  SiRNA target sequence
atggaaaaaataaaaaatt

SEQ ID NO: 209653 - DNA, 19 bp, Artificial sequence
  SiRNA target sequence
tggaaaaaataaaaaattt

SEQ ID NO: 209654 - DNA, 19 bp, Artificial sequence
  SiRNA target sequence
ggaaaaaataaaaaattta

SEQ ID NO: 209655 - DNA, 19 bp, Artificial sequence
  SiRNA target sequence
gaaaaaataaaaaatttat

SEQ ID NO: 209656 - DNA, 19 bp, Artificial sequence
  SiRNA target sequence
aaaaaataaaaaatttatt

SEQ ID NO: 209657 - DNA, 19 bp, Artificial sequence
  SiRNA target sequence
aaaaataaaaaatttatta

SEQ ID NO: 209658 - DNA, 19 bp, Artificial sequence
  SiRNA target sequence
aaaataaaaaatttattaa

SEQ ID NO: 209659 - DNA, 19 bp, Artificial sequence
  SiRNA target sequence
aaataaaaaatttattaac

SEQ ID NO: 209660 - DNA, 19 bp, Artificial sequence
  SiRNA target sequence
aataaaaaatttattaaca

SEQ ID NO: 209661 - DNA, 19 bp, Artificial sequence
  SiRNA target sequence
ataaaaaatttattaacag

SEQ ID NO: 209662 - DNA, 19 bp, Artificial sequence
  SiRNA target sequence
taaaaaatttattaacaga

SEQ ID NO: 209663 - DNA, 19 bp, Artificial sequence
  SiRNA target sequence
aaaaaatttattaacagag

SEQ ID NO: 209664 - DNA, 19 bp, Artificial sequence
  SiRNA target sequence
aaaaatttattaacagagg

SEQ ID NO: 209665 - DNA, 19 bp, Artificial sequence
  SiRNA target sequence
aaaatttattaacagagga

SEQ ID NO: 209666 - DNA, 19 bp, Artificial sequence
  SiRNA target sequence
aaatttattaacagaggat

SEQ ID NO: 209667 - DNA, 19 bp, Artificial sequence
  SiRNA target sequence
aatttattaacagaggatg

SEQ ID NO: 209668 - DNA, 19 bp, Artificial sequence
  SiRNA target sequence
atttattaacagaggatga

SEQ ID NO: 209669 - DNA, 19 bp, Artificial sequence
  SiRNA target sequence
tttattaacagaggatgaa

SEQ ID NO: 209670 - DNA, 19 bp, Artificial sequence
  SiRNA target sequence
ttattaacagaggatgaag

SEQ ID NO: 209671 - DNA, 19 bp, Artificial sequence
  SiRNA target sequence
tattaacagaggatgaagt

SEQ ID NO: 209672 - DNA, 19 bp, Artificial sequence
  SiRNA target sequence
attaacagaggatgaagta

SEQ ID NO: 209673 - DNA, 19 bp, Artificial sequence
  SiRNA target sequence
ttaacagaggatgaagtag

SEQ ID NO: 209674 - DNA, 19 bp, Artificial sequence
  SiRNA target sequence
taacagaggatgaagtaga

SEQ ID NO: 209675 - DNA, 19 bp, Artificial sequence
  SiRNA target sequence
aacagaggatgaagtagaa

SEQ ID NO: 209676 - DNA, 19 bp, Artificial sequence
  SiRNA target sequence
acagaggatgaagtagaag

SEQ ID NO: 209677 - DNA, 19 bp, Artificial sequence
  SiRNA target sequence
cagaggatgaagtagaagc

SEQ ID NO: 209678 - DNA, 19 bp, Artificial sequence
  SiRNA target sequence
agaggatgaagtagaagca

SEQ ID NO: 209679 - DNA, 19 bp, Artificial sequence
  SiRNA target sequence
gaggatgaagtagaagcag

SEQ ID NO: 209680 - DNA, 19 bp, Artificial sequence
  SiRNA target sequence
aggatgaagtagaagcaga

SEQ ID NO: 209681 - DNA, 19 bp, Artificial sequence
  SiRNA target sequence
ggatgaagtagaagcagaa

SEQ ID NO: 209682 - DNA, 19 bp, Artificial sequence
  SiRNA target sequence
gatgaagtagaagcagaag

SEQ ID NO: 209683 - DNA, 19 bp, Artificial sequence
  SiRNA target sequence
atgaagtagaagcagaagc

SEQ ID NO: 209684 - DNA, 19 bp, Artificial sequence
  SiRNA target sequence
tgaagtagaagcagaagca

SEQ ID NO: 209685 - DNA, 19 bp, Artificial sequence
  SiRNA target sequence
gaagtagaagcagaagcaa

SEQ ID NO: 209686 - DNA, 19 bp, Artificial sequence
  SiRNA target sequence
aagtagaagcagaagcaaa

SEQ ID NO: 209687 - DNA, 19 bp, Artificial sequence
  SiRNA target sequence
agtagaagcagaagcaaat

SEQ ID NO: 209688 - DNA, 19 bp, Artificial sequence
  SiRNA target sequence
gtagaagcagaagcaaatt

SEQ ID NO: 209689 - DNA, 19 bp, Artificial sequence
  SiRNA target sequence
tagaagcagaagcaaattc

SEQ ID NO: 209690 - DNA, 19 bp, Artificial sequence
  SiRNA target sequence
agaagcagaagcaaattct

SEQ ID NO: 209691 - DNA, 19 bp, Artificial sequence
  SiRNA target sequence
gaagcagaagcaaattctg

SEQ ID NO: 209692 - DNA, 19 bp, Artificial sequence
  SiRNA target sequence
aagcagaagcaaattctgg

SEQ ID NO: 209693 - DNA, 19 bp, Artificial sequence
  SiRNA target sequence
agcagaagcaaattctgga

SEQ ID NO: 209694 - DNA, 19 bp, Artificial sequence
  SiRNA target sequence
gcagaagcaaattctggaa

SEQ ID NO: 209695 - DNA, 19 bp, Artificial sequence
  SiRNA target sequence
cagaagcaaattctggaag

SEQ ID NO: 209696 - DNA, 19 bp, Artificial sequence
  SiRNA target sequence
agaagcaaattctggaagg

SEQ ID NO: 209697 - DNA, 19 bp, Artificial sequence
  SiRNA target sequence
gaagcaaattctggaaggg

SEQ ID NO: 209698 - DNA, 19 bp, Artificial sequence
  SiRNA target sequence
aagcaaattctggaagggg

SEQ ID NO: 209699 - DNA, 19 bp, Artificial sequence
  SiRNA target sequence
agcaaattctggaaggggc

SEQ ID NO: 209700 - DNA, 19 bp, Artificial sequence
  SiRNA target sequence
gcaaattctggaaggggca

SEQ ID NO: 209701 - DNA, 19 bp, Artificial sequence
  SiRNA target sequence
caaattctggaaggggcat

SEQ ID NO: 209702 - DNA, 19 bp, Artificial sequence
  SiRNA target sequence
aaattctggaaggggcatt

SEQ ID NO: 209703 - DNA, 19 bp, Artificial sequence
  SiRNA target sequence
aattctggaaggggcattt

SEQ ID NO: 209704 - DNA, 19 bp, Artificial sequence
  SiRNA target sequence
attctggaaggggcatttt

SEQ ID NO: 209705 - DNA, 19 bp, Artificial sequence
  SiRNA target sequence
ttctggaaggggcatttta

SEQ ID NO: 209706 - DNA, 19 bp, Artificial sequence
  SiRNA target sequence
tctggaaggggcattttat

SEQ ID NO: 209707 - DNA, 19 bp, Artificial sequence
  SiRNA target sequence
ctggaaggggcattttatc

SEQ ID NO: 209708 - DNA, 19 bp, Artificial sequence
  SiRNA target sequence
tggaaggggcattttatca

SEQ ID NO: 209709 - DNA, 19 bp, Artificial sequence
  SiRNA target sequence
ggaaggggcattttatcaa

SEQ ID NO: 209710 - DNA, 19 bp, Artificial sequence
  SiRNA target sequence
gaaggggcattttatcaat

SEQ ID NO: 209711 - DNA, 19 bp, Artificial sequence
  SiRNA target sequence
aaggggcattttatcaata

SEQ ID NO: 209712 - DNA, 19 bp, Artificial sequence
  SiRNA target sequence
aggggcattttatcaatat

SEQ ID NO: 209713 - DNA, 19 bp, Artificial sequence
  SiRNA target sequence
ggggcattttatcaatatt

SEQ ID NO: 209714 - DNA, 19 bp, Artificial sequence
  SiRNA target sequence
gggcattttatcaatattt

SEQ ID NO: 209715 - DNA, 19 bp, Artificial sequence
  SiRNA target sequence
ggcattttatcaatattta

SEQ ID NO: 209716 - DNA, 19 bp, Artificial sequence
  SiRNA target sequence
gcattttatcaatatttag

SEQ ID NO: 209717 - DNA, 19 bp, Artificial sequence
  SiRNA target sequence
cattttatcaatatttaga

SEQ ID NO: 209718 - DNA, 19 bp, Artificial sequence
  SiRNA target sequence
attttatcaatatttagaa

SEQ ID NO: 209719 - DNA, 19 bp, Artificial sequence
  SiRNA target sequence
ttttatcaatatttagaat

SEQ ID NO: 209720 - DNA, 19 bp, Artificial sequence
  SiRNA target sequence
tttatcaatatttagaatt

SEQ ID NO: 209721 - DNA, 19 bp, Artificial sequence
  SiRNA target sequence
ttatcaatatttagaattg

SEQ ID NO: 209722 - DNA, 19 bp, Artificial sequence
  SiRNA target sequence
tatcaatatttagaattgc

SEQ ID NO: 209723 - DNA, 19 bp, Artificial sequence
  SiRNA target sequence
atcaatatttagaattgct

SEQ ID NO: 209724 - DNA, 19 bp, Artificial sequence
  SiRNA target sequence
tcaatatttagaattgcta

SEQ ID NO: 209725 - DNA, 19 bp, Artificial sequence
  SiRNA target sequence
caatatttagaattgctaa

SEQ ID NO: 209726 - DNA, 19 bp, Artificial sequence
  SiRNA target sequence
aatatttagaattgctaag

SEQ ID NO: 209727 - DNA, 19 bp, Artificial sequence
  SiRNA target sequence
atatttagaattgctaagg

SEQ ID NO: 209728 - DNA, 19 bp, Artificial sequence
  SiRNA target sequence
tatttagaattgctaaggt

SEQ ID NO: 209729 - DNA, 19 bp, Artificial sequence
  SiRNA target sequence
atttagaattgctaaggta

SEQ ID NO: 209730 - DNA, 19 bp, Artificial sequence
  SiRNA target sequence
tttagaattgctaaggtag

SEQ ID NO: 209731 - DNA, 19 bp, Artificial sequence
  SiRNA target sequence
ttagaattgctaaggtaga

SEQ ID NO: 209732 - DNA, 19 bp, Artificial sequence
  SiRNA target sequence
tagaattgctaaggtagaa

SEQ ID NO: 209733 - DNA, 19 bp, Artificial sequence
  SiRNA target sequence
agaattgctaaggtagaaa

SEQ ID NO: 209734 - DNA, 19 bp, Artificial sequence
  SiRNA target sequence
gaattgctaaggtagaaag

SEQ ID NO: 209735 - DNA, 19 bp, Artificial sequence
  SiRNA target sequence
aattgctaaggtagaaaga

SEQ ID NO: 209736 - DNA, 19 bp, Artificial sequence
  SiRNA target sequence
attgctaaggtagaaagaa

SEQ ID NO: 209737 - DNA, 19 bp, Artificial sequence
  SiRNA target sequence
ttgctaaggtagaaagaag

SEQ ID NO: 209738 - DNA, 19 bp, Artificial sequence
  SiRNA target sequence
tgctaaggtagaaagaaga

SEQ ID NO: 209739 - DNA, 19 bp, Artificial sequence
  SiRNA target sequence
gctaaggtagaaagaagaa

SEQ ID NO: 209740 - DNA, 19 bp, Artificial sequence
  SiRNA target sequence
ctaaggtagaaagaagaat

SEQ ID NO: 209741 - DNA, 19 bp, Artificial sequence
  SiRNA target sequence
taaggtagaaagaagaatg

SEQ ID NO: 209742 - DNA, 19 bp, Artificial sequence
  SiRNA target sequence
aaggtagaaagaagaatgt

SEQ ID NO: 209743 - DNA, 19 bp, Artificial sequence
  SiRNA target sequence
aggtagaaagaagaatgtt

SEQ ID NO: 209744 - DNA, 19 bp, Artificial sequence
  SiRNA target sequence
ggtagaaagaagaatgttt

SEQ ID NO: 209745 - DNA, 19 bp, Artificial sequence
  SiRNA target sequence
gtagaaagaagaatgtttt

SEQ ID NO: 209746 - DNA, 19 bp, Artificial sequence
  SiRNA target sequence
tagaaagaagaatgttttg

SEQ ID NO: 209747 - DNA, 19 bp, Artificial sequence
  SiRNA target sequence
agaaagaagaatgttttgg

SEQ ID NO: 209748 - DNA, 19 bp, Artificial sequence
  SiRNA target sequence
gaaagaagaatgttttggc

SEQ ID NO: 209749 - DNA, 19 bp, Artificial sequence
  SiRNA target sequence
aaagaagaatgttttggct

SEQ ID NO: 209750 - DNA, 19 bp, Artificial sequence
  SiRNA target sequence
aagaagaatgttttggctt

SEQ ID NO: 209751 - DNA, 19 bp, Artificial sequence
  SiRNA target sequence
agaagaatgttttggctta

SEQ ID NO: 209752 - DNA, 19 bp, Artificial sequence
  SiRNA target sequence
gaagaatgttttggcttat

SEQ ID NO: 209753 - DNA, 19 bp, Artificial sequence
  SiRNA target sequence
aagaatgttttggcttatg

SEQ ID NO: 209754 - DNA, 19 bp, Artificial sequence
  SiRNA target sequence
agaatgttttggcttatga

SEQ ID NO: 209755 - DNA, 19 bp, Artificial sequence
  SiRNA target sequence
gaatgttttggcttatgac

SEQ ID NO: 209756 - DNA, 19 bp, Artificial sequence
  SiRNA target sequence
aatgttttggcttatgacg

SEQ ID NO: 209757 - DNA, 19 bp, Artificial sequence
  SiRNA target sequence
atgttttggcttatgacgc

SEQ ID NO: 209758 - DNA, 19 bp, Artificial sequence
  SiRNA target sequence
tgttttggcttatgacgct

SEQ ID NO: 209759 - DNA, 19 bp, Artificial sequence
  SiRNA target sequence
gttttggcttatgacgctt

SEQ ID NO: 209760 - DNA, 19 bp, Artificial sequence
  SiRNA target sequence
ttttggcttatgacgctta

SEQ ID NO: 209761 - DNA, 19 bp, Artificial sequence
  SiRNA target sequence
tttggcttatgacgcttat

SEQ ID NO: 209762 - DNA, 19 bp, Artificial sequence
  SiRNA target sequence
ttggcttatgacgcttatg

SEQ ID NO: 209763 - DNA, 19 bp, Artificial sequence
  SiRNA target sequence
tggcttatgacgcttatgt

SEQ ID NO: 209764 - DNA, 19 bp, Artificial sequence
  SiRNA target sequence
ggcttatgacgcttatgtt

SEQ ID NO: 209765 - DNA, 19 bp, Artificial sequence
  SiRNA target sequence
gcttatgacgcttatgttt

SEQ ID NO: 209766 - DNA, 19 bp, Artificial sequence
  SiRNA target sequence
cttatgacgcttatgtttt

SEQ ID NO: 209767 - DNA, 19 bp, Artificial sequence
  SiRNA target sequence
ttatgacgcttatgttttc

SEQ ID NO: 209768 - DNA, 19 bp, Artificial sequence
  SiRNA target sequence
tatgacgcttatgttttcg

SEQ ID NO: 209769 - DNA, 19 bp, Artificial sequence
  SiRNA target sequence
atgacgcttatgttttcgc

SEQ ID NO: 209770 - DNA, 19 bp, Artificial sequence
  SiRNA target sequence
tgacgcttatgttttcgct

SEQ ID NO: 209771 - DNA, 19 bp, Artificial sequence
  SiRNA target sequence
gacgcttatgttttcgctt

SEQ ID NO: 209772 - DNA, 19 bp, Artificial sequence
  SiRNA target sequence
acgcttatgttttcgctta

SEQ ID NO: 209773 - DNA, 19 bp, Artificial sequence
  SiRNA target sequence
cgcttatgttttcgcttat

SEQ ID NO: 209774 - DNA, 19 bp, Artificial sequence
  SiRNA target sequence
gcttatgttttcgcttatt

SEQ ID NO: 209775 - DNA, 19 bp, Artificial sequence
  SiRNA target sequence
cttatgttttcgcttattt

SEQ ID NO: 209776 - DNA, 19 bp, Artificial sequence
  SiRNA target sequence
ttatgttttcgcttatttc

SEQ ID NO: 209777 - DNA, 19 bp, Artificial sequence
  SiRNA target sequence
tatgttttcgcttatttcc

SEQ ID NO: 209778 - DNA, 19 bp, Artificial sequence
  SiRNA target sequence
atgttttcgcttatttcct

SEQ ID NO: 209779 - DNA, 19 bp, Artificial sequence
  SiRNA target sequence
tgttttcgcttatttcctt

SEQ ID NO: 209780 - DNA, 19 bp, Artificial sequence
  SiRNA target sequence
gttttcgcttatttccttt

SEQ ID NO: 209781 - DNA, 19 bp, Artificial sequence
  SiRNA target sequence
ttttcgcttatttccttta

SEQ ID NO: 209782 - DNA, 19 bp, Artificial sequence
  SiRNA target sequence
tttcgcttatttcctttat

SEQ ID NO: 209783 - DNA, 19 bp, Artificial sequence
  SiRNA target sequence
ttcgcttatttcctttatt

SEQ ID NO: 209784 - DNA, 19 bp, Artificial sequence
  SiRNA target sequence
tcgcttatttcctttattt

SEQ ID NO: 209785 - DNA, 19 bp, Artificial sequence
  SiRNA target sequence
cgcttatttcctttattta

SEQ ID NO: 209786 - DNA, 19 bp, Artificial sequence
  SiRNA target sequence
gcttatttcctttatttac

SEQ ID NO: 209787 - DNA, 19 bp, Artificial sequence
  SiRNA target sequence
cttatttcctttatttact

SEQ ID NO: 209788 - DNA, 19 bp, Artificial sequence
  SiRNA target sequence
ttatttcctttatttactc

SEQ ID NO: 209789 - DNA, 19 bp, Artificial sequence
  SiRNA target sequence
tatttcctttatttactca

SEQ ID NO: 209790 - DNA, 19 bp, Artificial sequence
  SiRNA target sequence
atttcctttatttactcag

SEQ ID NO: 209791 - DNA, 19 bp, Artificial sequence
  SiRNA target sequence
tttcctttatttactcagt

SEQ ID NO: 209792 - DNA, 19 bp, Artificial sequence
  SiRNA target sequence
ttcctttatttactcagta

SEQ ID NO: 209793 - DNA, 19 bp, Artificial sequence
  SiRNA target sequence
tcctttatttactcagtag

SEQ ID NO: 209794 - DNA, 19 bp, Artificial sequence
  SiRNA target sequence
cctttatttactcagtagg

SEQ ID NO: 209795 - DNA, 19 bp, Artificial sequence
  SiRNA target sequence
ctttatttactcagtagga

SEQ ID NO: 209796 - DNA, 19 bp, Artificial sequence
  SiRNA target sequence
tttatttactcagtaggac

SEQ ID NO: 209797 - DNA, 19 bp, Artificial sequence
  SiRNA target sequence
ttatttactcagtaggacg

SEQ ID NO: 209798 - DNA, 19 bp, Artificial sequence
  SiRNA target sequence
tatttactcagtaggacga

SEQ ID NO: 209799 - DNA, 19 bp, Artificial sequence
  SiRNA target sequence
atttactcagtaggacgag

SEQ ID NO: 209800 - DNA, 19 bp, Artificial sequence
  SiRNA target sequence
tttactcagtaggacgagt

SEQ ID NO: 209801 - DNA, 19 bp, Artificial sequence
  SiRNA target sequence
ttactcagtaggacgagtg

SEQ ID NO: 209802 - DNA, 19 bp, Artificial sequence
  SiRNA target sequence
tactcagtaggacgagtgt

SEQ ID NO: 209803 - DNA, 19 bp, Artificial sequence
  SiRNA target sequence
actcagtaggacgagtgtt

SEQ ID NO: 209804 - DNA, 19 bp, Artificial sequence
  SiRNA target sequence
ctcagtaggacgagtgtta

SEQ ID NO: 209805 - DNA, 19 bp, Artificial sequence
  SiRNA target sequence
tcagtaggacgagtgttaa

SEQ ID NO: 209806 - DNA, 19 bp, Artificial sequence
  SiRNA target sequence
cagtaggacgagtgttaaa

SEQ ID NO: 209807 - DNA, 19 bp, Artificial sequence
  SiRNA target sequence
agtaggacgagtgttaaaa

SEQ ID NO: 209808 - DNA, 19 bp, Artificial sequence
  SiRNA target sequence
gtaggacgagtgttaaaag

SEQ ID NO: 209809 - DNA, 19 bp, Artificial sequence
  SiRNA target sequence
taggacgagtgttaaaaga

SEQ ID NO: 209810 - DNA, 19 bp, Artificial sequence
  SiRNA target sequence
aggacgagtgttaaaagat

SEQ ID NO: 209811 - DNA, 19 bp, Artificial sequence
  SiRNA target sequence
ggacgagtgttaaaagatg

SEQ ID NO: 209812 - DNA, 19 bp, Artificial sequence
  SiRNA target sequence
gacgagtgttaaaagatgc

SEQ ID NO: 209813 - DNA, 19 bp, Artificial sequence
  SiRNA target sequence
acgagtgttaaaagatgca

SEQ ID NO: 209814 - DNA, 19 bp, Artificial sequence
  SiRNA target sequence
cgagtgttaaaagatgcag

SEQ ID NO: 209815 - DNA, 19 bp, Artificial sequence
  SiRNA target sequence
gagtgttaaaagatgcagc

SEQ ID NO: 209816 - DNA, 19 bp, Artificial sequence
  SiRNA target sequence
agtgttaaaagatgcagca

SEQ ID NO: 209817 - DNA, 19 bp, Artificial sequence
  SiRNA target sequence
gtgttaaaagatgcagcag

SEQ ID NO: 209818 - DNA, 19 bp, Artificial sequence
  SiRNA target sequence
tgttaaaagatgcagcagt

SEQ ID NO: 209819 - DNA, 19 bp, Artificial sequence
  SiRNA target sequence
gttaaaagatgcagcagtt

SEQ ID NO: 209820 - DNA, 19 bp, Artificial sequence
  SiRNA target sequence
ttaaaagatgcagcagttc

SEQ ID NO: 209821 - DNA, 19 bp, Artificial sequence
  SiRNA target sequence
taaaagatgcagcagttct

SEQ ID NO: 209822 - DNA, 19 bp, Artificial sequence
  SiRNA target sequence
aaaagatgcagcagttctt

SEQ ID NO: 209823 - DNA, 19 bp, Artificial sequence
  SiRNA target sequence
aaagatgcagcagttctta

SEQ ID NO: 209824 - DNA, 19 bp, Artificial sequence
  SiRNA target sequence
aagatgcagcagttcttag

SEQ ID NO: 209825 - DNA, 19 bp, Artificial sequence
  SiRNA target sequence
agatgcagcagttcttagt

SEQ ID NO: 209826 - DNA, 19 bp, Artificial sequence
  SiRNA target sequence
gatgcagcagttcttagta

SEQ ID NO: 209827 - DNA, 19 bp, Artificial sequence
  SiRNA target sequence
atgcagcagttcttagtag

SEQ ID NO: 209828 - DNA, 19 bp, Artificial sequence
  SiRNA target sequence
tgcagcagttcttagtaga

SEQ ID NO: 209829 - DNA, 19 bp, Artificial sequence
  SiRNA target sequence
gcagcagttcttagtagac

SEQ ID NO: 209830 - DNA, 19 bp, Artificial sequence
  SiRNA target sequence
cagcagttcttagtagaca

SEQ ID NO: 209831 - DNA, 19 bp, Artificial sequence
  SiRNA target sequence
agcagttcttagtagacag

SEQ ID NO: 209832 - DNA, 19 bp, Artificial sequence
  SiRNA target sequence
gcagttcttagtagacaga

SEQ ID NO: 209833 - DNA, 19 bp, Artificial sequence
  SiRNA target sequence
cagttcttagtagacagat

SEQ ID NO: 209834 - DNA, 19 bp, Artificial sequence
  SiRNA target sequence
agttcttagtagacagatg

SEQ ID NO: 209835 - DNA, 19 bp, Artificial sequence
  SiRNA target sequence
gttcttagtagacagatgc

SEQ ID NO: 209836 - DNA, 19 bp, Artificial sequence
  SiRNA target sequence
ttcttagtagacagatgcc

SEQ ID NO: 209837 - DNA, 19 bp, Artificial sequence
  SiRNA target sequence
tcttagtagacagatgcca

SEQ ID NO: 209838 - DNA, 19 bp, Artificial sequence
  SiRNA target sequence
cttagtagacagatgccac

SEQ ID NO: 209839 - DNA, 19 bp, Artificial sequence
  SiRNA target sequence
ttagtagacagatgccact

SEQ ID NO: 209840 - DNA, 19 bp, Artificial sequence
  SiRNA target sequence
tagtagacagatgccacta

SEQ ID NO: 209841 - DNA, 19 bp, Artificial sequence
  SiRNA target sequence
agtagacagatgccactat

SEQ ID NO: 209842 - DNA, 19 bp, Artificial sequence
  SiRNA target sequence
gtagacagatgccactatc

SEQ ID NO: 209843 - DNA, 19 bp, Artificial sequence
  SiRNA target sequence
tagacagatgccactatcc

SEQ ID NO: 209844 - DNA, 19 bp, Artificial sequence
  SiRNA target sequence
agacagatgccactatcca

SEQ ID NO: 209845 - DNA, 19 bp, Artificial sequence
  SiRNA target sequence
gacagatgccactatccat

SEQ ID NO: 209846 - DNA, 19 bp, Artificial sequence
  SiRNA target sequence
acagatgccactatccatt

SEQ ID NO: 209847 - DNA, 19 bp, Artificial sequence
  SiRNA target sequence
cagatgccactatccatta

SEQ ID NO: 209848 - DNA, 19 bp, Artificial sequence
  SiRNA target sequence
agatgccactatccattaa

SEQ ID NO: 209849 - DNA, 19 bp, Artificial sequence
  SiRNA target sequence
gatgccactatccattaat

SEQ ID NO: 209850 - DNA, 19 bp, Artificial sequence
  SiRNA target sequence
atgccactatccattaatt

SEQ ID NO: 209851 - DNA, 19 bp, Artificial sequence
  SiRNA target sequence
tgccactatccattaattg

SEQ ID NO: 209852 - DNA, 19 bp, Artificial sequence
  SiRNA target sequence
gccactatccattaattgt

SEQ ID NO: 209853 - DNA, 19 bp, Artificial sequence
  SiRNA target sequence
ccactatccattaattgtc

SEQ ID NO: 209854 - DNA, 19 bp, Artificial sequence
  SiRNA target sequence
cactatccattaattgtct

SEQ ID NO: 209855 - DNA, 19 bp, Artificial sequence
  SiRNA target sequence
actatccattaattgtctt

SEQ ID NO: 209856 - DNA, 19 bp, Artificial sequence
  SiRNA target sequence
ctatccattaattgtctta

SEQ ID NO: 209857 - DNA, 19 bp, Artificial sequence
  SiRNA target sequence
tatccattaattgtcttaa

SEQ ID NO: 209858 - DNA, 19 bp, Artificial sequence
  SiRNA target sequence
atccattaattgtcttaaa

SEQ ID NO: 209859 - DNA, 19 bp, Artificial sequence
  SiRNA target sequence
tccattaattgtcttaaaa

SEQ ID NO: 209860 - DNA, 19 bp, Artificial sequence
  SiRNA target sequence
ccattaattgtcttaaaag

SEQ ID NO: 209861 - DNA, 19 bp, Artificial sequence
  SiRNA target sequence
cattaattgtcttaaaagc

SEQ ID NO: 209862 - DNA, 19 bp, Artificial sequence
  SiRNA target sequence
attaattgtcttaaaagct

SEQ ID NO: 209863 - DNA, 19 bp, Artificial sequence
  SiRNA target sequence
ttaattgtcttaaaagctt

SEQ ID NO: 209864 - DNA, 19 bp, Artificial sequence
  SiRNA target sequence
taattgtcttaaaagcttt

SEQ ID NO: 209865 - DNA, 19 bp, Artificial sequence
  SiRNA target sequence
aattgtcttaaaagctttg

SEQ ID NO: 209866 - DNA, 19 bp, Artificial sequence
  SiRNA target sequence
attgtcttaaaagctttgt

SEQ ID NO: 209867 - DNA, 19 bp, Artificial sequence
  SiRNA target sequence
ttgtcttaaaagctttgta

SEQ ID NO: 209868 - DNA, 19 bp, Artificial sequence
  SiRNA target sequence
tgtcttaaaagctttgtaa

SEQ ID NO: 209869 - DNA, 19 bp, Artificial sequence
  SiRNA target sequence
gtcttaaaagctttgtaat

SEQ ID NO: 209870 - DNA, 19 bp, Artificial sequence
  SiRNA target sequence
tcttaaaagctttgtaatt

SEQ ID NO: 209871 - DNA, 19 bp, Artificial sequence
  SiRNA target sequence
cttaaaagctttgtaattt

SEQ ID NO: 209872 - DNA, 19 bp, Artificial sequence
  SiRNA target sequence
ttaaaagctttgtaatttt

SEQ ID NO: 209873 - DNA, 19 bp, Artificial sequence
  SiRNA target sequence
taaaagctttgtaatttta

SEQ ID NO: 209874 - DNA, 19 bp, Artificial sequence
  SiRNA target sequence
aaaagctttgtaattttac

SEQ ID NO: 209875 - DNA, 19 bp, Artificial sequence
  SiRNA target sequence
aaagctttgtaattttacc

SEQ ID NO: 209876 - DNA, 19 bp, Artificial sequence
  SiRNA target sequence
aagctttgtaattttacca

SEQ ID NO: 209877 - DNA, 19 bp, Artificial sequence
  SiRNA target sequence
agctttgtaattttaccag

SEQ ID NO: 209878 - DNA, 19 bp, Artificial sequence
  SiRNA target sequence
gctttgtaattttaccagt

SEQ ID NO: 209879 - DNA, 19 bp, Artificial sequence
  SiRNA target sequence
ctttgtaattttaccagtt

SEQ ID NO: 209880 - DNA, 19 bp, Artificial sequence
  SiRNA target sequence
tttgtaattttaccagtta

SEQ ID NO: 209881 - DNA, 19 bp, Artificial sequence
  SiRNA target sequence
ttgtaattttaccagttac

SEQ ID NO: 209882 - DNA, 19 bp, Artificial sequence
  SiRNA target sequence
tgtaattttaccagttact

SEQ ID NO: 209883 - DNA, 19 bp, Artificial sequence
  SiRNA target sequence
gtaattttaccagttactc

SEQ ID NO: 209884 - DNA, 19 bp, Artificial sequence
  SiRNA target sequence
taattttaccagttactct

SEQ ID NO: 209885 - DNA, 19 bp, Artificial sequence
  SiRNA target sequence
aattttaccagttactctt

SEQ ID NO: 209886 - DNA, 19 bp, Artificial sequence
  SiRNA target sequence
attttaccagttactcttg

SEQ ID NO: 209887 - DNA, 19 bp, Artificial sequence
  SiRNA target sequence
ttttaccagttactcttgt

SEQ ID NO: 209888 - DNA, 19 bp, Artificial sequence
  SiRNA target sequence
tttaccagttactcttgtt

SEQ ID NO: 209889 - DNA, 19 bp, Artificial sequence
  SiRNA target sequence
ttaccagttactcttgttt

SEQ ID NO: 209890 - DNA, 19 bp, Artificial sequence
  SiRNA target sequence
taccagttactcttgtttg

SEQ ID NO: 209891 - DNA, 19 bp, Artificial sequence
  SiRNA target sequence
accagttactcttgtttgt

SEQ ID NO: 209892 - DNA, 19 bp, Artificial sequence
  SiRNA target sequence
ccagttactcttgtttgtg

SEQ ID NO: 209893 - DNA, 19 bp, Artificial sequence
  SiRNA target sequence
cagttactcttgtttgtgt

SEQ ID NO: 209894 - DNA, 19 bp, Artificial sequence
  SiRNA target sequence
agttactcttgtttgtgta

SEQ ID NO: 209895 - DNA, 19 bp, Artificial sequence
  SiRNA target sequence
gttactcttgtttgtgtag

SEQ ID NO: 209896 - DNA, 19 bp, Artificial sequence
  SiRNA target sequence
ttactcttgtttgtgtagg

SEQ ID NO: 209897 - DNA, 19 bp, Artificial sequence
  SiRNA target sequence
tactcttgtttgtgtagga

SEQ ID NO: 209898 - DNA, 19 bp, Artificial sequence
  SiRNA target sequence
actcttgtttgtgtaggat

SEQ ID NO: 209899 - DNA, 19 bp, Artificial sequence
  SiRNA target sequence
ctcttgtttgtgtaggatt

SEQ ID NO: 209900 - DNA, 19 bp, Artificial sequence
  SiRNA target sequence
tcttgtttgtgtaggatta

SEQ ID NO: 209901 - DNA, 19 bp, Artificial sequence
  SiRNA target sequence
cttgtttgtgtaggattaa

SEQ ID NO: 209902 - DNA, 19 bp, Artificial sequence
  SiRNA target sequence
ttgtttgtgtaggattaat

SEQ ID NO: 209903 - DNA, 19 bp, Artificial sequence
  SiRNA target sequence
tgtttgtgtaggattaatt

SEQ ID NO: 209904 - DNA, 19 bp, Artificial sequence
  SiRNA target sequence
gtttgtgtaggattaattc

SEQ ID NO: 209905 - DNA, 19 bp, Artificial sequence
  SiRNA target sequence
tttgtgtaggattaattca

SEQ ID NO: 209906 - DNA, 19 bp, Artificial sequence
  SiRNA target sequence
ttgtgtaggattaattcag

SEQ ID NO: 209907 - DNA, 19 bp, Artificial sequence
  SiRNA target sequence
tgtgtaggattaattcaga

SEQ ID NO: 209908 - DNA, 19 bp, Artificial sequence
  SiRNA target sequence
gtgtaggattaattcagaa

SEQ ID NO: 209909 - DNA, 19 bp, Artificial sequence
  SiRNA target sequence
tgtaggattaattcagaag

SEQ ID NO: 209910 - DNA, 19 bp, Artificial sequence
  SiRNA target sequence
gtaggattaattcagaagt

SEQ ID NO: 209911 - DNA, 19 bp, Artificial sequence
  SiRNA target sequence
taggattaattcagaagtc

SEQ ID NO: 209912 - DNA, 19 bp, Artificial sequence
  SiRNA target sequence
aggattaattcagaagtct

SEQ ID NO: 209913 - DNA, 19 bp, Artificial sequence
  SiRNA target sequence
ggattaattcagaagtcta

SEQ ID NO: 209914 - DNA, 19 bp, Artificial sequence
  SiRNA target sequence
gattaattcagaagtctac

SEQ ID NO: 209915 - DNA, 19 bp, Artificial sequence
  SiRNA target sequence
attaattcagaagtctaca

SEQ ID NO: 209916 - DNA, 19 bp, Artificial sequence
  SiRNA target sequence
ttaattcagaagtctacac

SEQ ID NO: 209917 - DNA, 19 bp, Artificial sequence
  SiRNA target sequence
taattcagaagtctacact

SEQ ID NO: 209918 - DNA, 19 bp, Artificial sequence
  SiRNA target sequence
aattcagaagtctacactc

SEQ ID NO: 209919 - DNA, 19 bp, Artificial sequence
  SiRNA target sequence
attcagaagtctacactct

SEQ ID NO: 209920 - DNA, 19 bp, Artificial sequence
  SiRNA target sequence
ttcagaagtctacactctc

SEQ ID NO: 209921 - DNA, 19 bp, Artificial sequence
  SiRNA target sequence
tcagaagtctacactctct

SEQ ID NO: 209922 - DNA, 19 bp, Artificial sequence
  SiRNA target sequence
cagaagtctacactctctt

SEQ ID NO: 209923 - DNA, 19 bp, Artificial sequence
  SiRNA target sequence
agaagtctacactctctta

SEQ ID NO: 209924 - DNA, 19 bp, Artificial sequence
  SiRNA target sequence
gaagtctacactctcttat

SEQ ID NO: 209925 - DNA, 19 bp, Artificial sequence
  SiRNA target sequence
aagtctacactctcttatt

SEQ ID NO: 209926 - DNA, 19 bp, Artificial sequence
  SiRNA target sequence
agtctacactctcttattc

SEQ ID NO: 209927 - DNA, 19 bp, Artificial sequence
  SiRNA target sequence
gtctacactctcttattct

SEQ ID NO: 209928 - DNA, 19 bp, Artificial sequence
  SiRNA target sequence
tctacactctcttattctt

SEQ ID NO: 209929 - DNA, 19 bp, Artificial sequence
  SiRNA target sequence
ctacactctcttattcttt

SEQ ID NO: 209930 - DNA, 19 bp, Artificial sequence
  SiRNA target sequence
tacactctcttattctttt

SEQ ID NO: 209931 - DNA, 19 bp, Artificial sequence
  SiRNA target sequence
acactctcttattctttta

SEQ ID NO: 209932 - DNA, 19 bp, Artificial sequence
  SiRNA target sequence
cactctcttattcttttac

SEQ ID NO: 209933 - DNA, 19 bp, Artificial sequence
  SiRNA target sequence
actctcttattcttttaca

SEQ ID NO: 209934 - DNA, 19 bp, Artificial sequence
  SiRNA target sequence
ctctcttattcttttacaa

SEQ ID NO: 209935 - DNA, 19 bp, Artificial sequence
  SiRNA target sequence
tctcttattcttttacaaa

SEQ ID NO: 209936 - DNA, 19 bp, Artificial sequence
  SiRNA target sequence
ctcttattcttttacaaaa

SEQ ID NO: 209937 - DNA, 19 bp, Artificial sequence
  SiRNA target sequence
tcttattcttttacaaaaa

SEQ ID NO: 209938 - DNA, 19 bp, Artificial sequence
  SiRNA target sequence
cttattcttttacaaaaat

SEQ ID NO: 209939 - DNA, 19 bp, Artificial sequence
  SiRNA target sequence
ttattcttttacaaaaata

SEQ ID NO: 209940 - DNA, 19 bp, Artificial sequence
  SiRNA target sequence
tattcttttacaaaaatat

SEQ ID NO: 209941 - DNA, 19 bp, Artificial sequence
  SiRNA target sequence
attcttttacaaaaatatt

SEQ ID NO: 209942 - DNA, 19 bp, Artificial sequence
  SiRNA target sequence
ttcttttacaaaaatattt

SEQ ID NO: 209943 - DNA, 19 bp, Artificial sequence
  SiRNA target sequence
tcttttacaaaaatatttg

SEQ ID NO: 209944 - DNA, 19 bp, Artificial sequence
  SiRNA target sequence
cttttacaaaaatatttga

SEQ ID NO: 209945 - DNA, 19 bp, Artificial sequence
  SiRNA target sequence
ttttacaaaaatatttgat

SEQ ID NO: 209946 - DNA, 19 bp, Artificial sequence
  SiRNA target sequence
tttacaaaaatatttgatg

SEQ ID NO: 209947 - DNA, 19 bp, Artificial sequence
  SiRNA target sequence
ttacaaaaatatttgatgg

SEQ ID NO: 209948 - DNA, 19 bp, Artificial sequence
  SiRNA target sequence
tacaaaaatatttgatggt

SEQ ID NO: 209949 - DNA, 19 bp, Artificial sequence
  SiRNA target sequence
acaaaaatatttgatggtg

SEQ ID NO: 209950 - DNA, 19 bp, Artificial sequence
  SiRNA target sequence
caaaaatatttgatggtgc

SEQ ID NO: 209951 - DNA, 19 bp, Artificial sequence
  SiRNA target sequence
aaaaatatttgatggtgca

SEQ ID NO: 209952 - DNA, 19 bp, Artificial sequence
  SiRNA target sequence
aaaatatttgatggtgcat

SEQ ID NO: 209953 - DNA, 19 bp, Artificial sequence
  SiRNA target sequence
aaatatttgatggtgcatt

SEQ ID NO: 209954 - DNA, 19 bp, Artificial sequence
  SiRNA target sequence
aatatttgatggtgcattg

SEQ ID NO: 209955 - DNA, 19 bp, Artificial sequence
  SiRNA target sequence
atatttgatggtgcattgt

SEQ ID NO: 209956 - DNA, 19 bp, Artificial sequence
  SiRNA target sequence
tatttgatggtgcattgtt

SEQ ID NO: 209957 - DNA, 19 bp, Artificial sequence
  SiRNA target sequence
atttgatggtgcattgtta

SEQ ID NO: 209958 - DNA, 19 bp, Artificial sequence
  SiRNA target sequence
tttgatggtgcattgttaa

SEQ ID NO: 209959 - DNA, 19 bp, Artificial sequence
  SiRNA target sequence
ttgatggtgcattgttaat

SEQ ID NO: 209960 - DNA, 19 bp, Artificial sequence
  SiRNA target sequence
tgatggtgcattgttaata

SEQ ID NO: 209961 - DNA, 19 bp, Artificial sequence
  SiRNA target sequence
gatggtgcattgttaatat

SEQ ID NO: 209962 - DNA, 19 bp, Artificial sequence
  SiRNA target sequence
atggtgcattgttaatatt

SEQ ID NO: 209963 - DNA, 19 bp, Artificial sequence
  SiRNA target sequence
tggtgcattgttaatattt

SEQ ID NO: 209964 - DNA, 19 bp, Artificial sequence
  SiRNA target sequence
ggtgcattgttaatatttg

SEQ ID NO: 209965 - DNA, 19 bp, Artificial sequence
  SiRNA target sequence
gtgcattgttaatatttgc

SEQ ID NO: 209966 - DNA, 19 bp, Artificial sequence
  SiRNA target sequence
tgcattgttaatatttgct

SEQ ID NO: 209967 - DNA, 19 bp, Artificial sequence
  SiRNA target sequence
gcattgttaatatttgctt

SEQ ID NO: 209968 - DNA, 19 bp, Artificial sequence
  SiRNA target sequence
cattgttaatatttgcttt

SEQ ID NO: 209969 - DNA, 19 bp, Artificial sequence
  SiRNA target sequence
attgttaatatttgctttt

SEQ ID NO: 209970 - DNA, 19 bp, Artificial sequence
  SiRNA target sequence
ttgttaatatttgcttttc

SEQ ID NO: 209971 - DNA, 19 bp, Artificial sequence
  SiRNA target sequence
tgttaatatttgcttttct

SEQ ID NO: 209972 - DNA, 19 bp, Artificial sequence
  SiRNA target sequence
gttaatatttgcttttctt

SEQ ID NO: 209973 - DNA, 19 bp, Artificial sequence
  SiRNA target sequence
ttaatatttgcttttcttt

SEQ ID NO: 209974 - DNA, 19 bp, Artificial sequence
  SiRNA target sequence
taatatttgcttttcttta

SEQ ID NO: 209975 - DNA, 19 bp, Artificial sequence
  SiRNA target sequence
aatatttgcttttctttat

SEQ ID NO: 209976 - DNA, 19 bp, Artificial sequence
  SiRNA target sequence
atatttgcttttctttata

SEQ ID NO: 209977 - DNA, 19 bp, Artificial sequence
  SiRNA target sequence
tatttgcttttctttatat

SEQ ID NO: 209978 - DNA, 19 bp, Artificial sequence
  SiRNA target sequence
atttgcttttctttatatc

SEQ ID NO: 209979 - DNA, 19 bp, Artificial sequence
  SiRNA target sequence
tttgcttttctttatatca

SEQ ID NO: 209980 - DNA, 19 bp, Artificial sequence
  SiRNA target sequence
ttgcttttctttatatcat

SEQ ID NO: 209981 - DNA, 19 bp, Artificial sequence
  SiRNA target sequence
tgcttttctttatatcatt

SEQ ID NO: 209982 - DNA, 19 bp, Artificial sequence
  SiRNA target sequence
gcttttctttatatcattc

SEQ ID NO: 209983 - DNA, 19 bp, Artificial sequence
  SiRNA target sequence
cttttctttatatcattct

SEQ ID NO: 209984 - DNA, 19 bp, Artificial sequence
  SiRNA target sequence
ttttctttatatcattctt

SEQ ID NO: 209985 - DNA, 19 bp, Artificial sequence
  SiRNA target sequence
tttctttatatcattcttg

SEQ ID NO: 209986 - DNA, 19 bp, Artificial sequence
  SiRNA target sequence
ttctttatatcattcttgg

SEQ ID NO: 209987 - DNA, 19 bp, Artificial sequence
  SiRNA target sequence
tctttatatcattcttggt

SEQ ID NO: 209988 - DNA, 19 bp, Artificial sequence
  SiRNA target sequence
ctttatatcattcttggtc

SEQ ID NO: 209989 - DNA, 19 bp, Artificial sequence
  SiRNA target sequence
tttatatcattcttggtct

SEQ ID NO: 209990 - DNA, 19 bp, Artificial sequence
  SiRNA target sequence
ttatatcattcttggtcta

SEQ ID NO: 209991 - DNA, 19 bp, Artificial sequence
  SiRNA target sequence
tatatcattcttggtctag

SEQ ID NO: 209992 - DNA, 19 bp, Artificial sequence
  SiRNA target sequence
atatcattcttggtctagt

SEQ ID NO: 209993 - DNA, 19 bp, Artificial sequence
  SiRNA target sequence
tatcattcttggtctagtt

SEQ ID NO: 209994 - DNA, 19 bp, Artificial sequence
  SiRNA target sequence
atcattcttggtctagttc

SEQ ID NO: 209995 - DNA, 19 bp, Artificial sequence
  SiRNA target sequence
tcattcttggtctagttct

SEQ ID NO: 209996 - DNA, 19 bp, Artificial sequence
  SiRNA target sequence
cattcttggtctagttctt

SEQ ID NO: 209997 - DNA, 19 bp, Artificial sequence
  SiRNA target sequence
attcttggtctagttcttc

SEQ ID NO: 209998 - DNA, 19 bp, Artificial sequence
  SiRNA target sequence
ttcttggtctagttcttct

SEQ ID NO: 209999 - DNA, 19 bp, Artificial sequence
  SiRNA target sequence
tcttggtctagttcttctt

SEQ ID NO: 210000 - DNA, 19 bp, Artificial sequence
  SiRNA target sequence
cttggtctagttcttcttc

SEQ ID NO: 210001 - DNA, 19 bp, Artificial sequence
  SiRNA target sequence
ttggtctagttcttcttcc

SEQ ID NO: 210002 - DNA, 19 bp, Artificial sequence
  SiRNA target sequence
tggtctagttcttcttcca

SEQ ID NO: 210003 - DNA, 19 bp, Artificial sequence
  SiRNA target sequence
ggtctagttcttcttccat

SEQ ID NO: 210004 - DNA, 19 bp, Artificial sequence
  SiRNA target sequence
gtctagttcttcttccata

SEQ ID NO: 210005 - DNA, 19 bp, Artificial sequence
  SiRNA target sequence
tctagttcttcttccatat

SEQ ID NO: 210006 - DNA, 19 bp, Artificial sequence
  SiRNA target sequence
ctagttcttcttccatatt

SEQ ID NO: 210007 - DNA, 19 bp, Artificial sequence
  SiRNA target sequence
tagttcttcttccatattc

SEQ ID NO: 210008 - DNA, 19 bp, Artificial sequence
  SiRNA target sequence
agttcttcttccatattct

SEQ ID NO: 210009 - DNA, 19 bp, Artificial sequence
  SiRNA target sequence
gttcttcttccatattctc

SEQ ID NO: 210010 - DNA, 19 bp, Artificial sequence
  SiRNA target sequence
ttcttcttccatattctca

SEQ ID NO: 210011 - DNA, 19 bp, Artificial sequence
  SiRNA target sequence
tcttcttccatattctcat

SEQ ID NO: 210012 - DNA, 19 bp, Artificial sequence
  SiRNA target sequence
cttcttccatattctcatc

SEQ ID NO: 210013 - DNA, 19 bp, Artificial sequence
  SiRNA target sequence
ttcttccatattctcatct

SEQ ID NO: 210014 - DNA, 19 bp, Artificial sequence
  SiRNA target sequence
tcttccatattctcatctt

SEQ ID NO: 210015 - DNA, 19 bp, Artificial sequence
  SiRNA target sequence
cttccatattctcatcttt

SEQ ID NO: 210016 - DNA, 19 bp, Artificial sequence
  SiRNA target sequence
ttccatattctcatctttt

SEQ ID NO: 210017 - DNA, 19 bp, Artificial sequence
  SiRNA target sequence
tccatattctcatcttttc

SEQ ID NO: 210018 - DNA, 19 bp, Artificial sequence
  SiRNA target sequence
ccatattctcatcttttcc

SEQ ID NO: 210019 - DNA, 19 bp, Artificial sequence
  SiRNA target sequence
catattctcatcttttcca

SEQ ID NO: 210020 - DNA, 19 bp, Artificial sequence
  SiRNA target sequence
atattctcatcttttccag

SEQ ID NO: 210021 - DNA, 19 bp, Artificial sequence
  SiRNA target sequence
tattctcatcttttccagc

SEQ ID NO: 210022 - DNA, 19 bp, Artificial sequence
  SiRNA target sequence
attctcatcttttccagct

SEQ ID NO: 210023 - DNA, 19 bp, Artificial sequence
  SiRNA target sequence
ttctcatcttttccagctt

SEQ ID NO: 210024 - DNA, 19 bp, Artificial sequence
  SiRNA target sequence
tctcatcttttccagcttg

SEQ ID NO: 210025 - DNA, 19 bp, Artificial sequence
  SiRNA target sequence
ctcatcttttccagcttga

SEQ ID NO: 210026 - DNA, 19 bp, Artificial sequence
  SiRNA target sequence
tcatcttttccagcttgat

SEQ ID NO: 210027 - DNA, 19 bp, Artificial sequence
  SiRNA target sequence
catcttttccagcttgata

SEQ ID NO: 210028 - DNA, 19 bp, Artificial sequence
  SiRNA target sequence
atcttttccagcttgatag

SEQ ID NO: 210029 - DNA, 19 bp, Artificial sequence
  SiRNA target sequence
tcttttccagcttgatagt

SEQ ID NO: 210030 - DNA, 19 bp, Artificial sequence
  SiRNA target sequence
cttttccagcttgatagtt

SEQ ID NO: 210031 - DNA, 19 bp, Artificial sequence
  SiRNA target sequence
ttttccagcttgatagtta

SEQ ID NO: 210032 - DNA, 19 bp, Artificial sequence
  SiRNA target sequence
tttccagcttgatagttat

SEQ ID NO: 210033 - DNA, 19 bp, Artificial sequence
  SiRNA target sequence
ttccagcttgatagttatt

SEQ ID NO: 210034 - DNA, 19 bp, Artificial sequence
  SiRNA target sequence
tccagcttgatagttattt

SEQ ID NO: 210035 - DNA, 19 bp, Artificial sequence
  SiRNA target sequence
ccagcttgatagttatttt

SEQ ID NO: 210036 - DNA, 19 bp, Artificial sequence
  SiRNA target sequence
cagcttgatagttattttt

SEQ ID NO: 210037 - DNA, 19 bp, Artificial sequence
  SiRNA target sequence
agcttgatagttatttttt

SEQ ID NO: 210038 - DNA, 19 bp, Artificial sequence
  SiRNA target sequence
gcttgatagttattttttt

SEQ ID NO: 210039 - DNA, 19 bp, Artificial sequence
  SiRNA target sequence
cttgatagttattttttta

SEQ ID NO: 210040 - DNA, 19 bp, Artificial sequence
  SiRNA target sequence
ttgatagttatttttttag

SEQ ID NO: 210041 - DNA, 19 bp, Artificial sequence
  SiRNA target sequence
tgatagttatttttttaga

SEQ ID NO: 210042 - DNA, 19 bp, Artificial sequence
  SiRNA target sequence
gatagttatttttttagag

SEQ ID NO: 210043 - DNA, 19 bp, Artificial sequence
  SiRNA target sequence
atagttatttttttagaga

SEQ ID NO: 210044 - DNA, 19 bp, Artificial sequence
  SiRNA target sequence
tagttatttttttagagac

SEQ ID NO: 210045 - DNA, 19 bp, Artificial sequence
  SiRNA target sequence
agttatttttttagagacc

SEQ ID NO: 210046 - DNA, 19 bp, Artificial sequence
  SiRNA target sequence
gttatttttttagagacct

SEQ ID NO: 210047 - DNA, 19 bp, Artificial sequence
  SiRNA target sequence
ttatttttttagagacctt

SEQ ID NO: 210048 - DNA, 19 bp, Artificial sequence
  SiRNA target sequence
tatttttttagagaccttt

SEQ ID NO: 210049 - DNA, 19 bp, Artificial sequence
  SiRNA target sequence
atttttttagagacctttt

SEQ ID NO: 210050 - DNA, 19 bp, Artificial sequence
  SiRNA target sequence
tttttttagagaccttttt

SEQ ID NO: 210051 - DNA, 19 bp, Artificial sequence
  SiRNA target sequence
ttttttagagaccttttta

SEQ ID NO: 210052 - DNA, 19 bp, Artificial sequence
  SiRNA target sequence
tttttagagacctttttag

SEQ ID NO: 210053 - DNA, 19 bp, Artificial sequence
  SiRNA target sequence
ttttagagacctttttagt

SEQ ID NO: 210054 - DNA, 19 bp, Artificial sequence
  SiRNA target sequence
tttagagacctttttagtg

SEQ ID NO: 210055 - DNA, 19 bp, Artificial sequence
  SiRNA target sequence
ttagagacctttttagtga

SEQ ID NO: 210056 - DNA, 19 bp, Artificial sequence
  SiRNA target sequence
tagagacctttttagtgat

SEQ ID NO: 210057 - DNA, 19 bp, Artificial sequence
  SiRNA target sequence
agagacctttttagtgatg

SEQ ID NO: 210058 - DNA, 19 bp, Artificial sequence
  SiRNA target sequence
gagacctttttagtgatgg

SEQ ID NO: 210059 - DNA, 19 bp, Artificial sequence
  SiRNA target sequence
agacctttttagtgatggg

SEQ ID NO: 210060 - DNA, 19 bp, Artificial sequence
  SiRNA target sequence
gacctttttagtgatggga

SEQ ID NO: 210061 - DNA, 19 bp, Artificial sequence
  SiRNA target sequence
acctttttagtgatgggaa

SEQ ID NO: 210062 - DNA, 19 bp, Artificial sequence
  SiRNA target sequence
cctttttagtgatgggaaa

SEQ ID NO: 210063 - DNA, 19 bp, Artificial sequence
  SiRNA target sequence
ctttttagtgatgggaaat

SEQ ID NO: 210064 - DNA, 19 bp, Artificial sequence
  SiRNA target sequence
tttttagtgatgggaaatg

SEQ ID NO: 210065 - DNA, 19 bp, Artificial sequence
  SiRNA target sequence
ttttagtgatgggaaatgt

SEQ ID NO: 210066 - DNA, 19 bp, Artificial sequence
  SiRNA target sequence
tttagtgatgggaaatgtg

SEQ ID NO: 210067 - DNA, 19 bp, Artificial sequence
  SiRNA target sequence
ttagtgatgggaaatgtgt

SEQ ID NO: 210068 - DNA, 19 bp, Artificial sequence
  SiRNA target sequence
tagtgatgggaaatgtgtt

SEQ ID NO: 210069 - DNA, 19 bp, Artificial sequence
  SiRNA target sequence
agtgatgggaaatgtgttg

SEQ ID NO: 210070 - DNA, 19 bp, Artificial sequence
  SiRNA target sequence
gtgatgggaaatgtgttgt

SEQ ID NO: 210071 - DNA, 19 bp, Artificial sequence
  SiRNA target sequence
tgatgggaaatgtgttgta

SEQ ID NO: 210072 - DNA, 19 bp, Artificial sequence
  SiRNA target sequence
gatgggaaatgtgttgtaa

SEQ ID NO: 210073 - DNA, 19 bp, Artificial sequence
  SiRNA target sequence
atgggaaatgtgttgtaag

SEQ ID NO: 210074 - DNA, 19 bp, Artificial sequence
  SiRNA target sequence
tgggaaatgtgttgtaaga

SEQ ID NO: 210075 - DNA, 19 bp, Artificial sequence
  SiRNA target sequence
gggaaatgtgttgtaagag

SEQ ID NO: 210076 - DNA, 19 bp, Artificial sequence
  SiRNA target sequence
ggaaatgtgttgtaagagg

SEQ ID NO: 210077 - DNA, 19 bp, Artificial sequence
  SiRNA target sequence
gaaatgtgttgtaagaggc

SEQ ID NO: 210078 - DNA, 19 bp, Artificial sequence
  SiRNA target sequence
aaatgtgttgtaagaggct

SEQ ID NO: 210079 - DNA, 19 bp, Artificial sequence
  SiRNA target sequence
aatgtgttgtaagaggcta

SEQ ID NO: 210080 - DNA, 19 bp, Artificial sequence
  SiRNA target sequence
atgtgttgtaagaggctat

SEQ ID NO: 210081 - DNA, 19 bp, Artificial sequence
  SiRNA target sequence
tgtgttgtaagaggctatg

SEQ ID NO: 210082 - DNA, 19 bp, Artificial sequence
  SiRNA target sequence
gtgttgtaagaggctatga

SEQ ID NO: 210083 - DNA, 19 bp, Artificial sequence
  SiRNA target sequence
tgttgtaagaggctatgat

SEQ ID NO: 210084 - DNA, 19 bp, Artificial sequence
  SiRNA target sequence
gttgtaagaggctatgatg

SEQ ID NO: 210085 - DNA, 19 bp, Artificial sequence
  SiRNA target sequence
ttgtaagaggctatgatgc

SEQ ID NO: 210086 - DNA, 19 bp, Artificial sequence
  SiRNA target sequence
tgtaagaggctatgatgct

SEQ ID NO: 210087 - DNA, 19 bp, Artificial sequence
  SiRNA target sequence
gtaagaggctatgatgctt

SEQ ID NO: 210088 - DNA, 19 bp, Artificial sequence
  SiRNA target sequence
taagaggctatgatgcttt

SEQ ID NO: 210089 - DNA, 19 bp, Artificial sequence
  SiRNA target sequence
aagaggctatgatgcttta

SEQ ID NO: 210090 - DNA, 19 bp, Artificial sequence
  SiRNA target sequence
agaggctatgatgctttat

SEQ ID NO: 210091 - DNA, 19 bp, Artificial sequence
  SiRNA target sequence
gaggctatgatgctttatt

SEQ ID NO: 210092 - DNA, 19 bp, Artificial sequence
  SiRNA target sequence
aggctatgatgctttatta

SEQ ID NO: 210093 - DNA, 19 bp, Artificial sequence
  SiRNA target sequence
ggctatgatgctttattat

SEQ ID NO: 210094 - DNA, 19 bp, Artificial sequence
  SiRNA target sequence
gctatgatgctttattatc

SEQ ID NO: 210095 - DNA, 19 bp, Artificial sequence
  SiRNA target sequence
ctatgatgctttattatct

SEQ ID NO: 210096 - DNA, 19 bp, Artificial sequence
  SiRNA target sequence
tatgatgctttattatctt

SEQ ID NO: 210097 - DNA, 19 bp, Artificial sequence
  SiRNA target sequence
atgatgctttattatcttt

SEQ ID NO: 210098 - DNA, 19 bp, Artificial sequence
  SiRNA target sequence
tgatgctttattatctttg

SEQ ID NO: 210099 - DNA, 19 bp, Artificial sequence
  SiRNA target sequence
gatgctttattatctttgg

SEQ ID NO: 210100 - DNA, 19 bp, Artificial sequence
  SiRNA target sequence
atgctttattatctttggc

SEQ ID NO: 210101 - DNA, 19 bp, Artificial sequence
  SiRNA target sequence
tgctttattatctttggca

SEQ ID NO: 210102 - DNA, 19 bp, Artificial sequence
  SiRNA target sequence
gctttattatctttggcac

SEQ ID NO: 210103 - DNA, 19 bp, Artificial sequence
  SiRNA target sequence
ctttattatctttggcact

SEQ ID NO: 210104 - DNA, 19 bp, Artificial sequence
  SiRNA target sequence
tttattatctttggcactg

SEQ ID NO: 210105 - DNA, 19 bp, Artificial sequence
  SiRNA target sequence
ttattatctttggcactgg

SEQ ID NO: 210106 - DNA, 19 bp, Artificial sequence
  SiRNA target sequence
tattatctttggcactggt

SEQ ID NO: 210107 - DNA, 19 bp, Artificial sequence
  SiRNA target sequence
attatctttggcactggtc

SEQ ID NO: 210108 - DNA, 19 bp, Artificial sequence
  SiRNA target sequence
ttatctttggcactggtct

SEQ ID NO: 210109 - DNA, 19 bp, Artificial sequence
  SiRNA target sequence
tatctttggcactggtctt

SEQ ID NO: 210110 - DNA, 19 bp, Artificial sequence
  SiRNA target sequence
atctttggcactggtcttt

SEQ ID NO: 210111 - DNA, 19 bp, Artificial sequence
  SiRNA target sequence
tctttggcactggtcttta

SEQ ID NO: 210112 - DNA, 19 bp, Artificial sequence
  SiRNA target sequence
ctttggcactggtctttaa

SEQ ID NO: 210113 - DNA, 19 bp, Artificial sequence
  SiRNA target sequence
tttggcactggtctttaac

SEQ ID NO: 210114 - DNA, 19 bp, Artificial sequence
  SiRNA target sequence
ttggcactggtctttaacg

SEQ ID NO: 210115 - DNA, 19 bp, Artificial sequence
  SiRNA target sequence
tggcactggtctttaacga

SEQ ID NO: 210116 - DNA, 19 bp, Artificial sequence
  SiRNA target sequence
ggcactggtctttaacgaa

SEQ ID NO: 210117 - DNA, 19 bp, Artificial sequence
  SiRNA target sequence
gcactggtctttaacgaat

SEQ ID NO: 210118 - DNA, 19 bp, Artificial sequence
  SiRNA target sequence
cactggtctttaacgaatg

SEQ ID NO: 210119 - DNA, 19 bp, Artificial sequence
  SiRNA target sequence
actggtctttaacgaatgg

SEQ ID NO: 210120 - DNA, 19 bp, Artificial sequence
  SiRNA target sequence
ctggtctttaacgaatgga

SEQ ID NO: 210121 - DNA, 19 bp, Artificial sequence
  SiRNA target sequence
tggtctttaacgaatggac

SEQ ID NO: 210122 - DNA, 19 bp, Artificial sequence
  SiRNA target sequence
ggtctttaacgaatggaca

SEQ ID NO: 210123 - DNA, 19 bp, Artificial sequence
  SiRNA target sequence
gtctttaacgaatggacat

SEQ ID NO: 210124 - DNA, 19 bp, Artificial sequence
  SiRNA target sequence
tctttaacgaatggacatc

SEQ ID NO: 210125 - DNA, 19 bp, Artificial sequence
  SiRNA target sequence
ctttaacgaatggacatcc

SEQ ID NO: 210126 - DNA, 19 bp, Artificial sequence
  SiRNA target sequence
tttaacgaatggacatcct

SEQ ID NO: 210127 - DNA, 19 bp, Artificial sequence
  SiRNA target sequence
ttaacgaatggacatcctc

SEQ ID NO: 210128 - DNA, 19 bp, Artificial sequence
  SiRNA target sequence
taacgaatggacatcctct

SEQ ID NO: 210129 - DNA, 19 bp, Artificial sequence
  SiRNA target sequence
aacgaatggacatcctctc

SEQ ID NO: 210130 - DNA, 19 bp, Artificial sequence
  SiRNA target sequence
acgaatggacatcctctct

SEQ ID NO: 210131 - DNA, 19 bp, Artificial sequence
  SiRNA target sequence
cgaatggacatcctctcta

SEQ ID NO: 210132 - DNA, 19 bp, Artificial sequence
  SiRNA target sequence
gaatggacatcctctctag

SEQ ID NO: 210133 - DNA, 19 bp, Artificial sequence
  SiRNA target sequence
aatggacatcctctctagt

SEQ ID NO: 210134 - DNA, 19 bp, Artificial sequence
  SiRNA target sequence
atggacatcctctctagtt

SEQ ID NO: 210135 - DNA, 19 bp, Artificial sequence
  SiRNA target sequence
tggacatcctctctagttt

SEQ ID NO: 210136 - DNA, 19 bp, Artificial sequence
  SiRNA target sequence
ggacatcctctctagttta

SEQ ID NO: 210137 - DNA, 19 bp, Artificial sequence
  SiRNA target sequence
gacatcctctctagtttac

SEQ ID NO: 210138 - DNA, 19 bp, Artificial sequence
  SiRNA target sequence
acatcctctctagtttaca

SEQ ID NO: 210139 - DNA, 19 bp, Artificial sequence
  SiRNA target sequence
catcctctctagtttacat

SEQ ID NO: 210140 - DNA, 19 bp, Artificial sequence
  SiRNA target sequence
atcctctctagtttacatt

SEQ ID NO: 210141 - DNA, 19 bp, Artificial sequence
  SiRNA target sequence
tcctctctagtttacattg

SEQ ID NO: 210142 - DNA, 19 bp, Artificial sequence
  SiRNA target sequence
cctctctagtttacattgt

SEQ ID NO: 210143 - DNA, 19 bp, Artificial sequence
  SiRNA target sequence
ctctctagtttacattgtt

SEQ ID NO: 210144 - DNA, 19 bp, Artificial sequence
  SiRNA target sequence
tctctagtttacattgttt

SEQ ID NO: 210145 - DNA, 19 bp, Artificial sequence
  SiRNA target sequence
ctctagtttacattgtttc

SEQ ID NO: 210146 - DNA, 19 bp, Artificial sequence
  SiRNA target sequence
tctagtttacattgtttca

SEQ ID NO: 210147 - DNA, 19 bp, Artificial sequence
  SiRNA target sequence
ctagtttacattgtttcag

SEQ ID NO: 210148 - DNA, 19 bp, Artificial sequence
  SiRNA target sequence
tagtttacattgtttcaga

SEQ ID NO: 210149 - DNA, 19 bp, Artificial sequence
  SiRNA target sequence
agtttacattgtttcagaa

SEQ ID NO: 210150 - DNA, 19 bp, Artificial sequence
  SiRNA target sequence
gtttacattgtttcagaaa

SEQ ID NO: 210151 - DNA, 19 bp, Artificial sequence
  SiRNA target sequence
tttacattgtttcagaaat

SEQ ID NO: 210152 - DNA, 19 bp, Artificial sequence
  SiRNA target sequence
ttacattgtttcagaaatg

SEQ ID NO: 210153 - DNA, 19 bp, Artificial sequence
  SiRNA target sequence
tacattgtttcagaaatgt

SEQ ID NO: 210154 - DNA, 19 bp, Artificial sequence
  SiRNA target sequence
acattgtttcagaaatgtt

SEQ ID NO: 210155 - DNA, 19 bp, Artificial sequence
  SiRNA target sequence
cattgtttcagaaatgttt

SEQ ID NO: 210156 - DNA, 19 bp, Artificial sequence
  SiRNA target sequence
attgtttcagaaatgtttg

SEQ ID NO: 210157 - DNA, 19 bp, Artificial sequence
  SiRNA target sequence
ttgtttcagaaatgtttgg

SEQ ID NO: 210158 - DNA, 19 bp, Artificial sequence
  SiRNA target sequence
tgtttcagaaatgtttggt

SEQ ID NO: 210159 - DNA, 19 bp, Artificial sequence
  SiRNA target sequence
gtttcagaaatgtttggta

SEQ ID NO: 210160 - DNA, 19 bp, Artificial sequence
  SiRNA target sequence
tttcagaaatgtttggtaa

SEQ ID NO: 210161 - DNA, 19 bp, Artificial sequence
  SiRNA target sequence
ttcagaaatgtttggtaat

SEQ ID NO: 210162 - DNA, 19 bp, Artificial sequence
  SiRNA target sequence
tcagaaatgtttggtaatt

SEQ ID NO: 210163 - DNA, 19 bp, Artificial sequence
  SiRNA target sequence
cagaaatgtttggtaattt

SEQ ID NO: 210164 - DNA, 19 bp, Artificial sequence
  SiRNA target sequence
agaaatgtttggtaattta

SEQ ID NO: 210165 - DNA, 19 bp, Artificial sequence
  SiRNA target sequence
gaaatgtttggtaatttag

SEQ ID NO: 210166 - DNA, 19 bp, Artificial sequence
  SiRNA target sequence
aaatgtttggtaatttagt

SEQ ID NO: 210167 - DNA, 19 bp, Artificial sequence
  SiRNA target sequence
aatgtttggtaatttagta

SEQ ID NO: 210168 - DNA, 19 bp, Artificial sequence
  SiRNA target sequence
atgtttggtaatttagtat

SEQ ID NO: 210169 - DNA, 19 bp, Artificial sequence
  SiRNA target sequence
tgtttggtaatttagtatt

SEQ ID NO: 210170 - DNA, 19 bp, Artificial sequence
  SiRNA target sequence
gtttggtaatttagtattg

SEQ ID NO: 210171 - DNA, 19 bp, Artificial sequence
  SiRNA target sequence
tttggtaatttagtattgt

SEQ ID NO: 210172 - DNA, 19 bp, Artificial sequence
  SiRNA target sequence
ttggtaatttagtattgtc

SEQ ID NO: 210173 - DNA, 19 bp, Artificial sequence
  SiRNA target sequence
tggtaatttagtattgtct

SEQ ID NO: 210174 - DNA, 19 bp, Artificial sequence
  SiRNA target sequence
ggtaatttagtattgtctt

SEQ ID NO: 210175 - DNA, 19 bp, Artificial sequence
  SiRNA target sequence
gtaatttagtattgtctta

SEQ ID NO: 210176 - DNA, 19 bp, Artificial sequence
  SiRNA target sequence
taatttagtattgtcttat

SEQ ID NO: 210177 - DNA, 19 bp, Artificial sequence
  SiRNA target sequence
aatttagtattgtcttatt

SEQ ID NO: 210178 - DNA, 19 bp, Artificial sequence
  SiRNA target sequence
atttagtattgtcttattt

SEQ ID NO: 210179 - DNA, 19 bp, Artificial sequence
  SiRNA target sequence
tttagtattgtcttatttc

SEQ ID NO: 210180 - DNA, 19 bp, Artificial sequence
  SiRNA target sequence
ttagtattgtcttatttct

SEQ ID NO: 210181 - DNA, 19 bp, Artificial sequence
  SiRNA target sequence
tagtattgtcttatttctt

SEQ ID NO: 210182 - DNA, 19 bp, Artificial sequence
  SiRNA target sequence
agtattgtcttatttcttc

SEQ ID NO: 210183 - DNA, 19 bp, Artificial sequence
  SiRNA target sequence
gtattgtcttatttcttct

SEQ ID NO: 210184 - DNA, 19 bp, Artificial sequence
  SiRNA target sequence
tattgtcttatttcttctt

SEQ ID NO: 210185 - DNA, 19 bp, Artificial sequence
  SiRNA target sequence
attgtcttatttcttcttg

SEQ ID NO: 210186 - DNA, 19 bp, Artificial sequence
  SiRNA target sequence
ttgtcttatttcttcttga

SEQ ID NO: 210187 - DNA, 19 bp, Artificial sequence
  SiRNA target sequence
tgtcttatttcttcttgac

SEQ ID NO: 210188 - DNA, 19 bp, Artificial sequence
  SiRNA target sequence
gtcttatttcttcttgacg

SEQ ID NO: 210189 - DNA, 19 bp, Artificial sequence
  SiRNA target sequence
tcttatttcttcttgacgt

SEQ ID NO: 210190 - DNA, 19 bp, Artificial sequence
  SiRNA target sequence
cttatttcttcttgacgtt

SEQ ID NO: 210191 - DNA, 19 bp, Artificial sequence
  SiRNA target sequence
ttatttcttcttgacgttt

SEQ ID NO: 210192 - DNA, 19 bp, Artificial sequence
  SiRNA target sequence
tatttcttcttgacgtttg

SEQ ID NO: 210193 - DNA, 19 bp, Artificial sequence
  SiRNA target sequence
atttcttcttgacgtttgc

SEQ ID NO: 210194 - DNA, 19 bp, Artificial sequence
  SiRNA target sequence
tttcttcttgacgtttgct

SEQ ID NO: 210195 - DNA, 19 bp, Artificial sequence
  SiRNA target sequence
ttcttcttgacgtttgcta

SEQ ID NO: 210196 - DNA, 19 bp, Artificial sequence
  SiRNA target sequence
tcttcttgacgtttgctaa

SEQ ID NO: 210197 - DNA, 19 bp, Artificial sequence
  SiRNA target sequence
cttcttgacgtttgctaat

SEQ ID NO: 210198 - DNA, 19 bp, Artificial sequence
  SiRNA target sequence
ttcttgacgtttgctaatt

SEQ ID NO: 210199 - DNA, 19 bp, Artificial sequence
  SiRNA target sequence
tcttgacgtttgctaattc

SEQ ID NO: 210200 - DNA, 19 bp, Artificial sequence
  SiRNA target sequence
cttgacgtttgctaattct

SEQ ID NO: 210201 - DNA, 19 bp, Artificial sequence
  SiRNA target sequence
ttgacgtttgctaattctt

SEQ ID NO: 210202 - DNA, 19 bp, Artificial sequence
  SiRNA target sequence
tgacgtttgctaattcttt

SEQ ID NO: 210203 - DNA, 19 bp, Artificial sequence
  SiRNA target sequence
gacgtttgctaattcttta

SEQ ID NO: 210204 - DNA, 19 bp, Artificial sequence
  SiRNA target sequence
acgtttgctaattctttaa

SEQ ID NO: 210205 - DNA, 19 bp, Artificial sequence
  SiRNA target sequence
cgtttgctaattctttaac

SEQ ID NO: 210206 - DNA, 19 bp, Artificial sequence
  SiRNA target sequence
gtttgctaattctttaaca

SEQ ID NO: 210207 - DNA, 19 bp, Artificial sequence
  SiRNA target sequence
tttgctaattctttaacaa

SEQ ID NO: 210208 - DNA, 19 bp, Artificial sequence
  SiRNA target sequence
ttgctaattctttaacaac

SEQ ID NO: 210209 - DNA, 19 bp, Artificial sequence
  SiRNA target sequence
tgctaattctttaacaact

SEQ ID NO: 210210 - DNA, 19 bp, Artificial sequence
  SiRNA target sequence
gctaattctttaacaactc

SEQ ID NO: 210211 - DNA, 19 bp, Artificial sequence
  SiRNA target sequence
ctaattctttaacaactcc

SEQ ID NO: 210212 - DNA, 19 bp, Artificial sequence
  SiRNA target sequence
taattctttaacaactcca

SEQ ID NO: 210213 - DNA, 19 bp, Artificial sequence
  SiRNA target sequence
aattctttaacaactccag

SEQ ID NO: 210214 - DNA, 19 bp, Artificial sequence
  SiRNA target sequence
attctttaacaactccagg

SEQ ID NO: 210215 - DNA, 19 bp, Artificial sequence
  SiRNA target sequence
ttctttaacaactccagga

SEQ ID NO: 210216 - DNA, 19 bp, Artificial sequence
  SiRNA target sequence
tctttaacaactccaggac

SEQ ID NO: 210217 - DNA, 19 bp, Artificial sequence
  SiRNA target sequence
ctttaacaactccaggaca

SEQ ID NO: 210218 - DNA, 19 bp, Artificial sequence
  SiRNA target sequence
tttaacaactccaggacaa

SEQ ID NO: 210219 - DNA, 19 bp, Artificial sequence
  SiRNA target sequence
ttaacaactccaggacaaa

SEQ ID NO: 210220 - DNA, 19 bp, Artificial sequence
  SiRNA target sequence
taacaactccaggacaaag

SEQ ID NO: 210221 - DNA, 19 bp, Artificial sequence
  SiRNA target sequence
aacaactccaggacaaagt

SEQ ID NO: 210222 - DNA, 19 bp, Artificial sequence
  SiRNA target sequence
acaactccaggacaaagtg

SEQ ID NO: 210223 - DNA, 19 bp, Artificial sequence
  SiRNA target sequence
caactccaggacaaagtgc

SEQ ID NO: 210224 - DNA, 19 bp, Artificial sequence
  SiRNA target sequence
aactccaggacaaagtgca

SEQ ID NO: 210225 - DNA, 19 bp, Artificial sequence
  SiRNA target sequence
actccaggacaaagtgcaa

SEQ ID NO: 210226 - DNA, 19 bp, Artificial sequence
  SiRNA target sequence
ctccaggacaaagtgcaag

SEQ ID NO: 210227 - DNA, 19 bp, Artificial sequence
  SiRNA target sequence
tccaggacaaagtgcaaga

SEQ ID NO: 210228 - DNA, 19 bp, Artificial sequence
  SiRNA target sequence
ccaggacaaagtgcaagat

SEQ ID NO: 210229 - DNA, 19 bp, Artificial sequence
  SiRNA target sequence
caggacaaagtgcaagatt

SEQ ID NO: 210230 - DNA, 19 bp, Artificial sequence
  SiRNA target sequence
aggacaaagtgcaagattc

SEQ ID NO: 210231 - DNA, 19 bp, Artificial sequence
  SiRNA target sequence
ggacaaagtgcaagattca

SEQ ID NO: 210232 - DNA, 19 bp, Artificial sequence
  SiRNA target sequence
gacaaagtgcaagattcat

SEQ ID NO: 210233 - DNA, 19 bp, Artificial sequence
  SiRNA target sequence
acaaagtgcaagattcata

SEQ ID NO: 210234 - DNA, 19 bp, Artificial sequence
  SiRNA target sequence
caaagtgcaagattcatac

SEQ ID NO: 210235 - DNA, 19 bp, Artificial sequence
  SiRNA target sequence
aaagtgcaagattcatacc

SEQ ID NO: 210236 - DNA, 19 bp, Artificial sequence
  SiRNA target sequence
aagtgcaagattcatacct

SEQ ID NO: 210237 - DNA, 19 bp, Artificial sequence
  SiRNA target sequence
agtgcaagattcatacctt

SEQ ID NO: 210238 - DNA, 19 bp, Artificial sequence
  SiRNA target sequence
gtgcaagattcataccttt

SEQ ID NO: 210239 - DNA, 19 bp, Artificial sequence
  SiRNA target sequence
tgcaagattcataccttta

SEQ ID NO: 210240 - DNA, 19 bp, Artificial sequence
  SiRNA target sequence
gcaagattcatacctttat

SEQ ID NO: 210241 - DNA, 19 bp, Artificial sequence
  SiRNA target sequence
caagattcatacctttatt

SEQ ID NO: 210242 - DNA, 19 bp, Artificial sequence
  SiRNA target sequence
aagattcatacctttattt

SEQ ID NO: 210243 - DNA, 19 bp, Artificial sequence
  SiRNA target sequence
agattcatacctttatttt

SEQ ID NO: 210244 - DNA, 19 bp, Artificial sequence
  SiRNA target sequence
gattcatacctttatttta

SEQ ID NO: 210245 - DNA, 19 bp, Artificial sequence
  SiRNA target sequence
attcatacctttattttat

SEQ ID NO: 210246 - DNA, 19 bp, Artificial sequence
  SiRNA target sequence
ttcatacctttattttatg

SEQ ID NO: 210247 - DNA, 19 bp, Artificial sequence
  SiRNA target sequence
tcatacctttattttatgt

SEQ ID NO: 210248 - DNA, 19 bp, Artificial sequence
  SiRNA target sequence
catacctttattttatgtt

SEQ ID NO: 210249 - DNA, 19 bp, Artificial sequence
  SiRNA target sequence
atacctttattttatgttt

SEQ ID NO: 210250 - DNA, 19 bp, Artificial sequence
  SiRNA target sequence
tacctttattttatgtttt

SEQ ID NO: 210251 - DNA, 19 bp, Artificial sequence
  SiRNA target sequence
acctttattttatgttttc

SEQ ID NO: 210252 - DNA, 19 bp, Artificial sequence
  SiRNA target sequence
cctttattttatgttttct

SEQ ID NO: 210253 - DNA, 19 bp, Artificial sequence
  SiRNA target sequence
ctttattttatgttttctc

SEQ ID NO: 210254 - DNA, 19 bp, Artificial sequence
  SiRNA target sequence
tttattttatgttttctcg

SEQ ID NO: 210255 - DNA, 19 bp, Artificial sequence
  SiRNA target sequence
ttattttatgttttctcga

SEQ ID NO: 210256 - DNA, 19 bp, Artificial sequence
  SiRNA target sequence
tattttatgttttctcgaa

SEQ ID NO: 210257 - DNA, 19 bp, Artificial sequence
  SiRNA target sequence
attttatgttttctcgaat

SEQ ID NO: 210258 - DNA, 19 bp, Artificial sequence
  SiRNA target sequence
ttttatgttttctcgaata

SEQ ID NO: 210259 - DNA, 19 bp, Artificial sequence
  SiRNA target sequence
tttatgttttctcgaatat

SEQ ID NO: 210260 - DNA, 19 bp, Artificial sequence
  SiRNA target sequence
ttatgttttctcgaatatt

SEQ ID NO: 210261 - DNA, 19 bp, Artificial sequence
  SiRNA target sequence
tatgttttctcgaatattt

SEQ ID NO: 210262 - DNA, 19 bp, Artificial sequence
  SiRNA target sequence
atgttttctcgaatatttc

SEQ ID NO: 210263 - DNA, 19 bp, Artificial sequence
  SiRNA target sequence
tgttttctcgaatatttct

SEQ ID NO: 210264 - DNA, 19 bp, Artificial sequence
  SiRNA target sequence
gttttctcgaatatttctc

SEQ ID NO: 210265 - DNA, 19 bp, Artificial sequence
  SiRNA target sequence
ttttctcgaatatttctct

SEQ ID NO: 210266 - DNA, 19 bp, Artificial sequence
  SiRNA target sequence
tttctcgaatatttctctt

SEQ ID NO: 210267 - DNA, 19 bp, Artificial sequence
  SiRNA target sequence
ttctcgaatatttctcttt

SEQ ID NO: 210268 - DNA, 19 bp, Artificial sequence
  SiRNA target sequence
tctcgaatatttctctttt

SEQ ID NO: 210269 - DNA, 19 bp, Artificial sequence
  SiRNA target sequence
ctcgaatatttctcttttc

SEQ ID NO: 210270 - DNA, 19 bp, Artificial sequence
  SiRNA target sequence
tcgaatatttctcttttct

SEQ ID NO: 210271 - DNA, 19 bp, Artificial sequence
  SiRNA target sequence
cgaatatttctcttttctt

SEQ ID NO: 210272 - DNA, 19 bp, Artificial sequence
  SiRNA target sequence
gaatatttctcttttctta

SEQ ID NO: 210273 - DNA, 19 bp, Artificial sequence
  SiRNA target sequence
aatatttctcttttcttat

SEQ ID NO: 210274 - DNA, 19 bp, Artificial sequence
  SiRNA target sequence
atatttctcttttcttatc

SEQ ID NO: 210275 - DNA, 19 bp, Artificial sequence
  SiRNA target sequence
tatttctcttttcttatct

SEQ ID NO: 210276 - DNA, 19 bp, Artificial sequence
  SiRNA target sequence
atttctcttttcttatctt

SEQ ID NO: 210277 - DNA, 19 bp, Artificial sequence
  SiRNA target sequence
tttctcttttcttatcttc

SEQ ID NO: 210278 - DNA, 19 bp, Artificial sequence
  SiRNA target sequence
ttctcttttcttatcttct

SEQ ID NO: 210279 - DNA, 19 bp, Artificial sequence
  SiRNA target sequence
tctcttttcttatcttctc

SEQ ID NO: 210280 - DNA, 19 bp, Artificial sequence
  SiRNA target sequence
ctcttttcttatcttctca

SEQ ID NO: 210281 - DNA, 19 bp, Artificial sequence
  SiRNA target sequence
tcttttcttatcttctcaa

SEQ ID NO: 210282 - DNA, 19 bp, Artificial sequence
  SiRNA target sequence
cttttcttatcttctcaag

SEQ ID NO: 210283 - DNA, 19 bp, Artificial sequence
  SiRNA target sequence
ttttcttatcttctcaagt

SEQ ID NO: 210284 - DNA, 19 bp, Artificial sequence
  SiRNA target sequence
tttcttatcttctcaagtg

SEQ ID NO: 210285 - DNA, 19 bp, Artificial sequence
  SiRNA target sequence
ttcttatcttctcaagtga

SEQ ID NO: 210286 - DNA, 19 bp, Artificial sequence
  SiRNA target sequence
tcttatcttctcaagtgac

SEQ ID NO: 210287 - DNA, 19 bp, Artificial sequence
  SiRNA target sequence
cttatcttctcaagtgaca

SEQ ID NO: 210288 - DNA, 19 bp, Artificial sequence
  SiRNA target sequence
ttatcttctcaagtgacag

SEQ ID NO: 210289 - DNA, 19 bp, Artificial sequence
  SiRNA target sequence
tatcttctcaagtgacaga

SEQ ID NO: 210290 - DNA, 19 bp, Artificial sequence
  SiRNA target sequence
atcttctcaagtgacagaa

SEQ ID NO: 210291 - DNA, 19 bp, Artificial sequence
  SiRNA target sequence
tcttctcaagtgacagaac

SEQ ID NO: 210292 - DNA, 19 bp, Artificial sequence
  SiRNA target sequence
cttctcaagtgacagaact

SEQ ID NO: 210293 - DNA, 19 bp, Artificial sequence
  SiRNA target sequence
ttctcaagtgacagaactt

SEQ ID NO: 210294 - DNA, 19 bp, Artificial sequence
  SiRNA target sequence
tctcaagtgacagaacttt

SEQ ID NO: 210295 - DNA, 19 bp, Artificial sequence
  SiRNA target sequence
ctcaagtgacagaactttt

SEQ ID NO: 210296 - DNA, 19 bp, Artificial sequence
  SiRNA target sequence
tcaagtgacagaacttttt

SEQ ID NO: 210297 - DNA, 19 bp, Artificial sequence
  SiRNA target sequence
caagtgacagaacttttta

SEQ ID NO: 210298 - DNA, 19 bp, Artificial sequence
  SiRNA target sequence
aagtgacagaactttttac

SEQ ID NO: 210299 - DNA, 19 bp, Artificial sequence
  SiRNA target sequence
agtgacagaactttttaca

SEQ ID NO: 210300 - DNA, 19 bp, Artificial sequence
  SiRNA target sequence
gtgacagaactttttacaa

SEQ ID NO: 210301 - DNA, 19 bp, Artificial sequence
  SiRNA target sequence
tgacagaactttttacaag

SEQ ID NO: 210302 - DNA, 19 bp, Artificial sequence
  SiRNA target sequence
gacagaactttttacaaga

SEQ ID NO: 210303 - DNA, 19 bp, Artificial sequence
  SiRNA target sequence
acagaactttttacaagat

SEQ ID NO: 210304 - DNA, 19 bp, Artificial sequence
  SiRNA target sequence
cagaactttttacaagata

SEQ ID NO: 210305 - DNA, 19 bp, Artificial sequence
  SiRNA target sequence
agaactttttacaagatat

SEQ ID NO: 210306 - DNA, 19 bp, Artificial sequence
  SiRNA target sequence
gaactttttacaagatata

SEQ ID NO: 210307 - DNA, 19 bp, Artificial sequence
  SiRNA target sequence
aactttttacaagatatag

SEQ ID NO: 210308 - DNA, 19 bp, Artificial sequence
  SiRNA target sequence
actttttacaagatataga

SEQ ID NO: 210309 - DNA, 19 bp, Artificial sequence
  SiRNA target sequence
ctttttacaagatatagat

SEQ ID NO: 210310 - DNA, 19 bp, Artificial sequence
  SiRNA target sequence
tttttacaagatatagatc

SEQ ID NO: 210311 - DNA, 19 bp, Artificial sequence
  SiRNA target sequence
ttttacaagatatagatca

SEQ ID NO: 210312 - DNA, 19 bp, Artificial sequence
  SiRNA target sequence
tttacaagatatagatcaa

SEQ ID NO: 210313 - DNA, 19 bp, Artificial sequence
  SiRNA target sequence
ttacaagatatagatcaaa

SEQ ID NO: 210314 - DNA, 19 bp, Artificial sequence
  SiRNA target sequence
tacaagatatagatcaaag

SEQ ID NO: 210315 - DNA, 19 bp, Artificial sequence
  SiRNA target sequence
acaagatatagatcaaagc

SEQ ID NO: 210316 - DNA, 19 bp, Artificial sequence
  SiRNA target sequence
caagatatagatcaaagct

SEQ ID NO: 210317 - DNA, 19 bp, Artificial sequence
  SiRNA target sequence
aagatatagatcaaagctc

SEQ ID NO: 210318 - DNA, 19 bp, Artificial sequence
  SiRNA target sequence
agatatagatcaaagctca

SEQ ID NO: 210319 - DNA, 19 bp, Artificial sequence
  SiRNA target sequence
gatatagatcaaagctcac

SEQ ID NO: 210320 - DNA, 19 bp, Artificial sequence
  SiRNA target sequence
atatagatcaaagctcact

SEQ ID NO: 210321 - DNA, 19 bp, Artificial sequence
  SiRNA target sequence
tatagatcaaagctcactt

SEQ ID NO: 210322 - DNA, 19 bp, Artificial sequence
  SiRNA target sequence
atagatcaaagctcacttt

SEQ ID NO: 210323 - DNA, 19 bp, Artificial sequence
  SiRNA target sequence
tagatcaaagctcactttc

SEQ ID NO: 210324 - DNA, 19 bp, Artificial sequence
  SiRNA target sequence
agatcaaagctcactttct

SEQ ID NO: 210325 - DNA, 19 bp, Artificial sequence
  SiRNA target sequence
gatcaaagctcactttctc

SEQ ID NO: 210326 - DNA, 19 bp, Artificial sequence
  SiRNA target sequence
atcaaagctcactttctca

SEQ ID NO: 210327 - DNA, 19 bp, Artificial sequence
  SiRNA target sequence
tcaaagctcactttctcag

SEQ ID NO: 210328 - DNA, 19 bp, Artificial sequence
  SiRNA target sequence
caaagctcactttctcaga

SEQ ID NO: 210329 - DNA, 19 bp, Artificial sequence
  SiRNA target sequence
aaagctcactttctcagag

SEQ ID NO: 210330 - DNA, 19 bp, Artificial sequence
  SiRNA target sequence
aagctcactttctcagagg

SEQ ID NO: 210331 - DNA, 19 bp, Artificial sequence
  SiRNA target sequence
agctcactttctcagaggc

SEQ ID NO: 210332 - DNA, 19 bp, Artificial sequence
  SiRNA target sequence
gctcactttctcagaggcg

SEQ ID NO: 210333 - DNA, 19 bp, Artificial sequence
  SiRNA target sequence
ctcactttctcagaggcgg

SEQ ID NO: 210334 - DNA, 19 bp, Artificial sequence
  SiRNA target sequence
tcactttctcagaggcgga

SEQ ID NO: 210335 - DNA, 19 bp, Artificial sequence
  SiRNA target sequence
cactttctcagaggcggaa

SEQ ID NO: 210336 - DNA, 19 bp, Artificial sequence
  SiRNA target sequence
actttctcagaggcggaat

SEQ ID NO: 210337 - DNA, 19 bp, Artificial sequence
  SiRNA target sequence
ctttctcagaggcggaatt

SEQ ID NO: 210338 - DNA, 19 bp, Artificial sequence
  SiRNA target sequence
tttctcagaggcggaattt

SEQ ID NO: 210339 - DNA, 19 bp, Artificial sequence
  SiRNA target sequence
ttctcagaggcggaatttt

SEQ ID NO: 210340 - DNA, 19 bp, Artificial sequence
  SiRNA target sequence
tctcagaggcggaattttt

SEQ ID NO: 210341 - DNA, 19 bp, Artificial sequence
  SiRNA target sequence
ctcagaggcggaattttta

SEQ ID NO: 210342 - DNA, 19 bp, Artificial sequence
  SiRNA target sequence
tcagaggcggaatttttat

SEQ ID NO: 210343 - DNA, 19 bp, Artificial sequence
  SiRNA target sequence
cagaggcggaatttttata

SEQ ID NO: 210344 - DNA, 19 bp, Artificial sequence
  SiRNA target sequence
agaggcggaatttttatat

SEQ ID NO: 210345 - DNA, 19 bp, Artificial sequence
  SiRNA target sequence
gaggcggaatttttatata

SEQ ID NO: 210346 - DNA, 19 bp, Artificial sequence
  SiRNA target sequence
aggcggaatttttatataa

SEQ ID NO: 210347 - DNA, 19 bp, Artificial sequence
  SiRNA target sequence
ggcggaatttttatataat

SEQ ID NO: 210348 - DNA, 19 bp, Artificial sequence
  SiRNA target sequence
gcggaatttttatataatg

SEQ ID NO: 210349 - DNA, 19 bp, Artificial sequence
  SiRNA target sequence
cggaatttttatataatgg

SEQ ID NO: 210350 - DNA, 19 bp, Artificial sequence
  SiRNA target sequence
ggaatttttatataatggc

SEQ ID NO: 210351 - DNA, 19 bp, Artificial sequence
  SiRNA target sequence
gaatttttatataatggct

SEQ ID NO: 210352 - DNA, 19 bp, Artificial sequence
  SiRNA target sequence
aatttttatataatggctt

SEQ ID NO: 210353 - DNA, 19 bp, Artificial sequence
  SiRNA target sequence
atttttatataatggcttt

SEQ ID NO: 210354 - DNA, 19 bp, Artificial sequence
  SiRNA target sequence
tttttatataatggctttt

SEQ ID NO: 210355 - DNA, 19 bp, Artificial sequence
  SiRNA target sequence
ttttatataatggcttttt

SEQ ID NO: 210356 - DNA, 19 bp, Artificial sequence
  SiRNA target sequence
tttatataatggctttttt

SEQ ID NO: 210357 - DNA, 19 bp, Artificial sequence
  SiRNA target sequence
ttatataatggcttttttg

SEQ ID NO: 210358 - DNA, 19 bp, Artificial sequence
  SiRNA target sequence
tatataatggcttttttgt

SEQ ID NO: 210359 - DNA, 19 bp, Artificial sequence
  SiRNA target sequence
atataatggcttttttgta

SEQ ID NO: 210360 - DNA, 19 bp, Artificial sequence
  SiRNA target sequence
tataatggcttttttgtat

SEQ ID NO: 210361 - DNA, 19 bp, Artificial sequence
  SiRNA target sequence
ataatggcttttttgtatt

SEQ ID NO: 210362 - DNA, 19 bp, Artificial sequence
  SiRNA target sequence
taatggcttttttgtattt

SEQ ID NO: 210363 - DNA, 19 bp, Artificial sequence
  SiRNA target sequence
aatggcttttttgtatttt

SEQ ID NO: 210364 - DNA, 19 bp, Artificial sequence
  SiRNA target sequence
atggcttttttgtattttc

SEQ ID NO: 210365 - DNA, 19 bp, Artificial sequence
  SiRNA target sequence
tggcttttttgtattttct

SEQ ID NO: 210366 - DNA, 19 bp, Artificial sequence
  SiRNA target sequence
ggcttttttgtattttctg

SEQ ID NO: 210367 - DNA, 19 bp, Artificial sequence
  SiRNA target sequence
gcttttttgtattttctgg

SEQ ID NO: 210368 - DNA, 19 bp, Artificial sequence
  SiRNA target sequence
cttttttgtattttctgga

SEQ ID NO: 210369 - DNA, 19 bp, Artificial sequence
  SiRNA target sequence
ttttttgtattttctggag

SEQ ID NO: 210370 - DNA, 19 bp, Artificial sequence
  SiRNA target sequence
tttttgtattttctggagt

SEQ ID NO: 210371 - DNA, 19 bp, Artificial sequence
  SiRNA target sequence
ttttgtattttctggagtt

SEQ ID NO: 210372 - DNA, 19 bp, Artificial sequence
  SiRNA target sequence
tttgtattttctggagttc

SEQ ID NO: 210373 - DNA, 19 bp, Artificial sequence
  SiRNA target sequence
ttgtattttctggagttct

SEQ ID NO: 210374 - DNA, 19 bp, Artificial sequence
  SiRNA target sequence
tgtattttctggagttcta

SEQ ID NO: 210375 - DNA, 19 bp, Artificial sequence
  SiRNA target sequence
gtattttctggagttctag

SEQ ID NO: 210376 - DNA, 19 bp, Artificial sequence
  SiRNA target sequence
tattttctggagttctagt

SEQ ID NO: 210377 - DNA, 19 bp, Artificial sequence
  SiRNA target sequence
attttctggagttctagta

SEQ ID NO: 210378 - DNA, 19 bp, Artificial sequence
  SiRNA target sequence
ttttctggagttctagtaa

SEQ ID NO: 210379 - DNA, 19 bp, Artificial sequence
  SiRNA target sequence
tttctggagttctagtaat

SEQ ID NO: 210380 - DNA, 19 bp, Artificial sequence
  SiRNA target sequence
ttctggagttctagtaata

SEQ ID NO: 210381 - DNA, 19 bp, Artificial sequence
  SiRNA target sequence
tctggagttctagtaatag

SEQ ID NO: 210382 - DNA, 19 bp, Artificial sequence
  SiRNA target sequence
ctggagttctagtaatagt

SEQ ID NO: 210383 - DNA, 19 bp, Artificial sequence
  SiRNA target sequence
tggagttctagtaatagtt

SEQ ID NO: 210384 - DNA, 19 bp, Artificial sequence
  SiRNA target sequence
ggagttctagtaatagtta

SEQ ID NO: 210385 - DNA, 19 bp, Artificial sequence
  SiRNA target sequence
gagttctagtaatagttat

SEQ ID NO: 210386 - DNA, 19 bp, Artificial sequence
  SiRNA target sequence
agttctagtaatagttata

SEQ ID NO: 210387 - DNA, 19 bp, Artificial sequence
  SiRNA target sequence
gttctagtaatagttatat

SEQ ID NO: 210388 - DNA, 19 bp, Artificial sequence
  SiRNA target sequence
ttctagtaatagttatatt

SEQ ID NO: 210389 - DNA, 19 bp, Artificial sequence
  SiRNA target sequence
tctagtaatagttatattt

SEQ ID NO: 210390 - DNA, 19 bp, Artificial sequence
  SiRNA target sequence
ctagtaatagttatatttt

SEQ ID NO: 210391 - DNA, 19 bp, Artificial sequence
  SiRNA target sequence
tagtaatagttatattttt

SEQ ID NO: 210392 - DNA, 19 bp, Artificial sequence
  SiRNA target sequence
agtaatagttatattttta

SEQ ID NO: 210393 - DNA, 19 bp, Artificial sequence
  SiRNA target sequence
gtaatagttatatttttaa

SEQ ID NO: 210394 - DNA, 19 bp, Artificial sequence
  SiRNA target sequence
taatagttatatttttaat

SEQ ID NO: 210395 - DNA, 19 bp, Artificial sequence
  SiRNA target sequence
aatagttatatttttaatt

SEQ ID NO: 210396 - DNA, 19 bp, Artificial sequence
  SiRNA target sequence
atagttatatttttaatta

SEQ ID NO: 210397 - DNA, 19 bp, Artificial sequence
  SiRNA target sequence
tagttatatttttaattaa

SEQ ID NO: 210398 - DNA, 19 bp, Artificial sequence
  SiRNA target sequence
agttatatttttaattaaa

SEQ ID NO: 210399 - DNA, 19 bp, Artificial sequence
  SiRNA target sequence
gttatatttttaattaaaa

SEQ ID NO: 210400 - DNA, 19 bp, Artificial sequence
  SiRNA target sequence
ttatatttttaattaaaaa

SEQ ID NO: 210401 - DNA, 19 bp, Artificial sequence
  SiRNA target sequence
tatatttttaattaaaaaa

SEQ ID NO: 210402 - DNA, 19 bp, Artificial sequence
  SiRNA target sequence
atatttttaattaaaaaat

SEQ ID NO: 210403 - DNA, 19 bp, Artificial sequence
  SiRNA target sequence
tatttttaattaaaaaata

SEQ ID NO: 210404 - DNA, 19 bp, Artificial sequence
  SiRNA target sequence
atttttaattaaaaaatat

SEQ ID NO: 210405 - DNA, 19 bp, Artificial sequence
  SiRNA target sequence
tttttaattaaaaaatatt

SEQ ID NO: 210406 - DNA, 19 bp, Artificial sequence
  SiRNA target sequence
ttttaattaaaaaatattt

SEQ ID NO: 210407 - DNA, 19 bp, Artificial sequence
  SiRNA target sequence
tttaattaaaaaatatttg

SEQ ID NO: 210408 - DNA, 19 bp, Artificial sequence
  SiRNA target sequence
ttaattaaaaaatatttgg

SEQ ID NO: 210409 - DNA, 19 bp, Artificial sequence
  SiRNA target sequence
taattaaaaaatatttgga

SEQ ID NO: 210410 - DNA, 19 bp, Artificial sequence
  SiRNA target sequence
aattaaaaaatatttggag

SEQ ID NO: 210411 - DNA, 19 bp, Artificial sequence
  SiRNA target sequence
attaaaaaatatttggaga

SEQ ID NO: 210412 - DNA, 19 bp, Artificial sequence
  SiRNA target sequence
ttaaaaaatatttggagag

SEQ ID NO: 210413 - DNA, 19 bp, Artificial sequence
  SiRNA target sequence
taaaaaatatttggagagg

SEQ ID NO: 210414 - DNA, 19 bp, Artificial sequence
  SiRNA target sequence
aaaaaatatttggagagga

SEQ ID NO: 210415 - DNA, 19 bp, Artificial sequence
  SiRNA target sequence
aaaaatatttggagaggaa

SEQ ID NO: 210416 - DNA, 19 bp, Artificial sequence
  SiRNA target sequence
aaaatatttggagaggaat

SEQ ID NO: 210417 - DNA, 19 bp, Artificial sequence
  SiRNA target sequence
aaatatttggagaggaatg

SEQ ID NO: 210418 - DNA, 19 bp, Artificial sequence
  SiRNA target sequence
aatatttggagaggaatgt

SEQ ID NO: 210419 - DNA, 19 bp, Artificial sequence
  SiRNA target sequence
atatttggagaggaatgtg

SEQ ID NO: 210420 - DNA, 19 bp, Artificial sequence
  SiRNA target sequence
tatttggagaggaatgtga

SEQ ID NO: 210421 - DNA, 19 bp, Artificial sequence
  SiRNA target sequence
atttggagaggaatgtgac

SEQ ID NO: 210422 - DNA, 19 bp, Artificial sequence
  SiRNA target sequence
tttggagaggaatgtgact

SEQ ID NO: 210423 - DNA, 19 bp, Artificial sequence
  SiRNA target sequence
ttggagaggaatgtgacta

SEQ ID NO: 210424 - DNA, 19 bp, Artificial sequence
  SiRNA target sequence
tggagaggaatgtgactaa

SEQ ID NO: 210425 - DNA, 19 bp, Artificial sequence
  SiRNA target sequence
ggagaggaatgtgactaac

SEQ ID NO: 210426 - DNA, 19 bp, Artificial sequence
  SiRNA target sequence
gagaggaatgtgactaaca

SEQ ID NO: 210427 - DNA, 19 bp, Artificial sequence
  SiRNA target sequence
agaggaatgtgactaacaa

SEQ ID NO: 210428 - DNA, 19 bp, Artificial sequence
  SiRNA target sequence
gaggaatgtgactaacaaa

SEQ ID NO: 210429 - DNA, 19 bp, Artificial sequence
  SiRNA target sequence
aggaatgtgactaacaaac

SEQ ID NO: 210430 - DNA, 19 bp, Artificial sequence
  SiRNA target sequence
ggaatgtgactaacaaacc

SEQ ID NO: 210431 - DNA, 19 bp, Artificial sequence
  SiRNA target sequence
gaatgtgactaacaaacct

SEQ ID NO: 210432 - DNA, 19 bp, Artificial sequence
  SiRNA target sequence
aatgtgactaacaaacctt

SEQ ID NO: 210433 - DNA, 19 bp, Artificial sequence
  SiRNA target sequence
atgtgactaacaaaccttt

SEQ ID NO: 210434 - DNA, 19 bp, Artificial sequence
  SiRNA target sequence
tgtgactaacaaacctttg

SEQ ID NO: 210435 - DNA, 19 bp, Artificial sequence
  SiRNA target sequence
gtgactaacaaacctttgt

SEQ ID NO: 210436 - DNA, 19 bp, Artificial sequence
  SiRNA target sequence
tgactaacaaacctttgtt

SEQ ID NO: 210437 - DNA, 19 bp, Artificial sequence
  SiRNA target sequence
gactaacaaacctttgttt

SEQ ID NO: 210438 - DNA, 19 bp, Artificial sequence
  SiRNA target sequence
actaacaaacctttgtttg

SEQ ID NO: 210439 - DNA, 19 bp, Artificial sequence
  SiRNA target sequence
ctaacaaacctttgtttgt

SEQ ID NO: 210440 - DNA, 19 bp, Artificial sequence
  SiRNA target sequence
taacaaacctttgtttgtt

SEQ ID NO: 210441 - DNA, 19 bp, Artificial sequence
  SiRNA target sequence
aacaaacctttgtttgttg

SEQ ID NO: 210442 - DNA, 19 bp, Artificial sequence
  SiRNA target sequence
acaaacctttgtttgttgt

SEQ ID NO: 210443 - DNA, 19 bp, Artificial sequence
  SiRNA target sequence
caaacctttgtttgttgta

SEQ ID NO: 210444 - DNA, 19 bp, Artificial sequence
  SiRNA target sequence
aaacctttgtttgttgtaa

SEQ ID NO: 210445 - DNA, 19 bp, Artificial sequence
  SiRNA target sequence
aacctttgtttgttgtaaa

SEQ ID NO: 210446 - DNA, 19 bp, Artificial sequence
  SiRNA target sequence
acctttgtttgttgtaaaa

SEQ ID NO: 210447 - DNA, 19 bp, Artificial sequence
  SiRNA target sequence
cctttgtttgttgtaaaat

SEQ ID NO: 210448 - DNA, 19 bp, Artificial sequence
  SiRNA target sequence
ctttgtttgttgtaaaatc

SEQ ID NO: 210449 - DNA, 19 bp, Artificial sequence
  SiRNA target sequence
tttgtttgttgtaaaatct

SEQ ID NO: 210450 - DNA, 19 bp, Artificial sequence
  SiRNA target sequence
ttgtttgttgtaaaatctg

SEQ ID NO: 210451 - DNA, 19 bp, Artificial sequence
  SiRNA target sequence
tgtttgttgtaaaatctgt

SEQ ID NO: 210452 - DNA, 19 bp, Artificial sequence
  SiRNA target sequence
gtttgttgtaaaatctgtt

SEQ ID NO: 210453 - DNA, 19 bp, Artificial sequence
  SiRNA target sequence
tttgttgtaaaatctgtta

SEQ ID NO: 210454 - DNA, 19 bp, Artificial sequence
  SiRNA target sequence
ttgttgtaaaatctgttaa

SEQ ID NO: 210455 - DNA, 19 bp, Artificial sequence
  SiRNA target sequence
tgttgtaaaatctgttaaa

SEQ ID NO: 210456 - DNA, 19 bp, Artificial sequence
  SiRNA target sequence
gttgtaaaatctgttaaaa

SEQ ID NO: 210457 - DNA, 19 bp, Artificial sequence
  SiRNA target sequence
ttgtaaaatctgttaaaaa

SEQ ID NO: 210458 - DNA, 19 bp, Artificial sequence
  SiRNA target sequence
tgtaaaatctgttaaaaag

SEQ ID NO: 210459 - DNA, 19 bp, Artificial sequence
  SiRNA target sequence
gtaaaatctgttaaaaaga

SEQ ID NO: 210460 - DNA, 19 bp, Artificial sequence
  SiRNA target sequence
taaaatctgttaaaaagaa

SEQ ID NO: 210461 - DNA, 19 bp, Artificial sequence
  SiRNA target sequence
aaaatctgttaaaaagaag

SEQ ID NO: 210462 - DNA, 19 bp, Artificial sequence
  SiRNA target sequence
aaatctgttaaaaagaagg

SEQ ID NO: 210463 - DNA, 19 bp, Artificial sequence
  SiRNA target sequence
aatctgttaaaaagaaggg

SEQ ID NO: 210464 - DNA, 19 bp, Artificial sequence
  SiRNA target sequence
atctgttaaaaagaaggga

SEQ ID NO: 210465 - DNA, 19 bp, Artificial sequence
  SiRNA target sequence
tctgttaaaaagaagggac

SEQ ID NO: 210466 - DNA, 19 bp, Artificial sequence
  SiRNA target sequence
ctgttaaaaagaagggacc

SEQ ID NO: 210467 - DNA, 19 bp, Artificial sequence
  SiRNA target sequence
tgttaaaaagaagggacca

SEQ ID NO: 210468 - DNA, 19 bp, Artificial sequence
  SiRNA target sequence
gttaaaaagaagggaccaa

SEQ ID NO: 210469 - DNA, 19 bp, Artificial sequence
  SiRNA target sequence
ttaaaaagaagggaccaaa

SEQ ID NO: 210470 - DNA, 19 bp, Artificial sequence
  SiRNA target sequence
taaaaagaagggaccaaaa

SEQ ID NO: 210471 - DNA, 19 bp, Artificial sequence
  SiRNA target sequence
aaaaagaagggaccaaaag

SEQ ID NO: 210472 - DNA, 19 bp, Artificial sequence
  SiRNA target sequence
aaaagaagggaccaaaagt

SEQ ID NO: 210473 - DNA, 19 bp, Artificial sequence
  SiRNA target sequence
aaagaagggaccaaaagtt

SEQ ID NO: 210474 - DNA, 19 bp, Artificial sequence
  SiRNA target sequence
aagaagggaccaaaagtta

SEQ ID NO: 210475 - DNA, 19 bp, Artificial sequence
  SiRNA target sequence
agaagggaccaaaagttaa

SEQ ID NO: 210476 - DNA, 19 bp, Artificial sequence
  SiRNA target sequence
gaagggaccaaaagttaaa

SEQ ID NO: 210477 - DNA, 19 bp, Artificial sequence
  SiRNA target sequence
aagggaccaaaagttaaag

SEQ ID NO: 210478 - DNA, 19 bp, Artificial sequence
  SiRNA target sequence
agggaccaaaagttaaagt

SEQ ID NO: 210479 - DNA, 19 bp, Artificial sequence
  SiRNA target sequence
gggaccaaaagttaaagta

SEQ ID NO: 210480 - DNA, 19 bp, Artificial sequence
  SiRNA target sequence
ggaccaaaagttaaagtag

SEQ ID NO: 210481 - DNA, 19 bp, Artificial sequence
  SiRNA target sequence
gaccaaaagttaaagtagg

SEQ ID NO: 210482 - DNA, 19 bp, Artificial sequence
  SiRNA target sequence
accaaaagttaaagtagga

SEQ ID NO: 210483 - DNA, 19 bp, Artificial sequence
  SiRNA target sequence
ccaaaagttaaagtaggat

SEQ ID NO: 210484 - DNA, 19 bp, Artificial sequence
  SiRNA target sequence
caaaagttaaagtaggatt

SEQ ID NO: 210485 - DNA, 19 bp, Artificial sequence
  SiRNA target sequence
aaaagttaaagtaggattt

SEQ ID NO: 210486 - DNA, 19 bp, Artificial sequence
  SiRNA target sequence
aaagttaaagtaggatttg

SEQ ID NO: 210487 - DNA, 19 bp, Artificial sequence
  SiRNA target sequence
aagttaaagtaggatttgc

SEQ ID NO: 210488 - DNA, 19 bp, Artificial sequence
  SiRNA target sequence
agttaaagtaggatttgcg

SEQ ID NO: 210489 - DNA, 19 bp, Artificial sequence
  SiRNA target sequence
gttaaagtaggatttgcgg

SEQ ID NO: 210490 - DNA, 19 bp, Artificial sequence
  SiRNA target sequence
ttaaagtaggatttgcgga

SEQ ID NO: 210491 - DNA, 19 bp, Artificial sequence
  SiRNA target sequence
taaagtaggatttgcggag

SEQ ID NO: 210492 - DNA, 19 bp, Artificial sequence
  SiRNA target sequence
aaagtaggatttgcggagg

SEQ ID NO: 210493 - DNA, 19 bp, Artificial sequence
  SiRNA target sequence
aagtaggatttgcggaggg

SEQ ID NO: 210494 - DNA, 19 bp, Artificial sequence
  SiRNA target sequence
agtaggatttgcggagggc

SEQ ID NO: 210495 - DNA, 19 bp, Artificial sequence
  SiRNA target sequence
gtaggatttgcggagggcc

SEQ ID NO: 210496 - DNA, 19 bp, Artificial sequence
  SiRNA target sequence
taggatttgcggagggcct

SEQ ID NO: 210497 - DNA, 19 bp, Artificial sequence
  SiRNA target sequence
aggatttgcggagggcctt

SEQ ID NO: 210498 - DNA, 19 bp, Artificial sequence
  SiRNA target sequence
ggatttgcggagggcctta

SEQ ID NO: 210499 - DNA, 19 bp, Artificial sequence
  SiRNA target sequence
gatttgcggagggccttaa

SEQ ID NO: 210500 - DNA, 19 bp, Artificial sequence
  SiRNA target sequence
atttgcggagggccttaaa

SEQ ID NO: 210501 - DNA, 19 bp, Artificial sequence
  SiRNA target sequence
tttgcggagggccttaaag

SEQ ID NO: 210502 - DNA, 19 bp, Artificial sequence
  SiRNA target sequence
ttgcggagggccttaaaga

SEQ ID NO: 210503 - DNA, 19 bp, Artificial sequence
  SiRNA target sequence
tgcggagggccttaaagaa

SEQ ID NO: 210504 - DNA, 19 bp, Artificial sequence
  SiRNA target sequence
gcggagggccttaaagaaa

SEQ ID NO: 210505 - DNA, 19 bp, Artificial sequence
  SiRNA target sequence
cggagggccttaaagaaat

SEQ ID NO: 210506 - DNA, 19 bp, Artificial sequence
  SiRNA target sequence
ggagggccttaaagaaatg

SEQ ID NO: 210507 - DNA, 19 bp, Artificial sequence
  SiRNA target sequence
gagggccttaaagaaatga

SEQ ID NO: 210508 - DNA, 19 bp, Artificial sequence
  SiRNA target sequence
agggccttaaagaaatgat

SEQ ID NO: 210509 - DNA, 19 bp, Artificial sequence
  SiRNA target sequence
gggccttaaagaaatgatg

SEQ ID NO: 210510 - DNA, 19 bp, Artificial sequence
  SiRNA target sequence
ggccttaaagaaatgatgg

SEQ ID NO: 210511 - DNA, 19 bp, Artificial sequence
  SiRNA target sequence
gccttaaagaaatgatggc

SEQ ID NO: 210512 - DNA, 19 bp, Artificial sequence
  SiRNA target sequence
ccttaaagaaatgatggca

SEQ ID NO: 210513 - DNA, 19 bp, Artificial sequence
  SiRNA target sequence
cttaaagaaatgatggcat

SEQ ID NO: 210514 - DNA, 19 bp, Artificial sequence
  SiRNA target sequence
ttaaagaaatgatggcatc

SEQ ID NO: 210515 - DNA, 19 bp, Artificial sequence
  SiRNA target sequence
taaagaaatgatggcatca

SEQ ID NO: 210516 - DNA, 19 bp, Artificial sequence
  SiRNA target sequence
aaagaaatgatggcatcaa

SEQ ID NO: 210517 - DNA, 19 bp, Artificial sequence
  SiRNA target sequence
aagaaatgatggcatcaaa

SEQ ID NO: 210518 - DNA, 19 bp, Artificial sequence
  SiRNA target sequence
agaaatgatggcatcaaag

SEQ ID NO: 210519 - DNA, 19 bp, Artificial sequence
  SiRNA target sequence
gaaatgatggcatcaaagt

SEQ ID NO: 210520 - DNA, 19 bp, Artificial sequence
  SiRNA target sequence
aaatgatggcatcaaagtt

SEQ ID NO: 210521 - DNA, 19 bp, Artificial sequence
  SiRNA target sequence
aatgatggcatcaaagtta

SEQ ID NO: 210522 - DNA, 19 bp, Artificial sequence
  SiRNA target sequence
atgatggcatcaaagttat

SEQ ID NO: 210523 - DNA, 19 bp, Artificial sequence
  SiRNA target sequence
tgatggcatcaaagttatt

SEQ ID NO: 210524 - DNA, 19 bp, Artificial sequence
  SiRNA target sequence
gatggcatcaaagttatta

SEQ ID NO: 210525 - DNA, 19 bp, Artificial sequence
  SiRNA target sequence
atggcatcaaagttattac

SEQ ID NO: 210526 - DNA, 19 bp, Artificial sequence
  SiRNA target sequence
tggcatcaaagttattact

SEQ ID NO: 210527 - DNA, 19 bp, Artificial sequence
  SiRNA target sequence
ggcatcaaagttattactt

SEQ ID NO: 210528 - DNA, 19 bp, Artificial sequence
  SiRNA target sequence
gcatcaaagttattactta

SEQ ID NO: 210529 - DNA, 19 bp, Artificial sequence
  SiRNA target sequence
catcaaagttattacttaa

SEQ ID NO: 210530 - DNA, 19 bp, Artificial sequence
  SiRNA target sequence
atcaaagttattacttaac

SEQ ID NO: 210531 - DNA, 19 bp, Artificial sequence
  SiRNA target sequence
tcaaagttattacttaaca

SEQ ID NO: 210532 - DNA, 19 bp, Artificial sequence
  SiRNA target sequence
caaagttattacttaacat

SEQ ID NO: 210533 - DNA, 19 bp, Artificial sequence
  SiRNA target sequence
aaagttattacttaacatt

SEQ ID NO: 210534 - DNA, 19 bp, Artificial sequence
  SiRNA target sequence
aagttattacttaacattt

SEQ ID NO: 210535 - DNA, 19 bp, Artificial sequence
  SiRNA target sequence
agttattacttaacatttc

SEQ ID NO: 210536 - DNA, 19 bp, Artificial sequence
  SiRNA target sequence
gttattacttaacatttca

SEQ ID NO: 210537 - DNA, 19 bp, Artificial sequence
  SiRNA target sequence
ttattacttaacatttcat

SEQ ID NO: 210538 - DNA, 19 bp, Artificial sequence
  SiRNA target sequence
tattacttaacatttcatt

SEQ ID NO: 210539 - DNA, 19 bp, Artificial sequence
  SiRNA target sequence
attacttaacatttcatta

SEQ ID NO: 210540 - DNA, 19 bp, Artificial sequence
  SiRNA target sequence
ttacttaacatttcattaa

SEQ ID NO: 210541 - DNA, 19 bp, Artificial sequence
  SiRNA target sequence
tacttaacatttcattaac

SEQ ID NO: 210542 - DNA, 19 bp, Artificial sequence
  SiRNA target sequence
acttaacatttcattaact

SEQ ID NO: 210543 - DNA, 19 bp, Artificial sequence
  SiRNA target sequence
cttaacatttcattaactg

SEQ ID NO: 210544 - DNA, 19 bp, Artificial sequence
  SiRNA target sequence
ttaacatttcattaactgt

SEQ ID NO: 210545 - DNA, 19 bp, Artificial sequence
  SiRNA target sequence
taacatttcattaactgtt

SEQ ID NO: 210546 - DNA, 19 bp, Artificial sequence
  SiRNA target sequence
aacatttcattaactgtta

SEQ ID NO: 210547 - DNA, 19 bp, Artificial sequence
  SiRNA target sequence
acatttcattaactgttat

SEQ ID NO: 210548 - DNA, 19 bp, Artificial sequence
  SiRNA target sequence
catttcattaactgttatg

SEQ ID NO: 210549 - DNA, 19 bp, Artificial sequence
  SiRNA target sequence
atttcattaactgttatgt

SEQ ID NO: 210550 - DNA, 19 bp, Artificial sequence
  SiRNA target sequence
tttcattaactgttatgtt

SEQ ID NO: 210551 - DNA, 19 bp, Artificial sequence
  SiRNA target sequence
ttcattaactgttatgttc

SEQ ID NO: 210552 - DNA, 19 bp, Artificial sequence
  SiRNA target sequence
tcattaactgttatgttct

SEQ ID NO: 210553 - DNA, 19 bp, Artificial sequence
  SiRNA target sequence
cattaactgttatgttcta

SEQ ID NO: 210554 - DNA, 19 bp, Artificial sequence
  SiRNA target sequence
attaactgttatgttctat

SEQ ID NO: 210555 - DNA, 19 bp, Artificial sequence
  SiRNA target sequence
ttaactgttatgttctatg

SEQ ID NO: 210556 - DNA, 19 bp, Artificial sequence
  SiRNA target sequence
taactgttatgttctatgg

SEQ ID NO: 210557 - DNA, 19 bp, Artificial sequence
  SiRNA target sequence
aactgttatgttctatggt

SEQ ID NO: 210558 - DNA, 19 bp, Artificial sequence
  SiRNA target sequence
actgttatgttctatggta

SEQ ID NO: 210559 - DNA, 19 bp, Artificial sequence
  SiRNA target sequence
ctgttatgttctatggtat

SEQ ID NO: 210560 - DNA, 19 bp, Artificial sequence
  SiRNA target sequence
tgttatgttctatggtata

SEQ ID NO: 210561 - DNA, 19 bp, Artificial sequence
  SiRNA target sequence
gttatgttctatggtatat

SEQ ID NO: 210562 - DNA, 19 bp, Artificial sequence
  SiRNA target sequence
ttatgttctatggtatatc

SEQ ID NO: 210563 - DNA, 19 bp, Artificial sequence
  SiRNA target sequence
tatgttctatggtatatca

SEQ ID NO: 210564 - DNA, 19 bp, Artificial sequence
  SiRNA target sequence
atgttctatggtatatcaa

SEQ ID NO: 210565 - DNA, 19 bp, Artificial sequence
  SiRNA target sequence
tgttctatggtatatcaac

SEQ ID NO: 210566 - DNA, 19 bp, Artificial sequence
  SiRNA target sequence
gttctatggtatatcaact

SEQ ID NO: 210567 - DNA, 19 bp, Artificial sequence
  SiRNA target sequence
ttctatggtatatcaacta

SEQ ID NO: 210568 - DNA, 19 bp, Artificial sequence
  SiRNA target sequence
tctatggtatatcaactaa

SEQ ID NO: 210569 - DNA, 19 bp, Artificial sequence
  SiRNA target sequence
ctatggtatatcaactaat

SEQ ID NO: 210570 - DNA, 19 bp, Artificial sequence
  SiRNA target sequence
tatggtatatcaactaatt

SEQ ID NO: 210571 - DNA, 19 bp, Artificial sequence
  SiRNA target sequence
atggtatatcaactaattt

SEQ ID NO: 210572 - DNA, 19 bp, Artificial sequence
  SiRNA target sequence
tggtatatcaactaattta

SEQ ID NO: 210573 - DNA, 19 bp, Artificial sequence
  SiRNA target sequence
ggtatatcaactaatttaa

SEQ ID NO: 210574 - DNA, 19 bp, Artificial sequence
  SiRNA target sequence
gtatatcaactaatttaat

SEQ ID NO: 210575 - DNA, 19 bp, Artificial sequence
  SiRNA target sequence
tatatcaactaatttaata

SEQ ID NO: 210576 - DNA, 19 bp, Artificial sequence
  SiRNA target sequence
atatcaactaatttaatag

SEQ ID NO: 210577 - DNA, 19 bp, Artificial sequence
  SiRNA target sequence
tatcaactaatttaataga

SEQ ID NO: 210578 - DNA, 19 bp, Artificial sequence
  SiRNA target sequence
atcaactaatttaatagaa

SEQ ID NO: 210579 - DNA, 19 bp, Artificial sequence
  SiRNA target sequence
tcaactaatttaatagaat

SEQ ID NO: 210580 - DNA, 19 bp, Artificial sequence
  SiRNA target sequence
caactaatttaatagaatc

SEQ ID NO: 210581 - DNA, 19 bp, Artificial sequence
  SiRNA target sequence
aactaatttaatagaatca

SEQ ID NO: 210582 - DNA, 19 bp, Artificial sequence
  SiRNA target sequence
actaatttaatagaatcaa

SEQ ID NO: 210583 - DNA, 19 bp, Artificial sequence
  SiRNA target sequence
ctaatttaatagaatcaac

SEQ ID NO: 210584 - DNA, 19 bp, Artificial sequence
  SiRNA target sequence
taatttaatagaatcaaca

SEQ ID NO: 210585 - DNA, 19 bp, Artificial sequence
  SiRNA target sequence
aatttaatagaatcaacat

SEQ ID NO: 210586 - DNA, 19 bp, Artificial sequence
  SiRNA target sequence
atttaatagaatcaacatt

SEQ ID NO: 210587 - DNA, 19 bp, Artificial sequence
  SiRNA target sequence
tttaatagaatcaacattt

SEQ ID NO: 210588 - DNA, 19 bp, Artificial sequence
  SiRNA target sequence
ttaatagaatcaacattta

SEQ ID NO: 210589 - DNA, 19 bp, Artificial sequence
  SiRNA target sequence
taatagaatcaacatttaa

SEQ ID NO: 210590 - DNA, 19 bp, Artificial sequence
  SiRNA target sequence
aatagaatcaacatttaaa

SEQ ID NO: 210591 - DNA, 19 bp, Artificial sequence
  SiRNA target sequence
atagaatcaacatttaaaa

SEQ ID NO: 210592 - DNA, 19 bp, Artificial sequence
  SiRNA target sequence
tagaatcaacatttaaaag

SEQ ID NO: 210593 - DNA, 19 bp, Artificial sequence
  SiRNA target sequence
agaatcaacatttaaaagt

SEQ ID NO: 210594 - DNA, 19 bp, Artificial sequence
  SiRNA target sequence
gaatcaacatttaaaagtg

SEQ ID NO: 210595 - DNA, 19 bp, Artificial sequence
  SiRNA target sequence
aatcaacatttaaaagtgg

SEQ ID NO: 210596 - DNA, 19 bp, Artificial sequence
  SiRNA target sequence
atcaacatttaaaagtgga

SEQ ID NO: 210597 - DNA, 19 bp, Artificial sequence
  SiRNA target sequence
tcaacatttaaaagtggac

SEQ ID NO: 210598 - DNA, 19 bp, Artificial sequence
  SiRNA target sequence
caacatttaaaagtggact

SEQ ID NO: 210599 - DNA, 19 bp, Artificial sequence
  SiRNA target sequence
aacatttaaaagtggactt

SEQ ID NO: 210600 - DNA, 19 bp, Artificial sequence
  SiRNA target sequence
acatttaaaagtggacttg

SEQ ID NO: 210601 - DNA, 19 bp, Artificial sequence
  SiRNA target sequence
catttaaaagtggacttgt

SEQ ID NO: 210602 - DNA, 19 bp, Artificial sequence
  SiRNA target sequence
atttaaaagtggacttgtg

SEQ ID NO: 210603 - DNA, 19 bp, Artificial sequence
  SiRNA target sequence
tttaaaagtggacttgtga

SEQ ID NO: 210604 - DNA, 19 bp, Artificial sequence
  SiRNA target sequence
ttaaaagtggacttgtgaa

SEQ ID NO: 210605 - DNA, 19 bp, Artificial sequence
  SiRNA target sequence
taaaagtggacttgtgaaa

SEQ ID NO: 210606 - DNA, 19 bp, Artificial sequence
  SiRNA target sequence
aaaagtggacttgtgaaag

SEQ ID NO: 210607 - DNA, 19 bp, Artificial sequence
  SiRNA target sequence
aaagtggacttgtgaaagg

SEQ ID NO: 210608 - DNA, 19 bp, Artificial sequence
  SiRNA target sequence
aagtggacttgtgaaaggt

SEQ ID NO: 210609 - DNA, 19 bp, Artificial sequence
  SiRNA target sequence
agtggacttgtgaaaggtg

SEQ ID NO: 210610 - DNA, 19 bp, Artificial sequence
  SiRNA target sequence
gtggacttgtgaaaggtgc

SEQ ID NO: 210611 - DNA, 19 bp, Artificial sequence
  SiRNA target sequence
tggacttgtgaaaggtgca

SEQ ID NO: 210612 - DNA, 19 bp, Artificial sequence
  SiRNA target sequence
ggacttgtgaaaggtgcag

SEQ ID NO: 210613 - DNA, 19 bp, Artificial sequence
  SiRNA target sequence
gacttgtgaaaggtgcaga

SEQ ID NO: 210614 - DNA, 19 bp, Artificial sequence
  SiRNA target sequence
acttgtgaaaggtgcagaa

SEQ ID NO: 210615 - DNA, 19 bp, Artificial sequence
  SiRNA target sequence
cttgtgaaaggtgcagaag

SEQ ID NO: 210616 - DNA, 19 bp, Artificial sequence
  SiRNA target sequence
ttgtgaaaggtgcagaaga

SEQ ID NO: 210617 - DNA, 19 bp, Artificial sequence
  SiRNA target sequence
tgtgaaaggtgcagaagaa

SEQ ID NO: 210618 - DNA, 19 bp, Artificial sequence
  SiRNA target sequence
gtgaaaggtgcagaagaat

SEQ ID NO: 210619 - DNA, 19 bp, Artificial sequence
  SiRNA target sequence
tgaaaggtgcagaagaatt

SEQ ID NO: 210620 - DNA, 19 bp, Artificial sequence
  SiRNA target sequence
gaaaggtgcagaagaatta

SEQ ID NO: 210621 - DNA, 19 bp, Artificial sequence
  SiRNA target sequence
aaaggtgcagaagaattaa

SEQ ID NO: 210622 - DNA, 19 bp, Artificial sequence
  SiRNA target sequence
aaggtgcagaagaattaaa

SEQ ID NO: 210623 - DNA, 19 bp, Artificial sequence
  SiRNA target sequence
aggtgcagaagaattaaac

SEQ ID NO: 210624 - DNA, 19 bp, Artificial sequence
  SiRNA target sequence
ggtgcagaagaattaaacg

SEQ ID NO: 210625 - DNA, 19 bp, Artificial sequence
  SiRNA target sequence
gtgcagaagaattaaacga

SEQ ID NO: 210626 - DNA, 19 bp, Artificial sequence
  SiRNA target sequence
tgcagaagaattaaacgag

SEQ ID NO: 210627 - DNA, 19 bp, Artificial sequence
  SiRNA target sequence
gcagaagaattaaacgaga

SEQ ID NO: 210628 - DNA, 19 bp, Artificial sequence
  SiRNA target sequence
cagaagaattaaacgagaa

SEQ ID NO: 210629 - DNA, 19 bp, Artificial sequence
  SiRNA target sequence
agaagaattaaacgagaat

SEQ ID NO: 210630 - DNA, 19 bp, Artificial sequence
  SiRNA target sequence
gaagaattaaacgagaata

SEQ ID NO: 210631 - DNA, 19 bp, Artificial sequence
  SiRNA target sequence
aagaattaaacgagaatac

SEQ ID NO: 210632 - DNA, 19 bp, Artificial sequence
  SiRNA target sequence
agaattaaacgagaatact

SEQ ID NO: 210633 - DNA, 19 bp, Artificial sequence
  SiRNA target sequence
gaattaaacgagaatacta

SEQ ID NO: 210634 - DNA, 19 bp, Artificial sequence
  SiRNA target sequence
aattaaacgagaatactaa

SEQ ID NO: 210635 - DNA, 19 bp, Artificial sequence
  SiRNA target sequence
attaaacgagaatactaaa

SEQ ID NO: 210636 - DNA, 19 bp, Artificial sequence
  SiRNA target sequence
ttaaacgagaatactaaaa

SEQ ID NO: 210637 - DNA, 19 bp, Artificial sequence
  SiRNA target sequence
taaacgagaatactaaaag

SEQ ID NO: 210638 - DNA, 19 bp, Artificial sequence
  SiRNA target sequence
aaacgagaatactaaaagt

SEQ ID NO: 210639 - DNA, 19 bp, Artificial sequence
  SiRNA target sequence
aacgagaatactaaaagtt

SEQ ID NO: 210640 - DNA, 19 bp, Artificial sequence
  SiRNA target sequence
acgagaatactaaaagtta

SEQ ID NO: 210641 - DNA, 19 bp, Artificial sequence
  SiRNA target sequence
cgagaatactaaaagttat

SEQ ID NO: 210642 - DNA, 19 bp, Artificial sequence
  SiRNA target sequence
gagaatactaaaagttatt

SEQ ID NO: 210643 - DNA, 19 bp, Artificial sequence
  SiRNA target sequence
agaatactaaaagttattc

SEQ ID NO: 210644 - DNA, 19 bp, Artificial sequence
  SiRNA target sequence
gaatactaaaagttattct

SEQ ID NO: 210645 - DNA, 19 bp, Artificial sequence
  SiRNA target sequence
aatactaaaagttattcta

SEQ ID NO: 210646 - DNA, 19 bp, Artificial sequence
  SiRNA target sequence
atactaaaagttattctat

SEQ ID NO: 210647 - DNA, 19 bp, Artificial sequence
  SiRNA target sequence
tactaaaagttattctatg

SEQ ID NO: 210648 - DNA, 19 bp, Artificial sequence
  SiRNA target sequence
actaaaagttattctatgg

SEQ ID NO: 210649 - DNA, 19 bp, Artificial sequence
  SiRNA target sequence
ctaaaagttattctatggg

SEQ ID NO: 210650 - DNA, 19 bp, Artificial sequence
  SiRNA target sequence
taaaagttattctatggga

SEQ ID NO: 210651 - DNA, 19 bp, Artificial sequence
  SiRNA target sequence
aaaagttattctatgggat

SEQ ID NO: 210652 - DNA, 19 bp, Artificial sequence
  SiRNA target sequence
aaagttattctatgggata

SEQ ID NO: 210653 - DNA, 19 bp, Artificial sequence
  SiRNA target sequence
aagttattctatgggatat

SEQ ID NO: 210654 - DNA, 19 bp, Artificial sequence
  SiRNA target sequence
agttattctatgggatata

SEQ ID NO: 210655 - DNA, 19 bp, Artificial sequence
  SiRNA target sequence
gttattctatgggatataa

SEQ ID NO: 210656 - DNA, 19 bp, Artificial sequence
  SiRNA target sequence
ttattctatgggatataat

SEQ ID NO: 210657 - DNA, 19 bp, Artificial sequence
  SiRNA target sequence
tattctatgggatataatt

SEQ ID NO: 210658 - DNA, 19 bp, Artificial sequence
  SiRNA target sequence
attctatgggatataattc

SEQ ID NO: 210659 - DNA, 19 bp, Artificial sequence
  SiRNA target sequence
ttctatgggatataattca

SEQ ID NO: 210660 - DNA, 19 bp, Artificial sequence
  SiRNA target sequence
tctatgggatataattcat

SEQ ID NO: 210661 - DNA, 19 bp, Artificial sequence
  SiRNA target sequence
ctatgggatataattcatt

SEQ ID NO: 210662 - DNA, 19 bp, Artificial sequence
  SiRNA target sequence
tatgggatataattcattt

SEQ ID NO: 210663 - DNA, 19 bp, Artificial sequence
  SiRNA target sequence
atgggatataattcatttg

SEQ ID NO: 210664 - DNA, 19 bp, Artificial sequence
  SiRNA target sequence
tgggatataattcatttga

SEQ ID NO: 210665 - DNA, 19 bp, Artificial sequence
  SiRNA target sequence
gggatataattcatttgaa

SEQ ID NO: 210666 - DNA, 19 bp, Artificial sequence
  SiRNA target sequence
ggatataattcatttgaac

SEQ ID NO: 210667 - DNA, 19 bp, Artificial sequence
  SiRNA target sequence
gatataattcatttgaaca

SEQ ID NO: 210668 - DNA, 19 bp, Artificial sequence
  SiRNA target sequence
atataattcatttgaacaa

SEQ ID NO: 210669 - DNA, 19 bp, Artificial sequence
  SiRNA target sequence
tataattcatttgaacaaa

SEQ ID NO: 210670 - DNA, 19 bp, Artificial sequence
  SiRNA target sequence
ataattcatttgaacaaaa

SEQ ID NO: 210671 - DNA, 19 bp, Artificial sequence
  SiRNA target sequence
taattcatttgaacaaaag

SEQ ID NO: 210672 - DNA, 19 bp, Artificial sequence
  SiRNA target sequence
aattcatttgaacaaaaga

SEQ ID NO: 210673 - DNA, 19 bp, Artificial sequence
  SiRNA target sequence
attcatttgaacaaaagat

SEQ ID NO: 210674 - DNA, 19 bp, Artificial sequence
  SiRNA target sequence
ttcatttgaacaaaagata

SEQ ID NO: 210675 - DNA, 19 bp, Artificial sequence
  SiRNA target sequence
tcatttgaacaaaagatag

SEQ ID NO: 210676 - DNA, 19 bp, Artificial sequence
  SiRNA target sequence
catttgaacaaaagatagc

SEQ ID NO: 210677 - DNA, 19 bp, Artificial sequence
  SiRNA target sequence
atttgaacaaaagatagca

SEQ ID NO: 210678 - DNA, 19 bp, Artificial sequence
  SiRNA target sequence
tttgaacaaaagatagcat

SEQ ID NO: 210679 - DNA, 19 bp, Artificial sequence
  SiRNA target sequence
ttgaacaaaagatagcatc

SEQ ID NO: 210680 - DNA, 19 bp, Artificial sequence
  SiRNA target sequence
tgaacaaaagatagcatca

SEQ ID NO: 210681 - DNA, 19 bp, Artificial sequence
  SiRNA target sequence
gaacaaaagatagcatcaa

SEQ ID NO: 210682 - DNA, 19 bp, Artificial sequence
  SiRNA target sequence
aacaaaagatagcatcaat

SEQ ID NO: 210683 - DNA, 19 bp, Artificial sequence
  SiRNA target sequence
acaaaagatagcatcaata

SEQ ID NO: 210684 - DNA, 19 bp, Artificial sequence
  SiRNA target sequence
caaaagatagcatcaataa

SEQ ID NO: 210685 - DNA, 19 bp, Artificial sequence
  SiRNA target sequence
aaaagatagcatcaataac

SEQ ID NO: 210686 - DNA, 19 bp, Artificial sequence
  SiRNA target sequence
aaagatagcatcaataact

SEQ ID NO: 210687 - DNA, 19 bp, Artificial sequence
  SiRNA target sequence
aagatagcatcaataactg

SEQ ID NO: 210688 - DNA, 19 bp, Artificial sequence
  SiRNA target sequence
agatagcatcaataactgt

SEQ ID NO: 210689 - DNA, 19 bp, Artificial sequence
  SiRNA target sequence
gatagcatcaataactgtt

SEQ ID NO: 210690 - DNA, 19 bp, Artificial sequence
  SiRNA target sequence
atagcatcaataactgtta

SEQ ID NO: 210691 - DNA, 19 bp, Artificial sequence
  SiRNA target sequence
tagcatcaataactgttat

SEQ ID NO: 210692 - DNA, 19 bp, Artificial sequence
  SiRNA target sequence
agcatcaataactgttatt

SEQ ID NO: 210693 - DNA, 19 bp, Artificial sequence
  SiRNA target sequence
gcatcaataactgttatta

SEQ ID NO: 210694 - DNA, 19 bp, Artificial sequence
  SiRNA target sequence
catcaataactgttattat

SEQ ID NO: 210695 - DNA, 19 bp, Artificial sequence
  SiRNA target sequence
atcaataactgttattatc

SEQ ID NO: 210696 - DNA, 19 bp, Artificial sequence
  SiRNA target sequence
tcaataactgttattatcc

SEQ ID NO: 210697 - DNA, 19 bp, Artificial sequence
  SiRNA target sequence
caataactgttattatcct

SEQ ID NO: 210698 - DNA, 19 bp, Artificial sequence
  SiRNA target sequence
aataactgttattatcctg

SEQ ID NO: 210699 - DNA, 19 bp, Artificial sequence
  SiRNA target sequence
ataactgttattatcctgc

SEQ ID NO: 210700 - DNA, 19 bp, Artificial sequence
  SiRNA target sequence
taactgttattatcctgct

SEQ ID NO: 210701 - DNA, 19 bp, Artificial sequence
  SiRNA target sequence
aactgttattatcctgctt

SEQ ID NO: 210702 - DNA, 19 bp, Artificial sequence
  SiRNA target sequence
actgttattatcctgcttt

SEQ ID NO: 210703 - DNA, 19 bp, Artificial sequence
  SiRNA target sequence
ctgttattatcctgctttt

SEQ ID NO: 210704 - DNA, 19 bp, Artificial sequence
  SiRNA target sequence
tgttattatcctgctttta

SEQ ID NO: 210705 - DNA, 19 bp, Artificial sequence
  SiRNA target sequence
gttattatcctgcttttat

SEQ ID NO: 210706 - DNA, 19 bp, Artificial sequence
  SiRNA target sequence
ttattatcctgcttttatc

SEQ ID NO: 210707 - DNA, 19 bp, Artificial sequence
  SiRNA target sequence
tattatcctgcttttatca

SEQ ID NO: 210708 - DNA, 19 bp, Artificial sequence
  SiRNA target sequence
attatcctgcttttatcac

SEQ ID NO: 210709 - DNA, 19 bp, Artificial sequence
  SiRNA target sequence
ttatcctgcttttatcacc

SEQ ID NO: 210710 - DNA, 19 bp, Artificial sequence
  SiRNA target sequence
tatcctgcttttatcacca

SEQ ID NO: 210711 - DNA, 19 bp, Artificial sequence
  SiRNA target sequence
atcctgcttttatcaccat

SEQ ID NO: 210712 - DNA, 19 bp, Artificial sequence
  SiRNA target sequence
tcctgcttttatcaccatt

SEQ ID NO: 210713 - DNA, 19 bp, Artificial sequence
  SiRNA target sequence
cctgcttttatcaccattt

SEQ ID NO: 210714 - DNA, 19 bp, Artificial sequence
  SiRNA target sequence
ctgcttttatcaccatttc

SEQ ID NO: 210715 - DNA, 19 bp, Artificial sequence
  SiRNA target sequence
tgcttttatcaccatttcc

SEQ ID NO: 210716 - DNA, 19 bp, Artificial sequence
  SiRNA target sequence
gcttttatcaccatttcca

SEQ ID NO: 210717 - DNA, 19 bp, Artificial sequence
  SiRNA target sequence
cttttatcaccatttccaa

SEQ ID NO: 210718 - DNA, 19 bp, Artificial sequence
  SiRNA target sequence
ttttatcaccatttccaaa

SEQ ID NO: 210719 - DNA, 19 bp, Artificial sequence
  SiRNA target sequence
tttatcaccatttccaaaa

SEQ ID NO: 210720 - DNA, 19 bp, Artificial sequence
  SiRNA target sequence
ttatcaccatttccaaaat

SEQ ID NO: 210721 - DNA, 19 bp, Artificial sequence
  SiRNA target sequence
tatcaccatttccaaaatt

SEQ ID NO: 210722 - DNA, 19 bp, Artificial sequence
  SiRNA target sequence
atcaccatttccaaaatta

SEQ ID NO: 210723 - DNA, 19 bp, Artificial sequence
  SiRNA target sequence
tcaccatttccaaaattaa

SEQ ID NO: 210724 - DNA, 19 bp, Artificial sequence
  SiRNA target sequence
caccatttccaaaattaat

SEQ ID NO: 210725 - DNA, 19 bp, Artificial sequence
  SiRNA target sequence
accatttccaaaattaata

SEQ ID NO: 210726 - DNA, 19 bp, Artificial sequence
  SiRNA target sequence
ccatttccaaaattaatac

SEQ ID NO: 210727 - DNA, 19 bp, Artificial sequence
  SiRNA target sequence
catttccaaaattaataca

SEQ ID NO: 210728 - DNA, 19 bp, Artificial sequence
  SiRNA target sequence
atttccaaaattaatacaa

SEQ ID NO: 210729 - DNA, 19 bp, Artificial sequence
  SiRNA target sequence
tttccaaaattaatacaaa

SEQ ID NO: 210730 - DNA, 19 bp, Artificial sequence
  SiRNA target sequence
ttccaaaattaatacaaac

SEQ ID NO: 210731 - DNA, 19 bp, Artificial sequence
  SiRNA target sequence
tccaaaattaatacaaacc

SEQ ID NO: 210732 - DNA, 19 bp, Artificial sequence
  SiRNA target sequence
ccaaaattaatacaaacca

SEQ ID NO: 210733 - DNA, 19 bp, Artificial sequence
  SiRNA target sequence
caaaattaatacaaaccaa

SEQ ID NO: 210734 - DNA, 19 bp, Artificial sequence
  SiRNA target sequence
aaaattaatacaaaccaaa

SEQ ID NO: 210735 - DNA, 19 bp, Artificial sequence
  SiRNA target sequence
aaattaatacaaaccaaag

SEQ ID NO: 210736 - DNA, 19 bp, Artificial sequence
  SiRNA target sequence
aattaatacaaaccaaagg

SEQ ID NO: 210737 - DNA, 19 bp, Artificial sequence
  SiRNA target sequence
attaatacaaaccaaagga

SEQ ID NO: 210738 - DNA, 19 bp, Artificial sequence
  SiRNA target sequence
ttaatacaaaccaaaggat

SEQ ID NO: 210739 - DNA, 19 bp, Artificial sequence
  SiRNA target sequence
taatacaaaccaaaggatg

SEQ ID NO: 210740 - DNA, 19 bp, Artificial sequence
  SiRNA target sequence
aatacaaaccaaaggatgg

SEQ ID NO: 210741 - DNA, 19 bp, Artificial sequence
  SiRNA target sequence
atacaaaccaaaggatgga

SEQ ID NO: 210742 - DNA, 19 bp, Artificial sequence
  SiRNA target sequence
tacaaaccaaaggatggat

SEQ ID NO: 210743 - DNA, 19 bp, Artificial sequence
  SiRNA target sequence
acaaaccaaaggatggata

SEQ ID NO: 210744 - DNA, 19 bp, Artificial sequence
  SiRNA target sequence
caaaccaaaggatggatat

SEQ ID NO: 210745 - DNA, 19 bp, Artificial sequence
  SiRNA target sequence
aaaccaaaggatggatatt

SEQ ID NO: 210746 - DNA, 19 bp, Artificial sequence
  SiRNA target sequence
aaccaaaggatggatattt

SEQ ID NO: 210747 - DNA, 19 bp, Artificial sequence
  SiRNA target sequence
accaaaggatggatatttg

SEQ ID NO: 210748 - DNA, 19 bp, Artificial sequence
  SiRNA target sequence
ccaaaggatggatatttgt

SEQ ID NO: 210749 - DNA, 19 bp, Artificial sequence
  SiRNA target sequence
caaaggatggatatttgtt

SEQ ID NO: 210750 - DNA, 19 bp, Artificial sequence
  SiRNA target sequence
aaaggatggatatttgttg

SEQ ID NO: 210751 - DNA, 19 bp, Artificial sequence
  SiRNA target sequence
aaggatggatatttgttgc

SEQ ID NO: 210752 - DNA, 19 bp, Artificial sequence
  SiRNA target sequence
aggatggatatttgttgcc

SEQ ID NO: 210753 - DNA, 19 bp, Artificial sequence
  SiRNA target sequence
ggatggatatttgttgcca

SEQ ID NO: 210754 - DNA, 19 bp, Artificial sequence
  SiRNA target sequence
gatggatatttgttgccat

SEQ ID NO: 210755 - DNA, 19 bp, Artificial sequence
  SiRNA target sequence
atggatatttgttgccata

SEQ ID NO: 210756 - DNA, 19 bp, Artificial sequence
  SiRNA target sequence
tggatatttgttgccatag

SEQ ID NO: 210757 - DNA, 19 bp, Artificial sequence
  SiRNA target sequence
ggatatttgttgccatagc

SEQ ID NO: 210758 - DNA, 19 bp, Artificial sequence
  SiRNA target sequence
gatatttgttgccatagcg

SEQ ID NO: 210759 - DNA, 19 bp, Artificial sequence
  SiRNA target sequence
atatttgttgccatagcgt

SEQ ID NO: 210760 - DNA, 19 bp, Artificial sequence
  SiRNA target sequence
tatttgttgccatagcgtg

SEQ ID NO: 210761 - DNA, 19 bp, Artificial sequence
  SiRNA target sequence
atttgttgccatagcgtgc

SEQ ID NO: 210762 - DNA, 19 bp, Artificial sequence
  SiRNA target sequence
tttgttgccatagcgtgcc

SEQ ID NO: 210763 - DNA, 19 bp, Artificial sequence
  SiRNA target sequence
ttgttgccatagcgtgccc

SEQ ID NO: 210764 - DNA, 19 bp, Artificial sequence
  SiRNA target sequence
tgttgccatagcgtgccca

SEQ ID NO: 210765 - DNA, 19 bp, Artificial sequence
  SiRNA target sequence
gttgccatagcgtgcccac

SEQ ID NO: 210766 - DNA, 19 bp, Artificial sequence
  SiRNA target sequence
ttgccatagcgtgcccact

SEQ ID NO: 210767 - DNA, 19 bp, Artificial sequence
  SiRNA target sequence
tgccatagcgtgcccactt

SEQ ID NO: 210768 - DNA, 19 bp, Artificial sequence
  SiRNA target sequence
gccatagcgtgcccactta

SEQ ID NO: 210769 - DNA, 19 bp, Artificial sequence
  SiRNA target sequence
ccatagcgtgcccacttat

SEQ ID NO: 210770 - DNA, 19 bp, Artificial sequence
  SiRNA target sequence
catagcgtgcccacttatt

SEQ ID NO: 210771 - DNA, 19 bp, Artificial sequence
  SiRNA target sequence
atagcgtgcccacttatta

SEQ ID NO: 210772 - DNA, 19 bp, Artificial sequence
  SiRNA target sequence
tagcgtgcccacttattac

SEQ ID NO: 210773 - DNA, 19 bp, Artificial sequence
  SiRNA target sequence
agcgtgcccacttattacc

SEQ ID NO: 210774 - DNA, 19 bp, Artificial sequence
  SiRNA target sequence
gcgtgcccacttattaccc

SEQ ID NO: 210775 - DNA, 19 bp, Artificial sequence
  SiRNA target sequence
cgtgcccacttattaccct

SEQ ID NO: 210776 - DNA, 19 bp, Artificial sequence
  SiRNA target sequence
gtgcccacttattaccctt

SEQ ID NO: 210777 - DNA, 19 bp, Artificial sequence
  SiRNA target sequence
tgcccacttattacccttt

SEQ ID NO: 210778 - DNA, 19 bp, Artificial sequence
  SiRNA target sequence
gcccacttattaccctttt

SEQ ID NO: 210779 - DNA, 19 bp, Artificial sequence
  SiRNA target sequence
cccacttattacccttttt

SEQ ID NO: 210780 - DNA, 19 bp, Artificial sequence
  SiRNA target sequence
ccacttattaccctttttg

SEQ ID NO: 210781 - DNA, 19 bp, Artificial sequence
  SiRNA target sequence
cacttattaccctttttgc

SEQ ID NO: 210782 - DNA, 19 bp, Artificial sequence
  SiRNA target sequence
acttattaccctttttgct

SEQ ID NO: 210783 - DNA, 19 bp, Artificial sequence
  SiRNA target sequence
cttattaccctttttgctg

SEQ ID NO: 210784 - DNA, 19 bp, Artificial sequence
  SiRNA target sequence
ttattaccctttttgctgt

SEQ ID NO: 210785 - DNA, 19 bp, Artificial sequence
  SiRNA target sequence
tattaccctttttgctgta

SEQ ID NO: 210786 - DNA, 19 bp, Artificial sequence
  SiRNA target sequence
attaccctttttgctgtag

SEQ ID NO: 210787 - DNA, 19 bp, Artificial sequence
  SiRNA target sequence
ttaccctttttgctgtagt

SEQ ID NO: 210788 - DNA, 19 bp, Artificial sequence
  SiRNA target sequence
taccctttttgctgtagtt

SEQ ID NO: 210789 - DNA, 19 bp, Artificial sequence
  SiRNA target sequence
accctttttgctgtagttt

SEQ ID NO: 210790 - DNA, 19 bp, Artificial sequence
  SiRNA target sequence
ccctttttgctgtagtttc

SEQ ID NO: 210791 - DNA, 19 bp, Artificial sequence
  SiRNA target sequence
cctttttgctgtagtttct

SEQ ID NO: 210792 - DNA, 19 bp, Artificial sequence
  SiRNA target sequence
ctttttgctgtagtttctg

SEQ ID NO: 210793 - DNA, 19 bp, Artificial sequence
  SiRNA target sequence
tttttgctgtagtttctgt

SEQ ID NO: 210794 - DNA, 19 bp, Artificial sequence
  SiRNA target sequence
ttttgctgtagtttctgtg

SEQ ID NO: 210795 - DNA, 19 bp, Artificial sequence
  SiRNA target sequence
tttgctgtagtttctgtgt

SEQ ID NO: 210796 - DNA, 19 bp, Artificial sequence
  SiRNA target sequence
ttgctgtagtttctgtgtg

SEQ ID NO: 210797 - DNA, 19 bp, Artificial sequence
  SiRNA target sequence
tgctgtagtttctgtgtgt

SEQ ID NO: 210798 - DNA, 19 bp, Artificial sequence
  SiRNA target sequence
gctgtagtttctgtgtgtg

SEQ ID NO: 210799 - DNA, 19 bp, Artificial sequence
  SiRNA target sequence
ctgtagtttctgtgtgtgg

SEQ ID NO: 210800 - DNA, 19 bp, Artificial sequence
  SiRNA target sequence
tgtagtttctgtgtgtggt

SEQ ID NO: 210801 - DNA, 19 bp, Artificial sequence
  SiRNA target sequence
gtagtttctgtgtgtggtc

SEQ ID NO: 210802 - DNA, 19 bp, Artificial sequence
  SiRNA target sequence
tagtttctgtgtgtggtct

SEQ ID NO: 210803 - DNA, 19 bp, Artificial sequence
  SiRNA target sequence
agtttctgtgtgtggtctt

SEQ ID NO: 210804 - DNA, 19 bp, Artificial sequence
  SiRNA target sequence
gtttctgtgtgtggtcttg

SEQ ID NO: 210805 - DNA, 19 bp, Artificial sequence
  SiRNA target sequence
tttctgtgtgtggtcttgc

SEQ ID NO: 210806 - DNA, 19 bp, Artificial sequence
  SiRNA target sequence
ttctgtgtgtggtcttgct

SEQ ID NO: 210807 - DNA, 19 bp, Artificial sequence
  SiRNA target sequence
tctgtgtgtggtcttgctt

SEQ ID NO: 210808 - DNA, 19 bp, Artificial sequence
  SiRNA target sequence
ctgtgtgtggtcttgcttt

SEQ ID NO: 210809 - DNA, 19 bp, Artificial sequence
  SiRNA target sequence
tgtgtgtggtcttgctttt

SEQ ID NO: 210810 - DNA, 19 bp, Artificial sequence
  SiRNA target sequence
gtgtgtggtcttgcttttt

SEQ ID NO: 210811 - DNA, 19 bp, Artificial sequence
  SiRNA target sequence
tgtgtggtcttgcttttta

SEQ ID NO: 210812 - DNA, 19 bp, Artificial sequence
  SiRNA target sequence
gtgtggtcttgctttttac

SEQ ID NO: 210813 - DNA, 19 bp, Artificial sequence
  SiRNA target sequence
tgtggtcttgctttttaca

SEQ ID NO: 210814 - DNA, 19 bp, Artificial sequence
  SiRNA target sequence
gtggtcttgctttttacaa

SEQ ID NO: 210815 - DNA, 19 bp, Artificial sequence
  SiRNA target sequence
tggtcttgctttttacaat

SEQ ID NO: 210816 - DNA, 19 bp, Artificial sequence
  SiRNA target sequence
ggtcttgctttttacaatt

SEQ ID NO: 210817 - DNA, 19 bp, Artificial sequence
  SiRNA target sequence
gtcttgctttttacaatta

SEQ ID NO: 210818 - DNA, 19 bp, Artificial sequence
  SiRNA target sequence
tcttgctttttacaattat

SEQ ID NO: 210819 - DNA, 19 bp, Artificial sequence
  SiRNA target sequence
cttgctttttacaattatc

SEQ ID NO: 210820 - DNA, 19 bp, Artificial sequence
  SiRNA target sequence
ttgctttttacaattatcc

SEQ ID NO: 210821 - DNA, 19 bp, Artificial sequence
  SiRNA target sequence
tgctttttacaattatccg

SEQ ID NO: 210822 - DNA, 19 bp, Artificial sequence
  SiRNA target sequence
gctttttacaattatccgg

SEQ ID NO: 210823 - DNA, 19 bp, Artificial sequence
  SiRNA target sequence
ctttttacaattatccggc

SEQ ID NO: 210824 - DNA, 19 bp, Artificial sequence
  SiRNA target sequence
tttttacaattatccggca

SEQ ID NO: 210825 - DNA, 19 bp, Artificial sequence
  SiRNA target sequence
ttttacaattatccggcaa

SEQ ID NO: 210826 - DNA, 19 bp, Artificial sequence
  SiRNA target sequence
tttacaattatccggcaac

SEQ ID NO: 210827 - DNA, 19 bp, Artificial sequence
  SiRNA target sequence
ttacaattatccggcaaca

SEQ ID NO: 210828 - DNA, 19 bp, Artificial sequence
  SiRNA target sequence
tacaattatccggcaacaa

SEQ ID NO: 210829 - DNA, 19 bp, Artificial sequence
  SiRNA target sequence
acaattatccggcaacaaa

SEQ ID NO: 210830 - DNA, 19 bp, Artificial sequence
  SiRNA target sequence
caattatccggcaacaaat

SEQ ID NO: 210831 - DNA, 19 bp, Artificial sequence
  SiRNA target sequence
aattatccggcaacaaata

SEQ ID NO: 210832 - DNA, 19 bp, Artificial sequence
  SiRNA target sequence
attatccggcaacaaataa

SEQ ID NO: 210833 - DNA, 19 bp, Artificial sequence
  SiRNA target sequence
ttatccggcaacaaataat

SEQ ID NO: 210834 - DNA, 19 bp, Artificial sequence
  SiRNA target sequence
tatccggcaacaaataatg

SEQ ID NO: 210835 - DNA, 19 bp, Artificial sequence
  SiRNA target sequence
atccggcaacaaataatga

SEQ ID NO: 210836 - DNA, 19 bp, Artificial sequence
  SiRNA target sequence
tccggcaacaaataatgac

SEQ ID NO: 210837 - DNA, 19 bp, Artificial sequence
  SiRNA target sequence
ccggcaacaaataatgaca

SEQ ID NO: 210838 - DNA, 19 bp, Artificial sequence
  SiRNA target sequence
cggcaacaaataatgacac

SEQ ID NO: 210839 - DNA, 19 bp, Artificial sequence
  SiRNA target sequence
ggcaacaaataatgacaca

SEQ ID NO: 210840 - DNA, 19 bp, Artificial sequence
  SiRNA target sequence
gcaacaaataatgacacaa

SEQ ID NO: 210841 - DNA, 19 bp, Artificial sequence
  SiRNA target sequence
caacaaataatgacacaaa

SEQ ID NO: 210842 - DNA, 19 bp, Artificial sequence
  SiRNA target sequence
aacaaataatgacacaaat

SEQ ID NO: 210843 - DNA, 19 bp, Artificial sequence
  SiRNA target sequence
acaaataatgacacaaatt

SEQ ID NO: 210844 - DNA, 19 bp, Artificial sequence
  SiRNA target sequence
caaataatgacacaaattt

SEQ ID NO: 210845 - DNA, 19 bp, Artificial sequence
  SiRNA target sequence
aaataatgacacaaatttt

SEQ ID NO: 210846 - DNA, 19 bp, Artificial sequence
  SiRNA target sequence
aataatgacacaaattttt

SEQ ID NO: 210847 - DNA, 19 bp, Artificial sequence
  SiRNA target sequence
ataatgacacaaatttttt

SEQ ID NO: 210848 - DNA, 19 bp, Artificial sequence
  SiRNA target sequence
taatgacacaaattttttt

SEQ ID NO: 210849 - DNA, 19 bp, Artificial sequence
  SiRNA target sequence
aatgacacaaatttttttc

SEQ ID NO: 210850 - DNA, 19 bp, Artificial sequence
  SiRNA target sequence
atgacacaaatttttttct

SEQ ID NO: 210851 - DNA, 19 bp, Artificial sequence
  SiRNA target sequence
tgacacaaatttttttcta

SEQ ID NO: 210852 - DNA, 19 bp, Artificial sequence
  SiRNA target sequence
gacacaaatttttttctaa

SEQ ID NO: 210853 - DNA, 19 bp, Artificial sequence
  SiRNA target sequence
acacaaatttttttctaaa

SEQ ID NO: 210854 - DNA, 19 bp, Artificial sequence
  SiRNA target sequence
cacaaatttttttctaaat

SEQ ID NO: 210855 - DNA, 19 bp, Artificial sequence
  SiRNA target sequence
acaaatttttttctaaatt

SEQ ID NO: 210856 - DNA, 19 bp, Artificial sequence
  SiRNA target sequence
caaatttttttctaaattc

SEQ ID NO: 210857 - DNA, 19 bp, Artificial sequence
  SiRNA target sequence
aaatttttttctaaattca

SEQ ID NO: 210858 - DNA, 19 bp, Artificial sequence
  SiRNA target sequence
aatttttttctaaattcat

SEQ ID NO: 210859 - DNA, 19 bp, Artificial sequence
  SiRNA target sequence
atttttttctaaattcatt

SEQ ID NO: 210860 - DNA, 19 bp, Artificial sequence
  SiRNA target sequence
tttttttctaaattcatta

SEQ ID NO: 210861 - DNA, 19 bp, Artificial sequence
  SiRNA target sequence
ttttttctaaattcattat

SEQ ID NO: 210862 - DNA, 19 bp, Artificial sequence
  SiRNA target sequence
tttttctaaattcattatg

SEQ ID NO: 210863 - DNA, 19 bp, Artificial sequence
  SiRNA target sequence
ttttctaaattcattatgt

SEQ ID NO: 210864 - DNA, 19 bp, Artificial sequence
  SiRNA target sequence
tttctaaattcattatgtg

SEQ ID NO: 210865 - DNA, 19 bp, Artificial sequence
  SiRNA target sequence
ttctaaattcattatgtgc

SEQ ID NO: 210866 - DNA, 19 bp, Artificial sequence
  SiRNA target sequence
tctaaattcattatgtgct

SEQ ID NO: 210867 - DNA, 19 bp, Artificial sequence
  SiRNA target sequence
ctaaattcattatgtgcta

SEQ ID NO: 210868 - DNA, 19 bp, Artificial sequence
  SiRNA target sequence
taaattcattatgtgctac

SEQ ID NO: 210869 - DNA, 19 bp, Artificial sequence
  SiRNA target sequence
aaattcattatgtgctacg

SEQ ID NO: 210870 - DNA, 19 bp, Artificial sequence
  SiRNA target sequence
aattcattatgtgctacgc

SEQ ID NO: 210871 - DNA, 19 bp, Artificial sequence
  SiRNA target sequence
attcattatgtgctacgcc

SEQ ID NO: 210872 - DNA, 19 bp, Artificial sequence
  SiRNA target sequence
ttcattatgtgctacgccc

SEQ ID NO: 210873 - DNA, 19 bp, Artificial sequence
  SiRNA target sequence
tcattatgtgctacgcccg

SEQ ID NO: 210874 - DNA, 19 bp, Artificial sequence
  SiRNA target sequence
cattatgtgctacgcccgg

SEQ ID NO: 210875 - DNA, 19 bp, Artificial sequence
  SiRNA target sequence
attatgtgctacgcccggt

SEQ ID NO: 210876 - DNA, 19 bp, Artificial sequence
  SiRNA target sequence
ttatgtgctacgcccggta

SEQ ID NO: 210877 - DNA, 19 bp, Artificial sequence
  SiRNA target sequence
tatgtgctacgcccggtaa

SEQ ID NO: 210878 - DNA, 19 bp, Artificial sequence
  SiRNA target sequence
atgtgctacgcccggtaaa

SEQ ID NO: 210879 - DNA, 19 bp, Artificial sequence
  SiRNA target sequence
tgtgctacgcccggtaaat

SEQ ID NO: 210880 - DNA, 19 bp, Artificial sequence
  SiRNA target sequence
gtgctacgcccggtaaatc

SEQ ID NO: 210881 - DNA, 19 bp, Artificial sequence
  SiRNA target sequence
tgctacgcccggtaaatcg

SEQ ID NO: 210882 - DNA, 19 bp, Artificial sequence
  SiRNA target sequence
gctacgcccggtaaatcgt

SEQ ID NO: 210883 - DNA, 19 bp, Artificial sequence
  SiRNA target sequence
ctacgcccggtaaatcgtt

SEQ ID NO: 210884 - DNA, 19 bp, Artificial sequence
  SiRNA target sequence
tacgcccggtaaatcgttt

SEQ ID NO: 210885 - DNA, 19 bp, Artificial sequence
  SiRNA target sequence
acgcccggtaaatcgttta

SEQ ID NO: 210886 - DNA, 19 bp, Artificial sequence
  SiRNA target sequence
cgcccggtaaatcgtttat

SEQ ID NO: 210887 - DNA, 19 bp, Artificial sequence
  SiRNA target sequence
gcccggtaaatcgtttata

SEQ ID NO: 210888 - DNA, 19 bp, Artificial sequence
  SiRNA target sequence
cccggtaaatcgtttataa

SEQ ID NO: 210889 - DNA, 19 bp, Artificial sequence
  SiRNA target sequence
ccggtaaatcgtttataaa

SEQ ID NO: 210890 - DNA, 19 bp, Artificial sequence
  SiRNA target sequence
cggtaaatcgtttataaaa

SEQ ID NO: 210891 - DNA, 19 bp, Artificial sequence
  SiRNA target sequence
ggtaaatcgtttataaaat

SEQ ID NO: 210892 - DNA, 19 bp, Artificial sequence
  SiRNA target sequence
gtaaatcgtttataaaatt

SEQ ID NO: 210893 - DNA, 19 bp, Artificial sequence
  SiRNA target sequence
taaatcgtttataaaatta

SEQ ID NO: 210894 - DNA, 19 bp, Artificial sequence
  SiRNA target sequence
aaatcgtttataaaattag

SEQ ID NO: 210895 - DNA, 19 bp, Artificial sequence
  SiRNA target sequence
aatcgtttataaaattaga

SEQ ID NO: 210896 - DNA, 19 bp, Artificial sequence
  SiRNA target sequence
atcgtttataaaattagaa

SEQ ID NO: 210897 - DNA, 19 bp, Artificial sequence
  SiRNA target sequence
tcgtttataaaattagaaa

SEQ ID NO: 210898 - DNA, 19 bp, Artificial sequence
  SiRNA target sequence
cgtttataaaattagaaaa

SEQ ID NO: 210899 - DNA, 19 bp, Artificial sequence
  SiRNA target sequence
gtttataaaattagaaaat

SEQ ID NO: 210900 - DNA, 19 bp, Artificial sequence
  SiRNA target sequence
tttataaaattagaaaatg

SEQ ID NO: 210901 - DNA, 19 bp, Artificial sequence
  SiRNA target sequence
ttataaaattagaaaatgt

SEQ ID NO: 210902 - DNA, 19 bp, Artificial sequence
  SiRNA target sequence
tataaaattagaaaatgtt

SEQ ID NO: 210903 - DNA, 19 bp, Artificial sequence
  SiRNA target sequence
ataaaattagaaaatgttt

SEQ ID NO: 210904 - DNA, 19 bp, Artificial sequence
  SiRNA target sequence
taaaattagaaaatgtttt

SEQ ID NO: 210905 - DNA, 19 bp, Artificial sequence
  SiRNA target sequence
aaaattagaaaatgtttta

SEQ ID NO: 210906 - DNA, 19 bp, Artificial sequence
  SiRNA target sequence
aaattagaaaatgttttag

SEQ ID NO: 210907 - DNA, 19 bp, Artificial sequence
  SiRNA target sequence
aattagaaaatgttttagg

SEQ ID NO: 210908 - DNA, 19 bp, Artificial sequence
  SiRNA target sequence
attagaaaatgttttagga

SEQ ID NO: 210909 - DNA, 19 bp, Artificial sequence
  SiRNA target sequence
ttagaaaatgttttaggat

SEQ ID NO: 210910 - DNA, 19 bp, Artificial sequence
  SiRNA target sequence
tagaaaatgttttaggatg

SEQ ID NO: 210911 - DNA, 19 bp, Artificial sequence
  SiRNA target sequence
agaaaatgttttaggatgt

SEQ ID NO: 210912 - DNA, 19 bp, Artificial sequence
  SiRNA target sequence
gaaaatgttttaggatgtg

SEQ ID NO: 210913 - DNA, 19 bp, Artificial sequence
  SiRNA target sequence
aaaatgttttaggatgtgt

SEQ ID NO: 210914 - DNA, 19 bp, Artificial sequence
  SiRNA target sequence
aaatgttttaggatgtgta

SEQ ID NO: 210915 - DNA, 19 bp, Artificial sequence
  SiRNA target sequence
aatgttttaggatgtgtag

SEQ ID NO: 210916 - DNA, 19 bp, Artificial sequence
  SiRNA target sequence
atgttttaggatgtgtagc

SEQ ID NO: 210917 - DNA, 19 bp, Artificial sequence
  SiRNA target sequence
tgttttaggatgtgtagct

SEQ ID NO: 210918 - DNA, 19 bp, Artificial sequence
  SiRNA target sequence
gttttaggatgtgtagctg

SEQ ID NO: 210919 - DNA, 19 bp, Artificial sequence
  SiRNA target sequence
ttttaggatgtgtagctgt

SEQ ID NO: 210920 - DNA, 19 bp, Artificial sequence
  SiRNA target sequence
tttaggatgtgtagctgta

SEQ ID NO: 210921 - DNA, 19 bp, Artificial sequence
  SiRNA target sequence
ttaggatgtgtagctgtag

SEQ ID NO: 210922 - DNA, 19 bp, Artificial sequence
  SiRNA target sequence
taggatgtgtagctgtagc

SEQ ID NO: 210923 - DNA, 19 bp, Artificial sequence
  SiRNA target sequence
aggatgtgtagctgtagct

SEQ ID NO: 210924 - DNA, 19 bp, Artificial sequence
  SiRNA target sequence
ggatgtgtagctgtagctc

SEQ ID NO: 210925 - DNA, 19 bp, Artificial sequence
  SiRNA target sequence
gatgtgtagctgtagctct

SEQ ID NO: 210926 - DNA, 19 bp, Artificial sequence
  SiRNA target sequence
atgtgtagctgtagctctt

SEQ ID NO: 210927 - DNA, 19 bp, Artificial sequence
  SiRNA target sequence
tgtgtagctgtagctctta

SEQ ID NO: 210928 - DNA, 19 bp, Artificial sequence
  SiRNA target sequence
gtgtagctgtagctcttat

SEQ ID NO: 210929 - DNA, 19 bp, Artificial sequence
  SiRNA target sequence
tgtagctgtagctcttatg

SEQ ID NO: 210930 - DNA, 19 bp, Artificial sequence
  SiRNA target sequence
gtagctgtagctcttatga

SEQ ID NO: 210931 - DNA, 19 bp, Artificial sequence
  SiRNA target sequence
tagctgtagctcttatgaa

SEQ ID NO: 210932 - DNA, 19 bp, Artificial sequence
  SiRNA target sequence
agctgtagctcttatgaaa

SEQ ID NO: 210933 - DNA, 19 bp, Artificial sequence
  SiRNA target sequence
gctgtagctcttatgaaag

SEQ ID NO: 210934 - DNA, 19 bp, Artificial sequence
  SiRNA target sequence
ctgtagctcttatgaaagt

SEQ ID NO: 210935 - DNA, 19 bp, Artificial sequence
  SiRNA target sequence
tgtagctcttatgaaagta

SEQ ID NO: 210936 - DNA, 19 bp, Artificial sequence
  SiRNA target sequence
gtagctcttatgaaagtag

SEQ ID NO: 210937 - DNA, 19 bp, Artificial sequence
  SiRNA target sequence
tagctcttatgaaagtagc

SEQ ID NO: 210938 - DNA, 19 bp, Artificial sequence
  SiRNA target sequence
agctcttatgaaagtagca

SEQ ID NO: 210939 - DNA, 19 bp, Artificial sequence
  SiRNA target sequence
gctcttatgaaagtagcaa

SEQ ID NO: 210940 - DNA, 19 bp, Artificial sequence
  SiRNA target sequence
ctcttatgaaagtagcaaa

SEQ ID NO: 210941 - DNA, 19 bp, Artificial sequence
  SiRNA target sequence
tcttatgaaagtagcaaaa

SEQ ID NO: 210942 - DNA, 19 bp, Artificial sequence
  SiRNA target sequence
cttatgaaagtagcaaaat

SEQ ID NO: 210943 - DNA, 19 bp, Artificial sequence
  SiRNA target sequence
ttatgaaagtagcaaaata

SEQ ID NO: 210944 - DNA, 19 bp, Artificial sequence
  SiRNA target sequence
tatgaaagtagcaaaatat

SEQ ID NO: 210945 - DNA, 19 bp, Artificial sequence
  SiRNA target sequence
atgaaagtagcaaaatatg

SEQ ID NO: 210946 - DNA, 19 bp, Artificial sequence
  SiRNA target sequence
tgaaagtagcaaaatatgg

SEQ ID NO: 210947 - DNA, 19 bp, Artificial sequence
  SiRNA target sequence
gaaagtagcaaaatatggc

SEQ ID NO: 210948 - DNA, 19 bp, Artificial sequence
  SiRNA target sequence
aaagtagcaaaatatggct

SEQ ID NO: 210949 - DNA, 19 bp, Artificial sequence
  SiRNA target sequence
aagtagcaaaatatggctc

SEQ ID NO: 210950 - DNA, 19 bp, Artificial sequence
  SiRNA target sequence
agtagcaaaatatggctct

SEQ ID NO: 210951 - DNA, 19 bp, Artificial sequence
  SiRNA target sequence
gtagcaaaatatggctctt

SEQ ID NO: 210952 - DNA, 19 bp, Artificial sequence
  SiRNA target sequence
tagcaaaatatggctcttt

SEQ ID NO: 210953 - DNA, 19 bp, Artificial sequence
  SiRNA target sequence
agcaaaatatggctctttt

SEQ ID NO: 210954 - DNA, 19 bp, Artificial sequence
  SiRNA target sequence
gcaaaatatggctcttttg

SEQ ID NO: 210955 - DNA, 19 bp, Artificial sequence
  SiRNA target sequence
caaaatatggctcttttga

SEQ ID NO: 210956 - DNA, 19 bp, Artificial sequence
  SiRNA target sequence
aaaatatggctcttttgat

SEQ ID NO: 210957 - DNA, 19 bp, Artificial sequence
  SiRNA target sequence
aaatatggctcttttgata

SEQ ID NO: 210958 - DNA, 19 bp, Artificial sequence
  SiRNA target sequence
aatatggctcttttgatat

SEQ ID NO: 210959 - DNA, 19 bp, Artificial sequence
  SiRNA target sequence
atatggctcttttgatatt

SEQ ID NO: 210960 - DNA, 19 bp, Artificial sequence
  SiRNA target sequence
tatggctcttttgatattt

SEQ ID NO: 210961 - DNA, 19 bp, Artificial sequence
  SiRNA target sequence
atggctcttttgatatttc

SEQ ID NO: 210962 - DNA, 19 bp, Artificial sequence
  SiRNA target sequence
tggctcttttgatatttcc

SEQ ID NO: 210963 - DNA, 19 bp, Artificial sequence
  SiRNA target sequence
ggctcttttgatatttcca

SEQ ID NO: 210964 - DNA, 19 bp, Artificial sequence
  SiRNA target sequence
gctcttttgatatttccaa

SEQ ID NO: 210965 - DNA, 19 bp, Artificial sequence
  SiRNA target sequence
ctcttttgatatttccaaa

SEQ ID NO: 210966 - DNA, 19 bp, Artificial sequence
  SiRNA target sequence
tcttttgatatttccaaag

SEQ ID NO: 210967 - DNA, 19 bp, Artificial sequence
  SiRNA target sequence
cttttgatatttccaaaga

SEQ ID NO: 210968 - DNA, 19 bp, Artificial sequence
  SiRNA target sequence
ttttgatatttccaaagaa

SEQ ID NO: 210969 - DNA, 19 bp, Artificial sequence
  SiRNA target sequence
tttgatatttccaaagaag

SEQ ID NO: 210970 - DNA, 19 bp, Artificial sequence
  SiRNA target sequence
ttgatatttccaaagaagc

SEQ ID NO: 210971 - DNA, 19 bp, Artificial sequence
  SiRNA target sequence
tgatatttccaaagaagcc

SEQ ID NO: 210972 - DNA, 19 bp, Artificial sequence
  SiRNA target sequence
gatatttccaaagaagcca

SEQ ID NO: 210973 - DNA, 19 bp, Artificial sequence
  SiRNA target sequence
atatttccaaagaagccat

SEQ ID NO: 210974 - DNA, 19 bp, Artificial sequence
  SiRNA target sequence
tatttccaaagaagccatt

SEQ ID NO: 210975 - DNA, 19 bp, Artificial sequence
  SiRNA target sequence
atttccaaagaagccattt

SEQ ID NO: 210976 - DNA, 19 bp, Artificial sequence
  SiRNA target sequence
tttccaaagaagccatttc

SEQ ID NO: 210977 - DNA, 19 bp, Artificial sequence
  SiRNA target sequence
ttccaaagaagccatttca

SEQ ID NO: 210978 - DNA, 19 bp, Artificial sequence
  SiRNA target sequence
tccaaagaagccatttcaa

SEQ ID NO: 210979 - DNA, 19 bp, Artificial sequence
  SiRNA target sequence
ccaaagaagccatttcaat

SEQ ID NO: 210980 - DNA, 19 bp, Artificial sequence
  SiRNA target sequence
caaagaagccatttcaatg

SEQ ID NO: 210981 - DNA, 19 bp, Artificial sequence
  SiRNA target sequence
aaagaagccatttcaatgc

SEQ ID NO: 210982 - DNA, 19 bp, Artificial sequence
  SiRNA target sequence
aagaagccatttcaatgca

SEQ ID NO: 210983 - DNA, 19 bp, Artificial sequence
  SiRNA target sequence
agaagccatttcaatgcag

SEQ ID NO: 210984 - DNA, 19 bp, Artificial sequence
  SiRNA target sequence
gaagccatttcaatgcaga

SEQ ID NO: 210985 - DNA, 19 bp, Artificial sequence
  SiRNA target sequence
aagccatttcaatgcagat

SEQ ID NO: 210986 - DNA, 19 bp, Artificial sequence
  SiRNA target sequence
agccatttcaatgcagatt

SEQ ID NO: 210987 - DNA, 19 bp, Artificial sequence
  SiRNA target sequence
gccatttcaatgcagattg

SEQ ID NO: 210988 - DNA, 19 bp, Artificial sequence
  SiRNA target sequence
ccatttcaatgcagattga

SEQ ID NO: 210989 - DNA, 19 bp, Artificial sequence
  SiRNA target sequence
catttcaatgcagattgat

SEQ ID NO: 210990 - DNA, 19 bp, Artificial sequence
  SiRNA target sequence
atttcaatgcagattgatt

SEQ ID NO: 210991 - DNA, 19 bp, Artificial sequence
  SiRNA target sequence
tttcaatgcagattgattc

SEQ ID NO: 210992 - DNA, 19 bp, Artificial sequence
  SiRNA target sequence
ttcaatgcagattgattcg

SEQ ID NO: 210993 - DNA, 19 bp, Artificial sequence
  SiRNA target sequence
tcaatgcagattgattcgt

SEQ ID NO: 210994 - DNA, 19 bp, Artificial sequence
  SiRNA target sequence
caatgcagattgattcgtc

SEQ ID NO: 210995 - DNA, 19 bp, Artificial sequence
  SiRNA target sequence
aatgcagattgattcgtca

SEQ ID NO: 210996 - DNA, 19 bp, Artificial sequence
  SiRNA target sequence
atgcagattgattcgtcat

SEQ ID NO: 210997 - DNA, 19 bp, Artificial sequence
  SiRNA target sequence
tgcagattgattcgtcatt

SEQ ID NO: 210998 - DNA, 19 bp, Artificial sequence
  SiRNA target sequence
gcagattgattcgtcattg

SEQ ID NO: 210999 - DNA, 19 bp, Artificial sequence
  SiRNA target sequence
cagattgattcgtcattgc

SEQ ID NO: 211000 - DNA, 19 bp, Artificial sequence
  SiRNA target sequence
agattgattcgtcattgcg

SEQ ID NO: 211001 - DNA, 19 bp, Artificial sequence
  SiRNA target sequence
gattgattcgtcattgcgt

SEQ ID NO: 211002 - DNA, 19 bp, Artificial sequence
  SiRNA target sequence
attgattcgtcattgcgtg

SEQ ID NO: 211003 - DNA, 19 bp, Artificial sequence
  SiRNA target sequence
ttgattcgtcattgcgtgc

SEQ ID NO: 211004 - DNA, 19 bp, Artificial sequence
  SiRNA target sequence
tgattcgtcattgcgtgca

SEQ ID NO: 211005 - DNA, 19 bp, Artificial sequence
  SiRNA target sequence
gattcgtcattgcgtgcac

SEQ ID NO: 211006 - DNA, 19 bp, Artificial sequence
  SiRNA target sequence
attcgtcattgcgtgcacg

SEQ ID NO: 211007 - DNA, 19 bp, Artificial sequence
  SiRNA target sequence
ttcgtcattgcgtgcacgt

SEQ ID NO: 211008 - DNA, 19 bp, Artificial sequence
  SiRNA target sequence
tcgtcattgcgtgcacgtt

SEQ ID NO: 211009 - DNA, 19 bp, Artificial sequence
  SiRNA target sequence
cgtcattgcgtgcacgtta

SEQ ID NO: 211010 - DNA, 19 bp, Artificial sequence
  SiRNA target sequence
gtcattgcgtgcacgttat

SEQ ID NO: 211011 - DNA, 19 bp, Artificial sequence
  SiRNA target sequence
tcattgcgtgcacgttata

SEQ ID NO: 211012 - DNA, 19 bp, Artificial sequence
  SiRNA target sequence
cattgcgtgcacgttataa

SEQ ID NO: 211013 - DNA, 19 bp, Artificial sequence
  SiRNA target sequence
attgcgtgcacgttataaa

SEQ ID NO: 211014 - DNA, 19 bp, Artificial sequence
  SiRNA target sequence
ttgcgtgcacgttataaag

SEQ ID NO: 211015 - DNA, 19 bp, Artificial sequence
  SiRNA target sequence
tgcgtgcacgttataaagg

SEQ ID NO: 211016 - DNA, 19 bp, Artificial sequence
  SiRNA target sequence
gcgtgcacgttataaagga

SEQ ID NO: 211017 - DNA, 19 bp, Artificial sequence
  SiRNA target sequence
cgtgcacgttataaaggaa

SEQ ID NO: 211018 - DNA, 19 bp, Artificial sequence
  SiRNA target sequence
gtgcacgttataaaggaat

SEQ ID NO: 211019 - DNA, 19 bp, Artificial sequence
  SiRNA target sequence
tgcacgttataaaggaatt

SEQ ID NO: 211020 - DNA, 19 bp, Artificial sequence
  SiRNA target sequence
gcacgttataaaggaattt

SEQ ID NO: 211021 - DNA, 19 bp, Artificial sequence
  SiRNA target sequence
cacgttataaaggaatttt

SEQ ID NO: 211022 - DNA, 19 bp, Artificial sequence
  SiRNA target sequence
acgttataaaggaattttt

SEQ ID NO: 211023 - DNA, 19 bp, Artificial sequence
  SiRNA target sequence
cgttataaaggaatttttg

SEQ ID NO: 211024 - DNA, 19 bp, Artificial sequence
  SiRNA target sequence
gttataaaggaatttttga

SEQ ID NO: 211025 - DNA, 19 bp, Artificial sequence
  SiRNA target sequence
ttataaaggaatttttgac

SEQ ID NO: 211026 - DNA, 19 bp, Artificial sequence
  SiRNA target sequence
tataaaggaatttttgacg

SEQ ID NO: 211027 - DNA, 19 bp, Artificial sequence
  SiRNA target sequence
ataaaggaatttttgacgg

SEQ ID NO: 211028 - DNA, 19 bp, Artificial sequence
  SiRNA target sequence
taaaggaatttttgacggt

SEQ ID NO: 211029 - DNA, 19 bp, Artificial sequence
  SiRNA target sequence
aaaggaatttttgacggtg

SEQ ID NO: 211030 - DNA, 19 bp, Artificial sequence
  SiRNA target sequence
aaggaatttttgacggtgt

SEQ ID NO: 211031 - DNA, 19 bp, Artificial sequence
  SiRNA target sequence
aggaatttttgacggtgtt

SEQ ID NO: 211032 - DNA, 19 bp, Artificial sequence
  SiRNA target sequence
ggaatttttgacggtgttt

SEQ ID NO: 211033 - DNA, 19 bp, Artificial sequence
  SiRNA target sequence
gaatttttgacggtgtttt

SEQ ID NO: 211034 - DNA, 19 bp, Artificial sequence
  SiRNA target sequence
aatttttgacggtgttttt

SEQ ID NO: 211035 - DNA, 19 bp, Artificial sequence
  SiRNA target sequence
atttttgacggtgtttttg

SEQ ID NO: 211036 - DNA, 19 bp, Artificial sequence
  SiRNA target sequence
tttttgacggtgtttttgg

SEQ ID NO: 211037 - DNA, 19 bp, Artificial sequence
  SiRNA target sequence
ttttgacggtgtttttggt

SEQ ID NO: 211038 - DNA, 19 bp, Artificial sequence
  SiRNA target sequence
tttgacggtgtttttggta

SEQ ID NO: 211039 - DNA, 19 bp, Artificial sequence
  SiRNA target sequence
ttgacggtgtttttggtaa

SEQ ID NO: 211040 - DNA, 19 bp, Artificial sequence
  SiRNA target sequence
tgacggtgtttttggtaag

SEQ ID NO: 211041 - DNA, 19 bp, Artificial sequence
  SiRNA target sequence
gacggtgtttttggtaagt

SEQ ID NO: 211042 - DNA, 19 bp, Artificial sequence
  SiRNA target sequence
acggtgtttttggtaagtt

SEQ ID NO: 211043 - DNA, 19 bp, Artificial sequence
  SiRNA target sequence
cggtgtttttggtaagtta

SEQ ID NO: 211044 - DNA, 19 bp, Artificial sequence
  SiRNA target sequence
ggtgtttttggtaagttag

SEQ ID NO: 211045 - DNA, 19 bp, Artificial sequence
  SiRNA target sequence
gtgtttttggtaagttagg

SEQ ID NO: 211046 - DNA, 19 bp, Artificial sequence
  SiRNA target sequence
tgtttttggtaagttagga

SEQ ID NO: 211047 - DNA, 19 bp, Artificial sequence
  SiRNA target sequence
gtttttggtaagttaggaa

SEQ ID NO: 211048 - DNA, 19 bp, Artificial sequence
  SiRNA target sequence
tttttggtaagttaggaaa

SEQ ID NO: 211049 - DNA, 19 bp, Artificial sequence
  SiRNA target sequence
ttttggtaagttaggaaaa

SEQ ID NO: 211050 - DNA, 19 bp, Artificial sequence
  SiRNA target sequence
tttggtaagttaggaaaat

SEQ ID NO: 211051 - DNA, 19 bp, Artificial sequence
  SiRNA target sequence
ttggtaagttaggaaaatc

SEQ ID NO: 211052 - DNA, 19 bp, Artificial sequence
  SiRNA target sequence
tggtaagttaggaaaatct

SEQ ID NO: 211053 - DNA, 19 bp, Artificial sequence
  SiRNA target sequence
ggtaagttaggaaaatctc

SEQ ID NO: 211054 - DNA, 19 bp, Artificial sequence
  SiRNA target sequence
gtaagttaggaaaatctct

SEQ ID NO: 211055 - DNA, 19 bp, Artificial sequence
  SiRNA target sequence
taagttaggaaaatctctt

SEQ ID NO: 211056 - DNA, 19 bp, Artificial sequence
  SiRNA target sequence
aagttaggaaaatctcttg

SEQ ID NO: 211057 - DNA, 19 bp, Artificial sequence
  SiRNA target sequence
agttaggaaaatctcttgg

SEQ ID NO: 211058 - DNA, 19 bp, Artificial sequence
  SiRNA target sequence
gttaggaaaatctcttgga

SEQ ID NO: 211059 - DNA, 19 bp, Artificial sequence
  SiRNA target sequence
ttaggaaaatctcttggat

SEQ ID NO: 211060 - DNA, 19 bp, Artificial sequence
  SiRNA target sequence
taggaaaatctcttggatc

SEQ ID NO: 211061 - DNA, 19 bp, Artificial sequence
  SiRNA target sequence
aggaaaatctcttggatcg

SEQ ID NO: 211062 - DNA, 19 bp, Artificial sequence
  SiRNA target sequence
ggaaaatctcttggatcgt

SEQ ID NO: 211063 - DNA, 19 bp, Artificial sequence
  SiRNA target sequence
gaaaatctcttggatcgtt

SEQ ID NO: 211064 - DNA, 19 bp, Artificial sequence
  SiRNA target sequence
aaaatctcttggatcgtta

SEQ ID NO: 211065 - DNA, 19 bp, Artificial sequence
  SiRNA target sequence
aaatctcttggatcgttat

SEQ ID NO: 211066 - DNA, 19 bp, Artificial sequence
  SiRNA target sequence
aatctcttggatcgttatt

SEQ ID NO: 211067 - DNA, 19 bp, Artificial sequence
  SiRNA target sequence
atctcttggatcgttattt

SEQ ID NO: 211068 - DNA, 19 bp, Artificial sequence
  SiRNA target sequence
tctcttggatcgttatttg

SEQ ID NO: 211069 - DNA, 19 bp, Artificial sequence
  SiRNA target sequence
ctcttggatcgttatttgt

SEQ ID NO: 211070 - DNA, 19 bp, Artificial sequence
  SiRNA target sequence
tcttggatcgttatttgtg

SEQ ID NO: 211071 - DNA, 19 bp, Artificial sequence
  SiRNA target sequence
cttggatcgttatttgtgt

SEQ ID NO: 211072 - DNA, 19 bp, Artificial sequence
  SiRNA target sequence
ttggatcgttatttgtgtg

SEQ ID NO: 211073 - DNA, 19 bp, Artificial sequence
  SiRNA target sequence
tggatcgttatttgtgtgg

SEQ ID NO: 211074 - DNA, 19 bp, Artificial sequence
  SiRNA target sequence
ggatcgttatttgtgtgga

SEQ ID NO: 211075 - DNA, 19 bp, Artificial sequence
  SiRNA target sequence
gatcgttatttgtgtggat

SEQ ID NO: 211076 - DNA, 19 bp, Artificial sequence
  SiRNA target sequence
atcgttatttgtgtggatt

SEQ ID NO: 211077 - DNA, 19 bp, Artificial sequence
  SiRNA target sequence
tcgttatttgtgtggatta

SEQ ID NO: 211078 - DNA, 19 bp, Artificial sequence
  SiRNA target sequence
cgttatttgtgtggattat

SEQ ID NO: 211079 - DNA, 19 bp, Artificial sequence
  SiRNA target sequence
gttatttgtgtggattatg

SEQ ID NO: 211080 - DNA, 19 bp, Artificial sequence
  SiRNA target sequence
ttatttgtgtggattatgg

SEQ ID NO: 211081 - DNA, 19 bp, Artificial sequence
  SiRNA target sequence
tatttgtgtggattatggg

SEQ ID NO: 211082 - DNA, 19 bp, Artificial sequence
  SiRNA target sequence
atttgtgtggattatggga

SEQ ID NO: 211083 - DNA, 19 bp, Artificial sequence
  SiRNA target sequence
tttgtgtggattatgggat

SEQ ID NO: 211084 - DNA, 19 bp, Artificial sequence
  SiRNA target sequence
ttgtgtggattatgggata

SEQ ID NO: 211085 - DNA, 19 bp, Artificial sequence
  SiRNA target sequence
tgtgtggattatgggatat

SEQ ID NO: 211086 - DNA, 19 bp, Artificial sequence
  SiRNA target sequence
gtgtggattatgggatatg

SEQ ID NO: 211087 - DNA, 19 bp, Artificial sequence
  SiRNA target sequence
tgtggattatgggatatgc

SEQ ID NO: 211088 - DNA, 19 bp, Artificial sequence
  SiRNA target sequence
gtggattatgggatatgca

SEQ ID NO: 211089 - DNA, 19 bp, Artificial sequence
  SiRNA target sequence
tggattatgggatatgcat

SEQ ID NO: 211090 - DNA, 19 bp, Artificial sequence
  SiRNA target sequence
ggattatgggatatgcatt

SEQ ID NO: 211091 - DNA, 19 bp, Artificial sequence
  SiRNA target sequence
gattatgggatatgcattt

SEQ ID NO: 211092 - DNA, 19 bp, Artificial sequence
  SiRNA target sequence
attatgggatatgcatttc

SEQ ID NO: 211093 - DNA, 19 bp, Artificial sequence
  SiRNA target sequence
ttatgggatatgcatttca

SEQ ID NO: 211094 - DNA, 19 bp, Artificial sequence
  SiRNA target sequence
tatgggatatgcatttcaa

SEQ ID NO: 211095 - DNA, 19 bp, Artificial sequence
  SiRNA target sequence
atgggatatgcatttcaaa

SEQ ID NO: 211096 - DNA, 19 bp, Artificial sequence
  SiRNA target sequence
tgggatatgcatttcaaac

SEQ ID NO: 211097 - DNA, 19 bp, Artificial sequence
  SiRNA target sequence
gggatatgcatttcaaaca

SEQ ID NO: 211098 - DNA, 19 bp, Artificial sequence
  SiRNA target sequence
ggatatgcatttcaaacaa

SEQ ID NO: 211099 - DNA, 19 bp, Artificial sequence
  SiRNA target sequence
gatatgcatttcaaacaag

SEQ ID NO: 211100 - DNA, 19 bp, Artificial sequence
  SiRNA target sequence
atatgcatttcaaacaaga

SEQ ID NO: 211101 - DNA, 19 bp, Artificial sequence
  SiRNA target sequence
tatgcatttcaaacaagag

SEQ ID NO: 211102 - DNA, 19 bp, Artificial sequence
  SiRNA target sequence
atgcatttcaaacaagaga

SEQ ID NO: 211103 - DNA, 19 bp, Artificial sequence
  SiRNA target sequence
tgcatttcaaacaagagat

SEQ ID NO: 211104 - DNA, 19 bp, Artificial sequence
  SiRNA target sequence
gcatttcaaacaagagatt

SEQ ID NO: 211105 - DNA, 19 bp, Artificial sequence
  SiRNA target sequence
catttcaaacaagagattt

SEQ ID NO: 211106 - DNA, 19 bp, Artificial sequence
  SiRNA target sequence
atttcaaacaagagatttt

SEQ ID NO: 211107 - DNA, 19 bp, Artificial sequence
  SiRNA target sequence
tttcaaacaagagatttta

SEQ ID NO: 211108 - DNA, 19 bp, Artificial sequence
  SiRNA target sequence
ttcaaacaagagattttag

SEQ ID NO: 211109 - DNA, 19 bp, Artificial sequence
  SiRNA target sequence
tcaaacaagagattttaga

SEQ ID NO: 211110 - DNA, 19 bp, Artificial sequence
  SiRNA target sequence
caaacaagagattttagaa

SEQ ID NO: 211111 - DNA, 19 bp, Artificial sequence
  SiRNA target sequence
aaacaagagattttagaaa

SEQ ID NO: 211112 - DNA, 19 bp, Artificial sequence
  SiRNA target sequence
aacaagagattttagaaaa

SEQ ID NO: 211113 - DNA, 19 bp, Artificial sequence
  SiRNA target sequence
acaagagattttagaaaat

SEQ ID NO: 211114 - DNA, 19 bp, Artificial sequence
  SiRNA target sequence
caagagattttagaaaatt

SEQ ID NO: 211115 - DNA, 19 bp, Artificial sequence
  SiRNA target sequence
aagagattttagaaaatta

SEQ ID NO: 211116 - DNA, 19 bp, Artificial sequence
  SiRNA target sequence
agagattttagaaaattag

SEQ ID NO: 211117 - DNA, 19 bp, Artificial sequence
  SiRNA target sequence
gagattttagaaaattagc

SEQ ID NO: 211118 - DNA, 19 bp, Artificial sequence
  SiRNA target sequence
agattttagaaaattagct

SEQ ID NO: 211119 - DNA, 19 bp, Artificial sequence
  SiRNA target sequence
gattttagaaaattagctc

SEQ ID NO: 211120 - DNA, 19 bp, Artificial sequence
  SiRNA target sequence
attttagaaaattagctcc

SEQ ID NO: 211121 - DNA, 19 bp, Artificial sequence
  SiRNA target sequence
ttttagaaaattagctccc

SEQ ID NO: 211122 - DNA, 19 bp, Artificial sequence
  SiRNA target sequence
tttagaaaattagctccct

SEQ ID NO: 211123 - DNA, 19 bp, Artificial sequence
  SiRNA target sequence
ttagaaaattagctccctt

SEQ ID NO: 211124 - DNA, 19 bp, Artificial sequence
  SiRNA target sequence
tagaaaattagctccctta

SEQ ID NO: 211125 - DNA, 19 bp, Artificial sequence
  SiRNA target sequence
agaaaattagctcccttat

SEQ ID NO: 211126 - DNA, 19 bp, Artificial sequence
  SiRNA target sequence
gaaaattagctcccttatg

SEQ ID NO: 211127 - DNA, 19 bp, Artificial sequence
  SiRNA target sequence
aaaattagctcccttatgt

SEQ ID NO: 211128 - DNA, 19 bp, Artificial sequence
  SiRNA target sequence
aaattagctcccttatgta

SEQ ID NO: 211129 - DNA, 19 bp, Artificial sequence
  SiRNA target sequence
aattagctcccttatgtat

SEQ ID NO: 211130 - DNA, 19 bp, Artificial sequence
  SiRNA target sequence
attagctcccttatgtatc

SEQ ID NO: 211131 - DNA, 19 bp, Artificial sequence
  SiRNA target sequence
ttagctcccttatgtatca

SEQ ID NO: 211132 - DNA, 19 bp, Artificial sequence
  SiRNA target sequence
tagctcccttatgtatcag

SEQ ID NO: 211133 - DNA, 19 bp, Artificial sequence
  SiRNA target sequence
agctcccttatgtatcagc

SEQ ID NO: 211134 - DNA, 19 bp, Artificial sequence
  SiRNA target sequence
gctcccttatgtatcagcg

SEQ ID NO: 211135 - DNA, 19 bp, Artificial sequence
  SiRNA target sequence
ctcccttatgtatcagcgt

SEQ ID NO: 211136 - DNA, 19 bp, Artificial sequence
  SiRNA target sequence
tcccttatgtatcagcgta

SEQ ID NO: 211137 - DNA, 19 bp, Artificial sequence
  SiRNA target sequence
cccttatgtatcagcgtaa

SEQ ID NO: 211138 - DNA, 19 bp, Artificial sequence
  SiRNA target sequence
ccttatgtatcagcgtaat

SEQ ID NO: 211139 - DNA, 19 bp, Artificial sequence
  SiRNA target sequence
cttatgtatcagcgtaatt

SEQ ID NO: 211140 - DNA, 19 bp, Artificial sequence
  SiRNA target sequence
ttatgtatcagcgtaattg

SEQ ID NO: 211141 - DNA, 19 bp, Artificial sequence
  SiRNA target sequence
tatgtatcagcgtaattgt

SEQ ID NO: 211142 - DNA, 19 bp, Artificial sequence
  SiRNA target sequence
atgtatcagcgtaattgtc

SEQ ID NO: 211143 - DNA, 19 bp, Artificial sequence
  SiRNA target sequence
tgtatcagcgtaattgtct

SEQ ID NO: 211144 - DNA, 19 bp, Artificial sequence
  SiRNA target sequence
gtatcagcgtaattgtctt

SEQ ID NO: 211145 - DNA, 19 bp, Artificial sequence
  SiRNA target sequence
tatcagcgtaattgtcttt

SEQ ID NO: 211146 - DNA, 19 bp, Artificial sequence
  SiRNA target sequence
atcagcgtaattgtctttt

SEQ ID NO: 211147 - DNA, 19 bp, Artificial sequence
  SiRNA target sequence
tcagcgtaattgtcttttt

SEQ ID NO: 211148 - DNA, 19 bp, Artificial sequence
  SiRNA target sequence
cagcgtaattgtctttttt

SEQ ID NO: 211149 - DNA, 19 bp, Artificial sequence
  SiRNA target sequence
agcgtaattgtcttttttg

SEQ ID NO: 211150 - DNA, 19 bp, Artificial sequence
  SiRNA target sequence
gcgtaattgtcttttttgt

SEQ ID NO: 211151 - DNA, 19 bp, Artificial sequence
  SiRNA target sequence
cgtaattgtcttttttgtt

SEQ ID NO: 211152 - DNA, 19 bp, Artificial sequence
  SiRNA target sequence
gtaattgtcttttttgtta

SEQ ID NO: 211153 - DNA, 19 bp, Artificial sequence
  SiRNA target sequence
taattgtcttttttgttat

SEQ ID NO: 211154 - DNA, 19 bp, Artificial sequence
  SiRNA target sequence
aattgtcttttttgttatt

SEQ ID NO: 211155 - DNA, 19 bp, Artificial sequence
  SiRNA target sequence
attgtcttttttgttatta

SEQ ID NO: 211156 - DNA, 19 bp, Artificial sequence
  SiRNA target sequence
ttgtcttttttgttattat

SEQ ID NO: 211157 - DNA, 19 bp, Artificial sequence
  SiRNA target sequence
tgtcttttttgttattatt

SEQ ID NO: 211158 - DNA, 19 bp, Artificial sequence
  SiRNA target sequence
gtcttttttgttattattt

SEQ ID NO: 211159 - DNA, 19 bp, Artificial sequence
  SiRNA target sequence
tcttttttgttattatttg

SEQ ID NO: 211160 - DNA, 19 bp, Artificial sequence
  SiRNA target sequence
cttttttgttattatttgg

SEQ ID NO: 211161 - DNA, 19 bp, Artificial sequence
  SiRNA target sequence
ttttttgttattatttgga

SEQ ID NO: 211162 - DNA, 19 bp, Artificial sequence
  SiRNA target sequence
tttttgttattatttggat

SEQ ID NO: 211163 - DNA, 19 bp, Artificial sequence
  SiRNA target sequence
ttttgttattatttggatt

SEQ ID NO: 211164 - DNA, 19 bp, Artificial sequence
  SiRNA target sequence
tttgttattatttggattt

SEQ ID NO: 211165 - DNA, 19 bp, Artificial sequence
  SiRNA target sequence
ttgttattatttggattta

SEQ ID NO: 211166 - DNA, 19 bp, Artificial sequence
  SiRNA target sequence
tgttattatttggatttat

SEQ ID NO: 211167 - DNA, 19 bp, Artificial sequence
  SiRNA target sequence
gttattatttggatttatt

SEQ ID NO: 211168 - DNA, 19 bp, Artificial sequence
  SiRNA target sequence
ttattatttggatttattc

SEQ ID NO: 211169 - DNA, 19 bp, Artificial sequence
  SiRNA target sequence
tattatttggatttattca

SEQ ID NO: 211170 - DNA, 19 bp, Artificial sequence
  SiRNA target sequence
attatttggatttattcag

SEQ ID NO: 211171 - DNA, 19 bp, Artificial sequence
  SiRNA target sequence
ttatttggatttattcagt

SEQ ID NO: 211172 - DNA, 19 bp, Artificial sequence
  SiRNA target sequence
tatttggatttattcagtt

SEQ ID NO: 211173 - DNA, 19 bp, Artificial sequence
  SiRNA target sequence
atttggatttattcagtta

SEQ ID NO: 211174 - DNA, 19 bp, Artificial sequence
  SiRNA target sequence
tttggatttattcagttat

SEQ ID NO: 211175 - DNA, 19 bp, Artificial sequence
  SiRNA target sequence
ttggatttattcagttatt

SEQ ID NO: 211176 - DNA, 19 bp, Artificial sequence
  SiRNA target sequence
tggatttattcagttattt

SEQ ID NO: 211177 - DNA, 19 bp, Artificial sequence
  SiRNA target sequence
ggatttattcagttattta

SEQ ID NO: 211178 - DNA, 19 bp, Artificial sequence
  SiRNA target sequence
gatttattcagttatttat

SEQ ID NO: 211179 - DNA, 19 bp, Artificial sequence
  SiRNA target sequence
atttattcagttatttatt

SEQ ID NO: 211180 - DNA, 19 bp, Artificial sequence
  SiRNA target sequence
tttattcagttatttattt

SEQ ID NO: 211181 - DNA, 19 bp, Artificial sequence
  SiRNA target sequence
ttattcagttatttattta

SEQ ID NO: 211182 - DNA, 19 bp, Artificial sequence
  SiRNA target sequence
tattcagttatttatttaa

SEQ ID NO: 211183 - DNA, 19 bp, Artificial sequence
  SiRNA target sequence
attcagttatttatttaaa

SEQ ID NO: 211184 - DNA, 19 bp, Artificial sequence
  SiRNA target sequence
ttcagttatttatttaaat

SEQ ID NO: 211185 - DNA, 19 bp, Artificial sequence
  SiRNA target sequence
tcagttatttatttaaata

SEQ ID NO: 211186 - DNA, 19 bp, Artificial sequence
  SiRNA target sequence
cagttatttatttaaataa

SEQ ID NO: 211187 - DNA, 19 bp, Artificial sequence
  SiRNA target sequence
agttatttatttaaataag

SEQ ID NO: 211188 - DNA, 19 bp, Artificial sequence
  SiRNA target sequence
gttatttatttaaataaga

SEQ ID NO: 211189 - DNA, 19 bp, Artificial sequence
  SiRNA target sequence
ttatttatttaaataagaa

SEQ ID NO: 211190 - DNA, 19 bp, Artificial sequence
  SiRNA target sequence
tatttatttaaataagaaa

SEQ ID NO: 211191 - DNA, 19 bp, Artificial sequence
  SiRNA target sequence
atttatttaaataagaaat

SEQ ID NO: 211192 - DNA, 19 bp, Artificial sequence
  SiRNA target sequence
tttatttaaataagaaata

SEQ ID NO: 211193 - DNA, 19 bp, Artificial sequence
  SiRNA target sequence
ttatttaaataagaaatac

SEQ ID NO: 211194 - DNA, 19 bp, Artificial sequence
  SiRNA target sequence
tatttaaataagaaataca

SEQ ID NO: 211195 - DNA, 19 bp, Artificial sequence
  SiRNA target sequence
atttaaataagaaatacaa

SEQ ID NO: 211196 - DNA, 19 bp, Artificial sequence
  SiRNA target sequence
tttaaataagaaatacaaa

SEQ ID NO: 211197 - DNA, 19 bp, Artificial sequence
  SiRNA target sequence
ttaaataagaaatacaaag

SEQ ID NO: 211198 - DNA, 19 bp, Artificial sequence
  SiRNA target sequence
taaataagaaatacaaaga

SEQ ID NO: 211199 - DNA, 19 bp, Artificial sequence
  SiRNA target sequence
aaataagaaatacaaagaa

SEQ ID NO: 211200 - DNA, 19 bp, Artificial sequence
  SiRNA target sequence
aataagaaatacaaagaat

SEQ ID NO: 211201 - DNA, 19 bp, Artificial sequence
  SiRNA target sequence
ataagaaatacaaagaatc

SEQ ID NO: 211202 - DNA, 19 bp, Artificial sequence
  SiRNA target sequence
taagaaatacaaagaatca

SEQ ID NO: 211203 - DNA, 19 bp, Artificial sequence
  SiRNA target sequence
aagaaatacaaagaatcag

SEQ ID NO: 211204 - DNA, 19 bp, Artificial sequence
  SiRNA target sequence
agaaatacaaagaatcagt

SEQ ID NO: 211205 - DNA, 19 bp, Artificial sequence
  SiRNA target sequence
gaaatacaaagaatcagtt

SEQ ID NO: 211206 - DNA, 19 bp, Artificial sequence
  SiRNA target sequence
aaatacaaagaatcagttg

SEQ ID NO: 211207 - DNA, 19 bp, Artificial sequence
  SiRNA target sequence
aatacaaagaatcagttgt

SEQ ID NO: 211208 - DNA, 19 bp, Artificial sequence
  SiRNA target sequence
atacaaagaatcagttgtt

SEQ ID NO: 211209 - DNA, 19 bp, Artificial sequence
  SiRNA target sequence
tacaaagaatcagttgtta

SEQ ID NO: 211210 - DNA, 19 bp, Artificial sequence
  SiRNA target sequence
acaaagaatcagttgttag

SEQ ID NO: 211211 - DNA, 19 bp, Artificial sequence
  SiRNA target sequence
caaagaatcagttgttagt

SEQ ID NO: 211212 - DNA, 19 bp, Artificial sequence
  SiRNA target sequence
aaagaatcagttgttagta

SEQ ID NO: 211213 - DNA, 19 bp, Artificial sequence
  SiRNA target sequence
aagaatcagttgttagtaa

SEQ ID NO: 211214 - DNA, 19 bp, Artificial sequence
  SiRNA target sequence
agaatcagttgttagtaat

SEQ ID NO: 211215 - DNA, 19 bp, Artificial sequence
  SiRNA target sequence
gaatcagttgttagtaatt

SEQ ID NO: 211216 - DNA, 19 bp, Artificial sequence
  SiRNA target sequence
aatcagttgttagtaattt

SEQ ID NO: 211217 - DNA, 19 bp, Artificial sequence
  SiRNA target sequence
atcagttgttagtaattta

SEQ ID NO: 211218 - DNA, 19 bp, Artificial sequence
  SiRNA target sequence
tcagttgttagtaatttac

SEQ ID NO: 211219 - DNA, 19 bp, Artificial sequence
  SiRNA target sequence
cagttgttagtaatttacc

SEQ ID NO: 211220 - DNA, 19 bp, Artificial sequence
  SiRNA target sequence
agttgttagtaatttaccc

SEQ ID NO: 211221 - DNA, 19 bp, Artificial sequence
  SiRNA target sequence
gttgttagtaatttaccca

SEQ ID NO: 211222 - DNA, 19 bp, Artificial sequence
  SiRNA target sequence
ttgttagtaatttacccat

SEQ ID NO: 211223 - DNA, 19 bp, Artificial sequence
  SiRNA target sequence
tgttagtaatttacccatc

SEQ ID NO: 211224 - DNA, 19 bp, Artificial sequence
  SiRNA target sequence
gttagtaatttacccatcg

SEQ ID NO: 211225 - DNA, 19 bp, Artificial sequence
  SiRNA target sequence
ttagtaatttacccatcga

SEQ ID NO: 211226 - DNA, 19 bp, Artificial sequence
  SiRNA target sequence
tagtaatttacccatcgat

SEQ ID NO: 211227 - DNA, 19 bp, Artificial sequence
  SiRNA target sequence
agtaatttacccatcgatg

SEQ ID NO: 211228 - DNA, 19 bp, Artificial sequence
  SiRNA target sequence
gtaatttacccatcgatgt

SEQ ID NO: 211229 - DNA, 19 bp, Artificial sequence
  SiRNA target sequence
taatttacccatcgatgtt

SEQ ID NO: 211230 - DNA, 19 bp, Artificial sequence
  SiRNA target sequence
aatttacccatcgatgttg

SEQ ID NO: 211231 - DNA, 19 bp, Artificial sequence
  SiRNA target sequence
atttacccatcgatgttga

SEQ ID NO: 211232 - DNA, 19 bp, Artificial sequence
  SiRNA target sequence
tttacccatcgatgttgat

SEQ ID NO: 211233 - DNA, 19 bp, Artificial sequence
  SiRNA target sequence
ttacccatcgatgttgatt

SEQ ID NO: 211234 - DNA, 19 bp, Artificial sequence
  SiRNA target sequence
tacccatcgatgttgattt

SEQ ID NO: 211235 - DNA, 19 bp, Artificial sequence
  SiRNA target sequence
acccatcgatgttgatttg

SEQ ID NO: 211236 - DNA, 19 bp, Artificial sequence
  SiRNA target sequence
cccatcgatgttgatttgt

SEQ ID NO: 211237 - DNA, 19 bp, Artificial sequence
  SiRNA target sequence
ccatcgatgttgatttgtt

SEQ ID NO: 211238 - DNA, 19 bp, Artificial sequence
  SiRNA target sequence
catcgatgttgatttgttt

SEQ ID NO: 211239 - DNA, 19 bp, Artificial sequence
  SiRNA target sequence
atcgatgttgatttgtttg

SEQ ID NO: 211240 - DNA, 19 bp, Artificial sequence
  SiRNA target sequence
tcgatgttgatttgtttgc

SEQ ID NO: 211241 - DNA, 19 bp, Artificial sequence
  SiRNA target sequence
cgatgttgatttgtttgca

SEQ ID NO: 211242 - DNA, 19 bp, Artificial sequence
  SiRNA target sequence
gatgttgatttgtttgcat

SEQ ID NO: 211243 - DNA, 19 bp, Artificial sequence
  SiRNA target sequence
atgttgatttgtttgcatc

SEQ ID NO: 211244 - DNA, 19 bp, Artificial sequence
  SiRNA target sequence
tgttgatttgtttgcatca

SEQ ID NO: 211245 - DNA, 19 bp, Artificial sequence
  SiRNA target sequence
gttgatttgtttgcatcaa

SEQ ID NO: 211246 - DNA, 19 bp, Artificial sequence
  SiRNA target sequence
ttgatttgtttgcatcaaa

SEQ ID NO: 211247 - DNA, 19 bp, Artificial sequence
  SiRNA target sequence
tgatttgtttgcatcaaag

SEQ ID NO: 211248 - DNA, 19 bp, Artificial sequence
  SiRNA target sequence
gatttgtttgcatcaaagt

SEQ ID NO: 211249 - DNA, 19 bp, Artificial sequence
  SiRNA target sequence
atttgtttgcatcaaagtt

SEQ ID NO: 211250 - DNA, 19 bp, Artificial sequence
  SiRNA target sequence
tttgtttgcatcaaagttg

SEQ ID NO: 211251 - DNA, 19 bp, Artificial sequence
  SiRNA target sequence
ttgtttgcatcaaagttgt

SEQ ID NO: 211252 - DNA, 19 bp, Artificial sequence
  SiRNA target sequence
tgtttgcatcaaagttgtt

SEQ ID NO: 211253 - DNA, 19 bp, Artificial sequence
  SiRNA target sequence
gtttgcatcaaagttgtta

SEQ ID NO: 211254 - DNA, 19 bp, Artificial sequence
  SiRNA target sequence
tttgcatcaaagttgttag

SEQ ID NO: 211255 - DNA, 19 bp, Artificial sequence
  SiRNA target sequence
ttgcatcaaagttgttaga

SEQ ID NO: 211256 - DNA, 19 bp, Artificial sequence
  SiRNA target sequence
tgcatcaaagttgttagat

SEQ ID NO: 211257 - DNA, 19 bp, Artificial sequence
  SiRNA target sequence
gcatcaaagttgttagata

SEQ ID NO: 211258 - DNA, 19 bp, Artificial sequence
  SiRNA target sequence
catcaaagttgttagataa

SEQ ID NO: 211259 - DNA, 19 bp, Artificial sequence
  SiRNA target sequence
atcaaagttgttagataat

SEQ ID NO: 211260 - DNA, 19 bp, Artificial sequence
  SiRNA target sequence
tcaaagttgttagataata

SEQ ID NO: 211261 - DNA, 19 bp, Artificial sequence
  SiRNA target sequence
caaagttgttagataataa

SEQ ID NO: 211262 - DNA, 19 bp, Artificial sequence
  SiRNA target sequence
aaagttgttagataataaa

SEQ ID NO: 211263 - DNA, 19 bp, Artificial sequence
  SiRNA target sequence
aagttgttagataataaaa

SEQ ID NO: 211264 - DNA, 19 bp, Artificial sequence
  SiRNA target sequence
agttgttagataataaaaa

SEQ ID NO: 211265 - DNA, 19 bp, Artificial sequence
  SiRNA target sequence
gttgttagataataaaaaa

SEQ ID NO: 211266 - DNA, 19 bp, Artificial sequence
  SiRNA target sequence
ttgttagataataaaaaag

SEQ ID NO: 211267 - DNA, 19 bp, Artificial sequence
  SiRNA target sequence
tgttagataataaaaaaga

SEQ ID NO: 211268 - DNA, 19 bp, Artificial sequence
  SiRNA target sequence
gttagataataaaaaagaa

SEQ ID NO: 211269 - DNA, 19 bp, Artificial sequence
  SiRNA target sequence
ttagataataaaaaagaag

SEQ ID NO: 211270 - DNA, 19 bp, Artificial sequence
  SiRNA target sequence
tagataataaaaaagaaga

SEQ ID NO: 211271 - DNA, 19 bp, Artificial sequence
  SiRNA target sequence
agataataaaaaagaagag

SEQ ID NO: 211272 - DNA, 19 bp, Artificial sequence
  SiRNA target sequence
gataataaaaaagaagagg

SEQ ID NO: 211273 - DNA, 19 bp, Artificial sequence
  SiRNA target sequence
ataataaaaaagaagagga

SEQ ID NO: 211274 - DNA, 19 bp, Artificial sequence
  SiRNA target sequence
taataaaaaagaagaggaa

SEQ ID NO: 211275 - DNA, 19 bp, Artificial sequence
  SiRNA target sequence
aataaaaaagaagaggaaa

SEQ ID NO: 211276 - DNA, 19 bp, Artificial sequence
  SiRNA target sequence
ataaaaaagaagaggaaat

SEQ ID NO: 211277 - DNA, 19 bp, Artificial sequence
  SiRNA target sequence
taaaaaagaagaggaaatt

SEQ ID NO: 211278 - DNA, 19 bp, Artificial sequence
  SiRNA target sequence
aaaaaagaagaggaaattg

SEQ ID NO: 211279 - DNA, 19 bp, Artificial sequence
  SiRNA target sequence
aaaaagaagaggaaattga

SEQ ID NO: 211280 - DNA, 19 bp, Artificial sequence
  SiRNA target sequence
aaaagaagaggaaattgat

SEQ ID NO: 211281 - DNA, 19 bp, Artificial sequence
  SiRNA target sequence
aaagaagaggaaattgatg

SEQ ID NO: 211282 - DNA, 19 bp, Artificial sequence
  SiRNA target sequence
aagaagaggaaattgatgt

SEQ ID NO: 211283 - DNA, 19 bp, Artificial sequence
  SiRNA target sequence
agaagaggaaattgatgtg

SEQ ID NO: 211284 - DNA, 19 bp, Artificial sequence
  SiRNA target sequence
gaagaggaaattgatgtgt

SEQ ID NO: 211285 - DNA, 19 bp, Artificial sequence
  SiRNA target sequence
aagaggaaattgatgtgtc

SEQ ID NO: 211286 - DNA, 19 bp, Artificial sequence
  SiRNA target sequence
agaggaaattgatgtgtca

SEQ ID NO: 211287 - DNA, 19 bp, Artificial sequence
  SiRNA target sequence
gaggaaattgatgtgtcag

SEQ ID NO: 211288 - DNA, 19 bp, Artificial sequence
  SiRNA target sequence
aggaaattgatgtgtcagt

SEQ ID NO: 211289 - DNA, 19 bp, Artificial sequence
  SiRNA target sequence
ggaaattgatgtgtcagtg

SEQ ID NO: 211290 - DNA, 19 bp, Artificial sequence
  SiRNA target sequence
gaaattgatgtgtcagtgc

SEQ ID NO: 211291 - DNA, 19 bp, Artificial sequence
  SiRNA target sequence
aaattgatgtgtcagtgct

SEQ ID NO: 211292 - DNA, 19 bp, Artificial sequence
  SiRNA target sequence
aattgatgtgtcagtgctc

SEQ ID NO: 211293 - DNA, 19 bp, Artificial sequence
  SiRNA target sequence
attgatgtgtcagtgctcg

SEQ ID NO: 211294 - DNA, 19 bp, Artificial sequence
  SiRNA target sequence
ttgatgtgtcagtgctcgt

SEQ ID NO: 211295 - DNA, 19 bp, Artificial sequence
  SiRNA target sequence
tgatgtgtcagtgctcgtt

SEQ ID NO: 211296 - DNA, 19 bp, Artificial sequence
  SiRNA target sequence
gatgtgtcagtgctcgtta

SEQ ID NO: 211297 - DNA, 19 bp, Artificial sequence
  SiRNA target sequence
atgtgtcagtgctcgttaa

SEQ ID NO: 211298 - DNA, 19 bp, Artificial sequence
  SiRNA target sequence
tgtgtcagtgctcgttaat

SEQ ID NO: 211299 - DNA, 19 bp, Artificial sequence
  SiRNA target sequence
gtgtcagtgctcgttaatt

SEQ ID NO: 211300 - DNA, 19 bp, Artificial sequence
  SiRNA target sequence
tgtcagtgctcgttaatta

SEQ ID NO: 211301 - DNA, 19 bp, Artificial sequence
  SiRNA target sequence
gtcagtgctcgttaattaa

SEQ ID NO: 211302 - DNA, 20 bp, Artificial sequence
  SiRNA target sequence
atgattgagaggggtattat

SEQ ID NO: 211303 - DNA, 20 bp, Artificial sequence
  SiRNA target sequence
tgattgagaggggtattatg

SEQ ID NO: 211304 - DNA, 20 bp, Artificial sequence
  SiRNA target sequence
gattgagaggggtattatgg

SEQ ID NO: 211305 - DNA, 20 bp, Artificial sequence
  SiRNA target sequence
attgagaggggtattatgga

SEQ ID NO: 211306 - DNA, 20 bp, Artificial sequence
  SiRNA target sequence
ttgagaggggtattatggaa

SEQ ID NO: 211307 - DNA, 20 bp, Artificial sequence
  SiRNA target sequence
tgagaggggtattatggaaa

SEQ ID NO: 211308 - DNA, 20 bp, Artificial sequence
  SiRNA target sequence
gagaggggtattatggaaaa

SEQ ID NO: 211309 - DNA, 20 bp, Artificial sequence
  SiRNA target sequence
agaggggtattatggaaaaa

SEQ ID NO: 211310 - DNA, 20 bp, Artificial sequence
  SiRNA target sequence
gaggggtattatggaaaaaa

SEQ ID NO: 211311 - DNA, 20 bp, Artificial sequence
  SiRNA target sequence
aggggtattatggaaaaaat

SEQ ID NO: 211312 - DNA, 20 bp, Artificial sequence
  SiRNA target sequence
ggggtattatggaaaaaata

SEQ ID NO: 211313 - DNA, 20 bp, Artificial sequence
  SiRNA target sequence
gggtattatggaaaaaataa

SEQ ID NO: 211314 - DNA, 20 bp, Artificial sequence
  SiRNA target sequence
ggtattatggaaaaaataaa

SEQ ID NO: 211315 - DNA, 20 bp, Artificial sequence
  SiRNA target sequence
gtattatggaaaaaataaaa

SEQ ID NO: 211316 - DNA, 20 bp, Artificial sequence
  SiRNA target sequence
tattatggaaaaaataaaaa

SEQ ID NO: 211317 - DNA, 20 bp, Artificial sequence
  SiRNA target sequence
attatggaaaaaataaaaaa

SEQ ID NO: 211318 - DNA, 20 bp, Artificial sequence
  SiRNA target sequence
ttatggaaaaaataaaaaat

SEQ ID NO: 211319 - DNA, 20 bp, Artificial sequence
  SiRNA target sequence
tatggaaaaaataaaaaatt

SEQ ID NO: 211320 - DNA, 20 bp, Artificial sequence
  SiRNA target sequence
atggaaaaaataaaaaattt

SEQ ID NO: 211321 - DNA, 20 bp, Artificial sequence
  SiRNA target sequence
tggaaaaaataaaaaattta

SEQ ID NO: 211322 - DNA, 20 bp, Artificial sequence
  SiRNA target sequence
ggaaaaaataaaaaatttat

SEQ ID NO: 211323 - DNA, 20 bp, Artificial sequence
  SiRNA target sequence
gaaaaaataaaaaatttatt

SEQ ID NO: 211324 - DNA, 20 bp, Artificial sequence
  SiRNA target sequence
aaaaaataaaaaatttatta

SEQ ID NO: 211325 - DNA, 20 bp, Artificial sequence
  SiRNA target sequence
aaaaataaaaaatttattaa

SEQ ID NO: 211326 - DNA, 20 bp, Artificial sequence
  SiRNA target sequence
aaaataaaaaatttattaac

SEQ ID NO: 211327 - DNA, 20 bp, Artificial sequence
  SiRNA target sequence
aaataaaaaatttattaaca

SEQ ID NO: 211328 - DNA, 20 bp, Artificial sequence
  SiRNA target sequence
aataaaaaatttattaacag

SEQ ID NO: 211329 - DNA, 20 bp, Artificial sequence
  SiRNA target sequence
ataaaaaatttattaacaga

SEQ ID NO: 211330 - DNA, 20 bp, Artificial sequence
  SiRNA target sequence
taaaaaatttattaacagag

SEQ ID NO: 211331 - DNA, 20 bp, Artificial sequence
  SiRNA target sequence
aaaaaatttattaacagagg

SEQ ID NO: 211332 - DNA, 20 bp, Artificial sequence
  SiRNA target sequence
aaaaatttattaacagagga

SEQ ID NO: 211333 - DNA, 20 bp, Artificial sequence
  SiRNA target sequence
aaaatttattaacagaggat

SEQ ID NO: 211334 - DNA, 20 bp, Artificial sequence
  SiRNA target sequence
aaatttattaacagaggatg

SEQ ID NO: 211335 - DNA, 20 bp, Artificial sequence
  SiRNA target sequence
aatttattaacagaggatga

SEQ ID NO: 211336 - DNA, 20 bp, Artificial sequence
  SiRNA target sequence
atttattaacagaggatgaa

SEQ ID NO: 211337 - DNA, 20 bp, Artificial sequence
  SiRNA target sequence
tttattaacagaggatgaag

SEQ ID NO: 211338 - DNA, 20 bp, Artificial sequence
  SiRNA target sequence
ttattaacagaggatgaagt

SEQ ID NO: 211339 - DNA, 20 bp, Artificial sequence
  SiRNA target sequence
tattaacagaggatgaagta

SEQ ID NO: 211340 - DNA, 20 bp, Artificial sequence
  SiRNA target sequence
attaacagaggatgaagtag

SEQ ID NO: 211341 - DNA, 20 bp, Artificial sequence
  SiRNA target sequence
ttaacagaggatgaagtaga

SEQ ID NO: 211342 - DNA, 20 bp, Artificial sequence
  SiRNA target sequence
taacagaggatgaagtagaa

SEQ ID NO: 211343 - DNA, 20 bp, Artificial sequence
  SiRNA target sequence
aacagaggatgaagtagaag

SEQ ID NO: 211344 - DNA, 20 bp, Artificial sequence
  SiRNA target sequence
acagaggatgaagtagaagc

SEQ ID NO: 211345 - DNA, 20 bp, Artificial sequence
  SiRNA target sequence
cagaggatgaagtagaagca

SEQ ID NO: 211346 - DNA, 20 bp, Artificial sequence
  SiRNA target sequence
agaggatgaagtagaagcag

SEQ ID NO: 211347 - DNA, 20 bp, Artificial sequence
  SiRNA target sequence
gaggatgaagtagaagcaga

SEQ ID NO: 211348 - DNA, 20 bp, Artificial sequence
  SiRNA target sequence
aggatgaagtagaagcagaa

SEQ ID NO: 211349 - DNA, 20 bp, Artificial sequence
  SiRNA target sequence
ggatgaagtagaagcagaag

SEQ ID NO: 211350 - DNA, 20 bp, Artificial sequence
  SiRNA target sequence
gatgaagtagaagcagaagc

SEQ ID NO: 211351 - DNA, 20 bp, Artificial sequence
  SiRNA target sequence
atgaagtagaagcagaagca

SEQ ID NO: 211352 - DNA, 20 bp, Artificial sequence
  SiRNA target sequence
tgaagtagaagcagaagcaa

SEQ ID NO: 211353 - DNA, 20 bp, Artificial sequence
  SiRNA target sequence
gaagtagaagcagaagcaaa

SEQ ID NO: 211354 - DNA, 20 bp, Artificial sequence
  SiRNA target sequence
aagtagaagcagaagcaaat

SEQ ID NO: 211355 - DNA, 20 bp, Artificial sequence
  SiRNA target sequence
agtagaagcagaagcaaatt

SEQ ID NO: 211356 - DNA, 20 bp, Artificial sequence
  SiRNA target sequence
gtagaagcagaagcaaattc

SEQ ID NO: 211357 - DNA, 20 bp, Artificial sequence
  SiRNA target sequence
tagaagcagaagcaaattct

SEQ ID NO: 211358 - DNA, 20 bp, Artificial sequence
  SiRNA target sequence
agaagcagaagcaaattctg

SEQ ID NO: 211359 - DNA, 20 bp, Artificial sequence
  SiRNA target sequence
gaagcagaagcaaattctgg

SEQ ID NO: 211360 - DNA, 20 bp, Artificial sequence
  SiRNA target sequence
aagcagaagcaaattctgga

SEQ ID NO: 211361 - DNA, 20 bp, Artificial sequence
  SiRNA target sequence
agcagaagcaaattctggaa

SEQ ID NO: 211362 - DNA, 20 bp, Artificial sequence
  SiRNA target sequence
gcagaagcaaattctggaag

SEQ ID NO: 211363 - DNA, 20 bp, Artificial sequence
  SiRNA target sequence
cagaagcaaattctggaagg

SEQ ID NO: 211364 - DNA, 20 bp, Artificial sequence
  SiRNA target sequence
agaagcaaattctggaaggg

SEQ ID NO: 211365 - DNA, 20 bp, Artificial sequence
  SiRNA target sequence
gaagcaaattctggaagggg

SEQ ID NO: 211366 - DNA, 20 bp, Artificial sequence
  SiRNA target sequence
aagcaaattctggaaggggc

SEQ ID NO: 211367 - DNA, 20 bp, Artificial sequence
  SiRNA target sequence
agcaaattctggaaggggca

SEQ ID NO: 211368 - DNA, 20 bp, Artificial sequence
  SiRNA target sequence
gcaaattctggaaggggcat

SEQ ID NO: 211369 - DNA, 20 bp, Artificial sequence
  SiRNA target sequence
caaattctggaaggggcatt

SEQ ID NO: 211370 - DNA, 20 bp, Artificial sequence
  SiRNA target sequence
aaattctggaaggggcattt

SEQ ID NO: 211371 - DNA, 20 bp, Artificial sequence
  SiRNA target sequence
aattctggaaggggcatttt

SEQ ID NO: 211372 - DNA, 20 bp, Artificial sequence
  SiRNA target sequence
attctggaaggggcatttta

SEQ ID NO: 211373 - DNA, 20 bp, Artificial sequence
  SiRNA target sequence
ttctggaaggggcattttat

SEQ ID NO: 211374 - DNA, 20 bp, Artificial sequence
  SiRNA target sequence
tctggaaggggcattttatc

SEQ ID NO: 211375 - DNA, 20 bp, Artificial sequence
  SiRNA target sequence
ctggaaggggcattttatca

SEQ ID NO: 211376 - DNA, 20 bp, Artificial sequence
  SiRNA target sequence
tggaaggggcattttatcaa

SEQ ID NO: 211377 - DNA, 20 bp, Artificial sequence
  SiRNA target sequence
ggaaggggcattttatcaat

SEQ ID NO: 211378 - DNA, 20 bp, Artificial sequence
  SiRNA target sequence
gaaggggcattttatcaata

SEQ ID NO: 211379 - DNA, 20 bp, Artificial sequence
  SiRNA target sequence
aaggggcattttatcaatat

SEQ ID NO: 211380 - DNA, 20 bp, Artificial sequence
  SiRNA target sequence
aggggcattttatcaatatt

SEQ ID NO: 211381 - DNA, 20 bp, Artificial sequence
  SiRNA target sequence
ggggcattttatcaatattt

SEQ ID NO: 211382 - DNA, 20 bp, Artificial sequence
  SiRNA target sequence
gggcattttatcaatattta

SEQ ID NO: 211383 - DNA, 20 bp, Artificial sequence
  SiRNA target sequence
ggcattttatcaatatttag

SEQ ID NO: 211384 - DNA, 20 bp, Artificial sequence
  SiRNA target sequence
gcattttatcaatatttaga

SEQ ID NO: 211385 - DNA, 20 bp, Artificial sequence
  SiRNA target sequence
cattttatcaatatttagaa

SEQ ID NO: 211386 - DNA, 20 bp, Artificial sequence
  SiRNA target sequence
attttatcaatatttagaat

SEQ ID NO: 211387 - DNA, 20 bp, Artificial sequence
  SiRNA target sequence
ttttatcaatatttagaatt

SEQ ID NO: 211388 - DNA, 20 bp, Artificial sequence
  SiRNA target sequence
tttatcaatatttagaattg

SEQ ID NO: 211389 - DNA, 20 bp, Artificial sequence
  SiRNA target sequence
ttatcaatatttagaattgc

SEQ ID NO: 211390 - DNA, 20 bp, Artificial sequence
  SiRNA target sequence
tatcaatatttagaattgct

SEQ ID NO: 211391 - DNA, 20 bp, Artificial sequence
  SiRNA target sequence
atcaatatttagaattgcta

SEQ ID NO: 211392 - DNA, 20 bp, Artificial sequence
  SiRNA target sequence
tcaatatttagaattgctaa

SEQ ID NO: 211393 - DNA, 20 bp, Artificial sequence
  SiRNA target sequence
caatatttagaattgctaag

SEQ ID NO: 211394 - DNA, 20 bp, Artificial sequence
  SiRNA target sequence
aatatttagaattgctaagg

SEQ ID NO: 211395 - DNA, 20 bp, Artificial sequence
  SiRNA target sequence
atatttagaattgctaaggt

SEQ ID NO: 211396 - DNA, 20 bp, Artificial sequence
  SiRNA target sequence
tatttagaattgctaaggta

SEQ ID NO: 211397 - DNA, 20 bp, Artificial sequence
  SiRNA target sequence
atttagaattgctaaggtag

SEQ ID NO: 211398 - DNA, 20 bp, Artificial sequence
  SiRNA target sequence
tttagaattgctaaggtaga

SEQ ID NO: 211399 - DNA, 20 bp, Artificial sequence
  SiRNA target sequence
ttagaattgctaaggtagaa

SEQ ID NO: 211400 - DNA, 20 bp, Artificial sequence
  SiRNA target sequence
tagaattgctaaggtagaaa

SEQ ID NO: 211401 - DNA, 20 bp, Artificial sequence
  SiRNA target sequence
agaattgctaaggtagaaag

SEQ ID NO: 211402 - DNA, 20 bp, Artificial sequence
  SiRNA target sequence
gaattgctaaggtagaaaga

SEQ ID NO: 211403 - DNA, 20 bp, Artificial sequence
  SiRNA target sequence
aattgctaaggtagaaagaa

SEQ ID NO: 211404 - DNA, 20 bp, Artificial sequence
  SiRNA target sequence
attgctaaggtagaaagaag

SEQ ID NO: 211405 - DNA, 20 bp, Artificial sequence
  SiRNA target sequence
ttgctaaggtagaaagaaga

SEQ ID NO: 211406 - DNA, 20 bp, Artificial sequence
  SiRNA target sequence
tgctaaggtagaaagaagaa

SEQ ID NO: 211407 - DNA, 20 bp, Artificial sequence
  SiRNA target sequence
gctaaggtagaaagaagaat

SEQ ID NO: 211408 - DNA, 20 bp, Artificial sequence
  SiRNA target sequence
ctaaggtagaaagaagaatg

SEQ ID NO: 211409 - DNA, 20 bp, Artificial sequence
  SiRNA target sequence
taaggtagaaagaagaatgt

SEQ ID NO: 211410 - DNA, 20 bp, Artificial sequence
  SiRNA target sequence
aaggtagaaagaagaatgtt

SEQ ID NO: 211411 - DNA, 20 bp, Artificial sequence
  SiRNA target sequence
aggtagaaagaagaatgttt

SEQ ID NO: 211412 - DNA, 20 bp, Artificial sequence
  SiRNA target sequence
ggtagaaagaagaatgtttt

SEQ ID NO: 211413 - DNA, 20 bp, Artificial sequence
  SiRNA target sequence
gtagaaagaagaatgttttg

SEQ ID NO: 211414 - DNA, 20 bp, Artificial sequence
  SiRNA target sequence
tagaaagaagaatgttttgg

SEQ ID NO: 211415 - DNA, 20 bp, Artificial sequence
  SiRNA target sequence
agaaagaagaatgttttggc

SEQ ID NO: 211416 - DNA, 20 bp, Artificial sequence
  SiRNA target sequence
gaaagaagaatgttttggct

SEQ ID NO: 211417 - DNA, 20 bp, Artificial sequence
  SiRNA target sequence
aaagaagaatgttttggctt

SEQ ID NO: 211418 - DNA, 20 bp, Artificial sequence
  SiRNA target sequence
aagaagaatgttttggctta

SEQ ID NO: 211419 - DNA, 20 bp, Artificial sequence
  SiRNA target sequence
agaagaatgttttggcttat

SEQ ID NO: 211420 - DNA, 20 bp, Artificial sequence
  SiRNA target sequence
gaagaatgttttggcttatg

SEQ ID NO: 211421 - DNA, 20 bp, Artificial sequence
  SiRNA target sequence
aagaatgttttggcttatga

SEQ ID NO: 211422 - DNA, 20 bp, Artificial sequence
  SiRNA target sequence
agaatgttttggcttatgac

SEQ ID NO: 211423 - DNA, 20 bp, Artificial sequence
  SiRNA target sequence
gaatgttttggcttatgacg

SEQ ID NO: 211424 - DNA, 20 bp, Artificial sequence
  SiRNA target sequence
aatgttttggcttatgacgc

SEQ ID NO: 211425 - DNA, 20 bp, Artificial sequence
  SiRNA target sequence
atgttttggcttatgacgct

SEQ ID NO: 211426 - DNA, 20 bp, Artificial sequence
  SiRNA target sequence
tgttttggcttatgacgctt

SEQ ID NO: 211427 - DNA, 20 bp, Artificial sequence
  SiRNA target sequence
gttttggcttatgacgctta

SEQ ID NO: 211428 - DNA, 20 bp, Artificial sequence
  SiRNA target sequence
ttttggcttatgacgcttat

SEQ ID NO: 211429 - DNA, 20 bp, Artificial sequence
  SiRNA target sequence
tttggcttatgacgcttatg

SEQ ID NO: 211430 - DNA, 20 bp, Artificial sequence
  SiRNA target sequence
ttggcttatgacgcttatgt

SEQ ID NO: 211431 - DNA, 20 bp, Artificial sequence
  SiRNA target sequence
tggcttatgacgcttatgtt

SEQ ID NO: 211432 - DNA, 20 bp, Artificial sequence
  SiRNA target sequence
ggcttatgacgcttatgttt

SEQ ID NO: 211433 - DNA, 20 bp, Artificial sequence
  SiRNA target sequence
gcttatgacgcttatgtttt

SEQ ID NO: 211434 - DNA, 20 bp, Artificial sequence
  SiRNA target sequence
cttatgacgcttatgttttc

SEQ ID NO: 211435 - DNA, 20 bp, Artificial sequence
  SiRNA target sequence
ttatgacgcttatgttttcg

SEQ ID NO: 211436 - DNA, 20 bp, Artificial sequence
  SiRNA target sequence
tatgacgcttatgttttcgc

SEQ ID NO: 211437 - DNA, 20 bp, Artificial sequence
  SiRNA target sequence
atgacgcttatgttttcgct

SEQ ID NO: 211438 - DNA, 20 bp, Artificial sequence
  SiRNA target sequence
tgacgcttatgttttcgctt

SEQ ID NO: 211439 - DNA, 20 bp, Artificial sequence
  SiRNA target sequence
gacgcttatgttttcgctta

SEQ ID NO: 211440 - DNA, 20 bp, Artificial sequence
  SiRNA target sequence
acgcttatgttttcgcttat

SEQ ID NO: 211441 - DNA, 20 bp, Artificial sequence
  SiRNA target sequence
cgcttatgttttcgcttatt

SEQ ID NO: 211442 - DNA, 20 bp, Artificial sequence
  SiRNA target sequence
gcttatgttttcgcttattt

SEQ ID NO: 211443 - DNA, 20 bp, Artificial sequence
  SiRNA target sequence
cttatgttttcgcttatttc

SEQ ID NO: 211444 - DNA, 20 bp, Artificial sequence
  SiRNA target sequence
ttatgttttcgcttatttcc

SEQ ID NO: 211445 - DNA, 20 bp, Artificial sequence
  SiRNA target sequence
tatgttttcgcttatttcct

SEQ ID NO: 211446 - DNA, 20 bp, Artificial sequence
  SiRNA target sequence
atgttttcgcttatttcctt

SEQ ID NO: 211447 - DNA, 20 bp, Artificial sequence
  SiRNA target sequence
tgttttcgcttatttccttt

SEQ ID NO: 211448 - DNA, 20 bp, Artificial sequence
  SiRNA target sequence
gttttcgcttatttccttta

SEQ ID NO: 211449 - DNA, 20 bp, Artificial sequence
  SiRNA target sequence
ttttcgcttatttcctttat

SEQ ID NO: 211450 - DNA, 20 bp, Artificial sequence
  SiRNA target sequence
tttcgcttatttcctttatt

SEQ ID NO: 211451 - DNA, 20 bp, Artificial sequence
  SiRNA target sequence
ttcgcttatttcctttattt

SEQ ID NO: 211452 - DNA, 20 bp, Artificial sequence
  SiRNA target sequence
tcgcttatttcctttattta

SEQ ID NO: 211453 - DNA, 20 bp, Artificial sequence
  SiRNA target sequence
cgcttatttcctttatttac

SEQ ID NO: 211454 - DNA, 20 bp, Artificial sequence
  SiRNA target sequence
gcttatttcctttatttact

SEQ ID NO: 211455 - DNA, 20 bp, Artificial sequence
  SiRNA target sequence
cttatttcctttatttactc

SEQ ID NO: 211456 - DNA, 20 bp, Artificial sequence
  SiRNA target sequence
ttatttcctttatttactca

SEQ ID NO: 211457 - DNA, 20 bp, Artificial sequence
  SiRNA target sequence
tatttcctttatttactcag

SEQ ID NO: 211458 - DNA, 20 bp, Artificial sequence
  SiRNA target sequence
atttcctttatttactcagt

SEQ ID NO: 211459 - DNA, 20 bp, Artificial sequence
  SiRNA target sequence
tttcctttatttactcagta

SEQ ID NO: 211460 - DNA, 20 bp, Artificial sequence
  SiRNA target sequence
ttcctttatttactcagtag

SEQ ID NO: 211461 - DNA, 20 bp, Artificial sequence
  SiRNA target sequence
tcctttatttactcagtagg

SEQ ID NO: 211462 - DNA, 20 bp, Artificial sequence
  SiRNA target sequence
cctttatttactcagtagga

SEQ ID NO: 211463 - DNA, 20 bp, Artificial sequence
  SiRNA target sequence
ctttatttactcagtaggac

SEQ ID NO: 211464 - DNA, 20 bp, Artificial sequence
  SiRNA target sequence
tttatttactcagtaggacg

SEQ ID NO: 211465 - DNA, 20 bp, Artificial sequence
  SiRNA target sequence
ttatttactcagtaggacga

SEQ ID NO: 211466 - DNA, 20 bp, Artificial sequence
  SiRNA target sequence
tatttactcagtaggacgag

SEQ ID NO: 211467 - DNA, 20 bp, Artificial sequence
  SiRNA target sequence
atttactcagtaggacgagt

SEQ ID NO: 211468 - DNA, 20 bp, Artificial sequence
  SiRNA target sequence
tttactcagtaggacgagtg

SEQ ID NO: 211469 - DNA, 20 bp, Artificial sequence
  SiRNA target sequence
ttactcagtaggacgagtgt

SEQ ID NO: 211470 - DNA, 20 bp, Artificial sequence
  SiRNA target sequence
tactcagtaggacgagtgtt

SEQ ID NO: 211471 - DNA, 20 bp, Artificial sequence
  SiRNA target sequence
actcagtaggacgagtgtta

SEQ ID NO: 211472 - DNA, 20 bp, Artificial sequence
  SiRNA target sequence
ctcagtaggacgagtgttaa

SEQ ID NO: 211473 - DNA, 20 bp, Artificial sequence
  SiRNA target sequence
tcagtaggacgagtgttaaa

SEQ ID NO: 211474 - DNA, 20 bp, Artificial sequence
  SiRNA target sequence
cagtaggacgagtgttaaaa

SEQ ID NO: 211475 - DNA, 20 bp, Artificial sequence
  SiRNA target sequence
agtaggacgagtgttaaaag

SEQ ID NO: 211476 - DNA, 20 bp, Artificial sequence
  SiRNA target sequence
gtaggacgagtgttaaaaga

SEQ ID NO: 211477 - DNA, 20 bp, Artificial sequence
  SiRNA target sequence
taggacgagtgttaaaagat

SEQ ID NO: 211478 - DNA, 20 bp, Artificial sequence
  SiRNA target sequence
aggacgagtgttaaaagatg

SEQ ID NO: 211479 - DNA, 20 bp, Artificial sequence
  SiRNA target sequence
ggacgagtgttaaaagatgc

SEQ ID NO: 211480 - DNA, 20 bp, Artificial sequence
  SiRNA target sequence
gacgagtgttaaaagatgca

SEQ ID NO: 211481 - DNA, 20 bp, Artificial sequence
  SiRNA target sequence
acgagtgttaaaagatgcag

SEQ ID NO: 211482 - DNA, 20 bp, Artificial sequence
  SiRNA target sequence
cgagtgttaaaagatgcagc

SEQ ID NO: 211483 - DNA, 20 bp, Artificial sequence
  SiRNA target sequence
gagtgttaaaagatgcagca

SEQ ID NO: 211484 - DNA, 20 bp, Artificial sequence
  SiRNA target sequence
agtgttaaaagatgcagcag

SEQ ID NO: 211485 - DNA, 20 bp, Artificial sequence
  SiRNA target sequence
gtgttaaaagatgcagcagt

SEQ ID NO: 211486 - DNA, 20 bp, Artificial sequence
  SiRNA target sequence
tgttaaaagatgcagcagtt

SEQ ID NO: 211487 - DNA, 20 bp, Artificial sequence
  SiRNA target sequence
gttaaaagatgcagcagttc

SEQ ID NO: 211488 - DNA, 20 bp, Artificial sequence
  SiRNA target sequence
ttaaaagatgcagcagttct

SEQ ID NO: 211489 - DNA, 20 bp, Artificial sequence
  SiRNA target sequence
taaaagatgcagcagttctt

SEQ ID NO: 211490 - DNA, 20 bp, Artificial sequence
  SiRNA target sequence
aaaagatgcagcagttctta

SEQ ID NO: 211491 - DNA, 20 bp, Artificial sequence
  SiRNA target sequence
aaagatgcagcagttcttag

SEQ ID NO: 211492 - DNA, 20 bp, Artificial sequence
  SiRNA target sequence
aagatgcagcagttcttagt

SEQ ID NO: 211493 - DNA, 20 bp, Artificial sequence
  SiRNA target sequence
agatgcagcagttcttagta

SEQ ID NO: 211494 - DNA, 20 bp, Artificial sequence
  SiRNA target sequence
gatgcagcagttcttagtag

SEQ ID NO: 211495 - DNA, 20 bp, Artificial sequence
  SiRNA target sequence
atgcagcagttcttagtaga

SEQ ID NO: 211496 - DNA, 20 bp, Artificial sequence
  SiRNA target sequence
tgcagcagttcttagtagac

SEQ ID NO: 211497 - DNA, 20 bp, Artificial sequence
  SiRNA target sequence
gcagcagttcttagtagaca

SEQ ID NO: 211498 - DNA, 20 bp, Artificial sequence
  SiRNA target sequence
cagcagttcttagtagacag

SEQ ID NO: 211499 - DNA, 20 bp, Artificial sequence
  SiRNA target sequence
agcagttcttagtagacaga

SEQ ID NO: 211500 - DNA, 20 bp, Artificial sequence
  SiRNA target sequence
gcagttcttagtagacagat

SEQ ID NO: 211501 - DNA, 20 bp, Artificial sequence
  SiRNA target sequence
cagttcttagtagacagatg

SEQ ID NO: 211502 - DNA, 20 bp, Artificial sequence
  SiRNA target sequence
agttcttagtagacagatgc

SEQ ID NO: 211503 - DNA, 20 bp, Artificial sequence
  SiRNA target sequence
gttcttagtagacagatgcc

SEQ ID NO: 211504 - DNA, 20 bp, Artificial sequence
  SiRNA target sequence
ttcttagtagacagatgcca

SEQ ID NO: 211505 - DNA, 20 bp, Artificial sequence
  SiRNA target sequence
tcttagtagacagatgccac

SEQ ID NO: 211506 - DNA, 20 bp, Artificial sequence
  SiRNA target sequence
cttagtagacagatgccact

SEQ ID NO: 211507 - DNA, 20 bp, Artificial sequence
  SiRNA target sequence
ttagtagacagatgccacta

SEQ ID NO: 211508 - DNA, 20 bp, Artificial sequence
  SiRNA target sequence
tagtagacagatgccactat

SEQ ID NO: 211509 - DNA, 20 bp, Artificial sequence
  SiRNA target sequence
agtagacagatgccactatc

SEQ ID NO: 211510 - DNA, 20 bp, Artificial sequence
  SiRNA target sequence
gtagacagatgccactatcc

SEQ ID NO: 211511 - DNA, 20 bp, Artificial sequence
  SiRNA target sequence
tagacagatgccactatcca

SEQ ID NO: 211512 - DNA, 20 bp, Artificial sequence
  SiRNA target sequence
agacagatgccactatccat

SEQ ID NO: 211513 - DNA, 20 bp, Artificial sequence
  SiRNA target sequence
gacagatgccactatccatt

SEQ ID NO: 211514 - DNA, 20 bp, Artificial sequence
  SiRNA target sequence
acagatgccactatccatta

SEQ ID NO: 211515 - DNA, 20 bp, Artificial sequence
  SiRNA target sequence
cagatgccactatccattaa

SEQ ID NO: 211516 - DNA, 20 bp, Artificial sequence
  SiRNA target sequence
agatgccactatccattaat

SEQ ID NO: 211517 - DNA, 20 bp, Artificial sequence
  SiRNA target sequence
gatgccactatccattaatt

SEQ ID NO: 211518 - DNA, 20 bp, Artificial sequence
  SiRNA target sequence
atgccactatccattaattg

SEQ ID NO: 211519 - DNA, 20 bp, Artificial sequence
  SiRNA target sequence
tgccactatccattaattgt

SEQ ID NO: 211520 - DNA, 20 bp, Artificial sequence
  SiRNA target sequence
gccactatccattaattgtc

SEQ ID NO: 211521 - DNA, 20 bp, Artificial sequence
  SiRNA target sequence
ccactatccattaattgtct

SEQ ID NO: 211522 - DNA, 20 bp, Artificial sequence
  SiRNA target sequence
cactatccattaattgtctt

SEQ ID NO: 211523 - DNA, 20 bp, Artificial sequence
  SiRNA target sequence
actatccattaattgtctta

SEQ ID NO: 211524 - DNA, 20 bp, Artificial sequence
  SiRNA target sequence
ctatccattaattgtcttaa

SEQ ID NO: 211525 - DNA, 20 bp, Artificial sequence
  SiRNA target sequence
tatccattaattgtcttaaa

SEQ ID NO: 211526 - DNA, 20 bp, Artificial sequence
  SiRNA target sequence
atccattaattgtcttaaaa

SEQ ID NO: 211527 - DNA, 20 bp, Artificial sequence
  SiRNA target sequence
tccattaattgtcttaaaag

SEQ ID NO: 211528 - DNA, 20 bp, Artificial sequence
  SiRNA target sequence
ccattaattgtcttaaaagc

SEQ ID NO: 211529 - DNA, 20 bp, Artificial sequence
  SiRNA target sequence
cattaattgtcttaaaagct

SEQ ID NO: 211530 - DNA, 20 bp, Artificial sequence
  SiRNA target sequence
attaattgtcttaaaagctt

SEQ ID NO: 211531 - DNA, 20 bp, Artificial sequence
  SiRNA target sequence
ttaattgtcttaaaagcttt

SEQ ID NO: 211532 - DNA, 20 bp, Artificial sequence
  SiRNA target sequence
taattgtcttaaaagctttg

SEQ ID NO: 211533 - DNA, 20 bp, Artificial sequence
  SiRNA target sequence
aattgtcttaaaagctttgt

SEQ ID NO: 211534 - DNA, 20 bp, Artificial sequence
  SiRNA target sequence
attgtcttaaaagctttgta

SEQ ID NO: 211535 - DNA, 20 bp, Artificial sequence
  SiRNA target sequence
ttgtcttaaaagctttgtaa

SEQ ID NO: 211536 - DNA, 20 bp, Artificial sequence
  SiRNA target sequence
tgtcttaaaagctttgtaat

SEQ ID NO: 211537 - DNA, 20 bp, Artificial sequence
  SiRNA target sequence
gtcttaaaagctttgtaatt

SEQ ID NO: 211538 - DNA, 20 bp, Artificial sequence
  SiRNA target sequence
tcttaaaagctttgtaattt

SEQ ID NO: 211539 - DNA, 20 bp, Artificial sequence
  SiRNA target sequence
cttaaaagctttgtaatttt

SEQ ID NO: 211540 - DNA, 20 bp, Artificial sequence
  SiRNA target sequence
ttaaaagctttgtaatttta

SEQ ID NO: 211541 - DNA, 20 bp, Artificial sequence
  SiRNA target sequence
taaaagctttgtaattttac

SEQ ID NO: 211542 - DNA, 20 bp, Artificial sequence
  SiRNA target sequence
aaaagctttgtaattttacc

SEQ ID NO: 211543 - DNA, 20 bp, Artificial sequence
  SiRNA target sequence
aaagctttgtaattttacca

SEQ ID NO: 211544 - DNA, 20 bp, Artificial sequence
  SiRNA target sequence
aagctttgtaattttaccag

SEQ ID NO: 211545 - DNA, 20 bp, Artificial sequence
  SiRNA target sequence
agctttgtaattttaccagt

SEQ ID NO: 211546 - DNA, 20 bp, Artificial sequence
  SiRNA target sequence
gctttgtaattttaccagtt

SEQ ID NO: 211547 - DNA, 20 bp, Artificial sequence
  SiRNA target sequence
ctttgtaattttaccagtta

SEQ ID NO: 211548 - DNA, 20 bp, Artificial sequence
  SiRNA target sequence
tttgtaattttaccagttac

SEQ ID NO: 211549 - DNA, 20 bp, Artificial sequence
  SiRNA target sequence
ttgtaattttaccagttact

SEQ ID NO: 211550 - DNA, 20 bp, Artificial sequence
  SiRNA target sequence
tgtaattttaccagttactc

SEQ ID NO: 211551 - DNA, 20 bp, Artificial sequence
  SiRNA target sequence
gtaattttaccagttactct

SEQ ID NO: 211552 - DNA, 20 bp, Artificial sequence
  SiRNA target sequence
taattttaccagttactctt

SEQ ID NO: 211553 - DNA, 20 bp, Artificial sequence
  SiRNA target sequence
aattttaccagttactcttg

SEQ ID NO: 211554 - DNA, 20 bp, Artificial sequence
  SiRNA target sequence
attttaccagttactcttgt

SEQ ID NO: 211555 - DNA, 20 bp, Artificial sequence
  SiRNA target sequence
ttttaccagttactcttgtt

SEQ ID NO: 211556 - DNA, 20 bp, Artificial sequence
  SiRNA target sequence
tttaccagttactcttgttt

SEQ ID NO: 211557 - DNA, 20 bp, Artificial sequence
  SiRNA target sequence
ttaccagttactcttgtttg

SEQ ID NO: 211558 - DNA, 20 bp, Artificial sequence
  SiRNA target sequence
taccagttactcttgtttgt

SEQ ID NO: 211559 - DNA, 20 bp, Artificial sequence
  SiRNA target sequence
accagttactcttgtttgtg

SEQ ID NO: 211560 - DNA, 20 bp, Artificial sequence
  SiRNA target sequence
ccagttactcttgtttgtgt

SEQ ID NO: 211561 - DNA, 20 bp, Artificial sequence
  SiRNA target sequence
cagttactcttgtttgtgta

SEQ ID NO: 211562 - DNA, 20 bp, Artificial sequence
  SiRNA target sequence
agttactcttgtttgtgtag

SEQ ID NO: 211563 - DNA, 20 bp, Artificial sequence
  SiRNA target sequence
gttactcttgtttgtgtagg

SEQ ID NO: 211564 - DNA, 20 bp, Artificial sequence
  SiRNA target sequence
ttactcttgtttgtgtagga

SEQ ID NO: 211565 - DNA, 20 bp, Artificial sequence
  SiRNA target sequence
tactcttgtttgtgtaggat

SEQ ID NO: 211566 - DNA, 20 bp, Artificial sequence
  SiRNA target sequence
actcttgtttgtgtaggatt

SEQ ID NO: 211567 - DNA, 20 bp, Artificial sequence
  SiRNA target sequence
ctcttgtttgtgtaggatta

SEQ ID NO: 211568 - DNA, 20 bp, Artificial sequence
  SiRNA target sequence
tcttgtttgtgtaggattaa

SEQ ID NO: 211569 - DNA, 20 bp, Artificial sequence
  SiRNA target sequence
cttgtttgtgtaggattaat

SEQ ID NO: 211570 - DNA, 20 bp, Artificial sequence
  SiRNA target sequence
ttgtttgtgtaggattaatt

SEQ ID NO: 211571 - DNA, 20 bp, Artificial sequence
  SiRNA target sequence
tgtttgtgtaggattaattc

SEQ ID NO: 211572 - DNA, 20 bp, Artificial sequence
  SiRNA target sequence
gtttgtgtaggattaattca

SEQ ID NO: 211573 - DNA, 20 bp, Artificial sequence
  SiRNA target sequence
tttgtgtaggattaattcag

SEQ ID NO: 211574 - DNA, 20 bp, Artificial sequence
  SiRNA target sequence
ttgtgtaggattaattcaga

SEQ ID NO: 211575 - DNA, 20 bp, Artificial sequence
  SiRNA target sequence
tgtgtaggattaattcagaa

SEQ ID NO: 211576 - DNA, 20 bp, Artificial sequence
  SiRNA target sequence
gtgtaggattaattcagaag

SEQ ID NO: 211577 - DNA, 20 bp, Artificial sequence
  SiRNA target sequence
tgtaggattaattcagaagt

SEQ ID NO: 211578 - DNA, 20 bp, Artificial sequence
  SiRNA target sequence
gtaggattaattcagaagtc

SEQ ID NO: 211579 - DNA, 20 bp, Artificial sequence
  SiRNA target sequence
taggattaattcagaagtct

SEQ ID NO: 211580 - DNA, 20 bp, Artificial sequence
  SiRNA target sequence
aggattaattcagaagtcta

SEQ ID NO: 211581 - DNA, 20 bp, Artificial sequence
  SiRNA target sequence
ggattaattcagaagtctac

SEQ ID NO: 211582 - DNA, 20 bp, Artificial sequence
  SiRNA target sequence
gattaattcagaagtctaca

SEQ ID NO: 211583 - DNA, 20 bp, Artificial sequence
  SiRNA target sequence
attaattcagaagtctacac

SEQ ID NO: 211584 - DNA, 20 bp, Artificial sequence
  SiRNA target sequence
ttaattcagaagtctacact

SEQ ID NO: 211585 - DNA, 20 bp, Artificial sequence
  SiRNA target sequence
taattcagaagtctacactc

SEQ ID NO: 211586 - DNA, 20 bp, Artificial sequence
  SiRNA target sequence
aattcagaagtctacactct

SEQ ID NO: 211587 - DNA, 20 bp, Artificial sequence
  SiRNA target sequence
attcagaagtctacactctc

SEQ ID NO: 211588 - DNA, 20 bp, Artificial sequence
  SiRNA target sequence
ttcagaagtctacactctct

SEQ ID NO: 211589 - DNA, 20 bp, Artificial sequence
  SiRNA target sequence
tcagaagtctacactctctt

SEQ ID NO: 211590 - DNA, 20 bp, Artificial sequence
  SiRNA target sequence
cagaagtctacactctctta

SEQ ID NO: 211591 - DNA, 20 bp, Artificial sequence
  SiRNA target sequence
agaagtctacactctcttat

SEQ ID NO: 211592 - DNA, 20 bp, Artificial sequence
  SiRNA target sequence
gaagtctacactctcttatt

SEQ ID NO: 211593 - DNA, 20 bp, Artificial sequence
  SiRNA target sequence
aagtctacactctcttattc

SEQ ID NO: 211594 - DNA, 20 bp, Artificial sequence
  SiRNA target sequence
agtctacactctcttattct

SEQ ID NO: 211595 - DNA, 20 bp, Artificial sequence
  SiRNA target sequence
gtctacactctcttattctt

SEQ ID NO: 211596 - DNA, 20 bp, Artificial sequence
  SiRNA target sequence
tctacactctcttattcttt

SEQ ID NO: 211597 - DNA, 20 bp, Artificial sequence
  SiRNA target sequence
ctacactctcttattctttt

SEQ ID NO: 211598 - DNA, 20 bp, Artificial sequence
  SiRNA target sequence
tacactctcttattctttta

SEQ ID NO: 211599 - DNA, 20 bp, Artificial sequence
  SiRNA target sequence
acactctcttattcttttac

SEQ ID NO: 211600 - DNA, 20 bp, Artificial sequence
  SiRNA target sequence
cactctcttattcttttaca

SEQ ID NO: 211601 - DNA, 20 bp, Artificial sequence
  SiRNA target sequence
actctcttattcttttacaa

SEQ ID NO: 211602 - DNA, 20 bp, Artificial sequence
  SiRNA target sequence
ctctcttattcttttacaaa

SEQ ID NO: 211603 - DNA, 20 bp, Artificial sequence
  SiRNA target sequence
tctcttattcttttacaaaa

SEQ ID NO: 211604 - DNA, 20 bp, Artificial sequence
  SiRNA target sequence
ctcttattcttttacaaaaa

SEQ ID NO: 211605 - DNA, 20 bp, Artificial sequence
  SiRNA target sequence
tcttattcttttacaaaaat

SEQ ID NO: 211606 - DNA, 20 bp, Artificial sequence
  SiRNA target sequence
cttattcttttacaaaaata

SEQ ID NO: 211607 - DNA, 20 bp, Artificial sequence
  SiRNA target sequence
ttattcttttacaaaaatat

SEQ ID NO: 211608 - DNA, 20 bp, Artificial sequence
  SiRNA target sequence
tattcttttacaaaaatatt

SEQ ID NO: 211609 - DNA, 20 bp, Artificial sequence
  SiRNA target sequence
attcttttacaaaaatattt

SEQ ID NO: 211610 - DNA, 20 bp, Artificial sequence
  SiRNA target sequence
ttcttttacaaaaatatttg

SEQ ID NO: 211611 - DNA, 20 bp, Artificial sequence
  SiRNA target sequence
tcttttacaaaaatatttga

SEQ ID NO: 211612 - DNA, 20 bp, Artificial sequence
  SiRNA target sequence
cttttacaaaaatatttgat

SEQ ID NO: 211613 - DNA, 20 bp, Artificial sequence
  SiRNA target sequence
ttttacaaaaatatttgatg

SEQ ID NO: 211614 - DNA, 20 bp, Artificial sequence
  SiRNA target sequence
tttacaaaaatatttgatgg

SEQ ID NO: 211615 - DNA, 20 bp, Artificial sequence
  SiRNA target sequence
ttacaaaaatatttgatggt

SEQ ID NO: 211616 - DNA, 20 bp, Artificial sequence
  SiRNA target sequence
tacaaaaatatttgatggtg

SEQ ID NO: 211617 - DNA, 20 bp, Artificial sequence
  SiRNA target sequence
acaaaaatatttgatggtgc

SEQ ID NO: 211618 - DNA, 20 bp, Artificial sequence
  SiRNA target sequence
caaaaatatttgatggtgca

SEQ ID NO: 211619 - DNA, 20 bp, Artificial sequence
  SiRNA target sequence
aaaaatatttgatggtgcat

SEQ ID NO: 211620 - DNA, 20 bp, Artificial sequence
  SiRNA target sequence
aaaatatttgatggtgcatt

SEQ ID NO: 211621 - DNA, 20 bp, Artificial sequence
  SiRNA target sequence
aaatatttgatggtgcattg

SEQ ID NO: 211622 - DNA, 20 bp, Artificial sequence
  SiRNA target sequence
aatatttgatggtgcattgt

SEQ ID NO: 211623 - DNA, 20 bp, Artificial sequence
  SiRNA target sequence
atatttgatggtgcattgtt

SEQ ID NO: 211624 - DNA, 20 bp, Artificial sequence
  SiRNA target sequence
tatttgatggtgcattgtta

SEQ ID NO: 211625 - DNA, 20 bp, Artificial sequence
  SiRNA target sequence
atttgatggtgcattgttaa

SEQ ID NO: 211626 - DNA, 20 bp, Artificial sequence
  SiRNA target sequence
tttgatggtgcattgttaat

SEQ ID NO: 211627 - DNA, 20 bp, Artificial sequence
  SiRNA target sequence
ttgatggtgcattgttaata

SEQ ID NO: 211628 - DNA, 20 bp, Artificial sequence
  SiRNA target sequence
tgatggtgcattgttaatat

SEQ ID NO: 211629 - DNA, 20 bp, Artificial sequence
  SiRNA target sequence
gatggtgcattgttaatatt

SEQ ID NO: 211630 - DNA, 20 bp, Artificial sequence
  SiRNA target sequence
atggtgcattgttaatattt

SEQ ID NO: 211631 - DNA, 20 bp, Artificial sequence
  SiRNA target sequence
tggtgcattgttaatatttg

SEQ ID NO: 211632 - DNA, 20 bp, Artificial sequence
  SiRNA target sequence
ggtgcattgttaatatttgc

SEQ ID NO: 211633 - DNA, 20 bp, Artificial sequence
  SiRNA target sequence
gtgcattgttaatatttgct

SEQ ID NO: 211634 - DNA, 20 bp, Artificial sequence
  SiRNA target sequence
tgcattgttaatatttgctt

SEQ ID NO: 211635 - DNA, 20 bp, Artificial sequence
  SiRNA target sequence
gcattgttaatatttgcttt

SEQ ID NO: 211636 - DNA, 20 bp, Artificial sequence
  SiRNA target sequence
cattgttaatatttgctttt

SEQ ID NO: 211637 - DNA, 20 bp, Artificial sequence
  SiRNA target sequence
attgttaatatttgcttttc

SEQ ID NO: 211638 - DNA, 20 bp, Artificial sequence
  SiRNA target sequence
ttgttaatatttgcttttct

SEQ ID NO: 211639 - DNA, 20 bp, Artificial sequence
  SiRNA target sequence
tgttaatatttgcttttctt

SEQ ID NO: 211640 - DNA, 20 bp, Artificial sequence
  SiRNA target sequence
gttaatatttgcttttcttt

SEQ ID NO: 211641 - DNA, 20 bp, Artificial sequence
  SiRNA target sequence
ttaatatttgcttttcttta

SEQ ID NO: 211642 - DNA, 20 bp, Artificial sequence
  SiRNA target sequence
taatatttgcttttctttat

SEQ ID NO: 211643 - DNA, 20 bp, Artificial sequence
  SiRNA target sequence
aatatttgcttttctttata

SEQ ID NO: 211644 - DNA, 20 bp, Artificial sequence
  SiRNA target sequence
atatttgcttttctttatat

SEQ ID NO: 211645 - DNA, 20 bp, Artificial sequence
  SiRNA target sequence
tatttgcttttctttatatc

SEQ ID NO: 211646 - DNA, 20 bp, Artificial sequence
  SiRNA target sequence
atttgcttttctttatatca

SEQ ID NO: 211647 - DNA, 20 bp, Artificial sequence
  SiRNA target sequence
tttgcttttctttatatcat

SEQ ID NO: 211648 - DNA, 20 bp, Artificial sequence
  SiRNA target sequence
ttgcttttctttatatcatt

SEQ ID NO: 211649 - DNA, 20 bp, Artificial sequence
  SiRNA target sequence
tgcttttctttatatcattc

SEQ ID NO: 211650 - DNA, 20 bp, Artificial sequence
  SiRNA target sequence
gcttttctttatatcattct

SEQ ID NO: 211651 - DNA, 20 bp, Artificial sequence
  SiRNA target sequence
cttttctttatatcattctt

SEQ ID NO: 211652 - DNA, 20 bp, Artificial sequence
  SiRNA target sequence
ttttctttatatcattcttg

SEQ ID NO: 211653 - DNA, 20 bp, Artificial sequence
  SiRNA target sequence
tttctttatatcattcttgg

SEQ ID NO: 211654 - DNA, 20 bp, Artificial sequence
  SiRNA target sequence
ttctttatatcattcttggt

SEQ ID NO: 211655 - DNA, 20 bp, Artificial sequence
  SiRNA target sequence
tctttatatcattcttggtc

SEQ ID NO: 211656 - DNA, 20 bp, Artificial sequence
  SiRNA target sequence
ctttatatcattcttggtct

SEQ ID NO: 211657 - DNA, 20 bp, Artificial sequence
  SiRNA target sequence
tttatatcattcttggtcta

SEQ ID NO: 211658 - DNA, 20 bp, Artificial sequence
  SiRNA target sequence
ttatatcattcttggtctag

SEQ ID NO: 211659 - DNA, 20 bp, Artificial sequence
  SiRNA target sequence
tatatcattcttggtctagt

SEQ ID NO: 211660 - DNA, 20 bp, Artificial sequence
  SiRNA target sequence
atatcattcttggtctagtt

SEQ ID NO: 211661 - DNA, 20 bp, Artificial sequence
  SiRNA target sequence
tatcattcttggtctagttc

SEQ ID NO: 211662 - DNA, 20 bp, Artificial sequence
  SiRNA target sequence
atcattcttggtctagttct

SEQ ID NO: 211663 - DNA, 20 bp, Artificial sequence
  SiRNA target sequence
tcattcttggtctagttctt

SEQ ID NO: 211664 - DNA, 20 bp, Artificial sequence
  SiRNA target sequence
cattcttggtctagttcttc

SEQ ID NO: 211665 - DNA, 20 bp, Artificial sequence
  SiRNA target sequence
attcttggtctagttcttct

SEQ ID NO: 211666 - DNA, 20 bp, Artificial sequence
  SiRNA target sequence
ttcttggtctagttcttctt

SEQ ID NO: 211667 - DNA, 20 bp, Artificial sequence
  SiRNA target sequence
tcttggtctagttcttcttc

SEQ ID NO: 211668 - DNA, 20 bp, Artificial sequence
  SiRNA target sequence
cttggtctagttcttcttcc

SEQ ID NO: 211669 - DNA, 20 bp, Artificial sequence
  SiRNA target sequence
ttggtctagttcttcttcca

SEQ ID NO: 211670 - DNA, 20 bp, Artificial sequence
  SiRNA target sequence
tggtctagttcttcttccat

SEQ ID NO: 211671 - DNA, 20 bp, Artificial sequence
  SiRNA target sequence
ggtctagttcttcttccata

SEQ ID NO: 211672 - DNA, 20 bp, Artificial sequence
  SiRNA target sequence
gtctagttcttcttccatat

SEQ ID NO: 211673 - DNA, 20 bp, Artificial sequence
  SiRNA target sequence
tctagttcttcttccatatt

SEQ ID NO: 211674 - DNA, 20 bp, Artificial sequence
  SiRNA target sequence
ctagttcttcttccatattc

SEQ ID NO: 211675 - DNA, 20 bp, Artificial sequence
  SiRNA target sequence
tagttcttcttccatattct

SEQ ID NO: 211676 - DNA, 20 bp, Artificial sequence
  SiRNA target sequence
agttcttcttccatattctc

SEQ ID NO: 211677 - DNA, 20 bp, Artificial sequence
  SiRNA target sequence
gttcttcttccatattctca

SEQ ID NO: 211678 - DNA, 20 bp, Artificial sequence
  SiRNA target sequence
ttcttcttccatattctcat

SEQ ID NO: 211679 - DNA, 20 bp, Artificial sequence
  SiRNA target sequence
tcttcttccatattctcatc

SEQ ID NO: 211680 - DNA, 20 bp, Artificial sequence
  SiRNA target sequence
cttcttccatattctcatct

SEQ ID NO: 211681 - DNA, 20 bp, Artificial sequence
  SiRNA target sequence
ttcttccatattctcatctt

SEQ ID NO: 211682 - DNA, 20 bp, Artificial sequence
  SiRNA target sequence
tcttccatattctcatcttt

SEQ ID NO: 211683 - DNA, 20 bp, Artificial sequence
  SiRNA target sequence
cttccatattctcatctttt

SEQ ID NO: 211684 - DNA, 20 bp, Artificial sequence
  SiRNA target sequence
ttccatattctcatcttttc

SEQ ID NO: 211685 - DNA, 20 bp, Artificial sequence
  SiRNA target sequence
tccatattctcatcttttcc

SEQ ID NO: 211686 - DNA, 20 bp, Artificial sequence
  SiRNA target sequence
ccatattctcatcttttcca

SEQ ID NO: 211687 - DNA, 20 bp, Artificial sequence
  SiRNA target sequence
catattctcatcttttccag

SEQ ID NO: 211688 - DNA, 20 bp, Artificial sequence
  SiRNA target sequence
atattctcatcttttccagc

SEQ ID NO: 211689 - DNA, 20 bp, Artificial sequence
  SiRNA target sequence
tattctcatcttttccagct

SEQ ID NO: 211690 - DNA, 20 bp, Artificial sequence
  SiRNA target sequence
attctcatcttttccagctt

SEQ ID NO: 211691 - DNA, 20 bp, Artificial sequence
  SiRNA target sequence
ttctcatcttttccagcttg

SEQ ID NO: 211692 - DNA, 20 bp, Artificial sequence
  SiRNA target sequence
tctcatcttttccagcttga

SEQ ID NO: 211693 - DNA, 20 bp, Artificial sequence
  SiRNA target sequence
ctcatcttttccagcttgat

SEQ ID NO: 211694 - DNA, 20 bp, Artificial sequence
  SiRNA target sequence
tcatcttttccagcttgata

SEQ ID NO: 211695 - DNA, 20 bp, Artificial sequence
  SiRNA target sequence
catcttttccagcttgatag

SEQ ID NO: 211696 - DNA, 20 bp, Artificial sequence
  SiRNA target sequence
atcttttccagcttgatagt

SEQ ID NO: 211697 - DNA, 20 bp, Artificial sequence
  SiRNA target sequence
tcttttccagcttgatagtt

SEQ ID NO: 211698 - DNA, 20 bp, Artificial sequence
  SiRNA target sequence
cttttccagcttgatagtta

SEQ ID NO: 211699 - DNA, 20 bp, Artificial sequence
  SiRNA target sequence
ttttccagcttgatagttat

SEQ ID NO: 211700 - DNA, 20 bp, Artificial sequence
  SiRNA target sequence
tttccagcttgatagttatt

SEQ ID NO: 211701 - DNA, 20 bp, Artificial sequence
  SiRNA target sequence
ttccagcttgatagttattt

SEQ ID NO: 211702 - DNA, 20 bp, Artificial sequence
  SiRNA target sequence
tccagcttgatagttatttt

SEQ ID NO: 211703 - DNA, 20 bp, Artificial sequence
  SiRNA target sequence
ccagcttgatagttattttt

SEQ ID NO: 211704 - DNA, 20 bp, Artificial sequence
  SiRNA target sequence
cagcttgatagttatttttt

SEQ ID NO: 211705 - DNA, 20 bp, Artificial sequence
  SiRNA target sequence
agcttgatagttattttttt

SEQ ID NO: 211706 - DNA, 20 bp, Artificial sequence
  SiRNA target sequence
gcttgatagttattttttta

SEQ ID NO: 211707 - DNA, 20 bp, Artificial sequence
  SiRNA target sequence
cttgatagttatttttttag

SEQ ID NO: 211708 - DNA, 20 bp, Artificial sequence
  SiRNA target sequence
ttgatagttatttttttaga

SEQ ID NO: 211709 - DNA, 20 bp, Artificial sequence
  SiRNA target sequence
tgatagttatttttttagag

SEQ ID NO: 211710 - DNA, 20 bp, Artificial sequence
  SiRNA target sequence
gatagttatttttttagaga

SEQ ID NO: 211711 - DNA, 20 bp, Artificial sequence
  SiRNA target sequence
atagttatttttttagagac

SEQ ID NO: 211712 - DNA, 20 bp, Artificial sequence
  SiRNA target sequence
tagttatttttttagagacc

SEQ ID NO: 211713 - DNA, 20 bp, Artificial sequence
  SiRNA target sequence
agttatttttttagagacct

SEQ ID NO: 211714 - DNA, 20 bp, Artificial sequence
  SiRNA target sequence
gttatttttttagagacctt

SEQ ID NO: 211715 - DNA, 20 bp, Artificial sequence
  SiRNA target sequence
ttatttttttagagaccttt

SEQ ID NO: 211716 - DNA, 20 bp, Artificial sequence
  SiRNA target sequence
tatttttttagagacctttt

SEQ ID NO: 211717 - DNA, 20 bp, Artificial sequence
  SiRNA target sequence
atttttttagagaccttttt

SEQ ID NO: 211718 - DNA, 20 bp, Artificial sequence
  SiRNA target sequence
tttttttagagaccttttta

SEQ ID NO: 211719 - DNA, 20 bp, Artificial sequence
  SiRNA target sequence
ttttttagagacctttttag

SEQ ID NO: 211720 - DNA, 20 bp, Artificial sequence
  SiRNA target sequence
tttttagagacctttttagt

SEQ ID NO: 211721 - DNA, 20 bp, Artificial sequence
  SiRNA target sequence
ttttagagacctttttagtg

SEQ ID NO: 211722 - DNA, 20 bp, Artificial sequence
  SiRNA target sequence
tttagagacctttttagtga

SEQ ID NO: 211723 - DNA, 20 bp, Artificial sequence
  SiRNA target sequence
ttagagacctttttagtgat

SEQ ID NO: 211724 - DNA, 20 bp, Artificial sequence
  SiRNA target sequence
tagagacctttttagtgatg

SEQ ID NO: 211725 - DNA, 20 bp, Artificial sequence
  SiRNA target sequence
agagacctttttagtgatgg

SEQ ID NO: 211726 - DNA, 20 bp, Artificial sequence
  SiRNA target sequence
gagacctttttagtgatggg

SEQ ID NO: 211727 - DNA, 20 bp, Artificial sequence
  SiRNA target sequence
agacctttttagtgatggga

SEQ ID NO: 211728 - DNA, 20 bp, Artificial sequence
  SiRNA target sequence
gacctttttagtgatgggaa

SEQ ID NO: 211729 - DNA, 20 bp, Artificial sequence
  SiRNA target sequence
acctttttagtgatgggaaa

SEQ ID NO: 211730 - DNA, 20 bp, Artificial sequence
  SiRNA target sequence
cctttttagtgatgggaaat

SEQ ID NO: 211731 - DNA, 20 bp, Artificial sequence
  SiRNA target sequence
ctttttagtgatgggaaatg

SEQ ID NO: 211732 - DNA, 20 bp, Artificial sequence
  SiRNA target sequence
tttttagtgatgggaaatgt

SEQ ID NO: 211733 - DNA, 20 bp, Artificial sequence
  SiRNA target sequence
ttttagtgatgggaaatgtg

SEQ ID NO: 211734 - DNA, 20 bp, Artificial sequence
  SiRNA target sequence
tttagtgatgggaaatgtgt

SEQ ID NO: 211735 - DNA, 20 bp, Artificial sequence
  SiRNA target sequence
ttagtgatgggaaatgtgtt

SEQ ID NO: 211736 - DNA, 20 bp, Artificial sequence
  SiRNA target sequence
tagtgatgggaaatgtgttg

SEQ ID NO: 211737 - DNA, 20 bp, Artificial sequence
  SiRNA target sequence
agtgatgggaaatgtgttgt

SEQ ID NO: 211738 - DNA, 20 bp, Artificial sequence
  SiRNA target sequence
gtgatgggaaatgtgttgta

SEQ ID NO: 211739 - DNA, 20 bp, Artificial sequence
  SiRNA target sequence
tgatgggaaatgtgttgtaa

SEQ ID NO: 211740 - DNA, 20 bp, Artificial sequence
  SiRNA target sequence
gatgggaaatgtgttgtaag

SEQ ID NO: 211741 - DNA, 20 bp, Artificial sequence
  SiRNA target sequence
atgggaaatgtgttgtaaga

SEQ ID NO: 211742 - DNA, 20 bp, Artificial sequence
  SiRNA target sequence
tgggaaatgtgttgtaagag

SEQ ID NO: 211743 - DNA, 20 bp, Artificial sequence
  SiRNA target sequence
gggaaatgtgttgtaagagg

SEQ ID NO: 211744 - DNA, 20 bp, Artificial sequence
  SiRNA target sequence
ggaaatgtgttgtaagaggc

SEQ ID NO: 211745 - DNA, 20 bp, Artificial sequence
  SiRNA target sequence
gaaatgtgttgtaagaggct

SEQ ID NO: 211746 - DNA, 20 bp, Artificial sequence
  SiRNA target sequence
aaatgtgttgtaagaggcta

SEQ ID NO: 211747 - DNA, 20 bp, Artificial sequence
  SiRNA target sequence
aatgtgttgtaagaggctat

SEQ ID NO: 211748 - DNA, 20 bp, Artificial sequence
  SiRNA target sequence
atgtgttgtaagaggctatg

SEQ ID NO: 211749 - DNA, 20 bp, Artificial sequence
  SiRNA target sequence
tgtgttgtaagaggctatga

SEQ ID NO: 211750 - DNA, 20 bp, Artificial sequence
  SiRNA target sequence
gtgttgtaagaggctatgat

SEQ ID NO: 211751 - DNA, 20 bp, Artificial sequence
  SiRNA target sequence
tgttgtaagaggctatgatg

SEQ ID NO: 211752 - DNA, 20 bp, Artificial sequence
  SiRNA target sequence
gttgtaagaggctatgatgc

SEQ ID NO: 211753 - DNA, 20 bp, Artificial sequence
  SiRNA target sequence
ttgtaagaggctatgatgct

SEQ ID NO: 211754 - DNA, 20 bp, Artificial sequence
  SiRNA target sequence
tgtaagaggctatgatgctt

SEQ ID NO: 211755 - DNA, 20 bp, Artificial sequence
  SiRNA target sequence
gtaagaggctatgatgcttt

SEQ ID NO: 211756 - DNA, 20 bp, Artificial sequence
  SiRNA target sequence
taagaggctatgatgcttta

SEQ ID NO: 211757 - DNA, 20 bp, Artificial sequence
  SiRNA target sequence
aagaggctatgatgctttat

SEQ ID NO: 211758 - DNA, 20 bp, Artificial sequence
  SiRNA target sequence
agaggctatgatgctttatt

SEQ ID NO: 211759 - DNA, 20 bp, Artificial sequence
  SiRNA target sequence
gaggctatgatgctttatta

SEQ ID NO: 211760 - DNA, 20 bp, Artificial sequence
  SiRNA target sequence
aggctatgatgctttattat

SEQ ID NO: 211761 - DNA, 20 bp, Artificial sequence
  SiRNA target sequence
ggctatgatgctttattatc

SEQ ID NO: 211762 - DNA, 20 bp, Artificial sequence
  SiRNA target sequence
gctatgatgctttattatct

SEQ ID NO: 211763 - DNA, 20 bp, Artificial sequence
  SiRNA target sequence
ctatgatgctttattatctt

SEQ ID NO: 211764 - DNA, 20 bp, Artificial sequence
  SiRNA target sequence
tatgatgctttattatcttt

SEQ ID NO: 211765 - DNA, 20 bp, Artificial sequence
  SiRNA target sequence
atgatgctttattatctttg

SEQ ID NO: 211766 - DNA, 20 bp, Artificial sequence
  SiRNA target sequence
tgatgctttattatctttgg

SEQ ID NO: 211767 - DNA, 20 bp, Artificial sequence
  SiRNA target sequence
gatgctttattatctttggc

SEQ ID NO: 211768 - DNA, 20 bp, Artificial sequence
  SiRNA target sequence
atgctttattatctttggca

SEQ ID NO: 211769 - DNA, 20 bp, Artificial sequence
  SiRNA target sequence
tgctttattatctttggcac

SEQ ID NO: 211770 - DNA, 20 bp, Artificial sequence
  SiRNA target sequence
gctttattatctttggcact

SEQ ID NO: 211771 - DNA, 20 bp, Artificial sequence
  SiRNA target sequence
ctttattatctttggcactg

SEQ ID NO: 211772 - DNA, 20 bp, Artificial sequence
  SiRNA target sequence
tttattatctttggcactgg

SEQ ID NO: 211773 - DNA, 20 bp, Artificial sequence
  SiRNA target sequence
ttattatctttggcactggt

SEQ ID NO: 211774 - DNA, 20 bp, Artificial sequence
  SiRNA target sequence
tattatctttggcactggtc

SEQ ID NO: 211775 - DNA, 20 bp, Artificial sequence
  SiRNA target sequence
attatctttggcactggtct

SEQ ID NO: 211776 - DNA, 20 bp, Artificial sequence
  SiRNA target sequence
ttatctttggcactggtctt

SEQ ID NO: 211777 - DNA, 20 bp, Artificial sequence
  SiRNA target sequence
tatctttggcactggtcttt

SEQ ID NO: 211778 - DNA, 20 bp, Artificial sequence
  SiRNA target sequence
atctttggcactggtcttta

SEQ ID NO: 211779 - DNA, 20 bp, Artificial sequence
  SiRNA target sequence
tctttggcactggtctttaa

SEQ ID NO: 211780 - DNA, 20 bp, Artificial sequence
  SiRNA target sequence
ctttggcactggtctttaac

SEQ ID NO: 211781 - DNA, 20 bp, Artificial sequence
  SiRNA target sequence
tttggcactggtctttaacg

SEQ ID NO: 211782 - DNA, 20 bp, Artificial sequence
  SiRNA target sequence
ttggcactggtctttaacga

SEQ ID NO: 211783 - DNA, 20 bp, Artificial sequence
  SiRNA target sequence
tggcactggtctttaacgaa

SEQ ID NO: 211784 - DNA, 20 bp, Artificial sequence
  SiRNA target sequence
ggcactggtctttaacgaat

SEQ ID NO: 211785 - DNA, 20 bp, Artificial sequence
  SiRNA target sequence
gcactggtctttaacgaatg

SEQ ID NO: 211786 - DNA, 20 bp, Artificial sequence
  SiRNA target sequence
cactggtctttaacgaatgg

SEQ ID NO: 211787 - DNA, 20 bp, Artificial sequence
  SiRNA target sequence
actggtctttaacgaatgga

SEQ ID NO: 211788 - DNA, 20 bp, Artificial sequence
  SiRNA target sequence
ctggtctttaacgaatggac

SEQ ID NO: 211789 - DNA, 20 bp, Artificial sequence
  SiRNA target sequence
tggtctttaacgaatggaca

SEQ ID NO: 211790 - DNA, 20 bp, Artificial sequence
  SiRNA target sequence
ggtctttaacgaatggacat

SEQ ID NO: 211791 - DNA, 20 bp, Artificial sequence
  SiRNA target sequence
gtctttaacgaatggacatc

SEQ ID NO: 211792 - DNA, 20 bp, Artificial sequence
  SiRNA target sequence
tctttaacgaatggacatcc

SEQ ID NO: 211793 - DNA, 20 bp, Artificial sequence
  SiRNA target sequence
ctttaacgaatggacatcct

SEQ ID NO: 211794 - DNA, 20 bp, Artificial sequence
  SiRNA target sequence
tttaacgaatggacatcctc

SEQ ID NO: 211795 - DNA, 20 bp, Artificial sequence
  SiRNA target sequence
ttaacgaatggacatcctct

SEQ ID NO: 211796 - DNA, 20 bp, Artificial sequence
  SiRNA target sequence
taacgaatggacatcctctc

SEQ ID NO: 211797 - DNA, 20 bp, Artificial sequence
  SiRNA target sequence
aacgaatggacatcctctct

SEQ ID NO: 211798 - DNA, 20 bp, Artificial sequence
  SiRNA target sequence
acgaatggacatcctctcta

SEQ ID NO: 211799 - DNA, 20 bp, Artificial sequence
  SiRNA target sequence
cgaatggacatcctctctag

SEQ ID NO: 211800 - DNA, 20 bp, Artificial sequence
  SiRNA target sequence
gaatggacatcctctctagt

SEQ ID NO: 211801 - DNA, 20 bp, Artificial sequence
  SiRNA target sequence
aatggacatcctctctagtt

SEQ ID NO: 211802 - DNA, 20 bp, Artificial sequence
  SiRNA target sequence
atggacatcctctctagttt

SEQ ID NO: 211803 - DNA, 20 bp, Artificial sequence
  SiRNA target sequence
tggacatcctctctagttta

SEQ ID NO: 211804 - DNA, 20 bp, Artificial sequence
  SiRNA target sequence
ggacatcctctctagtttac

SEQ ID NO: 211805 - DNA, 20 bp, Artificial sequence
  SiRNA target sequence
gacatcctctctagtttaca

SEQ ID NO: 211806 - DNA, 20 bp, Artificial sequence
  SiRNA target sequence
acatcctctctagtttacat

SEQ ID NO: 211807 - DNA, 20 bp, Artificial sequence
  SiRNA target sequence
catcctctctagtttacatt

SEQ ID NO: 211808 - DNA, 20 bp, Artificial sequence
  SiRNA target sequence
atcctctctagtttacattg

SEQ ID NO: 211809 - DNA, 20 bp, Artificial sequence
  SiRNA target sequence
tcctctctagtttacattgt

SEQ ID NO: 211810 - DNA, 20 bp, Artificial sequence
  SiRNA target sequence
cctctctagtttacattgtt

SEQ ID NO: 211811 - DNA, 20 bp, Artificial sequence
  SiRNA target sequence
ctctctagtttacattgttt

SEQ ID NO: 211812 - DNA, 20 bp, Artificial sequence
  SiRNA target sequence
tctctagtttacattgtttc

SEQ ID NO: 211813 - DNA, 20 bp, Artificial sequence
  SiRNA target sequence
ctctagtttacattgtttca

SEQ ID NO: 211814 - DNA, 20 bp, Artificial sequence
  SiRNA target sequence
tctagtttacattgtttcag

SEQ ID NO: 211815 - DNA, 20 bp, Artificial sequence
  SiRNA target sequence
ctagtttacattgtttcaga

SEQ ID NO: 211816 - DNA, 20 bp, Artificial sequence
  SiRNA target sequence
tagtttacattgtttcagaa

SEQ ID NO: 211817 - DNA, 20 bp, Artificial sequence
  SiRNA target sequence
agtttacattgtttcagaaa

SEQ ID NO: 211818 - DNA, 20 bp, Artificial sequence
  SiRNA target sequence
gtttacattgtttcagaaat

SEQ ID NO: 211819 - DNA, 20 bp, Artificial sequence
  SiRNA target sequence
tttacattgtttcagaaatg

SEQ ID NO: 211820 - DNA, 20 bp, Artificial sequence
  SiRNA target sequence
ttacattgtttcagaaatgt

SEQ ID NO: 211821 - DNA, 20 bp, Artificial sequence
  SiRNA target sequence
tacattgtttcagaaatgtt

SEQ ID NO: 211822 - DNA, 20 bp, Artificial sequence
  SiRNA target sequence
acattgtttcagaaatgttt

SEQ ID NO: 211823 - DNA, 20 bp, Artificial sequence
  SiRNA target sequence
cattgtttcagaaatgtttg

SEQ ID NO: 211824 - DNA, 20 bp, Artificial sequence
  SiRNA target sequence
attgtttcagaaatgtttgg

SEQ ID NO: 211825 - DNA, 20 bp, Artificial sequence
  SiRNA target sequence
ttgtttcagaaatgtttggt

SEQ ID NO: 211826 - DNA, 20 bp, Artificial sequence
  SiRNA target sequence
tgtttcagaaatgtttggta

SEQ ID NO: 211827 - DNA, 20 bp, Artificial sequence
  SiRNA target sequence
gtttcagaaatgtttggtaa

SEQ ID NO: 211828 - DNA, 20 bp, Artificial sequence
  SiRNA target sequence
tttcagaaatgtttggtaat

SEQ ID NO: 211829 - DNA, 20 bp, Artificial sequence
  SiRNA target sequence
ttcagaaatgtttggtaatt

SEQ ID NO: 211830 - DNA, 20 bp, Artificial sequence
  SiRNA target sequence
tcagaaatgtttggtaattt

SEQ ID NO: 211831 - DNA, 20 bp, Artificial sequence
  SiRNA target sequence
cagaaatgtttggtaattta

SEQ ID NO: 211832 - DNA, 20 bp, Artificial sequence
  SiRNA target sequence
agaaatgtttggtaatttag

SEQ ID NO: 211833 - DNA, 20 bp, Artificial sequence
  SiRNA target sequence
gaaatgtttggtaatttagt

SEQ ID NO: 211834 - DNA, 20 bp, Artificial sequence
  SiRNA target sequence
aaatgtttggtaatttagta

SEQ ID NO: 211835 - DNA, 20 bp, Artificial sequence
  SiRNA target sequence
aatgtttggtaatttagtat

SEQ ID NO: 211836 - DNA, 20 bp, Artificial sequence
  SiRNA target sequence
atgtttggtaatttagtatt

SEQ ID NO: 211837 - DNA, 20 bp, Artificial sequence
  SiRNA target sequence
tgtttggtaatttagtattg

SEQ ID NO: 211838 - DNA, 20 bp, Artificial sequence
  SiRNA target sequence
gtttggtaatttagtattgt

SEQ ID NO: 211839 - DNA, 20 bp, Artificial sequence
  SiRNA target sequence
tttggtaatttagtattgtc

SEQ ID NO: 211840 - DNA, 20 bp, Artificial sequence
  SiRNA target sequence
ttggtaatttagtattgtct

SEQ ID NO: 211841 - DNA, 20 bp, Artificial sequence
  SiRNA target sequence
tggtaatttagtattgtctt

SEQ ID NO: 211842 - DNA, 20 bp, Artificial sequence
  SiRNA target sequence
ggtaatttagtattgtctta

SEQ ID NO: 211843 - DNA, 20 bp, Artificial sequence
  SiRNA target sequence
gtaatttagtattgtcttat

SEQ ID NO: 211844 - DNA, 20 bp, Artificial sequence
  SiRNA target sequence
taatttagtattgtcttatt

SEQ ID NO: 211845 - DNA, 20 bp, Artificial sequence
  SiRNA target sequence
aatttagtattgtcttattt

SEQ ID NO: 211846 - DNA, 20 bp, Artificial sequence
  SiRNA target sequence
atttagtattgtcttatttc

SEQ ID NO: 211847 - DNA, 20 bp, Artificial sequence
  SiRNA target sequence
tttagtattgtcttatttct

SEQ ID NO: 211848 - DNA, 20 bp, Artificial sequence
  SiRNA target sequence
ttagtattgtcttatttctt

SEQ ID NO: 211849 - DNA, 20 bp, Artificial sequence
  SiRNA target sequence
tagtattgtcttatttcttc

SEQ ID NO: 211850 - DNA, 20 bp, Artificial sequence
  SiRNA target sequence
agtattgtcttatttcttct

SEQ ID NO: 211851 - DNA, 20 bp, Artificial sequence
  SiRNA target sequence
gtattgtcttatttcttctt

SEQ ID NO: 211852 - DNA, 20 bp, Artificial sequence
  SiRNA target sequence
tattgtcttatttcttcttg

SEQ ID NO: 211853 - DNA, 20 bp, Artificial sequence
  SiRNA target sequence
attgtcttatttcttcttga

SEQ ID NO: 211854 - DNA, 20 bp, Artificial sequence
  SiRNA target sequence
ttgtcttatttcttcttgac

SEQ ID NO: 211855 - DNA, 20 bp, Artificial sequence
  SiRNA target sequence
tgtcttatttcttcttgacg

SEQ ID NO: 211856 - DNA, 20 bp, Artificial sequence
  SiRNA target sequence
gtcttatttcttcttgacgt

SEQ ID NO: 211857 - DNA, 20 bp, Artificial sequence
  SiRNA target sequence
tcttatttcttcttgacgtt

SEQ ID NO: 211858 - DNA, 20 bp, Artificial sequence
  SiRNA target sequence
cttatttcttcttgacgttt

SEQ ID NO: 211859 - DNA, 20 bp, Artificial sequence
  SiRNA target sequence
ttatttcttcttgacgtttg

SEQ ID NO: 211860 - DNA, 20 bp, Artificial sequence
  SiRNA target sequence
tatttcttcttgacgtttgc

SEQ ID NO: 211861 - DNA, 20 bp, Artificial sequence
  SiRNA target sequence
atttcttcttgacgtttgct

SEQ ID NO: 211862 - DNA, 20 bp, Artificial sequence
  SiRNA target sequence
tttcttcttgacgtttgcta

SEQ ID NO: 211863 - DNA, 20 bp, Artificial sequence
  SiRNA target sequence
ttcttcttgacgtttgctaa

SEQ ID NO: 211864 - DNA, 20 bp, Artificial sequence
  SiRNA target sequence
tcttcttgacgtttgctaat

SEQ ID NO: 211865 - DNA, 20 bp, Artificial sequence
  SiRNA target sequence
cttcttgacgtttgctaatt

SEQ ID NO: 211866 - DNA, 20 bp, Artificial sequence
  SiRNA target sequence
ttcttgacgtttgctaattc

SEQ ID NO: 211867 - DNA, 20 bp, Artificial sequence
  SiRNA target sequence
tcttgacgtttgctaattct

SEQ ID NO: 211868 - DNA, 20 bp, Artificial sequence
  SiRNA target sequence
cttgacgtttgctaattctt

SEQ ID NO: 211869 - DNA, 20 bp, Artificial sequence
  SiRNA target sequence
ttgacgtttgctaattcttt

SEQ ID NO: 211870 - DNA, 20 bp, Artificial sequence
  SiRNA target sequence
tgacgtttgctaattcttta

SEQ ID NO: 211871 - DNA, 20 bp, Artificial sequence
  SiRNA target sequence
gacgtttgctaattctttaa

SEQ ID NO: 211872 - DNA, 20 bp, Artificial sequence
  SiRNA target sequence
acgtttgctaattctttaac

SEQ ID NO: 211873 - DNA, 20 bp, Artificial sequence
  SiRNA target sequence
cgtttgctaattctttaaca

SEQ ID NO: 211874 - DNA, 20 bp, Artificial sequence
  SiRNA target sequence
gtttgctaattctttaacaa

SEQ ID NO: 211875 - DNA, 20 bp, Artificial sequence
  SiRNA target sequence
tttgctaattctttaacaac

SEQ ID NO: 211876 - DNA, 20 bp, Artificial sequence
  SiRNA target sequence
ttgctaattctttaacaact

SEQ ID NO: 211877 - DNA, 20 bp, Artificial sequence
  SiRNA target sequence
tgctaattctttaacaactc

SEQ ID NO: 211878 - DNA, 20 bp, Artificial sequence
  SiRNA target sequence
gctaattctttaacaactcc

SEQ ID NO: 211879 - DNA, 20 bp, Artificial sequence
  SiRNA target sequence
ctaattctttaacaactcca

SEQ ID NO: 211880 - DNA, 20 bp, Artificial sequence
  SiRNA target sequence
taattctttaacaactccag

SEQ ID NO: 211881 - DNA, 20 bp, Artificial sequence
  SiRNA target sequence
aattctttaacaactccagg

SEQ ID NO: 211882 - DNA, 20 bp, Artificial sequence
  SiRNA target sequence
attctttaacaactccagga

SEQ ID NO: 211883 - DNA, 20 bp, Artificial sequence
  SiRNA target sequence
ttctttaacaactccaggac

SEQ ID NO: 211884 - DNA, 20 bp, Artificial sequence
  SiRNA target sequence
tctttaacaactccaggaca

SEQ ID NO: 211885 - DNA, 20 bp, Artificial sequence
  SiRNA target sequence
ctttaacaactccaggacaa

SEQ ID NO: 211886 - DNA, 20 bp, Artificial sequence
  SiRNA target sequence
tttaacaactccaggacaaa

SEQ ID NO: 211887 - DNA, 20 bp, Artificial sequence
  SiRNA target sequence
ttaacaactccaggacaaag

SEQ ID NO: 211888 - DNA, 20 bp, Artificial sequence
  SiRNA target sequence
taacaactccaggacaaagt

SEQ ID NO: 211889 - DNA, 20 bp, Artificial sequence
  SiRNA target sequence
aacaactccaggacaaagtg

SEQ ID NO: 211890 - DNA, 20 bp, Artificial sequence
  SiRNA target sequence
acaactccaggacaaagtgc

SEQ ID NO: 211891 - DNA, 20 bp, Artificial sequence
  SiRNA target sequence
caactccaggacaaagtgca

SEQ ID NO: 211892 - DNA, 20 bp, Artificial sequence
  SiRNA target sequence
aactccaggacaaagtgcaa

SEQ ID NO: 211893 - DNA, 20 bp, Artificial sequence
  SiRNA target sequence
actccaggacaaagtgcaag

SEQ ID NO: 211894 - DNA, 20 bp, Artificial sequence
  SiRNA target sequence
ctccaggacaaagtgcaaga

SEQ ID NO: 211895 - DNA, 20 bp, Artificial sequence
  SiRNA target sequence
tccaggacaaagtgcaagat

SEQ ID NO: 211896 - DNA, 20 bp, Artificial sequence
  SiRNA target sequence
ccaggacaaagtgcaagatt

SEQ ID NO: 211897 - DNA, 20 bp, Artificial sequence
  SiRNA target sequence
caggacaaagtgcaagattc

SEQ ID NO: 211898 - DNA, 20 bp, Artificial sequence
  SiRNA target sequence
aggacaaagtgcaagattca

SEQ ID NO: 211899 - DNA, 20 bp, Artificial sequence
  SiRNA target sequence
ggacaaagtgcaagattcat

SEQ ID NO: 211900 - DNA, 20 bp, Artificial sequence
  SiRNA target sequence
gacaaagtgcaagattcata

SEQ ID NO: 211901 - DNA, 20 bp, Artificial sequence
  SiRNA target sequence
acaaagtgcaagattcatac

SEQ ID NO: 211902 - DNA, 20 bp, Artificial sequence
  SiRNA target sequence
caaagtgcaagattcatacc

SEQ ID NO: 211903 - DNA, 20 bp, Artificial sequence
  SiRNA target sequence
aaagtgcaagattcatacct

SEQ ID NO: 211904 - DNA, 20 bp, Artificial sequence
  SiRNA target sequence
aagtgcaagattcatacctt

SEQ ID NO: 211905 - DNA, 20 bp, Artificial sequence
  SiRNA target sequence
agtgcaagattcataccttt

SEQ ID NO: 211906 - DNA, 20 bp, Artificial sequence
  SiRNA target sequence
gtgcaagattcataccttta

SEQ ID NO: 211907 - DNA, 20 bp, Artificial sequence
  SiRNA target sequence
tgcaagattcatacctttat

SEQ ID NO: 211908 - DNA, 20 bp, Artificial sequence
  SiRNA target sequence
gcaagattcatacctttatt

SEQ ID NO: 211909 - DNA, 20 bp, Artificial sequence
  SiRNA target sequence
caagattcatacctttattt

SEQ ID NO: 211910 - DNA, 20 bp, Artificial sequence
  SiRNA target sequence
aagattcatacctttatttt

SEQ ID NO: 211911 - DNA, 20 bp, Artificial sequence
  SiRNA target sequence
agattcatacctttatttta

SEQ ID NO: 211912 - DNA, 20 bp, Artificial sequence
  SiRNA target sequence
gattcatacctttattttat

SEQ ID NO: 211913 - DNA, 20 bp, Artificial sequence
  SiRNA target sequence
attcatacctttattttatg

SEQ ID NO: 211914 - DNA, 20 bp, Artificial sequence
  SiRNA target sequence
ttcatacctttattttatgt

SEQ ID NO: 211915 - DNA, 20 bp, Artificial sequence
  SiRNA target sequence
tcatacctttattttatgtt

SEQ ID NO: 211916 - DNA, 20 bp, Artificial sequence
  SiRNA target sequence
catacctttattttatgttt

SEQ ID NO: 211917 - DNA, 20 bp, Artificial sequence
  SiRNA target sequence
atacctttattttatgtttt

SEQ ID NO: 211918 - DNA, 20 bp, Artificial sequence
  SiRNA target sequence
tacctttattttatgttttc

SEQ ID NO: 211919 - DNA, 20 bp, Artificial sequence
  SiRNA target sequence
acctttattttatgttttct

SEQ ID NO: 211920 - DNA, 20 bp, Artificial sequence
  SiRNA target sequence
cctttattttatgttttctc

SEQ ID NO: 211921 - DNA, 20 bp, Artificial sequence
  SiRNA target sequence
ctttattttatgttttctcg

SEQ ID NO: 211922 - DNA, 20 bp, Artificial sequence
  SiRNA target sequence
tttattttatgttttctcga

SEQ ID NO: 211923 - DNA, 20 bp, Artificial sequence
  SiRNA target sequence
ttattttatgttttctcgaa

SEQ ID NO: 211924 - DNA, 20 bp, Artificial sequence
  SiRNA target sequence
tattttatgttttctcgaat

SEQ ID NO: 211925 - DNA, 20 bp, Artificial sequence
  SiRNA target sequence
attttatgttttctcgaata

SEQ ID NO: 211926 - DNA, 20 bp, Artificial sequence
  SiRNA target sequence
ttttatgttttctcgaatat

SEQ ID NO: 211927 - DNA, 20 bp, Artificial sequence
  SiRNA target sequence
tttatgttttctcgaatatt

SEQ ID NO: 211928 - DNA, 20 bp, Artificial sequence
  SiRNA target sequence
ttatgttttctcgaatattt

SEQ ID NO: 211929 - DNA, 20 bp, Artificial sequence
  SiRNA target sequence
tatgttttctcgaatatttc

SEQ ID NO: 211930 - DNA, 20 bp, Artificial sequence
  SiRNA target sequence
atgttttctcgaatatttct

SEQ ID NO: 211931 - DNA, 20 bp, Artificial sequence
  SiRNA target sequence
tgttttctcgaatatttctc

SEQ ID NO: 211932 - DNA, 20 bp, Artificial sequence
  SiRNA target sequence
gttttctcgaatatttctct

SEQ ID NO: 211933 - DNA, 20 bp, Artificial sequence
  SiRNA target sequence
ttttctcgaatatttctctt

SEQ ID NO: 211934 - DNA, 20 bp, Artificial sequence
  SiRNA target sequence
tttctcgaatatttctcttt

SEQ ID NO: 211935 - DNA, 20 bp, Artificial sequence
  SiRNA target sequence
ttctcgaatatttctctttt

SEQ ID NO: 211936 - DNA, 20 bp, Artificial sequence
  SiRNA target sequence
tctcgaatatttctcttttc

SEQ ID NO: 211937 - DNA, 20 bp, Artificial sequence
  SiRNA target sequence
ctcgaatatttctcttttct

SEQ ID NO: 211938 - DNA, 20 bp, Artificial sequence
  SiRNA target sequence
tcgaatatttctcttttctt

SEQ ID NO: 211939 - DNA, 20 bp, Artificial sequence
  SiRNA target sequence
cgaatatttctcttttctta

SEQ ID NO: 211940 - DNA, 20 bp, Artificial sequence
  SiRNA target sequence
gaatatttctcttttcttat

SEQ ID NO: 211941 - DNA, 20 bp, Artificial sequence
  SiRNA target sequence
aatatttctcttttcttatc

SEQ ID NO: 211942 - DNA, 20 bp, Artificial sequence
  SiRNA target sequence
atatttctcttttcttatct

SEQ ID NO: 211943 - DNA, 20 bp, Artificial sequence
  SiRNA target sequence
tatttctcttttcttatctt

SEQ ID NO: 211944 - DNA, 20 bp, Artificial sequence
  SiRNA target sequence
atttctcttttcttatcttc

SEQ ID NO: 211945 - DNA, 20 bp, Artificial sequence
  SiRNA target sequence
tttctcttttcttatcttct

SEQ ID NO: 211946 - DNA, 20 bp, Artificial sequence
  SiRNA target sequence
ttctcttttcttatcttctc

SEQ ID NO: 211947 - DNA, 20 bp, Artificial sequence
  SiRNA target sequence
tctcttttcttatcttctca

SEQ ID NO: 211948 - DNA, 20 bp, Artificial sequence
  SiRNA target sequence
ctcttttcttatcttctcaa

SEQ ID NO: 211949 - DNA, 20 bp, Artificial sequence
  SiRNA target sequence
tcttttcttatcttctcaag

SEQ ID NO: 211950 - DNA, 20 bp, Artificial sequence
  SiRNA target sequence
cttttcttatcttctcaagt

SEQ ID NO: 211951 - DNA, 20 bp, Artificial sequence
  SiRNA target sequence
ttttcttatcttctcaagtg

SEQ ID NO: 211952 - DNA, 20 bp, Artificial sequence
  SiRNA target sequence
tttcttatcttctcaagtga

SEQ ID NO: 211953 - DNA, 20 bp, Artificial sequence
  SiRNA target sequence
ttcttatcttctcaagtgac

SEQ ID NO: 211954 - DNA, 20 bp, Artificial sequence
  SiRNA target sequence
tcttatcttctcaagtgaca

SEQ ID NO: 211955 - DNA, 20 bp, Artificial sequence
  SiRNA target sequence
cttatcttctcaagtgacag

SEQ ID NO: 211956 - DNA, 20 bp, Artificial sequence
  SiRNA target sequence
ttatcttctcaagtgacaga

SEQ ID NO: 211957 - DNA, 20 bp, Artificial sequence
  SiRNA target sequence
tatcttctcaagtgacagaa

SEQ ID NO: 211958 - DNA, 20 bp, Artificial sequence
  SiRNA target sequence
atcttctcaagtgacagaac

SEQ ID NO: 211959 - DNA, 20 bp, Artificial sequence
  SiRNA target sequence
tcttctcaagtgacagaact

SEQ ID NO: 211960 - DNA, 20 bp, Artificial sequence
  SiRNA target sequence
cttctcaagtgacagaactt

SEQ ID NO: 211961 - DNA, 20 bp, Artificial sequence
  SiRNA target sequence
ttctcaagtgacagaacttt

SEQ ID NO: 211962 - DNA, 20 bp, Artificial sequence
  SiRNA target sequence
tctcaagtgacagaactttt

SEQ ID NO: 211963 - DNA, 20 bp, Artificial sequence
  SiRNA target sequence
ctcaagtgacagaacttttt

SEQ ID NO: 211964 - DNA, 20 bp, Artificial sequence
  SiRNA target sequence
tcaagtgacagaacttttta

SEQ ID NO: 211965 - DNA, 20 bp, Artificial sequence
  SiRNA target sequence
caagtgacagaactttttac

SEQ ID NO: 211966 - DNA, 20 bp, Artificial sequence
  SiRNA target sequence
aagtgacagaactttttaca

SEQ ID NO: 211967 - DNA, 20 bp, Artificial sequence
  SiRNA target sequence
agtgacagaactttttacaa

SEQ ID NO: 211968 - DNA, 20 bp, Artificial sequence
  SiRNA target sequence
gtgacagaactttttacaag

SEQ ID NO: 211969 - DNA, 20 bp, Artificial sequence
  SiRNA target sequence
tgacagaactttttacaaga

SEQ ID NO: 211970 - DNA, 20 bp, Artificial sequence
  SiRNA target sequence
gacagaactttttacaagat

SEQ ID NO: 211971 - DNA, 20 bp, Artificial sequence
  SiRNA target sequence
acagaactttttacaagata

SEQ ID NO: 211972 - DNA, 20 bp, Artificial sequence
  SiRNA target sequence
cagaactttttacaagatat

SEQ ID NO: 211973 - DNA, 20 bp, Artificial sequence
  SiRNA target sequence
agaactttttacaagatata

SEQ ID NO: 211974 - DNA, 20 bp, Artificial sequence
  SiRNA target sequence
gaactttttacaagatatag

SEQ ID NO: 211975 - DNA, 20 bp, Artificial sequence
  SiRNA target sequence
aactttttacaagatataga

SEQ ID NO: 211976 - DNA, 20 bp, Artificial sequence
  SiRNA target sequence
actttttacaagatatagat

SEQ ID NO: 211977 - DNA, 20 bp, Artificial sequence
  SiRNA target sequence
ctttttacaagatatagatc

SEQ ID NO: 211978 - DNA, 20 bp, Artificial sequence
  SiRNA target sequence
tttttacaagatatagatca

SEQ ID NO: 211979 - DNA, 20 bp, Artificial sequence
  SiRNA target sequence
ttttacaagatatagatcaa

SEQ ID NO: 211980 - DNA, 20 bp, Artificial sequence
  SiRNA target sequence
tttacaagatatagatcaaa

SEQ ID NO: 211981 - DNA, 20 bp, Artificial sequence
  SiRNA target sequence
ttacaagatatagatcaaag

SEQ ID NO: 211982 - DNA, 20 bp, Artificial sequence
  SiRNA target sequence
tacaagatatagatcaaagc

SEQ ID NO: 211983 - DNA, 20 bp, Artificial sequence
  SiRNA target sequence
acaagatatagatcaaagct

SEQ ID NO: 211984 - DNA, 20 bp, Artificial sequence
  SiRNA target sequence
caagatatagatcaaagctc

SEQ ID NO: 211985 - DNA, 20 bp, Artificial sequence
  SiRNA target sequence
aagatatagatcaaagctca

SEQ ID NO: 211986 - DNA, 20 bp, Artificial sequence
  SiRNA target sequence
agatatagatcaaagctcac

SEQ ID NO: 211987 - DNA, 20 bp, Artificial sequence
  SiRNA target sequence
gatatagatcaaagctcact

SEQ ID NO: 211988 - DNA, 20 bp, Artificial sequence
  SiRNA target sequence
atatagatcaaagctcactt

SEQ ID NO: 211989 - DNA, 20 bp, Artificial sequence
  SiRNA target sequence
tatagatcaaagctcacttt

SEQ ID NO: 211990 - DNA, 20 bp, Artificial sequence
  SiRNA target sequence
atagatcaaagctcactttc

SEQ ID NO: 211991 - DNA, 20 bp, Artificial sequence
  SiRNA target sequence
tagatcaaagctcactttct

SEQ ID NO: 211992 - DNA, 20 bp, Artificial sequence
  SiRNA target sequence
agatcaaagctcactttctc

SEQ ID NO: 211993 - DNA, 20 bp, Artificial sequence
  SiRNA target sequence
gatcaaagctcactttctca

SEQ ID NO: 211994 - DNA, 20 bp, Artificial sequence
  SiRNA target sequence
atcaaagctcactttctcag

SEQ ID NO: 211995 - DNA, 20 bp, Artificial sequence
  SiRNA target sequence
tcaaagctcactttctcaga

SEQ ID NO: 211996 - DNA, 20 bp, Artificial sequence
  SiRNA target sequence
caaagctcactttctcagag

SEQ ID NO: 211997 - DNA, 20 bp, Artificial sequence
  SiRNA target sequence
aaagctcactttctcagagg

SEQ ID NO: 211998 - DNA, 20 bp, Artificial sequence
  SiRNA target sequence
aagctcactttctcagaggc

SEQ ID NO: 211999 - DNA, 20 bp, Artificial sequence
  SiRNA target sequence
agctcactttctcagaggcg

SEQ ID NO: 212000 - DNA, 20 bp, Artificial sequence
  SiRNA target sequence
gctcactttctcagaggcgg

SEQ ID NO: 212001 - DNA, 20 bp, Artificial sequence
  SiRNA target sequence
ctcactttctcagaggcgga

SEQ ID NO: 212002 - DNA, 20 bp, Artificial sequence
  SiRNA target sequence
tcactttctcagaggcggaa

SEQ ID NO: 212003 - DNA, 20 bp, Artificial sequence
  SiRNA target sequence
cactttctcagaggcggaat

SEQ ID NO: 212004 - DNA, 20 bp, Artificial sequence
  SiRNA target sequence
actttctcagaggcggaatt

SEQ ID NO: 212005 - DNA, 20 bp, Artificial sequence
  SiRNA target sequence
ctttctcagaggcggaattt

SEQ ID NO: 212006 - DNA, 20 bp, Artificial sequence
  SiRNA target sequence
tttctcagaggcggaatttt

SEQ ID NO: 212007 - DNA, 20 bp, Artificial sequence
  SiRNA target sequence
ttctcagaggcggaattttt

SEQ ID NO: 212008 - DNA, 20 bp, Artificial sequence
  SiRNA target sequence
tctcagaggcggaattttta

SEQ ID NO: 212009 - DNA, 20 bp, Artificial sequence
  SiRNA target sequence
ctcagaggcggaatttttat

SEQ ID NO: 212010 - DNA, 20 bp, Artificial sequence
  SiRNA target sequence
tcagaggcggaatttttata

SEQ ID NO: 212011 - DNA, 20 bp, Artificial sequence
  SiRNA target sequence
cagaggcggaatttttatat

SEQ ID NO: 212012 - DNA, 20 bp, Artificial sequence
  SiRNA target sequence
agaggcggaatttttatata

SEQ ID NO: 212013 - DNA, 20 bp, Artificial sequence
  SiRNA target sequence
gaggcggaatttttatataa

SEQ ID NO: 212014 - DNA, 20 bp, Artificial sequence
  SiRNA target sequence
aggcggaatttttatataat

SEQ ID NO: 212015 - DNA, 20 bp, Artificial sequence
  SiRNA target sequence
ggcggaatttttatataatg

SEQ ID NO: 212016 - DNA, 20 bp, Artificial sequence
  SiRNA target sequence
gcggaatttttatataatgg

SEQ ID NO: 212017 - DNA, 20 bp, Artificial sequence
  SiRNA target sequence
cggaatttttatataatggc

SEQ ID NO: 212018 - DNA, 20 bp, Artificial sequence
  SiRNA target sequence
ggaatttttatataatggct

SEQ ID NO: 212019 - DNA, 20 bp, Artificial sequence
  SiRNA target sequence
gaatttttatataatggctt

SEQ ID NO: 212020 - DNA, 20 bp, Artificial sequence
  SiRNA target sequence
aatttttatataatggcttt

SEQ ID NO: 212021 - DNA, 20 bp, Artificial sequence
  SiRNA target sequence
atttttatataatggctttt

SEQ ID NO: 212022 - DNA, 20 bp, Artificial sequence
  SiRNA target sequence
tttttatataatggcttttt

SEQ ID NO: 212023 - DNA, 20 bp, Artificial sequence
  SiRNA target sequence
ttttatataatggctttttt

SEQ ID NO: 212024 - DNA, 20 bp, Artificial sequence
  SiRNA target sequence
tttatataatggcttttttg

SEQ ID NO: 212025 - DNA, 20 bp, Artificial sequence
  SiRNA target sequence
ttatataatggcttttttgt

SEQ ID NO: 212026 - DNA, 20 bp, Artificial sequence
  SiRNA target sequence
tatataatggcttttttgta

SEQ ID NO: 212027 - DNA, 20 bp, Artificial sequence
  SiRNA target sequence
atataatggcttttttgtat

SEQ ID NO: 212028 - DNA, 20 bp, Artificial sequence
  SiRNA target sequence
tataatggcttttttgtatt

SEQ ID NO: 212029 - DNA, 20 bp, Artificial sequence
  SiRNA target sequence
ataatggcttttttgtattt

SEQ ID NO: 212030 - DNA, 20 bp, Artificial sequence
  SiRNA target sequence
taatggcttttttgtatttt

SEQ ID NO: 212031 - DNA, 20 bp, Artificial sequence
  SiRNA target sequence
aatggcttttttgtattttc

SEQ ID NO: 212032 - DNA, 20 bp, Artificial sequence
  SiRNA target sequence
atggcttttttgtattttct

SEQ ID NO: 212033 - DNA, 20 bp, Artificial sequence
  SiRNA target sequence
tggcttttttgtattttctg

SEQ ID NO: 212034 - DNA, 20 bp, Artificial sequence
  SiRNA target sequence
ggcttttttgtattttctgg

SEQ ID NO: 212035 - DNA, 20 bp, Artificial sequence
  SiRNA target sequence
gcttttttgtattttctgga

SEQ ID NO: 212036 - DNA, 20 bp, Artificial sequence
  SiRNA target sequence
cttttttgtattttctggag

SEQ ID NO: 212037 - DNA, 20 bp, Artificial sequence
  SiRNA target sequence
ttttttgtattttctggagt

SEQ ID NO: 212038 - DNA, 20 bp, Artificial sequence
  SiRNA target sequence
tttttgtattttctggagtt

SEQ ID NO: 212039 - DNA, 20 bp, Artificial sequence
  SiRNA target sequence
ttttgtattttctggagttc

SEQ ID NO: 212040 - DNA, 20 bp, Artificial sequence
  SiRNA target sequence
tttgtattttctggagttct

SEQ ID NO: 212041 - DNA, 20 bp, Artificial sequence
  SiRNA target sequence
ttgtattttctggagttcta

SEQ ID NO: 212042 - DNA, 20 bp, Artificial sequence
  SiRNA target sequence
tgtattttctggagttctag

SEQ ID NO: 212043 - DNA, 20 bp, Artificial sequence
  SiRNA target sequence
gtattttctggagttctagt

SEQ ID NO: 212044 - DNA, 20 bp, Artificial sequence
  SiRNA target sequence
tattttctggagttctagta

SEQ ID NO: 212045 - DNA, 20 bp, Artificial sequence
  SiRNA target sequence
attttctggagttctagtaa

SEQ ID NO: 212046 - DNA, 20 bp, Artificial sequence
  SiRNA target sequence
ttttctggagttctagtaat

SEQ ID NO: 212047 - DNA, 20 bp, Artificial sequence
  SiRNA target sequence
tttctggagttctagtaata

SEQ ID NO: 212048 - DNA, 20 bp, Artificial sequence
  SiRNA target sequence
ttctggagttctagtaatag

SEQ ID NO: 212049 - DNA, 20 bp, Artificial sequence
  SiRNA target sequence
tctggagttctagtaatagt

SEQ ID NO: 212050 - DNA, 20 bp, Artificial sequence
  SiRNA target sequence
ctggagttctagtaatagtt

SEQ ID NO: 212051 - DNA, 20 bp, Artificial sequence
  SiRNA target sequence
tggagttctagtaatagtta

SEQ ID NO: 212052 - DNA, 20 bp, Artificial sequence
  SiRNA target sequence
ggagttctagtaatagttat

SEQ ID NO: 212053 - DNA, 20 bp, Artificial sequence
  SiRNA target sequence
gagttctagtaatagttata

SEQ ID NO: 212054 - DNA, 20 bp, Artificial sequence
  SiRNA target sequence
agttctagtaatagttatat

SEQ ID NO: 212055 - DNA, 20 bp, Artificial sequence
  SiRNA target sequence
gttctagtaatagttatatt

SEQ ID NO: 212056 - DNA, 20 bp, Artificial sequence
  SiRNA target sequence
ttctagtaatagttatattt

SEQ ID NO: 212057 - DNA, 20 bp, Artificial sequence
  SiRNA target sequence
tctagtaatagttatatttt

SEQ ID NO: 212058 - DNA, 20 bp, Artificial sequence
  SiRNA target sequence
ctagtaatagttatattttt

SEQ ID NO: 212059 - DNA, 20 bp, Artificial sequence
  SiRNA target sequence
tagtaatagttatattttta

SEQ ID NO: 212060 - DNA, 20 bp, Artificial sequence
  SiRNA target sequence
agtaatagttatatttttaa

SEQ ID NO: 212061 - DNA, 20 bp, Artificial sequence
  SiRNA target sequence
gtaatagttatatttttaat

SEQ ID NO: 212062 - DNA, 20 bp, Artificial sequence
  SiRNA target sequence
taatagttatatttttaatt

SEQ ID NO: 212063 - DNA, 20 bp, Artificial sequence
  SiRNA target sequence
aatagttatatttttaatta

SEQ ID NO: 212064 - DNA, 20 bp, Artificial sequence
  SiRNA target sequence
atagttatatttttaattaa

SEQ ID NO: 212065 - DNA, 20 bp, Artificial sequence
  SiRNA target sequence
tagttatatttttaattaaa

SEQ ID NO: 212066 - DNA, 20 bp, Artificial sequence
  SiRNA target sequence
agttatatttttaattaaaa

SEQ ID NO: 212067 - DNA, 20 bp, Artificial sequence
  SiRNA target sequence
gttatatttttaattaaaaa

SEQ ID NO: 212068 - DNA, 20 bp, Artificial sequence
  SiRNA target sequence
ttatatttttaattaaaaaa

SEQ ID NO: 212069 - DNA, 20 bp, Artificial sequence
  SiRNA target sequence
tatatttttaattaaaaaat

SEQ ID NO: 212070 - DNA, 20 bp, Artificial sequence
  SiRNA target sequence
atatttttaattaaaaaata

SEQ ID NO: 212071 - DNA, 20 bp, Artificial sequence
  SiRNA target sequence
tatttttaattaaaaaatat

SEQ ID NO: 212072 - DNA, 20 bp, Artificial sequence
  SiRNA target sequence
atttttaattaaaaaatatt

SEQ ID NO: 212073 - DNA, 20 bp, Artificial sequence
  SiRNA target sequence
tttttaattaaaaaatattt

SEQ ID NO: 212074 - DNA, 20 bp, Artificial sequence
  SiRNA target sequence
ttttaattaaaaaatatttg

SEQ ID NO: 212075 - DNA, 20 bp, Artificial sequence
  SiRNA target sequence
tttaattaaaaaatatttgg

SEQ ID NO: 212076 - DNA, 20 bp, Artificial sequence
  SiRNA target sequence
ttaattaaaaaatatttgga

SEQ ID NO: 212077 - DNA, 20 bp, Artificial sequence
  SiRNA target sequence
taattaaaaaatatttggag

SEQ ID NO: 212078 - DNA, 20 bp, Artificial sequence
  SiRNA target sequence
aattaaaaaatatttggaga

SEQ ID NO: 212079 - DNA, 20 bp, Artificial sequence
  SiRNA target sequence
attaaaaaatatttggagag

SEQ ID NO: 212080 - DNA, 20 bp, Artificial sequence
  SiRNA target sequence
ttaaaaaatatttggagagg

SEQ ID NO: 212081 - DNA, 20 bp, Artificial sequence
  SiRNA target sequence
taaaaaatatttggagagga

SEQ ID NO: 212082 - DNA, 20 bp, Artificial sequence
  SiRNA target sequence
aaaaaatatttggagaggaa

SEQ ID NO: 212083 - DNA, 20 bp, Artificial sequence
  SiRNA target sequence
aaaaatatttggagaggaat

SEQ ID NO: 212084 - DNA, 20 bp, Artificial sequence
  SiRNA target sequence
aaaatatttggagaggaatg

SEQ ID NO: 212085 - DNA, 20 bp, Artificial sequence
  SiRNA target sequence
aaatatttggagaggaatgt

SEQ ID NO: 212086 - DNA, 20 bp, Artificial sequence
  SiRNA target sequence
aatatttggagaggaatgtg

SEQ ID NO: 212087 - DNA, 20 bp, Artificial sequence
  SiRNA target sequence
atatttggagaggaatgtga

SEQ ID NO: 212088 - DNA, 20 bp, Artificial sequence
  SiRNA target sequence
tatttggagaggaatgtgac

SEQ ID NO: 212089 - DNA, 20 bp, Artificial sequence
  SiRNA target sequence
atttggagaggaatgtgact

SEQ ID NO: 212090 - DNA, 20 bp, Artificial sequence
  SiRNA target sequence
tttggagaggaatgtgacta

SEQ ID NO: 212091 - DNA, 20 bp, Artificial sequence
  SiRNA target sequence
ttggagaggaatgtgactaa

SEQ ID NO: 212092 - DNA, 20 bp, Artificial sequence
  SiRNA target sequence
tggagaggaatgtgactaac

SEQ ID NO: 212093 - DNA, 20 bp, Artificial sequence
  SiRNA target sequence
ggagaggaatgtgactaaca

SEQ ID NO: 212094 - DNA, 20 bp, Artificial sequence
  SiRNA target sequence
gagaggaatgtgactaacaa

SEQ ID NO: 212095 - DNA, 20 bp, Artificial sequence
  SiRNA target sequence
agaggaatgtgactaacaaa

SEQ ID NO: 212096 - DNA, 20 bp, Artificial sequence
  SiRNA target sequence
gaggaatgtgactaacaaac

SEQ ID NO: 212097 - DNA, 20 bp, Artificial sequence
  SiRNA target sequence
aggaatgtgactaacaaacc

SEQ ID NO: 212098 - DNA, 20 bp, Artificial sequence
  SiRNA target sequence
ggaatgtgactaacaaacct

SEQ ID NO: 212099 - DNA, 20 bp, Artificial sequence
  SiRNA target sequence
gaatgtgactaacaaacctt

SEQ ID NO: 212100 - DNA, 20 bp, Artificial sequence
  SiRNA target sequence
aatgtgactaacaaaccttt

SEQ ID NO: 212101 - DNA, 20 bp, Artificial sequence
  SiRNA target sequence
atgtgactaacaaacctttg

SEQ ID NO: 212102 - DNA, 20 bp, Artificial sequence
  SiRNA target sequence
tgtgactaacaaacctttgt

SEQ ID NO: 212103 - DNA, 20 bp, Artificial sequence
  SiRNA target sequence
gtgactaacaaacctttgtt

SEQ ID NO: 212104 - DNA, 20 bp, Artificial sequence
  SiRNA target sequence
tgactaacaaacctttgttt

SEQ ID NO: 212105 - DNA, 20 bp, Artificial sequence
  SiRNA target sequence
gactaacaaacctttgtttg

SEQ ID NO: 212106 - DNA, 20 bp, Artificial sequence
  SiRNA target sequence
actaacaaacctttgtttgt

SEQ ID NO: 212107 - DNA, 20 bp, Artificial sequence
  SiRNA target sequence
ctaacaaacctttgtttgtt

SEQ ID NO: 212108 - DNA, 20 bp, Artificial sequence
  SiRNA target sequence
taacaaacctttgtttgttg

SEQ ID NO: 212109 - DNA, 20 bp, Artificial sequence
  SiRNA target sequence
aacaaacctttgtttgttgt

SEQ ID NO: 212110 - DNA, 20 bp, Artificial sequence
  SiRNA target sequence
acaaacctttgtttgttgta

SEQ ID NO: 212111 - DNA, 20 bp, Artificial sequence
  SiRNA target sequence
caaacctttgtttgttgtaa

SEQ ID NO: 212112 - DNA, 20 bp, Artificial sequence
  SiRNA target sequence
aaacctttgtttgttgtaaa

SEQ ID NO: 212113 - DNA, 20 bp, Artificial sequence
  SiRNA target sequence
aacctttgtttgttgtaaaa

SEQ ID NO: 212114 - DNA, 20 bp, Artificial sequence
  SiRNA target sequence
acctttgtttgttgtaaaat

SEQ ID NO: 212115 - DNA, 20 bp, Artificial sequence
  SiRNA target sequence
cctttgtttgttgtaaaatc

SEQ ID NO: 212116 - DNA, 20 bp, Artificial sequence
  SiRNA target sequence
ctttgtttgttgtaaaatct

SEQ ID NO: 212117 - DNA, 20 bp, Artificial sequence
  SiRNA target sequence
tttgtttgttgtaaaatctg

SEQ ID NO: 212118 - DNA, 20 bp, Artificial sequence
  SiRNA target sequence
ttgtttgttgtaaaatctgt

SEQ ID NO: 212119 - DNA, 20 bp, Artificial sequence
  SiRNA target sequence
tgtttgttgtaaaatctgtt

SEQ ID NO: 212120 - DNA, 20 bp, Artificial sequence
  SiRNA target sequence
gtttgttgtaaaatctgtta

SEQ ID NO: 212121 - DNA, 20 bp, Artificial sequence
  SiRNA target sequence
tttgttgtaaaatctgttaa

SEQ ID NO: 212122 - DNA, 20 bp, Artificial sequence
  SiRNA target sequence
ttgttgtaaaatctgttaaa

SEQ ID NO: 212123 - DNA, 20 bp, Artificial sequence
  SiRNA target sequence
tgttgtaaaatctgttaaaa

SEQ ID NO: 212124 - DNA, 20 bp, Artificial sequence
  SiRNA target sequence
gttgtaaaatctgttaaaaa

SEQ ID NO: 212125 - DNA, 20 bp, Artificial sequence
  SiRNA target sequence
ttgtaaaatctgttaaaaag

SEQ ID NO: 212126 - DNA, 20 bp, Artificial sequence
  SiRNA target sequence
tgtaaaatctgttaaaaaga

SEQ ID NO: 212127 - DNA, 20 bp, Artificial sequence
  SiRNA target sequence
gtaaaatctgttaaaaagaa

SEQ ID NO: 212128 - DNA, 20 bp, Artificial sequence
  SiRNA target sequence
taaaatctgttaaaaagaag

SEQ ID NO: 212129 - DNA, 20 bp, Artificial sequence
  SiRNA target sequence
aaaatctgttaaaaagaagg

SEQ ID NO: 212130 - DNA, 20 bp, Artificial sequence
  SiRNA target sequence
aaatctgttaaaaagaaggg

SEQ ID NO: 212131 - DNA, 20 bp, Artificial sequence
  SiRNA target sequence
aatctgttaaaaagaaggga

SEQ ID NO: 212132 - DNA, 20 bp, Artificial sequence
  SiRNA target sequence
atctgttaaaaagaagggac

SEQ ID NO: 212133 - DNA, 20 bp, Artificial sequence
  SiRNA target sequence
tctgttaaaaagaagggacc

SEQ ID NO: 212134 - DNA, 20 bp, Artificial sequence
  SiRNA target sequence
ctgttaaaaagaagggacca

SEQ ID NO: 212135 - DNA, 20 bp, Artificial sequence
  SiRNA target sequence
tgttaaaaagaagggaccaa

SEQ ID NO: 212136 - DNA, 20 bp, Artificial sequence
  SiRNA target sequence
gttaaaaagaagggaccaaa

SEQ ID NO: 212137 - DNA, 20 bp, Artificial sequence
  SiRNA target sequence
ttaaaaagaagggaccaaaa

SEQ ID NO: 212138 - DNA, 20 bp, Artificial sequence
  SiRNA target sequence
taaaaagaagggaccaaaag

SEQ ID NO: 212139 - DNA, 20 bp, Artificial sequence
  SiRNA target sequence
aaaaagaagggaccaaaagt

SEQ ID NO: 212140 - DNA, 20 bp, Artificial sequence
  SiRNA target sequence
aaaagaagggaccaaaagtt

SEQ ID NO: 212141 - DNA, 20 bp, Artificial sequence
  SiRNA target sequence
aaagaagggaccaaaagtta

SEQ ID NO: 212142 - DNA, 20 bp, Artificial sequence
  SiRNA target sequence
aagaagggaccaaaagttaa

SEQ ID NO: 212143 - DNA, 20 bp, Artificial sequence
  SiRNA target sequence
agaagggaccaaaagttaaa

SEQ ID NO: 212144 - DNA, 20 bp, Artificial sequence
  SiRNA target sequence
gaagggaccaaaagttaaag

SEQ ID NO: 212145 - DNA, 20 bp, Artificial sequence
  SiRNA target sequence
aagggaccaaaagttaaagt

SEQ ID NO: 212146 - DNA, 20 bp, Artificial sequence
  SiRNA target sequence
agggaccaaaagttaaagta

SEQ ID NO: 212147 - DNA, 20 bp, Artificial sequence
  SiRNA target sequence
gggaccaaaagttaaagtag

SEQ ID NO: 212148 - DNA, 20 bp, Artificial sequence
  SiRNA target sequence
ggaccaaaagttaaagtagg

SEQ ID NO: 212149 - DNA, 20 bp, Artificial sequence
  SiRNA target sequence
gaccaaaagttaaagtagga

SEQ ID NO: 212150 - DNA, 20 bp, Artificial sequence
  SiRNA target sequence
accaaaagttaaagtaggat

SEQ ID NO: 212151 - DNA, 20 bp, Artificial sequence
  SiRNA target sequence
ccaaaagttaaagtaggatt

SEQ ID NO: 212152 - DNA, 20 bp, Artificial sequence
  SiRNA target sequence
caaaagttaaagtaggattt

SEQ ID NO: 212153 - DNA, 20 bp, Artificial sequence
  SiRNA target sequence
aaaagttaaagtaggatttg

SEQ ID NO: 212154 - DNA, 20 bp, Artificial sequence
  SiRNA target sequence
aaagttaaagtaggatttgc

SEQ ID NO: 212155 - DNA, 20 bp, Artificial sequence
  SiRNA target sequence
aagttaaagtaggatttgcg

SEQ ID NO: 212156 - DNA, 20 bp, Artificial sequence
  SiRNA target sequence
agttaaagtaggatttgcgg

SEQ ID NO: 212157 - DNA, 20 bp, Artificial sequence
  SiRNA target sequence
gttaaagtaggatttgcgga

SEQ ID NO: 212158 - DNA, 20 bp, Artificial sequence
  SiRNA target sequence
ttaaagtaggatttgcggag

SEQ ID NO: 212159 - DNA, 20 bp, Artificial sequence
  SiRNA target sequence
taaagtaggatttgcggagg

SEQ ID NO: 212160 - DNA, 20 bp, Artificial sequence
  SiRNA target sequence
aaagtaggatttgcggaggg

SEQ ID NO: 212161 - DNA, 20 bp, Artificial sequence
  SiRNA target sequence
aagtaggatttgcggagggc

SEQ ID NO: 212162 - DNA, 20 bp, Artificial sequence
  SiRNA target sequence
agtaggatttgcggagggcc

SEQ ID NO: 212163 - DNA, 20 bp, Artificial sequence
  SiRNA target sequence
gtaggatttgcggagggcct

SEQ ID NO: 212164 - DNA, 20 bp, Artificial sequence
  SiRNA target sequence
taggatttgcggagggcctt

SEQ ID NO: 212165 - DNA, 20 bp, Artificial sequence
  SiRNA target sequence
aggatttgcggagggcctta

SEQ ID NO: 212166 - DNA, 20 bp, Artificial sequence
  SiRNA target sequence
ggatttgcggagggccttaa

SEQ ID NO: 212167 - DNA, 20 bp, Artificial sequence
  SiRNA target sequence
gatttgcggagggccttaaa

SEQ ID NO: 212168 - DNA, 20 bp, Artificial sequence
  SiRNA target sequence
atttgcggagggccttaaag

SEQ ID NO: 212169 - DNA, 20 bp, Artificial sequence
  SiRNA target sequence
tttgcggagggccttaaaga

SEQ ID NO: 212170 - DNA, 20 bp, Artificial sequence
  SiRNA target sequence
ttgcggagggccttaaagaa

SEQ ID NO: 212171 - DNA, 20 bp, Artificial sequence
  SiRNA target sequence
tgcggagggccttaaagaaa

SEQ ID NO: 212172 - DNA, 20 bp, Artificial sequence
  SiRNA target sequence
gcggagggccttaaagaaat

SEQ ID NO: 212173 - DNA, 20 bp, Artificial sequence
  SiRNA target sequence
cggagggccttaaagaaatg

SEQ ID NO: 212174 - DNA, 20 bp, Artificial sequence
  SiRNA target sequence
ggagggccttaaagaaatga

SEQ ID NO: 212175 - DNA, 20 bp, Artificial sequence
  SiRNA target sequence
gagggccttaaagaaatgat

SEQ ID NO: 212176 - DNA, 20 bp, Artificial sequence
  SiRNA target sequence
agggccttaaagaaatgatg

SEQ ID NO: 212177 - DNA, 20 bp, Artificial sequence
  SiRNA target sequence
gggccttaaagaaatgatgg

SEQ ID NO: 212178 - DNA, 20 bp, Artificial sequence
  SiRNA target sequence
ggccttaaagaaatgatggc

SEQ ID NO: 212179 - DNA, 20 bp, Artificial sequence
  SiRNA target sequence
gccttaaagaaatgatggca

SEQ ID NO: 212180 - DNA, 20 bp, Artificial sequence
  SiRNA target sequence
ccttaaagaaatgatggcat

SEQ ID NO: 212181 - DNA, 20 bp, Artificial sequence
  SiRNA target sequence
cttaaagaaatgatggcatc

SEQ ID NO: 212182 - DNA, 20 bp, Artificial sequence
  SiRNA target sequence
ttaaagaaatgatggcatca

SEQ ID NO: 212183 - DNA, 20 bp, Artificial sequence
  SiRNA target sequence
taaagaaatgatggcatcaa

SEQ ID NO: 212184 - DNA, 20 bp, Artificial sequence
  SiRNA target sequence
aaagaaatgatggcatcaaa

SEQ ID NO: 212185 - DNA, 20 bp, Artificial sequence
  SiRNA target sequence
aagaaatgatggcatcaaag

SEQ ID NO: 212186 - DNA, 20 bp, Artificial sequence
  SiRNA target sequence
agaaatgatggcatcaaagt

SEQ ID NO: 212187 - DNA, 20 bp, Artificial sequence
  SiRNA target sequence
gaaatgatggcatcaaagtt

SEQ ID NO: 212188 - DNA, 20 bp, Artificial sequence
  SiRNA target sequence
aaatgatggcatcaaagtta

SEQ ID NO: 212189 - DNA, 20 bp, Artificial sequence
  SiRNA target sequence
aatgatggcatcaaagttat

SEQ ID NO: 212190 - DNA, 20 bp, Artificial sequence
  SiRNA target sequence
atgatggcatcaaagttatt

SEQ ID NO: 212191 - DNA, 20 bp, Artificial sequence
  SiRNA target sequence
tgatggcatcaaagttatta

SEQ ID NO: 212192 - DNA, 20 bp, Artificial sequence
  SiRNA target sequence
gatggcatcaaagttattac

SEQ ID NO: 212193 - DNA, 20 bp, Artificial sequence
  SiRNA target sequence
atggcatcaaagttattact

SEQ ID NO: 212194 - DNA, 20 bp, Artificial sequence
  SiRNA target sequence
tggcatcaaagttattactt

SEQ ID NO: 212195 - DNA, 20 bp, Artificial sequence
  SiRNA target sequence
ggcatcaaagttattactta

SEQ ID NO: 212196 - DNA, 20 bp, Artificial sequence
  SiRNA target sequence
gcatcaaagttattacttaa

SEQ ID NO: 212197 - DNA, 20 bp, Artificial sequence
  SiRNA target sequence
catcaaagttattacttaac

SEQ ID NO: 212198 - DNA, 20 bp, Artificial sequence
  SiRNA target sequence
atcaaagttattacttaaca

SEQ ID NO: 212199 - DNA, 20 bp, Artificial sequence
  SiRNA target sequence
tcaaagttattacttaacat

SEQ ID NO: 212200 - DNA, 20 bp, Artificial sequence
  SiRNA target sequence
caaagttattacttaacatt

SEQ ID NO: 212201 - DNA, 20 bp, Artificial sequence
  SiRNA target sequence
aaagttattacttaacattt

SEQ ID NO: 212202 - DNA, 20 bp, Artificial sequence
  SiRNA target sequence
aagttattacttaacatttc

SEQ ID NO: 212203 - DNA, 20 bp, Artificial sequence
  SiRNA target sequence
agttattacttaacatttca

SEQ ID NO: 212204 - DNA, 20 bp, Artificial sequence
  SiRNA target sequence
gttattacttaacatttcat

SEQ ID NO: 212205 - DNA, 20 bp, Artificial sequence
  SiRNA target sequence
ttattacttaacatttcatt

SEQ ID NO: 212206 - DNA, 20 bp, Artificial sequence
  SiRNA target sequence
tattacttaacatttcatta

SEQ ID NO: 212207 - DNA, 20 bp, Artificial sequence
  SiRNA target sequence
attacttaacatttcattaa

SEQ ID NO: 212208 - DNA, 20 bp, Artificial sequence
  SiRNA target sequence
ttacttaacatttcattaac

SEQ ID NO: 212209 - DNA, 20 bp, Artificial sequence
  SiRNA target sequence
tacttaacatttcattaact

SEQ ID NO: 212210 - DNA, 20 bp, Artificial sequence
  SiRNA target sequence
acttaacatttcattaactg

SEQ ID NO: 212211 - DNA, 20 bp, Artificial sequence
  SiRNA target sequence
cttaacatttcattaactgt

SEQ ID NO: 212212 - DNA, 20 bp, Artificial sequence
  SiRNA target sequence
ttaacatttcattaactgtt

SEQ ID NO: 212213 - DNA, 20 bp, Artificial sequence
  SiRNA target sequence
taacatttcattaactgtta

SEQ ID NO: 212214 - DNA, 20 bp, Artificial sequence
  SiRNA target sequence
aacatttcattaactgttat

SEQ ID NO: 212215 - DNA, 20 bp, Artificial sequence
  SiRNA target sequence
acatttcattaactgttatg

SEQ ID NO: 212216 - DNA, 20 bp, Artificial sequence
  SiRNA target sequence
catttcattaactgttatgt

SEQ ID NO: 212217 - DNA, 20 bp, Artificial sequence
  SiRNA target sequence
atttcattaactgttatgtt

SEQ ID NO: 212218 - DNA, 20 bp, Artificial sequence
  SiRNA target sequence
tttcattaactgttatgttc

SEQ ID NO: 212219 - DNA, 20 bp, Artificial sequence
  SiRNA target sequence
ttcattaactgttatgttct

SEQ ID NO: 212220 - DNA, 20 bp, Artificial sequence
  SiRNA target sequence
tcattaactgttatgttcta

SEQ ID NO: 212221 - DNA, 20 bp, Artificial sequence
  SiRNA target sequence
cattaactgttatgttctat

SEQ ID NO: 212222 - DNA, 20 bp, Artificial sequence
  SiRNA target sequence
attaactgttatgttctatg

SEQ ID NO: 212223 - DNA, 20 bp, Artificial sequence
  SiRNA target sequence
ttaactgttatgttctatgg

SEQ ID NO: 212224 - DNA, 20 bp, Artificial sequence
  SiRNA target sequence
taactgttatgttctatggt

SEQ ID NO: 212225 - DNA, 20 bp, Artificial sequence
  SiRNA target sequence
aactgttatgttctatggta

SEQ ID NO: 212226 - DNA, 20 bp, Artificial sequence
  SiRNA target sequence
actgttatgttctatggtat

SEQ ID NO: 212227 - DNA, 20 bp, Artificial sequence
  SiRNA target sequence
ctgttatgttctatggtata

SEQ ID NO: 212228 - DNA, 20 bp, Artificial sequence
  SiRNA target sequence
tgttatgttctatggtatat

SEQ ID NO: 212229 - DNA, 20 bp, Artificial sequence
  SiRNA target sequence
gttatgttctatggtatatc

SEQ ID NO: 212230 - DNA, 20 bp, Artificial sequence
  SiRNA target sequence
ttatgttctatggtatatca

SEQ ID NO: 212231 - DNA, 20 bp, Artificial sequence
  SiRNA target sequence
tatgttctatggtatatcaa

SEQ ID NO: 212232 - DNA, 20 bp, Artificial sequence
  SiRNA target sequence
atgttctatggtatatcaac

SEQ ID NO: 212233 - DNA, 20 bp, Artificial sequence
  SiRNA target sequence
tgttctatggtatatcaact

SEQ ID NO: 212234 - DNA, 20 bp, Artificial sequence
  SiRNA target sequence
gttctatggtatatcaacta

SEQ ID NO: 212235 - DNA, 20 bp, Artificial sequence
  SiRNA target sequence
ttctatggtatatcaactaa

SEQ ID NO: 212236 - DNA, 20 bp, Artificial sequence
  SiRNA target sequence
tctatggtatatcaactaat

SEQ ID NO: 212237 - DNA, 20 bp, Artificial sequence
  SiRNA target sequence
ctatggtatatcaactaatt

SEQ ID NO: 212238 - DNA, 20 bp, Artificial sequence
  SiRNA target sequence
tatggtatatcaactaattt

SEQ ID NO: 212239 - DNA, 20 bp, Artificial sequence
  SiRNA target sequence
atggtatatcaactaattta

SEQ ID NO: 212240 - DNA, 20 bp, Artificial sequence
  SiRNA target sequence
tggtatatcaactaatttaa

SEQ ID NO: 212241 - DNA, 20 bp, Artificial sequence
  SiRNA target sequence
ggtatatcaactaatttaat

SEQ ID NO: 212242 - DNA, 20 bp, Artificial sequence
  SiRNA target sequence
gtatatcaactaatttaata

SEQ ID NO: 212243 - DNA, 20 bp, Artificial sequence
  SiRNA target sequence
tatatcaactaatttaatag

SEQ ID NO: 212244 - DNA, 20 bp, Artificial sequence
  SiRNA target sequence
atatcaactaatttaataga

SEQ ID NO: 212245 - DNA, 20 bp, Artificial sequence
  SiRNA target sequence
tatcaactaatttaatagaa

SEQ ID NO: 212246 - DNA, 20 bp, Artificial sequence
  SiRNA target sequence
atcaactaatttaatagaat

SEQ ID NO: 212247 - DNA, 20 bp, Artificial sequence
  SiRNA target sequence
tcaactaatttaatagaatc

SEQ ID NO: 212248 - DNA, 20 bp, Artificial sequence
  SiRNA target sequence
caactaatttaatagaatca

SEQ ID NO: 212249 - DNA, 20 bp, Artificial sequence
  SiRNA target sequence
aactaatttaatagaatcaa

SEQ ID NO: 212250 - DNA, 20 bp, Artificial sequence
  SiRNA target sequence
actaatttaatagaatcaac

SEQ ID NO: 212251 - DNA, 20 bp, Artificial sequence
  SiRNA target sequence
ctaatttaatagaatcaaca

SEQ ID NO: 212252 - DNA, 20 bp, Artificial sequence
  SiRNA target sequence
taatttaatagaatcaacat

SEQ ID NO: 212253 - DNA, 20 bp, Artificial sequence
  SiRNA target sequence
aatttaatagaatcaacatt

SEQ ID NO: 212254 - DNA, 20 bp, Artificial sequence
  SiRNA target sequence
atttaatagaatcaacattt

SEQ ID NO: 212255 - DNA, 20 bp, Artificial sequence
  SiRNA target sequence
tttaatagaatcaacattta

SEQ ID NO: 212256 - DNA, 20 bp, Artificial sequence
  SiRNA target sequence
ttaatagaatcaacatttaa

SEQ ID NO: 212257 - DNA, 20 bp, Artificial sequence
  SiRNA target sequence
taatagaatcaacatttaaa

SEQ ID NO: 212258 - DNA, 20 bp, Artificial sequence
  SiRNA target sequence
aatagaatcaacatttaaaa

SEQ ID NO: 212259 - DNA, 20 bp, Artificial sequence
  SiRNA target sequence
atagaatcaacatttaaaag

SEQ ID NO: 212260 - DNA, 20 bp, Artificial sequence
  SiRNA target sequence
tagaatcaacatttaaaagt

SEQ ID NO: 212261 - DNA, 20 bp, Artificial sequence
  SiRNA target sequence
agaatcaacatttaaaagtg

SEQ ID NO: 212262 - DNA, 20 bp, Artificial sequence
  SiRNA target sequence
gaatcaacatttaaaagtgg

SEQ ID NO: 212263 - DNA, 20 bp, Artificial sequence
  SiRNA target sequence
aatcaacatttaaaagtgga

SEQ ID NO: 212264 - DNA, 20 bp, Artificial sequence
  SiRNA target sequence
atcaacatttaaaagtggac

SEQ ID NO: 212265 - DNA, 20 bp, Artificial sequence
  SiRNA target sequence
tcaacatttaaaagtggact

SEQ ID NO: 212266 - DNA, 20 bp, Artificial sequence
  SiRNA target sequence
caacatttaaaagtggactt

SEQ ID NO: 212267 - DNA, 20 bp, Artificial sequence
  SiRNA target sequence
aacatttaaaagtggacttg

SEQ ID NO: 212268 - DNA, 20 bp, Artificial sequence
  SiRNA target sequence
acatttaaaagtggacttgt

SEQ ID NO: 212269 - DNA, 20 bp, Artificial sequence
  SiRNA target sequence
catttaaaagtggacttgtg

SEQ ID NO: 212270 - DNA, 20 bp, Artificial sequence
  SiRNA target sequence
atttaaaagtggacttgtga

SEQ ID NO: 212271 - DNA, 20 bp, Artificial sequence
  SiRNA target sequence
tttaaaagtggacttgtgaa

SEQ ID NO: 212272 - DNA, 20 bp, Artificial sequence
  SiRNA target sequence
ttaaaagtggacttgtgaaa

SEQ ID NO: 212273 - DNA, 20 bp, Artificial sequence
  SiRNA target sequence
taaaagtggacttgtgaaag

SEQ ID NO: 212274 - DNA, 20 bp, Artificial sequence
  SiRNA target sequence
aaaagtggacttgtgaaagg

SEQ ID NO: 212275 - DNA, 20 bp, Artificial sequence
  SiRNA target sequence
aaagtggacttgtgaaaggt

SEQ ID NO: 212276 - DNA, 20 bp, Artificial sequence
  SiRNA target sequence
aagtggacttgtgaaaggtg

SEQ ID NO: 212277 - DNA, 20 bp, Artificial sequence
  SiRNA target sequence
agtggacttgtgaaaggtgc

SEQ ID NO: 212278 - DNA, 20 bp, Artificial sequence
  SiRNA target sequence
gtggacttgtgaaaggtgca

SEQ ID NO: 212279 - DNA, 20 bp, Artificial sequence
  SiRNA target sequence
tggacttgtgaaaggtgcag

SEQ ID NO: 212280 - DNA, 20 bp, Artificial sequence
  SiRNA target sequence
ggacttgtgaaaggtgcaga

SEQ ID NO: 212281 - DNA, 20 bp, Artificial sequence
  SiRNA target sequence
gacttgtgaaaggtgcagaa

SEQ ID NO: 212282 - DNA, 20 bp, Artificial sequence
  SiRNA target sequence
acttgtgaaaggtgcagaag

SEQ ID NO: 212283 - DNA, 20 bp, Artificial sequence
  SiRNA target sequence
cttgtgaaaggtgcagaaga

SEQ ID NO: 212284 - DNA, 20 bp, Artificial sequence
  SiRNA target sequence
ttgtgaaaggtgcagaagaa

SEQ ID NO: 212285 - DNA, 20 bp, Artificial sequence
  SiRNA target sequence
tgtgaaaggtgcagaagaat

SEQ ID NO: 212286 - DNA, 20 bp, Artificial sequence
  SiRNA target sequence
gtgaaaggtgcagaagaatt

SEQ ID NO: 212287 - DNA, 20 bp, Artificial sequence
  SiRNA target sequence
tgaaaggtgcagaagaatta

SEQ ID NO: 212288 - DNA, 20 bp, Artificial sequence
  SiRNA target sequence
gaaaggtgcagaagaattaa

SEQ ID NO: 212289 - DNA, 20 bp, Artificial sequence
  SiRNA target sequence
aaaggtgcagaagaattaaa

SEQ ID NO: 212290 - DNA, 20 bp, Artificial sequence
  SiRNA target sequence
aaggtgcagaagaattaaac

SEQ ID NO: 212291 - DNA, 20 bp, Artificial sequence
  SiRNA target sequence
aggtgcagaagaattaaacg

SEQ ID NO: 212292 - DNA, 20 bp, Artificial sequence
  SiRNA target sequence
ggtgcagaagaattaaacga

SEQ ID NO: 212293 - DNA, 20 bp, Artificial sequence
  SiRNA target sequence
gtgcagaagaattaaacgag

SEQ ID NO: 212294 - DNA, 20 bp, Artificial sequence
  SiRNA target sequence
tgcagaagaattaaacgaga

SEQ ID NO: 212295 - DNA, 20 bp, Artificial sequence
  SiRNA target sequence
gcagaagaattaaacgagaa

SEQ ID NO: 212296 - DNA, 20 bp, Artificial sequence
  SiRNA target sequence
cagaagaattaaacgagaat

SEQ ID NO: 212297 - DNA, 20 bp, Artificial sequence
  SiRNA target sequence
agaagaattaaacgagaata

SEQ ID NO: 212298 - DNA, 20 bp, Artificial sequence
  SiRNA target sequence
gaagaattaaacgagaatac

SEQ ID NO: 212299 - DNA, 20 bp, Artificial sequence
  SiRNA target sequence
aagaattaaacgagaatact

SEQ ID NO: 212300 - DNA, 20 bp, Artificial sequence
  SiRNA target sequence
agaattaaacgagaatacta

SEQ ID NO: 212301 - DNA, 20 bp, Artificial sequence
  SiRNA target sequence
gaattaaacgagaatactaa

SEQ ID NO: 212302 - DNA, 20 bp, Artificial sequence
  SiRNA target sequence
aattaaacgagaatactaaa

SEQ ID NO: 212303 - DNA, 20 bp, Artificial sequence
  SiRNA target sequence
attaaacgagaatactaaaa

SEQ ID NO: 212304 - DNA, 20 bp, Artificial sequence
  SiRNA target sequence
ttaaacgagaatactaaaag

SEQ ID NO: 212305 - DNA, 20 bp, Artificial sequence
  SiRNA target sequence
taaacgagaatactaaaagt

SEQ ID NO: 212306 - DNA, 20 bp, Artificial sequence
  SiRNA target sequence
aaacgagaatactaaaagtt

SEQ ID NO: 212307 - DNA, 20 bp, Artificial sequence
  SiRNA target sequence
aacgagaatactaaaagtta

SEQ ID NO: 212308 - DNA, 20 bp, Artificial sequence
  SiRNA target sequence
acgagaatactaaaagttat

SEQ ID NO: 212309 - DNA, 20 bp, Artificial sequence
  SiRNA target sequence
cgagaatactaaaagttatt

SEQ ID NO: 212310 - DNA, 20 bp, Artificial sequence
  SiRNA target sequence
gagaatactaaaagttattc

SEQ ID NO: 212311 - DNA, 20 bp, Artificial sequence
  SiRNA target sequence
agaatactaaaagttattct

SEQ ID NO: 212312 - DNA, 20 bp, Artificial sequence
  SiRNA target sequence
gaatactaaaagttattcta

SEQ ID NO: 212313 - DNA, 20 bp, Artificial sequence
  SiRNA target sequence
aatactaaaagttattctat

SEQ ID NO: 212314 - DNA, 20 bp, Artificial sequence
  SiRNA target sequence
atactaaaagttattctatg

SEQ ID NO: 212315 - DNA, 20 bp, Artificial sequence
  SiRNA target sequence
tactaaaagttattctatgg

SEQ ID NO: 212316 - DNA, 20 bp, Artificial sequence
  SiRNA target sequence
actaaaagttattctatggg

SEQ ID NO: 212317 - DNA, 20 bp, Artificial sequence
  SiRNA target sequence
ctaaaagttattctatggga

SEQ ID NO: 212318 - DNA, 20 bp, Artificial sequence
  SiRNA target sequence
taaaagttattctatgggat

SEQ ID NO: 212319 - DNA, 20 bp, Artificial sequence
  SiRNA target sequence
aaaagttattctatgggata

SEQ ID NO: 212320 - DNA, 20 bp, Artificial sequence
  SiRNA target sequence
aaagttattctatgggatat

SEQ ID NO: 212321 - DNA, 20 bp, Artificial sequence
  SiRNA target sequence
aagttattctatgggatata

SEQ ID NO: 212322 - DNA, 20 bp, Artificial sequence
  SiRNA target sequence
agttattctatgggatataa

SEQ ID NO: 212323 - DNA, 20 bp, Artificial sequence
  SiRNA target sequence
gttattctatgggatataat

SEQ ID NO: 212324 - DNA, 20 bp, Artificial sequence
  SiRNA target sequence
ttattctatgggatataatt

SEQ ID NO: 212325 - DNA, 20 bp, Artificial sequence
  SiRNA target sequence
tattctatgggatataattc

SEQ ID NO: 212326 - DNA, 20 bp, Artificial sequence
  SiRNA target sequence
attctatgggatataattca

SEQ ID NO: 212327 - DNA, 20 bp, Artificial sequence
  SiRNA target sequence
ttctatgggatataattcat

SEQ ID NO: 212328 - DNA, 20 bp, Artificial sequence
  SiRNA target sequence
tctatgggatataattcatt

SEQ ID NO: 212329 - DNA, 20 bp, Artificial sequence
  SiRNA target sequence
ctatgggatataattcattt

SEQ ID NO: 212330 - DNA, 20 bp, Artificial sequence
  SiRNA target sequence
tatgggatataattcatttg

SEQ ID NO: 212331 - DNA, 20 bp, Artificial sequence
  SiRNA target sequence
atgggatataattcatttga

SEQ ID NO: 212332 - DNA, 20 bp, Artificial sequence
  SiRNA target sequence
tgggatataattcatttgaa

SEQ ID NO: 212333 - DNA, 20 bp, Artificial sequence
  SiRNA target sequence
gggatataattcatttgaac

SEQ ID NO: 212334 - DNA, 20 bp, Artificial sequence
  SiRNA target sequence
ggatataattcatttgaaca

SEQ ID NO: 212335 - DNA, 20 bp, Artificial sequence
  SiRNA target sequence
gatataattcatttgaacaa

SEQ ID NO: 212336 - DNA, 20 bp, Artificial sequence
  SiRNA target sequence
atataattcatttgaacaaa

SEQ ID NO: 212337 - DNA, 20 bp, Artificial sequence
  SiRNA target sequence
tataattcatttgaacaaaa

SEQ ID NO: 212338 - DNA, 20 bp, Artificial sequence
  SiRNA target sequence
ataattcatttgaacaaaag

SEQ ID NO: 212339 - DNA, 20 bp, Artificial sequence
  SiRNA target sequence
taattcatttgaacaaaaga

SEQ ID NO: 212340 - DNA, 20 bp, Artificial sequence
  SiRNA target sequence
aattcatttgaacaaaagat

SEQ ID NO: 212341 - DNA, 20 bp, Artificial sequence
  SiRNA target sequence
attcatttgaacaaaagata

SEQ ID NO: 212342 - DNA, 20 bp, Artificial sequence
  SiRNA target sequence
ttcatttgaacaaaagatag

SEQ ID NO: 212343 - DNA, 20 bp, Artificial sequence
  SiRNA target sequence
tcatttgaacaaaagatagc

SEQ ID NO: 212344 - DNA, 20 bp, Artificial sequence
  SiRNA target sequence
catttgaacaaaagatagca

SEQ ID NO: 212345 - DNA, 20 bp, Artificial sequence
  SiRNA target sequence
atttgaacaaaagatagcat

SEQ ID NO: 212346 - DNA, 20 bp, Artificial sequence
  SiRNA target sequence
tttgaacaaaagatagcatc

SEQ ID NO: 212347 - DNA, 20 bp, Artificial sequence
  SiRNA target sequence
ttgaacaaaagatagcatca

SEQ ID NO: 212348 - DNA, 20 bp, Artificial sequence
  SiRNA target sequence
tgaacaaaagatagcatcaa

SEQ ID NO: 212349 - DNA, 20 bp, Artificial sequence
  SiRNA target sequence
gaacaaaagatagcatcaat

SEQ ID NO: 212350 - DNA, 20 bp, Artificial sequence
  SiRNA target sequence
aacaaaagatagcatcaata

SEQ ID NO: 212351 - DNA, 20 bp, Artificial sequence
  SiRNA target sequence
acaaaagatagcatcaataa

SEQ ID NO: 212352 - DNA, 20 bp, Artificial sequence
  SiRNA target sequence
caaaagatagcatcaataac

SEQ ID NO: 212353 - DNA, 20 bp, Artificial sequence
  SiRNA target sequence
aaaagatagcatcaataact

SEQ ID NO: 212354 - DNA, 20 bp, Artificial sequence
  SiRNA target sequence
aaagatagcatcaataactg

SEQ ID NO: 212355 - DNA, 20 bp, Artificial sequence
  SiRNA target sequence
aagatagcatcaataactgt

SEQ ID NO: 212356 - DNA, 20 bp, Artificial sequence
  SiRNA target sequence
agatagcatcaataactgtt

SEQ ID NO: 212357 - DNA, 20 bp, Artificial sequence
  SiRNA target sequence
gatagcatcaataactgtta

SEQ ID NO: 212358 - DNA, 20 bp, Artificial sequence
  SiRNA target sequence
atagcatcaataactgttat

SEQ ID NO: 212359 - DNA, 20 bp, Artificial sequence
  SiRNA target sequence
tagcatcaataactgttatt

SEQ ID NO: 212360 - DNA, 20 bp, Artificial sequence
  SiRNA target sequence
agcatcaataactgttatta

SEQ ID NO: 212361 - DNA, 20 bp, Artificial sequence
  SiRNA target sequence
gcatcaataactgttattat

SEQ ID NO: 212362 - DNA, 20 bp, Artificial sequence
  SiRNA target sequence
catcaataactgttattatc

SEQ ID NO: 212363 - DNA, 20 bp, Artificial sequence
  SiRNA target sequence
atcaataactgttattatcc

SEQ ID NO: 212364 - DNA, 20 bp, Artificial sequence
  SiRNA target sequence
tcaataactgttattatcct

SEQ ID NO: 212365 - DNA, 20 bp, Artificial sequence
  SiRNA target sequence
caataactgttattatcctg

SEQ ID NO: 212366 - DNA, 20 bp, Artificial sequence
  SiRNA target sequence
aataactgttattatcctgc

SEQ ID NO: 212367 - DNA, 20 bp, Artificial sequence
  SiRNA target sequence
ataactgttattatcctgct

SEQ ID NO: 212368 - DNA, 20 bp, Artificial sequence
  SiRNA target sequence
taactgttattatcctgctt

SEQ ID NO: 212369 - DNA, 20 bp, Artificial sequence
  SiRNA target sequence
aactgttattatcctgcttt

SEQ ID NO: 212370 - DNA, 20 bp, Artificial sequence
  SiRNA target sequence
actgttattatcctgctttt

SEQ ID NO: 212371 - DNA, 20 bp, Artificial sequence
  SiRNA target sequence
ctgttattatcctgctttta

SEQ ID NO: 212372 - DNA, 20 bp, Artificial sequence
  SiRNA target sequence
tgttattatcctgcttttat

SEQ ID NO: 212373 - DNA, 20 bp, Artificial sequence
  SiRNA target sequence
gttattatcctgcttttatc

SEQ ID NO: 212374 - DNA, 20 bp, Artificial sequence
  SiRNA target sequence
ttattatcctgcttttatca

SEQ ID NO: 212375 - DNA, 20 bp, Artificial sequence
  SiRNA target sequence
tattatcctgcttttatcac

SEQ ID NO: 212376 - DNA, 20 bp, Artificial sequence
  SiRNA target sequence
attatcctgcttttatcacc

SEQ ID NO: 212377 - DNA, 20 bp, Artificial sequence
  SiRNA target sequence
ttatcctgcttttatcacca

SEQ ID NO: 212378 - DNA, 20 bp, Artificial sequence
  SiRNA target sequence
tatcctgcttttatcaccat

SEQ ID NO: 212379 - DNA, 20 bp, Artificial sequence
  SiRNA target sequence
atcctgcttttatcaccatt

SEQ ID NO: 212380 - DNA, 20 bp, Artificial sequence
  SiRNA target sequence
tcctgcttttatcaccattt

SEQ ID NO: 212381 - DNA, 20 bp, Artificial sequence
  SiRNA target sequence
cctgcttttatcaccatttc

SEQ ID NO: 212382 - DNA, 20 bp, Artificial sequence
  SiRNA target sequence
ctgcttttatcaccatttcc

SEQ ID NO: 212383 - DNA, 20 bp, Artificial sequence
  SiRNA target sequence
tgcttttatcaccatttcca

SEQ ID NO: 212384 - DNA, 20 bp, Artificial sequence
  SiRNA target sequence
gcttttatcaccatttccaa

SEQ ID NO: 212385 - DNA, 20 bp, Artificial sequence
  SiRNA target sequence
cttttatcaccatttccaaa

SEQ ID NO: 212386 - DNA, 20 bp, Artificial sequence
  SiRNA target sequence
ttttatcaccatttccaaaa

SEQ ID NO: 212387 - DNA, 20 bp, Artificial sequence
  SiRNA target sequence
tttatcaccatttccaaaat

SEQ ID NO: 212388 - DNA, 20 bp, Artificial sequence
  SiRNA target sequence
ttatcaccatttccaaaatt

SEQ ID NO: 212389 - DNA, 20 bp, Artificial sequence
  SiRNA target sequence
tatcaccatttccaaaatta

SEQ ID NO: 212390 - DNA, 20 bp, Artificial sequence
  SiRNA target sequence
atcaccatttccaaaattaa

SEQ ID NO: 212391 - DNA, 20 bp, Artificial sequence
  SiRNA target sequence
tcaccatttccaaaattaat

SEQ ID NO: 212392 - DNA, 20 bp, Artificial sequence
  SiRNA target sequence
caccatttccaaaattaata

SEQ ID NO: 212393 - DNA, 20 bp, Artificial sequence
  SiRNA target sequence
accatttccaaaattaatac

SEQ ID NO: 212394 - DNA, 20 bp, Artificial sequence
  SiRNA target sequence
ccatttccaaaattaataca

SEQ ID NO: 212395 - DNA, 20 bp, Artificial sequence
  SiRNA target sequence
catttccaaaattaatacaa

SEQ ID NO: 212396 - DNA, 20 bp, Artificial sequence
  SiRNA target sequence
atttccaaaattaatacaaa

SEQ ID NO: 212397 - DNA, 20 bp, Artificial sequence
  SiRNA target sequence
tttccaaaattaatacaaac

SEQ ID NO: 212398 - DNA, 20 bp, Artificial sequence
  SiRNA target sequence
ttccaaaattaatacaaacc

SEQ ID NO: 212399 - DNA, 20 bp, Artificial sequence
  SiRNA target sequence
tccaaaattaatacaaacca

SEQ ID NO: 212400 - DNA, 20 bp, Artificial sequence
  SiRNA target sequence
ccaaaattaatacaaaccaa

SEQ ID NO: 212401 - DNA, 20 bp, Artificial sequence
  SiRNA target sequence
caaaattaatacaaaccaaa

SEQ ID NO: 212402 - DNA, 20 bp, Artificial sequence
  SiRNA target sequence
aaaattaatacaaaccaaag

SEQ ID NO: 212403 - DNA, 20 bp, Artificial sequence
  SiRNA target sequence
aaattaatacaaaccaaagg

SEQ ID NO: 212404 - DNA, 20 bp, Artificial sequence
  SiRNA target sequence
aattaatacaaaccaaagga

SEQ ID NO: 212405 - DNA, 20 bp, Artificial sequence
  SiRNA target sequence
attaatacaaaccaaaggat

SEQ ID NO: 212406 - DNA, 20 bp, Artificial sequence
  SiRNA target sequence
ttaatacaaaccaaaggatg

SEQ ID NO: 212407 - DNA, 20 bp, Artificial sequence
  SiRNA target sequence
taatacaaaccaaaggatgg

SEQ ID NO: 212408 - DNA, 20 bp, Artificial sequence
  SiRNA target sequence
aatacaaaccaaaggatgga

SEQ ID NO: 212409 - DNA, 20 bp, Artificial sequence
  SiRNA target sequence
atacaaaccaaaggatggat

SEQ ID NO: 212410 - DNA, 20 bp, Artificial sequence
  SiRNA target sequence
tacaaaccaaaggatggata

SEQ ID NO: 212411 - DNA, 20 bp, Artificial sequence
  SiRNA target sequence
acaaaccaaaggatggatat

SEQ ID NO: 212412 - DNA, 20 bp, Artificial sequence
  SiRNA target sequence
caaaccaaaggatggatatt

SEQ ID NO: 212413 - DNA, 20 bp, Artificial sequence
  SiRNA target sequence
aaaccaaaggatggatattt

SEQ ID NO: 212414 - DNA, 20 bp, Artificial sequence
  SiRNA target sequence
aaccaaaggatggatatttg

SEQ ID NO: 212415 - DNA, 20 bp, Artificial sequence
  SiRNA target sequence
accaaaggatggatatttgt

SEQ ID NO: 212416 - DNA, 20 bp, Artificial sequence
  SiRNA target sequence
ccaaaggatggatatttgtt

SEQ ID NO: 212417 - DNA, 20 bp, Artificial sequence
  SiRNA target sequence
caaaggatggatatttgttg

SEQ ID NO: 212418 - DNA, 20 bp, Artificial sequence
  SiRNA target sequence
aaaggatggatatttgttgc

SEQ ID NO: 212419 - DNA, 20 bp, Artificial sequence
  SiRNA target sequence
aaggatggatatttgttgcc

SEQ ID NO: 212420 - DNA, 20 bp, Artificial sequence
  SiRNA target sequence
aggatggatatttgttgcca

SEQ ID NO: 212421 - DNA, 20 bp, Artificial sequence
  SiRNA target sequence
ggatggatatttgttgccat

SEQ ID NO: 212422 - DNA, 20 bp, Artificial sequence
  SiRNA target sequence
gatggatatttgttgccata

SEQ ID NO: 212423 - DNA, 20 bp, Artificial sequence
  SiRNA target sequence
atggatatttgttgccatag

SEQ ID NO: 212424 - DNA, 20 bp, Artificial sequence
  SiRNA target sequence
tggatatttgttgccatagc

SEQ ID NO: 212425 - DNA, 20 bp, Artificial sequence
  SiRNA target sequence
ggatatttgttgccatagcg

SEQ ID NO: 212426 - DNA, 20 bp, Artificial sequence
  SiRNA target sequence
gatatttgttgccatagcgt

SEQ ID NO: 212427 - DNA, 20 bp, Artificial sequence
  SiRNA target sequence
atatttgttgccatagcgtg

SEQ ID NO: 212428 - DNA, 20 bp, Artificial sequence
  SiRNA target sequence
tatttgttgccatagcgtgc

SEQ ID NO: 212429 - DNA, 20 bp, Artificial sequence
  SiRNA target sequence
atttgttgccatagcgtgcc

SEQ ID NO: 212430 - DNA, 20 bp, Artificial sequence
  SiRNA target sequence
tttgttgccatagcgtgccc

SEQ ID NO: 212431 - DNA, 20 bp, Artificial sequence
  SiRNA target sequence
ttgttgccatagcgtgccca

SEQ ID NO: 212432 - DNA, 20 bp, Artificial sequence
  SiRNA target sequence
tgttgccatagcgtgcccac

SEQ ID NO: 212433 - DNA, 20 bp, Artificial sequence
  SiRNA target sequence
gttgccatagcgtgcccact

SEQ ID NO: 212434 - DNA, 20 bp, Artificial sequence
  SiRNA target sequence
ttgccatagcgtgcccactt

SEQ ID NO: 212435 - DNA, 20 bp, Artificial sequence
  SiRNA target sequence
tgccatagcgtgcccactta

SEQ ID NO: 212436 - DNA, 20 bp, Artificial sequence
  SiRNA target sequence
gccatagcgtgcccacttat

SEQ ID NO: 212437 - DNA, 20 bp, Artificial sequence
  SiRNA target sequence
ccatagcgtgcccacttatt

SEQ ID NO: 212438 - DNA, 20 bp, Artificial sequence
  SiRNA target sequence
catagcgtgcccacttatta

SEQ ID NO: 212439 - DNA, 20 bp, Artificial sequence
  SiRNA target sequence
atagcgtgcccacttattac

SEQ ID NO: 212440 - DNA, 20 bp, Artificial sequence
  SiRNA target sequence
tagcgtgcccacttattacc

SEQ ID NO: 212441 - DNA, 20 bp, Artificial sequence
  SiRNA target sequence
agcgtgcccacttattaccc

SEQ ID NO: 212442 - DNA, 20 bp, Artificial sequence
  SiRNA target sequence
gcgtgcccacttattaccct

SEQ ID NO: 212443 - DNA, 20 bp, Artificial sequence
  SiRNA target sequence
cgtgcccacttattaccctt

SEQ ID NO: 212444 - DNA, 20 bp, Artificial sequence
  SiRNA target sequence
gtgcccacttattacccttt

SEQ ID NO: 212445 - DNA, 20 bp, Artificial sequence
  SiRNA target sequence
tgcccacttattaccctttt

SEQ ID NO: 212446 - DNA, 20 bp, Artificial sequence
  SiRNA target sequence
gcccacttattacccttttt

SEQ ID NO: 212447 - DNA, 20 bp, Artificial sequence
  SiRNA target sequence
cccacttattaccctttttg

SEQ ID NO: 212448 - DNA, 20 bp, Artificial sequence
  SiRNA target sequence
ccacttattaccctttttgc

SEQ ID NO: 212449 - DNA, 20 bp, Artificial sequence
  SiRNA target sequence
cacttattaccctttttgct

SEQ ID NO: 212450 - DNA, 20 bp, Artificial sequence
  SiRNA target sequence
acttattaccctttttgctg

SEQ ID NO: 212451 - DNA, 20 bp, Artificial sequence
  SiRNA target sequence
cttattaccctttttgctgt

SEQ ID NO: 212452 - DNA, 20 bp, Artificial sequence
  SiRNA target sequence
ttattaccctttttgctgta

SEQ ID NO: 212453 - DNA, 20 bp, Artificial sequence
  SiRNA target sequence
tattaccctttttgctgtag

SEQ ID NO: 212454 - DNA, 20 bp, Artificial sequence
  SiRNA target sequence
attaccctttttgctgtagt

SEQ ID NO: 212455 - DNA, 20 bp, Artificial sequence
  SiRNA target sequence
ttaccctttttgctgtagtt

SEQ ID NO: 212456 - DNA, 20 bp, Artificial sequence
  SiRNA target sequence
taccctttttgctgtagttt

SEQ ID NO: 212457 - DNA, 20 bp, Artificial sequence
  SiRNA target sequence
accctttttgctgtagtttc

SEQ ID NO: 212458 - DNA, 20 bp, Artificial sequence
  SiRNA target sequence
ccctttttgctgtagtttct

SEQ ID NO: 212459 - DNA, 20 bp, Artificial sequence
  SiRNA target sequence
cctttttgctgtagtttctg

SEQ ID NO: 212460 - DNA, 20 bp, Artificial sequence
  SiRNA target sequence
ctttttgctgtagtttctgt

SEQ ID NO: 212461 - DNA, 20 bp, Artificial sequence
  SiRNA target sequence
tttttgctgtagtttctgtg

SEQ ID NO: 212462 - DNA, 20 bp, Artificial sequence
  SiRNA target sequence
ttttgctgtagtttctgtgt

SEQ ID NO: 212463 - DNA, 20 bp, Artificial sequence
  SiRNA target sequence
tttgctgtagtttctgtgtg

SEQ ID NO: 212464 - DNA, 20 bp, Artificial sequence
  SiRNA target sequence
ttgctgtagtttctgtgtgt

SEQ ID NO: 212465 - DNA, 20 bp, Artificial sequence
  SiRNA target sequence
tgctgtagtttctgtgtgtg

SEQ ID NO: 212466 - DNA, 20 bp, Artificial sequence
  SiRNA target sequence
gctgtagtttctgtgtgtgg

SEQ ID NO: 212467 - DNA, 20 bp, Artificial sequence
  SiRNA target sequence
ctgtagtttctgtgtgtggt

SEQ ID NO: 212468 - DNA, 20 bp, Artificial sequence
  SiRNA target sequence
tgtagtttctgtgtgtggtc

SEQ ID NO: 212469 - DNA, 20 bp, Artificial sequence
  SiRNA target sequence
gtagtttctgtgtgtggtct

SEQ ID NO: 212470 - DNA, 20 bp, Artificial sequence
  SiRNA target sequence
tagtttctgtgtgtggtctt

SEQ ID NO: 212471 - DNA, 20 bp, Artificial sequence
  SiRNA target sequence
agtttctgtgtgtggtcttg

SEQ ID NO: 212472 - DNA, 20 bp, Artificial sequence
  SiRNA target sequence
gtttctgtgtgtggtcttgc

SEQ ID NO: 212473 - DNA, 20 bp, Artificial sequence
  SiRNA target sequence
tttctgtgtgtggtcttgct

SEQ ID NO: 212474 - DNA, 20 bp, Artificial sequence
  SiRNA target sequence
ttctgtgtgtggtcttgctt

SEQ ID NO: 212475 - DNA, 20 bp, Artificial sequence
  SiRNA target sequence
tctgtgtgtggtcttgcttt

SEQ ID NO: 212476 - DNA, 20 bp, Artificial sequence
  SiRNA target sequence
ctgtgtgtggtcttgctttt

SEQ ID NO: 212477 - DNA, 20 bp, Artificial sequence
  SiRNA target sequence
tgtgtgtggtcttgcttttt

SEQ ID NO: 212478 - DNA, 20 bp, Artificial sequence
  SiRNA target sequence
gtgtgtggtcttgcttttta

SEQ ID NO: 212479 - DNA, 20 bp, Artificial sequence
  SiRNA target sequence
tgtgtggtcttgctttttac

SEQ ID NO: 212480 - DNA, 20 bp, Artificial sequence
  SiRNA target sequence
gtgtggtcttgctttttaca

SEQ ID NO: 212481 - DNA, 20 bp, Artificial sequence
  SiRNA target sequence
tgtggtcttgctttttacaa

SEQ ID NO: 212482 - DNA, 20 bp, Artificial sequence
  SiRNA target sequence
gtggtcttgctttttacaat

SEQ ID NO: 212483 - DNA, 20 bp, Artificial sequence
  SiRNA target sequence
tggtcttgctttttacaatt

SEQ ID NO: 212484 - DNA, 20 bp, Artificial sequence
  SiRNA target sequence
ggtcttgctttttacaatta

SEQ ID NO: 212485 - DNA, 20 bp, Artificial sequence
  SiRNA target sequence
gtcttgctttttacaattat

SEQ ID NO: 212486 - DNA, 20 bp, Artificial sequence
  SiRNA target sequence
tcttgctttttacaattatc

SEQ ID NO: 212487 - DNA, 20 bp, Artificial sequence
  SiRNA target sequence
cttgctttttacaattatcc

SEQ ID NO: 212488 - DNA, 20 bp, Artificial sequence
  SiRNA target sequence
ttgctttttacaattatccg

SEQ ID NO: 212489 - DNA, 20 bp, Artificial sequence
  SiRNA target sequence
tgctttttacaattatccgg

SEQ ID NO: 212490 - DNA, 20 bp, Artificial sequence
  SiRNA target sequence
gctttttacaattatccggc

SEQ ID NO: 212491 - DNA, 20 bp, Artificial sequence
  SiRNA target sequence
ctttttacaattatccggca

SEQ ID NO: 212492 - DNA, 20 bp, Artificial sequence
  SiRNA target sequence
tttttacaattatccggcaa

SEQ ID NO: 212493 - DNA, 20 bp, Artificial sequence
  SiRNA target sequence
ttttacaattatccggcaac

SEQ ID NO: 212494 - DNA, 20 bp, Artificial sequence
  SiRNA target sequence
tttacaattatccggcaaca

SEQ ID NO: 212495 - DNA, 20 bp, Artificial sequence
  SiRNA target sequence
ttacaattatccggcaacaa

SEQ ID NO: 212496 - DNA, 20 bp, Artificial sequence
  SiRNA target sequence
tacaattatccggcaacaaa

SEQ ID NO: 212497 - DNA, 20 bp, Artificial sequence
  SiRNA target sequence
acaattatccggcaacaaat

SEQ ID NO: 212498 - DNA, 20 bp, Artificial sequence
  SiRNA target sequence
caattatccggcaacaaata

SEQ ID NO: 212499 - DNA, 20 bp, Artificial sequence
  SiRNA target sequence
aattatccggcaacaaataa

SEQ ID NO: 212500 - DNA, 20 bp, Artificial sequence
  SiRNA target sequence
attatccggcaacaaataat

SEQ ID NO: 212501 - DNA, 20 bp, Artificial sequence
  SiRNA target sequence
ttatccggcaacaaataatg

SEQ ID NO: 212502 - DNA, 20 bp, Artificial sequence
  SiRNA target sequence
tatccggcaacaaataatga

SEQ ID NO: 212503 - DNA, 20 bp, Artificial sequence
  SiRNA target sequence
atccggcaacaaataatgac

SEQ ID NO: 212504 - DNA, 20 bp, Artificial sequence
  SiRNA target sequence
tccggcaacaaataatgaca

SEQ ID NO: 212505 - DNA, 20 bp, Artificial sequence
  SiRNA target sequence
ccggcaacaaataatgacac

SEQ ID NO: 212506 - DNA, 20 bp, Artificial sequence
  SiRNA target sequence
cggcaacaaataatgacaca

SEQ ID NO: 212507 - DNA, 20 bp, Artificial sequence
  SiRNA target sequence
ggcaacaaataatgacacaa

SEQ ID NO: 212508 - DNA, 20 bp, Artificial sequence
  SiRNA target sequence
gcaacaaataatgacacaaa

SEQ ID NO: 212509 - DNA, 20 bp, Artificial sequence
  SiRNA target sequence
caacaaataatgacacaaat

SEQ ID NO: 212510 - DNA, 20 bp, Artificial sequence
  SiRNA target sequence
aacaaataatgacacaaatt

SEQ ID NO: 212511 - DNA, 20 bp, Artificial sequence
  SiRNA target sequence
acaaataatgacacaaattt

SEQ ID NO: 212512 - DNA, 20 bp, Artificial sequence
  SiRNA target sequence
caaataatgacacaaatttt

SEQ ID NO: 212513 - DNA, 20 bp, Artificial sequence
  SiRNA target sequence
aaataatgacacaaattttt

SEQ ID NO: 212514 - DNA, 20 bp, Artificial sequence
  SiRNA target sequence
aataatgacacaaatttttt

SEQ ID NO: 212515 - DNA, 20 bp, Artificial sequence
  SiRNA target sequence
ataatgacacaaattttttt

SEQ ID NO: 212516 - DNA, 20 bp, Artificial sequence
  SiRNA target sequence
taatgacacaaatttttttc

SEQ ID NO: 212517 - DNA, 20 bp, Artificial sequence
  SiRNA target sequence
aatgacacaaatttttttct

SEQ ID NO: 212518 - DNA, 20 bp, Artificial sequence
  SiRNA target sequence
atgacacaaatttttttcta

SEQ ID NO: 212519 - DNA, 20 bp, Artificial sequence
  SiRNA target sequence
tgacacaaatttttttctaa

SEQ ID NO: 212520 - DNA, 20 bp, Artificial sequence
  SiRNA target sequence
gacacaaatttttttctaaa

SEQ ID NO: 212521 - DNA, 20 bp, Artificial sequence
  SiRNA target sequence
acacaaatttttttctaaat

SEQ ID NO: 212522 - DNA, 20 bp, Artificial sequence
  SiRNA target sequence
cacaaatttttttctaaatt

SEQ ID NO: 212523 - DNA, 20 bp, Artificial sequence
  SiRNA target sequence
acaaatttttttctaaattc

SEQ ID NO: 212524 - DNA, 20 bp, Artificial sequence
  SiRNA target sequence
caaatttttttctaaattca

SEQ ID NO: 212525 - DNA, 20 bp, Artificial sequence
  SiRNA target sequence
aaatttttttctaaattcat

SEQ ID NO: 212526 - DNA, 20 bp, Artificial sequence
  SiRNA target sequence
aatttttttctaaattcatt

SEQ ID NO: 212527 - DNA, 20 bp, Artificial sequence
  SiRNA target sequence
atttttttctaaattcatta

SEQ ID NO: 212528 - DNA, 20 bp, Artificial sequence
  SiRNA target sequence
tttttttctaaattcattat

SEQ ID NO: 212529 - DNA, 20 bp, Artificial sequence
  SiRNA target sequence
ttttttctaaattcattatg

SEQ ID NO: 212530 - DNA, 20 bp, Artificial sequence
  SiRNA target sequence
tttttctaaattcattatgt

SEQ ID NO: 212531 - DNA, 20 bp, Artificial sequence
  SiRNA target sequence
ttttctaaattcattatgtg

SEQ ID NO: 212532 - DNA, 20 bp, Artificial sequence
  SiRNA target sequence
tttctaaattcattatgtgc

SEQ ID NO: 212533 - DNA, 20 bp, Artificial sequence
  SiRNA target sequence
ttctaaattcattatgtgct

SEQ ID NO: 212534 - DNA, 20 bp, Artificial sequence
  SiRNA target sequence
tctaaattcattatgtgcta

SEQ ID NO: 212535 - DNA, 20 bp, Artificial sequence
  SiRNA target sequence
ctaaattcattatgtgctac

SEQ ID NO: 212536 - DNA, 20 bp, Artificial sequence
  SiRNA target sequence
taaattcattatgtgctacg

SEQ ID NO: 212537 - DNA, 20 bp, Artificial sequence
  SiRNA target sequence
aaattcattatgtgctacgc

SEQ ID NO: 212538 - DNA, 20 bp, Artificial sequence
  SiRNA target sequence
aattcattatgtgctacgcc

SEQ ID NO: 212539 - DNA, 20 bp, Artificial sequence
  SiRNA target sequence
attcattatgtgctacgccc

SEQ ID NO: 212540 - DNA, 20 bp, Artificial sequence
  SiRNA target sequence
ttcattatgtgctacgcccg

SEQ ID NO: 212541 - DNA, 20 bp, Artificial sequence
  SiRNA target sequence
tcattatgtgctacgcccgg

SEQ ID NO: 212542 - DNA, 20 bp, Artificial sequence
  SiRNA target sequence
cattatgtgctacgcccggt

SEQ ID NO: 212543 - DNA, 20 bp, Artificial sequence
  SiRNA target sequence
attatgtgctacgcccggta

SEQ ID NO: 212544 - DNA, 20 bp, Artificial sequence
  SiRNA target sequence
ttatgtgctacgcccggtaa

SEQ ID NO: 212545 - DNA, 20 bp, Artificial sequence
  SiRNA target sequence
tatgtgctacgcccggtaaa

SEQ ID NO: 212546 - DNA, 20 bp, Artificial sequence
  SiRNA target sequence
atgtgctacgcccggtaaat

SEQ ID NO: 212547 - DNA, 20 bp, Artificial sequence
  SiRNA target sequence
tgtgctacgcccggtaaatc

SEQ ID NO: 212548 - DNA, 20 bp, Artificial sequence
  SiRNA target sequence
gtgctacgcccggtaaatcg

SEQ ID NO: 212549 - DNA, 20 bp, Artificial sequence
  SiRNA target sequence
tgctacgcccggtaaatcgt

SEQ ID NO: 212550 - DNA, 20 bp, Artificial sequence
  SiRNA target sequence
gctacgcccggtaaatcgtt

SEQ ID NO: 212551 - DNA, 20 bp, Artificial sequence
  SiRNA target sequence
ctacgcccggtaaatcgttt

SEQ ID NO: 212552 - DNA, 20 bp, Artificial sequence
  SiRNA target sequence
tacgcccggtaaatcgttta

SEQ ID NO: 212553 - DNA, 20 bp, Artificial sequence
  SiRNA target sequence
acgcccggtaaatcgtttat

SEQ ID NO: 212554 - DNA, 20 bp, Artificial sequence
  SiRNA target sequence
cgcccggtaaatcgtttata

SEQ ID NO: 212555 - DNA, 20 bp, Artificial sequence
  SiRNA target sequence
gcccggtaaatcgtttataa

SEQ ID NO: 212556 - DNA, 20 bp, Artificial sequence
  SiRNA target sequence
cccggtaaatcgtttataaa

SEQ ID NO: 212557 - DNA, 20 bp, Artificial sequence
  SiRNA target sequence
ccggtaaatcgtttataaaa

SEQ ID NO: 212558 - DNA, 20 bp, Artificial sequence
  SiRNA target sequence
cggtaaatcgtttataaaat

SEQ ID NO: 212559 - DNA, 20 bp, Artificial sequence
  SiRNA target sequence
ggtaaatcgtttataaaatt

SEQ ID NO: 212560 - DNA, 20 bp, Artificial sequence
  SiRNA target sequence
gtaaatcgtttataaaatta

SEQ ID NO: 212561 - DNA, 20 bp, Artificial sequence
  SiRNA target sequence
taaatcgtttataaaattag

SEQ ID NO: 212562 - DNA, 20 bp, Artificial sequence
  SiRNA target sequence
aaatcgtttataaaattaga

SEQ ID NO: 212563 - DNA, 20 bp, Artificial sequence
  SiRNA target sequence
aatcgtttataaaattagaa

SEQ ID NO: 212564 - DNA, 20 bp, Artificial sequence
  SiRNA target sequence
atcgtttataaaattagaaa

SEQ ID NO: 212565 - DNA, 20 bp, Artificial sequence
  SiRNA target sequence
tcgtttataaaattagaaaa

SEQ ID NO: 212566 - DNA, 20 bp, Artificial sequence
  SiRNA target sequence
cgtttataaaattagaaaat

SEQ ID NO: 212567 - DNA, 20 bp, Artificial sequence
  SiRNA target sequence
gtttataaaattagaaaatg

SEQ ID NO: 212568 - DNA, 20 bp, Artificial sequence
  SiRNA target sequence
tttataaaattagaaaatgt

SEQ ID NO: 212569 - DNA, 20 bp, Artificial sequence
  SiRNA target sequence
ttataaaattagaaaatgtt

SEQ ID NO: 212570 - DNA, 20 bp, Artificial sequence
  SiRNA target sequence
tataaaattagaaaatgttt

SEQ ID NO: 212571 - DNA, 20 bp, Artificial sequence
  SiRNA target sequence
ataaaattagaaaatgtttt

SEQ ID NO: 212572 - DNA, 20 bp, Artificial sequence
  SiRNA target sequence
taaaattagaaaatgtttta

SEQ ID NO: 212573 - DNA, 20 bp, Artificial sequence
  SiRNA target sequence
aaaattagaaaatgttttag

SEQ ID NO: 212574 - DNA, 20 bp, Artificial sequence
  SiRNA target sequence
aaattagaaaatgttttagg

SEQ ID NO: 212575 - DNA, 20 bp, Artificial sequence
  SiRNA target sequence
aattagaaaatgttttagga

SEQ ID NO: 212576 - DNA, 20 bp, Artificial sequence
  SiRNA target sequence
attagaaaatgttttaggat

SEQ ID NO: 212577 - DNA, 20 bp, Artificial sequence
  SiRNA target sequence
ttagaaaatgttttaggatg

SEQ ID NO: 212578 - DNA, 20 bp, Artificial sequence
  SiRNA target sequence
tagaaaatgttttaggatgt

SEQ ID NO: 212579 - DNA, 20 bp, Artificial sequence
  SiRNA target sequence
agaaaatgttttaggatgtg

SEQ ID NO: 212580 - DNA, 20 bp, Artificial sequence
  SiRNA target sequence
gaaaatgttttaggatgtgt

SEQ ID NO: 212581 - DNA, 20 bp, Artificial sequence
  SiRNA target sequence
aaaatgttttaggatgtgta

SEQ ID NO: 212582 - DNA, 20 bp, Artificial sequence
  SiRNA target sequence
aaatgttttaggatgtgtag

SEQ ID NO: 212583 - DNA, 20 bp, Artificial sequence
  SiRNA target sequence
aatgttttaggatgtgtagc

SEQ ID NO: 212584 - DNA, 20 bp, Artificial sequence
  SiRNA target sequence
atgttttaggatgtgtagct

SEQ ID NO: 212585 - DNA, 20 bp, Artificial sequence
  SiRNA target sequence
tgttttaggatgtgtagctg

SEQ ID NO: 212586 - DNA, 20 bp, Artificial sequence
  SiRNA target sequence
gttttaggatgtgtagctgt

SEQ ID NO: 212587 - DNA, 20 bp, Artificial sequence
  SiRNA target sequence
ttttaggatgtgtagctgta

SEQ ID NO: 212588 - DNA, 20 bp, Artificial sequence
  SiRNA target sequence
tttaggatgtgtagctgtag

SEQ ID NO: 212589 - DNA, 20 bp, Artificial sequence
  SiRNA target sequence
ttaggatgtgtagctgtagc

SEQ ID NO: 212590 - DNA, 20 bp, Artificial sequence
  SiRNA target sequence
taggatgtgtagctgtagct

SEQ ID NO: 212591 - DNA, 20 bp, Artificial sequence
  SiRNA target sequence
aggatgtgtagctgtagctc

SEQ ID NO: 212592 - DNA, 20 bp, Artificial sequence
  SiRNA target sequence
ggatgtgtagctgtagctct

SEQ ID NO: 212593 - DNA, 20 bp, Artificial sequence
  SiRNA target sequence
gatgtgtagctgtagctctt

SEQ ID NO: 212594 - DNA, 20 bp, Artificial sequence
  SiRNA target sequence
atgtgtagctgtagctctta

SEQ ID NO: 212595 - DNA, 20 bp, Artificial sequence
  SiRNA target sequence
tgtgtagctgtagctcttat

SEQ ID NO: 212596 - DNA, 20 bp, Artificial sequence
  SiRNA target sequence
gtgtagctgtagctcttatg

SEQ ID NO: 212597 - DNA, 20 bp, Artificial sequence
  SiRNA target sequence
tgtagctgtagctcttatga

SEQ ID NO: 212598 - DNA, 20 bp, Artificial sequence
  SiRNA target sequence
gtagctgtagctcttatgaa

SEQ ID NO: 212599 - DNA, 20 bp, Artificial sequence
  SiRNA target sequence
tagctgtagctcttatgaaa

SEQ ID NO: 212600 - DNA, 20 bp, Artificial sequence
  SiRNA target sequence
agctgtagctcttatgaaag

SEQ ID NO: 212601 - DNA, 20 bp, Artificial sequence
  SiRNA target sequence
gctgtagctcttatgaaagt

SEQ ID NO: 212602 - DNA, 20 bp, Artificial sequence
  SiRNA target sequence
ctgtagctcttatgaaagta

SEQ ID NO: 212603 - DNA, 20 bp, Artificial sequence
  SiRNA target sequence
tgtagctcttatgaaagtag

SEQ ID NO: 212604 - DNA, 20 bp, Artificial sequence
  SiRNA target sequence
gtagctcttatgaaagtagc

SEQ ID NO: 212605 - DNA, 20 bp, Artificial sequence
  SiRNA target sequence
tagctcttatgaaagtagca

SEQ ID NO: 212606 - DNA, 20 bp, Artificial sequence
  SiRNA target sequence
agctcttatgaaagtagcaa

SEQ ID NO: 212607 - DNA, 20 bp, Artificial sequence
  SiRNA target sequence
gctcttatgaaagtagcaaa

SEQ ID NO: 212608 - DNA, 20 bp, Artificial sequence
  SiRNA target sequence
ctcttatgaaagtagcaaaa

SEQ ID NO: 212609 - DNA, 20 bp, Artificial sequence
  SiRNA target sequence
tcttatgaaagtagcaaaat

SEQ ID NO: 212610 - DNA, 20 bp, Artificial sequence
  SiRNA target sequence
cttatgaaagtagcaaaata

SEQ ID NO: 212611 - DNA, 20 bp, Artificial sequence
  SiRNA target sequence
ttatgaaagtagcaaaatat

SEQ ID NO: 212612 - DNA, 20 bp, Artificial sequence
  SiRNA target sequence
tatgaaagtagcaaaatatg

SEQ ID NO: 212613 - DNA, 20 bp, Artificial sequence
  SiRNA target sequence
atgaaagtagcaaaatatgg

SEQ ID NO: 212614 - DNA, 20 bp, Artificial sequence
  SiRNA target sequence
tgaaagtagcaaaatatggc

SEQ ID NO: 212615 - DNA, 20 bp, Artificial sequence
  SiRNA target sequence
gaaagtagcaaaatatggct

SEQ ID NO: 212616 - DNA, 20 bp, Artificial sequence
  SiRNA target sequence
aaagtagcaaaatatggctc

SEQ ID NO: 212617 - DNA, 20 bp, Artificial sequence
  SiRNA target sequence
aagtagcaaaatatggctct

SEQ ID NO: 212618 - DNA, 20 bp, Artificial sequence
  SiRNA target sequence
agtagcaaaatatggctctt

SEQ ID NO: 212619 - DNA, 20 bp, Artificial sequence
  SiRNA target sequence
gtagcaaaatatggctcttt

SEQ ID NO: 212620 - DNA, 20 bp, Artificial sequence
  SiRNA target sequence
tagcaaaatatggctctttt

SEQ ID NO: 212621 - DNA, 20 bp, Artificial sequence
  SiRNA target sequence
agcaaaatatggctcttttg

SEQ ID NO: 212622 - DNA, 20 bp, Artificial sequence
  SiRNA target sequence
gcaaaatatggctcttttga

SEQ ID NO: 212623 - DNA, 20 bp, Artificial sequence
  SiRNA target sequence
caaaatatggctcttttgat

SEQ ID NO: 212624 - DNA, 20 bp, Artificial sequence
  SiRNA target sequence
aaaatatggctcttttgata

SEQ ID NO: 212625 - DNA, 20 bp, Artificial sequence
  SiRNA target sequence
aaatatggctcttttgatat

SEQ ID NO: 212626 - DNA, 20 bp, Artificial sequence
  SiRNA target sequence
aatatggctcttttgatatt

SEQ ID NO: 212627 - DNA, 20 bp, Artificial sequence
  SiRNA target sequence
atatggctcttttgatattt

SEQ ID NO: 212628 - DNA, 20 bp, Artificial sequence
  SiRNA target sequence
tatggctcttttgatatttc

SEQ ID NO: 212629 - DNA, 20 bp, Artificial sequence
  SiRNA target sequence
atggctcttttgatatttcc

SEQ ID NO: 212630 - DNA, 20 bp, Artificial sequence
  SiRNA target sequence
tggctcttttgatatttcca

SEQ ID NO: 212631 - DNA, 20 bp, Artificial sequence
  SiRNA target sequence
ggctcttttgatatttccaa

SEQ ID NO: 212632 - DNA, 20 bp, Artificial sequence
  SiRNA target sequence
gctcttttgatatttccaaa

SEQ ID NO: 212633 - DNA, 20 bp, Artificial sequence
  SiRNA target sequence
ctcttttgatatttccaaag

SEQ ID NO: 212634 - DNA, 20 bp, Artificial sequence
  SiRNA target sequence
tcttttgatatttccaaaga

SEQ ID NO: 212635 - DNA, 20 bp, Artificial sequence
  SiRNA target sequence
cttttgatatttccaaagaa

SEQ ID NO: 212636 - DNA, 20 bp, Artificial sequence
  SiRNA target sequence
ttttgatatttccaaagaag

SEQ ID NO: 212637 - DNA, 20 bp, Artificial sequence
  SiRNA target sequence
tttgatatttccaaagaagc

SEQ ID NO: 212638 - DNA, 20 bp, Artificial sequence
  SiRNA target sequence
ttgatatttccaaagaagcc

SEQ ID NO: 212639 - DNA, 20 bp, Artificial sequence
  SiRNA target sequence
tgatatttccaaagaagcca

SEQ ID NO: 212640 - DNA, 20 bp, Artificial sequence
  SiRNA target sequence
gatatttccaaagaagccat

SEQ ID NO: 212641 - DNA, 20 bp, Artificial sequence
  SiRNA target sequence
atatttccaaagaagccatt

SEQ ID NO: 212642 - DNA, 20 bp, Artificial sequence
  SiRNA target sequence
tatttccaaagaagccattt

SEQ ID NO: 212643 - DNA, 20 bp, Artificial sequence
  SiRNA target sequence
atttccaaagaagccatttc

SEQ ID NO: 212644 - DNA, 20 bp, Artificial sequence
  SiRNA target sequence
tttccaaagaagccatttca

SEQ ID NO: 212645 - DNA, 20 bp, Artificial sequence
  SiRNA target sequence
ttccaaagaagccatttcaa

SEQ ID NO: 212646 - DNA, 20 bp, Artificial sequence
  SiRNA target sequence
tccaaagaagccatttcaat

SEQ ID NO: 212647 - DNA, 20 bp, Artificial sequence
  SiRNA target sequence
ccaaagaagccatttcaatg

SEQ ID NO: 212648 - DNA, 20 bp, Artificial sequence
  SiRNA target sequence
caaagaagccatttcaatgc

SEQ ID NO: 212649 - DNA, 20 bp, Artificial sequence
  SiRNA target sequence
aaagaagccatttcaatgca

SEQ ID NO: 212650 - DNA, 20 bp, Artificial sequence
  SiRNA target sequence
aagaagccatttcaatgcag

SEQ ID NO: 212651 - DNA, 20 bp, Artificial sequence
  SiRNA target sequence
agaagccatttcaatgcaga

SEQ ID NO: 212652 - DNA, 20 bp, Artificial sequence
  SiRNA target sequence
gaagccatttcaatgcagat

SEQ ID NO: 212653 - DNA, 20 bp, Artificial sequence
  SiRNA target sequence
aagccatttcaatgcagatt

SEQ ID NO: 212654 - DNA, 20 bp, Artificial sequence
  SiRNA target sequence
agccatttcaatgcagattg

SEQ ID NO: 212655 - DNA, 20 bp, Artificial sequence
  SiRNA target sequence
gccatttcaatgcagattga

SEQ ID NO: 212656 - DNA, 20 bp, Artificial sequence
  SiRNA target sequence
ccatttcaatgcagattgat

SEQ ID NO: 212657 - DNA, 20 bp, Artificial sequence
  SiRNA target sequence
catttcaatgcagattgatt

SEQ ID NO: 212658 - DNA, 20 bp, Artificial sequence
  SiRNA target sequence
atttcaatgcagattgattc

SEQ ID NO: 212659 - DNA, 20 bp, Artificial sequence
  SiRNA target sequence
tttcaatgcagattgattcg

SEQ ID NO: 212660 - DNA, 20 bp, Artificial sequence
  SiRNA target sequence
ttcaatgcagattgattcgt

SEQ ID NO: 212661 - DNA, 20 bp, Artificial sequence
  SiRNA target sequence
tcaatgcagattgattcgtc

SEQ ID NO: 212662 - DNA, 20 bp, Artificial sequence
  SiRNA target sequence
caatgcagattgattcgtca

SEQ ID NO: 212663 - DNA, 20 bp, Artificial sequence
  SiRNA target sequence
aatgcagattgattcgtcat

SEQ ID NO: 212664 - DNA, 20 bp, Artificial sequence
  SiRNA target sequence
atgcagattgattcgtcatt

SEQ ID NO: 212665 - DNA, 20 bp, Artificial sequence
  SiRNA target sequence
tgcagattgattcgtcattg

SEQ ID NO: 212666 - DNA, 20 bp, Artificial sequence
  SiRNA target sequence
gcagattgattcgtcattgc

SEQ ID NO: 212667 - DNA, 20 bp, Artificial sequence
  SiRNA target sequence
cagattgattcgtcattgcg

SEQ ID NO: 212668 - DNA, 20 bp, Artificial sequence
  SiRNA target sequence
agattgattcgtcattgcgt

SEQ ID NO: 212669 - DNA, 20 bp, Artificial sequence
  SiRNA target sequence
gattgattcgtcattgcgtg

SEQ ID NO: 212670 - DNA, 20 bp, Artificial sequence
  SiRNA target sequence
attgattcgtcattgcgtgc

SEQ ID NO: 212671 - DNA, 20 bp, Artificial sequence
  SiRNA target sequence
ttgattcgtcattgcgtgca

SEQ ID NO: 212672 - DNA, 20 bp, Artificial sequence
  SiRNA target sequence
tgattcgtcattgcgtgcac

SEQ ID NO: 212673 - DNA, 20 bp, Artificial sequence
  SiRNA target sequence
gattcgtcattgcgtgcacg

SEQ ID NO: 212674 - DNA, 20 bp, Artificial sequence
  SiRNA target sequence
attcgtcattgcgtgcacgt

SEQ ID NO: 212675 - DNA, 20 bp, Artificial sequence
  SiRNA target sequence
ttcgtcattgcgtgcacgtt

SEQ ID NO: 212676 - DNA, 20 bp, Artificial sequence
  SiRNA target sequence
tcgtcattgcgtgcacgtta

SEQ ID NO: 212677 - DNA, 20 bp, Artificial sequence
  SiRNA target sequence
cgtcattgcgtgcacgttat

SEQ ID NO: 212678 - DNA, 20 bp, Artificial sequence
  SiRNA target sequence
gtcattgcgtgcacgttata

SEQ ID NO: 212679 - DNA, 20 bp, Artificial sequence
  SiRNA target sequence
tcattgcgtgcacgttataa

SEQ ID NO: 212680 - DNA, 20 bp, Artificial sequence
  SiRNA target sequence
cattgcgtgcacgttataaa

SEQ ID NO: 212681 - DNA, 20 bp, Artificial sequence
  SiRNA target sequence
attgcgtgcacgttataaag

SEQ ID NO: 212682 - DNA, 20 bp, Artificial sequence
  SiRNA target sequence
ttgcgtgcacgttataaagg

SEQ ID NO: 212683 - DNA, 20 bp, Artificial sequence
  SiRNA target sequence
tgcgtgcacgttataaagga

SEQ ID NO: 212684 - DNA, 20 bp, Artificial sequence
  SiRNA target sequence
gcgtgcacgttataaaggaa

SEQ ID NO: 212685 - DNA, 20 bp, Artificial sequence
  SiRNA target sequence
cgtgcacgttataaaggaat

SEQ ID NO: 212686 - DNA, 20 bp, Artificial sequence
  SiRNA target sequence
gtgcacgttataaaggaatt

SEQ ID NO: 212687 - DNA, 20 bp, Artificial sequence
  SiRNA target sequence
tgcacgttataaaggaattt

SEQ ID NO: 212688 - DNA, 20 bp, Artificial sequence
  SiRNA target sequence
gcacgttataaaggaatttt

SEQ ID NO: 212689 - DNA, 20 bp, Artificial sequence
  SiRNA target sequence
cacgttataaaggaattttt

SEQ ID NO: 212690 - DNA, 20 bp, Artificial sequence
  SiRNA target sequence
acgttataaaggaatttttg

SEQ ID NO: 212691 - DNA, 20 bp, Artificial sequence
  SiRNA target sequence
cgttataaaggaatttttga

SEQ ID NO: 212692 - DNA, 20 bp, Artificial sequence
  SiRNA target sequence
gttataaaggaatttttgac

SEQ ID NO: 212693 - DNA, 20 bp, Artificial sequence
  SiRNA target sequence
ttataaaggaatttttgacg

SEQ ID NO: 212694 - DNA, 20 bp, Artificial sequence
  SiRNA target sequence
tataaaggaatttttgacgg

SEQ ID NO: 212695 - DNA, 20 bp, Artificial sequence
  SiRNA target sequence
ataaaggaatttttgacggt

SEQ ID NO: 212696 - DNA, 20 bp, Artificial sequence
  SiRNA target sequence
taaaggaatttttgacggtg

SEQ ID NO: 212697 - DNA, 20 bp, Artificial sequence
  SiRNA target sequence
aaaggaatttttgacggtgt

SEQ ID NO: 212698 - DNA, 20 bp, Artificial sequence
  SiRNA target sequence
aaggaatttttgacggtgtt

SEQ ID NO: 212699 - DNA, 20 bp, Artificial sequence
  SiRNA target sequence
aggaatttttgacggtgttt

SEQ ID NO: 212700 - DNA, 20 bp, Artificial sequence
  SiRNA target sequence
ggaatttttgacggtgtttt

SEQ ID NO: 212701 - DNA, 20 bp, Artificial sequence
  SiRNA target sequence
gaatttttgacggtgttttt

SEQ ID NO: 212702 - DNA, 20 bp, Artificial sequence
  SiRNA target sequence
aatttttgacggtgtttttg

SEQ ID NO: 212703 - DNA, 20 bp, Artificial sequence
  SiRNA target sequence
atttttgacggtgtttttgg

SEQ ID NO: 212704 - DNA, 20 bp, Artificial sequence
  SiRNA target sequence
tttttgacggtgtttttggt

SEQ ID NO: 212705 - DNA, 20 bp, Artificial sequence
  SiRNA target sequence
ttttgacggtgtttttggta

SEQ ID NO: 212706 - DNA, 20 bp, Artificial sequence
  SiRNA target sequence
tttgacggtgtttttggtaa

SEQ ID NO: 212707 - DNA, 20 bp, Artificial sequence
  SiRNA target sequence
ttgacggtgtttttggtaag

SEQ ID NO: 212708 - DNA, 20 bp, Artificial sequence
  SiRNA target sequence
tgacggtgtttttggtaagt

SEQ ID NO: 212709 - DNA, 20 bp, Artificial sequence
  SiRNA target sequence
gacggtgtttttggtaagtt

SEQ ID NO: 212710 - DNA, 20 bp, Artificial sequence
  SiRNA target sequence
acggtgtttttggtaagtta

SEQ ID NO: 212711 - DNA, 20 bp, Artificial sequence
  SiRNA target sequence
cggtgtttttggtaagttag

SEQ ID NO: 212712 - DNA, 20 bp, Artificial sequence
  SiRNA target sequence
ggtgtttttggtaagttagg

SEQ ID NO: 212713 - DNA, 20 bp, Artificial sequence
  SiRNA target sequence
gtgtttttggtaagttagga

SEQ ID NO: 212714 - DNA, 20 bp, Artificial sequence
  SiRNA target sequence
tgtttttggtaagttaggaa

SEQ ID NO: 212715 - DNA, 20 bp, Artificial sequence
  SiRNA target sequence
gtttttggtaagttaggaaa

SEQ ID NO: 212716 - DNA, 20 bp, Artificial sequence
  SiRNA target sequence
tttttggtaagttaggaaaa

SEQ ID NO: 212717 - DNA, 20 bp, Artificial sequence
  SiRNA target sequence
ttttggtaagttaggaaaat

SEQ ID NO: 212718 - DNA, 20 bp, Artificial sequence
  SiRNA target sequence
tttggtaagttaggaaaatc

SEQ ID NO: 212719 - DNA, 20 bp, Artificial sequence
  SiRNA target sequence
ttggtaagttaggaaaatct

SEQ ID NO: 212720 - DNA, 20 bp, Artificial sequence
  SiRNA target sequence
tggtaagttaggaaaatctc

SEQ ID NO: 212721 - DNA, 20 bp, Artificial sequence
  SiRNA target sequence
ggtaagttaggaaaatctct

SEQ ID NO: 212722 - DNA, 20 bp, Artificial sequence
  SiRNA target sequence
gtaagttaggaaaatctctt

SEQ ID NO: 212723 - DNA, 20 bp, Artificial sequence
  SiRNA target sequence
taagttaggaaaatctcttg

SEQ ID NO: 212724 - DNA, 20 bp, Artificial sequence
  SiRNA target sequence
aagttaggaaaatctcttgg

SEQ ID NO: 212725 - DNA, 20 bp, Artificial sequence
  SiRNA target sequence
agttaggaaaatctcttgga

SEQ ID NO: 212726 - DNA, 20 bp, Artificial sequence
  SiRNA target sequence
gttaggaaaatctcttggat

SEQ ID NO: 212727 - DNA, 20 bp, Artificial sequence
  SiRNA target sequence
ttaggaaaatctcttggatc

SEQ ID NO: 212728 - DNA, 20 bp, Artificial sequence
  SiRNA target sequence
taggaaaatctcttggatcg

SEQ ID NO: 212729 - DNA, 20 bp, Artificial sequence
  SiRNA target sequence
aggaaaatctcttggatcgt

SEQ ID NO: 212730 - DNA, 20 bp, Artificial sequence
  SiRNA target sequence
ggaaaatctcttggatcgtt

SEQ ID NO: 212731 - DNA, 20 bp, Artificial sequence
  SiRNA target sequence
gaaaatctcttggatcgtta

SEQ ID NO: 212732 - DNA, 20 bp, Artificial sequence
  SiRNA target sequence
aaaatctcttggatcgttat

SEQ ID NO: 212733 - DNA, 20 bp, Artificial sequence
  SiRNA target sequence
aaatctcttggatcgttatt

SEQ ID NO: 212734 - DNA, 20 bp, Artificial sequence
  SiRNA target sequence
aatctcttggatcgttattt

SEQ ID NO: 212735 - DNA, 20 bp, Artificial sequence
  SiRNA target sequence
atctcttggatcgttatttg

SEQ ID NO: 212736 - DNA, 20 bp, Artificial sequence
  SiRNA target sequence
tctcttggatcgttatttgt

SEQ ID NO: 212737 - DNA, 20 bp, Artificial sequence
  SiRNA target sequence
ctcttggatcgttatttgtg

SEQ ID NO: 212738 - DNA, 20 bp, Artificial sequence
  SiRNA target sequence
tcttggatcgttatttgtgt

SEQ ID NO: 212739 - DNA, 20 bp, Artificial sequence
  SiRNA target sequence
cttggatcgttatttgtgtg

SEQ ID NO: 212740 - DNA, 20 bp, Artificial sequence
  SiRNA target sequence
ttggatcgttatttgtgtgg

SEQ ID NO: 212741 - DNA, 20 bp, Artificial sequence
  SiRNA target sequence
tggatcgttatttgtgtgga

SEQ ID NO: 212742 - DNA, 20 bp, Artificial sequence
  SiRNA target sequence
ggatcgttatttgtgtggat

SEQ ID NO: 212743 - DNA, 20 bp, Artificial sequence
  SiRNA target sequence
gatcgttatttgtgtggatt

SEQ ID NO: 212744 - DNA, 20 bp, Artificial sequence
  SiRNA target sequence
atcgttatttgtgtggatta

SEQ ID NO: 212745 - DNA, 20 bp, Artificial sequence
  SiRNA target sequence
tcgttatttgtgtggattat

SEQ ID NO: 212746 - DNA, 20 bp, Artificial sequence
  SiRNA target sequence
cgttatttgtgtggattatg

SEQ ID NO: 212747 - DNA, 20 bp, Artificial sequence
  SiRNA target sequence
gttatttgtgtggattatgg

SEQ ID NO: 212748 - DNA, 20 bp, Artificial sequence
  SiRNA target sequence
ttatttgtgtggattatggg

SEQ ID NO: 212749 - DNA, 20 bp, Artificial sequence
  SiRNA target sequence
tatttgtgtggattatggga

SEQ ID NO: 212750 - DNA, 20 bp, Artificial sequence
  SiRNA target sequence
atttgtgtggattatgggat

SEQ ID NO: 212751 - DNA, 20 bp, Artificial sequence
  SiRNA target sequence
tttgtgtggattatgggata

SEQ ID NO: 212752 - DNA, 20 bp, Artificial sequence
  SiRNA target sequence
ttgtgtggattatgggatat

SEQ ID NO: 212753 - DNA, 20 bp, Artificial sequence
  SiRNA target sequence
tgtgtggattatgggatatg

SEQ ID NO: 212754 - DNA, 20 bp, Artificial sequence
  SiRNA target sequence
gtgtggattatgggatatgc

SEQ ID NO: 212755 - DNA, 20 bp, Artificial sequence
  SiRNA target sequence
tgtggattatgggatatgca

SEQ ID NO: 212756 - DNA, 20 bp, Artificial sequence
  SiRNA target sequence
gtggattatgggatatgcat

SEQ ID NO: 212757 - DNA, 20 bp, Artificial sequence
  SiRNA target sequence
tggattatgggatatgcatt

SEQ ID NO: 212758 - DNA, 20 bp, Artificial sequence
  SiRNA target sequence
ggattatgggatatgcattt

SEQ ID NO: 212759 - DNA, 20 bp, Artificial sequence
  SiRNA target sequence
gattatgggatatgcatttc

SEQ ID NO: 212760 - DNA, 20 bp, Artificial sequence
  SiRNA target sequence
attatgggatatgcatttca

SEQ ID NO: 212761 - DNA, 20 bp, Artificial sequence
  SiRNA target sequence
ttatgggatatgcatttcaa

SEQ ID NO: 212762 - DNA, 20 bp, Artificial sequence
  SiRNA target sequence
tatgggatatgcatttcaaa

SEQ ID NO: 212763 - DNA, 20 bp, Artificial sequence
  SiRNA target sequence
atgggatatgcatttcaaac

SEQ ID NO: 212764 - DNA, 20 bp, Artificial sequence
  SiRNA target sequence
tgggatatgcatttcaaaca

SEQ ID NO: 212765 - DNA, 20 bp, Artificial sequence
  SiRNA target sequence
gggatatgcatttcaaacaa

SEQ ID NO: 212766 - DNA, 20 bp, Artificial sequence
  SiRNA target sequence
ggatatgcatttcaaacaag

SEQ ID NO: 212767 - DNA, 20 bp, Artificial sequence
  SiRNA target sequence
gatatgcatttcaaacaaga

SEQ ID NO: 212768 - DNA, 20 bp, Artificial sequence
  SiRNA target sequence
atatgcatttcaaacaagag

SEQ ID NO: 212769 - DNA, 20 bp, Artificial sequence
  SiRNA target sequence
tatgcatttcaaacaagaga

SEQ ID NO: 212770 - DNA, 20 bp, Artificial sequence
  SiRNA target sequence
atgcatttcaaacaagagat

SEQ ID NO: 212771 - DNA, 20 bp, Artificial sequence
  SiRNA target sequence
tgcatttcaaacaagagatt

SEQ ID NO: 212772 - DNA, 20 bp, Artificial sequence
  SiRNA target sequence
gcatttcaaacaagagattt

SEQ ID NO: 212773 - DNA, 20 bp, Artificial sequence
  SiRNA target sequence
catttcaaacaagagatttt

SEQ ID NO: 212774 - DNA, 20 bp, Artificial sequence
  SiRNA target sequence
atttcaaacaagagatttta

SEQ ID NO: 212775 - DNA, 20 bp, Artificial sequence
  SiRNA target sequence
tttcaaacaagagattttag

SEQ ID NO: 212776 - DNA, 20 bp, Artificial sequence
  SiRNA target sequence
ttcaaacaagagattttaga

SEQ ID NO: 212777 - DNA, 20 bp, Artificial sequence
  SiRNA target sequence
tcaaacaagagattttagaa

SEQ ID NO: 212778 - DNA, 20 bp, Artificial sequence
  SiRNA target sequence
caaacaagagattttagaaa

SEQ ID NO: 212779 - DNA, 20 bp, Artificial sequence
  SiRNA target sequence
aaacaagagattttagaaaa

SEQ ID NO: 212780 - DNA, 20 bp, Artificial sequence
  SiRNA target sequence
aacaagagattttagaaaat

SEQ ID NO: 212781 - DNA, 20 bp, Artificial sequence
  SiRNA target sequence
acaagagattttagaaaatt

SEQ ID NO: 212782 - DNA, 20 bp, Artificial sequence
  SiRNA target sequence
caagagattttagaaaatta

SEQ ID NO: 212783 - DNA, 20 bp, Artificial sequence
  SiRNA target sequence
aagagattttagaaaattag

SEQ ID NO: 212784 - DNA, 20 bp, Artificial sequence
  SiRNA target sequence
agagattttagaaaattagc

SEQ ID NO: 212785 - DNA, 20 bp, Artificial sequence
  SiRNA target sequence
gagattttagaaaattagct

SEQ ID NO: 212786 - DNA, 20 bp, Artificial sequence
  SiRNA target sequence
agattttagaaaattagctc

SEQ ID NO: 212787 - DNA, 20 bp, Artificial sequence
  SiRNA target sequence
gattttagaaaattagctcc

SEQ ID NO: 212788 - DNA, 20 bp, Artificial sequence
  SiRNA target sequence
attttagaaaattagctccc

SEQ ID NO: 212789 - DNA, 20 bp, Artificial sequence
  SiRNA target sequence
ttttagaaaattagctccct

SEQ ID NO: 212790 - DNA, 20 bp, Artificial sequence
  SiRNA target sequence
tttagaaaattagctccctt

SEQ ID NO: 212791 - DNA, 20 bp, Artificial sequence
  SiRNA target sequence
ttagaaaattagctccctta

SEQ ID NO: 212792 - DNA, 20 bp, Artificial sequence
  SiRNA target sequence
tagaaaattagctcccttat

SEQ ID NO: 212793 - DNA, 20 bp, Artificial sequence
  SiRNA target sequence
agaaaattagctcccttatg

SEQ ID NO: 212794 - DNA, 20 bp, Artificial sequence
  SiRNA target sequence
gaaaattagctcccttatgt

SEQ ID NO: 212795 - DNA, 20 bp, Artificial sequence
  SiRNA target sequence
aaaattagctcccttatgta

SEQ ID NO: 212796 - DNA, 20 bp, Artificial sequence
  SiRNA target sequence
aaattagctcccttatgtat

SEQ ID NO: 212797 - DNA, 20 bp, Artificial sequence
  SiRNA target sequence
aattagctcccttatgtatc

SEQ ID NO: 212798 - DNA, 20 bp, Artificial sequence
  SiRNA target sequence
attagctcccttatgtatca

SEQ ID NO: 212799 - DNA, 20 bp, Artificial sequence
  SiRNA target sequence
ttagctcccttatgtatcag

SEQ ID NO: 212800 - DNA, 20 bp, Artificial sequence
  SiRNA target sequence
tagctcccttatgtatcagc

SEQ ID NO: 212801 - DNA, 20 bp, Artificial sequence
  SiRNA target sequence
agctcccttatgtatcagcg

SEQ ID NO: 212802 - DNA, 20 bp, Artificial sequence
  SiRNA target sequence
gctcccttatgtatcagcgt

SEQ ID NO: 212803 - DNA, 20 bp, Artificial sequence
  SiRNA target sequence
ctcccttatgtatcagcgta

SEQ ID NO: 212804 - DNA, 20 bp, Artificial sequence
  SiRNA target sequence
tcccttatgtatcagcgtaa

SEQ ID NO: 212805 - DNA, 20 bp, Artificial sequence
  SiRNA target sequence
cccttatgtatcagcgtaat

SEQ ID NO: 212806 - DNA, 20 bp, Artificial sequence
  SiRNA target sequence
ccttatgtatcagcgtaatt

SEQ ID NO: 212807 - DNA, 20 bp, Artificial sequence
  SiRNA target sequence
cttatgtatcagcgtaattg

SEQ ID NO: 212808 - DNA, 20 bp, Artificial sequence
  SiRNA target sequence
ttatgtatcagcgtaattgt

SEQ ID NO: 212809 - DNA, 20 bp, Artificial sequence
  SiRNA target sequence
tatgtatcagcgtaattgtc

SEQ ID NO: 212810 - DNA, 20 bp, Artificial sequence
  SiRNA target sequence
atgtatcagcgtaattgtct

SEQ ID NO: 212811 - DNA, 20 bp, Artificial sequence
  SiRNA target sequence
tgtatcagcgtaattgtctt

SEQ ID NO: 212812 - DNA, 20 bp, Artificial sequence
  SiRNA target sequence
gtatcagcgtaattgtcttt

SEQ ID NO: 212813 - DNA, 20 bp, Artificial sequence
  SiRNA target sequence
tatcagcgtaattgtctttt

SEQ ID NO: 212814 - DNA, 20 bp, Artificial sequence
  SiRNA target sequence
atcagcgtaattgtcttttt

SEQ ID NO: 212815 - DNA, 20 bp, Artificial sequence
  SiRNA target sequence
tcagcgtaattgtctttttt

SEQ ID NO: 212816 - DNA, 20 bp, Artificial sequence
  SiRNA target sequence
cagcgtaattgtcttttttg

SEQ ID NO: 212817 - DNA, 20 bp, Artificial sequence
  SiRNA target sequence
agcgtaattgtcttttttgt

SEQ ID NO: 212818 - DNA, 20 bp, Artificial sequence
  SiRNA target sequence
gcgtaattgtcttttttgtt

SEQ ID NO: 212819 - DNA, 20 bp, Artificial sequence
  SiRNA target sequence
cgtaattgtcttttttgtta

SEQ ID NO: 212820 - DNA, 20 bp, Artificial sequence
  SiRNA target sequence
gtaattgtcttttttgttat

SEQ ID NO: 212821 - DNA, 20 bp, Artificial sequence
  SiRNA target sequence
taattgtcttttttgttatt

SEQ ID NO: 212822 - DNA, 20 bp, Artificial sequence
  SiRNA target sequence
aattgtcttttttgttatta

SEQ ID NO: 212823 - DNA, 20 bp, Artificial sequence
  SiRNA target sequence
attgtcttttttgttattat

SEQ ID NO: 212824 - DNA, 20 bp, Artificial sequence
  SiRNA target sequence
ttgtcttttttgttattatt

SEQ ID NO: 212825 - DNA, 20 bp, Artificial sequence
  SiRNA target sequence
tgtcttttttgttattattt

SEQ ID NO: 212826 - DNA, 20 bp, Artificial sequence
  SiRNA target sequence
gtcttttttgttattatttg

SEQ ID NO: 212827 - DNA, 20 bp, Artificial sequence
  SiRNA target sequence
tcttttttgttattatttgg

SEQ ID NO: 212828 - DNA, 20 bp, Artificial sequence
  SiRNA target sequence
cttttttgttattatttgga

SEQ ID NO: 212829 - DNA, 20 bp, Artificial sequence
  SiRNA target sequence
ttttttgttattatttggat

SEQ ID NO: 212830 - DNA, 20 bp, Artificial sequence
  SiRNA target sequence
tttttgttattatttggatt

SEQ ID NO: 212831 - DNA, 20 bp, Artificial sequence
  SiRNA target sequence
ttttgttattatttggattt

SEQ ID NO: 212832 - DNA, 20 bp, Artificial sequence
  SiRNA target sequence
tttgttattatttggattta

SEQ ID NO: 212833 - DNA, 20 bp, Artificial sequence
  SiRNA target sequence
ttgttattatttggatttat

SEQ ID NO: 212834 - DNA, 20 bp, Artificial sequence
  SiRNA target sequence
tgttattatttggatttatt

SEQ ID NO: 212835 - DNA, 20 bp, Artificial sequence
  SiRNA target sequence
gttattatttggatttattc

SEQ ID NO: 212836 - DNA, 20 bp, Artificial sequence
  SiRNA target sequence
ttattatttggatttattca

SEQ ID NO: 212837 - DNA, 20 bp, Artificial sequence
  SiRNA target sequence
tattatttggatttattcag

SEQ ID NO: 212838 - DNA, 20 bp, Artificial sequence
  SiRNA target sequence
attatttggatttattcagt

SEQ ID NO: 212839 - DNA, 20 bp, Artificial sequence
  SiRNA target sequence
ttatttggatttattcagtt

SEQ ID NO: 212840 - DNA, 20 bp, Artificial sequence
  SiRNA target sequence
tatttggatttattcagtta

SEQ ID NO: 212841 - DNA, 20 bp, Artificial sequence
  SiRNA target sequence
atttggatttattcagttat

SEQ ID NO: 212842 - DNA, 20 bp, Artificial sequence
  SiRNA target sequence
tttggatttattcagttatt

SEQ ID NO: 212843 - DNA, 20 bp, Artificial sequence
  SiRNA target sequence
ttggatttattcagttattt

SEQ ID NO: 212844 - DNA, 20 bp, Artificial sequence
  SiRNA target sequence
tggatttattcagttattta

SEQ ID NO: 212845 - DNA, 20 bp, Artificial sequence
  SiRNA target sequence
ggatttattcagttatttat

SEQ ID NO: 212846 - DNA, 20 bp, Artificial sequence
  SiRNA target sequence
gatttattcagttatttatt

SEQ ID NO: 212847 - DNA, 20 bp, Artificial sequence
  SiRNA target sequence
atttattcagttatttattt

SEQ ID NO: 212848 - DNA, 20 bp, Artificial sequence
  SiRNA target sequence
tttattcagttatttattta

SEQ ID NO: 212849 - DNA, 20 bp, Artificial sequence
  SiRNA target sequence
ttattcagttatttatttaa

SEQ ID NO: 212850 - DNA, 20 bp, Artificial sequence
  SiRNA target sequence
tattcagttatttatttaaa

SEQ ID NO: 212851 - DNA, 20 bp, Artificial sequence
  SiRNA target sequence
attcagttatttatttaaat

SEQ ID NO: 212852 - DNA, 20 bp, Artificial sequence
  SiRNA target sequence
ttcagttatttatttaaata

SEQ ID NO: 212853 - DNA, 20 bp, Artificial sequence
  SiRNA target sequence
tcagttatttatttaaataa

SEQ ID NO: 212854 - DNA, 20 bp, Artificial sequence
  SiRNA target sequence
cagttatttatttaaataag

SEQ ID NO: 212855 - DNA, 20 bp, Artificial sequence
  SiRNA target sequence
agttatttatttaaataaga

SEQ ID NO: 212856 - DNA, 20 bp, Artificial sequence
  SiRNA target sequence
gttatttatttaaataagaa

SEQ ID NO: 212857 - DNA, 20 bp, Artificial sequence
  SiRNA target sequence
ttatttatttaaataagaaa

SEQ ID NO: 212858 - DNA, 20 bp, Artificial sequence
  SiRNA target sequence
tatttatttaaataagaaat

SEQ ID NO: 212859 - DNA, 20 bp, Artificial sequence
  SiRNA target sequence
atttatttaaataagaaata

SEQ ID NO: 212860 - DNA, 20 bp, Artificial sequence
  SiRNA target sequence
tttatttaaataagaaatac

SEQ ID NO: 212861 - DNA, 20 bp, Artificial sequence
  SiRNA target sequence
ttatttaaataagaaataca

SEQ ID NO: 212862 - DNA, 20 bp, Artificial sequence
  SiRNA target sequence
tatttaaataagaaatacaa

SEQ ID NO: 212863 - DNA, 20 bp, Artificial sequence
  SiRNA target sequence
atttaaataagaaatacaaa

SEQ ID NO: 212864 - DNA, 20 bp, Artificial sequence
  SiRNA target sequence
tttaaataagaaatacaaag

SEQ ID NO: 212865 - DNA, 20 bp, Artificial sequence
  SiRNA target sequence
ttaaataagaaatacaaaga

SEQ ID NO: 212866 - DNA, 20 bp, Artificial sequence
  SiRNA target sequence
taaataagaaatacaaagaa

SEQ ID NO: 212867 - DNA, 20 bp, Artificial sequence
  SiRNA target sequence
aaataagaaatacaaagaat

SEQ ID NO: 212868 - DNA, 20 bp, Artificial sequence
  SiRNA target sequence
aataagaaatacaaagaatc

SEQ ID NO: 212869 - DNA, 20 bp, Artificial sequence
  SiRNA target sequence
ataagaaatacaaagaatca

SEQ ID NO: 212870 - DNA, 20 bp, Artificial sequence
  SiRNA target sequence
taagaaatacaaagaatcag

SEQ ID NO: 212871 - DNA, 20 bp, Artificial sequence
  SiRNA target sequence
aagaaatacaaagaatcagt

SEQ ID NO: 212872 - DNA, 20 bp, Artificial sequence
  SiRNA target sequence
agaaatacaaagaatcagtt

SEQ ID NO: 212873 - DNA, 20 bp, Artificial sequence
  SiRNA target sequence
gaaatacaaagaatcagttg

SEQ ID NO: 212874 - DNA, 20 bp, Artificial sequence
  SiRNA target sequence
aaatacaaagaatcagttgt

SEQ ID NO: 212875 - DNA, 20 bp, Artificial sequence
  SiRNA target sequence
aatacaaagaatcagttgtt

SEQ ID NO: 212876 - DNA, 20 bp, Artificial sequence
  SiRNA target sequence
atacaaagaatcagttgtta

SEQ ID NO: 212877 - DNA, 20 bp, Artificial sequence
  SiRNA target sequence
tacaaagaatcagttgttag

SEQ ID NO: 212878 - DNA, 20 bp, Artificial sequence
  SiRNA target sequence
acaaagaatcagttgttagt

SEQ ID NO: 212879 - DNA, 20 bp, Artificial sequence
  SiRNA target sequence
caaagaatcagttgttagta

SEQ ID NO: 212880 - DNA, 20 bp, Artificial sequence
  SiRNA target sequence
aaagaatcagttgttagtaa

SEQ ID NO: 212881 - DNA, 20 bp, Artificial sequence
  SiRNA target sequence
aagaatcagttgttagtaat

SEQ ID NO: 212882 - DNA, 20 bp, Artificial sequence
  SiRNA target sequence
agaatcagttgttagtaatt

SEQ ID NO: 212883 - DNA, 20 bp, Artificial sequence
  SiRNA target sequence
gaatcagttgttagtaattt

SEQ ID NO: 212884 - DNA, 20 bp, Artificial sequence
  SiRNA target sequence
aatcagttgttagtaattta

SEQ ID NO: 212885 - DNA, 20 bp, Artificial sequence
  SiRNA target sequence
atcagttgttagtaatttac

SEQ ID NO: 212886 - DNA, 20 bp, Artificial sequence
  SiRNA target sequence
tcagttgttagtaatttacc

SEQ ID NO: 212887 - DNA, 20 bp, Artificial sequence
  SiRNA target sequence
cagttgttagtaatttaccc

SEQ ID NO: 212888 - DNA, 20 bp, Artificial sequence
  SiRNA target sequence
agttgttagtaatttaccca

SEQ ID NO: 212889 - DNA, 20 bp, Artificial sequence
  SiRNA target sequence
gttgttagtaatttacccat

SEQ ID NO: 212890 - DNA, 20 bp, Artificial sequence
  SiRNA target sequence
ttgttagtaatttacccatc

SEQ ID NO: 212891 - DNA, 20 bp, Artificial sequence
  SiRNA target sequence
tgttagtaatttacccatcg

SEQ ID NO: 212892 - DNA, 20 bp, Artificial sequence
  SiRNA target sequence
gttagtaatttacccatcga

SEQ ID NO: 212893 - DNA, 20 bp, Artificial sequence
  SiRNA target sequence
ttagtaatttacccatcgat

SEQ ID NO: 212894 - DNA, 20 bp, Artificial sequence
  SiRNA target sequence
tagtaatttacccatcgatg

SEQ ID NO: 212895 - DNA, 20 bp, Artificial sequence
  SiRNA target sequence
agtaatttacccatcgatgt

SEQ ID NO: 212896 - DNA, 20 bp, Artificial sequence
  SiRNA target sequence
gtaatttacccatcgatgtt

SEQ ID NO: 212897 - DNA, 20 bp, Artificial sequence
  SiRNA target sequence
taatttacccatcgatgttg

SEQ ID NO: 212898 - DNA, 20 bp, Artificial sequence
  SiRNA target sequence
aatttacccatcgatgttga

SEQ ID NO: 212899 - DNA, 20 bp, Artificial sequence
  SiRNA target sequence
atttacccatcgatgttgat

SEQ ID NO: 212900 - DNA, 20 bp, Artificial sequence
  SiRNA target sequence
tttacccatcgatgttgatt

SEQ ID NO: 212901 - DNA, 20 bp, Artificial sequence
  SiRNA target sequence
ttacccatcgatgttgattt

SEQ ID NO: 212902 - DNA, 20 bp, Artificial sequence
  SiRNA target sequence
tacccatcgatgttgatttg

SEQ ID NO: 212903 - DNA, 20 bp, Artificial sequence
  SiRNA target sequence
acccatcgatgttgatttgt

SEQ ID NO: 212904 - DNA, 20 bp, Artificial sequence
  SiRNA target sequence
cccatcgatgttgatttgtt

SEQ ID NO: 212905 - DNA, 20 bp, Artificial sequence
  SiRNA target sequence
ccatcgatgttgatttgttt

SEQ ID NO: 212906 - DNA, 20 bp, Artificial sequence
  SiRNA target sequence
catcgatgttgatttgtttg

SEQ ID NO: 212907 - DNA, 20 bp, Artificial sequence
  SiRNA target sequence
atcgatgttgatttgtttgc

SEQ ID NO: 212908 - DNA, 20 bp, Artificial sequence
  SiRNA target sequence
tcgatgttgatttgtttgca

SEQ ID NO: 212909 - DNA, 20 bp, Artificial sequence
  SiRNA target sequence
cgatgttgatttgtttgcat

SEQ ID NO: 212910 - DNA, 20 bp, Artificial sequence
  SiRNA target sequence
gatgttgatttgtttgcatc

SEQ ID NO: 212911 - DNA, 20 bp, Artificial sequence
  SiRNA target sequence
atgttgatttgtttgcatca

SEQ ID NO: 212912 - DNA, 20 bp, Artificial sequence
  SiRNA target sequence
tgttgatttgtttgcatcaa

SEQ ID NO: 212913 - DNA, 20 bp, Artificial sequence
  SiRNA target sequence
gttgatttgtttgcatcaaa

SEQ ID NO: 212914 - DNA, 20 bp, Artificial sequence
  SiRNA target sequence
ttgatttgtttgcatcaaag

SEQ ID NO: 212915 - DNA, 20 bp, Artificial sequence
  SiRNA target sequence
tgatttgtttgcatcaaagt

SEQ ID NO: 212916 - DNA, 20 bp, Artificial sequence
  SiRNA target sequence
gatttgtttgcatcaaagtt

SEQ ID NO: 212917 - DNA, 20 bp, Artificial sequence
  SiRNA target sequence
atttgtttgcatcaaagttg

SEQ ID NO: 212918 - DNA, 20 bp, Artificial sequence
  SiRNA target sequence
tttgtttgcatcaaagttgt

SEQ ID NO: 212919 - DNA, 20 bp, Artificial sequence
  SiRNA target sequence
ttgtttgcatcaaagttgtt

SEQ ID NO: 212920 - DNA, 20 bp, Artificial sequence
  SiRNA target sequence
tgtttgcatcaaagttgtta

SEQ ID NO: 212921 - DNA, 20 bp, Artificial sequence
  SiRNA target sequence
gtttgcatcaaagttgttag

SEQ ID NO: 212922 - DNA, 20 bp, Artificial sequence
  SiRNA target sequence
tttgcatcaaagttgttaga

SEQ ID NO: 212923 - DNA, 20 bp, Artificial sequence
  SiRNA target sequence
ttgcatcaaagttgttagat

SEQ ID NO: 212924 - DNA, 20 bp, Artificial sequence
  SiRNA target sequence
tgcatcaaagttgttagata

SEQ ID NO: 212925 - DNA, 20 bp, Artificial sequence
  SiRNA target sequence
gcatcaaagttgttagataa

SEQ ID NO: 212926 - DNA, 20 bp, Artificial sequence
  SiRNA target sequence
catcaaagttgttagataat

SEQ ID NO: 212927 - DNA, 20 bp, Artificial sequence
  SiRNA target sequence
atcaaagttgttagataata

SEQ ID NO: 212928 - DNA, 20 bp, Artificial sequence
  SiRNA target sequence
tcaaagttgttagataataa

SEQ ID NO: 212929 - DNA, 20 bp, Artificial sequence
  SiRNA target sequence
caaagttgttagataataaa

SEQ ID NO: 212930 - DNA, 20 bp, Artificial sequence
  SiRNA target sequence
aaagttgttagataataaaa

SEQ ID NO: 212931 - DNA, 20 bp, Artificial sequence
  SiRNA target sequence
aagttgttagataataaaaa

SEQ ID NO: 212932 - DNA, 20 bp, Artificial sequence
  SiRNA target sequence
agttgttagataataaaaaa

SEQ ID NO: 212933 - DNA, 20 bp, Artificial sequence
  SiRNA target sequence
gttgttagataataaaaaag

SEQ ID NO: 212934 - DNA, 20 bp, Artificial sequence
  SiRNA target sequence
ttgttagataataaaaaaga

SEQ ID NO: 212935 - DNA, 20 bp, Artificial sequence
  SiRNA target sequence
tgttagataataaaaaagaa

SEQ ID NO: 212936 - DNA, 20 bp, Artificial sequence
  SiRNA target sequence
gttagataataaaaaagaag

SEQ ID NO: 212937 - DNA, 20 bp, Artificial sequence
  SiRNA target sequence
ttagataataaaaaagaaga

SEQ ID NO: 212938 - DNA, 20 bp, Artificial sequence
  SiRNA target sequence
tagataataaaaaagaagag

SEQ ID NO: 212939 - DNA, 20 bp, Artificial sequence
  SiRNA target sequence
agataataaaaaagaagagg

SEQ ID NO: 212940 - DNA, 20 bp, Artificial sequence
  SiRNA target sequence
gataataaaaaagaagagga

SEQ ID NO: 212941 - DNA, 20 bp, Artificial sequence
  SiRNA target sequence
ataataaaaaagaagaggaa

SEQ ID NO: 212942 - DNA, 20 bp, Artificial sequence
  SiRNA target sequence
taataaaaaagaagaggaaa

SEQ ID NO: 212943 - DNA, 20 bp, Artificial sequence
  SiRNA target sequence
aataaaaaagaagaggaaat

SEQ ID NO: 212944 - DNA, 20 bp, Artificial sequence
  SiRNA target sequence
ataaaaaagaagaggaaatt

SEQ ID NO: 212945 - DNA, 20 bp, Artificial sequence
  SiRNA target sequence
taaaaaagaagaggaaattg

SEQ ID NO: 212946 - DNA, 20 bp, Artificial sequence
  SiRNA target sequence
aaaaaagaagaggaaattga

SEQ ID NO: 212947 - DNA, 20 bp, Artificial sequence
  SiRNA target sequence
aaaaagaagaggaaattgat

SEQ ID NO: 212948 - DNA, 20 bp, Artificial sequence
  SiRNA target sequence
aaaagaagaggaaattgatg

SEQ ID NO: 212949 - DNA, 20 bp, Artificial sequence
  SiRNA target sequence
aaagaagaggaaattgatgt

SEQ ID NO: 212950 - DNA, 20 bp, Artificial sequence
  SiRNA target sequence
aagaagaggaaattgatgtg

SEQ ID NO: 212951 - DNA, 20 bp, Artificial sequence
  SiRNA target sequence
agaagaggaaattgatgtgt

SEQ ID NO: 212952 - DNA, 20 bp, Artificial sequence
  SiRNA target sequence
gaagaggaaattgatgtgtc

SEQ ID NO: 212953 - DNA, 20 bp, Artificial sequence
  SiRNA target sequence
aagaggaaattgatgtgtca

SEQ ID NO: 212954 - DNA, 20 bp, Artificial sequence
  SiRNA target sequence
agaggaaattgatgtgtcag

SEQ ID NO: 212955 - DNA, 20 bp, Artificial sequence
  SiRNA target sequence
gaggaaattgatgtgtcagt

SEQ ID NO: 212956 - DNA, 20 bp, Artificial sequence
  SiRNA target sequence
aggaaattgatgtgtcagtg

SEQ ID NO: 212957 - DNA, 20 bp, Artificial sequence
  SiRNA target sequence
ggaaattgatgtgtcagtgc

SEQ ID NO: 212958 - DNA, 20 bp, Artificial sequence
  SiRNA target sequence
gaaattgatgtgtcagtgct

SEQ ID NO: 212959 - DNA, 20 bp, Artificial sequence
  SiRNA target sequence
aaattgatgtgtcagtgctc

SEQ ID NO: 212960 - DNA, 20 bp, Artificial sequence
  SiRNA target sequence
aattgatgtgtcagtgctcg

SEQ ID NO: 212961 - DNA, 20 bp, Artificial sequence
  SiRNA target sequence
attgatgtgtcagtgctcgt

SEQ ID NO: 212962 - DNA, 20 bp, Artificial sequence
  SiRNA target sequence
ttgatgtgtcagtgctcgtt

SEQ ID NO: 212963 - DNA, 20 bp, Artificial sequence
  SiRNA target sequence
tgatgtgtcagtgctcgtta

SEQ ID NO: 212964 - DNA, 20 bp, Artificial sequence
  SiRNA target sequence
gatgtgtcagtgctcgttaa

SEQ ID NO: 212965 - DNA, 20 bp, Artificial sequence
  SiRNA target sequence
atgtgtcagtgctcgttaat

SEQ ID NO: 212966 - DNA, 20 bp, Artificial sequence
  SiRNA target sequence
tgtgtcagtgctcgttaatt

SEQ ID NO: 212967 - DNA, 20 bp, Artificial sequence
  SiRNA target sequence
gtgtcagtgctcgttaatta

SEQ ID NO: 212968 - DNA, 20 bp, Artificial sequence
  SiRNA target sequence
tgtcagtgctcgttaattaa

SEQ ID NO: 212969 - DNA, 21 bp, Artificial sequence
  SiRNA target sequence
atgattgagaggggtattatg

SEQ ID NO: 212970 - DNA, 21 bp, Artificial sequence
  SiRNA target sequence
tgattgagaggggtattatgg

SEQ ID NO: 212971 - DNA, 21 bp, Artificial sequence
  SiRNA target sequence
gattgagaggggtattatgga

SEQ ID NO: 212972 - DNA, 21 bp, Artificial sequence
  SiRNA target sequence
attgagaggggtattatggaa

SEQ ID NO: 212973 - DNA, 21 bp, Artificial sequence
  SiRNA target sequence
ttgagaggggtattatggaaa

SEQ ID NO: 212974 - DNA, 21 bp, Artificial sequence
  SiRNA target sequence
tgagaggggtattatggaaaa

SEQ ID NO: 212975 - DNA, 21 bp, Artificial sequence
  SiRNA target sequence
gagaggggtattatggaaaaa

SEQ ID NO: 212976 - DNA, 21 bp, Artificial sequence
  SiRNA target sequence
agaggggtattatggaaaaaa

SEQ ID NO: 212977 - DNA, 21 bp, Artificial sequence
  SiRNA target sequence
gaggggtattatggaaaaaat

SEQ ID NO: 212978 - DNA, 21 bp, Artificial sequence
  SiRNA target sequence
aggggtattatggaaaaaata

SEQ ID NO: 212979 - DNA, 21 bp, Artificial sequence
  SiRNA target sequence
ggggtattatggaaaaaataa

SEQ ID NO: 212980 - DNA, 21 bp, Artificial sequence
  SiRNA target sequence
gggtattatggaaaaaataaa

SEQ ID NO: 212981 - DNA, 21 bp, Artificial sequence
  SiRNA target sequence
ggtattatggaaaaaataaaa

SEQ ID NO: 212982 - DNA, 21 bp, Artificial sequence
  SiRNA target sequence
gtattatggaaaaaataaaaa

SEQ ID NO: 212983 - DNA, 21 bp, Artificial sequence
  SiRNA target sequence
tattatggaaaaaataaaaaa

SEQ ID NO: 212984 - DNA, 21 bp, Artificial sequence
  SiRNA target sequence
attatggaaaaaataaaaaat

SEQ ID NO: 212985 - DNA, 21 bp, Artificial sequence
  SiRNA target sequence
ttatggaaaaaataaaaaatt

SEQ ID NO: 212986 - DNA, 21 bp, Artificial sequence
  SiRNA target sequence
tatggaaaaaataaaaaattt

SEQ ID NO: 212987 - DNA, 21 bp, Artificial sequence
  SiRNA target sequence
atggaaaaaataaaaaattta

SEQ ID NO: 212988 - DNA, 21 bp, Artificial sequence
  SiRNA target sequence
tggaaaaaataaaaaatttat

SEQ ID NO: 212989 - DNA, 21 bp, Artificial sequence
  SiRNA target sequence
ggaaaaaataaaaaatttatt

SEQ ID NO: 212990 - DNA, 21 bp, Artificial sequence
  SiRNA target sequence
gaaaaaataaaaaatttatta

SEQ ID NO: 212991 - DNA, 21 bp, Artificial sequence
  SiRNA target sequence
aaaaaataaaaaatttattaa

SEQ ID NO: 212992 - DNA, 21 bp, Artificial sequence
  SiRNA target sequence
aaaaataaaaaatttattaac

SEQ ID NO: 212993 - DNA, 21 bp, Artificial sequence
  SiRNA target sequence
aaaataaaaaatttattaaca

SEQ ID NO: 212994 - DNA, 21 bp, Artificial sequence
  SiRNA target sequence
aaataaaaaatttattaacag

SEQ ID NO: 212995 - DNA, 21 bp, Artificial sequence
  SiRNA target sequence
aataaaaaatttattaacaga

SEQ ID NO: 212996 - DNA, 21 bp, Artificial sequence
  SiRNA target sequence
ataaaaaatttattaacagag

SEQ ID NO: 212997 - DNA, 21 bp, Artificial sequence
  SiRNA target sequence
taaaaaatttattaacagagg

SEQ ID NO: 212998 - DNA, 21 bp, Artificial sequence
  SiRNA target sequence
aaaaaatttattaacagagga

SEQ ID NO: 212999 - DNA, 21 bp, Artificial sequence
  SiRNA target sequence
aaaaatttattaacagaggat

SEQ ID NO: 213000 - DNA, 21 bp, Artificial sequence
  SiRNA target sequence
aaaatttattaacagaggatg

SEQ ID NO: 213001 - DNA, 21 bp, Artificial sequence
  SiRNA target sequence
aaatttattaacagaggatga

SEQ ID NO: 213002 - DNA, 21 bp, Artificial sequence
  SiRNA target sequence
aatttattaacagaggatgaa

SEQ ID NO: 213003 - DNA, 21 bp, Artificial sequence
  SiRNA target sequence
atttattaacagaggatgaag

SEQ ID NO: 213004 - DNA, 21 bp, Artificial sequence
  SiRNA target sequence
tttattaacagaggatgaagt

SEQ ID NO: 213005 - DNA, 21 bp, Artificial sequence
  SiRNA target sequence
ttattaacagaggatgaagta

SEQ ID NO: 213006 - DNA, 21 bp, Artificial sequence
  SiRNA target sequence
tattaacagaggatgaagtag

SEQ ID NO: 213007 - DNA, 21 bp, Artificial sequence
  SiRNA target sequence
attaacagaggatgaagtaga

SEQ ID NO: 213008 - DNA, 21 bp, Artificial sequence
  SiRNA target sequence
ttaacagaggatgaagtagaa

SEQ ID NO: 213009 - DNA, 21 bp, Artificial sequence
  SiRNA target sequence
taacagaggatgaagtagaag

SEQ ID NO: 213010 - DNA, 21 bp, Artificial sequence
  SiRNA target sequence
aacagaggatgaagtagaagc

SEQ ID NO: 213011 - DNA, 21 bp, Artificial sequence
  SiRNA target sequence
acagaggatgaagtagaagca

SEQ ID NO: 213012 - DNA, 21 bp, Artificial sequence
  SiRNA target sequence
cagaggatgaagtagaagcag

SEQ ID NO: 213013 - DNA, 21 bp, Artificial sequence
  SiRNA target sequence
agaggatgaagtagaagcaga

SEQ ID NO: 213014 - DNA, 21 bp, Artificial sequence
  SiRNA target sequence
gaggatgaagtagaagcagaa

SEQ ID NO: 213015 - DNA, 21 bp, Artificial sequence
  SiRNA target sequence
aggatgaagtagaagcagaag

SEQ ID NO: 213016 - DNA, 21 bp, Artificial sequence
  SiRNA target sequence
ggatgaagtagaagcagaagc

SEQ ID NO: 213017 - DNA, 21 bp, Artificial sequence
  SiRNA target sequence
gatgaagtagaagcagaagca

SEQ ID NO: 213018 - DNA, 21 bp, Artificial sequence
  SiRNA target sequence
atgaagtagaagcagaagcaa

SEQ ID NO: 213019 - DNA, 21 bp, Artificial sequence
  SiRNA target sequence
tgaagtagaagcagaagcaaa

SEQ ID NO: 213020 - DNA, 21 bp, Artificial sequence
  SiRNA target sequence
gaagtagaagcagaagcaaat

SEQ ID NO: 213021 - DNA, 21 bp, Artificial sequence
  SiRNA target sequence
aagtagaagcagaagcaaatt

SEQ ID NO: 213022 - DNA, 21 bp, Artificial sequence
  SiRNA target sequence
agtagaagcagaagcaaattc

SEQ ID NO: 213023 - DNA, 21 bp, Artificial sequence
  SiRNA target sequence
gtagaagcagaagcaaattct

SEQ ID NO: 213024 - DNA, 21 bp, Artificial sequence
  SiRNA target sequence
tagaagcagaagcaaattctg

SEQ ID NO: 213025 - DNA, 21 bp, Artificial sequence
  SiRNA target sequence
agaagcagaagcaaattctgg

SEQ ID NO: 213026 - DNA, 21 bp, Artificial sequence
  SiRNA target sequence
gaagcagaagcaaattctgga

SEQ ID NO: 213027 - DNA, 21 bp, Artificial sequence
  SiRNA target sequence
aagcagaagcaaattctggaa

SEQ ID NO: 213028 - DNA, 21 bp, Artificial sequence
  SiRNA target sequence
agcagaagcaaattctggaag

SEQ ID NO: 213029 - DNA, 21 bp, Artificial sequence
  SiRNA target sequence
gcagaagcaaattctggaagg

SEQ ID NO: 213030 - DNA, 21 bp, Artificial sequence
  SiRNA target sequence
cagaagcaaattctggaaggg

SEQ ID NO: 213031 - DNA, 21 bp, Artificial sequence
  SiRNA target sequence
agaagcaaattctggaagggg

SEQ ID NO: 213032 - DNA, 21 bp, Artificial sequence
  SiRNA target sequence
gaagcaaattctggaaggggc

SEQ ID NO: 213033 - DNA, 21 bp, Artificial sequence
  SiRNA target sequence
aagcaaattctggaaggggca

SEQ ID NO: 213034 - DNA, 21 bp, Artificial sequence
  SiRNA target sequence
agcaaattctggaaggggcat

SEQ ID NO: 213035 - DNA, 21 bp, Artificial sequence
  SiRNA target sequence
gcaaattctggaaggggcatt

SEQ ID NO: 213036 - DNA, 21 bp, Artificial sequence
  SiRNA target sequence
caaattctggaaggggcattt

SEQ ID NO: 213037 - DNA, 21 bp, Artificial sequence
  SiRNA target sequence
aaattctggaaggggcatttt

SEQ ID NO: 213038 - DNA, 21 bp, Artificial sequence
  SiRNA target sequence
aattctggaaggggcatttta

SEQ ID NO: 213039 - DNA, 21 bp, Artificial sequence
  SiRNA target sequence
attctggaaggggcattttat

SEQ ID NO: 213040 - DNA, 21 bp, Artificial sequence
  SiRNA target sequence
ttctggaaggggcattttatc

SEQ ID NO: 213041 - DNA, 21 bp, Artificial sequence
  SiRNA target sequence
tctggaaggggcattttatca

SEQ ID NO: 213042 - DNA, 21 bp, Artificial sequence
  SiRNA target sequence
ctggaaggggcattttatcaa

SEQ ID NO: 213043 - DNA, 21 bp, Artificial sequence
  SiRNA target sequence
tggaaggggcattttatcaat

SEQ ID NO: 213044 - DNA, 21 bp, Artificial sequence
  SiRNA target sequence
ggaaggggcattttatcaata

SEQ ID NO: 213045 - DNA, 21 bp, Artificial sequence
  SiRNA target sequence
gaaggggcattttatcaatat

SEQ ID NO: 213046 - DNA, 21 bp, Artificial sequence
  SiRNA target sequence
aaggggcattttatcaatatt

SEQ ID NO: 213047 - DNA, 21 bp, Artificial sequence
  SiRNA target sequence
aggggcattttatcaatattt

SEQ ID NO: 213048 - DNA, 21 bp, Artificial sequence
  SiRNA target sequence
ggggcattttatcaatattta

SEQ ID NO: 213049 - DNA, 21 bp, Artificial sequence
  SiRNA target sequence
gggcattttatcaatatttag

SEQ ID NO: 213050 - DNA, 21 bp, Artificial sequence
  SiRNA target sequence
ggcattttatcaatatttaga

SEQ ID NO: 213051 - DNA, 21 bp, Artificial sequence
  SiRNA target sequence
gcattttatcaatatttagaa

SEQ ID NO: 213052 - DNA, 21 bp, Artificial sequence
  SiRNA target sequence
cattttatcaatatttagaat

SEQ ID NO: 213053 - DNA, 21 bp, Artificial sequence
  SiRNA target sequence
attttatcaatatttagaatt

SEQ ID NO: 213054 - DNA, 21 bp, Artificial sequence
  SiRNA target sequence
ttttatcaatatttagaattg

SEQ ID NO: 213055 - DNA, 21 bp, Artificial sequence
  SiRNA target sequence
tttatcaatatttagaattgc

SEQ ID NO: 213056 - DNA, 21 bp, Artificial sequence
  SiRNA target sequence
ttatcaatatttagaattgct

SEQ ID NO: 213057 - DNA, 21 bp, Artificial sequence
  SiRNA target sequence
tatcaatatttagaattgcta

SEQ ID NO: 213058 - DNA, 21 bp, Artificial sequence
  SiRNA target sequence
atcaatatttagaattgctaa

SEQ ID NO: 213059 - DNA, 21 bp, Artificial sequence
  SiRNA target sequence
tcaatatttagaattgctaag

SEQ ID NO: 213060 - DNA, 21 bp, Artificial sequence
  SiRNA target sequence
caatatttagaattgctaagg

SEQ ID NO: 213061 - DNA, 21 bp, Artificial sequence
  SiRNA target sequence
aatatttagaattgctaaggt

SEQ ID NO: 213062 - DNA, 21 bp, Artificial sequence
  SiRNA target sequence
atatttagaattgctaaggta

SEQ ID NO: 213063 - DNA, 21 bp, Artificial sequence
  SiRNA target sequence
tatttagaattgctaaggtag

SEQ ID NO: 213064 - DNA, 21 bp, Artificial sequence
  SiRNA target sequence
atttagaattgctaaggtaga

SEQ ID NO: 213065 - DNA, 21 bp, Artificial sequence
  SiRNA target sequence
tttagaattgctaaggtagaa

SEQ ID NO: 213066 - DNA, 21 bp, Artificial sequence
  SiRNA target sequence
ttagaattgctaaggtagaaa

SEQ ID NO: 213067 - DNA, 21 bp, Artificial sequence
  SiRNA target sequence
tagaattgctaaggtagaaag

SEQ ID NO: 213068 - DNA, 21 bp, Artificial sequence
  SiRNA target sequence
agaattgctaaggtagaaaga

SEQ ID NO: 213069 - DNA, 21 bp, Artificial sequence
  SiRNA target sequence
gaattgctaaggtagaaagaa

SEQ ID NO: 213070 - DNA, 21 bp, Artificial sequence
  SiRNA target sequence
aattgctaaggtagaaagaag

SEQ ID NO: 213071 - DNA, 21 bp, Artificial sequence
  SiRNA target sequence
attgctaaggtagaaagaaga

SEQ ID NO: 213072 - DNA, 21 bp, Artificial sequence
  SiRNA target sequence
ttgctaaggtagaaagaagaa

SEQ ID NO: 213073 - DNA, 21 bp, Artificial sequence
  SiRNA target sequence
tgctaaggtagaaagaagaat

SEQ ID NO: 213074 - DNA, 21 bp, Artificial sequence
  SiRNA target sequence
gctaaggtagaaagaagaatg

SEQ ID NO: 213075 - DNA, 21 bp, Artificial sequence
  SiRNA target sequence
ctaaggtagaaagaagaatgt

SEQ ID NO: 213076 - DNA, 21 bp, Artificial sequence
  SiRNA target sequence
taaggtagaaagaagaatgtt

SEQ ID NO: 213077 - DNA, 21 bp, Artificial sequence
  SiRNA target sequence
aaggtagaaagaagaatgttt

SEQ ID NO: 213078 - DNA, 21 bp, Artificial sequence
  SiRNA target sequence
aggtagaaagaagaatgtttt

SEQ ID NO: 213079 - DNA, 21 bp, Artificial sequence
  SiRNA target sequence
ggtagaaagaagaatgttttg

SEQ ID NO: 213080 - DNA, 21 bp, Artificial sequence
  SiRNA target sequence
gtagaaagaagaatgttttgg

SEQ ID NO: 213081 - DNA, 21 bp, Artificial sequence
  SiRNA target sequence
tagaaagaagaatgttttggc

SEQ ID NO: 213082 - DNA, 21 bp, Artificial sequence
  SiRNA target sequence
agaaagaagaatgttttggct

SEQ ID NO: 213083 - DNA, 21 bp, Artificial sequence
  SiRNA target sequence
gaaagaagaatgttttggctt

SEQ ID NO: 213084 - DNA, 21 bp, Artificial sequence
  SiRNA target sequence
aaagaagaatgttttggctta

SEQ ID NO: 213085 - DNA, 21 bp, Artificial sequence
  SiRNA target sequence
aagaagaatgttttggcttat

SEQ ID NO: 213086 - DNA, 21 bp, Artificial sequence
  SiRNA target sequence
agaagaatgttttggcttatg

SEQ ID NO: 213087 - DNA, 21 bp, Artificial sequence
  SiRNA target sequence
gaagaatgttttggcttatga

SEQ ID NO: 213088 - DNA, 21 bp, Artificial sequence
  SiRNA target sequence
aagaatgttttggcttatgac

SEQ ID NO: 213089 - DNA, 21 bp, Artificial sequence
  SiRNA target sequence
agaatgttttggcttatgacg

SEQ ID NO: 213090 - DNA, 21 bp, Artificial sequence
  SiRNA target sequence
gaatgttttggcttatgacgc

SEQ ID NO: 213091 - DNA, 21 bp, Artificial sequence
  SiRNA target sequence
aatgttttggcttatgacgct

SEQ ID NO: 213092 - DNA, 21 bp, Artificial sequence
  SiRNA target sequence
atgttttggcttatgacgctt

SEQ ID NO: 213093 - DNA, 21 bp, Artificial sequence
  SiRNA target sequence
tgttttggcttatgacgctta

SEQ ID NO: 213094 - DNA, 21 bp, Artificial sequence
  SiRNA target sequence
gttttggcttatgacgcttat

SEQ ID NO: 213095 - DNA, 21 bp, Artificial sequence
  SiRNA target sequence
ttttggcttatgacgcttatg

SEQ ID NO: 213096 - DNA, 21 bp, Artificial sequence
  SiRNA target sequence
tttggcttatgacgcttatgt

SEQ ID NO: 213097 - DNA, 21 bp, Artificial sequence
  SiRNA target sequence
ttggcttatgacgcttatgtt

SEQ ID NO: 213098 - DNA, 21 bp, Artificial sequence
  SiRNA target sequence
tggcttatgacgcttatgttt

SEQ ID NO: 213099 - DNA, 21 bp, Artificial sequence
  SiRNA target sequence
ggcttatgacgcttatgtttt

SEQ ID NO: 213100 - DNA, 21 bp, Artificial sequence
  SiRNA target sequence
gcttatgacgcttatgttttc

SEQ ID NO: 213101 - DNA, 21 bp, Artificial sequence
  SiRNA target sequence
cttatgacgcttatgttttcg

SEQ ID NO: 213102 - DNA, 21 bp, Artificial sequence
  SiRNA target sequence
ttatgacgcttatgttttcgc

SEQ ID NO: 213103 - DNA, 21 bp, Artificial sequence
  SiRNA target sequence
tatgacgcttatgttttcgct

SEQ ID NO: 213104 - DNA, 21 bp, Artificial sequence
  SiRNA target sequence
atgacgcttatgttttcgctt

SEQ ID NO: 213105 - DNA, 21 bp, Artificial sequence
  SiRNA target sequence
tgacgcttatgttttcgctta

SEQ ID NO: 213106 - DNA, 21 bp, Artificial sequence
  SiRNA target sequence
gacgcttatgttttcgcttat

SEQ ID NO: 213107 - DNA, 21 bp, Artificial sequence
  SiRNA target sequence
acgcttatgttttcgcttatt

SEQ ID NO: 213108 - DNA, 21 bp, Artificial sequence
  SiRNA target sequence
cgcttatgttttcgcttattt

SEQ ID NO: 213109 - DNA, 21 bp, Artificial sequence
  SiRNA target sequence
gcttatgttttcgcttatttc

SEQ ID NO: 213110 - DNA, 21 bp, Artificial sequence
  SiRNA target sequence
cttatgttttcgcttatttcc

SEQ ID NO: 213111 - DNA, 21 bp, Artificial sequence
  SiRNA target sequence
ttatgttttcgcttatttcct

SEQ ID NO: 213112 - DNA, 21 bp, Artificial sequence
  SiRNA target sequence
tatgttttcgcttatttcctt

SEQ ID NO: 213113 - DNA, 21 bp, Artificial sequence
  SiRNA target sequence
atgttttcgcttatttccttt

SEQ ID NO: 213114 - DNA, 21 bp, Artificial sequence
  SiRNA target sequence
tgttttcgcttatttccttta

SEQ ID NO: 213115 - DNA, 21 bp, Artificial sequence
  SiRNA target sequence
gttttcgcttatttcctttat

SEQ ID NO: 213116 - DNA, 21 bp, Artificial sequence
  SiRNA target sequence
ttttcgcttatttcctttatt

SEQ ID NO: 213117 - DNA, 21 bp, Artificial sequence
  SiRNA target sequence
tttcgcttatttcctttattt

SEQ ID NO: 213118 - DNA, 21 bp, Artificial sequence
  SiRNA target sequence
ttcgcttatttcctttattta

SEQ ID NO: 213119 - DNA, 21 bp, Artificial sequence
  SiRNA target sequence
tcgcttatttcctttatttac

SEQ ID NO: 213120 - DNA, 21 bp, Artificial sequence
  SiRNA target sequence
cgcttatttcctttatttact

SEQ ID NO: 213121 - DNA, 21 bp, Artificial sequence
  SiRNA target sequence
gcttatttcctttatttactc

SEQ ID NO: 213122 - DNA, 21 bp, Artificial sequence
  SiRNA target sequence
cttatttcctttatttactca

SEQ ID NO: 213123 - DNA, 21 bp, Artificial sequence
  SiRNA target sequence
ttatttcctttatttactcag

SEQ ID NO: 213124 - DNA, 21 bp, Artificial sequence
  SiRNA target sequence
tatttcctttatttactcagt

SEQ ID NO: 213125 - DNA, 21 bp, Artificial sequence
  SiRNA target sequence
atttcctttatttactcagta

SEQ ID NO: 213126 - DNA, 21 bp, Artificial sequence
  SiRNA target sequence
tttcctttatttactcagtag

SEQ ID NO: 213127 - DNA, 21 bp, Artificial sequence
  SiRNA target sequence
ttcctttatttactcagtagg

SEQ ID NO: 213128 - DNA, 21 bp, Artificial sequence
  SiRNA target sequence
tcctttatttactcagtagga

SEQ ID NO: 213129 - DNA, 21 bp, Artificial sequence
  SiRNA target sequence
cctttatttactcagtaggac

SEQ ID NO: 213130 - DNA, 21 bp, Artificial sequence
  SiRNA target sequence
ctttatttactcagtaggacg

SEQ ID NO: 213131 - DNA, 21 bp, Artificial sequence
  SiRNA target sequence
tttatttactcagtaggacga

SEQ ID NO: 213132 - DNA, 21 bp, Artificial sequence
  SiRNA target sequence
ttatttactcagtaggacgag

SEQ ID NO: 213133 - DNA, 21 bp, Artificial sequence
  SiRNA target sequence
tatttactcagtaggacgagt

SEQ ID NO: 213134 - DNA, 21 bp, Artificial sequence
  SiRNA target sequence
atttactcagtaggacgagtg

SEQ ID NO: 213135 - DNA, 21 bp, Artificial sequence
  SiRNA target sequence
tttactcagtaggacgagtgt

SEQ ID NO: 213136 - DNA, 21 bp, Artificial sequence
  SiRNA target sequence
ttactcagtaggacgagtgtt

SEQ ID NO: 213137 - DNA, 21 bp, Artificial sequence
  SiRNA target sequence
tactcagtaggacgagtgtta

SEQ ID NO: 213138 - DNA, 21 bp, Artificial sequence
  SiRNA target sequence
actcagtaggacgagtgttaa

SEQ ID NO: 213139 - DNA, 21 bp, Artificial sequence
  SiRNA target sequence
ctcagtaggacgagtgttaaa

SEQ ID NO: 213140 - DNA, 21 bp, Artificial sequence
  SiRNA target sequence
tcagtaggacgagtgttaaaa

SEQ ID NO: 213141 - DNA, 21 bp, Artificial sequence
  SiRNA target sequence
cagtaggacgagtgttaaaag

SEQ ID NO: 213142 - DNA, 21 bp, Artificial sequence
  SiRNA target sequence
agtaggacgagtgttaaaaga

SEQ ID NO: 213143 - DNA, 21 bp, Artificial sequence
  SiRNA target sequence
gtaggacgagtgttaaaagat

SEQ ID NO: 213144 - DNA, 21 bp, Artificial sequence
  SiRNA target sequence
taggacgagtgttaaaagatg

SEQ ID NO: 213145 - DNA, 21 bp, Artificial sequence
  SiRNA target sequence
aggacgagtgttaaaagatgc

SEQ ID NO: 213146 - DNA, 21 bp, Artificial sequence
  SiRNA target sequence
ggacgagtgttaaaagatgca

SEQ ID NO: 213147 - DNA, 21 bp, Artificial sequence
  SiRNA target sequence
gacgagtgttaaaagatgcag

SEQ ID NO: 213148 - DNA, 21 bp, Artificial sequence
  SiRNA target sequence
acgagtgttaaaagatgcagc

SEQ ID NO: 213149 - DNA, 21 bp, Artificial sequence
  SiRNA target sequence
cgagtgttaaaagatgcagca

SEQ ID NO: 213150 - DNA, 21 bp, Artificial sequence
  SiRNA target sequence
gagtgttaaaagatgcagcag

SEQ ID NO: 213151 - DNA, 21 bp, Artificial sequence
  SiRNA target sequence
agtgttaaaagatgcagcagt

SEQ ID NO: 213152 - DNA, 21 bp, Artificial sequence
  SiRNA target sequence
gtgttaaaagatgcagcagtt

SEQ ID NO: 213153 - DNA, 21 bp, Artificial sequence
  SiRNA target sequence
tgttaaaagatgcagcagttc

SEQ ID NO: 213154 - DNA, 21 bp, Artificial sequence
  SiRNA target sequence
gttaaaagatgcagcagttct

SEQ ID NO: 213155 - DNA, 21 bp, Artificial sequence
  SiRNA target sequence
ttaaaagatgcagcagttctt

SEQ ID NO: 213156 - DNA, 21 bp, Artificial sequence
  SiRNA target sequence
taaaagatgcagcagttctta

SEQ ID NO: 213157 - DNA, 21 bp, Artificial sequence
  SiRNA target sequence
aaaagatgcagcagttcttag

SEQ ID NO: 213158 - DNA, 21 bp, Artificial sequence
  SiRNA target sequence
aaagatgcagcagttcttagt

SEQ ID NO: 213159 - DNA, 21 bp, Artificial sequence
  SiRNA target sequence
aagatgcagcagttcttagta

SEQ ID NO: 213160 - DNA, 21 bp, Artificial sequence
  SiRNA target sequence
agatgcagcagttcttagtag

SEQ ID NO: 213161 - DNA, 21 bp, Artificial sequence
  SiRNA target sequence
gatgcagcagttcttagtaga

SEQ ID NO: 213162 - DNA, 21 bp, Artificial sequence
  SiRNA target sequence
atgcagcagttcttagtagac

SEQ ID NO: 213163 - DNA, 21 bp, Artificial sequence
  SiRNA target sequence
tgcagcagttcttagtagaca

SEQ ID NO: 213164 - DNA, 21 bp, Artificial sequence
  SiRNA target sequence
gcagcagttcttagtagacag

SEQ ID NO: 213165 - DNA, 21 bp, Artificial sequence
  SiRNA target sequence
cagcagttcttagtagacaga

SEQ ID NO: 213166 - DNA, 21 bp, Artificial sequence
  SiRNA target sequence
agcagttcttagtagacagat

SEQ ID NO: 213167 - DNA, 21 bp, Artificial sequence
  SiRNA target sequence
gcagttcttagtagacagatg

SEQ ID NO: 213168 - DNA, 21 bp, Artificial sequence
  SiRNA target sequence
cagttcttagtagacagatgc

SEQ ID NO: 213169 - DNA, 21 bp, Artificial sequence
  SiRNA target sequence
agttcttagtagacagatgcc

SEQ ID NO: 213170 - DNA, 21 bp, Artificial sequence
  SiRNA target sequence
gttcttagtagacagatgcca

SEQ ID NO: 213171 - DNA, 21 bp, Artificial sequence
  SiRNA target sequence
ttcttagtagacagatgccac

SEQ ID NO: 213172 - DNA, 21 bp, Artificial sequence
  SiRNA target sequence
tcttagtagacagatgccact

SEQ ID NO: 213173 - DNA, 21 bp, Artificial sequence
  SiRNA target sequence
cttagtagacagatgccacta

SEQ ID NO: 213174 - DNA, 21 bp, Artificial sequence
  SiRNA target sequence
ttagtagacagatgccactat

SEQ ID NO: 213175 - DNA, 21 bp, Artificial sequence
  SiRNA target sequence
tagtagacagatgccactatc

SEQ ID NO: 213176 - DNA, 21 bp, Artificial sequence
  SiRNA target sequence
agtagacagatgccactatcc

SEQ ID NO: 213177 - DNA, 21 bp, Artificial sequence
  SiRNA target sequence
gtagacagatgccactatcca

SEQ ID NO: 213178 - DNA, 21 bp, Artificial sequence
  SiRNA target sequence
tagacagatgccactatccat

SEQ ID NO: 213179 - DNA, 21 bp, Artificial sequence
  SiRNA target sequence
agacagatgccactatccatt

SEQ ID NO: 213180 - DNA, 21 bp, Artificial sequence
  SiRNA target sequence
gacagatgccactatccatta

SEQ ID NO: 213181 - DNA, 21 bp, Artificial sequence
  SiRNA target sequence
acagatgccactatccattaa

SEQ ID NO: 213182 - DNA, 21 bp, Artificial sequence
  SiRNA target sequence
cagatgccactatccattaat

SEQ ID NO: 213183 - DNA, 21 bp, Artificial sequence
  SiRNA target sequence
agatgccactatccattaatt

SEQ ID NO: 213184 - DNA, 21 bp, Artificial sequence
  SiRNA target sequence
gatgccactatccattaattg

SEQ ID NO: 213185 - DNA, 21 bp, Artificial sequence
  SiRNA target sequence
atgccactatccattaattgt

SEQ ID NO: 213186 - DNA, 21 bp, Artificial sequence
  SiRNA target sequence
tgccactatccattaattgtc

SEQ ID NO: 213187 - DNA, 21 bp, Artificial sequence
  SiRNA target sequence
gccactatccattaattgtct

SEQ ID NO: 213188 - DNA, 21 bp, Artificial sequence
  SiRNA target sequence
ccactatccattaattgtctt

SEQ ID NO: 213189 - DNA, 21 bp, Artificial sequence
  SiRNA target sequence
cactatccattaattgtctta

SEQ ID NO: 213190 - DNA, 21 bp, Artificial sequence
  SiRNA target sequence
actatccattaattgtcttaa

SEQ ID NO: 213191 - DNA, 21 bp, Artificial sequence
  SiRNA target sequence
ctatccattaattgtcttaaa

SEQ ID NO: 213192 - DNA, 21 bp, Artificial sequence
  SiRNA target sequence
tatccattaattgtcttaaaa

SEQ ID NO: 213193 - DNA, 21 bp, Artificial sequence
  SiRNA target sequence
atccattaattgtcttaaaag

SEQ ID NO: 213194 - DNA, 21 bp, Artificial sequence
  SiRNA target sequence
tccattaattgtcttaaaagc

SEQ ID NO: 213195 - DNA, 21 bp, Artificial sequence
  SiRNA target sequence
ccattaattgtcttaaaagct

SEQ ID NO: 213196 - DNA, 21 bp, Artificial sequence
  SiRNA target sequence
cattaattgtcttaaaagctt

SEQ ID NO: 213197 - DNA, 21 bp, Artificial sequence
  SiRNA target sequence
attaattgtcttaaaagcttt

SEQ ID NO: 213198 - DNA, 21 bp, Artificial sequence
  SiRNA target sequence
ttaattgtcttaaaagctttg

SEQ ID NO: 213199 - DNA, 21 bp, Artificial sequence
  SiRNA target sequence
taattgtcttaaaagctttgt

SEQ ID NO: 213200 - DNA, 21 bp, Artificial sequence
  SiRNA target sequence
aattgtcttaaaagctttgta

SEQ ID NO: 213201 - DNA, 21 bp, Artificial sequence
  SiRNA target sequence
attgtcttaaaagctttgtaa

SEQ ID NO: 213202 - DNA, 21 bp, Artificial sequence
  SiRNA target sequence
ttgtcttaaaagctttgtaat

SEQ ID NO: 213203 - DNA, 21 bp, Artificial sequence
  SiRNA target sequence
tgtcttaaaagctttgtaatt

SEQ ID NO: 213204 - DNA, 21 bp, Artificial sequence
  SiRNA target sequence
gtcttaaaagctttgtaattt

SEQ ID NO: 213205 - DNA, 21 bp, Artificial sequence
  SiRNA target sequence
tcttaaaagctttgtaatttt

SEQ ID NO: 213206 - DNA, 21 bp, Artificial sequence
  SiRNA target sequence
cttaaaagctttgtaatttta

SEQ ID NO: 213207 - DNA, 21 bp, Artificial sequence
  SiRNA target sequence
ttaaaagctttgtaattttac

SEQ ID NO: 213208 - DNA, 21 bp, Artificial sequence
  SiRNA target sequence
taaaagctttgtaattttacc

SEQ ID NO: 213209 - DNA, 21 bp, Artificial sequence
  SiRNA target sequence
aaaagctttgtaattttacca

SEQ ID NO: 213210 - DNA, 21 bp, Artificial sequence
  SiRNA target sequence
aaagctttgtaattttaccag

SEQ ID NO: 213211 - DNA, 21 bp, Artificial sequence
  SiRNA target sequence
aagctttgtaattttaccagt

SEQ ID NO: 213212 - DNA, 21 bp, Artificial sequence
  SiRNA target sequence
agctttgtaattttaccagtt

SEQ ID NO: 213213 - DNA, 21 bp, Artificial sequence
  SiRNA target sequence
gctttgtaattttaccagtta

SEQ ID NO: 213214 - DNA, 21 bp, Artificial sequence
  SiRNA target sequence
ctttgtaattttaccagttac

SEQ ID NO: 213215 - DNA, 21 bp, Artificial sequence
  SiRNA target sequence
tttgtaattttaccagttact

SEQ ID NO: 213216 - DNA, 21 bp, Artificial sequence
  SiRNA target sequence
ttgtaattttaccagttactc

SEQ ID NO: 213217 - DNA, 21 bp, Artificial sequence
  SiRNA target sequence
tgtaattttaccagttactct

SEQ ID NO: 213218 - DNA, 21 bp, Artificial sequence
  SiRNA target sequence
gtaattttaccagttactctt

SEQ ID NO: 213219 - DNA, 21 bp, Artificial sequence
  SiRNA target sequence
taattttaccagttactcttg

SEQ ID NO: 213220 - DNA, 21 bp, Artificial sequence
  SiRNA target sequence
aattttaccagttactcttgt

SEQ ID NO: 213221 - DNA, 21 bp, Artificial sequence
  SiRNA target sequence
attttaccagttactcttgtt

SEQ ID NO: 213222 - DNA, 21 bp, Artificial sequence
  SiRNA target sequence
ttttaccagttactcttgttt

SEQ ID NO: 213223 - DNA, 21 bp, Artificial sequence
  SiRNA target sequence
tttaccagttactcttgtttg

SEQ ID NO: 213224 - DNA, 21 bp, Artificial sequence
  SiRNA target sequence
ttaccagttactcttgtttgt

SEQ ID NO: 213225 - DNA, 21 bp, Artificial sequence
  SiRNA target sequence
taccagttactcttgtttgtg

SEQ ID NO: 213226 - DNA, 21 bp, Artificial sequence
  SiRNA target sequence
accagttactcttgtttgtgt

SEQ ID NO: 213227 - DNA, 21 bp, Artificial sequence
  SiRNA target sequence
ccagttactcttgtttgtgta

SEQ ID NO: 213228 - DNA, 21 bp, Artificial sequence
  SiRNA target sequence
cagttactcttgtttgtgtag

SEQ ID NO: 213229 - DNA, 21 bp, Artificial sequence
  SiRNA target sequence
agttactcttgtttgtgtagg

SEQ ID NO: 213230 - DNA, 21 bp, Artificial sequence
  SiRNA target sequence
gttactcttgtttgtgtagga

SEQ ID NO: 213231 - DNA, 21 bp, Artificial sequence
  SiRNA target sequence
ttactcttgtttgtgtaggat

SEQ ID NO: 213232 - DNA, 21 bp, Artificial sequence
  SiRNA target sequence
tactcttgtttgtgtaggatt

SEQ ID NO: 213233 - DNA, 21 bp, Artificial sequence
  SiRNA target sequence
actcttgtttgtgtaggatta

SEQ ID NO: 213234 - DNA, 21 bp, Artificial sequence
  SiRNA target sequence
ctcttgtttgtgtaggattaa

SEQ ID NO: 213235 - DNA, 21 bp, Artificial sequence
  SiRNA target sequence
tcttgtttgtgtaggattaat

SEQ ID NO: 213236 - DNA, 21 bp, Artificial sequence
  SiRNA target sequence
cttgtttgtgtaggattaatt

SEQ ID NO: 213237 - DNA, 21 bp, Artificial sequence
  SiRNA target sequence
ttgtttgtgtaggattaattc

SEQ ID NO: 213238 - DNA, 21 bp, Artificial sequence
  SiRNA target sequence
tgtttgtgtaggattaattca

SEQ ID NO: 213239 - DNA, 21 bp, Artificial sequence
  SiRNA target sequence
gtttgtgtaggattaattcag

SEQ ID NO: 213240 - DNA, 21 bp, Artificial sequence
  SiRNA target sequence
tttgtgtaggattaattcaga

SEQ ID NO: 213241 - DNA, 21 bp, Artificial sequence
  SiRNA target sequence
ttgtgtaggattaattcagaa

SEQ ID NO: 213242 - DNA, 21 bp, Artificial sequence
  SiRNA target sequence
tgtgtaggattaattcagaag

SEQ ID NO: 213243 - DNA, 21 bp, Artificial sequence
  SiRNA target sequence
gtgtaggattaattcagaagt

SEQ ID NO: 213244 - DNA, 21 bp, Artificial sequence
  SiRNA target sequence
tgtaggattaattcagaagtc

SEQ ID NO: 213245 - DNA, 21 bp, Artificial sequence
  SiRNA target sequence
gtaggattaattcagaagtct

SEQ ID NO: 213246 - DNA, 21 bp, Artificial sequence
  SiRNA target sequence
taggattaattcagaagtcta

SEQ ID NO: 213247 - DNA, 21 bp, Artificial sequence
  SiRNA target sequence
aggattaattcagaagtctac

SEQ ID NO: 213248 - DNA, 21 bp, Artificial sequence
  SiRNA target sequence
ggattaattcagaagtctaca

SEQ ID NO: 213249 - DNA, 21 bp, Artificial sequence
  SiRNA target sequence
gattaattcagaagtctacac

SEQ ID NO: 213250 - DNA, 21 bp, Artificial sequence
  SiRNA target sequence
attaattcagaagtctacact

SEQ ID NO: 213251 - DNA, 21 bp, Artificial sequence
  SiRNA target sequence
ttaattcagaagtctacactc

SEQ ID NO: 213252 - DNA, 21 bp, Artificial sequence
  SiRNA target sequence
taattcagaagtctacactct

SEQ ID NO: 213253 - DNA, 21 bp, Artificial sequence
  SiRNA target sequence
aattcagaagtctacactctc

SEQ ID NO: 213254 - DNA, 21 bp, Artificial sequence
  SiRNA target sequence
attcagaagtctacactctct

SEQ ID NO: 213255 - DNA, 21 bp, Artificial sequence
  SiRNA target sequence
ttcagaagtctacactctctt

SEQ ID NO: 213256 - DNA, 21 bp, Artificial sequence
  SiRNA target sequence
tcagaagtctacactctctta

SEQ ID NO: 213257 - DNA, 21 bp, Artificial sequence
  SiRNA target sequence
cagaagtctacactctcttat

SEQ ID NO: 213258 - DNA, 21 bp, Artificial sequence
  SiRNA target sequence
agaagtctacactctcttatt

SEQ ID NO: 213259 - DNA, 21 bp, Artificial sequence
  SiRNA target sequence
gaagtctacactctcttattc

SEQ ID NO: 213260 - DNA, 21 bp, Artificial sequence
  SiRNA target sequence
aagtctacactctcttattct

SEQ ID NO: 213261 - DNA, 21 bp, Artificial sequence
  SiRNA target sequence
agtctacactctcttattctt

SEQ ID NO: 213262 - DNA, 21 bp, Artificial sequence
  SiRNA target sequence
gtctacactctcttattcttt

SEQ ID NO: 213263 - DNA, 21 bp, Artificial sequence
  SiRNA target sequence
tctacactctcttattctttt

SEQ ID NO: 213264 - DNA, 21 bp, Artificial sequence
  SiRNA target sequence
ctacactctcttattctttta

SEQ ID NO: 213265 - DNA, 21 bp, Artificial sequence
  SiRNA target sequence
tacactctcttattcttttac

SEQ ID NO: 213266 - DNA, 21 bp, Artificial sequence
  SiRNA target sequence
acactctcttattcttttaca

SEQ ID NO: 213267 - DNA, 21 bp, Artificial sequence
  SiRNA target sequence
cactctcttattcttttacaa

SEQ ID NO: 213268 - DNA, 21 bp, Artificial sequence
  SiRNA target sequence
actctcttattcttttacaaa

SEQ ID NO: 213269 - DNA, 21 bp, Artificial sequence
  SiRNA target sequence
ctctcttattcttttacaaaa

SEQ ID NO: 213270 - DNA, 21 bp, Artificial sequence
  SiRNA target sequence
tctcttattcttttacaaaaa

SEQ ID NO: 213271 - DNA, 21 bp, Artificial sequence
  SiRNA target sequence
ctcttattcttttacaaaaat

SEQ ID NO: 213272 - DNA, 21 bp, Artificial sequence
  SiRNA target sequence
tcttattcttttacaaaaata

SEQ ID NO: 213273 - DNA, 21 bp, Artificial sequence
  SiRNA target sequence
cttattcttttacaaaaatat

SEQ ID NO: 213274 - DNA, 21 bp, Artificial sequence
  SiRNA target sequence
ttattcttttacaaaaatatt

SEQ ID NO: 213275 - DNA, 21 bp, Artificial sequence
  SiRNA target sequence
tattcttttacaaaaatattt

SEQ ID NO: 213276 - DNA, 21 bp, Artificial sequence
  SiRNA target sequence
attcttttacaaaaatatttg

SEQ ID NO: 213277 - DNA, 21 bp, Artificial sequence
  SiRNA target sequence
ttcttttacaaaaatatttga

SEQ ID NO: 213278 - DNA, 21 bp, Artificial sequence
  SiRNA target sequence
tcttttacaaaaatatttgat

SEQ ID NO: 213279 - DNA, 21 bp, Artificial sequence
  SiRNA target sequence
cttttacaaaaatatttgatg

SEQ ID NO: 213280 - DNA, 21 bp, Artificial sequence
  SiRNA target sequence
ttttacaaaaatatttgatgg

SEQ ID NO: 213281 - DNA, 21 bp, Artificial sequence
  SiRNA target sequence
tttacaaaaatatttgatggt

SEQ ID NO: 213282 - DNA, 21 bp, Artificial sequence
  SiRNA target sequence
ttacaaaaatatttgatggtg

SEQ ID NO: 213283 - DNA, 21 bp, Artificial sequence
  SiRNA target sequence
tacaaaaatatttgatggtgc

SEQ ID NO: 213284 - DNA, 21 bp, Artificial sequence
  SiRNA target sequence
acaaaaatatttgatggtgca

SEQ ID NO: 213285 - DNA, 21 bp, Artificial sequence
  SiRNA target sequence
caaaaatatttgatggtgcat

SEQ ID NO: 213286 - DNA, 21 bp, Artificial sequence
  SiRNA target sequence
aaaaatatttgatggtgcatt

SEQ ID NO: 213287 - DNA, 21 bp, Artificial sequence
  SiRNA target sequence
aaaatatttgatggtgcattg

SEQ ID NO: 213288 - DNA, 21 bp, Artificial sequence
  SiRNA target sequence
aaatatttgatggtgcattgt

SEQ ID NO: 213289 - DNA, 21 bp, Artificial sequence
  SiRNA target sequence
aatatttgatggtgcattgtt

SEQ ID NO: 213290 - DNA, 21 bp, Artificial sequence
  SiRNA target sequence
atatttgatggtgcattgtta

SEQ ID NO: 213291 - DNA, 21 bp, Artificial sequence
  SiRNA target sequence
tatttgatggtgcattgttaa

SEQ ID NO: 213292 - DNA, 21 bp, Artificial sequence
  SiRNA target sequence
atttgatggtgcattgttaat

SEQ ID NO: 213293 - DNA, 21 bp, Artificial sequence
  SiRNA target sequence
tttgatggtgcattgttaata

SEQ ID NO: 213294 - DNA, 21 bp, Artificial sequence
  SiRNA target sequence
ttgatggtgcattgttaatat

SEQ ID NO: 213295 - DNA, 21 bp, Artificial sequence
  SiRNA target sequence
tgatggtgcattgttaatatt

SEQ ID NO: 213296 - DNA, 21 bp, Artificial sequence
  SiRNA target sequence
gatggtgcattgttaatattt

SEQ ID NO: 213297 - DNA, 21 bp, Artificial sequence
  SiRNA target sequence
atggtgcattgttaatatttg

SEQ ID NO: 213298 - DNA, 21 bp, Artificial sequence
  SiRNA target sequence
tggtgcattgttaatatttgc

SEQ ID NO: 213299 - DNA, 21 bp, Artificial sequence
  SiRNA target sequence
ggtgcattgttaatatttgct

SEQ ID NO: 213300 - DNA, 21 bp, Artificial sequence
  SiRNA target sequence
gtgcattgttaatatttgctt

SEQ ID NO: 213301 - DNA, 21 bp, Artificial sequence
  SiRNA target sequence
tgcattgttaatatttgcttt

SEQ ID NO: 213302 - DNA, 21 bp, Artificial sequence
  SiRNA target sequence
gcattgttaatatttgctttt

SEQ ID NO: 213303 - DNA, 21 bp, Artificial sequence
  SiRNA target sequence
cattgttaatatttgcttttc

SEQ ID NO: 213304 - DNA, 21 bp, Artificial sequence
  SiRNA target sequence
attgttaatatttgcttttct

SEQ ID NO: 213305 - DNA, 21 bp, Artificial sequence
  SiRNA target sequence
ttgttaatatttgcttttctt

SEQ ID NO: 213306 - DNA, 21 bp, Artificial sequence
  SiRNA target sequence
tgttaatatttgcttttcttt

SEQ ID NO: 213307 - DNA, 21 bp, Artificial sequence
  SiRNA target sequence
gttaatatttgcttttcttta

SEQ ID NO: 213308 - DNA, 21 bp, Artificial sequence
  SiRNA target sequence
ttaatatttgcttttctttat

SEQ ID NO: 213309 - DNA, 21 bp, Artificial sequence
  SiRNA target sequence
taatatttgcttttctttata

SEQ ID NO: 213310 - DNA, 21 bp, Artificial sequence
  SiRNA target sequence
aatatttgcttttctttatat

SEQ ID NO: 213311 - DNA, 21 bp, Artificial sequence
  SiRNA target sequence
atatttgcttttctttatatc

SEQ ID NO: 213312 - DNA, 21 bp, Artificial sequence
  SiRNA target sequence
tatttgcttttctttatatca

SEQ ID NO: 213313 - DNA, 21 bp, Artificial sequence
  SiRNA target sequence
atttgcttttctttatatcat

SEQ ID NO: 213314 - DNA, 21 bp, Artificial sequence
  SiRNA target sequence
tttgcttttctttatatcatt

SEQ ID NO: 213315 - DNA, 21 bp, Artificial sequence
  SiRNA target sequence
ttgcttttctttatatcattc

SEQ ID NO: 213316 - DNA, 21 bp, Artificial sequence
  SiRNA target sequence
tgcttttctttatatcattct

SEQ ID NO: 213317 - DNA, 21 bp, Artificial sequence
  SiRNA target sequence
gcttttctttatatcattctt

SEQ ID NO: 213318 - DNA, 21 bp, Artificial sequence
  SiRNA target sequence
cttttctttatatcattcttg

SEQ ID NO: 213319 - DNA, 21 bp, Artificial sequence
  SiRNA target sequence
ttttctttatatcattcttgg

SEQ ID NO: 213320 - DNA, 21 bp, Artificial sequence
  SiRNA target sequence
tttctttatatcattcttggt

SEQ ID NO: 213321 - DNA, 21 bp, Artificial sequence
  SiRNA target sequence
ttctttatatcattcttggtc

SEQ ID NO: 213322 - DNA, 21 bp, Artificial sequence
  SiRNA target sequence
tctttatatcattcttggtct

SEQ ID NO: 213323 - DNA, 21 bp, Artificial sequence
  SiRNA target sequence
ctttatatcattcttggtcta

SEQ ID NO: 213324 - DNA, 21 bp, Artificial sequence
  SiRNA target sequence
tttatatcattcttggtctag

SEQ ID NO: 213325 - DNA, 21 bp, Artificial sequence
  SiRNA target sequence
ttatatcattcttggtctagt

SEQ ID NO: 213326 - DNA, 21 bp, Artificial sequence
  SiRNA target sequence
tatatcattcttggtctagtt

SEQ ID NO: 213327 - DNA, 21 bp, Artificial sequence
  SiRNA target sequence
atatcattcttggtctagttc

SEQ ID NO: 213328 - DNA, 21 bp, Artificial sequence
  SiRNA target sequence
tatcattcttggtctagttct

SEQ ID NO: 213329 - DNA, 21 bp, Artificial sequence
  SiRNA target sequence
atcattcttggtctagttctt

SEQ ID NO: 213330 - DNA, 21 bp, Artificial sequence
  SiRNA target sequence
tcattcttggtctagttcttc

SEQ ID NO: 213331 - DNA, 21 bp, Artificial sequence
  SiRNA target sequence
cattcttggtctagttcttct

SEQ ID NO: 213332 - DNA, 21 bp, Artificial sequence
  SiRNA target sequence
attcttggtctagttcttctt

SEQ ID NO: 213333 - DNA, 21 bp, Artificial sequence
  SiRNA target sequence
ttcttggtctagttcttcttc

SEQ ID NO: 213334 - DNA, 21 bp, Artificial sequence
  SiRNA target sequence
tcttggtctagttcttcttcc

SEQ ID NO: 213335 - DNA, 21 bp, Artificial sequence
  SiRNA target sequence
cttggtctagttcttcttcca

SEQ ID NO: 213336 - DNA, 21 bp, Artificial sequence
  SiRNA target sequence
ttggtctagttcttcttccat

SEQ ID NO: 213337 - DNA, 21 bp, Artificial sequence
  SiRNA target sequence
tggtctagttcttcttccata

SEQ ID NO: 213338 - DNA, 21 bp, Artificial sequence
  SiRNA target sequence
ggtctagttcttcttccatat

SEQ ID NO: 213339 - DNA, 21 bp, Artificial sequence
  SiRNA target sequence
gtctagttcttcttccatatt

SEQ ID NO: 213340 - DNA, 21 bp, Artificial sequence
  SiRNA target sequence
tctagttcttcttccatattc

SEQ ID NO: 213341 - DNA, 21 bp, Artificial sequence
  SiRNA target sequence
ctagttcttcttccatattct

SEQ ID NO: 213342 - DNA, 21 bp, Artificial sequence
  SiRNA target sequence
tagttcttcttccatattctc

SEQ ID NO: 213343 - DNA, 21 bp, Artificial sequence
  SiRNA target sequence
agttcttcttccatattctca

SEQ ID NO: 213344 - DNA, 21 bp, Artificial sequence
  SiRNA target sequence
gttcttcttccatattctcat

SEQ ID NO: 213345 - DNA, 21 bp, Artificial sequence
  SiRNA target sequence
ttcttcttccatattctcatc

SEQ ID NO: 213346 - DNA, 21 bp, Artificial sequence
  SiRNA target sequence
tcttcttccatattctcatct

SEQ ID NO: 213347 - DNA, 21 bp, Artificial sequence
  SiRNA target sequence
cttcttccatattctcatctt

SEQ ID NO: 213348 - DNA, 21 bp, Artificial sequence
  SiRNA target sequence
ttcttccatattctcatcttt

SEQ ID NO: 213349 - DNA, 21 bp, Artificial sequence
  SiRNA target sequence
tcttccatattctcatctttt

SEQ ID NO: 213350 - DNA, 21 bp, Artificial sequence
  SiRNA target sequence
cttccatattctcatcttttc

SEQ ID NO: 213351 - DNA, 21 bp, Artificial sequence
  SiRNA target sequence
ttccatattctcatcttttcc

SEQ ID NO: 213352 - DNA, 21 bp, Artificial sequence
  SiRNA target sequence
tccatattctcatcttttcca

SEQ ID NO: 213353 - DNA, 21 bp, Artificial sequence
  SiRNA target sequence
ccatattctcatcttttccag

SEQ ID NO: 213354 - DNA, 21 bp, Artificial sequence
  SiRNA target sequence
catattctcatcttttccagc

SEQ ID NO: 213355 - DNA, 21 bp, Artificial sequence
  SiRNA target sequence
atattctcatcttttccagct

SEQ ID NO: 213356 - DNA, 21 bp, Artificial sequence
  SiRNA target sequence
tattctcatcttttccagctt

SEQ ID NO: 213357 - DNA, 21 bp, Artificial sequence
  SiRNA target sequence
attctcatcttttccagcttg

SEQ ID NO: 213358 - DNA, 21 bp, Artificial sequence
  SiRNA target sequence
ttctcatcttttccagcttga

SEQ ID NO: 213359 - DNA, 21 bp, Artificial sequence
  SiRNA target sequence
tctcatcttttccagcttgat

SEQ ID NO: 213360 - DNA, 21 bp, Artificial sequence
  SiRNA target sequence
ctcatcttttccagcttgata

SEQ ID NO: 213361 - DNA, 21 bp, Artificial sequence
  SiRNA target sequence
tcatcttttccagcttgatag

SEQ ID NO: 213362 - DNA, 21 bp, Artificial sequence
  SiRNA target sequence
catcttttccagcttgatagt

SEQ ID NO: 213363 - DNA, 21 bp, Artificial sequence
  SiRNA target sequence
atcttttccagcttgatagtt

SEQ ID NO: 213364 - DNA, 21 bp, Artificial sequence
  SiRNA target sequence
tcttttccagcttgatagtta

SEQ ID NO: 213365 - DNA, 21 bp, Artificial sequence
  SiRNA target sequence
cttttccagcttgatagttat

SEQ ID NO: 213366 - DNA, 21 bp, Artificial sequence
  SiRNA target sequence
ttttccagcttgatagttatt

SEQ ID NO: 213367 - DNA, 21 bp, Artificial sequence
  SiRNA target sequence
tttccagcttgatagttattt

SEQ ID NO: 213368 - DNA, 21 bp, Artificial sequence
  SiRNA target sequence
ttccagcttgatagttatttt

SEQ ID NO: 213369 - DNA, 21 bp, Artificial sequence
  SiRNA target sequence
tccagcttgatagttattttt

SEQ ID NO: 213370 - DNA, 21 bp, Artificial sequence
  SiRNA target sequence
ccagcttgatagttatttttt

SEQ ID NO: 213371 - DNA, 21 bp, Artificial sequence
  SiRNA target sequence
cagcttgatagttattttttt

SEQ ID NO: 213372 - DNA, 21 bp, Artificial sequence
  SiRNA target sequence
agcttgatagttattttttta

SEQ ID NO: 213373 - DNA, 21 bp, Artificial sequence
  SiRNA target sequence
gcttgatagttatttttttag

SEQ ID NO: 213374 - DNA, 21 bp, Artificial sequence
  SiRNA target sequence
cttgatagttatttttttaga

SEQ ID NO: 213375 - DNA, 21 bp, Artificial sequence
  SiRNA target sequence
ttgatagttatttttttagag

SEQ ID NO: 213376 - DNA, 21 bp, Artificial sequence
  SiRNA target sequence
tgatagttatttttttagaga

SEQ ID NO: 213377 - DNA, 21 bp, Artificial sequence
  SiRNA target sequence
gatagttatttttttagagac

SEQ ID NO: 213378 - DNA, 21 bp, Artificial sequence
  SiRNA target sequence
atagttatttttttagagacc

SEQ ID NO: 213379 - DNA, 21 bp, Artificial sequence
  SiRNA target sequence
tagttatttttttagagacct

SEQ ID NO: 213380 - DNA, 21 bp, Artificial sequence
  SiRNA target sequence
agttatttttttagagacctt

SEQ ID NO: 213381 - DNA, 21 bp, Artificial sequence
  SiRNA target sequence
gttatttttttagagaccttt

SEQ ID NO: 213382 - DNA, 21 bp, Artificial sequence
  SiRNA target sequence
ttatttttttagagacctttt

SEQ ID NO: 213383 - DNA, 21 bp, Artificial sequence
  SiRNA target sequence
tatttttttagagaccttttt

SEQ ID NO: 213384 - DNA, 21 bp, Artificial sequence
  SiRNA target sequence
atttttttagagaccttttta

SEQ ID NO: 213385 - DNA, 21 bp, Artificial sequence
  SiRNA target sequence
tttttttagagacctttttag

SEQ ID NO: 213386 - DNA, 21 bp, Artificial sequence
  SiRNA target sequence
ttttttagagacctttttagt

SEQ ID NO: 213387 - DNA, 21 bp, Artificial sequence
  SiRNA target sequence
tttttagagacctttttagtg

SEQ ID NO: 213388 - DNA, 21 bp, Artificial sequence
  SiRNA target sequence
ttttagagacctttttagtga

SEQ ID NO: 213389 - DNA, 21 bp, Artificial sequence
  SiRNA target sequence
tttagagacctttttagtgat

SEQ ID NO: 213390 - DNA, 21 bp, Artificial sequence
  SiRNA target sequence
ttagagacctttttagtgatg

SEQ ID NO: 213391 - DNA, 21 bp, Artificial sequence
  SiRNA target sequence
tagagacctttttagtgatgg

SEQ ID NO: 213392 - DNA, 21 bp, Artificial sequence
  SiRNA target sequence
agagacctttttagtgatggg

SEQ ID NO: 213393 - DNA, 21 bp, Artificial sequence
  SiRNA target sequence
gagacctttttagtgatggga

SEQ ID NO: 213394 - DNA, 21 bp, Artificial sequence
  SiRNA target sequence
agacctttttagtgatgggaa

SEQ ID NO: 213395 - DNA, 21 bp, Artificial sequence
  SiRNA target sequence
gacctttttagtgatgggaaa

SEQ ID NO: 213396 - DNA, 21 bp, Artificial sequence
  SiRNA target sequence
acctttttagtgatgggaaat

SEQ ID NO: 213397 - DNA, 21 bp, Artificial sequence
  SiRNA target sequence
cctttttagtgatgggaaatg

SEQ ID NO: 213398 - DNA, 21 bp, Artificial sequence
  SiRNA target sequence
ctttttagtgatgggaaatgt

SEQ ID NO: 213399 - DNA, 21 bp, Artificial sequence
  SiRNA target sequence
tttttagtgatgggaaatgtg

SEQ ID NO: 213400 - DNA, 21 bp, Artificial sequence
  SiRNA target sequence
ttttagtgatgggaaatgtgt

SEQ ID NO: 213401 - DNA, 21 bp, Artificial sequence
  SiRNA target sequence
tttagtgatgggaaatgtgtt

SEQ ID NO: 213402 - DNA, 21 bp, Artificial sequence
  SiRNA target sequence
ttagtgatgggaaatgtgttg

SEQ ID NO: 213403 - DNA, 21 bp, Artificial sequence
  SiRNA target sequence
tagtgatgggaaatgtgttgt

SEQ ID NO: 213404 - DNA, 21 bp, Artificial sequence
  SiRNA target sequence
agtgatgggaaatgtgttgta

SEQ ID NO: 213405 - DNA, 21 bp, Artificial sequence
  SiRNA target sequence
gtgatgggaaatgtgttgtaa

SEQ ID NO: 213406 - DNA, 21 bp, Artificial sequence
  SiRNA target sequence
tgatgggaaatgtgttgtaag

SEQ ID NO: 213407 - DNA, 21 bp, Artificial sequence
  SiRNA target sequence
gatgggaaatgtgttgtaaga

SEQ ID NO: 213408 - DNA, 21 bp, Artificial sequence
  SiRNA target sequence
atgggaaatgtgttgtaagag

SEQ ID NO: 213409 - DNA, 21 bp, Artificial sequence
  SiRNA target sequence
tgggaaatgtgttgtaagagg

SEQ ID NO: 213410 - DNA, 21 bp, Artificial sequence
  SiRNA target sequence
gggaaatgtgttgtaagaggc

SEQ ID NO: 213411 - DNA, 21 bp, Artificial sequence
  SiRNA target sequence
ggaaatgtgttgtaagaggct

SEQ ID NO: 213412 - DNA, 21 bp, Artificial sequence
  SiRNA target sequence
gaaatgtgttgtaagaggcta

SEQ ID NO: 213413 - DNA, 21 bp, Artificial sequence
  SiRNA target sequence
aaatgtgttgtaagaggctat

SEQ ID NO: 213414 - DNA, 21 bp, Artificial sequence
  SiRNA target sequence
aatgtgttgtaagaggctatg

SEQ ID NO: 213415 - DNA, 21 bp, Artificial sequence
  SiRNA target sequence
atgtgttgtaagaggctatga

SEQ ID NO: 213416 - DNA, 21 bp, Artificial sequence
  SiRNA target sequence
tgtgttgtaagaggctatgat

SEQ ID NO: 213417 - DNA, 21 bp, Artificial sequence
  SiRNA target sequence
gtgttgtaagaggctatgatg

SEQ ID NO: 213418 - DNA, 21 bp, Artificial sequence
  SiRNA target sequence
tgttgtaagaggctatgatgc

SEQ ID NO: 213419 - DNA, 21 bp, Artificial sequence
  SiRNA target sequence
gttgtaagaggctatgatgct

SEQ ID NO: 213420 - DNA, 21 bp, Artificial sequence
  SiRNA target sequence
ttgtaagaggctatgatgctt

SEQ ID NO: 213421 - DNA, 21 bp, Artificial sequence
  SiRNA target sequence
tgtaagaggctatgatgcttt

SEQ ID NO: 213422 - DNA, 21 bp, Artificial sequence
  SiRNA target sequence
gtaagaggctatgatgcttta

SEQ ID NO: 213423 - DNA, 21 bp, Artificial sequence
  SiRNA target sequence
taagaggctatgatgctttat

SEQ ID NO: 213424 - DNA, 21 bp, Artificial sequence
  SiRNA target sequence
aagaggctatgatgctttatt

SEQ ID NO: 213425 - DNA, 21 bp, Artificial sequence
  SiRNA target sequence
agaggctatgatgctttatta

SEQ ID NO: 213426 - DNA, 21 bp, Artificial sequence
  SiRNA target sequence
gaggctatgatgctttattat

SEQ ID NO: 213427 - DNA, 21 bp, Artificial sequence
  SiRNA target sequence
aggctatgatgctttattatc

SEQ ID NO: 213428 - DNA, 21 bp, Artificial sequence
  SiRNA target sequence
ggctatgatgctttattatct

SEQ ID NO: 213429 - DNA, 21 bp, Artificial sequence
  SiRNA target sequence
gctatgatgctttattatctt

SEQ ID NO: 213430 - DNA, 21 bp, Artificial sequence
  SiRNA target sequence
ctatgatgctttattatcttt

SEQ ID NO: 213431 - DNA, 21 bp, Artificial sequence
  SiRNA target sequence
tatgatgctttattatctttg

SEQ ID NO: 213432 - DNA, 21 bp, Artificial sequence
  SiRNA target sequence
atgatgctttattatctttgg

SEQ ID NO: 213433 - DNA, 21 bp, Artificial sequence
  SiRNA target sequence
tgatgctttattatctttggc

SEQ ID NO: 213434 - DNA, 21 bp, Artificial sequence
  SiRNA target sequence
gatgctttattatctttggca

SEQ ID NO: 213435 - DNA, 21 bp, Artificial sequence
  SiRNA target sequence
atgctttattatctttggcac

SEQ ID NO: 213436 - DNA, 21 bp, Artificial sequence
  SiRNA target sequence
tgctttattatctttggcact

SEQ ID NO: 213437 - DNA, 21 bp, Artificial sequence
  SiRNA target sequence
gctttattatctttggcactg

SEQ ID NO: 213438 - DNA, 21 bp, Artificial sequence
  SiRNA target sequence
ctttattatctttggcactgg

SEQ ID NO: 213439 - DNA, 21 bp, Artificial sequence
  SiRNA target sequence
tttattatctttggcactggt

SEQ ID NO: 213440 - DNA, 21 bp, Artificial sequence
  SiRNA target sequence
ttattatctttggcactggtc

SEQ ID NO: 213441 - DNA, 21 bp, Artificial sequence
  SiRNA target sequence
tattatctttggcactggtct

SEQ ID NO: 213442 - DNA, 21 bp, Artificial sequence
  SiRNA target sequence
attatctttggcactggtctt

SEQ ID NO: 213443 - DNA, 21 bp, Artificial sequence
  SiRNA target sequence
ttatctttggcactggtcttt

SEQ ID NO: 213444 - DNA, 21 bp, Artificial sequence
  SiRNA target sequence
tatctttggcactggtcttta

SEQ ID NO: 213445 - DNA, 21 bp, Artificial sequence
  SiRNA target sequence
atctttggcactggtctttaa

SEQ ID NO: 213446 - DNA, 21 bp, Artificial sequence
  SiRNA target sequence
tctttggcactggtctttaac

SEQ ID NO: 213447 - DNA, 21 bp, Artificial sequence
  SiRNA target sequence
ctttggcactggtctttaacg

SEQ ID NO: 213448 - DNA, 21 bp, Artificial sequence
  SiRNA target sequence
tttggcactggtctttaacga

SEQ ID NO: 213449 - DNA, 21 bp, Artificial sequence
  SiRNA target sequence
ttggcactggtctttaacgaa

SEQ ID NO: 213450 - DNA, 21 bp, Artificial sequence
  SiRNA target sequence
tggcactggtctttaacgaat

SEQ ID NO: 213451 - DNA, 21 bp, Artificial sequence
  SiRNA target sequence
ggcactggtctttaacgaatg

SEQ ID NO: 213452 - DNA, 21 bp, Artificial sequence
  SiRNA target sequence
gcactggtctttaacgaatgg

SEQ ID NO: 213453 - DNA, 21 bp, Artificial sequence
  SiRNA target sequence
cactggtctttaacgaatgga

SEQ ID NO: 213454 - DNA, 21 bp, Artificial sequence
  SiRNA target sequence
actggtctttaacgaatggac

SEQ ID NO: 213455 - DNA, 21 bp, Artificial sequence
  SiRNA target sequence
ctggtctttaacgaatggaca

SEQ ID NO: 213456 - DNA, 21 bp, Artificial sequence
  SiRNA target sequence
tggtctttaacgaatggacat

SEQ ID NO: 213457 - DNA, 21 bp, Artificial sequence
  SiRNA target sequence
ggtctttaacgaatggacatc

SEQ ID NO: 213458 - DNA, 21 bp, Artificial sequence
  SiRNA target sequence
gtctttaacgaatggacatcc

SEQ ID NO: 213459 - DNA, 21 bp, Artificial sequence
  SiRNA target sequence
tctttaacgaatggacatcct

SEQ ID NO: 213460 - DNA, 21 bp, Artificial sequence
  SiRNA target sequence
ctttaacgaatggacatcctc

SEQ ID NO: 213461 - DNA, 21 bp, Artificial sequence
  SiRNA target sequence
tttaacgaatggacatcctct

SEQ ID NO: 213462 - DNA, 21 bp, Artificial sequence
  SiRNA target sequence
ttaacgaatggacatcctctc

SEQ ID NO: 213463 - DNA, 21 bp, Artificial sequence
  SiRNA target sequence
taacgaatggacatcctctct

SEQ ID NO: 213464 - DNA, 21 bp, Artificial sequence
  SiRNA target sequence
aacgaatggacatcctctcta

SEQ ID NO: 213465 - DNA, 21 bp, Artificial sequence
  SiRNA target sequence
acgaatggacatcctctctag

SEQ ID NO: 213466 - DNA, 21 bp, Artificial sequence
  SiRNA target sequence
cgaatggacatcctctctagt

SEQ ID NO: 213467 - DNA, 21 bp, Artificial sequence
  SiRNA target sequence
gaatggacatcctctctagtt

SEQ ID NO: 213468 - DNA, 21 bp, Artificial sequence
  SiRNA target sequence
aatggacatcctctctagttt

SEQ ID NO: 213469 - DNA, 21 bp, Artificial sequence
  SiRNA target sequence
atggacatcctctctagttta

SEQ ID NO: 213470 - DNA, 21 bp, Artificial sequence
  SiRNA target sequence
tggacatcctctctagtttac

SEQ ID NO: 213471 - DNA, 21 bp, Artificial sequence
  SiRNA target sequence
ggacatcctctctagtttaca

SEQ ID NO: 213472 - DNA, 21 bp, Artificial sequence
  SiRNA target sequence
gacatcctctctagtttacat

SEQ ID NO: 213473 - DNA, 21 bp, Artificial sequence
  SiRNA target sequence
acatcctctctagtttacatt

SEQ ID NO: 213474 - DNA, 21 bp, Artificial sequence
  SiRNA target sequence
catcctctctagtttacattg

SEQ ID NO: 213475 - DNA, 21 bp, Artificial sequence
  SiRNA target sequence
atcctctctagtttacattgt

SEQ ID NO: 213476 - DNA, 21 bp, Artificial sequence
  SiRNA target sequence
tcctctctagtttacattgtt

SEQ ID NO: 213477 - DNA, 21 bp, Artificial sequence
  SiRNA target sequence
cctctctagtttacattgttt

SEQ ID NO: 213478 - DNA, 21 bp, Artificial sequence
  SiRNA target sequence
ctctctagtttacattgtttc

SEQ ID NO: 213479 - DNA, 21 bp, Artificial sequence
  SiRNA target sequence
tctctagtttacattgtttca

SEQ ID NO: 213480 - DNA, 21 bp, Artificial sequence
  SiRNA target sequence
ctctagtttacattgtttcag

SEQ ID NO: 213481 - DNA, 21 bp, Artificial sequence
  SiRNA target sequence
tctagtttacattgtttcaga

SEQ ID NO: 213482 - DNA, 21 bp, Artificial sequence
  SiRNA target sequence
ctagtttacattgtttcagaa

SEQ ID NO: 213483 - DNA, 21 bp, Artificial sequence
  SiRNA target sequence
tagtttacattgtttcagaaa

SEQ ID NO: 213484 - DNA, 21 bp, Artificial sequence
  SiRNA target sequence
agtttacattgtttcagaaat

SEQ ID NO: 213485 - DNA, 21 bp, Artificial sequence
  SiRNA target sequence
gtttacattgtttcagaaatg

SEQ ID NO: 213486 - DNA, 21 bp, Artificial sequence
  SiRNA target sequence
tttacattgtttcagaaatgt

SEQ ID NO: 213487 - DNA, 21 bp, Artificial sequence
  SiRNA target sequence
ttacattgtttcagaaatgtt

SEQ ID NO: 213488 - DNA, 21 bp, Artificial sequence
  SiRNA target sequence
tacattgtttcagaaatgttt

SEQ ID NO: 213489 - DNA, 21 bp, Artificial sequence
  SiRNA target sequence
acattgtttcagaaatgtttg

SEQ ID NO: 213490 - DNA, 21 bp, Artificial sequence
  SiRNA target sequence
cattgtttcagaaatgtttgg

SEQ ID NO: 213491 - DNA, 21 bp, Artificial sequence
  SiRNA target sequence
attgtttcagaaatgtttggt

SEQ ID NO: 213492 - DNA, 21 bp, Artificial sequence
  SiRNA target sequence
ttgtttcagaaatgtttggta

SEQ ID NO: 213493 - DNA, 21 bp, Artificial sequence
  SiRNA target sequence
tgtttcagaaatgtttggtaa

SEQ ID NO: 213494 - DNA, 21 bp, Artificial sequence
  SiRNA target sequence
gtttcagaaatgtttggtaat

SEQ ID NO: 213495 - DNA, 21 bp, Artificial sequence
  SiRNA target sequence
tttcagaaatgtttggtaatt

SEQ ID NO: 213496 - DNA, 21 bp, Artificial sequence
  SiRNA target sequence
ttcagaaatgtttggtaattt

SEQ ID NO: 213497 - DNA, 21 bp, Artificial sequence
  SiRNA target sequence
tcagaaatgtttggtaattta

SEQ ID NO: 213498 - DNA, 21 bp, Artificial sequence
  SiRNA target sequence
cagaaatgtttggtaatttag

SEQ ID NO: 213499 - DNA, 21 bp, Artificial sequence
  SiRNA target sequence
agaaatgtttggtaatttagt

SEQ ID NO: 213500 - DNA, 21 bp, Artificial sequence
  SiRNA target sequence
gaaatgtttggtaatttagta

SEQ ID NO: 213501 - DNA, 21 bp, Artificial sequence
  SiRNA target sequence
aaatgtttggtaatttagtat

SEQ ID NO: 213502 - DNA, 21 bp, Artificial sequence
  SiRNA target sequence
aatgtttggtaatttagtatt

SEQ ID NO: 213503 - DNA, 21 bp, Artificial sequence
  SiRNA target sequence
atgtttggtaatttagtattg

SEQ ID NO: 213504 - DNA, 21 bp, Artificial sequence
  SiRNA target sequence
tgtttggtaatttagtattgt

SEQ ID NO: 213505 - DNA, 21 bp, Artificial sequence
  SiRNA target sequence
gtttggtaatttagtattgtc

SEQ ID NO: 213506 - DNA, 21 bp, Artificial sequence
  SiRNA target sequence
tttggtaatttagtattgtct

SEQ ID NO: 213507 - DNA, 21 bp, Artificial sequence
  SiRNA target sequence
ttggtaatttagtattgtctt

SEQ ID NO: 213508 - DNA, 21 bp, Artificial sequence
  SiRNA target sequence
tggtaatttagtattgtctta

SEQ ID NO: 213509 - DNA, 21 bp, Artificial sequence
  SiRNA target sequence
ggtaatttagtattgtcttat

SEQ ID NO: 213510 - DNA, 21 bp, Artificial sequence
  SiRNA target sequence
gtaatttagtattgtcttatt

SEQ ID NO: 213511 - DNA, 21 bp, Artificial sequence
  SiRNA target sequence
taatttagtattgtcttattt

SEQ ID NO: 213512 - DNA, 21 bp, Artificial sequence
  SiRNA target sequence
aatttagtattgtcttatttc

SEQ ID NO: 213513 - DNA, 21 bp, Artificial sequence
  SiRNA target sequence
atttagtattgtcttatttct

SEQ ID NO: 213514 - DNA, 21 bp, Artificial sequence
  SiRNA target sequence
tttagtattgtcttatttctt

SEQ ID NO: 213515 - DNA, 21 bp, Artificial sequence
  SiRNA target sequence
ttagtattgtcttatttcttc

SEQ ID NO: 213516 - DNA, 21 bp, Artificial sequence
  SiRNA target sequence
tagtattgtcttatttcttct

SEQ ID NO: 213517 - DNA, 21 bp, Artificial sequence
  SiRNA target sequence
agtattgtcttatttcttctt

SEQ ID NO: 213518 - DNA, 21 bp, Artificial sequence
  SiRNA target sequence
gtattgtcttatttcttcttg

SEQ ID NO: 213519 - DNA, 21 bp, Artificial sequence
  SiRNA target sequence
tattgtcttatttcttcttga

SEQ ID NO: 213520 - DNA, 21 bp, Artificial sequence
  SiRNA target sequence
attgtcttatttcttcttgac

SEQ ID NO: 213521 - DNA, 21 bp, Artificial sequence
  SiRNA target sequence
ttgtcttatttcttcttgacg

SEQ ID NO: 213522 - DNA, 21 bp, Artificial sequence
  SiRNA target sequence
tgtcttatttcttcttgacgt

SEQ ID NO: 213523 - DNA, 21 bp, Artificial sequence
  SiRNA target sequence
gtcttatttcttcttgacgtt

SEQ ID NO: 213524 - DNA, 21 bp, Artificial sequence
  SiRNA target sequence
tcttatttcttcttgacgttt

SEQ ID NO: 213525 - DNA, 21 bp, Artificial sequence
  SiRNA target sequence
cttatttcttcttgacgtttg

SEQ ID NO: 213526 - DNA, 21 bp, Artificial sequence
  SiRNA target sequence
ttatttcttcttgacgtttgc

SEQ ID NO: 213527 - DNA, 21 bp, Artificial sequence
  SiRNA target sequence
tatttcttcttgacgtttgct

SEQ ID NO: 213528 - DNA, 21 bp, Artificial sequence
  SiRNA target sequence
atttcttcttgacgtttgcta

SEQ ID NO: 213529 - DNA, 21 bp, Artificial sequence
  SiRNA target sequence
tttcttcttgacgtttgctaa

SEQ ID NO: 213530 - DNA, 21 bp, Artificial sequence
  SiRNA target sequence
ttcttcttgacgtttgctaat

SEQ ID NO: 213531 - DNA, 21 bp, Artificial sequence
  SiRNA target sequence
tcttcttgacgtttgctaatt

SEQ ID NO: 213532 - DNA, 21 bp, Artificial sequence
  SiRNA target sequence
cttcttgacgtttgctaattc

SEQ ID NO: 213533 - DNA, 21 bp, Artificial sequence
  SiRNA target sequence
ttcttgacgtttgctaattct

SEQ ID NO: 213534 - DNA, 21 bp, Artificial sequence
  SiRNA target sequence
tcttgacgtttgctaattctt

SEQ ID NO: 213535 - DNA, 21 bp, Artificial sequence
  SiRNA target sequence
cttgacgtttgctaattcttt

SEQ ID NO: 213536 - DNA, 21 bp, Artificial sequence
  SiRNA target sequence
ttgacgtttgctaattcttta

SEQ ID NO: 213537 - DNA, 21 bp, Artificial sequence
  SiRNA target sequence
tgacgtttgctaattctttaa

SEQ ID NO: 213538 - DNA, 21 bp, Artificial sequence
  SiRNA target sequence
gacgtttgctaattctttaac

SEQ ID NO: 213539 - DNA, 21 bp, Artificial sequence
  SiRNA target sequence
acgtttgctaattctttaaca

SEQ ID NO: 213540 - DNA, 21 bp, Artificial sequence
  SiRNA target sequence
cgtttgctaattctttaacaa

SEQ ID NO: 213541 - DNA, 21 bp, Artificial sequence
  SiRNA target sequence
gtttgctaattctttaacaac

SEQ ID NO: 213542 - DNA, 21 bp, Artificial sequence
  SiRNA target sequence
tttgctaattctttaacaact

SEQ ID NO: 213543 - DNA, 21 bp, Artificial sequence
  SiRNA target sequence
ttgctaattctttaacaactc

SEQ ID NO: 213544 - DNA, 21 bp, Artificial sequence
  SiRNA target sequence
tgctaattctttaacaactcc

SEQ ID NO: 213545 - DNA, 21 bp, Artificial sequence
  SiRNA target sequence
gctaattctttaacaactcca

SEQ ID NO: 213546 - DNA, 21 bp, Artificial sequence
  SiRNA target sequence
ctaattctttaacaactccag

SEQ ID NO: 213547 - DNA, 21 bp, Artificial sequence
  SiRNA target sequence
taattctttaacaactccagg

SEQ ID NO: 213548 - DNA, 21 bp, Artificial sequence
  SiRNA target sequence
aattctttaacaactccagga

SEQ ID NO: 213549 - DNA, 21 bp, Artificial sequence
  SiRNA target sequence
attctttaacaactccaggac

SEQ ID NO: 213550 - DNA, 21 bp, Artificial sequence
  SiRNA target sequence
ttctttaacaactccaggaca

SEQ ID NO: 213551 - DNA, 21 bp, Artificial sequence
  SiRNA target sequence
tctttaacaactccaggacaa

SEQ ID NO: 213552 - DNA, 21 bp, Artificial sequence
  SiRNA target sequence
ctttaacaactccaggacaaa

SEQ ID NO: 213553 - DNA, 21 bp, Artificial sequence
  SiRNA target sequence
tttaacaactccaggacaaag

SEQ ID NO: 213554 - DNA, 21 bp, Artificial sequence
  SiRNA target sequence
ttaacaactccaggacaaagt

SEQ ID NO: 213555 - DNA, 21 bp, Artificial sequence
  SiRNA target sequence
taacaactccaggacaaagtg

SEQ ID NO: 213556 - DNA, 21 bp, Artificial sequence
  SiRNA target sequence
aacaactccaggacaaagtgc

SEQ ID NO: 213557 - DNA, 21 bp, Artificial sequence
  SiRNA target sequence
acaactccaggacaaagtgca

SEQ ID NO: 213558 - DNA, 21 bp, Artificial sequence
  SiRNA target sequence
caactccaggacaaagtgcaa

SEQ ID NO: 213559 - DNA, 21 bp, Artificial sequence
  SiRNA target sequence
aactccaggacaaagtgcaag

SEQ ID NO: 213560 - DNA, 21 bp, Artificial sequence
  SiRNA target sequence
actccaggacaaagtgcaaga

SEQ ID NO: 213561 - DNA, 21 bp, Artificial sequence
  SiRNA target sequence
ctccaggacaaagtgcaagat

SEQ ID NO: 213562 - DNA, 21 bp, Artificial sequence
  SiRNA target sequence
tccaggacaaagtgcaagatt

SEQ ID NO: 213563 - DNA, 21 bp, Artificial sequence
  SiRNA target sequence
ccaggacaaagtgcaagattc

SEQ ID NO: 213564 - DNA, 21 bp, Artificial sequence
  SiRNA target sequence
caggacaaagtgcaagattca

SEQ ID NO: 213565 - DNA, 21 bp, Artificial sequence
  SiRNA target sequence
aggacaaagtgcaagattcat

SEQ ID NO: 213566 - DNA, 21 bp, Artificial sequence
  SiRNA target sequence
ggacaaagtgcaagattcata

SEQ ID NO: 213567 - DNA, 21 bp, Artificial sequence
  SiRNA target sequence
gacaaagtgcaagattcatac

SEQ ID NO: 213568 - DNA, 21 bp, Artificial sequence
  SiRNA target sequence
acaaagtgcaagattcatacc

SEQ ID NO: 213569 - DNA, 21 bp, Artificial sequence
  SiRNA target sequence
caaagtgcaagattcatacct

SEQ ID NO: 213570 - DNA, 21 bp, Artificial sequence
  SiRNA target sequence
aaagtgcaagattcatacctt

SEQ ID NO: 213571 - DNA, 21 bp, Artificial sequence
  SiRNA target sequence
aagtgcaagattcataccttt

SEQ ID NO: 213572 - DNA, 21 bp, Artificial sequence
  SiRNA target sequence
agtgcaagattcataccttta

SEQ ID NO: 213573 - DNA, 21 bp, Artificial sequence
  SiRNA target sequence
gtgcaagattcatacctttat

SEQ ID NO: 213574 - DNA, 21 bp, Artificial sequence
  SiRNA target sequence
tgcaagattcatacctttatt

SEQ ID NO: 213575 - DNA, 21 bp, Artificial sequence
  SiRNA target sequence
gcaagattcatacctttattt

SEQ ID NO: 213576 - DNA, 21 bp, Artificial sequence
  SiRNA target sequence
caagattcatacctttatttt

SEQ ID NO: 213577 - DNA, 21 bp, Artificial sequence
  SiRNA target sequence
aagattcatacctttatttta

SEQ ID NO: 213578 - DNA, 21 bp, Artificial sequence
  SiRNA target sequence
agattcatacctttattttat

SEQ ID NO: 213579 - DNA, 21 bp, Artificial sequence
  SiRNA target sequence
gattcatacctttattttatg

SEQ ID NO: 213580 - DNA, 21 bp, Artificial sequence
  SiRNA target sequence
attcatacctttattttatgt

SEQ ID NO: 213581 - DNA, 21 bp, Artificial sequence
  SiRNA target sequence
ttcatacctttattttatgtt

SEQ ID NO: 213582 - DNA, 21 bp, Artificial sequence
  SiRNA target sequence
tcatacctttattttatgttt

SEQ ID NO: 213583 - DNA, 21 bp, Artificial sequence
  SiRNA target sequence
catacctttattttatgtttt

SEQ ID NO: 213584 - DNA, 21 bp, Artificial sequence
  SiRNA target sequence
atacctttattttatgttttc

SEQ ID NO: 213585 - DNA, 21 bp, Artificial sequence
  SiRNA target sequence
tacctttattttatgttttct

SEQ ID NO: 213586 - DNA, 21 bp, Artificial sequence
  SiRNA target sequence
acctttattttatgttttctc

SEQ ID NO: 213587 - DNA, 21 bp, Artificial sequence
  SiRNA target sequence
cctttattttatgttttctcg

SEQ ID NO: 213588 - DNA, 21 bp, Artificial sequence
  SiRNA target sequence
ctttattttatgttttctcga

SEQ ID NO: 213589 - DNA, 21 bp, Artificial sequence
  SiRNA target sequence
tttattttatgttttctcgaa

SEQ ID NO: 213590 - DNA, 21 bp, Artificial sequence
  SiRNA target sequence
ttattttatgttttctcgaat

SEQ ID NO: 213591 - DNA, 21 bp, Artificial sequence
  SiRNA target sequence
tattttatgttttctcgaata

SEQ ID NO: 213592 - DNA, 21 bp, Artificial sequence
  SiRNA target sequence
attttatgttttctcgaatat

SEQ ID NO: 213593 - DNA, 21 bp, Artificial sequence
  SiRNA target sequence
ttttatgttttctcgaatatt

SEQ ID NO: 213594 - DNA, 21 bp, Artificial sequence
  SiRNA target sequence
tttatgttttctcgaatattt

SEQ ID NO: 213595 - DNA, 21 bp, Artificial sequence
  SiRNA target sequence
ttatgttttctcgaatatttc

SEQ ID NO: 213596 - DNA, 21 bp, Artificial sequence
  SiRNA target sequence
tatgttttctcgaatatttct

SEQ ID NO: 213597 - DNA, 21 bp, Artificial sequence
  SiRNA target sequence
atgttttctcgaatatttctc

SEQ ID NO: 213598 - DNA, 21 bp, Artificial sequence
  SiRNA target sequence
tgttttctcgaatatttctct

SEQ ID NO: 213599 - DNA, 21 bp, Artificial sequence
  SiRNA target sequence
gttttctcgaatatttctctt

SEQ ID NO: 213600 - DNA, 21 bp, Artificial sequence
  SiRNA target sequence
ttttctcgaatatttctcttt

SEQ ID NO: 213601 - DNA, 21 bp, Artificial sequence
  SiRNA target sequence
tttctcgaatatttctctttt

SEQ ID NO: 213602 - DNA, 21 bp, Artificial sequence
  SiRNA target sequence
ttctcgaatatttctcttttc

SEQ ID NO: 213603 - DNA, 21 bp, Artificial sequence
  SiRNA target sequence
tctcgaatatttctcttttct

SEQ ID NO: 213604 - DNA, 21 bp, Artificial sequence
  SiRNA target sequence
ctcgaatatttctcttttctt

SEQ ID NO: 213605 - DNA, 21 bp, Artificial sequence
  SiRNA target sequence
tcgaatatttctcttttctta

SEQ ID NO: 213606 - DNA, 21 bp, Artificial sequence
  SiRNA target sequence
cgaatatttctcttttcttat

SEQ ID NO: 213607 - DNA, 21 bp, Artificial sequence
  SiRNA target sequence
gaatatttctcttttcttatc

SEQ ID NO: 213608 - DNA, 21 bp, Artificial sequence
  SiRNA target sequence
aatatttctcttttcttatct

SEQ ID NO: 213609 - DNA, 21 bp, Artificial sequence
  SiRNA target sequence
atatttctcttttcttatctt

SEQ ID NO: 213610 - DNA, 21 bp, Artificial sequence
  SiRNA target sequence
tatttctcttttcttatcttc

SEQ ID NO: 213611 - DNA, 21 bp, Artificial sequence
  SiRNA target sequence
atttctcttttcttatcttct

SEQ ID NO: 213612 - DNA, 21 bp, Artificial sequence
  SiRNA target sequence
tttctcttttcttatcttctc

SEQ ID NO: 213613 - DNA, 21 bp, Artificial sequence
  SiRNA target sequence
ttctcttttcttatcttctca

SEQ ID NO: 213614 - DNA, 21 bp, Artificial sequence
  SiRNA target sequence
tctcttttcttatcttctcaa

SEQ ID NO: 213615 - DNA, 21 bp, Artificial sequence
  SiRNA target sequence
ctcttttcttatcttctcaag

SEQ ID NO: 213616 - DNA, 21 bp, Artificial sequence
  SiRNA target sequence
tcttttcttatcttctcaagt

SEQ ID NO: 213617 - DNA, 21 bp, Artificial sequence
  SiRNA target sequence
cttttcttatcttctcaagtg

SEQ ID NO: 213618 - DNA, 21 bp, Artificial sequence
  SiRNA target sequence
ttttcttatcttctcaagtga

SEQ ID NO: 213619 - DNA, 21 bp, Artificial sequence
  SiRNA target sequence
tttcttatcttctcaagtgac

SEQ ID NO: 213620 - DNA, 21 bp, Artificial sequence
  SiRNA target sequence
ttcttatcttctcaagtgaca

SEQ ID NO: 213621 - DNA, 21 bp, Artificial sequence
  SiRNA target sequence
tcttatcttctcaagtgacag

SEQ ID NO: 213622 - DNA, 21 bp, Artificial sequence
  SiRNA target sequence
cttatcttctcaagtgacaga

SEQ ID NO: 213623 - DNA, 21 bp, Artificial sequence
  SiRNA target sequence
ttatcttctcaagtgacagaa

SEQ ID NO: 213624 - DNA, 21 bp, Artificial sequence
  SiRNA target sequence
tatcttctcaagtgacagaac

SEQ ID NO: 213625 - DNA, 21 bp, Artificial sequence
  SiRNA target sequence
atcttctcaagtgacagaact

SEQ ID NO: 213626 - DNA, 21 bp, Artificial sequence
  SiRNA target sequence
tcttctcaagtgacagaactt

SEQ ID NO: 213627 - DNA, 21 bp, Artificial sequence
  SiRNA target sequence
cttctcaagtgacagaacttt

SEQ ID NO: 213628 - DNA, 21 bp, Artificial sequence
  SiRNA target sequence
ttctcaagtgacagaactttt

SEQ ID NO: 213629 - DNA, 21 bp, Artificial sequence
  SiRNA target sequence
tctcaagtgacagaacttttt

SEQ ID NO: 213630 - DNA, 21 bp, Artificial sequence
  SiRNA target sequence
ctcaagtgacagaacttttta

SEQ ID NO: 213631 - DNA, 21 bp, Artificial sequence
  SiRNA target sequence
tcaagtgacagaactttttac

SEQ ID NO: 213632 - DNA, 21 bp, Artificial sequence
  SiRNA target sequence
caagtgacagaactttttaca

SEQ ID NO: 213633 - DNA, 21 bp, Artificial sequence
  SiRNA target sequence
aagtgacagaactttttacaa

SEQ ID NO: 213634 - DNA, 21 bp, Artificial sequence
  SiRNA target sequence
agtgacagaactttttacaag

SEQ ID NO: 213635 - DNA, 21 bp, Artificial sequence
  SiRNA target sequence
gtgacagaactttttacaaga

SEQ ID NO: 213636 - DNA, 21 bp, Artificial sequence
  SiRNA target sequence
tgacagaactttttacaagat

SEQ ID NO: 213637 - DNA, 21 bp, Artificial sequence
  SiRNA target sequence
gacagaactttttacaagata

SEQ ID NO: 213638 - DNA, 21 bp, Artificial sequence
  SiRNA target sequence
acagaactttttacaagatat

SEQ ID NO: 213639 - DNA, 21 bp, Artificial sequence
  SiRNA target sequence
cagaactttttacaagatata

SEQ ID NO: 213640 - DNA, 21 bp, Artificial sequence
  SiRNA target sequence
agaactttttacaagatatag

SEQ ID NO: 213641 - DNA, 21 bp, Artificial sequence
  SiRNA target sequence
gaactttttacaagatataga

SEQ ID NO: 213642 - DNA, 21 bp, Artificial sequence
  SiRNA target sequence
aactttttacaagatatagat

SEQ ID NO: 213643 - DNA, 21 bp, Artificial sequence
  SiRNA target sequence
actttttacaagatatagatc

SEQ ID NO: 213644 - DNA, 21 bp, Artificial sequence
  SiRNA target sequence
ctttttacaagatatagatca

SEQ ID NO: 213645 - DNA, 21 bp, Artificial sequence
  SiRNA target sequence
tttttacaagatatagatcaa

SEQ ID NO: 213646 - DNA, 21 bp, Artificial sequence
  SiRNA target sequence
ttttacaagatatagatcaaa

SEQ ID NO: 213647 - DNA, 21 bp, Artificial sequence
  SiRNA target sequence
tttacaagatatagatcaaag

SEQ ID NO: 213648 - DNA, 21 bp, Artificial sequence
  SiRNA target sequence
ttacaagatatagatcaaagc

SEQ ID NO: 213649 - DNA, 21 bp, Artificial sequence
  SiRNA target sequence
tacaagatatagatcaaagct

SEQ ID NO: 213650 - DNA, 21 bp, Artificial sequence
  SiRNA target sequence
acaagatatagatcaaagctc

SEQ ID NO: 213651 - DNA, 21 bp, Artificial sequence
  SiRNA target sequence
caagatatagatcaaagctca

SEQ ID NO: 213652 - DNA, 21 bp, Artificial sequence
  SiRNA target sequence
aagatatagatcaaagctcac

SEQ ID NO: 213653 - DNA, 21 bp, Artificial sequence
  SiRNA target sequence
agatatagatcaaagctcact

SEQ ID NO: 213654 - DNA, 21 bp, Artificial sequence
  SiRNA target sequence
gatatagatcaaagctcactt

SEQ ID NO: 213655 - DNA, 21 bp, Artificial sequence
  SiRNA target sequence
atatagatcaaagctcacttt

SEQ ID NO: 213656 - DNA, 21 bp, Artificial sequence
  SiRNA target sequence
tatagatcaaagctcactttc

SEQ ID NO: 213657 - DNA, 21 bp, Artificial sequence
  SiRNA target sequence
atagatcaaagctcactttct

SEQ ID NO: 213658 - DNA, 21 bp, Artificial sequence
  SiRNA target sequence
tagatcaaagctcactttctc

SEQ ID NO: 213659 - DNA, 21 bp, Artificial sequence
  SiRNA target sequence
agatcaaagctcactttctca

SEQ ID NO: 213660 - DNA, 21 bp, Artificial sequence
  SiRNA target sequence
gatcaaagctcactttctcag

SEQ ID NO: 213661 - DNA, 21 bp, Artificial sequence
  SiRNA target sequence
atcaaagctcactttctcaga

SEQ ID NO: 213662 - DNA, 21 bp, Artificial sequence
  SiRNA target sequence
tcaaagctcactttctcagag

SEQ ID NO: 213663 - DNA, 21 bp, Artificial sequence
  SiRNA target sequence
caaagctcactttctcagagg

SEQ ID NO: 213664 - DNA, 21 bp, Artificial sequence
  SiRNA target sequence
aaagctcactttctcagaggc

SEQ ID NO: 213665 - DNA, 21 bp, Artificial sequence
  SiRNA target sequence
aagctcactttctcagaggcg

SEQ ID NO: 213666 - DNA, 21 bp, Artificial sequence
  SiRNA target sequence
agctcactttctcagaggcgg

SEQ ID NO: 213667 - DNA, 21 bp, Artificial sequence
  SiRNA target sequence
gctcactttctcagaggcgga

SEQ ID NO: 213668 - DNA, 21 bp, Artificial sequence
  SiRNA target sequence
ctcactttctcagaggcggaa

SEQ ID NO: 213669 - DNA, 21 bp, Artificial sequence
  SiRNA target sequence
tcactttctcagaggcggaat

SEQ ID NO: 213670 - DNA, 21 bp, Artificial sequence
  SiRNA target sequence
cactttctcagaggcggaatt

SEQ ID NO: 213671 - DNA, 21 bp, Artificial sequence
  SiRNA target sequence
actttctcagaggcggaattt

SEQ ID NO: 213672 - DNA, 21 bp, Artificial sequence
  SiRNA target sequence
ctttctcagaggcggaatttt

SEQ ID NO: 213673 - DNA, 21 bp, Artificial sequence
  SiRNA target sequence
tttctcagaggcggaattttt

SEQ ID NO: 213674 - DNA, 21 bp, Artificial sequence
  SiRNA target sequence
ttctcagaggcggaattttta

SEQ ID NO: 213675 - DNA, 21 bp, Artificial sequence
  SiRNA target sequence
tctcagaggcggaatttttat

SEQ ID NO: 213676 - DNA, 21 bp, Artificial sequence
  SiRNA target sequence
ctcagaggcggaatttttata

SEQ ID NO: 213677 - DNA, 21 bp, Artificial sequence
  SiRNA target sequence
tcagaggcggaatttttatat

SEQ ID NO: 213678 - DNA, 21 bp, Artificial sequence
  SiRNA target sequence
cagaggcggaatttttatata

SEQ ID NO: 213679 - DNA, 21 bp, Artificial sequence
  SiRNA target sequence
agaggcggaatttttatataa

SEQ ID NO: 213680 - DNA, 21 bp, Artificial sequence
  SiRNA target sequence
gaggcggaatttttatataat

SEQ ID NO: 213681 - DNA, 21 bp, Artificial sequence
  SiRNA target sequence
aggcggaatttttatataatg

SEQ ID NO: 213682 - DNA, 21 bp, Artificial sequence
  SiRNA target sequence
ggcggaatttttatataatgg

SEQ ID NO: 213683 - DNA, 21 bp, Artificial sequence
  SiRNA target sequence
gcggaatttttatataatggc

SEQ ID NO: 213684 - DNA, 21 bp, Artificial sequence
  SiRNA target sequence
cggaatttttatataatggct

SEQ ID NO: 213685 - DNA, 21 bp, Artificial sequence
  SiRNA target sequence
ggaatttttatataatggctt

SEQ ID NO: 213686 - DNA, 21 bp, Artificial sequence
  SiRNA target sequence
gaatttttatataatggcttt

SEQ ID NO: 213687 - DNA, 21 bp, Artificial sequence
  SiRNA target sequence
aatttttatataatggctttt

SEQ ID NO: 213688 - DNA, 21 bp, Artificial sequence
  SiRNA target sequence
atttttatataatggcttttt

SEQ ID NO: 213689 - DNA, 21 bp, Artificial sequence
  SiRNA target sequence
tttttatataatggctttttt

SEQ ID NO: 213690 - DNA, 21 bp, Artificial sequence
  SiRNA target sequence
ttttatataatggcttttttg

SEQ ID NO: 213691 - DNA, 21 bp, Artificial sequence
  SiRNA target sequence
tttatataatggcttttttgt

SEQ ID NO: 213692 - DNA, 21 bp, Artificial sequence
  SiRNA target sequence
ttatataatggcttttttgta

SEQ ID NO: 213693 - DNA, 21 bp, Artificial sequence
  SiRNA target sequence
tatataatggcttttttgtat

SEQ ID NO: 213694 - DNA, 21 bp, Artificial sequence
  SiRNA target sequence
atataatggcttttttgtatt

SEQ ID NO: 213695 - DNA, 21 bp, Artificial sequence
  SiRNA target sequence
tataatggcttttttgtattt

SEQ ID NO: 213696 - DNA, 21 bp, Artificial sequence
  SiRNA target sequence
ataatggcttttttgtatttt

SEQ ID NO: 213697 - DNA, 21 bp, Artificial sequence
  SiRNA target sequence
taatggcttttttgtattttc

SEQ ID NO: 213698 - DNA, 21 bp, Artificial sequence
  SiRNA target sequence
aatggcttttttgtattttct

SEQ ID NO: 213699 - DNA, 21 bp, Artificial sequence
  SiRNA target sequence
atggcttttttgtattttctg

SEQ ID NO: 213700 - DNA, 21 bp, Artificial sequence
  SiRNA target sequence
tggcttttttgtattttctgg

SEQ ID NO: 213701 - DNA, 21 bp, Artificial sequence
  SiRNA target sequence
ggcttttttgtattttctgga

SEQ ID NO: 213702 - DNA, 21 bp, Artificial sequence
  SiRNA target sequence
gcttttttgtattttctggag

SEQ ID NO: 213703 - DNA, 21 bp, Artificial sequence
  SiRNA target sequence
cttttttgtattttctggagt

SEQ ID NO: 213704 - DNA, 21 bp, Artificial sequence
  SiRNA target sequence
ttttttgtattttctggagtt

SEQ ID NO: 213705 - DNA, 21 bp, Artificial sequence
  SiRNA target sequence
tttttgtattttctggagttc

SEQ ID NO: 213706 - DNA, 21 bp, Artificial sequence
  SiRNA target sequence
ttttgtattttctggagttct

SEQ ID NO: 213707 - DNA, 21 bp, Artificial sequence
  SiRNA target sequence
tttgtattttctggagttcta

SEQ ID NO: 213708 - DNA, 21 bp, Artificial sequence
  SiRNA target sequence
ttgtattttctggagttctag

SEQ ID NO: 213709 - DNA, 21 bp, Artificial sequence
  SiRNA target sequence
tgtattttctggagttctagt

SEQ ID NO: 213710 - DNA, 21 bp, Artificial sequence
  SiRNA target sequence
gtattttctggagttctagta

SEQ ID NO: 213711 - DNA, 21 bp, Artificial sequence
  SiRNA target sequence
tattttctggagttctagtaa

SEQ ID NO: 213712 - DNA, 21 bp, Artificial sequence
  SiRNA target sequence
attttctggagttctagtaat

SEQ ID NO: 213713 - DNA, 21 bp, Artificial sequence
  SiRNA target sequence
ttttctggagttctagtaata

SEQ ID NO: 213714 - DNA, 21 bp, Artificial sequence
  SiRNA target sequence
tttctggagttctagtaatag

SEQ ID NO: 213715 - DNA, 21 bp, Artificial sequence
  SiRNA target sequence
ttctggagttctagtaatagt

SEQ ID NO: 213716 - DNA, 21 bp, Artificial sequence
  SiRNA target sequence
tctggagttctagtaatagtt

SEQ ID NO: 213717 - DNA, 21 bp, Artificial sequence
  SiRNA target sequence
ctggagttctagtaatagtta

SEQ ID NO: 213718 - DNA, 21 bp, Artificial sequence
  SiRNA target sequence
tggagttctagtaatagttat

SEQ ID NO: 213719 - DNA, 21 bp, Artificial sequence
  SiRNA target sequence
ggagttctagtaatagttata

SEQ ID NO: 213720 - DNA, 21 bp, Artificial sequence
  SiRNA target sequence
gagttctagtaatagttatat

SEQ ID NO: 213721 - DNA, 21 bp, Artificial sequence
  SiRNA target sequence
agttctagtaatagttatatt

SEQ ID NO: 213722 - DNA, 21 bp, Artificial sequence
  SiRNA target sequence
gttctagtaatagttatattt

SEQ ID NO: 213723 - DNA, 21 bp, Artificial sequence
  SiRNA target sequence
ttctagtaatagttatatttt

SEQ ID NO: 213724 - DNA, 21 bp, Artificial sequence
  SiRNA target sequence
tctagtaatagttatattttt

SEQ ID NO: 213725 - DNA, 21 bp, Artificial sequence
  SiRNA target sequence
ctagtaatagttatattttta

SEQ ID NO: 213726 - DNA, 21 bp, Artificial sequence
  SiRNA target sequence
tagtaatagttatatttttaa

SEQ ID NO: 213727 - DNA, 21 bp, Artificial sequence
  SiRNA target sequence
agtaatagttatatttttaat

SEQ ID NO: 213728 - DNA, 21 bp, Artificial sequence
  SiRNA target sequence
gtaatagttatatttttaatt

SEQ ID NO: 213729 - DNA, 21 bp, Artificial sequence
  SiRNA target sequence
taatagttatatttttaatta

SEQ ID NO: 213730 - DNA, 21 bp, Artificial sequence
  SiRNA target sequence
aatagttatatttttaattaa

SEQ ID NO: 213731 - DNA, 21 bp, Artificial sequence
  SiRNA target sequence
atagttatatttttaattaaa

SEQ ID NO: 213732 - DNA, 21 bp, Artificial sequence
  SiRNA target sequence
tagttatatttttaattaaaa

SEQ ID NO: 213733 - DNA, 21 bp, Artificial sequence
  SiRNA target sequence
agttatatttttaattaaaaa

SEQ ID NO: 213734 - DNA, 21 bp, Artificial sequence
  SiRNA target sequence
gttatatttttaattaaaaaa

SEQ ID NO: 213735 - DNA, 21 bp, Artificial sequence
  SiRNA target sequence
ttatatttttaattaaaaaat

SEQ ID NO: 213736 - DNA, 21 bp, Artificial sequence
  SiRNA target sequence
tatatttttaattaaaaaata

SEQ ID NO: 213737 - DNA, 21 bp, Artificial sequence
  SiRNA target sequence
atatttttaattaaaaaatat

SEQ ID NO: 213738 - DNA, 21 bp, Artificial sequence
  SiRNA target sequence
tatttttaattaaaaaatatt

SEQ ID NO: 213739 - DNA, 21 bp, Artificial sequence
  SiRNA target sequence
atttttaattaaaaaatattt

SEQ ID NO: 213740 - DNA, 21 bp, Artificial sequence
  SiRNA target sequence
tttttaattaaaaaatatttg

SEQ ID NO: 213741 - DNA, 21 bp, Artificial sequence
  SiRNA target sequence
ttttaattaaaaaatatttgg

SEQ ID NO: 213742 - DNA, 21 bp, Artificial sequence
  SiRNA target sequence
tttaattaaaaaatatttgga

SEQ ID NO: 213743 - DNA, 21 bp, Artificial sequence
  SiRNA target sequence
ttaattaaaaaatatttggag

SEQ ID NO: 213744 - DNA, 21 bp, Artificial sequence
  SiRNA target sequence
taattaaaaaatatttggaga

SEQ ID NO: 213745 - DNA, 21 bp, Artificial sequence
  SiRNA target sequence
aattaaaaaatatttggagag

SEQ ID NO: 213746 - DNA, 21 bp, Artificial sequence
  SiRNA target sequence
attaaaaaatatttggagagg

SEQ ID NO: 213747 - DNA, 21 bp, Artificial sequence
  SiRNA target sequence
ttaaaaaatatttggagagga

SEQ ID NO: 213748 - DNA, 21 bp, Artificial sequence
  SiRNA target sequence
taaaaaatatttggagaggaa

SEQ ID NO: 213749 - DNA, 21 bp, Artificial sequence
  SiRNA target sequence
aaaaaatatttggagaggaat

SEQ ID NO: 213750 - DNA, 21 bp, Artificial sequence
  SiRNA target sequence
aaaaatatttggagaggaatg

SEQ ID NO: 213751 - DNA, 21 bp, Artificial sequence
  SiRNA target sequence
aaaatatttggagaggaatgt

SEQ ID NO: 213752 - DNA, 21 bp, Artificial sequence
  SiRNA target sequence
aaatatttggagaggaatgtg

SEQ ID NO: 213753 - DNA, 21 bp, Artificial sequence
  SiRNA target sequence
aatatttggagaggaatgtga

SEQ ID NO: 213754 - DNA, 21 bp, Artificial sequence
  SiRNA target sequence
atatttggagaggaatgtgac

SEQ ID NO: 213755 - DNA, 21 bp, Artificial sequence
  SiRNA target sequence
tatttggagaggaatgtgact

SEQ ID NO: 213756 - DNA, 21 bp, Artificial sequence
  SiRNA target sequence
atttggagaggaatgtgacta

SEQ ID NO: 213757 - DNA, 21 bp, Artificial sequence
  SiRNA target sequence
tttggagaggaatgtgactaa

SEQ ID NO: 213758 - DNA, 21 bp, Artificial sequence
  SiRNA target sequence
ttggagaggaatgtgactaac

SEQ ID NO: 213759 - DNA, 21 bp, Artificial sequence
  SiRNA target sequence
tggagaggaatgtgactaaca

SEQ ID NO: 213760 - DNA, 21 bp, Artificial sequence
  SiRNA target sequence
ggagaggaatgtgactaacaa

SEQ ID NO: 213761 - DNA, 21 bp, Artificial sequence
  SiRNA target sequence
gagaggaatgtgactaacaaa

SEQ ID NO: 213762 - DNA, 21 bp, Artificial sequence
  SiRNA target sequence
agaggaatgtgactaacaaac

SEQ ID NO: 213763 - DNA, 21 bp, Artificial sequence
  SiRNA target sequence
gaggaatgtgactaacaaacc

SEQ ID NO: 213764 - DNA, 21 bp, Artificial sequence
  SiRNA target sequence
aggaatgtgactaacaaacct

SEQ ID NO: 213765 - DNA, 21 bp, Artificial sequence
  SiRNA target sequence
ggaatgtgactaacaaacctt

SEQ ID NO: 213766 - DNA, 21 bp, Artificial sequence
  SiRNA target sequence
gaatgtgactaacaaaccttt

SEQ ID NO: 213767 - DNA, 21 bp, Artificial sequence
  SiRNA target sequence
aatgtgactaacaaacctttg

SEQ ID NO: 213768 - DNA, 21 bp, Artificial sequence
  SiRNA target sequence
atgtgactaacaaacctttgt

SEQ ID NO: 213769 - DNA, 21 bp, Artificial sequence
  SiRNA target sequence
tgtgactaacaaacctttgtt

SEQ ID NO: 213770 - DNA, 21 bp, Artificial sequence
  SiRNA target sequence
gtgactaacaaacctttgttt

SEQ ID NO: 213771 - DNA, 21 bp, Artificial sequence
  SiRNA target sequence
tgactaacaaacctttgtttg

SEQ ID NO: 213772 - DNA, 21 bp, Artificial sequence
  SiRNA target sequence
gactaacaaacctttgtttgt

SEQ ID NO: 213773 - DNA, 21 bp, Artificial sequence
  SiRNA target sequence
actaacaaacctttgtttgtt

SEQ ID NO: 213774 - DNA, 21 bp, Artificial sequence
  SiRNA target sequence
ctaacaaacctttgtttgttg

SEQ ID NO: 213775 - DNA, 21 bp, Artificial sequence
  SiRNA target sequence
taacaaacctttgtttgttgt

SEQ ID NO: 213776 - DNA, 21 bp, Artificial sequence
  SiRNA target sequence
aacaaacctttgtttgttgta

SEQ ID NO: 213777 - DNA, 21 bp, Artificial sequence
  SiRNA target sequence
acaaacctttgtttgttgtaa

SEQ ID NO: 213778 - DNA, 21 bp, Artificial sequence
  SiRNA target sequence
caaacctttgtttgttgtaaa

SEQ ID NO: 213779 - DNA, 21 bp, Artificial sequence
  SiRNA target sequence
aaacctttgtttgttgtaaaa

SEQ ID NO: 213780 - DNA, 21 bp, Artificial sequence
  SiRNA target sequence
aacctttgtttgttgtaaaat

SEQ ID NO: 213781 - DNA, 21 bp, Artificial sequence
  SiRNA target sequence
acctttgtttgttgtaaaatc

SEQ ID NO: 213782 - DNA, 21 bp, Artificial sequence
  SiRNA target sequence
cctttgtttgttgtaaaatct

SEQ ID NO: 213783 - DNA, 21 bp, Artificial sequence
  SiRNA target sequence
ctttgtttgttgtaaaatctg

SEQ ID NO: 213784 - DNA, 21 bp, Artificial sequence
  SiRNA target sequence
tttgtttgttgtaaaatctgt

SEQ ID NO: 213785 - DNA, 21 bp, Artificial sequence
  SiRNA target sequence
ttgtttgttgtaaaatctgtt

SEQ ID NO: 213786 - DNA, 21 bp, Artificial sequence
  SiRNA target sequence
tgtttgttgtaaaatctgtta

SEQ ID NO: 213787 - DNA, 21 bp, Artificial sequence
  SiRNA target sequence
gtttgttgtaaaatctgttaa

SEQ ID NO: 213788 - DNA, 21 bp, Artificial sequence
  SiRNA target sequence
tttgttgtaaaatctgttaaa

SEQ ID NO: 213789 - DNA, 21 bp, Artificial sequence
  SiRNA target sequence
ttgttgtaaaatctgttaaaa

SEQ ID NO: 213790 - DNA, 21 bp, Artificial sequence
  SiRNA target sequence
tgttgtaaaatctgttaaaaa

SEQ ID NO: 213791 - DNA, 21 bp, Artificial sequence
  SiRNA target sequence
gttgtaaaatctgttaaaaag

SEQ ID NO: 213792 - DNA, 21 bp, Artificial sequence
  SiRNA target sequence
ttgtaaaatctgttaaaaaga

SEQ ID NO: 213793 - DNA, 21 bp, Artificial sequence
  SiRNA target sequence
tgtaaaatctgttaaaaagaa

SEQ ID NO: 213794 - DNA, 21 bp, Artificial sequence
  SiRNA target sequence
gtaaaatctgttaaaaagaag

SEQ ID NO: 213795 - DNA, 21 bp, Artificial sequence
  SiRNA target sequence
taaaatctgttaaaaagaagg

SEQ ID NO: 213796 - DNA, 21 bp, Artificial sequence
  SiRNA target sequence
aaaatctgttaaaaagaaggg

SEQ ID NO: 213797 - DNA, 21 bp, Artificial sequence
  SiRNA target sequence
aaatctgttaaaaagaaggga

SEQ ID NO: 213798 - DNA, 21 bp, Artificial sequence
  SiRNA target sequence
aatctgttaaaaagaagggac

SEQ ID NO: 213799 - DNA, 21 bp, Artificial sequence
  SiRNA target sequence
atctgttaaaaagaagggacc

SEQ ID NO: 213800 - DNA, 21 bp, Artificial sequence
  SiRNA target sequence
tctgttaaaaagaagggacca

SEQ ID NO: 213801 - DNA, 21 bp, Artificial sequence
  SiRNA target sequence
ctgttaaaaagaagggaccaa

SEQ ID NO: 213802 - DNA, 21 bp, Artificial sequence
  SiRNA target sequence
tgttaaaaagaagggaccaaa

SEQ ID NO: 213803 - DNA, 21 bp, Artificial sequence
  SiRNA target sequence
gttaaaaagaagggaccaaaa

SEQ ID NO: 213804 - DNA, 21 bp, Artificial sequence
  SiRNA target sequence
ttaaaaagaagggaccaaaag

SEQ ID NO: 213805 - DNA, 21 bp, Artificial sequence
  SiRNA target sequence
taaaaagaagggaccaaaagt

SEQ ID NO: 213806 - DNA, 21 bp, Artificial sequence
  SiRNA target sequence
aaaaagaagggaccaaaagtt

SEQ ID NO: 213807 - DNA, 21 bp, Artificial sequence
  SiRNA target sequence
aaaagaagggaccaaaagtta

SEQ ID NO: 213808 - DNA, 21 bp, Artificial sequence
  SiRNA target sequence
aaagaagggaccaaaagttaa

SEQ ID NO: 213809 - DNA, 21 bp, Artificial sequence
  SiRNA target sequence
aagaagggaccaaaagttaaa

SEQ ID NO: 213810 - DNA, 21 bp, Artificial sequence
  SiRNA target sequence
agaagggaccaaaagttaaag

SEQ ID NO: 213811 - DNA, 21 bp, Artificial sequence
  SiRNA target sequence
gaagggaccaaaagttaaagt

SEQ ID NO: 213812 - DNA, 21 bp, Artificial sequence
  SiRNA target sequence
aagggaccaaaagttaaagta

SEQ ID NO: 213813 - DNA, 21 bp, Artificial sequence
  SiRNA target sequence
agggaccaaaagttaaagtag

SEQ ID NO: 213814 - DNA, 21 bp, Artificial sequence
  SiRNA target sequence
gggaccaaaagttaaagtagg

SEQ ID NO: 213815 - DNA, 21 bp, Artificial sequence
  SiRNA target sequence
ggaccaaaagttaaagtagga

SEQ ID NO: 213816 - DNA, 21 bp, Artificial sequence
  SiRNA target sequence
gaccaaaagttaaagtaggat

SEQ ID NO: 213817 - DNA, 21 bp, Artificial sequence
  SiRNA target sequence
accaaaagttaaagtaggatt

SEQ ID NO: 213818 - DNA, 21 bp, Artificial sequence
  SiRNA target sequence
ccaaaagttaaagtaggattt

SEQ ID NO: 213819 - DNA, 21 bp, Artificial sequence
  SiRNA target sequence
caaaagttaaagtaggatttg

SEQ ID NO: 213820 - DNA, 21 bp, Artificial sequence
  SiRNA target sequence
aaaagttaaagtaggatttgc

SEQ ID NO: 213821 - DNA, 21 bp, Artificial sequence
  SiRNA target sequence
aaagttaaagtaggatttgcg

SEQ ID NO: 213822 - DNA, 21 bp, Artificial sequence
  SiRNA target sequence
aagttaaagtaggatttgcgg

SEQ ID NO: 213823 - DNA, 21 bp, Artificial sequence
  SiRNA target sequence
agttaaagtaggatttgcgga

SEQ ID NO: 213824 - DNA, 21 bp, Artificial sequence
  SiRNA target sequence
gttaaagtaggatttgcggag

SEQ ID NO: 213825 - DNA, 21 bp, Artificial sequence
  SiRNA target sequence
ttaaagtaggatttgcggagg

SEQ ID NO: 213826 - DNA, 21 bp, Artificial sequence
  SiRNA target sequence
taaagtaggatttgcggaggg

SEQ ID NO: 213827 - DNA, 21 bp, Artificial sequence
  SiRNA target sequence
aaagtaggatttgcggagggc

SEQ ID NO: 213828 - DNA, 21 bp, Artificial sequence
  SiRNA target sequence
aagtaggatttgcggagggcc

SEQ ID NO: 213829 - DNA, 21 bp, Artificial sequence
  SiRNA target sequence
agtaggatttgcggagggcct

SEQ ID NO: 213830 - DNA, 21 bp, Artificial sequence
  SiRNA target sequence
gtaggatttgcggagggcctt

SEQ ID NO: 213831 - DNA, 21 bp, Artificial sequence
  SiRNA target sequence
taggatttgcggagggcctta

SEQ ID NO: 213832 - DNA, 21 bp, Artificial sequence
  SiRNA target sequence
aggatttgcggagggccttaa

SEQ ID NO: 213833 - DNA, 21 bp, Artificial sequence
  SiRNA target sequence
ggatttgcggagggccttaaa

SEQ ID NO: 213834 - DNA, 21 bp, Artificial sequence
  SiRNA target sequence
gatttgcggagggccttaaag

SEQ ID NO: 213835 - DNA, 21 bp, Artificial sequence
  SiRNA target sequence
atttgcggagggccttaaaga

SEQ ID NO: 213836 - DNA, 21 bp, Artificial sequence
  SiRNA target sequence
tttgcggagggccttaaagaa

SEQ ID NO: 213837 - DNA, 21 bp, Artificial sequence
  SiRNA target sequence
ttgcggagggccttaaagaaa

SEQ ID NO: 213838 - DNA, 21 bp, Artificial sequence
  SiRNA target sequence
tgcggagggccttaaagaaat

SEQ ID NO: 213839 - DNA, 21 bp, Artificial sequence
  SiRNA target sequence
gcggagggccttaaagaaatg

SEQ ID NO: 213840 - DNA, 21 bp, Artificial sequence
  SiRNA target sequence
cggagggccttaaagaaatga

SEQ ID NO: 213841 - DNA, 21 bp, Artificial sequence
  SiRNA target sequence
ggagggccttaaagaaatgat

SEQ ID NO: 213842 - DNA, 21 bp, Artificial sequence
  SiRNA target sequence
gagggccttaaagaaatgatg

SEQ ID NO: 213843 - DNA, 21 bp, Artificial sequence
  SiRNA target sequence
agggccttaaagaaatgatgg

SEQ ID NO: 213844 - DNA, 21 bp, Artificial sequence
  SiRNA target sequence
gggccttaaagaaatgatggc

SEQ ID NO: 213845 - DNA, 21 bp, Artificial sequence
  SiRNA target sequence
ggccttaaagaaatgatggca

SEQ ID NO: 213846 - DNA, 21 bp, Artificial sequence
  SiRNA target sequence
gccttaaagaaatgatggcat

SEQ ID NO: 213847 - DNA, 21 bp, Artificial sequence
  SiRNA target sequence
ccttaaagaaatgatggcatc

SEQ ID NO: 213848 - DNA, 21 bp, Artificial sequence
  SiRNA target sequence
cttaaagaaatgatggcatca

SEQ ID NO: 213849 - DNA, 21 bp, Artificial sequence
  SiRNA target sequence
ttaaagaaatgatggcatcaa

SEQ ID NO: 213850 - DNA, 21 bp, Artificial sequence
  SiRNA target sequence
taaagaaatgatggcatcaaa

SEQ ID NO: 213851 - DNA, 21 bp, Artificial sequence
  SiRNA target sequence
aaagaaatgatggcatcaaag

SEQ ID NO: 213852 - DNA, 21 bp, Artificial sequence
  SiRNA target sequence
aagaaatgatggcatcaaagt

SEQ ID NO: 213853 - DNA, 21 bp, Artificial sequence
  SiRNA target sequence
agaaatgatggcatcaaagtt

SEQ ID NO: 213854 - DNA, 21 bp, Artificial sequence
  SiRNA target sequence
gaaatgatggcatcaaagtta

SEQ ID NO: 213855 - DNA, 21 bp, Artificial sequence
  SiRNA target sequence
aaatgatggcatcaaagttat

SEQ ID NO: 213856 - DNA, 21 bp, Artificial sequence
  SiRNA target sequence
aatgatggcatcaaagttatt

SEQ ID NO: 213857 - DNA, 21 bp, Artificial sequence
  SiRNA target sequence
atgatggcatcaaagttatta

SEQ ID NO: 213858 - DNA, 21 bp, Artificial sequence
  SiRNA target sequence
tgatggcatcaaagttattac

SEQ ID NO: 213859 - DNA, 21 bp, Artificial sequence
  SiRNA target sequence
gatggcatcaaagttattact

SEQ ID NO: 213860 - DNA, 21 bp, Artificial sequence
  SiRNA target sequence
atggcatcaaagttattactt

SEQ ID NO: 213861 - DNA, 21 bp, Artificial sequence
  SiRNA target sequence
tggcatcaaagttattactta

SEQ ID NO: 213862 - DNA, 21 bp, Artificial sequence
  SiRNA target sequence
ggcatcaaagttattacttaa

SEQ ID NO: 213863 - DNA, 21 bp, Artificial sequence
  SiRNA target sequence
gcatcaaagttattacttaac

SEQ ID NO: 213864 - DNA, 21 bp, Artificial sequence
  SiRNA target sequence
catcaaagttattacttaaca

SEQ ID NO: 213865 - DNA, 21 bp, Artificial sequence
  SiRNA target sequence
atcaaagttattacttaacat

SEQ ID NO: 213866 - DNA, 21 bp, Artificial sequence
  SiRNA target sequence
tcaaagttattacttaacatt

SEQ ID NO: 213867 - DNA, 21 bp, Artificial sequence
  SiRNA target sequence
caaagttattacttaacattt

SEQ ID NO: 213868 - DNA, 21 bp, Artificial sequence
  SiRNA target sequence
aaagttattacttaacatttc

SEQ ID NO: 213869 - DNA, 21 bp, Artificial sequence
  SiRNA target sequence
aagttattacttaacatttca

SEQ ID NO: 213870 - DNA, 21 bp, Artificial sequence
  SiRNA target sequence
agttattacttaacatttcat

SEQ ID NO: 213871 - DNA, 21 bp, Artificial sequence
  SiRNA target sequence
gttattacttaacatttcatt

SEQ ID NO: 213872 - DNA, 21 bp, Artificial sequence
  SiRNA target sequence
ttattacttaacatttcatta

SEQ ID NO: 213873 - DNA, 21 bp, Artificial sequence
  SiRNA target sequence
tattacttaacatttcattaa

SEQ ID NO: 213874 - DNA, 21 bp, Artificial sequence
  SiRNA target sequence
attacttaacatttcattaac

SEQ ID NO: 213875 - DNA, 21 bp, Artificial sequence
  SiRNA target sequence
ttacttaacatttcattaact

SEQ ID NO: 213876 - DNA, 21 bp, Artificial sequence
  SiRNA target sequence
tacttaacatttcattaactg

SEQ ID NO: 213877 - DNA, 21 bp, Artificial sequence
  SiRNA target sequence
acttaacatttcattaactgt

SEQ ID NO: 213878 - DNA, 21 bp, Artificial sequence
  SiRNA target sequence
cttaacatttcattaactgtt

SEQ ID NO: 213879 - DNA, 21 bp, Artificial sequence
  SiRNA target sequence
ttaacatttcattaactgtta

SEQ ID NO: 213880 - DNA, 21 bp, Artificial sequence
  SiRNA target sequence
taacatttcattaactgttat

SEQ ID NO: 213881 - DNA, 21 bp, Artificial sequence
  SiRNA target sequence
aacatttcattaactgttatg

SEQ ID NO: 213882 - DNA, 21 bp, Artificial sequence
  SiRNA target sequence
acatttcattaactgttatgt

SEQ ID NO: 213883 - DNA, 21 bp, Artificial sequence
  SiRNA target sequence
catttcattaactgttatgtt

SEQ ID NO: 213884 - DNA, 21 bp, Artificial sequence
  SiRNA target sequence
atttcattaactgttatgttc

SEQ ID NO: 213885 - DNA, 21 bp, Artificial sequence
  SiRNA target sequence
tttcattaactgttatgttct

SEQ ID NO: 213886 - DNA, 21 bp, Artificial sequence
  SiRNA target sequence
ttcattaactgttatgttcta

SEQ ID NO: 213887 - DNA, 21 bp, Artificial sequence
  SiRNA target sequence
tcattaactgttatgttctat

SEQ ID NO: 213888 - DNA, 21 bp, Artificial sequence
  SiRNA target sequence
cattaactgttatgttctatg

SEQ ID NO: 213889 - DNA, 21 bp, Artificial sequence
  SiRNA target sequence
attaactgttatgttctatgg

SEQ ID NO: 213890 - DNA, 21 bp, Artificial sequence
  SiRNA target sequence
ttaactgttatgttctatggt

SEQ ID NO: 213891 - DNA, 21 bp, Artificial sequence
  SiRNA target sequence
taactgttatgttctatggta

SEQ ID NO: 213892 - DNA, 21 bp, Artificial sequence
  SiRNA target sequence
aactgttatgttctatggtat

SEQ ID NO: 213893 - DNA, 21 bp, Artificial sequence
  SiRNA target sequence
actgttatgttctatggtata

SEQ ID NO: 213894 - DNA, 21 bp, Artificial sequence
  SiRNA target sequence
ctgttatgttctatggtatat

SEQ ID NO: 213895 - DNA, 21 bp, Artificial sequence
  SiRNA target sequence
tgttatgttctatggtatatc

SEQ ID NO: 213896 - DNA, 21 bp, Artificial sequence
  SiRNA target sequence
gttatgttctatggtatatca

SEQ ID NO: 213897 - DNA, 21 bp, Artificial sequence
  SiRNA target sequence
ttatgttctatggtatatcaa

SEQ ID NO: 213898 - DNA, 21 bp, Artificial sequence
  SiRNA target sequence
tatgttctatggtatatcaac

SEQ ID NO: 213899 - DNA, 21 bp, Artificial sequence
  SiRNA target sequence
atgttctatggtatatcaact

SEQ ID NO: 213900 - DNA, 21 bp, Artificial sequence
  SiRNA target sequence
tgttctatggtatatcaacta

SEQ ID NO: 213901 - DNA, 21 bp, Artificial sequence
  SiRNA target sequence
gttctatggtatatcaactaa

SEQ ID NO: 213902 - DNA, 21 bp, Artificial sequence
  SiRNA target sequence
ttctatggtatatcaactaat

SEQ ID NO: 213903 - DNA, 21 bp, Artificial sequence
  SiRNA target sequence
tctatggtatatcaactaatt

SEQ ID NO: 213904 - DNA, 21 bp, Artificial sequence
  SiRNA target sequence
ctatggtatatcaactaattt

SEQ ID NO: 213905 - DNA, 21 bp, Artificial sequence
  SiRNA target sequence
tatggtatatcaactaattta

SEQ ID NO: 213906 - DNA, 21 bp, Artificial sequence
  SiRNA target sequence
atggtatatcaactaatttaa

SEQ ID NO: 213907 - DNA, 21 bp, Artificial sequence
  SiRNA target sequence
tggtatatcaactaatttaat

SEQ ID NO: 213908 - DNA, 21 bp, Artificial sequence
  SiRNA target sequence
ggtatatcaactaatttaata

SEQ ID NO: 213909 - DNA, 21 bp, Artificial sequence
  SiRNA target sequence
gtatatcaactaatttaatag

SEQ ID NO: 213910 - DNA, 21 bp, Artificial sequence
  SiRNA target sequence
tatatcaactaatttaataga

SEQ ID NO: 213911 - DNA, 21 bp, Artificial sequence
  SiRNA target sequence
atatcaactaatttaatagaa

SEQ ID NO: 213912 - DNA, 21 bp, Artificial sequence
  SiRNA target sequence
tatcaactaatttaatagaat

SEQ ID NO: 213913 - DNA, 21 bp, Artificial sequence
  SiRNA target sequence
atcaactaatttaatagaatc

SEQ ID NO: 213914 - DNA, 21 bp, Artificial sequence
  SiRNA target sequence
tcaactaatttaatagaatca

SEQ ID NO: 213915 - DNA, 21 bp, Artificial sequence
  SiRNA target sequence
caactaatttaatagaatcaa

SEQ ID NO: 213916 - DNA, 21 bp, Artificial sequence
  SiRNA target sequence
aactaatttaatagaatcaac

SEQ ID NO: 213917 - DNA, 21 bp, Artificial sequence
  SiRNA target sequence
actaatttaatagaatcaaca

SEQ ID NO: 213918 - DNA, 21 bp, Artificial sequence
  SiRNA target sequence
ctaatttaatagaatcaacat

SEQ ID NO: 213919 - DNA, 21 bp, Artificial sequence
  SiRNA target sequence
taatttaatagaatcaacatt

SEQ ID NO: 213920 - DNA, 21 bp, Artificial sequence
  SiRNA target sequence
aatttaatagaatcaacattt

SEQ ID NO: 213921 - DNA, 21 bp, Artificial sequence
  SiRNA target sequence
atttaatagaatcaacattta

SEQ ID NO: 213922 - DNA, 21 bp, Artificial sequence
  SiRNA target sequence
tttaatagaatcaacatttaa

SEQ ID NO: 213923 - DNA, 21 bp, Artificial sequence
  SiRNA target sequence
ttaatagaatcaacatttaaa

SEQ ID NO: 213924 - DNA, 21 bp, Artificial sequence
  SiRNA target sequence
taatagaatcaacatttaaaa

SEQ ID NO: 213925 - DNA, 21 bp, Artificial sequence
  SiRNA target sequence
aatagaatcaacatttaaaag

SEQ ID NO: 213926 - DNA, 21 bp, Artificial sequence
  SiRNA target sequence
atagaatcaacatttaaaagt

SEQ ID NO: 213927 - DNA, 21 bp, Artificial sequence
  SiRNA target sequence
tagaatcaacatttaaaagtg

SEQ ID NO: 213928 - DNA, 21 bp, Artificial sequence
  SiRNA target sequence
agaatcaacatttaaaagtgg

SEQ ID NO: 213929 - DNA, 21 bp, Artificial sequence
  SiRNA target sequence
gaatcaacatttaaaagtgga

SEQ ID NO: 213930 - DNA, 21 bp, Artificial sequence
  SiRNA target sequence
aatcaacatttaaaagtggac

SEQ ID NO: 213931 - DNA, 21 bp, Artificial sequence
  SiRNA target sequence
atcaacatttaaaagtggact

SEQ ID NO: 213932 - DNA, 21 bp, Artificial sequence
  SiRNA target sequence
tcaacatttaaaagtggactt

SEQ ID NO: 213933 - DNA, 21 bp, Artificial sequence
  SiRNA target sequence
caacatttaaaagtggacttg

SEQ ID NO: 213934 - DNA, 21 bp, Artificial sequence
  SiRNA target sequence
aacatttaaaagtggacttgt

SEQ ID NO: 213935 - DNA, 21 bp, Artificial sequence
  SiRNA target sequence
acatttaaaagtggacttgtg

SEQ ID NO: 213936 - DNA, 21 bp, Artificial sequence
  SiRNA target sequence
catttaaaagtggacttgtga

SEQ ID NO: 213937 - DNA, 21 bp, Artificial sequence
  SiRNA target sequence
atttaaaagtggacttgtgaa

SEQ ID NO: 213938 - DNA, 21 bp, Artificial sequence
  SiRNA target sequence
tttaaaagtggacttgtgaaa

SEQ ID NO: 213939 - DNA, 21 bp, Artificial sequence
  SiRNA target sequence
ttaaaagtggacttgtgaaag

SEQ ID NO: 213940 - DNA, 21 bp, Artificial sequence
  SiRNA target sequence
taaaagtggacttgtgaaagg

SEQ ID NO: 213941 - DNA, 21 bp, Artificial sequence
  SiRNA target sequence
aaaagtggacttgtgaaaggt

SEQ ID NO: 213942 - DNA, 21 bp, Artificial sequence
  SiRNA target sequence
aaagtggacttgtgaaaggtg

SEQ ID NO: 213943 - DNA, 21 bp, Artificial sequence
  SiRNA target sequence
aagtggacttgtgaaaggtgc

SEQ ID NO: 213944 - DNA, 21 bp, Artificial sequence
  SiRNA target sequence
agtggacttgtgaaaggtgca

SEQ ID NO: 213945 - DNA, 21 bp, Artificial sequence
  SiRNA target sequence
gtggacttgtgaaaggtgcag

SEQ ID NO: 213946 - DNA, 21 bp, Artificial sequence
  SiRNA target sequence
tggacttgtgaaaggtgcaga

SEQ ID NO: 213947 - DNA, 21 bp, Artificial sequence
  SiRNA target sequence
ggacttgtgaaaggtgcagaa

SEQ ID NO: 213948 - DNA, 21 bp, Artificial sequence
  SiRNA target sequence
gacttgtgaaaggtgcagaag

SEQ ID NO: 213949 - DNA, 21 bp, Artificial sequence
  SiRNA target sequence
acttgtgaaaggtgcagaaga

SEQ ID NO: 213950 - DNA, 21 bp, Artificial sequence
  SiRNA target sequence
cttgtgaaaggtgcagaagaa

SEQ ID NO: 213951 - DNA, 21 bp, Artificial sequence
  SiRNA target sequence
ttgtgaaaggtgcagaagaat

SEQ ID NO: 213952 - DNA, 21 bp, Artificial sequence
  SiRNA target sequence
tgtgaaaggtgcagaagaatt

SEQ ID NO: 213953 - DNA, 21 bp, Artificial sequence
  SiRNA target sequence
gtgaaaggtgcagaagaatta

SEQ ID NO: 213954 - DNA, 21 bp, Artificial sequence
  SiRNA target sequence
tgaaaggtgcagaagaattaa

SEQ ID NO: 213955 - DNA, 21 bp, Artificial sequence
  SiRNA target sequence
gaaaggtgcagaagaattaaa

SEQ ID NO: 213956 - DNA, 21 bp, Artificial sequence
  SiRNA target sequence
aaaggtgcagaagaattaaac

SEQ ID NO: 213957 - DNA, 21 bp, Artificial sequence
  SiRNA target sequence
aaggtgcagaagaattaaacg

SEQ ID NO: 213958 - DNA, 21 bp, Artificial sequence
  SiRNA target sequence
aggtgcagaagaattaaacga

SEQ ID NO: 213959 - DNA, 21 bp, Artificial sequence
  SiRNA target sequence
ggtgcagaagaattaaacgag

SEQ ID NO: 213960 - DNA, 21 bp, Artificial sequence
  SiRNA target sequence
gtgcagaagaattaaacgaga

SEQ ID NO: 213961 - DNA, 21 bp, Artificial sequence
  SiRNA target sequence
tgcagaagaattaaacgagaa

SEQ ID NO: 213962 - DNA, 21 bp, Artificial sequence
  SiRNA target sequence
gcagaagaattaaacgagaat

SEQ ID NO: 213963 - DNA, 21 bp, Artificial sequence
  SiRNA target sequence
cagaagaattaaacgagaata

SEQ ID NO: 213964 - DNA, 21 bp, Artificial sequence
  SiRNA target sequence
agaagaattaaacgagaatac

SEQ ID NO: 213965 - DNA, 21 bp, Artificial sequence
  SiRNA target sequence
gaagaattaaacgagaatact

SEQ ID NO: 213966 - DNA, 21 bp, Artificial sequence
  SiRNA target sequence
aagaattaaacgagaatacta

SEQ ID NO: 213967 - DNA, 21 bp, Artificial sequence
  SiRNA target sequence
agaattaaacgagaatactaa

SEQ ID NO: 213968 - DNA, 21 bp, Artificial sequence
  SiRNA target sequence
gaattaaacgagaatactaaa

SEQ ID NO: 213969 - DNA, 21 bp, Artificial sequence
  SiRNA target sequence
aattaaacgagaatactaaaa

SEQ ID NO: 213970 - DNA, 21 bp, Artificial sequence
  SiRNA target sequence
attaaacgagaatactaaaag

SEQ ID NO: 213971 - DNA, 21 bp, Artificial sequence
  SiRNA target sequence
ttaaacgagaatactaaaagt

SEQ ID NO: 213972 - DNA, 21 bp, Artificial sequence
  SiRNA target sequence
taaacgagaatactaaaagtt

SEQ ID NO: 213973 - DNA, 21 bp, Artificial sequence
  SiRNA target sequence
aaacgagaatactaaaagtta

SEQ ID NO: 213974 - DNA, 21 bp, Artificial sequence
  SiRNA target sequence
aacgagaatactaaaagttat

SEQ ID NO: 213975 - DNA, 21 bp, Artificial sequence
  SiRNA target sequence
acgagaatactaaaagttatt

SEQ ID NO: 213976 - DNA, 21 bp, Artificial sequence
  SiRNA target sequence
cgagaatactaaaagttattc

SEQ ID NO: 213977 - DNA, 21 bp, Artificial sequence
  SiRNA target sequence
gagaatactaaaagttattct

SEQ ID NO: 213978 - DNA, 21 bp, Artificial sequence
  SiRNA target sequence
agaatactaaaagttattcta

SEQ ID NO: 213979 - DNA, 21 bp, Artificial sequence
  SiRNA target sequence
gaatactaaaagttattctat

SEQ ID NO: 213980 - DNA, 21 bp, Artificial sequence
  SiRNA target sequence
aatactaaaagttattctatg

SEQ ID NO: 213981 - DNA, 21 bp, Artificial sequence
  SiRNA target sequence
atactaaaagttattctatgg

SEQ ID NO: 213982 - DNA, 21 bp, Artificial sequence
  SiRNA target sequence
tactaaaagttattctatggg

SEQ ID NO: 213983 - DNA, 21 bp, Artificial sequence
  SiRNA target sequence
actaaaagttattctatggga

SEQ ID NO: 213984 - DNA, 21 bp, Artificial sequence
  SiRNA target sequence
ctaaaagttattctatgggat

SEQ ID NO: 213985 - DNA, 21 bp, Artificial sequence
  SiRNA target sequence
taaaagttattctatgggata

SEQ ID NO: 213986 - DNA, 21 bp, Artificial sequence
  SiRNA target sequence
aaaagttattctatgggatat

SEQ ID NO: 213987 - DNA, 21 bp, Artificial sequence
  SiRNA target sequence
aaagttattctatgggatata

SEQ ID NO: 213988 - DNA, 21 bp, Artificial sequence
  SiRNA target sequence
aagttattctatgggatataa

SEQ ID NO: 213989 - DNA, 21 bp, Artificial sequence
  SiRNA target sequence
agttattctatgggatataat

SEQ ID NO: 213990 - DNA, 21 bp, Artificial sequence
  SiRNA target sequence
gttattctatgggatataatt

SEQ ID NO: 213991 - DNA, 21 bp, Artificial sequence
  SiRNA target sequence
ttattctatgggatataattc

SEQ ID NO: 213992 - DNA, 21 bp, Artificial sequence
  SiRNA target sequence
tattctatgggatataattca

SEQ ID NO: 213993 - DNA, 21 bp, Artificial sequence
  SiRNA target sequence
attctatgggatataattcat

SEQ ID NO: 213994 - DNA, 21 bp, Artificial sequence
  SiRNA target sequence
ttctatgggatataattcatt

SEQ ID NO: 213995 - DNA, 21 bp, Artificial sequence
  SiRNA target sequence
tctatgggatataattcattt

SEQ ID NO: 213996 - DNA, 21 bp, Artificial sequence
  SiRNA target sequence
ctatgggatataattcatttg

SEQ ID NO: 213997 - DNA, 21 bp, Artificial sequence
  SiRNA target sequence
tatgggatataattcatttga

SEQ ID NO: 213998 - DNA, 21 bp, Artificial sequence
  SiRNA target sequence
atgggatataattcatttgaa

SEQ ID NO: 213999 - DNA, 21 bp, Artificial sequence
  SiRNA target sequence
tgggatataattcatttgaac

SEQ ID NO: 214000 - DNA, 21 bp, Artificial sequence
  SiRNA target sequence
gggatataattcatttgaaca

SEQ ID NO: 214001 - DNA, 21 bp, Artificial sequence
  SiRNA target sequence
ggatataattcatttgaacaa

SEQ ID NO: 214002 - DNA, 21 bp, Artificial sequence
  SiRNA target sequence
gatataattcatttgaacaaa

SEQ ID NO: 214003 - DNA, 21 bp, Artificial sequence
  SiRNA target sequence
atataattcatttgaacaaaa

SEQ ID NO: 214004 - DNA, 21 bp, Artificial sequence
  SiRNA target sequence
tataattcatttgaacaaaag

SEQ ID NO: 214005 - DNA, 21 bp, Artificial sequence
  SiRNA target sequence
ataattcatttgaacaaaaga

SEQ ID NO: 214006 - DNA, 21 bp, Artificial sequence
  SiRNA target sequence
taattcatttgaacaaaagat

SEQ ID NO: 214007 - DNA, 21 bp, Artificial sequence
  SiRNA target sequence
aattcatttgaacaaaagata

SEQ ID NO: 214008 - DNA, 21 bp, Artificial sequence
  SiRNA target sequence
attcatttgaacaaaagatag

SEQ ID NO: 214009 - DNA, 21 bp, Artificial sequence
  SiRNA target sequence
ttcatttgaacaaaagatagc

SEQ ID NO: 214010 - DNA, 21 bp, Artificial sequence
  SiRNA target sequence
tcatttgaacaaaagatagca

SEQ ID NO: 214011 - DNA, 21 bp, Artificial sequence
  SiRNA target sequence
catttgaacaaaagatagcat

SEQ ID NO: 214012 - DNA, 21 bp, Artificial sequence
  SiRNA target sequence
atttgaacaaaagatagcatc

SEQ ID NO: 214013 - DNA, 21 bp, Artificial sequence
  SiRNA target sequence
tttgaacaaaagatagcatca

SEQ ID NO: 214014 - DNA, 21 bp, Artificial sequence
  SiRNA target sequence
ttgaacaaaagatagcatcaa

SEQ ID NO: 214015 - DNA, 21 bp, Artificial sequence
  SiRNA target sequence
tgaacaaaagatagcatcaat

SEQ ID NO: 214016 - DNA, 21 bp, Artificial sequence
  SiRNA target sequence
gaacaaaagatagcatcaata

SEQ ID NO: 214017 - DNA, 21 bp, Artificial sequence
  SiRNA target sequence
aacaaaagatagcatcaataa

SEQ ID NO: 214018 - DNA, 21 bp, Artificial sequence
  SiRNA target sequence
acaaaagatagcatcaataac

SEQ ID NO: 214019 - DNA, 21 bp, Artificial sequence
  SiRNA target sequence
caaaagatagcatcaataact

SEQ ID NO: 214020 - DNA, 21 bp, Artificial sequence
  SiRNA target sequence
aaaagatagcatcaataactg

SEQ ID NO: 214021 - DNA, 21 bp, Artificial sequence
  SiRNA target sequence
aaagatagcatcaataactgt

SEQ ID NO: 214022 - DNA, 21 bp, Artificial sequence
  SiRNA target sequence
aagatagcatcaataactgtt

SEQ ID NO: 214023 - DNA, 21 bp, Artificial sequence
  SiRNA target sequence
agatagcatcaataactgtta

SEQ ID NO: 214024 - DNA, 21 bp, Artificial sequence
  SiRNA target sequence
gatagcatcaataactgttat

SEQ ID NO: 214025 - DNA, 21 bp, Artificial sequence
  SiRNA target sequence
atagcatcaataactgttatt

SEQ ID NO: 214026 - DNA, 21 bp, Artificial sequence
  SiRNA target sequence
tagcatcaataactgttatta

SEQ ID NO: 214027 - DNA, 21 bp, Artificial sequence
  SiRNA target sequence
agcatcaataactgttattat

SEQ ID NO: 214028 - DNA, 21 bp, Artificial sequence
  SiRNA target sequence
gcatcaataactgttattatc

SEQ ID NO: 214029 - DNA, 21 bp, Artificial sequence
  SiRNA target sequence
catcaataactgttattatcc

SEQ ID NO: 214030 - DNA, 21 bp, Artificial sequence
  SiRNA target sequence
atcaataactgttattatcct

SEQ ID NO: 214031 - DNA, 21 bp, Artificial sequence
  SiRNA target sequence
tcaataactgttattatcctg

SEQ ID NO: 214032 - DNA, 21 bp, Artificial sequence
  SiRNA target sequence
caataactgttattatcctgc

SEQ ID NO: 214033 - DNA, 21 bp, Artificial sequence
  SiRNA target sequence
aataactgttattatcctgct

SEQ ID NO: 214034 - DNA, 21 bp, Artificial sequence
  SiRNA target sequence
ataactgttattatcctgctt

SEQ ID NO: 214035 - DNA, 21 bp, Artificial sequence
  SiRNA target sequence
taactgttattatcctgcttt

SEQ ID NO: 214036 - DNA, 21 bp, Artificial sequence
  SiRNA target sequence
aactgttattatcctgctttt

SEQ ID NO: 214037 - DNA, 21 bp, Artificial sequence
  SiRNA target sequence
actgttattatcctgctttta

SEQ ID NO: 214038 - DNA, 21 bp, Artificial sequence
  SiRNA target sequence
ctgttattatcctgcttttat

SEQ ID NO: 214039 - DNA, 21 bp, Artificial sequence
  SiRNA target sequence
tgttattatcctgcttttatc

SEQ ID NO: 214040 - DNA, 21 bp, Artificial sequence
  SiRNA target sequence
gttattatcctgcttttatca

SEQ ID NO: 214041 - DNA, 21 bp, Artificial sequence
  SiRNA target sequence
ttattatcctgcttttatcac

SEQ ID NO: 214042 - DNA, 21 bp, Artificial sequence
  SiRNA target sequence
tattatcctgcttttatcacc

SEQ ID NO: 214043 - DNA, 21 bp, Artificial sequence
  SiRNA target sequence
attatcctgcttttatcacca

SEQ ID NO: 214044 - DNA, 21 bp, Artificial sequence
  SiRNA target sequence
ttatcctgcttttatcaccat

SEQ ID NO: 214045 - DNA, 21 bp, Artificial sequence
  SiRNA target sequence
tatcctgcttttatcaccatt

SEQ ID NO: 214046 - DNA, 21 bp, Artificial sequence
  SiRNA target sequence
atcctgcttttatcaccattt

SEQ ID NO: 214047 - DNA, 21 bp, Artificial sequence
  SiRNA target sequence
tcctgcttttatcaccatttc

SEQ ID NO: 214048 - DNA, 21 bp, Artificial sequence
  SiRNA target sequence
cctgcttttatcaccatttcc

SEQ ID NO: 214049 - DNA, 21 bp, Artificial sequence
  SiRNA target sequence
ctgcttttatcaccatttcca

SEQ ID NO: 214050 - DNA, 21 bp, Artificial sequence
  SiRNA target sequence
tgcttttatcaccatttccaa

SEQ ID NO: 214051 - DNA, 21 bp, Artificial sequence
  SiRNA target sequence
gcttttatcaccatttccaaa

SEQ ID NO: 214052 - DNA, 21 bp, Artificial sequence
  SiRNA target sequence
cttttatcaccatttccaaaa

SEQ ID NO: 214053 - DNA, 21 bp, Artificial sequence
  SiRNA target sequence
ttttatcaccatttccaaaat

SEQ ID NO: 214054 - DNA, 21 bp, Artificial sequence
  SiRNA target sequence
tttatcaccatttccaaaatt

SEQ ID NO: 214055 - DNA, 21 bp, Artificial sequence
  SiRNA target sequence
ttatcaccatttccaaaatta

SEQ ID NO: 214056 - DNA, 21 bp, Artificial sequence
  SiRNA target sequence
tatcaccatttccaaaattaa

SEQ ID NO: 214057 - DNA, 21 bp, Artificial sequence
  SiRNA target sequence
atcaccatttccaaaattaat

SEQ ID NO: 214058 - DNA, 21 bp, Artificial sequence
  SiRNA target sequence
tcaccatttccaaaattaata

SEQ ID NO: 214059 - DNA, 21 bp, Artificial sequence
  SiRNA target sequence
caccatttccaaaattaatac

SEQ ID NO: 214060 - DNA, 21 bp, Artificial sequence
  SiRNA target sequence
accatttccaaaattaataca

SEQ ID NO: 214061 - DNA, 21 bp, Artificial sequence
  SiRNA target sequence
ccatttccaaaattaatacaa

SEQ ID NO: 214062 - DNA, 21 bp, Artificial sequence
  SiRNA target sequence
catttccaaaattaatacaaa

SEQ ID NO: 214063 - DNA, 21 bp, Artificial sequence
  SiRNA target sequence
atttccaaaattaatacaaac

SEQ ID NO: 214064 - DNA, 21 bp, Artificial sequence
  SiRNA target sequence
tttccaaaattaatacaaacc

SEQ ID NO: 214065 - DNA, 21 bp, Artificial sequence
  SiRNA target sequence
ttccaaaattaatacaaacca

SEQ ID NO: 214066 - DNA, 21 bp, Artificial sequence
  SiRNA target sequence
tccaaaattaatacaaaccaa

SEQ ID NO: 214067 - DNA, 21 bp, Artificial sequence
  SiRNA target sequence
ccaaaattaatacaaaccaaa

SEQ ID NO: 214068 - DNA, 21 bp, Artificial sequence
  SiRNA target sequence
caaaattaatacaaaccaaag

SEQ ID NO: 214069 - DNA, 21 bp, Artificial sequence
  SiRNA target sequence
aaaattaatacaaaccaaagg

SEQ ID NO: 214070 - DNA, 21 bp, Artificial sequence
  SiRNA target sequence
aaattaatacaaaccaaagga

SEQ ID NO: 214071 - DNA, 21 bp, Artificial sequence
  SiRNA target sequence
aattaatacaaaccaaaggat

SEQ ID NO: 214072 - DNA, 21 bp, Artificial sequence
  SiRNA target sequence
attaatacaaaccaaaggatg

SEQ ID NO: 214073 - DNA, 21 bp, Artificial sequence
  SiRNA target sequence
ttaatacaaaccaaaggatgg

SEQ ID NO: 214074 - DNA, 21 bp, Artificial sequence
  SiRNA target sequence
taatacaaaccaaaggatgga

SEQ ID NO: 214075 - DNA, 21 bp, Artificial sequence
  SiRNA target sequence
aatacaaaccaaaggatggat

SEQ ID NO: 214076 - DNA, 21 bp, Artificial sequence
  SiRNA target sequence
atacaaaccaaaggatggata

SEQ ID NO: 214077 - DNA, 21 bp, Artificial sequence
  SiRNA target sequence
tacaaaccaaaggatggatat

SEQ ID NO: 214078 - DNA, 21 bp, Artificial sequence
  SiRNA target sequence
acaaaccaaaggatggatatt

SEQ ID NO: 214079 - DNA, 21 bp, Artificial sequence
  SiRNA target sequence
caaaccaaaggatggatattt

SEQ ID NO: 214080 - DNA, 21 bp, Artificial sequence
  SiRNA target sequence
aaaccaaaggatggatatttg

SEQ ID NO: 214081 - DNA, 21 bp, Artificial sequence
  SiRNA target sequence
aaccaaaggatggatatttgt

SEQ ID NO: 214082 - DNA, 21 bp, Artificial sequence
  SiRNA target sequence
accaaaggatggatatttgtt

SEQ ID NO: 214083 - DNA, 21 bp, Artificial sequence
  SiRNA target sequence
ccaaaggatggatatttgttg

SEQ ID NO: 214084 - DNA, 21 bp, Artificial sequence
  SiRNA target sequence
caaaggatggatatttgttgc

SEQ ID NO: 214085 - DNA, 21 bp, Artificial sequence
  SiRNA target sequence
aaaggatggatatttgttgcc

SEQ ID NO: 214086 - DNA, 21 bp, Artificial sequence
  SiRNA target sequence
aaggatggatatttgttgcca

SEQ ID NO: 214087 - DNA, 21 bp, Artificial sequence
  SiRNA target sequence
aggatggatatttgttgccat

SEQ ID NO: 214088 - DNA, 21 bp, Artificial sequence
  SiRNA target sequence
ggatggatatttgttgccata

SEQ ID NO: 214089 - DNA, 21 bp, Artificial sequence
  SiRNA target sequence
gatggatatttgttgccatag

SEQ ID NO: 214090 - DNA, 21 bp, Artificial sequence
  SiRNA target sequence
atggatatttgttgccatagc

SEQ ID NO: 214091 - DNA, 21 bp, Artificial sequence
  SiRNA target sequence
tggatatttgttgccatagcg

SEQ ID NO: 214092 - DNA, 21 bp, Artificial sequence
  SiRNA target sequence
ggatatttgttgccatagcgt

SEQ ID NO: 214093 - DNA, 21 bp, Artificial sequence
  SiRNA target sequence
gatatttgttgccatagcgtg

SEQ ID NO: 214094 - DNA, 21 bp, Artificial sequence
  SiRNA target sequence
atatttgttgccatagcgtgc

SEQ ID NO: 214095 - DNA, 21 bp, Artificial sequence
  SiRNA target sequence
tatttgttgccatagcgtgcc

SEQ ID NO: 214096 - DNA, 21 bp, Artificial sequence
  SiRNA target sequence
atttgttgccatagcgtgccc

SEQ ID NO: 214097 - DNA, 21 bp, Artificial sequence
  SiRNA target sequence
tttgttgccatagcgtgccca

SEQ ID NO: 214098 - DNA, 21 bp, Artificial sequence
  SiRNA target sequence
ttgttgccatagcgtgcccac

SEQ ID NO: 214099 - DNA, 21 bp, Artificial sequence
  SiRNA target sequence
tgttgccatagcgtgcccact

SEQ ID NO: 214100 - DNA, 21 bp, Artificial sequence
  SiRNA target sequence
gttgccatagcgtgcccactt

SEQ ID NO: 214101 - DNA, 21 bp, Artificial sequence
  SiRNA target sequence
ttgccatagcgtgcccactta

SEQ ID NO: 214102 - DNA, 21 bp, Artificial sequence
  SiRNA target sequence
tgccatagcgtgcccacttat

SEQ ID NO: 214103 - DNA, 21 bp, Artificial sequence
  SiRNA target sequence
gccatagcgtgcccacttatt

SEQ ID NO: 214104 - DNA, 21 bp, Artificial sequence
  SiRNA target sequence
ccatagcgtgcccacttatta

SEQ ID NO: 214105 - DNA, 21 bp, Artificial sequence
  SiRNA target sequence
catagcgtgcccacttattac

SEQ ID NO: 214106 - DNA, 21 bp, Artificial sequence
  SiRNA target sequence
atagcgtgcccacttattacc

SEQ ID NO: 214107 - DNA, 21 bp, Artificial sequence
  SiRNA target sequence
tagcgtgcccacttattaccc

SEQ ID NO: 214108 - DNA, 21 bp, Artificial sequence
  SiRNA target sequence
agcgtgcccacttattaccct

SEQ ID NO: 214109 - DNA, 21 bp, Artificial sequence
  SiRNA target sequence
gcgtgcccacttattaccctt

SEQ ID NO: 214110 - DNA, 21 bp, Artificial sequence
  SiRNA target sequence
cgtgcccacttattacccttt

SEQ ID NO: 214111 - DNA, 21 bp, Artificial sequence
  SiRNA target sequence
gtgcccacttattaccctttt

SEQ ID NO: 214112 - DNA, 21 bp, Artificial sequence
  SiRNA target sequence
tgcccacttattacccttttt

SEQ ID NO: 214113 - DNA, 21 bp, Artificial sequence
  SiRNA target sequence
gcccacttattaccctttttg

SEQ ID NO: 214114 - DNA, 21 bp, Artificial sequence
  SiRNA target sequence
cccacttattaccctttttgc

SEQ ID NO: 214115 - DNA, 21 bp, Artificial sequence
  SiRNA target sequence
ccacttattaccctttttgct

SEQ ID NO: 214116 - DNA, 21 bp, Artificial sequence
  SiRNA target sequence
cacttattaccctttttgctg

SEQ ID NO: 214117 - DNA, 21 bp, Artificial sequence
  SiRNA target sequence
acttattaccctttttgctgt

SEQ ID NO: 214118 - DNA, 21 bp, Artificial sequence
  SiRNA target sequence
cttattaccctttttgctgta

SEQ ID NO: 214119 - DNA, 21 bp, Artificial sequence
  SiRNA target sequence
ttattaccctttttgctgtag

SEQ ID NO: 214120 - DNA, 21 bp, Artificial sequence
  SiRNA target sequence
tattaccctttttgctgtagt

SEQ ID NO: 214121 - DNA, 21 bp, Artificial sequence
  SiRNA target sequence
attaccctttttgctgtagtt

SEQ ID NO: 214122 - DNA, 21 bp, Artificial sequence
  SiRNA target sequence
ttaccctttttgctgtagttt

SEQ ID NO: 214123 - DNA, 21 bp, Artificial sequence
  SiRNA target sequence
taccctttttgctgtagtttc

SEQ ID NO: 214124 - DNA, 21 bp, Artificial sequence
  SiRNA target sequence
accctttttgctgtagtttct

SEQ ID NO: 214125 - DNA, 21 bp, Artificial sequence
  SiRNA target sequence
ccctttttgctgtagtttctg

SEQ ID NO: 214126 - DNA, 21 bp, Artificial sequence
  SiRNA target sequence
cctttttgctgtagtttctgt

SEQ ID NO: 214127 - DNA, 21 bp, Artificial sequence
  SiRNA target sequence
ctttttgctgtagtttctgtg

SEQ ID NO: 214128 - DNA, 21 bp, Artificial sequence
  SiRNA target sequence
tttttgctgtagtttctgtgt

SEQ ID NO: 214129 - DNA, 21 bp, Artificial sequence
  SiRNA target sequence
ttttgctgtagtttctgtgtg

SEQ ID NO: 214130 - DNA, 21 bp, Artificial sequence
  SiRNA target sequence
tttgctgtagtttctgtgtgt

SEQ ID NO: 214131 - DNA, 21 bp, Artificial sequence
  SiRNA target sequence
ttgctgtagtttctgtgtgtg

SEQ ID NO: 214132 - DNA, 21 bp, Artificial sequence
  SiRNA target sequence
tgctgtagtttctgtgtgtgg

SEQ ID NO: 214133 - DNA, 21 bp, Artificial sequence
  SiRNA target sequence
gctgtagtttctgtgtgtggt

SEQ ID NO: 214134 - DNA, 21 bp, Artificial sequence
  SiRNA target sequence
ctgtagtttctgtgtgtggtc

SEQ ID NO: 214135 - DNA, 21 bp, Artificial sequence
  SiRNA target sequence
tgtagtttctgtgtgtggtct

SEQ ID NO: 214136 - DNA, 21 bp, Artificial sequence
  SiRNA target sequence
gtagtttctgtgtgtggtctt

SEQ ID NO: 214137 - DNA, 21 bp, Artificial sequence
  SiRNA target sequence
tagtttctgtgtgtggtcttg

SEQ ID NO: 214138 - DNA, 21 bp, Artificial sequence
  SiRNA target sequence
agtttctgtgtgtggtcttgc

SEQ ID NO: 214139 - DNA, 21 bp, Artificial sequence
  SiRNA target sequence
gtttctgtgtgtggtcttgct

SEQ ID NO: 214140 - DNA, 21 bp, Artificial sequence
  SiRNA target sequence
tttctgtgtgtggtcttgctt

SEQ ID NO: 214141 - DNA, 21 bp, Artificial sequence
  SiRNA target sequence
ttctgtgtgtggtcttgcttt

SEQ ID NO: 214142 - DNA, 21 bp, Artificial sequence
  SiRNA target sequence
tctgtgtgtggtcttgctttt

SEQ ID NO: 214143 - DNA, 21 bp, Artificial sequence
  SiRNA target sequence
ctgtgtgtggtcttgcttttt

SEQ ID NO: 214144 - DNA, 21 bp, Artificial sequence
  SiRNA target sequence
tgtgtgtggtcttgcttttta

SEQ ID NO: 214145 - DNA, 21 bp, Artificial sequence
  SiRNA target sequence
gtgtgtggtcttgctttttac

SEQ ID NO: 214146 - DNA, 21 bp, Artificial sequence
  SiRNA target sequence
tgtgtggtcttgctttttaca

SEQ ID NO: 214147 - DNA, 21 bp, Artificial sequence
  SiRNA target sequence
gtgtggtcttgctttttacaa

SEQ ID NO: 214148 - DNA, 21 bp, Artificial sequence
  SiRNA target sequence
tgtggtcttgctttttacaat

SEQ ID NO: 214149 - DNA, 21 bp, Artificial sequence
  SiRNA target sequence
gtggtcttgctttttacaatt

SEQ ID NO: 214150 - DNA, 21 bp, Artificial sequence
  SiRNA target sequence
tggtcttgctttttacaatta

SEQ ID NO: 214151 - DNA, 21 bp, Artificial sequence
  SiRNA target sequence
ggtcttgctttttacaattat

SEQ ID NO: 214152 - DNA, 21 bp, Artificial sequence
  SiRNA target sequence
gtcttgctttttacaattatc

SEQ ID NO: 214153 - DNA, 21 bp, Artificial sequence
  SiRNA target sequence
tcttgctttttacaattatcc

SEQ ID NO: 214154 - DNA, 21 bp, Artificial sequence
  SiRNA target sequence
cttgctttttacaattatccg

SEQ ID NO: 214155 - DNA, 21 bp, Artificial sequence
  SiRNA target sequence
ttgctttttacaattatccgg

SEQ ID NO: 214156 - DNA, 21 bp, Artificial sequence
  SiRNA target sequence
tgctttttacaattatccggc

SEQ ID NO: 214157 - DNA, 21 bp, Artificial sequence
  SiRNA target sequence
gctttttacaattatccggca

SEQ ID NO: 214158 - DNA, 21 bp, Artificial sequence
  SiRNA target sequence
ctttttacaattatccggcaa

SEQ ID NO: 214159 - DNA, 21 bp, Artificial sequence
  SiRNA target sequence
tttttacaattatccggcaac

SEQ ID NO: 214160 - DNA, 21 bp, Artificial sequence
  SiRNA target sequence
ttttacaattatccggcaaca

SEQ ID NO: 214161 - DNA, 21 bp, Artificial sequence
  SiRNA target sequence
tttacaattatccggcaacaa

SEQ ID NO: 214162 - DNA, 21 bp, Artificial sequence
  SiRNA target sequence
ttacaattatccggcaacaaa

SEQ ID NO: 214163 - DNA, 21 bp, Artificial sequence
  SiRNA target sequence
tacaattatccggcaacaaat

SEQ ID NO: 214164 - DNA, 21 bp, Artificial sequence
  SiRNA target sequence
acaattatccggcaacaaata

SEQ ID NO: 214165 - DNA, 21 bp, Artificial sequence
  SiRNA target sequence
caattatccggcaacaaataa

SEQ ID NO: 214166 - DNA, 21 bp, Artificial sequence
  SiRNA target sequence
aattatccggcaacaaataat

SEQ ID NO: 214167 - DNA, 21 bp, Artificial sequence
  SiRNA target sequence
attatccggcaacaaataatg

SEQ ID NO: 214168 - DNA, 21 bp, Artificial sequence
  SiRNA target sequence
ttatccggcaacaaataatga

SEQ ID NO: 214169 - DNA, 21 bp, Artificial sequence
  SiRNA target sequence
tatccggcaacaaataatgac

SEQ ID NO: 214170 - DNA, 21 bp, Artificial sequence
  SiRNA target sequence
atccggcaacaaataatgaca

SEQ ID NO: 214171 - DNA, 21 bp, Artificial sequence
  SiRNA target sequence
tccggcaacaaataatgacac

SEQ ID NO: 214172 - DNA, 21 bp, Artificial sequence
  SiRNA target sequence
ccggcaacaaataatgacaca

SEQ ID NO: 214173 - DNA, 21 bp, Artificial sequence
  SiRNA target sequence
cggcaacaaataatgacacaa

SEQ ID NO: 214174 - DNA, 21 bp, Artificial sequence
  SiRNA target sequence
ggcaacaaataatgacacaaa

SEQ ID NO: 214175 - DNA, 21 bp, Artificial sequence
  SiRNA target sequence
gcaacaaataatgacacaaat

SEQ ID NO: 214176 - DNA, 21 bp, Artificial sequence
  SiRNA target sequence
caacaaataatgacacaaatt

SEQ ID NO: 214177 - DNA, 21 bp, Artificial sequence
  SiRNA target sequence
aacaaataatgacacaaattt

SEQ ID NO: 214178 - DNA, 21 bp, Artificial sequence
  SiRNA target sequence
acaaataatgacacaaatttt

SEQ ID NO: 214179 - DNA, 21 bp, Artificial sequence
  SiRNA target sequence
caaataatgacacaaattttt

SEQ ID NO: 214180 - DNA, 21 bp, Artificial sequence
  SiRNA target sequence
aaataatgacacaaatttttt

SEQ ID NO: 214181 - DNA, 21 bp, Artificial sequence
  SiRNA target sequence
aataatgacacaaattttttt

SEQ ID NO: 214182 - DNA, 21 bp, Artificial sequence
  SiRNA target sequence
ataatgacacaaatttttttc

SEQ ID NO: 214183 - DNA, 21 bp, Artificial sequence
  SiRNA target sequence
taatgacacaaatttttttct

SEQ ID NO: 214184 - DNA, 21 bp, Artificial sequence
  SiRNA target sequence
aatgacacaaatttttttcta

SEQ ID NO: 214185 - DNA, 21 bp, Artificial sequence
  SiRNA target sequence
atgacacaaatttttttctaa

SEQ ID NO: 214186 - DNA, 21 bp, Artificial sequence
  SiRNA target sequence
tgacacaaatttttttctaaa

SEQ ID NO: 214187 - DNA, 21 bp, Artificial sequence
  SiRNA target sequence
gacacaaatttttttctaaat

SEQ ID NO: 214188 - DNA, 21 bp, Artificial sequence
  SiRNA target sequence
acacaaatttttttctaaatt

SEQ ID NO: 214189 - DNA, 21 bp, Artificial sequence
  SiRNA target sequence
cacaaatttttttctaaattc

SEQ ID NO: 214190 - DNA, 21 bp, Artificial sequence
  SiRNA target sequence
acaaatttttttctaaattca

SEQ ID NO: 214191 - DNA, 21 bp, Artificial sequence
  SiRNA target sequence
caaatttttttctaaattcat

SEQ ID NO: 214192 - DNA, 21 bp, Artificial sequence
  SiRNA target sequence
aaatttttttctaaattcatt

SEQ ID NO: 214193 - DNA, 21 bp, Artificial sequence
  SiRNA target sequence
aatttttttctaaattcatta

SEQ ID NO: 214194 - DNA, 21 bp, Artificial sequence
  SiRNA target sequence
atttttttctaaattcattat

SEQ ID NO: 214195 - DNA, 21 bp, Artificial sequence
  SiRNA target sequence
tttttttctaaattcattatg

SEQ ID NO: 214196 - DNA, 21 bp, Artificial sequence
  SiRNA target sequence
ttttttctaaattcattatgt

SEQ ID NO: 214197 - DNA, 21 bp, Artificial sequence
  SiRNA target sequence
tttttctaaattcattatgtg

SEQ ID NO: 214198 - DNA, 21 bp, Artificial sequence
  SiRNA target sequence
ttttctaaattcattatgtgc

SEQ ID NO: 214199 - DNA, 21 bp, Artificial sequence
  SiRNA target sequence
tttctaaattcattatgtgct

SEQ ID NO: 214200 - DNA, 21 bp, Artificial sequence
  SiRNA target sequence
ttctaaattcattatgtgcta

SEQ ID NO: 214201 - DNA, 21 bp, Artificial sequence
  SiRNA target sequence
tctaaattcattatgtgctac

SEQ ID NO: 214202 - DNA, 21 bp, Artificial sequence
  SiRNA target sequence
ctaaattcattatgtgctacg

SEQ ID NO: 214203 - DNA, 21 bp, Artificial sequence
  SiRNA target sequence
taaattcattatgtgctacgc

SEQ ID NO: 214204 - DNA, 21 bp, Artificial sequence
  SiRNA target sequence
aaattcattatgtgctacgcc

SEQ ID NO: 214205 - DNA, 21 bp, Artificial sequence
  SiRNA target sequence
aattcattatgtgctacgccc

SEQ ID NO: 214206 - DNA, 21 bp, Artificial sequence
  SiRNA target sequence
attcattatgtgctacgcccg

SEQ ID NO: 214207 - DNA, 21 bp, Artificial sequence
  SiRNA target sequence
ttcattatgtgctacgcccgg

SEQ ID NO: 214208 - DNA, 21 bp, Artificial sequence
  SiRNA target sequence
tcattatgtgctacgcccggt

SEQ ID NO: 214209 - DNA, 21 bp, Artificial sequence
  SiRNA target sequence
cattatgtgctacgcccggta

SEQ ID NO: 214210 - DNA, 21 bp, Artificial sequence
  SiRNA target sequence
attatgtgctacgcccggtaa

SEQ ID NO: 214211 - DNA, 21 bp, Artificial sequence
  SiRNA target sequence
ttatgtgctacgcccggtaaa

SEQ ID NO: 214212 - DNA, 21 bp, Artificial sequence
  SiRNA target sequence
tatgtgctacgcccggtaaat

SEQ ID NO: 214213 - DNA, 21 bp, Artificial sequence
  SiRNA target sequence
atgtgctacgcccggtaaatc

SEQ ID NO: 214214 - DNA, 21 bp, Artificial sequence
  SiRNA target sequence
tgtgctacgcccggtaaatcg

SEQ ID NO: 214215 - DNA, 21 bp, Artificial sequence
  SiRNA target sequence
gtgctacgcccggtaaatcgt

SEQ ID NO: 214216 - DNA, 21 bp, Artificial sequence
  SiRNA target sequence
tgctacgcccggtaaatcgtt

SEQ ID NO: 214217 - DNA, 21 bp, Artificial sequence
  SiRNA target sequence
gctacgcccggtaaatcgttt

SEQ ID NO: 214218 - DNA, 21 bp, Artificial sequence
  SiRNA target sequence
ctacgcccggtaaatcgttta

SEQ ID NO: 214219 - DNA, 21 bp, Artificial sequence
  SiRNA target sequence
tacgcccggtaaatcgtttat

SEQ ID NO: 214220 - DNA, 21 bp, Artificial sequence
  SiRNA target sequence
acgcccggtaaatcgtttata

SEQ ID NO: 214221 - DNA, 21 bp, Artificial sequence
  SiRNA target sequence
cgcccggtaaatcgtttataa

SEQ ID NO: 214222 - DNA, 21 bp, Artificial sequence
  SiRNA target sequence
gcccggtaaatcgtttataaa

SEQ ID NO: 214223 - DNA, 21 bp, Artificial sequence
  SiRNA target sequence
cccggtaaatcgtttataaaa

SEQ ID NO: 214224 - DNA, 21 bp, Artificial sequence
  SiRNA target sequence
ccggtaaatcgtttataaaat

SEQ ID NO: 214225 - DNA, 21 bp, Artificial sequence
  SiRNA target sequence
cggtaaatcgtttataaaatt

SEQ ID NO: 214226 - DNA, 21 bp, Artificial sequence
  SiRNA target sequence
ggtaaatcgtttataaaatta

SEQ ID NO: 214227 - DNA, 21 bp, Artificial sequence
  SiRNA target sequence
gtaaatcgtttataaaattag

SEQ ID NO: 214228 - DNA, 21 bp, Artificial sequence
  SiRNA target sequence
taaatcgtttataaaattaga

SEQ ID NO: 214229 - DNA, 21 bp, Artificial sequence
  SiRNA target sequence
aaatcgtttataaaattagaa

SEQ ID NO: 214230 - DNA, 21 bp, Artificial sequence
  SiRNA target sequence
aatcgtttataaaattagaaa

SEQ ID NO: 214231 - DNA, 21 bp, Artificial sequence
  SiRNA target sequence
atcgtttataaaattagaaaa

SEQ ID NO: 214232 - DNA, 21 bp, Artificial sequence
  SiRNA target sequence
tcgtttataaaattagaaaat

SEQ ID NO: 214233 - DNA, 21 bp, Artificial sequence
  SiRNA target sequence
cgtttataaaattagaaaatg

SEQ ID NO: 214234 - DNA, 21 bp, Artificial sequence
  SiRNA target sequence
gtttataaaattagaaaatgt

SEQ ID NO: 214235 - DNA, 21 bp, Artificial sequence
  SiRNA target sequence
tttataaaattagaaaatgtt

SEQ ID NO: 214236 - DNA, 21 bp, Artificial sequence
  SiRNA target sequence
ttataaaattagaaaatgttt

SEQ ID NO: 214237 - DNA, 21 bp, Artificial sequence
  SiRNA target sequence
tataaaattagaaaatgtttt

SEQ ID NO: 214238 - DNA, 21 bp, Artificial sequence
  SiRNA target sequence
ataaaattagaaaatgtttta

SEQ ID NO: 214239 - DNA, 21 bp, Artificial sequence
  SiRNA target sequence
taaaattagaaaatgttttag

SEQ ID NO: 214240 - DNA, 21 bp, Artificial sequence
  SiRNA target sequence
aaaattagaaaatgttttagg

SEQ ID NO: 214241 - DNA, 21 bp, Artificial sequence
  SiRNA target sequence
aaattagaaaatgttttagga

SEQ ID NO: 214242 - DNA, 21 bp, Artificial sequence
  SiRNA target sequence
aattagaaaatgttttaggat

SEQ ID NO: 214243 - DNA, 21 bp, Artificial sequence
  SiRNA target sequence
attagaaaatgttttaggatg

SEQ ID NO: 214244 - DNA, 21 bp, Artificial sequence
  SiRNA target sequence
ttagaaaatgttttaggatgt

SEQ ID NO: 214245 - DNA, 21 bp, Artificial sequence
  SiRNA target sequence
tagaaaatgttttaggatgtg

SEQ ID NO: 214246 - DNA, 21 bp, Artificial sequence
  SiRNA target sequence
agaaaatgttttaggatgtgt

SEQ ID NO: 214247 - DNA, 21 bp, Artificial sequence
  SiRNA target sequence
gaaaatgttttaggatgtgta

SEQ ID NO: 214248 - DNA, 21 bp, Artificial sequence
  SiRNA target sequence
aaaatgttttaggatgtgtag

SEQ ID NO: 214249 - DNA, 21 bp, Artificial sequence
  SiRNA target sequence
aaatgttttaggatgtgtagc

SEQ ID NO: 214250 - DNA, 21 bp, Artificial sequence
  SiRNA target sequence
aatgttttaggatgtgtagct

SEQ ID NO: 214251 - DNA, 21 bp, Artificial sequence
  SiRNA target sequence
atgttttaggatgtgtagctg

SEQ ID NO: 214252 - DNA, 21 bp, Artificial sequence
  SiRNA target sequence
tgttttaggatgtgtagctgt

SEQ ID NO: 214253 - DNA, 21 bp, Artificial sequence
  SiRNA target sequence
gttttaggatgtgtagctgta

SEQ ID NO: 214254 - DNA, 21 bp, Artificial sequence
  SiRNA target sequence
ttttaggatgtgtagctgtag

SEQ ID NO: 214255 - DNA, 21 bp, Artificial sequence
  SiRNA target sequence
tttaggatgtgtagctgtagc

SEQ ID NO: 214256 - DNA, 21 bp, Artificial sequence
  SiRNA target sequence
ttaggatgtgtagctgtagct

SEQ ID NO: 214257 - DNA, 21 bp, Artificial sequence
  SiRNA target sequence
taggatgtgtagctgtagctc

SEQ ID NO: 214258 - DNA, 21 bp, Artificial sequence
  SiRNA target sequence
aggatgtgtagctgtagctct

SEQ ID NO: 214259 - DNA, 21 bp, Artificial sequence
  SiRNA target sequence
ggatgtgtagctgtagctctt

SEQ ID NO: 214260 - DNA, 21 bp, Artificial sequence
  SiRNA target sequence
gatgtgtagctgtagctctta

SEQ ID NO: 214261 - DNA, 21 bp, Artificial sequence
  SiRNA target sequence
atgtgtagctgtagctcttat

SEQ ID NO: 214262 - DNA, 21 bp, Artificial sequence
  SiRNA target sequence
tgtgtagctgtagctcttatg

SEQ ID NO: 214263 - DNA, 21 bp, Artificial sequence
  SiRNA target sequence
gtgtagctgtagctcttatga

SEQ ID NO: 214264 - DNA, 21 bp, Artificial sequence
  SiRNA target sequence
tgtagctgtagctcttatgaa

SEQ ID NO: 214265 - DNA, 21 bp, Artificial sequence
  SiRNA target sequence
gtagctgtagctcttatgaaa

SEQ ID NO: 214266 - DNA, 21 bp, Artificial sequence
  SiRNA target sequence
tagctgtagctcttatgaaag

SEQ ID NO: 214267 - DNA, 21 bp, Artificial sequence
  SiRNA target sequence
agctgtagctcttatgaaagt

SEQ ID NO: 214268 - DNA, 21 bp, Artificial sequence
  SiRNA target sequence
gctgtagctcttatgaaagta

SEQ ID NO: 214269 - DNA, 21 bp, Artificial sequence
  SiRNA target sequence
ctgtagctcttatgaaagtag

SEQ ID NO: 214270 - DNA, 21 bp, Artificial sequence
  SiRNA target sequence
tgtagctcttatgaaagtagc

SEQ ID NO: 214271 - DNA, 21 bp, Artificial sequence
  SiRNA target sequence
gtagctcttatgaaagtagca

SEQ ID NO: 214272 - DNA, 21 bp, Artificial sequence
  SiRNA target sequence
tagctcttatgaaagtagcaa

SEQ ID NO: 214273 - DNA, 21 bp, Artificial sequence
  SiRNA target sequence
agctcttatgaaagtagcaaa

SEQ ID NO: 214274 - DNA, 21 bp, Artificial sequence
  SiRNA target sequence
gctcttatgaaagtagcaaaa

SEQ ID NO: 214275 - DNA, 21 bp, Artificial sequence
  SiRNA target sequence
ctcttatgaaagtagcaaaat

SEQ ID NO: 214276 - DNA, 21 bp, Artificial sequence
  SiRNA target sequence
tcttatgaaagtagcaaaata

SEQ ID NO: 214277 - DNA, 21 bp, Artificial sequence
  SiRNA target sequence
cttatgaaagtagcaaaatat

SEQ ID NO: 214278 - DNA, 21 bp, Artificial sequence
  SiRNA target sequence
ttatgaaagtagcaaaatatg

SEQ ID NO: 214279 - DNA, 21 bp, Artificial sequence
  SiRNA target sequence
tatgaaagtagcaaaatatgg

SEQ ID NO: 214280 - DNA, 21 bp, Artificial sequence
  SiRNA target sequence
atgaaagtagcaaaatatggc

SEQ ID NO: 214281 - DNA, 21 bp, Artificial sequence
  SiRNA target sequence
tgaaagtagcaaaatatggct

SEQ ID NO: 214282 - DNA, 21 bp, Artificial sequence
  SiRNA target sequence
gaaagtagcaaaatatggctc

SEQ ID NO: 214283 - DNA, 21 bp, Artificial sequence
  SiRNA target sequence
aaagtagcaaaatatggctct

SEQ ID NO: 214284 - DNA, 21 bp, Artificial sequence
  SiRNA target sequence
aagtagcaaaatatggctctt

SEQ ID NO: 214285 - DNA, 21 bp, Artificial sequence
  SiRNA target sequence
agtagcaaaatatggctcttt

SEQ ID NO: 214286 - DNA, 21 bp, Artificial sequence
  SiRNA target sequence
gtagcaaaatatggctctttt

SEQ ID NO: 214287 - DNA, 21 bp, Artificial sequence
  SiRNA target sequence
tagcaaaatatggctcttttg

SEQ ID NO: 214288 - DNA, 21 bp, Artificial sequence
  SiRNA target sequence
agcaaaatatggctcttttga

SEQ ID NO: 214289 - DNA, 21 bp, Artificial sequence
  SiRNA target sequence
gcaaaatatggctcttttgat

SEQ ID NO: 214290 - DNA, 21 bp, Artificial sequence
  SiRNA target sequence
caaaatatggctcttttgata

SEQ ID NO: 214291 - DNA, 21 bp, Artificial sequence
  SiRNA target sequence
aaaatatggctcttttgatat

SEQ ID NO: 214292 - DNA, 21 bp, Artificial sequence
  SiRNA target sequence
aaatatggctcttttgatatt

SEQ ID NO: 214293 - DNA, 21 bp, Artificial sequence
  SiRNA target sequence
aatatggctcttttgatattt

SEQ ID NO: 214294 - DNA, 21 bp, Artificial sequence
  SiRNA target sequence
atatggctcttttgatatttc

SEQ ID NO: 214295 - DNA, 21 bp, Artificial sequence
  SiRNA target sequence
tatggctcttttgatatttcc

SEQ ID NO: 214296 - DNA, 21 bp, Artificial sequence
  SiRNA target sequence
atggctcttttgatatttcca

SEQ ID NO: 214297 - DNA, 21 bp, Artificial sequence
  SiRNA target sequence
tggctcttttgatatttccaa

SEQ ID NO: 214298 - DNA, 21 bp, Artificial sequence
  SiRNA target sequence
ggctcttttgatatttccaaa

SEQ ID NO: 214299 - DNA, 21 bp, Artificial sequence
  SiRNA target sequence
gctcttttgatatttccaaag

SEQ ID NO: 214300 - DNA, 21 bp, Artificial sequence
  SiRNA target sequence
ctcttttgatatttccaaaga

SEQ ID NO: 214301 - DNA, 21 bp, Artificial sequence
  SiRNA target sequence
tcttttgatatttccaaagaa

SEQ ID NO: 214302 - DNA, 21 bp, Artificial sequence
  SiRNA target sequence
cttttgatatttccaaagaag

SEQ ID NO: 214303 - DNA, 21 bp, Artificial sequence
  SiRNA target sequence
ttttgatatttccaaagaagc

SEQ ID NO: 214304 - DNA, 21 bp, Artificial sequence
  SiRNA target sequence
tttgatatttccaaagaagcc

SEQ ID NO: 214305 - DNA, 21 bp, Artificial sequence
  SiRNA target sequence
ttgatatttccaaagaagcca

SEQ ID NO: 214306 - DNA, 21 bp, Artificial sequence
  SiRNA target sequence
tgatatttccaaagaagccat

SEQ ID NO: 214307 - DNA, 21 bp, Artificial sequence
  SiRNA target sequence
gatatttccaaagaagccatt

SEQ ID NO: 214308 - DNA, 21 bp, Artificial sequence
  SiRNA target sequence
atatttccaaagaagccattt

SEQ ID NO: 214309 - DNA, 21 bp, Artificial sequence
  SiRNA target sequence
tatttccaaagaagccatttc

SEQ ID NO: 214310 - DNA, 21 bp, Artificial sequence
  SiRNA target sequence
atttccaaagaagccatttca

SEQ ID NO: 214311 - DNA, 21 bp, Artificial sequence
  SiRNA target sequence
tttccaaagaagccatttcaa

SEQ ID NO: 214312 - DNA, 21 bp, Artificial sequence
  SiRNA target sequence
ttccaaagaagccatttcaat

SEQ ID NO: 214313 - DNA, 21 bp, Artificial sequence
  SiRNA target sequence
tccaaagaagccatttcaatg

SEQ ID NO: 214314 - DNA, 21 bp, Artificial sequence
  SiRNA target sequence
ccaaagaagccatttcaatgc

SEQ ID NO: 214315 - DNA, 21 bp, Artificial sequence
  SiRNA target sequence
caaagaagccatttcaatgca

SEQ ID NO: 214316 - DNA, 21 bp, Artificial sequence
  SiRNA target sequence
aaagaagccatttcaatgcag

SEQ ID NO: 214317 - DNA, 21 bp, Artificial sequence
  SiRNA target sequence
aagaagccatttcaatgcaga

SEQ ID NO: 214318 - DNA, 21 bp, Artificial sequence
  SiRNA target sequence
agaagccatttcaatgcagat

SEQ ID NO: 214319 - DNA, 21 bp, Artificial sequence
  SiRNA target sequence
gaagccatttcaatgcagatt

SEQ ID NO: 214320 - DNA, 21 bp, Artificial sequence
  SiRNA target sequence
aagccatttcaatgcagattg

SEQ ID NO: 214321 - DNA, 21 bp, Artificial sequence
  SiRNA target sequence
agccatttcaatgcagattga

SEQ ID NO: 214322 - DNA, 21 bp, Artificial sequence
  SiRNA target sequence
gccatttcaatgcagattgat

SEQ ID NO: 214323 - DNA, 21 bp, Artificial sequence
  SiRNA target sequence
ccatttcaatgcagattgatt

SEQ ID NO: 214324 - DNA, 21 bp, Artificial sequence
  SiRNA target sequence
catttcaatgcagattgattc

SEQ ID NO: 214325 - DNA, 21 bp, Artificial sequence
  SiRNA target sequence
atttcaatgcagattgattcg

SEQ ID NO: 214326 - DNA, 21 bp, Artificial sequence
  SiRNA target sequence
tttcaatgcagattgattcgt

SEQ ID NO: 214327 - DNA, 21 bp, Artificial sequence
  SiRNA target sequence
ttcaatgcagattgattcgtc

SEQ ID NO: 214328 - DNA, 21 bp, Artificial sequence
  SiRNA target sequence
tcaatgcagattgattcgtca

SEQ ID NO: 214329 - DNA, 21 bp, Artificial sequence
  SiRNA target sequence
caatgcagattgattcgtcat

SEQ ID NO: 214330 - DNA, 21 bp, Artificial sequence
  SiRNA target sequence
aatgcagattgattcgtcatt

SEQ ID NO: 214331 - DNA, 21 bp, Artificial sequence
  SiRNA target sequence
atgcagattgattcgtcattg

SEQ ID NO: 214332 - DNA, 21 bp, Artificial sequence
  SiRNA target sequence
tgcagattgattcgtcattgc

SEQ ID NO: 214333 - DNA, 21 bp, Artificial sequence
  SiRNA target sequence
gcagattgattcgtcattgcg

SEQ ID NO: 214334 - DNA, 21 bp, Artificial sequence
  SiRNA target sequence
cagattgattcgtcattgcgt

SEQ ID NO: 214335 - DNA, 21 bp, Artificial sequence
  SiRNA target sequence
agattgattcgtcattgcgtg

SEQ ID NO: 214336 - DNA, 21 bp, Artificial sequence
  SiRNA target sequence
gattgattcgtcattgcgtgc

SEQ ID NO: 214337 - DNA, 21 bp, Artificial sequence
  SiRNA target sequence
attgattcgtcattgcgtgca

SEQ ID NO: 214338 - DNA, 21 bp, Artificial sequence
  SiRNA target sequence
ttgattcgtcattgcgtgcac

SEQ ID NO: 214339 - DNA, 21 bp, Artificial sequence
  SiRNA target sequence
tgattcgtcattgcgtgcacg

SEQ ID NO: 214340 - DNA, 21 bp, Artificial sequence
  SiRNA target sequence
gattcgtcattgcgtgcacgt

SEQ ID NO: 214341 - DNA, 21 bp, Artificial sequence
  SiRNA target sequence
attcgtcattgcgtgcacgtt

SEQ ID NO: 214342 - DNA, 21 bp, Artificial sequence
  SiRNA target sequence
ttcgtcattgcgtgcacgtta

SEQ ID NO: 214343 - DNA, 21 bp, Artificial sequence
  SiRNA target sequence
tcgtcattgcgtgcacgttat

SEQ ID NO: 214344 - DNA, 21 bp, Artificial sequence
  SiRNA target sequence
cgtcattgcgtgcacgttata

SEQ ID NO: 214345 - DNA, 21 bp, Artificial sequence
  SiRNA target sequence
gtcattgcgtgcacgttataa

SEQ ID NO: 214346 - DNA, 21 bp, Artificial sequence
  SiRNA target sequence
tcattgcgtgcacgttataaa

SEQ ID NO: 214347 - DNA, 21 bp, Artificial sequence
  SiRNA target sequence
cattgcgtgcacgttataaag

SEQ ID NO: 214348 - DNA, 21 bp, Artificial sequence
  SiRNA target sequence
attgcgtgcacgttataaagg

SEQ ID NO: 214349 - DNA, 21 bp, Artificial sequence
  SiRNA target sequence
ttgcgtgcacgttataaagga

SEQ ID NO: 214350 - DNA, 21 bp, Artificial sequence
  SiRNA target sequence
tgcgtgcacgttataaaggaa

SEQ ID NO: 214351 - DNA, 21 bp, Artificial sequence
  SiRNA target sequence
gcgtgcacgttataaaggaat

SEQ ID NO: 214352 - DNA, 21 bp, Artificial sequence
  SiRNA target sequence
cgtgcacgttataaaggaatt

SEQ ID NO: 214353 - DNA, 21 bp, Artificial sequence
  SiRNA target sequence
gtgcacgttataaaggaattt

SEQ ID NO: 214354 - DNA, 21 bp, Artificial sequence
  SiRNA target sequence
tgcacgttataaaggaatttt

SEQ ID NO: 214355 - DNA, 21 bp, Artificial sequence
  SiRNA target sequence
gcacgttataaaggaattttt

SEQ ID NO: 214356 - DNA, 21 bp, Artificial sequence
  SiRNA target sequence
cacgttataaaggaatttttg

SEQ ID NO: 214357 - DNA, 21 bp, Artificial sequence
  SiRNA target sequence
acgttataaaggaatttttga

SEQ ID NO: 214358 - DNA, 21 bp, Artificial sequence
  SiRNA target sequence
cgttataaaggaatttttgac

SEQ ID NO: 214359 - DNA, 21 bp, Artificial sequence
  SiRNA target sequence
gttataaaggaatttttgacg

SEQ ID NO: 214360 - DNA, 21 bp, Artificial sequence
  SiRNA target sequence
ttataaaggaatttttgacgg

SEQ ID NO: 214361 - DNA, 21 bp, Artificial sequence
  SiRNA target sequence
tataaaggaatttttgacggt

SEQ ID NO: 214362 - DNA, 21 bp, Artificial sequence
  SiRNA target sequence
ataaaggaatttttgacggtg

SEQ ID NO: 214363 - DNA, 21 bp, Artificial sequence
  SiRNA target sequence
taaaggaatttttgacggtgt

SEQ ID NO: 214364 - DNA, 21 bp, Artificial sequence
  SiRNA target sequence
aaaggaatttttgacggtgtt

SEQ ID NO: 214365 - DNA, 21 bp, Artificial sequence
  SiRNA target sequence
aaggaatttttgacggtgttt

SEQ ID NO: 214366 - DNA, 21 bp, Artificial sequence
  SiRNA target sequence
aggaatttttgacggtgtttt

SEQ ID NO: 214367 - DNA, 21 bp, Artificial sequence
  SiRNA target sequence
ggaatttttgacggtgttttt

SEQ ID NO: 214368 - DNA, 21 bp, Artificial sequence
  SiRNA target sequence
gaatttttgacggtgtttttg

SEQ ID NO: 214369 - DNA, 21 bp, Artificial sequence
  SiRNA target sequence
aatttttgacggtgtttttgg

SEQ ID NO: 214370 - DNA, 21 bp, Artificial sequence
  SiRNA target sequence
atttttgacggtgtttttggt

SEQ ID NO: 214371 - DNA, 21 bp, Artificial sequence
  SiRNA target sequence
tttttgacggtgtttttggta

SEQ ID NO: 214372 - DNA, 21 bp, Artificial sequence
  SiRNA target sequence
ttttgacggtgtttttggtaa

SEQ ID NO: 214373 - DNA, 21 bp, Artificial sequence
  SiRNA target sequence
tttgacggtgtttttggtaag

SEQ ID NO: 214374 - DNA, 21 bp, Artificial sequence
  SiRNA target sequence
ttgacggtgtttttggtaagt

SEQ ID NO: 214375 - DNA, 21 bp, Artificial sequence
  SiRNA target sequence
tgacggtgtttttggtaagtt

SEQ ID NO: 214376 - DNA, 21 bp, Artificial sequence
  SiRNA target sequence
gacggtgtttttggtaagtta

SEQ ID NO: 214377 - DNA, 21 bp, Artificial sequence
  SiRNA target sequence
acggtgtttttggtaagttag

SEQ ID NO: 214378 - DNA, 21 bp, Artificial sequence
  SiRNA target sequence
cggtgtttttggtaagttagg

SEQ ID NO: 214379 - DNA, 21 bp, Artificial sequence
  SiRNA target sequence
ggtgtttttggtaagttagga

SEQ ID NO: 214380 - DNA, 21 bp, Artificial sequence
  SiRNA target sequence
gtgtttttggtaagttaggaa

SEQ ID NO: 214381 - DNA, 21 bp, Artificial sequence
  SiRNA target sequence
tgtttttggtaagttaggaaa

SEQ ID NO: 214382 - DNA, 21 bp, Artificial sequence
  SiRNA target sequence
gtttttggtaagttaggaaaa

SEQ ID NO: 214383 - DNA, 21 bp, Artificial sequence
  SiRNA target sequence
tttttggtaagttaggaaaat

SEQ ID NO: 214384 - DNA, 21 bp, Artificial sequence
  SiRNA target sequence
ttttggtaagttaggaaaatc

SEQ ID NO: 214385 - DNA, 21 bp, Artificial sequence
  SiRNA target sequence
tttggtaagttaggaaaatct

SEQ ID NO: 214386 - DNA, 21 bp, Artificial sequence
  SiRNA target sequence
ttggtaagttaggaaaatctc

SEQ ID NO: 214387 - DNA, 21 bp, Artificial sequence
  SiRNA target sequence
tggtaagttaggaaaatctct

SEQ ID NO: 214388 - DNA, 21 bp, Artificial sequence
  SiRNA target sequence
ggtaagttaggaaaatctctt

SEQ ID NO: 214389 - DNA, 21 bp, Artificial sequence
  SiRNA target sequence
gtaagttaggaaaatctcttg

SEQ ID NO: 214390 - DNA, 21 bp, Artificial sequence
  SiRNA target sequence
taagttaggaaaatctcttgg

SEQ ID NO: 214391 - DNA, 21 bp, Artificial sequence
  SiRNA target sequence
aagttaggaaaatctcttgga

SEQ ID NO: 214392 - DNA, 21 bp, Artificial sequence
  SiRNA target sequence
agttaggaaaatctcttggat

SEQ ID NO: 214393 - DNA, 21 bp, Artificial sequence
  SiRNA target sequence
gttaggaaaatctcttggatc

SEQ ID NO: 214394 - DNA, 21 bp, Artificial sequence
  SiRNA target sequence
ttaggaaaatctcttggatcg

SEQ ID NO: 214395 - DNA, 21 bp, Artificial sequence
  SiRNA target sequence
taggaaaatctcttggatcgt

SEQ ID NO: 214396 - DNA, 21 bp, Artificial sequence
  SiRNA target sequence
aggaaaatctcttggatcgtt

SEQ ID NO: 214397 - DNA, 21 bp, Artificial sequence
  SiRNA target sequence
ggaaaatctcttggatcgtta

SEQ ID NO: 214398 - DNA, 21 bp, Artificial sequence
  SiRNA target sequence
gaaaatctcttggatcgttat

SEQ ID NO: 214399 - DNA, 21 bp, Artificial sequence
  SiRNA target sequence
aaaatctcttggatcgttatt

SEQ ID NO: 214400 - DNA, 21 bp, Artificial sequence
  SiRNA target sequence
aaatctcttggatcgttattt

SEQ ID NO: 214401 - DNA, 21 bp, Artificial sequence
  SiRNA target sequence
aatctcttggatcgttatttg

SEQ ID NO: 214402 - DNA, 21 bp, Artificial sequence
  SiRNA target sequence
atctcttggatcgttatttgt

SEQ ID NO: 214403 - DNA, 21 bp, Artificial sequence
  SiRNA target sequence
tctcttggatcgttatttgtg

SEQ ID NO: 214404 - DNA, 21 bp, Artificial sequence
  SiRNA target sequence
ctcttggatcgttatttgtgt

SEQ ID NO: 214405 - DNA, 21 bp, Artificial sequence
  SiRNA target sequence
tcttggatcgttatttgtgtg

SEQ ID NO: 214406 - DNA, 21 bp, Artificial sequence
  SiRNA target sequence
cttggatcgttatttgtgtgg

SEQ ID NO: 214407 - DNA, 21 bp, Artificial sequence
  SiRNA target sequence
ttggatcgttatttgtgtgga

SEQ ID NO: 214408 - DNA, 21 bp, Artificial sequence
  SiRNA target sequence
tggatcgttatttgtgtggat

SEQ ID NO: 214409 - DNA, 21 bp, Artificial sequence
  SiRNA target sequence
ggatcgttatttgtgtggatt

SEQ ID NO: 214410 - DNA, 21 bp, Artificial sequence
  SiRNA target sequence
gatcgttatttgtgtggatta

SEQ ID NO: 214411 - DNA, 21 bp, Artificial sequence
  SiRNA target sequence
atcgttatttgtgtggattat

SEQ ID NO: 214412 - DNA, 21 bp, Artificial sequence
  SiRNA target sequence
tcgttatttgtgtggattatg

SEQ ID NO: 214413 - DNA, 21 bp, Artificial sequence
  SiRNA target sequence
cgttatttgtgtggattatgg

SEQ ID NO: 214414 - DNA, 21 bp, Artificial sequence
  SiRNA target sequence
gttatttgtgtggattatggg

SEQ ID NO: 214415 - DNA, 21 bp, Artificial sequence
  SiRNA target sequence
ttatttgtgtggattatggga

SEQ ID NO: 214416 - DNA, 21 bp, Artificial sequence
  SiRNA target sequence
tatttgtgtggattatgggat

SEQ ID NO: 214417 - DNA, 21 bp, Artificial sequence
  SiRNA target sequence
atttgtgtggattatgggata

SEQ ID NO: 214418 - DNA, 21 bp, Artificial sequence
  SiRNA target sequence
tttgtgtggattatgggatat

SEQ ID NO: 214419 - DNA, 21 bp, Artificial sequence
  SiRNA target sequence
ttgtgtggattatgggatatg

SEQ ID NO: 214420 - DNA, 21 bp, Artificial sequence
  SiRNA target sequence
tgtgtggattatgggatatgc

SEQ ID NO: 214421 - DNA, 21 bp, Artificial sequence
  SiRNA target sequence
gtgtggattatgggatatgca

SEQ ID NO: 214422 - DNA, 21 bp, Artificial sequence
  SiRNA target sequence
tgtggattatgggatatgcat

SEQ ID NO: 214423 - DNA, 21 bp, Artificial sequence
  SiRNA target sequence
gtggattatgggatatgcatt

SEQ ID NO: 214424 - DNA, 21 bp, Artificial sequence
  SiRNA target sequence
tggattatgggatatgcattt

SEQ ID NO: 214425 - DNA, 21 bp, Artificial sequence
  SiRNA target sequence
ggattatgggatatgcatttc

SEQ ID NO: 214426 - DNA, 21 bp, Artificial sequence
  SiRNA target sequence
gattatgggatatgcatttca

SEQ ID NO: 214427 - DNA, 21 bp, Artificial sequence
  SiRNA target sequence
attatgggatatgcatttcaa

SEQ ID NO: 214428 - DNA, 21 bp, Artificial sequence
  SiRNA target sequence
ttatgggatatgcatttcaaa

SEQ ID NO: 214429 - DNA, 21 bp, Artificial sequence
  SiRNA target sequence
tatgggatatgcatttcaaac

SEQ ID NO: 214430 - DNA, 21 bp, Artificial sequence
  SiRNA target sequence
atgggatatgcatttcaaaca

SEQ ID NO: 214431 - DNA, 21 bp, Artificial sequence
  SiRNA target sequence
tgggatatgcatttcaaacaa

SEQ ID NO: 214432 - DNA, 21 bp, Artificial sequence
  SiRNA target sequence
gggatatgcatttcaaacaag

SEQ ID NO: 214433 - DNA, 21 bp, Artificial sequence
  SiRNA target sequence
ggatatgcatttcaaacaaga

SEQ ID NO: 214434 - DNA, 21 bp, Artificial sequence
  SiRNA target sequence
gatatgcatttcaaacaagag

SEQ ID NO: 214435 - DNA, 21 bp, Artificial sequence
  SiRNA target sequence
atatgcatttcaaacaagaga

SEQ ID NO: 214436 - DNA, 21 bp, Artificial sequence
  SiRNA target sequence
tatgcatttcaaacaagagat

SEQ ID NO: 214437 - DNA, 21 bp, Artificial sequence
  SiRNA target sequence
atgcatttcaaacaagagatt

SEQ ID NO: 214438 - DNA, 21 bp, Artificial sequence
  SiRNA target sequence
tgcatttcaaacaagagattt

SEQ ID NO: 214439 - DNA, 21 bp, Artificial sequence
  SiRNA target sequence
gcatttcaaacaagagatttt

SEQ ID NO: 214440 - DNA, 21 bp, Artificial sequence
  SiRNA target sequence
catttcaaacaagagatttta

SEQ ID NO: 214441 - DNA, 21 bp, Artificial sequence
  SiRNA target sequence
atttcaaacaagagattttag

SEQ ID NO: 214442 - DNA, 21 bp, Artificial sequence
  SiRNA target sequence
tttcaaacaagagattttaga

SEQ ID NO: 214443 - DNA, 21 bp, Artificial sequence
  SiRNA target sequence
ttcaaacaagagattttagaa

SEQ ID NO: 214444 - DNA, 21 bp, Artificial sequence
  SiRNA target sequence
tcaaacaagagattttagaaa

SEQ ID NO: 214445 - DNA, 21 bp, Artificial sequence
  SiRNA target sequence
caaacaagagattttagaaaa

SEQ ID NO: 214446 - DNA, 21 bp, Artificial sequence
  SiRNA target sequence
aaacaagagattttagaaaat

SEQ ID NO: 214447 - DNA, 21 bp, Artificial sequence
  SiRNA target sequence
aacaagagattttagaaaatt

SEQ ID NO: 214448 - DNA, 21 bp, Artificial sequence
  SiRNA target sequence
acaagagattttagaaaatta

SEQ ID NO: 214449 - DNA, 21 bp, Artificial sequence
  SiRNA target sequence
caagagattttagaaaattag

SEQ ID NO: 214450 - DNA, 21 bp, Artificial sequence
  SiRNA target sequence
aagagattttagaaaattagc

SEQ ID NO: 214451 - DNA, 21 bp, Artificial sequence
  SiRNA target sequence
agagattttagaaaattagct

SEQ ID NO: 214452 - DNA, 21 bp, Artificial sequence
  SiRNA target sequence
gagattttagaaaattagctc

SEQ ID NO: 214453 - DNA, 21 bp, Artificial sequence
  SiRNA target sequence
agattttagaaaattagctcc

SEQ ID NO: 214454 - DNA, 21 bp, Artificial sequence
  SiRNA target sequence
gattttagaaaattagctccc

SEQ ID NO: 214455 - DNA, 21 bp, Artificial sequence
  SiRNA target sequence
attttagaaaattagctccct

SEQ ID NO: 214456 - DNA, 21 bp, Artificial sequence
  SiRNA target sequence
ttttagaaaattagctccctt

SEQ ID NO: 214457 - DNA, 21 bp, Artificial sequence
  SiRNA target sequence
tttagaaaattagctccctta

SEQ ID NO: 214458 - DNA, 21 bp, Artificial sequence
  SiRNA target sequence
ttagaaaattagctcccttat

SEQ ID NO: 214459 - DNA, 21 bp, Artificial sequence
  SiRNA target sequence
tagaaaattagctcccttatg

SEQ ID NO: 214460 - DNA, 21 bp, Artificial sequence
  SiRNA target sequence
agaaaattagctcccttatgt

SEQ ID NO: 214461 - DNA, 21 bp, Artificial sequence
  SiRNA target sequence
gaaaattagctcccttatgta

SEQ ID NO: 214462 - DNA, 21 bp, Artificial sequence
  SiRNA target sequence
aaaattagctcccttatgtat

SEQ ID NO: 214463 - DNA, 21 bp, Artificial sequence
  SiRNA target sequence
aaattagctcccttatgtatc

SEQ ID NO: 214464 - DNA, 21 bp, Artificial sequence
  SiRNA target sequence
aattagctcccttatgtatca

SEQ ID NO: 214465 - DNA, 21 bp, Artificial sequence
  SiRNA target sequence
attagctcccttatgtatcag

SEQ ID NO: 214466 - DNA, 21 bp, Artificial sequence
  SiRNA target sequence
ttagctcccttatgtatcagc

SEQ ID NO: 214467 - DNA, 21 bp, Artificial sequence
  SiRNA target sequence
tagctcccttatgtatcagcg

SEQ ID NO: 214468 - DNA, 21 bp, Artificial sequence
  SiRNA target sequence
agctcccttatgtatcagcgt

SEQ ID NO: 214469 - DNA, 21 bp, Artificial sequence
  SiRNA target sequence
gctcccttatgtatcagcgta

SEQ ID NO: 214470 - DNA, 21 bp, Artificial sequence
  SiRNA target sequence
ctcccttatgtatcagcgtaa

SEQ ID NO: 214471 - DNA, 21 bp, Artificial sequence
  SiRNA target sequence
tcccttatgtatcagcgtaat

SEQ ID NO: 214472 - DNA, 21 bp, Artificial sequence
  SiRNA target sequence
cccttatgtatcagcgtaatt

SEQ ID NO: 214473 - DNA, 21 bp, Artificial sequence
  SiRNA target sequence
ccttatgtatcagcgtaattg

SEQ ID NO: 214474 - DNA, 21 bp, Artificial sequence
  SiRNA target sequence
cttatgtatcagcgtaattgt

SEQ ID NO: 214475 - DNA, 21 bp, Artificial sequence
  SiRNA target sequence
ttatgtatcagcgtaattgtc

SEQ ID NO: 214476 - DNA, 21 bp, Artificial sequence
  SiRNA target sequence
tatgtatcagcgtaattgtct

SEQ ID NO: 214477 - DNA, 21 bp, Artificial sequence
  SiRNA target sequence
atgtatcagcgtaattgtctt

SEQ ID NO: 214478 - DNA, 21 bp, Artificial sequence
  SiRNA target sequence
tgtatcagcgtaattgtcttt

SEQ ID NO: 214479 - DNA, 21 bp, Artificial sequence
  SiRNA target sequence
gtatcagcgtaattgtctttt

SEQ ID NO: 214480 - DNA, 21 bp, Artificial sequence
  SiRNA target sequence
tatcagcgtaattgtcttttt

SEQ ID NO: 214481 - DNA, 21 bp, Artificial sequence
  SiRNA target sequence
atcagcgtaattgtctttttt

SEQ ID NO: 214482 - DNA, 21 bp, Artificial sequence
  SiRNA target sequence
tcagcgtaattgtcttttttg

SEQ ID NO: 214483 - DNA, 21 bp, Artificial sequence
  SiRNA target sequence
cagcgtaattgtcttttttgt

SEQ ID NO: 214484 - DNA, 21 bp, Artificial sequence
  SiRNA target sequence
agcgtaattgtcttttttgtt

SEQ ID NO: 214485 - DNA, 21 bp, Artificial sequence
  SiRNA target sequence
gcgtaattgtcttttttgtta

SEQ ID NO: 214486 - DNA, 21 bp, Artificial sequence
  SiRNA target sequence
cgtaattgtcttttttgttat

SEQ ID NO: 214487 - DNA, 21 bp, Artificial sequence
  SiRNA target sequence
gtaattgtcttttttgttatt

SEQ ID NO: 214488 - DNA, 21 bp, Artificial sequence
  SiRNA target sequence
taattgtcttttttgttatta

SEQ ID NO: 214489 - DNA, 21 bp, Artificial sequence
  SiRNA target sequence
aattgtcttttttgttattat

SEQ ID NO: 214490 - DNA, 21 bp, Artificial sequence
  SiRNA target sequence
attgtcttttttgttattatt

SEQ ID NO: 214491 - DNA, 21 bp, Artificial sequence
  SiRNA target sequence
ttgtcttttttgttattattt

SEQ ID NO: 214492 - DNA, 21 bp, Artificial sequence
  SiRNA target sequence
tgtcttttttgttattatttg

SEQ ID NO: 214493 - DNA, 21 bp, Artificial sequence
  SiRNA target sequence
gtcttttttgttattatttgg

SEQ ID NO: 214494 - DNA, 21 bp, Artificial sequence
  SiRNA target sequence
tcttttttgttattatttgga

SEQ ID NO: 214495 - DNA, 21 bp, Artificial sequence
  SiRNA target sequence
cttttttgttattatttggat

SEQ ID NO: 214496 - DNA, 21 bp, Artificial sequence
  SiRNA target sequence
ttttttgttattatttggatt

SEQ ID NO: 214497 - DNA, 21 bp, Artificial sequence
  SiRNA target sequence
tttttgttattatttggattt

SEQ ID NO: 214498 - DNA, 21 bp, Artificial sequence
  SiRNA target sequence
ttttgttattatttggattta

SEQ ID NO: 214499 - DNA, 21 bp, Artificial sequence
  SiRNA target sequence
tttgttattatttggatttat

SEQ ID NO: 214500 - DNA, 21 bp, Artificial sequence
  SiRNA target sequence
ttgttattatttggatttatt

SEQ ID NO: 214501 - DNA, 21 bp, Artificial sequence
  SiRNA target sequence
tgttattatttggatttattc

SEQ ID NO: 214502 - DNA, 21 bp, Artificial sequence
  SiRNA target sequence
gttattatttggatttattca

SEQ ID NO: 214503 - DNA, 21 bp, Artificial sequence
  SiRNA target sequence
ttattatttggatttattcag

SEQ ID NO: 214504 - DNA, 21 bp, Artificial sequence
  SiRNA target sequence
tattatttggatttattcagt

SEQ ID NO: 214505 - DNA, 21 bp, Artificial sequence
  SiRNA target sequence
attatttggatttattcagtt

SEQ ID NO: 214506 - DNA, 21 bp, Artificial sequence
  SiRNA target sequence
ttatttggatttattcagtta

SEQ ID NO: 214507 - DNA, 21 bp, Artificial sequence
  SiRNA target sequence
tatttggatttattcagttat

SEQ ID NO: 214508 - DNA, 21 bp, Artificial sequence
  SiRNA target sequence
atttggatttattcagttatt

SEQ ID NO: 214509 - DNA, 21 bp, Artificial sequence
  SiRNA target sequence
tttggatttattcagttattt

SEQ ID NO: 214510 - DNA, 21 bp, Artificial sequence
  SiRNA target sequence
ttggatttattcagttattta

SEQ ID NO: 214511 - DNA, 21 bp, Artificial sequence
  SiRNA target sequence
tggatttattcagttatttat

SEQ ID NO: 214512 - DNA, 21 bp, Artificial sequence
  SiRNA target sequence
ggatttattcagttatttatt

SEQ ID NO: 214513 - DNA, 21 bp, Artificial sequence
  SiRNA target sequence
gatttattcagttatttattt

SEQ ID NO: 214514 - DNA, 21 bp, Artificial sequence
  SiRNA target sequence
atttattcagttatttattta

SEQ ID NO: 214515 - DNA, 21 bp, Artificial sequence
  SiRNA target sequence
tttattcagttatttatttaa

SEQ ID NO: 214516 - DNA, 21 bp, Artificial sequence
  SiRNA target sequence
ttattcagttatttatttaaa

SEQ ID NO: 214517 - DNA, 21 bp, Artificial sequence
  SiRNA target sequence
tattcagttatttatttaaat

SEQ ID NO: 214518 - DNA, 21 bp, Artificial sequence
  SiRNA target sequence
attcagttatttatttaaata

SEQ ID NO: 214519 - DNA, 21 bp, Artificial sequence
  SiRNA target sequence
ttcagttatttatttaaataa

SEQ ID NO: 214520 - DNA, 21 bp, Artificial sequence
  SiRNA target sequence
tcagttatttatttaaataag

SEQ ID NO: 214521 - DNA, 21 bp, Artificial sequence
  SiRNA target sequence
cagttatttatttaaataaga

SEQ ID NO: 214522 - DNA, 21 bp, Artificial sequence
  SiRNA target sequence
agttatttatttaaataagaa

SEQ ID NO: 214523 - DNA, 21 bp, Artificial sequence
  SiRNA target sequence
gttatttatttaaataagaaa

SEQ ID NO: 214524 - DNA, 21 bp, Artificial sequence
  SiRNA target sequence
ttatttatttaaataagaaat

SEQ ID NO: 214525 - DNA, 21 bp, Artificial sequence
  SiRNA target sequence
tatttatttaaataagaaata

SEQ ID NO: 214526 - DNA, 21 bp, Artificial sequence
  SiRNA target sequence
atttatttaaataagaaatac

SEQ ID NO: 214527 - DNA, 21 bp, Artificial sequence
  SiRNA target sequence
tttatttaaataagaaataca

SEQ ID NO: 214528 - DNA, 21 bp, Artificial sequence
  SiRNA target sequence
ttatttaaataagaaatacaa

SEQ ID NO: 214529 - DNA, 21 bp, Artificial sequence
  SiRNA target sequence
tatttaaataagaaatacaaa

SEQ ID NO: 214530 - DNA, 21 bp, Artificial sequence
  SiRNA target sequence
atttaaataagaaatacaaag

SEQ ID NO: 214531 - DNA, 21 bp, Artificial sequence
  SiRNA target sequence
tttaaataagaaatacaaaga

SEQ ID NO: 214532 - DNA, 21 bp, Artificial sequence
  SiRNA target sequence
ttaaataagaaatacaaagaa

SEQ ID NO: 214533 - DNA, 21 bp, Artificial sequence
  SiRNA target sequence
taaataagaaatacaaagaat

SEQ ID NO: 214534 - DNA, 21 bp, Artificial sequence
  SiRNA target sequence
aaataagaaatacaaagaatc

SEQ ID NO: 214535 - DNA, 21 bp, Artificial sequence
  SiRNA target sequence
aataagaaatacaaagaatca

SEQ ID NO: 214536 - DNA, 21 bp, Artificial sequence
  SiRNA target sequence
ataagaaatacaaagaatcag

SEQ ID NO: 214537 - DNA, 21 bp, Artificial sequence
  SiRNA target sequence
taagaaatacaaagaatcagt

SEQ ID NO: 214538 - DNA, 21 bp, Artificial sequence
  SiRNA target sequence
aagaaatacaaagaatcagtt

SEQ ID NO: 214539 - DNA, 21 bp, Artificial sequence
  SiRNA target sequence
agaaatacaaagaatcagttg

SEQ ID NO: 214540 - DNA, 21 bp, Artificial sequence
  SiRNA target sequence
gaaatacaaagaatcagttgt

SEQ ID NO: 214541 - DNA, 21 bp, Artificial sequence
  SiRNA target sequence
aaatacaaagaatcagttgtt

SEQ ID NO: 214542 - DNA, 21 bp, Artificial sequence
  SiRNA target sequence
aatacaaagaatcagttgtta

SEQ ID NO: 214543 - DNA, 21 bp, Artificial sequence
  SiRNA target sequence
atacaaagaatcagttgttag

SEQ ID NO: 214544 - DNA, 21 bp, Artificial sequence
  SiRNA target sequence
tacaaagaatcagttgttagt

SEQ ID NO: 214545 - DNA, 21 bp, Artificial sequence
  SiRNA target sequence
acaaagaatcagttgttagta

SEQ ID NO: 214546 - DNA, 21 bp, Artificial sequence
  SiRNA target sequence
caaagaatcagttgttagtaa

SEQ ID NO: 214547 - DNA, 21 bp, Artificial sequence
  SiRNA target sequence
aaagaatcagttgttagtaat

SEQ ID NO: 214548 - DNA, 21 bp, Artificial sequence
  SiRNA target sequence
aagaatcagttgttagtaatt

SEQ ID NO: 214549 - DNA, 21 bp, Artificial sequence
  SiRNA target sequence
agaatcagttgttagtaattt

SEQ ID NO: 214550 - DNA, 21 bp, Artificial sequence
  SiRNA target sequence
gaatcagttgttagtaattta

SEQ ID NO: 214551 - DNA, 21 bp, Artificial sequence
  SiRNA target sequence
aatcagttgttagtaatttac

SEQ ID NO: 214552 - DNA, 21 bp, Artificial sequence
  SiRNA target sequence
atcagttgttagtaatttacc

SEQ ID NO: 214553 - DNA, 21 bp, Artificial sequence
  SiRNA target sequence
tcagttgttagtaatttaccc

SEQ ID NO: 214554 - DNA, 21 bp, Artificial sequence
  SiRNA target sequence
cagttgttagtaatttaccca

SEQ ID NO: 214555 - DNA, 21 bp, Artificial sequence
  SiRNA target sequence
agttgttagtaatttacccat

SEQ ID NO: 214556 - DNA, 21 bp, Artificial sequence
  SiRNA target sequence
gttgttagtaatttacccatc

SEQ ID NO: 214557 - DNA, 21 bp, Artificial sequence
  SiRNA target sequence
ttgttagtaatttacccatcg

SEQ ID NO: 214558 - DNA, 21 bp, Artificial sequence
  SiRNA target sequence
tgttagtaatttacccatcga

SEQ ID NO: 214559 - DNA, 21 bp, Artificial sequence
  SiRNA target sequence
gttagtaatttacccatcgat

SEQ ID NO: 214560 - DNA, 21 bp, Artificial sequence
  SiRNA target sequence
ttagtaatttacccatcgatg

SEQ ID NO: 214561 - DNA, 21 bp, Artificial sequence
  SiRNA target sequence
tagtaatttacccatcgatgt

SEQ ID NO: 214562 - DNA, 21 bp, Artificial sequence
  SiRNA target sequence
agtaatttacccatcgatgtt

SEQ ID NO: 214563 - DNA, 21 bp, Artificial sequence
  SiRNA target sequence
gtaatttacccatcgatgttg

SEQ ID NO: 214564 - DNA, 21 bp, Artificial sequence
  SiRNA target sequence
taatttacccatcgatgttga

SEQ ID NO: 214565 - DNA, 21 bp, Artificial sequence
  SiRNA target sequence
aatttacccatcgatgttgat

SEQ ID NO: 214566 - DNA, 21 bp, Artificial sequence
  SiRNA target sequence
atttacccatcgatgttgatt

SEQ ID NO: 214567 - DNA, 21 bp, Artificial sequence
  SiRNA target sequence
tttacccatcgatgttgattt

SEQ ID NO: 214568 - DNA, 21 bp, Artificial sequence
  SiRNA target sequence
ttacccatcgatgttgatttg

SEQ ID NO: 214569 - DNA, 21 bp, Artificial sequence
  SiRNA target sequence
tacccatcgatgttgatttgt

SEQ ID NO: 214570 - DNA, 21 bp, Artificial sequence
  SiRNA target sequence
acccatcgatgttgatttgtt

SEQ ID NO: 214571 - DNA, 21 bp, Artificial sequence
  SiRNA target sequence
cccatcgatgttgatttgttt

SEQ ID NO: 214572 - DNA, 21 bp, Artificial sequence
  SiRNA target sequence
ccatcgatgttgatttgtttg

SEQ ID NO: 214573 - DNA, 21 bp, Artificial sequence
  SiRNA target sequence
catcgatgttgatttgtttgc

SEQ ID NO: 214574 - DNA, 21 bp, Artificial sequence
  SiRNA target sequence
atcgatgttgatttgtttgca

SEQ ID NO: 214575 - DNA, 21 bp, Artificial sequence
  SiRNA target sequence
tcgatgttgatttgtttgcat

SEQ ID NO: 214576 - DNA, 21 bp, Artificial sequence
  SiRNA target sequence
cgatgttgatttgtttgcatc

SEQ ID NO: 214577 - DNA, 21 bp, Artificial sequence
  SiRNA target sequence
gatgttgatttgtttgcatca

SEQ ID NO: 214578 - DNA, 21 bp, Artificial sequence
  SiRNA target sequence
atgttgatttgtttgcatcaa

SEQ ID NO: 214579 - DNA, 21 bp, Artificial sequence
  SiRNA target sequence
tgttgatttgtttgcatcaaa

SEQ ID NO: 214580 - DNA, 21 bp, Artificial sequence
  SiRNA target sequence
gttgatttgtttgcatcaaag

SEQ ID NO: 214581 - DNA, 21 bp, Artificial sequence
  SiRNA target sequence
ttgatttgtttgcatcaaagt

SEQ ID NO: 214582 - DNA, 21 bp, Artificial sequence
  SiRNA target sequence
tgatttgtttgcatcaaagtt

SEQ ID NO: 214583 - DNA, 21 bp, Artificial sequence
  SiRNA target sequence
gatttgtttgcatcaaagttg

SEQ ID NO: 214584 - DNA, 21 bp, Artificial sequence
  SiRNA target sequence
atttgtttgcatcaaagttgt

SEQ ID NO: 214585 - DNA, 21 bp, Artificial sequence
  SiRNA target sequence
tttgtttgcatcaaagttgtt

SEQ ID NO: 214586 - DNA, 21 bp, Artificial sequence
  SiRNA target sequence
ttgtttgcatcaaagttgtta

SEQ ID NO: 214587 - DNA, 21 bp, Artificial sequence
  SiRNA target sequence
tgtttgcatcaaagttgttag

SEQ ID NO: 214588 - DNA, 21 bp, Artificial sequence
  SiRNA target sequence
gtttgcatcaaagttgttaga

SEQ ID NO: 214589 - DNA, 21 bp, Artificial sequence
  SiRNA target sequence
tttgcatcaaagttgttagat

SEQ ID NO: 214590 - DNA, 21 bp, Artificial sequence
  SiRNA target sequence
ttgcatcaaagttgttagata

SEQ ID NO: 214591 - DNA, 21 bp, Artificial sequence
  SiRNA target sequence
tgcatcaaagttgttagataa

SEQ ID NO: 214592 - DNA, 21 bp, Artificial sequence
  SiRNA target sequence
gcatcaaagttgttagataat

SEQ ID NO: 214593 - DNA, 21 bp, Artificial sequence
  SiRNA target sequence
catcaaagttgttagataata

SEQ ID NO: 214594 - DNA, 21 bp, Artificial sequence
  SiRNA target sequence
atcaaagttgttagataataa

SEQ ID NO: 214595 - DNA, 21 bp, Artificial sequence
  SiRNA target sequence
tcaaagttgttagataataaa

SEQ ID NO: 214596 - DNA, 21 bp, Artificial sequence
  SiRNA target sequence
caaagttgttagataataaaa

SEQ ID NO: 214597 - DNA, 21 bp, Artificial sequence
  SiRNA target sequence
aaagttgttagataataaaaa

SEQ ID NO: 214598 - DNA, 21 bp, Artificial sequence
  SiRNA target sequence
aagttgttagataataaaaaa

SEQ ID NO: 214599 - DNA, 21 bp, Artificial sequence
  SiRNA target sequence
agttgttagataataaaaaag

SEQ ID NO: 214600 - DNA, 21 bp, Artificial sequence
  SiRNA target sequence
gttgttagataataaaaaaga

SEQ ID NO: 214601 - DNA, 21 bp, Artificial sequence
  SiRNA target sequence
ttgttagataataaaaaagaa

SEQ ID NO: 214602 - DNA, 21 bp, Artificial sequence
  SiRNA target sequence
tgttagataataaaaaagaag

SEQ ID NO: 214603 - DNA, 21 bp, Artificial sequence
  SiRNA target sequence
gttagataataaaaaagaaga

SEQ ID NO: 214604 - DNA, 21 bp, Artificial sequence
  SiRNA target sequence
ttagataataaaaaagaagag

SEQ ID NO: 214605 - DNA, 21 bp, Artificial sequence
  SiRNA target sequence
tagataataaaaaagaagagg

SEQ ID NO: 214606 - DNA, 21 bp, Artificial sequence
  SiRNA target sequence
agataataaaaaagaagagga

SEQ ID NO: 214607 - DNA, 21 bp, Artificial sequence
  SiRNA target sequence
gataataaaaaagaagaggaa

SEQ ID NO: 214608 - DNA, 21 bp, Artificial sequence
  SiRNA target sequence
ataataaaaaagaagaggaaa

SEQ ID NO: 214609 - DNA, 21 bp, Artificial sequence
  SiRNA target sequence
taataaaaaagaagaggaaat

SEQ ID NO: 214610 - DNA, 21 bp, Artificial sequence
  SiRNA target sequence
aataaaaaagaagaggaaatt

SEQ ID NO: 214611 - DNA, 21 bp, Artificial sequence
  SiRNA target sequence
ataaaaaagaagaggaaattg

SEQ ID NO: 214612 - DNA, 21 bp, Artificial sequence
  SiRNA target sequence
taaaaaagaagaggaaattga

SEQ ID NO: 214613 - DNA, 21 bp, Artificial sequence
  SiRNA target sequence
aaaaaagaagaggaaattgat

SEQ ID NO: 214614 - DNA, 21 bp, Artificial sequence
  SiRNA target sequence
aaaaagaagaggaaattgatg

SEQ ID NO: 214615 - DNA, 21 bp, Artificial sequence
  SiRNA target sequence
aaaagaagaggaaattgatgt

SEQ ID NO: 214616 - DNA, 21 bp, Artificial sequence
  SiRNA target sequence
aaagaagaggaaattgatgtg

SEQ ID NO: 214617 - DNA, 21 bp, Artificial sequence
  SiRNA target sequence
aagaagaggaaattgatgtgt

SEQ ID NO: 214618 - DNA, 21 bp, Artificial sequence
  SiRNA target sequence
agaagaggaaattgatgtgtc

SEQ ID NO: 214619 - DNA, 21 bp, Artificial sequence
  SiRNA target sequence
gaagaggaaattgatgtgtca

SEQ ID NO: 214620 - DNA, 21 bp, Artificial sequence
  SiRNA target sequence
aagaggaaattgatgtgtcag

SEQ ID NO: 214621 - DNA, 21 bp, Artificial sequence
  SiRNA target sequence
agaggaaattgatgtgtcagt

SEQ ID NO: 214622 - DNA, 21 bp, Artificial sequence
  SiRNA target sequence
gaggaaattgatgtgtcagtg

SEQ ID NO: 214623 - DNA, 21 bp, Artificial sequence
  SiRNA target sequence
aggaaattgatgtgtcagtgc

SEQ ID NO: 214624 - DNA, 21 bp, Artificial sequence
  SiRNA target sequence
ggaaattgatgtgtcagtgct

SEQ ID NO: 214625 - DNA, 21 bp, Artificial sequence
  SiRNA target sequence
gaaattgatgtgtcagtgctc

SEQ ID NO: 214626 - DNA, 21 bp, Artificial sequence
  SiRNA target sequence
aaattgatgtgtcagtgctcg

SEQ ID NO: 214627 - DNA, 21 bp, Artificial sequence
  SiRNA target sequence
aattgatgtgtcagtgctcgt

SEQ ID NO: 214628 - DNA, 21 bp, Artificial sequence
  SiRNA target sequence
attgatgtgtcagtgctcgtt

SEQ ID NO: 214629 - DNA, 21 bp, Artificial sequence
  SiRNA target sequence
ttgatgtgtcagtgctcgtta

SEQ ID NO: 214630 - DNA, 21 bp, Artificial sequence
  SiRNA target sequence
tgatgtgtcagtgctcgttaa

SEQ ID NO: 214631 - DNA, 21 bp, Artificial sequence
  SiRNA target sequence
gatgtgtcagtgctcgttaat

SEQ ID NO: 214632 - DNA, 21 bp, Artificial sequence
  SiRNA target sequence
atgtgtcagtgctcgttaatt

SEQ ID NO: 214633 - DNA, 21 bp, Artificial sequence
  SiRNA target sequence
tgtgtcagtgctcgttaatta

SEQ ID NO: 214634 - DNA, 21 bp, Artificial sequence
  SiRNA target sequence
gtgtcagtgctcgttaattaa

SEQ ID NO: 214635 - DNA, 22 bp, Artificial sequence
  SiRNA target sequence
atgattgagaggggtattatgg

SEQ ID NO: 214636 - DNA, 22 bp, Artificial sequence
  SiRNA target sequence
tgattgagaggggtattatgga

SEQ ID NO: 214637 - DNA, 22 bp, Artificial sequence
  SiRNA target sequence
gattgagaggggtattatggaa

SEQ ID NO: 214638 - DNA, 22 bp, Artificial sequence
  SiRNA target sequence
attgagaggggtattatggaaa

SEQ ID NO: 214639 - DNA, 22 bp, Artificial sequence
  SiRNA target sequence
ttgagaggggtattatggaaaa

SEQ ID NO: 214640 - DNA, 22 bp, Artificial sequence
  SiRNA target sequence
tgagaggggtattatggaaaaa

SEQ ID NO: 214641 - DNA, 22 bp, Artificial sequence
  SiRNA target sequence
gagaggggtattatggaaaaaa

SEQ ID NO: 214642 - DNA, 22 bp, Artificial sequence
  SiRNA target sequence
agaggggtattatggaaaaaat

SEQ ID NO: 214643 - DNA, 22 bp, Artificial sequence
  SiRNA target sequence
gaggggtattatggaaaaaata

SEQ ID NO: 214644 - DNA, 22 bp, Artificial sequence
  SiRNA target sequence
aggggtattatggaaaaaataa

SEQ ID NO: 214645 - DNA, 22 bp, Artificial sequence
  SiRNA target sequence
ggggtattatggaaaaaataaa

SEQ ID NO: 214646 - DNA, 22 bp, Artificial sequence
  SiRNA target sequence
gggtattatggaaaaaataaaa

SEQ ID NO: 214647 - DNA, 22 bp, Artificial sequence
  SiRNA target sequence
ggtattatggaaaaaataaaaa

SEQ ID NO: 214648 - DNA, 22 bp, Artificial sequence
  SiRNA target sequence
gtattatggaaaaaataaaaaa

SEQ ID NO: 214649 - DNA, 22 bp, Artificial sequence
  SiRNA target sequence
tattatggaaaaaataaaaaat

SEQ ID NO: 214650 - DNA, 22 bp, Artificial sequence
  SiRNA target sequence
attatggaaaaaataaaaaatt

SEQ ID NO: 214651 - DNA, 22 bp, Artificial sequence
  SiRNA target sequence
ttatggaaaaaataaaaaattt

SEQ ID NO: 214652 - DNA, 22 bp, Artificial sequence
  SiRNA target sequence
tatggaaaaaataaaaaattta

SEQ ID NO: 214653 - DNA, 22 bp, Artificial sequence
  SiRNA target sequence
atggaaaaaataaaaaatttat

SEQ ID NO: 214654 - DNA, 22 bp, Artificial sequence
  SiRNA target sequence
tggaaaaaataaaaaatttatt

SEQ ID NO: 214655 - DNA, 22 bp, Artificial sequence
  SiRNA target sequence
ggaaaaaataaaaaatttatta

SEQ ID NO: 214656 - DNA, 22 bp, Artificial sequence
  SiRNA target sequence
gaaaaaataaaaaatttattaa

SEQ ID NO: 214657 - DNA, 22 bp, Artificial sequence
  SiRNA target sequence
aaaaaataaaaaatttattaac

SEQ ID NO: 214658 - DNA, 22 bp, Artificial sequence
  SiRNA target sequence
aaaaataaaaaatttattaaca

SEQ ID NO: 214659 - DNA, 22 bp, Artificial sequence
  SiRNA target sequence
aaaataaaaaatttattaacag

SEQ ID NO: 214660 - DNA, 22 bp, Artificial sequence
  SiRNA target sequence
aaataaaaaatttattaacaga

SEQ ID NO: 214661 - DNA, 22 bp, Artificial sequence
  SiRNA target sequence
aataaaaaatttattaacagag

SEQ ID NO: 214662 - DNA, 22 bp, Artificial sequence
  SiRNA target sequence
ataaaaaatttattaacagagg

SEQ ID NO: 214663 - DNA, 22 bp, Artificial sequence
  SiRNA target sequence
taaaaaatttattaacagagga

SEQ ID NO: 214664 - DNA, 22 bp, Artificial sequence
  SiRNA target sequence
aaaaaatttattaacagaggat

SEQ ID NO: 214665 - DNA, 22 bp, Artificial sequence
  SiRNA target sequence
aaaaatttattaacagaggatg

SEQ ID NO: 214666 - DNA, 22 bp, Artificial sequence
  SiRNA target sequence
aaaatttattaacagaggatga

SEQ ID NO: 214667 - DNA, 22 bp, Artificial sequence
  SiRNA target sequence
aaatttattaacagaggatgaa

SEQ ID NO: 214668 - DNA, 22 bp, Artificial sequence
  SiRNA target sequence
aatttattaacagaggatgaag

SEQ ID NO: 214669 - DNA, 22 bp, Artificial sequence
  SiRNA target sequence
atttattaacagaggatgaagt

SEQ ID NO: 214670 - DNA, 22 bp, Artificial sequence
  SiRNA target sequence
tttattaacagaggatgaagta

SEQ ID NO: 214671 - DNA, 22 bp, Artificial sequence
  SiRNA target sequence
ttattaacagaggatgaagtag

SEQ ID NO: 214672 - DNA, 22 bp, Artificial sequence
  SiRNA target sequence
tattaacagaggatgaagtaga

SEQ ID NO: 214673 - DNA, 22 bp, Artificial sequence
  SiRNA target sequence
attaacagaggatgaagtagaa

SEQ ID NO: 214674 - DNA, 22 bp, Artificial sequence
  SiRNA target sequence
ttaacagaggatgaagtagaag

SEQ ID NO: 214675 - DNA, 22 bp, Artificial sequence
  SiRNA target sequence
taacagaggatgaagtagaagc

SEQ ID NO: 214676 - DNA, 22 bp, Artificial sequence
  SiRNA target sequence
aacagaggatgaagtagaagca

SEQ ID NO: 214677 - DNA, 22 bp, Artificial sequence
  SiRNA target sequence
acagaggatgaagtagaagcag

SEQ ID NO: 214678 - DNA, 22 bp, Artificial sequence
  SiRNA target sequence
cagaggatgaagtagaagcaga

SEQ ID NO: 214679 - DNA, 22 bp, Artificial sequence
  SiRNA target sequence
agaggatgaagtagaagcagaa

SEQ ID NO: 214680 - DNA, 22 bp, Artificial sequence
  SiRNA target sequence
gaggatgaagtagaagcagaag

SEQ ID NO: 214681 - DNA, 22 bp, Artificial sequence
  SiRNA target sequence
aggatgaagtagaagcagaagc

SEQ ID NO: 214682 - DNA, 22 bp, Artificial sequence
  SiRNA target sequence
ggatgaagtagaagcagaagca

SEQ ID NO: 214683 - DNA, 22 bp, Artificial sequence
  SiRNA target sequence
gatgaagtagaagcagaagcaa

SEQ ID NO: 214684 - DNA, 22 bp, Artificial sequence
  SiRNA target sequence
atgaagtagaagcagaagcaaa

SEQ ID NO: 214685 - DNA, 22 bp, Artificial sequence
  SiRNA target sequence
tgaagtagaagcagaagcaaat

SEQ ID NO: 214686 - DNA, 22 bp, Artificial sequence
  SiRNA target sequence
gaagtagaagcagaagcaaatt

SEQ ID NO: 214687 - DNA, 22 bp, Artificial sequence
  SiRNA target sequence
aagtagaagcagaagcaaattc

SEQ ID NO: 214688 - DNA, 22 bp, Artificial sequence
  SiRNA target sequence
agtagaagcagaagcaaattct

SEQ ID NO: 214689 - DNA, 22 bp, Artificial sequence
  SiRNA target sequence
gtagaagcagaagcaaattctg

SEQ ID NO: 214690 - DNA, 22 bp, Artificial sequence
  SiRNA target sequence
tagaagcagaagcaaattctgg

SEQ ID NO: 214691 - DNA, 22 bp, Artificial sequence
  SiRNA target sequence
agaagcagaagcaaattctgga

SEQ ID NO: 214692 - DNA, 22 bp, Artificial sequence
  SiRNA target sequence
gaagcagaagcaaattctggaa

SEQ ID NO: 214693 - DNA, 22 bp, Artificial sequence
  SiRNA target sequence
aagcagaagcaaattctggaag

SEQ ID NO: 214694 - DNA, 22 bp, Artificial sequence
  SiRNA target sequence
agcagaagcaaattctggaagg

SEQ ID NO: 214695 - DNA, 22 bp, Artificial sequence
  SiRNA target sequence
gcagaagcaaattctggaaggg

SEQ ID NO: 214696 - DNA, 22 bp, Artificial sequence
  SiRNA target sequence
cagaagcaaattctggaagggg

SEQ ID NO: 214697 - DNA, 22 bp, Artificial sequence
  SiRNA target sequence
agaagcaaattctggaaggggc

SEQ ID NO: 214698 - DNA, 22 bp, Artificial sequence
  SiRNA target sequence
gaagcaaattctggaaggggca

SEQ ID NO: 214699 - DNA, 22 bp, Artificial sequence
  SiRNA target sequence
aagcaaattctggaaggggcat

SEQ ID NO: 214700 - DNA, 22 bp, Artificial sequence
  SiRNA target sequence
agcaaattctggaaggggcatt

SEQ ID NO: 214701 - DNA, 22 bp, Artificial sequence
  SiRNA target sequence
gcaaattctggaaggggcattt

SEQ ID NO: 214702 - DNA, 22 bp, Artificial sequence
  SiRNA target sequence
caaattctggaaggggcatttt

SEQ ID NO: 214703 - DNA, 22 bp, Artificial sequence
  SiRNA target sequence
aaattctggaaggggcatttta

SEQ ID NO: 214704 - DNA, 22 bp, Artificial sequence
  SiRNA target sequence
aattctggaaggggcattttat

SEQ ID NO: 214705 - DNA, 22 bp, Artificial sequence
  SiRNA target sequence
attctggaaggggcattttatc

SEQ ID NO: 214706 - DNA, 22 bp, Artificial sequence
  SiRNA target sequence
ttctggaaggggcattttatca

SEQ ID NO: 214707 - DNA, 22 bp, Artificial sequence
  SiRNA target sequence
tctggaaggggcattttatcaa

SEQ ID NO: 214708 - DNA, 22 bp, Artificial sequence
  SiRNA target sequence
ctggaaggggcattttatcaat

SEQ ID NO: 214709 - DNA, 22 bp, Artificial sequence
  SiRNA target sequence
tggaaggggcattttatcaata

SEQ ID NO: 214710 - DNA, 22 bp, Artificial sequence
  SiRNA target sequence
ggaaggggcattttatcaatat

SEQ ID NO: 214711 - DNA, 22 bp, Artificial sequence
  SiRNA target sequence
gaaggggcattttatcaatatt

SEQ ID NO: 214712 - DNA, 22 bp, Artificial sequence
  SiRNA target sequence
aaggggcattttatcaatattt

SEQ ID NO: 214713 - DNA, 22 bp, Artificial sequence
  SiRNA target sequence
aggggcattttatcaatattta

SEQ ID NO: 214714 - DNA, 22 bp, Artificial sequence
  SiRNA target sequence
ggggcattttatcaatatttag

SEQ ID NO: 214715 - DNA, 22 bp, Artificial sequence
  SiRNA target sequence
gggcattttatcaatatttaga

SEQ ID NO: 214716 - DNA, 22 bp, Artificial sequence
  SiRNA target sequence
ggcattttatcaatatttagaa

SEQ ID NO: 214717 - DNA, 22 bp, Artificial sequence
  SiRNA target sequence
gcattttatcaatatttagaat

SEQ ID NO: 214718 - DNA, 22 bp, Artificial sequence
  SiRNA target sequence
cattttatcaatatttagaatt

SEQ ID NO: 214719 - DNA, 22 bp, Artificial sequence
  SiRNA target sequence
attttatcaatatttagaattg

SEQ ID NO: 214720 - DNA, 22 bp, Artificial sequence
  SiRNA target sequence
ttttatcaatatttagaattgc

SEQ ID NO: 214721 - DNA, 22 bp, Artificial sequence
  SiRNA target sequence
tttatcaatatttagaattgct

SEQ ID NO: 214722 - DNA, 22 bp, Artificial sequence
  SiRNA target sequence
ttatcaatatttagaattgcta

SEQ ID NO: 214723 - DNA, 22 bp, Artificial sequence
  SiRNA target sequence
tatcaatatttagaattgctaa

SEQ ID NO: 214724 - DNA, 22 bp, Artificial sequence
  SiRNA target sequence
atcaatatttagaattgctaag

SEQ ID NO: 214725 - DNA, 22 bp, Artificial sequence
  SiRNA target sequence
tcaatatttagaattgctaagg

SEQ ID NO: 214726 - DNA, 22 bp, Artificial sequence
  SiRNA target sequence
caatatttagaattgctaaggt

SEQ ID NO: 214727 - DNA, 22 bp, Artificial sequence
  SiRNA target sequence
aatatttagaattgctaaggta

SEQ ID NO: 214728 - DNA, 22 bp, Artificial sequence
  SiRNA target sequence
atatttagaattgctaaggtag

SEQ ID NO: 214729 - DNA, 22 bp, Artificial sequence
  SiRNA target sequence
tatttagaattgctaaggtaga

SEQ ID NO: 214730 - DNA, 22 bp, Artificial sequence
  SiRNA target sequence
atttagaattgctaaggtagaa

SEQ ID NO: 214731 - DNA, 22 bp, Artificial sequence
  SiRNA target sequence
tttagaattgctaaggtagaaa

SEQ ID NO: 214732 - DNA, 22 bp, Artificial sequence
  SiRNA target sequence
ttagaattgctaaggtagaaag

SEQ ID NO: 214733 - DNA, 22 bp, Artificial sequence
  SiRNA target sequence
tagaattgctaaggtagaaaga

SEQ ID NO: 214734 - DNA, 22 bp, Artificial sequence
  SiRNA target sequence
agaattgctaaggtagaaagaa

SEQ ID NO: 214735 - DNA, 22 bp, Artificial sequence
  SiRNA target sequence
gaattgctaaggtagaaagaag

SEQ ID NO: 214736 - DNA, 22 bp, Artificial sequence
  SiRNA target sequence
aattgctaaggtagaaagaaga

SEQ ID NO: 214737 - DNA, 22 bp, Artificial sequence
  SiRNA target sequence
attgctaaggtagaaagaagaa

SEQ ID NO: 214738 - DNA, 22 bp, Artificial sequence
  SiRNA target sequence
ttgctaaggtagaaagaagaat

SEQ ID NO: 214739 - DNA, 22 bp, Artificial sequence
  SiRNA target sequence
tgctaaggtagaaagaagaatg

SEQ ID NO: 214740 - DNA, 22 bp, Artificial sequence
  SiRNA target sequence
gctaaggtagaaagaagaatgt

SEQ ID NO: 214741 - DNA, 22 bp, Artificial sequence
  SiRNA target sequence
ctaaggtagaaagaagaatgtt

SEQ ID NO: 214742 - DNA, 22 bp, Artificial sequence
  SiRNA target sequence
taaggtagaaagaagaatgttt

SEQ ID NO: 214743 - DNA, 22 bp, Artificial sequence
  SiRNA target sequence
aaggtagaaagaagaatgtttt

SEQ ID NO: 214744 - DNA, 22 bp, Artificial sequence
  SiRNA target sequence
aggtagaaagaagaatgttttg

SEQ ID NO: 214745 - DNA, 22 bp, Artificial sequence
  SiRNA target sequence
ggtagaaagaagaatgttttgg

SEQ ID NO: 214746 - DNA, 22 bp, Artificial sequence
  SiRNA target sequence
gtagaaagaagaatgttttggc

SEQ ID NO: 214747 - DNA, 22 bp, Artificial sequence
  SiRNA target sequence
tagaaagaagaatgttttggct

SEQ ID NO: 214748 - DNA, 22 bp, Artificial sequence
  SiRNA target sequence
agaaagaagaatgttttggctt

SEQ ID NO: 214749 - DNA, 22 bp, Artificial sequence
  SiRNA target sequence
gaaagaagaatgttttggctta

SEQ ID NO: 214750 - DNA, 22 bp, Artificial sequence
  SiRNA target sequence
aaagaagaatgttttggcttat

SEQ ID NO: 214751 - DNA, 22 bp, Artificial sequence
  SiRNA target sequence
aagaagaatgttttggcttatg

SEQ ID NO: 214752 - DNA, 22 bp, Artificial sequence
  SiRNA target sequence
agaagaatgttttggcttatga

SEQ ID NO: 214753 - DNA, 22 bp, Artificial sequence
  SiRNA target sequence
gaagaatgttttggcttatgac

SEQ ID NO: 214754 - DNA, 22 bp, Artificial sequence
  SiRNA target sequence
aagaatgttttggcttatgacg

SEQ ID NO: 214755 - DNA, 22 bp, Artificial sequence
  SiRNA target sequence
agaatgttttggcttatgacgc

SEQ ID NO: 214756 - DNA, 22 bp, Artificial sequence
  SiRNA target sequence
gaatgttttggcttatgacgct

SEQ ID NO: 214757 - DNA, 22 bp, Artificial sequence
  SiRNA target sequence
aatgttttggcttatgacgctt

SEQ ID NO: 214758 - DNA, 22 bp, Artificial sequence
  SiRNA target sequence
atgttttggcttatgacgctta

SEQ ID NO: 214759 - DNA, 22 bp, Artificial sequence
  SiRNA target sequence
tgttttggcttatgacgcttat

SEQ ID NO: 214760 - DNA, 22 bp, Artificial sequence
  SiRNA target sequence
gttttggcttatgacgcttatg

SEQ ID NO: 214761 - DNA, 22 bp, Artificial sequence
  SiRNA target sequence
ttttggcttatgacgcttatgt

SEQ ID NO: 214762 - DNA, 22 bp, Artificial sequence
  SiRNA target sequence
tttggcttatgacgcttatgtt

SEQ ID NO: 214763 - DNA, 22 bp, Artificial sequence
  SiRNA target sequence
ttggcttatgacgcttatgttt

SEQ ID NO: 214764 - DNA, 22 bp, Artificial sequence
  SiRNA target sequence
tggcttatgacgcttatgtttt

SEQ ID NO: 214765 - DNA, 22 bp, Artificial sequence
  SiRNA target sequence
ggcttatgacgcttatgttttc

SEQ ID NO: 214766 - DNA, 22 bp, Artificial sequence
  SiRNA target sequence
gcttatgacgcttatgttttcg

SEQ ID NO: 214767 - DNA, 22 bp, Artificial sequence
  SiRNA target sequence
cttatgacgcttatgttttcgc

SEQ ID NO: 214768 - DNA, 22 bp, Artificial sequence
  SiRNA target sequence
ttatgacgcttatgttttcgct

SEQ ID NO: 214769 - DNA, 22 bp, Artificial sequence
  SiRNA target sequence
tatgacgcttatgttttcgctt

SEQ ID NO: 214770 - DNA, 22 bp, Artificial sequence
  SiRNA target sequence
atgacgcttatgttttcgctta

SEQ ID NO: 214771 - DNA, 22 bp, Artificial sequence
  SiRNA target sequence
tgacgcttatgttttcgcttat

SEQ ID NO: 214772 - DNA, 22 bp, Artificial sequence
  SiRNA target sequence
gacgcttatgttttcgcttatt

SEQ ID NO: 214773 - DNA, 22 bp, Artificial sequence
  SiRNA target sequence
acgcttatgttttcgcttattt

SEQ ID NO: 214774 - DNA, 22 bp, Artificial sequence
  SiRNA target sequence
cgcttatgttttcgcttatttc

SEQ ID NO: 214775 - DNA, 22 bp, Artificial sequence
  SiRNA target sequence
gcttatgttttcgcttatttcc

SEQ ID NO: 214776 - DNA, 22 bp, Artificial sequence
  SiRNA target sequence
cttatgttttcgcttatttcct

SEQ ID NO: 214777 - DNA, 22 bp, Artificial sequence
  SiRNA target sequence
ttatgttttcgcttatttcctt

SEQ ID NO: 214778 - DNA, 22 bp, Artificial sequence
  SiRNA target sequence
tatgttttcgcttatttccttt

SEQ ID NO: 214779 - DNA, 22 bp, Artificial sequence
  SiRNA target sequence
atgttttcgcttatttccttta

SEQ ID NO: 214780 - DNA, 22 bp, Artificial sequence
  SiRNA target sequence
tgttttcgcttatttcctttat

SEQ ID NO: 214781 - DNA, 22 bp, Artificial sequence
  SiRNA target sequence
gttttcgcttatttcctttatt

SEQ ID NO: 214782 - DNA, 22 bp, Artificial sequence
  SiRNA target sequence
ttttcgcttatttcctttattt

SEQ ID NO: 214783 - DNA, 22 bp, Artificial sequence
  SiRNA target sequence
tttcgcttatttcctttattta

SEQ ID NO: 214784 - DNA, 22 bp, Artificial sequence
  SiRNA target sequence
ttcgcttatttcctttatttac

SEQ ID NO: 214785 - DNA, 22 bp, Artificial sequence
  SiRNA target sequence
tcgcttatttcctttatttact

SEQ ID NO: 214786 - DNA, 22 bp, Artificial sequence
  SiRNA target sequence
cgcttatttcctttatttactc

SEQ ID NO: 214787 - DNA, 22 bp, Artificial sequence
  SiRNA target sequence
gcttatttcctttatttactca

SEQ ID NO: 214788 - DNA, 22 bp, Artificial sequence
  SiRNA target sequence
cttatttcctttatttactcag

SEQ ID NO: 214789 - DNA, 22 bp, Artificial sequence
  SiRNA target sequence
ttatttcctttatttactcagt

SEQ ID NO: 214790 - DNA, 22 bp, Artificial sequence
  SiRNA target sequence
tatttcctttatttactcagta

SEQ ID NO: 214791 - DNA, 22 bp, Artificial sequence
  SiRNA target sequence
atttcctttatttactcagtag

SEQ ID NO: 214792 - DNA, 22 bp, Artificial sequence
  SiRNA target sequence
tttcctttatttactcagtagg

SEQ ID NO: 214793 - DNA, 22 bp, Artificial sequence
  SiRNA target sequence
ttcctttatttactcagtagga

SEQ ID NO: 214794 - DNA, 22 bp, Artificial sequence
  SiRNA target sequence
tcctttatttactcagtaggac

SEQ ID NO: 214795 - DNA, 22 bp, Artificial sequence
  SiRNA target sequence
cctttatttactcagtaggacg

SEQ ID NO: 214796 - DNA, 22 bp, Artificial sequence
  SiRNA target sequence
ctttatttactcagtaggacga

SEQ ID NO: 214797 - DNA, 22 bp, Artificial sequence
  SiRNA target sequence
tttatttactcagtaggacgag

SEQ ID NO: 214798 - DNA, 22 bp, Artificial sequence
  SiRNA target sequence
ttatttactcagtaggacgagt

SEQ ID NO: 214799 - DNA, 22 bp, Artificial sequence
  SiRNA target sequence
tatttactcagtaggacgagtg

SEQ ID NO: 214800 - DNA, 22 bp, Artificial sequence
  SiRNA target sequence
atttactcagtaggacgagtgt

SEQ ID NO: 214801 - DNA, 22 bp, Artificial sequence
  SiRNA target sequence
tttactcagtaggacgagtgtt

SEQ ID NO: 214802 - DNA, 22 bp, Artificial sequence
  SiRNA target sequence
ttactcagtaggacgagtgtta

SEQ ID NO: 214803 - DNA, 22 bp, Artificial sequence
  SiRNA target sequence
tactcagtaggacgagtgttaa

SEQ ID NO: 214804 - DNA, 22 bp, Artificial sequence
  SiRNA target sequence
actcagtaggacgagtgttaaa

SEQ ID NO: 214805 - DNA, 22 bp, Artificial sequence
  SiRNA target sequence
ctcagtaggacgagtgttaaaa

SEQ ID NO: 214806 - DNA, 22 bp, Artificial sequence
  SiRNA target sequence
tcagtaggacgagtgttaaaag

SEQ ID NO: 214807 - DNA, 22 bp, Artificial sequence
  SiRNA target sequence
cagtaggacgagtgttaaaaga

SEQ ID NO: 214808 - DNA, 22 bp, Artificial sequence
  SiRNA target sequence
agtaggacgagtgttaaaagat

SEQ ID NO: 214809 - DNA, 22 bp, Artificial sequence
  SiRNA target sequence
gtaggacgagtgttaaaagatg

SEQ ID NO: 214810 - DNA, 22 bp, Artificial sequence
  SiRNA target sequence
taggacgagtgttaaaagatgc

SEQ ID NO: 214811 - DNA, 22 bp, Artificial sequence
  SiRNA target sequence
aggacgagtgttaaaagatgca

SEQ ID NO: 214812 - DNA, 22 bp, Artificial sequence
  SiRNA target sequence
ggacgagtgttaaaagatgcag

SEQ ID NO: 214813 - DNA, 22 bp, Artificial sequence
  SiRNA target sequence
gacgagtgttaaaagatgcagc

SEQ ID NO: 214814 - DNA, 22 bp, Artificial sequence
  SiRNA target sequence
acgagtgttaaaagatgcagca

SEQ ID NO: 214815 - DNA, 22 bp, Artificial sequence
  SiRNA target sequence
cgagtgttaaaagatgcagcag

SEQ ID NO: 214816 - DNA, 22 bp, Artificial sequence
  SiRNA target sequence
gagtgttaaaagatgcagcagt

SEQ ID NO: 214817 - DNA, 22 bp, Artificial sequence
  SiRNA target sequence
agtgttaaaagatgcagcagtt

SEQ ID NO: 214818 - DNA, 22 bp, Artificial sequence
  SiRNA target sequence
gtgttaaaagatgcagcagttc

SEQ ID NO: 214819 - DNA, 22 bp, Artificial sequence
  SiRNA target sequence
tgttaaaagatgcagcagttct

SEQ ID NO: 214820 - DNA, 22 bp, Artificial sequence
  SiRNA target sequence
gttaaaagatgcagcagttctt

SEQ ID NO: 214821 - DNA, 22 bp, Artificial sequence
  SiRNA target sequence
ttaaaagatgcagcagttctta

SEQ ID NO: 214822 - DNA, 22 bp, Artificial sequence
  SiRNA target sequence
taaaagatgcagcagttcttag

SEQ ID NO: 214823 - DNA, 22 bp, Artificial sequence
  SiRNA target sequence
aaaagatgcagcagttcttagt

SEQ ID NO: 214824 - DNA, 22 bp, Artificial sequence
  SiRNA target sequence
aaagatgcagcagttcttagta

SEQ ID NO: 214825 - DNA, 22 bp, Artificial sequence
  SiRNA target sequence
aagatgcagcagttcttagtag

SEQ ID NO: 214826 - DNA, 22 bp, Artificial sequence
  SiRNA target sequence
agatgcagcagttcttagtaga

SEQ ID NO: 214827 - DNA, 22 bp, Artificial sequence
  SiRNA target sequence
gatgcagcagttcttagtagac

SEQ ID NO: 214828 - DNA, 22 bp, Artificial sequence
  SiRNA target sequence
atgcagcagttcttagtagaca

SEQ ID NO: 214829 - DNA, 22 bp, Artificial sequence
  SiRNA target sequence
tgcagcagttcttagtagacag

SEQ ID NO: 214830 - DNA, 22 bp, Artificial sequence
  SiRNA target sequence
gcagcagttcttagtagacaga

SEQ ID NO: 214831 - DNA, 22 bp, Artificial sequence
  SiRNA target sequence
cagcagttcttagtagacagat

SEQ ID NO: 214832 - DNA, 22 bp, Artificial sequence
  SiRNA target sequence
agcagttcttagtagacagatg

SEQ ID NO: 214833 - DNA, 22 bp, Artificial sequence
  SiRNA target sequence
gcagttcttagtagacagatgc

SEQ ID NO: 214834 - DNA, 22 bp, Artificial sequence
  SiRNA target sequence
cagttcttagtagacagatgcc

SEQ ID NO: 214835 - DNA, 22 bp, Artificial sequence
  SiRNA target sequence
agttcttagtagacagatgcca

SEQ ID NO: 214836 - DNA, 22 bp, Artificial sequence
  SiRNA target sequence
gttcttagtagacagatgccac

SEQ ID NO: 214837 - DNA, 22 bp, Artificial sequence
  SiRNA target sequence
ttcttagtagacagatgccact

SEQ ID NO: 214838 - DNA, 22 bp, Artificial sequence
  SiRNA target sequence
tcttagtagacagatgccacta

SEQ ID NO: 214839 - DNA, 22 bp, Artificial sequence
  SiRNA target sequence
cttagtagacagatgccactat

SEQ ID NO: 214840 - DNA, 22 bp, Artificial sequence
  SiRNA target sequence
ttagtagacagatgccactatc

SEQ ID NO: 214841 - DNA, 22 bp, Artificial sequence
  SiRNA target sequence
tagtagacagatgccactatcc

SEQ ID NO: 214842 - DNA, 22 bp, Artificial sequence
  SiRNA target sequence
agtagacagatgccactatcca

SEQ ID NO: 214843 - DNA, 22 bp, Artificial sequence
  SiRNA target sequence
gtagacagatgccactatccat

SEQ ID NO: 214844 - DNA, 22 bp, Artificial sequence
  SiRNA target sequence
tagacagatgccactatccatt

SEQ ID NO: 214845 - DNA, 22 bp, Artificial sequence
  SiRNA target sequence
agacagatgccactatccatta

SEQ ID NO: 214846 - DNA, 22 bp, Artificial sequence
  SiRNA target sequence
gacagatgccactatccattaa

SEQ ID NO: 214847 - DNA, 22 bp, Artificial sequence
  SiRNA target sequence
acagatgccactatccattaat

SEQ ID NO: 214848 - DNA, 22 bp, Artificial sequence
  SiRNA target sequence
cagatgccactatccattaatt

SEQ ID NO: 214849 - DNA, 22 bp, Artificial sequence
  SiRNA target sequence
agatgccactatccattaattg

SEQ ID NO: 214850 - DNA, 22 bp, Artificial sequence
  SiRNA target sequence
gatgccactatccattaattgt

SEQ ID NO: 214851 - DNA, 22 bp, Artificial sequence
  SiRNA target sequence
atgccactatccattaattgtc

SEQ ID NO: 214852 - DNA, 22 bp, Artificial sequence
  SiRNA target sequence
tgccactatccattaattgtct

SEQ ID NO: 214853 - DNA, 22 bp, Artificial sequence
  SiRNA target sequence
gccactatccattaattgtctt

SEQ ID NO: 214854 - DNA, 22 bp, Artificial sequence
  SiRNA target sequence
ccactatccattaattgtctta

SEQ ID NO: 214855 - DNA, 22 bp, Artificial sequence
  SiRNA target sequence
cactatccattaattgtcttaa

SEQ ID NO: 214856 - DNA, 22 bp, Artificial sequence
  SiRNA target sequence
actatccattaattgtcttaaa

SEQ ID NO: 214857 - DNA, 22 bp, Artificial sequence
  SiRNA target sequence
ctatccattaattgtcttaaaa

SEQ ID NO: 214858 - DNA, 22 bp, Artificial sequence
  SiRNA target sequence
tatccattaattgtcttaaaag

SEQ ID NO: 214859 - DNA, 22 bp, Artificial sequence
  SiRNA target sequence
atccattaattgtcttaaaagc

SEQ ID NO: 214860 - DNA, 22 bp, Artificial sequence
  SiRNA target sequence
tccattaattgtcttaaaagct

SEQ ID NO: 214861 - DNA, 22 bp, Artificial sequence
  SiRNA target sequence
ccattaattgtcttaaaagctt

SEQ ID NO: 214862 - DNA, 22 bp, Artificial sequence
  SiRNA target sequence
cattaattgtcttaaaagcttt

SEQ ID NO: 214863 - DNA, 22 bp, Artificial sequence
  SiRNA target sequence
attaattgtcttaaaagctttg

SEQ ID NO: 214864 - DNA, 22 bp, Artificial sequence
  SiRNA target sequence
ttaattgtcttaaaagctttgt

SEQ ID NO: 214865 - DNA, 22 bp, Artificial sequence
  SiRNA target sequence
taattgtcttaaaagctttgta

SEQ ID NO: 214866 - DNA, 22 bp, Artificial sequence
  SiRNA target sequence
aattgtcttaaaagctttgtaa

SEQ ID NO: 214867 - DNA, 22 bp, Artificial sequence
  SiRNA target sequence
attgtcttaaaagctttgtaat

SEQ ID NO: 214868 - DNA, 22 bp, Artificial sequence
  SiRNA target sequence
ttgtcttaaaagctttgtaatt

SEQ ID NO: 214869 - DNA, 22 bp, Artificial sequence
  SiRNA target sequence
tgtcttaaaagctttgtaattt

SEQ ID NO: 214870 - DNA, 22 bp, Artificial sequence
  SiRNA target sequence
gtcttaaaagctttgtaatttt

SEQ ID NO: 214871 - DNA, 22 bp, Artificial sequence
  SiRNA target sequence
tcttaaaagctttgtaatttta

SEQ ID NO: 214872 - DNA, 22 bp, Artificial sequence
  SiRNA target sequence
cttaaaagctttgtaattttac

SEQ ID NO: 214873 - DNA, 22 bp, Artificial sequence
  SiRNA target sequence
ttaaaagctttgtaattttacc

SEQ ID NO: 214874 - DNA, 22 bp, Artificial sequence
  SiRNA target sequence
taaaagctttgtaattttacca

SEQ ID NO: 214875 - DNA, 22 bp, Artificial sequence
  SiRNA target sequence
aaaagctttgtaattttaccag

SEQ ID NO: 214876 - DNA, 22 bp, Artificial sequence
  SiRNA target sequence
aaagctttgtaattttaccagt

SEQ ID NO: 214877 - DNA, 22 bp, Artificial sequence
  SiRNA target sequence
aagctttgtaattttaccagtt

SEQ ID NO: 214878 - DNA, 22 bp, Artificial sequence
  SiRNA target sequence
agctttgtaattttaccagtta

SEQ ID NO: 214879 - DNA, 22 bp, Artificial sequence
  SiRNA target sequence
gctttgtaattttaccagttac

SEQ ID NO: 214880 - DNA, 22 bp, Artificial sequence
  SiRNA target sequence
ctttgtaattttaccagttact

SEQ ID NO: 214881 - DNA, 22 bp, Artificial sequence
  SiRNA target sequence
tttgtaattttaccagttactc

SEQ ID NO: 214882 - DNA, 22 bp, Artificial sequence
  SiRNA target sequence
ttgtaattttaccagttactct

SEQ ID NO: 214883 - DNA, 22 bp, Artificial sequence
  SiRNA target sequence
tgtaattttaccagttactctt

SEQ ID NO: 214884 - DNA, 22 bp, Artificial sequence
  SiRNA target sequence
gtaattttaccagttactcttg

SEQ ID NO: 214885 - DNA, 22 bp, Artificial sequence
  SiRNA target sequence
taattttaccagttactcttgt

SEQ ID NO: 214886 - DNA, 22 bp, Artificial sequence
  SiRNA target sequence
aattttaccagttactcttgtt

SEQ ID NO: 214887 - DNA, 22 bp, Artificial sequence
  SiRNA target sequence
attttaccagttactcttgttt

SEQ ID NO: 214888 - DNA, 22 bp, Artificial sequence
  SiRNA target sequence
ttttaccagttactcttgtttg

SEQ ID NO: 214889 - DNA, 22 bp, Artificial sequence
  SiRNA target sequence
tttaccagttactcttgtttgt

SEQ ID NO: 214890 - DNA, 22 bp, Artificial sequence
  SiRNA target sequence
ttaccagttactcttgtttgtg

SEQ ID NO: 214891 - DNA, 22 bp, Artificial sequence
  SiRNA target sequence
taccagttactcttgtttgtgt

SEQ ID NO: 214892 - DNA, 22 bp, Artificial sequence
  SiRNA target sequence
accagttactcttgtttgtgta

SEQ ID NO: 214893 - DNA, 22 bp, Artificial sequence
  SiRNA target sequence
ccagttactcttgtttgtgtag

SEQ ID NO: 214894 - DNA, 22 bp, Artificial sequence
  SiRNA target sequence
cagttactcttgtttgtgtagg

SEQ ID NO: 214895 - DNA, 22 bp, Artificial sequence
  SiRNA target sequence
agttactcttgtttgtgtagga

SEQ ID NO: 214896 - DNA, 22 bp, Artificial sequence
  SiRNA target sequence
gttactcttgtttgtgtaggat

SEQ ID NO: 214897 - DNA, 22 bp, Artificial sequence
  SiRNA target sequence
ttactcttgtttgtgtaggatt

SEQ ID NO: 214898 - DNA, 22 bp, Artificial sequence
  SiRNA target sequence
tactcttgtttgtgtaggatta

SEQ ID NO: 214899 - DNA, 22 bp, Artificial sequence
  SiRNA target sequence
actcttgtttgtgtaggattaa

SEQ ID NO: 214900 - DNA, 22 bp, Artificial sequence
  SiRNA target sequence
ctcttgtttgtgtaggattaat

SEQ ID NO: 214901 - DNA, 22 bp, Artificial sequence
  SiRNA target sequence
tcttgtttgtgtaggattaatt

SEQ ID NO: 214902 - DNA, 22 bp, Artificial sequence
  SiRNA target sequence
cttgtttgtgtaggattaattc

SEQ ID NO: 214903 - DNA, 22 bp, Artificial sequence
  SiRNA target sequence
ttgtttgtgtaggattaattca

SEQ ID NO: 214904 - DNA, 22 bp, Artificial sequence
  SiRNA target sequence
tgtttgtgtaggattaattcag

SEQ ID NO: 214905 - DNA, 22 bp, Artificial sequence
  SiRNA target sequence
gtttgtgtaggattaattcaga

SEQ ID NO: 214906 - DNA, 22 bp, Artificial sequence
  SiRNA target sequence
tttgtgtaggattaattcagaa

SEQ ID NO: 214907 - DNA, 22 bp, Artificial sequence
  SiRNA target sequence
ttgtgtaggattaattcagaag

SEQ ID NO: 214908 - DNA, 22 bp, Artificial sequence
  SiRNA target sequence
tgtgtaggattaattcagaagt

SEQ ID NO: 214909 - DNA, 22 bp, Artificial sequence
  SiRNA target sequence
gtgtaggattaattcagaagtc

SEQ ID NO: 214910 - DNA, 22 bp, Artificial sequence
  SiRNA target sequence
tgtaggattaattcagaagtct

SEQ ID NO: 214911 - DNA, 22 bp, Artificial sequence
  SiRNA target sequence
gtaggattaattcagaagtcta

SEQ ID NO: 214912 - DNA, 22 bp, Artificial sequence
  SiRNA target sequence
taggattaattcagaagtctac

SEQ ID NO: 214913 - DNA, 22 bp, Artificial sequence
  SiRNA target sequence
aggattaattcagaagtctaca

SEQ ID NO: 214914 - DNA, 22 bp, Artificial sequence
  SiRNA target sequence
ggattaattcagaagtctacac

SEQ ID NO: 214915 - DNA, 22 bp, Artificial sequence
  SiRNA target sequence
gattaattcagaagtctacact

SEQ ID NO: 214916 - DNA, 22 bp, Artificial sequence
  SiRNA target sequence
attaattcagaagtctacactc

SEQ ID NO: 214917 - DNA, 22 bp, Artificial sequence
  SiRNA target sequence
ttaattcagaagtctacactct

SEQ ID NO: 214918 - DNA, 22 bp, Artificial sequence
  SiRNA target sequence
taattcagaagtctacactctc

SEQ ID NO: 214919 - DNA, 22 bp, Artificial sequence
  SiRNA target sequence
aattcagaagtctacactctct

SEQ ID NO: 214920 - DNA, 22 bp, Artificial sequence
  SiRNA target sequence
attcagaagtctacactctctt

SEQ ID NO: 214921 - DNA, 22 bp, Artificial sequence
  SiRNA target sequence
ttcagaagtctacactctctta

SEQ ID NO: 214922 - DNA, 22 bp, Artificial sequence
  SiRNA target sequence
tcagaagtctacactctcttat

SEQ ID NO: 214923 - DNA, 22 bp, Artificial sequence
  SiRNA target sequence
cagaagtctacactctcttatt

SEQ ID NO: 214924 - DNA, 22 bp, Artificial sequence
  SiRNA target sequence
agaagtctacactctcttattc

SEQ ID NO: 214925 - DNA, 22 bp, Artificial sequence
  SiRNA target sequence
gaagtctacactctcttattct

SEQ ID NO: 214926 - DNA, 22 bp, Artificial sequence
  SiRNA target sequence
aagtctacactctcttattctt

SEQ ID NO: 214927 - DNA, 22 bp, Artificial sequence
  SiRNA target sequence
agtctacactctcttattcttt

SEQ ID NO: 214928 - DNA, 22 bp, Artificial sequence
  SiRNA target sequence
gtctacactctcttattctttt

SEQ ID NO: 214929 - DNA, 22 bp, Artificial sequence
  SiRNA target sequence
tctacactctcttattctttta

SEQ ID NO: 214930 - DNA, 22 bp, Artificial sequence
  SiRNA target sequence
ctacactctcttattcttttac

SEQ ID NO: 214931 - DNA, 22 bp, Artificial sequence
  SiRNA target sequence
tacactctcttattcttttaca

SEQ ID NO: 214932 - DNA, 22 bp, Artificial sequence
  SiRNA target sequence
acactctcttattcttttacaa

SEQ ID NO: 214933 - DNA, 22 bp, Artificial sequence
  SiRNA target sequence
cactctcttattcttttacaaa

SEQ ID NO: 214934 - DNA, 22 bp, Artificial sequence
  SiRNA target sequence
actctcttattcttttacaaaa

SEQ ID NO: 214935 - DNA, 22 bp, Artificial sequence
  SiRNA target sequence
ctctcttattcttttacaaaaa

SEQ ID NO: 214936 - DNA, 22 bp, Artificial sequence
  SiRNA target sequence
tctcttattcttttacaaaaat

SEQ ID NO: 214937 - DNA, 22 bp, Artificial sequence
  SiRNA target sequence
ctcttattcttttacaaaaata

SEQ ID NO: 214938 - DNA, 22 bp, Artificial sequence
  SiRNA target sequence
tcttattcttttacaaaaatat

SEQ ID NO: 214939 - DNA, 22 bp, Artificial sequence
  SiRNA target sequence
cttattcttttacaaaaatatt

SEQ ID NO: 214940 - DNA, 22 bp, Artificial sequence
  SiRNA target sequence
ttattcttttacaaaaatattt

SEQ ID NO: 214941 - DNA, 22 bp, Artificial sequence
  SiRNA target sequence
tattcttttacaaaaatatttg

SEQ ID NO: 214942 - DNA, 22 bp, Artificial sequence
  SiRNA target sequence
attcttttacaaaaatatttga

SEQ ID NO: 214943 - DNA, 22 bp, Artificial sequence
  SiRNA target sequence
ttcttttacaaaaatatttgat

SEQ ID NO: 214944 - DNA, 22 bp, Artificial sequence
  SiRNA target sequence
tcttttacaaaaatatttgatg

SEQ ID NO: 214945 - DNA, 22 bp, Artificial sequence
  SiRNA target sequence
cttttacaaaaatatttgatgg

SEQ ID NO: 214946 - DNA, 22 bp, Artificial sequence
  SiRNA target sequence
ttttacaaaaatatttgatggt

SEQ ID NO: 214947 - DNA, 22 bp, Artificial sequence
  SiRNA target sequence
tttacaaaaatatttgatggtg

SEQ ID NO: 214948 - DNA, 22 bp, Artificial sequence
  SiRNA target sequence
ttacaaaaatatttgatggtgc

SEQ ID NO: 214949 - DNA, 22 bp, Artificial sequence
  SiRNA target sequence
tacaaaaatatttgatggtgca

SEQ ID NO: 214950 - DNA, 22 bp, Artificial sequence
  SiRNA target sequence
acaaaaatatttgatggtgcat

SEQ ID NO: 214951 - DNA, 22 bp, Artificial sequence
  SiRNA target sequence
caaaaatatttgatggtgcatt

SEQ ID NO: 214952 - DNA, 22 bp, Artificial sequence
  SiRNA target sequence
aaaaatatttgatggtgcattg

SEQ ID NO: 214953 - DNA, 22 bp, Artificial sequence
  SiRNA target sequence
aaaatatttgatggtgcattgt

SEQ ID NO: 214954 - DNA, 22 bp, Artificial sequence
  SiRNA target sequence
aaatatttgatggtgcattgtt

SEQ ID NO: 214955 - DNA, 22 bp, Artificial sequence
  SiRNA target sequence
aatatttgatggtgcattgtta

SEQ ID NO: 214956 - DNA, 22 bp, Artificial sequence
  SiRNA target sequence
atatttgatggtgcattgttaa

SEQ ID NO: 214957 - DNA, 22 bp, Artificial sequence
  SiRNA target sequence
tatttgatggtgcattgttaat

SEQ ID NO: 214958 - DNA, 22 bp, Artificial sequence
  SiRNA target sequence
atttgatggtgcattgttaata

SEQ ID NO: 214959 - DNA, 22 bp, Artificial sequence
  SiRNA target sequence
tttgatggtgcattgttaatat

SEQ ID NO: 214960 - DNA, 22 bp, Artificial sequence
  SiRNA target sequence
ttgatggtgcattgttaatatt

SEQ ID NO: 214961 - DNA, 22 bp, Artificial sequence
  SiRNA target sequence
tgatggtgcattgttaatattt

SEQ ID NO: 214962 - DNA, 22 bp, Artificial sequence
  SiRNA target sequence
gatggtgcattgttaatatttg

SEQ ID NO: 214963 - DNA, 22 bp, Artificial sequence
  SiRNA target sequence
atggtgcattgttaatatttgc

SEQ ID NO: 214964 - DNA, 22 bp, Artificial sequence
  SiRNA target sequence
tggtgcattgttaatatttgct

SEQ ID NO: 214965 - DNA, 22 bp, Artificial sequence
  SiRNA target sequence
ggtgcattgttaatatttgctt

SEQ ID NO: 214966 - DNA, 22 bp, Artificial sequence
  SiRNA target sequence
gtgcattgttaatatttgcttt

SEQ ID NO: 214967 - DNA, 22 bp, Artificial sequence
  SiRNA target sequence
tgcattgttaatatttgctttt

SEQ ID NO: 214968 - DNA, 22 bp, Artificial sequence
  SiRNA target sequence
gcattgttaatatttgcttttc

SEQ ID NO: 214969 - DNA, 22 bp, Artificial sequence
  SiRNA target sequence
cattgttaatatttgcttttct

SEQ ID NO: 214970 - DNA, 22 bp, Artificial sequence
  SiRNA target sequence
attgttaatatttgcttttctt

SEQ ID NO: 214971 - DNA, 22 bp, Artificial sequence
  SiRNA target sequence
ttgttaatatttgcttttcttt

SEQ ID NO: 214972 - DNA, 22 bp, Artificial sequence
  SiRNA target sequence
tgttaatatttgcttttcttta

SEQ ID NO: 214973 - DNA, 22 bp, Artificial sequence
  SiRNA target sequence
gttaatatttgcttttctttat

SEQ ID NO: 214974 - DNA, 22 bp, Artificial sequence
  SiRNA target sequence
ttaatatttgcttttctttata

SEQ ID NO: 214975 - DNA, 22 bp, Artificial sequence
  SiRNA target sequence
taatatttgcttttctttatat

SEQ ID NO: 214976 - DNA, 22 bp, Artificial sequence
  SiRNA target sequence
aatatttgcttttctttatatc

SEQ ID NO: 214977 - DNA, 22 bp, Artificial sequence
  SiRNA target sequence
atatttgcttttctttatatca

SEQ ID NO: 214978 - DNA, 22 bp, Artificial sequence
  SiRNA target sequence
tatttgcttttctttatatcat

SEQ ID NO: 214979 - DNA, 22 bp, Artificial sequence
  SiRNA target sequence
atttgcttttctttatatcatt

SEQ ID NO: 214980 - DNA, 22 bp, Artificial sequence
  SiRNA target sequence
tttgcttttctttatatcattc

SEQ ID NO: 214981 - DNA, 22 bp, Artificial sequence
  SiRNA target sequence
ttgcttttctttatatcattct

SEQ ID NO: 214982 - DNA, 22 bp, Artificial sequence
  SiRNA target sequence
tgcttttctttatatcattctt

SEQ ID NO: 214983 - DNA, 22 bp, Artificial sequence
  SiRNA target sequence
gcttttctttatatcattcttg

SEQ ID NO: 214984 - DNA, 22 bp, Artificial sequence
  SiRNA target sequence
cttttctttatatcattcttgg

SEQ ID NO: 214985 - DNA, 22 bp, Artificial sequence
  SiRNA target sequence
ttttctttatatcattcttggt

SEQ ID NO: 214986 - DNA, 22 bp, Artificial sequence
  SiRNA target sequence
tttctttatatcattcttggtc

SEQ ID NO: 214987 - DNA, 22 bp, Artificial sequence
  SiRNA target sequence
ttctttatatcattcttggtct

SEQ ID NO: 214988 - DNA, 22 bp, Artificial sequence
  SiRNA target sequence
tctttatatcattcttggtcta

SEQ ID NO: 214989 - DNA, 22 bp, Artificial sequence
  SiRNA target sequence
ctttatatcattcttggtctag

SEQ ID NO: 214990 - DNA, 22 bp, Artificial sequence
  SiRNA target sequence
tttatatcattcttggtctagt

SEQ ID NO: 214991 - DNA, 22 bp, Artificial sequence
  SiRNA target sequence
ttatatcattcttggtctagtt

SEQ ID NO: 214992 - DNA, 22 bp, Artificial sequence
  SiRNA target sequence
tatatcattcttggtctagttc

SEQ ID NO: 214993 - DNA, 22 bp, Artificial sequence
  SiRNA target sequence
atatcattcttggtctagttct

SEQ ID NO: 214994 - DNA, 22 bp, Artificial sequence
  SiRNA target sequence
tatcattcttggtctagttctt

SEQ ID NO: 214995 - DNA, 22 bp, Artificial sequence
  SiRNA target sequence
atcattcttggtctagttcttc

SEQ ID NO: 214996 - DNA, 22 bp, Artificial sequence
  SiRNA target sequence
tcattcttggtctagttcttct

SEQ ID NO: 214997 - DNA, 22 bp, Artificial sequence
  SiRNA target sequence
cattcttggtctagttcttctt

SEQ ID NO: 214998 - DNA, 22 bp, Artificial sequence
  SiRNA target sequence
attcttggtctagttcttcttc

SEQ ID NO: 214999 - DNA, 22 bp, Artificial sequence
  SiRNA target sequence
ttcttggtctagttcttcttcc

SEQ ID NO: 215000 - DNA, 22 bp, Artificial sequence
  SiRNA target sequence
tcttggtctagttcttcttcca

SEQ ID NO: 215001 - DNA, 22 bp, Artificial sequence
  SiRNA target sequence
cttggtctagttcttcttccat

SEQ ID NO: 215002 - DNA, 22 bp, Artificial sequence
  SiRNA target sequence
ttggtctagttcttcttccata

SEQ ID NO: 215003 - DNA, 22 bp, Artificial sequence
  SiRNA target sequence
tggtctagttcttcttccatat

SEQ ID NO: 215004 - DNA, 22 bp, Artificial sequence
  SiRNA target sequence
ggtctagttcttcttccatatt

SEQ ID NO: 215005 - DNA, 22 bp, Artificial sequence
  SiRNA target sequence
gtctagttcttcttccatattc

SEQ ID NO: 215006 - DNA, 22 bp, Artificial sequence
  SiRNA target sequence
tctagttcttcttccatattct

SEQ ID NO: 215007 - DNA, 22 bp, Artificial sequence
  SiRNA target sequence
ctagttcttcttccatattctc

SEQ ID NO: 215008 - DNA, 22 bp, Artificial sequence
  SiRNA target sequence
tagttcttcttccatattctca

SEQ ID NO: 215009 - DNA, 22 bp, Artificial sequence
  SiRNA target sequence
agttcttcttccatattctcat

SEQ ID NO: 215010 - DNA, 22 bp, Artificial sequence
  SiRNA target sequence
gttcttcttccatattctcatc

SEQ ID NO: 215011 - DNA, 22 bp, Artificial sequence
  SiRNA target sequence
ttcttcttccatattctcatct

SEQ ID NO: 215012 - DNA, 22 bp, Artificial sequence
  SiRNA target sequence
tcttcttccatattctcatctt

SEQ ID NO: 215013 - DNA, 22 bp, Artificial sequence
  SiRNA target sequence
cttcttccatattctcatcttt

SEQ ID NO: 215014 - DNA, 22 bp, Artificial sequence
  SiRNA target sequence
ttcttccatattctcatctttt

SEQ ID NO: 215015 - DNA, 22 bp, Artificial sequence
  SiRNA target sequence
tcttccatattctcatcttttc

SEQ ID NO: 215016 - DNA, 22 bp, Artificial sequence
  SiRNA target sequence
cttccatattctcatcttttcc

SEQ ID NO: 215017 - DNA, 22 bp, Artificial sequence
  SiRNA target sequence
ttccatattctcatcttttcca

SEQ ID NO: 215018 - DNA, 22 bp, Artificial sequence
  SiRNA target sequence
tccatattctcatcttttccag

SEQ ID NO: 215019 - DNA, 22 bp, Artificial sequence
  SiRNA target sequence
ccatattctcatcttttccagc

SEQ ID NO: 215020 - DNA, 22 bp, Artificial sequence
  SiRNA target sequence
catattctcatcttttccagct

SEQ ID NO: 215021 - DNA, 22 bp, Artificial sequence
  SiRNA target sequence
atattctcatcttttccagctt

SEQ ID NO: 215022 - DNA, 22 bp, Artificial sequence
  SiRNA target sequence
tattctcatcttttccagcttg

SEQ ID NO: 215023 - DNA, 22 bp, Artificial sequence
  SiRNA target sequence
attctcatcttttccagcttga

SEQ ID NO: 215024 - DNA, 22 bp, Artificial sequence
  SiRNA target sequence
ttctcatcttttccagcttgat

SEQ ID NO: 215025 - DNA, 22 bp, Artificial sequence
  SiRNA target sequence
tctcatcttttccagcttgata

SEQ ID NO: 215026 - DNA, 22 bp, Artificial sequence
  SiRNA target sequence
ctcatcttttccagcttgatag

SEQ ID NO: 215027 - DNA, 22 bp, Artificial sequence
  SiRNA target sequence
tcatcttttccagcttgatagt

SEQ ID NO: 215028 - DNA, 22 bp, Artificial sequence
  SiRNA target sequence
catcttttccagcttgatagtt

SEQ ID NO: 215029 - DNA, 22 bp, Artificial sequence
  SiRNA target sequence
atcttttccagcttgatagtta

SEQ ID NO: 215030 - DNA, 22 bp, Artificial sequence
  SiRNA target sequence
tcttttccagcttgatagttat

SEQ ID NO: 215031 - DNA, 22 bp, Artificial sequence
  SiRNA target sequence
cttttccagcttgatagttatt

SEQ ID NO: 215032 - DNA, 22 bp, Artificial sequence
  SiRNA target sequence
ttttccagcttgatagttattt

SEQ ID NO: 215033 - DNA, 22 bp, Artificial sequence
  SiRNA target sequence
tttccagcttgatagttatttt

SEQ ID NO: 215034 - DNA, 22 bp, Artificial sequence
  SiRNA target sequence
ttccagcttgatagttattttt

SEQ ID NO: 215035 - DNA, 22 bp, Artificial sequence
  SiRNA target sequence
tccagcttgatagttatttttt

SEQ ID NO: 215036 - DNA, 22 bp, Artificial sequence
  SiRNA target sequence
ccagcttgatagttattttttt

SEQ ID NO: 215037 - DNA, 22 bp, Artificial sequence
  SiRNA target sequence
cagcttgatagttattttttta

SEQ ID NO: 215038 - DNA, 22 bp, Artificial sequence
  SiRNA target sequence
agcttgatagttatttttttag

SEQ ID NO: 215039 - DNA, 22 bp, Artificial sequence
  SiRNA target sequence
gcttgatagttatttttttaga

SEQ ID NO: 215040 - DNA, 22 bp, Artificial sequence
  SiRNA target sequence
cttgatagttatttttttagag

SEQ ID NO: 215041 - DNA, 22 bp, Artificial sequence
  SiRNA target sequence
ttgatagttatttttttagaga

SEQ ID NO: 215042 - DNA, 22 bp, Artificial sequence
  SiRNA target sequence
tgatagttatttttttagagac

SEQ ID NO: 215043 - DNA, 22 bp, Artificial sequence
  SiRNA target sequence
gatagttatttttttagagacc

SEQ ID NO: 215044 - DNA, 22 bp, Artificial sequence
  SiRNA target sequence
atagttatttttttagagacct

SEQ ID NO: 215045 - DNA, 22 bp, Artificial sequence
  SiRNA target sequence
tagttatttttttagagacctt

SEQ ID NO: 215046 - DNA, 22 bp, Artificial sequence
  SiRNA target sequence
agttatttttttagagaccttt

SEQ ID NO: 215047 - DNA, 22 bp, Artificial sequence
  SiRNA target sequence
gttatttttttagagacctttt

SEQ ID NO: 215048 - DNA, 22 bp, Artificial sequence
  SiRNA target sequence
ttatttttttagagaccttttt

SEQ ID NO: 215049 - DNA, 22 bp, Artificial sequence
  SiRNA target sequence
tatttttttagagaccttttta

SEQ ID NO: 215050 - DNA, 22 bp, Artificial sequence
  SiRNA target sequence
atttttttagagacctttttag

SEQ ID NO: 215051 - DNA, 22 bp, Artificial sequence
  SiRNA target sequence
tttttttagagacctttttagt

SEQ ID NO: 215052 - DNA, 22 bp, Artificial sequence
  SiRNA target sequence
ttttttagagacctttttagtg

SEQ ID NO: 215053 - DNA, 22 bp, Artificial sequence
  SiRNA target sequence
tttttagagacctttttagtga

SEQ ID NO: 215054 - DNA, 22 bp, Artificial sequence
  SiRNA target sequence
ttttagagacctttttagtgat

SEQ ID NO: 215055 - DNA, 22 bp, Artificial sequence
  SiRNA target sequence
tttagagacctttttagtgatg

SEQ ID NO: 215056 - DNA, 22 bp, Artificial sequence
  SiRNA target sequence
ttagagacctttttagtgatgg

SEQ ID NO: 215057 - DNA, 22 bp, Artificial sequence
  SiRNA target sequence
tagagacctttttagtgatggg

SEQ ID NO: 215058 - DNA, 22 bp, Artificial sequence
  SiRNA target sequence
agagacctttttagtgatggga

SEQ ID NO: 215059 - DNA, 22 bp, Artificial sequence
  SiRNA target sequence
gagacctttttagtgatgggaa

SEQ ID NO: 215060 - DNA, 22 bp, Artificial sequence
  SiRNA target sequence
agacctttttagtgatgggaaa

SEQ ID NO: 215061 - DNA, 22 bp, Artificial sequence
  SiRNA target sequence
gacctttttagtgatgggaaat

SEQ ID NO: 215062 - DNA, 22 bp, Artificial sequence
  SiRNA target sequence
acctttttagtgatgggaaatg

SEQ ID NO: 215063 - DNA, 22 bp, Artificial sequence
  SiRNA target sequence
cctttttagtgatgggaaatgt

SEQ ID NO: 215064 - DNA, 22 bp, Artificial sequence
  SiRNA target sequence
ctttttagtgatgggaaatgtg

SEQ ID NO: 215065 - DNA, 22 bp, Artificial sequence
  SiRNA target sequence
tttttagtgatgggaaatgtgt

SEQ ID NO: 215066 - DNA, 22 bp, Artificial sequence
  SiRNA target sequence
ttttagtgatgggaaatgtgtt

SEQ ID NO: 215067 - DNA, 22 bp, Artificial sequence
  SiRNA target sequence
tttagtgatgggaaatgtgttg

SEQ ID NO: 215068 - DNA, 22 bp, Artificial sequence
  SiRNA target sequence
ttagtgatgggaaatgtgttgt

SEQ ID NO: 215069 - DNA, 22 bp, Artificial sequence
  SiRNA target sequence
tagtgatgggaaatgtgttgta

SEQ ID NO: 215070 - DNA, 22 bp, Artificial sequence
  SiRNA target sequence
agtgatgggaaatgtgttgtaa

SEQ ID NO: 215071 - DNA, 22 bp, Artificial sequence
  SiRNA target sequence
gtgatgggaaatgtgttgtaag

SEQ ID NO: 215072 - DNA, 22 bp, Artificial sequence
  SiRNA target sequence
tgatgggaaatgtgttgtaaga

SEQ ID NO: 215073 - DNA, 22 bp, Artificial sequence
  SiRNA target sequence
gatgggaaatgtgttgtaagag

SEQ ID NO: 215074 - DNA, 22 bp, Artificial sequence
  SiRNA target sequence
atgggaaatgtgttgtaagagg

SEQ ID NO: 215075 - DNA, 22 bp, Artificial sequence
  SiRNA target sequence
tgggaaatgtgttgtaagaggc

SEQ ID NO: 215076 - DNA, 22 bp, Artificial sequence
  SiRNA target sequence
gggaaatgtgttgtaagaggct

SEQ ID NO: 215077 - DNA, 22 bp, Artificial sequence
  SiRNA target sequence
ggaaatgtgttgtaagaggcta

SEQ ID NO: 215078 - DNA, 22 bp, Artificial sequence
  SiRNA target sequence
gaaatgtgttgtaagaggctat

SEQ ID NO: 215079 - DNA, 22 bp, Artificial sequence
  SiRNA target sequence
aaatgtgttgtaagaggctatg

SEQ ID NO: 215080 - DNA, 22 bp, Artificial sequence
  SiRNA target sequence
aatgtgttgtaagaggctatga

SEQ ID NO: 215081 - DNA, 22 bp, Artificial sequence
  SiRNA target sequence
atgtgttgtaagaggctatgat

SEQ ID NO: 215082 - DNA, 22 bp, Artificial sequence
  SiRNA target sequence
tgtgttgtaagaggctatgatg

SEQ ID NO: 215083 - DNA, 22 bp, Artificial sequence
  SiRNA target sequence
gtgttgtaagaggctatgatgc

SEQ ID NO: 215084 - DNA, 22 bp, Artificial sequence
  SiRNA target sequence
tgttgtaagaggctatgatgct

SEQ ID NO: 215085 - DNA, 22 bp, Artificial sequence
  SiRNA target sequence
gttgtaagaggctatgatgctt

SEQ ID NO: 215086 - DNA, 22 bp, Artificial sequence
  SiRNA target sequence
ttgtaagaggctatgatgcttt

SEQ ID NO: 215087 - DNA, 22 bp, Artificial sequence
  SiRNA target sequence
tgtaagaggctatgatgcttta

SEQ ID NO: 215088 - DNA, 22 bp, Artificial sequence
  SiRNA target sequence
gtaagaggctatgatgctttat

SEQ ID NO: 215089 - DNA, 22 bp, Artificial sequence
  SiRNA target sequence
taagaggctatgatgctttatt

SEQ ID NO: 215090 - DNA, 22 bp, Artificial sequence
  SiRNA target sequence
aagaggctatgatgctttatta

SEQ ID NO: 215091 - DNA, 22 bp, Artificial sequence
  SiRNA target sequence
agaggctatgatgctttattat

SEQ ID NO: 215092 - DNA, 22 bp, Artificial sequence
  SiRNA target sequence
gaggctatgatgctttattatc

SEQ ID NO: 215093 - DNA, 22 bp, Artificial sequence
  SiRNA target sequence
aggctatgatgctttattatct

SEQ ID NO: 215094 - DNA, 22 bp, Artificial sequence
  SiRNA target sequence
ggctatgatgctttattatctt

SEQ ID NO: 215095 - DNA, 22 bp, Artificial sequence
  SiRNA target sequence
gctatgatgctttattatcttt

SEQ ID NO: 215096 - DNA, 22 bp, Artificial sequence
  SiRNA target sequence
ctatgatgctttattatctttg

SEQ ID NO: 215097 - DNA, 22 bp, Artificial sequence
  SiRNA target sequence
tatgatgctttattatctttgg

SEQ ID NO: 215098 - DNA, 22 bp, Artificial sequence
  SiRNA target sequence
atgatgctttattatctttggc

SEQ ID NO: 215099 - DNA, 22 bp, Artificial sequence
  SiRNA target sequence
tgatgctttattatctttggca

SEQ ID NO: 215100 - DNA, 22 bp, Artificial sequence
  SiRNA target sequence
gatgctttattatctttggcac

SEQ ID NO: 215101 - DNA, 22 bp, Artificial sequence
  SiRNA target sequence
atgctttattatctttggcact

SEQ ID NO: 215102 - DNA, 22 bp, Artificial sequence
  SiRNA target sequence
tgctttattatctttggcactg

SEQ ID NO: 215103 - DNA, 22 bp, Artificial sequence
  SiRNA target sequence
gctttattatctttggcactgg

SEQ ID NO: 215104 - DNA, 22 bp, Artificial sequence
  SiRNA target sequence
ctttattatctttggcactggt

SEQ ID NO: 215105 - DNA, 22 bp, Artificial sequence
  SiRNA target sequence
tttattatctttggcactggtc

SEQ ID NO: 215106 - DNA, 22 bp, Artificial sequence
  SiRNA target sequence
ttattatctttggcactggtct

SEQ ID NO: 215107 - DNA, 22 bp, Artificial sequence
  SiRNA target sequence
tattatctttggcactggtctt

SEQ ID NO: 215108 - DNA, 22 bp, Artificial sequence
  SiRNA target sequence
attatctttggcactggtcttt

SEQ ID NO: 215109 - DNA, 22 bp, Artificial sequence
  SiRNA target sequence
ttatctttggcactggtcttta

SEQ ID NO: 215110 - DNA, 22 bp, Artificial sequence
  SiRNA target sequence
tatctttggcactggtctttaa

SEQ ID NO: 215111 - DNA, 22 bp, Artificial sequence
  SiRNA target sequence
atctttggcactggtctttaac

SEQ ID NO: 215112 - DNA, 22 bp, Artificial sequence
  SiRNA target sequence
tctttggcactggtctttaacg

SEQ ID NO: 215113 - DNA, 22 bp, Artificial sequence
  SiRNA target sequence
ctttggcactggtctttaacga

SEQ ID NO: 215114 - DNA, 22 bp, Artificial sequence
  SiRNA target sequence
tttggcactggtctttaacgaa

SEQ ID NO: 215115 - DNA, 22 bp, Artificial sequence
  SiRNA target sequence
ttggcactggtctttaacgaat

SEQ ID NO: 215116 - DNA, 22 bp, Artificial sequence
  SiRNA target sequence
tggcactggtctttaacgaatg

SEQ ID NO: 215117 - DNA, 22 bp, Artificial sequence
  SiRNA target sequence
ggcactggtctttaacgaatgg

SEQ ID NO: 215118 - DNA, 22 bp, Artificial sequence
  SiRNA target sequence
gcactggtctttaacgaatgga

SEQ ID NO: 215119 - DNA, 22 bp, Artificial sequence
  SiRNA target sequence
cactggtctttaacgaatggac

SEQ ID NO: 215120 - DNA, 22 bp, Artificial sequence
  SiRNA target sequence
actggtctttaacgaatggaca

SEQ ID NO: 215121 - DNA, 22 bp, Artificial sequence
  SiRNA target sequence
ctggtctttaacgaatggacat

SEQ ID NO: 215122 - DNA, 22 bp, Artificial sequence
  SiRNA target sequence
tggtctttaacgaatggacatc

SEQ ID NO: 215123 - DNA, 22 bp, Artificial sequence
  SiRNA target sequence
ggtctttaacgaatggacatcc

SEQ ID NO: 215124 - DNA, 22 bp, Artificial sequence
  SiRNA target sequence
gtctttaacgaatggacatcct

SEQ ID NO: 215125 - DNA, 22 bp, Artificial sequence
  SiRNA target sequence
tctttaacgaatggacatcctc

SEQ ID NO: 215126 - DNA, 22 bp, Artificial sequence
  SiRNA target sequence
ctttaacgaatggacatcctct

SEQ ID NO: 215127 - DNA, 22 bp, Artificial sequence
  SiRNA target sequence
tttaacgaatggacatcctctc

SEQ ID NO: 215128 - DNA, 22 bp, Artificial sequence
  SiRNA target sequence
ttaacgaatggacatcctctct

SEQ ID NO: 215129 - DNA, 22 bp, Artificial sequence
  SiRNA target sequence
taacgaatggacatcctctcta

SEQ ID NO: 215130 - DNA, 22 bp, Artificial sequence
  SiRNA target sequence
aacgaatggacatcctctctag

SEQ ID NO: 215131 - DNA, 22 bp, Artificial sequence
  SiRNA target sequence
acgaatggacatcctctctagt

SEQ ID NO: 215132 - DNA, 22 bp, Artificial sequence
  SiRNA target sequence
cgaatggacatcctctctagtt

SEQ ID NO: 215133 - DNA, 22 bp, Artificial sequence
  SiRNA target sequence
gaatggacatcctctctagttt

SEQ ID NO: 215134 - DNA, 22 bp, Artificial sequence
  SiRNA target sequence
aatggacatcctctctagttta

SEQ ID NO: 215135 - DNA, 22 bp, Artificial sequence
  SiRNA target sequence
atggacatcctctctagtttac

SEQ ID NO: 215136 - DNA, 22 bp, Artificial sequence
  SiRNA target sequence
tggacatcctctctagtttaca

SEQ ID NO: 215137 - DNA, 22 bp, Artificial sequence
  SiRNA target sequence
ggacatcctctctagtttacat

SEQ ID NO: 215138 - DNA, 22 bp, Artificial sequence
  SiRNA target sequence
gacatcctctctagtttacatt

SEQ ID NO: 215139 - DNA, 22 bp, Artificial sequence
  SiRNA target sequence
acatcctctctagtttacattg

SEQ ID NO: 215140 - DNA, 22 bp, Artificial sequence
  SiRNA target sequence
catcctctctagtttacattgt

SEQ ID NO: 215141 - DNA, 22 bp, Artificial sequence
  SiRNA target sequence
atcctctctagtttacattgtt

SEQ ID NO: 215142 - DNA, 22 bp, Artificial sequence
  SiRNA target sequence
tcctctctagtttacattgttt

SEQ ID NO: 215143 - DNA, 22 bp, Artificial sequence
  SiRNA target sequence
cctctctagtttacattgtttc

SEQ ID NO: 215144 - DNA, 22 bp, Artificial sequence
  SiRNA target sequence
ctctctagtttacattgtttca

SEQ ID NO: 215145 - DNA, 22 bp, Artificial sequence
  SiRNA target sequence
tctctagtttacattgtttcag

SEQ ID NO: 215146 - DNA, 22 bp, Artificial sequence
  SiRNA target sequence
ctctagtttacattgtttcaga

SEQ ID NO: 215147 - DNA, 22 bp, Artificial sequence
  SiRNA target sequence
tctagtttacattgtttcagaa

SEQ ID NO: 215148 - DNA, 22 bp, Artificial sequence
  SiRNA target sequence
ctagtttacattgtttcagaaa

SEQ ID NO: 215149 - DNA, 22 bp, Artificial sequence
  SiRNA target sequence
tagtttacattgtttcagaaat

SEQ ID NO: 215150 - DNA, 22 bp, Artificial sequence
  SiRNA target sequence
agtttacattgtttcagaaatg

SEQ ID NO: 215151 - DNA, 22 bp, Artificial sequence
  SiRNA target sequence
gtttacattgtttcagaaatgt

SEQ ID NO: 215152 - DNA, 22 bp, Artificial sequence
  SiRNA target sequence
tttacattgtttcagaaatgtt

SEQ ID NO: 215153 - DNA, 22 bp, Artificial sequence
  SiRNA target sequence
ttacattgtttcagaaatgttt

SEQ ID NO: 215154 - DNA, 22 bp, Artificial sequence
  SiRNA target sequence
tacattgtttcagaaatgtttg

SEQ ID NO: 215155 - DNA, 22 bp, Artificial sequence
  SiRNA target sequence
acattgtttcagaaatgtttgg

SEQ ID NO: 215156 - DNA, 22 bp, Artificial sequence
  SiRNA target sequence
cattgtttcagaaatgtttggt

SEQ ID NO: 215157 - DNA, 22 bp, Artificial sequence
  SiRNA target sequence
attgtttcagaaatgtttggta

SEQ ID NO: 215158 - DNA, 22 bp, Artificial sequence
  SiRNA target sequence
ttgtttcagaaatgtttggtaa

SEQ ID NO: 215159 - DNA, 22 bp, Artificial sequence
  SiRNA target sequence
tgtttcagaaatgtttggtaat

SEQ ID NO: 215160 - DNA, 22 bp, Artificial sequence
  SiRNA target sequence
gtttcagaaatgtttggtaatt

SEQ ID NO: 215161 - DNA, 22 bp, Artificial sequence
  SiRNA target sequence
tttcagaaatgtttggtaattt

SEQ ID NO: 215162 - DNA, 22 bp, Artificial sequence
  SiRNA target sequence
ttcagaaatgtttggtaattta

SEQ ID NO: 215163 - DNA, 22 bp, Artificial sequence
  SiRNA target sequence
tcagaaatgtttggtaatttag

SEQ ID NO: 215164 - DNA, 22 bp, Artificial sequence
  SiRNA target sequence
cagaaatgtttggtaatttagt

SEQ ID NO: 215165 - DNA, 22 bp, Artificial sequence
  SiRNA target sequence
agaaatgtttggtaatttagta

SEQ ID NO: 215166 - DNA, 22 bp, Artificial sequence
  SiRNA target sequence
gaaatgtttggtaatttagtat

SEQ ID NO: 215167 - DNA, 22 bp, Artificial sequence
  SiRNA target sequence
aaatgtttggtaatttagtatt

SEQ ID NO: 215168 - DNA, 22 bp, Artificial sequence
  SiRNA target sequence
aatgtttggtaatttagtattg

SEQ ID NO: 215169 - DNA, 22 bp, Artificial sequence
  SiRNA target sequence
atgtttggtaatttagtattgt

SEQ ID NO: 215170 - DNA, 22 bp, Artificial sequence
  SiRNA target sequence
tgtttggtaatttagtattgtc

SEQ ID NO: 215171 - DNA, 22 bp, Artificial sequence
  SiRNA target sequence
gtttggtaatttagtattgtct

SEQ ID NO: 215172 - DNA, 22 bp, Artificial sequence
  SiRNA target sequence
tttggtaatttagtattgtctt

SEQ ID NO: 215173 - DNA, 22 bp, Artificial sequence
  SiRNA target sequence
ttggtaatttagtattgtctta

SEQ ID NO: 215174 - DNA, 22 bp, Artificial sequence
  SiRNA target sequence
tggtaatttagtattgtcttat

SEQ ID NO: 215175 - DNA, 22 bp, Artificial sequence
  SiRNA target sequence
ggtaatttagtattgtcttatt

SEQ ID NO: 215176 - DNA, 22 bp, Artificial sequence
  SiRNA target sequence
gtaatttagtattgtcttattt

SEQ ID NO: 215177 - DNA, 22 bp, Artificial sequence
  SiRNA target sequence
taatttagtattgtcttatttc

SEQ ID NO: 215178 - DNA, 22 bp, Artificial sequence
  SiRNA target sequence
aatttagtattgtcttatttct

SEQ ID NO: 215179 - DNA, 22 bp, Artificial sequence
  SiRNA target sequence
atttagtattgtcttatttctt

SEQ ID NO: 215180 - DNA, 22 bp, Artificial sequence
  SiRNA target sequence
tttagtattgtcttatttcttc

SEQ ID NO: 215181 - DNA, 22 bp, Artificial sequence
  SiRNA target sequence
ttagtattgtcttatttcttct

SEQ ID NO: 215182 - DNA, 22 bp, Artificial sequence
  SiRNA target sequence
tagtattgtcttatttcttctt

SEQ ID NO: 215183 - DNA, 22 bp, Artificial sequence
  SiRNA target sequence
agtattgtcttatttcttcttg

SEQ ID NO: 215184 - DNA, 22 bp, Artificial sequence
  SiRNA target sequence
gtattgtcttatttcttcttga

SEQ ID NO: 215185 - DNA, 22 bp, Artificial sequence
  SiRNA target sequence
tattgtcttatttcttcttgac

SEQ ID NO: 215186 - DNA, 22 bp, Artificial sequence
  SiRNA target sequence
attgtcttatttcttcttgacg

SEQ ID NO: 215187 - DNA, 22 bp, Artificial sequence
  SiRNA target sequence
ttgtcttatttcttcttgacgt

SEQ ID NO: 215188 - DNA, 22 bp, Artificial sequence
  SiRNA target sequence
tgtcttatttcttcttgacgtt

SEQ ID NO: 215189 - DNA, 22 bp, Artificial sequence
  SiRNA target sequence
gtcttatttcttcttgacgttt

SEQ ID NO: 215190 - DNA, 22 bp, Artificial sequence
  SiRNA target sequence
tcttatttcttcttgacgtttg

SEQ ID NO: 215191 - DNA, 22 bp, Artificial sequence
  SiRNA target sequence
cttatttcttcttgacgtttgc

SEQ ID NO: 215192 - DNA, 22 bp, Artificial sequence
  SiRNA target sequence
ttatttcttcttgacgtttgct

SEQ ID NO: 215193 - DNA, 22 bp, Artificial sequence
  SiRNA target sequence
tatttcttcttgacgtttgcta

SEQ ID NO: 215194 - DNA, 22 bp, Artificial sequence
  SiRNA target sequence
atttcttcttgacgtttgctaa

SEQ ID NO: 215195 - DNA, 22 bp, Artificial sequence
  SiRNA target sequence
tttcttcttgacgtttgctaat

SEQ ID NO: 215196 - DNA, 22 bp, Artificial sequence
  SiRNA target sequence
ttcttcttgacgtttgctaatt

SEQ ID NO: 215197 - DNA, 22 bp, Artificial sequence
  SiRNA target sequence
tcttcttgacgtttgctaattc

SEQ ID NO: 215198 - DNA, 22 bp, Artificial sequence
  SiRNA target sequence
cttcttgacgtttgctaattct

SEQ ID NO: 215199 - DNA, 22 bp, Artificial sequence
  SiRNA target sequence
ttcttgacgtttgctaattctt

SEQ ID NO: 215200 - DNA, 22 bp, Artificial sequence
  SiRNA target sequence
tcttgacgtttgctaattcttt

SEQ ID NO: 215201 - DNA, 22 bp, Artificial sequence
  SiRNA target sequence
cttgacgtttgctaattcttta

SEQ ID NO: 215202 - DNA, 22 bp, Artificial sequence
  SiRNA target sequence
ttgacgtttgctaattctttaa

SEQ ID NO: 215203 - DNA, 22 bp, Artificial sequence
  SiRNA target sequence
tgacgtttgctaattctttaac

SEQ ID NO: 215204 - DNA, 22 bp, Artificial sequence
  SiRNA target sequence
gacgtttgctaattctttaaca

SEQ ID NO: 215205 - DNA, 22 bp, Artificial sequence
  SiRNA target sequence
acgtttgctaattctttaacaa

SEQ ID NO: 215206 - DNA, 22 bp, Artificial sequence
  SiRNA target sequence
cgtttgctaattctttaacaac

SEQ ID NO: 215207 - DNA, 22 bp, Artificial sequence
  SiRNA target sequence
gtttgctaattctttaacaact

SEQ ID NO: 215208 - DNA, 22 bp, Artificial sequence
  SiRNA target sequence
tttgctaattctttaacaactc

SEQ ID NO: 215209 - DNA, 22 bp, Artificial sequence
  SiRNA target sequence
ttgctaattctttaacaactcc

SEQ ID NO: 215210 - DNA, 22 bp, Artificial sequence
  SiRNA target sequence
tgctaattctttaacaactcca

SEQ ID NO: 215211 - DNA, 22 bp, Artificial sequence
  SiRNA target sequence
gctaattctttaacaactccag

SEQ ID NO: 215212 - DNA, 22 bp, Artificial sequence
  SiRNA target sequence
ctaattctttaacaactccagg

SEQ ID NO: 215213 - DNA, 22 bp, Artificial sequence
  SiRNA target sequence
taattctttaacaactccagga

SEQ ID NO: 215214 - DNA, 22 bp, Artificial sequence
  SiRNA target sequence
aattctttaacaactccaggac

SEQ ID NO: 215215 - DNA, 22 bp, Artificial sequence
  SiRNA target sequence
attctttaacaactccaggaca

SEQ ID NO: 215216 - DNA, 22 bp, Artificial sequence
  SiRNA target sequence
ttctttaacaactccaggacaa

SEQ ID NO: 215217 - DNA, 22 bp, Artificial sequence
  SiRNA target sequence
tctttaacaactccaggacaaa

SEQ ID NO: 215218 - DNA, 22 bp, Artificial sequence
  SiRNA target sequence
ctttaacaactccaggacaaag

SEQ ID NO: 215219 - DNA, 22 bp, Artificial sequence
  SiRNA target sequence
tttaacaactccaggacaaagt

SEQ ID NO: 215220 - DNA, 22 bp, Artificial sequence
  SiRNA target sequence
ttaacaactccaggacaaagtg

SEQ ID NO: 215221 - DNA, 22 bp, Artificial sequence
  SiRNA target sequence
taacaactccaggacaaagtgc

SEQ ID NO: 215222 - DNA, 22 bp, Artificial sequence
  SiRNA target sequence
aacaactccaggacaaagtgca

SEQ ID NO: 215223 - DNA, 22 bp, Artificial sequence
  SiRNA target sequence
acaactccaggacaaagtgcaa

SEQ ID NO: 215224 - DNA, 22 bp, Artificial sequence
  SiRNA target sequence
caactccaggacaaagtgcaag

SEQ ID NO: 215225 - DNA, 22 bp, Artificial sequence
  SiRNA target sequence
aactccaggacaaagtgcaaga

SEQ ID NO: 215226 - DNA, 22 bp, Artificial sequence
  SiRNA target sequence
actccaggacaaagtgcaagat

SEQ ID NO: 215227 - DNA, 22 bp, Artificial sequence
  SiRNA target sequence
ctccaggacaaagtgcaagatt

SEQ ID NO: 215228 - DNA, 22 bp, Artificial sequence
  SiRNA target sequence
tccaggacaaagtgcaagattc

SEQ ID NO: 215229 - DNA, 22 bp, Artificial sequence
  SiRNA target sequence
ccaggacaaagtgcaagattca

SEQ ID NO: 215230 - DNA, 22 bp, Artificial sequence
  SiRNA target sequence
caggacaaagtgcaagattcat

SEQ ID NO: 215231 - DNA, 22 bp, Artificial sequence
  SiRNA target sequence
aggacaaagtgcaagattcata

SEQ ID NO: 215232 - DNA, 22 bp, Artificial sequence
  SiRNA target sequence
ggacaaagtgcaagattcatac

SEQ ID NO: 215233 - DNA, 22 bp, Artificial sequence
  SiRNA target sequence
gacaaagtgcaagattcatacc

SEQ ID NO: 215234 - DNA, 22 bp, Artificial sequence
  SiRNA target sequence
acaaagtgcaagattcatacct

SEQ ID NO: 215235 - DNA, 22 bp, Artificial sequence
  SiRNA target sequence
caaagtgcaagattcatacctt

SEQ ID NO: 215236 - DNA, 22 bp, Artificial sequence
  SiRNA target sequence
aaagtgcaagattcataccttt

SEQ ID NO: 215237 - DNA, 22 bp, Artificial sequence
  SiRNA target sequence
aagtgcaagattcataccttta

SEQ ID NO: 215238 - DNA, 22 bp, Artificial sequence
  SiRNA target sequence
agtgcaagattcatacctttat

SEQ ID NO: 215239 - DNA, 22 bp, Artificial sequence
  SiRNA target sequence
gtgcaagattcatacctttatt

SEQ ID NO: 215240 - DNA, 22 bp, Artificial sequence
  SiRNA target sequence
tgcaagattcatacctttattt

SEQ ID NO: 215241 - DNA, 22 bp, Artificial sequence
  SiRNA target sequence
gcaagattcatacctttatttt

SEQ ID NO: 215242 - DNA, 22 bp, Artificial sequence
  SiRNA target sequence
caagattcatacctttatttta

SEQ ID NO: 215243 - DNA, 22 bp, Artificial sequence
  SiRNA target sequence
aagattcatacctttattttat

SEQ ID NO: 215244 - DNA, 22 bp, Artificial sequence
  SiRNA target sequence
agattcatacctttattttatg

SEQ ID NO: 215245 - DNA, 22 bp, Artificial sequence
  SiRNA target sequence
gattcatacctttattttatgt

SEQ ID NO: 215246 - DNA, 22 bp, Artificial sequence
  SiRNA target sequence
attcatacctttattttatgtt

SEQ ID NO: 215247 - DNA, 22 bp, Artificial sequence
  SiRNA target sequence
ttcatacctttattttatgttt

SEQ ID NO: 215248 - DNA, 22 bp, Artificial sequence
  SiRNA target sequence
tcatacctttattttatgtttt

SEQ ID NO: 215249 - DNA, 22 bp, Artificial sequence
  SiRNA target sequence
catacctttattttatgttttc

SEQ ID NO: 215250 - DNA, 22 bp, Artificial sequence
  SiRNA target sequence
atacctttattttatgttttct

SEQ ID NO: 215251 - DNA, 22 bp, Artificial sequence
  SiRNA target sequence
tacctttattttatgttttctc

SEQ ID NO: 215252 - DNA, 22 bp, Artificial sequence
  SiRNA target sequence
acctttattttatgttttctcg

SEQ ID NO: 215253 - DNA, 22 bp, Artificial sequence
  SiRNA target sequence
cctttattttatgttttctcga

SEQ ID NO: 215254 - DNA, 22 bp, Artificial sequence
  SiRNA target sequence
ctttattttatgttttctcgaa

SEQ ID NO: 215255 - DNA, 22 bp, Artificial sequence
  SiRNA target sequence
tttattttatgttttctcgaat

SEQ ID NO: 215256 - DNA, 22 bp, Artificial sequence
  SiRNA target sequence
ttattttatgttttctcgaata

SEQ ID NO: 215257 - DNA, 22 bp, Artificial sequence
  SiRNA target sequence
tattttatgttttctcgaatat

SEQ ID NO: 215258 - DNA, 22 bp, Artificial sequence
  SiRNA target sequence
attttatgttttctcgaatatt

SEQ ID NO: 215259 - DNA, 22 bp, Artificial sequence
  SiRNA target sequence
ttttatgttttctcgaatattt

SEQ ID NO: 215260 - DNA, 22 bp, Artificial sequence
  SiRNA target sequence
tttatgttttctcgaatatttc

SEQ ID NO: 215261 - DNA, 22 bp, Artificial sequence
  SiRNA target sequence
ttatgttttctcgaatatttct

SEQ ID NO: 215262 - DNA, 22 bp, Artificial sequence
  SiRNA target sequence
tatgttttctcgaatatttctc

SEQ ID NO: 215263 - DNA, 22 bp, Artificial sequence
  SiRNA target sequence
atgttttctcgaatatttctct

SEQ ID NO: 215264 - DNA, 22 bp, Artificial sequence
  SiRNA target sequence
tgttttctcgaatatttctctt

SEQ ID NO: 215265 - DNA, 22 bp, Artificial sequence
  SiRNA target sequence
gttttctcgaatatttctcttt

SEQ ID NO: 215266 - DNA, 22 bp, Artificial sequence
  SiRNA target sequence
ttttctcgaatatttctctttt

SEQ ID NO: 215267 - DNA, 22 bp, Artificial sequence
  SiRNA target sequence
tttctcgaatatttctcttttc

SEQ ID NO: 215268 - DNA, 22 bp, Artificial sequence
  SiRNA target sequence
ttctcgaatatttctcttttct

SEQ ID NO: 215269 - DNA, 22 bp, Artificial sequence
  SiRNA target sequence
tctcgaatatttctcttttctt

SEQ ID NO: 215270 - DNA, 22 bp, Artificial sequence
  SiRNA target sequence
ctcgaatatttctcttttctta

SEQ ID NO: 215271 - DNA, 22 bp, Artificial sequence
  SiRNA target sequence
tcgaatatttctcttttcttat

SEQ ID NO: 215272 - DNA, 22 bp, Artificial sequence
  SiRNA target sequence
cgaatatttctcttttcttatc

SEQ ID NO: 215273 - DNA, 22 bp, Artificial sequence
  SiRNA target sequence
gaatatttctcttttcttatct

SEQ ID NO: 215274 - DNA, 22 bp, Artificial sequence
  SiRNA target sequence
aatatttctcttttcttatctt

SEQ ID NO: 215275 - DNA, 22 bp, Artificial sequence
  SiRNA target sequence
atatttctcttttcttatcttc

SEQ ID NO: 215276 - DNA, 22 bp, Artificial sequence
  SiRNA target sequence
tatttctcttttcttatcttct

SEQ ID NO: 215277 - DNA, 22 bp, Artificial sequence
  SiRNA target sequence
atttctcttttcttatcttctc

SEQ ID NO: 215278 - DNA, 22 bp, Artificial sequence
  SiRNA target sequence
tttctcttttcttatcttctca

SEQ ID NO: 215279 - DNA, 22 bp, Artificial sequence
  SiRNA target sequence
ttctcttttcttatcttctcaa

SEQ ID NO: 215280 - DNA, 22 bp, Artificial sequence
  SiRNA target sequence
tctcttttcttatcttctcaag

SEQ ID NO: 215281 - DNA, 22 bp, Artificial sequence
  SiRNA target sequence
ctcttttcttatcttctcaagt

SEQ ID NO: 215282 - DNA, 22 bp, Artificial sequence
  SiRNA target sequence
tcttttcttatcttctcaagtg

SEQ ID NO: 215283 - DNA, 22 bp, Artificial sequence
  SiRNA target sequence
cttttcttatcttctcaagtga

SEQ ID NO: 215284 - DNA, 22 bp, Artificial sequence
  SiRNA target sequence
ttttcttatcttctcaagtgac

SEQ ID NO: 215285 - DNA, 22 bp, Artificial sequence
  SiRNA target sequence
tttcttatcttctcaagtgaca

SEQ ID NO: 215286 - DNA, 22 bp, Artificial sequence
  SiRNA target sequence
ttcttatcttctcaagtgacag

SEQ ID NO: 215287 - DNA, 22 bp, Artificial sequence
  SiRNA target sequence
tcttatcttctcaagtgacaga

SEQ ID NO: 215288 - DNA, 22 bp, Artificial sequence
  SiRNA target sequence
cttatcttctcaagtgacagaa

SEQ ID NO: 215289 - DNA, 22 bp, Artificial sequence
  SiRNA target sequence
ttatcttctcaagtgacagaac

SEQ ID NO: 215290 - DNA, 22 bp, Artificial sequence
  SiRNA target sequence
tatcttctcaagtgacagaact

SEQ ID NO: 215291 - DNA, 22 bp, Artificial sequence
  SiRNA target sequence
atcttctcaagtgacagaactt

SEQ ID NO: 215292 - DNA, 22 bp, Artificial sequence
  SiRNA target sequence
tcttctcaagtgacagaacttt

SEQ ID NO: 215293 - DNA, 22 bp, Artificial sequence
  SiRNA target sequence
cttctcaagtgacagaactttt

SEQ ID NO: 215294 - DNA, 22 bp, Artificial sequence
  SiRNA target sequence
ttctcaagtgacagaacttttt

SEQ ID NO: 215295 - DNA, 22 bp, Artificial sequence
  SiRNA target sequence
tctcaagtgacagaacttttta

SEQ ID NO: 215296 - DNA, 22 bp, Artificial sequence
  SiRNA target sequence
ctcaagtgacagaactttttac

SEQ ID NO: 215297 - DNA, 22 bp, Artificial sequence
  SiRNA target sequence
tcaagtgacagaactttttaca

SEQ ID NO: 215298 - DNA, 22 bp, Artificial sequence
  SiRNA target sequence
caagtgacagaactttttacaa

SEQ ID NO: 215299 - DNA, 22 bp, Artificial sequence
  SiRNA target sequence
aagtgacagaactttttacaag

SEQ ID NO: 215300 - DNA, 22 bp, Artificial sequence
  SiRNA target sequence
agtgacagaactttttacaaga

SEQ ID NO: 215301 - DNA, 22 bp, Artificial sequence
  SiRNA target sequence
gtgacagaactttttacaagat

SEQ ID NO: 215302 - DNA, 22 bp, Artificial sequence
  SiRNA target sequence
tgacagaactttttacaagata

SEQ ID NO: 215303 - DNA, 22 bp, Artificial sequence
  SiRNA target sequence
gacagaactttttacaagatat

SEQ ID NO: 215304 - DNA, 22 bp, Artificial sequence
  SiRNA target sequence
acagaactttttacaagatata

SEQ ID NO: 215305 - DNA, 22 bp, Artificial sequence
  SiRNA target sequence
cagaactttttacaagatatag

SEQ ID NO: 215306 - DNA, 22 bp, Artificial sequence
  SiRNA target sequence
agaactttttacaagatataga

SEQ ID NO: 215307 - DNA, 22 bp, Artificial sequence
  SiRNA target sequence
gaactttttacaagatatagat

SEQ ID NO: 215308 - DNA, 22 bp, Artificial sequence
  SiRNA target sequence
aactttttacaagatatagatc

SEQ ID NO: 215309 - DNA, 22 bp, Artificial sequence
  SiRNA target sequence
actttttacaagatatagatca

SEQ ID NO: 215310 - DNA, 22 bp, Artificial sequence
  SiRNA target sequence
ctttttacaagatatagatcaa

SEQ ID NO: 215311 - DNA, 22 bp, Artificial sequence
  SiRNA target sequence
tttttacaagatatagatcaaa

SEQ ID NO: 215312 - DNA, 22 bp, Artificial sequence
  SiRNA target sequence
ttttacaagatatagatcaaag

SEQ ID NO: 215313 - DNA, 22 bp, Artificial sequence
  SiRNA target sequence
tttacaagatatagatcaaagc

SEQ ID NO: 215314 - DNA, 22 bp, Artificial sequence
  SiRNA target sequence
ttacaagatatagatcaaagct

SEQ ID NO: 215315 - DNA, 22 bp, Artificial sequence
  SiRNA target sequence
tacaagatatagatcaaagctc

SEQ ID NO: 215316 - DNA, 22 bp, Artificial sequence
  SiRNA target sequence
acaagatatagatcaaagctca

SEQ ID NO: 215317 - DNA, 22 bp, Artificial sequence
  SiRNA target sequence
caagatatagatcaaagctcac

SEQ ID NO: 215318 - DNA, 22 bp, Artificial sequence
  SiRNA target sequence
aagatatagatcaaagctcact

SEQ ID NO: 215319 - DNA, 22 bp, Artificial sequence
  SiRNA target sequence
agatatagatcaaagctcactt

SEQ ID NO: 215320 - DNA, 22 bp, Artificial sequence
  SiRNA target sequence
gatatagatcaaagctcacttt

SEQ ID NO: 215321 - DNA, 22 bp, Artificial sequence
  SiRNA target sequence
atatagatcaaagctcactttc

SEQ ID NO: 215322 - DNA, 22 bp, Artificial sequence
  SiRNA target sequence
tatagatcaaagctcactttct

SEQ ID NO: 215323 - DNA, 22 bp, Artificial sequence
  SiRNA target sequence
atagatcaaagctcactttctc

SEQ ID NO: 215324 - DNA, 22 bp, Artificial sequence
  SiRNA target sequence
tagatcaaagctcactttctca

SEQ ID NO: 215325 - DNA, 22 bp, Artificial sequence
  SiRNA target sequence
agatcaaagctcactttctcag

SEQ ID NO: 215326 - DNA, 22 bp, Artificial sequence
  SiRNA target sequence
gatcaaagctcactttctcaga

SEQ ID NO: 215327 - DNA, 22 bp, Artificial sequence
  SiRNA target sequence
atcaaagctcactttctcagag

SEQ ID NO: 215328 - DNA, 22 bp, Artificial sequence
  SiRNA target sequence
tcaaagctcactttctcagagg

SEQ ID NO: 215329 - DNA, 22 bp, Artificial sequence
  SiRNA target sequence
caaagctcactttctcagaggc

SEQ ID NO: 215330 - DNA, 22 bp, Artificial sequence
  SiRNA target sequence
aaagctcactttctcagaggcg

SEQ ID NO: 215331 - DNA, 22 bp, Artificial sequence
  SiRNA target sequence
aagctcactttctcagaggcgg

SEQ ID NO: 215332 - DNA, 22 bp, Artificial sequence
  SiRNA target sequence
agctcactttctcagaggcgga

SEQ ID NO: 215333 - DNA, 22 bp, Artificial sequence
  SiRNA target sequence
gctcactttctcagaggcggaa

SEQ ID NO: 215334 - DNA, 22 bp, Artificial sequence
  SiRNA target sequence
ctcactttctcagaggcggaat

SEQ ID NO: 215335 - DNA, 22 bp, Artificial sequence
  SiRNA target sequence
tcactttctcagaggcggaatt

SEQ ID NO: 215336 - DNA, 22 bp, Artificial sequence
  SiRNA target sequence
cactttctcagaggcggaattt

SEQ ID NO: 215337 - DNA, 22 bp, Artificial sequence
  SiRNA target sequence
actttctcagaggcggaatttt

SEQ ID NO: 215338 - DNA, 22 bp, Artificial sequence
  SiRNA target sequence
ctttctcagaggcggaattttt

SEQ ID NO: 215339 - DNA, 22 bp, Artificial sequence
  SiRNA target sequence
tttctcagaggcggaattttta

SEQ ID NO: 215340 - DNA, 22 bp, Artificial sequence
  SiRNA target sequence
ttctcagaggcggaatttttat

SEQ ID NO: 215341 - DNA, 22 bp, Artificial sequence
  SiRNA target sequence
tctcagaggcggaatttttata

SEQ ID NO: 215342 - DNA, 22 bp, Artificial sequence
  SiRNA target sequence
ctcagaggcggaatttttatat

SEQ ID NO: 215343 - DNA, 22 bp, Artificial sequence
  SiRNA target sequence
tcagaggcggaatttttatata

SEQ ID NO: 215344 - DNA, 22 bp, Artificial sequence
  SiRNA target sequence
cagaggcggaatttttatataa

SEQ ID NO: 215345 - DNA, 22 bp, Artificial sequence
  SiRNA target sequence
agaggcggaatttttatataat

SEQ ID NO: 215346 - DNA, 22 bp, Artificial sequence
  SiRNA target sequence
gaggcggaatttttatataatg

SEQ ID NO: 215347 - DNA, 22 bp, Artificial sequence
  SiRNA target sequence
aggcggaatttttatataatgg

SEQ ID NO: 215348 - DNA, 22 bp, Artificial sequence
  SiRNA target sequence
ggcggaatttttatataatggc

SEQ ID NO: 215349 - DNA, 22 bp, Artificial sequence
  SiRNA target sequence
gcggaatttttatataatggct

SEQ ID NO: 215350 - DNA, 22 bp, Artificial sequence
  SiRNA target sequence
cggaatttttatataatggctt

SEQ ID NO: 215351 - DNA, 22 bp, Artificial sequence
  SiRNA target sequence
ggaatttttatataatggcttt

SEQ ID NO: 215352 - DNA, 22 bp, Artificial sequence
  SiRNA target sequence
gaatttttatataatggctttt

SEQ ID NO: 215353 - DNA, 22 bp, Artificial sequence
  SiRNA target sequence
aatttttatataatggcttttt

SEQ ID NO: 215354 - DNA, 22 bp, Artificial sequence
  SiRNA target sequence
atttttatataatggctttttt

SEQ ID NO: 215355 - DNA, 22 bp, Artificial sequence
  SiRNA target sequence
tttttatataatggcttttttg

SEQ ID NO: 215356 - DNA, 22 bp, Artificial sequence
  SiRNA target sequence
ttttatataatggcttttttgt

SEQ ID NO: 215357 - DNA, 22 bp, Artificial sequence
  SiRNA target sequence
tttatataatggcttttttgta

SEQ ID NO: 215358 - DNA, 22 bp, Artificial sequence
  SiRNA target sequence
ttatataatggcttttttgtat

SEQ ID NO: 215359 - DNA, 22 bp, Artificial sequence
  SiRNA target sequence
tatataatggcttttttgtatt

SEQ ID NO: 215360 - DNA, 22 bp, Artificial sequence
  SiRNA target sequence
atataatggcttttttgtattt

SEQ ID NO: 215361 - DNA, 22 bp, Artificial sequence
  SiRNA target sequence
tataatggcttttttgtatttt

SEQ ID NO: 215362 - DNA, 22 bp, Artificial sequence
  SiRNA target sequence
ataatggcttttttgtattttc

SEQ ID NO: 215363 - DNA, 22 bp, Artificial sequence
  SiRNA target sequence
taatggcttttttgtattttct

SEQ ID NO: 215364 - DNA, 22 bp, Artificial sequence
  SiRNA target sequence
aatggcttttttgtattttctg

SEQ ID NO: 215365 - DNA, 22 bp, Artificial sequence
  SiRNA target sequence
atggcttttttgtattttctgg

SEQ ID NO: 215366 - DNA, 22 bp, Artificial sequence
  SiRNA target sequence
tggcttttttgtattttctgga

SEQ ID NO: 215367 - DNA, 22 bp, Artificial sequence
  SiRNA target sequence
ggcttttttgtattttctggag

SEQ ID NO: 215368 - DNA, 22 bp, Artificial sequence
  SiRNA target sequence
gcttttttgtattttctggagt

SEQ ID NO: 215369 - DNA, 22 bp, Artificial sequence
  SiRNA target sequence
cttttttgtattttctggagtt

SEQ ID NO: 215370 - DNA, 22 bp, Artificial sequence
  SiRNA target sequence
ttttttgtattttctggagttc

SEQ ID NO: 215371 - DNA, 22 bp, Artificial sequence
  SiRNA target sequence
tttttgtattttctggagttct

SEQ ID NO: 215372 - DNA, 22 bp, Artificial sequence
  SiRNA target sequence
ttttgtattttctggagttcta

SEQ ID NO: 215373 - DNA, 22 bp, Artificial sequence
  SiRNA target sequence
tttgtattttctggagttctag

SEQ ID NO: 215374 - DNA, 22 bp, Artificial sequence
  SiRNA target sequence
ttgtattttctggagttctagt

SEQ ID NO: 215375 - DNA, 22 bp, Artificial sequence
  SiRNA target sequence
tgtattttctggagttctagta

SEQ ID NO: 215376 - DNA, 22 bp, Artificial sequence
  SiRNA target sequence
gtattttctggagttctagtaa

SEQ ID NO: 215377 - DNA, 22 bp, Artificial sequence
  SiRNA target sequence
tattttctggagttctagtaat

SEQ ID NO: 215378 - DNA, 22 bp, Artificial sequence
  SiRNA target sequence
attttctggagttctagtaata

SEQ ID NO: 215379 - DNA, 22 bp, Artificial sequence
  SiRNA target sequence
ttttctggagttctagtaatag

SEQ ID NO: 215380 - DNA, 22 bp, Artificial sequence
  SiRNA target sequence
tttctggagttctagtaatagt

SEQ ID NO: 215381 - DNA, 22 bp, Artificial sequence
  SiRNA target sequence
ttctggagttctagtaatagtt

SEQ ID NO: 215382 - DNA, 22 bp, Artificial sequence
  SiRNA target sequence
tctggagttctagtaatagtta

SEQ ID NO: 215383 - DNA, 22 bp, Artificial sequence
  SiRNA target sequence
ctggagttctagtaatagttat

SEQ ID NO: 215384 - DNA, 22 bp, Artificial sequence
  SiRNA target sequence
tggagttctagtaatagttata

SEQ ID NO: 215385 - DNA, 22 bp, Artificial sequence
  SiRNA target sequence
ggagttctagtaatagttatat

SEQ ID NO: 215386 - DNA, 22 bp, Artificial sequence
  SiRNA target sequence
gagttctagtaatagttatatt

SEQ ID NO: 215387 - DNA, 22 bp, Artificial sequence
  SiRNA target sequence
agttctagtaatagttatattt

SEQ ID NO: 215388 - DNA, 22 bp, Artificial sequence
  SiRNA target sequence
gttctagtaatagttatatttt

SEQ ID NO: 215389 - DNA, 22 bp, Artificial sequence
  SiRNA target sequence
ttctagtaatagttatattttt

SEQ ID NO: 215390 - DNA, 22 bp, Artificial sequence
  SiRNA target sequence
tctagtaatagttatattttta

SEQ ID NO: 215391 - DNA, 22 bp, Artificial sequence
  SiRNA target sequence
ctagtaatagttatatttttaa

SEQ ID NO: 215392 - DNA, 22 bp, Artificial sequence
  SiRNA target sequence
tagtaatagttatatttttaat

SEQ ID NO: 215393 - DNA, 22 bp, Artificial sequence
  SiRNA target sequence
agtaatagttatatttttaatt

SEQ ID NO: 215394 - DNA, 22 bp, Artificial sequence
  SiRNA target sequence
gtaatagttatatttttaatta

SEQ ID NO: 215395 - DNA, 22 bp, Artificial sequence
  SiRNA target sequence
taatagttatatttttaattaa

SEQ ID NO: 215396 - DNA, 22 bp, Artificial sequence
  SiRNA target sequence
aatagttatatttttaattaaa

SEQ ID NO: 215397 - DNA, 22 bp, Artificial sequence
  SiRNA target sequence
atagttatatttttaattaaaa

SEQ ID NO: 215398 - DNA, 22 bp, Artificial sequence
  SiRNA target sequence
tagttatatttttaattaaaaa

SEQ ID NO: 215399 - DNA, 22 bp, Artificial sequence
  SiRNA target sequence
agttatatttttaattaaaaaa

SEQ ID NO: 215400 - DNA, 22 bp, Artificial sequence
  SiRNA target sequence
gttatatttttaattaaaaaat

SEQ ID NO: 215401 - DNA, 22 bp, Artificial sequence
  SiRNA target sequence
ttatatttttaattaaaaaata

SEQ ID NO: 215402 - DNA, 22 bp, Artificial sequence
  SiRNA target sequence
tatatttttaattaaaaaatat

SEQ ID NO: 215403 - DNA, 22 bp, Artificial sequence
  SiRNA target sequence
atatttttaattaaaaaatatt

SEQ ID NO: 215404 - DNA, 22 bp, Artificial sequence
  SiRNA target sequence
tatttttaattaaaaaatattt

SEQ ID NO: 215405 - DNA, 22 bp, Artificial sequence
  SiRNA target sequence
atttttaattaaaaaatatttg

SEQ ID NO: 215406 - DNA, 22 bp, Artificial sequence
  SiRNA target sequence
tttttaattaaaaaatatttgg

SEQ ID NO: 215407 - DNA, 22 bp, Artificial sequence
  SiRNA target sequence
ttttaattaaaaaatatttgga

SEQ ID NO: 215408 - DNA, 22 bp, Artificial sequence
  SiRNA target sequence
tttaattaaaaaatatttggag

SEQ ID NO: 215409 - DNA, 22 bp, Artificial sequence
  SiRNA target sequence
ttaattaaaaaatatttggaga

SEQ ID NO: 215410 - DNA, 22 bp, Artificial sequence
  SiRNA target sequence
taattaaaaaatatttggagag

SEQ ID NO: 215411 - DNA, 22 bp, Artificial sequence
  SiRNA target sequence
aattaaaaaatatttggagagg

SEQ ID NO: 215412 - DNA, 22 bp, Artificial sequence
  SiRNA target sequence
attaaaaaatatttggagagga

SEQ ID NO: 215413 - DNA, 22 bp, Artificial sequence
  SiRNA target sequence
ttaaaaaatatttggagaggaa

SEQ ID NO: 215414 - DNA, 22 bp, Artificial sequence
  SiRNA target sequence
taaaaaatatttggagaggaat

SEQ ID NO: 215415 - DNA, 22 bp, Artificial sequence
  SiRNA target sequence
aaaaaatatttggagaggaatg

SEQ ID NO: 215416 - DNA, 22 bp, Artificial sequence
  SiRNA target sequence
aaaaatatttggagaggaatgt

SEQ ID NO: 215417 - DNA, 22 bp, Artificial sequence
  SiRNA target sequence
aaaatatttggagaggaatgtg

SEQ ID NO: 215418 - DNA, 22 bp, Artificial sequence
  SiRNA target sequence
aaatatttggagaggaatgtga

SEQ ID NO: 215419 - DNA, 22 bp, Artificial sequence
  SiRNA target sequence
aatatttggagaggaatgtgac

SEQ ID NO: 215420 - DNA, 22 bp, Artificial sequence
  SiRNA target sequence
atatttggagaggaatgtgact

SEQ ID NO: 215421 - DNA, 22 bp, Artificial sequence
  SiRNA target sequence
tatttggagaggaatgtgacta

SEQ ID NO: 215422 - DNA, 22 bp, Artificial sequence
  SiRNA target sequence
atttggagaggaatgtgactaa

SEQ ID NO: 215423 - DNA, 22 bp, Artificial sequence
  SiRNA target sequence
tttggagaggaatgtgactaac

SEQ ID NO: 215424 - DNA, 22 bp, Artificial sequence
  SiRNA target sequence
ttggagaggaatgtgactaaca

SEQ ID NO: 215425 - DNA, 22 bp, Artificial sequence
  SiRNA target sequence
tggagaggaatgtgactaacaa

SEQ ID NO: 215426 - DNA, 22 bp, Artificial sequence
  SiRNA target sequence
ggagaggaatgtgactaacaaa

SEQ ID NO: 215427 - DNA, 22 bp, Artificial sequence
  SiRNA target sequence
gagaggaatgtgactaacaaac

SEQ ID NO: 215428 - DNA, 22 bp, Artificial sequence
  SiRNA target sequence
agaggaatgtgactaacaaacc

SEQ ID NO: 215429 - DNA, 22 bp, Artificial sequence
  SiRNA target sequence
gaggaatgtgactaacaaacct

SEQ ID NO: 215430 - DNA, 22 bp, Artificial sequence
  SiRNA target sequence
aggaatgtgactaacaaacctt

SEQ ID NO: 215431 - DNA, 22 bp, Artificial sequence
  SiRNA target sequence
ggaatgtgactaacaaaccttt

SEQ ID NO: 215432 - DNA, 22 bp, Artificial sequence
  SiRNA target sequence
gaatgtgactaacaaacctttg

SEQ ID NO: 215433 - DNA, 22 bp, Artificial sequence
  SiRNA target sequence
aatgtgactaacaaacctttgt

SEQ ID NO: 215434 - DNA, 22 bp, Artificial sequence
  SiRNA target sequence
atgtgactaacaaacctttgtt

SEQ ID NO: 215435 - DNA, 22 bp, Artificial sequence
  SiRNA target sequence
tgtgactaacaaacctttgttt

SEQ ID NO: 215436 - DNA, 22 bp, Artificial sequence
  SiRNA target sequence
gtgactaacaaacctttgtttg

SEQ ID NO: 215437 - DNA, 22 bp, Artificial sequence
  SiRNA target sequence
tgactaacaaacctttgtttgt

SEQ ID NO: 215438 - DNA, 22 bp, Artificial sequence
  SiRNA target sequence
gactaacaaacctttgtttgtt

SEQ ID NO: 215439 - DNA, 22 bp, Artificial sequence
  SiRNA target sequence
actaacaaacctttgtttgttg

SEQ ID NO: 215440 - DNA, 22 bp, Artificial sequence
  SiRNA target sequence
ctaacaaacctttgtttgttgt

SEQ ID NO: 215441 - DNA, 22 bp, Artificial sequence
  SiRNA target sequence
taacaaacctttgtttgttgta

SEQ ID NO: 215442 - DNA, 22 bp, Artificial sequence
  SiRNA target sequence
aacaaacctttgtttgttgtaa

SEQ ID NO: 215443 - DNA, 22 bp, Artificial sequence
  SiRNA target sequence
acaaacctttgtttgttgtaaa

SEQ ID NO: 215444 - DNA, 22 bp, Artificial sequence
  SiRNA target sequence
caaacctttgtttgttgtaaaa

SEQ ID NO: 215445 - DNA, 22 bp, Artificial sequence
  SiRNA target sequence
aaacctttgtttgttgtaaaat

SEQ ID NO: 215446 - DNA, 22 bp, Artificial sequence
  SiRNA target sequence
aacctttgtttgttgtaaaatc

SEQ ID NO: 215447 - DNA, 22 bp, Artificial sequence
  SiRNA target sequence
acctttgtttgttgtaaaatct

SEQ ID NO: 215448 - DNA, 22 bp, Artificial sequence
  SiRNA target sequence
cctttgtttgttgtaaaatctg

SEQ ID NO: 215449 - DNA, 22 bp, Artificial sequence
  SiRNA target sequence
ctttgtttgttgtaaaatctgt

SEQ ID NO: 215450 - DNA, 22 bp, Artificial sequence
  SiRNA target sequence
tttgtttgttgtaaaatctgtt

SEQ ID NO: 215451 - DNA, 22 bp, Artificial sequence
  SiRNA target sequence
ttgtttgttgtaaaatctgtta

SEQ ID NO: 215452 - DNA, 22 bp, Artificial sequence
  SiRNA target sequence
tgtttgttgtaaaatctgttaa

SEQ ID NO: 215453 - DNA, 22 bp, Artificial sequence
  SiRNA target sequence
gtttgttgtaaaatctgttaaa

SEQ ID NO: 215454 - DNA, 22 bp, Artificial sequence
  SiRNA target sequence
tttgttgtaaaatctgttaaaa

SEQ ID NO: 215455 - DNA, 22 bp, Artificial sequence
  SiRNA target sequence
ttgttgtaaaatctgttaaaaa

SEQ ID NO: 215456 - DNA, 22 bp, Artificial sequence
  SiRNA target sequence
tgttgtaaaatctgttaaaaag

SEQ ID NO: 215457 - DNA, 22 bp, Artificial sequence
  SiRNA target sequence
gttgtaaaatctgttaaaaaga

SEQ ID NO: 215458 - DNA, 22 bp, Artificial sequence
  SiRNA target sequence
ttgtaaaatctgttaaaaagaa

SEQ ID NO: 215459 - DNA, 22 bp, Artificial sequence
  SiRNA target sequence
tgtaaaatctgttaaaaagaag

SEQ ID NO: 215460 - DNA, 22 bp, Artificial sequence
  SiRNA target sequence
gtaaaatctgttaaaaagaagg

SEQ ID NO: 215461 - DNA, 22 bp, Artificial sequence
  SiRNA target sequence
taaaatctgttaaaaagaaggg

SEQ ID NO: 215462 - DNA, 22 bp, Artificial sequence
  SiRNA target sequence
aaaatctgttaaaaagaaggga

SEQ ID NO: 215463 - DNA, 22 bp, Artificial sequence
  SiRNA target sequence
aaatctgttaaaaagaagggac

SEQ ID NO: 215464 - DNA, 22 bp, Artificial sequence
  SiRNA target sequence
aatctgttaaaaagaagggacc

SEQ ID NO: 215465 - DNA, 22 bp, Artificial sequence
  SiRNA target sequence
atctgttaaaaagaagggacca

SEQ ID NO: 215466 - DNA, 22 bp, Artificial sequence
  SiRNA target sequence
tctgttaaaaagaagggaccaa

SEQ ID NO: 215467 - DNA, 22 bp, Artificial sequence
  SiRNA target sequence
ctgttaaaaagaagggaccaaa

SEQ ID NO: 215468 - DNA, 22 bp, Artificial sequence
  SiRNA target sequence
tgttaaaaagaagggaccaaaa

SEQ ID NO: 215469 - DNA, 22 bp, Artificial sequence
  SiRNA target sequence
gttaaaaagaagggaccaaaag

SEQ ID NO: 215470 - DNA, 22 bp, Artificial sequence
  SiRNA target sequence
ttaaaaagaagggaccaaaagt

SEQ ID NO: 215471 - DNA, 22 bp, Artificial sequence
  SiRNA target sequence
taaaaagaagggaccaaaagtt

SEQ ID NO: 215472 - DNA, 22 bp, Artificial sequence
  SiRNA target sequence
aaaaagaagggaccaaaagtta

SEQ ID NO: 215473 - DNA, 22 bp, Artificial sequence
  SiRNA target sequence
aaaagaagggaccaaaagttaa

SEQ ID NO: 215474 - DNA, 22 bp, Artificial sequence
  SiRNA target sequence
aaagaagggaccaaaagttaaa

SEQ ID NO: 215475 - DNA, 22 bp, Artificial sequence
  SiRNA target sequence
aagaagggaccaaaagttaaag

SEQ ID NO: 215476 - DNA, 22 bp, Artificial sequence
  SiRNA target sequence
agaagggaccaaaagttaaagt

SEQ ID NO: 215477 - DNA, 22 bp, Artificial sequence
  SiRNA target sequence
gaagggaccaaaagttaaagta

SEQ ID NO: 215478 - DNA, 22 bp, Artificial sequence
  SiRNA target sequence
aagggaccaaaagttaaagtag

SEQ ID NO: 215479 - DNA, 22 bp, Artificial sequence
  SiRNA target sequence
agggaccaaaagttaaagtagg

SEQ ID NO: 215480 - DNA, 22 bp, Artificial sequence
  SiRNA target sequence
gggaccaaaagttaaagtagga

SEQ ID NO: 215481 - DNA, 22 bp, Artificial sequence
  SiRNA target sequence
ggaccaaaagttaaagtaggat

SEQ ID NO: 215482 - DNA, 22 bp, Artificial sequence
  SiRNA target sequence
gaccaaaagttaaagtaggatt

SEQ ID NO: 215483 - DNA, 22 bp, Artificial sequence
  SiRNA target sequence
accaaaagttaaagtaggattt

SEQ ID NO: 215484 - DNA, 22 bp, Artificial sequence
  SiRNA target sequence
ccaaaagttaaagtaggatttg

SEQ ID NO: 215485 - DNA, 22 bp, Artificial sequence
  SiRNA target sequence
caaaagttaaagtaggatttgc

SEQ ID NO: 215486 - DNA, 22 bp, Artificial sequence
  SiRNA target sequence
aaaagttaaagtaggatttgcg

SEQ ID NO: 215487 - DNA, 22 bp, Artificial sequence
  SiRNA target sequence
aaagttaaagtaggatttgcgg

SEQ ID NO: 215488 - DNA, 22 bp, Artificial sequence
  SiRNA target sequence
aagttaaagtaggatttgcgga

SEQ ID NO: 215489 - DNA, 22 bp, Artificial sequence
  SiRNA target sequence
agttaaagtaggatttgcggag

SEQ ID NO: 215490 - DNA, 22 bp, Artificial sequence
  SiRNA target sequence
gttaaagtaggatttgcggagg

SEQ ID NO: 215491 - DNA, 22 bp, Artificial sequence
  SiRNA target sequence
ttaaagtaggatttgcggaggg

SEQ ID NO: 215492 - DNA, 22 bp, Artificial sequence
  SiRNA target sequence
taaagtaggatttgcggagggc

SEQ ID NO: 215493 - DNA, 22 bp, Artificial sequence
  SiRNA target sequence
aaagtaggatttgcggagggcc

SEQ ID NO: 215494 - DNA, 22 bp, Artificial sequence
  SiRNA target sequence
aagtaggatttgcggagggcct

SEQ ID NO: 215495 - DNA, 22 bp, Artificial sequence
  SiRNA target sequence
agtaggatttgcggagggcctt

SEQ ID NO: 215496 - DNA, 22 bp, Artificial sequence
  SiRNA target sequence
gtaggatttgcggagggcctta

SEQ ID NO: 215497 - DNA, 22 bp, Artificial sequence
  SiRNA target sequence
taggatttgcggagggccttaa

SEQ ID NO: 215498 - DNA, 22 bp, Artificial sequence
  SiRNA target sequence
aggatttgcggagggccttaaa

SEQ ID NO: 215499 - DNA, 22 bp, Artificial sequence
  SiRNA target sequence
ggatttgcggagggccttaaag

SEQ ID NO: 215500 - DNA, 22 bp, Artificial sequence
  SiRNA target sequence
gatttgcggagggccttaaaga

SEQ ID NO: 215501 - DNA, 22 bp, Artificial sequence
  SiRNA target sequence
atttgcggagggccttaaagaa

SEQ ID NO: 215502 - DNA, 22 bp, Artificial sequence
  SiRNA target sequence
tttgcggagggccttaaagaaa

SEQ ID NO: 215503 - DNA, 22 bp, Artificial sequence
  SiRNA target sequence
ttgcggagggccttaaagaaat

SEQ ID NO: 215504 - DNA, 22 bp, Artificial sequence
  SiRNA target sequence
tgcggagggccttaaagaaatg

SEQ ID NO: 215505 - DNA, 22 bp, Artificial sequence
  SiRNA target sequence
gcggagggccttaaagaaatga

SEQ ID NO: 215506 - DNA, 22 bp, Artificial sequence
  SiRNA target sequence
cggagggccttaaagaaatgat

SEQ ID NO: 215507 - DNA, 22 bp, Artificial sequence
  SiRNA target sequence
ggagggccttaaagaaatgatg

SEQ ID NO: 215508 - DNA, 22 bp, Artificial sequence
  SiRNA target sequence
gagggccttaaagaaatgatgg

SEQ ID NO: 215509 - DNA, 22 bp, Artificial sequence
  SiRNA target sequence
agggccttaaagaaatgatggc

SEQ ID NO: 215510 - DNA, 22 bp, Artificial sequence
  SiRNA target sequence
gggccttaaagaaatgatggca

SEQ ID NO: 215511 - DNA, 22 bp, Artificial sequence
  SiRNA target sequence
ggccttaaagaaatgatggcat

SEQ ID NO: 215512 - DNA, 22 bp, Artificial sequence
  SiRNA target sequence
gccttaaagaaatgatggcatc

SEQ ID NO: 215513 - DNA, 22 bp, Artificial sequence
  SiRNA target sequence
ccttaaagaaatgatggcatca

SEQ ID NO: 215514 - DNA, 22 bp, Artificial sequence
  SiRNA target sequence
cttaaagaaatgatggcatcaa

SEQ ID NO: 215515 - DNA, 22 bp, Artificial sequence
  SiRNA target sequence
ttaaagaaatgatggcatcaaa

SEQ ID NO: 215516 - DNA, 22 bp, Artificial sequence
  SiRNA target sequence
taaagaaatgatggcatcaaag

SEQ ID NO: 215517 - DNA, 22 bp, Artificial sequence
  SiRNA target sequence
aaagaaatgatggcatcaaagt

SEQ ID NO: 215518 - DNA, 22 bp, Artificial sequence
  SiRNA target sequence
aagaaatgatggcatcaaagtt

SEQ ID NO: 215519 - DNA, 22 bp, Artificial sequence
  SiRNA target sequence
agaaatgatggcatcaaagtta

SEQ ID NO: 215520 - DNA, 22 bp, Artificial sequence
  SiRNA target sequence
gaaatgatggcatcaaagttat

SEQ ID NO: 215521 - DNA, 22 bp, Artificial sequence
  SiRNA target sequence
aaatgatggcatcaaagttatt

SEQ ID NO: 215522 - DNA, 22 bp, Artificial sequence
  SiRNA target sequence
aatgatggcatcaaagttatta

SEQ ID NO: 215523 - DNA, 22 bp, Artificial sequence
  SiRNA target sequence
atgatggcatcaaagttattac

SEQ ID NO: 215524 - DNA, 22 bp, Artificial sequence
  SiRNA target sequence
tgatggcatcaaagttattact

SEQ ID NO: 215525 - DNA, 22 bp, Artificial sequence
  SiRNA target sequence
gatggcatcaaagttattactt

SEQ ID NO: 215526 - DNA, 22 bp, Artificial sequence
  SiRNA target sequence
atggcatcaaagttattactta

SEQ ID NO: 215527 - DNA, 22 bp, Artificial sequence
  SiRNA target sequence
tggcatcaaagttattacttaa

SEQ ID NO: 215528 - DNA, 22 bp, Artificial sequence
  SiRNA target sequence
ggcatcaaagttattacttaac

SEQ ID NO: 215529 - DNA, 22 bp, Artificial sequence
  SiRNA target sequence
gcatcaaagttattacttaaca

SEQ ID NO: 215530 - DNA, 22 bp, Artificial sequence
  SiRNA target sequence
catcaaagttattacttaacat

SEQ ID NO: 215531 - DNA, 22 bp, Artificial sequence
  SiRNA target sequence
atcaaagttattacttaacatt

SEQ ID NO: 215532 - DNA, 22 bp, Artificial sequence
  SiRNA target sequence
tcaaagttattacttaacattt

SEQ ID NO: 215533 - DNA, 22 bp, Artificial sequence
  SiRNA target sequence
caaagttattacttaacatttc

SEQ ID NO: 215534 - DNA, 22 bp, Artificial sequence
  SiRNA target sequence
aaagttattacttaacatttca

SEQ ID NO: 215535 - DNA, 22 bp, Artificial sequence
  SiRNA target sequence
aagttattacttaacatttcat

SEQ ID NO: 215536 - DNA, 22 bp, Artificial sequence
  SiRNA target sequence
agttattacttaacatttcatt

SEQ ID NO: 215537 - DNA, 22 bp, Artificial sequence
  SiRNA target sequence
gttattacttaacatttcatta

SEQ ID NO: 215538 - DNA, 22 bp, Artificial sequence
  SiRNA target sequence
ttattacttaacatttcattaa

SEQ ID NO: 215539 - DNA, 22 bp, Artificial sequence
  SiRNA target sequence
tattacttaacatttcattaac

SEQ ID NO: 215540 - DNA, 22 bp, Artificial sequence
  SiRNA target sequence
attacttaacatttcattaact

SEQ ID NO: 215541 - DNA, 22 bp, Artificial sequence
  SiRNA target sequence
ttacttaacatttcattaactg

SEQ ID NO: 215542 - DNA, 22 bp, Artificial sequence
  SiRNA target sequence
tacttaacatttcattaactgt

SEQ ID NO: 215543 - DNA, 22 bp, Artificial sequence
  SiRNA target sequence
acttaacatttcattaactgtt

SEQ ID NO: 215544 - DNA, 22 bp, Artificial sequence
  SiRNA target sequence
cttaacatttcattaactgtta

SEQ ID NO: 215545 - DNA, 22 bp, Artificial sequence
  SiRNA target sequence
ttaacatttcattaactgttat

SEQ ID NO: 215546 - DNA, 22 bp, Artificial sequence
  SiRNA target sequence
taacatttcattaactgttatg

SEQ ID NO: 215547 - DNA, 22 bp, Artificial sequence
  SiRNA target sequence
aacatttcattaactgttatgt

SEQ ID NO: 215548 - DNA, 22 bp, Artificial sequence
  SiRNA target sequence
acatttcattaactgttatgtt

SEQ ID NO: 215549 - DNA, 22 bp, Artificial sequence
  SiRNA target sequence
catttcattaactgttatgttc

SEQ ID NO: 215550 - DNA, 22 bp, Artificial sequence
  SiRNA target sequence
atttcattaactgttatgttct

SEQ ID NO: 215551 - DNA, 22 bp, Artificial sequence
  SiRNA target sequence
tttcattaactgttatgttcta

SEQ ID NO: 215552 - DNA, 22 bp, Artificial sequence
  SiRNA target sequence
ttcattaactgttatgttctat

SEQ ID NO: 215553 - DNA, 22 bp, Artificial sequence
  SiRNA target sequence
tcattaactgttatgttctatg

SEQ ID NO: 215554 - DNA, 22 bp, Artificial sequence
  SiRNA target sequence
cattaactgttatgttctatgg

SEQ ID NO: 215555 - DNA, 22 bp, Artificial sequence
  SiRNA target sequence
attaactgttatgttctatggt

SEQ ID NO: 215556 - DNA, 22 bp, Artificial sequence
  SiRNA target sequence
ttaactgttatgttctatggta

SEQ ID NO: 215557 - DNA, 22 bp, Artificial sequence
  SiRNA target sequence
taactgttatgttctatggtat

SEQ ID NO: 215558 - DNA, 22 bp, Artificial sequence
  SiRNA target sequence
aactgttatgttctatggtata

SEQ ID NO: 215559 - DNA, 22 bp, Artificial sequence
  SiRNA target sequence
actgttatgttctatggtatat

SEQ ID NO: 215560 - DNA, 22 bp, Artificial sequence
  SiRNA target sequence
ctgttatgttctatggtatatc

SEQ ID NO: 215561 - DNA, 22 bp, Artificial sequence
  SiRNA target sequence
tgttatgttctatggtatatca

SEQ ID NO: 215562 - DNA, 22 bp, Artificial sequence
  SiRNA target sequence
gttatgttctatggtatatcaa

SEQ ID NO: 215563 - DNA, 22 bp, Artificial sequence
  SiRNA target sequence
ttatgttctatggtatatcaac

SEQ ID NO: 215564 - DNA, 22 bp, Artificial sequence
  SiRNA target sequence
tatgttctatggtatatcaact

SEQ ID NO: 215565 - DNA, 22 bp, Artificial sequence
  SiRNA target sequence
atgttctatggtatatcaacta

SEQ ID NO: 215566 - DNA, 22 bp, Artificial sequence
  SiRNA target sequence
tgttctatggtatatcaactaa

SEQ ID NO: 215567 - DNA, 22 bp, Artificial sequence
  SiRNA target sequence
gttctatggtatatcaactaat

SEQ ID NO: 215568 - DNA, 22 bp, Artificial sequence
  SiRNA target sequence
ttctatggtatatcaactaatt

SEQ ID NO: 215569 - DNA, 22 bp, Artificial sequence
  SiRNA target sequence
tctatggtatatcaactaattt

SEQ ID NO: 215570 - DNA, 22 bp, Artificial sequence
  SiRNA target sequence
ctatggtatatcaactaattta

SEQ ID NO: 215571 - DNA, 22 bp, Artificial sequence
  SiRNA target sequence
tatggtatatcaactaatttaa

SEQ ID NO: 215572 - DNA, 22 bp, Artificial sequence
  SiRNA target sequence
atggtatatcaactaatttaat

SEQ ID NO: 215573 - DNA, 22 bp, Artificial sequence
  SiRNA target sequence
tggtatatcaactaatttaata

SEQ ID NO: 215574 - DNA, 22 bp, Artificial sequence
  SiRNA target sequence
ggtatatcaactaatttaatag

SEQ ID NO: 215575 - DNA, 22 bp, Artificial sequence
  SiRNA target sequence
gtatatcaactaatttaataga

SEQ ID NO: 215576 - DNA, 22 bp, Artificial sequence
  SiRNA target sequence
tatatcaactaatttaatagaa

SEQ ID NO: 215577 - DNA, 22 bp, Artificial sequence
  SiRNA target sequence
atatcaactaatttaatagaat

SEQ ID NO: 215578 - DNA, 22 bp, Artificial sequence
  SiRNA target sequence
tatcaactaatttaatagaatc

SEQ ID NO: 215579 - DNA, 22 bp, Artificial sequence
  SiRNA target sequence
atcaactaatttaatagaatca

SEQ ID NO: 215580 - DNA, 22 bp, Artificial sequence
  SiRNA target sequence
tcaactaatttaatagaatcaa

SEQ ID NO: 215581 - DNA, 22 bp, Artificial sequence
  SiRNA target sequence
caactaatttaatagaatcaac

SEQ ID NO: 215582 - DNA, 22 bp, Artificial sequence
  SiRNA target sequence
aactaatttaatagaatcaaca

SEQ ID NO: 215583 - DNA, 22 bp, Artificial sequence
  SiRNA target sequence
actaatttaatagaatcaacat

SEQ ID NO: 215584 - DNA, 22 bp, Artificial sequence
  SiRNA target sequence
ctaatttaatagaatcaacatt

SEQ ID NO: 215585 - DNA, 22 bp, Artificial sequence
  SiRNA target sequence
taatttaatagaatcaacattt

SEQ ID NO: 215586 - DNA, 22 bp, Artificial sequence
  SiRNA target sequence
aatttaatagaatcaacattta

SEQ ID NO: 215587 - DNA, 22 bp, Artificial sequence
  SiRNA target sequence
atttaatagaatcaacatttaa

SEQ ID NO: 215588 - DNA, 22 bp, Artificial sequence
  SiRNA target sequence
tttaatagaatcaacatttaaa

SEQ ID NO: 215589 - DNA, 22 bp, Artificial sequence
  SiRNA target sequence
ttaatagaatcaacatttaaaa

SEQ ID NO: 215590 - DNA, 22 bp, Artificial sequence
  SiRNA target sequence
taatagaatcaacatttaaaag

SEQ ID NO: 215591 - DNA, 22 bp, Artificial sequence
  SiRNA target sequence
aatagaatcaacatttaaaagt

SEQ ID NO: 215592 - DNA, 22 bp, Artificial sequence
  SiRNA target sequence
atagaatcaacatttaaaagtg

SEQ ID NO: 215593 - DNA, 22 bp, Artificial sequence
  SiRNA target sequence
tagaatcaacatttaaaagtgg

SEQ ID NO: 215594 - DNA, 22 bp, Artificial sequence
  SiRNA target sequence
agaatcaacatttaaaagtgga

SEQ ID NO: 215595 - DNA, 22 bp, Artificial sequence
  SiRNA target sequence
gaatcaacatttaaaagtggac

SEQ ID NO: 215596 - DNA, 22 bp, Artificial sequence
  SiRNA target sequence
aatcaacatttaaaagtggact

SEQ ID NO: 215597 - DNA, 22 bp, Artificial sequence
  SiRNA target sequence
atcaacatttaaaagtggactt

SEQ ID NO: 215598 - DNA, 22 bp, Artificial sequence
  SiRNA target sequence
tcaacatttaaaagtggacttg

SEQ ID NO: 215599 - DNA, 22 bp, Artificial sequence
  SiRNA target sequence
caacatttaaaagtggacttgt

SEQ ID NO: 215600 - DNA, 22 bp, Artificial sequence
  SiRNA target sequence
aacatttaaaagtggacttgtg

SEQ ID NO: 215601 - DNA, 22 bp, Artificial sequence
  SiRNA target sequence
acatttaaaagtggacttgtga

SEQ ID NO: 215602 - DNA, 22 bp, Artificial sequence
  SiRNA target sequence
catttaaaagtggacttgtgaa

SEQ ID NO: 215603 - DNA, 22 bp, Artificial sequence
  SiRNA target sequence
atttaaaagtggacttgtgaaa

SEQ ID NO: 215604 - DNA, 22 bp, Artificial sequence
  SiRNA target sequence
tttaaaagtggacttgtgaaag

SEQ ID NO: 215605 - DNA, 22 bp, Artificial sequence
  SiRNA target sequence
ttaaaagtggacttgtgaaagg

SEQ ID NO: 215606 - DNA, 22 bp, Artificial sequence
  SiRNA target sequence
taaaagtggacttgtgaaaggt

SEQ ID NO: 215607 - DNA, 22 bp, Artificial sequence
  SiRNA target sequence
aaaagtggacttgtgaaaggtg

SEQ ID NO: 215608 - DNA, 22 bp, Artificial sequence
  SiRNA target sequence
aaagtggacttgtgaaaggtgc

SEQ ID NO: 215609 - DNA, 22 bp, Artificial sequence
  SiRNA target sequence
aagtggacttgtgaaaggtgca

SEQ ID NO: 215610 - DNA, 22 bp, Artificial sequence
  SiRNA target sequence
agtggacttgtgaaaggtgcag

SEQ ID NO: 215611 - DNA, 22 bp, Artificial sequence
  SiRNA target sequence
gtggacttgtgaaaggtgcaga

SEQ ID NO: 215612 - DNA, 22 bp, Artificial sequence
  SiRNA target sequence
tggacttgtgaaaggtgcagaa

SEQ ID NO: 215613 - DNA, 22 bp, Artificial sequence
  SiRNA target sequence
ggacttgtgaaaggtgcagaag

SEQ ID NO: 215614 - DNA, 22 bp, Artificial sequence
  SiRNA target sequence
gacttgtgaaaggtgcagaaga

SEQ ID NO: 215615 - DNA, 22 bp, Artificial sequence
  SiRNA target sequence
acttgtgaaaggtgcagaagaa

SEQ ID NO: 215616 - DNA, 22 bp, Artificial sequence
  SiRNA target sequence
cttgtgaaaggtgcagaagaat

SEQ ID NO: 215617 - DNA, 22 bp, Artificial sequence
  SiRNA target sequence
ttgtgaaaggtgcagaagaatt

SEQ ID NO: 215618 - DNA, 22 bp, Artificial sequence
  SiRNA target sequence
tgtgaaaggtgcagaagaatta

SEQ ID NO: 215619 - DNA, 22 bp, Artificial sequence
  SiRNA target sequence
gtgaaaggtgcagaagaattaa

SEQ ID NO: 215620 - DNA, 22 bp, Artificial sequence
  SiRNA target sequence
tgaaaggtgcagaagaattaaa

SEQ ID NO: 215621 - DNA, 22 bp, Artificial sequence
  SiRNA target sequence
gaaaggtgcagaagaattaaac

SEQ ID NO: 215622 - DNA, 22 bp, Artificial sequence
  SiRNA target sequence
aaaggtgcagaagaattaaacg

SEQ ID NO: 215623 - DNA, 22 bp, Artificial sequence
  SiRNA target sequence
aaggtgcagaagaattaaacga

SEQ ID NO: 215624 - DNA, 22 bp, Artificial sequence
  SiRNA target sequence
aggtgcagaagaattaaacgag

SEQ ID NO: 215625 - DNA, 22 bp, Artificial sequence
  SiRNA target sequence
ggtgcagaagaattaaacgaga

SEQ ID NO: 215626 - DNA, 22 bp, Artificial sequence
  SiRNA target sequence
gtgcagaagaattaaacgagaa

SEQ ID NO: 215627 - DNA, 22 bp, Artificial sequence
  SiRNA target sequence
tgcagaagaattaaacgagaat

SEQ ID NO: 215628 - DNA, 22 bp, Artificial sequence
  SiRNA target sequence
gcagaagaattaaacgagaata

SEQ ID NO: 215629 - DNA, 22 bp, Artificial sequence
  SiRNA target sequence
cagaagaattaaacgagaatac

SEQ ID NO: 215630 - DNA, 22 bp, Artificial sequence
  SiRNA target sequence
agaagaattaaacgagaatact

SEQ ID NO: 215631 - DNA, 22 bp, Artificial sequence
  SiRNA target sequence
gaagaattaaacgagaatacta

SEQ ID NO: 215632 - DNA, 22 bp, Artificial sequence
  SiRNA target sequence
aagaattaaacgagaatactaa

SEQ ID NO: 215633 - DNA, 22 bp, Artificial sequence
  SiRNA target sequence
agaattaaacgagaatactaaa

SEQ ID NO: 215634 - DNA, 22 bp, Artificial sequence
  SiRNA target sequence
gaattaaacgagaatactaaaa

SEQ ID NO: 215635 - DNA, 22 bp, Artificial sequence
  SiRNA target sequence
aattaaacgagaatactaaaag

SEQ ID NO: 215636 - DNA, 22 bp, Artificial sequence
  SiRNA target sequence
attaaacgagaatactaaaagt

SEQ ID NO: 215637 - DNA, 22 bp, Artificial sequence
  SiRNA target sequence
ttaaacgagaatactaaaagtt

SEQ ID NO: 215638 - DNA, 22 bp, Artificial sequence
  SiRNA target sequence
taaacgagaatactaaaagtta

SEQ ID NO: 215639 - DNA, 22 bp, Artificial sequence
  SiRNA target sequence
aaacgagaatactaaaagttat

SEQ ID NO: 215640 - DNA, 22 bp, Artificial sequence
  SiRNA target sequence
aacgagaatactaaaagttatt

SEQ ID NO: 215641 - DNA, 22 bp, Artificial sequence
  SiRNA target sequence
acgagaatactaaaagttattc

SEQ ID NO: 215642 - DNA, 22 bp, Artificial sequence
  SiRNA target sequence
cgagaatactaaaagttattct

SEQ ID NO: 215643 - DNA, 22 bp, Artificial sequence
  SiRNA target sequence
gagaatactaaaagttattcta

SEQ ID NO: 215644 - DNA, 22 bp, Artificial sequence
  SiRNA target sequence
agaatactaaaagttattctat

SEQ ID NO: 215645 - DNA, 22 bp, Artificial sequence
  SiRNA target sequence
gaatactaaaagttattctatg

SEQ ID NO: 215646 - DNA, 22 bp, Artificial sequence
  SiRNA target sequence
aatactaaaagttattctatgg

SEQ ID NO: 215647 - DNA, 22 bp, Artificial sequence
  SiRNA target sequence
atactaaaagttattctatggg

SEQ ID NO: 215648 - DNA, 22 bp, Artificial sequence
  SiRNA target sequence
tactaaaagttattctatggga

SEQ ID NO: 215649 - DNA, 22 bp, Artificial sequence
  SiRNA target sequence
actaaaagttattctatgggat

SEQ ID NO: 215650 - DNA, 22 bp, Artificial sequence
  SiRNA target sequence
ctaaaagttattctatgggata

SEQ ID NO: 215651 - DNA, 22 bp, Artificial sequence
  SiRNA target sequence
taaaagttattctatgggatat

SEQ ID NO: 215652 - DNA, 22 bp, Artificial sequence
  SiRNA target sequence
aaaagttattctatgggatata

SEQ ID NO: 215653 - DNA, 22 bp, Artificial sequence
  SiRNA target sequence
aaagttattctatgggatataa

SEQ ID NO: 215654 - DNA, 22 bp, Artificial sequence
  SiRNA target sequence
aagttattctatgggatataat

SEQ ID NO: 215655 - DNA, 22 bp, Artificial sequence
  SiRNA target sequence
agttattctatgggatataatt

SEQ ID NO: 215656 - DNA, 22 bp, Artificial sequence
  SiRNA target sequence
gttattctatgggatataattc

SEQ ID NO: 215657 - DNA, 22 bp, Artificial sequence
  SiRNA target sequence
ttattctatgggatataattca

SEQ ID NO: 215658 - DNA, 22 bp, Artificial sequence
  SiRNA target sequence
tattctatgggatataattcat

SEQ ID NO: 215659 - DNA, 22 bp, Artificial sequence
  SiRNA target sequence
attctatgggatataattcatt

SEQ ID NO: 215660 - DNA, 22 bp, Artificial sequence
  SiRNA target sequence
ttctatgggatataattcattt

SEQ ID NO: 215661 - DNA, 22 bp, Artificial sequence
  SiRNA target sequence
tctatgggatataattcatttg

SEQ ID NO: 215662 - DNA, 22 bp, Artificial sequence
  SiRNA target sequence
ctatgggatataattcatttga

SEQ ID NO: 215663 - DNA, 22 bp, Artificial sequence
  SiRNA target sequence
tatgggatataattcatttgaa

SEQ ID NO: 215664 - DNA, 22 bp, Artificial sequence
  SiRNA target sequence
atgggatataattcatttgaac

SEQ ID NO: 215665 - DNA, 22 bp, Artificial sequence
  SiRNA target sequence
tgggatataattcatttgaaca

SEQ ID NO: 215666 - DNA, 22 bp, Artificial sequence
  SiRNA target sequence
gggatataattcatttgaacaa

SEQ ID NO: 215667 - DNA, 22 bp, Artificial sequence
  SiRNA target sequence
ggatataattcatttgaacaaa

SEQ ID NO: 215668 - DNA, 22 bp, Artificial sequence
  SiRNA target sequence
gatataattcatttgaacaaaa

SEQ ID NO: 215669 - DNA, 22 bp, Artificial sequence
  SiRNA target sequence
atataattcatttgaacaaaag

SEQ ID NO: 215670 - DNA, 22 bp, Artificial sequence
  SiRNA target sequence
tataattcatttgaacaaaaga

SEQ ID NO: 215671 - DNA, 22 bp, Artificial sequence
  SiRNA target sequence
ataattcatttgaacaaaagat

SEQ ID NO: 215672 - DNA, 22 bp, Artificial sequence
  SiRNA target sequence
taattcatttgaacaaaagata

SEQ ID NO: 215673 - DNA, 22 bp, Artificial sequence
  SiRNA target sequence
aattcatttgaacaaaagatag

SEQ ID NO: 215674 - DNA, 22 bp, Artificial sequence
  SiRNA target sequence
attcatttgaacaaaagatagc

SEQ ID NO: 215675 - DNA, 22 bp, Artificial sequence
  SiRNA target sequence
ttcatttgaacaaaagatagca

SEQ ID NO: 215676 - DNA, 22 bp, Artificial sequence
  SiRNA target sequence
tcatttgaacaaaagatagcat

SEQ ID NO: 215677 - DNA, 22 bp, Artificial sequence
  SiRNA target sequence
catttgaacaaaagatagcatc

SEQ ID NO: 215678 - DNA, 22 bp, Artificial sequence
  SiRNA target sequence
atttgaacaaaagatagcatca

SEQ ID NO: 215679 - DNA, 22 bp, Artificial sequence
  SiRNA target sequence
tttgaacaaaagatagcatcaa

SEQ ID NO: 215680 - DNA, 22 bp, Artificial sequence
  SiRNA target sequence
ttgaacaaaagatagcatcaat

SEQ ID NO: 215681 - DNA, 22 bp, Artificial sequence
  SiRNA target sequence
tgaacaaaagatagcatcaata

SEQ ID NO: 215682 - DNA, 22 bp, Artificial sequence
  SiRNA target sequence
gaacaaaagatagcatcaataa

SEQ ID NO: 215683 - DNA, 22 bp, Artificial sequence
  SiRNA target sequence
aacaaaagatagcatcaataac

SEQ ID NO: 215684 - DNA, 22 bp, Artificial sequence
  SiRNA target sequence
acaaaagatagcatcaataact

SEQ ID NO: 215685 - DNA, 22 bp, Artificial sequence
  SiRNA target sequence
caaaagatagcatcaataactg

SEQ ID NO: 215686 - DNA, 22 bp, Artificial sequence
  SiRNA target sequence
aaaagatagcatcaataactgt

SEQ ID NO: 215687 - DNA, 22 bp, Artificial sequence
  SiRNA target sequence
aaagatagcatcaataactgtt

SEQ ID NO: 215688 - DNA, 22 bp, Artificial sequence
  SiRNA target sequence
aagatagcatcaataactgtta

SEQ ID NO: 215689 - DNA, 22 bp, Artificial sequence
  SiRNA target sequence
agatagcatcaataactgttat

SEQ ID NO: 215690 - DNA, 22 bp, Artificial sequence
  SiRNA target sequence
gatagcatcaataactgttatt

SEQ ID NO: 215691 - DNA, 22 bp, Artificial sequence
  SiRNA target sequence
atagcatcaataactgttatta

SEQ ID NO: 215692 - DNA, 22 bp, Artificial sequence
  SiRNA target sequence
tagcatcaataactgttattat

SEQ ID NO: 215693 - DNA, 22 bp, Artificial sequence
  SiRNA target sequence
agcatcaataactgttattatc

SEQ ID NO: 215694 - DNA, 22 bp, Artificial sequence
  SiRNA target sequence
gcatcaataactgttattatcc

SEQ ID NO: 215695 - DNA, 22 bp, Artificial sequence
  SiRNA target sequence
catcaataactgttattatcct

SEQ ID NO: 215696 - DNA, 22 bp, Artificial sequence
  SiRNA target sequence
atcaataactgttattatcctg

SEQ ID NO: 215697 - DNA, 22 bp, Artificial sequence
  SiRNA target sequence
tcaataactgttattatcctgc

SEQ ID NO: 215698 - DNA, 22 bp, Artificial sequence
  SiRNA target sequence
caataactgttattatcctgct

SEQ ID NO: 215699 - DNA, 22 bp, Artificial sequence
  SiRNA target sequence
aataactgttattatcctgctt

SEQ ID NO: 215700 - DNA, 22 bp, Artificial sequence
  SiRNA target sequence
ataactgttattatcctgcttt

SEQ ID NO: 215701 - DNA, 22 bp, Artificial sequence
  SiRNA target sequence
taactgttattatcctgctttt

SEQ ID NO: 215702 - DNA, 22 bp, Artificial sequence
  SiRNA target sequence
aactgttattatcctgctttta

SEQ ID NO: 215703 - DNA, 22 bp, Artificial sequence
  SiRNA target sequence
actgttattatcctgcttttat

SEQ ID NO: 215704 - DNA, 22 bp, Artificial sequence
  SiRNA target sequence
ctgttattatcctgcttttatc

SEQ ID NO: 215705 - DNA, 22 bp, Artificial sequence
  SiRNA target sequence
tgttattatcctgcttttatca

SEQ ID NO: 215706 - DNA, 22 bp, Artificial sequence
  SiRNA target sequence
gttattatcctgcttttatcac

SEQ ID NO: 215707 - DNA, 22 bp, Artificial sequence
  SiRNA target sequence
ttattatcctgcttttatcacc

SEQ ID NO: 215708 - DNA, 22 bp, Artificial sequence
  SiRNA target sequence
tattatcctgcttttatcacca

SEQ ID NO: 215709 - DNA, 22 bp, Artificial sequence
  SiRNA target sequence
attatcctgcttttatcaccat

SEQ ID NO: 215710 - DNA, 22 bp, Artificial sequence
  SiRNA target sequence
ttatcctgcttttatcaccatt

SEQ ID NO: 215711 - DNA, 22 bp, Artificial sequence
  SiRNA target sequence
tatcctgcttttatcaccattt

SEQ ID NO: 215712 - DNA, 22 bp, Artificial sequence
  SiRNA target sequence
atcctgcttttatcaccatttc

SEQ ID NO: 215713 - DNA, 22 bp, Artificial sequence
  SiRNA target sequence
tcctgcttttatcaccatttcc

SEQ ID NO: 215714 - DNA, 22 bp, Artificial sequence
  SiRNA target sequence
cctgcttttatcaccatttcca

SEQ ID NO: 215715 - DNA, 22 bp, Artificial sequence
  SiRNA target sequence
ctgcttttatcaccatttccaa

SEQ ID NO: 215716 - DNA, 22 bp, Artificial sequence
  SiRNA target sequence
tgcttttatcaccatttccaaa

SEQ ID NO: 215717 - DNA, 22 bp, Artificial sequence
  SiRNA target sequence
gcttttatcaccatttccaaaa

SEQ ID NO: 215718 - DNA, 22 bp, Artificial sequence
  SiRNA target sequence
cttttatcaccatttccaaaat

SEQ ID NO: 215719 - DNA, 22 bp, Artificial sequence
  SiRNA target sequence
ttttatcaccatttccaaaatt

SEQ ID NO: 215720 - DNA, 22 bp, Artificial sequence
  SiRNA target sequence
tttatcaccatttccaaaatta

SEQ ID NO: 215721 - DNA, 22 bp, Artificial sequence
  SiRNA target sequence
ttatcaccatttccaaaattaa

SEQ ID NO: 215722 - DNA, 22 bp, Artificial sequence
  SiRNA target sequence
tatcaccatttccaaaattaat

SEQ ID NO: 215723 - DNA, 22 bp, Artificial sequence
  SiRNA target sequence
atcaccatttccaaaattaata

SEQ ID NO: 215724 - DNA, 22 bp, Artificial sequence
  SiRNA target sequence
tcaccatttccaaaattaatac

SEQ ID NO: 215725 - DNA, 22 bp, Artificial sequence
  SiRNA target sequence
caccatttccaaaattaataca

SEQ ID NO: 215726 - DNA, 22 bp, Artificial sequence
  SiRNA target sequence
accatttccaaaattaatacaa

SEQ ID NO: 215727 - DNA, 22 bp, Artificial sequence
  SiRNA target sequence
ccatttccaaaattaatacaaa

SEQ ID NO: 215728 - DNA, 22 bp, Artificial sequence
  SiRNA target sequence
catttccaaaattaatacaaac

SEQ ID NO: 215729 - DNA, 22 bp, Artificial sequence
  SiRNA target sequence
atttccaaaattaatacaaacc

SEQ ID NO: 215730 - DNA, 22 bp, Artificial sequence
  SiRNA target sequence
tttccaaaattaatacaaacca

SEQ ID NO: 215731 - DNA, 22 bp, Artificial sequence
  SiRNA target sequence
ttccaaaattaatacaaaccaa

SEQ ID NO: 215732 - DNA, 22 bp, Artificial sequence
  SiRNA target sequence
tccaaaattaatacaaaccaaa

SEQ ID NO: 215733 - DNA, 22 bp, Artificial sequence
  SiRNA target sequence
ccaaaattaatacaaaccaaag

SEQ ID NO: 215734 - DNA, 22 bp, Artificial sequence
  SiRNA target sequence
caaaattaatacaaaccaaagg

SEQ ID NO: 215735 - DNA, 22 bp, Artificial sequence
  SiRNA target sequence
aaaattaatacaaaccaaagga

SEQ ID NO: 215736 - DNA, 22 bp, Artificial sequence
  SiRNA target sequence
aaattaatacaaaccaaaggat

SEQ ID NO: 215737 - DNA, 22 bp, Artificial sequence
  SiRNA target sequence
aattaatacaaaccaaaggatg

SEQ ID NO: 215738 - DNA, 22 bp, Artificial sequence
  SiRNA target sequence
attaatacaaaccaaaggatgg

SEQ ID NO: 215739 - DNA, 22 bp, Artificial sequence
  SiRNA target sequence
ttaatacaaaccaaaggatgga

SEQ ID NO: 215740 - DNA, 22 bp, Artificial sequence
  SiRNA target sequence
taatacaaaccaaaggatggat

SEQ ID NO: 215741 - DNA, 22 bp, Artificial sequence
  SiRNA target sequence
aatacaaaccaaaggatggata

SEQ ID NO: 215742 - DNA, 22 bp, Artificial sequence
  SiRNA target sequence
atacaaaccaaaggatggatat

SEQ ID NO: 215743 - DNA, 22 bp, Artificial sequence
  SiRNA target sequence
tacaaaccaaaggatggatatt

SEQ ID NO: 215744 - DNA, 22 bp, Artificial sequence
  SiRNA target sequence
acaaaccaaaggatggatattt

SEQ ID NO: 215745 - DNA, 22 bp, Artificial sequence
  SiRNA target sequence
caaaccaaaggatggatatttg

SEQ ID NO: 215746 - DNA, 22 bp, Artificial sequence
  SiRNA target sequence
aaaccaaaggatggatatttgt

SEQ ID NO: 215747 - DNA, 22 bp, Artificial sequence
  SiRNA target sequence
aaccaaaggatggatatttgtt

SEQ ID NO: 215748 - DNA, 22 bp, Artificial sequence
  SiRNA target sequence
accaaaggatggatatttgttg

SEQ ID NO: 215749 - DNA, 22 bp, Artificial sequence
  SiRNA target sequence
ccaaaggatggatatttgttgc

SEQ ID NO: 215750 - DNA, 22 bp, Artificial sequence
  SiRNA target sequence
caaaggatggatatttgttgcc

SEQ ID NO: 215751 - DNA, 22 bp, Artificial sequence
  SiRNA target sequence
aaaggatggatatttgttgcca

SEQ ID NO: 215752 - DNA, 22 bp, Artificial sequence
  SiRNA target sequence
aaggatggatatttgttgccat

SEQ ID NO: 215753 - DNA, 22 bp, Artificial sequence
  SiRNA target sequence
aggatggatatttgttgccata

SEQ ID NO: 215754 - DNA, 22 bp, Artificial sequence
  SiRNA target sequence
ggatggatatttgttgccatag

SEQ ID NO: 215755 - DNA, 22 bp, Artificial sequence
  SiRNA target sequence
gatggatatttgttgccatagc

SEQ ID NO: 215756 - DNA, 22 bp, Artificial sequence
  SiRNA target sequence
atggatatttgttgccatagcg

SEQ ID NO: 215757 - DNA, 22 bp, Artificial sequence
  SiRNA target sequence
tggatatttgttgccatagcgt

SEQ ID NO: 215758 - DNA, 22 bp, Artificial sequence
  SiRNA target sequence
ggatatttgttgccatagcgtg

SEQ ID NO: 215759 - DNA, 22 bp, Artificial sequence
  SiRNA target sequence
gatatttgttgccatagcgtgc

SEQ ID NO: 215760 - DNA, 22 bp, Artificial sequence
  SiRNA target sequence
atatttgttgccatagcgtgcc

SEQ ID NO: 215761 - DNA, 22 bp, Artificial sequence
  SiRNA target sequence
tatttgttgccatagcgtgccc

SEQ ID NO: 215762 - DNA, 22 bp, Artificial sequence
  SiRNA target sequence
atttgttgccatagcgtgccca

SEQ ID NO: 215763 - DNA, 22 bp, Artificial sequence
  SiRNA target sequence
tttgttgccatagcgtgcccac

SEQ ID NO: 215764 - DNA, 22 bp, Artificial sequence
  SiRNA target sequence
ttgttgccatagcgtgcccact

SEQ ID NO: 215765 - DNA, 22 bp, Artificial sequence
  SiRNA target sequence
tgttgccatagcgtgcccactt

SEQ ID NO: 215766 - DNA, 22 bp, Artificial sequence
  SiRNA target sequence
gttgccatagcgtgcccactta

SEQ ID NO: 215767 - DNA, 22 bp, Artificial sequence
  SiRNA target sequence
ttgccatagcgtgcccacttat

SEQ ID NO: 215768 - DNA, 22 bp, Artificial sequence
  SiRNA target sequence
tgccatagcgtgcccacttatt

SEQ ID NO: 215769 - DNA, 22 bp, Artificial sequence
  SiRNA target sequence
gccatagcgtgcccacttatta

SEQ ID NO: 215770 - DNA, 22 bp, Artificial sequence
  SiRNA target sequence
ccatagcgtgcccacttattac

SEQ ID NO: 215771 - DNA, 22 bp, Artificial sequence
  SiRNA target sequence
catagcgtgcccacttattacc

SEQ ID NO: 215772 - DNA, 22 bp, Artificial sequence
  SiRNA target sequence
atagcgtgcccacttattaccc

SEQ ID NO: 215773 - DNA, 22 bp, Artificial sequence
  SiRNA target sequence
tagcgtgcccacttattaccct

SEQ ID NO: 215774 - DNA, 22 bp, Artificial sequence
  SiRNA target sequence
agcgtgcccacttattaccctt

SEQ ID NO: 215775 - DNA, 22 bp, Artificial sequence
  SiRNA target sequence
gcgtgcccacttattacccttt

SEQ ID NO: 215776 - DNA, 22 bp, Artificial sequence
  SiRNA target sequence
cgtgcccacttattaccctttt

SEQ ID NO: 215777 - DNA, 22 bp, Artificial sequence
  SiRNA target sequence
gtgcccacttattacccttttt

SEQ ID NO: 215778 - DNA, 22 bp, Artificial sequence
  SiRNA target sequence
tgcccacttattaccctttttg

SEQ ID NO: 215779 - DNA, 22 bp, Artificial sequence
  SiRNA target sequence
gcccacttattaccctttttgc

SEQ ID NO: 215780 - DNA, 22 bp, Artificial sequence
  SiRNA target sequence
cccacttattaccctttttgct

SEQ ID NO: 215781 - DNA, 22 bp, Artificial sequence
  SiRNA target sequence
ccacttattaccctttttgctg

SEQ ID NO: 215782 - DNA, 22 bp, Artificial sequence
  SiRNA target sequence
cacttattaccctttttgctgt

SEQ ID NO: 215783 - DNA, 22 bp, Artificial sequence
  SiRNA target sequence
acttattaccctttttgctgta

SEQ ID NO: 215784 - DNA, 22 bp, Artificial sequence
  SiRNA target sequence
cttattaccctttttgctgtag

SEQ ID NO: 215785 - DNA, 22 bp, Artificial sequence
  SiRNA target sequence
ttattaccctttttgctgtagt

SEQ ID NO: 215786 - DNA, 22 bp, Artificial sequence
  SiRNA target sequence
tattaccctttttgctgtagtt

SEQ ID NO: 215787 - DNA, 22 bp, Artificial sequence
  SiRNA target sequence
attaccctttttgctgtagttt

SEQ ID NO: 215788 - DNA, 22 bp, Artificial sequence
  SiRNA target sequence
ttaccctttttgctgtagtttc

SEQ ID NO: 215789 - DNA, 22 bp, Artificial sequence
  SiRNA target sequence
taccctttttgctgtagtttct

SEQ ID NO: 215790 - DNA, 22 bp, Artificial sequence
  SiRNA target sequence
accctttttgctgtagtttctg

SEQ ID NO: 215791 - DNA, 22 bp, Artificial sequence
  SiRNA target sequence
ccctttttgctgtagtttctgt

SEQ ID NO: 215792 - DNA, 22 bp, Artificial sequence
  SiRNA target sequence
cctttttgctgtagtttctgtg

SEQ ID NO: 215793 - DNA, 22 bp, Artificial sequence
  SiRNA target sequence
ctttttgctgtagtttctgtgt

SEQ ID NO: 215794 - DNA, 22 bp, Artificial sequence
  SiRNA target sequence
tttttgctgtagtttctgtgtg

SEQ ID NO: 215795 - DNA, 22 bp, Artificial sequence
  SiRNA target sequence
ttttgctgtagtttctgtgtgt

SEQ ID NO: 215796 - DNA, 22 bp, Artificial sequence
  SiRNA target sequence
tttgctgtagtttctgtgtgtg

SEQ ID NO: 215797 - DNA, 22 bp, Artificial sequence
  SiRNA target sequence
ttgctgtagtttctgtgtgtgg

SEQ ID NO: 215798 - DNA, 22 bp, Artificial sequence
  SiRNA target sequence
tgctgtagtttctgtgtgtggt

SEQ ID NO: 215799 - DNA, 22 bp, Artificial sequence
  SiRNA target sequence
gctgtagtttctgtgtgtggtc

SEQ ID NO: 215800 - DNA, 22 bp, Artificial sequence
  SiRNA target sequence
ctgtagtttctgtgtgtggtct

SEQ ID NO: 215801 - DNA, 22 bp, Artificial sequence
  SiRNA target sequence
tgtagtttctgtgtgtggtctt

SEQ ID NO: 215802 - DNA, 22 bp, Artificial sequence
  SiRNA target sequence
gtagtttctgtgtgtggtcttg

SEQ ID NO: 215803 - DNA, 22 bp, Artificial sequence
  SiRNA target sequence
tagtttctgtgtgtggtcttgc

SEQ ID NO: 215804 - DNA, 22 bp, Artificial sequence
  SiRNA target sequence
agtttctgtgtgtggtcttgct

SEQ ID NO: 215805 - DNA, 22 bp, Artificial sequence
  SiRNA target sequence
gtttctgtgtgtggtcttgctt

SEQ ID NO: 215806 - DNA, 22 bp, Artificial sequence
  SiRNA target sequence
tttctgtgtgtggtcttgcttt

SEQ ID NO: 215807 - DNA, 22 bp, Artificial sequence
  SiRNA target sequence
ttctgtgtgtggtcttgctttt

SEQ ID NO: 215808 - DNA, 22 bp, Artificial sequence
  SiRNA target sequence
tctgtgtgtggtcttgcttttt

SEQ ID NO: 215809 - DNA, 22 bp, Artificial sequence
  SiRNA target sequence
ctgtgtgtggtcttgcttttta

SEQ ID NO: 215810 - DNA, 22 bp, Artificial sequence
  SiRNA target sequence
tgtgtgtggtcttgctttttac

SEQ ID NO: 215811 - DNA, 22 bp, Artificial sequence
  SiRNA target sequence
gtgtgtggtcttgctttttaca

SEQ ID NO: 215812 - DNA, 22 bp, Artificial sequence
  SiRNA target sequence
tgtgtggtcttgctttttacaa

SEQ ID NO: 215813 - DNA, 22 bp, Artificial sequence
  SiRNA target sequence
gtgtggtcttgctttttacaat

SEQ ID NO: 215814 - DNA, 22 bp, Artificial sequence
  SiRNA target sequence
tgtggtcttgctttttacaatt

SEQ ID NO: 215815 - DNA, 22 bp, Artificial sequence
  SiRNA target sequence
gtggtcttgctttttacaatta

SEQ ID NO: 215816 - DNA, 22 bp, Artificial sequence
  SiRNA target sequence
tggtcttgctttttacaattat

SEQ ID NO: 215817 - DNA, 22 bp, Artificial sequence
  SiRNA target sequence
ggtcttgctttttacaattatc

SEQ ID NO: 215818 - DNA, 22 bp, Artificial sequence
  SiRNA target sequence
gtcttgctttttacaattatcc

SEQ ID NO: 215819 - DNA, 22 bp, Artificial sequence
  SiRNA target sequence
tcttgctttttacaattatccg

SEQ ID NO: 215820 - DNA, 22 bp, Artificial sequence
  SiRNA target sequence
cttgctttttacaattatccgg

SEQ ID NO: 215821 - DNA, 22 bp, Artificial sequence
  SiRNA target sequence
ttgctttttacaattatccggc

SEQ ID NO: 215822 - DNA, 22 bp, Artificial sequence
  SiRNA target sequence
tgctttttacaattatccggca

SEQ ID NO: 215823 - DNA, 22 bp, Artificial sequence
  SiRNA target sequence
gctttttacaattatccggcaa

SEQ ID NO: 215824 - DNA, 22 bp, Artificial sequence
  SiRNA target sequence
ctttttacaattatccggcaac

SEQ ID NO: 215825 - DNA, 22 bp, Artificial sequence
  SiRNA target sequence
tttttacaattatccggcaaca

SEQ ID NO: 215826 - DNA, 22 bp, Artificial sequence
  SiRNA target sequence
ttttacaattatccggcaacaa

SEQ ID NO: 215827 - DNA, 22 bp, Artificial sequence
  SiRNA target sequence
tttacaattatccggcaacaaa

SEQ ID NO: 215828 - DNA, 22 bp, Artificial sequence
  SiRNA target sequence
ttacaattatccggcaacaaat

SEQ ID NO: 215829 - DNA, 22 bp, Artificial sequence
  SiRNA target sequence
tacaattatccggcaacaaata

SEQ ID NO: 215830 - DNA, 22 bp, Artificial sequence
  SiRNA target sequence
acaattatccggcaacaaataa

SEQ ID NO: 215831 - DNA, 22 bp, Artificial sequence
  SiRNA target sequence
caattatccggcaacaaataat

SEQ ID NO: 215832 - DNA, 22 bp, Artificial sequence
  SiRNA target sequence
aattatccggcaacaaataatg

SEQ ID NO: 215833 - DNA, 22 bp, Artificial sequence
  SiRNA target sequence
attatccggcaacaaataatga

SEQ ID NO: 215834 - DNA, 22 bp, Artificial sequence
  SiRNA target sequence
ttatccggcaacaaataatgac

SEQ ID NO: 215835 - DNA, 22 bp, Artificial sequence
  SiRNA target sequence
tatccggcaacaaataatgaca

SEQ ID NO: 215836 - DNA, 22 bp, Artificial sequence
  SiRNA target sequence
atccggcaacaaataatgacac

SEQ ID NO: 215837 - DNA, 22 bp, Artificial sequence
  SiRNA target sequence
tccggcaacaaataatgacaca

SEQ ID NO: 215838 - DNA, 22 bp, Artificial sequence
  SiRNA target sequence
ccggcaacaaataatgacacaa

SEQ ID NO: 215839 - DNA, 22 bp, Artificial sequence
  SiRNA target sequence
cggcaacaaataatgacacaaa

SEQ ID NO: 215840 - DNA, 22 bp, Artificial sequence
  SiRNA target sequence
ggcaacaaataatgacacaaat

SEQ ID NO: 215841 - DNA, 22 bp, Artificial sequence
  SiRNA target sequence
gcaacaaataatgacacaaatt

SEQ ID NO: 215842 - DNA, 22 bp, Artificial sequence
  SiRNA target sequence
caacaaataatgacacaaattt

SEQ ID NO: 215843 - DNA, 22 bp, Artificial sequence
  SiRNA target sequence
aacaaataatgacacaaatttt

SEQ ID NO: 215844 - DNA, 22 bp, Artificial sequence
  SiRNA target sequence
acaaataatgacacaaattttt

SEQ ID NO: 215845 - DNA, 22 bp, Artificial sequence
  SiRNA target sequence
caaataatgacacaaatttttt

SEQ ID NO: 215846 - DNA, 22 bp, Artificial sequence
  SiRNA target sequence
aaataatgacacaaattttttt

SEQ ID NO: 215847 - DNA, 22 bp, Artificial sequence
  SiRNA target sequence
aataatgacacaaatttttttc

SEQ ID NO: 215848 - DNA, 22 bp, Artificial sequence
  SiRNA target sequence
ataatgacacaaatttttttct

SEQ ID NO: 215849 - DNA, 22 bp, Artificial sequence
  SiRNA target sequence
taatgacacaaatttttttcta

SEQ ID NO: 215850 - DNA, 22 bp, Artificial sequence
  SiRNA target sequence
aatgacacaaatttttttctaa

SEQ ID NO: 215851 - DNA, 22 bp, Artificial sequence
  SiRNA target sequence
atgacacaaatttttttctaaa

SEQ ID NO: 215852 - DNA, 22 bp, Artificial sequence
  SiRNA target sequence
tgacacaaatttttttctaaat

SEQ ID NO: 215853 - DNA, 22 bp, Artificial sequence
  SiRNA target sequence
gacacaaatttttttctaaatt

SEQ ID NO: 215854 - DNA, 22 bp, Artificial sequence
  SiRNA target sequence
acacaaatttttttctaaattc

SEQ ID NO: 215855 - DNA, 22 bp, Artificial sequence
  SiRNA target sequence
cacaaatttttttctaaattca

SEQ ID NO: 215856 - DNA, 22 bp, Artificial sequence
  SiRNA target sequence
acaaatttttttctaaattcat

SEQ ID NO: 215857 - DNA, 22 bp, Artificial sequence
  SiRNA target sequence
caaatttttttctaaattcatt

SEQ ID NO: 215858 - DNA, 22 bp, Artificial sequence
  SiRNA target sequence
aaatttttttctaaattcatta

SEQ ID NO: 215859 - DNA, 22 bp, Artificial sequence
  SiRNA target sequence
aatttttttctaaattcattat

SEQ ID NO: 215860 - DNA, 22 bp, Artificial sequence
  SiRNA target sequence
atttttttctaaattcattatg

SEQ ID NO: 215861 - DNA, 22 bp, Artificial sequence
  SiRNA target sequence
tttttttctaaattcattatgt

SEQ ID NO: 215862 - DNA, 22 bp, Artificial sequence
  SiRNA target sequence
ttttttctaaattcattatgtg

SEQ ID NO: 215863 - DNA, 22 bp, Artificial sequence
  SiRNA target sequence
tttttctaaattcattatgtgc

SEQ ID NO: 215864 - DNA, 22 bp, Artificial sequence
  SiRNA target sequence
ttttctaaattcattatgtgct

SEQ ID NO: 215865 - DNA, 22 bp, Artificial sequence
  SiRNA target sequence
tttctaaattcattatgtgcta

SEQ ID NO: 215866 - DNA, 22 bp, Artificial sequence
  SiRNA target sequence
ttctaaattcattatgtgctac

SEQ ID NO: 215867 - DNA, 22 bp, Artificial sequence
  SiRNA target sequence
tctaaattcattatgtgctacg

SEQ ID NO: 215868 - DNA, 22 bp, Artificial sequence
  SiRNA target sequence
ctaaattcattatgtgctacgc

SEQ ID NO: 215869 - DNA, 22 bp, Artificial sequence
  SiRNA target sequence
taaattcattatgtgctacgcc

SEQ ID NO: 215870 - DNA, 22 bp, Artificial sequence
  SiRNA target sequence
aaattcattatgtgctacgccc

SEQ ID NO: 215871 - DNA, 22 bp, Artificial sequence
  SiRNA target sequence
aattcattatgtgctacgcccg

SEQ ID NO: 215872 - DNA, 22 bp, Artificial sequence
  SiRNA target sequence
attcattatgtgctacgcccgg

SEQ ID NO: 215873 - DNA, 22 bp, Artificial sequence
  SiRNA target sequence
ttcattatgtgctacgcccggt

SEQ ID NO: 215874 - DNA, 22 bp, Artificial sequence
  SiRNA target sequence
tcattatgtgctacgcccggta

SEQ ID NO: 215875 - DNA, 22 bp, Artificial sequence
  SiRNA target sequence
cattatgtgctacgcccggtaa

SEQ ID NO: 215876 - DNA, 22 bp, Artificial sequence
  SiRNA target sequence
attatgtgctacgcccggtaaa

SEQ ID NO: 215877 - DNA, 22 bp, Artificial sequence
  SiRNA target sequence
ttatgtgctacgcccggtaaat

SEQ ID NO: 215878 - DNA, 22 bp, Artificial sequence
  SiRNA target sequence
tatgtgctacgcccggtaaatc

SEQ ID NO: 215879 - DNA, 22 bp, Artificial sequence
  SiRNA target sequence
atgtgctacgcccggtaaatcg

SEQ ID NO: 215880 - DNA, 22 bp, Artificial sequence
  SiRNA target sequence
tgtgctacgcccggtaaatcgt

SEQ ID NO: 215881 - DNA, 22 bp, Artificial sequence
  SiRNA target sequence
gtgctacgcccggtaaatcgtt

SEQ ID NO: 215882 - DNA, 22 bp, Artificial sequence
  SiRNA target sequence
tgctacgcccggtaaatcgttt

SEQ ID NO: 215883 - DNA, 22 bp, Artificial sequence
  SiRNA target sequence
gctacgcccggtaaatcgttta

SEQ ID NO: 215884 - DNA, 22 bp, Artificial sequence
  SiRNA target sequence
ctacgcccggtaaatcgtttat

SEQ ID NO: 215885 - DNA, 22 bp, Artificial sequence
  SiRNA target sequence
tacgcccggtaaatcgtttata

SEQ ID NO: 215886 - DNA, 22 bp, Artificial sequence
  SiRNA target sequence
acgcccggtaaatcgtttataa

SEQ ID NO: 215887 - DNA, 22 bp, Artificial sequence
  SiRNA target sequence
cgcccggtaaatcgtttataaa

SEQ ID NO: 215888 - DNA, 22 bp, Artificial sequence
  SiRNA target sequence
gcccggtaaatcgtttataaaa

SEQ ID NO: 215889 - DNA, 22 bp, Artificial sequence
  SiRNA target sequence
cccggtaaatcgtttataaaat

SEQ ID NO: 215890 - DNA, 22 bp, Artificial sequence
  SiRNA target sequence
ccggtaaatcgtttataaaatt

SEQ ID NO: 215891 - DNA, 22 bp, Artificial sequence
  SiRNA target sequence
cggtaaatcgtttataaaatta

SEQ ID NO: 215892 - DNA, 22 bp, Artificial sequence
  SiRNA target sequence
ggtaaatcgtttataaaattag

SEQ ID NO: 215893 - DNA, 22 bp, Artificial sequence
  SiRNA target sequence
gtaaatcgtttataaaattaga

SEQ ID NO: 215894 - DNA, 22 bp, Artificial sequence
  SiRNA target sequence
taaatcgtttataaaattagaa

SEQ ID NO: 215895 - DNA, 22 bp, Artificial sequence
  SiRNA target sequence
aaatcgtttataaaattagaaa

SEQ ID NO: 215896 - DNA, 22 bp, Artificial sequence
  SiRNA target sequence
aatcgtttataaaattagaaaa

SEQ ID NO: 215897 - DNA, 22 bp, Artificial sequence
  SiRNA target sequence
atcgtttataaaattagaaaat

SEQ ID NO: 215898 - DNA, 22 bp, Artificial sequence
  SiRNA target sequence
tcgtttataaaattagaaaatg

SEQ ID NO: 215899 - DNA, 22 bp, Artificial sequence
  SiRNA target sequence
cgtttataaaattagaaaatgt

SEQ ID NO: 215900 - DNA, 22 bp, Artificial sequence
  SiRNA target sequence
gtttataaaattagaaaatgtt

SEQ ID NO: 215901 - DNA, 22 bp, Artificial sequence
  SiRNA target sequence
tttataaaattagaaaatgttt

SEQ ID NO: 215902 - DNA, 22 bp, Artificial sequence
  SiRNA target sequence
ttataaaattagaaaatgtttt

SEQ ID NO: 215903 - DNA, 22 bp, Artificial sequence
  SiRNA target sequence
tataaaattagaaaatgtttta

SEQ ID NO: 215904 - DNA, 22 bp, Artificial sequence
  SiRNA target sequence
ataaaattagaaaatgttttag

SEQ ID NO: 215905 - DNA, 22 bp, Artificial sequence
  SiRNA target sequence
taaaattagaaaatgttttagg

SEQ ID NO: 215906 - DNA, 22 bp, Artificial sequence
  SiRNA target sequence
aaaattagaaaatgttttagga

SEQ ID NO: 215907 - DNA, 22 bp, Artificial sequence
  SiRNA target sequence
aaattagaaaatgttttaggat

SEQ ID NO: 215908 - DNA, 22 bp, Artificial sequence
  SiRNA target sequence
aattagaaaatgttttaggatg

SEQ ID NO: 215909 - DNA, 22 bp, Artificial sequence
  SiRNA target sequence
attagaaaatgttttaggatgt

SEQ ID NO: 215910 - DNA, 22 bp, Artificial sequence
  SiRNA target sequence
ttagaaaatgttttaggatgtg

SEQ ID NO: 215911 - DNA, 22 bp, Artificial sequence
  SiRNA target sequence
tagaaaatgttttaggatgtgt

SEQ ID NO: 215912 - DNA, 22 bp, Artificial sequence
  SiRNA target sequence
agaaaatgttttaggatgtgta

SEQ ID NO: 215913 - DNA, 22 bp, Artificial sequence
  SiRNA target sequence
gaaaatgttttaggatgtgtag

SEQ ID NO: 215914 - DNA, 22 bp, Artificial sequence
  SiRNA target sequence
aaaatgttttaggatgtgtagc

SEQ ID NO: 215915 - DNA, 22 bp, Artificial sequence
  SiRNA target sequence
aaatgttttaggatgtgtagct

SEQ ID NO: 215916 - DNA, 22 bp, Artificial sequence
  SiRNA target sequence
aatgttttaggatgtgtagctg

SEQ ID NO: 215917 - DNA, 22 bp, Artificial sequence
  SiRNA target sequence
atgttttaggatgtgtagctgt

SEQ ID NO: 215918 - DNA, 22 bp, Artificial sequence
  SiRNA target sequence
tgttttaggatgtgtagctgta

SEQ ID NO: 215919 - DNA, 22 bp, Artificial sequence
  SiRNA target sequence
gttttaggatgtgtagctgtag

SEQ ID NO: 215920 - DNA, 22 bp, Artificial sequence
  SiRNA target sequence
ttttaggatgtgtagctgtagc

SEQ ID NO: 215921 - DNA, 22 bp, Artificial sequence
  SiRNA target sequence
tttaggatgtgtagctgtagct

SEQ ID NO: 215922 - DNA, 22 bp, Artificial sequence
  SiRNA target sequence
ttaggatgtgtagctgtagctc

SEQ ID NO: 215923 - DNA, 22 bp, Artificial sequence
  SiRNA target sequence
taggatgtgtagctgtagctct

SEQ ID NO: 215924 - DNA, 22 bp, Artificial sequence
  SiRNA target sequence
aggatgtgtagctgtagctctt

SEQ ID NO: 215925 - DNA, 22 bp, Artificial sequence
  SiRNA target sequence
ggatgtgtagctgtagctctta

SEQ ID NO: 215926 - DNA, 22 bp, Artificial sequence
  SiRNA target sequence
gatgtgtagctgtagctcttat

SEQ ID NO: 215927 - DNA, 22 bp, Artificial sequence
  SiRNA target sequence
atgtgtagctgtagctcttatg

SEQ ID NO: 215928 - DNA, 22 bp, Artificial sequence
  SiRNA target sequence
tgtgtagctgtagctcttatga

SEQ ID NO: 215929 - DNA, 22 bp, Artificial sequence
  SiRNA target sequence
gtgtagctgtagctcttatgaa

SEQ ID NO: 215930 - DNA, 22 bp, Artificial sequence
  SiRNA target sequence
tgtagctgtagctcttatgaaa

SEQ ID NO: 215931 - DNA, 22 bp, Artificial sequence
  SiRNA target sequence
gtagctgtagctcttatgaaag

SEQ ID NO: 215932 - DNA, 22 bp, Artificial sequence
  SiRNA target sequence
tagctgtagctcttatgaaagt

SEQ ID NO: 215933 - DNA, 22 bp, Artificial sequence
  SiRNA target sequence
agctgtagctcttatgaaagta

SEQ ID NO: 215934 - DNA, 22 bp, Artificial sequence
  SiRNA target sequence
gctgtagctcttatgaaagtag

SEQ ID NO: 215935 - DNA, 22 bp, Artificial sequence
  SiRNA target sequence
ctgtagctcttatgaaagtagc

SEQ ID NO: 215936 - DNA, 22 bp, Artificial sequence
  SiRNA target sequence
tgtagctcttatgaaagtagca

SEQ ID NO: 215937 - DNA, 22 bp, Artificial sequence
  SiRNA target sequence
gtagctcttatgaaagtagcaa

SEQ ID NO: 215938 - DNA, 22 bp, Artificial sequence
  SiRNA target sequence
tagctcttatgaaagtagcaaa

SEQ ID NO: 215939 - DNA, 22 bp, Artificial sequence
  SiRNA target sequence
agctcttatgaaagtagcaaaa

SEQ ID NO: 215940 - DNA, 22 bp, Artificial sequence
  SiRNA target sequence
gctcttatgaaagtagcaaaat

SEQ ID NO: 215941 - DNA, 22 bp, Artificial sequence
  SiRNA target sequence
ctcttatgaaagtagcaaaata

SEQ ID NO: 215942 - DNA, 22 bp, Artificial sequence
  SiRNA target sequence
tcttatgaaagtagcaaaatat

SEQ ID NO: 215943 - DNA, 22 bp, Artificial sequence
  SiRNA target sequence
cttatgaaagtagcaaaatatg

SEQ ID NO: 215944 - DNA, 22 bp, Artificial sequence
  SiRNA target sequence
ttatgaaagtagcaaaatatgg

SEQ ID NO: 215945 - DNA, 22 bp, Artificial sequence
  SiRNA target sequence
tatgaaagtagcaaaatatggc

SEQ ID NO: 215946 - DNA, 22 bp, Artificial sequence
  SiRNA target sequence
atgaaagtagcaaaatatggct

SEQ ID NO: 215947 - DNA, 22 bp, Artificial sequence
  SiRNA target sequence
tgaaagtagcaaaatatggctc

SEQ ID NO: 215948 - DNA, 22 bp, Artificial sequence
  SiRNA target sequence
gaaagtagcaaaatatggctct

SEQ ID NO: 215949 - DNA, 22 bp, Artificial sequence
  SiRNA target sequence
aaagtagcaaaatatggctctt

SEQ ID NO: 215950 - DNA, 22 bp, Artificial sequence
  SiRNA target sequence
aagtagcaaaatatggctcttt

SEQ ID NO: 215951 - DNA, 22 bp, Artificial sequence
  SiRNA target sequence
agtagcaaaatatggctctttt

SEQ ID NO: 215952 - DNA, 22 bp, Artificial sequence
  SiRNA target sequence
gtagcaaaatatggctcttttg

SEQ ID NO: 215953 - DNA, 22 bp, Artificial sequence
  SiRNA target sequence
tagcaaaatatggctcttttga

SEQ ID NO: 215954 - DNA, 22 bp, Artificial sequence
  SiRNA target sequence
agcaaaatatggctcttttgat

SEQ ID NO: 215955 - DNA, 22 bp, Artificial sequence
  SiRNA target sequence
gcaaaatatggctcttttgata

SEQ ID NO: 215956 - DNA, 22 bp, Artificial sequence
  SiRNA target sequence
caaaatatggctcttttgatat

SEQ ID NO: 215957 - DNA, 22 bp, Artificial sequence
  SiRNA target sequence
aaaatatggctcttttgatatt

SEQ ID NO: 215958 - DNA, 22 bp, Artificial sequence
  SiRNA target sequence
aaatatggctcttttgatattt

SEQ ID NO: 215959 - DNA, 22 bp, Artificial sequence
  SiRNA target sequence
aatatggctcttttgatatttc

SEQ ID NO: 215960 - DNA, 22 bp, Artificial sequence
  SiRNA target sequence
atatggctcttttgatatttcc

SEQ ID NO: 215961 - DNA, 22 bp, Artificial sequence
  SiRNA target sequence
tatggctcttttgatatttcca

SEQ ID NO: 215962 - DNA, 22 bp, Artificial sequence
  SiRNA target sequence
atggctcttttgatatttccaa

SEQ ID NO: 215963 - DNA, 22 bp, Artificial sequence
  SiRNA target sequence
tggctcttttgatatttccaaa

SEQ ID NO: 215964 - DNA, 22 bp, Artificial sequence
  SiRNA target sequence
ggctcttttgatatttccaaag

SEQ ID NO: 215965 - DNA, 22 bp, Artificial sequence
  SiRNA target sequence
gctcttttgatatttccaaaga

SEQ ID NO: 215966 - DNA, 22 bp, Artificial sequence
  SiRNA target sequence
ctcttttgatatttccaaagaa

SEQ ID NO: 215967 - DNA, 22 bp, Artificial sequence
  SiRNA target sequence
tcttttgatatttccaaagaag

SEQ ID NO: 215968 - DNA, 22 bp, Artificial sequence
  SiRNA target sequence
cttttgatatttccaaagaagc

SEQ ID NO: 215969 - DNA, 22 bp, Artificial sequence
  SiRNA target sequence
ttttgatatttccaaagaagcc

SEQ ID NO: 215970 - DNA, 22 bp, Artificial sequence
  SiRNA target sequence
tttgatatttccaaagaagcca

SEQ ID NO: 215971 - DNA, 22 bp, Artificial sequence
  SiRNA target sequence
ttgatatttccaaagaagccat

SEQ ID NO: 215972 - DNA, 22 bp, Artificial sequence
  SiRNA target sequence
tgatatttccaaagaagccatt

SEQ ID NO: 215973 - DNA, 22 bp, Artificial sequence
  SiRNA target sequence
gatatttccaaagaagccattt

SEQ ID NO: 215974 - DNA, 22 bp, Artificial sequence
  SiRNA target sequence
atatttccaaagaagccatttc

SEQ ID NO: 215975 - DNA, 22 bp, Artificial sequence
  SiRNA target sequence
tatttccaaagaagccatttca

SEQ ID NO: 215976 - DNA, 22 bp, Artificial sequence
  SiRNA target sequence
atttccaaagaagccatttcaa

SEQ ID NO: 215977 - DNA, 22 bp, Artificial sequence
  SiRNA target sequence
tttccaaagaagccatttcaat

SEQ ID NO: 215978 - DNA, 22 bp, Artificial sequence
  SiRNA target sequence
ttccaaagaagccatttcaatg

SEQ ID NO: 215979 - DNA, 22 bp, Artificial sequence
  SiRNA target sequence
tccaaagaagccatttcaatgc

SEQ ID NO: 215980 - DNA, 22 bp, Artificial sequence
  SiRNA target sequence
ccaaagaagccatttcaatgca

SEQ ID NO: 215981 - DNA, 22 bp, Artificial sequence
  SiRNA target sequence
caaagaagccatttcaatgcag

SEQ ID NO: 215982 - DNA, 22 bp, Artificial sequence
  SiRNA target sequence
aaagaagccatttcaatgcaga

SEQ ID NO: 215983 - DNA, 22 bp, Artificial sequence
  SiRNA target sequence
aagaagccatttcaatgcagat

SEQ ID NO: 215984 - DNA, 22 bp, Artificial sequence
  SiRNA target sequence
agaagccatttcaatgcagatt

SEQ ID NO: 215985 - DNA, 22 bp, Artificial sequence
  SiRNA target sequence
gaagccatttcaatgcagattg

SEQ ID NO: 215986 - DNA, 22 bp, Artificial sequence
  SiRNA target sequence
aagccatttcaatgcagattga

SEQ ID NO: 215987 - DNA, 22 bp, Artificial sequence
  SiRNA target sequence
agccatttcaatgcagattgat

SEQ ID NO: 215988 - DNA, 22 bp, Artificial sequence
  SiRNA target sequence
gccatttcaatgcagattgatt

SEQ ID NO: 215989 - DNA, 22 bp, Artificial sequence
  SiRNA target sequence
ccatttcaatgcagattgattc

SEQ ID NO: 215990 - DNA, 22 bp, Artificial sequence
  SiRNA target sequence
catttcaatgcagattgattcg

SEQ ID NO: 215991 - DNA, 22 bp, Artificial sequence
  SiRNA target sequence
atttcaatgcagattgattcgt

SEQ ID NO: 215992 - DNA, 22 bp, Artificial sequence
  SiRNA target sequence
tttcaatgcagattgattcgtc

SEQ ID NO: 215993 - DNA, 22 bp, Artificial sequence
  SiRNA target sequence
ttcaatgcagattgattcgtca

SEQ ID NO: 215994 - DNA, 22 bp, Artificial sequence
  SiRNA target sequence
tcaatgcagattgattcgtcat

SEQ ID NO: 215995 - DNA, 22 bp, Artificial sequence
  SiRNA target sequence
caatgcagattgattcgtcatt

SEQ ID NO: 215996 - DNA, 22 bp, Artificial sequence
  SiRNA target sequence
aatgcagattgattcgtcattg

SEQ ID NO: 215997 - DNA, 22 bp, Artificial sequence
  SiRNA target sequence
atgcagattgattcgtcattgc

SEQ ID NO: 215998 - DNA, 22 bp, Artificial sequence
  SiRNA target sequence
tgcagattgattcgtcattgcg

SEQ ID NO: 215999 - DNA, 22 bp, Artificial sequence
  SiRNA target sequence
gcagattgattcgtcattgcgt

SEQ ID NO: 216000 - DNA, 22 bp, Artificial sequence
  SiRNA target sequence
cagattgattcgtcattgcgtg

SEQ ID NO: 216001 - DNA, 22 bp, Artificial sequence
  SiRNA target sequence
agattgattcgtcattgcgtgc

SEQ ID NO: 216002 - DNA, 22 bp, Artificial sequence
  SiRNA target sequence
gattgattcgtcattgcgtgca

SEQ ID NO: 216003 - DNA, 22 bp, Artificial sequence
  SiRNA target sequence
attgattcgtcattgcgtgcac

SEQ ID NO: 216004 - DNA, 22 bp, Artificial sequence
  SiRNA target sequence
ttgattcgtcattgcgtgcacg

SEQ ID NO: 216005 - DNA, 22 bp, Artificial sequence
  SiRNA target sequence
tgattcgtcattgcgtgcacgt

SEQ ID NO: 216006 - DNA, 22 bp, Artificial sequence
  SiRNA target sequence
gattcgtcattgcgtgcacgtt

SEQ ID NO: 216007 - DNA, 22 bp, Artificial sequence
  SiRNA target sequence
attcgtcattgcgtgcacgtta

SEQ ID NO: 216008 - DNA, 22 bp, Artificial sequence
  SiRNA target sequence
ttcgtcattgcgtgcacgttat

SEQ ID NO: 216009 - DNA, 22 bp, Artificial sequence
  SiRNA target sequence
tcgtcattgcgtgcacgttata

SEQ ID NO: 216010 - DNA, 22 bp, Artificial sequence
  SiRNA target sequence
cgtcattgcgtgcacgttataa

SEQ ID NO: 216011 - DNA, 22 bp, Artificial sequence
  SiRNA target sequence
gtcattgcgtgcacgttataaa

SEQ ID NO: 216012 - DNA, 22 bp, Artificial sequence
  SiRNA target sequence
tcattgcgtgcacgttataaag

SEQ ID NO: 216013 - DNA, 22 bp, Artificial sequence
  SiRNA target sequence
cattgcgtgcacgttataaagg

SEQ ID NO: 216014 - DNA, 22 bp, Artificial sequence
  SiRNA target sequence
attgcgtgcacgttataaagga

SEQ ID NO: 216015 - DNA, 22 bp, Artificial sequence
  SiRNA target sequence
ttgcgtgcacgttataaaggaa

SEQ ID NO: 216016 - DNA, 22 bp, Artificial sequence
  SiRNA target sequence
tgcgtgcacgttataaaggaat

SEQ ID NO: 216017 - DNA, 22 bp, Artificial sequence
  SiRNA target sequence
gcgtgcacgttataaaggaatt

SEQ ID NO: 216018 - DNA, 22 bp, Artificial sequence
  SiRNA target sequence
cgtgcacgttataaaggaattt

SEQ ID NO: 216019 - DNA, 22 bp, Artificial sequence
  SiRNA target sequence
gtgcacgttataaaggaatttt

SEQ ID NO: 216020 - DNA, 22 bp, Artificial sequence
  SiRNA target sequence
tgcacgttataaaggaattttt

SEQ ID NO: 216021 - DNA, 22 bp, Artificial sequence
  SiRNA target sequence
gcacgttataaaggaatttttg

SEQ ID NO: 216022 - DNA, 22 bp, Artificial sequence
  SiRNA target sequence
cacgttataaaggaatttttga

SEQ ID NO: 216023 - DNA, 22 bp, Artificial sequence
  SiRNA target sequence
acgttataaaggaatttttgac

SEQ ID NO: 216024 - DNA, 22 bp, Artificial sequence
  SiRNA target sequence
cgttataaaggaatttttgacg

SEQ ID NO: 216025 - DNA, 22 bp, Artificial sequence
  SiRNA target sequence
gttataaaggaatttttgacgg

SEQ ID NO: 216026 - DNA, 22 bp, Artificial sequence
  SiRNA target sequence
ttataaaggaatttttgacggt

SEQ ID NO: 216027 - DNA, 22 bp, Artificial sequence
  SiRNA target sequence
tataaaggaatttttgacggtg

SEQ ID NO: 216028 - DNA, 22 bp, Artificial sequence
  SiRNA target sequence
ataaaggaatttttgacggtgt

SEQ ID NO: 216029 - DNA, 22 bp, Artificial sequence
  SiRNA target sequence
taaaggaatttttgacggtgtt

SEQ ID NO: 216030 - DNA, 22 bp, Artificial sequence
  SiRNA target sequence
aaaggaatttttgacggtgttt

SEQ ID NO: 216031 - DNA, 22 bp, Artificial sequence
  SiRNA target sequence
aaggaatttttgacggtgtttt

SEQ ID NO: 216032 - DNA, 22 bp, Artificial sequence
  SiRNA target sequence
aggaatttttgacggtgttttt

SEQ ID NO: 216033 - DNA, 22 bp, Artificial sequence
  SiRNA target sequence
ggaatttttgacggtgtttttg

SEQ ID NO: 216034 - DNA, 22 bp, Artificial sequence
  SiRNA target sequence
gaatttttgacggtgtttttgg

SEQ ID NO: 216035 - DNA, 22 bp, Artificial sequence
  SiRNA target sequence
aatttttgacggtgtttttggt

SEQ ID NO: 216036 - DNA, 22 bp, Artificial sequence
  SiRNA target sequence
atttttgacggtgtttttggta

SEQ ID NO: 216037 - DNA, 22 bp, Artificial sequence
  SiRNA target sequence
tttttgacggtgtttttggtaa

SEQ ID NO: 216038 - DNA, 22 bp, Artificial sequence
  SiRNA target sequence
ttttgacggtgtttttggtaag

SEQ ID NO: 216039 - DNA, 22 bp, Artificial sequence
  SiRNA target sequence
tttgacggtgtttttggtaagt

SEQ ID NO: 216040 - DNA, 22 bp, Artificial sequence
  SiRNA target sequence
ttgacggtgtttttggtaagtt

SEQ ID NO: 216041 - DNA, 22 bp, Artificial sequence
  SiRNA target sequence
tgacggtgtttttggtaagtta

SEQ ID NO: 216042 - DNA, 22 bp, Artificial sequence
  SiRNA target sequence
gacggtgtttttggtaagttag

SEQ ID NO: 216043 - DNA, 22 bp, Artificial sequence
  SiRNA target sequence
acggtgtttttggtaagttagg

SEQ ID NO: 216044 - DNA, 22 bp, Artificial sequence
  SiRNA target sequence
cggtgtttttggtaagttagga

SEQ ID NO: 216045 - DNA, 22 bp, Artificial sequence
  SiRNA target sequence
ggtgtttttggtaagttaggaa

SEQ ID NO: 216046 - DNA, 22 bp, Artificial sequence
  SiRNA target sequence
gtgtttttggtaagttaggaaa

SEQ ID NO: 216047 - DNA, 22 bp, Artificial sequence
  SiRNA target sequence
tgtttttggtaagttaggaaaa

SEQ ID NO: 216048 - DNA, 22 bp, Artificial sequence
  SiRNA target sequence
gtttttggtaagttaggaaaat

SEQ ID NO: 216049 - DNA, 22 bp, Artificial sequence
  SiRNA target sequence
tttttggtaagttaggaaaatc

SEQ ID NO: 216050 - DNA, 22 bp, Artificial sequence
  SiRNA target sequence
ttttggtaagttaggaaaatct

SEQ ID NO: 216051 - DNA, 22 bp, Artificial sequence
  SiRNA target sequence
tttggtaagttaggaaaatctc

SEQ ID NO: 216052 - DNA, 22 bp, Artificial sequence
  SiRNA target sequence
ttggtaagttaggaaaatctct

SEQ ID NO: 216053 - DNA, 22 bp, Artificial sequence
  SiRNA target sequence
tggtaagttaggaaaatctctt

SEQ ID NO: 216054 - DNA, 22 bp, Artificial sequence
  SiRNA target sequence
ggtaagttaggaaaatctcttg

SEQ ID NO: 216055 - DNA, 22 bp, Artificial sequence
  SiRNA target sequence
gtaagttaggaaaatctcttgg

SEQ ID NO: 216056 - DNA, 22 bp, Artificial sequence
  SiRNA target sequence
taagttaggaaaatctcttgga

SEQ ID NO: 216057 - DNA, 22 bp, Artificial sequence
  SiRNA target sequence
aagttaggaaaatctcttggat

SEQ ID NO: 216058 - DNA, 22 bp, Artificial sequence
  SiRNA target sequence
agttaggaaaatctcttggatc

SEQ ID NO: 216059 - DNA, 22 bp, Artificial sequence
  SiRNA target sequence
gttaggaaaatctcttggatcg

SEQ ID NO: 216060 - DNA, 22 bp, Artificial sequence
  SiRNA target sequence
ttaggaaaatctcttggatcgt

SEQ ID NO: 216061 - DNA, 22 bp, Artificial sequence
  SiRNA target sequence
taggaaaatctcttggatcgtt

SEQ ID NO: 216062 - DNA, 22 bp, Artificial sequence
  SiRNA target sequence
aggaaaatctcttggatcgtta

SEQ ID NO: 216063 - DNA, 22 bp, Artificial sequence
  SiRNA target sequence
ggaaaatctcttggatcgttat

SEQ ID NO: 216064 - DNA, 22 bp, Artificial sequence
  SiRNA target sequence
gaaaatctcttggatcgttatt

SEQ ID NO: 216065 - DNA, 22 bp, Artificial sequence
  SiRNA target sequence
aaaatctcttggatcgttattt

SEQ ID NO: 216066 - DNA, 22 bp, Artificial sequence
  SiRNA target sequence
aaatctcttggatcgttatttg

SEQ ID NO: 216067 - DNA, 22 bp, Artificial sequence
  SiRNA target sequence
aatctcttggatcgttatttgt

SEQ ID NO: 216068 - DNA, 22 bp, Artificial sequence
  SiRNA target sequence
atctcttggatcgttatttgtg

SEQ ID NO: 216069 - DNA, 22 bp, Artificial sequence
  SiRNA target sequence
tctcttggatcgttatttgtgt

SEQ ID NO: 216070 - DNA, 22 bp, Artificial sequence
  SiRNA target sequence
ctcttggatcgttatttgtgtg

SEQ ID NO: 216071 - DNA, 22 bp, Artificial sequence
  SiRNA target sequence
tcttggatcgttatttgtgtgg

SEQ ID NO: 216072 - DNA, 22 bp, Artificial sequence
  SiRNA target sequence
cttggatcgttatttgtgtgga

SEQ ID NO: 216073 - DNA, 22 bp, Artificial sequence
  SiRNA target sequence
ttggatcgttatttgtgtggat

SEQ ID NO: 216074 - DNA, 22 bp, Artificial sequence
  SiRNA target sequence
tggatcgttatttgtgtggatt

SEQ ID NO: 216075 - DNA, 22 bp, Artificial sequence
  SiRNA target sequence
ggatcgttatttgtgtggatta

SEQ ID NO: 216076 - DNA, 22 bp, Artificial sequence
  SiRNA target sequence
gatcgttatttgtgtggattat

SEQ ID NO: 216077 - DNA, 22 bp, Artificial sequence
  SiRNA target sequence
atcgttatttgtgtggattatg

SEQ ID NO: 216078 - DNA, 22 bp, Artificial sequence
  SiRNA target sequence
tcgttatttgtgtggattatgg

SEQ ID NO: 216079 - DNA, 22 bp, Artificial sequence
  SiRNA target sequence
cgttatttgtgtggattatggg

SEQ ID NO: 216080 - DNA, 22 bp, Artificial sequence
  SiRNA target sequence
gttatttgtgtggattatggga

SEQ ID NO: 216081 - DNA, 22 bp, Artificial sequence
  SiRNA target sequence
ttatttgtgtggattatgggat

SEQ ID NO: 216082 - DNA, 22 bp, Artificial sequence
  SiRNA target sequence
tatttgtgtggattatgggata

SEQ ID NO: 216083 - DNA, 22 bp, Artificial sequence
  SiRNA target sequence
atttgtgtggattatgggatat

SEQ ID NO: 216084 - DNA, 22 bp, Artificial sequence
  SiRNA target sequence
tttgtgtggattatgggatatg

SEQ ID NO: 216085 - DNA, 22 bp, Artificial sequence
  SiRNA target sequence
ttgtgtggattatgggatatgc

SEQ ID NO: 216086 - DNA, 22 bp, Artificial sequence
  SiRNA target sequence
tgtgtggattatgggatatgca

SEQ ID NO: 216087 - DNA, 22 bp, Artificial sequence
  SiRNA target sequence
gtgtggattatgggatatgcat

SEQ ID NO: 216088 - DNA, 22 bp, Artificial sequence
  SiRNA target sequence
tgtggattatgggatatgcatt

SEQ ID NO: 216089 - DNA, 22 bp, Artificial sequence
  SiRNA target sequence
gtggattatgggatatgcattt

SEQ ID NO: 216090 - DNA, 22 bp, Artificial sequence
  SiRNA target sequence
tggattatgggatatgcatttc

SEQ ID NO: 216091 - DNA, 22 bp, Artificial sequence
  SiRNA target sequence
ggattatgggatatgcatttca

SEQ ID NO: 216092 - DNA, 22 bp, Artificial sequence
  SiRNA target sequence
gattatgggatatgcatttcaa

SEQ ID NO: 216093 - DNA, 22 bp, Artificial sequence
  SiRNA target sequence
attatgggatatgcatttcaaa

SEQ ID NO: 216094 - DNA, 22 bp, Artificial sequence
  SiRNA target sequence
ttatgggatatgcatttcaaac

SEQ ID NO: 216095 - DNA, 22 bp, Artificial sequence
  SiRNA target sequence
tatgggatatgcatttcaaaca

SEQ ID NO: 216096 - DNA, 22 bp, Artificial sequence
  SiRNA target sequence
atgggatatgcatttcaaacaa

SEQ ID NO: 216097 - DNA, 22 bp, Artificial sequence
  SiRNA target sequence
tgggatatgcatttcaaacaag

SEQ ID NO: 216098 - DNA, 22 bp, Artificial sequence
  SiRNA target sequence
gggatatgcatttcaaacaaga

SEQ ID NO: 216099 - DNA, 22 bp, Artificial sequence
  SiRNA target sequence
ggatatgcatttcaaacaagag

SEQ ID NO: 216100 - DNA, 22 bp, Artificial sequence
  SiRNA target sequence
gatatgcatttcaaacaagaga

SEQ ID NO: 216101 - DNA, 22 bp, Artificial sequence
  SiRNA target sequence
atatgcatttcaaacaagagat

SEQ ID NO: 216102 - DNA, 22 bp, Artificial sequence
  SiRNA target sequence
tatgcatttcaaacaagagatt

SEQ ID NO: 216103 - DNA, 22 bp, Artificial sequence
  SiRNA target sequence
atgcatttcaaacaagagattt

SEQ ID NO: 216104 - DNA, 22 bp, Artificial sequence
  SiRNA target sequence
tgcatttcaaacaagagatttt

SEQ ID NO: 216105 - DNA, 22 bp, Artificial sequence
  SiRNA target sequence
gcatttcaaacaagagatttta

SEQ ID NO: 216106 - DNA, 22 bp, Artificial sequence
  SiRNA target sequence
catttcaaacaagagattttag

SEQ ID NO: 216107 - DNA, 22 bp, Artificial sequence
  SiRNA target sequence
atttcaaacaagagattttaga

SEQ ID NO: 216108 - DNA, 22 bp, Artificial sequence
  SiRNA target sequence
tttcaaacaagagattttagaa

SEQ ID NO: 216109 - DNA, 22 bp, Artificial sequence
  SiRNA target sequence
ttcaaacaagagattttagaaa

SEQ ID NO: 216110 - DNA, 22 bp, Artificial sequence
  SiRNA target sequence
tcaaacaagagattttagaaaa

SEQ ID NO: 216111 - DNA, 22 bp, Artificial sequence
  SiRNA target sequence
caaacaagagattttagaaaat

SEQ ID NO: 216112 - DNA, 22 bp, Artificial sequence
  SiRNA target sequence
aaacaagagattttagaaaatt

SEQ ID NO: 216113 - DNA, 22 bp, Artificial sequence
  SiRNA target sequence
aacaagagattttagaaaatta

SEQ ID NO: 216114 - DNA, 22 bp, Artificial sequence
  SiRNA target sequence
acaagagattttagaaaattag

SEQ ID NO: 216115 - DNA, 22 bp, Artificial sequence
  SiRNA target sequence
caagagattttagaaaattagc

SEQ ID NO: 216116 - DNA, 22 bp, Artificial sequence
  SiRNA target sequence
aagagattttagaaaattagct

SEQ ID NO: 216117 - DNA, 22 bp, Artificial sequence
  SiRNA target sequence
agagattttagaaaattagctc

SEQ ID NO: 216118 - DNA, 22 bp, Artificial sequence
  SiRNA target sequence
gagattttagaaaattagctcc

SEQ ID NO: 216119 - DNA, 22 bp, Artificial sequence
  SiRNA target sequence
agattttagaaaattagctccc

SEQ ID NO: 216120 - DNA, 22 bp, Artificial sequence
  SiRNA target sequence
gattttagaaaattagctccct

SEQ ID NO: 216121 - DNA, 22 bp, Artificial sequence
  SiRNA target sequence
attttagaaaattagctccctt

SEQ ID NO: 216122 - DNA, 22 bp, Artificial sequence
  SiRNA target sequence
ttttagaaaattagctccctta

SEQ ID NO: 216123 - DNA, 22 bp, Artificial sequence
  SiRNA target sequence
tttagaaaattagctcccttat

SEQ ID NO: 216124 - DNA, 22 bp, Artificial sequence
  SiRNA target sequence
ttagaaaattagctcccttatg

SEQ ID NO: 216125 - DNA, 22 bp, Artificial sequence
  SiRNA target sequence
tagaaaattagctcccttatgt

SEQ ID NO: 216126 - DNA, 22 bp, Artificial sequence
  SiRNA target sequence
agaaaattagctcccttatgta

SEQ ID NO: 216127 - DNA, 22 bp, Artificial sequence
  SiRNA target sequence
gaaaattagctcccttatgtat

SEQ ID NO: 216128 - DNA, 22 bp, Artificial sequence
  SiRNA target sequence
aaaattagctcccttatgtatc

SEQ ID NO: 216129 - DNA, 22 bp, Artificial sequence
  SiRNA target sequence
aaattagctcccttatgtatca

SEQ ID NO: 216130 - DNA, 22 bp, Artificial sequence
  SiRNA target sequence
aattagctcccttatgtatcag

SEQ ID NO: 216131 - DNA, 22 bp, Artificial sequence
  SiRNA target sequence
attagctcccttatgtatcagc

SEQ ID NO: 216132 - DNA, 22 bp, Artificial sequence
  SiRNA target sequence
ttagctcccttatgtatcagcg

SEQ ID NO: 216133 - DNA, 22 bp, Artificial sequence
  SiRNA target sequence
tagctcccttatgtatcagcgt

SEQ ID NO: 216134 - DNA, 22 bp, Artificial sequence
  SiRNA target sequence
agctcccttatgtatcagcgta

SEQ ID NO: 216135 - DNA, 22 bp, Artificial sequence
  SiRNA target sequence
gctcccttatgtatcagcgtaa

SEQ ID NO: 216136 - DNA, 22 bp, Artificial sequence
  SiRNA target sequence
ctcccttatgtatcagcgtaat

SEQ ID NO: 216137 - DNA, 22 bp, Artificial sequence
  SiRNA target sequence
tcccttatgtatcagcgtaatt

SEQ ID NO: 216138 - DNA, 22 bp, Artificial sequence
  SiRNA target sequence
cccttatgtatcagcgtaattg

SEQ ID NO: 216139 - DNA, 22 bp, Artificial sequence
  SiRNA target sequence
ccttatgtatcagcgtaattgt

SEQ ID NO: 216140 - DNA, 22 bp, Artificial sequence
  SiRNA target sequence
cttatgtatcagcgtaattgtc

SEQ ID NO: 216141 - DNA, 22 bp, Artificial sequence
  SiRNA target sequence
ttatgtatcagcgtaattgtct

SEQ ID NO: 216142 - DNA, 22 bp, Artificial sequence
  SiRNA target sequence
tatgtatcagcgtaattgtctt

SEQ ID NO: 216143 - DNA, 22 bp, Artificial sequence
  SiRNA target sequence
atgtatcagcgtaattgtcttt

SEQ ID NO: 216144 - DNA, 22 bp, Artificial sequence
  SiRNA target sequence
tgtatcagcgtaattgtctttt

SEQ ID NO: 216145 - DNA, 22 bp, Artificial sequence
  SiRNA target sequence
gtatcagcgtaattgtcttttt

SEQ ID NO: 216146 - DNA, 22 bp, Artificial sequence
  SiRNA target sequence
tatcagcgtaattgtctttttt

SEQ ID NO: 216147 - DNA, 22 bp, Artificial sequence
  SiRNA target sequence
atcagcgtaattgtcttttttg

SEQ ID NO: 216148 - DNA, 22 bp, Artificial sequence
  SiRNA target sequence
tcagcgtaattgtcttttttgt

SEQ ID NO: 216149 - DNA, 22 bp, Artificial sequence
  SiRNA target sequence
cagcgtaattgtcttttttgtt

SEQ ID NO: 216150 - DNA, 22 bp, Artificial sequence
  SiRNA target sequence
agcgtaattgtcttttttgtta

SEQ ID NO: 216151 - DNA, 22 bp, Artificial sequence
  SiRNA target sequence
gcgtaattgtcttttttgttat

SEQ ID NO: 216152 - DNA, 22 bp, Artificial sequence
  SiRNA target sequence
cgtaattgtcttttttgttatt

SEQ ID NO: 216153 - DNA, 22 bp, Artificial sequence
  SiRNA target sequence
gtaattgtcttttttgttatta

SEQ ID NO: 216154 - DNA, 22 bp, Artificial sequence
  SiRNA target sequence
taattgtcttttttgttattat

SEQ ID NO: 216155 - DNA, 22 bp, Artificial sequence
  SiRNA target sequence
aattgtcttttttgttattatt

SEQ ID NO: 216156 - DNA, 22 bp, Artificial sequence
  SiRNA target sequence
attgtcttttttgttattattt

SEQ ID NO: 216157 - DNA, 22 bp, Artificial sequence
  SiRNA target sequence
ttgtcttttttgttattatttg

SEQ ID NO: 216158 - DNA, 22 bp, Artificial sequence
  SiRNA target sequence
tgtcttttttgttattatttgg

SEQ ID NO: 216159 - DNA, 22 bp, Artificial sequence
  SiRNA target sequence
gtcttttttgttattatttgga

SEQ ID NO: 216160 - DNA, 22 bp, Artificial sequence
  SiRNA target sequence
tcttttttgttattatttggat

SEQ ID NO: 216161 - DNA, 22 bp, Artificial sequence
  SiRNA target sequence
cttttttgttattatttggatt

SEQ ID NO: 216162 - DNA, 22 bp, Artificial sequence
  SiRNA target sequence
ttttttgttattatttggattt

SEQ ID NO: 216163 - DNA, 22 bp, Artificial sequence
  SiRNA target sequence
tttttgttattatttggattta

SEQ ID NO: 216164 - DNA, 22 bp, Artificial sequence
  SiRNA target sequence
ttttgttattatttggatttat

SEQ ID NO: 216165 - DNA, 22 bp, Artificial sequence
  SiRNA target sequence
tttgttattatttggatttatt

SEQ ID NO: 216166 - DNA, 22 bp, Artificial sequence
  SiRNA target sequence
ttgttattatttggatttattc

SEQ ID NO: 216167 - DNA, 22 bp, Artificial sequence
  SiRNA target sequence
tgttattatttggatttattca

SEQ ID NO: 216168 - DNA, 22 bp, Artificial sequence
  SiRNA target sequence
gttattatttggatttattcag

SEQ ID NO: 216169 - DNA, 22 bp, Artificial sequence
  SiRNA target sequence
ttattatttggatttattcagt

SEQ ID NO: 216170 - DNA, 22 bp, Artificial sequence
  SiRNA target sequence
tattatttggatttattcagtt

SEQ ID NO: 216171 - DNA, 22 bp, Artificial sequence
  SiRNA target sequence
attatttggatttattcagtta

SEQ ID NO: 216172 - DNA, 22 bp, Artificial sequence
  SiRNA target sequence
ttatttggatttattcagttat

SEQ ID NO: 216173 - DNA, 22 bp, Artificial sequence
  SiRNA target sequence
tatttggatttattcagttatt

SEQ ID NO: 216174 - DNA, 22 bp, Artificial sequence
  SiRNA target sequence
atttggatttattcagttattt

SEQ ID NO: 216175 - DNA, 22 bp, Artificial sequence
  SiRNA target sequence
tttggatttattcagttattta

SEQ ID NO: 216176 - DNA, 22 bp, Artificial sequence
  SiRNA target sequence
ttggatttattcagttatttat

SEQ ID NO: 216177 - DNA, 22 bp, Artificial sequence
  SiRNA target sequence
tggatttattcagttatttatt

SEQ ID NO: 216178 - DNA, 22 bp, Artificial sequence
  SiRNA target sequence
ggatttattcagttatttattt

SEQ ID NO: 216179 - DNA, 22 bp, Artificial sequence
  SiRNA target sequence
gatttattcagttatttattta

SEQ ID NO: 216180 - DNA, 22 bp, Artificial sequence
  SiRNA target sequence
atttattcagttatttatttaa

SEQ ID NO: 216181 - DNA, 22 bp, Artificial sequence
  SiRNA target sequence
tttattcagttatttatttaaa

SEQ ID NO: 216182 - DNA, 22 bp, Artificial sequence
  SiRNA target sequence
ttattcagttatttatttaaat

SEQ ID NO: 216183 - DNA, 22 bp, Artificial sequence
  SiRNA target sequence
tattcagttatttatttaaata

SEQ ID NO: 216184 - DNA, 22 bp, Artificial sequence
  SiRNA target sequence
attcagttatttatttaaataa

SEQ ID NO: 216185 - DNA, 22 bp, Artificial sequence
  SiRNA target sequence
ttcagttatttatttaaataag

SEQ ID NO: 216186 - DNA, 22 bp, Artificial sequence
  SiRNA target sequence
tcagttatttatttaaataaga

SEQ ID NO: 216187 - DNA, 22 bp, Artificial sequence
  SiRNA target sequence
cagttatttatttaaataagaa

SEQ ID NO: 216188 - DNA, 22 bp, Artificial sequence
  SiRNA target sequence
agttatttatttaaataagaaa

SEQ ID NO: 216189 - DNA, 22 bp, Artificial sequence
  SiRNA target sequence
gttatttatttaaataagaaat

SEQ ID NO: 216190 - DNA, 22 bp, Artificial sequence
  SiRNA target sequence
ttatttatttaaataagaaata

SEQ ID NO: 216191 - DNA, 22 bp, Artificial sequence
  SiRNA target sequence
tatttatttaaataagaaatac

SEQ ID NO: 216192 - DNA, 22 bp, Artificial sequence
  SiRNA target sequence
atttatttaaataagaaataca

SEQ ID NO: 216193 - DNA, 22 bp, Artificial sequence
  SiRNA target sequence
tttatttaaataagaaatacaa

SEQ ID NO: 216194 - DNA, 22 bp, Artificial sequence
  SiRNA target sequence
ttatttaaataagaaatacaaa

SEQ ID NO: 216195 - DNA, 22 bp, Artificial sequence
  SiRNA target sequence
tatttaaataagaaatacaaag

SEQ ID NO: 216196 - DNA, 22 bp, Artificial sequence
  SiRNA target sequence
atttaaataagaaatacaaaga

SEQ ID NO: 216197 - DNA, 22 bp, Artificial sequence
  SiRNA target sequence
tttaaataagaaatacaaagaa

SEQ ID NO: 216198 - DNA, 22 bp, Artificial sequence
  SiRNA target sequence
ttaaataagaaatacaaagaat

SEQ ID NO: 216199 - DNA, 22 bp, Artificial sequence
  SiRNA target sequence
taaataagaaatacaaagaatc

SEQ ID NO: 216200 - DNA, 22 bp, Artificial sequence
  SiRNA target sequence
aaataagaaatacaaagaatca

SEQ ID NO: 216201 - DNA, 22 bp, Artificial sequence
  SiRNA target sequence
aataagaaatacaaagaatcag

SEQ ID NO: 216202 - DNA, 22 bp, Artificial sequence
  SiRNA target sequence
ataagaaatacaaagaatcagt

SEQ ID NO: 216203 - DNA, 22 bp, Artificial sequence
  SiRNA target sequence
taagaaatacaaagaatcagtt

SEQ ID NO: 216204 - DNA, 22 bp, Artificial sequence
  SiRNA target sequence
aagaaatacaaagaatcagttg

SEQ ID NO: 216205 - DNA, 22 bp, Artificial sequence
  SiRNA target sequence
agaaatacaaagaatcagttgt

SEQ ID NO: 216206 - DNA, 22 bp, Artificial sequence
  SiRNA target sequence
gaaatacaaagaatcagttgtt

SEQ ID NO: 216207 - DNA, 22 bp, Artificial sequence
  SiRNA target sequence
aaatacaaagaatcagttgtta

SEQ ID NO: 216208 - DNA, 22 bp, Artificial sequence
  SiRNA target sequence
aatacaaagaatcagttgttag

SEQ ID NO: 216209 - DNA, 22 bp, Artificial sequence
  SiRNA target sequence
atacaaagaatcagttgttagt

SEQ ID NO: 216210 - DNA, 22 bp, Artificial sequence
  SiRNA target sequence
tacaaagaatcagttgttagta

SEQ ID NO: 216211 - DNA, 22 bp, Artificial sequence
  SiRNA target sequence
acaaagaatcagttgttagtaa

SEQ ID NO: 216212 - DNA, 22 bp, Artificial sequence
  SiRNA target sequence
caaagaatcagttgttagtaat

SEQ ID NO: 216213 - DNA, 22 bp, Artificial sequence
  SiRNA target sequence
aaagaatcagttgttagtaatt

SEQ ID NO: 216214 - DNA, 22 bp, Artificial sequence
  SiRNA target sequence
aagaatcagttgttagtaattt

SEQ ID NO: 216215 - DNA, 22 bp, Artificial sequence
  SiRNA target sequence
agaatcagttgttagtaattta

SEQ ID NO: 216216 - DNA, 22 bp, Artificial sequence
  SiRNA target sequence
gaatcagttgttagtaatttac

SEQ ID NO: 216217 - DNA, 22 bp, Artificial sequence
  SiRNA target sequence
aatcagttgttagtaatttacc

SEQ ID NO: 216218 - DNA, 22 bp, Artificial sequence
  SiRNA target sequence
atcagttgttagtaatttaccc

SEQ ID NO: 216219 - DNA, 22 bp, Artificial sequence
  SiRNA target sequence
tcagttgttagtaatttaccca

SEQ ID NO: 216220 - DNA, 22 bp, Artificial sequence
  SiRNA target sequence
cagttgttagtaatttacccat

SEQ ID NO: 216221 - DNA, 22 bp, Artificial sequence
  SiRNA target sequence
agttgttagtaatttacccatc

SEQ ID NO: 216222 - DNA, 22 bp, Artificial sequence
  SiRNA target sequence
gttgttagtaatttacccatcg

SEQ ID NO: 216223 - DNA, 22 bp, Artificial sequence
  SiRNA target sequence
ttgttagtaatttacccatcga

SEQ ID NO: 216224 - DNA, 22 bp, Artificial sequence
  SiRNA target sequence
tgttagtaatttacccatcgat

SEQ ID NO: 216225 - DNA, 22 bp, Artificial sequence
  SiRNA target sequence
gttagtaatttacccatcgatg

SEQ ID NO: 216226 - DNA, 22 bp, Artificial sequence
  SiRNA target sequence
ttagtaatttacccatcgatgt

SEQ ID NO: 216227 - DNA, 22 bp, Artificial sequence
  SiRNA target sequence
tagtaatttacccatcgatgtt

SEQ ID NO: 216228 - DNA, 22 bp, Artificial sequence
  SiRNA target sequence
agtaatttacccatcgatgttg

SEQ ID NO: 216229 - DNA, 22 bp, Artificial sequence
  SiRNA target sequence
gtaatttacccatcgatgttga

SEQ ID NO: 216230 - DNA, 22 bp, Artificial sequence
  SiRNA target sequence
taatttacccatcgatgttgat

SEQ ID NO: 216231 - DNA, 22 bp, Artificial sequence
  SiRNA target sequence
aatttacccatcgatgttgatt

SEQ ID NO: 216232 - DNA, 22 bp, Artificial sequence
  SiRNA target sequence
atttacccatcgatgttgattt

SEQ ID NO: 216233 - DNA, 22 bp, Artificial sequence
  SiRNA target sequence
tttacccatcgatgttgatttg

SEQ ID NO: 216234 - DNA, 22 bp, Artificial sequence
  SiRNA target sequence
ttacccatcgatgttgatttgt

SEQ ID NO: 216235 - DNA, 22 bp, Artificial sequence
  SiRNA target sequence
tacccatcgatgttgatttgtt

SEQ ID NO: 216236 - DNA, 22 bp, Artificial sequence
  SiRNA target sequence
acccatcgatgttgatttgttt

SEQ ID NO: 216237 - DNA, 22 bp, Artificial sequence
  SiRNA target sequence
cccatcgatgttgatttgtttg

SEQ ID NO: 216238 - DNA, 22 bp, Artificial sequence
  SiRNA target sequence
ccatcgatgttgatttgtttgc

SEQ ID NO: 216239 - DNA, 22 bp, Artificial sequence
  SiRNA target sequence
catcgatgttgatttgtttgca

SEQ ID NO: 216240 - DNA, 22 bp, Artificial sequence
  SiRNA target sequence
atcgatgttgatttgtttgcat

SEQ ID NO: 216241 - DNA, 22 bp, Artificial sequence
  SiRNA target sequence
tcgatgttgatttgtttgcatc

SEQ ID NO: 216242 - DNA, 22 bp, Artificial sequence
  SiRNA target sequence
cgatgttgatttgtttgcatca

SEQ ID NO: 216243 - DNA, 22 bp, Artificial sequence
  SiRNA target sequence
gatgttgatttgtttgcatcaa

SEQ ID NO: 216244 - DNA, 22 bp, Artificial sequence
  SiRNA target sequence
atgttgatttgtttgcatcaaa

SEQ ID NO: 216245 - DNA, 22 bp, Artificial sequence
  SiRNA target sequence
tgttgatttgtttgcatcaaag

SEQ ID NO: 216246 - DNA, 22 bp, Artificial sequence
  SiRNA target sequence
gttgatttgtttgcatcaaagt

SEQ ID NO: 216247 - DNA, 22 bp, Artificial sequence
  SiRNA target sequence
ttgatttgtttgcatcaaagtt

SEQ ID NO: 216248 - DNA, 22 bp, Artificial sequence
  SiRNA target sequence
tgatttgtttgcatcaaagttg

SEQ ID NO: 216249 - DNA, 22 bp, Artificial sequence
  SiRNA target sequence
gatttgtttgcatcaaagttgt

SEQ ID NO: 216250 - DNA, 22 bp, Artificial sequence
  SiRNA target sequence
atttgtttgcatcaaagttgtt

SEQ ID NO: 216251 - DNA, 22 bp, Artificial sequence
  SiRNA target sequence
tttgtttgcatcaaagttgtta

SEQ ID NO: 216252 - DNA, 22 bp, Artificial sequence
  SiRNA target sequence
ttgtttgcatcaaagttgttag

SEQ ID NO: 216253 - DNA, 22 bp, Artificial sequence
  SiRNA target sequence
tgtttgcatcaaagttgttaga

SEQ ID NO: 216254 - DNA, 22 bp, Artificial sequence
  SiRNA target sequence
gtttgcatcaaagttgttagat

SEQ ID NO: 216255 - DNA, 22 bp, Artificial sequence
  SiRNA target sequence
tttgcatcaaagttgttagata

SEQ ID NO: 216256 - DNA, 22 bp, Artificial sequence
  SiRNA target sequence
ttgcatcaaagttgttagataa

SEQ ID NO: 216257 - DNA, 22 bp, Artificial sequence
  SiRNA target sequence
tgcatcaaagttgttagataat

SEQ ID NO: 216258 - DNA, 22 bp, Artificial sequence
  SiRNA target sequence
gcatcaaagttgttagataata

SEQ ID NO: 216259 - DNA, 22 bp, Artificial sequence
  SiRNA target sequence
catcaaagttgttagataataa

SEQ ID NO: 216260 - DNA, 22 bp, Artificial sequence
  SiRNA target sequence
atcaaagttgttagataataaa

SEQ ID NO: 216261 - DNA, 22 bp, Artificial sequence
  SiRNA target sequence
tcaaagttgttagataataaaa

SEQ ID NO: 216262 - DNA, 22 bp, Artificial sequence
  SiRNA target sequence
caaagttgttagataataaaaa

SEQ ID NO: 216263 - DNA, 22 bp, Artificial sequence
  SiRNA target sequence
aaagttgttagataataaaaaa

SEQ ID NO: 216264 - DNA, 22 bp, Artificial sequence
  SiRNA target sequence
aagttgttagataataaaaaag

SEQ ID NO: 216265 - DNA, 22 bp, Artificial sequence
  SiRNA target sequence
agttgttagataataaaaaaga

SEQ ID NO: 216266 - DNA, 22 bp, Artificial sequence
  SiRNA target sequence
gttgttagataataaaaaagaa

SEQ ID NO: 216267 - DNA, 22 bp, Artificial sequence
  SiRNA target sequence
ttgttagataataaaaaagaag

SEQ ID NO: 216268 - DNA, 22 bp, Artificial sequence
  SiRNA target sequence
tgttagataataaaaaagaaga

SEQ ID NO: 216269 - DNA, 22 bp, Artificial sequence
  SiRNA target sequence
gttagataataaaaaagaagag

SEQ ID NO: 216270 - DNA, 22 bp, Artificial sequence
  SiRNA target sequence
ttagataataaaaaagaagagg

SEQ ID NO: 216271 - DNA, 22 bp, Artificial sequence
  SiRNA target sequence
tagataataaaaaagaagagga

SEQ ID NO: 216272 - DNA, 22 bp, Artificial sequence
  SiRNA target sequence
agataataaaaaagaagaggaa

SEQ ID NO: 216273 - DNA, 22 bp, Artificial sequence
  SiRNA target sequence
gataataaaaaagaagaggaaa

SEQ ID NO: 216274 - DNA, 22 bp, Artificial sequence
  SiRNA target sequence
ataataaaaaagaagaggaaat

SEQ ID NO: 216275 - DNA, 22 bp, Artificial sequence
  SiRNA target sequence
taataaaaaagaagaggaaatt

SEQ ID NO: 216276 - DNA, 22 bp, Artificial sequence
  SiRNA target sequence
aataaaaaagaagaggaaattg

SEQ ID NO: 216277 - DNA, 22 bp, Artificial sequence
  SiRNA target sequence
ataaaaaagaagaggaaattga

SEQ ID NO: 216278 - DNA, 22 bp, Artificial sequence
  SiRNA target sequence
taaaaaagaagaggaaattgat

SEQ ID NO: 216279 - DNA, 22 bp, Artificial sequence
  SiRNA target sequence
aaaaaagaagaggaaattgatg

SEQ ID NO: 216280 - DNA, 22 bp, Artificial sequence
  SiRNA target sequence
aaaaagaagaggaaattgatgt

SEQ ID NO: 216281 - DNA, 22 bp, Artificial sequence
  SiRNA target sequence
aaaagaagaggaaattgatgtg

SEQ ID NO: 216282 - DNA, 22 bp, Artificial sequence
  SiRNA target sequence
aaagaagaggaaattgatgtgt

SEQ ID NO: 216283 - DNA, 22 bp, Artificial sequence
  SiRNA target sequence
aagaagaggaaattgatgtgtc

SEQ ID NO: 216284 - DNA, 22 bp, Artificial sequence
  SiRNA target sequence
agaagaggaaattgatgtgtca

SEQ ID NO: 216285 - DNA, 22 bp, Artificial sequence
  SiRNA target sequence
gaagaggaaattgatgtgtcag

SEQ ID NO: 216286 - DNA, 22 bp, Artificial sequence
  SiRNA target sequence
aagaggaaattgatgtgtcagt

SEQ ID NO: 216287 - DNA, 22 bp, Artificial sequence
  SiRNA target sequence
agaggaaattgatgtgtcagtg

SEQ ID NO: 216288 - DNA, 22 bp, Artificial sequence
  SiRNA target sequence
gaggaaattgatgtgtcagtgc

SEQ ID NO: 216289 - DNA, 22 bp, Artificial sequence
  SiRNA target sequence
aggaaattgatgtgtcagtgct

SEQ ID NO: 216290 - DNA, 22 bp, Artificial sequence
  SiRNA target sequence
ggaaattgatgtgtcagtgctc

SEQ ID NO: 216291 - DNA, 22 bp, Artificial sequence
  SiRNA target sequence
gaaattgatgtgtcagtgctcg

SEQ ID NO: 216292 - DNA, 22 bp, Artificial sequence
  SiRNA target sequence
aaattgatgtgtcagtgctcgt

SEQ ID NO: 216293 - DNA, 22 bp, Artificial sequence
  SiRNA target sequence
aattgatgtgtcagtgctcgtt

SEQ ID NO: 216294 - DNA, 22 bp, Artificial sequence
  SiRNA target sequence
attgatgtgtcagtgctcgtta

SEQ ID NO: 216295 - DNA, 22 bp, Artificial sequence
  SiRNA target sequence
ttgatgtgtcagtgctcgttaa

SEQ ID NO: 216296 - DNA, 22 bp, Artificial sequence
  SiRNA target sequence
tgatgtgtcagtgctcgttaat

SEQ ID NO: 216297 - DNA, 22 bp, Artificial sequence
  SiRNA target sequence
gatgtgtcagtgctcgttaatt

SEQ ID NO: 216298 - DNA, 22 bp, Artificial sequence
  SiRNA target sequence
atgtgtcagtgctcgttaatta

SEQ ID NO: 216299 - DNA, 22 bp, Artificial sequence
  SiRNA target sequence
tgtgtcagtgctcgttaattaa

SEQ ID NO: 216300 - DNA, 23 bp, Artificial sequence
  SiRNA target sequence
atgattgagaggggtattatgga

SEQ ID NO: 216301 - DNA, 23 bp, Artificial sequence
  SiRNA target sequence
tgattgagaggggtattatggaa

SEQ ID NO: 216302 - DNA, 23 bp, Artificial sequence
  SiRNA target sequence
gattgagaggggtattatggaaa

SEQ ID NO: 216303 - DNA, 23 bp, Artificial sequence
  SiRNA target sequence
attgagaggggtattatggaaaa

SEQ ID NO: 216304 - DNA, 23 bp, Artificial sequence
  SiRNA target sequence
ttgagaggggtattatggaaaaa

SEQ ID NO: 216305 - DNA, 23 bp, Artificial sequence
  SiRNA target sequence
tgagaggggtattatggaaaaaa

SEQ ID NO: 216306 - DNA, 23 bp, Artificial sequence
  SiRNA target sequence
gagaggggtattatggaaaaaat

SEQ ID NO: 216307 - DNA, 23 bp, Artificial sequence
  SiRNA target sequence
agaggggtattatggaaaaaata

SEQ ID NO: 216308 - DNA, 23 bp, Artificial sequence
  SiRNA target sequence
gaggggtattatggaaaaaataa

SEQ ID NO: 216309 - DNA, 23 bp, Artificial sequence
  SiRNA target sequence
aggggtattatggaaaaaataaa

SEQ ID NO: 216310 - DNA, 23 bp, Artificial sequence
  SiRNA target sequence
ggggtattatggaaaaaataaaa

SEQ ID NO: 216311 - DNA, 23 bp, Artificial sequence
  SiRNA target sequence
gggtattatggaaaaaataaaaa

SEQ ID NO: 216312 - DNA, 23 bp, Artificial sequence
  SiRNA target sequence
ggtattatggaaaaaataaaaaa

SEQ ID NO: 216313 - DNA, 23 bp, Artificial sequence
  SiRNA target sequence
gtattatggaaaaaataaaaaat

SEQ ID NO: 216314 - DNA, 23 bp, Artificial sequence
  SiRNA target sequence
tattatggaaaaaataaaaaatt

SEQ ID NO: 216315 - DNA, 23 bp, Artificial sequence
  SiRNA target sequence
attatggaaaaaataaaaaattt

SEQ ID NO: 216316 - DNA, 23 bp, Artificial sequence
  SiRNA target sequence
ttatggaaaaaataaaaaattta

SEQ ID NO: 216317 - DNA, 23 bp, Artificial sequence
  SiRNA target sequence
tatggaaaaaataaaaaatttat

SEQ ID NO: 216318 - DNA, 23 bp, Artificial sequence
  SiRNA target sequence
atggaaaaaataaaaaatttatt

SEQ ID NO: 216319 - DNA, 23 bp, Artificial sequence
  SiRNA target sequence
tggaaaaaataaaaaatttatta

SEQ ID NO: 216320 - DNA, 23 bp, Artificial sequence
  SiRNA target sequence
ggaaaaaataaaaaatttattaa

SEQ ID NO: 216321 - DNA, 23 bp, Artificial sequence
  SiRNA target sequence
gaaaaaataaaaaatttattaac

SEQ ID NO: 216322 - DNA, 23 bp, Artificial sequence
  SiRNA target sequence
aaaaaataaaaaatttattaaca

SEQ ID NO: 216323 - DNA, 23 bp, Artificial sequence
  SiRNA target sequence
aaaaataaaaaatttattaacag

SEQ ID NO: 216324 - DNA, 23 bp, Artificial sequence
  SiRNA target sequence
aaaataaaaaatttattaacaga

SEQ ID NO: 216325 - DNA, 23 bp, Artificial sequence
  SiRNA target sequence
aaataaaaaatttattaacagag

SEQ ID NO: 216326 - DNA, 23 bp, Artificial sequence
  SiRNA target sequence
aataaaaaatttattaacagagg

SEQ ID NO: 216327 - DNA, 23 bp, Artificial sequence
  SiRNA target sequence
ataaaaaatttattaacagagga

SEQ ID NO: 216328 - DNA, 23 bp, Artificial sequence
  SiRNA target sequence
taaaaaatttattaacagaggat

SEQ ID NO: 216329 - DNA, 23 bp, Artificial sequence
  SiRNA target sequence
aaaaaatttattaacagaggatg

SEQ ID NO: 216330 - DNA, 23 bp, Artificial sequence
  SiRNA target sequence
aaaaatttattaacagaggatga

SEQ ID NO: 216331 - DNA, 23 bp, Artificial sequence
  SiRNA target sequence
aaaatttattaacagaggatgaa

SEQ ID NO: 216332 - DNA, 23 bp, Artificial sequence
  SiRNA target sequence
aaatttattaacagaggatgaag

SEQ ID NO: 216333 - DNA, 23 bp, Artificial sequence
  SiRNA target sequence
aatttattaacagaggatgaagt

SEQ ID NO: 216334 - DNA, 23 bp, Artificial sequence
  SiRNA target sequence
atttattaacagaggatgaagta

SEQ ID NO: 216335 - DNA, 23 bp, Artificial sequence
  SiRNA target sequence
tttattaacagaggatgaagtag

SEQ ID NO: 216336 - DNA, 23 bp, Artificial sequence
  SiRNA target sequence
ttattaacagaggatgaagtaga

SEQ ID NO: 216337 - DNA, 23 bp, Artificial sequence
  SiRNA target sequence
tattaacagaggatgaagtagaa

SEQ ID NO: 216338 - DNA, 23 bp, Artificial sequence
  SiRNA target sequence
attaacagaggatgaagtagaag

SEQ ID NO: 216339 - DNA, 23 bp, Artificial sequence
  SiRNA target sequence
ttaacagaggatgaagtagaagc

SEQ ID NO: 216340 - DNA, 23 bp, Artificial sequence
  SiRNA target sequence
taacagaggatgaagtagaagca

SEQ ID NO: 216341 - DNA, 23 bp, Artificial sequence
  SiRNA target sequence
aacagaggatgaagtagaagcag

SEQ ID NO: 216342 - DNA, 23 bp, Artificial sequence
  SiRNA target sequence
acagaggatgaagtagaagcaga

SEQ ID NO: 216343 - DNA, 23 bp, Artificial sequence
  SiRNA target sequence
cagaggatgaagtagaagcagaa

SEQ ID NO: 216344 - DNA, 23 bp, Artificial sequence
  SiRNA target sequence
agaggatgaagtagaagcagaag

SEQ ID NO: 216345 - DNA, 23 bp, Artificial sequence
  SiRNA target sequence
gaggatgaagtagaagcagaagc

SEQ ID NO: 216346 - DNA, 23 bp, Artificial sequence
  SiRNA target sequence
aggatgaagtagaagcagaagca

SEQ ID NO: 216347 - DNA, 23 bp, Artificial sequence
  SiRNA target sequence
ggatgaagtagaagcagaagcaa

SEQ ID NO: 216348 - DNA, 23 bp, Artificial sequence
  SiRNA target sequence
gatgaagtagaagcagaagcaaa

SEQ ID NO: 216349 - DNA, 23 bp, Artificial sequence
  SiRNA target sequence
atgaagtagaagcagaagcaaat

SEQ ID NO: 216350 - DNA, 23 bp, Artificial sequence
  SiRNA target sequence
tgaagtagaagcagaagcaaatt

SEQ ID NO: 216351 - DNA, 23 bp, Artificial sequence
  SiRNA target sequence
gaagtagaagcagaagcaaattc

SEQ ID NO: 216352 - DNA, 23 bp, Artificial sequence
  SiRNA target sequence
aagtagaagcagaagcaaattct

SEQ ID NO: 216353 - DNA, 23 bp, Artificial sequence
  SiRNA target sequence
agtagaagcagaagcaaattctg

SEQ ID NO: 216354 - DNA, 23 bp, Artificial sequence
  SiRNA target sequence
gtagaagcagaagcaaattctgg

SEQ ID NO: 216355 - DNA, 23 bp, Artificial sequence
  SiRNA target sequence
tagaagcagaagcaaattctgga

SEQ ID NO: 216356 - DNA, 23 bp, Artificial sequence
  SiRNA target sequence
agaagcagaagcaaattctggaa

SEQ ID NO: 216357 - DNA, 23 bp, Artificial sequence
  SiRNA target sequence
gaagcagaagcaaattctggaag

SEQ ID NO: 216358 - DNA, 23 bp, Artificial sequence
  SiRNA target sequence
aagcagaagcaaattctggaagg

SEQ ID NO: 216359 - DNA, 23 bp, Artificial sequence
  SiRNA target sequence
agcagaagcaaattctggaaggg

SEQ ID NO: 216360 - DNA, 23 bp, Artificial sequence
  SiRNA target sequence
gcagaagcaaattctggaagggg

SEQ ID NO: 216361 - DNA, 23 bp, Artificial sequence
  SiRNA target sequence
cagaagcaaattctggaaggggc

SEQ ID NO: 216362 - DNA, 23 bp, Artificial sequence
  SiRNA target sequence
agaagcaaattctggaaggggca

SEQ ID NO: 216363 - DNA, 23 bp, Artificial sequence
  SiRNA target sequence
gaagcaaattctggaaggggcat

SEQ ID NO: 216364 - DNA, 23 bp, Artificial sequence
  SiRNA target sequence
aagcaaattctggaaggggcatt

SEQ ID NO: 216365 - DNA, 23 bp, Artificial sequence
  SiRNA target sequence
agcaaattctggaaggggcattt

SEQ ID NO: 216366 - DNA, 23 bp, Artificial sequence
  SiRNA target sequence
gcaaattctggaaggggcatttt

SEQ ID NO: 216367 - DNA, 23 bp, Artificial sequence
  SiRNA target sequence
caaattctggaaggggcatttta

SEQ ID NO: 216368 - DNA, 23 bp, Artificial sequence
  SiRNA target sequence
aaattctggaaggggcattttat

SEQ ID NO: 216369 - DNA, 23 bp, Artificial sequence
  SiRNA target sequence
aattctggaaggggcattttatc

SEQ ID NO: 216370 - DNA, 23 bp, Artificial sequence
  SiRNA target sequence
attctggaaggggcattttatca

SEQ ID NO: 216371 - DNA, 23 bp, Artificial sequence
  SiRNA target sequence
ttctggaaggggcattttatcaa

SEQ ID NO: 216372 - DNA, 23 bp, Artificial sequence
  SiRNA target sequence
tctggaaggggcattttatcaat

SEQ ID NO: 216373 - DNA, 23 bp, Artificial sequence
  SiRNA target sequence
ctggaaggggcattttatcaata

SEQ ID NO: 216374 - DNA, 23 bp, Artificial sequence
  SiRNA target sequence
tggaaggggcattttatcaatat

SEQ ID NO: 216375 - DNA, 23 bp, Artificial sequence
  SiRNA target sequence
ggaaggggcattttatcaatatt

SEQ ID NO: 216376 - DNA, 23 bp, Artificial sequence
  SiRNA target sequence
gaaggggcattttatcaatattt

SEQ ID NO: 216377 - DNA, 23 bp, Artificial sequence
  SiRNA target sequence
aaggggcattttatcaatattta

SEQ ID NO: 216378 - DNA, 23 bp, Artificial sequence
  SiRNA target sequence
aggggcattttatcaatatttag

SEQ ID NO: 216379 - DNA, 23 bp, Artificial sequence
  SiRNA target sequence
ggggcattttatcaatatttaga

SEQ ID NO: 216380 - DNA, 23 bp, Artificial sequence
  SiRNA target sequence
gggcattttatcaatatttagaa

SEQ ID NO: 216381 - DNA, 23 bp, Artificial sequence
  SiRNA target sequence
ggcattttatcaatatttagaat

SEQ ID NO: 216382 - DNA, 23 bp, Artificial sequence
  SiRNA target sequence
gcattttatcaatatttagaatt

SEQ ID NO: 216383 - DNA, 23 bp, Artificial sequence
  SiRNA target sequence
cattttatcaatatttagaattg

SEQ ID NO: 216384 - DNA, 23 bp, Artificial sequence
  SiRNA target sequence
attttatcaatatttagaattgc

SEQ ID NO: 216385 - DNA, 23 bp, Artificial sequence
  SiRNA target sequence
ttttatcaatatttagaattgct

SEQ ID NO: 216386 - DNA, 23 bp, Artificial sequence
  SiRNA target sequence
tttatcaatatttagaattgcta

SEQ ID NO: 216387 - DNA, 23 bp, Artificial sequence
  SiRNA target sequence
ttatcaatatttagaattgctaa

SEQ ID NO: 216388 - DNA, 23 bp, Artificial sequence
  SiRNA target sequence
tatcaatatttagaattgctaag

SEQ ID NO: 216389 - DNA, 23 bp, Artificial sequence
  SiRNA target sequence
atcaatatttagaattgctaagg

SEQ ID NO: 216390 - DNA, 23 bp, Artificial sequence
  SiRNA target sequence
tcaatatttagaattgctaaggt

SEQ ID NO: 216391 - DNA, 23 bp, Artificial sequence
  SiRNA target sequence
caatatttagaattgctaaggta

SEQ ID NO: 216392 - DNA, 23 bp, Artificial sequence
  SiRNA target sequence
aatatttagaattgctaaggtag

SEQ ID NO: 216393 - DNA, 23 bp, Artificial sequence
  SiRNA target sequence
atatttagaattgctaaggtaga

SEQ ID NO: 216394 - DNA, 23 bp, Artificial sequence
  SiRNA target sequence
tatttagaattgctaaggtagaa

SEQ ID NO: 216395 - DNA, 23 bp, Artificial sequence
  SiRNA target sequence
atttagaattgctaaggtagaaa

SEQ ID NO: 216396 - DNA, 23 bp, Artificial sequence
  SiRNA target sequence
tttagaattgctaaggtagaaag

SEQ ID NO: 216397 - DNA, 23 bp, Artificial sequence
  SiRNA target sequence
ttagaattgctaaggtagaaaga

SEQ ID NO: 216398 - DNA, 23 bp, Artificial sequence
  SiRNA target sequence
tagaattgctaaggtagaaagaa

SEQ ID NO: 216399 - DNA, 23 bp, Artificial sequence
  SiRNA target sequence
agaattgctaaggtagaaagaag

SEQ ID NO: 216400 - DNA, 23 bp, Artificial sequence
  SiRNA target sequence
gaattgctaaggtagaaagaaga

SEQ ID NO: 216401 - DNA, 23 bp, Artificial sequence
  SiRNA target sequence
aattgctaaggtagaaagaagaa

SEQ ID NO: 216402 - DNA, 23 bp, Artificial sequence
  SiRNA target sequence
attgctaaggtagaaagaagaat

SEQ ID NO: 216403 - DNA, 23 bp, Artificial sequence
  SiRNA target sequence
ttgctaaggtagaaagaagaatg

SEQ ID NO: 216404 - DNA, 23 bp, Artificial sequence
  SiRNA target sequence
tgctaaggtagaaagaagaatgt

SEQ ID NO: 216405 - DNA, 23 bp, Artificial sequence
  SiRNA target sequence
gctaaggtagaaagaagaatgtt

SEQ ID NO: 216406 - DNA, 23 bp, Artificial sequence
  SiRNA target sequence
ctaaggtagaaagaagaatgttt

SEQ ID NO: 216407 - DNA, 23 bp, Artificial sequence
  SiRNA target sequence
taaggtagaaagaagaatgtttt

SEQ ID NO: 216408 - DNA, 23 bp, Artificial sequence
  SiRNA target sequence
aaggtagaaagaagaatgttttg

SEQ ID NO: 216409 - DNA, 23 bp, Artificial sequence
  SiRNA target sequence
aggtagaaagaagaatgttttgg

SEQ ID NO: 216410 - DNA, 23 bp, Artificial sequence
  SiRNA target sequence
ggtagaaagaagaatgttttggc

SEQ ID NO: 216411 - DNA, 23 bp, Artificial sequence
  SiRNA target sequence
gtagaaagaagaatgttttggct

SEQ ID NO: 216412 - DNA, 23 bp, Artificial sequence
  SiRNA target sequence
tagaaagaagaatgttttggctt

SEQ ID NO: 216413 - DNA, 23 bp, Artificial sequence
  SiRNA target sequence
agaaagaagaatgttttggctta

SEQ ID NO: 216414 - DNA, 23 bp, Artificial sequence
  SiRNA target sequence
gaaagaagaatgttttggcttat

SEQ ID NO: 216415 - DNA, 23 bp, Artificial sequence
  SiRNA target sequence
aaagaagaatgttttggcttatg

SEQ ID NO: 216416 - DNA, 23 bp, Artificial sequence
  SiRNA target sequence
aagaagaatgttttggcttatga

SEQ ID NO: 216417 - DNA, 23 bp, Artificial sequence
  SiRNA target sequence
agaagaatgttttggcttatgac

SEQ ID NO: 216418 - DNA, 23 bp, Artificial sequence
  SiRNA target sequence
gaagaatgttttggcttatgacg

SEQ ID NO: 216419 - DNA, 23 bp, Artificial sequence
  SiRNA target sequence
aagaatgttttggcttatgacgc

SEQ ID NO: 216420 - DNA, 23 bp, Artificial sequence
  SiRNA target sequence
agaatgttttggcttatgacgct

SEQ ID NO: 216421 - DNA, 23 bp, Artificial sequence
  SiRNA target sequence
gaatgttttggcttatgacgctt

SEQ ID NO: 216422 - DNA, 23 bp, Artificial sequence
  SiRNA target sequence
aatgttttggcttatgacgctta

SEQ ID NO: 216423 - DNA, 23 bp, Artificial sequence
  SiRNA target sequence
atgttttggcttatgacgcttat

SEQ ID NO: 216424 - DNA, 23 bp, Artificial sequence
  SiRNA target sequence
tgttttggcttatgacgcttatg

SEQ ID NO: 216425 - DNA, 23 bp, Artificial sequence
  SiRNA target sequence
gttttggcttatgacgcttatgt

SEQ ID NO: 216426 - DNA, 23 bp, Artificial sequence
  SiRNA target sequence
ttttggcttatgacgcttatgtt

SEQ ID NO: 216427 - DNA, 23 bp, Artificial sequence
  SiRNA target sequence
tttggcttatgacgcttatgttt

SEQ ID NO: 216428 - DNA, 23 bp, Artificial sequence
  SiRNA target sequence
ttggcttatgacgcttatgtttt

SEQ ID NO: 216429 - DNA, 23 bp, Artificial sequence
  SiRNA target sequence
tggcttatgacgcttatgttttc

SEQ ID NO: 216430 - DNA, 23 bp, Artificial sequence
  SiRNA target sequence
ggcttatgacgcttatgttttcg

SEQ ID NO: 216431 - DNA, 23 bp, Artificial sequence
  SiRNA target sequence
gcttatgacgcttatgttttcgc

SEQ ID NO: 216432 - DNA, 23 bp, Artificial sequence
  SiRNA target sequence
cttatgacgcttatgttttcgct

SEQ ID NO: 216433 - DNA, 23 bp, Artificial sequence
  SiRNA target sequence
ttatgacgcttatgttttcgctt

SEQ ID NO: 216434 - DNA, 23 bp, Artificial sequence
  SiRNA target sequence
tatgacgcttatgttttcgctta

SEQ ID NO: 216435 - DNA, 23 bp, Artificial sequence
  SiRNA target sequence
atgacgcttatgttttcgcttat

SEQ ID NO: 216436 - DNA, 23 bp, Artificial sequence
  SiRNA target sequence
tgacgcttatgttttcgcttatt

SEQ ID NO: 216437 - DNA, 23 bp, Artificial sequence
  SiRNA target sequence
gacgcttatgttttcgcttattt

SEQ ID NO: 216438 - DNA, 23 bp, Artificial sequence
  SiRNA target sequence
acgcttatgttttcgcttatttc

SEQ ID NO: 216439 - DNA, 23 bp, Artificial sequence
  SiRNA target sequence
cgcttatgttttcgcttatttcc

SEQ ID NO: 216440 - DNA, 23 bp, Artificial sequence
  SiRNA target sequence
gcttatgttttcgcttatttcct

SEQ ID NO: 216441 - DNA, 23 bp, Artificial sequence
  SiRNA target sequence
cttatgttttcgcttatttcctt

SEQ ID NO: 216442 - DNA, 23 bp, Artificial sequence
  SiRNA target sequence
ttatgttttcgcttatttccttt

SEQ ID NO: 216443 - DNA, 23 bp, Artificial sequence
  SiRNA target sequence
tatgttttcgcttatttccttta

SEQ ID NO: 216444 - DNA, 23 bp, Artificial sequence
  SiRNA target sequence
atgttttcgcttatttcctttat

SEQ ID NO: 216445 - DNA, 23 bp, Artificial sequence
  SiRNA target sequence
tgttttcgcttatttcctttatt

SEQ ID NO: 216446 - DNA, 23 bp, Artificial sequence
  SiRNA target sequence
gttttcgcttatttcctttattt

SEQ ID NO: 216447 - DNA, 23 bp, Artificial sequence
  SiRNA target sequence
ttttcgcttatttcctttattta

SEQ ID NO: 216448 - DNA, 23 bp, Artificial sequence
  SiRNA target sequence
tttcgcttatttcctttatttac

SEQ ID NO: 216449 - DNA, 23 bp, Artificial sequence
  SiRNA target sequence
ttcgcttatttcctttatttact

SEQ ID NO: 216450 - DNA, 23 bp, Artificial sequence
  SiRNA target sequence
tcgcttatttcctttatttactc

SEQ ID NO: 216451 - DNA, 23 bp, Artificial sequence
  SiRNA target sequence
cgcttatttcctttatttactca

SEQ ID NO: 216452 - DNA, 23 bp, Artificial sequence
  SiRNA target sequence
gcttatttcctttatttactcag

SEQ ID NO: 216453 - DNA, 23 bp, Artificial sequence
  SiRNA target sequence
cttatttcctttatttactcagt

SEQ ID NO: 216454 - DNA, 23 bp, Artificial sequence
  SiRNA target sequence
ttatttcctttatttactcagta

SEQ ID NO: 216455 - DNA, 23 bp, Artificial sequence
  SiRNA target sequence
tatttcctttatttactcagtag

SEQ ID NO: 216456 - DNA, 23 bp, Artificial sequence
  SiRNA target sequence
atttcctttatttactcagtagg

SEQ ID NO: 216457 - DNA, 23 bp, Artificial sequence
  SiRNA target sequence
tttcctttatttactcagtagga

SEQ ID NO: 216458 - DNA, 23 bp, Artificial sequence
  SiRNA target sequence
ttcctttatttactcagtaggac

SEQ ID NO: 216459 - DNA, 23 bp, Artificial sequence
  SiRNA target sequence
tcctttatttactcagtaggacg

SEQ ID NO: 216460 - DNA, 23 bp, Artificial sequence
  SiRNA target sequence
cctttatttactcagtaggacga

SEQ ID NO: 216461 - DNA, 23 bp, Artificial sequence
  SiRNA target sequence
ctttatttactcagtaggacgag

SEQ ID NO: 216462 - DNA, 23 bp, Artificial sequence
  SiRNA target sequence
tttatttactcagtaggacgagt

SEQ ID NO: 216463 - DNA, 23 bp, Artificial sequence
  SiRNA target sequence
ttatttactcagtaggacgagtg

SEQ ID NO: 216464 - DNA, 23 bp, Artificial sequence
  SiRNA target sequence
tatttactcagtaggacgagtgt

SEQ ID NO: 216465 - DNA, 23 bp, Artificial sequence
  SiRNA target sequence
atttactcagtaggacgagtgtt

SEQ ID NO: 216466 - DNA, 23 bp, Artificial sequence
  SiRNA target sequence
tttactcagtaggacgagtgtta

SEQ ID NO: 216467 - DNA, 23 bp, Artificial sequence
  SiRNA target sequence
ttactcagtaggacgagtgttaa

SEQ ID NO: 216468 - DNA, 23 bp, Artificial sequence
  SiRNA target sequence
tactcagtaggacgagtgttaaa

SEQ ID NO: 216469 - DNA, 23 bp, Artificial sequence
  SiRNA target sequence
actcagtaggacgagtgttaaaa

SEQ ID NO: 216470 - DNA, 23 bp, Artificial sequence
  SiRNA target sequence
ctcagtaggacgagtgttaaaag

SEQ ID NO: 216471 - DNA, 23 bp, Artificial sequence
  SiRNA target sequence
tcagtaggacgagtgttaaaaga

SEQ ID NO: 216472 - DNA, 23 bp, Artificial sequence
  SiRNA target sequence
cagtaggacgagtgttaaaagat

SEQ ID NO: 216473 - DNA, 23 bp, Artificial sequence
  SiRNA target sequence
agtaggacgagtgttaaaagatg

SEQ ID NO: 216474 - DNA, 23 bp, Artificial sequence
  SiRNA target sequence
gtaggacgagtgttaaaagatgc

SEQ ID NO: 216475 - DNA, 23 bp, Artificial sequence
  SiRNA target sequence
taggacgagtgttaaaagatgca

SEQ ID NO: 216476 - DNA, 23 bp, Artificial sequence
  SiRNA target sequence
aggacgagtgttaaaagatgcag

SEQ ID NO: 216477 - DNA, 23 bp, Artificial sequence
  SiRNA target sequence
ggacgagtgttaaaagatgcagc

SEQ ID NO: 216478 - DNA, 23 bp, Artificial sequence
  SiRNA target sequence
gacgagtgttaaaagatgcagca

SEQ ID NO: 216479 - DNA, 23 bp, Artificial sequence
  SiRNA target sequence
acgagtgttaaaagatgcagcag

SEQ ID NO: 216480 - DNA, 23 bp, Artificial sequence
  SiRNA target sequence
cgagtgttaaaagatgcagcagt

SEQ ID NO: 216481 - DNA, 23 bp, Artificial sequence
  SiRNA target sequence
gagtgttaaaagatgcagcagtt

SEQ ID NO: 216482 - DNA, 23 bp, Artificial sequence
  SiRNA target sequence
agtgttaaaagatgcagcagttc

SEQ ID NO: 216483 - DNA, 23 bp, Artificial sequence
  SiRNA target sequence
gtgttaaaagatgcagcagttct

SEQ ID NO: 216484 - DNA, 23 bp, Artificial sequence
  SiRNA target sequence
tgttaaaagatgcagcagttctt

SEQ ID NO: 216485 - DNA, 23 bp, Artificial sequence
  SiRNA target sequence
gttaaaagatgcagcagttctta

SEQ ID NO: 216486 - DNA, 23 bp, Artificial sequence
  SiRNA target sequence
ttaaaagatgcagcagttcttag

SEQ ID NO: 216487 - DNA, 23 bp, Artificial sequence
  SiRNA target sequence
taaaagatgcagcagttcttagt

SEQ ID NO: 216488 - DNA, 23 bp, Artificial sequence
  SiRNA target sequence
aaaagatgcagcagttcttagta

SEQ ID NO: 216489 - DNA, 23 bp, Artificial sequence
  SiRNA target sequence
aaagatgcagcagttcttagtag

SEQ ID NO: 216490 - DNA, 23 bp, Artificial sequence
  SiRNA target sequence
aagatgcagcagttcttagtaga

SEQ ID NO: 216491 - DNA, 23 bp, Artificial sequence
  SiRNA target sequence
agatgcagcagttcttagtagac

SEQ ID NO: 216492 - DNA, 23 bp, Artificial sequence
  SiRNA target sequence
gatgcagcagttcttagtagaca

SEQ ID NO: 216493 - DNA, 23 bp, Artificial sequence
  SiRNA target sequence
atgcagcagttcttagtagacag

SEQ ID NO: 216494 - DNA, 23 bp, Artificial sequence
  SiRNA target sequence
tgcagcagttcttagtagacaga

SEQ ID NO: 216495 - DNA, 23 bp, Artificial sequence
  SiRNA target sequence
gcagcagttcttagtagacagat

SEQ ID NO: 216496 - DNA, 23 bp, Artificial sequence
  SiRNA target sequence
cagcagttcttagtagacagatg

SEQ ID NO: 216497 - DNA, 23 bp, Artificial sequence
  SiRNA target sequence
agcagttcttagtagacagatgc

SEQ ID NO: 216498 - DNA, 23 bp, Artificial sequence
  SiRNA target sequence
gcagttcttagtagacagatgcc

SEQ ID NO: 216499 - DNA, 23 bp, Artificial sequence
  SiRNA target sequence
cagttcttagtagacagatgcca

SEQ ID NO: 216500 - DNA, 23 bp, Artificial sequence
  SiRNA target sequence
agttcttagtagacagatgccac

SEQ ID NO: 216501 - DNA, 23 bp, Artificial sequence
  SiRNA target sequence
gttcttagtagacagatgccact

SEQ ID NO: 216502 - DNA, 23 bp, Artificial sequence
  SiRNA target sequence
ttcttagtagacagatgccacta

SEQ ID NO: 216503 - DNA, 23 bp, Artificial sequence
  SiRNA target sequence
tcttagtagacagatgccactat

SEQ ID NO: 216504 - DNA, 23 bp, Artificial sequence
  SiRNA target sequence
cttagtagacagatgccactatc

SEQ ID NO: 216505 - DNA, 23 bp, Artificial sequence
  SiRNA target sequence
ttagtagacagatgccactatcc

SEQ ID NO: 216506 - DNA, 23 bp, Artificial sequence
  SiRNA target sequence
tagtagacagatgccactatcca

SEQ ID NO: 216507 - DNA, 23 bp, Artificial sequence
  SiRNA target sequence
agtagacagatgccactatccat

SEQ ID NO: 216508 - DNA, 23 bp, Artificial sequence
  SiRNA target sequence
gtagacagatgccactatccatt

SEQ ID NO: 216509 - DNA, 23 bp, Artificial sequence
  SiRNA target sequence
tagacagatgccactatccatta

SEQ ID NO: 216510 - DNA, 23 bp, Artificial sequence
  SiRNA target sequence
agacagatgccactatccattaa

SEQ ID NO: 216511 - DNA, 23 bp, Artificial sequence
  SiRNA target sequence
gacagatgccactatccattaat

SEQ ID NO: 216512 - DNA, 23 bp, Artificial sequence
  SiRNA target sequence
acagatgccactatccattaatt

SEQ ID NO: 216513 - DNA, 23 bp, Artificial sequence
  SiRNA target sequence
cagatgccactatccattaattg

SEQ ID NO: 216514 - DNA, 23 bp, Artificial sequence
  SiRNA target sequence
agatgccactatccattaattgt

SEQ ID NO: 216515 - DNA, 23 bp, Artificial sequence
  SiRNA target sequence
gatgccactatccattaattgtc

SEQ ID NO: 216516 - DNA, 23 bp, Artificial sequence
  SiRNA target sequence
atgccactatccattaattgtct

SEQ ID NO: 216517 - DNA, 23 bp, Artificial sequence
  SiRNA target sequence
tgccactatccattaattgtctt

SEQ ID NO: 216518 - DNA, 23 bp, Artificial sequence
  SiRNA target sequence
gccactatccattaattgtctta

SEQ ID NO: 216519 - DNA, 23 bp, Artificial sequence
  SiRNA target sequence
ccactatccattaattgtcttaa

SEQ ID NO: 216520 - DNA, 23 bp, Artificial sequence
  SiRNA target sequence
cactatccattaattgtcttaaa

SEQ ID NO: 216521 - DNA, 23 bp, Artificial sequence
  SiRNA target sequence
actatccattaattgtcttaaaa

SEQ ID NO: 216522 - DNA, 23 bp, Artificial sequence
  SiRNA target sequence
ctatccattaattgtcttaaaag

SEQ ID NO: 216523 - DNA, 23 bp, Artificial sequence
  SiRNA target sequence
tatccattaattgtcttaaaagc

SEQ ID NO: 216524 - DNA, 23 bp, Artificial sequence
  SiRNA target sequence
atccattaattgtcttaaaagct

SEQ ID NO: 216525 - DNA, 23 bp, Artificial sequence
  SiRNA target sequence
tccattaattgtcttaaaagctt

SEQ ID NO: 216526 - DNA, 23 bp, Artificial sequence
  SiRNA target sequence
ccattaattgtcttaaaagcttt

SEQ ID NO: 216527 - DNA, 23 bp, Artificial sequence
  SiRNA target sequence
cattaattgtcttaaaagctttg

SEQ ID NO: 216528 - DNA, 23 bp, Artificial sequence
  SiRNA target sequence
attaattgtcttaaaagctttgt

SEQ ID NO: 216529 - DNA, 23 bp, Artificial sequence
  SiRNA target sequence
ttaattgtcttaaaagctttgta

SEQ ID NO: 216530 - DNA, 23 bp, Artificial sequence
  SiRNA target sequence
taattgtcttaaaagctttgtaa

SEQ ID NO: 216531 - DNA, 23 bp, Artificial sequence
  SiRNA target sequence
aattgtcttaaaagctttgtaat

SEQ ID NO: 216532 - DNA, 23 bp, Artificial sequence
  SiRNA target sequence
attgtcttaaaagctttgtaatt

SEQ ID NO: 216533 - DNA, 23 bp, Artificial sequence
  SiRNA target sequence
ttgtcttaaaagctttgtaattt

SEQ ID NO: 216534 - DNA, 23 bp, Artificial sequence
  SiRNA target sequence
tgtcttaaaagctttgtaatttt

SEQ ID NO: 216535 - DNA, 23 bp, Artificial sequence
  SiRNA target sequence
gtcttaaaagctttgtaatttta

SEQ ID NO: 216536 - DNA, 23 bp, Artificial sequence
  SiRNA target sequence
tcttaaaagctttgtaattttac

SEQ ID NO: 216537 - DNA, 23 bp, Artificial sequence
  SiRNA target sequence
cttaaaagctttgtaattttacc

SEQ ID NO: 216538 - DNA, 23 bp, Artificial sequence
  SiRNA target sequence
ttaaaagctttgtaattttacca

SEQ ID NO: 216539 - DNA, 23 bp, Artificial sequence
  SiRNA target sequence
taaaagctttgtaattttaccag

SEQ ID NO: 216540 - DNA, 23 bp, Artificial sequence
  SiRNA target sequence
aaaagctttgtaattttaccagt

SEQ ID NO: 216541 - DNA, 23 bp, Artificial sequence
  SiRNA target sequence
aaagctttgtaattttaccagtt

SEQ ID NO: 216542 - DNA, 23 bp, Artificial sequence
  SiRNA target sequence
aagctttgtaattttaccagtta

SEQ ID NO: 216543 - DNA, 23 bp, Artificial sequence
  SiRNA target sequence
agctttgtaattttaccagttac

SEQ ID NO: 216544 - DNA, 23 bp, Artificial sequence
  SiRNA target sequence
gctttgtaattttaccagttact

SEQ ID NO: 216545 - DNA, 23 bp, Artificial sequence
  SiRNA target sequence
ctttgtaattttaccagttactc

SEQ ID NO: 216546 - DNA, 23 bp, Artificial sequence
  SiRNA target sequence
tttgtaattttaccagttactct

SEQ ID NO: 216547 - DNA, 23 bp, Artificial sequence
  SiRNA target sequence
ttgtaattttaccagttactctt

SEQ ID NO: 216548 - DNA, 23 bp, Artificial sequence
  SiRNA target sequence
tgtaattttaccagttactcttg

SEQ ID NO: 216549 - DNA, 23 bp, Artificial sequence
  SiRNA target sequence
gtaattttaccagttactcttgt

SEQ ID NO: 216550 - DNA, 23 bp, Artificial sequence
  SiRNA target sequence
taattttaccagttactcttgtt

SEQ ID NO: 216551 - DNA, 23 bp, Artificial sequence
  SiRNA target sequence
aattttaccagttactcttgttt

SEQ ID NO: 216552 - DNA, 23 bp, Artificial sequence
  SiRNA target sequence
attttaccagttactcttgtttg

SEQ ID NO: 216553 - DNA, 23 bp, Artificial sequence
  SiRNA target sequence
ttttaccagttactcttgtttgt

SEQ ID NO: 216554 - DNA, 23 bp, Artificial sequence
  SiRNA target sequence
tttaccagttactcttgtttgtg

SEQ ID NO: 216555 - DNA, 23 bp, Artificial sequence
  SiRNA target sequence
ttaccagttactcttgtttgtgt

SEQ ID NO: 216556 - DNA, 23 bp, Artificial sequence
  SiRNA target sequence
taccagttactcttgtttgtgta

SEQ ID NO: 216557 - DNA, 23 bp, Artificial sequence
  SiRNA target sequence
accagttactcttgtttgtgtag

SEQ ID NO: 216558 - DNA, 23 bp, Artificial sequence
  SiRNA target sequence
ccagttactcttgtttgtgtagg

SEQ ID NO: 216559 - DNA, 23 bp, Artificial sequence
  SiRNA target sequence
cagttactcttgtttgtgtagga

SEQ ID NO: 216560 - DNA, 23 bp, Artificial sequence
  SiRNA target sequence
agttactcttgtttgtgtaggat

SEQ ID NO: 216561 - DNA, 23 bp, Artificial sequence
  SiRNA target sequence
gttactcttgtttgtgtaggatt

SEQ ID NO: 216562 - DNA, 23 bp, Artificial sequence
  SiRNA target sequence
ttactcttgtttgtgtaggatta

SEQ ID NO: 216563 - DNA, 23 bp, Artificial sequence
  SiRNA target sequence
tactcttgtttgtgtaggattaa

SEQ ID NO: 216564 - DNA, 23 bp, Artificial sequence
  SiRNA target sequence
actcttgtttgtgtaggattaat

SEQ ID NO: 216565 - DNA, 23 bp, Artificial sequence
  SiRNA target sequence
ctcttgtttgtgtaggattaatt

SEQ ID NO: 216566 - DNA, 23 bp, Artificial sequence
  SiRNA target sequence
tcttgtttgtgtaggattaattc

SEQ ID NO: 216567 - DNA, 23 bp, Artificial sequence
  SiRNA target sequence
cttgtttgtgtaggattaattca

SEQ ID NO: 216568 - DNA, 23 bp, Artificial sequence
  SiRNA target sequence
ttgtttgtgtaggattaattcag

SEQ ID NO: 216569 - DNA, 23 bp, Artificial sequence
  SiRNA target sequence
tgtttgtgtaggattaattcaga

SEQ ID NO: 216570 - DNA, 23 bp, Artificial sequence
  SiRNA target sequence
gtttgtgtaggattaattcagaa

SEQ ID NO: 216571 - DNA, 23 bp, Artificial sequence
  SiRNA target sequence
tttgtgtaggattaattcagaag

SEQ ID NO: 216572 - DNA, 23 bp, Artificial sequence
  SiRNA target sequence
ttgtgtaggattaattcagaagt

SEQ ID NO: 216573 - DNA, 23 bp, Artificial sequence
  SiRNA target sequence
tgtgtaggattaattcagaagtc

SEQ ID NO: 216574 - DNA, 23 bp, Artificial sequence
  SiRNA target sequence
gtgtaggattaattcagaagtct

SEQ ID NO: 216575 - DNA, 23 bp, Artificial sequence
  SiRNA target sequence
tgtaggattaattcagaagtcta

SEQ ID NO: 216576 - DNA, 23 bp, Artificial sequence
  SiRNA target sequence
gtaggattaattcagaagtctac

SEQ ID NO: 216577 - DNA, 23 bp, Artificial sequence
  SiRNA target sequence
taggattaattcagaagtctaca

SEQ ID NO: 216578 - DNA, 23 bp, Artificial sequence
  SiRNA target sequence
aggattaattcagaagtctacac

SEQ ID NO: 216579 - DNA, 23 bp, Artificial sequence
  SiRNA target sequence
ggattaattcagaagtctacact

SEQ ID NO: 216580 - DNA, 23 bp, Artificial sequence
  SiRNA target sequence
gattaattcagaagtctacactc

SEQ ID NO: 216581 - DNA, 23 bp, Artificial sequence
  SiRNA target sequence
attaattcagaagtctacactct

SEQ ID NO: 216582 - DNA, 23 bp, Artificial sequence
  SiRNA target sequence
ttaattcagaagtctacactctc

SEQ ID NO: 216583 - DNA, 23 bp, Artificial sequence
  SiRNA target sequence
taattcagaagtctacactctct

SEQ ID NO: 216584 - DNA, 23 bp, Artificial sequence
  SiRNA target sequence
aattcagaagtctacactctctt

SEQ ID NO: 216585 - DNA, 23 bp, Artificial sequence
  SiRNA target sequence
attcagaagtctacactctctta

SEQ ID NO: 216586 - DNA, 23 bp, Artificial sequence
  SiRNA target sequence
ttcagaagtctacactctcttat

SEQ ID NO: 216587 - DNA, 23 bp, Artificial sequence
  SiRNA target sequence
tcagaagtctacactctcttatt

SEQ ID NO: 216588 - DNA, 23 bp, Artificial sequence
  SiRNA target sequence
cagaagtctacactctcttattc

SEQ ID NO: 216589 - DNA, 23 bp, Artificial sequence
  SiRNA target sequence
agaagtctacactctcttattct

SEQ ID NO: 216590 - DNA, 23 bp, Artificial sequence
  SiRNA target sequence
gaagtctacactctcttattctt

SEQ ID NO: 216591 - DNA, 23 bp, Artificial sequence
  SiRNA target sequence
aagtctacactctcttattcttt

SEQ ID NO: 216592 - DNA, 23 bp, Artificial sequence
  SiRNA target sequence
agtctacactctcttattctttt

SEQ ID NO: 216593 - DNA, 23 bp, Artificial sequence
  SiRNA target sequence
gtctacactctcttattctttta

SEQ ID NO: 216594 - DNA, 23 bp, Artificial sequence
  SiRNA target sequence
tctacactctcttattcttttac

SEQ ID NO: 216595 - DNA, 23 bp, Artificial sequence
  SiRNA target sequence
ctacactctcttattcttttaca

SEQ ID NO: 216596 - DNA, 23 bp, Artificial sequence
  SiRNA target sequence
tacactctcttattcttttacaa

SEQ ID NO: 216597 - DNA, 23 bp, Artificial sequence
  SiRNA target sequence
acactctcttattcttttacaaa

SEQ ID NO: 216598 - DNA, 23 bp, Artificial sequence
  SiRNA target sequence
cactctcttattcttttacaaaa

SEQ ID NO: 216599 - DNA, 23 bp, Artificial sequence
  SiRNA target sequence
actctcttattcttttacaaaaa

SEQ ID NO: 216600 - DNA, 23 bp, Artificial sequence
  SiRNA target sequence
ctctcttattcttttacaaaaat

SEQ ID NO: 216601 - DNA, 23 bp, Artificial sequence
  SiRNA target sequence
tctcttattcttttacaaaaata

SEQ ID NO: 216602 - DNA, 23 bp, Artificial sequence
  SiRNA target sequence
ctcttattcttttacaaaaatat

SEQ ID NO: 216603 - DNA, 23 bp, Artificial sequence
  SiRNA target sequence
tcttattcttttacaaaaatatt

SEQ ID NO: 216604 - DNA, 23 bp, Artificial sequence
  SiRNA target sequence
cttattcttttacaaaaatattt

SEQ ID NO: 216605 - DNA, 23 bp, Artificial sequence
  SiRNA target sequence
ttattcttttacaaaaatatttg

SEQ ID NO: 216606 - DNA, 23 bp, Artificial sequence
  SiRNA target sequence
tattcttttacaaaaatatttga

SEQ ID NO: 216607 - DNA, 23 bp, Artificial sequence
  SiRNA target sequence
attcttttacaaaaatatttgat

SEQ ID NO: 216608 - DNA, 23 bp, Artificial sequence
  SiRNA target sequence
ttcttttacaaaaatatttgatg

SEQ ID NO: 216609 - DNA, 23 bp, Artificial sequence
  SiRNA target sequence
tcttttacaaaaatatttgatgg

SEQ ID NO: 216610 - DNA, 23 bp, Artificial sequence
  SiRNA target sequence
cttttacaaaaatatttgatggt

SEQ ID NO: 216611 - DNA, 23 bp, Artificial sequence
  SiRNA target sequence
ttttacaaaaatatttgatggtg

SEQ ID NO: 216612 - DNA, 23 bp, Artificial sequence
  SiRNA target sequence
tttacaaaaatatttgatggtgc

SEQ ID NO: 216613 - DNA, 23 bp, Artificial sequence
  SiRNA target sequence
ttacaaaaatatttgatggtgca

SEQ ID NO: 216614 - DNA, 23 bp, Artificial sequence
  SiRNA target sequence
tacaaaaatatttgatggtgcat

SEQ ID NO: 216615 - DNA, 23 bp, Artificial sequence
  SiRNA target sequence
acaaaaatatttgatggtgcatt

SEQ ID NO: 216616 - DNA, 23 bp, Artificial sequence
  SiRNA target sequence
caaaaatatttgatggtgcattg

SEQ ID NO: 216617 - DNA, 23 bp, Artificial sequence
  SiRNA target sequence
aaaaatatttgatggtgcattgt

SEQ ID NO: 216618 - DNA, 23 bp, Artificial sequence
  SiRNA target sequence
aaaatatttgatggtgcattgtt

SEQ ID NO: 216619 - DNA, 23 bp, Artificial sequence
  SiRNA target sequence
aaatatttgatggtgcattgtta

SEQ ID NO: 216620 - DNA, 23 bp, Artificial sequence
  SiRNA target sequence
aatatttgatggtgcattgttaa

SEQ ID NO: 216621 - DNA, 23 bp, Artificial sequence
  SiRNA target sequence
atatttgatggtgcattgttaat

SEQ ID NO: 216622 - DNA, 23 bp, Artificial sequence
  SiRNA target sequence
tatttgatggtgcattgttaata

SEQ ID NO: 216623 - DNA, 23 bp, Artificial sequence
  SiRNA target sequence
atttgatggtgcattgttaatat

SEQ ID NO: 216624 - DNA, 23 bp, Artificial sequence
  SiRNA target sequence
tttgatggtgcattgttaatatt

SEQ ID NO: 216625 - DNA, 23 bp, Artificial sequence
  SiRNA target sequence
ttgatggtgcattgttaatattt

SEQ ID NO: 216626 - DNA, 23 bp, Artificial sequence
  SiRNA target sequence
tgatggtgcattgttaatatttg

SEQ ID NO: 216627 - DNA, 23 bp, Artificial sequence
  SiRNA target sequence
gatggtgcattgttaatatttgc

SEQ ID NO: 216628 - DNA, 23 bp, Artificial sequence
  SiRNA target sequence
atggtgcattgttaatatttgct

SEQ ID NO: 216629 - DNA, 23 bp, Artificial sequence
  SiRNA target sequence
tggtgcattgttaatatttgctt

SEQ ID NO: 216630 - DNA, 23 bp, Artificial sequence
  SiRNA target sequence
ggtgcattgttaatatttgcttt

SEQ ID NO: 216631 - DNA, 23 bp, Artificial sequence
  SiRNA target sequence
gtgcattgttaatatttgctttt

SEQ ID NO: 216632 - DNA, 23 bp, Artificial sequence
  SiRNA target sequence
tgcattgttaatatttgcttttc

SEQ ID NO: 216633 - DNA, 23 bp, Artificial sequence
  SiRNA target sequence
gcattgttaatatttgcttttct

SEQ ID NO: 216634 - DNA, 23 bp, Artificial sequence
  SiRNA target sequence
cattgttaatatttgcttttctt

SEQ ID NO: 216635 - DNA, 23 bp, Artificial sequence
  SiRNA target sequence
attgttaatatttgcttttcttt

SEQ ID NO: 216636 - DNA, 23 bp, Artificial sequence
  SiRNA target sequence
ttgttaatatttgcttttcttta

SEQ ID NO: 216637 - DNA, 23 bp, Artificial sequence
  SiRNA target sequence
tgttaatatttgcttttctttat

SEQ ID NO: 216638 - DNA, 23 bp, Artificial sequence
  SiRNA target sequence
gttaatatttgcttttctttata

SEQ ID NO: 216639 - DNA, 23 bp, Artificial sequence
  SiRNA target sequence
ttaatatttgcttttctttatat

SEQ ID NO: 216640 - DNA, 23 bp, Artificial sequence
  SiRNA target sequence
taatatttgcttttctttatatc

SEQ ID NO: 216641 - DNA, 23 bp, Artificial sequence
  SiRNA target sequence
aatatttgcttttctttatatca

SEQ ID NO: 216642 - DNA, 23 bp, Artificial sequence
  SiRNA target sequence
atatttgcttttctttatatcat

SEQ ID NO: 216643 - DNA, 23 bp, Artificial sequence
  SiRNA target sequence
tatttgcttttctttatatcatt

SEQ ID NO: 216644 - DNA, 23 bp, Artificial sequence
  SiRNA target sequence
atttgcttttctttatatcattc

SEQ ID NO: 216645 - DNA, 23 bp, Artificial sequence
  SiRNA target sequence
tttgcttttctttatatcattct

SEQ ID NO: 216646 - DNA, 23 bp, Artificial sequence
  SiRNA target sequence
ttgcttttctttatatcattctt

SEQ ID NO: 216647 - DNA, 23 bp, Artificial sequence
  SiRNA target sequence
tgcttttctttatatcattcttg

SEQ ID NO: 216648 - DNA, 23 bp, Artificial sequence
  SiRNA target sequence
gcttttctttatatcattcttgg

SEQ ID NO: 216649 - DNA, 23 bp, Artificial sequence
  SiRNA target sequence
cttttctttatatcattcttggt

SEQ ID NO: 216650 - DNA, 23 bp, Artificial sequence
  SiRNA target sequence
ttttctttatatcattcttggtc

SEQ ID NO: 216651 - DNA, 23 bp, Artificial sequence
  SiRNA target sequence
tttctttatatcattcttggtct

SEQ ID NO: 216652 - DNA, 23 bp, Artificial sequence
  SiRNA target sequence
ttctttatatcattcttggtcta

SEQ ID NO: 216653 - DNA, 23 bp, Artificial sequence
  SiRNA target sequence
tctttatatcattcttggtctag

SEQ ID NO: 216654 - DNA, 23 bp, Artificial sequence
  SiRNA target sequence
ctttatatcattcttggtctagt

SEQ ID NO: 216655 - DNA, 23 bp, Artificial sequence
  SiRNA target sequence
tttatatcattcttggtctagtt

SEQ ID NO: 216656 - DNA, 23 bp, Artificial sequence
  SiRNA target sequence
ttatatcattcttggtctagttc

SEQ ID NO: 216657 - DNA, 23 bp, Artificial sequence
  SiRNA target sequence
tatatcattcttggtctagttct

SEQ ID NO: 216658 - DNA, 23 bp, Artificial sequence
  SiRNA target sequence
atatcattcttggtctagttctt

SEQ ID NO: 216659 - DNA, 23 bp, Artificial sequence
  SiRNA target sequence
tatcattcttggtctagttcttc

SEQ ID NO: 216660 - DNA, 23 bp, Artificial sequence
  SiRNA target sequence
atcattcttggtctagttcttct

SEQ ID NO: 216661 - DNA, 23 bp, Artificial sequence
  SiRNA target sequence
tcattcttggtctagttcttctt

SEQ ID NO: 216662 - DNA, 23 bp, Artificial sequence
  SiRNA target sequence
cattcttggtctagttcttcttc

SEQ ID NO: 216663 - DNA, 23 bp, Artificial sequence
  SiRNA target sequence
attcttggtctagttcttcttcc

SEQ ID NO: 216664 - DNA, 23 bp, Artificial sequence
  SiRNA target sequence
ttcttggtctagttcttcttcca

SEQ ID NO: 216665 - DNA, 23 bp, Artificial sequence
  SiRNA target sequence
tcttggtctagttcttcttccat

SEQ ID NO: 216666 - DNA, 23 bp, Artificial sequence
  SiRNA target sequence
cttggtctagttcttcttccata

SEQ ID NO: 216667 - DNA, 23 bp, Artificial sequence
  SiRNA target sequence
ttggtctagttcttcttccatat

SEQ ID NO: 216668 - DNA, 23 bp, Artificial sequence
  SiRNA target sequence
tggtctagttcttcttccatatt

SEQ ID NO: 216669 - DNA, 23 bp, Artificial sequence
  SiRNA target sequence
ggtctagttcttcttccatattc

SEQ ID NO: 216670 - DNA, 23 bp, Artificial sequence
  SiRNA target sequence
gtctagttcttcttccatattct

SEQ ID NO: 216671 - DNA, 23 bp, Artificial sequence
  SiRNA target sequence
tctagttcttcttccatattctc

SEQ ID NO: 216672 - DNA, 23 bp, Artificial sequence
  SiRNA target sequence
ctagttcttcttccatattctca

SEQ ID NO: 216673 - DNA, 23 bp, Artificial sequence
  SiRNA target sequence
tagttcttcttccatattctcat

SEQ ID NO: 216674 - DNA, 23 bp, Artificial sequence
  SiRNA target sequence
agttcttcttccatattctcatc

SEQ ID NO: 216675 - DNA, 23 bp, Artificial sequence
  SiRNA target sequence
gttcttcttccatattctcatct

SEQ ID NO: 216676 - DNA, 23 bp, Artificial sequence
  SiRNA target sequence
ttcttcttccatattctcatctt

SEQ ID NO: 216677 - DNA, 23 bp, Artificial sequence
  SiRNA target sequence
tcttcttccatattctcatcttt

SEQ ID NO: 216678 - DNA, 23 bp, Artificial sequence
  SiRNA target sequence
cttcttccatattctcatctttt

SEQ ID NO: 216679 - DNA, 23 bp, Artificial sequence
  SiRNA target sequence
ttcttccatattctcatcttttc

SEQ ID NO: 216680 - DNA, 23 bp, Artificial sequence
  SiRNA target sequence
tcttccatattctcatcttttcc

SEQ ID NO: 216681 - DNA, 23 bp, Artificial sequence
  SiRNA target sequence
cttccatattctcatcttttcca

SEQ ID NO: 216682 - DNA, 23 bp, Artificial sequence
  SiRNA target sequence
ttccatattctcatcttttccag

SEQ ID NO: 216683 - DNA, 23 bp, Artificial sequence
  SiRNA target sequence
tccatattctcatcttttccagc

SEQ ID NO: 216684 - DNA, 23 bp, Artificial sequence
  SiRNA target sequence
ccatattctcatcttttccagct

SEQ ID NO: 216685 - DNA, 23 bp, Artificial sequence
  SiRNA target sequence
catattctcatcttttccagctt

SEQ ID NO: 216686 - DNA, 23 bp, Artificial sequence
  SiRNA target sequence
atattctcatcttttccagcttg

SEQ ID NO: 216687 - DNA, 23 bp, Artificial sequence
  SiRNA target sequence
tattctcatcttttccagcttga

SEQ ID NO: 216688 - DNA, 23 bp, Artificial sequence
  SiRNA target sequence
attctcatcttttccagcttgat

SEQ ID NO: 216689 - DNA, 23 bp, Artificial sequence
  SiRNA target sequence
ttctcatcttttccagcttgata

SEQ ID NO: 216690 - DNA, 23 bp, Artificial sequence
  SiRNA target sequence
tctcatcttttccagcttgatag

SEQ ID NO: 216691 - DNA, 23 bp, Artificial sequence
  SiRNA target sequence
ctcatcttttccagcttgatagt

SEQ ID NO: 216692 - DNA, 23 bp, Artificial sequence
  SiRNA target sequence
tcatcttttccagcttgatagtt

SEQ ID NO: 216693 - DNA, 23 bp, Artificial sequence
  SiRNA target sequence
catcttttccagcttgatagtta

SEQ ID NO: 216694 - DNA, 23 bp, Artificial sequence
  SiRNA target sequence
atcttttccagcttgatagttat

SEQ ID NO: 216695 - DNA, 23 bp, Artificial sequence
  SiRNA target sequence
tcttttccagcttgatagttatt

SEQ ID NO: 216696 - DNA, 23 bp, Artificial sequence
  SiRNA target sequence
cttttccagcttgatagttattt

SEQ ID NO: 216697 - DNA, 23 bp, Artificial sequence
  SiRNA target sequence
ttttccagcttgatagttatttt

SEQ ID NO: 216698 - DNA, 23 bp, Artificial sequence
  SiRNA target sequence
tttccagcttgatagttattttt

SEQ ID NO: 216699 - DNA, 23 bp, Artificial sequence
  SiRNA target sequence
ttccagcttgatagttatttttt

SEQ ID NO: 216700 - DNA, 23 bp, Artificial sequence
  SiRNA target sequence
tccagcttgatagttattttttt

SEQ ID NO: 216701 - DNA, 23 bp, Artificial sequence
  SiRNA target sequence
ccagcttgatagttattttttta

SEQ ID NO: 216702 - DNA, 23 bp, Artificial sequence
  SiRNA target sequence
cagcttgatagttatttttttag

SEQ ID NO: 216703 - DNA, 23 bp, Artificial sequence
  SiRNA target sequence
agcttgatagttatttttttaga

SEQ ID NO: 216704 - DNA, 23 bp, Artificial sequence
  SiRNA target sequence
gcttgatagttatttttttagag

SEQ ID NO: 216705 - DNA, 23 bp, Artificial sequence
  SiRNA target sequence
cttgatagttatttttttagaga

SEQ ID NO: 216706 - DNA, 23 bp, Artificial sequence
  SiRNA target sequence
ttgatagttatttttttagagac

SEQ ID NO: 216707 - DNA, 23 bp, Artificial sequence
  SiRNA target sequence
tgatagttatttttttagagacc

SEQ ID NO: 216708 - DNA, 23 bp, Artificial sequence
  SiRNA target sequence
gatagttatttttttagagacct

SEQ ID NO: 216709 - DNA, 23 bp, Artificial sequence
  SiRNA target sequence
atagttatttttttagagacctt

SEQ ID NO: 216710 - DNA, 23 bp, Artificial sequence
  SiRNA target sequence
tagttatttttttagagaccttt

SEQ ID NO: 216711 - DNA, 23 bp, Artificial sequence
  SiRNA target sequence
agttatttttttagagacctttt

SEQ ID NO: 216712 - DNA, 23 bp, Artificial sequence
  SiRNA target sequence
gttatttttttagagaccttttt

SEQ ID NO: 216713 - DNA, 23 bp, Artificial sequence
  SiRNA target sequence
ttatttttttagagaccttttta

SEQ ID NO: 216714 - DNA, 23 bp, Artificial sequence
  SiRNA target sequence
tatttttttagagacctttttag

SEQ ID NO: 216715 - DNA, 23 bp, Artificial sequence
  SiRNA target sequence
atttttttagagacctttttagt

SEQ ID NO: 216716 - DNA, 23 bp, Artificial sequence
  SiRNA target sequence
tttttttagagacctttttagtg

SEQ ID NO: 216717 - DNA, 23 bp, Artificial sequence
  SiRNA target sequence
ttttttagagacctttttagtga

SEQ ID NO: 216718 - DNA, 23 bp, Artificial sequence
  SiRNA target sequence
tttttagagacctttttagtgat

SEQ ID NO: 216719 - DNA, 23 bp, Artificial sequence
  SiRNA target sequence
ttttagagacctttttagtgatg

SEQ ID NO: 216720 - DNA, 23 bp, Artificial sequence
  SiRNA target sequence
tttagagacctttttagtgatgg

SEQ ID NO: 216721 - DNA, 23 bp, Artificial sequence
  SiRNA target sequence
ttagagacctttttagtgatggg

SEQ ID NO: 216722 - DNA, 23 bp, Artificial sequence
  SiRNA target sequence
tagagacctttttagtgatggga

SEQ ID NO: 216723 - DNA, 23 bp, Artificial sequence
  SiRNA target sequence
agagacctttttagtgatgggaa

SEQ ID NO: 216724 - DNA, 23 bp, Artificial sequence
  SiRNA target sequence
gagacctttttagtgatgggaaa

SEQ ID NO: 216725 - DNA, 23 bp, Artificial sequence
  SiRNA target sequence
agacctttttagtgatgggaaat

SEQ ID NO: 216726 - DNA, 23 bp, Artificial sequence
  SiRNA target sequence
gacctttttagtgatgggaaatg

SEQ ID NO: 216727 - DNA, 23 bp, Artificial sequence
  SiRNA target sequence
acctttttagtgatgggaaatgt

SEQ ID NO: 216728 - DNA, 23 bp, Artificial sequence
  SiRNA target sequence
cctttttagtgatgggaaatgtg

SEQ ID NO: 216729 - DNA, 23 bp, Artificial sequence
  SiRNA target sequence
ctttttagtgatgggaaatgtgt

SEQ ID NO: 216730 - DNA, 23 bp, Artificial sequence
  SiRNA target sequence
tttttagtgatgggaaatgtgtt

SEQ ID NO: 216731 - DNA, 23 bp, Artificial sequence
  SiRNA target sequence
ttttagtgatgggaaatgtgttg

SEQ ID NO: 216732 - DNA, 23 bp, Artificial sequence
  SiRNA target sequence
tttagtgatgggaaatgtgttgt

SEQ ID NO: 216733 - DNA, 23 bp, Artificial sequence
  SiRNA target sequence
ttagtgatgggaaatgtgttgta

SEQ ID NO: 216734 - DNA, 23 bp, Artificial sequence
  SiRNA target sequence
tagtgatgggaaatgtgttgtaa

SEQ ID NO: 216735 - DNA, 23 bp, Artificial sequence
  SiRNA target sequence
agtgatgggaaatgtgttgtaag

SEQ ID NO: 216736 - DNA, 23 bp, Artificial sequence
  SiRNA target sequence
gtgatgggaaatgtgttgtaaga

SEQ ID NO: 216737 - DNA, 23 bp, Artificial sequence
  SiRNA target sequence
tgatgggaaatgtgttgtaagag

SEQ ID NO: 216738 - DNA, 23 bp, Artificial sequence
  SiRNA target sequence
gatgggaaatgtgttgtaagagg

SEQ ID NO: 216739 - DNA, 23 bp, Artificial sequence
  SiRNA target sequence
atgggaaatgtgttgtaagaggc

SEQ ID NO: 216740 - DNA, 23 bp, Artificial sequence
  SiRNA target sequence
tgggaaatgtgttgtaagaggct

SEQ ID NO: 216741 - DNA, 23 bp, Artificial sequence
  SiRNA target sequence
gggaaatgtgttgtaagaggcta

SEQ ID NO: 216742 - DNA, 23 bp, Artificial sequence
  SiRNA target sequence
ggaaatgtgttgtaagaggctat

SEQ ID NO: 216743 - DNA, 23 bp, Artificial sequence
  SiRNA target sequence
gaaatgtgttgtaagaggctatg

SEQ ID NO: 216744 - DNA, 23 bp, Artificial sequence
  SiRNA target sequence
aaatgtgttgtaagaggctatga

SEQ ID NO: 216745 - DNA, 23 bp, Artificial sequence
  SiRNA target sequence
aatgtgttgtaagaggctatgat

SEQ ID NO: 216746 - DNA, 23 bp, Artificial sequence
  SiRNA target sequence
atgtgttgtaagaggctatgatg

SEQ ID NO: 216747 - DNA, 23 bp, Artificial sequence
  SiRNA target sequence
tgtgttgtaagaggctatgatgc

SEQ ID NO: 216748 - DNA, 23 bp, Artificial sequence
  SiRNA target sequence
gtgttgtaagaggctatgatgct

SEQ ID NO: 216749 - DNA, 23 bp, Artificial sequence
  SiRNA target sequence
tgttgtaagaggctatgatgctt

SEQ ID NO: 216750 - DNA, 23 bp, Artificial sequence
  SiRNA target sequence
gttgtaagaggctatgatgcttt

SEQ ID NO: 216751 - DNA, 23 bp, Artificial sequence
  SiRNA target sequence
ttgtaagaggctatgatgcttta

SEQ ID NO: 216752 - DNA, 23 bp, Artificial sequence
  SiRNA target sequence
tgtaagaggctatgatgctttat

SEQ ID NO: 216753 - DNA, 23 bp, Artificial sequence
  SiRNA target sequence
gtaagaggctatgatgctttatt

SEQ ID NO: 216754 - DNA, 23 bp, Artificial sequence
  SiRNA target sequence
taagaggctatgatgctttatta

SEQ ID NO: 216755 - DNA, 23 bp, Artificial sequence
  SiRNA target sequence
aagaggctatgatgctttattat

SEQ ID NO: 216756 - DNA, 23 bp, Artificial sequence
  SiRNA target sequence
agaggctatgatgctttattatc

SEQ ID NO: 216757 - DNA, 23 bp, Artificial sequence
  SiRNA target sequence
gaggctatgatgctttattatct

SEQ ID NO: 216758 - DNA, 23 bp, Artificial sequence
  SiRNA target sequence
aggctatgatgctttattatctt

SEQ ID NO: 216759 - DNA, 23 bp, Artificial sequence
  SiRNA target sequence
ggctatgatgctttattatcttt

SEQ ID NO: 216760 - DNA, 23 bp, Artificial sequence
  SiRNA target sequence
gctatgatgctttattatctttg

SEQ ID NO: 216761 - DNA, 23 bp, Artificial sequence
  SiRNA target sequence
ctatgatgctttattatctttgg

SEQ ID NO: 216762 - DNA, 23 bp, Artificial sequence
  SiRNA target sequence
tatgatgctttattatctttggc

SEQ ID NO: 216763 - DNA, 23 bp, Artificial sequence
  SiRNA target sequence
atgatgctttattatctttggca

SEQ ID NO: 216764 - DNA, 23 bp, Artificial sequence
  SiRNA target sequence
tgatgctttattatctttggcac

SEQ ID NO: 216765 - DNA, 23 bp, Artificial sequence
  SiRNA target sequence
gatgctttattatctttggcact

SEQ ID NO: 216766 - DNA, 23 bp, Artificial sequence
  SiRNA target sequence
atgctttattatctttggcactg

SEQ ID NO: 216767 - DNA, 23 bp, Artificial sequence
  SiRNA target sequence
tgctttattatctttggcactgg

SEQ ID NO: 216768 - DNA, 23 bp, Artificial sequence
  SiRNA target sequence
gctttattatctttggcactggt

SEQ ID NO: 216769 - DNA, 23 bp, Artificial sequence
  SiRNA target sequence
ctttattatctttggcactggtc

SEQ ID NO: 216770 - DNA, 23 bp, Artificial sequence
  SiRNA target sequence
tttattatctttggcactggtct

SEQ ID NO: 216771 - DNA, 23 bp, Artificial sequence
  SiRNA target sequence
ttattatctttggcactggtctt

SEQ ID NO: 216772 - DNA, 23 bp, Artificial sequence
  SiRNA target sequence
tattatctttggcactggtcttt

SEQ ID NO: 216773 - DNA, 23 bp, Artificial sequence
  SiRNA target sequence
attatctttggcactggtcttta

SEQ ID NO: 216774 - DNA, 23 bp, Artificial sequence
  SiRNA target sequence
ttatctttggcactggtctttaa

SEQ ID NO: 216775 - DNA, 23 bp, Artificial sequence
  SiRNA target sequence
tatctttggcactggtctttaac

SEQ ID NO: 216776 - DNA, 23 bp, Artificial sequence
  SiRNA target sequence
atctttggcactggtctttaacg

SEQ ID NO: 216777 - DNA, 23 bp, Artificial sequence
  SiRNA target sequence
tctttggcactggtctttaacga

SEQ ID NO: 216778 - DNA, 23 bp, Artificial sequence
  SiRNA target sequence
ctttggcactggtctttaacgaa

SEQ ID NO: 216779 - DNA, 23 bp, Artificial sequence
  SiRNA target sequence
tttggcactggtctttaacgaat

SEQ ID NO: 216780 - DNA, 23 bp, Artificial sequence
  SiRNA target sequence
ttggcactggtctttaacgaatg

SEQ ID NO: 216781 - DNA, 23 bp, Artificial sequence
  SiRNA target sequence
tggcactggtctttaacgaatgg

SEQ ID NO: 216782 - DNA, 23 bp, Artificial sequence
  SiRNA target sequence
ggcactggtctttaacgaatgga

SEQ ID NO: 216783 - DNA, 23 bp, Artificial sequence
  SiRNA target sequence
gcactggtctttaacgaatggac

SEQ ID NO: 216784 - DNA, 23 bp, Artificial sequence
  SiRNA target sequence
cactggtctttaacgaatggaca

SEQ ID NO: 216785 - DNA, 23 bp, Artificial sequence
  SiRNA target sequence
actggtctttaacgaatggacat

SEQ ID NO: 216786 - DNA, 23 bp, Artificial sequence
  SiRNA target sequence
ctggtctttaacgaatggacatc

SEQ ID NO: 216787 - DNA, 23 bp, Artificial sequence
  SiRNA target sequence
tggtctttaacgaatggacatcc

SEQ ID NO: 216788 - DNA, 23 bp, Artificial sequence
  SiRNA target sequence
ggtctttaacgaatggacatcct

SEQ ID NO: 216789 - DNA, 23 bp, Artificial sequence
  SiRNA target sequence
gtctttaacgaatggacatcctc

SEQ ID NO: 216790 - DNA, 23 bp, Artificial sequence
  SiRNA target sequence
tctttaacgaatggacatcctct

SEQ ID NO: 216791 - DNA, 23 bp, Artificial sequence
  SiRNA target sequence
ctttaacgaatggacatcctctc

SEQ ID NO: 216792 - DNA, 23 bp, Artificial sequence
  SiRNA target sequence
tttaacgaatggacatcctctct

SEQ ID NO: 216793 - DNA, 23 bp, Artificial sequence
  SiRNA target sequence
ttaacgaatggacatcctctcta

SEQ ID NO: 216794 - DNA, 23 bp, Artificial sequence
  SiRNA target sequence
taacgaatggacatcctctctag

SEQ ID NO: 216795 - DNA, 23 bp, Artificial sequence
  SiRNA target sequence
aacgaatggacatcctctctagt

SEQ ID NO: 216796 - DNA, 23 bp, Artificial sequence
  SiRNA target sequence
acgaatggacatcctctctagtt

SEQ ID NO: 216797 - DNA, 23 bp, Artificial sequence
  SiRNA target sequence
cgaatggacatcctctctagttt

SEQ ID NO: 216798 - DNA, 23 bp, Artificial sequence
  SiRNA target sequence
gaatggacatcctctctagttta

SEQ ID NO: 216799 - DNA, 23 bp, Artificial sequence
  SiRNA target sequence
aatggacatcctctctagtttac

SEQ ID NO: 216800 - DNA, 23 bp, Artificial sequence
  SiRNA target sequence
atggacatcctctctagtttaca

SEQ ID NO: 216801 - DNA, 23 bp, Artificial sequence
  SiRNA target sequence
tggacatcctctctagtttacat

SEQ ID NO: 216802 - DNA, 23 bp, Artificial sequence
  SiRNA target sequence
ggacatcctctctagtttacatt

SEQ ID NO: 216803 - DNA, 23 bp, Artificial sequence
  SiRNA target sequence
gacatcctctctagtttacattg

SEQ ID NO: 216804 - DNA, 23 bp, Artificial sequence
  SiRNA target sequence
acatcctctctagtttacattgt

SEQ ID NO: 216805 - DNA, 23 bp, Artificial sequence
  SiRNA target sequence
catcctctctagtttacattgtt

SEQ ID NO: 216806 - DNA, 23 bp, Artificial sequence
  SiRNA target sequence
atcctctctagtttacattgttt

SEQ ID NO: 216807 - DNA, 23 bp, Artificial sequence
  SiRNA target sequence
tcctctctagtttacattgtttc

SEQ ID NO: 216808 - DNA, 23 bp, Artificial sequence
  SiRNA target sequence
cctctctagtttacattgtttca

SEQ ID NO: 216809 - DNA, 23 bp, Artificial sequence
  SiRNA target sequence
ctctctagtttacattgtttcag

SEQ ID NO: 216810 - DNA, 23 bp, Artificial sequence
  SiRNA target sequence
tctctagtttacattgtttcaga

SEQ ID NO: 216811 - DNA, 23 bp, Artificial sequence
  SiRNA target sequence
ctctagtttacattgtttcagaa

SEQ ID NO: 216812 - DNA, 23 bp, Artificial sequence
  SiRNA target sequence
tctagtttacattgtttcagaaa

SEQ ID NO: 216813 - DNA, 23 bp, Artificial sequence
  SiRNA target sequence
ctagtttacattgtttcagaaat

SEQ ID NO: 216814 - DNA, 23 bp, Artificial sequence
  SiRNA target sequence
tagtttacattgtttcagaaatg

SEQ ID NO: 216815 - DNA, 23 bp, Artificial sequence
  SiRNA target sequence
agtttacattgtttcagaaatgt

SEQ ID NO: 216816 - DNA, 23 bp, Artificial sequence
  SiRNA target sequence
gtttacattgtttcagaaatgtt

SEQ ID NO: 216817 - DNA, 23 bp, Artificial sequence
  SiRNA target sequence
tttacattgtttcagaaatgttt

SEQ ID NO: 216818 - DNA, 23 bp, Artificial sequence
  SiRNA target sequence
ttacattgtttcagaaatgtttg

SEQ ID NO: 216819 - DNA, 23 bp, Artificial sequence
  SiRNA target sequence
tacattgtttcagaaatgtttgg

SEQ ID NO: 216820 - DNA, 23 bp, Artificial sequence
  SiRNA target sequence
acattgtttcagaaatgtttggt

SEQ ID NO: 216821 - DNA, 23 bp, Artificial sequence
  SiRNA target sequence
cattgtttcagaaatgtttggta

SEQ ID NO: 216822 - DNA, 23 bp, Artificial sequence
  SiRNA target sequence
attgtttcagaaatgtttggtaa

SEQ ID NO: 216823 - DNA, 23 bp, Artificial sequence
  SiRNA target sequence
ttgtttcagaaatgtttggtaat

SEQ ID NO: 216824 - DNA, 23 bp, Artificial sequence
  SiRNA target sequence
tgtttcagaaatgtttggtaatt

SEQ ID NO: 216825 - DNA, 23 bp, Artificial sequence
  SiRNA target sequence
gtttcagaaatgtttggtaattt

SEQ ID NO: 216826 - DNA, 23 bp, Artificial sequence
  SiRNA target sequence
tttcagaaatgtttggtaattta

SEQ ID NO: 216827 - DNA, 23 bp, Artificial sequence
  SiRNA target sequence
ttcagaaatgtttggtaatttag

SEQ ID NO: 216828 - DNA, 23 bp, Artificial sequence
  SiRNA target sequence
tcagaaatgtttggtaatttagt

SEQ ID NO: 216829 - DNA, 23 bp, Artificial sequence
  SiRNA target sequence
cagaaatgtttggtaatttagta

SEQ ID NO: 216830 - DNA, 23 bp, Artificial sequence
  SiRNA target sequence
agaaatgtttggtaatttagtat

SEQ ID NO: 216831 - DNA, 23 bp, Artificial sequence
  SiRNA target sequence
gaaatgtttggtaatttagtatt

SEQ ID NO: 216832 - DNA, 23 bp, Artificial sequence
  SiRNA target sequence
aaatgtttggtaatttagtattg

SEQ ID NO: 216833 - DNA, 23 bp, Artificial sequence
  SiRNA target sequence
aatgtttggtaatttagtattgt

SEQ ID NO: 216834 - DNA, 23 bp, Artificial sequence
  SiRNA target sequence
atgtttggtaatttagtattgtc

SEQ ID NO: 216835 - DNA, 23 bp, Artificial sequence
  SiRNA target sequence
tgtttggtaatttagtattgtct

SEQ ID NO: 216836 - DNA, 23 bp, Artificial sequence
  SiRNA target sequence
gtttggtaatttagtattgtctt

SEQ ID NO: 216837 - DNA, 23 bp, Artificial sequence
  SiRNA target sequence
tttggtaatttagtattgtctta

SEQ ID NO: 216838 - DNA, 23 bp, Artificial sequence
  SiRNA target sequence
ttggtaatttagtattgtcttat

SEQ ID NO: 216839 - DNA, 23 bp, Artificial sequence
  SiRNA target sequence
tggtaatttagtattgtcttatt

SEQ ID NO: 216840 - DNA, 23 bp, Artificial sequence
  SiRNA target sequence
ggtaatttagtattgtcttattt

SEQ ID NO: 216841 - DNA, 23 bp, Artificial sequence
  SiRNA target sequence
gtaatttagtattgtcttatttc

SEQ ID NO: 216842 - DNA, 23 bp, Artificial sequence
  SiRNA target sequence
taatttagtattgtcttatttct

SEQ ID NO: 216843 - DNA, 23 bp, Artificial sequence
  SiRNA target sequence
aatttagtattgtcttatttctt

SEQ ID NO: 216844 - DNA, 23 bp, Artificial sequence
  SiRNA target sequence
atttagtattgtcttatttcttc

SEQ ID NO: 216845 - DNA, 23 bp, Artificial sequence
  SiRNA target sequence
tttagtattgtcttatttcttct

SEQ ID NO: 216846 - DNA, 23 bp, Artificial sequence
  SiRNA target sequence
ttagtattgtcttatttcttctt

SEQ ID NO: 216847 - DNA, 23 bp, Artificial sequence
  SiRNA target sequence
tagtattgtcttatttcttcttg

SEQ ID NO: 216848 - DNA, 23 bp, Artificial sequence
  SiRNA target sequence
agtattgtcttatttcttcttga

SEQ ID NO: 216849 - DNA, 23 bp, Artificial sequence
  SiRNA target sequence
gtattgtcttatttcttcttgac

SEQ ID NO: 216850 - DNA, 23 bp, Artificial sequence
  SiRNA target sequence
tattgtcttatttcttcttgacg

SEQ ID NO: 216851 - DNA, 23 bp, Artificial sequence
  SiRNA target sequence
attgtcttatttcttcttgacgt

SEQ ID NO: 216852 - DNA, 23 bp, Artificial sequence
  SiRNA target sequence
ttgtcttatttcttcttgacgtt

SEQ ID NO: 216853 - DNA, 23 bp, Artificial sequence
  SiRNA target sequence
tgtcttatttcttcttgacgttt

SEQ ID NO: 216854 - DNA, 23 bp, Artificial sequence
  SiRNA target sequence
gtcttatttcttcttgacgtttg

SEQ ID NO: 216855 - DNA, 23 bp, Artificial sequence
  SiRNA target sequence
tcttatttcttcttgacgtttgc

SEQ ID NO: 216856 - DNA, 23 bp, Artificial sequence
  SiRNA target sequence
cttatttcttcttgacgtttgct

SEQ ID NO: 216857 - DNA, 23 bp, Artificial sequence
  SiRNA target sequence
ttatttcttcttgacgtttgcta

SEQ ID NO: 216858 - DNA, 23 bp, Artificial sequence
  SiRNA target sequence
tatttcttcttgacgtttgctaa

SEQ ID NO: 216859 - DNA, 23 bp, Artificial sequence
  SiRNA target sequence
atttcttcttgacgtttgctaat

SEQ ID NO: 216860 - DNA, 23 bp, Artificial sequence
  SiRNA target sequence
tttcttcttgacgtttgctaatt

SEQ ID NO: 216861 - DNA, 23 bp, Artificial sequence
  SiRNA target sequence
ttcttcttgacgtttgctaattc

SEQ ID NO: 216862 - DNA, 23 bp, Artificial sequence
  SiRNA target sequence
tcttcttgacgtttgctaattct

SEQ ID NO: 216863 - DNA, 23 bp, Artificial sequence
  SiRNA target sequence
cttcttgacgtttgctaattctt

SEQ ID NO: 216864 - DNA, 23 bp, Artificial sequence
  SiRNA target sequence
ttcttgacgtttgctaattcttt

SEQ ID NO: 216865 - DNA, 23 bp, Artificial sequence
  SiRNA target sequence
tcttgacgtttgctaattcttta

SEQ ID NO: 216866 - DNA, 23 bp, Artificial sequence
  SiRNA target sequence
cttgacgtttgctaattctttaa

SEQ ID NO: 216867 - DNA, 23 bp, Artificial sequence
  SiRNA target sequence
ttgacgtttgctaattctttaac

SEQ ID NO: 216868 - DNA, 23 bp, Artificial sequence
  SiRNA target sequence
tgacgtttgctaattctttaaca

SEQ ID NO: 216869 - DNA, 23 bp, Artificial sequence
  SiRNA target sequence
gacgtttgctaattctttaacaa

SEQ ID NO: 216870 - DNA, 23 bp, Artificial sequence
  SiRNA target sequence
acgtttgctaattctttaacaac

SEQ ID NO: 216871 - DNA, 23 bp, Artificial sequence
  SiRNA target sequence
cgtttgctaattctttaacaact

SEQ ID NO: 216872 - DNA, 23 bp, Artificial sequence
  SiRNA target sequence
gtttgctaattctttaacaactc

SEQ ID NO: 216873 - DNA, 23 bp, Artificial sequence
  SiRNA target sequence
tttgctaattctttaacaactcc

SEQ ID NO: 216874 - DNA, 23 bp, Artificial sequence
  SiRNA target sequence
ttgctaattctttaacaactcca

SEQ ID NO: 216875 - DNA, 23 bp, Artificial sequence
  SiRNA target sequence
tgctaattctttaacaactccag

SEQ ID NO: 216876 - DNA, 23 bp, Artificial sequence
  SiRNA target sequence
gctaattctttaacaactccagg

SEQ ID NO: 216877 - DNA, 23 bp, Artificial sequence
  SiRNA target sequence
ctaattctttaacaactccagga

SEQ ID NO: 216878 - DNA, 23 bp, Artificial sequence
  SiRNA target sequence
taattctttaacaactccaggac

SEQ ID NO: 216879 - DNA, 23 bp, Artificial sequence
  SiRNA target sequence
aattctttaacaactccaggaca

SEQ ID NO: 216880 - DNA, 23 bp, Artificial sequence
  SiRNA target sequence
attctttaacaactccaggacaa

SEQ ID NO: 216881 - DNA, 23 bp, Artificial sequence
  SiRNA target sequence
ttctttaacaactccaggacaaa

SEQ ID NO: 216882 - DNA, 23 bp, Artificial sequence
  SiRNA target sequence
tctttaacaactccaggacaaag

SEQ ID NO: 216883 - DNA, 23 bp, Artificial sequence
  SiRNA target sequence
ctttaacaactccaggacaaagt

SEQ ID NO: 216884 - DNA, 23 bp, Artificial sequence
  SiRNA target sequence
tttaacaactccaggacaaagtg

SEQ ID NO: 216885 - DNA, 23 bp, Artificial sequence
  SiRNA target sequence
ttaacaactccaggacaaagtgc

SEQ ID NO: 216886 - DNA, 23 bp, Artificial sequence
  SiRNA target sequence
taacaactccaggacaaagtgca

SEQ ID NO: 216887 - DNA, 23 bp, Artificial sequence
  SiRNA target sequence
aacaactccaggacaaagtgcaa

SEQ ID NO: 216888 - DNA, 23 bp, Artificial sequence
  SiRNA target sequence
acaactccaggacaaagtgcaag

SEQ ID NO: 216889 - DNA, 23 bp, Artificial sequence
  SiRNA target sequence
caactccaggacaaagtgcaaga

SEQ ID NO: 216890 - DNA, 23 bp, Artificial sequence
  SiRNA target sequence
aactccaggacaaagtgcaagat

SEQ ID NO: 216891 - DNA, 23 bp, Artificial sequence
  SiRNA target sequence
actccaggacaaagtgcaagatt

SEQ ID NO: 216892 - DNA, 23 bp, Artificial sequence
  SiRNA target sequence
ctccaggacaaagtgcaagattc

SEQ ID NO: 216893 - DNA, 23 bp, Artificial sequence
  SiRNA target sequence
tccaggacaaagtgcaagattca

SEQ ID NO: 216894 - DNA, 23 bp, Artificial sequence
  SiRNA target sequence
ccaggacaaagtgcaagattcat

SEQ ID NO: 216895 - DNA, 23 bp, Artificial sequence
  SiRNA target sequence
caggacaaagtgcaagattcata

SEQ ID NO: 216896 - DNA, 23 bp, Artificial sequence
  SiRNA target sequence
aggacaaagtgcaagattcatac

SEQ ID NO: 216897 - DNA, 23 bp, Artificial sequence
  SiRNA target sequence
ggacaaagtgcaagattcatacc

SEQ ID NO: 216898 - DNA, 23 bp, Artificial sequence
  SiRNA target sequence
gacaaagtgcaagattcatacct

SEQ ID NO: 216899 - DNA, 23 bp, Artificial sequence
  SiRNA target sequence
acaaagtgcaagattcatacctt

SEQ ID NO: 216900 - DNA, 23 bp, Artificial sequence
  SiRNA target sequence
caaagtgcaagattcataccttt

SEQ ID NO: 216901 - DNA, 23 bp, Artificial sequence
  SiRNA target sequence
aaagtgcaagattcataccttta

SEQ ID NO: 216902 - DNA, 23 bp, Artificial sequence
  SiRNA target sequence
aagtgcaagattcatacctttat

SEQ ID NO: 216903 - DNA, 23 bp, Artificial sequence
  SiRNA target sequence
agtgcaagattcatacctttatt

SEQ ID NO: 216904 - DNA, 23 bp, Artificial sequence
  SiRNA target sequence
gtgcaagattcatacctttattt

SEQ ID NO: 216905 - DNA, 23 bp, Artificial sequence
  SiRNA target sequence
tgcaagattcatacctttatttt

SEQ ID NO: 216906 - DNA, 23 bp, Artificial sequence
  SiRNA target sequence
gcaagattcatacctttatttta

SEQ ID NO: 216907 - DNA, 23 bp, Artificial sequence
  SiRNA target sequence
caagattcatacctttattttat

SEQ ID NO: 216908 - DNA, 23 bp, Artificial sequence
  SiRNA target sequence
aagattcatacctttattttatg

SEQ ID NO: 216909 - DNA, 23 bp, Artificial sequence
  SiRNA target sequence
agattcatacctttattttatgt

SEQ ID NO: 216910 - DNA, 23 bp, Artificial sequence
  SiRNA target sequence
gattcatacctttattttatgtt

SEQ ID NO: 216911 - DNA, 23 bp, Artificial sequence
  SiRNA target sequence
attcatacctttattttatgttt

SEQ ID NO: 216912 - DNA, 23 bp, Artificial sequence
  SiRNA target sequence
ttcatacctttattttatgtttt

SEQ ID NO: 216913 - DNA, 23 bp, Artificial sequence
  SiRNA target sequence
tcatacctttattttatgttttc

SEQ ID NO: 216914 - DNA, 23 bp, Artificial sequence
  SiRNA target sequence
catacctttattttatgttttct

SEQ ID NO: 216915 - DNA, 23 bp, Artificial sequence
  SiRNA target sequence
atacctttattttatgttttctc

SEQ ID NO: 216916 - DNA, 23 bp, Artificial sequence
  SiRNA target sequence
tacctttattttatgttttctcg

SEQ ID NO: 216917 - DNA, 23 bp, Artificial sequence
  SiRNA target sequence
acctttattttatgttttctcga

SEQ ID NO: 216918 - DNA, 23 bp, Artificial sequence
  SiRNA target sequence
cctttattttatgttttctcgaa

SEQ ID NO: 216919 - DNA, 23 bp, Artificial sequence
  SiRNA target sequence
ctttattttatgttttctcgaat

SEQ ID NO: 216920 - DNA, 23 bp, Artificial sequence
  SiRNA target sequence
tttattttatgttttctcgaata

SEQ ID NO: 216921 - DNA, 23 bp, Artificial sequence
  SiRNA target sequence
ttattttatgttttctcgaatat

SEQ ID NO: 216922 - DNA, 23 bp, Artificial sequence
  SiRNA target sequence
tattttatgttttctcgaatatt

SEQ ID NO: 216923 - DNA, 23 bp, Artificial sequence
  SiRNA target sequence
attttatgttttctcgaatattt

SEQ ID NO: 216924 - DNA, 23 bp, Artificial sequence
  SiRNA target sequence
ttttatgttttctcgaatatttc

SEQ ID NO: 216925 - DNA, 23 bp, Artificial sequence
  SiRNA target sequence
tttatgttttctcgaatatttct

SEQ ID NO: 216926 - DNA, 23 bp, Artificial sequence
  SiRNA target sequence
ttatgttttctcgaatatttctc

SEQ ID NO: 216927 - DNA, 23 bp, Artificial sequence
  SiRNA target sequence
tatgttttctcgaatatttctct

SEQ ID NO: 216928 - DNA, 23 bp, Artificial sequence
  SiRNA target sequence
atgttttctcgaatatttctctt

SEQ ID NO: 216929 - DNA, 23 bp, Artificial sequence
  SiRNA target sequence
tgttttctcgaatatttctcttt

SEQ ID NO: 216930 - DNA, 23 bp, Artificial sequence
  SiRNA target sequence
gttttctcgaatatttctctttt

SEQ ID NO: 216931 - DNA, 23 bp, Artificial sequence
  SiRNA target sequence
ttttctcgaatatttctcttttc

SEQ ID NO: 216932 - DNA, 23 bp, Artificial sequence
  SiRNA target sequence
tttctcgaatatttctcttttct

SEQ ID NO: 216933 - DNA, 23 bp, Artificial sequence
  SiRNA target sequence
ttctcgaatatttctcttttctt

SEQ ID NO: 216934 - DNA, 23 bp, Artificial sequence
  SiRNA target sequence
tctcgaatatttctcttttctta

SEQ ID NO: 216935 - DNA, 23 bp, Artificial sequence
  SiRNA target sequence
ctcgaatatttctcttttcttat

SEQ ID NO: 216936 - DNA, 23 bp, Artificial sequence
  SiRNA target sequence
tcgaatatttctcttttcttatc

SEQ ID NO: 216937 - DNA, 23 bp, Artificial sequence
  SiRNA target sequence
cgaatatttctcttttcttatct

SEQ ID NO: 216938 - DNA, 23 bp, Artificial sequence
  SiRNA target sequence
gaatatttctcttttcttatctt

SEQ ID NO: 216939 - DNA, 23 bp, Artificial sequence
  SiRNA target sequence
aatatttctcttttcttatcttc

SEQ ID NO: 216940 - DNA, 23 bp, Artificial sequence
  SiRNA target sequence
atatttctcttttcttatcttct

SEQ ID NO: 216941 - DNA, 23 bp, Artificial sequence
  SiRNA target sequence
tatttctcttttcttatcttctc

SEQ ID NO: 216942 - DNA, 23 bp, Artificial sequence
  SiRNA target sequence
atttctcttttcttatcttctca

SEQ ID NO: 216943 - DNA, 23 bp, Artificial sequence
  SiRNA target sequence
tttctcttttcttatcttctcaa

SEQ ID NO: 216944 - DNA, 23 bp, Artificial sequence
  SiRNA target sequence
ttctcttttcttatcttctcaag

SEQ ID NO: 216945 - DNA, 23 bp, Artificial sequence
  SiRNA target sequence
tctcttttcttatcttctcaagt

SEQ ID NO: 216946 - DNA, 23 bp, Artificial sequence
  SiRNA target sequence
ctcttttcttatcttctcaagtg

SEQ ID NO: 216947 - DNA, 23 bp, Artificial sequence
  SiRNA target sequence
tcttttcttatcttctcaagtga

SEQ ID NO: 216948 - DNA, 23 bp, Artificial sequence
  SiRNA target sequence
cttttcttatcttctcaagtgac

SEQ ID NO: 216949 - DNA, 23 bp, Artificial sequence
  SiRNA target sequence
ttttcttatcttctcaagtgaca

SEQ ID NO: 216950 - DNA, 23 bp, Artificial sequence
  SiRNA target sequence
tttcttatcttctcaagtgacag

SEQ ID NO: 216951 - DNA, 23 bp, Artificial sequence
  SiRNA target sequence
ttcttatcttctcaagtgacaga

SEQ ID NO: 216952 - DNA, 23 bp, Artificial sequence
  SiRNA target sequence
tcttatcttctcaagtgacagaa

SEQ ID NO: 216953 - DNA, 23 bp, Artificial sequence
  SiRNA target sequence
cttatcttctcaagtgacagaac

SEQ ID NO: 216954 - DNA, 23 bp, Artificial sequence
  SiRNA target sequence
ttatcttctcaagtgacagaact

SEQ ID NO: 216955 - DNA, 23 bp, Artificial sequence
  SiRNA target sequence
tatcttctcaagtgacagaactt

SEQ ID NO: 216956 - DNA, 23 bp, Artificial sequence
  SiRNA target sequence
atcttctcaagtgacagaacttt

SEQ ID NO: 216957 - DNA, 23 bp, Artificial sequence
  SiRNA target sequence
tcttctcaagtgacagaactttt

SEQ ID NO: 216958 - DNA, 23 bp, Artificial sequence
  SiRNA target sequence
cttctcaagtgacagaacttttt

SEQ ID NO: 216959 - DNA, 23 bp, Artificial sequence
  SiRNA target sequence
ttctcaagtgacagaacttttta

SEQ ID NO: 216960 - DNA, 23 bp, Artificial sequence
  SiRNA target sequence
tctcaagtgacagaactttttac

SEQ ID NO: 216961 - DNA, 23 bp, Artificial sequence
  SiRNA target sequence
ctcaagtgacagaactttttaca

SEQ ID NO: 216962 - DNA, 23 bp, Artificial sequence
  SiRNA target sequence
tcaagtgacagaactttttacaa

SEQ ID NO: 216963 - DNA, 23 bp, Artificial sequence
  SiRNA target sequence
caagtgacagaactttttacaag

SEQ ID NO: 216964 - DNA, 23 bp, Artificial sequence
  SiRNA target sequence
aagtgacagaactttttacaaga

SEQ ID NO: 216965 - DNA, 23 bp, Artificial sequence
  SiRNA target sequence
agtgacagaactttttacaagat

SEQ ID NO: 216966 - DNA, 23 bp, Artificial sequence
  SiRNA target sequence
gtgacagaactttttacaagata

SEQ ID NO: 216967 - DNA, 23 bp, Artificial sequence
  SiRNA target sequence
tgacagaactttttacaagatat

SEQ ID NO: 216968 - DNA, 23 bp, Artificial sequence
  SiRNA target sequence
gacagaactttttacaagatata

SEQ ID NO: 216969 - DNA, 23 bp, Artificial sequence
  SiRNA target sequence
acagaactttttacaagatatag

SEQ ID NO: 216970 - DNA, 23 bp, Artificial sequence
  SiRNA target sequence
cagaactttttacaagatataga

SEQ ID NO: 216971 - DNA, 23 bp, Artificial sequence
  SiRNA target sequence
agaactttttacaagatatagat

SEQ ID NO: 216972 - DNA, 23 bp, Artificial sequence
  SiRNA target sequence
gaactttttacaagatatagatc

SEQ ID NO: 216973 - DNA, 23 bp, Artificial sequence
  SiRNA target sequence
aactttttacaagatatagatca

SEQ ID NO: 216974 - DNA, 23 bp, Artificial sequence
  SiRNA target sequence
actttttacaagatatagatcaa

SEQ ID NO: 216975 - DNA, 23 bp, Artificial sequence
  SiRNA target sequence
ctttttacaagatatagatcaaa

SEQ ID NO: 216976 - DNA, 23 bp, Artificial sequence
  SiRNA target sequence
tttttacaagatatagatcaaag

SEQ ID NO: 216977 - DNA, 23 bp, Artificial sequence
  SiRNA target sequence
ttttacaagatatagatcaaagc

SEQ ID NO: 216978 - DNA, 23 bp, Artificial sequence
  SiRNA target sequence
tttacaagatatagatcaaagct

SEQ ID NO: 216979 - DNA, 23 bp, Artificial sequence
  SiRNA target sequence
ttacaagatatagatcaaagctc

SEQ ID NO: 216980 - DNA, 23 bp, Artificial sequence
  SiRNA target sequence
tacaagatatagatcaaagctca

SEQ ID NO: 216981 - DNA, 23 bp, Artificial sequence
  SiRNA target sequence
acaagatatagatcaaagctcac

SEQ ID NO: 216982 - DNA, 23 bp, Artificial sequence
  SiRNA target sequence
caagatatagatcaaagctcact

SEQ ID NO: 216983 - DNA, 23 bp, Artificial sequence
  SiRNA target sequence
aagatatagatcaaagctcactt

SEQ ID NO: 216984 - DNA, 23 bp, Artificial sequence
  SiRNA target sequence
agatatagatcaaagctcacttt

SEQ ID NO: 216985 - DNA, 23 bp, Artificial sequence
  SiRNA target sequence
gatatagatcaaagctcactttc

SEQ ID NO: 216986 - DNA, 23 bp, Artificial sequence
  SiRNA target sequence
atatagatcaaagctcactttct

SEQ ID NO: 216987 - DNA, 23 bp, Artificial sequence
  SiRNA target sequence
tatagatcaaagctcactttctc

SEQ ID NO: 216988 - DNA, 23 bp, Artificial sequence
  SiRNA target sequence
atagatcaaagctcactttctca

SEQ ID NO: 216989 - DNA, 23 bp, Artificial sequence
  SiRNA target sequence
tagatcaaagctcactttctcag

SEQ ID NO: 216990 - DNA, 23 bp, Artificial sequence
  SiRNA target sequence
agatcaaagctcactttctcaga

SEQ ID NO: 216991 - DNA, 23 bp, Artificial sequence
  SiRNA target sequence
gatcaaagctcactttctcagag

SEQ ID NO: 216992 - DNA, 23 bp, Artificial sequence
  SiRNA target sequence
atcaaagctcactttctcagagg

SEQ ID NO: 216993 - DNA, 23 bp, Artificial sequence
  SiRNA target sequence
tcaaagctcactttctcagaggc

SEQ ID NO: 216994 - DNA, 23 bp, Artificial sequence
  SiRNA target sequence
caaagctcactttctcagaggcg

SEQ ID NO: 216995 - DNA, 23 bp, Artificial sequence
  SiRNA target sequence
aaagctcactttctcagaggcgg

SEQ ID NO: 216996 - DNA, 23 bp, Artificial sequence
  SiRNA target sequence
aagctcactttctcagaggcgga

SEQ ID NO: 216997 - DNA, 23 bp, Artificial sequence
  SiRNA target sequence
agctcactttctcagaggcggaa

SEQ ID NO: 216998 - DNA, 23 bp, Artificial sequence
  SiRNA target sequence
gctcactttctcagaggcggaat

SEQ ID NO: 216999 - DNA, 23 bp, Artificial sequence
  SiRNA target sequence
ctcactttctcagaggcggaatt

SEQ ID NO: 217000 - DNA, 23 bp, Artificial sequence
  SiRNA target sequence
tcactttctcagaggcggaattt

SEQ ID NO: 217001 - DNA, 23 bp, Artificial sequence
  SiRNA target sequence
cactttctcagaggcggaatttt

SEQ ID NO: 217002 - DNA, 23 bp, Artificial sequence
  SiRNA target sequence
actttctcagaggcggaattttt

SEQ ID NO: 217003 - DNA, 23 bp, Artificial sequence
  SiRNA target sequence
ctttctcagaggcggaattttta

SEQ ID NO: 217004 - DNA, 23 bp, Artificial sequence
  SiRNA target sequence
tttctcagaggcggaatttttat

SEQ ID NO: 217005 - DNA, 23 bp, Artificial sequence
  SiRNA target sequence
ttctcagaggcggaatttttata

SEQ ID NO: 217006 - DNA, 23 bp, Artificial sequence
  SiRNA target sequence
tctcagaggcggaatttttatat

SEQ ID NO: 217007 - DNA, 23 bp, Artificial sequence
  SiRNA target sequence
ctcagaggcggaatttttatata

SEQ ID NO: 217008 - DNA, 23 bp, Artificial sequence
  SiRNA target sequence
tcagaggcggaatttttatataa

SEQ ID NO: 217009 - DNA, 23 bp, Artificial sequence
  SiRNA target sequence
cagaggcggaatttttatataat

SEQ ID NO: 217010 - DNA, 23 bp, Artificial sequence
  SiRNA target sequence
agaggcggaatttttatataatg

SEQ ID NO: 217011 - DNA, 23 bp, Artificial sequence
  SiRNA target sequence
gaggcggaatttttatataatgg

SEQ ID NO: 217012 - DNA, 23 bp, Artificial sequence
  SiRNA target sequence
aggcggaatttttatataatggc

SEQ ID NO: 217013 - DNA, 23 bp, Artificial sequence
  SiRNA target sequence
ggcggaatttttatataatggct

SEQ ID NO: 217014 - DNA, 23 bp, Artificial sequence
  SiRNA target sequence
gcggaatttttatataatggctt

SEQ ID NO: 217015 - DNA, 23 bp, Artificial sequence
  SiRNA target sequence
cggaatttttatataatggcttt

SEQ ID NO: 217016 - DNA, 23 bp, Artificial sequence
  SiRNA target sequence
ggaatttttatataatggctttt

SEQ ID NO: 217017 - DNA, 23 bp, Artificial sequence
  SiRNA target sequence
gaatttttatataatggcttttt

SEQ ID NO: 217018 - DNA, 23 bp, Artificial sequence
  SiRNA target sequence
aatttttatataatggctttttt

SEQ ID NO: 217019 - DNA, 23 bp, Artificial sequence
  SiRNA target sequence
atttttatataatggcttttttg

SEQ ID NO: 217020 - DNA, 23 bp, Artificial sequence
  SiRNA target sequence
tttttatataatggcttttttgt

SEQ ID NO: 217021 - DNA, 23 bp, Artificial sequence
  SiRNA target sequence
ttttatataatggcttttttgta

SEQ ID NO: 217022 - DNA, 23 bp, Artificial sequence
  SiRNA target sequence
tttatataatggcttttttgtat

SEQ ID NO: 217023 - DNA, 23 bp, Artificial sequence
  SiRNA target sequence
ttatataatggcttttttgtatt

SEQ ID NO: 217024 - DNA, 23 bp, Artificial sequence
  SiRNA target sequence
tatataatggcttttttgtattt

SEQ ID NO: 217025 - DNA, 23 bp, Artificial sequence
  SiRNA target sequence
atataatggcttttttgtatttt

SEQ ID NO: 217026 - DNA, 23 bp, Artificial sequence
  SiRNA target sequence
tataatggcttttttgtattttc

SEQ ID NO: 217027 - DNA, 23 bp, Artificial sequence
  SiRNA target sequence
ataatggcttttttgtattttct

SEQ ID NO: 217028 - DNA, 23 bp, Artificial sequence
  SiRNA target sequence
taatggcttttttgtattttctg

SEQ ID NO: 217029 - DNA, 23 bp, Artificial sequence
  SiRNA target sequence
aatggcttttttgtattttctgg

SEQ ID NO: 217030 - DNA, 23 bp, Artificial sequence
  SiRNA target sequence
atggcttttttgtattttctgga

SEQ ID NO: 217031 - DNA, 23 bp, Artificial sequence
  SiRNA target sequence
tggcttttttgtattttctggag

SEQ ID NO: 217032 - DNA, 23 bp, Artificial sequence
  SiRNA target sequence
ggcttttttgtattttctggagt

SEQ ID NO: 217033 - DNA, 23 bp, Artificial sequence
  SiRNA target sequence
gcttttttgtattttctggagtt

SEQ ID NO: 217034 - DNA, 23 bp, Artificial sequence
  SiRNA target sequence
cttttttgtattttctggagttc

SEQ ID NO: 217035 - DNA, 23 bp, Artificial sequence
  SiRNA target sequence
ttttttgtattttctggagttct

SEQ ID NO: 217036 - DNA, 23 bp, Artificial sequence
  SiRNA target sequence
tttttgtattttctggagttcta

SEQ ID NO: 217037 - DNA, 23 bp, Artificial sequence
  SiRNA target sequence
ttttgtattttctggagttctag

SEQ ID NO: 217038 - DNA, 23 bp, Artificial sequence
  SiRNA target sequence
tttgtattttctggagttctagt

SEQ ID NO: 217039 - DNA, 23 bp, Artificial sequence
  SiRNA target sequence
ttgtattttctggagttctagta

SEQ ID NO: 217040 - DNA, 23 bp, Artificial sequence
  SiRNA target sequence
tgtattttctggagttctagtaa

SEQ ID NO: 217041 - DNA, 23 bp, Artificial sequence
  SiRNA target sequence
gtattttctggagttctagtaat

SEQ ID NO: 217042 - DNA, 23 bp, Artificial sequence
  SiRNA target sequence
tattttctggagttctagtaata

SEQ ID NO: 217043 - DNA, 23 bp, Artificial sequence
  SiRNA target sequence
attttctggagttctagtaatag

SEQ ID NO: 217044 - DNA, 23 bp, Artificial sequence
  SiRNA target sequence
ttttctggagttctagtaatagt

SEQ ID NO: 217045 - DNA, 23 bp, Artificial sequence
  SiRNA target sequence
tttctggagttctagtaatagtt

SEQ ID NO: 217046 - DNA, 23 bp, Artificial sequence
  SiRNA target sequence
ttctggagttctagtaatagtta

SEQ ID NO: 217047 - DNA, 23 bp, Artificial sequence
  SiRNA target sequence
tctggagttctagtaatagttat

SEQ ID NO: 217048 - DNA, 23 bp, Artificial sequence
  SiRNA target sequence
ctggagttctagtaatagttata

SEQ ID NO: 217049 - DNA, 23 bp, Artificial sequence
  SiRNA target sequence
tggagttctagtaatagttatat

SEQ ID NO: 217050 - DNA, 23 bp, Artificial sequence
  SiRNA target sequence
ggagttctagtaatagttatatt

SEQ ID NO: 217051 - DNA, 23 bp, Artificial sequence
  SiRNA target sequence
gagttctagtaatagttatattt

SEQ ID NO: 217052 - DNA, 23 bp, Artificial sequence
  SiRNA target sequence
agttctagtaatagttatatttt

SEQ ID NO: 217053 - DNA, 23 bp, Artificial sequence
  SiRNA target sequence
gttctagtaatagttatattttt

SEQ ID NO: 217054 - DNA, 23 bp, Artificial sequence
  SiRNA target sequence
ttctagtaatagttatattttta

SEQ ID NO: 217055 - DNA, 23 bp, Artificial sequence
  SiRNA target sequence
tctagtaatagttatatttttaa

SEQ ID NO: 217056 - DNA, 23 bp, Artificial sequence
  SiRNA target sequence
ctagtaatagttatatttttaat

SEQ ID NO: 217057 - DNA, 23 bp, Artificial sequence
  SiRNA target sequence
tagtaatagttatatttttaatt

SEQ ID NO: 217058 - DNA, 23 bp, Artificial sequence
  SiRNA target sequence
agtaatagttatatttttaatta

SEQ ID NO: 217059 - DNA, 23 bp, Artificial sequence
  SiRNA target sequence
gtaatagttatatttttaattaa

SEQ ID NO: 217060 - DNA, 23 bp, Artificial sequence
  SiRNA target sequence
taatagttatatttttaattaaa

SEQ ID NO: 217061 - DNA, 23 bp, Artificial sequence
  SiRNA target sequence
aatagttatatttttaattaaaa

SEQ ID NO: 217062 - DNA, 23 bp, Artificial sequence
  SiRNA target sequence
atagttatatttttaattaaaaa

SEQ ID NO: 217063 - DNA, 23 bp, Artificial sequence
  SiRNA target sequence
tagttatatttttaattaaaaaa

SEQ ID NO: 217064 - DNA, 23 bp, Artificial sequence
  SiRNA target sequence
agttatatttttaattaaaaaat

SEQ ID NO: 217065 - DNA, 23 bp, Artificial sequence
  SiRNA target sequence
gttatatttttaattaaaaaata

SEQ ID NO: 217066 - DNA, 23 bp, Artificial sequence
  SiRNA target sequence
ttatatttttaattaaaaaatat

SEQ ID NO: 217067 - DNA, 23 bp, Artificial sequence
  SiRNA target sequence
tatatttttaattaaaaaatatt

SEQ ID NO: 217068 - DNA, 23 bp, Artificial sequence
  SiRNA target sequence
atatttttaattaaaaaatattt

SEQ ID NO: 217069 - DNA, 23 bp, Artificial sequence
  SiRNA target sequence
tatttttaattaaaaaatatttg

SEQ ID NO: 217070 - DNA, 23 bp, Artificial sequence
  SiRNA target sequence
atttttaattaaaaaatatttgg

SEQ ID NO: 217071 - DNA, 23 bp, Artificial sequence
  SiRNA target sequence
tttttaattaaaaaatatttgga

SEQ ID NO: 217072 - DNA, 23 bp, Artificial sequence
  SiRNA target sequence
ttttaattaaaaaatatttggag

SEQ ID NO: 217073 - DNA, 23 bp, Artificial sequence
  SiRNA target sequence
tttaattaaaaaatatttggaga

SEQ ID NO: 217074 - DNA, 23 bp, Artificial sequence
  SiRNA target sequence
ttaattaaaaaatatttggagag

SEQ ID NO: 217075 - DNA, 23 bp, Artificial sequence
  SiRNA target sequence
taattaaaaaatatttggagagg

SEQ ID NO: 217076 - DNA, 23 bp, Artificial sequence
  SiRNA target sequence
aattaaaaaatatttggagagga

SEQ ID NO: 217077 - DNA, 23 bp, Artificial sequence
  SiRNA target sequence
attaaaaaatatttggagaggaa

SEQ ID NO: 217078 - DNA, 23 bp, Artificial sequence
  SiRNA target sequence
ttaaaaaatatttggagaggaat

SEQ ID NO: 217079 - DNA, 23 bp, Artificial sequence
  SiRNA target sequence
taaaaaatatttggagaggaatg

SEQ ID NO: 217080 - DNA, 23 bp, Artificial sequence
  SiRNA target sequence
aaaaaatatttggagaggaatgt

SEQ ID NO: 217081 - DNA, 23 bp, Artificial sequence
  SiRNA target sequence
aaaaatatttggagaggaatgtg

SEQ ID NO: 217082 - DNA, 23 bp, Artificial sequence
  SiRNA target sequence
aaaatatttggagaggaatgtga

SEQ ID NO: 217083 - DNA, 23 bp, Artificial sequence
  SiRNA target sequence
aaatatttggagaggaatgtgac

SEQ ID NO: 217084 - DNA, 23 bp, Artificial sequence
  SiRNA target sequence
aatatttggagaggaatgtgact

SEQ ID NO: 217085 - DNA, 23 bp, Artificial sequence
  SiRNA target sequence
atatttggagaggaatgtgacta

SEQ ID NO: 217086 - DNA, 23 bp, Artificial sequence
  SiRNA target sequence
tatttggagaggaatgtgactaa

SEQ ID NO: 217087 - DNA, 23 bp, Artificial sequence
  SiRNA target sequence
atttggagaggaatgtgactaac

SEQ ID NO: 217088 - DNA, 23 bp, Artificial sequence
  SiRNA target sequence
tttggagaggaatgtgactaaca

SEQ ID NO: 217089 - DNA, 23 bp, Artificial sequence
  SiRNA target sequence
ttggagaggaatgtgactaacaa

SEQ ID NO: 217090 - DNA, 23 bp, Artificial sequence
  SiRNA target sequence
tggagaggaatgtgactaacaaa

SEQ ID NO: 217091 - DNA, 23 bp, Artificial sequence
  SiRNA target sequence
ggagaggaatgtgactaacaaac

SEQ ID NO: 217092 - DNA, 23 bp, Artificial sequence
  SiRNA target sequence
gagaggaatgtgactaacaaacc

SEQ ID NO: 217093 - DNA, 23 bp, Artificial sequence
  SiRNA target sequence
agaggaatgtgactaacaaacct

SEQ ID NO: 217094 - DNA, 23 bp, Artificial sequence
  SiRNA target sequence
gaggaatgtgactaacaaacctt

SEQ ID NO: 217095 - DNA, 23 bp, Artificial sequence
  SiRNA target sequence
aggaatgtgactaacaaaccttt

SEQ ID NO: 217096 - DNA, 23 bp, Artificial sequence
  SiRNA target sequence
ggaatgtgactaacaaacctttg

SEQ ID NO: 217097 - DNA, 23 bp, Artificial sequence
  SiRNA target sequence
gaatgtgactaacaaacctttgt

SEQ ID NO: 217098 - DNA, 23 bp, Artificial sequence
  SiRNA target sequence
aatgtgactaacaaacctttgtt

SEQ ID NO: 217099 - DNA, 23 bp, Artificial sequence
  SiRNA target sequence
atgtgactaacaaacctttgttt

SEQ ID NO: 217100 - DNA, 23 bp, Artificial sequence
  SiRNA target sequence
tgtgactaacaaacctttgtttg

SEQ ID NO: 217101 - DNA, 23 bp, Artificial sequence
  SiRNA target sequence
gtgactaacaaacctttgtttgt

SEQ ID NO: 217102 - DNA, 23 bp, Artificial sequence
  SiRNA target sequence
tgactaacaaacctttgtttgtt

SEQ ID NO: 217103 - DNA, 23 bp, Artificial sequence
  SiRNA target sequence
gactaacaaacctttgtttgttg

SEQ ID NO: 217104 - DNA, 23 bp, Artificial sequence
  SiRNA target sequence
actaacaaacctttgtttgttgt

SEQ ID NO: 217105 - DNA, 23 bp, Artificial sequence
  SiRNA target sequence
ctaacaaacctttgtttgttgta

SEQ ID NO: 217106 - DNA, 23 bp, Artificial sequence
  SiRNA target sequence
taacaaacctttgtttgttgtaa

SEQ ID NO: 217107 - DNA, 23 bp, Artificial sequence
  SiRNA target sequence
aacaaacctttgtttgttgtaaa

SEQ ID NO: 217108 - DNA, 23 bp, Artificial sequence
  SiRNA target sequence
acaaacctttgtttgttgtaaaa

SEQ ID NO: 217109 - DNA, 23 bp, Artificial sequence
  SiRNA target sequence
caaacctttgtttgttgtaaaat

SEQ ID NO: 217110 - DNA, 23 bp, Artificial sequence
  SiRNA target sequence
aaacctttgtttgttgtaaaatc

SEQ ID NO: 217111 - DNA, 23 bp, Artificial sequence
  SiRNA target sequence
aacctttgtttgttgtaaaatct

SEQ ID NO: 217112 - DNA, 23 bp, Artificial sequence
  SiRNA target sequence
acctttgtttgttgtaaaatctg

SEQ ID NO: 217113 - DNA, 23 bp, Artificial sequence
  SiRNA target sequence
cctttgtttgttgtaaaatctgt

SEQ ID NO: 217114 - DNA, 23 bp, Artificial sequence
  SiRNA target sequence
ctttgtttgttgtaaaatctgtt

SEQ ID NO: 217115 - DNA, 23 bp, Artificial sequence
  SiRNA target sequence
tttgtttgttgtaaaatctgtta

SEQ ID NO: 217116 - DNA, 23 bp, Artificial sequence
  SiRNA target sequence
ttgtttgttgtaaaatctgttaa

SEQ ID NO: 217117 - DNA, 23 bp, Artificial sequence
  SiRNA target sequence
tgtttgttgtaaaatctgttaaa

SEQ ID NO: 217118 - DNA, 23 bp, Artificial sequence
  SiRNA target sequence
gtttgttgtaaaatctgttaaaa

SEQ ID NO: 217119 - DNA, 23 bp, Artificial sequence
  SiRNA target sequence
tttgttgtaaaatctgttaaaaa

SEQ ID NO: 217120 - DNA, 23 bp, Artificial sequence
  SiRNA target sequence
ttgttgtaaaatctgttaaaaag

SEQ ID NO: 217121 - DNA, 23 bp, Artificial sequence
  SiRNA target sequence
tgttgtaaaatctgttaaaaaga

SEQ ID NO: 217122 - DNA, 23 bp, Artificial sequence
  SiRNA target sequence
gttgtaaaatctgttaaaaagaa

SEQ ID NO: 217123 - DNA, 23 bp, Artificial sequence
  SiRNA target sequence
ttgtaaaatctgttaaaaagaag

SEQ ID NO: 217124 - DNA, 23 bp, Artificial sequence
  SiRNA target sequence
tgtaaaatctgttaaaaagaagg

SEQ ID NO: 217125 - DNA, 23 bp, Artificial sequence
  SiRNA target sequence
gtaaaatctgttaaaaagaaggg

SEQ ID NO: 217126 - DNA, 23 bp, Artificial sequence
  SiRNA target sequence
taaaatctgttaaaaagaaggga

SEQ ID NO: 217127 - DNA, 23 bp, Artificial sequence
  SiRNA target sequence
aaaatctgttaaaaagaagggac

SEQ ID NO: 217128 - DNA, 23 bp, Artificial sequence
  SiRNA target sequence
aaatctgttaaaaagaagggacc

SEQ ID NO: 217129 - DNA, 23 bp, Artificial sequence
  SiRNA target sequence
aatctgttaaaaagaagggacca

SEQ ID NO: 217130 - DNA, 23 bp, Artificial sequence
  SiRNA target sequence
atctgttaaaaagaagggaccaa

SEQ ID NO: 217131 - DNA, 23 bp, Artificial sequence
  SiRNA target sequence
tctgttaaaaagaagggaccaaa

SEQ ID NO: 217132 - DNA, 23 bp, Artificial sequence
  SiRNA target sequence
ctgttaaaaagaagggaccaaaa

SEQ ID NO: 217133 - DNA, 23 bp, Artificial sequence
  SiRNA target sequence
tgttaaaaagaagggaccaaaag

SEQ ID NO: 217134 - DNA, 23 bp, Artificial sequence
  SiRNA target sequence
gttaaaaagaagggaccaaaagt

SEQ ID NO: 217135 - DNA, 23 bp, Artificial sequence
  SiRNA target sequence
ttaaaaagaagggaccaaaagtt

SEQ ID NO: 217136 - DNA, 23 bp, Artificial sequence
  SiRNA target sequence
taaaaagaagggaccaaaagtta

SEQ ID NO: 217137 - DNA, 23 bp, Artificial sequence
  SiRNA target sequence
aaaaagaagggaccaaaagttaa

SEQ ID NO: 217138 - DNA, 23 bp, Artificial sequence
  SiRNA target sequence
aaaagaagggaccaaaagttaaa

SEQ ID NO: 217139 - DNA, 23 bp, Artificial sequence
  SiRNA target sequence
aaagaagggaccaaaagttaaag

SEQ ID NO: 217140 - DNA, 23 bp, Artificial sequence
  SiRNA target sequence
aagaagggaccaaaagttaaagt

SEQ ID NO: 217141 - DNA, 23 bp, Artificial sequence
  SiRNA target sequence
agaagggaccaaaagttaaagta

SEQ ID NO: 217142 - DNA, 23 bp, Artificial sequence
  SiRNA target sequence
gaagggaccaaaagttaaagtag

SEQ ID NO: 217143 - DNA, 23 bp, Artificial sequence
  SiRNA target sequence
aagggaccaaaagttaaagtagg

SEQ ID NO: 217144 - DNA, 23 bp, Artificial sequence
  SiRNA target sequence
agggaccaaaagttaaagtagga

SEQ ID NO: 217145 - DNA, 23 bp, Artificial sequence
  SiRNA target sequence
gggaccaaaagttaaagtaggat

SEQ ID NO: 217146 - DNA, 23 bp, Artificial sequence
  SiRNA target sequence
ggaccaaaagttaaagtaggatt

SEQ ID NO: 217147 - DNA, 23 bp, Artificial sequence
  SiRNA target sequence
gaccaaaagttaaagtaggattt

SEQ ID NO: 217148 - DNA, 23 bp, Artificial sequence
  SiRNA target sequence
accaaaagttaaagtaggatttg

SEQ ID NO: 217149 - DNA, 23 bp, Artificial sequence
  SiRNA target sequence
ccaaaagttaaagtaggatttgc

SEQ ID NO: 217150 - DNA, 23 bp, Artificial sequence
  SiRNA target sequence
caaaagttaaagtaggatttgcg

SEQ ID NO: 217151 - DNA, 23 bp, Artificial sequence
  SiRNA target sequence
aaaagttaaagtaggatttgcgg

SEQ ID NO: 217152 - DNA, 23 bp, Artificial sequence
  SiRNA target sequence
aaagttaaagtaggatttgcgga

SEQ ID NO: 217153 - DNA, 23 bp, Artificial sequence
  SiRNA target sequence
aagttaaagtaggatttgcggag

SEQ ID NO: 217154 - DNA, 23 bp, Artificial sequence
  SiRNA target sequence
agttaaagtaggatttgcggagg

SEQ ID NO: 217155 - DNA, 23 bp, Artificial sequence
  SiRNA target sequence
gttaaagtaggatttgcggaggg

SEQ ID NO: 217156 - DNA, 23 bp, Artificial sequence
  SiRNA target sequence
ttaaagtaggatttgcggagggc

SEQ ID NO: 217157 - DNA, 23 bp, Artificial sequence
  SiRNA target sequence
taaagtaggatttgcggagggcc

SEQ ID NO: 217158 - DNA, 23 bp, Artificial sequence
  SiRNA target sequence
aaagtaggatttgcggagggcct

SEQ ID NO: 217159 - DNA, 23 bp, Artificial sequence
  SiRNA target sequence
aagtaggatttgcggagggcctt

SEQ ID NO: 217160 - DNA, 23 bp, Artificial sequence
  SiRNA target sequence
agtaggatttgcggagggcctta

SEQ ID NO: 217161 - DNA, 23 bp, Artificial sequence
  SiRNA target sequence
gtaggatttgcggagggccttaa

SEQ ID NO: 217162 - DNA, 23 bp, Artificial sequence
  SiRNA target sequence
taggatttgcggagggccttaaa

SEQ ID NO: 217163 - DNA, 23 bp, Artificial sequence
  SiRNA target sequence
aggatttgcggagggccttaaag

SEQ ID NO: 217164 - DNA, 23 bp, Artificial sequence
  SiRNA target sequence
ggatttgcggagggccttaaaga

SEQ ID NO: 217165 - DNA, 23 bp, Artificial sequence
  SiRNA target sequence
gatttgcggagggccttaaagaa

SEQ ID NO: 217166 - DNA, 23 bp, Artificial sequence
  SiRNA target sequence
atttgcggagggccttaaagaaa

SEQ ID NO: 217167 - DNA, 23 bp, Artificial sequence
  SiRNA target sequence
tttgcggagggccttaaagaaat

SEQ ID NO: 217168 - DNA, 23 bp, Artificial sequence
  SiRNA target sequence
ttgcggagggccttaaagaaatg

SEQ ID NO: 217169 - DNA, 23 bp, Artificial sequence
  SiRNA target sequence
tgcggagggccttaaagaaatga

SEQ ID NO: 217170 - DNA, 23 bp, Artificial sequence
  SiRNA target sequence
gcggagggccttaaagaaatgat

SEQ ID NO: 217171 - DNA, 23 bp, Artificial sequence
  SiRNA target sequence
cggagggccttaaagaaatgatg

SEQ ID NO: 217172 - DNA, 23 bp, Artificial sequence
  SiRNA target sequence
ggagggccttaaagaaatgatgg

SEQ ID NO: 217173 - DNA, 23 bp, Artificial sequence
  SiRNA target sequence
gagggccttaaagaaatgatggc

SEQ ID NO: 217174 - DNA, 23 bp, Artificial sequence
  SiRNA target sequence
agggccttaaagaaatgatggca

SEQ ID NO: 217175 - DNA, 23 bp, Artificial sequence
  SiRNA target sequence
gggccttaaagaaatgatggcat

SEQ ID NO: 217176 - DNA, 23 bp, Artificial sequence
  SiRNA target sequence
ggccttaaagaaatgatggcatc

SEQ ID NO: 217177 - DNA, 23 bp, Artificial sequence
  SiRNA target sequence
gccttaaagaaatgatggcatca

SEQ ID NO: 217178 - DNA, 23 bp, Artificial sequence
  SiRNA target sequence
ccttaaagaaatgatggcatcaa

SEQ ID NO: 217179 - DNA, 23 bp, Artificial sequence
  SiRNA target sequence
cttaaagaaatgatggcatcaaa

SEQ ID NO: 217180 - DNA, 23 bp, Artificial sequence
  SiRNA target sequence
ttaaagaaatgatggcatcaaag

SEQ ID NO: 217181 - DNA, 23 bp, Artificial sequence
  SiRNA target sequence
taaagaaatgatggcatcaaagt

SEQ ID NO: 217182 - DNA, 23 bp, Artificial sequence
  SiRNA target sequence
aaagaaatgatggcatcaaagtt

SEQ ID NO: 217183 - DNA, 23 bp, Artificial sequence
  SiRNA target sequence
aagaaatgatggcatcaaagtta

SEQ ID NO: 217184 - DNA, 23 bp, Artificial sequence
  SiRNA target sequence
agaaatgatggcatcaaagttat

SEQ ID NO: 217185 - DNA, 23 bp, Artificial sequence
  SiRNA target sequence
gaaatgatggcatcaaagttatt

SEQ ID NO: 217186 - DNA, 23 bp, Artificial sequence
  SiRNA target sequence
aaatgatggcatcaaagttatta

SEQ ID NO: 217187 - DNA, 23 bp, Artificial sequence
  SiRNA target sequence
aatgatggcatcaaagttattac

SEQ ID NO: 217188 - DNA, 23 bp, Artificial sequence
  SiRNA target sequence
atgatggcatcaaagttattact

SEQ ID NO: 217189 - DNA, 23 bp, Artificial sequence
  SiRNA target sequence
tgatggcatcaaagttattactt

SEQ ID NO: 217190 - DNA, 23 bp, Artificial sequence
  SiRNA target sequence
gatggcatcaaagttattactta

SEQ ID NO: 217191 - DNA, 23 bp, Artificial sequence
  SiRNA target sequence
atggcatcaaagttattacttaa

SEQ ID NO: 217192 - DNA, 23 bp, Artificial sequence
  SiRNA target sequence
tggcatcaaagttattacttaac

SEQ ID NO: 217193 - DNA, 23 bp, Artificial sequence
  SiRNA target sequence
ggcatcaaagttattacttaaca

SEQ ID NO: 217194 - DNA, 23 bp, Artificial sequence
  SiRNA target sequence
gcatcaaagttattacttaacat

SEQ ID NO: 217195 - DNA, 23 bp, Artificial sequence
  SiRNA target sequence
catcaaagttattacttaacatt

SEQ ID NO: 217196 - DNA, 23 bp, Artificial sequence
  SiRNA target sequence
atcaaagttattacttaacattt

SEQ ID NO: 217197 - DNA, 23 bp, Artificial sequence
  SiRNA target sequence
tcaaagttattacttaacatttc

SEQ ID NO: 217198 - DNA, 23 bp, Artificial sequence
  SiRNA target sequence
caaagttattacttaacatttca

SEQ ID NO: 217199 - DNA, 23 bp, Artificial sequence
  SiRNA target sequence
aaagttattacttaacatttcat

SEQ ID NO: 217200 - DNA, 23 bp, Artificial sequence
  SiRNA target sequence
aagttattacttaacatttcatt

SEQ ID NO: 217201 - DNA, 23 bp, Artificial sequence
  SiRNA target sequence
agttattacttaacatttcatta

SEQ ID NO: 217202 - DNA, 23 bp, Artificial sequence
  SiRNA target sequence
gttattacttaacatttcattaa

SEQ ID NO: 217203 - DNA, 23 bp, Artificial sequence
  SiRNA target sequence
ttattacttaacatttcattaac

SEQ ID NO: 217204 - DNA, 23 bp, Artificial sequence
  SiRNA target sequence
tattacttaacatttcattaact

SEQ ID NO: 217205 - DNA, 23 bp, Artificial sequence
  SiRNA target sequence
attacttaacatttcattaactg

SEQ ID NO: 217206 - DNA, 23 bp, Artificial sequence
  SiRNA target sequence
ttacttaacatttcattaactgt

SEQ ID NO: 217207 - DNA, 23 bp, Artificial sequence
  SiRNA target sequence
tacttaacatttcattaactgtt

SEQ ID NO: 217208 - DNA, 23 bp, Artificial sequence
  SiRNA target sequence
acttaacatttcattaactgtta

SEQ ID NO: 217209 - DNA, 23 bp, Artificial sequence
  SiRNA target sequence
cttaacatttcattaactgttat

SEQ ID NO: 217210 - DNA, 23 bp, Artificial sequence
  SiRNA target sequence
ttaacatttcattaactgttatg

SEQ ID NO: 217211 - DNA, 23 bp, Artificial sequence
  SiRNA target sequence
taacatttcattaactgttatgt

SEQ ID NO: 217212 - DNA, 23 bp, Artificial sequence
  SiRNA target sequence
aacatttcattaactgttatgtt

SEQ ID NO: 217213 - DNA, 23 bp, Artificial sequence
  SiRNA target sequence
acatttcattaactgttatgttc

SEQ ID NO: 217214 - DNA, 23 bp, Artificial sequence
  SiRNA target sequence
catttcattaactgttatgttct

SEQ ID NO: 217215 - DNA, 23 bp, Artificial sequence
  SiRNA target sequence
atttcattaactgttatgttcta

SEQ ID NO: 217216 - DNA, 23 bp, Artificial sequence
  SiRNA target sequence
tttcattaactgttatgttctat

SEQ ID NO: 217217 - DNA, 23 bp, Artificial sequence
  SiRNA target sequence
ttcattaactgttatgttctatg

SEQ ID NO: 217218 - DNA, 23 bp, Artificial sequence
  SiRNA target sequence
tcattaactgttatgttctatgg

SEQ ID NO: 217219 - DNA, 23 bp, Artificial sequence
  SiRNA target sequence
cattaactgttatgttctatggt

SEQ ID NO: 217220 - DNA, 23 bp, Artificial sequence
  SiRNA target sequence
attaactgttatgttctatggta

SEQ ID NO: 217221 - DNA, 23 bp, Artificial sequence
  SiRNA target sequence
ttaactgttatgttctatggtat

SEQ ID NO: 217222 - DNA, 23 bp, Artificial sequence
  SiRNA target sequence
taactgttatgttctatggtata

SEQ ID NO: 217223 - DNA, 23 bp, Artificial sequence
  SiRNA target sequence
aactgttatgttctatggtatat

SEQ ID NO: 217224 - DNA, 23 bp, Artificial sequence
  SiRNA target sequence
actgttatgttctatggtatatc

SEQ ID NO: 217225 - DNA, 23 bp, Artificial sequence
  SiRNA target sequence
ctgttatgttctatggtatatca

SEQ ID NO: 217226 - DNA, 23 bp, Artificial sequence
  SiRNA target sequence
tgttatgttctatggtatatcaa

SEQ ID NO: 217227 - DNA, 23 bp, Artificial sequence
  SiRNA target sequence
gttatgttctatggtatatcaac

SEQ ID NO: 217228 - DNA, 23 bp, Artificial sequence
  SiRNA target sequence
ttatgttctatggtatatcaact

SEQ ID NO: 217229 - DNA, 23 bp, Artificial sequence
  SiRNA target sequence
tatgttctatggtatatcaacta

SEQ ID NO: 217230 - DNA, 23 bp, Artificial sequence
  SiRNA target sequence
atgttctatggtatatcaactaa

SEQ ID NO: 217231 - DNA, 23 bp, Artificial sequence
  SiRNA target sequence
tgttctatggtatatcaactaat

SEQ ID NO: 217232 - DNA, 23 bp, Artificial sequence
  SiRNA target sequence
gttctatggtatatcaactaatt

SEQ ID NO: 217233 - DNA, 23 bp, Artificial sequence
  SiRNA target sequence
ttctatggtatatcaactaattt

SEQ ID NO: 217234 - DNA, 23 bp, Artificial sequence
  SiRNA target sequence
tctatggtatatcaactaattta

SEQ ID NO: 217235 - DNA, 23 bp, Artificial sequence
  SiRNA target sequence
ctatggtatatcaactaatttaa

SEQ ID NO: 217236 - DNA, 23 bp, Artificial sequence
  SiRNA target sequence
tatggtatatcaactaatttaat

SEQ ID NO: 217237 - DNA, 23 bp, Artificial sequence
  SiRNA target sequence
atggtatatcaactaatttaata

SEQ ID NO: 217238 - DNA, 23 bp, Artificial sequence
  SiRNA target sequence
tggtatatcaactaatttaatag

SEQ ID NO: 217239 - DNA, 23 bp, Artificial sequence
  SiRNA target sequence
ggtatatcaactaatttaataga

SEQ ID NO: 217240 - DNA, 23 bp, Artificial sequence
  SiRNA target sequence
gtatatcaactaatttaatagaa

SEQ ID NO: 217241 - DNA, 23 bp, Artificial sequence
  SiRNA target sequence
tatatcaactaatttaatagaat

SEQ ID NO: 217242 - DNA, 23 bp, Artificial sequence
  SiRNA target sequence
atatcaactaatttaatagaatc

SEQ ID NO: 217243 - DNA, 23 bp, Artificial sequence
  SiRNA target sequence
tatcaactaatttaatagaatca

SEQ ID NO: 217244 - DNA, 23 bp, Artificial sequence
  SiRNA target sequence
atcaactaatttaatagaatcaa

SEQ ID NO: 217245 - DNA, 23 bp, Artificial sequence
  SiRNA target sequence
tcaactaatttaatagaatcaac

SEQ ID NO: 217246 - DNA, 23 bp, Artificial sequence
  SiRNA target sequence
caactaatttaatagaatcaaca

SEQ ID NO: 217247 - DNA, 23 bp, Artificial sequence
  SiRNA target sequence
aactaatttaatagaatcaacat

SEQ ID NO: 217248 - DNA, 23 bp, Artificial sequence
  SiRNA target sequence
actaatttaatagaatcaacatt

SEQ ID NO: 217249 - DNA, 23 bp, Artificial sequence
  SiRNA target sequence
ctaatttaatagaatcaacattt

SEQ ID NO: 217250 - DNA, 23 bp, Artificial sequence
  SiRNA target sequence
taatttaatagaatcaacattta

SEQ ID NO: 217251 - DNA, 23 bp, Artificial sequence
  SiRNA target sequence
aatttaatagaatcaacatttaa

SEQ ID NO: 217252 - DNA, 23 bp, Artificial sequence
  SiRNA target sequence
atttaatagaatcaacatttaaa

SEQ ID NO: 217253 - DNA, 23 bp, Artificial sequence
  SiRNA target sequence
tttaatagaatcaacatttaaaa

SEQ ID NO: 217254 - DNA, 23 bp, Artificial sequence
  SiRNA target sequence
ttaatagaatcaacatttaaaag

SEQ ID NO: 217255 - DNA, 23 bp, Artificial sequence
  SiRNA target sequence
taatagaatcaacatttaaaagt

SEQ ID NO: 217256 - DNA, 23 bp, Artificial sequence
  SiRNA target sequence
aatagaatcaacatttaaaagtg

SEQ ID NO: 217257 - DNA, 23 bp, Artificial sequence
  SiRNA target sequence
atagaatcaacatttaaaagtgg

SEQ ID NO: 217258 - DNA, 23 bp, Artificial sequence
  SiRNA target sequence
tagaatcaacatttaaaagtgga

SEQ ID NO: 217259 - DNA, 23 bp, Artificial sequence
  SiRNA target sequence
agaatcaacatttaaaagtggac

SEQ ID NO: 217260 - DNA, 23 bp, Artificial sequence
  SiRNA target sequence
gaatcaacatttaaaagtggact

SEQ ID NO: 217261 - DNA, 23 bp, Artificial sequence
  SiRNA target sequence
aatcaacatttaaaagtggactt

SEQ ID NO: 217262 - DNA, 23 bp, Artificial sequence
  SiRNA target sequence
atcaacatttaaaagtggacttg

SEQ ID NO: 217263 - DNA, 23 bp, Artificial sequence
  SiRNA target sequence
tcaacatttaaaagtggacttgt

SEQ ID NO: 217264 - DNA, 23 bp, Artificial sequence
  SiRNA target sequence
caacatttaaaagtggacttgtg

SEQ ID NO: 217265 - DNA, 23 bp, Artificial sequence
  SiRNA target sequence
aacatttaaaagtggacttgtga

SEQ ID NO: 217266 - DNA, 23 bp, Artificial sequence
  SiRNA target sequence
acatttaaaagtggacttgtgaa

SEQ ID NO: 217267 - DNA, 23 bp, Artificial sequence
  SiRNA target sequence
catttaaaagtggacttgtgaaa

SEQ ID NO: 217268 - DNA, 23 bp, Artificial sequence
  SiRNA target sequence
atttaaaagtggacttgtgaaag

SEQ ID NO: 217269 - DNA, 23 bp, Artificial sequence
  SiRNA target sequence
tttaaaagtggacttgtgaaagg

SEQ ID NO: 217270 - DNA, 23 bp, Artificial sequence
  SiRNA target sequence
ttaaaagtggacttgtgaaaggt

SEQ ID NO: 217271 - DNA, 23 bp, Artificial sequence
  SiRNA target sequence
taaaagtggacttgtgaaaggtg

SEQ ID NO: 217272 - DNA, 23 bp, Artificial sequence
  SiRNA target sequence
aaaagtggacttgtgaaaggtgc

SEQ ID NO: 217273 - DNA, 23 bp, Artificial sequence
  SiRNA target sequence
aaagtggacttgtgaaaggtgca

SEQ ID NO: 217274 - DNA, 23 bp, Artificial sequence
  SiRNA target sequence
aagtggacttgtgaaaggtgcag

SEQ ID NO: 217275 - DNA, 23 bp, Artificial sequence
  SiRNA target sequence
agtggacttgtgaaaggtgcaga

SEQ ID NO: 217276 - DNA, 23 bp, Artificial sequence
  SiRNA target sequence
gtggacttgtgaaaggtgcagaa

SEQ ID NO: 217277 - DNA, 23 bp, Artificial sequence
  SiRNA target sequence
tggacttgtgaaaggtgcagaag

SEQ ID NO: 217278 - DNA, 23 bp, Artificial sequence
  SiRNA target sequence
ggacttgtgaaaggtgcagaaga

SEQ ID NO: 217279 - DNA, 23 bp, Artificial sequence
  SiRNA target sequence
gacttgtgaaaggtgcagaagaa

SEQ ID NO: 217280 - DNA, 23 bp, Artificial sequence
  SiRNA target sequence
acttgtgaaaggtgcagaagaat

SEQ ID NO: 217281 - DNA, 23 bp, Artificial sequence
  SiRNA target sequence
cttgtgaaaggtgcagaagaatt

SEQ ID NO: 217282 - DNA, 23 bp, Artificial sequence
  SiRNA target sequence
ttgtgaaaggtgcagaagaatta

SEQ ID NO: 217283 - DNA, 23 bp, Artificial sequence
  SiRNA target sequence
tgtgaaaggtgcagaagaattaa

SEQ ID NO: 217284 - DNA, 23 bp, Artificial sequence
  SiRNA target sequence
gtgaaaggtgcagaagaattaaa

SEQ ID NO: 217285 - DNA, 23 bp, Artificial sequence
  SiRNA target sequence
tgaaaggtgcagaagaattaaac

SEQ ID NO: 217286 - DNA, 23 bp, Artificial sequence
  SiRNA target sequence
gaaaggtgcagaagaattaaacg

SEQ ID NO: 217287 - DNA, 23 bp, Artificial sequence
  SiRNA target sequence
aaaggtgcagaagaattaaacga

SEQ ID NO: 217288 - DNA, 23 bp, Artificial sequence
  SiRNA target sequence
aaggtgcagaagaattaaacgag

SEQ ID NO: 217289 - DNA, 23 bp, Artificial sequence
  SiRNA target sequence
aggtgcagaagaattaaacgaga

SEQ ID NO: 217290 - DNA, 23 bp, Artificial sequence
  SiRNA target sequence
ggtgcagaagaattaaacgagaa

SEQ ID NO: 217291 - DNA, 23 bp, Artificial sequence
  SiRNA target sequence
gtgcagaagaattaaacgagaat

SEQ ID NO: 217292 - DNA, 23 bp, Artificial sequence
  SiRNA target sequence
tgcagaagaattaaacgagaata

SEQ ID NO: 217293 - DNA, 23 bp, Artificial sequence
  SiRNA target sequence
gcagaagaattaaacgagaatac

SEQ ID NO: 217294 - DNA, 23 bp, Artificial sequence
  SiRNA target sequence
cagaagaattaaacgagaatact

SEQ ID NO: 217295 - DNA, 23 bp, Artificial sequence
  SiRNA target sequence
agaagaattaaacgagaatacta

SEQ ID NO: 217296 - DNA, 23 bp, Artificial sequence
  SiRNA target sequence
gaagaattaaacgagaatactaa

SEQ ID NO: 217297 - DNA, 23 bp, Artificial sequence
  SiRNA target sequence
aagaattaaacgagaatactaaa

SEQ ID NO: 217298 - DNA, 23 bp, Artificial sequence
  SiRNA target sequence
agaattaaacgagaatactaaaa

SEQ ID NO: 217299 - DNA, 23 bp, Artificial sequence
  SiRNA target sequence
gaattaaacgagaatactaaaag

SEQ ID NO: 217300 - DNA, 23 bp, Artificial sequence
  SiRNA target sequence
aattaaacgagaatactaaaagt

SEQ ID NO: 217301 - DNA, 23 bp, Artificial sequence
  SiRNA target sequence
attaaacgagaatactaaaagtt

SEQ ID NO: 217302 - DNA, 23 bp, Artificial sequence
  SiRNA target sequence
ttaaacgagaatactaaaagtta

SEQ ID NO: 217303 - DNA, 23 bp, Artificial sequence
  SiRNA target sequence
taaacgagaatactaaaagttat

SEQ ID NO: 217304 - DNA, 23 bp, Artificial sequence
  SiRNA target sequence
aaacgagaatactaaaagttatt

SEQ ID NO: 217305 - DNA, 23 bp, Artificial sequence
  SiRNA target sequence
aacgagaatactaaaagttattc

SEQ ID NO: 217306 - DNA, 23 bp, Artificial sequence
  SiRNA target sequence
acgagaatactaaaagttattct

SEQ ID NO: 217307 - DNA, 23 bp, Artificial sequence
  SiRNA target sequence
cgagaatactaaaagttattcta

SEQ ID NO: 217308 - DNA, 23 bp, Artificial sequence
  SiRNA target sequence
gagaatactaaaagttattctat

SEQ ID NO: 217309 - DNA, 23 bp, Artificial sequence
  SiRNA target sequence
agaatactaaaagttattctatg

SEQ ID NO: 217310 - DNA, 23 bp, Artificial sequence
  SiRNA target sequence
gaatactaaaagttattctatgg

SEQ ID NO: 217311 - DNA, 23 bp, Artificial sequence
  SiRNA target sequence
aatactaaaagttattctatggg

SEQ ID NO: 217312 - DNA, 23 bp, Artificial sequence
  SiRNA target sequence
atactaaaagttattctatggga

SEQ ID NO: 217313 - DNA, 23 bp, Artificial sequence
  SiRNA target sequence
tactaaaagttattctatgggat

SEQ ID NO: 217314 - DNA, 23 bp, Artificial sequence
  SiRNA target sequence
actaaaagttattctatgggata

SEQ ID NO: 217315 - DNA, 23 bp, Artificial sequence
  SiRNA target sequence
ctaaaagttattctatgggatat

SEQ ID NO: 217316 - DNA, 23 bp, Artificial sequence
  SiRNA target sequence
taaaagttattctatgggatata

SEQ ID NO: 217317 - DNA, 23 bp, Artificial sequence
  SiRNA target sequence
aaaagttattctatgggatataa

SEQ ID NO: 217318 - DNA, 23 bp, Artificial sequence
  SiRNA target sequence
aaagttattctatgggatataat

SEQ ID NO: 217319 - DNA, 23 bp, Artificial sequence
  SiRNA target sequence
aagttattctatgggatataatt

SEQ ID NO: 217320 - DNA, 23 bp, Artificial sequence
  SiRNA target sequence
agttattctatgggatataattc

SEQ ID NO: 217321 - DNA, 23 bp, Artificial sequence
  SiRNA target sequence
gttattctatgggatataattca

SEQ ID NO: 217322 - DNA, 23 bp, Artificial sequence
  SiRNA target sequence
ttattctatgggatataattcat

SEQ ID NO: 217323 - DNA, 23 bp, Artificial sequence
  SiRNA target sequence
tattctatgggatataattcatt

SEQ ID NO: 217324 - DNA, 23 bp, Artificial sequence
  SiRNA target sequence
attctatgggatataattcattt

SEQ ID NO: 217325 - DNA, 23 bp, Artificial sequence
  SiRNA target sequence
ttctatgggatataattcatttg

SEQ ID NO: 217326 - DNA, 23 bp, Artificial sequence
  SiRNA target sequence
tctatgggatataattcatttga

SEQ ID NO: 217327 - DNA, 23 bp, Artificial sequence
  SiRNA target sequence
ctatgggatataattcatttgaa

SEQ ID NO: 217328 - DNA, 23 bp, Artificial sequence
  SiRNA target sequence
tatgggatataattcatttgaac

SEQ ID NO: 217329 - DNA, 23 bp, Artificial sequence
  SiRNA target sequence
atgggatataattcatttgaaca

SEQ ID NO: 217330 - DNA, 23 bp, Artificial sequence
  SiRNA target sequence
tgggatataattcatttgaacaa

SEQ ID NO: 217331 - DNA, 23 bp, Artificial sequence
  SiRNA target sequence
gggatataattcatttgaacaaa

SEQ ID NO: 217332 - DNA, 23 bp, Artificial sequence
  SiRNA target sequence
ggatataattcatttgaacaaaa

SEQ ID NO: 217333 - DNA, 23 bp, Artificial sequence
  SiRNA target sequence
gatataattcatttgaacaaaag

SEQ ID NO: 217334 - DNA, 23 bp, Artificial sequence
  SiRNA target sequence
atataattcatttgaacaaaaga

SEQ ID NO: 217335 - DNA, 23 bp, Artificial sequence
  SiRNA target sequence
tataattcatttgaacaaaagat

SEQ ID NO: 217336 - DNA, 23 bp, Artificial sequence
  SiRNA target sequence
ataattcatttgaacaaaagata

SEQ ID NO: 217337 - DNA, 23 bp, Artificial sequence
  SiRNA target sequence
taattcatttgaacaaaagatag

SEQ ID NO: 217338 - DNA, 23 bp, Artificial sequence
  SiRNA target sequence
aattcatttgaacaaaagatagc

SEQ ID NO: 217339 - DNA, 23 bp, Artificial sequence
  SiRNA target sequence
attcatttgaacaaaagatagca

SEQ ID NO: 217340 - DNA, 23 bp, Artificial sequence
  SiRNA target sequence
ttcatttgaacaaaagatagcat

SEQ ID NO: 217341 - DNA, 23 bp, Artificial sequence
  SiRNA target sequence
tcatttgaacaaaagatagcatc

SEQ ID NO: 217342 - DNA, 23 bp, Artificial sequence
  SiRNA target sequence
catttgaacaaaagatagcatca

SEQ ID NO: 217343 - DNA, 23 bp, Artificial sequence
  SiRNA target sequence
atttgaacaaaagatagcatcaa

SEQ ID NO: 217344 - DNA, 23 bp, Artificial sequence
  SiRNA target sequence
tttgaacaaaagatagcatcaat

SEQ ID NO: 217345 - DNA, 23 bp, Artificial sequence
  SiRNA target sequence
ttgaacaaaagatagcatcaata

SEQ ID NO: 217346 - DNA, 23 bp, Artificial sequence
  SiRNA target sequence
tgaacaaaagatagcatcaataa

SEQ ID NO: 217347 - DNA, 23 bp, Artificial sequence
  SiRNA target sequence
gaacaaaagatagcatcaataac

SEQ ID NO: 217348 - DNA, 23 bp, Artificial sequence
  SiRNA target sequence
aacaaaagatagcatcaataact

SEQ ID NO: 217349 - DNA, 23 bp, Artificial sequence
  SiRNA target sequence
acaaaagatagcatcaataactg

SEQ ID NO: 217350 - DNA, 23 bp, Artificial sequence
  SiRNA target sequence
caaaagatagcatcaataactgt

SEQ ID NO: 217351 - DNA, 23 bp, Artificial sequence
  SiRNA target sequence
aaaagatagcatcaataactgtt

SEQ ID NO: 217352 - DNA, 23 bp, Artificial sequence
  SiRNA target sequence
aaagatagcatcaataactgtta

SEQ ID NO: 217353 - DNA, 23 bp, Artificial sequence
  SiRNA target sequence
aagatagcatcaataactgttat

SEQ ID NO: 217354 - DNA, 23 bp, Artificial sequence
  SiRNA target sequence
agatagcatcaataactgttatt

SEQ ID NO: 217355 - DNA, 23 bp, Artificial sequence
  SiRNA target sequence
gatagcatcaataactgttatta

SEQ ID NO: 217356 - DNA, 23 bp, Artificial sequence
  SiRNA target sequence
atagcatcaataactgttattat

SEQ ID NO: 217357 - DNA, 23 bp, Artificial sequence
  SiRNA target sequence
tagcatcaataactgttattatc

SEQ ID NO: 217358 - DNA, 23 bp, Artificial sequence
  SiRNA target sequence
agcatcaataactgttattatcc

SEQ ID NO: 217359 - DNA, 23 bp, Artificial sequence
  SiRNA target sequence
gcatcaataactgttattatcct

SEQ ID NO: 217360 - DNA, 23 bp, Artificial sequence
  SiRNA target sequence
catcaataactgttattatcctg

SEQ ID NO: 217361 - DNA, 23 bp, Artificial sequence
  SiRNA target sequence
atcaataactgttattatcctgc

SEQ ID NO: 217362 - DNA, 23 bp, Artificial sequence
  SiRNA target sequence
tcaataactgttattatcctgct

SEQ ID NO: 217363 - DNA, 23 bp, Artificial sequence
  SiRNA target sequence
caataactgttattatcctgctt

SEQ ID NO: 217364 - DNA, 23 bp, Artificial sequence
  SiRNA target sequence
aataactgttattatcctgcttt

SEQ ID NO: 217365 - DNA, 23 bp, Artificial sequence
  SiRNA target sequence
ataactgttattatcctgctttt

SEQ ID NO: 217366 - DNA, 23 bp, Artificial sequence
  SiRNA target sequence
taactgttattatcctgctttta

SEQ ID NO: 217367 - DNA, 23 bp, Artificial sequence
  SiRNA target sequence
aactgttattatcctgcttttat

SEQ ID NO: 217368 - DNA, 23 bp, Artificial sequence
  SiRNA target sequence
actgttattatcctgcttttatc

SEQ ID NO: 217369 - DNA, 23 bp, Artificial sequence
  SiRNA target sequence
ctgttattatcctgcttttatca

SEQ ID NO: 217370 - DNA, 23 bp, Artificial sequence
  SiRNA target sequence
tgttattatcctgcttttatcac

SEQ ID NO: 217371 - DNA, 23 bp, Artificial sequence
  SiRNA target sequence
gttattatcctgcttttatcacc

SEQ ID NO: 217372 - DNA, 23 bp, Artificial sequence
  SiRNA target sequence
ttattatcctgcttttatcacca

SEQ ID NO: 217373 - DNA, 23 bp, Artificial sequence
  SiRNA target sequence
tattatcctgcttttatcaccat

SEQ ID NO: 217374 - DNA, 23 bp, Artificial sequence
  SiRNA target sequence
attatcctgcttttatcaccatt

SEQ ID NO: 217375 - DNA, 23 bp, Artificial sequence
  SiRNA target sequence
ttatcctgcttttatcaccattt

SEQ ID NO: 217376 - DNA, 23 bp, Artificial sequence
  SiRNA target sequence
tatcctgcttttatcaccatttc

SEQ ID NO: 217377 - DNA, 23 bp, Artificial sequence
  SiRNA target sequence
atcctgcttttatcaccatttcc

SEQ ID NO: 217378 - DNA, 23 bp, Artificial sequence
  SiRNA target sequence
tcctgcttttatcaccatttcca

SEQ ID NO: 217379 - DNA, 23 bp, Artificial sequence
  SiRNA target sequence
cctgcttttatcaccatttccaa

SEQ ID NO: 217380 - DNA, 23 bp, Artificial sequence
  SiRNA target sequence
ctgcttttatcaccatttccaaa

SEQ ID NO: 217381 - DNA, 23 bp, Artificial sequence
  SiRNA target sequence
tgcttttatcaccatttccaaaa

SEQ ID NO: 217382 - DNA, 23 bp, Artificial sequence
  SiRNA target sequence
gcttttatcaccatttccaaaat

SEQ ID NO: 217383 - DNA, 23 bp, Artificial sequence
  SiRNA target sequence
cttttatcaccatttccaaaatt

SEQ ID NO: 217384 - DNA, 23 bp, Artificial sequence
  SiRNA target sequence
ttttatcaccatttccaaaatta

SEQ ID NO: 217385 - DNA, 23 bp, Artificial sequence
  SiRNA target sequence
tttatcaccatttccaaaattaa

SEQ ID NO: 217386 - DNA, 23 bp, Artificial sequence
  SiRNA target sequence
ttatcaccatttccaaaattaat

SEQ ID NO: 217387 - DNA, 23 bp, Artificial sequence
  SiRNA target sequence
tatcaccatttccaaaattaata

SEQ ID NO: 217388 - DNA, 23 bp, Artificial sequence
  SiRNA target sequence
atcaccatttccaaaattaatac

SEQ ID NO: 217389 - DNA, 23 bp, Artificial sequence
  SiRNA target sequence
tcaccatttccaaaattaataca

SEQ ID NO: 217390 - DNA, 23 bp, Artificial sequence
  SiRNA target sequence
caccatttccaaaattaatacaa

SEQ ID NO: 217391 - DNA, 23 bp, Artificial sequence
  SiRNA target sequence
accatttccaaaattaatacaaa

SEQ ID NO: 217392 - DNA, 23 bp, Artificial sequence
  SiRNA target sequence
ccatttccaaaattaatacaaac

SEQ ID NO: 217393 - DNA, 23 bp, Artificial sequence
  SiRNA target sequence
catttccaaaattaatacaaacc

SEQ ID NO: 217394 - DNA, 23 bp, Artificial sequence
  SiRNA target sequence
atttccaaaattaatacaaacca

SEQ ID NO: 217395 - DNA, 23 bp, Artificial sequence
  SiRNA target sequence
tttccaaaattaatacaaaccaa

SEQ ID NO: 217396 - DNA, 23 bp, Artificial sequence
  SiRNA target sequence
ttccaaaattaatacaaaccaaa

SEQ ID NO: 217397 - DNA, 23 bp, Artificial sequence
  SiRNA target sequence
tccaaaattaatacaaaccaaag

SEQ ID NO: 217398 - DNA, 23 bp, Artificial sequence
  SiRNA target sequence
ccaaaattaatacaaaccaaagg

SEQ ID NO: 217399 - DNA, 23 bp, Artificial sequence
  SiRNA target sequence
caaaattaatacaaaccaaagga

SEQ ID NO: 217400 - DNA, 23 bp, Artificial sequence
  SiRNA target sequence
aaaattaatacaaaccaaaggat

SEQ ID NO: 217401 - DNA, 23 bp, Artificial sequence
  SiRNA target sequence
aaattaatacaaaccaaaggatg

SEQ ID NO: 217402 - DNA, 23 bp, Artificial sequence
  SiRNA target sequence
aattaatacaaaccaaaggatgg

SEQ ID NO: 217403 - DNA, 23 bp, Artificial sequence
  SiRNA target sequence
attaatacaaaccaaaggatgga

SEQ ID NO: 217404 - DNA, 23 bp, Artificial sequence
  SiRNA target sequence
ttaatacaaaccaaaggatggat

SEQ ID NO: 217405 - DNA, 23 bp, Artificial sequence
  SiRNA target sequence
taatacaaaccaaaggatggata

SEQ ID NO: 217406 - DNA, 23 bp, Artificial sequence
  SiRNA target sequence
aatacaaaccaaaggatggatat

SEQ ID NO: 217407 - DNA, 23 bp, Artificial sequence
  SiRNA target sequence
atacaaaccaaaggatggatatt

SEQ ID NO: 217408 - DNA, 23 bp, Artificial sequence
  SiRNA target sequence
tacaaaccaaaggatggatattt

SEQ ID NO: 217409 - DNA, 23 bp, Artificial sequence
  SiRNA target sequence
acaaaccaaaggatggatatttg

SEQ ID NO: 217410 - DNA, 23 bp, Artificial sequence
  SiRNA target sequence
caaaccaaaggatggatatttgt

SEQ ID NO: 217411 - DNA, 23 bp, Artificial sequence
  SiRNA target sequence
aaaccaaaggatggatatttgtt

SEQ ID NO: 217412 - DNA, 23 bp, Artificial sequence
  SiRNA target sequence
aaccaaaggatggatatttgttg

SEQ ID NO: 217413 - DNA, 23 bp, Artificial sequence
  SiRNA target sequence
accaaaggatggatatttgttgc

SEQ ID NO: 217414 - DNA, 23 bp, Artificial sequence
  SiRNA target sequence
ccaaaggatggatatttgttgcc

SEQ ID NO: 217415 - DNA, 23 bp, Artificial sequence
  SiRNA target sequence
caaaggatggatatttgttgcca

SEQ ID NO: 217416 - DNA, 23 bp, Artificial sequence
  SiRNA target sequence
aaaggatggatatttgttgccat

SEQ ID NO: 217417 - DNA, 23 bp, Artificial sequence
  SiRNA target sequence
aaggatggatatttgttgccata

SEQ ID NO: 217418 - DNA, 23 bp, Artificial sequence
  SiRNA target sequence
aggatggatatttgttgccatag

SEQ ID NO: 217419 - DNA, 23 bp, Artificial sequence
  SiRNA target sequence
ggatggatatttgttgccatagc

SEQ ID NO: 217420 - DNA, 23 bp, Artificial sequence
  SiRNA target sequence
gatggatatttgttgccatagcg

SEQ ID NO: 217421 - DNA, 23 bp, Artificial sequence
  SiRNA target sequence
atggatatttgttgccatagcgt

SEQ ID NO: 217422 - DNA, 23 bp, Artificial sequence
  SiRNA target sequence
tggatatttgttgccatagcgtg

SEQ ID NO: 217423 - DNA, 23 bp, Artificial sequence
  SiRNA target sequence
ggatatttgttgccatagcgtgc

SEQ ID NO: 217424 - DNA, 23 bp, Artificial sequence
  SiRNA target sequence
gatatttgttgccatagcgtgcc

SEQ ID NO: 217425 - DNA, 23 bp, Artificial sequence
  SiRNA target sequence
atatttgttgccatagcgtgccc

SEQ ID NO: 217426 - DNA, 23 bp, Artificial sequence
  SiRNA target sequence
tatttgttgccatagcgtgccca

SEQ ID NO: 217427 - DNA, 23 bp, Artificial sequence
  SiRNA target sequence
atttgttgccatagcgtgcccac

SEQ ID NO: 217428 - DNA, 23 bp, Artificial sequence
  SiRNA target sequence
tttgttgccatagcgtgcccact

SEQ ID NO: 217429 - DNA, 23 bp, Artificial sequence
  SiRNA target sequence
ttgttgccatagcgtgcccactt

SEQ ID NO: 217430 - DNA, 23 bp, Artificial sequence
  SiRNA target sequence
tgttgccatagcgtgcccactta

SEQ ID NO: 217431 - DNA, 23 bp, Artificial sequence
  SiRNA target sequence
gttgccatagcgtgcccacttat

SEQ ID NO: 217432 - DNA, 23 bp, Artificial sequence
  SiRNA target sequence
ttgccatagcgtgcccacttatt

SEQ ID NO: 217433 - DNA, 23 bp, Artificial sequence
  SiRNA target sequence
tgccatagcgtgcccacttatta

SEQ ID NO: 217434 - DNA, 23 bp, Artificial sequence
  SiRNA target sequence
gccatagcgtgcccacttattac

SEQ ID NO: 217435 - DNA, 23 bp, Artificial sequence
  SiRNA target sequence
ccatagcgtgcccacttattacc

SEQ ID NO: 217436 - DNA, 23 bp, Artificial sequence
  SiRNA target sequence
catagcgtgcccacttattaccc

SEQ ID NO: 217437 - DNA, 23 bp, Artificial sequence
  SiRNA target sequence
atagcgtgcccacttattaccct

SEQ ID NO: 217438 - DNA, 23 bp, Artificial sequence
  SiRNA target sequence
tagcgtgcccacttattaccctt

SEQ ID NO: 217439 - DNA, 23 bp, Artificial sequence
  SiRNA target sequence
agcgtgcccacttattacccttt

SEQ ID NO: 217440 - DNA, 23 bp, Artificial sequence
  SiRNA target sequence
gcgtgcccacttattaccctttt

SEQ ID NO: 217441 - DNA, 23 bp, Artificial sequence
  SiRNA target sequence
cgtgcccacttattacccttttt

SEQ ID NO: 217442 - DNA, 23 bp, Artificial sequence
  SiRNA target sequence
gtgcccacttattaccctttttg

SEQ ID NO: 217443 - DNA, 23 bp, Artificial sequence
  SiRNA target sequence
tgcccacttattaccctttttgc

SEQ ID NO: 217444 - DNA, 23 bp, Artificial sequence
  SiRNA target sequence
gcccacttattaccctttttgct

SEQ ID NO: 217445 - DNA, 23 bp, Artificial sequence
  SiRNA target sequence
cccacttattaccctttttgctg

SEQ ID NO: 217446 - DNA, 23 bp, Artificial sequence
  SiRNA target sequence
ccacttattaccctttttgctgt

SEQ ID NO: 217447 - DNA, 23 bp, Artificial sequence
  SiRNA target sequence
cacttattaccctttttgctgta

SEQ ID NO: 217448 - DNA, 23 bp, Artificial sequence
  SiRNA target sequence
acttattaccctttttgctgtag

SEQ ID NO: 217449 - DNA, 23 bp, Artificial sequence
  SiRNA target sequence
cttattaccctttttgctgtagt

SEQ ID NO: 217450 - DNA, 23 bp, Artificial sequence
  SiRNA target sequence
ttattaccctttttgctgtagtt

SEQ ID NO: 217451 - DNA, 23 bp, Artificial sequence
  SiRNA target sequence
tattaccctttttgctgtagttt

SEQ ID NO: 217452 - DNA, 23 bp, Artificial sequence
  SiRNA target sequence
attaccctttttgctgtagtttc

SEQ ID NO: 217453 - DNA, 23 bp, Artificial sequence
  SiRNA target sequence
ttaccctttttgctgtagtttct

SEQ ID NO: 217454 - DNA, 23 bp, Artificial sequence
  SiRNA target sequence
taccctttttgctgtagtttctg

SEQ ID NO: 217455 - DNA, 23 bp, Artificial sequence
  SiRNA target sequence
accctttttgctgtagtttctgt

SEQ ID NO: 217456 - DNA, 23 bp, Artificial sequence
  SiRNA target sequence
ccctttttgctgtagtttctgtg

SEQ ID NO: 217457 - DNA, 23 bp, Artificial sequence
  SiRNA target sequence
cctttttgctgtagtttctgtgt

SEQ ID NO: 217458 - DNA, 23 bp, Artificial sequence
  SiRNA target sequence
ctttttgctgtagtttctgtgtg

SEQ ID NO: 217459 - DNA, 23 bp, Artificial sequence
  SiRNA target sequence
tttttgctgtagtttctgtgtgt

SEQ ID NO: 217460 - DNA, 23 bp, Artificial sequence
  SiRNA target sequence
ttttgctgtagtttctgtgtgtg

SEQ ID NO: 217461 - DNA, 23 bp, Artificial sequence
  SiRNA target sequence
tttgctgtagtttctgtgtgtgg

SEQ ID NO: 217462 - DNA, 23 bp, Artificial sequence
  SiRNA target sequence
ttgctgtagtttctgtgtgtggt

SEQ ID NO: 217463 - DNA, 23 bp, Artificial sequence
  SiRNA target sequence
tgctgtagtttctgtgtgtggtc

SEQ ID NO: 217464 - DNA, 23 bp, Artificial sequence
  SiRNA target sequence
gctgtagtttctgtgtgtggtct

SEQ ID NO: 217465 - DNA, 23 bp, Artificial sequence
  SiRNA target sequence
ctgtagtttctgtgtgtggtctt

SEQ ID NO: 217466 - DNA, 23 bp, Artificial sequence
  SiRNA target sequence
tgtagtttctgtgtgtggtcttg

SEQ ID NO: 217467 - DNA, 23 bp, Artificial sequence
  SiRNA target sequence
gtagtttctgtgtgtggtcttgc

SEQ ID NO: 217468 - DNA, 23 bp, Artificial sequence
  SiRNA target sequence
tagtttctgtgtgtggtcttgct

SEQ ID NO: 217469 - DNA, 23 bp, Artificial sequence
  SiRNA target sequence
agtttctgtgtgtggtcttgctt

SEQ ID NO: 217470 - DNA, 23 bp, Artificial sequence
  SiRNA target sequence
gtttctgtgtgtggtcttgcttt

SEQ ID NO: 217471 - DNA, 23 bp, Artificial sequence
  SiRNA target sequence
tttctgtgtgtggtcttgctttt

SEQ ID NO: 217472 - DNA, 23 bp, Artificial sequence
  SiRNA target sequence
ttctgtgtgtggtcttgcttttt

SEQ ID NO: 217473 - DNA, 23 bp, Artificial sequence
  SiRNA target sequence
tctgtgtgtggtcttgcttttta

SEQ ID NO: 217474 - DNA, 23 bp, Artificial sequence
  SiRNA target sequence
ctgtgtgtggtcttgctttttac

SEQ ID NO: 217475 - DNA, 23 bp, Artificial sequence
  SiRNA target sequence
tgtgtgtggtcttgctttttaca

SEQ ID NO: 217476 - DNA, 23 bp, Artificial sequence
  SiRNA target sequence
gtgtgtggtcttgctttttacaa

SEQ ID NO: 217477 - DNA, 23 bp, Artificial sequence
  SiRNA target sequence
tgtgtggtcttgctttttacaat

SEQ ID NO: 217478 - DNA, 23 bp, Artificial sequence
  SiRNA target sequence
gtgtggtcttgctttttacaatt

SEQ ID NO: 217479 - DNA, 23 bp, Artificial sequence
  SiRNA target sequence
tgtggtcttgctttttacaatta

SEQ ID NO: 217480 - DNA, 23 bp, Artificial sequence
  SiRNA target sequence
gtggtcttgctttttacaattat

SEQ ID NO: 217481 - DNA, 23 bp, Artificial sequence
  SiRNA target sequence
tggtcttgctttttacaattatc

SEQ ID NO: 217482 - DNA, 23 bp, Artificial sequence
  SiRNA target sequence
ggtcttgctttttacaattatcc

SEQ ID NO: 217483 - DNA, 23 bp, Artificial sequence
  SiRNA target sequence
gtcttgctttttacaattatccg

SEQ ID NO: 217484 - DNA, 23 bp, Artificial sequence
  SiRNA target sequence
tcttgctttttacaattatccgg

SEQ ID NO: 217485 - DNA, 23 bp, Artificial sequence
  SiRNA target sequence
cttgctttttacaattatccggc

SEQ ID NO: 217486 - DNA, 23 bp, Artificial sequence
  SiRNA target sequence
ttgctttttacaattatccggca

SEQ ID NO: 217487 - DNA, 23 bp, Artificial sequence
  SiRNA target sequence
tgctttttacaattatccggcaa

SEQ ID NO: 217488 - DNA, 23 bp, Artificial sequence
  SiRNA target sequence
gctttttacaattatccggcaac

SEQ ID NO: 217489 - DNA, 23 bp, Artificial sequence
  SiRNA target sequence
ctttttacaattatccggcaaca

SEQ ID NO: 217490 - DNA, 23 bp, Artificial sequence
  SiRNA target sequence
tttttacaattatccggcaacaa

SEQ ID NO: 217491 - DNA, 23 bp, Artificial sequence
  SiRNA target sequence
ttttacaattatccggcaacaaa

SEQ ID NO: 217492 - DNA, 23 bp, Artificial sequence
  SiRNA target sequence
tttacaattatccggcaacaaat

SEQ ID NO: 217493 - DNA, 23 bp, Artificial sequence
  SiRNA target sequence
ttacaattatccggcaacaaata

SEQ ID NO: 217494 - DNA, 23 bp, Artificial sequence
  SiRNA target sequence
tacaattatccggcaacaaataa

SEQ ID NO: 217495 - DNA, 23 bp, Artificial sequence
  SiRNA target sequence
acaattatccggcaacaaataat

SEQ ID NO: 217496 - DNA, 23 bp, Artificial sequence
  SiRNA target sequence
caattatccggcaacaaataatg

SEQ ID NO: 217497 - DNA, 23 bp, Artificial sequence
  SiRNA target sequence
aattatccggcaacaaataatga

SEQ ID NO: 217498 - DNA, 23 bp, Artificial sequence
  SiRNA target sequence
attatccggcaacaaataatgac

SEQ ID NO: 217499 - DNA, 23 bp, Artificial sequence
  SiRNA target sequence
ttatccggcaacaaataatgaca

SEQ ID NO: 217500 - DNA, 23 bp, Artificial sequence
  SiRNA target sequence
tatccggcaacaaataatgacac

SEQ ID NO: 217501 - DNA, 23 bp, Artificial sequence
  SiRNA target sequence
atccggcaacaaataatgacaca

SEQ ID NO: 217502 - DNA, 23 bp, Artificial sequence
  SiRNA target sequence
tccggcaacaaataatgacacaa

SEQ ID NO: 217503 - DNA, 23 bp, Artificial sequence
  SiRNA target sequence
ccggcaacaaataatgacacaaa

SEQ ID NO: 217504 - DNA, 23 bp, Artificial sequence
  SiRNA target sequence
cggcaacaaataatgacacaaat

SEQ ID NO: 217505 - DNA, 23 bp, Artificial sequence
  SiRNA target sequence
ggcaacaaataatgacacaaatt

SEQ ID NO: 217506 - DNA, 23 bp, Artificial sequence
  SiRNA target sequence
gcaacaaataatgacacaaattt

SEQ ID NO: 217507 - DNA, 23 bp, Artificial sequence
  SiRNA target sequence
caacaaataatgacacaaatttt

SEQ ID NO: 217508 - DNA, 23 bp, Artificial sequence
  SiRNA target sequence
aacaaataatgacacaaattttt

SEQ ID NO: 217509 - DNA, 23 bp, Artificial sequence
  SiRNA target sequence
acaaataatgacacaaatttttt

SEQ ID NO: 217510 - DNA, 23 bp, Artificial sequence
  SiRNA target sequence
caaataatgacacaaattttttt

SEQ ID NO: 217511 - DNA, 23 bp, Artificial sequence
  SiRNA target sequence
aaataatgacacaaatttttttc

SEQ ID NO: 217512 - DNA, 23 bp, Artificial sequence
  SiRNA target sequence
aataatgacacaaatttttttct

SEQ ID NO: 217513 - DNA, 23 bp, Artificial sequence
  SiRNA target sequence
ataatgacacaaatttttttcta

SEQ ID NO: 217514 - DNA, 23 bp, Artificial sequence
  SiRNA target sequence
taatgacacaaatttttttctaa

SEQ ID NO: 217515 - DNA, 23 bp, Artificial sequence
  SiRNA target sequence
aatgacacaaatttttttctaaa

SEQ ID NO: 217516 - DNA, 23 bp, Artificial sequence
  SiRNA target sequence
atgacacaaatttttttctaaat

SEQ ID NO: 217517 - DNA, 23 bp, Artificial sequence
  SiRNA target sequence
tgacacaaatttttttctaaatt

SEQ ID NO: 217518 - DNA, 23 bp, Artificial sequence
  SiRNA target sequence
gacacaaatttttttctaaattc

SEQ ID NO: 217519 - DNA, 23 bp, Artificial sequence
  SiRNA target sequence
acacaaatttttttctaaattca

SEQ ID NO: 217520 - DNA, 23 bp, Artificial sequence
  SiRNA target sequence
cacaaatttttttctaaattcat

SEQ ID NO: 217521 - DNA, 23 bp, Artificial sequence
  SiRNA target sequence
acaaatttttttctaaattcatt

SEQ ID NO: 217522 - DNA, 23 bp, Artificial sequence
  SiRNA target sequence
caaatttttttctaaattcatta

SEQ ID NO: 217523 - DNA, 23 bp, Artificial sequence
  SiRNA target sequence
aaatttttttctaaattcattat

SEQ ID NO: 217524 - DNA, 23 bp, Artificial sequence
  SiRNA target sequence
aatttttttctaaattcattatg

SEQ ID NO: 217525 - DNA, 23 bp, Artificial sequence
  SiRNA target sequence
atttttttctaaattcattatgt

SEQ ID NO: 217526 - DNA, 23 bp, Artificial sequence
  SiRNA target sequence
tttttttctaaattcattatgtg

SEQ ID NO: 217527 - DNA, 23 bp, Artificial sequence
  SiRNA target sequence
ttttttctaaattcattatgtgc

SEQ ID NO: 217528 - DNA, 23 bp, Artificial sequence
  SiRNA target sequence
tttttctaaattcattatgtgct

SEQ ID NO: 217529 - DNA, 23 bp, Artificial sequence
  SiRNA target sequence
ttttctaaattcattatgtgcta

SEQ ID NO: 217530 - DNA, 23 bp, Artificial sequence
  SiRNA target sequence
tttctaaattcattatgtgctac

SEQ ID NO: 217531 - DNA, 23 bp, Artificial sequence
  SiRNA target sequence
ttctaaattcattatgtgctacg

SEQ ID NO: 217532 - DNA, 23 bp, Artificial sequence
  SiRNA target sequence
tctaaattcattatgtgctacgc

SEQ ID NO: 217533 - DNA, 23 bp, Artificial sequence
  SiRNA target sequence
ctaaattcattatgtgctacgcc

SEQ ID NO: 217534 - DNA, 23 bp, Artificial sequence
  SiRNA target sequence
taaattcattatgtgctacgccc

SEQ ID NO: 217535 - DNA, 23 bp, Artificial sequence
  SiRNA target sequence
aaattcattatgtgctacgcccg

SEQ ID NO: 217536 - DNA, 23 bp, Artificial sequence
  SiRNA target sequence
aattcattatgtgctacgcccgg

SEQ ID NO: 217537 - DNA, 23 bp, Artificial sequence
  SiRNA target sequence
attcattatgtgctacgcccggt

SEQ ID NO: 217538 - DNA, 23 bp, Artificial sequence
  SiRNA target sequence
ttcattatgtgctacgcccggta

SEQ ID NO: 217539 - DNA, 23 bp, Artificial sequence
  SiRNA target sequence
tcattatgtgctacgcccggtaa

SEQ ID NO: 217540 - DNA, 23 bp, Artificial sequence
  SiRNA target sequence
cattatgtgctacgcccggtaaa

SEQ ID NO: 217541 - DNA, 23 bp, Artificial sequence
  SiRNA target sequence
attatgtgctacgcccggtaaat

SEQ ID NO: 217542 - DNA, 23 bp, Artificial sequence
  SiRNA target sequence
ttatgtgctacgcccggtaaatc

SEQ ID NO: 217543 - DNA, 23 bp, Artificial sequence
  SiRNA target sequence
tatgtgctacgcccggtaaatcg

SEQ ID NO: 217544 - DNA, 23 bp, Artificial sequence
  SiRNA target sequence
atgtgctacgcccggtaaatcgt

SEQ ID NO: 217545 - DNA, 23 bp, Artificial sequence
  SiRNA target sequence
tgtgctacgcccggtaaatcgtt

SEQ ID NO: 217546 - DNA, 23 bp, Artificial sequence
  SiRNA target sequence
gtgctacgcccggtaaatcgttt

SEQ ID NO: 217547 - DNA, 23 bp, Artificial sequence
  SiRNA target sequence
tgctacgcccggtaaatcgttta

SEQ ID NO: 217548 - DNA, 23 bp, Artificial sequence
  SiRNA target sequence
gctacgcccggtaaatcgtttat

SEQ ID NO: 217549 - DNA, 23 bp, Artificial sequence
  SiRNA target sequence
ctacgcccggtaaatcgtttata

SEQ ID NO: 217550 - DNA, 23 bp, Artificial sequence
  SiRNA target sequence
tacgcccggtaaatcgtttataa

SEQ ID NO: 217551 - DNA, 23 bp, Artificial sequence
  SiRNA target sequence
acgcccggtaaatcgtttataaa

SEQ ID NO: 217552 - DNA, 23 bp, Artificial sequence
  SiRNA target sequence
cgcccggtaaatcgtttataaaa

SEQ ID NO: 217553 - DNA, 23 bp, Artificial sequence
  SiRNA target sequence
gcccggtaaatcgtttataaaat

SEQ ID NO: 217554 - DNA, 23 bp, Artificial sequence
  SiRNA target sequence
cccggtaaatcgtttataaaatt

SEQ ID NO: 217555 - DNA, 23 bp, Artificial sequence
  SiRNA target sequence
ccggtaaatcgtttataaaatta

SEQ ID NO: 217556 - DNA, 23 bp, Artificial sequence
  SiRNA target sequence
cggtaaatcgtttataaaattag

SEQ ID NO: 217557 - DNA, 23 bp, Artificial sequence
  SiRNA target sequence
ggtaaatcgtttataaaattaga

SEQ ID NO: 217558 - DNA, 23 bp, Artificial sequence
  SiRNA target sequence
gtaaatcgtttataaaattagaa

SEQ ID NO: 217559 - DNA, 23 bp, Artificial sequence
  SiRNA target sequence
taaatcgtttataaaattagaaa

SEQ ID NO: 217560 - DNA, 23 bp, Artificial sequence
  SiRNA target sequence
aaatcgtttataaaattagaaaa

SEQ ID NO: 217561 - DNA, 23 bp, Artificial sequence
  SiRNA target sequence
aatcgtttataaaattagaaaat

SEQ ID NO: 217562 - DNA, 23 bp, Artificial sequence
  SiRNA target sequence
atcgtttataaaattagaaaatg

SEQ ID NO: 217563 - DNA, 23 bp, Artificial sequence
  SiRNA target sequence
tcgtttataaaattagaaaatgt

SEQ ID NO: 217564 - DNA, 23 bp, Artificial sequence
  SiRNA target sequence
cgtttataaaattagaaaatgtt

SEQ ID NO: 217565 - DNA, 23 bp, Artificial sequence
  SiRNA target sequence
gtttataaaattagaaaatgttt

SEQ ID NO: 217566 - DNA, 23 bp, Artificial sequence
  SiRNA target sequence
tttataaaattagaaaatgtttt

SEQ ID NO: 217567 - DNA, 23 bp, Artificial sequence
  SiRNA target sequence
ttataaaattagaaaatgtttta

SEQ ID NO: 217568 - DNA, 23 bp, Artificial sequence
  SiRNA target sequence
tataaaattagaaaatgttttag

SEQ ID NO: 217569 - DNA, 23 bp, Artificial sequence
  SiRNA target sequence
ataaaattagaaaatgttttagg

SEQ ID NO: 217570 - DNA, 23 bp, Artificial sequence
  SiRNA target sequence
taaaattagaaaatgttttagga

SEQ ID NO: 217571 - DNA, 23 bp, Artificial sequence
  SiRNA target sequence
aaaattagaaaatgttttaggat

SEQ ID NO: 217572 - DNA, 23 bp, Artificial sequence
  SiRNA target sequence
aaattagaaaatgttttaggatg

SEQ ID NO: 217573 - DNA, 23 bp, Artificial sequence
  SiRNA target sequence
aattagaaaatgttttaggatgt

SEQ ID NO: 217574 - DNA, 23 bp, Artificial sequence
  SiRNA target sequence
attagaaaatgttttaggatgtg

SEQ ID NO: 217575 - DNA, 23 bp, Artificial sequence
  SiRNA target sequence
ttagaaaatgttttaggatgtgt

SEQ ID NO: 217576 - DNA, 23 bp, Artificial sequence
  SiRNA target sequence
tagaaaatgttttaggatgtgta

SEQ ID NO: 217577 - DNA, 23 bp, Artificial sequence
  SiRNA target sequence
agaaaatgttttaggatgtgtag

SEQ ID NO: 217578 - DNA, 23 bp, Artificial sequence
  SiRNA target sequence
gaaaatgttttaggatgtgtagc

SEQ ID NO: 217579 - DNA, 23 bp, Artificial sequence
  SiRNA target sequence
aaaatgttttaggatgtgtagct

SEQ ID NO: 217580 - DNA, 23 bp, Artificial sequence
  SiRNA target sequence
aaatgttttaggatgtgtagctg

SEQ ID NO: 217581 - DNA, 23 bp, Artificial sequence
  SiRNA target sequence
aatgttttaggatgtgtagctgt

SEQ ID NO: 217582 - DNA, 23 bp, Artificial sequence
  SiRNA target sequence
atgttttaggatgtgtagctgta

SEQ ID NO: 217583 - DNA, 23 bp, Artificial sequence
  SiRNA target sequence
tgttttaggatgtgtagctgtag

SEQ ID NO: 217584 - DNA, 23 bp, Artificial sequence
  SiRNA target sequence
gttttaggatgtgtagctgtagc

SEQ ID NO: 217585 - DNA, 23 bp, Artificial sequence
  SiRNA target sequence
ttttaggatgtgtagctgtagct

SEQ ID NO: 217586 - DNA, 23 bp, Artificial sequence
  SiRNA target sequence
tttaggatgtgtagctgtagctc

SEQ ID NO: 217587 - DNA, 23 bp, Artificial sequence
  SiRNA target sequence
ttaggatgtgtagctgtagctct

SEQ ID NO: 217588 - DNA, 23 bp, Artificial sequence
  SiRNA target sequence
taggatgtgtagctgtagctctt

SEQ ID NO: 217589 - DNA, 23 bp, Artificial sequence
  SiRNA target sequence
aggatgtgtagctgtagctctta

SEQ ID NO: 217590 - DNA, 23 bp, Artificial sequence
  SiRNA target sequence
ggatgtgtagctgtagctcttat

SEQ ID NO: 217591 - DNA, 23 bp, Artificial sequence
  SiRNA target sequence
gatgtgtagctgtagctcttatg

SEQ ID NO: 217592 - DNA, 23 bp, Artificial sequence
  SiRNA target sequence
atgtgtagctgtagctcttatga

SEQ ID NO: 217593 - DNA, 23 bp, Artificial sequence
  SiRNA target sequence
tgtgtagctgtagctcttatgaa

SEQ ID NO: 217594 - DNA, 23 bp, Artificial sequence
  SiRNA target sequence
gtgtagctgtagctcttatgaaa

SEQ ID NO: 217595 - DNA, 23 bp, Artificial sequence
  SiRNA target sequence
tgtagctgtagctcttatgaaag

SEQ ID NO: 217596 - DNA, 23 bp, Artificial sequence
  SiRNA target sequence
gtagctgtagctcttatgaaagt

SEQ ID NO: 217597 - DNA, 23 bp, Artificial sequence
  SiRNA target sequence
tagctgtagctcttatgaaagta

SEQ ID NO: 217598 - DNA, 23 bp, Artificial sequence
  SiRNA target sequence
agctgtagctcttatgaaagtag

SEQ ID NO: 217599 - DNA, 23 bp, Artificial sequence
  SiRNA target sequence
gctgtagctcttatgaaagtagc

SEQ ID NO: 217600 - DNA, 23 bp, Artificial sequence
  SiRNA target sequence
ctgtagctcttatgaaagtagca

SEQ ID NO: 217601 - DNA, 23 bp, Artificial sequence
  SiRNA target sequence
tgtagctcttatgaaagtagcaa

SEQ ID NO: 217602 - DNA, 23 bp, Artificial sequence
  SiRNA target sequence
gtagctcttatgaaagtagcaaa

SEQ ID NO: 217603 - DNA, 23 bp, Artificial sequence
  SiRNA target sequence
tagctcttatgaaagtagcaaaa

SEQ ID NO: 217604 - DNA, 23 bp, Artificial sequence
  SiRNA target sequence
agctcttatgaaagtagcaaaat

SEQ ID NO: 217605 - DNA, 23 bp, Artificial sequence
  SiRNA target sequence
gctcttatgaaagtagcaaaata

SEQ ID NO: 217606 - DNA, 23 bp, Artificial sequence
  SiRNA target sequence
ctcttatgaaagtagcaaaatat

SEQ ID NO: 217607 - DNA, 23 bp, Artificial sequence
  SiRNA target sequence
tcttatgaaagtagcaaaatatg

SEQ ID NO: 217608 - DNA, 23 bp, Artificial sequence
  SiRNA target sequence
cttatgaaagtagcaaaatatgg

SEQ ID NO: 217609 - DNA, 23 bp, Artificial sequence
  SiRNA target sequence
ttatgaaagtagcaaaatatggc

SEQ ID NO: 217610 - DNA, 23 bp, Artificial sequence
  SiRNA target sequence
tatgaaagtagcaaaatatggct

SEQ ID NO: 217611 - DNA, 23 bp, Artificial sequence
  SiRNA target sequence
atgaaagtagcaaaatatggctc

SEQ ID NO: 217612 - DNA, 23 bp, Artificial sequence
  SiRNA target sequence
tgaaagtagcaaaatatggctct

SEQ ID NO: 217613 - DNA, 23 bp, Artificial sequence
  SiRNA target sequence
gaaagtagcaaaatatggctctt

SEQ ID NO: 217614 - DNA, 23 bp, Artificial sequence
  SiRNA target sequence
aaagtagcaaaatatggctcttt

SEQ ID NO: 217615 - DNA, 23 bp, Artificial sequence
  SiRNA target sequence
aagtagcaaaatatggctctttt

SEQ ID NO: 217616 - DNA, 23 bp, Artificial sequence
  SiRNA target sequence
agtagcaaaatatggctcttttg

SEQ ID NO: 217617 - DNA, 23 bp, Artificial sequence
  SiRNA target sequence
gtagcaaaatatggctcttttga

SEQ ID NO: 217618 - DNA, 23 bp, Artificial sequence
  SiRNA target sequence
tagcaaaatatggctcttttgat

SEQ ID NO: 217619 - DNA, 23 bp, Artificial sequence
  SiRNA target sequence
agcaaaatatggctcttttgata

SEQ ID NO: 217620 - DNA, 23 bp, Artificial sequence
  SiRNA target sequence
gcaaaatatggctcttttgatat

SEQ ID NO: 217621 - DNA, 23 bp, Artificial sequence
  SiRNA target sequence
caaaatatggctcttttgatatt

SEQ ID NO: 217622 - DNA, 23 bp, Artificial sequence
  SiRNA target sequence
aaaatatggctcttttgatattt

SEQ ID NO: 217623 - DNA, 23 bp, Artificial sequence
  SiRNA target sequence
aaatatggctcttttgatatttc

SEQ ID NO: 217624 - DNA, 23 bp, Artificial sequence
  SiRNA target sequence
aatatggctcttttgatatttcc

SEQ ID NO: 217625 - DNA, 23 bp, Artificial sequence
  SiRNA target sequence
atatggctcttttgatatttcca

SEQ ID NO: 217626 - DNA, 23 bp, Artificial sequence
  SiRNA target sequence
tatggctcttttgatatttccaa

SEQ ID NO: 217627 - DNA, 23 bp, Artificial sequence
  SiRNA target sequence
atggctcttttgatatttccaaa

SEQ ID NO: 217628 - DNA, 23 bp, Artificial sequence
  SiRNA target sequence
tggctcttttgatatttccaaag

SEQ ID NO: 217629 - DNA, 23 bp, Artificial sequence
  SiRNA target sequence
ggctcttttgatatttccaaaga

SEQ ID NO: 217630 - DNA, 23 bp, Artificial sequence
  SiRNA target sequence
gctcttttgatatttccaaagaa

SEQ ID NO: 217631 - DNA, 23 bp, Artificial sequence
  SiRNA target sequence
ctcttttgatatttccaaagaag

SEQ ID NO: 217632 - DNA, 23 bp, Artificial sequence
  SiRNA target sequence
tcttttgatatttccaaagaagc

SEQ ID NO: 217633 - DNA, 23 bp, Artificial sequence
  SiRNA target sequence
cttttgatatttccaaagaagcc

SEQ ID NO: 217634 - DNA, 23 bp, Artificial sequence
  SiRNA target sequence
ttttgatatttccaaagaagcca

SEQ ID NO: 217635 - DNA, 23 bp, Artificial sequence
  SiRNA target sequence
tttgatatttccaaagaagccat

SEQ ID NO: 217636 - DNA, 23 bp, Artificial sequence
  SiRNA target sequence
ttgatatttccaaagaagccatt

SEQ ID NO: 217637 - DNA, 23 bp, Artificial sequence
  SiRNA target sequence
tgatatttccaaagaagccattt

SEQ ID NO: 217638 - DNA, 23 bp, Artificial sequence
  SiRNA target sequence
gatatttccaaagaagccatttc

SEQ ID NO: 217639 - DNA, 23 bp, Artificial sequence
  SiRNA target sequence
atatttccaaagaagccatttca

SEQ ID NO: 217640 - DNA, 23 bp, Artificial sequence
  SiRNA target sequence
tatttccaaagaagccatttcaa

SEQ ID NO: 217641 - DNA, 23 bp, Artificial sequence
  SiRNA target sequence
atttccaaagaagccatttcaat

SEQ ID NO: 217642 - DNA, 23 bp, Artificial sequence
  SiRNA target sequence
tttccaaagaagccatttcaatg

SEQ ID NO: 217643 - DNA, 23 bp, Artificial sequence
  SiRNA target sequence
ttccaaagaagccatttcaatgc

SEQ ID NO: 217644 - DNA, 23 bp, Artificial sequence
  SiRNA target sequence
tccaaagaagccatttcaatgca

SEQ ID NO: 217645 - DNA, 23 bp, Artificial sequence
  SiRNA target sequence
ccaaagaagccatttcaatgcag

SEQ ID NO: 217646 - DNA, 23 bp, Artificial sequence
  SiRNA target sequence
caaagaagccatttcaatgcaga

SEQ ID NO: 217647 - DNA, 23 bp, Artificial sequence
  SiRNA target sequence
aaagaagccatttcaatgcagat

SEQ ID NO: 217648 - DNA, 23 bp, Artificial sequence
  SiRNA target sequence
aagaagccatttcaatgcagatt

SEQ ID NO: 217649 - DNA, 23 bp, Artificial sequence
  SiRNA target sequence
agaagccatttcaatgcagattg

SEQ ID NO: 217650 - DNA, 23 bp, Artificial sequence
  SiRNA target sequence
gaagccatttcaatgcagattga

SEQ ID NO: 217651 - DNA, 23 bp, Artificial sequence
  SiRNA target sequence
aagccatttcaatgcagattgat

SEQ ID NO: 217652 - DNA, 23 bp, Artificial sequence
  SiRNA target sequence
agccatttcaatgcagattgatt

SEQ ID NO: 217653 - DNA, 23 bp, Artificial sequence
  SiRNA target sequence
gccatttcaatgcagattgattc

SEQ ID NO: 217654 - DNA, 23 bp, Artificial sequence
  SiRNA target sequence
ccatttcaatgcagattgattcg

SEQ ID NO: 217655 - DNA, 23 bp, Artificial sequence
  SiRNA target sequence
catttcaatgcagattgattcgt

SEQ ID NO: 217656 - DNA, 23 bp, Artificial sequence
  SiRNA target sequence
atttcaatgcagattgattcgtc

SEQ ID NO: 217657 - DNA, 23 bp, Artificial sequence
  SiRNA target sequence
tttcaatgcagattgattcgtca

SEQ ID NO: 217658 - DNA, 23 bp, Artificial sequence
  SiRNA target sequence
ttcaatgcagattgattcgtcat

SEQ ID NO: 217659 - DNA, 23 bp, Artificial sequence
  SiRNA target sequence
tcaatgcagattgattcgtcatt

SEQ ID NO: 217660 - DNA, 23 bp, Artificial sequence
  SiRNA target sequence
caatgcagattgattcgtcattg

SEQ ID NO: 217661 - DNA, 23 bp, Artificial sequence
  SiRNA target sequence
aatgcagattgattcgtcattgc

SEQ ID NO: 217662 - DNA, 23 bp, Artificial sequence
  SiRNA target sequence
atgcagattgattcgtcattgcg

SEQ ID NO: 217663 - DNA, 23 bp, Artificial sequence
  SiRNA target sequence
tgcagattgattcgtcattgcgt

SEQ ID NO: 217664 - DNA, 23 bp, Artificial sequence
  SiRNA target sequence
gcagattgattcgtcattgcgtg

SEQ ID NO: 217665 - DNA, 23 bp, Artificial sequence
  SiRNA target sequence
cagattgattcgtcattgcgtgc

SEQ ID NO: 217666 - DNA, 23 bp, Artificial sequence
  SiRNA target sequence
agattgattcgtcattgcgtgca

SEQ ID NO: 217667 - DNA, 23 bp, Artificial sequence
  SiRNA target sequence
gattgattcgtcattgcgtgcac

SEQ ID NO: 217668 - DNA, 23 bp, Artificial sequence
  SiRNA target sequence
attgattcgtcattgcgtgcacg

SEQ ID NO: 217669 - DNA, 23 bp, Artificial sequence
  SiRNA target sequence
ttgattcgtcattgcgtgcacgt

SEQ ID NO: 217670 - DNA, 23 bp, Artificial sequence
  SiRNA target sequence
tgattcgtcattgcgtgcacgtt

SEQ ID NO: 217671 - DNA, 23 bp, Artificial sequence
  SiRNA target sequence
gattcgtcattgcgtgcacgtta

SEQ ID NO: 217672 - DNA, 23 bp, Artificial sequence
  SiRNA target sequence
attcgtcattgcgtgcacgttat

SEQ ID NO: 217673 - DNA, 23 bp, Artificial sequence
  SiRNA target sequence
ttcgtcattgcgtgcacgttata

SEQ ID NO: 217674 - DNA, 23 bp, Artificial sequence
  SiRNA target sequence
tcgtcattgcgtgcacgttataa

SEQ ID NO: 217675 - DNA, 23 bp, Artificial sequence
  SiRNA target sequence
cgtcattgcgtgcacgttataaa

SEQ ID NO: 217676 - DNA, 23 bp, Artificial sequence
  SiRNA target sequence
gtcattgcgtgcacgttataaag

SEQ ID NO: 217677 - DNA, 23 bp, Artificial sequence
  SiRNA target sequence
tcattgcgtgcacgttataaagg

SEQ ID NO: 217678 - DNA, 23 bp, Artificial sequence
  SiRNA target sequence
cattgcgtgcacgttataaagga

SEQ ID NO: 217679 - DNA, 23 bp, Artificial sequence
  SiRNA target sequence
attgcgtgcacgttataaaggaa

SEQ ID NO: 217680 - DNA, 23 bp, Artificial sequence
  SiRNA target sequence
ttgcgtgcacgttataaaggaat

SEQ ID NO: 217681 - DNA, 23 bp, Artificial sequence
  SiRNA target sequence
tgcgtgcacgttataaaggaatt

SEQ ID NO: 217682 - DNA, 23 bp, Artificial sequence
  SiRNA target sequence
gcgtgcacgttataaaggaattt

SEQ ID NO: 217683 - DNA, 23 bp, Artificial sequence
  SiRNA target sequence
cgtgcacgttataaaggaatttt

SEQ ID NO: 217684 - DNA, 23 bp, Artificial sequence
  SiRNA target sequence
gtgcacgttataaaggaattttt

SEQ ID NO: 217685 - DNA, 23 bp, Artificial sequence
  SiRNA target sequence
tgcacgttataaaggaatttttg

SEQ ID NO: 217686 - DNA, 23 bp, Artificial sequence
  SiRNA target sequence
gcacgttataaaggaatttttga

SEQ ID NO: 217687 - DNA, 23 bp, Artificial sequence
  SiRNA target sequence
cacgttataaaggaatttttgac

SEQ ID NO: 217688 - DNA, 23 bp, Artificial sequence
  SiRNA target sequence
acgttataaaggaatttttgacg

SEQ ID NO: 217689 - DNA, 23 bp, Artificial sequence
  SiRNA target sequence
cgttataaaggaatttttgacgg

SEQ ID NO: 217690 - DNA, 23 bp, Artificial sequence
  SiRNA target sequence
gttataaaggaatttttgacggt

SEQ ID NO: 217691 - DNA, 23 bp, Artificial sequence
  SiRNA target sequence
ttataaaggaatttttgacggtg

SEQ ID NO: 217692 - DNA, 23 bp, Artificial sequence
  SiRNA target sequence
tataaaggaatttttgacggtgt

SEQ ID NO: 217693 - DNA, 23 bp, Artificial sequence
  SiRNA target sequence
ataaaggaatttttgacggtgtt

SEQ ID NO: 217694 - DNA, 23 bp, Artificial sequence
  SiRNA target sequence
taaaggaatttttgacggtgttt

SEQ ID NO: 217695 - DNA, 23 bp, Artificial sequence
  SiRNA target sequence
aaaggaatttttgacggtgtttt

SEQ ID NO: 217696 - DNA, 23 bp, Artificial sequence
  SiRNA target sequence
aaggaatttttgacggtgttttt

SEQ ID NO: 217697 - DNA, 23 bp, Artificial sequence
  SiRNA target sequence
aggaatttttgacggtgtttttg

SEQ ID NO: 217698 - DNA, 23 bp, Artificial sequence
  SiRNA target sequence
ggaatttttgacggtgtttttgg

SEQ ID NO: 217699 - DNA, 23 bp, Artificial sequence
  SiRNA target sequence
gaatttttgacggtgtttttggt

SEQ ID NO: 217700 - DNA, 23 bp, Artificial sequence
  SiRNA target sequence
aatttttgacggtgtttttggta

SEQ ID NO: 217701 - DNA, 23 bp, Artificial sequence
  SiRNA target sequence
atttttgacggtgtttttggtaa

SEQ ID NO: 217702 - DNA, 23 bp, Artificial sequence
  SiRNA target sequence
tttttgacggtgtttttggtaag

SEQ ID NO: 217703 - DNA, 23 bp, Artificial sequence
  SiRNA target sequence
ttttgacggtgtttttggtaagt

SEQ ID NO: 217704 - DNA, 23 bp, Artificial sequence
  SiRNA target sequence
tttgacggtgtttttggtaagtt

SEQ ID NO: 217705 - DNA, 23 bp, Artificial sequence
  SiRNA target sequence
ttgacggtgtttttggtaagtta

SEQ ID NO: 217706 - DNA, 23 bp, Artificial sequence
  SiRNA target sequence
tgacggtgtttttggtaagttag

SEQ ID NO: 217707 - DNA, 23 bp, Artificial sequence
  SiRNA target sequence
gacggtgtttttggtaagttagg

SEQ ID NO: 217708 - DNA, 23 bp, Artificial sequence
  SiRNA target sequence
acggtgtttttggtaagttagga

SEQ ID NO: 217709 - DNA, 23 bp, Artificial sequence
  SiRNA target sequence
cggtgtttttggtaagttaggaa

SEQ ID NO: 217710 - DNA, 23 bp, Artificial sequence
  SiRNA target sequence
ggtgtttttggtaagttaggaaa

SEQ ID NO: 217711 - DNA, 23 bp, Artificial sequence
  SiRNA target sequence
gtgtttttggtaagttaggaaaa

SEQ ID NO: 217712 - DNA, 23 bp, Artificial sequence
  SiRNA target sequence
tgtttttggtaagttaggaaaat

SEQ ID NO: 217713 - DNA, 23 bp, Artificial sequence
  SiRNA target sequence
gtttttggtaagttaggaaaatc

SEQ ID NO: 217714 - DNA, 23 bp, Artificial sequence
  SiRNA target sequence
tttttggtaagttaggaaaatct

SEQ ID NO: 217715 - DNA, 23 bp, Artificial sequence
  SiRNA target sequence
ttttggtaagttaggaaaatctc

SEQ ID NO: 217716 - DNA, 23 bp, Artificial sequence
  SiRNA target sequence
tttggtaagttaggaaaatctct

SEQ ID NO: 217717 - DNA, 23 bp, Artificial sequence
  SiRNA target sequence
ttggtaagttaggaaaatctctt

SEQ ID NO: 217718 - DNA, 23 bp, Artificial sequence
  SiRNA target sequence
tggtaagttaggaaaatctcttg

SEQ ID NO: 217719 - DNA, 23 bp, Artificial sequence
  SiRNA target sequence
ggtaagttaggaaaatctcttgg

SEQ ID NO: 217720 - DNA, 23 bp, Artificial sequence
  SiRNA target sequence
gtaagttaggaaaatctcttgga

SEQ ID NO: 217721 - DNA, 23 bp, Artificial sequence
  SiRNA target sequence
taagttaggaaaatctcttggat

SEQ ID NO: 217722 - DNA, 23 bp, Artificial sequence
  SiRNA target sequence
aagttaggaaaatctcttggatc

SEQ ID NO: 217723 - DNA, 23 bp, Artificial sequence
  SiRNA target sequence
agttaggaaaatctcttggatcg

SEQ ID NO: 217724 - DNA, 23 bp, Artificial sequence
  SiRNA target sequence
gttaggaaaatctcttggatcgt

SEQ ID NO: 217725 - DNA, 23 bp, Artificial sequence
  SiRNA target sequence
ttaggaaaatctcttggatcgtt

SEQ ID NO: 217726 - DNA, 23 bp, Artificial sequence
  SiRNA target sequence
taggaaaatctcttggatcgtta

SEQ ID NO: 217727 - DNA, 23 bp, Artificial sequence
  SiRNA target sequence
aggaaaatctcttggatcgttat

SEQ ID NO: 217728 - DNA, 23 bp, Artificial sequence
  SiRNA target sequence
ggaaaatctcttggatcgttatt

SEQ ID NO: 217729 - DNA, 23 bp, Artificial sequence
  SiRNA target sequence
gaaaatctcttggatcgttattt

SEQ ID NO: 217730 - DNA, 23 bp, Artificial sequence
  SiRNA target sequence
aaaatctcttggatcgttatttg

SEQ ID NO: 217731 - DNA, 23 bp, Artificial sequence
  SiRNA target sequence
aaatctcttggatcgttatttgt

SEQ ID NO: 217732 - DNA, 23 bp, Artificial sequence
  SiRNA target sequence
aatctcttggatcgttatttgtg

SEQ ID NO: 217733 - DNA, 23 bp, Artificial sequence
  SiRNA target sequence
atctcttggatcgttatttgtgt

SEQ ID NO: 217734 - DNA, 23 bp, Artificial sequence
  SiRNA target sequence
tctcttggatcgttatttgtgtg

SEQ ID NO: 217735 - DNA, 23 bp, Artificial sequence
  SiRNA target sequence
ctcttggatcgttatttgtgtgg

SEQ ID NO: 217736 - DNA, 23 bp, Artificial sequence
  SiRNA target sequence
tcttggatcgttatttgtgtgga

SEQ ID NO: 217737 - DNA, 23 bp, Artificial sequence
  SiRNA target sequence
cttggatcgttatttgtgtggat

SEQ ID NO: 217738 - DNA, 23 bp, Artificial sequence
  SiRNA target sequence
ttggatcgttatttgtgtggatt

SEQ ID NO: 217739 - DNA, 23 bp, Artificial sequence
  SiRNA target sequence
tggatcgttatttgtgtggatta

SEQ ID NO: 217740 - DNA, 23 bp, Artificial sequence
  SiRNA target sequence
ggatcgttatttgtgtggattat

SEQ ID NO: 217741 - DNA, 23 bp, Artificial sequence
  SiRNA target sequence
gatcgttatttgtgtggattatg

SEQ ID NO: 217742 - DNA, 23 bp, Artificial sequence
  SiRNA target sequence
atcgttatttgtgtggattatgg

SEQ ID NO: 217743 - DNA, 23 bp, Artificial sequence
  SiRNA target sequence
tcgttatttgtgtggattatggg

SEQ ID NO: 217744 - DNA, 23 bp, Artificial sequence
  SiRNA target sequence
cgttatttgtgtggattatggga

SEQ ID NO: 217745 - DNA, 23 bp, Artificial sequence
  SiRNA target sequence
gttatttgtgtggattatgggat

SEQ ID NO: 217746 - DNA, 23 bp, Artificial sequence
  SiRNA target sequence
ttatttgtgtggattatgggata

SEQ ID NO: 217747 - DNA, 23 bp, Artificial sequence
  SiRNA target sequence
tatttgtgtggattatgggatat

SEQ ID NO: 217748 - DNA, 23 bp, Artificial sequence
  SiRNA target sequence
atttgtgtggattatgggatatg

SEQ ID NO: 217749 - DNA, 23 bp, Artificial sequence
  SiRNA target sequence
tttgtgtggattatgggatatgc

SEQ ID NO: 217750 - DNA, 23 bp, Artificial sequence
  SiRNA target sequence
ttgtgtggattatgggatatgca

SEQ ID NO: 217751 - DNA, 23 bp, Artificial sequence
  SiRNA target sequence
tgtgtggattatgggatatgcat

SEQ ID NO: 217752 - DNA, 23 bp, Artificial sequence
  SiRNA target sequence
gtgtggattatgggatatgcatt

SEQ ID NO: 217753 - DNA, 23 bp, Artificial sequence
  SiRNA target sequence
tgtggattatgggatatgcattt

SEQ ID NO: 217754 - DNA, 23 bp, Artificial sequence
  SiRNA target sequence
gtggattatgggatatgcatttc

SEQ ID NO: 217755 - DNA, 23 bp, Artificial sequence
  SiRNA target sequence
tggattatgggatatgcatttca

SEQ ID NO: 217756 - DNA, 23 bp, Artificial sequence
  SiRNA target sequence
ggattatgggatatgcatttcaa

SEQ ID NO: 217757 - DNA, 23 bp, Artificial sequence
  SiRNA target sequence
gattatgggatatgcatttcaaa

SEQ ID NO: 217758 - DNA, 23 bp, Artificial sequence
  SiRNA target sequence
attatgggatatgcatttcaaac

SEQ ID NO: 217759 - DNA, 23 bp, Artificial sequence
  SiRNA target sequence
ttatgggatatgcatttcaaaca

SEQ ID NO: 217760 - DNA, 23 bp, Artificial sequence
  SiRNA target sequence
tatgggatatgcatttcaaacaa

SEQ ID NO: 217761 - DNA, 23 bp, Artificial sequence
  SiRNA target sequence
atgggatatgcatttcaaacaag

SEQ ID NO: 217762 - DNA, 23 bp, Artificial sequence
  SiRNA target sequence
tgggatatgcatttcaaacaaga

SEQ ID NO: 217763 - DNA, 23 bp, Artificial sequence
  SiRNA target sequence
gggatatgcatttcaaacaagag

SEQ ID NO: 217764 - DNA, 23 bp, Artificial sequence
  SiRNA target sequence
ggatatgcatttcaaacaagaga

SEQ ID NO: 217765 - DNA, 23 bp, Artificial sequence
  SiRNA target sequence
gatatgcatttcaaacaagagat

SEQ ID NO: 217766 - DNA, 23 bp, Artificial sequence
  SiRNA target sequence
atatgcatttcaaacaagagatt

SEQ ID NO: 217767 - DNA, 23 bp, Artificial sequence
  SiRNA target sequence
tatgcatttcaaacaagagattt

SEQ ID NO: 217768 - DNA, 23 bp, Artificial sequence
  SiRNA target sequence
atgcatttcaaacaagagatttt

SEQ ID NO: 217769 - DNA, 23 bp, Artificial sequence
  SiRNA target sequence
tgcatttcaaacaagagatttta

SEQ ID NO: 217770 - DNA, 23 bp, Artificial sequence
  SiRNA target sequence
gcatttcaaacaagagattttag

SEQ ID NO: 217771 - DNA, 23 bp, Artificial sequence
  SiRNA target sequence
catttcaaacaagagattttaga

SEQ ID NO: 217772 - DNA, 23 bp, Artificial sequence
  SiRNA target sequence
atttcaaacaagagattttagaa

SEQ ID NO: 217773 - DNA, 23 bp, Artificial sequence
  SiRNA target sequence
tttcaaacaagagattttagaaa

SEQ ID NO: 217774 - DNA, 23 bp, Artificial sequence
  SiRNA target sequence
ttcaaacaagagattttagaaaa

SEQ ID NO: 217775 - DNA, 23 bp, Artificial sequence
  SiRNA target sequence
tcaaacaagagattttagaaaat

SEQ ID NO: 217776 - DNA, 23 bp, Artificial sequence
  SiRNA target sequence
caaacaagagattttagaaaatt

SEQ ID NO: 217777 - DNA, 23 bp, Artificial sequence
  SiRNA target sequence
aaacaagagattttagaaaatta

SEQ ID NO: 217778 - DNA, 23 bp, Artificial sequence
  SiRNA target sequence
aacaagagattttagaaaattag

SEQ ID NO: 217779 - DNA, 23 bp, Artificial sequence
  SiRNA target sequence
acaagagattttagaaaattagc

SEQ ID NO: 217780 - DNA, 23 bp, Artificial sequence
  SiRNA target sequence
caagagattttagaaaattagct

SEQ ID NO: 217781 - DNA, 23 bp, Artificial sequence
  SiRNA target sequence
aagagattttagaaaattagctc

SEQ ID NO: 217782 - DNA, 23 bp, Artificial sequence
  SiRNA target sequence
agagattttagaaaattagctcc

SEQ ID NO: 217783 - DNA, 23 bp, Artificial sequence
  SiRNA target sequence
gagattttagaaaattagctccc

SEQ ID NO: 217784 - DNA, 23 bp, Artificial sequence
  SiRNA target sequence
agattttagaaaattagctccct

SEQ ID NO: 217785 - DNA, 23 bp, Artificial sequence
  SiRNA target sequence
gattttagaaaattagctccctt

SEQ ID NO: 217786 - DNA, 23 bp, Artificial sequence
  SiRNA target sequence
attttagaaaattagctccctta

SEQ ID NO: 217787 - DNA, 23 bp, Artificial sequence
  SiRNA target sequence
ttttagaaaattagctcccttat

SEQ ID NO: 217788 - DNA, 23 bp, Artificial sequence
  SiRNA target sequence
tttagaaaattagctcccttatg

SEQ ID NO: 217789 - DNA, 23 bp, Artificial sequence
  SiRNA target sequence
ttagaaaattagctcccttatgt

SEQ ID NO: 217790 - DNA, 23 bp, Artificial sequence
  SiRNA target sequence
tagaaaattagctcccttatgta

SEQ ID NO: 217791 - DNA, 23 bp, Artificial sequence
  SiRNA target sequence
agaaaattagctcccttatgtat

SEQ ID NO: 217792 - DNA, 23 bp, Artificial sequence
  SiRNA target sequence
gaaaattagctcccttatgtatc

SEQ ID NO: 217793 - DNA, 23 bp, Artificial sequence
  SiRNA target sequence
aaaattagctcccttatgtatca

SEQ ID NO: 217794 - DNA, 23 bp, Artificial sequence
  SiRNA target sequence
aaattagctcccttatgtatcag

SEQ ID NO: 217795 - DNA, 23 bp, Artificial sequence
  SiRNA target sequence
aattagctcccttatgtatcagc

SEQ ID NO: 217796 - DNA, 23 bp, Artificial sequence
  SiRNA target sequence
attagctcccttatgtatcagcg

SEQ ID NO: 217797 - DNA, 23 bp, Artificial sequence
  SiRNA target sequence
ttagctcccttatgtatcagcgt

SEQ ID NO: 217798 - DNA, 23 bp, Artificial sequence
  SiRNA target sequence
tagctcccttatgtatcagcgta

SEQ ID NO: 217799 - DNA, 23 bp, Artificial sequence
  SiRNA target sequence
agctcccttatgtatcagcgtaa

SEQ ID NO: 217800 - DNA, 23 bp, Artificial sequence
  SiRNA target sequence
gctcccttatgtatcagcgtaat

SEQ ID NO: 217801 - DNA, 23 bp, Artificial sequence
  SiRNA target sequence
ctcccttatgtatcagcgtaatt

SEQ ID NO: 217802 - DNA, 23 bp, Artificial sequence
  SiRNA target sequence
tcccttatgtatcagcgtaattg

SEQ ID NO: 217803 - DNA, 23 bp, Artificial sequence
  SiRNA target sequence
cccttatgtatcagcgtaattgt

SEQ ID NO: 217804 - DNA, 23 bp, Artificial sequence
  SiRNA target sequence
ccttatgtatcagcgtaattgtc

SEQ ID NO: 217805 - DNA, 23 bp, Artificial sequence
  SiRNA target sequence
cttatgtatcagcgtaattgtct

SEQ ID NO: 217806 - DNA, 23 bp, Artificial sequence
  SiRNA target sequence
ttatgtatcagcgtaattgtctt

SEQ ID NO: 217807 - DNA, 23 bp, Artificial sequence
  SiRNA target sequence
tatgtatcagcgtaattgtcttt

SEQ ID NO: 217808 - DNA, 23 bp, Artificial sequence
  SiRNA target sequence
atgtatcagcgtaattgtctttt

SEQ ID NO: 217809 - DNA, 23 bp, Artificial sequence
  SiRNA target sequence
tgtatcagcgtaattgtcttttt

SEQ ID NO: 217810 - DNA, 23 bp, Artificial sequence
  SiRNA target sequence
gtatcagcgtaattgtctttttt

SEQ ID NO: 217811 - DNA, 23 bp, Artificial sequence
  SiRNA target sequence
tatcagcgtaattgtcttttttg

SEQ ID NO: 217812 - DNA, 23 bp, Artificial sequence
  SiRNA target sequence
atcagcgtaattgtcttttttgt

SEQ ID NO: 217813 - DNA, 23 bp, Artificial sequence
  SiRNA target sequence
tcagcgtaattgtcttttttgtt

SEQ ID NO: 217814 - DNA, 23 bp, Artificial sequence
  SiRNA target sequence
cagcgtaattgtcttttttgtta

SEQ ID NO: 217815 - DNA, 23 bp, Artificial sequence
  SiRNA target sequence
agcgtaattgtcttttttgttat

SEQ ID NO: 217816 - DNA, 23 bp, Artificial sequence
  SiRNA target sequence
gcgtaattgtcttttttgttatt

SEQ ID NO: 217817 - DNA, 23 bp, Artificial sequence
  SiRNA target sequence
cgtaattgtcttttttgttatta

SEQ ID NO: 217818 - DNA, 23 bp, Artificial sequence
  SiRNA target sequence
gtaattgtcttttttgttattat

SEQ ID NO: 217819 - DNA, 23 bp, Artificial sequence
  SiRNA target sequence
taattgtcttttttgttattatt

SEQ ID NO: 217820 - DNA, 23 bp, Artificial sequence
  SiRNA target sequence
aattgtcttttttgttattattt

SEQ ID NO: 217821 - DNA, 23 bp, Artificial sequence
  SiRNA target sequence
attgtcttttttgttattatttg

SEQ ID NO: 217822 - DNA, 23 bp, Artificial sequence
  SiRNA target sequence
ttgtcttttttgttattatttgg

SEQ ID NO: 217823 - DNA, 23 bp, Artificial sequence
  SiRNA target sequence
tgtcttttttgttattatttgga

SEQ ID NO: 217824 - DNA, 23 bp, Artificial sequence
  SiRNA target sequence
gtcttttttgttattatttggat

SEQ ID NO: 217825 - DNA, 23 bp, Artificial sequence
  SiRNA target sequence
tcttttttgttattatttggatt

SEQ ID NO: 217826 - DNA, 23 bp, Artificial sequence
  SiRNA target sequence
cttttttgttattatttggattt

SEQ ID NO: 217827 - DNA, 23 bp, Artificial sequence
  SiRNA target sequence
ttttttgttattatttggattta

SEQ ID NO: 217828 - DNA, 23 bp, Artificial sequence
  SiRNA target sequence
tttttgttattatttggatttat

SEQ ID NO: 217829 - DNA, 23 bp, Artificial sequence
  SiRNA target sequence
ttttgttattatttggatttatt

SEQ ID NO: 217830 - DNA, 23 bp, Artificial sequence
  SiRNA target sequence
tttgttattatttggatttattc

SEQ ID NO: 217831 - DNA, 23 bp, Artificial sequence
  SiRNA target sequence
ttgttattatttggatttattca

SEQ ID NO: 217832 - DNA, 23 bp, Artificial sequence
  SiRNA target sequence
tgttattatttggatttattcag

SEQ ID NO: 217833 - DNA, 23 bp, Artificial sequence
  SiRNA target sequence
gttattatttggatttattcagt

SEQ ID NO: 217834 - DNA, 23 bp, Artificial sequence
  SiRNA target sequence
ttattatttggatttattcagtt

SEQ ID NO: 217835 - DNA, 23 bp, Artificial sequence
  SiRNA target sequence
tattatttggatttattcagtta

SEQ ID NO: 217836 - DNA, 23 bp, Artificial sequence
  SiRNA target sequence
attatttggatttattcagttat

SEQ ID NO: 217837 - DNA, 23 bp, Artificial sequence
  SiRNA target sequence
ttatttggatttattcagttatt

SEQ ID NO: 217838 - DNA, 23 bp, Artificial sequence
  SiRNA target sequence
tatttggatttattcagttattt

SEQ ID NO: 217839 - DNA, 23 bp, Artificial sequence
  SiRNA target sequence
atttggatttattcagttattta

SEQ ID NO: 217840 - DNA, 23 bp, Artificial sequence
  SiRNA target sequence
tttggatttattcagttatttat

SEQ ID NO: 217841 - DNA, 23 bp, Artificial sequence
  SiRNA target sequence
ttggatttattcagttatttatt

SEQ ID NO: 217842 - DNA, 23 bp, Artificial sequence
  SiRNA target sequence
tggatttattcagttatttattt

SEQ ID NO: 217843 - DNA, 23 bp, Artificial sequence
  SiRNA target sequence
ggatttattcagttatttattta

SEQ ID NO: 217844 - DNA, 23 bp, Artificial sequence
  SiRNA target sequence
gatttattcagttatttatttaa

SEQ ID NO: 217845 - DNA, 23 bp, Artificial sequence
  SiRNA target sequence
atttattcagttatttatttaaa

SEQ ID NO: 217846 - DNA, 23 bp, Artificial sequence
  SiRNA target sequence
tttattcagttatttatttaaat

SEQ ID NO: 217847 - DNA, 23 bp, Artificial sequence
  SiRNA target sequence
ttattcagttatttatttaaata

SEQ ID NO: 217848 - DNA, 23 bp, Artificial sequence
  SiRNA target sequence
tattcagttatttatttaaataa

SEQ ID NO: 217849 - DNA, 23 bp, Artificial sequence
  SiRNA target sequence
attcagttatttatttaaataag

SEQ ID NO: 217850 - DNA, 23 bp, Artificial sequence
  SiRNA target sequence
ttcagttatttatttaaataaga

SEQ ID NO: 217851 - DNA, 23 bp, Artificial sequence
  SiRNA target sequence
tcagttatttatttaaataagaa

SEQ ID NO: 217852 - DNA, 23 bp, Artificial sequence
  SiRNA target sequence
cagttatttatttaaataagaaa

SEQ ID NO: 217853 - DNA, 23 bp, Artificial sequence
  SiRNA target sequence
agttatttatttaaataagaaat

SEQ ID NO: 217854 - DNA, 23 bp, Artificial sequence
  SiRNA target sequence
gttatttatttaaataagaaata

SEQ ID NO: 217855 - DNA, 23 bp, Artificial sequence
  SiRNA target sequence
ttatttatttaaataagaaatac

SEQ ID NO: 217856 - DNA, 23 bp, Artificial sequence
  SiRNA target sequence
tatttatttaaataagaaataca

SEQ ID NO: 217857 - DNA, 23 bp, Artificial sequence
  SiRNA target sequence
atttatttaaataagaaatacaa

SEQ ID NO: 217858 - DNA, 23 bp, Artificial sequence
  SiRNA target sequence
tttatttaaataagaaatacaaa

SEQ ID NO: 217859 - DNA, 23 bp, Artificial sequence
  SiRNA target sequence
ttatttaaataagaaatacaaag

SEQ ID NO: 217860 - DNA, 23 bp, Artificial sequence
  SiRNA target sequence
tatttaaataagaaatacaaaga

SEQ ID NO: 217861 - DNA, 23 bp, Artificial sequence
  SiRNA target sequence
atttaaataagaaatacaaagaa

SEQ ID NO: 217862 - DNA, 23 bp, Artificial sequence
  SiRNA target sequence
tttaaataagaaatacaaagaat

SEQ ID NO: 217863 - DNA, 23 bp, Artificial sequence
  SiRNA target sequence
ttaaataagaaatacaaagaatc

SEQ ID NO: 217864 - DNA, 23 bp, Artificial sequence
  SiRNA target sequence
taaataagaaatacaaagaatca

SEQ ID NO: 217865 - DNA, 23 bp, Artificial sequence
  SiRNA target sequence
aaataagaaatacaaagaatcag

SEQ ID NO: 217866 - DNA, 23 bp, Artificial sequence
  SiRNA target sequence
aataagaaatacaaagaatcagt

SEQ ID NO: 217867 - DNA, 23 bp, Artificial sequence
  SiRNA target sequence
ataagaaatacaaagaatcagtt

SEQ ID NO: 217868 - DNA, 23 bp, Artificial sequence
  SiRNA target sequence
taagaaatacaaagaatcagttg

SEQ ID NO: 217869 - DNA, 23 bp, Artificial sequence
  SiRNA target sequence
aagaaatacaaagaatcagttgt

SEQ ID NO: 217870 - DNA, 23 bp, Artificial sequence
  SiRNA target sequence
agaaatacaaagaatcagttgtt

SEQ ID NO: 217871 - DNA, 23 bp, Artificial sequence
  SiRNA target sequence
gaaatacaaagaatcagttgtta

SEQ ID NO: 217872 - DNA, 23 bp, Artificial sequence
  SiRNA target sequence
aaatacaaagaatcagttgttag

SEQ ID NO: 217873 - DNA, 23 bp, Artificial sequence
  SiRNA target sequence
aatacaaagaatcagttgttagt

SEQ ID NO: 217874 - DNA, 23 bp, Artificial sequence
  SiRNA target sequence
atacaaagaatcagttgttagta

SEQ ID NO: 217875 - DNA, 23 bp, Artificial sequence
  SiRNA target sequence
tacaaagaatcagttgttagtaa

SEQ ID NO: 217876 - DNA, 23 bp, Artificial sequence
  SiRNA target sequence
acaaagaatcagttgttagtaat

SEQ ID NO: 217877 - DNA, 23 bp, Artificial sequence
  SiRNA target sequence
caaagaatcagttgttagtaatt

SEQ ID NO: 217878 - DNA, 23 bp, Artificial sequence
  SiRNA target sequence
aaagaatcagttgttagtaattt

SEQ ID NO: 217879 - DNA, 23 bp, Artificial sequence
  SiRNA target sequence
aagaatcagttgttagtaattta

SEQ ID NO: 217880 - DNA, 23 bp, Artificial sequence
  SiRNA target sequence
agaatcagttgttagtaatttac

SEQ ID NO: 217881 - DNA, 23 bp, Artificial sequence
  SiRNA target sequence
gaatcagttgttagtaatttacc

SEQ ID NO: 217882 - DNA, 23 bp, Artificial sequence
  SiRNA target sequence
aatcagttgttagtaatttaccc

SEQ ID NO: 217883 - DNA, 23 bp, Artificial sequence
  SiRNA target sequence
atcagttgttagtaatttaccca

SEQ ID NO: 217884 - DNA, 23 bp, Artificial sequence
  SiRNA target sequence
tcagttgttagtaatttacccat

SEQ ID NO: 217885 - DNA, 23 bp, Artificial sequence
  SiRNA target sequence
cagttgttagtaatttacccatc

SEQ ID NO: 217886 - DNA, 23 bp, Artificial sequence
  SiRNA target sequence
agttgttagtaatttacccatcg

SEQ ID NO: 217887 - DNA, 23 bp, Artificial sequence
  SiRNA target sequence
gttgttagtaatttacccatcga

SEQ ID NO: 217888 - DNA, 23 bp, Artificial sequence
  SiRNA target sequence
ttgttagtaatttacccatcgat

SEQ ID NO: 217889 - DNA, 23 bp, Artificial sequence
  SiRNA target sequence
tgttagtaatttacccatcgatg

SEQ ID NO: 217890 - DNA, 23 bp, Artificial sequence
  SiRNA target sequence
gttagtaatttacccatcgatgt

SEQ ID NO: 217891 - DNA, 23 bp, Artificial sequence
  SiRNA target sequence
ttagtaatttacccatcgatgtt

SEQ ID NO: 217892 - DNA, 23 bp, Artificial sequence
  SiRNA target sequence
tagtaatttacccatcgatgttg

SEQ ID NO: 217893 - DNA, 23 bp, Artificial sequence
  SiRNA target sequence
agtaatttacccatcgatgttga

SEQ ID NO: 217894 - DNA, 23 bp, Artificial sequence
  SiRNA target sequence
gtaatttacccatcgatgttgat

SEQ ID NO: 217895 - DNA, 23 bp, Artificial sequence
  SiRNA target sequence
taatttacccatcgatgttgatt

SEQ ID NO: 217896 - DNA, 23 bp, Artificial sequence
  SiRNA target sequence
aatttacccatcgatgttgattt

SEQ ID NO: 217897 - DNA, 23 bp, Artificial sequence
  SiRNA target sequence
atttacccatcgatgttgatttg

SEQ ID NO: 217898 - DNA, 23 bp, Artificial sequence
  SiRNA target sequence
tttacccatcgatgttgatttgt

SEQ ID NO: 217899 - DNA, 23 bp, Artificial sequence
  SiRNA target sequence
ttacccatcgatgttgatttgtt

SEQ ID NO: 217900 - DNA, 23 bp, Artificial sequence
  SiRNA target sequence
tacccatcgatgttgatttgttt

SEQ ID NO: 217901 - DNA, 23 bp, Artificial sequence
  SiRNA target sequence
acccatcgatgttgatttgtttg

SEQ ID NO: 217902 - DNA, 23 bp, Artificial sequence
  SiRNA target sequence
cccatcgatgttgatttgtttgc

SEQ ID NO: 217903 - DNA, 23 bp, Artificial sequence
  SiRNA target sequence
ccatcgatgttgatttgtttgca

SEQ ID NO: 217904 - DNA, 23 bp, Artificial sequence
  SiRNA target sequence
catcgatgttgatttgtttgcat

SEQ ID NO: 217905 - DNA, 23 bp, Artificial sequence
  SiRNA target sequence
atcgatgttgatttgtttgcatc

SEQ ID NO: 217906 - DNA, 23 bp, Artificial sequence
  SiRNA target sequence
tcgatgttgatttgtttgcatca

SEQ ID NO: 217907 - DNA, 23 bp, Artificial sequence
  SiRNA target sequence
cgatgttgatttgtttgcatcaa

SEQ ID NO: 217908 - DNA, 23 bp, Artificial sequence
  SiRNA target sequence
gatgttgatttgtttgcatcaaa

SEQ ID NO: 217909 - DNA, 23 bp, Artificial sequence
  SiRNA target sequence
atgttgatttgtttgcatcaaag

SEQ ID NO: 217910 - DNA, 23 bp, Artificial sequence
  SiRNA target sequence
tgttgatttgtttgcatcaaagt

SEQ ID NO: 217911 - DNA, 23 bp, Artificial sequence
  SiRNA target sequence
gttgatttgtttgcatcaaagtt

SEQ ID NO: 217912 - DNA, 23 bp, Artificial sequence
  SiRNA target sequence
ttgatttgtttgcatcaaagttg

SEQ ID NO: 217913 - DNA, 23 bp, Artificial sequence
  SiRNA target sequence
tgatttgtttgcatcaaagttgt

SEQ ID NO: 217914 - DNA, 23 bp, Artificial sequence
  SiRNA target sequence
gatttgtttgcatcaaagttgtt

SEQ ID NO: 217915 - DNA, 23 bp, Artificial sequence
  SiRNA target sequence
atttgtttgcatcaaagttgtta

SEQ ID NO: 217916 - DNA, 23 bp, Artificial sequence
  SiRNA target sequence
tttgtttgcatcaaagttgttag

SEQ ID NO: 217917 - DNA, 23 bp, Artificial sequence
  SiRNA target sequence
ttgtttgcatcaaagttgttaga

SEQ ID NO: 217918 - DNA, 23 bp, Artificial sequence
  SiRNA target sequence
tgtttgcatcaaagttgttagat

SEQ ID NO: 217919 - DNA, 23 bp, Artificial sequence
  SiRNA target sequence
gtttgcatcaaagttgttagata

SEQ ID NO: 217920 - DNA, 23 bp, Artificial sequence
  SiRNA target sequence
tttgcatcaaagttgttagataa

SEQ ID NO: 217921 - DNA, 23 bp, Artificial sequence
  SiRNA target sequence
ttgcatcaaagttgttagataat

SEQ ID NO: 217922 - DNA, 23 bp, Artificial sequence
  SiRNA target sequence
tgcatcaaagttgttagataata

SEQ ID NO: 217923 - DNA, 23 bp, Artificial sequence
  SiRNA target sequence
gcatcaaagttgttagataataa

SEQ ID NO: 217924 - DNA, 23 bp, Artificial sequence
  SiRNA target sequence
catcaaagttgttagataataaa

SEQ ID NO: 217925 - DNA, 23 bp, Artificial sequence
  SiRNA target sequence
atcaaagttgttagataataaaa

SEQ ID NO: 217926 - DNA, 23 bp, Artificial sequence
  SiRNA target sequence
tcaaagttgttagataataaaaa

SEQ ID NO: 217927 - DNA, 23 bp, Artificial sequence
  SiRNA target sequence
caaagttgttagataataaaaaa

SEQ ID NO: 217928 - DNA, 23 bp, Artificial sequence
  SiRNA target sequence
aaagttgttagataataaaaaag

SEQ ID NO: 217929 - DNA, 23 bp, Artificial sequence
  SiRNA target sequence
aagttgttagataataaaaaaga

SEQ ID NO: 217930 - DNA, 23 bp, Artificial sequence
  SiRNA target sequence
agttgttagataataaaaaagaa

SEQ ID NO: 217931 - DNA, 23 bp, Artificial sequence
  SiRNA target sequence
gttgttagataataaaaaagaag

SEQ ID NO: 217932 - DNA, 23 bp, Artificial sequence
  SiRNA target sequence
ttgttagataataaaaaagaaga

SEQ ID NO: 217933 - DNA, 23 bp, Artificial sequence
  SiRNA target sequence
tgttagataataaaaaagaagag

SEQ ID NO: 217934 - DNA, 23 bp, Artificial sequence
  SiRNA target sequence
gttagataataaaaaagaagagg

SEQ ID NO: 217935 - DNA, 23 bp, Artificial sequence
  SiRNA target sequence
ttagataataaaaaagaagagga

SEQ ID NO: 217936 - DNA, 23 bp, Artificial sequence
  SiRNA target sequence
tagataataaaaaagaagaggaa

SEQ ID NO: 217937 - DNA, 23 bp, Artificial sequence
  SiRNA target sequence
agataataaaaaagaagaggaaa

SEQ ID NO: 217938 - DNA, 23 bp, Artificial sequence
  SiRNA target sequence
gataataaaaaagaagaggaaat

SEQ ID NO: 217939 - DNA, 23 bp, Artificial sequence
  SiRNA target sequence
ataataaaaaagaagaggaaatt

SEQ ID NO: 217940 - DNA, 23 bp, Artificial sequence
  SiRNA target sequence
taataaaaaagaagaggaaattg

SEQ ID NO: 217941 - DNA, 23 bp, Artificial sequence
  SiRNA target sequence
aataaaaaagaagaggaaattga

SEQ ID NO: 217942 - DNA, 23 bp, Artificial sequence
  SiRNA target sequence
ataaaaaagaagaggaaattgat

SEQ ID NO: 217943 - DNA, 23 bp, Artificial sequence
  SiRNA target sequence
taaaaaagaagaggaaattgatg

SEQ ID NO: 217944 - DNA, 23 bp, Artificial sequence
  SiRNA target sequence
aaaaaagaagaggaaattgatgt

SEQ ID NO: 217945 - DNA, 23 bp, Artificial sequence
  SiRNA target sequence
aaaaagaagaggaaattgatgtg

SEQ ID NO: 217946 - DNA, 23 bp, Artificial sequence
  SiRNA target sequence
aaaagaagaggaaattgatgtgt

SEQ ID NO: 217947 - DNA, 23 bp, Artificial sequence
  SiRNA target sequence
aaagaagaggaaattgatgtgtc

SEQ ID NO: 217948 - DNA, 23 bp, Artificial sequence
  SiRNA target sequence
aagaagaggaaattgatgtgtca

SEQ ID NO: 217949 - DNA, 23 bp, Artificial sequence
  SiRNA target sequence
agaagaggaaattgatgtgtcag

SEQ ID NO: 217950 - DNA, 23 bp, Artificial sequence
  SiRNA target sequence
gaagaggaaattgatgtgtcagt

SEQ ID NO: 217951 - DNA, 23 bp, Artificial sequence
  SiRNA target sequence
aagaggaaattgatgtgtcagtg

SEQ ID NO: 217952 - DNA, 23 bp, Artificial sequence
  SiRNA target sequence
agaggaaattgatgtgtcagtgc

SEQ ID NO: 217953 - DNA, 23 bp, Artificial sequence
  SiRNA target sequence
gaggaaattgatgtgtcagtgct

SEQ ID NO: 217954 - DNA, 23 bp, Artificial sequence
  SiRNA target sequence
aggaaattgatgtgtcagtgctc

SEQ ID NO: 217955 - DNA, 23 bp, Artificial sequence
  SiRNA target sequence
ggaaattgatgtgtcagtgctcg

SEQ ID NO: 217956 - DNA, 23 bp, Artificial sequence
  SiRNA target sequence
gaaattgatgtgtcagtgctcgt

SEQ ID NO: 217957 - DNA, 23 bp, Artificial sequence
  SiRNA target sequence
aaattgatgtgtcagtgctcgtt

SEQ ID NO: 217958 - DNA, 23 bp, Artificial sequence
  SiRNA target sequence
aattgatgtgtcagtgctcgtta

SEQ ID NO: 217959 - DNA, 23 bp, Artificial sequence
  SiRNA target sequence
attgatgtgtcagtgctcgttaa

SEQ ID NO: 217960 - DNA, 23 bp, Artificial sequence
  SiRNA target sequence
ttgatgtgtcagtgctcgttaat

SEQ ID NO: 217961 - DNA, 23 bp, Artificial sequence
  SiRNA target sequence
tgatgtgtcagtgctcgttaatt

SEQ ID NO: 217962 - DNA, 23 bp, Artificial sequence
  SiRNA target sequence
gatgtgtcagtgctcgttaatta

SEQ ID NO: 217963 - DNA, 23 bp, Artificial sequence
  SiRNA target sequence
atgtgtcagtgctcgttaattaa

SEQ ID NO: 217964 - DNA, 24 bp, Artificial sequence
  SiRNA target sequence
atgattgagaggggtattatggaa

SEQ ID NO: 217965 - DNA, 24 bp, Artificial sequence
  SiRNA target sequence
tgattgagaggggtattatggaaa

SEQ ID NO: 217966 - DNA, 24 bp, Artificial sequence
  SiRNA target sequence
gattgagaggggtattatggaaaa

SEQ ID NO: 217967 - DNA, 24 bp, Artificial sequence
  SiRNA target sequence
attgagaggggtattatggaaaaa

SEQ ID NO: 217968 - DNA, 24 bp, Artificial sequence
  SiRNA target sequence
ttgagaggggtattatggaaaaaa

SEQ ID NO: 217969 - DNA, 24 bp, Artificial sequence
  SiRNA target sequence
tgagaggggtattatggaaaaaat

SEQ ID NO: 217970 - DNA, 24 bp, Artificial sequence
  SiRNA target sequence
gagaggggtattatggaaaaaata

SEQ ID NO: 217971 - DNA, 24 bp, Artificial sequence
  SiRNA target sequence
agaggggtattatggaaaaaataa

SEQ ID NO: 217972 - DNA, 24 bp, Artificial sequence
  SiRNA target sequence
gaggggtattatggaaaaaataaa

SEQ ID NO: 217973 - DNA, 24 bp, Artificial sequence
  SiRNA target sequence
aggggtattatggaaaaaataaaa

SEQ ID NO: 217974 - DNA, 24 bp, Artificial sequence
  SiRNA target sequence
ggggtattatggaaaaaataaaaa

SEQ ID NO: 217975 - DNA, 24 bp, Artificial sequence
  SiRNA target sequence
gggtattatggaaaaaataaaaaa

SEQ ID NO: 217976 - DNA, 24 bp, Artificial sequence
  SiRNA target sequence
ggtattatggaaaaaataaaaaat

SEQ ID NO: 217977 - DNA, 24 bp, Artificial sequence
  SiRNA target sequence
gtattatggaaaaaataaaaaatt

SEQ ID NO: 217978 - DNA, 24 bp, Artificial sequence
  SiRNA target sequence
tattatggaaaaaataaaaaattt

SEQ ID NO: 217979 - DNA, 24 bp, Artificial sequence
  SiRNA target sequence
attatggaaaaaataaaaaattta

SEQ ID NO: 217980 - DNA, 24 bp, Artificial sequence
  SiRNA target sequence
ttatggaaaaaataaaaaatttat

SEQ ID NO: 217981 - DNA, 24 bp, Artificial sequence
  SiRNA target sequence
tatggaaaaaataaaaaatttatt

SEQ ID NO: 217982 - DNA, 24 bp, Artificial sequence
  SiRNA target sequence
atggaaaaaataaaaaatttatta

SEQ ID NO: 217983 - DNA, 24 bp, Artificial sequence
  SiRNA target sequence
tggaaaaaataaaaaatttattaa

SEQ ID NO: 217984 - DNA, 24 bp, Artificial sequence
  SiRNA target sequence
ggaaaaaataaaaaatttattaac

SEQ ID NO: 217985 - DNA, 24 bp, Artificial sequence
  SiRNA target sequence
gaaaaaataaaaaatttattaaca

SEQ ID NO: 217986 - DNA, 24 bp, Artificial sequence
  SiRNA target sequence
aaaaaataaaaaatttattaacag

SEQ ID NO: 217987 - DNA, 24 bp, Artificial sequence
  SiRNA target sequence
aaaaataaaaaatttattaacaga

SEQ ID NO: 217988 - DNA, 24 bp, Artificial sequence
  SiRNA target sequence
aaaataaaaaatttattaacagag

SEQ ID NO: 217989 - DNA, 24 bp, Artificial sequence
  SiRNA target sequence
aaataaaaaatttattaacagagg

SEQ ID NO: 217990 - DNA, 24 bp, Artificial sequence
  SiRNA target sequence
aataaaaaatttattaacagagga

SEQ ID NO: 217991 - DNA, 24 bp, Artificial sequence
  SiRNA target sequence
ataaaaaatttattaacagaggat

SEQ ID NO: 217992 - DNA, 24 bp, Artificial sequence
  SiRNA target sequence
taaaaaatttattaacagaggatg

SEQ ID NO: 217993 - DNA, 24 bp, Artificial sequence
  SiRNA target sequence
aaaaaatttattaacagaggatga

SEQ ID NO: 217994 - DNA, 24 bp, Artificial sequence
  SiRNA target sequence
aaaaatttattaacagaggatgaa

SEQ ID NO: 217995 - DNA, 24 bp, Artificial sequence
  SiRNA target sequence
aaaatttattaacagaggatgaag

SEQ ID NO: 217996 - DNA, 24 bp, Artificial sequence
  SiRNA target sequence
aaatttattaacagaggatgaagt

SEQ ID NO: 217997 - DNA, 24 bp, Artificial sequence
  SiRNA target sequence
aatttattaacagaggatgaagta

SEQ ID NO: 217998 - DNA, 24 bp, Artificial sequence
  SiRNA target sequence
atttattaacagaggatgaagtag

SEQ ID NO: 217999 - DNA, 24 bp, Artificial sequence
  SiRNA target sequence
tttattaacagaggatgaagtaga

SEQ ID NO: 218000 - DNA, 24 bp, Artificial sequence
  SiRNA target sequence
ttattaacagaggatgaagtagaa

SEQ ID NO: 218001 - DNA, 24 bp, Artificial sequence
  SiRNA target sequence
tattaacagaggatgaagtagaag

SEQ ID NO: 218002 - DNA, 24 bp, Artificial sequence
  SiRNA target sequence
attaacagaggatgaagtagaagc

SEQ ID NO: 218003 - DNA, 24 bp, Artificial sequence
  SiRNA target sequence
ttaacagaggatgaagtagaagca

SEQ ID NO: 218004 - DNA, 24 bp, Artificial sequence
  SiRNA target sequence
taacagaggatgaagtagaagcag

SEQ ID NO: 218005 - DNA, 24 bp, Artificial sequence
  SiRNA target sequence
aacagaggatgaagtagaagcaga

SEQ ID NO: 218006 - DNA, 24 bp, Artificial sequence
  SiRNA target sequence
acagaggatgaagtagaagcagaa

SEQ ID NO: 218007 - DNA, 24 bp, Artificial sequence
  SiRNA target sequence
cagaggatgaagtagaagcagaag

SEQ ID NO: 218008 - DNA, 24 bp, Artificial sequence
  SiRNA target sequence
agaggatgaagtagaagcagaagc

SEQ ID NO: 218009 - DNA, 24 bp, Artificial sequence
  SiRNA target sequence
gaggatgaagtagaagcagaagca

SEQ ID NO: 218010 - DNA, 24 bp, Artificial sequence
  SiRNA target sequence
aggatgaagtagaagcagaagcaa

SEQ ID NO: 218011 - DNA, 24 bp, Artificial sequence
  SiRNA target sequence
ggatgaagtagaagcagaagcaaa

SEQ ID NO: 218012 - DNA, 24 bp, Artificial sequence
  SiRNA target sequence
gatgaagtagaagcagaagcaaat

SEQ ID NO: 218013 - DNA, 24 bp, Artificial sequence
  SiRNA target sequence
atgaagtagaagcagaagcaaatt

SEQ ID NO: 218014 - DNA, 24 bp, Artificial sequence
  SiRNA target sequence
tgaagtagaagcagaagcaaattc

SEQ ID NO: 218015 - DNA, 24 bp, Artificial sequence
  SiRNA target sequence
gaagtagaagcagaagcaaattct

SEQ ID NO: 218016 - DNA, 24 bp, Artificial sequence
  SiRNA target sequence
aagtagaagcagaagcaaattctg

SEQ ID NO: 218017 - DNA, 24 bp, Artificial sequence
  SiRNA target sequence
agtagaagcagaagcaaattctgg

SEQ ID NO: 218018 - DNA, 24 bp, Artificial sequence
  SiRNA target sequence
gtagaagcagaagcaaattctgga

SEQ ID NO: 218019 - DNA, 24 bp, Artificial sequence
  SiRNA target sequence
tagaagcagaagcaaattctggaa

SEQ ID NO: 218020 - DNA, 24 bp, Artificial sequence
  SiRNA target sequence
agaagcagaagcaaattctggaag

SEQ ID NO: 218021 - DNA, 24 bp, Artificial sequence
  SiRNA target sequence
gaagcagaagcaaattctggaagg

SEQ ID NO: 218022 - DNA, 24 bp, Artificial sequence
  SiRNA target sequence
aagcagaagcaaattctggaaggg

SEQ ID NO: 218023 - DNA, 24 bp, Artificial sequence
  SiRNA target sequence
agcagaagcaaattctggaagggg

SEQ ID NO: 218024 - DNA, 24 bp, Artificial sequence
  SiRNA target sequence
gcagaagcaaattctggaaggggc

SEQ ID NO: 218025 - DNA, 24 bp, Artificial sequence
  SiRNA target sequence
cagaagcaaattctggaaggggca

SEQ ID NO: 218026 - DNA, 24 bp, Artificial sequence
  SiRNA target sequence
agaagcaaattctggaaggggcat

SEQ ID NO: 218027 - DNA, 24 bp, Artificial sequence
  SiRNA target sequence
gaagcaaattctggaaggggcatt

SEQ ID NO: 218028 - DNA, 24 bp, Artificial sequence
  SiRNA target sequence
aagcaaattctggaaggggcattt

SEQ ID NO: 218029 - DNA, 24 bp, Artificial sequence
  SiRNA target sequence
agcaaattctggaaggggcatttt

SEQ ID NO: 218030 - DNA, 24 bp, Artificial sequence
  SiRNA target sequence
gcaaattctggaaggggcatttta

SEQ ID NO: 218031 - DNA, 24 bp, Artificial sequence
  SiRNA target sequence
caaattctggaaggggcattttat

SEQ ID NO: 218032 - DNA, 24 bp, Artificial sequence
  SiRNA target sequence
aaattctggaaggggcattttatc

SEQ ID NO: 218033 - DNA, 24 bp, Artificial sequence
  SiRNA target sequence
aattctggaaggggcattttatca

SEQ ID NO: 218034 - DNA, 24 bp, Artificial sequence
  SiRNA target sequence
attctggaaggggcattttatcaa

SEQ ID NO: 218035 - DNA, 24 bp, Artificial sequence
  SiRNA target sequence
ttctggaaggggcattttatcaat

SEQ ID NO: 218036 - DNA, 24 bp, Artificial sequence
  SiRNA target sequence
tctggaaggggcattttatcaata

SEQ ID NO: 218037 - DNA, 24 bp, Artificial sequence
  SiRNA target sequence
ctggaaggggcattttatcaatat

SEQ ID NO: 218038 - DNA, 24 bp, Artificial sequence
  SiRNA target sequence
tggaaggggcattttatcaatatt

SEQ ID NO: 218039 - DNA, 24 bp, Artificial sequence
  SiRNA target sequence
ggaaggggcattttatcaatattt

SEQ ID NO: 218040 - DNA, 24 bp, Artificial sequence
  SiRNA target sequence
gaaggggcattttatcaatattta

SEQ ID NO: 218041 - DNA, 24 bp, Artificial sequence
  SiRNA target sequence
aaggggcattttatcaatatttag

SEQ ID NO: 218042 - DNA, 24 bp, Artificial sequence
  SiRNA target sequence
aggggcattttatcaatatttaga

SEQ ID NO: 218043 - DNA, 24 bp, Artificial sequence
  SiRNA target sequence
ggggcattttatcaatatttagaa

SEQ ID NO: 218044 - DNA, 24 bp, Artificial sequence
  SiRNA target sequence
gggcattttatcaatatttagaat

SEQ ID NO: 218045 - DNA, 24 bp, Artificial sequence
  SiRNA target sequence
ggcattttatcaatatttagaatt

SEQ ID NO: 218046 - DNA, 24 bp, Artificial sequence
  SiRNA target sequence
gcattttatcaatatttagaattg

SEQ ID NO: 218047 - DNA, 24 bp, Artificial sequence
  SiRNA target sequence
cattttatcaatatttagaattgc

SEQ ID NO: 218048 - DNA, 24 bp, Artificial sequence
  SiRNA target sequence
attttatcaatatttagaattgct

SEQ ID NO: 218049 - DNA, 24 bp, Artificial sequence
  SiRNA target sequence
ttttatcaatatttagaattgcta

SEQ ID NO: 218050 - DNA, 24 bp, Artificial sequence
  SiRNA target sequence
tttatcaatatttagaattgctaa

SEQ ID NO: 218051 - DNA, 24 bp, Artificial sequence
  SiRNA target sequence
ttatcaatatttagaattgctaag

SEQ ID NO: 218052 - DNA, 24 bp, Artificial sequence
  SiRNA target sequence
tatcaatatttagaattgctaagg

SEQ ID NO: 218053 - DNA, 24 bp, Artificial sequence
  SiRNA target sequence
atcaatatttagaattgctaaggt

SEQ ID NO: 218054 - DNA, 24 bp, Artificial sequence
  SiRNA target sequence
tcaatatttagaattgctaaggta

SEQ ID NO: 218055 - DNA, 24 bp, Artificial sequence
  SiRNA target sequence
caatatttagaattgctaaggtag

SEQ ID NO: 218056 - DNA, 24 bp, Artificial sequence
  SiRNA target sequence
aatatttagaattgctaaggtaga

SEQ ID NO: 218057 - DNA, 24 bp, Artificial sequence
  SiRNA target sequence
atatttagaattgctaaggtagaa

SEQ ID NO: 218058 - DNA, 24 bp, Artificial sequence
  SiRNA target sequence
tatttagaattgctaaggtagaaa

SEQ ID NO: 218059 - DNA, 24 bp, Artificial sequence
  SiRNA target sequence
atttagaattgctaaggtagaaag

SEQ ID NO: 218060 - DNA, 24 bp, Artificial sequence
  SiRNA target sequence
tttagaattgctaaggtagaaaga

SEQ ID NO: 218061 - DNA, 24 bp, Artificial sequence
  SiRNA target sequence
ttagaattgctaaggtagaaagaa

SEQ ID NO: 218062 - DNA, 24 bp, Artificial sequence
  SiRNA target sequence
tagaattgctaaggtagaaagaag

SEQ ID NO: 218063 - DNA, 24 bp, Artificial sequence
  SiRNA target sequence
agaattgctaaggtagaaagaaga

SEQ ID NO: 218064 - DNA, 24 bp, Artificial sequence
  SiRNA target sequence
gaattgctaaggtagaaagaagaa

SEQ ID NO: 218065 - DNA, 24 bp, Artificial sequence
  SiRNA target sequence
aattgctaaggtagaaagaagaat

SEQ ID NO: 218066 - DNA, 24 bp, Artificial sequence
  SiRNA target sequence
attgctaaggtagaaagaagaatg

SEQ ID NO: 218067 - DNA, 24 bp, Artificial sequence
  SiRNA target sequence
ttgctaaggtagaaagaagaatgt

SEQ ID NO: 218068 - DNA, 24 bp, Artificial sequence
  SiRNA target sequence
tgctaaggtagaaagaagaatgtt

SEQ ID NO: 218069 - DNA, 24 bp, Artificial sequence
  SiRNA target sequence
gctaaggtagaaagaagaatgttt

SEQ ID NO: 218070 - DNA, 24 bp, Artificial sequence
  SiRNA target sequence
ctaaggtagaaagaagaatgtttt

SEQ ID NO: 218071 - DNA, 24 bp, Artificial sequence
  SiRNA target sequence
taaggtagaaagaagaatgttttg

SEQ ID NO: 218072 - DNA, 24 bp, Artificial sequence
  SiRNA target sequence
aaggtagaaagaagaatgttttgg

SEQ ID NO: 218073 - DNA, 24 bp, Artificial sequence
  SiRNA target sequence
aggtagaaagaagaatgttttggc

SEQ ID NO: 218074 - DNA, 24 bp, Artificial sequence
  SiRNA target sequence
ggtagaaagaagaatgttttggct

SEQ ID NO: 218075 - DNA, 24 bp, Artificial sequence
  SiRNA target sequence
gtagaaagaagaatgttttggctt

SEQ ID NO: 218076 - DNA, 24 bp, Artificial sequence
  SiRNA target sequence
tagaaagaagaatgttttggctta

SEQ ID NO: 218077 - DNA, 24 bp, Artificial sequence
  SiRNA target sequence
agaaagaagaatgttttggcttat

SEQ ID NO: 218078 - DNA, 24 bp, Artificial sequence
  SiRNA target sequence
gaaagaagaatgttttggcttatg

SEQ ID NO: 218079 - DNA, 24 bp, Artificial sequence
  SiRNA target sequence
aaagaagaatgttttggcttatga

SEQ ID NO: 218080 - DNA, 24 bp, Artificial sequence
  SiRNA target sequence
aagaagaatgttttggcttatgac

SEQ ID NO: 218081 - DNA, 24 bp, Artificial sequence
  SiRNA target sequence
agaagaatgttttggcttatgacg

SEQ ID NO: 218082 - DNA, 24 bp, Artificial sequence
  SiRNA target sequence
gaagaatgttttggcttatgacgc

SEQ ID NO: 218083 - DNA, 24 bp, Artificial sequence
  SiRNA target sequence
aagaatgttttggcttatgacgct

SEQ ID NO: 218084 - DNA, 24 bp, Artificial sequence
  SiRNA target sequence
agaatgttttggcttatgacgctt

SEQ ID NO: 218085 - DNA, 24 bp, Artificial sequence
  SiRNA target sequence
gaatgttttggcttatgacgctta

SEQ ID NO: 218086 - DNA, 24 bp, Artificial sequence
  SiRNA target sequence
aatgttttggcttatgacgcttat

SEQ ID NO: 218087 - DNA, 24 bp, Artificial sequence
  SiRNA target sequence
atgttttggcttatgacgcttatg

SEQ ID NO: 218088 - DNA, 24 bp, Artificial sequence
  SiRNA target sequence
tgttttggcttatgacgcttatgt

SEQ ID NO: 218089 - DNA, 24 bp, Artificial sequence
  SiRNA target sequence
gttttggcttatgacgcttatgtt

SEQ ID NO: 218090 - DNA, 24 bp, Artificial sequence
  SiRNA target sequence
ttttggcttatgacgcttatgttt

SEQ ID NO: 218091 - DNA, 24 bp, Artificial sequence
  SiRNA target sequence
tttggcttatgacgcttatgtttt

SEQ ID NO: 218092 - DNA, 24 bp, Artificial sequence
  SiRNA target sequence
ttggcttatgacgcttatgttttc

SEQ ID NO: 218093 - DNA, 24 bp, Artificial sequence
  SiRNA target sequence
tggcttatgacgcttatgttttcg

SEQ ID NO: 218094 - DNA, 24 bp, Artificial sequence
  SiRNA target sequence
ggcttatgacgcttatgttttcgc

SEQ ID NO: 218095 - DNA, 24 bp, Artificial sequence
  SiRNA target sequence
gcttatgacgcttatgttttcgct

SEQ ID NO: 218096 - DNA, 24 bp, Artificial sequence
  SiRNA target sequence
cttatgacgcttatgttttcgctt

SEQ ID NO: 218097 - DNA, 24 bp, Artificial sequence
  SiRNA target sequence
ttatgacgcttatgttttcgctta

SEQ ID NO: 218098 - DNA, 24 bp, Artificial sequence
  SiRNA target sequence
tatgacgcttatgttttcgcttat

SEQ ID NO: 218099 - DNA, 24 bp, Artificial sequence
  SiRNA target sequence
atgacgcttatgttttcgcttatt

SEQ ID NO: 218100 - DNA, 24 bp, Artificial sequence
  SiRNA target sequence
tgacgcttatgttttcgcttattt

SEQ ID NO: 218101 - DNA, 24 bp, Artificial sequence
  SiRNA target sequence
gacgcttatgttttcgcttatttc

SEQ ID NO: 218102 - DNA, 24 bp, Artificial sequence
  SiRNA target sequence
acgcttatgttttcgcttatttcc

SEQ ID NO: 218103 - DNA, 24 bp, Artificial sequence
  SiRNA target sequence
cgcttatgttttcgcttatttcct

SEQ ID NO: 218104 - DNA, 24 bp, Artificial sequence
  SiRNA target sequence
gcttatgttttcgcttatttcctt

SEQ ID NO: 218105 - DNA, 24 bp, Artificial sequence
  SiRNA target sequence
cttatgttttcgcttatttccttt

SEQ ID NO: 218106 - DNA, 24 bp, Artificial sequence
  SiRNA target sequence
ttatgttttcgcttatttccttta

SEQ ID NO: 218107 - DNA, 24 bp, Artificial sequence
  SiRNA target sequence
tatgttttcgcttatttcctttat

SEQ ID NO: 218108 - DNA, 24 bp, Artificial sequence
  SiRNA target sequence
atgttttcgcttatttcctttatt

SEQ ID NO: 218109 - DNA, 24 bp, Artificial sequence
  SiRNA target sequence
tgttttcgcttatttcctttattt

SEQ ID NO: 218110 - DNA, 24 bp, Artificial sequence
  SiRNA target sequence
gttttcgcttatttcctttattta

SEQ ID NO: 218111 - DNA, 24 bp, Artificial sequence
  SiRNA target sequence
ttttcgcttatttcctttatttac

SEQ ID NO: 218112 - DNA, 24 bp, Artificial sequence
  SiRNA target sequence
tttcgcttatttcctttatttact

SEQ ID NO: 218113 - DNA, 24 bp, Artificial sequence
  SiRNA target sequence
ttcgcttatttcctttatttactc

SEQ ID NO: 218114 - DNA, 24 bp, Artificial sequence
  SiRNA target sequence
tcgcttatttcctttatttactca

SEQ ID NO: 218115 - DNA, 24 bp, Artificial sequence
  SiRNA target sequence
cgcttatttcctttatttactcag

SEQ ID NO: 218116 - DNA, 24 bp, Artificial sequence
  SiRNA target sequence
gcttatttcctttatttactcagt

SEQ ID NO: 218117 - DNA, 24 bp, Artificial sequence
  SiRNA target sequence
cttatttcctttatttactcagta

SEQ ID NO: 218118 - DNA, 24 bp, Artificial sequence
  SiRNA target sequence
ttatttcctttatttactcagtag

SEQ ID NO: 218119 - DNA, 24 bp, Artificial sequence
  SiRNA target sequence
tatttcctttatttactcagtagg

SEQ ID NO: 218120 - DNA, 24 bp, Artificial sequence
  SiRNA target sequence
atttcctttatttactcagtagga

SEQ ID NO: 218121 - DNA, 24 bp, Artificial sequence
  SiRNA target sequence
tttcctttatttactcagtaggac

SEQ ID NO: 218122 - DNA, 24 bp, Artificial sequence
  SiRNA target sequence
ttcctttatttactcagtaggacg

SEQ ID NO: 218123 - DNA, 24 bp, Artificial sequence
  SiRNA target sequence
tcctttatttactcagtaggacga

SEQ ID NO: 218124 - DNA, 24 bp, Artificial sequence
  SiRNA target sequence
cctttatttactcagtaggacgag

SEQ ID NO: 218125 - DNA, 24 bp, Artificial sequence
  SiRNA target sequence
ctttatttactcagtaggacgagt

SEQ ID NO: 218126 - DNA, 24 bp, Artificial sequence
  SiRNA target sequence
tttatttactcagtaggacgagtg

SEQ ID NO: 218127 - DNA, 24 bp, Artificial sequence
  SiRNA target sequence
ttatttactcagtaggacgagtgt

SEQ ID NO: 218128 - DNA, 24 bp, Artificial sequence
  SiRNA target sequence
tatttactcagtaggacgagtgtt

SEQ ID NO: 218129 - DNA, 24 bp, Artificial sequence
  SiRNA target sequence
atttactcagtaggacgagtgtta

SEQ ID NO: 218130 - DNA, 24 bp, Artificial sequence
  SiRNA target sequence
tttactcagtaggacgagtgttaa

SEQ ID NO: 218131 - DNA, 24 bp, Artificial sequence
  SiRNA target sequence
ttactcagtaggacgagtgttaaa

SEQ ID NO: 218132 - DNA, 24 bp, Artificial sequence
  SiRNA target sequence
tactcagtaggacgagtgttaaaa

SEQ ID NO: 218133 - DNA, 24 bp, Artificial sequence
  SiRNA target sequence
actcagtaggacgagtgttaaaag

SEQ ID NO: 218134 - DNA, 24 bp, Artificial sequence
  SiRNA target sequence
ctcagtaggacgagtgttaaaaga

SEQ ID NO: 218135 - DNA, 24 bp, Artificial sequence
  SiRNA target sequence
tcagtaggacgagtgttaaaagat

SEQ ID NO: 218136 - DNA, 24 bp, Artificial sequence
  SiRNA target sequence
cagtaggacgagtgttaaaagatg

SEQ ID NO: 218137 - DNA, 24 bp, Artificial sequence
  SiRNA target sequence
agtaggacgagtgttaaaagatgc

SEQ ID NO: 218138 - DNA, 24 bp, Artificial sequence
  SiRNA target sequence
gtaggacgagtgttaaaagatgca

SEQ ID NO: 218139 - DNA, 24 bp, Artificial sequence
  SiRNA target sequence
taggacgagtgttaaaagatgcag

SEQ ID NO: 218140 - DNA, 24 bp, Artificial sequence
  SiRNA target sequence
aggacgagtgttaaaagatgcagc

SEQ ID NO: 218141 - DNA, 24 bp, Artificial sequence
  SiRNA target sequence
ggacgagtgttaaaagatgcagca

SEQ ID NO: 218142 - DNA, 24 bp, Artificial sequence
  SiRNA target sequence
gacgagtgttaaaagatgcagcag

SEQ ID NO: 218143 - DNA, 24 bp, Artificial sequence
  SiRNA target sequence
acgagtgttaaaagatgcagcagt

SEQ ID NO: 218144 - DNA, 24 bp, Artificial sequence
  SiRNA target sequence
cgagtgttaaaagatgcagcagtt

SEQ ID NO: 218145 - DNA, 24 bp, Artificial sequence
  SiRNA target sequence
gagtgttaaaagatgcagcagttc

SEQ ID NO: 218146 - DNA, 24 bp, Artificial sequence
  SiRNA target sequence
agtgttaaaagatgcagcagttct

SEQ ID NO: 218147 - DNA, 24 bp, Artificial sequence
  SiRNA target sequence
gtgttaaaagatgcagcagttctt

SEQ ID NO: 218148 - DNA, 24 bp, Artificial sequence
  SiRNA target sequence
tgttaaaagatgcagcagttctta

SEQ ID NO: 218149 - DNA, 24 bp, Artificial sequence
  SiRNA target sequence
gttaaaagatgcagcagttcttag

SEQ ID NO: 218150 - DNA, 24 bp, Artificial sequence
  SiRNA target sequence
ttaaaagatgcagcagttcttagt

SEQ ID NO: 218151 - DNA, 24 bp, Artificial sequence
  SiRNA target sequence
taaaagatgcagcagttcttagta

SEQ ID NO: 218152 - DNA, 24 bp, Artificial sequence
  SiRNA target sequence
aaaagatgcagcagttcttagtag

SEQ ID NO: 218153 - DNA, 24 bp, Artificial sequence
  SiRNA target sequence
aaagatgcagcagttcttagtaga

SEQ ID NO: 218154 - DNA, 24 bp, Artificial sequence
  SiRNA target sequence
aagatgcagcagttcttagtagac

SEQ ID NO: 218155 - DNA, 24 bp, Artificial sequence
  SiRNA target sequence
agatgcagcagttcttagtagaca

SEQ ID NO: 218156 - DNA, 24 bp, Artificial sequence
  SiRNA target sequence
gatgcagcagttcttagtagacag

SEQ ID NO: 218157 - DNA, 24 bp, Artificial sequence
  SiRNA target sequence
atgcagcagttcttagtagacaga

SEQ ID NO: 218158 - DNA, 24 bp, Artificial sequence
  SiRNA target sequence
tgcagcagttcttagtagacagat

SEQ ID NO: 218159 - DNA, 24 bp, Artificial sequence
  SiRNA target sequence
gcagcagttcttagtagacagatg

SEQ ID NO: 218160 - DNA, 24 bp, Artificial sequence
  SiRNA target sequence
cagcagttcttagtagacagatgc

SEQ ID NO: 218161 - DNA, 24 bp, Artificial sequence
  SiRNA target sequence
agcagttcttagtagacagatgcc

SEQ ID NO: 218162 - DNA, 24 bp, Artificial sequence
  SiRNA target sequence
gcagttcttagtagacagatgcca

SEQ ID NO: 218163 - DNA, 24 bp, Artificial sequence
  SiRNA target sequence
cagttcttagtagacagatgccac

SEQ ID NO: 218164 - DNA, 24 bp, Artificial sequence
  SiRNA target sequence
agttcttagtagacagatgccact

SEQ ID NO: 218165 - DNA, 24 bp, Artificial sequence
  SiRNA target sequence
gttcttagtagacagatgccacta

SEQ ID NO: 218166 - DNA, 24 bp, Artificial sequence
  SiRNA target sequence
ttcttagtagacagatgccactat

SEQ ID NO: 218167 - DNA, 24 bp, Artificial sequence
  SiRNA target sequence
tcttagtagacagatgccactatc

SEQ ID NO: 218168 - DNA, 24 bp, Artificial sequence
  SiRNA target sequence
cttagtagacagatgccactatcc

SEQ ID NO: 218169 - DNA, 24 bp, Artificial sequence
  SiRNA target sequence
ttagtagacagatgccactatcca

SEQ ID NO: 218170 - DNA, 24 bp, Artificial sequence
  SiRNA target sequence
tagtagacagatgccactatccat

SEQ ID NO: 218171 - DNA, 24 bp, Artificial sequence
  SiRNA target sequence
agtagacagatgccactatccatt

SEQ ID NO: 218172 - DNA, 24 bp, Artificial sequence
  SiRNA target sequence
gtagacagatgccactatccatta

SEQ ID NO: 218173 - DNA, 24 bp, Artificial sequence
  SiRNA target sequence
tagacagatgccactatccattaa

SEQ ID NO: 218174 - DNA, 24 bp, Artificial sequence
  SiRNA target sequence
agacagatgccactatccattaat

SEQ ID NO: 218175 - DNA, 24 bp, Artificial sequence
  SiRNA target sequence
gacagatgccactatccattaatt

SEQ ID NO: 218176 - DNA, 24 bp, Artificial sequence
  SiRNA target sequence
acagatgccactatccattaattg

SEQ ID NO: 218177 - DNA, 24 bp, Artificial sequence
  SiRNA target sequence
cagatgccactatccattaattgt

SEQ ID NO: 218178 - DNA, 24 bp, Artificial sequence
  SiRNA target sequence
agatgccactatccattaattgtc

SEQ ID NO: 218179 - DNA, 24 bp, Artificial sequence
  SiRNA target sequence
gatgccactatccattaattgtct

SEQ ID NO: 218180 - DNA, 24 bp, Artificial sequence
  SiRNA target sequence
atgccactatccattaattgtctt

SEQ ID NO: 218181 - DNA, 24 bp, Artificial sequence
  SiRNA target sequence
tgccactatccattaattgtctta

SEQ ID NO: 218182 - DNA, 24 bp, Artificial sequence
  SiRNA target sequence
gccactatccattaattgtcttaa

SEQ ID NO: 218183 - DNA, 24 bp, Artificial sequence
  SiRNA target sequence
ccactatccattaattgtcttaaa

SEQ ID NO: 218184 - DNA, 24 bp, Artificial sequence
  SiRNA target sequence
cactatccattaattgtcttaaaa

SEQ ID NO: 218185 - DNA, 24 bp, Artificial sequence
  SiRNA target sequence
actatccattaattgtcttaaaag

SEQ ID NO: 218186 - DNA, 24 bp, Artificial sequence
  SiRNA target sequence
ctatccattaattgtcttaaaagc

SEQ ID NO: 218187 - DNA, 24 bp, Artificial sequence
  SiRNA target sequence
tatccattaattgtcttaaaagct

SEQ ID NO: 218188 - DNA, 24 bp, Artificial sequence
  SiRNA target sequence
atccattaattgtcttaaaagctt

SEQ ID NO: 218189 - DNA, 24 bp, Artificial sequence
  SiRNA target sequence
tccattaattgtcttaaaagcttt

SEQ ID NO: 218190 - DNA, 24 bp, Artificial sequence
  SiRNA target sequence
ccattaattgtcttaaaagctttg

SEQ ID NO: 218191 - DNA, 24 bp, Artificial sequence
  SiRNA target sequence
cattaattgtcttaaaagctttgt

SEQ ID NO: 218192 - DNA, 24 bp, Artificial sequence
  SiRNA target sequence
attaattgtcttaaaagctttgta

SEQ ID NO: 218193 - DNA, 24 bp, Artificial sequence
  SiRNA target sequence
ttaattgtcttaaaagctttgtaa

SEQ ID NO: 218194 - DNA, 24 bp, Artificial sequence
  SiRNA target sequence
taattgtcttaaaagctttgtaat

SEQ ID NO: 218195 - DNA, 24 bp, Artificial sequence
  SiRNA target sequence
aattgtcttaaaagctttgtaatt

SEQ ID NO: 218196 - DNA, 24 bp, Artificial sequence
  SiRNA target sequence
attgtcttaaaagctttgtaattt

SEQ ID NO: 218197 - DNA, 24 bp, Artificial sequence
  SiRNA target sequence
ttgtcttaaaagctttgtaatttt

SEQ ID NO: 218198 - DNA, 24 bp, Artificial sequence
  SiRNA target sequence
tgtcttaaaagctttgtaatttta

SEQ ID NO: 218199 - DNA, 24 bp, Artificial sequence
  SiRNA target sequence
gtcttaaaagctttgtaattttac

SEQ ID NO: 218200 - DNA, 24 bp, Artificial sequence
  SiRNA target sequence
tcttaaaagctttgtaattttacc

SEQ ID NO: 218201 - DNA, 24 bp, Artificial sequence
  SiRNA target sequence
cttaaaagctttgtaattttacca

SEQ ID NO: 218202 - DNA, 24 bp, Artificial sequence
  SiRNA target sequence
ttaaaagctttgtaattttaccag

SEQ ID NO: 218203 - DNA, 24 bp, Artificial sequence
  SiRNA target sequence
taaaagctttgtaattttaccagt

SEQ ID NO: 218204 - DNA, 24 bp, Artificial sequence
  SiRNA target sequence
aaaagctttgtaattttaccagtt

SEQ ID NO: 218205 - DNA, 24 bp, Artificial sequence
  SiRNA target sequence
aaagctttgtaattttaccagtta

SEQ ID NO: 218206 - DNA, 24 bp, Artificial sequence
  SiRNA target sequence
aagctttgtaattttaccagttac

SEQ ID NO: 218207 - DNA, 24 bp, Artificial sequence
  SiRNA target sequence
agctttgtaattttaccagttact

SEQ ID NO: 218208 - DNA, 24 bp, Artificial sequence
  SiRNA target sequence
gctttgtaattttaccagttactc

SEQ ID NO: 218209 - DNA, 24 bp, Artificial sequence
  SiRNA target sequence
ctttgtaattttaccagttactct

SEQ ID NO: 218210 - DNA, 24 bp, Artificial sequence
  SiRNA target sequence
tttgtaattttaccagttactctt

SEQ ID NO: 218211 - DNA, 24 bp, Artificial sequence
  SiRNA target sequence
ttgtaattttaccagttactcttg

SEQ ID NO: 218212 - DNA, 24 bp, Artificial sequence
  SiRNA target sequence
tgtaattttaccagttactcttgt

SEQ ID NO: 218213 - DNA, 24 bp, Artificial sequence
  SiRNA target sequence
gtaattttaccagttactcttgtt

SEQ ID NO: 218214 - DNA, 24 bp, Artificial sequence
  SiRNA target sequence
taattttaccagttactcttgttt

SEQ ID NO: 218215 - DNA, 24 bp, Artificial sequence
  SiRNA target sequence
aattttaccagttactcttgtttg

SEQ ID NO: 218216 - DNA, 24 bp, Artificial sequence
  SiRNA target sequence
attttaccagttactcttgtttgt

SEQ ID NO: 218217 - DNA, 24 bp, Artificial sequence
  SiRNA target sequence
ttttaccagttactcttgtttgtg

SEQ ID NO: 218218 - DNA, 24 bp, Artificial sequence
  SiRNA target sequence
tttaccagttactcttgtttgtgt

SEQ ID NO: 218219 - DNA, 24 bp, Artificial sequence
  SiRNA target sequence
ttaccagttactcttgtttgtgta

SEQ ID NO: 218220 - DNA, 24 bp, Artificial sequence
  SiRNA target sequence
taccagttactcttgtttgtgtag

SEQ ID NO: 218221 - DNA, 24 bp, Artificial sequence
  SiRNA target sequence
accagttactcttgtttgtgtagg

SEQ ID NO: 218222 - DNA, 24 bp, Artificial sequence
  SiRNA target sequence
ccagttactcttgtttgtgtagga

SEQ ID NO: 218223 - DNA, 24 bp, Artificial sequence
  SiRNA target sequence
cagttactcttgtttgtgtaggat

SEQ ID NO: 218224 - DNA, 24 bp, Artificial sequence
  SiRNA target sequence
agttactcttgtttgtgtaggatt

SEQ ID NO: 218225 - DNA, 24 bp, Artificial sequence
  SiRNA target sequence
gttactcttgtttgtgtaggatta

SEQ ID NO: 218226 - DNA, 24 bp, Artificial sequence
  SiRNA target sequence
ttactcttgtttgtgtaggattaa

SEQ ID NO: 218227 - DNA, 24 bp, Artificial sequence
  SiRNA target sequence
tactcttgtttgtgtaggattaat

SEQ ID NO: 218228 - DNA, 24 bp, Artificial sequence
  SiRNA target sequence
actcttgtttgtgtaggattaatt

SEQ ID NO: 218229 - DNA, 24 bp, Artificial sequence
  SiRNA target sequence
ctcttgtttgtgtaggattaattc

SEQ ID NO: 218230 - DNA, 24 bp, Artificial sequence
  SiRNA target sequence
tcttgtttgtgtaggattaattca

SEQ ID NO: 218231 - DNA, 24 bp, Artificial sequence
  SiRNA target sequence
cttgtttgtgtaggattaattcag

SEQ ID NO: 218232 - DNA, 24 bp, Artificial sequence
  SiRNA target sequence
ttgtttgtgtaggattaattcaga

SEQ ID NO: 218233 - DNA, 24 bp, Artificial sequence
  SiRNA target sequence
tgtttgtgtaggattaattcagaa

SEQ ID NO: 218234 - DNA, 24 bp, Artificial sequence
  SiRNA target sequence
gtttgtgtaggattaattcagaag

SEQ ID NO: 218235 - DNA, 24 bp, Artificial sequence
  SiRNA target sequence
tttgtgtaggattaattcagaagt

SEQ ID NO: 218236 - DNA, 24 bp, Artificial sequence
  SiRNA target sequence
ttgtgtaggattaattcagaagtc

SEQ ID NO: 218237 - DNA, 24 bp, Artificial sequence
  SiRNA target sequence
tgtgtaggattaattcagaagtct

SEQ ID NO: 218238 - DNA, 24 bp, Artificial sequence
  SiRNA target sequence
gtgtaggattaattcagaagtcta

SEQ ID NO: 218239 - DNA, 24 bp, Artificial sequence
  SiRNA target sequence
tgtaggattaattcagaagtctac

SEQ ID NO: 218240 - DNA, 24 bp, Artificial sequence
  SiRNA target sequence
gtaggattaattcagaagtctaca

SEQ ID NO: 218241 - DNA, 24 bp, Artificial sequence
  SiRNA target sequence
taggattaattcagaagtctacac

SEQ ID NO: 218242 - DNA, 24 bp, Artificial sequence
  SiRNA target sequence
aggattaattcagaagtctacact

SEQ ID NO: 218243 - DNA, 24 bp, Artificial sequence
  SiRNA target sequence
ggattaattcagaagtctacactc

SEQ ID NO: 218244 - DNA, 24 bp, Artificial sequence
  SiRNA target sequence
gattaattcagaagtctacactct

SEQ ID NO: 218245 - DNA, 24 bp, Artificial sequence
  SiRNA target sequence
attaattcagaagtctacactctc

SEQ ID NO: 218246 - DNA, 24 bp, Artificial sequence
  SiRNA target sequence
ttaattcagaagtctacactctct

SEQ ID NO: 218247 - DNA, 24 bp, Artificial sequence
  SiRNA target sequence
taattcagaagtctacactctctt

SEQ ID NO: 218248 - DNA, 24 bp, Artificial sequence
  SiRNA target sequence
aattcagaagtctacactctctta

SEQ ID NO: 218249 - DNA, 24 bp, Artificial sequence
  SiRNA target sequence
attcagaagtctacactctcttat

SEQ ID NO: 218250 - DNA, 24 bp, Artificial sequence
  SiRNA target sequence
ttcagaagtctacactctcttatt

SEQ ID NO: 218251 - DNA, 24 bp, Artificial sequence
  SiRNA target sequence
tcagaagtctacactctcttattc

SEQ ID NO: 218252 - DNA, 24 bp, Artificial sequence
  SiRNA target sequence
cagaagtctacactctcttattct

SEQ ID NO: 218253 - DNA, 24 bp, Artificial sequence
  SiRNA target sequence
agaagtctacactctcttattctt

SEQ ID NO: 218254 - DNA, 24 bp, Artificial sequence
  SiRNA target sequence
gaagtctacactctcttattcttt

SEQ ID NO: 218255 - DNA, 24 bp, Artificial sequence
  SiRNA target sequence
aagtctacactctcttattctttt

SEQ ID NO: 218256 - DNA, 24 bp, Artificial sequence
  SiRNA target sequence
agtctacactctcttattctttta

SEQ ID NO: 218257 - DNA, 24 bp, Artificial sequence
  SiRNA target sequence
gtctacactctcttattcttttac

SEQ ID NO: 218258 - DNA, 24 bp, Artificial sequence
  SiRNA target sequence
tctacactctcttattcttttaca

SEQ ID NO: 218259 - DNA, 24 bp, Artificial sequence
  SiRNA target sequence
ctacactctcttattcttttacaa

SEQ ID NO: 218260 - DNA, 24 bp, Artificial sequence
  SiRNA target sequence
tacactctcttattcttttacaaa

SEQ ID NO: 218261 - DNA, 24 bp, Artificial sequence
  SiRNA target sequence
acactctcttattcttttacaaaa

SEQ ID NO: 218262 - DNA, 24 bp, Artificial sequence
  SiRNA target sequence
cactctcttattcttttacaaaaa

SEQ ID NO: 218263 - DNA, 24 bp, Artificial sequence
  SiRNA target sequence
actctcttattcttttacaaaaat

SEQ ID NO: 218264 - DNA, 24 bp, Artificial sequence
  SiRNA target sequence
ctctcttattcttttacaaaaata

SEQ ID NO: 218265 - DNA, 24 bp, Artificial sequence
  SiRNA target sequence
tctcttattcttttacaaaaatat

SEQ ID NO: 218266 - DNA, 24 bp, Artificial sequence
  SiRNA target sequence
ctcttattcttttacaaaaatatt

SEQ ID NO: 218267 - DNA, 24 bp, Artificial sequence
  SiRNA target sequence
tcttattcttttacaaaaatattt

SEQ ID NO: 218268 - DNA, 24 bp, Artificial sequence
  SiRNA target sequence
cttattcttttacaaaaatatttg

SEQ ID NO: 218269 - DNA, 24 bp, Artificial sequence
  SiRNA target sequence
ttattcttttacaaaaatatttga

SEQ ID NO: 218270 - DNA, 24 bp, Artificial sequence
  SiRNA target sequence
tattcttttacaaaaatatttgat

SEQ ID NO: 218271 - DNA, 24 bp, Artificial sequence
  SiRNA target sequence
attcttttacaaaaatatttgatg

SEQ ID NO: 218272 - DNA, 24 bp, Artificial sequence
  SiRNA target sequence
ttcttttacaaaaatatttgatgg

SEQ ID NO: 218273 - DNA, 24 bp, Artificial sequence
  SiRNA target sequence
tcttttacaaaaatatttgatggt

SEQ ID NO: 218274 - DNA, 24 bp, Artificial sequence
  SiRNA target sequence
cttttacaaaaatatttgatggtg

SEQ ID NO: 218275 - DNA, 24 bp, Artificial sequence
  SiRNA target sequence
ttttacaaaaatatttgatggtgc

SEQ ID NO: 218276 - DNA, 24 bp, Artificial sequence
  SiRNA target sequence
tttacaaaaatatttgatggtgca

SEQ ID NO: 218277 - DNA, 24 bp, Artificial sequence
  SiRNA target sequence
ttacaaaaatatttgatggtgcat

SEQ ID NO: 218278 - DNA, 24 bp, Artificial sequence
  SiRNA target sequence
tacaaaaatatttgatggtgcatt

SEQ ID NO: 218279 - DNA, 24 bp, Artificial sequence
  SiRNA target sequence
acaaaaatatttgatggtgcattg

SEQ ID NO: 218280 - DNA, 24 bp, Artificial sequence
  SiRNA target sequence
caaaaatatttgatggtgcattgt

SEQ ID NO: 218281 - DNA, 24 bp, Artificial sequence
  SiRNA target sequence
aaaaatatttgatggtgcattgtt

SEQ ID NO: 218282 - DNA, 24 bp, Artificial sequence
  SiRNA target sequence
aaaatatttgatggtgcattgtta

SEQ ID NO: 218283 - DNA, 24 bp, Artificial sequence
  SiRNA target sequence
aaatatttgatggtgcattgttaa

SEQ ID NO: 218284 - DNA, 24 bp, Artificial sequence
  SiRNA target sequence
aatatttgatggtgcattgttaat

SEQ ID NO: 218285 - DNA, 24 bp, Artificial sequence
  SiRNA target sequence
atatttgatggtgcattgttaata

SEQ ID NO: 218286 - DNA, 24 bp, Artificial sequence
  SiRNA target sequence
tatttgatggtgcattgttaatat

SEQ ID NO: 218287 - DNA, 24 bp, Artificial sequence
  SiRNA target sequence
atttgatggtgcattgttaatatt

SEQ ID NO: 218288 - DNA, 24 bp, Artificial sequence
  SiRNA target sequence
tttgatggtgcattgttaatattt

SEQ ID NO: 218289 - DNA, 24 bp, Artificial sequence
  SiRNA target sequence
ttgatggtgcattgttaatatttg

SEQ ID NO: 218290 - DNA, 24 bp, Artificial sequence
  SiRNA target sequence
tgatggtgcattgttaatatttgc

SEQ ID NO: 218291 - DNA, 24 bp, Artificial sequence
  SiRNA target sequence
gatggtgcattgttaatatttgct

SEQ ID NO: 218292 - DNA, 24 bp, Artificial sequence
  SiRNA target sequence
atggtgcattgttaatatttgctt

SEQ ID NO: 218293 - DNA, 24 bp, Artificial sequence
  SiRNA target sequence
tggtgcattgttaatatttgcttt

SEQ ID NO: 218294 - DNA, 24 bp, Artificial sequence
  SiRNA target sequence
ggtgcattgttaatatttgctttt

SEQ ID NO: 218295 - DNA, 24 bp, Artificial sequence
  SiRNA target sequence
gtgcattgttaatatttgcttttc

SEQ ID NO: 218296 - DNA, 24 bp, Artificial sequence
  SiRNA target sequence
tgcattgttaatatttgcttttct

SEQ ID NO: 218297 - DNA, 24 bp, Artificial sequence
  SiRNA target sequence
gcattgttaatatttgcttttctt

SEQ ID NO: 218298 - DNA, 24 bp, Artificial sequence
  SiRNA target sequence
cattgttaatatttgcttttcttt

SEQ ID NO: 218299 - DNA, 24 bp, Artificial sequence
  SiRNA target sequence
attgttaatatttgcttttcttta

SEQ ID NO: 218300 - DNA, 24 bp, Artificial sequence
  SiRNA target sequence
ttgttaatatttgcttttctttat

SEQ ID NO: 218301 - DNA, 24 bp, Artificial sequence
  SiRNA target sequence
tgttaatatttgcttttctttata

SEQ ID NO: 218302 - DNA, 24 bp, Artificial sequence
  SiRNA target sequence
gttaatatttgcttttctttatat

SEQ ID NO: 218303 - DNA, 24 bp, Artificial sequence
  SiRNA target sequence
ttaatatttgcttttctttatatc

SEQ ID NO: 218304 - DNA, 24 bp, Artificial sequence
  SiRNA target sequence
taatatttgcttttctttatatca

SEQ ID NO: 218305 - DNA, 24 bp, Artificial sequence
  SiRNA target sequence
aatatttgcttttctttatatcat

SEQ ID NO: 218306 - DNA, 24 bp, Artificial sequence
  SiRNA target sequence
atatttgcttttctttatatcatt

SEQ ID NO: 218307 - DNA, 24 bp, Artificial sequence
  SiRNA target sequence
tatttgcttttctttatatcattc

SEQ ID NO: 218308 - DNA, 24 bp, Artificial sequence
  SiRNA target sequence
atttgcttttctttatatcattct

SEQ ID NO: 218309 - DNA, 24 bp, Artificial sequence
  SiRNA target sequence
tttgcttttctttatatcattctt

SEQ ID NO: 218310 - DNA, 24 bp, Artificial sequence
  SiRNA target sequence
ttgcttttctttatatcattcttg

SEQ ID NO: 218311 - DNA, 24 bp, Artificial sequence
  SiRNA target sequence
tgcttttctttatatcattcttgg

SEQ ID NO: 218312 - DNA, 24 bp, Artificial sequence
  SiRNA target sequence
gcttttctttatatcattcttggt

SEQ ID NO: 218313 - DNA, 24 bp, Artificial sequence
  SiRNA target sequence
cttttctttatatcattcttggtc

SEQ ID NO: 218314 - DNA, 24 bp, Artificial sequence
  SiRNA target sequence
ttttctttatatcattcttggtct

SEQ ID NO: 218315 - DNA, 24 bp, Artificial sequence
  SiRNA target sequence
tttctttatatcattcttggtcta

SEQ ID NO: 218316 - DNA, 24 bp, Artificial sequence
  SiRNA target sequence
ttctttatatcattcttggtctag

SEQ ID NO: 218317 - DNA, 24 bp, Artificial sequence
  SiRNA target sequence
tctttatatcattcttggtctagt

SEQ ID NO: 218318 - DNA, 24 bp, Artificial sequence
  SiRNA target sequence
ctttatatcattcttggtctagtt

SEQ ID NO: 218319 - DNA, 24 bp, Artificial sequence
  SiRNA target sequence
tttatatcattcttggtctagttc

SEQ ID NO: 218320 - DNA, 24 bp, Artificial sequence
  SiRNA target sequence
ttatatcattcttggtctagttct

SEQ ID NO: 218321 - DNA, 24 bp, Artificial sequence
  SiRNA target sequence
tatatcattcttggtctagttctt

SEQ ID NO: 218322 - DNA, 24 bp, Artificial sequence
  SiRNA target sequence
atatcattcttggtctagttcttc

SEQ ID NO: 218323 - DNA, 24 bp, Artificial sequence
  SiRNA target sequence
tatcattcttggtctagttcttct

SEQ ID NO: 218324 - DNA, 24 bp, Artificial sequence
  SiRNA target sequence
atcattcttggtctagttcttctt

SEQ ID NO: 218325 - DNA, 24 bp, Artificial sequence
  SiRNA target sequence
tcattcttggtctagttcttcttc

SEQ ID NO: 218326 - DNA, 24 bp, Artificial sequence
  SiRNA target sequence
cattcttggtctagttcttcttcc

SEQ ID NO: 218327 - DNA, 24 bp, Artificial sequence
  SiRNA target sequence
attcttggtctagttcttcttcca

SEQ ID NO: 218328 - DNA, 24 bp, Artificial sequence
  SiRNA target sequence
ttcttggtctagttcttcttccat

SEQ ID NO: 218329 - DNA, 24 bp, Artificial sequence
  SiRNA target sequence
tcttggtctagttcttcttccata

SEQ ID NO: 218330 - DNA, 24 bp, Artificial sequence
  SiRNA target sequence
cttggtctagttcttcttccatat

SEQ ID NO: 218331 - DNA, 24 bp, Artificial sequence
  SiRNA target sequence
ttggtctagttcttcttccatatt

SEQ ID NO: 218332 - DNA, 24 bp, Artificial sequence
  SiRNA target sequence
tggtctagttcttcttccatattc

SEQ ID NO: 218333 - DNA, 24 bp, Artificial sequence
  SiRNA target sequence
ggtctagttcttcttccatattct

SEQ ID NO: 218334 - DNA, 24 bp, Artificial sequence
  SiRNA target sequence
gtctagttcttcttccatattctc

SEQ ID NO: 218335 - DNA, 24 bp, Artificial sequence
  SiRNA target sequence
tctagttcttcttccatattctca

SEQ ID NO: 218336 - DNA, 24 bp, Artificial sequence
  SiRNA target sequence
ctagttcttcttccatattctcat

SEQ ID NO: 218337 - DNA, 24 bp, Artificial sequence
  SiRNA target sequence
tagttcttcttccatattctcatc

SEQ ID NO: 218338 - DNA, 24 bp, Artificial sequence
  SiRNA target sequence
agttcttcttccatattctcatct

SEQ ID NO: 218339 - DNA, 24 bp, Artificial sequence
  SiRNA target sequence
gttcttcttccatattctcatctt

SEQ ID NO: 218340 - DNA, 24 bp, Artificial sequence
  SiRNA target sequence
ttcttcttccatattctcatcttt

SEQ ID NO: 218341 - DNA, 24 bp, Artificial sequence
  SiRNA target sequence
tcttcttccatattctcatctttt

SEQ ID NO: 218342 - DNA, 24 bp, Artificial sequence
  SiRNA target sequence
cttcttccatattctcatcttttc

SEQ ID NO: 218343 - DNA, 24 bp, Artificial sequence
  SiRNA target sequence
ttcttccatattctcatcttttcc

SEQ ID NO: 218344 - DNA, 24 bp, Artificial sequence
  SiRNA target sequence
tcttccatattctcatcttttcca

SEQ ID NO: 218345 - DNA, 24 bp, Artificial sequence
  SiRNA target sequence
cttccatattctcatcttttccag

SEQ ID NO: 218346 - DNA, 24 bp, Artificial sequence
  SiRNA target sequence
ttccatattctcatcttttccagc

SEQ ID NO: 218347 - DNA, 24 bp, Artificial sequence
  SiRNA target sequence
tccatattctcatcttttccagct

SEQ ID NO: 218348 - DNA, 24 bp, Artificial sequence
  SiRNA target sequence
ccatattctcatcttttccagctt

SEQ ID NO: 218349 - DNA, 24 bp, Artificial sequence
  SiRNA target sequence
catattctcatcttttccagcttg

SEQ ID NO: 218350 - DNA, 24 bp, Artificial sequence
  SiRNA target sequence
atattctcatcttttccagcttga

SEQ ID NO: 218351 - DNA, 24 bp, Artificial sequence
  SiRNA target sequence
tattctcatcttttccagcttgat

SEQ ID NO: 218352 - DNA, 24 bp, Artificial sequence
  SiRNA target sequence
attctcatcttttccagcttgata

SEQ ID NO: 218353 - DNA, 24 bp, Artificial sequence
  SiRNA target sequence
ttctcatcttttccagcttgatag

SEQ ID NO: 218354 - DNA, 24 bp, Artificial sequence
  SiRNA target sequence
tctcatcttttccagcttgatagt

SEQ ID NO: 218355 - DNA, 24 bp, Artificial sequence
  SiRNA target sequence
ctcatcttttccagcttgatagtt

SEQ ID NO: 218356 - DNA, 24 bp, Artificial sequence
  SiRNA target sequence
tcatcttttccagcttgatagtta

SEQ ID NO: 218357 - DNA, 24 bp, Artificial sequence
  SiRNA target sequence
catcttttccagcttgatagttat

SEQ ID NO: 218358 - DNA, 24 bp, Artificial sequence
  SiRNA target sequence
atcttttccagcttgatagttatt

SEQ ID NO: 218359 - DNA, 24 bp, Artificial sequence
  SiRNA target sequence
tcttttccagcttgatagttattt

SEQ ID NO: 218360 - DNA, 24 bp, Artificial sequence
  SiRNA target sequence
cttttccagcttgatagttatttt

SEQ ID NO: 218361 - DNA, 24 bp, Artificial sequence
  SiRNA target sequence
ttttccagcttgatagttattttt

SEQ ID NO: 218362 - DNA, 24 bp, Artificial sequence
  SiRNA target sequence
tttccagcttgatagttatttttt

SEQ ID NO: 218363 - DNA, 24 bp, Artificial sequence
  SiRNA target sequence
ttccagcttgatagttattttttt

SEQ ID NO: 218364 - DNA, 24 bp, Artificial sequence
  SiRNA target sequence
tccagcttgatagttattttttta

SEQ ID NO: 218365 - DNA, 24 bp, Artificial sequence
  SiRNA target sequence
ccagcttgatagttatttttttag

SEQ ID NO: 218366 - DNA, 24 bp, Artificial sequence
  SiRNA target sequence
cagcttgatagttatttttttaga

SEQ ID NO: 218367 - DNA, 24 bp, Artificial sequence
  SiRNA target sequence
agcttgatagttatttttttagag

SEQ ID NO: 218368 - DNA, 24 bp, Artificial sequence
  SiRNA target sequence
gcttgatagttatttttttagaga

SEQ ID NO: 218369 - DNA, 24 bp, Artificial sequence
  SiRNA target sequence
cttgatagttatttttttagagac

SEQ ID NO: 218370 - DNA, 24 bp, Artificial sequence
  SiRNA target sequence
ttgatagttatttttttagagacc

SEQ ID NO: 218371 - DNA, 24 bp, Artificial sequence
  SiRNA target sequence
tgatagttatttttttagagacct

SEQ ID NO: 218372 - DNA, 24 bp, Artificial sequence
  SiRNA target sequence
gatagttatttttttagagacctt

SEQ ID NO: 218373 - DNA, 24 bp, Artificial sequence
  SiRNA target sequence
atagttatttttttagagaccttt

SEQ ID NO: 218374 - DNA, 24 bp, Artificial sequence
  SiRNA target sequence
tagttatttttttagagacctttt

SEQ ID NO: 218375 - DNA, 24 bp, Artificial sequence
  SiRNA target sequence
agttatttttttagagaccttttt

SEQ ID NO: 218376 - DNA, 24 bp, Artificial sequence
  SiRNA target sequence
gttatttttttagagaccttttta

SEQ ID NO: 218377 - DNA, 24 bp, Artificial sequence
  SiRNA target sequence
ttatttttttagagacctttttag

SEQ ID NO: 218378 - DNA, 24 bp, Artificial sequence
  SiRNA target sequence
tatttttttagagacctttttagt

SEQ ID NO: 218379 - DNA, 24 bp, Artificial sequence
  SiRNA target sequence
atttttttagagacctttttagtg

SEQ ID NO: 218380 - DNA, 24 bp, Artificial sequence
  SiRNA target sequence
tttttttagagacctttttagtga

SEQ ID NO: 218381 - DNA, 24 bp, Artificial sequence
  SiRNA target sequence
ttttttagagacctttttagtgat

SEQ ID NO: 218382 - DNA, 24 bp, Artificial sequence
  SiRNA target sequence
tttttagagacctttttagtgatg

SEQ ID NO: 218383 - DNA, 24 bp, Artificial sequence
  SiRNA target sequence
ttttagagacctttttagtgatgg

SEQ ID NO: 218384 - DNA, 24 bp, Artificial sequence
  SiRNA target sequence
tttagagacctttttagtgatggg

SEQ ID NO: 218385 - DNA, 24 bp, Artificial sequence
  SiRNA target sequence
ttagagacctttttagtgatggga

SEQ ID NO: 218386 - DNA, 24 bp, Artificial sequence
  SiRNA target sequence
tagagacctttttagtgatgggaa

SEQ ID NO: 218387 - DNA, 24 bp, Artificial sequence
  SiRNA target sequence
agagacctttttagtgatgggaaa

SEQ ID NO: 218388 - DNA, 24 bp, Artificial sequence
  SiRNA target sequence
gagacctttttagtgatgggaaat

SEQ ID NO: 218389 - DNA, 24 bp, Artificial sequence
  SiRNA target sequence
agacctttttagtgatgggaaatg

SEQ ID NO: 218390 - DNA, 24 bp, Artificial sequence
  SiRNA target sequence
gacctttttagtgatgggaaatgt

SEQ ID NO: 218391 - DNA, 24 bp, Artificial sequence
  SiRNA target sequence
acctttttagtgatgggaaatgtg

SEQ ID NO: 218392 - DNA, 24 bp, Artificial sequence
  SiRNA target sequence
cctttttagtgatgggaaatgtgt

SEQ ID NO: 218393 - DNA, 24 bp, Artificial sequence
  SiRNA target sequence
ctttttagtgatgggaaatgtgtt

SEQ ID NO: 218394 - DNA, 24 bp, Artificial sequence
  SiRNA target sequence
tttttagtgatgggaaatgtgttg

SEQ ID NO: 218395 - DNA, 24 bp, Artificial sequence
  SiRNA target sequence
ttttagtgatgggaaatgtgttgt

SEQ ID NO: 218396 - DNA, 24 bp, Artificial sequence
  SiRNA target sequence
tttagtgatgggaaatgtgttgta

SEQ ID NO: 218397 - DNA, 24 bp, Artificial sequence
  SiRNA target sequence
ttagtgatgggaaatgtgttgtaa

SEQ ID NO: 218398 - DNA, 24 bp, Artificial sequence
  SiRNA target sequence
tagtgatgggaaatgtgttgtaag

SEQ ID NO: 218399 - DNA, 24 bp, Artificial sequence
  SiRNA target sequence
agtgatgggaaatgtgttgtaaga

SEQ ID NO: 218400 - DNA, 24 bp, Artificial sequence
  SiRNA target sequence
gtgatgggaaatgtgttgtaagag

SEQ ID NO: 218401 - DNA, 24 bp, Artificial sequence
  SiRNA target sequence
tgatgggaaatgtgttgtaagagg

SEQ ID NO: 218402 - DNA, 24 bp, Artificial sequence
  SiRNA target sequence
gatgggaaatgtgttgtaagaggc

SEQ ID NO: 218403 - DNA, 24 bp, Artificial sequence
  SiRNA target sequence
atgggaaatgtgttgtaagaggct

SEQ ID NO: 218404 - DNA, 24 bp, Artificial sequence
  SiRNA target sequence
tgggaaatgtgttgtaagaggcta

SEQ ID NO: 218405 - DNA, 24 bp, Artificial sequence
  SiRNA target sequence
gggaaatgtgttgtaagaggctat

SEQ ID NO: 218406 - DNA, 24 bp, Artificial sequence
  SiRNA target sequence
ggaaatgtgttgtaagaggctatg

SEQ ID NO: 218407 - DNA, 24 bp, Artificial sequence
  SiRNA target sequence
gaaatgtgttgtaagaggctatga

SEQ ID NO: 218408 - DNA, 24 bp, Artificial sequence
  SiRNA target sequence
aaatgtgttgtaagaggctatgat

SEQ ID NO: 218409 - DNA, 24 bp, Artificial sequence
  SiRNA target sequence
aatgtgttgtaagaggctatgatg

SEQ ID NO: 218410 - DNA, 24 bp, Artificial sequence
  SiRNA target sequence
atgtgttgtaagaggctatgatgc

SEQ ID NO: 218411 - DNA, 24 bp, Artificial sequence
  SiRNA target sequence
tgtgttgtaagaggctatgatgct

SEQ ID NO: 218412 - DNA, 24 bp, Artificial sequence
  SiRNA target sequence
gtgttgtaagaggctatgatgctt

SEQ ID NO: 218413 - DNA, 24 bp, Artificial sequence
  SiRNA target sequence
tgttgtaagaggctatgatgcttt

SEQ ID NO: 218414 - DNA, 24 bp, Artificial sequence
  SiRNA target sequence
gttgtaagaggctatgatgcttta

SEQ ID NO: 218415 - DNA, 24 bp, Artificial sequence
  SiRNA target sequence
ttgtaagaggctatgatgctttat

SEQ ID NO: 218416 - DNA, 24 bp, Artificial sequence
  SiRNA target sequence
tgtaagaggctatgatgctttatt

SEQ ID NO: 218417 - DNA, 24 bp, Artificial sequence
  SiRNA target sequence
gtaagaggctatgatgctttatta

SEQ ID NO: 218418 - DNA, 24 bp, Artificial sequence
  SiRNA target sequence
taagaggctatgatgctttattat

SEQ ID NO: 218419 - DNA, 24 bp, Artificial sequence
  SiRNA target sequence
aagaggctatgatgctttattatc

SEQ ID NO: 218420 - DNA, 24 bp, Artificial sequence
  SiRNA target sequence
agaggctatgatgctttattatct

SEQ ID NO: 218421 - DNA, 24 bp, Artificial sequence
  SiRNA target sequence
gaggctatgatgctttattatctt

SEQ ID NO: 218422 - DNA, 24 bp, Artificial sequence
  SiRNA target sequence
aggctatgatgctttattatcttt

SEQ ID NO: 218423 - DNA, 24 bp, Artificial sequence
  SiRNA target sequence
ggctatgatgctttattatctttg

SEQ ID NO: 218424 - DNA, 24 bp, Artificial sequence
  SiRNA target sequence
gctatgatgctttattatctttgg

SEQ ID NO: 218425 - DNA, 24 bp, Artificial sequence
  SiRNA target sequence
ctatgatgctttattatctttggc

SEQ ID NO: 218426 - DNA, 24 bp, Artificial sequence
  SiRNA target sequence
tatgatgctttattatctttggca

SEQ ID NO: 218427 - DNA, 24 bp, Artificial sequence
  SiRNA target sequence
atgatgctttattatctttggcac

SEQ ID NO: 218428 - DNA, 24 bp, Artificial sequence
  SiRNA target sequence
tgatgctttattatctttggcact

SEQ ID NO: 218429 - DNA, 24 bp, Artificial sequence
  SiRNA target sequence
gatgctttattatctttggcactg

SEQ ID NO: 218430 - DNA, 24 bp, Artificial sequence
  SiRNA target sequence
atgctttattatctttggcactgg

SEQ ID NO: 218431 - DNA, 24 bp, Artificial sequence
  SiRNA target sequence
tgctttattatctttggcactggt

SEQ ID NO: 218432 - DNA, 24 bp, Artificial sequence
  SiRNA target sequence
gctttattatctttggcactggtc

SEQ ID NO: 218433 - DNA, 24 bp, Artificial sequence
  SiRNA target sequence
ctttattatctttggcactggtct

SEQ ID NO: 218434 - DNA, 24 bp, Artificial sequence
  SiRNA target sequence
tttattatctttggcactggtctt

SEQ ID NO: 218435 - DNA, 24 bp, Artificial sequence
  SiRNA target sequence
ttattatctttggcactggtcttt

SEQ ID NO: 218436 - DNA, 24 bp, Artificial sequence
  SiRNA target sequence
tattatctttggcactggtcttta

SEQ ID NO: 218437 - DNA, 24 bp, Artificial sequence
  SiRNA target sequence
attatctttggcactggtctttaa

SEQ ID NO: 218438 - DNA, 24 bp, Artificial sequence
  SiRNA target sequence
ttatctttggcactggtctttaac

SEQ ID NO: 218439 - DNA, 24 bp, Artificial sequence
  SiRNA target sequence
tatctttggcactggtctttaacg

SEQ ID NO: 218440 - DNA, 24 bp, Artificial sequence
  SiRNA target sequence
atctttggcactggtctttaacga

SEQ ID NO: 218441 - DNA, 24 bp, Artificial sequence
  SiRNA target sequence
tctttggcactggtctttaacgaa

SEQ ID NO: 218442 - DNA, 24 bp, Artificial sequence
  SiRNA target sequence
ctttggcactggtctttaacgaat

SEQ ID NO: 218443 - DNA, 24 bp, Artificial sequence
  SiRNA target sequence
tttggcactggtctttaacgaatg

SEQ ID NO: 218444 - DNA, 24 bp, Artificial sequence
  SiRNA target sequence
ttggcactggtctttaacgaatgg

SEQ ID NO: 218445 - DNA, 24 bp, Artificial sequence
  SiRNA target sequence
tggcactggtctttaacgaatgga

SEQ ID NO: 218446 - DNA, 24 bp, Artificial sequence
  SiRNA target sequence
ggcactggtctttaacgaatggac

SEQ ID NO: 218447 - DNA, 24 bp, Artificial sequence
  SiRNA target sequence
gcactggtctttaacgaatggaca

SEQ ID NO: 218448 - DNA, 24 bp, Artificial sequence
  SiRNA target sequence
cactggtctttaacgaatggacat

SEQ ID NO: 218449 - DNA, 24 bp, Artificial sequence
  SiRNA target sequence
actggtctttaacgaatggacatc

SEQ ID NO: 218450 - DNA, 24 bp, Artificial sequence
  SiRNA target sequence
ctggtctttaacgaatggacatcc

SEQ ID NO: 218451 - DNA, 24 bp, Artificial sequence
  SiRNA target sequence
tggtctttaacgaatggacatcct

SEQ ID NO: 218452 - DNA, 24 bp, Artificial sequence
  SiRNA target sequence
ggtctttaacgaatggacatcctc

SEQ ID NO: 218453 - DNA, 24 bp, Artificial sequence
  SiRNA target sequence
gtctttaacgaatggacatcctct

SEQ ID NO: 218454 - DNA, 24 bp, Artificial sequence
  SiRNA target sequence
tctttaacgaatggacatcctctc

SEQ ID NO: 218455 - DNA, 24 bp, Artificial sequence
  SiRNA target sequence
ctttaacgaatggacatcctctct

SEQ ID NO: 218456 - DNA, 24 bp, Artificial sequence
  SiRNA target sequence
tttaacgaatggacatcctctcta

SEQ ID NO: 218457 - DNA, 24 bp, Artificial sequence
  SiRNA target sequence
ttaacgaatggacatcctctctag

SEQ ID NO: 218458 - DNA, 24 bp, Artificial sequence
  SiRNA target sequence
taacgaatggacatcctctctagt

SEQ ID NO: 218459 - DNA, 24 bp, Artificial sequence
  SiRNA target sequence
aacgaatggacatcctctctagtt

SEQ ID NO: 218460 - DNA, 24 bp, Artificial sequence
  SiRNA target sequence
acgaatggacatcctctctagttt

SEQ ID NO: 218461 - DNA, 24 bp, Artificial sequence
  SiRNA target sequence
cgaatggacatcctctctagttta

SEQ ID NO: 218462 - DNA, 24 bp, Artificial sequence
  SiRNA target sequence
gaatggacatcctctctagtttac

SEQ ID NO: 218463 - DNA, 24 bp, Artificial sequence
  SiRNA target sequence
aatggacatcctctctagtttaca

SEQ ID NO: 218464 - DNA, 24 bp, Artificial sequence
  SiRNA target sequence
atggacatcctctctagtttacat

SEQ ID NO: 218465 - DNA, 24 bp, Artificial sequence
  SiRNA target sequence
tggacatcctctctagtttacatt

SEQ ID NO: 218466 - DNA, 24 bp, Artificial sequence
  SiRNA target sequence
ggacatcctctctagtttacattg

SEQ ID NO: 218467 - DNA, 24 bp, Artificial sequence
  SiRNA target sequence
gacatcctctctagtttacattgt

SEQ ID NO: 218468 - DNA, 24 bp, Artificial sequence
  SiRNA target sequence
acatcctctctagtttacattgtt

SEQ ID NO: 218469 - DNA, 24 bp, Artificial sequence
  SiRNA target sequence
catcctctctagtttacattgttt

SEQ ID NO: 218470 - DNA, 24 bp, Artificial sequence
  SiRNA target sequence
atcctctctagtttacattgtttc

SEQ ID NO: 218471 - DNA, 24 bp, Artificial sequence
  SiRNA target sequence
tcctctctagtttacattgtttca

SEQ ID NO: 218472 - DNA, 24 bp, Artificial sequence
  SiRNA target sequence
cctctctagtttacattgtttcag

SEQ ID NO: 218473 - DNA, 24 bp, Artificial sequence
  SiRNA target sequence
ctctctagtttacattgtttcaga

SEQ ID NO: 218474 - DNA, 24 bp, Artificial sequence
  SiRNA target sequence
tctctagtttacattgtttcagaa

SEQ ID NO: 218475 - DNA, 24 bp, Artificial sequence
  SiRNA target sequence
ctctagtttacattgtttcagaaa

SEQ ID NO: 218476 - DNA, 24 bp, Artificial sequence
  SiRNA target sequence
tctagtttacattgtttcagaaat

SEQ ID NO: 218477 - DNA, 24 bp, Artificial sequence
  SiRNA target sequence
ctagtttacattgtttcagaaatg

SEQ ID NO: 218478 - DNA, 24 bp, Artificial sequence
  SiRNA target sequence
tagtttacattgtttcagaaatgt

SEQ ID NO: 218479 - DNA, 24 bp, Artificial sequence
  SiRNA target sequence
agtttacattgtttcagaaatgtt

SEQ ID NO: 218480 - DNA, 24 bp, Artificial sequence
  SiRNA target sequence
gtttacattgtttcagaaatgttt

SEQ ID NO: 218481 - DNA, 24 bp, Artificial sequence
  SiRNA target sequence
tttacattgtttcagaaatgtttg

SEQ ID NO: 218482 - DNA, 24 bp, Artificial sequence
  SiRNA target sequence
ttacattgtttcagaaatgtttgg

SEQ ID NO: 218483 - DNA, 24 bp, Artificial sequence
  SiRNA target sequence
tacattgtttcagaaatgtttggt

SEQ ID NO: 218484 - DNA, 24 bp, Artificial sequence
  SiRNA target sequence
acattgtttcagaaatgtttggta

SEQ ID NO: 218485 - DNA, 24 bp, Artificial sequence
  SiRNA target sequence
cattgtttcagaaatgtttggtaa

SEQ ID NO: 218486 - DNA, 24 bp, Artificial sequence
  SiRNA target sequence
attgtttcagaaatgtttggtaat

SEQ ID NO: 218487 - DNA, 24 bp, Artificial sequence
  SiRNA target sequence
ttgtttcagaaatgtttggtaatt

SEQ ID NO: 218488 - DNA, 24 bp, Artificial sequence
  SiRNA target sequence
tgtttcagaaatgtttggtaattt

SEQ ID NO: 218489 - DNA, 24 bp, Artificial sequence
  SiRNA target sequence
gtttcagaaatgtttggtaattta

SEQ ID NO: 218490 - DNA, 24 bp, Artificial sequence
  SiRNA target sequence
tttcagaaatgtttggtaatttag

SEQ ID NO: 218491 - DNA, 24 bp, Artificial sequence
  SiRNA target sequence
ttcagaaatgtttggtaatttagt

SEQ ID NO: 218492 - DNA, 24 bp, Artificial sequence
  SiRNA target sequence
tcagaaatgtttggtaatttagta

SEQ ID NO: 218493 - DNA, 24 bp, Artificial sequence
  SiRNA target sequence
cagaaatgtttggtaatttagtat

SEQ ID NO: 218494 - DNA, 24 bp, Artificial sequence
  SiRNA target sequence
agaaatgtttggtaatttagtatt

SEQ ID NO: 218495 - DNA, 24 bp, Artificial sequence
  SiRNA target sequence
gaaatgtttggtaatttagtattg

SEQ ID NO: 218496 - DNA, 24 bp, Artificial sequence
  SiRNA target sequence
aaatgtttggtaatttagtattgt

SEQ ID NO: 218497 - DNA, 24 bp, Artificial sequence
  SiRNA target sequence
aatgtttggtaatttagtattgtc

SEQ ID NO: 218498 - DNA, 24 bp, Artificial sequence
  SiRNA target sequence
atgtttggtaatttagtattgtct

SEQ ID NO: 218499 - DNA, 24 bp, Artificial sequence
  SiRNA target sequence
tgtttggtaatttagtattgtctt

SEQ ID NO: 218500 - DNA, 24 bp, Artificial sequence
  SiRNA target sequence
gtttggtaatttagtattgtctta

SEQ ID NO: 218501 - DNA, 24 bp, Artificial sequence
  SiRNA target sequence
tttggtaatttagtattgtcttat

SEQ ID NO: 218502 - DNA, 24 bp, Artificial sequence
  SiRNA target sequence
ttggtaatttagtattgtcttatt

SEQ ID NO: 218503 - DNA, 24 bp, Artificial sequence
  SiRNA target sequence
tggtaatttagtattgtcttattt

SEQ ID NO: 218504 - DNA, 24 bp, Artificial sequence
  SiRNA target sequence
ggtaatttagtattgtcttatttc

SEQ ID NO: 218505 - DNA, 24 bp, Artificial sequence
  SiRNA target sequence
gtaatttagtattgtcttatttct

SEQ ID NO: 218506 - DNA, 24 bp, Artificial sequence
  SiRNA target sequence
taatttagtattgtcttatttctt

SEQ ID NO: 218507 - DNA, 24 bp, Artificial sequence
  SiRNA target sequence
aatttagtattgtcttatttcttc

SEQ ID NO: 218508 - DNA, 24 bp, Artificial sequence
  SiRNA target sequence
atttagtattgtcttatttcttct

SEQ ID NO: 218509 - DNA, 24 bp, Artificial sequence
  SiRNA target sequence
tttagtattgtcttatttcttctt

SEQ ID NO: 218510 - DNA, 24 bp, Artificial sequence
  SiRNA target sequence
ttagtattgtcttatttcttcttg

SEQ ID NO: 218511 - DNA, 24 bp, Artificial sequence
  SiRNA target sequence
tagtattgtcttatttcttcttga

SEQ ID NO: 218512 - DNA, 24 bp, Artificial sequence
  SiRNA target sequence
agtattgtcttatttcttcttgac

SEQ ID NO: 218513 - DNA, 24 bp, Artificial sequence
  SiRNA target sequence
gtattgtcttatttcttcttgacg

SEQ ID NO: 218514 - DNA, 24 bp, Artificial sequence
  SiRNA target sequence
tattgtcttatttcttcttgacgt

SEQ ID NO: 218515 - DNA, 24 bp, Artificial sequence
  SiRNA target sequence
attgtcttatttcttcttgacgtt

SEQ ID NO: 218516 - DNA, 24 bp, Artificial sequence
  SiRNA target sequence
ttgtcttatttcttcttgacgttt

SEQ ID NO: 218517 - DNA, 24 bp, Artificial sequence
  SiRNA target sequence
tgtcttatttcttcttgacgtttg

SEQ ID NO: 218518 - DNA, 24 bp, Artificial sequence
  SiRNA target sequence
gtcttatttcttcttgacgtttgc

SEQ ID NO: 218519 - DNA, 24 bp, Artificial sequence
  SiRNA target sequence
tcttatttcttcttgacgtttgct

SEQ ID NO: 218520 - DNA, 24 bp, Artificial sequence
  SiRNA target sequence
cttatttcttcttgacgtttgcta

SEQ ID NO: 218521 - DNA, 24 bp, Artificial sequence
  SiRNA target sequence
ttatttcttcttgacgtttgctaa

SEQ ID NO: 218522 - DNA, 24 bp, Artificial sequence
  SiRNA target sequence
tatttcttcttgacgtttgctaat

SEQ ID NO: 218523 - DNA, 24 bp, Artificial sequence
  SiRNA target sequence
atttcttcttgacgtttgctaatt

SEQ ID NO: 218524 - DNA, 24 bp, Artificial sequence
  SiRNA target sequence
tttcttcttgacgtttgctaattc

SEQ ID NO: 218525 - DNA, 24 bp, Artificial sequence
  SiRNA target sequence
ttcttcttgacgtttgctaattct

SEQ ID NO: 218526 - DNA, 24 bp, Artificial sequence
  SiRNA target sequence
tcttcttgacgtttgctaattctt

SEQ ID NO: 218527 - DNA, 24 bp, Artificial sequence
  SiRNA target sequence
cttcttgacgtttgctaattcttt

SEQ ID NO: 218528 - DNA, 24 bp, Artificial sequence
  SiRNA target sequence
ttcttgacgtttgctaattcttta

SEQ ID NO: 218529 - DNA, 24 bp, Artificial sequence
  SiRNA target sequence
tcttgacgtttgctaattctttaa

SEQ ID NO: 218530 - DNA, 24 bp, Artificial sequence
  SiRNA target sequence
cttgacgtttgctaattctttaac

SEQ ID NO: 218531 - DNA, 24 bp, Artificial sequence
  SiRNA target sequence
ttgacgtttgctaattctttaaca

SEQ ID NO: 218532 - DNA, 24 bp, Artificial sequence
  SiRNA target sequence
tgacgtttgctaattctttaacaa

SEQ ID NO: 218533 - DNA, 24 bp, Artificial sequence
  SiRNA target sequence
gacgtttgctaattctttaacaac

SEQ ID NO: 218534 - DNA, 24 bp, Artificial sequence
  SiRNA target sequence
acgtttgctaattctttaacaact

SEQ ID NO: 218535 - DNA, 24 bp, Artificial sequence
  SiRNA target sequence
cgtttgctaattctttaacaactc

SEQ ID NO: 218536 - DNA, 24 bp, Artificial sequence
  SiRNA target sequence
gtttgctaattctttaacaactcc

SEQ ID NO: 218537 - DNA, 24 bp, Artificial sequence
  SiRNA target sequence
tttgctaattctttaacaactcca

SEQ ID NO: 218538 - DNA, 24 bp, Artificial sequence
  SiRNA target sequence
ttgctaattctttaacaactccag

SEQ ID NO: 218539 - DNA, 24 bp, Artificial sequence
  SiRNA target sequence
tgctaattctttaacaactccagg

SEQ ID NO: 218540 - DNA, 24 bp, Artificial sequence
  SiRNA target sequence
gctaattctttaacaactccagga

SEQ ID NO: 218541 - DNA, 24 bp, Artificial sequence
  SiRNA target sequence
ctaattctttaacaactccaggac

SEQ ID NO: 218542 - DNA, 24 bp, Artificial sequence
  SiRNA target sequence
taattctttaacaactccaggaca

SEQ ID NO: 218543 - DNA, 24 bp, Artificial sequence
  SiRNA target sequence
aattctttaacaactccaggacaa

SEQ ID NO: 218544 - DNA, 24 bp, Artificial sequence
  SiRNA target sequence
attctttaacaactccaggacaaa

SEQ ID NO: 218545 - DNA, 24 bp, Artificial sequence
  SiRNA target sequence
ttctttaacaactccaggacaaag

SEQ ID NO: 218546 - DNA, 24 bp, Artificial sequence
  SiRNA target sequence
tctttaacaactccaggacaaagt

SEQ ID NO: 218547 - DNA, 24 bp, Artificial sequence
  SiRNA target sequence
ctttaacaactccaggacaaagtg

SEQ ID NO: 218548 - DNA, 24 bp, Artificial sequence
  SiRNA target sequence
tttaacaactccaggacaaagtgc

SEQ ID NO: 218549 - DNA, 24 bp, Artificial sequence
  SiRNA target sequence
ttaacaactccaggacaaagtgca

SEQ ID NO: 218550 - DNA, 24 bp, Artificial sequence
  SiRNA target sequence
taacaactccaggacaaagtgcaa

SEQ ID NO: 218551 - DNA, 24 bp, Artificial sequence
  SiRNA target sequence
aacaactccaggacaaagtgcaag

SEQ ID NO: 218552 - DNA, 24 bp, Artificial sequence
  SiRNA target sequence
acaactccaggacaaagtgcaaga

SEQ ID NO: 218553 - DNA, 24 bp, Artificial sequence
  SiRNA target sequence
caactccaggacaaagtgcaagat

SEQ ID NO: 218554 - DNA, 24 bp, Artificial sequence
  SiRNA target sequence
aactccaggacaaagtgcaagatt

SEQ ID NO: 218555 - DNA, 24 bp, Artificial sequence
  SiRNA target sequence
actccaggacaaagtgcaagattc

SEQ ID NO: 218556 - DNA, 24 bp, Artificial sequence
  SiRNA target sequence
ctccaggacaaagtgcaagattca

SEQ ID NO: 218557 - DNA, 24 bp, Artificial sequence
  SiRNA target sequence
tccaggacaaagtgcaagattcat

SEQ ID NO: 218558 - DNA, 24 bp, Artificial sequence
  SiRNA target sequence
ccaggacaaagtgcaagattcata

SEQ ID NO: 218559 - DNA, 24 bp, Artificial sequence
  SiRNA target sequence
caggacaaagtgcaagattcatac

SEQ ID NO: 218560 - DNA, 24 bp, Artificial sequence
  SiRNA target sequence
aggacaaagtgcaagattcatacc

SEQ ID NO: 218561 - DNA, 24 bp, Artificial sequence
  SiRNA target sequence
ggacaaagtgcaagattcatacct

SEQ ID NO: 218562 - DNA, 24 bp, Artificial sequence
  SiRNA target sequence
gacaaagtgcaagattcatacctt

SEQ ID NO: 218563 - DNA, 24 bp, Artificial sequence
  SiRNA target sequence
acaaagtgcaagattcataccttt

SEQ ID NO: 218564 - DNA, 24 bp, Artificial sequence
  SiRNA target sequence
caaagtgcaagattcataccttta

SEQ ID NO: 218565 - DNA, 24 bp, Artificial sequence
  SiRNA target sequence
aaagtgcaagattcatacctttat

SEQ ID NO: 218566 - DNA, 24 bp, Artificial sequence
  SiRNA target sequence
aagtgcaagattcatacctttatt

SEQ ID NO: 218567 - DNA, 24 bp, Artificial sequence
  SiRNA target sequence
agtgcaagattcatacctttattt

SEQ ID NO: 218568 - DNA, 24 bp, Artificial sequence
  SiRNA target sequence
gtgcaagattcatacctttatttt

SEQ ID NO: 218569 - DNA, 24 bp, Artificial sequence
  SiRNA target sequence
tgcaagattcatacctttatttta

SEQ ID NO: 218570 - DNA, 24 bp, Artificial sequence
  SiRNA target sequence
gcaagattcatacctttattttat

SEQ ID NO: 218571 - DNA, 24 bp, Artificial sequence
  SiRNA target sequence
caagattcatacctttattttatg

SEQ ID NO: 218572 - DNA, 24 bp, Artificial sequence
  SiRNA target sequence
aagattcatacctttattttatgt

SEQ ID NO: 218573 - DNA, 24 bp, Artificial sequence
  SiRNA target sequence
agattcatacctttattttatgtt

SEQ ID NO: 218574 - DNA, 24 bp, Artificial sequence
  SiRNA target sequence
gattcatacctttattttatgttt

SEQ ID NO: 218575 - DNA, 24 bp, Artificial sequence
  SiRNA target sequence
attcatacctttattttatgtttt

SEQ ID NO: 218576 - DNA, 24 bp, Artificial sequence
  SiRNA target sequence
ttcatacctttattttatgttttc

SEQ ID NO: 218577 - DNA, 24 bp, Artificial sequence
  SiRNA target sequence
tcatacctttattttatgttttct

SEQ ID NO: 218578 - DNA, 24 bp, Artificial sequence
  SiRNA target sequence
catacctttattttatgttttctc

SEQ ID NO: 218579 - DNA, 24 bp, Artificial sequence
  SiRNA target sequence
atacctttattttatgttttctcg

SEQ ID NO: 218580 - DNA, 24 bp, Artificial sequence
  SiRNA target sequence
tacctttattttatgttttctcga

SEQ ID NO: 218581 - DNA, 24 bp, Artificial sequence
  SiRNA target sequence
acctttattttatgttttctcgaa

SEQ ID NO: 218582 - DNA, 24 bp, Artificial sequence
  SiRNA target sequence
cctttattttatgttttctcgaat

SEQ ID NO: 218583 - DNA, 24 bp, Artificial sequence
  SiRNA target sequence
ctttattttatgttttctcgaata

SEQ ID NO: 218584 - DNA, 24 bp, Artificial sequence
  SiRNA target sequence
tttattttatgttttctcgaatat

SEQ ID NO: 218585 - DNA, 24 bp, Artificial sequence
  SiRNA target sequence
ttattttatgttttctcgaatatt

SEQ ID NO: 218586 - DNA, 24 bp, Artificial sequence
  SiRNA target sequence
tattttatgttttctcgaatattt

SEQ ID NO: 218587 - DNA, 24 bp, Artificial sequence
  SiRNA target sequence
attttatgttttctcgaatatttc

SEQ ID NO: 218588 - DNA, 24 bp, Artificial sequence
  SiRNA target sequence
ttttatgttttctcgaatatttct

SEQ ID NO: 218589 - DNA, 24 bp, Artificial sequence
  SiRNA target sequence
tttatgttttctcgaatatttctc

SEQ ID NO: 218590 - DNA, 24 bp, Artificial sequence
  SiRNA target sequence
ttatgttttctcgaatatttctct

SEQ ID NO: 218591 - DNA, 24 bp, Artificial sequence
  SiRNA target sequence
tatgttttctcgaatatttctctt

SEQ ID NO: 218592 - DNA, 24 bp, Artificial sequence
  SiRNA target sequence
atgttttctcgaatatttctcttt

SEQ ID NO: 218593 - DNA, 24 bp, Artificial sequence
  SiRNA target sequence
tgttttctcgaatatttctctttt

SEQ ID NO: 218594 - DNA, 24 bp, Artificial sequence
  SiRNA target sequence
gttttctcgaatatttctcttttc

SEQ ID NO: 218595 - DNA, 24 bp, Artificial sequence
  SiRNA target sequence
ttttctcgaatatttctcttttct

SEQ ID NO: 218596 - DNA, 24 bp, Artificial sequence
  SiRNA target sequence
tttctcgaatatttctcttttctt

SEQ ID NO: 218597 - DNA, 24 bp, Artificial sequence
  SiRNA target sequence
ttctcgaatatttctcttttctta

SEQ ID NO: 218598 - DNA, 24 bp, Artificial sequence
  SiRNA target sequence
tctcgaatatttctcttttcttat

SEQ ID NO: 218599 - DNA, 24 bp, Artificial sequence
  SiRNA target sequence
ctcgaatatttctcttttcttatc

SEQ ID NO: 218600 - DNA, 24 bp, Artificial sequence
  SiRNA target sequence
tcgaatatttctcttttcttatct

SEQ ID NO: 218601 - DNA, 24 bp, Artificial sequence
  SiRNA target sequence
cgaatatttctcttttcttatctt

SEQ ID NO: 218602 - DNA, 24 bp, Artificial sequence
  SiRNA target sequence
gaatatttctcttttcttatcttc

SEQ ID NO: 218603 - DNA, 24 bp, Artificial sequence
  SiRNA target sequence
aatatttctcttttcttatcttct

SEQ ID NO: 218604 - DNA, 24 bp, Artificial sequence
  SiRNA target sequence
atatttctcttttcttatcttctc

SEQ ID NO: 218605 - DNA, 24 bp, Artificial sequence
  SiRNA target sequence
tatttctcttttcttatcttctca

SEQ ID NO: 218606 - DNA, 24 bp, Artificial sequence
  SiRNA target sequence
atttctcttttcttatcttctcaa

SEQ ID NO: 218607 - DNA, 24 bp, Artificial sequence
  SiRNA target sequence
tttctcttttcttatcttctcaag

SEQ ID NO: 218608 - DNA, 24 bp, Artificial sequence
  SiRNA target sequence
ttctcttttcttatcttctcaagt

SEQ ID NO: 218609 - DNA, 24 bp, Artificial sequence
  SiRNA target sequence
tctcttttcttatcttctcaagtg

SEQ ID NO: 218610 - DNA, 24 bp, Artificial sequence
  SiRNA target sequence
ctcttttcttatcttctcaagtga

SEQ ID NO: 218611 - DNA, 24 bp, Artificial sequence
  SiRNA target sequence
tcttttcttatcttctcaagtgac

SEQ ID NO: 218612 - DNA, 24 bp, Artificial sequence
  SiRNA target sequence
cttttcttatcttctcaagtgaca

SEQ ID NO: 218613 - DNA, 24 bp, Artificial sequence
  SiRNA target sequence
ttttcttatcttctcaagtgacag

SEQ ID NO: 218614 - DNA, 24 bp, Artificial sequence
  SiRNA target sequence
tttcttatcttctcaagtgacaga

SEQ ID NO: 218615 - DNA, 24 bp, Artificial sequence
  SiRNA target sequence
ttcttatcttctcaagtgacagaa

SEQ ID NO: 218616 - DNA, 24 bp, Artificial sequence
  SiRNA target sequence
tcttatcttctcaagtgacagaac

SEQ ID NO: 218617 - DNA, 24 bp, Artificial sequence
  SiRNA target sequence
cttatcttctcaagtgacagaact

SEQ ID NO: 218618 - DNA, 24 bp, Artificial sequence
  SiRNA target sequence
ttatcttctcaagtgacagaactt

SEQ ID NO: 218619 - DNA, 24 bp, Artificial sequence
  SiRNA target sequence
tatcttctcaagtgacagaacttt

SEQ ID NO: 218620 - DNA, 24 bp, Artificial sequence
  SiRNA target sequence
atcttctcaagtgacagaactttt

SEQ ID NO: 218621 - DNA, 24 bp, Artificial sequence
  SiRNA target sequence
tcttctcaagtgacagaacttttt

SEQ ID NO: 218622 - DNA, 24 bp, Artificial sequence
  SiRNA target sequence
cttctcaagtgacagaacttttta

SEQ ID NO: 218623 - DNA, 24 bp, Artificial sequence
  SiRNA target sequence
ttctcaagtgacagaactttttac

SEQ ID NO: 218624 - DNA, 24 bp, Artificial sequence
  SiRNA target sequence
tctcaagtgacagaactttttaca

SEQ ID NO: 218625 - DNA, 24 bp, Artificial sequence
  SiRNA target sequence
ctcaagtgacagaactttttacaa

SEQ ID NO: 218626 - DNA, 24 bp, Artificial sequence
  SiRNA target sequence
tcaagtgacagaactttttacaag

SEQ ID NO: 218627 - DNA, 24 bp, Artificial sequence
  SiRNA target sequence
caagtgacagaactttttacaaga

SEQ ID NO: 218628 - DNA, 24 bp, Artificial sequence
  SiRNA target sequence
aagtgacagaactttttacaagat

SEQ ID NO: 218629 - DNA, 24 bp, Artificial sequence
  SiRNA target sequence
agtgacagaactttttacaagata

SEQ ID NO: 218630 - DNA, 24 bp, Artificial sequence
  SiRNA target sequence
gtgacagaactttttacaagatat

SEQ ID NO: 218631 - DNA, 24 bp, Artificial sequence
  SiRNA target sequence
tgacagaactttttacaagatata

SEQ ID NO: 218632 - DNA, 24 bp, Artificial sequence
  SiRNA target sequence
gacagaactttttacaagatatag

SEQ ID NO: 218633 - DNA, 24 bp, Artificial sequence
  SiRNA target sequence
acagaactttttacaagatataga

SEQ ID NO: 218634 - DNA, 24 bp, Artificial sequence
  SiRNA target sequence
cagaactttttacaagatatagat

SEQ ID NO: 218635 - DNA, 24 bp, Artificial sequence
  SiRNA target sequence
agaactttttacaagatatagatc

SEQ ID NO: 218636 - DNA, 24 bp, Artificial sequence
  SiRNA target sequence
gaactttttacaagatatagatca

SEQ ID NO: 218637 - DNA, 24 bp, Artificial sequence
  SiRNA target sequence
aactttttacaagatatagatcaa

SEQ ID NO: 218638 - DNA, 24 bp, Artificial sequence
  SiRNA target sequence
actttttacaagatatagatcaaa

SEQ ID NO: 218639 - DNA, 24 bp, Artificial sequence
  SiRNA target sequence
ctttttacaagatatagatcaaag

SEQ ID NO: 218640 - DNA, 24 bp, Artificial sequence
  SiRNA target sequence
tttttacaagatatagatcaaagc

SEQ ID NO: 218641 - DNA, 24 bp, Artificial sequence
  SiRNA target sequence
ttttacaagatatagatcaaagct

SEQ ID NO: 218642 - DNA, 24 bp, Artificial sequence
  SiRNA target sequence
tttacaagatatagatcaaagctc

SEQ ID NO: 218643 - DNA, 24 bp, Artificial sequence
  SiRNA target sequence
ttacaagatatagatcaaagctca

SEQ ID NO: 218644 - DNA, 24 bp, Artificial sequence
  SiRNA target sequence
tacaagatatagatcaaagctcac

SEQ ID NO: 218645 - DNA, 24 bp, Artificial sequence
  SiRNA target sequence
acaagatatagatcaaagctcact

SEQ ID NO: 218646 - DNA, 24 bp, Artificial sequence
  SiRNA target sequence
caagatatagatcaaagctcactt

SEQ ID NO: 218647 - DNA, 24 bp, Artificial sequence
  SiRNA target sequence
aagatatagatcaaagctcacttt

SEQ ID NO: 218648 - DNA, 24 bp, Artificial sequence
  SiRNA target sequence
agatatagatcaaagctcactttc

SEQ ID NO: 218649 - DNA, 24 bp, Artificial sequence
  SiRNA target sequence
gatatagatcaaagctcactttct

SEQ ID NO: 218650 - DNA, 24 bp, Artificial sequence
  SiRNA target sequence
atatagatcaaagctcactttctc

SEQ ID NO: 218651 - DNA, 24 bp, Artificial sequence
  SiRNA target sequence
tatagatcaaagctcactttctca

SEQ ID NO: 218652 - DNA, 24 bp, Artificial sequence
  SiRNA target sequence
atagatcaaagctcactttctcag

SEQ ID NO: 218653 - DNA, 24 bp, Artificial sequence
  SiRNA target sequence
tagatcaaagctcactttctcaga

SEQ ID NO: 218654 - DNA, 24 bp, Artificial sequence
  SiRNA target sequence
agatcaaagctcactttctcagag

SEQ ID NO: 218655 - DNA, 24 bp, Artificial sequence
  SiRNA target sequence
gatcaaagctcactttctcagagg

SEQ ID NO: 218656 - DNA, 24 bp, Artificial sequence
  SiRNA target sequence
atcaaagctcactttctcagaggc

SEQ ID NO: 218657 - DNA, 24 bp, Artificial sequence
  SiRNA target sequence
tcaaagctcactttctcagaggcg

SEQ ID NO: 218658 - DNA, 24 bp, Artificial sequence
  SiRNA target sequence
caaagctcactttctcagaggcgg

SEQ ID NO: 218659 - DNA, 24 bp, Artificial sequence
  SiRNA target sequence
aaagctcactttctcagaggcgga

SEQ ID NO: 218660 - DNA, 24 bp, Artificial sequence
  SiRNA target sequence
aagctcactttctcagaggcggaa

SEQ ID NO: 218661 - DNA, 24 bp, Artificial sequence
  SiRNA target sequence
agctcactttctcagaggcggaat

SEQ ID NO: 218662 - DNA, 24 bp, Artificial sequence
  SiRNA target sequence
gctcactttctcagaggcggaatt

SEQ ID NO: 218663 - DNA, 24 bp, Artificial sequence
  SiRNA target sequence
ctcactttctcagaggcggaattt

SEQ ID NO: 218664 - DNA, 24 bp, Artificial sequence
  SiRNA target sequence
tcactttctcagaggcggaatttt

SEQ ID NO: 218665 - DNA, 24 bp, Artificial sequence
  SiRNA target sequence
cactttctcagaggcggaattttt

SEQ ID NO: 218666 - DNA, 24 bp, Artificial sequence
  SiRNA target sequence
actttctcagaggcggaattttta

SEQ ID NO: 218667 - DNA, 24 bp, Artificial sequence
  SiRNA target sequence
ctttctcagaggcggaatttttat

SEQ ID NO: 218668 - DNA, 24 bp, Artificial sequence
  SiRNA target sequence
tttctcagaggcggaatttttata

SEQ ID NO: 218669 - DNA, 24 bp, Artificial sequence
  SiRNA target sequence
ttctcagaggcggaatttttatat

SEQ ID NO: 218670 - DNA, 24 bp, Artificial sequence
  SiRNA target sequence
tctcagaggcggaatttttatata

SEQ ID NO: 218671 - DNA, 24 bp, Artificial sequence
  SiRNA target sequence
ctcagaggcggaatttttatataa

SEQ ID NO: 218672 - DNA, 24 bp, Artificial sequence
  SiRNA target sequence
tcagaggcggaatttttatataat

SEQ ID NO: 218673 - DNA, 24 bp, Artificial sequence
  SiRNA target sequence
cagaggcggaatttttatataatg

SEQ ID NO: 218674 - DNA, 24 bp, Artificial sequence
  SiRNA target sequence
agaggcggaatttttatataatgg

SEQ ID NO: 218675 - DNA, 24 bp, Artificial sequence
  SiRNA target sequence
gaggcggaatttttatataatggc

SEQ ID NO: 218676 - DNA, 24 bp, Artificial sequence
  SiRNA target sequence
aggcggaatttttatataatggct

SEQ ID NO: 218677 - DNA, 24 bp, Artificial sequence
  SiRNA target sequence
ggcggaatttttatataatggctt

SEQ ID NO: 218678 - DNA, 24 bp, Artificial sequence
  SiRNA target sequence
gcggaatttttatataatggcttt

SEQ ID NO: 218679 - DNA, 24 bp, Artificial sequence
  SiRNA target sequence
cggaatttttatataatggctttt

SEQ ID NO: 218680 - DNA, 24 bp, Artificial sequence
  SiRNA target sequence
ggaatttttatataatggcttttt

SEQ ID NO: 218681 - DNA, 24 bp, Artificial sequence
  SiRNA target sequence
gaatttttatataatggctttttt

SEQ ID NO: 218682 - DNA, 24 bp, Artificial sequence
  SiRNA target sequence
aatttttatataatggcttttttg

SEQ ID NO: 218683 - DNA, 24 bp, Artificial sequence
  SiRNA target sequence
atttttatataatggcttttttgt

SEQ ID NO: 218684 - DNA, 24 bp, Artificial sequence
  SiRNA target sequence
tttttatataatggcttttttgta

SEQ ID NO: 218685 - DNA, 24 bp, Artificial sequence
  SiRNA target sequence
ttttatataatggcttttttgtat

SEQ ID NO: 218686 - DNA, 24 bp, Artificial sequence
  SiRNA target sequence
tttatataatggcttttttgtatt

SEQ ID NO: 218687 - DNA, 24 bp, Artificial sequence
  SiRNA target sequence
ttatataatggcttttttgtattt

SEQ ID NO: 218688 - DNA, 24 bp, Artificial sequence
  SiRNA target sequence
tatataatggcttttttgtatttt

SEQ ID NO: 218689 - DNA, 24 bp, Artificial sequence
  SiRNA target sequence
atataatggcttttttgtattttc

SEQ ID NO: 218690 - DNA, 24 bp, Artificial sequence
  SiRNA target sequence
tataatggcttttttgtattttct

SEQ ID NO: 218691 - DNA, 24 bp, Artificial sequence
  SiRNA target sequence
ataatggcttttttgtattttctg

SEQ ID NO: 218692 - DNA, 24 bp, Artificial sequence
  SiRNA target sequence
taatggcttttttgtattttctgg

SEQ ID NO: 218693 - DNA, 24 bp, Artificial sequence
  SiRNA target sequence
aatggcttttttgtattttctgga

SEQ ID NO: 218694 - DNA, 24 bp, Artificial sequence
  SiRNA target sequence
atggcttttttgtattttctggag

SEQ ID NO: 218695 - DNA, 24 bp, Artificial sequence
  SiRNA target sequence
tggcttttttgtattttctggagt

SEQ ID NO: 218696 - DNA, 24 bp, Artificial sequence
  SiRNA target sequence
ggcttttttgtattttctggagtt

SEQ ID NO: 218697 - DNA, 24 bp, Artificial sequence
  SiRNA target sequence
gcttttttgtattttctggagttc

SEQ ID NO: 218698 - DNA, 24 bp, Artificial sequence
  SiRNA target sequence
cttttttgtattttctggagttct

SEQ ID NO: 218699 - DNA, 24 bp, Artificial sequence
  SiRNA target sequence
ttttttgtattttctggagttcta

SEQ ID NO: 218700 - DNA, 24 bp, Artificial sequence
  SiRNA target sequence
tttttgtattttctggagttctag

SEQ ID NO: 218701 - DNA, 24 bp, Artificial sequence
  SiRNA target sequence
ttttgtattttctggagttctagt

SEQ ID NO: 218702 - DNA, 24 bp, Artificial sequence
  SiRNA target sequence
tttgtattttctggagttctagta

SEQ ID NO: 218703 - DNA, 24 bp, Artificial sequence
  SiRNA target sequence
ttgtattttctggagttctagtaa

SEQ ID NO: 218704 - DNA, 24 bp, Artificial sequence
  SiRNA target sequence
tgtattttctggagttctagtaat

SEQ ID NO: 218705 - DNA, 24 bp, Artificial sequence
  SiRNA target sequence
gtattttctggagttctagtaata

SEQ ID NO: 218706 - DNA, 24 bp, Artificial sequence
  SiRNA target sequence
tattttctggagttctagtaatag

SEQ ID NO: 218707 - DNA, 24 bp, Artificial sequence
  SiRNA target sequence
attttctggagttctagtaatagt

SEQ ID NO: 218708 - DNA, 24 bp, Artificial sequence
  SiRNA target sequence
ttttctggagttctagtaatagtt

SEQ ID NO: 218709 - DNA, 24 bp, Artificial sequence
  SiRNA target sequence
tttctggagttctagtaatagtta

SEQ ID NO: 218710 - DNA, 24 bp, Artificial sequence
  SiRNA target sequence
ttctggagttctagtaatagttat

SEQ ID NO: 218711 - DNA, 24 bp, Artificial sequence
  SiRNA target sequence
tctggagttctagtaatagttata

SEQ ID NO: 218712 - DNA, 24 bp, Artificial sequence
  SiRNA target sequence
ctggagttctagtaatagttatat

SEQ ID NO: 218713 - DNA, 24 bp, Artificial sequence
  SiRNA target sequence
tggagttctagtaatagttatatt

SEQ ID NO: 218714 - DNA, 24 bp, Artificial sequence
  SiRNA target sequence
ggagttctagtaatagttatattt

SEQ ID NO: 218715 - DNA, 24 bp, Artificial sequence
  SiRNA target sequence
gagttctagtaatagttatatttt

SEQ ID NO: 218716 - DNA, 24 bp, Artificial sequence
  SiRNA target sequence
agttctagtaatagttatattttt

SEQ ID NO: 218717 - DNA, 24 bp, Artificial sequence
  SiRNA target sequence
gttctagtaatagttatattttta

SEQ ID NO: 218718 - DNA, 24 bp, Artificial sequence
  SiRNA target sequence
ttctagtaatagttatatttttaa

SEQ ID NO: 218719 - DNA, 24 bp, Artificial sequence
  SiRNA target sequence
tctagtaatagttatatttttaat

SEQ ID NO: 218720 - DNA, 24 bp, Artificial sequence
  SiRNA target sequence
ctagtaatagttatatttttaatt

SEQ ID NO: 218721 - DNA, 24 bp, Artificial sequence
  SiRNA target sequence
tagtaatagttatatttttaatta

SEQ ID NO: 218722 - DNA, 24 bp, Artificial sequence
  SiRNA target sequence
agtaatagttatatttttaattaa

SEQ ID NO: 218723 - DNA, 24 bp, Artificial sequence
  SiRNA target sequence
gtaatagttatatttttaattaaa

SEQ ID NO: 218724 - DNA, 24 bp, Artificial sequence
  SiRNA target sequence
taatagttatatttttaattaaaa

SEQ ID NO: 218725 - DNA, 24 bp, Artificial sequence
  SiRNA target sequence
aatagttatatttttaattaaaaa

SEQ ID NO: 218726 - DNA, 24 bp, Artificial sequence
  SiRNA target sequence
atagttatatttttaattaaaaaa

SEQ ID NO: 218727 - DNA, 24 bp, Artificial sequence
  SiRNA target sequence
tagttatatttttaattaaaaaat

SEQ ID NO: 218728 - DNA, 24 bp, Artificial sequence
  SiRNA target sequence
agttatatttttaattaaaaaata

SEQ ID NO: 218729 - DNA, 24 bp, Artificial sequence
  SiRNA target sequence
gttatatttttaattaaaaaatat

SEQ ID NO: 218730 - DNA, 24 bp, Artificial sequence
  SiRNA target sequence
ttatatttttaattaaaaaatatt

SEQ ID NO: 218731 - DNA, 24 bp, Artificial sequence
  SiRNA target sequence
tatatttttaattaaaaaatattt

SEQ ID NO: 218732 - DNA, 24 bp, Artificial sequence
  SiRNA target sequence
atatttttaattaaaaaatatttg

SEQ ID NO: 218733 - DNA, 24 bp, Artificial sequence
  SiRNA target sequence
tatttttaattaaaaaatatttgg

SEQ ID NO: 218734 - DNA, 24 bp, Artificial sequence
  SiRNA target sequence
atttttaattaaaaaatatttgga

SEQ ID NO: 218735 - DNA, 24 bp, Artificial sequence
  SiRNA target sequence
tttttaattaaaaaatatttggag

SEQ ID NO: 218736 - DNA, 24 bp, Artificial sequence
  SiRNA target sequence
ttttaattaaaaaatatttggaga

SEQ ID NO: 218737 - DNA, 24 bp, Artificial sequence
  SiRNA target sequence
tttaattaaaaaatatttggagag

SEQ ID NO: 218738 - DNA, 24 bp, Artificial sequence
  SiRNA target sequence
ttaattaaaaaatatttggagagg

SEQ ID NO: 218739 - DNA, 24 bp, Artificial sequence
  SiRNA target sequence
taattaaaaaatatttggagagga

SEQ ID NO: 218740 - DNA, 24 bp, Artificial sequence
  SiRNA target sequence
aattaaaaaatatttggagaggaa

SEQ ID NO: 218741 - DNA, 24 bp, Artificial sequence
  SiRNA target sequence
attaaaaaatatttggagaggaat

SEQ ID NO: 218742 - DNA, 24 bp, Artificial sequence
  SiRNA target sequence
ttaaaaaatatttggagaggaatg

SEQ ID NO: 218743 - DNA, 24 bp, Artificial sequence
  SiRNA target sequence
taaaaaatatttggagaggaatgt

SEQ ID NO: 218744 - DNA, 24 bp, Artificial sequence
  SiRNA target sequence
aaaaaatatttggagaggaatgtg

SEQ ID NO: 218745 - DNA, 24 bp, Artificial sequence
  SiRNA target sequence
aaaaatatttggagaggaatgtga

SEQ ID NO: 218746 - DNA, 24 bp, Artificial sequence
  SiRNA target sequence
aaaatatttggagaggaatgtgac

SEQ ID NO: 218747 - DNA, 24 bp, Artificial sequence
  SiRNA target sequence
aaatatttggagaggaatgtgact

SEQ ID NO: 218748 - DNA, 24 bp, Artificial sequence
  SiRNA target sequence
aatatttggagaggaatgtgacta

SEQ ID NO: 218749 - DNA, 24 bp, Artificial sequence
  SiRNA target sequence
atatttggagaggaatgtgactaa

SEQ ID NO: 218750 - DNA, 24 bp, Artificial sequence
  SiRNA target sequence
tatttggagaggaatgtgactaac

SEQ ID NO: 218751 - DNA, 24 bp, Artificial sequence
  SiRNA target sequence
atttggagaggaatgtgactaaca

SEQ ID NO: 218752 - DNA, 24 bp, Artificial sequence
  SiRNA target sequence
tttggagaggaatgtgactaacaa

SEQ ID NO: 218753 - DNA, 24 bp, Artificial sequence
  SiRNA target sequence
ttggagaggaatgtgactaacaaa

SEQ ID NO: 218754 - DNA, 24 bp, Artificial sequence
  SiRNA target sequence
tggagaggaatgtgactaacaaac

SEQ ID NO: 218755 - DNA, 24 bp, Artificial sequence
  SiRNA target sequence
ggagaggaatgtgactaacaaacc

SEQ ID NO: 218756 - DNA, 24 bp, Artificial sequence
  SiRNA target sequence
gagaggaatgtgactaacaaacct

SEQ ID NO: 218757 - DNA, 24 bp, Artificial sequence
  SiRNA target sequence
agaggaatgtgactaacaaacctt

SEQ ID NO: 218758 - DNA, 24 bp, Artificial sequence
  SiRNA target sequence
gaggaatgtgactaacaaaccttt

SEQ ID NO: 218759 - DNA, 24 bp, Artificial sequence
  SiRNA target sequence
aggaatgtgactaacaaacctttg

SEQ ID NO: 218760 - DNA, 24 bp, Artificial sequence
  SiRNA target sequence
ggaatgtgactaacaaacctttgt

SEQ ID NO: 218761 - DNA, 24 bp, Artificial sequence
  SiRNA target sequence
gaatgtgactaacaaacctttgtt

SEQ ID NO: 218762 - DNA, 24 bp, Artificial sequence
  SiRNA target sequence
aatgtgactaacaaacctttgttt

SEQ ID NO: 218763 - DNA, 24 bp, Artificial sequence
  SiRNA target sequence
atgtgactaacaaacctttgtttg

SEQ ID NO: 218764 - DNA, 24 bp, Artificial sequence
  SiRNA target sequence
tgtgactaacaaacctttgtttgt

SEQ ID NO: 218765 - DNA, 24 bp, Artificial sequence
  SiRNA target sequence
gtgactaacaaacctttgtttgtt

SEQ ID NO: 218766 - DNA, 24 bp, Artificial sequence
  SiRNA target sequence
tgactaacaaacctttgtttgttg

SEQ ID NO: 218767 - DNA, 24 bp, Artificial sequence
  SiRNA target sequence
gactaacaaacctttgtttgttgt

SEQ ID NO: 218768 - DNA, 24 bp, Artificial sequence
  SiRNA target sequence
actaacaaacctttgtttgttgta

SEQ ID NO: 218769 - DNA, 24 bp, Artificial sequence
  SiRNA target sequence
ctaacaaacctttgtttgttgtaa

SEQ ID NO: 218770 - DNA, 24 bp, Artificial sequence
  SiRNA target sequence
taacaaacctttgtttgttgtaaa

SEQ ID NO: 218771 - DNA, 24 bp, Artificial sequence
  SiRNA target sequence
aacaaacctttgtttgttgtaaaa

SEQ ID NO: 218772 - DNA, 24 bp, Artificial sequence
  SiRNA target sequence
acaaacctttgtttgttgtaaaat

SEQ ID NO: 218773 - DNA, 24 bp, Artificial sequence
  SiRNA target sequence
caaacctttgtttgttgtaaaatc

SEQ ID NO: 218774 - DNA, 24 bp, Artificial sequence
  SiRNA target sequence
aaacctttgtttgttgtaaaatct

SEQ ID NO: 218775 - DNA, 24 bp, Artificial sequence
  SiRNA target sequence
aacctttgtttgttgtaaaatctg

SEQ ID NO: 218776 - DNA, 24 bp, Artificial sequence
  SiRNA target sequence
acctttgtttgttgtaaaatctgt

SEQ ID NO: 218777 - DNA, 24 bp, Artificial sequence
  SiRNA target sequence
cctttgtttgttgtaaaatctgtt

SEQ ID NO: 218778 - DNA, 24 bp, Artificial sequence
  SiRNA target sequence
ctttgtttgttgtaaaatctgtta

SEQ ID NO: 218779 - DNA, 24 bp, Artificial sequence
  SiRNA target sequence
tttgtttgttgtaaaatctgttaa

SEQ ID NO: 218780 - DNA, 24 bp, Artificial sequence
  SiRNA target sequence
ttgtttgttgtaaaatctgttaaa

SEQ ID NO: 218781 - DNA, 24 bp, Artificial sequence
  SiRNA target sequence
tgtttgttgtaaaatctgttaaaa

SEQ ID NO: 218782 - DNA, 24 bp, Artificial sequence
  SiRNA target sequence
gtttgttgtaaaatctgttaaaaa

SEQ ID NO: 218783 - DNA, 24 bp, Artificial sequence
  SiRNA target sequence
tttgttgtaaaatctgttaaaaag

SEQ ID NO: 218784 - DNA, 24 bp, Artificial sequence
  SiRNA target sequence
ttgttgtaaaatctgttaaaaaga

SEQ ID NO: 218785 - DNA, 24 bp, Artificial sequence
  SiRNA target sequence
tgttgtaaaatctgttaaaaagaa

SEQ ID NO: 218786 - DNA, 24 bp, Artificial sequence
  SiRNA target sequence
gttgtaaaatctgttaaaaagaag

SEQ ID NO: 218787 - DNA, 24 bp, Artificial sequence
  SiRNA target sequence
ttgtaaaatctgttaaaaagaagg

SEQ ID NO: 218788 - DNA, 24 bp, Artificial sequence
  SiRNA target sequence
tgtaaaatctgttaaaaagaaggg

SEQ ID NO: 218789 - DNA, 24 bp, Artificial sequence
  SiRNA target sequence
gtaaaatctgttaaaaagaaggga

SEQ ID NO: 218790 - DNA, 24 bp, Artificial sequence
  SiRNA target sequence
taaaatctgttaaaaagaagggac

SEQ ID NO: 218791 - DNA, 24 bp, Artificial sequence
  SiRNA target sequence
aaaatctgttaaaaagaagggacc

SEQ ID NO: 218792 - DNA, 24 bp, Artificial sequence
  SiRNA target sequence
aaatctgttaaaaagaagggacca

SEQ ID NO: 218793 - DNA, 24 bp, Artificial sequence
  SiRNA target sequence
aatctgttaaaaagaagggaccaa

SEQ ID NO: 218794 - DNA, 24 bp, Artificial sequence
  SiRNA target sequence
atctgttaaaaagaagggaccaaa

SEQ ID NO: 218795 - DNA, 24 bp, Artificial sequence
  SiRNA target sequence
tctgttaaaaagaagggaccaaaa

SEQ ID NO: 218796 - DNA, 24 bp, Artificial sequence
  SiRNA target sequence
ctgttaaaaagaagggaccaaaag

SEQ ID NO: 218797 - DNA, 24 bp, Artificial sequence
  SiRNA target sequence
tgttaaaaagaagggaccaaaagt

SEQ ID NO: 218798 - DNA, 24 bp, Artificial sequence
  SiRNA target sequence
gttaaaaagaagggaccaaaagtt

SEQ ID NO: 218799 - DNA, 24 bp, Artificial sequence
  SiRNA target sequence
ttaaaaagaagggaccaaaagtta

SEQ ID NO: 218800 - DNA, 24 bp, Artificial sequence
  SiRNA target sequence
taaaaagaagggaccaaaagttaa

SEQ ID NO: 218801 - DNA, 24 bp, Artificial sequence
  SiRNA target sequence
aaaaagaagggaccaaaagttaaa

SEQ ID NO: 218802 - DNA, 24 bp, Artificial sequence
  SiRNA target sequence
aaaagaagggaccaaaagttaaag

SEQ ID NO: 218803 - DNA, 24 bp, Artificial sequence
  SiRNA target sequence
aaagaagggaccaaaagttaaagt

SEQ ID NO: 218804 - DNA, 24 bp, Artificial sequence
  SiRNA target sequence
aagaagggaccaaaagttaaagta

SEQ ID NO: 218805 - DNA, 24 bp, Artificial sequence
  SiRNA target sequence
agaagggaccaaaagttaaagtag

SEQ ID NO: 218806 - DNA, 24 bp, Artificial sequence
  SiRNA target sequence
gaagggaccaaaagttaaagtagg

SEQ ID NO: 218807 - DNA, 24 bp, Artificial sequence
  SiRNA target sequence
aagggaccaaaagttaaagtagga

SEQ ID NO: 218808 - DNA, 24 bp, Artificial sequence
  SiRNA target sequence
agggaccaaaagttaaagtaggat

SEQ ID NO: 218809 - DNA, 24 bp, Artificial sequence
  SiRNA target sequence
gggaccaaaagttaaagtaggatt

SEQ ID NO: 218810 - DNA, 24 bp, Artificial sequence
  SiRNA target sequence
ggaccaaaagttaaagtaggattt

SEQ ID NO: 218811 - DNA, 24 bp, Artificial sequence
  SiRNA target sequence
gaccaaaagttaaagtaggatttg

SEQ ID NO: 218812 - DNA, 24 bp, Artificial sequence
  SiRNA target sequence
accaaaagttaaagtaggatttgc

SEQ ID NO: 218813 - DNA, 24 bp, Artificial sequence
  SiRNA target sequence
ccaaaagttaaagtaggatttgcg

SEQ ID NO: 218814 - DNA, 24 bp, Artificial sequence
  SiRNA target sequence
caaaagttaaagtaggatttgcgg

SEQ ID NO: 218815 - DNA, 24 bp, Artificial sequence
  SiRNA target sequence
aaaagttaaagtaggatttgcgga

SEQ ID NO: 218816 - DNA, 24 bp, Artificial sequence
  SiRNA target sequence
aaagttaaagtaggatttgcggag

SEQ ID NO: 218817 - DNA, 24 bp, Artificial sequence
  SiRNA target sequence
aagttaaagtaggatttgcggagg

SEQ ID NO: 218818 - DNA, 24 bp, Artificial sequence
  SiRNA target sequence
agttaaagtaggatttgcggaggg

SEQ ID NO: 218819 - DNA, 24 bp, Artificial sequence
  SiRNA target sequence
gttaaagtaggatttgcggagggc

SEQ ID NO: 218820 - DNA, 24 bp, Artificial sequence
  SiRNA target sequence
ttaaagtaggatttgcggagggcc

SEQ ID NO: 218821 - DNA, 24 bp, Artificial sequence
  SiRNA target sequence
taaagtaggatttgcggagggcct

SEQ ID NO: 218822 - DNA, 24 bp, Artificial sequence
  SiRNA target sequence
aaagtaggatttgcggagggcctt

SEQ ID NO: 218823 - DNA, 24 bp, Artificial sequence
  SiRNA target sequence
aagtaggatttgcggagggcctta

SEQ ID NO: 218824 - DNA, 24 bp, Artificial sequence
  SiRNA target sequence
agtaggatttgcggagggccttaa

SEQ ID NO: 218825 - DNA, 24 bp, Artificial sequence
  SiRNA target sequence
gtaggatttgcggagggccttaaa

SEQ ID NO: 218826 - DNA, 24 bp, Artificial sequence
  SiRNA target sequence
taggatttgcggagggccttaaag

SEQ ID NO: 218827 - DNA, 24 bp, Artificial sequence
  SiRNA target sequence
aggatttgcggagggccttaaaga

SEQ ID NO: 218828 - DNA, 24 bp, Artificial sequence
  SiRNA target sequence
ggatttgcggagggccttaaagaa

SEQ ID NO: 218829 - DNA, 24 bp, Artificial sequence
  SiRNA target sequence
gatttgcggagggccttaaagaaa

SEQ ID NO: 218830 - DNA, 24 bp, Artificial sequence
  SiRNA target sequence
atttgcggagggccttaaagaaat

SEQ ID NO: 218831 - DNA, 24 bp, Artificial sequence
  SiRNA target sequence
tttgcggagggccttaaagaaatg

SEQ ID NO: 218832 - DNA, 24 bp, Artificial sequence
  SiRNA target sequence
ttgcggagggccttaaagaaatga

SEQ ID NO: 218833 - DNA, 24 bp, Artificial sequence
  SiRNA target sequence
tgcggagggccttaaagaaatgat

SEQ ID NO: 218834 - DNA, 24 bp, Artificial sequence
  SiRNA target sequence
gcggagggccttaaagaaatgatg

SEQ ID NO: 218835 - DNA, 24 bp, Artificial sequence
  SiRNA target sequence
cggagggccttaaagaaatgatgg

SEQ ID NO: 218836 - DNA, 24 bp, Artificial sequence
  SiRNA target sequence
ggagggccttaaagaaatgatggc

SEQ ID NO: 218837 - DNA, 24 bp, Artificial sequence
  SiRNA target sequence
gagggccttaaagaaatgatggca

SEQ ID NO: 218838 - DNA, 24 bp, Artificial sequence
  SiRNA target sequence
agggccttaaagaaatgatggcat

SEQ ID NO: 218839 - DNA, 24 bp, Artificial sequence
  SiRNA target sequence
gggccttaaagaaatgatggcatc

SEQ ID NO: 218840 - DNA, 24 bp, Artificial sequence
  SiRNA target sequence
ggccttaaagaaatgatggcatca

SEQ ID NO: 218841 - DNA, 24 bp, Artificial sequence
  SiRNA target sequence
gccttaaagaaatgatggcatcaa

SEQ ID NO: 218842 - DNA, 24 bp, Artificial sequence
  SiRNA target sequence
ccttaaagaaatgatggcatcaaa

SEQ ID NO: 218843 - DNA, 24 bp, Artificial sequence
  SiRNA target sequence
cttaaagaaatgatggcatcaaag

SEQ ID NO: 218844 - DNA, 24 bp, Artificial sequence
  SiRNA target sequence
ttaaagaaatgatggcatcaaagt

SEQ ID NO: 218845 - DNA, 24 bp, Artificial sequence
  SiRNA target sequence
taaagaaatgatggcatcaaagtt

SEQ ID NO: 218846 - DNA, 24 bp, Artificial sequence
  SiRNA target sequence
aaagaaatgatggcatcaaagtta

SEQ ID NO: 218847 - DNA, 24 bp, Artificial sequence
  SiRNA target sequence
aagaaatgatggcatcaaagttat

SEQ ID NO: 218848 - DNA, 24 bp, Artificial sequence
  SiRNA target sequence
agaaatgatggcatcaaagttatt

SEQ ID NO: 218849 - DNA, 24 bp, Artificial sequence
  SiRNA target sequence
gaaatgatggcatcaaagttatta

SEQ ID NO: 218850 - DNA, 24 bp, Artificial sequence
  SiRNA target sequence
aaatgatggcatcaaagttattac

SEQ ID NO: 218851 - DNA, 24 bp, Artificial sequence
  SiRNA target sequence
aatgatggcatcaaagttattact

SEQ ID NO: 218852 - DNA, 24 bp, Artificial sequence
  SiRNA target sequence
atgatggcatcaaagttattactt

SEQ ID NO: 218853 - DNA, 24 bp, Artificial sequence
  SiRNA target sequence
tgatggcatcaaagttattactta

SEQ ID NO: 218854 - DNA, 24 bp, Artificial sequence
  SiRNA target sequence
gatggcatcaaagttattacttaa

SEQ ID NO: 218855 - DNA, 24 bp, Artificial sequence
  SiRNA target sequence
atggcatcaaagttattacttaac

SEQ ID NO: 218856 - DNA, 24 bp, Artificial sequence
  SiRNA target sequence
tggcatcaaagttattacttaaca

SEQ ID NO: 218857 - DNA, 24 bp, Artificial sequence
  SiRNA target sequence
ggcatcaaagttattacttaacat

SEQ ID NO: 218858 - DNA, 24 bp, Artificial sequence
  SiRNA target sequence
gcatcaaagttattacttaacatt

SEQ ID NO: 218859 - DNA, 24 bp, Artificial sequence
  SiRNA target sequence
catcaaagttattacttaacattt

SEQ ID NO: 218860 - DNA, 24 bp, Artificial sequence
  SiRNA target sequence
atcaaagttattacttaacatttc

SEQ ID NO: 218861 - DNA, 24 bp, Artificial sequence
  SiRNA target sequence
tcaaagttattacttaacatttca

SEQ ID NO: 218862 - DNA, 24 bp, Artificial sequence
  SiRNA target sequence
caaagttattacttaacatttcat

SEQ ID NO: 218863 - DNA, 24 bp, Artificial sequence
  SiRNA target sequence
aaagttattacttaacatttcatt

SEQ ID NO: 218864 - DNA, 24 bp, Artificial sequence
  SiRNA target sequence
aagttattacttaacatttcatta

SEQ ID NO: 218865 - DNA, 24 bp, Artificial sequence
  SiRNA target sequence
agttattacttaacatttcattaa

SEQ ID NO: 218866 - DNA, 24 bp, Artificial sequence
  SiRNA target sequence
gttattacttaacatttcattaac

SEQ ID NO: 218867 - DNA, 24 bp, Artificial sequence
  SiRNA target sequence
ttattacttaacatttcattaact

SEQ ID NO: 218868 - DNA, 24 bp, Artificial sequence
  SiRNA target sequence
tattacttaacatttcattaactg

SEQ ID NO: 218869 - DNA, 24 bp, Artificial sequence
  SiRNA target sequence
attacttaacatttcattaactgt

SEQ ID NO: 218870 - DNA, 24 bp, Artificial sequence
  SiRNA target sequence
ttacttaacatttcattaactgtt

SEQ ID NO: 218871 - DNA, 24 bp, Artificial sequence
  SiRNA target sequence
tacttaacatttcattaactgtta

SEQ ID NO: 218872 - DNA, 24 bp, Artificial sequence
  SiRNA target sequence
acttaacatttcattaactgttat

SEQ ID NO: 218873 - DNA, 24 bp, Artificial sequence
  SiRNA target sequence
cttaacatttcattaactgttatg

SEQ ID NO: 218874 - DNA, 24 bp, Artificial sequence
  SiRNA target sequence
ttaacatttcattaactgttatgt

SEQ ID NO: 218875 - DNA, 24 bp, Artificial sequence
  SiRNA target sequence
taacatttcattaactgttatgtt

SEQ ID NO: 218876 - DNA, 24 bp, Artificial sequence
  SiRNA target sequence
aacatttcattaactgttatgttc

SEQ ID NO: 218877 - DNA, 24 bp, Artificial sequence
  SiRNA target sequence
acatttcattaactgttatgttct

SEQ ID NO: 218878 - DNA, 24 bp, Artificial sequence
  SiRNA target sequence
catttcattaactgttatgttcta

SEQ ID NO: 218879 - DNA, 24 bp, Artificial sequence
  SiRNA target sequence
atttcattaactgttatgttctat

SEQ ID NO: 218880 - DNA, 24 bp, Artificial sequence
  SiRNA target sequence
tttcattaactgttatgttctatg

SEQ ID NO: 218881 - DNA, 24 bp, Artificial sequence
  SiRNA target sequence
ttcattaactgttatgttctatgg

SEQ ID NO: 218882 - DNA, 24 bp, Artificial sequence
  SiRNA target sequence
tcattaactgttatgttctatggt

SEQ ID NO: 218883 - DNA, 24 bp, Artificial sequence
  SiRNA target sequence
cattaactgttatgttctatggta

SEQ ID NO: 218884 - DNA, 24 bp, Artificial sequence
  SiRNA target sequence
attaactgttatgttctatggtat

SEQ ID NO: 218885 - DNA, 24 bp, Artificial sequence
  SiRNA target sequence
ttaactgttatgttctatggtata

SEQ ID NO: 218886 - DNA, 24 bp, Artificial sequence
  SiRNA target sequence
taactgttatgttctatggtatat

SEQ ID NO: 218887 - DNA, 24 bp, Artificial sequence
  SiRNA target sequence
aactgttatgttctatggtatatc

SEQ ID NO: 218888 - DNA, 24 bp, Artificial sequence
  SiRNA target sequence
actgttatgttctatggtatatca

SEQ ID NO: 218889 - DNA, 24 bp, Artificial sequence
  SiRNA target sequence
ctgttatgttctatggtatatcaa

SEQ ID NO: 218890 - DNA, 24 bp, Artificial sequence
  SiRNA target sequence
tgttatgttctatggtatatcaac

SEQ ID NO: 218891 - DNA, 24 bp, Artificial sequence
  SiRNA target sequence
gttatgttctatggtatatcaact

SEQ ID NO: 218892 - DNA, 24 bp, Artificial sequence
  SiRNA target sequence
ttatgttctatggtatatcaacta

SEQ ID NO: 218893 - DNA, 24 bp, Artificial sequence
  SiRNA target sequence
tatgttctatggtatatcaactaa

SEQ ID NO: 218894 - DNA, 24 bp, Artificial sequence
  SiRNA target sequence
atgttctatggtatatcaactaat

SEQ ID NO: 218895 - DNA, 24 bp, Artificial sequence
  SiRNA target sequence
tgttctatggtatatcaactaatt

SEQ ID NO: 218896 - DNA, 24 bp, Artificial sequence
  SiRNA target sequence
gttctatggtatatcaactaattt

SEQ ID NO: 218897 - DNA, 24 bp, Artificial sequence
  SiRNA target sequence
ttctatggtatatcaactaattta

SEQ ID NO: 218898 - DNA, 24 bp, Artificial sequence
  SiRNA target sequence
tctatggtatatcaactaatttaa

SEQ ID NO: 218899 - DNA, 24 bp, Artificial sequence
  SiRNA target sequence
ctatggtatatcaactaatttaat

SEQ ID NO: 218900 - DNA, 24 bp, Artificial sequence
  SiRNA target sequence
tatggtatatcaactaatttaata

SEQ ID NO: 218901 - DNA, 24 bp, Artificial sequence
  SiRNA target sequence
atggtatatcaactaatttaatag

SEQ ID NO: 218902 - DNA, 24 bp, Artificial sequence
  SiRNA target sequence
tggtatatcaactaatttaataga

SEQ ID NO: 218903 - DNA, 24 bp, Artificial sequence
  SiRNA target sequence
ggtatatcaactaatttaatagaa

SEQ ID NO: 218904 - DNA, 24 bp, Artificial sequence
  SiRNA target sequence
gtatatcaactaatttaatagaat

SEQ ID NO: 218905 - DNA, 24 bp, Artificial sequence
  SiRNA target sequence
tatatcaactaatttaatagaatc

SEQ ID NO: 218906 - DNA, 24 bp, Artificial sequence
  SiRNA target sequence
atatcaactaatttaatagaatca

SEQ ID NO: 218907 - DNA, 24 bp, Artificial sequence
  SiRNA target sequence
tatcaactaatttaatagaatcaa

SEQ ID NO: 218908 - DNA, 24 bp, Artificial sequence
  SiRNA target sequence
atcaactaatttaatagaatcaac

SEQ ID NO: 218909 - DNA, 24 bp, Artificial sequence
  SiRNA target sequence
tcaactaatttaatagaatcaaca

SEQ ID NO: 218910 - DNA, 24 bp, Artificial sequence
  SiRNA target sequence
caactaatttaatagaatcaacat

SEQ ID NO: 218911 - DNA, 24 bp, Artificial sequence
  SiRNA target sequence
aactaatttaatagaatcaacatt

SEQ ID NO: 218912 - DNA, 24 bp, Artificial sequence
  SiRNA target sequence
actaatttaatagaatcaacattt

SEQ ID NO: 218913 - DNA, 24 bp, Artificial sequence
  SiRNA target sequence
ctaatttaatagaatcaacattta

SEQ ID NO: 218914 - DNA, 24 bp, Artificial sequence
  SiRNA target sequence
taatttaatagaatcaacatttaa

SEQ ID NO: 218915 - DNA, 24 bp, Artificial sequence
  SiRNA target sequence
aatttaatagaatcaacatttaaa

SEQ ID NO: 218916 - DNA, 24 bp, Artificial sequence
  SiRNA target sequence
atttaatagaatcaacatttaaaa

SEQ ID NO: 218917 - DNA, 24 bp, Artificial sequence
  SiRNA target sequence
tttaatagaatcaacatttaaaag

SEQ ID NO: 218918 - DNA, 24 bp, Artificial sequence
  SiRNA target sequence
ttaatagaatcaacatttaaaagt

SEQ ID NO: 218919 - DNA, 24 bp, Artificial sequence
  SiRNA target sequence
taatagaatcaacatttaaaagtg

SEQ ID NO: 218920 - DNA, 24 bp, Artificial sequence
  SiRNA target sequence
aatagaatcaacatttaaaagtgg

SEQ ID NO: 218921 - DNA, 24 bp, Artificial sequence
  SiRNA target sequence
atagaatcaacatttaaaagtgga

SEQ ID NO: 218922 - DNA, 24 bp, Artificial sequence
  SiRNA target sequence
tagaatcaacatttaaaagtggac

SEQ ID NO: 218923 - DNA, 24 bp, Artificial sequence
  SiRNA target sequence
agaatcaacatttaaaagtggact

SEQ ID NO: 218924 - DNA, 24 bp, Artificial sequence
  SiRNA target sequence
gaatcaacatttaaaagtggactt

SEQ ID NO: 218925 - DNA, 24 bp, Artificial sequence
  SiRNA target sequence
aatcaacatttaaaagtggacttg

SEQ ID NO: 218926 - DNA, 24 bp, Artificial sequence
  SiRNA target sequence
atcaacatttaaaagtggacttgt

SEQ ID NO: 218927 - DNA, 24 bp, Artificial sequence
  SiRNA target sequence
tcaacatttaaaagtggacttgtg

SEQ ID NO: 218928 - DNA, 24 bp, Artificial sequence
  SiRNA target sequence
caacatttaaaagtggacttgtga

SEQ ID NO: 218929 - DNA, 24 bp, Artificial sequence
  SiRNA target sequence
aacatttaaaagtggacttgtgaa

SEQ ID NO: 218930 - DNA, 24 bp, Artificial sequence
  SiRNA target sequence
acatttaaaagtggacttgtgaaa

SEQ ID NO: 218931 - DNA, 24 bp, Artificial sequence
  SiRNA target sequence
catttaaaagtggacttgtgaaag

SEQ ID NO: 218932 - DNA, 24 bp, Artificial sequence
  SiRNA target sequence
atttaaaagtggacttgtgaaagg

SEQ ID NO: 218933 - DNA, 24 bp, Artificial sequence
  SiRNA target sequence
tttaaaagtggacttgtgaaaggt

SEQ ID NO: 218934 - DNA, 24 bp, Artificial sequence
  SiRNA target sequence
ttaaaagtggacttgtgaaaggtg

SEQ ID NO: 218935 - DNA, 24 bp, Artificial sequence
  SiRNA target sequence
taaaagtggacttgtgaaaggtgc

SEQ ID NO: 218936 - DNA, 24 bp, Artificial sequence
  SiRNA target sequence
aaaagtggacttgtgaaaggtgca

SEQ ID NO: 218937 - DNA, 24 bp, Artificial sequence
  SiRNA target sequence
aaagtggacttgtgaaaggtgcag

SEQ ID NO: 218938 - DNA, 24 bp, Artificial sequence
  SiRNA target sequence
aagtggacttgtgaaaggtgcaga

SEQ ID NO: 218939 - DNA, 24 bp, Artificial sequence
  SiRNA target sequence
agtggacttgtgaaaggtgcagaa

SEQ ID NO: 218940 - DNA, 24 bp, Artificial sequence
  SiRNA target sequence
gtggacttgtgaaaggtgcagaag

SEQ ID NO: 218941 - DNA, 24 bp, Artificial sequence
  SiRNA target sequence
tggacttgtgaaaggtgcagaaga

SEQ ID NO: 218942 - DNA, 24 bp, Artificial sequence
  SiRNA target sequence
ggacttgtgaaaggtgcagaagaa

SEQ ID NO: 218943 - DNA, 24 bp, Artificial sequence
  SiRNA target sequence
gacttgtgaaaggtgcagaagaat

SEQ ID NO: 218944 - DNA, 24 bp, Artificial sequence
  SiRNA target sequence
acttgtgaaaggtgcagaagaatt

SEQ ID NO: 218945 - DNA, 24 bp, Artificial sequence
  SiRNA target sequence
cttgtgaaaggtgcagaagaatta

SEQ ID NO: 218946 - DNA, 24 bp, Artificial sequence
  SiRNA target sequence
ttgtgaaaggtgcagaagaattaa

SEQ ID NO: 218947 - DNA, 24 bp, Artificial sequence
  SiRNA target sequence
tgtgaaaggtgcagaagaattaaa

SEQ ID NO: 218948 - DNA, 24 bp, Artificial sequence
  SiRNA target sequence
gtgaaaggtgcagaagaattaaac

SEQ ID NO: 218949 - DNA, 24 bp, Artificial sequence
  SiRNA target sequence
tgaaaggtgcagaagaattaaacg

SEQ ID NO: 218950 - DNA, 24 bp, Artificial sequence
  SiRNA target sequence
gaaaggtgcagaagaattaaacga

SEQ ID NO: 218951 - DNA, 24 bp, Artificial sequence
  SiRNA target sequence
aaaggtgcagaagaattaaacgag

SEQ ID NO: 218952 - DNA, 24 bp, Artificial sequence
  SiRNA target sequence
aaggtgcagaagaattaaacgaga

SEQ ID NO: 218953 - DNA, 24 bp, Artificial sequence
  SiRNA target sequence
aggtgcagaagaattaaacgagaa

SEQ ID NO: 218954 - DNA, 24 bp, Artificial sequence
  SiRNA target sequence
ggtgcagaagaattaaacgagaat

SEQ ID NO: 218955 - DNA, 24 bp, Artificial sequence
  SiRNA target sequence
gtgcagaagaattaaacgagaata

SEQ ID NO: 218956 - DNA, 24 bp, Artificial sequence
  SiRNA target sequence
tgcagaagaattaaacgagaatac

SEQ ID NO: 218957 - DNA, 24 bp, Artificial sequence
  SiRNA target sequence
gcagaagaattaaacgagaatact

SEQ ID NO: 218958 - DNA, 24 bp, Artificial sequence
  SiRNA target sequence
cagaagaattaaacgagaatacta

SEQ ID NO: 218959 - DNA, 24 bp, Artificial sequence
  SiRNA target sequence
agaagaattaaacgagaatactaa

SEQ ID NO: 218960 - DNA, 24 bp, Artificial sequence
  SiRNA target sequence
gaagaattaaacgagaatactaaa

SEQ ID NO: 218961 - DNA, 24 bp, Artificial sequence
  SiRNA target sequence
aagaattaaacgagaatactaaaa

SEQ ID NO: 218962 - DNA, 24 bp, Artificial sequence
  SiRNA target sequence
agaattaaacgagaatactaaaag

SEQ ID NO: 218963 - DNA, 24 bp, Artificial sequence
  SiRNA target sequence
gaattaaacgagaatactaaaagt

SEQ ID NO: 218964 - DNA, 24 bp, Artificial sequence
  SiRNA target sequence
aattaaacgagaatactaaaagtt

SEQ ID NO: 218965 - DNA, 24 bp, Artificial sequence
  SiRNA target sequence
attaaacgagaatactaaaagtta

SEQ ID NO: 218966 - DNA, 24 bp, Artificial sequence
  SiRNA target sequence
ttaaacgagaatactaaaagttat

SEQ ID NO: 218967 - DNA, 24 bp, Artificial sequence
  SiRNA target sequence
taaacgagaatactaaaagttatt

SEQ ID NO: 218968 - DNA, 24 bp, Artificial sequence
  SiRNA target sequence
aaacgagaatactaaaagttattc

SEQ ID NO: 218969 - DNA, 24 bp, Artificial sequence
  SiRNA target sequence
aacgagaatactaaaagttattct

SEQ ID NO: 218970 - DNA, 24 bp, Artificial sequence
  SiRNA target sequence
acgagaatactaaaagttattcta

SEQ ID NO: 218971 - DNA, 24 bp, Artificial sequence
  SiRNA target sequence
cgagaatactaaaagttattctat

SEQ ID NO: 218972 - DNA, 24 bp, Artificial sequence
  SiRNA target sequence
gagaatactaaaagttattctatg

SEQ ID NO: 218973 - DNA, 24 bp, Artificial sequence
  SiRNA target sequence
agaatactaaaagttattctatgg

SEQ ID NO: 218974 - DNA, 24 bp, Artificial sequence
  SiRNA target sequence
gaatactaaaagttattctatggg

SEQ ID NO: 218975 - DNA, 24 bp, Artificial sequence
  SiRNA target sequence
aatactaaaagttattctatggga

SEQ ID NO: 218976 - DNA, 24 bp, Artificial sequence
  SiRNA target sequence
atactaaaagttattctatgggat

SEQ ID NO: 218977 - DNA, 24 bp, Artificial sequence
  SiRNA target sequence
tactaaaagttattctatgggata

SEQ ID NO: 218978 - DNA, 24 bp, Artificial sequence
  SiRNA target sequence
actaaaagttattctatgggatat

SEQ ID NO: 218979 - DNA, 24 bp, Artificial sequence
  SiRNA target sequence
ctaaaagttattctatgggatata

SEQ ID NO: 218980 - DNA, 24 bp, Artificial sequence
  SiRNA target sequence
taaaagttattctatgggatataa

SEQ ID NO: 218981 - DNA, 24 bp, Artificial sequence
  SiRNA target sequence
aaaagttattctatgggatataat

SEQ ID NO: 218982 - DNA, 24 bp, Artificial sequence
  SiRNA target sequence
aaagttattctatgggatataatt

SEQ ID NO: 218983 - DNA, 24 bp, Artificial sequence
  SiRNA target sequence
aagttattctatgggatataattc

SEQ ID NO: 218984 - DNA, 24 bp, Artificial sequence
  SiRNA target sequence
agttattctatgggatataattca

SEQ ID NO: 218985 - DNA, 24 bp, Artificial sequence
  SiRNA target sequence
gttattctatgggatataattcat

SEQ ID NO: 218986 - DNA, 24 bp, Artificial sequence
  SiRNA target sequence
ttattctatgggatataattcatt

SEQ ID NO: 218987 - DNA, 24 bp, Artificial sequence
  SiRNA target sequence
tattctatgggatataattcattt

SEQ ID NO: 218988 - DNA, 24 bp, Artificial sequence
  SiRNA target sequence
attctatgggatataattcatttg

SEQ ID NO: 218989 - DNA, 24 bp, Artificial sequence
  SiRNA target sequence
ttctatgggatataattcatttga

SEQ ID NO: 218990 - DNA, 24 bp, Artificial sequence
  SiRNA target sequence
tctatgggatataattcatttgaa

SEQ ID NO: 218991 - DNA, 24 bp, Artificial sequence
  SiRNA target sequence
ctatgggatataattcatttgaac

SEQ ID NO: 218992 - DNA, 24 bp, Artificial sequence
  SiRNA target sequence
tatgggatataattcatttgaaca

SEQ ID NO: 218993 - DNA, 24 bp, Artificial sequence
  SiRNA target sequence
atgggatataattcatttgaacaa

SEQ ID NO: 218994 - DNA, 24 bp, Artificial sequence
  SiRNA target sequence
tgggatataattcatttgaacaaa

SEQ ID NO: 218995 - DNA, 24 bp, Artificial sequence
  SiRNA target sequence
gggatataattcatttgaacaaaa

SEQ ID NO: 218996 - DNA, 24 bp, Artificial sequence
  SiRNA target sequence
ggatataattcatttgaacaaaag

SEQ ID NO: 218997 - DNA, 24 bp, Artificial sequence
  SiRNA target sequence
gatataattcatttgaacaaaaga

SEQ ID NO: 218998 - DNA, 24 bp, Artificial sequence
  SiRNA target sequence
atataattcatttgaacaaaagat

SEQ ID NO: 218999 - DNA, 24 bp, Artificial sequence
  SiRNA target sequence
tataattcatttgaacaaaagata

SEQ ID NO: 219000 - DNA, 24 bp, Artificial sequence
  SiRNA target sequence
ataattcatttgaacaaaagatag

SEQ ID NO: 219001 - DNA, 24 bp, Artificial sequence
  SiRNA target sequence
taattcatttgaacaaaagatagc

SEQ ID NO: 219002 - DNA, 24 bp, Artificial sequence
  SiRNA target sequence
aattcatttgaacaaaagatagca

SEQ ID NO: 219003 - DNA, 24 bp, Artificial sequence
  SiRNA target sequence
attcatttgaacaaaagatagcat

SEQ ID NO: 219004 - DNA, 24 bp, Artificial sequence
  SiRNA target sequence
ttcatttgaacaaaagatagcatc

SEQ ID NO: 219005 - DNA, 24 bp, Artificial sequence
  SiRNA target sequence
tcatttgaacaaaagatagcatca

SEQ ID NO: 219006 - DNA, 24 bp, Artificial sequence
  SiRNA target sequence
catttgaacaaaagatagcatcaa

SEQ ID NO: 219007 - DNA, 24 bp, Artificial sequence
  SiRNA target sequence
atttgaacaaaagatagcatcaat

SEQ ID NO: 219008 - DNA, 24 bp, Artificial sequence
  SiRNA target sequence
tttgaacaaaagatagcatcaata

SEQ ID NO: 219009 - DNA, 24 bp, Artificial sequence
  SiRNA target sequence
ttgaacaaaagatagcatcaataa

SEQ ID NO: 219010 - DNA, 24 bp, Artificial sequence
  SiRNA target sequence
tgaacaaaagatagcatcaataac

SEQ ID NO: 219011 - DNA, 24 bp, Artificial sequence
  SiRNA target sequence
gaacaaaagatagcatcaataact

SEQ ID NO: 219012 - DNA, 24 bp, Artificial sequence
  SiRNA target sequence
aacaaaagatagcatcaataactg

SEQ ID NO: 219013 - DNA, 24 bp, Artificial sequence
  SiRNA target sequence
acaaaagatagcatcaataactgt

SEQ ID NO: 219014 - DNA, 24 bp, Artificial sequence
  SiRNA target sequence
caaaagatagcatcaataactgtt

SEQ ID NO: 219015 - DNA, 24 bp, Artificial sequence
  SiRNA target sequence
aaaagatagcatcaataactgtta

SEQ ID NO: 219016 - DNA, 24 bp, Artificial sequence
  SiRNA target sequence
aaagatagcatcaataactgttat

SEQ ID NO: 219017 - DNA, 24 bp, Artificial sequence
  SiRNA target sequence
aagatagcatcaataactgttatt

SEQ ID NO: 219018 - DNA, 24 bp, Artificial sequence
  SiRNA target sequence
agatagcatcaataactgttatta

SEQ ID NO: 219019 - DNA, 24 bp, Artificial sequence
  SiRNA target sequence
gatagcatcaataactgttattat

SEQ ID NO: 219020 - DNA, 24 bp, Artificial sequence
  SiRNA target sequence
atagcatcaataactgttattatc

SEQ ID NO: 219021 - DNA, 24 bp, Artificial sequence
  SiRNA target sequence
tagcatcaataactgttattatcc

SEQ ID NO: 219022 - DNA, 24 bp, Artificial sequence
  SiRNA target sequence
agcatcaataactgttattatcct

SEQ ID NO: 219023 - DNA, 24 bp, Artificial sequence
  SiRNA target sequence
gcatcaataactgttattatcctg

SEQ ID NO: 219024 - DNA, 24 bp, Artificial sequence
  SiRNA target sequence
catcaataactgttattatcctgc

SEQ ID NO: 219025 - DNA, 24 bp, Artificial sequence
  SiRNA target sequence
atcaataactgttattatcctgct

SEQ ID NO: 219026 - DNA, 24 bp, Artificial sequence
  SiRNA target sequence
tcaataactgttattatcctgctt

SEQ ID NO: 219027 - DNA, 24 bp, Artificial sequence
  SiRNA target sequence
caataactgttattatcctgcttt

SEQ ID NO: 219028 - DNA, 24 bp, Artificial sequence
  SiRNA target sequence
aataactgttattatcctgctttt

SEQ ID NO: 219029 - DNA, 24 bp, Artificial sequence
  SiRNA target sequence
ataactgttattatcctgctttta

SEQ ID NO: 219030 - DNA, 24 bp, Artificial sequence
  SiRNA target sequence
taactgttattatcctgcttttat

SEQ ID NO: 219031 - DNA, 24 bp, Artificial sequence
  SiRNA target sequence
aactgttattatcctgcttttatc

SEQ ID NO: 219032 - DNA, 24 bp, Artificial sequence
  SiRNA target sequence
actgttattatcctgcttttatca

SEQ ID NO: 219033 - DNA, 24 bp, Artificial sequence
  SiRNA target sequence
ctgttattatcctgcttttatcac

SEQ ID NO: 219034 - DNA, 24 bp, Artificial sequence
  SiRNA target sequence
tgttattatcctgcttttatcacc

SEQ ID NO: 219035 - DNA, 24 bp, Artificial sequence
  SiRNA target sequence
gttattatcctgcttttatcacca

SEQ ID NO: 219036 - DNA, 24 bp, Artificial sequence
  SiRNA target sequence
ttattatcctgcttttatcaccat

SEQ ID NO: 219037 - DNA, 24 bp, Artificial sequence
  SiRNA target sequence
tattatcctgcttttatcaccatt

SEQ ID NO: 219038 - DNA, 24 bp, Artificial sequence
  SiRNA target sequence
attatcctgcttttatcaccattt

SEQ ID NO: 219039 - DNA, 24 bp, Artificial sequence
  SiRNA target sequence
ttatcctgcttttatcaccatttc

SEQ ID NO: 219040 - DNA, 24 bp, Artificial sequence
  SiRNA target sequence
tatcctgcttttatcaccatttcc

SEQ ID NO: 219041 - DNA, 24 bp, Artificial sequence
  SiRNA target sequence
atcctgcttttatcaccatttcca

SEQ ID NO: 219042 - DNA, 24 bp, Artificial sequence
  SiRNA target sequence
tcctgcttttatcaccatttccaa

SEQ ID NO: 219043 - DNA, 24 bp, Artificial sequence
  SiRNA target sequence
cctgcttttatcaccatttccaaa

SEQ ID NO: 219044 - DNA, 24 bp, Artificial sequence
  SiRNA target sequence
ctgcttttatcaccatttccaaaa

SEQ ID NO: 219045 - DNA, 24 bp, Artificial sequence
  SiRNA target sequence
tgcttttatcaccatttccaaaat

SEQ ID NO: 219046 - DNA, 24 bp, Artificial sequence
  SiRNA target sequence
gcttttatcaccatttccaaaatt

SEQ ID NO: 219047 - DNA, 24 bp, Artificial sequence
  SiRNA target sequence
cttttatcaccatttccaaaatta

SEQ ID NO: 219048 - DNA, 24 bp, Artificial sequence
  SiRNA target sequence
ttttatcaccatttccaaaattaa

SEQ ID NO: 219049 - DNA, 24 bp, Artificial sequence
  SiRNA target sequence
tttatcaccatttccaaaattaat

SEQ ID NO: 219050 - DNA, 24 bp, Artificial sequence
  SiRNA target sequence
ttatcaccatttccaaaattaata

SEQ ID NO: 219051 - DNA, 24 bp, Artificial sequence
  SiRNA target sequence
tatcaccatttccaaaattaatac

SEQ ID NO: 219052 - DNA, 24 bp, Artificial sequence
  SiRNA target sequence
atcaccatttccaaaattaataca

SEQ ID NO: 219053 - DNA, 24 bp, Artificial sequence
  SiRNA target sequence
tcaccatttccaaaattaatacaa

SEQ ID NO: 219054 - DNA, 24 bp, Artificial sequence
  SiRNA target sequence
caccatttccaaaattaatacaaa

SEQ ID NO: 219055 - DNA, 24 bp, Artificial sequence
  SiRNA target sequence
accatttccaaaattaatacaaac

SEQ ID NO: 219056 - DNA, 24 bp, Artificial sequence
  SiRNA target sequence
ccatttccaaaattaatacaaacc

SEQ ID NO: 219057 - DNA, 24 bp, Artificial sequence
  SiRNA target sequence
catttccaaaattaatacaaacca

SEQ ID NO: 219058 - DNA, 24 bp, Artificial sequence
  SiRNA target sequence
atttccaaaattaatacaaaccaa

SEQ ID NO: 219059 - DNA, 24 bp, Artificial sequence
  SiRNA target sequence
tttccaaaattaatacaaaccaaa

SEQ ID NO: 219060 - DNA, 24 bp, Artificial sequence
  SiRNA target sequence
ttccaaaattaatacaaaccaaag

SEQ ID NO: 219061 - DNA, 24 bp, Artificial sequence
  SiRNA target sequence
tccaaaattaatacaaaccaaagg

SEQ ID NO: 219062 - DNA, 24 bp, Artificial sequence
  SiRNA target sequence
ccaaaattaatacaaaccaaagga

SEQ ID NO: 219063 - DNA, 24 bp, Artificial sequence
  SiRNA target sequence
caaaattaatacaaaccaaaggat

SEQ ID NO: 219064 - DNA, 24 bp, Artificial sequence
  SiRNA target sequence
aaaattaatacaaaccaaaggatg

SEQ ID NO: 219065 - DNA, 24 bp, Artificial sequence
  SiRNA target sequence
aaattaatacaaaccaaaggatgg

SEQ ID NO: 219066 - DNA, 24 bp, Artificial sequence
  SiRNA target sequence
aattaatacaaaccaaaggatgga

SEQ ID NO: 219067 - DNA, 24 bp, Artificial sequence
  SiRNA target sequence
attaatacaaaccaaaggatggat

SEQ ID NO: 219068 - DNA, 24 bp, Artificial sequence
  SiRNA target sequence
ttaatacaaaccaaaggatggata

SEQ ID NO: 219069 - DNA, 24 bp, Artificial sequence
  SiRNA target sequence
taatacaaaccaaaggatggatat

SEQ ID NO: 219070 - DNA, 24 bp, Artificial sequence
  SiRNA target sequence
aatacaaaccaaaggatggatatt

SEQ ID NO: 219071 - DNA, 24 bp, Artificial sequence
  SiRNA target sequence
atacaaaccaaaggatggatattt

SEQ ID NO: 219072 - DNA, 24 bp, Artificial sequence
  SiRNA target sequence
tacaaaccaaaggatggatatttg

SEQ ID NO: 219073 - DNA, 24 bp, Artificial sequence
  SiRNA target sequence
acaaaccaaaggatggatatttgt

SEQ ID NO: 219074 - DNA, 24 bp, Artificial sequence
  SiRNA target sequence
caaaccaaaggatggatatttgtt

SEQ ID NO: 219075 - DNA, 24 bp, Artificial sequence
  SiRNA target sequence
aaaccaaaggatggatatttgttg

SEQ ID NO: 219076 - DNA, 24 bp, Artificial sequence
  SiRNA target sequence
aaccaaaggatggatatttgttgc

SEQ ID NO: 219077 - DNA, 24 bp, Artificial sequence
  SiRNA target sequence
accaaaggatggatatttgttgcc

SEQ ID NO: 219078 - DNA, 24 bp, Artificial sequence
  SiRNA target sequence
ccaaaggatggatatttgttgcca

SEQ ID NO: 219079 - DNA, 24 bp, Artificial sequence
  SiRNA target sequence
caaaggatggatatttgttgccat

SEQ ID NO: 219080 - DNA, 24 bp, Artificial sequence
  SiRNA target sequence
aaaggatggatatttgttgccata

SEQ ID NO: 219081 - DNA, 24 bp, Artificial sequence
  SiRNA target sequence
aaggatggatatttgttgccatag

SEQ ID NO: 219082 - DNA, 24 bp, Artificial sequence
  SiRNA target sequence
aggatggatatttgttgccatagc

SEQ ID NO: 219083 - DNA, 24 bp, Artificial sequence
  SiRNA target sequence
ggatggatatttgttgccatagcg

SEQ ID NO: 219084 - DNA, 24 bp, Artificial sequence
  SiRNA target sequence
gatggatatttgttgccatagcgt

SEQ ID NO: 219085 - DNA, 24 bp, Artificial sequence
  SiRNA target sequence
atggatatttgttgccatagcgtg

SEQ ID NO: 219086 - DNA, 24 bp, Artificial sequence
  SiRNA target sequence
tggatatttgttgccatagcgtgc

SEQ ID NO: 219087 - DNA, 24 bp, Artificial sequence
  SiRNA target sequence
ggatatttgttgccatagcgtgcc

SEQ ID NO: 219088 - DNA, 24 bp, Artificial sequence
  SiRNA target sequence
gatatttgttgccatagcgtgccc

SEQ ID NO: 219089 - DNA, 24 bp, Artificial sequence
  SiRNA target sequence
atatttgttgccatagcgtgccca

SEQ ID NO: 219090 - DNA, 24 bp, Artificial sequence
  SiRNA target sequence
tatttgttgccatagcgtgcccac

SEQ ID NO: 219091 - DNA, 24 bp, Artificial sequence
  SiRNA target sequence
atttgttgccatagcgtgcccact

SEQ ID NO: 219092 - DNA, 24 bp, Artificial sequence
  SiRNA target sequence
tttgttgccatagcgtgcccactt

SEQ ID NO: 219093 - DNA, 24 bp, Artificial sequence
  SiRNA target sequence
ttgttgccatagcgtgcccactta

SEQ ID NO: 219094 - DNA, 24 bp, Artificial sequence
  SiRNA target sequence
tgttgccatagcgtgcccacttat

SEQ ID NO: 219095 - DNA, 24 bp, Artificial sequence
  SiRNA target sequence
gttgccatagcgtgcccacttatt

SEQ ID NO: 219096 - DNA, 24 bp, Artificial sequence
  SiRNA target sequence
ttgccatagcgtgcccacttatta

SEQ ID NO: 219097 - DNA, 24 bp, Artificial sequence
  SiRNA target sequence
tgccatagcgtgcccacttattac

SEQ ID NO: 219098 - DNA, 24 bp, Artificial sequence
  SiRNA target sequence
gccatagcgtgcccacttattacc

SEQ ID NO: 219099 - DNA, 24 bp, Artificial sequence
  SiRNA target sequence
ccatagcgtgcccacttattaccc

SEQ ID NO: 219100 - DNA, 24 bp, Artificial sequence
  SiRNA target sequence
catagcgtgcccacttattaccct

SEQ ID NO: 219101 - DNA, 24 bp, Artificial sequence
  SiRNA target sequence
atagcgtgcccacttattaccctt

SEQ ID NO: 219102 - DNA, 24 bp, Artificial sequence
  SiRNA target sequence
tagcgtgcccacttattacccttt

SEQ ID NO: 219103 - DNA, 24 bp, Artificial sequence
  SiRNA target sequence
agcgtgcccacttattaccctttt

SEQ ID NO: 219104 - DNA, 24 bp, Artificial sequence
  SiRNA target sequence
gcgtgcccacttattacccttttt

SEQ ID NO: 219105 - DNA, 24 bp, Artificial sequence
  SiRNA target sequence
cgtgcccacttattaccctttttg

SEQ ID NO: 219106 - DNA, 24 bp, Artificial sequence
  SiRNA target sequence
gtgcccacttattaccctttttgc

SEQ ID NO: 219107 - DNA, 24 bp, Artificial sequence
  SiRNA target sequence
tgcccacttattaccctttttgct

SEQ ID NO: 219108 - DNA, 24 bp, Artificial sequence
  SiRNA target sequence
gcccacttattaccctttttgctg

SEQ ID NO: 219109 - DNA, 24 bp, Artificial sequence
  SiRNA target sequence
cccacttattaccctttttgctgt

SEQ ID NO: 219110 - DNA, 24 bp, Artificial sequence
  SiRNA target sequence
ccacttattaccctttttgctgta

SEQ ID NO: 219111 - DNA, 24 bp, Artificial sequence
  SiRNA target sequence
cacttattaccctttttgctgtag

SEQ ID NO: 219112 - DNA, 24 bp, Artificial sequence
  SiRNA target sequence
acttattaccctttttgctgtagt

SEQ ID NO: 219113 - DNA, 24 bp, Artificial sequence
  SiRNA target sequence
cttattaccctttttgctgtagtt

SEQ ID NO: 219114 - DNA, 24 bp, Artificial sequence
  SiRNA target sequence
ttattaccctttttgctgtagttt

SEQ ID NO: 219115 - DNA, 24 bp, Artificial sequence
  SiRNA target sequence
tattaccctttttgctgtagtttc

SEQ ID NO: 219116 - DNA, 24 bp, Artificial sequence
  SiRNA target sequence
attaccctttttgctgtagtttct

SEQ ID NO: 219117 - DNA, 24 bp, Artificial sequence
  SiRNA target sequence
ttaccctttttgctgtagtttctg

SEQ ID NO: 219118 - DNA, 24 bp, Artificial sequence
  SiRNA target sequence
taccctttttgctgtagtttctgt

SEQ ID NO: 219119 - DNA, 24 bp, Artificial sequence
  SiRNA target sequence
accctttttgctgtagtttctgtg

SEQ ID NO: 219120 - DNA, 24 bp, Artificial sequence
  SiRNA target sequence
ccctttttgctgtagtttctgtgt

SEQ ID NO: 219121 - DNA, 24 bp, Artificial sequence
  SiRNA target sequence
cctttttgctgtagtttctgtgtg

SEQ ID NO: 219122 - DNA, 24 bp, Artificial sequence
  SiRNA target sequence
ctttttgctgtagtttctgtgtgt

SEQ ID NO: 219123 - DNA, 24 bp, Artificial sequence
  SiRNA target sequence
tttttgctgtagtttctgtgtgtg

SEQ ID NO: 219124 - DNA, 24 bp, Artificial sequence
  SiRNA target sequence
ttttgctgtagtttctgtgtgtgg

SEQ ID NO: 219125 - DNA, 24 bp, Artificial sequence
  SiRNA target sequence
tttgctgtagtttctgtgtgtggt

SEQ ID NO: 219126 - DNA, 24 bp, Artificial sequence
  SiRNA target sequence
ttgctgtagtttctgtgtgtggtc

SEQ ID NO: 219127 - DNA, 24 bp, Artificial sequence
  SiRNA target sequence
tgctgtagtttctgtgtgtggtct

SEQ ID NO: 219128 - DNA, 24 bp, Artificial sequence
  SiRNA target sequence
gctgtagtttctgtgtgtggtctt

SEQ ID NO: 219129 - DNA, 24 bp, Artificial sequence
  SiRNA target sequence
ctgtagtttctgtgtgtggtcttg

SEQ ID NO: 219130 - DNA, 24 bp, Artificial sequence
  SiRNA target sequence
tgtagtttctgtgtgtggtcttgc

SEQ ID NO: 219131 - DNA, 24 bp, Artificial sequence
  SiRNA target sequence
gtagtttctgtgtgtggtcttgct

SEQ ID NO: 219132 - DNA, 24 bp, Artificial sequence
  SiRNA target sequence
tagtttctgtgtgtggtcttgctt

SEQ ID NO: 219133 - DNA, 24 bp, Artificial sequence
  SiRNA target sequence
agtttctgtgtgtggtcttgcttt

SEQ ID NO: 219134 - DNA, 24 bp, Artificial sequence
  SiRNA target sequence
gtttctgtgtgtggtcttgctttt

SEQ ID NO: 219135 - DNA, 24 bp, Artificial sequence
  SiRNA target sequence
tttctgtgtgtggtcttgcttttt

SEQ ID NO: 219136 - DNA, 24 bp, Artificial sequence
  SiRNA target sequence
ttctgtgtgtggtcttgcttttta

SEQ ID NO: 219137 - DNA, 24 bp, Artificial sequence
  SiRNA target sequence
tctgtgtgtggtcttgctttttac

SEQ ID NO: 219138 - DNA, 24 bp, Artificial sequence
  SiRNA target sequence
ctgtgtgtggtcttgctttttaca

SEQ ID NO: 219139 - DNA, 24 bp, Artificial sequence
  SiRNA target sequence
tgtgtgtggtcttgctttttacaa

SEQ ID NO: 219140 - DNA, 24 bp, Artificial sequence
  SiRNA target sequence
gtgtgtggtcttgctttttacaat

SEQ ID NO: 219141 - DNA, 24 bp, Artificial sequence
  SiRNA target sequence
tgtgtggtcttgctttttacaatt

SEQ ID NO: 219142 - DNA, 24 bp, Artificial sequence
  SiRNA target sequence
gtgtggtcttgctttttacaatta

SEQ ID NO: 219143 - DNA, 24 bp, Artificial sequence
  SiRNA target sequence
tgtggtcttgctttttacaattat

SEQ ID NO: 219144 - DNA, 24 bp, Artificial sequence
  SiRNA target sequence
gtggtcttgctttttacaattatc

SEQ ID NO: 219145 - DNA, 24 bp, Artificial sequence
  SiRNA target sequence
tggtcttgctttttacaattatcc

SEQ ID NO: 219146 - DNA, 24 bp, Artificial sequence
  SiRNA target sequence
ggtcttgctttttacaattatccg

SEQ ID NO: 219147 - DNA, 24 bp, Artificial sequence
  SiRNA target sequence
gtcttgctttttacaattatccgg

SEQ ID NO: 219148 - DNA, 24 bp, Artificial sequence
  SiRNA target sequence
tcttgctttttacaattatccggc

SEQ ID NO: 219149 - DNA, 24 bp, Artificial sequence
  SiRNA target sequence
cttgctttttacaattatccggca

SEQ ID NO: 219150 - DNA, 24 bp, Artificial sequence
  SiRNA target sequence
ttgctttttacaattatccggcaa

SEQ ID NO: 219151 - DNA, 24 bp, Artificial sequence
  SiRNA target sequence
tgctttttacaattatccggcaac

SEQ ID NO: 219152 - DNA, 24 bp, Artificial sequence
  SiRNA target sequence
gctttttacaattatccggcaaca

SEQ ID NO: 219153 - DNA, 24 bp, Artificial sequence
  SiRNA target sequence
ctttttacaattatccggcaacaa

SEQ ID NO: 219154 - DNA, 24 bp, Artificial sequence
  SiRNA target sequence
tttttacaattatccggcaacaaa

SEQ ID NO: 219155 - DNA, 24 bp, Artificial sequence
  SiRNA target sequence
ttttacaattatccggcaacaaat

SEQ ID NO: 219156 - DNA, 24 bp, Artificial sequence
  SiRNA target sequence
tttacaattatccggcaacaaata

SEQ ID NO: 219157 - DNA, 24 bp, Artificial sequence
  SiRNA target sequence
ttacaattatccggcaacaaataa

SEQ ID NO: 219158 - DNA, 24 bp, Artificial sequence
  SiRNA target sequence
tacaattatccggcaacaaataat

SEQ ID NO: 219159 - DNA, 24 bp, Artificial sequence
  SiRNA target sequence
acaattatccggcaacaaataatg

SEQ ID NO: 219160 - DNA, 24 bp, Artificial sequence
  SiRNA target sequence
caattatccggcaacaaataatga

SEQ ID NO: 219161 - DNA, 24 bp, Artificial sequence
  SiRNA target sequence
aattatccggcaacaaataatgac

SEQ ID NO: 219162 - DNA, 24 bp, Artificial sequence
  SiRNA target sequence
attatccggcaacaaataatgaca

SEQ ID NO: 219163 - DNA, 24 bp, Artificial sequence
  SiRNA target sequence
ttatccggcaacaaataatgacac

SEQ ID NO: 219164 - DNA, 24 bp, Artificial sequence
  SiRNA target sequence
tatccggcaacaaataatgacaca

SEQ ID NO: 219165 - DNA, 24 bp, Artificial sequence
  SiRNA target sequence
atccggcaacaaataatgacacaa

SEQ ID NO: 219166 - DNA, 24 bp, Artificial sequence
  SiRNA target sequence
tccggcaacaaataatgacacaaa

SEQ ID NO: 219167 - DNA, 24 bp, Artificial sequence
  SiRNA target sequence
ccggcaacaaataatgacacaaat

SEQ ID NO: 219168 - DNA, 24 bp, Artificial sequence
  SiRNA target sequence
cggcaacaaataatgacacaaatt

SEQ ID NO: 219169 - DNA, 24 bp, Artificial sequence
  SiRNA target sequence
ggcaacaaataatgacacaaattt

SEQ ID NO: 219170 - DNA, 24 bp, Artificial sequence
  SiRNA target sequence
gcaacaaataatgacacaaatttt

SEQ ID NO: 219171 - DNA, 24 bp, Artificial sequence
  SiRNA target sequence
caacaaataatgacacaaattttt

SEQ ID NO: 219172 - DNA, 24 bp, Artificial sequence
  SiRNA target sequence
aacaaataatgacacaaatttttt

SEQ ID NO: 219173 - DNA, 24 bp, Artificial sequence
  SiRNA target sequence
acaaataatgacacaaattttttt

SEQ ID NO: 219174 - DNA, 24 bp, Artificial sequence
  SiRNA target sequence
caaataatgacacaaatttttttc

SEQ ID NO: 219175 - DNA, 24 bp, Artificial sequence
  SiRNA target sequence
aaataatgacacaaatttttttct

SEQ ID NO: 219176 - DNA, 24 bp, Artificial sequence
  SiRNA target sequence
aataatgacacaaatttttttcta

SEQ ID NO: 219177 - DNA, 24 bp, Artificial sequence
  SiRNA target sequence
ataatgacacaaatttttttctaa

SEQ ID NO: 219178 - DNA, 24 bp, Artificial sequence
  SiRNA target sequence
taatgacacaaatttttttctaaa

SEQ ID NO: 219179 - DNA, 24 bp, Artificial sequence
  SiRNA target sequence
aatgacacaaatttttttctaaat

SEQ ID NO: 219180 - DNA, 24 bp, Artificial sequence
  SiRNA target sequence
atgacacaaatttttttctaaatt

SEQ ID NO: 219181 - DNA, 24 bp, Artificial sequence
  SiRNA target sequence
tgacacaaatttttttctaaattc

SEQ ID NO: 219182 - DNA, 24 bp, Artificial sequence
  SiRNA target sequence
gacacaaatttttttctaaattca

SEQ ID NO: 219183 - DNA, 24 bp, Artificial sequence
  SiRNA target sequence
acacaaatttttttctaaattcat

SEQ ID NO: 219184 - DNA, 24 bp, Artificial sequence
  SiRNA target sequence
cacaaatttttttctaaattcatt

SEQ ID NO: 219185 - DNA, 24 bp, Artificial sequence
  SiRNA target sequence
acaaatttttttctaaattcatta

SEQ ID NO: 219186 - DNA, 24 bp, Artificial sequence
  SiRNA target sequence
caaatttttttctaaattcattat

SEQ ID NO: 219187 - DNA, 24 bp, Artificial sequence
  SiRNA target sequence
aaatttttttctaaattcattatg

SEQ ID NO: 219188 - DNA, 24 bp, Artificial sequence
  SiRNA target sequence
aatttttttctaaattcattatgt

SEQ ID NO: 219189 - DNA, 24 bp, Artificial sequence
  SiRNA target sequence
atttttttctaaattcattatgtg

SEQ ID NO: 219190 - DNA, 24 bp, Artificial sequence
  SiRNA target sequence
tttttttctaaattcattatgtgc

SEQ ID NO: 219191 - DNA, 24 bp, Artificial sequence
  SiRNA target sequence
ttttttctaaattcattatgtgct

SEQ ID NO: 219192 - DNA, 24 bp, Artificial sequence
  SiRNA target sequence
tttttctaaattcattatgtgcta

SEQ ID NO: 219193 - DNA, 24 bp, Artificial sequence
  SiRNA target sequence
ttttctaaattcattatgtgctac

SEQ ID NO: 219194 - DNA, 24 bp, Artificial sequence
  SiRNA target sequence
tttctaaattcattatgtgctacg

SEQ ID NO: 219195 - DNA, 24 bp, Artificial sequence
  SiRNA target sequence
ttctaaattcattatgtgctacgc

SEQ ID NO: 219196 - DNA, 24 bp, Artificial sequence
  SiRNA target sequence
tctaaattcattatgtgctacgcc

SEQ ID NO: 219197 - DNA, 24 bp, Artificial sequence
  SiRNA target sequence
ctaaattcattatgtgctacgccc

SEQ ID NO: 219198 - DNA, 24 bp, Artificial sequence
  SiRNA target sequence
taaattcattatgtgctacgcccg

SEQ ID NO: 219199 - DNA, 24 bp, Artificial sequence
  SiRNA target sequence
aaattcattatgtgctacgcccgg

SEQ ID NO: 219200 - DNA, 24 bp, Artificial sequence
  SiRNA target sequence
aattcattatgtgctacgcccggt

SEQ ID NO: 219201 - DNA, 24 bp, Artificial sequence
  SiRNA target sequence
attcattatgtgctacgcccggta

SEQ ID NO: 219202 - DNA, 24 bp, Artificial sequence
  SiRNA target sequence
ttcattatgtgctacgcccggtaa

SEQ ID NO: 219203 - DNA, 24 bp, Artificial sequence
  SiRNA target sequence
tcattatgtgctacgcccggtaaa

SEQ ID NO: 219204 - DNA, 24 bp, Artificial sequence
  SiRNA target sequence
cattatgtgctacgcccggtaaat

SEQ ID NO: 219205 - DNA, 24 bp, Artificial sequence
  SiRNA target sequence
attatgtgctacgcccggtaaatc

SEQ ID NO: 219206 - DNA, 24 bp, Artificial sequence
  SiRNA target sequence
ttatgtgctacgcccggtaaatcg

SEQ ID NO: 219207 - DNA, 24 bp, Artificial sequence
  SiRNA target sequence
tatgtgctacgcccggtaaatcgt

SEQ ID NO: 219208 - DNA, 24 bp, Artificial sequence
  SiRNA target sequence
atgtgctacgcccggtaaatcgtt

SEQ ID NO: 219209 - DNA, 24 bp, Artificial sequence
  SiRNA target sequence
tgtgctacgcccggtaaatcgttt

SEQ ID NO: 219210 - DNA, 24 bp, Artificial sequence
  SiRNA target sequence
gtgctacgcccggtaaatcgttta

SEQ ID NO: 219211 - DNA, 24 bp, Artificial sequence
  SiRNA target sequence
tgctacgcccggtaaatcgtttat

SEQ ID NO: 219212 - DNA, 24 bp, Artificial sequence
  SiRNA target sequence
gctacgcccggtaaatcgtttata

SEQ ID NO: 219213 - DNA, 24 bp, Artificial sequence
  SiRNA target sequence
ctacgcccggtaaatcgtttataa

SEQ ID NO: 219214 - DNA, 24 bp, Artificial sequence
  SiRNA target sequence
tacgcccggtaaatcgtttataaa

SEQ ID NO: 219215 - DNA, 24 bp, Artificial sequence
  SiRNA target sequence
acgcccggtaaatcgtttataaaa

SEQ ID NO: 219216 - DNA, 24 bp, Artificial sequence
  SiRNA target sequence
cgcccggtaaatcgtttataaaat

SEQ ID NO: 219217 - DNA, 24 bp, Artificial sequence
  SiRNA target sequence
gcccggtaaatcgtttataaaatt

SEQ ID NO: 219218 - DNA, 24 bp, Artificial sequence
  SiRNA target sequence
cccggtaaatcgtttataaaatta

SEQ ID NO: 219219 - DNA, 24 bp, Artificial sequence
  SiRNA target sequence
ccggtaaatcgtttataaaattag

SEQ ID NO: 219220 - DNA, 24 bp, Artificial sequence
  SiRNA target sequence
cggtaaatcgtttataaaattaga

SEQ ID NO: 219221 - DNA, 24 bp, Artificial sequence
  SiRNA target sequence
ggtaaatcgtttataaaattagaa

SEQ ID NO: 219222 - DNA, 24 bp, Artificial sequence
  SiRNA target sequence
gtaaatcgtttataaaattagaaa

SEQ ID NO: 219223 - DNA, 24 bp, Artificial sequence
  SiRNA target sequence
taaatcgtttataaaattagaaaa

SEQ ID NO: 219224 - DNA, 24 bp, Artificial sequence
  SiRNA target sequence
aaatcgtttataaaattagaaaat

SEQ ID NO: 219225 - DNA, 24 bp, Artificial sequence
  SiRNA target sequence
aatcgtttataaaattagaaaatg

SEQ ID NO: 219226 - DNA, 24 bp, Artificial sequence
  SiRNA target sequence
atcgtttataaaattagaaaatgt

SEQ ID NO: 219227 - DNA, 24 bp, Artificial sequence
  SiRNA target sequence
tcgtttataaaattagaaaatgtt

SEQ ID NO: 219228 - DNA, 24 bp, Artificial sequence
  SiRNA target sequence
cgtttataaaattagaaaatgttt

SEQ ID NO: 219229 - DNA, 24 bp, Artificial sequence
  SiRNA target sequence
gtttataaaattagaaaatgtttt

SEQ ID NO: 219230 - DNA, 24 bp, Artificial sequence
  SiRNA target sequence
tttataaaattagaaaatgtttta

SEQ ID NO: 219231 - DNA, 24 bp, Artificial sequence
  SiRNA target sequence
ttataaaattagaaaatgttttag

SEQ ID NO: 219232 - DNA, 24 bp, Artificial sequence
  SiRNA target sequence
tataaaattagaaaatgttttagg

SEQ ID NO: 219233 - DNA, 24 bp, Artificial sequence
  SiRNA target sequence
ataaaattagaaaatgttttagga

SEQ ID NO: 219234 - DNA, 24 bp, Artificial sequence
  SiRNA target sequence
taaaattagaaaatgttttaggat

SEQ ID NO: 219235 - DNA, 24 bp, Artificial sequence
  SiRNA target sequence
aaaattagaaaatgttttaggatg

SEQ ID NO: 219236 - DNA, 24 bp, Artificial sequence
  SiRNA target sequence
aaattagaaaatgttttaggatgt

SEQ ID NO: 219237 - DNA, 24 bp, Artificial sequence
  SiRNA target sequence
aattagaaaatgttttaggatgtg

SEQ ID NO: 219238 - DNA, 24 bp, Artificial sequence
  SiRNA target sequence
attagaaaatgttttaggatgtgt

SEQ ID NO: 219239 - DNA, 24 bp, Artificial sequence
  SiRNA target sequence
ttagaaaatgttttaggatgtgta

SEQ ID NO: 219240 - DNA, 24 bp, Artificial sequence
  SiRNA target sequence
tagaaaatgttttaggatgtgtag

SEQ ID NO: 219241 - DNA, 24 bp, Artificial sequence
  SiRNA target sequence
agaaaatgttttaggatgtgtagc

SEQ ID NO: 219242 - DNA, 24 bp, Artificial sequence
  SiRNA target sequence
gaaaatgttttaggatgtgtagct

SEQ ID NO: 219243 - DNA, 24 bp, Artificial sequence
  SiRNA target sequence
aaaatgttttaggatgtgtagctg

SEQ ID NO: 219244 - DNA, 24 bp, Artificial sequence
  SiRNA target sequence
aaatgttttaggatgtgtagctgt

SEQ ID NO: 219245 - DNA, 24 bp, Artificial sequence
  SiRNA target sequence
aatgttttaggatgtgtagctgta

SEQ ID NO: 219246 - DNA, 24 bp, Artificial sequence
  SiRNA target sequence
atgttttaggatgtgtagctgtag

SEQ ID NO: 219247 - DNA, 24 bp, Artificial sequence
  SiRNA target sequence
tgttttaggatgtgtagctgtagc

SEQ ID NO: 219248 - DNA, 24 bp, Artificial sequence
  SiRNA target sequence
gttttaggatgtgtagctgtagct

SEQ ID NO: 219249 - DNA, 24 bp, Artificial sequence
  SiRNA target sequence
ttttaggatgtgtagctgtagctc

SEQ ID NO: 219250 - DNA, 24 bp, Artificial sequence
  SiRNA target sequence
tttaggatgtgtagctgtagctct

SEQ ID NO: 219251 - DNA, 24 bp, Artificial sequence
  SiRNA target sequence
ttaggatgtgtagctgtagctctt

SEQ ID NO: 219252 - DNA, 24 bp, Artificial sequence
  SiRNA target sequence
taggatgtgtagctgtagctctta

SEQ ID NO: 219253 - DNA, 24 bp, Artificial sequence
  SiRNA target sequence
aggatgtgtagctgtagctcttat

SEQ ID NO: 219254 - DNA, 24 bp, Artificial sequence
  SiRNA target sequence
ggatgtgtagctgtagctcttatg

SEQ ID NO: 219255 - DNA, 24 bp, Artificial sequence
  SiRNA target sequence
gatgtgtagctgtagctcttatga

SEQ ID NO: 219256 - DNA, 24 bp, Artificial sequence
  SiRNA target sequence
atgtgtagctgtagctcttatgaa

SEQ ID NO: 219257 - DNA, 24 bp, Artificial sequence
  SiRNA target sequence
tgtgtagctgtagctcttatgaaa

SEQ ID NO: 219258 - DNA, 24 bp, Artificial sequence
  SiRNA target sequence
gtgtagctgtagctcttatgaaag

SEQ ID NO: 219259 - DNA, 24 bp, Artificial sequence
  SiRNA target sequence
tgtagctgtagctcttatgaaagt

SEQ ID NO: 219260 - DNA, 24 bp, Artificial sequence
  SiRNA target sequence
gtagctgtagctcttatgaaagta

SEQ ID NO: 219261 - DNA, 24 bp, Artificial sequence
  SiRNA target sequence
tagctgtagctcttatgaaagtag

SEQ ID NO: 219262 - DNA, 24 bp, Artificial sequence
  SiRNA target sequence
agctgtagctcttatgaaagtagc

SEQ ID NO: 219263 - DNA, 24 bp, Artificial sequence
  SiRNA target sequence
gctgtagctcttatgaaagtagca

SEQ ID NO: 219264 - DNA, 24 bp, Artificial sequence
  SiRNA target sequence
ctgtagctcttatgaaagtagcaa

SEQ ID NO: 219265 - DNA, 24 bp, Artificial sequence
  SiRNA target sequence
tgtagctcttatgaaagtagcaaa

SEQ ID NO: 219266 - DNA, 24 bp, Artificial sequence
  SiRNA target sequence
gtagctcttatgaaagtagcaaaa

SEQ ID NO: 219267 - DNA, 24 bp, Artificial sequence
  SiRNA target sequence
tagctcttatgaaagtagcaaaat

SEQ ID NO: 219268 - DNA, 24 bp, Artificial sequence
  SiRNA target sequence
agctcttatgaaagtagcaaaata

SEQ ID NO: 219269 - DNA, 24 bp, Artificial sequence
  SiRNA target sequence
gctcttatgaaagtagcaaaatat

SEQ ID NO: 219270 - DNA, 24 bp, Artificial sequence
  SiRNA target sequence
ctcttatgaaagtagcaaaatatg

SEQ ID NO: 219271 - DNA, 24 bp, Artificial sequence
  SiRNA target sequence
tcttatgaaagtagcaaaatatgg

SEQ ID NO: 219272 - DNA, 24 bp, Artificial sequence
  SiRNA target sequence
cttatgaaagtagcaaaatatggc

SEQ ID NO: 219273 - DNA, 24 bp, Artificial sequence
  SiRNA target sequence
ttatgaaagtagcaaaatatggct

SEQ ID NO: 219274 - DNA, 24 bp, Artificial sequence
  SiRNA target sequence
tatgaaagtagcaaaatatggctc

SEQ ID NO: 219275 - DNA, 24 bp, Artificial sequence
  SiRNA target sequence
atgaaagtagcaaaatatggctct

SEQ ID NO: 219276 - DNA, 24 bp, Artificial sequence
  SiRNA target sequence
tgaaagtagcaaaatatggctctt

SEQ ID NO: 219277 - DNA, 24 bp, Artificial sequence
  SiRNA target sequence
gaaagtagcaaaatatggctcttt

SEQ ID NO: 219278 - DNA, 24 bp, Artificial sequence
  SiRNA target sequence
aaagtagcaaaatatggctctttt

SEQ ID NO: 219279 - DNA, 24 bp, Artificial sequence
  SiRNA target sequence
aagtagcaaaatatggctcttttg

SEQ ID NO: 219280 - DNA, 24 bp, Artificial sequence
  SiRNA target sequence
agtagcaaaatatggctcttttga

SEQ ID NO: 219281 - DNA, 24 bp, Artificial sequence
  SiRNA target sequence
gtagcaaaatatggctcttttgat

SEQ ID NO: 219282 - DNA, 24 bp, Artificial sequence
  SiRNA target sequence
tagcaaaatatggctcttttgata

SEQ ID NO: 219283 - DNA, 24 bp, Artificial sequence
  SiRNA target sequence
agcaaaatatggctcttttgatat

SEQ ID NO: 219284 - DNA, 24 bp, Artificial sequence
  SiRNA target sequence
gcaaaatatggctcttttgatatt

SEQ ID NO: 219285 - DNA, 24 bp, Artificial sequence
  SiRNA target sequence
caaaatatggctcttttgatattt

SEQ ID NO: 219286 - DNA, 24 bp, Artificial sequence
  SiRNA target sequence
aaaatatggctcttttgatatttc

SEQ ID NO: 219287 - DNA, 24 bp, Artificial sequence
  SiRNA target sequence
aaatatggctcttttgatatttcc

SEQ ID NO: 219288 - DNA, 24 bp, Artificial sequence
  SiRNA target sequence
aatatggctcttttgatatttcca

SEQ ID NO: 219289 - DNA, 24 bp, Artificial sequence
  SiRNA target sequence
atatggctcttttgatatttccaa

SEQ ID NO: 219290 - DNA, 24 bp, Artificial sequence
  SiRNA target sequence
tatggctcttttgatatttccaaa

SEQ ID NO: 219291 - DNA, 24 bp, Artificial sequence
  SiRNA target sequence
atggctcttttgatatttccaaag

SEQ ID NO: 219292 - DNA, 24 bp, Artificial sequence
  SiRNA target sequence
tggctcttttgatatttccaaaga

SEQ ID NO: 219293 - DNA, 24 bp, Artificial sequence
  SiRNA target sequence
ggctcttttgatatttccaaagaa

SEQ ID NO: 219294 - DNA, 24 bp, Artificial sequence
  SiRNA target sequence
gctcttttgatatttccaaagaag

SEQ ID NO: 219295 - DNA, 24 bp, Artificial sequence
  SiRNA target sequence
ctcttttgatatttccaaagaagc

SEQ ID NO: 219296 - DNA, 24 bp, Artificial sequence
  SiRNA target sequence
tcttttgatatttccaaagaagcc

SEQ ID NO: 219297 - DNA, 24 bp, Artificial sequence
  SiRNA target sequence
cttttgatatttccaaagaagcca

SEQ ID NO: 219298 - DNA, 24 bp, Artificial sequence
  SiRNA target sequence
ttttgatatttccaaagaagccat

SEQ ID NO: 219299 - DNA, 24 bp, Artificial sequence
  SiRNA target sequence
tttgatatttccaaagaagccatt

SEQ ID NO: 219300 - DNA, 24 bp, Artificial sequence
  SiRNA target sequence
ttgatatttccaaagaagccattt

SEQ ID NO: 219301 - DNA, 24 bp, Artificial sequence
  SiRNA target sequence
tgatatttccaaagaagccatttc

SEQ ID NO: 219302 - DNA, 24 bp, Artificial sequence
  SiRNA target sequence
gatatttccaaagaagccatttca

SEQ ID NO: 219303 - DNA, 24 bp, Artificial sequence
  SiRNA target sequence
atatttccaaagaagccatttcaa

SEQ ID NO: 219304 - DNA, 24 bp, Artificial sequence
  SiRNA target sequence
tatttccaaagaagccatttcaat

SEQ ID NO: 219305 - DNA, 24 bp, Artificial sequence
  SiRNA target sequence
atttccaaagaagccatttcaatg

SEQ ID NO: 219306 - DNA, 24 bp, Artificial sequence
  SiRNA target sequence
tttccaaagaagccatttcaatgc

SEQ ID NO: 219307 - DNA, 24 bp, Artificial sequence
  SiRNA target sequence
ttccaaagaagccatttcaatgca

SEQ ID NO: 219308 - DNA, 24 bp, Artificial sequence
  SiRNA target sequence
tccaaagaagccatttcaatgcag

SEQ ID NO: 219309 - DNA, 24 bp, Artificial sequence
  SiRNA target sequence
ccaaagaagccatttcaatgcaga

SEQ ID NO: 219310 - DNA, 24 bp, Artificial sequence
  SiRNA target sequence
caaagaagccatttcaatgcagat

SEQ ID NO: 219311 - DNA, 24 bp, Artificial sequence
  SiRNA target sequence
aaagaagccatttcaatgcagatt

SEQ ID NO: 219312 - DNA, 24 bp, Artificial sequence
  SiRNA target sequence
aagaagccatttcaatgcagattg

SEQ ID NO: 219313 - DNA, 24 bp, Artificial sequence
  SiRNA target sequence
agaagccatttcaatgcagattga

SEQ ID NO: 219314 - DNA, 24 bp, Artificial sequence
  SiRNA target sequence
gaagccatttcaatgcagattgat

SEQ ID NO: 219315 - DNA, 24 bp, Artificial sequence
  SiRNA target sequence
aagccatttcaatgcagattgatt

SEQ ID NO: 219316 - DNA, 24 bp, Artificial sequence
  SiRNA target sequence
agccatttcaatgcagattgattc

SEQ ID NO: 219317 - DNA, 24 bp, Artificial sequence
  SiRNA target sequence
gccatttcaatgcagattgattcg

SEQ ID NO: 219318 - DNA, 24 bp, Artificial sequence
  SiRNA target sequence
ccatttcaatgcagattgattcgt

SEQ ID NO: 219319 - DNA, 24 bp, Artificial sequence
  SiRNA target sequence
catttcaatgcagattgattcgtc

SEQ ID NO: 219320 - DNA, 24 bp, Artificial sequence
  SiRNA target sequence
atttcaatgcagattgattcgtca

SEQ ID NO: 219321 - DNA, 24 bp, Artificial sequence
  SiRNA target sequence
tttcaatgcagattgattcgtcat

SEQ ID NO: 219322 - DNA, 24 bp, Artificial sequence
  SiRNA target sequence
ttcaatgcagattgattcgtcatt

SEQ ID NO: 219323 - DNA, 24 bp, Artificial sequence
  SiRNA target sequence
tcaatgcagattgattcgtcattg

SEQ ID NO: 219324 - DNA, 24 bp, Artificial sequence
  SiRNA target sequence
caatgcagattgattcgtcattgc

SEQ ID NO: 219325 - DNA, 24 bp, Artificial sequence
  SiRNA target sequence
aatgcagattgattcgtcattgcg

SEQ ID NO: 219326 - DNA, 24 bp, Artificial sequence
  SiRNA target sequence
atgcagattgattcgtcattgcgt

SEQ ID NO: 219327 - DNA, 24 bp, Artificial sequence
  SiRNA target sequence
tgcagattgattcgtcattgcgtg

SEQ ID NO: 219328 - DNA, 24 bp, Artificial sequence
  SiRNA target sequence
gcagattgattcgtcattgcgtgc

SEQ ID NO: 219329 - DNA, 24 bp, Artificial sequence
  SiRNA target sequence
cagattgattcgtcattgcgtgca

SEQ ID NO: 219330 - DNA, 24 bp, Artificial sequence
  SiRNA target sequence
agattgattcgtcattgcgtgcac

SEQ ID NO: 219331 - DNA, 24 bp, Artificial sequence
  SiRNA target sequence
gattgattcgtcattgcgtgcacg

SEQ ID NO: 219332 - DNA, 24 bp, Artificial sequence
  SiRNA target sequence
attgattcgtcattgcgtgcacgt

SEQ ID NO: 219333 - DNA, 24 bp, Artificial sequence
  SiRNA target sequence
ttgattcgtcattgcgtgcacgtt

SEQ ID NO: 219334 - DNA, 24 bp, Artificial sequence
  SiRNA target sequence
tgattcgtcattgcgtgcacgtta

SEQ ID NO: 219335 - DNA, 24 bp, Artificial sequence
  SiRNA target sequence
gattcgtcattgcgtgcacgttat

SEQ ID NO: 219336 - DNA, 24 bp, Artificial sequence
  SiRNA target sequence
attcgtcattgcgtgcacgttata

SEQ ID NO: 219337 - DNA, 24 bp, Artificial sequence
  SiRNA target sequence
ttcgtcattgcgtgcacgttataa

SEQ ID NO: 219338 - DNA, 24 bp, Artificial sequence
  SiRNA target sequence
tcgtcattgcgtgcacgttataaa

SEQ ID NO: 219339 - DNA, 24 bp, Artificial sequence
  SiRNA target sequence
cgtcattgcgtgcacgttataaag

SEQ ID NO: 219340 - DNA, 24 bp, Artificial sequence
  SiRNA target sequence
gtcattgcgtgcacgttataaagg

SEQ ID NO: 219341 - DNA, 24 bp, Artificial sequence
  SiRNA target sequence
tcattgcgtgcacgttataaagga

SEQ ID NO: 219342 - DNA, 24 bp, Artificial sequence
  SiRNA target sequence
cattgcgtgcacgttataaaggaa

SEQ ID NO: 219343 - DNA, 24 bp, Artificial sequence
  SiRNA target sequence
attgcgtgcacgttataaaggaat

SEQ ID NO: 219344 - DNA, 24 bp, Artificial sequence
  SiRNA target sequence
ttgcgtgcacgttataaaggaatt

SEQ ID NO: 219345 - DNA, 24 bp, Artificial sequence
  SiRNA target sequence
tgcgtgcacgttataaaggaattt

SEQ ID NO: 219346 - DNA, 24 bp, Artificial sequence
  SiRNA target sequence
gcgtgcacgttataaaggaatttt

SEQ ID NO: 219347 - DNA, 24 bp, Artificial sequence
  SiRNA target sequence
cgtgcacgttataaaggaattttt

SEQ ID NO: 219348 - DNA, 24 bp, Artificial sequence
  SiRNA target sequence
gtgcacgttataaaggaatttttg

SEQ ID NO: 219349 - DNA, 24 bp, Artificial sequence
  SiRNA target sequence
tgcacgttataaaggaatttttga

SEQ ID NO: 219350 - DNA, 24 bp, Artificial sequence
  SiRNA target sequence
gcacgttataaaggaatttttgac

SEQ ID NO: 219351 - DNA, 24 bp, Artificial sequence
  SiRNA target sequence
cacgttataaaggaatttttgacg

SEQ ID NO: 219352 - DNA, 24 bp, Artificial sequence
  SiRNA target sequence
acgttataaaggaatttttgacgg

SEQ ID NO: 219353 - DNA, 24 bp, Artificial sequence
  SiRNA target sequence
cgttataaaggaatttttgacggt

SEQ ID NO: 219354 - DNA, 24 bp, Artificial sequence
  SiRNA target sequence
gttataaaggaatttttgacggtg

SEQ ID NO: 219355 - DNA, 24 bp, Artificial sequence
  SiRNA target sequence
ttataaaggaatttttgacggtgt

SEQ ID NO: 219356 - DNA, 24 bp, Artificial sequence
  SiRNA target sequence
tataaaggaatttttgacggtgtt

SEQ ID NO: 219357 - DNA, 24 bp, Artificial sequence
  SiRNA target sequence
ataaaggaatttttgacggtgttt

SEQ ID NO: 219358 - DNA, 24 bp, Artificial sequence
  SiRNA target sequence
taaaggaatttttgacggtgtttt

SEQ ID NO: 219359 - DNA, 24 bp, Artificial sequence
  SiRNA target sequence
aaaggaatttttgacggtgttttt

SEQ ID NO: 219360 - DNA, 24 bp, Artificial sequence
  SiRNA target sequence
aaggaatttttgacggtgtttttg

SEQ ID NO: 219361 - DNA, 24 bp, Artificial sequence
  SiRNA target sequence
aggaatttttgacggtgtttttgg

SEQ ID NO: 219362 - DNA, 24 bp, Artificial sequence
  SiRNA target sequence
ggaatttttgacggtgtttttggt

SEQ ID NO: 219363 - DNA, 24 bp, Artificial sequence
  SiRNA target sequence
gaatttttgacggtgtttttggta

SEQ ID NO: 219364 - DNA, 24 bp, Artificial sequence
  SiRNA target sequence
aatttttgacggtgtttttggtaa

SEQ ID NO: 219365 - DNA, 24 bp, Artificial sequence
  SiRNA target sequence
atttttgacggtgtttttggtaag

SEQ ID NO: 219366 - DNA, 24 bp, Artificial sequence
  SiRNA target sequence
tttttgacggtgtttttggtaagt

SEQ ID NO: 219367 - DNA, 24 bp, Artificial sequence
  SiRNA target sequence
ttttgacggtgtttttggtaagtt

SEQ ID NO: 219368 - DNA, 24 bp, Artificial sequence
  SiRNA target sequence
tttgacggtgtttttggtaagtta

SEQ ID NO: 219369 - DNA, 24 bp, Artificial sequence
  SiRNA target sequence
ttgacggtgtttttggtaagttag

SEQ ID NO: 219370 - DNA, 24 bp, Artificial sequence
  SiRNA target sequence
tgacggtgtttttggtaagttagg

SEQ ID NO: 219371 - DNA, 24 bp, Artificial sequence
  SiRNA target sequence
gacggtgtttttggtaagttagga

SEQ ID NO: 219372 - DNA, 24 bp, Artificial sequence
  SiRNA target sequence
acggtgtttttggtaagttaggaa

SEQ ID NO: 219373 - DNA, 24 bp, Artificial sequence
  SiRNA target sequence
cggtgtttttggtaagttaggaaa

SEQ ID NO: 219374 - DNA, 24 bp, Artificial sequence
  SiRNA target sequence
ggtgtttttggtaagttaggaaaa

SEQ ID NO: 219375 - DNA, 24 bp, Artificial sequence
  SiRNA target sequence
gtgtttttggtaagttaggaaaat

SEQ ID NO: 219376 - DNA, 24 bp, Artificial sequence
  SiRNA target sequence
tgtttttggtaagttaggaaaatc

SEQ ID NO: 219377 - DNA, 24 bp, Artificial sequence
  SiRNA target sequence
gtttttggtaagttaggaaaatct

SEQ ID NO: 219378 - DNA, 24 bp, Artificial sequence
  SiRNA target sequence
tttttggtaagttaggaaaatctc

SEQ ID NO: 219379 - DNA, 24 bp, Artificial sequence
  SiRNA target sequence
ttttggtaagttaggaaaatctct

SEQ ID NO: 219380 - DNA, 24 bp, Artificial sequence
  SiRNA target sequence
tttggtaagttaggaaaatctctt

SEQ ID NO: 219381 - DNA, 24 bp, Artificial sequence
  SiRNA target sequence
ttggtaagttaggaaaatctcttg

SEQ ID NO: 219382 - DNA, 24 bp, Artificial sequence
  SiRNA target sequence
tggtaagttaggaaaatctcttgg

SEQ ID NO: 219383 - DNA, 24 bp, Artificial sequence
  SiRNA target sequence
ggtaagttaggaaaatctcttgga

SEQ ID NO: 219384 - DNA, 24 bp, Artificial sequence
  SiRNA target sequence
gtaagttaggaaaatctcttggat

SEQ ID NO: 219385 - DNA, 24 bp, Artificial sequence
  SiRNA target sequence
taagttaggaaaatctcttggatc

SEQ ID NO: 219386 - DNA, 24 bp, Artificial sequence
  SiRNA target sequence
aagttaggaaaatctcttggatcg

SEQ ID NO: 219387 - DNA, 24 bp, Artificial sequence
  SiRNA target sequence
agttaggaaaatctcttggatcgt

SEQ ID NO: 219388 - DNA, 24 bp, Artificial sequence
  SiRNA target sequence
gttaggaaaatctcttggatcgtt

SEQ ID NO: 219389 - DNA, 24 bp, Artificial sequence
  SiRNA target sequence
ttaggaaaatctcttggatcgtta

SEQ ID NO: 219390 - DNA, 24 bp, Artificial sequence
  SiRNA target sequence
taggaaaatctcttggatcgttat

SEQ ID NO: 219391 - DNA, 24 bp, Artificial sequence
  SiRNA target sequence
aggaaaatctcttggatcgttatt

SEQ ID NO: 219392 - DNA, 24 bp, Artificial sequence
  SiRNA target sequence
ggaaaatctcttggatcgttattt

SEQ ID NO: 219393 - DNA, 24 bp, Artificial sequence
  SiRNA target sequence
gaaaatctcttggatcgttatttg

SEQ ID NO: 219394 - DNA, 24 bp, Artificial sequence
  SiRNA target sequence
aaaatctcttggatcgttatttgt

SEQ ID NO: 219395 - DNA, 24 bp, Artificial sequence
  SiRNA target sequence
aaatctcttggatcgttatttgtg

SEQ ID NO: 219396 - DNA, 24 bp, Artificial sequence
  SiRNA target sequence
aatctcttggatcgttatttgtgt

SEQ ID NO: 219397 - DNA, 24 bp, Artificial sequence
  SiRNA target sequence
atctcttggatcgttatttgtgtg

SEQ ID NO: 219398 - DNA, 24 bp, Artificial sequence
  SiRNA target sequence
tctcttggatcgttatttgtgtgg

SEQ ID NO: 219399 - DNA, 24 bp, Artificial sequence
  SiRNA target sequence
ctcttggatcgttatttgtgtgga

SEQ ID NO: 219400 - DNA, 24 bp, Artificial sequence
  SiRNA target sequence
tcttggatcgttatttgtgtggat

SEQ ID NO: 219401 - DNA, 24 bp, Artificial sequence
  SiRNA target sequence
cttggatcgttatttgtgtggatt

SEQ ID NO: 219402 - DNA, 24 bp, Artificial sequence
  SiRNA target sequence
ttggatcgttatttgtgtggatta

SEQ ID NO: 219403 - DNA, 24 bp, Artificial sequence
  SiRNA target sequence
tggatcgttatttgtgtggattat

SEQ ID NO: 219404 - DNA, 24 bp, Artificial sequence
  SiRNA target sequence
ggatcgttatttgtgtggattatg

SEQ ID NO: 219405 - DNA, 24 bp, Artificial sequence
  SiRNA target sequence
gatcgttatttgtgtggattatgg

SEQ ID NO: 219406 - DNA, 24 bp, Artificial sequence
  SiRNA target sequence
atcgttatttgtgtggattatggg

SEQ ID NO: 219407 - DNA, 24 bp, Artificial sequence
  SiRNA target sequence
tcgttatttgtgtggattatggga

SEQ ID NO: 219408 - DNA, 24 bp, Artificial sequence
  SiRNA target sequence
cgttatttgtgtggattatgggat

SEQ ID NO: 219409 - DNA, 24 bp, Artificial sequence
  SiRNA target sequence
gttatttgtgtggattatgggata

SEQ ID NO: 219410 - DNA, 24 bp, Artificial sequence
  SiRNA target sequence
ttatttgtgtggattatgggatat

SEQ ID NO: 219411 - DNA, 24 bp, Artificial sequence
  SiRNA target sequence
tatttgtgtggattatgggatatg

SEQ ID NO: 219412 - DNA, 24 bp, Artificial sequence
  SiRNA target sequence
atttgtgtggattatgggatatgc

SEQ ID NO: 219413 - DNA, 24 bp, Artificial sequence
  SiRNA target sequence
tttgtgtggattatgggatatgca

SEQ ID NO: 219414 - DNA, 24 bp, Artificial sequence
  SiRNA target sequence
ttgtgtggattatgggatatgcat

SEQ ID NO: 219415 - DNA, 24 bp, Artificial sequence
  SiRNA target sequence
tgtgtggattatgggatatgcatt

SEQ ID NO: 219416 - DNA, 24 bp, Artificial sequence
  SiRNA target sequence
gtgtggattatgggatatgcattt

SEQ ID NO: 219417 - DNA, 24 bp, Artificial sequence
  SiRNA target sequence
tgtggattatgggatatgcatttc

SEQ ID NO: 219418 - DNA, 24 bp, Artificial sequence
  SiRNA target sequence
gtggattatgggatatgcatttca

SEQ ID NO: 219419 - DNA, 24 bp, Artificial sequence
  SiRNA target sequence
tggattatgggatatgcatttcaa

SEQ ID NO: 219420 - DNA, 24 bp, Artificial sequence
  SiRNA target sequence
ggattatgggatatgcatttcaaa

SEQ ID NO: 219421 - DNA, 24 bp, Artificial sequence
  SiRNA target sequence
gattatgggatatgcatttcaaac

SEQ ID NO: 219422 - DNA, 24 bp, Artificial sequence
  SiRNA target sequence
attatgggatatgcatttcaaaca

SEQ ID NO: 219423 - DNA, 24 bp, Artificial sequence
  SiRNA target sequence
ttatgggatatgcatttcaaacaa

SEQ ID NO: 219424 - DNA, 24 bp, Artificial sequence
  SiRNA target sequence
tatgggatatgcatttcaaacaag

SEQ ID NO: 219425 - DNA, 24 bp, Artificial sequence
  SiRNA target sequence
atgggatatgcatttcaaacaaga

SEQ ID NO: 219426 - DNA, 24 bp, Artificial sequence
  SiRNA target sequence
tgggatatgcatttcaaacaagag

SEQ ID NO: 219427 - DNA, 24 bp, Artificial sequence
  SiRNA target sequence
gggatatgcatttcaaacaagaga

SEQ ID NO: 219428 - DNA, 24 bp, Artificial sequence
  SiRNA target sequence
ggatatgcatttcaaacaagagat

SEQ ID NO: 219429 - DNA, 24 bp, Artificial sequence
  SiRNA target sequence
gatatgcatttcaaacaagagatt

SEQ ID NO: 219430 - DNA, 24 bp, Artificial sequence
  SiRNA target sequence
atatgcatttcaaacaagagattt

SEQ ID NO: 219431 - DNA, 24 bp, Artificial sequence
  SiRNA target sequence
tatgcatttcaaacaagagatttt

SEQ ID NO: 219432 - DNA, 24 bp, Artificial sequence
  SiRNA target sequence
atgcatttcaaacaagagatttta

SEQ ID NO: 219433 - DNA, 24 bp, Artificial sequence
  SiRNA target sequence
tgcatttcaaacaagagattttag

SEQ ID NO: 219434 - DNA, 24 bp, Artificial sequence
  SiRNA target sequence
gcatttcaaacaagagattttaga

SEQ ID NO: 219435 - DNA, 24 bp, Artificial sequence
  SiRNA target sequence
catttcaaacaagagattttagaa

SEQ ID NO: 219436 - DNA, 24 bp, Artificial sequence
  SiRNA target sequence
atttcaaacaagagattttagaaa

SEQ ID NO: 219437 - DNA, 24 bp, Artificial sequence
  SiRNA target sequence
tttcaaacaagagattttagaaaa

SEQ ID NO: 219438 - DNA, 24 bp, Artificial sequence
  SiRNA target sequence
ttcaaacaagagattttagaaaat

SEQ ID NO: 219439 - DNA, 24 bp, Artificial sequence
  SiRNA target sequence
tcaaacaagagattttagaaaatt

SEQ ID NO: 219440 - DNA, 24 bp, Artificial sequence
  SiRNA target sequence
caaacaagagattttagaaaatta

SEQ ID NO: 219441 - DNA, 24 bp, Artificial sequence
  SiRNA target sequence
aaacaagagattttagaaaattag

SEQ ID NO: 219442 - DNA, 24 bp, Artificial sequence
  SiRNA target sequence
aacaagagattttagaaaattagc

SEQ ID NO: 219443 - DNA, 24 bp, Artificial sequence
  SiRNA target sequence
acaagagattttagaaaattagct

SEQ ID NO: 219444 - DNA, 24 bp, Artificial sequence
  SiRNA target sequence
caagagattttagaaaattagctc

SEQ ID NO: 219445 - DNA, 24 bp, Artificial sequence
  SiRNA target sequence
aagagattttagaaaattagctcc

SEQ ID NO: 219446 - DNA, 24 bp, Artificial sequence
  SiRNA target sequence
agagattttagaaaattagctccc

SEQ ID NO: 219447 - DNA, 24 bp, Artificial sequence
  SiRNA target sequence
gagattttagaaaattagctccct

SEQ ID NO: 219448 - DNA, 24 bp, Artificial sequence
  SiRNA target sequence
agattttagaaaattagctccctt

SEQ ID NO: 219449 - DNA, 24 bp, Artificial sequence
  SiRNA target sequence
gattttagaaaattagctccctta

SEQ ID NO: 219450 - DNA, 24 bp, Artificial sequence
  SiRNA target sequence
attttagaaaattagctcccttat

SEQ ID NO: 219451 - DNA, 24 bp, Artificial sequence
  SiRNA target sequence
ttttagaaaattagctcccttatg

SEQ ID NO: 219452 - DNA, 24 bp, Artificial sequence
  SiRNA target sequence
tttagaaaattagctcccttatgt

SEQ ID NO: 219453 - DNA, 24 bp, Artificial sequence
  SiRNA target sequence
ttagaaaattagctcccttatgta

SEQ ID NO: 219454 - DNA, 24 bp, Artificial sequence
  SiRNA target sequence
tagaaaattagctcccttatgtat

SEQ ID NO: 219455 - DNA, 24 bp, Artificial sequence
  SiRNA target sequence
agaaaattagctcccttatgtatc

SEQ ID NO: 219456 - DNA, 24 bp, Artificial sequence
  SiRNA target sequence
gaaaattagctcccttatgtatca

SEQ ID NO: 219457 - DNA, 24 bp, Artificial sequence
  SiRNA target sequence
aaaattagctcccttatgtatcag

SEQ ID NO: 219458 - DNA, 24 bp, Artificial sequence
  SiRNA target sequence
aaattagctcccttatgtatcagc

SEQ ID NO: 219459 - DNA, 24 bp, Artificial sequence
  SiRNA target sequence
aattagctcccttatgtatcagcg

SEQ ID NO: 219460 - DNA, 24 bp, Artificial sequence
  SiRNA target sequence
attagctcccttatgtatcagcgt

SEQ ID NO: 219461 - DNA, 24 bp, Artificial sequence
  SiRNA target sequence
ttagctcccttatgtatcagcgta

SEQ ID NO: 219462 - DNA, 24 bp, Artificial sequence
  SiRNA target sequence
tagctcccttatgtatcagcgtaa

SEQ ID NO: 219463 - DNA, 24 bp, Artificial sequence
  SiRNA target sequence
agctcccttatgtatcagcgtaat

SEQ ID NO: 219464 - DNA, 24 bp, Artificial sequence
  SiRNA target sequence
gctcccttatgtatcagcgtaatt

SEQ ID NO: 219465 - DNA, 24 bp, Artificial sequence
  SiRNA target sequence
ctcccttatgtatcagcgtaattg

SEQ ID NO: 219466 - DNA, 24 bp, Artificial sequence
  SiRNA target sequence
tcccttatgtatcagcgtaattgt

SEQ ID NO: 219467 - DNA, 24 bp, Artificial sequence
  SiRNA target sequence
cccttatgtatcagcgtaattgtc

SEQ ID NO: 219468 - DNA, 24 bp, Artificial sequence
  SiRNA target sequence
ccttatgtatcagcgtaattgtct

SEQ ID NO: 219469 - DNA, 24 bp, Artificial sequence
  SiRNA target sequence
cttatgtatcagcgtaattgtctt

SEQ ID NO: 219470 - DNA, 24 bp, Artificial sequence
  SiRNA target sequence
ttatgtatcagcgtaattgtcttt

SEQ ID NO: 219471 - DNA, 24 bp, Artificial sequence
  SiRNA target sequence
tatgtatcagcgtaattgtctttt

SEQ ID NO: 219472 - DNA, 24 bp, Artificial sequence
  SiRNA target sequence
atgtatcagcgtaattgtcttttt

SEQ ID NO: 219473 - DNA, 24 bp, Artificial sequence
  SiRNA target sequence
tgtatcagcgtaattgtctttttt

SEQ ID NO: 219474 - DNA, 24 bp, Artificial sequence
  SiRNA target sequence
gtatcagcgtaattgtcttttttg

SEQ ID NO: 219475 - DNA, 24 bp, Artificial sequence
  SiRNA target sequence
tatcagcgtaattgtcttttttgt

SEQ ID NO: 219476 - DNA, 24 bp, Artificial sequence
  SiRNA target sequence
atcagcgtaattgtcttttttgtt

SEQ ID NO: 219477 - DNA, 24 bp, Artificial sequence
  SiRNA target sequence
tcagcgtaattgtcttttttgtta

SEQ ID NO: 219478 - DNA, 24 bp, Artificial sequence
  SiRNA target sequence
cagcgtaattgtcttttttgttat

SEQ ID NO: 219479 - DNA, 24 bp, Artificial sequence
  SiRNA target sequence
agcgtaattgtcttttttgttatt

SEQ ID NO: 219480 - DNA, 24 bp, Artificial sequence
  SiRNA target sequence
gcgtaattgtcttttttgttatta

SEQ ID NO: 219481 - DNA, 24 bp, Artificial sequence
  SiRNA target sequence
cgtaattgtcttttttgttattat

SEQ ID NO: 219482 - DNA, 24 bp, Artificial sequence
  SiRNA target sequence
gtaattgtcttttttgttattatt

SEQ ID NO: 219483 - DNA, 24 bp, Artificial sequence
  SiRNA target sequence
taattgtcttttttgttattattt

SEQ ID NO: 219484 - DNA, 24 bp, Artificial sequence
  SiRNA target sequence
aattgtcttttttgttattatttg

SEQ ID NO: 219485 - DNA, 24 bp, Artificial sequence
  SiRNA target sequence
attgtcttttttgttattatttgg

SEQ ID NO: 219486 - DNA, 24 bp, Artificial sequence
  SiRNA target sequence
ttgtcttttttgttattatttgga

SEQ ID NO: 219487 - DNA, 24 bp, Artificial sequence
  SiRNA target sequence
tgtcttttttgttattatttggat

SEQ ID NO: 219488 - DNA, 24 bp, Artificial sequence
  SiRNA target sequence
gtcttttttgttattatttggatt

SEQ ID NO: 219489 - DNA, 24 bp, Artificial sequence
  SiRNA target sequence
tcttttttgttattatttggattt

SEQ ID NO: 219490 - DNA, 24 bp, Artificial sequence
  SiRNA target sequence
cttttttgttattatttggattta

SEQ ID NO: 219491 - DNA, 24 bp, Artificial sequence
  SiRNA target sequence
ttttttgttattatttggatttat

SEQ ID NO: 219492 - DNA, 24 bp, Artificial sequence
  SiRNA target sequence
tttttgttattatttggatttatt

SEQ ID NO: 219493 - DNA, 24 bp, Artificial sequence
  SiRNA target sequence
ttttgttattatttggatttattc

SEQ ID NO: 219494 - DNA, 24 bp, Artificial sequence
  SiRNA target sequence
tttgttattatttggatttattca

SEQ ID NO: 219495 - DNA, 24 bp, Artificial sequence
  SiRNA target sequence
ttgttattatttggatttattcag

SEQ ID NO: 219496 - DNA, 24 bp, Artificial sequence
  SiRNA target sequence
tgttattatttggatttattcagt

SEQ ID NO: 219497 - DNA, 24 bp, Artificial sequence
  SiRNA target sequence
gttattatttggatttattcagtt

SEQ ID NO: 219498 - DNA, 24 bp, Artificial sequence
  SiRNA target sequence
ttattatttggatttattcagtta

SEQ ID NO: 219499 - DNA, 24 bp, Artificial sequence
  SiRNA target sequence
tattatttggatttattcagttat

SEQ ID NO: 219500 - DNA, 24 bp, Artificial sequence
  SiRNA target sequence
attatttggatttattcagttatt

SEQ ID NO: 219501 - DNA, 24 bp, Artificial sequence
  SiRNA target sequence
ttatttggatttattcagttattt

SEQ ID NO: 219502 - DNA, 24 bp, Artificial sequence
  SiRNA target sequence
tatttggatttattcagttattta

SEQ ID NO: 219503 - DNA, 24 bp, Artificial sequence
  SiRNA target sequence
atttggatttattcagttatttat

SEQ ID NO: 219504 - DNA, 24 bp, Artificial sequence
  SiRNA target sequence
tttggatttattcagttatttatt

SEQ ID NO: 219505 - DNA, 24 bp, Artificial sequence
  SiRNA target sequence
ttggatttattcagttatttattt

SEQ ID NO: 219506 - DNA, 24 bp, Artificial sequence
  SiRNA target sequence
tggatttattcagttatttattta

SEQ ID NO: 219507 - DNA, 24 bp, Artificial sequence
  SiRNA target sequence
ggatttattcagttatttatttaa

SEQ ID NO: 219508 - DNA, 24 bp, Artificial sequence
  SiRNA target sequence
gatttattcagttatttatttaaa

SEQ ID NO: 219509 - DNA, 24 bp, Artificial sequence
  SiRNA target sequence
atttattcagttatttatttaaat

SEQ ID NO: 219510 - DNA, 24 bp, Artificial sequence
  SiRNA target sequence
tttattcagttatttatttaaata

SEQ ID NO: 219511 - DNA, 24 bp, Artificial sequence
  SiRNA target sequence
ttattcagttatttatttaaataa

SEQ ID NO: 219512 - DNA, 24 bp, Artificial sequence
  SiRNA target sequence
tattcagttatttatttaaataag

SEQ ID NO: 219513 - DNA, 24 bp, Artificial sequence
  SiRNA target sequence
attcagttatttatttaaataaga

SEQ ID NO: 219514 - DNA, 24 bp, Artificial sequence
  SiRNA target sequence
ttcagttatttatttaaataagaa

SEQ ID NO: 219515 - DNA, 24 bp, Artificial sequence
  SiRNA target sequence
tcagttatttatttaaataagaaa

SEQ ID NO: 219516 - DNA, 24 bp, Artificial sequence
  SiRNA target sequence
cagttatttatttaaataagaaat

SEQ ID NO: 219517 - DNA, 24 bp, Artificial sequence
  SiRNA target sequence
agttatttatttaaataagaaata

SEQ ID NO: 219518 - DNA, 24 bp, Artificial sequence
  SiRNA target sequence
gttatttatttaaataagaaatac

SEQ ID NO: 219519 - DNA, 24 bp, Artificial sequence
  SiRNA target sequence
ttatttatttaaataagaaataca

SEQ ID NO: 219520 - DNA, 24 bp, Artificial sequence
  SiRNA target sequence
tatttatttaaataagaaatacaa

SEQ ID NO: 219521 - DNA, 24 bp, Artificial sequence
  SiRNA target sequence
atttatttaaataagaaatacaaa

SEQ ID NO: 219522 - DNA, 24 bp, Artificial sequence
  SiRNA target sequence
tttatttaaataagaaatacaaag

SEQ ID NO: 219523 - DNA, 24 bp, Artificial sequence
  SiRNA target sequence
ttatttaaataagaaatacaaaga

SEQ ID NO: 219524 - DNA, 24 bp, Artificial sequence
  SiRNA target sequence
tatttaaataagaaatacaaagaa

SEQ ID NO: 219525 - DNA, 24 bp, Artificial sequence
  SiRNA target sequence
atttaaataagaaatacaaagaat

SEQ ID NO: 219526 - DNA, 24 bp, Artificial sequence
  SiRNA target sequence
tttaaataagaaatacaaagaatc

SEQ ID NO: 219527 - DNA, 24 bp, Artificial sequence
  SiRNA target sequence
ttaaataagaaatacaaagaatca

SEQ ID NO: 219528 - DNA, 24 bp, Artificial sequence
  SiRNA target sequence
taaataagaaatacaaagaatcag

SEQ ID NO: 219529 - DNA, 24 bp, Artificial sequence
  SiRNA target sequence
aaataagaaatacaaagaatcagt

SEQ ID NO: 219530 - DNA, 24 bp, Artificial sequence
  SiRNA target sequence
aataagaaatacaaagaatcagtt

SEQ ID NO: 219531 - DNA, 24 bp, Artificial sequence
  SiRNA target sequence
ataagaaatacaaagaatcagttg

SEQ ID NO: 219532 - DNA, 24 bp, Artificial sequence
  SiRNA target sequence
taagaaatacaaagaatcagttgt

SEQ ID NO: 219533 - DNA, 24 bp, Artificial sequence
  SiRNA target sequence
aagaaatacaaagaatcagttgtt

SEQ ID NO: 219534 - DNA, 24 bp, Artificial sequence
  SiRNA target sequence
agaaatacaaagaatcagttgtta

SEQ ID NO: 219535 - DNA, 24 bp, Artificial sequence
  SiRNA target sequence
gaaatacaaagaatcagttgttag

SEQ ID NO: 219536 - DNA, 24 bp, Artificial sequence
  SiRNA target sequence
aaatacaaagaatcagttgttagt

SEQ ID NO: 219537 - DNA, 24 bp, Artificial sequence
  SiRNA target sequence
aatacaaagaatcagttgttagta

SEQ ID NO: 219538 - DNA, 24 bp, Artificial sequence
  SiRNA target sequence
atacaaagaatcagttgttagtaa

SEQ ID NO: 219539 - DNA, 24 bp, Artificial sequence
  SiRNA target sequence
tacaaagaatcagttgttagtaat

SEQ ID NO: 219540 - DNA, 24 bp, Artificial sequence
  SiRNA target sequence
acaaagaatcagttgttagtaatt

SEQ ID NO: 219541 - DNA, 24 bp, Artificial sequence
  SiRNA target sequence
caaagaatcagttgttagtaattt

SEQ ID NO: 219542 - DNA, 24 bp, Artificial sequence
  SiRNA target sequence
aaagaatcagttgttagtaattta

SEQ ID NO: 219543 - DNA, 24 bp, Artificial sequence
  SiRNA target sequence
aagaatcagttgttagtaatttac

SEQ ID NO: 219544 - DNA, 24 bp, Artificial sequence
  SiRNA target sequence
agaatcagttgttagtaatttacc

SEQ ID NO: 219545 - DNA, 24 bp, Artificial sequence
  SiRNA target sequence
gaatcagttgttagtaatttaccc

SEQ ID NO: 219546 - DNA, 24 bp, Artificial sequence
  SiRNA target sequence
aatcagttgttagtaatttaccca

SEQ ID NO: 219547 - DNA, 24 bp, Artificial sequence
  SiRNA target sequence
atcagttgttagtaatttacccat

SEQ ID NO: 219548 - DNA, 24 bp, Artificial sequence
  SiRNA target sequence
tcagttgttagtaatttacccatc

SEQ ID NO: 219549 - DNA, 24 bp, Artificial sequence
  SiRNA target sequence
cagttgttagtaatttacccatcg

SEQ ID NO: 219550 - DNA, 24 bp, Artificial sequence
  SiRNA target sequence
agttgttagtaatttacccatcga

SEQ ID NO: 219551 - DNA, 24 bp, Artificial sequence
  SiRNA target sequence
gttgttagtaatttacccatcgat

SEQ ID NO: 219552 - DNA, 24 bp, Artificial sequence
  SiRNA target sequence
ttgttagtaatttacccatcgatg

SEQ ID NO: 219553 - DNA, 24 bp, Artificial sequence
  SiRNA target sequence
tgttagtaatttacccatcgatgt

SEQ ID NO: 219554 - DNA, 24 bp, Artificial sequence
  SiRNA target sequence
gttagtaatttacccatcgatgtt

SEQ ID NO: 219555 - DNA, 24 bp, Artificial sequence
  SiRNA target sequence
ttagtaatttacccatcgatgttg

SEQ ID NO: 219556 - DNA, 24 bp, Artificial sequence
  SiRNA target sequence
tagtaatttacccatcgatgttga

SEQ ID NO: 219557 - DNA, 24 bp, Artificial sequence
  SiRNA target sequence
agtaatttacccatcgatgttgat

SEQ ID NO: 219558 - DNA, 24 bp, Artificial sequence
  SiRNA target sequence
gtaatttacccatcgatgttgatt

SEQ ID NO: 219559 - DNA, 24 bp, Artificial sequence
  SiRNA target sequence
taatttacccatcgatgttgattt

SEQ ID NO: 219560 - DNA, 24 bp, Artificial sequence
  SiRNA target sequence
aatttacccatcgatgttgatttg

SEQ ID NO: 219561 - DNA, 24 bp, Artificial sequence
  SiRNA target sequence
atttacccatcgatgttgatttgt

SEQ ID NO: 219562 - DNA, 24 bp, Artificial sequence
  SiRNA target sequence
tttacccatcgatgttgatttgtt

SEQ ID NO: 219563 - DNA, 24 bp, Artificial sequence
  SiRNA target sequence
ttacccatcgatgttgatttgttt

SEQ ID NO: 219564 - DNA, 24 bp, Artificial sequence
  SiRNA target sequence
tacccatcgatgttgatttgtttg

SEQ ID NO: 219565 - DNA, 24 bp, Artificial sequence
  SiRNA target sequence
acccatcgatgttgatttgtttgc

SEQ ID NO: 219566 - DNA, 24 bp, Artificial sequence
  SiRNA target sequence
cccatcgatgttgatttgtttgca

SEQ ID NO: 219567 - DNA, 24 bp, Artificial sequence
  SiRNA target sequence
ccatcgatgttgatttgtttgcat

SEQ ID NO: 219568 - DNA, 24 bp, Artificial sequence
  SiRNA target sequence
catcgatgttgatttgtttgcatc

SEQ ID NO: 219569 - DNA, 24 bp, Artificial sequence
  SiRNA target sequence
atcgatgttgatttgtttgcatca

SEQ ID NO: 219570 - DNA, 24 bp, Artificial sequence
  SiRNA target sequence
tcgatgttgatttgtttgcatcaa

SEQ ID NO: 219571 - DNA, 24 bp, Artificial sequence
  SiRNA target sequence
cgatgttgatttgtttgcatcaaa

SEQ ID NO: 219572 - DNA, 24 bp, Artificial sequence
  SiRNA target sequence
gatgttgatttgtttgcatcaaag

SEQ ID NO: 219573 - DNA, 24 bp, Artificial sequence
  SiRNA target sequence
atgttgatttgtttgcatcaaagt

SEQ ID NO: 219574 - DNA, 24 bp, Artificial sequence
  SiRNA target sequence
tgttgatttgtttgcatcaaagtt

SEQ ID NO: 219575 - DNA, 24 bp, Artificial sequence
  SiRNA target sequence
gttgatttgtttgcatcaaagttg

SEQ ID NO: 219576 - DNA, 24 bp, Artificial sequence
  SiRNA target sequence
ttgatttgtttgcatcaaagttgt

SEQ ID NO: 219577 - DNA, 24 bp, Artificial sequence
  SiRNA target sequence
tgatttgtttgcatcaaagttgtt

SEQ ID NO: 219578 - DNA, 24 bp, Artificial sequence
  SiRNA target sequence
gatttgtttgcatcaaagttgtta

SEQ ID NO: 219579 - DNA, 24 bp, Artificial sequence
  SiRNA target sequence
atttgtttgcatcaaagttgttag

SEQ ID NO: 219580 - DNA, 24 bp, Artificial sequence
  SiRNA target sequence
tttgtttgcatcaaagttgttaga

SEQ ID NO: 219581 - DNA, 24 bp, Artificial sequence
  SiRNA target sequence
ttgtttgcatcaaagttgttagat

SEQ ID NO: 219582 - DNA, 24 bp, Artificial sequence
  SiRNA target sequence
tgtttgcatcaaagttgttagata

SEQ ID NO: 219583 - DNA, 24 bp, Artificial sequence
  SiRNA target sequence
gtttgcatcaaagttgttagataa

SEQ ID NO: 219584 - DNA, 24 bp, Artificial sequence
  SiRNA target sequence
tttgcatcaaagttgttagataat

SEQ ID NO: 219585 - DNA, 24 bp, Artificial sequence
  SiRNA target sequence
ttgcatcaaagttgttagataata

SEQ ID NO: 219586 - DNA, 24 bp, Artificial sequence
  SiRNA target sequence
tgcatcaaagttgttagataataa

SEQ ID NO: 219587 - DNA, 24 bp, Artificial sequence
  SiRNA target sequence
gcatcaaagttgttagataataaa

SEQ ID NO: 219588 - DNA, 24 bp, Artificial sequence
  SiRNA target sequence
catcaaagttgttagataataaaa

SEQ ID NO: 219589 - DNA, 24 bp, Artificial sequence
  SiRNA target sequence
atcaaagttgttagataataaaaa

SEQ ID NO: 219590 - DNA, 24 bp, Artificial sequence
  SiRNA target sequence
tcaaagttgttagataataaaaaa

SEQ ID NO: 219591 - DNA, 24 bp, Artificial sequence
  SiRNA target sequence
caaagttgttagataataaaaaag

SEQ ID NO: 219592 - DNA, 24 bp, Artificial sequence
  SiRNA target sequence
aaagttgttagataataaaaaaga

SEQ ID NO: 219593 - DNA, 24 bp, Artificial sequence
  SiRNA target sequence
aagttgttagataataaaaaagaa

SEQ ID NO: 219594 - DNA, 24 bp, Artificial sequence
  SiRNA target sequence
agttgttagataataaaaaagaag

SEQ ID NO: 219595 - DNA, 24 bp, Artificial sequence
  SiRNA target sequence
gttgttagataataaaaaagaaga

SEQ ID NO: 219596 - DNA, 24 bp, Artificial sequence
  SiRNA target sequence
ttgttagataataaaaaagaagag

SEQ ID NO: 219597 - DNA, 24 bp, Artificial sequence
  SiRNA target sequence
tgttagataataaaaaagaagagg

SEQ ID NO: 219598 - DNA, 24 bp, Artificial sequence
  SiRNA target sequence
gttagataataaaaaagaagagga

SEQ ID NO: 219599 - DNA, 24 bp, Artificial sequence
  SiRNA target sequence
ttagataataaaaaagaagaggaa

SEQ ID NO: 219600 - DNA, 24 bp, Artificial sequence
  SiRNA target sequence
tagataataaaaaagaagaggaaa

SEQ ID NO: 219601 - DNA, 24 bp, Artificial sequence
  SiRNA target sequence
agataataaaaaagaagaggaaat

SEQ ID NO: 219602 - DNA, 24 bp, Artificial sequence
  SiRNA target sequence
gataataaaaaagaagaggaaatt

SEQ ID NO: 219603 - DNA, 24 bp, Artificial sequence
  SiRNA target sequence
ataataaaaaagaagaggaaattg

SEQ ID NO: 219604 - DNA, 24 bp, Artificial sequence
  SiRNA target sequence
taataaaaaagaagaggaaattga

SEQ ID NO: 219605 - DNA, 24 bp, Artificial sequence
  SiRNA target sequence
aataaaaaagaagaggaaattgat

SEQ ID NO: 219606 - DNA, 24 bp, Artificial sequence
  SiRNA target sequence
ataaaaaagaagaggaaattgatg

SEQ ID NO: 219607 - DNA, 24 bp, Artificial sequence
  SiRNA target sequence
taaaaaagaagaggaaattgatgt

SEQ ID NO: 219608 - DNA, 24 bp, Artificial sequence
  SiRNA target sequence
aaaaaagaagaggaaattgatgtg

SEQ ID NO: 219609 - DNA, 24 bp, Artificial sequence
  SiRNA target sequence
aaaaagaagaggaaattgatgtgt

SEQ ID NO: 219610 - DNA, 24 bp, Artificial sequence
  SiRNA target sequence
aaaagaagaggaaattgatgtgtc

SEQ ID NO: 219611 - DNA, 24 bp, Artificial sequence
  SiRNA target sequence
aaagaagaggaaattgatgtgtca

SEQ ID NO: 219612 - DNA, 24 bp, Artificial sequence
  SiRNA target sequence
aagaagaggaaattgatgtgtcag

SEQ ID NO: 219613 - DNA, 24 bp, Artificial sequence
  SiRNA target sequence
agaagaggaaattgatgtgtcagt

SEQ ID NO: 219614 - DNA, 24 bp, Artificial sequence
  SiRNA target sequence
gaagaggaaattgatgtgtcagtg

SEQ ID NO: 219615 - DNA, 24 bp, Artificial sequence
  SiRNA target sequence
aagaggaaattgatgtgtcagtgc

SEQ ID NO: 219616 - DNA, 24 bp, Artificial sequence
  SiRNA target sequence
agaggaaattgatgtgtcagtgct

SEQ ID NO: 219617 - DNA, 24 bp, Artificial sequence
  SiRNA target sequence
gaggaaattgatgtgtcagtgctc

SEQ ID NO: 219618 - DNA, 24 bp, Artificial sequence
  SiRNA target sequence
aggaaattgatgtgtcagtgctcg

SEQ ID NO: 219619 - DNA, 24 bp, Artificial sequence
  SiRNA target sequence
ggaaattgatgtgtcagtgctcgt

SEQ ID NO: 219620 - DNA, 24 bp, Artificial sequence
  SiRNA target sequence
gaaattgatgtgtcagtgctcgtt

SEQ ID NO: 219621 - DNA, 24 bp, Artificial sequence
  SiRNA target sequence
aaattgatgtgtcagtgctcgtta

SEQ ID NO: 219622 - DNA, 24 bp, Artificial sequence
  SiRNA target sequence
aattgatgtgtcagtgctcgttaa

SEQ ID NO: 219623 - DNA, 24 bp, Artificial sequence
  SiRNA target sequence
attgatgtgtcagtgctcgttaat

SEQ ID NO: 219624 - DNA, 24 bp, Artificial sequence
  SiRNA target sequence
ttgatgtgtcagtgctcgttaatt

SEQ ID NO: 219625 - DNA, 24 bp, Artificial sequence
  SiRNA target sequence
tgatgtgtcagtgctcgttaatta

SEQ ID NO: 219626 - DNA, 24 bp, Artificial sequence
  SiRNA target sequence
gatgtgtcagtgctcgttaattaa

SEQ ID NO: 219627 - DNA, 25 bp, Artificial sequence
  SiRNA target sequence
atgattgagaggggtattatggaaa

SEQ ID NO: 219628 - DNA, 25 bp, Artificial sequence
  SiRNA target sequence
tgattgagaggggtattatggaaaa

SEQ ID NO: 219629 - DNA, 25 bp, Artificial sequence
  SiRNA target sequence
gattgagaggggtattatggaaaaa

SEQ ID NO: 219630 - DNA, 25 bp, Artificial sequence
  SiRNA target sequence
attgagaggggtattatggaaaaaa

SEQ ID NO: 219631 - DNA, 25 bp, Artificial sequence
  SiRNA target sequence
ttgagaggggtattatggaaaaaat

SEQ ID NO: 219632 - DNA, 25 bp, Artificial sequence
  SiRNA target sequence
tgagaggggtattatggaaaaaata

SEQ ID NO: 219633 - DNA, 25 bp, Artificial sequence
  SiRNA target sequence
gagaggggtattatggaaaaaataa

SEQ ID NO: 219634 - DNA, 25 bp, Artificial sequence
  SiRNA target sequence
agaggggtattatggaaaaaataaa

SEQ ID NO: 219635 - DNA, 25 bp, Artificial sequence
  SiRNA target sequence
gaggggtattatggaaaaaataaaa

SEQ ID NO: 219636 - DNA, 25 bp, Artificial sequence
  SiRNA target sequence
aggggtattatggaaaaaataaaaa

SEQ ID NO: 219637 - DNA, 25 bp, Artificial sequence
  SiRNA target sequence
ggggtattatggaaaaaataaaaaa

SEQ ID NO: 219638 - DNA, 25 bp, Artificial sequence
  SiRNA target sequence
gggtattatggaaaaaataaaaaat

SEQ ID NO: 219639 - DNA, 25 bp, Artificial sequence
  SiRNA target sequence
ggtattatggaaaaaataaaaaatt

SEQ ID NO: 219640 - DNA, 25 bp, Artificial sequence
  SiRNA target sequence
gtattatggaaaaaataaaaaattt

SEQ ID NO: 219641 - DNA, 25 bp, Artificial sequence
  SiRNA target sequence
tattatggaaaaaataaaaaattta

SEQ ID NO: 219642 - DNA, 25 bp, Artificial sequence
  SiRNA target sequence
attatggaaaaaataaaaaatttat

SEQ ID NO: 219643 - DNA, 25 bp, Artificial sequence
  SiRNA target sequence
ttatggaaaaaataaaaaatttatt

SEQ ID NO: 219644 - DNA, 25 bp, Artificial sequence
  SiRNA target sequence
tatggaaaaaataaaaaatttatta

SEQ ID NO: 219645 - DNA, 25 bp, Artificial sequence
  SiRNA target sequence
atggaaaaaataaaaaatttattaa

SEQ ID NO: 219646 - DNA, 25 bp, Artificial sequence
  SiRNA target sequence
tggaaaaaataaaaaatttattaac

SEQ ID NO: 219647 - DNA, 25 bp, Artificial sequence
  SiRNA target sequence
ggaaaaaataaaaaatttattaaca

SEQ ID NO: 219648 - DNA, 25 bp, Artificial sequence
  SiRNA target sequence
gaaaaaataaaaaatttattaacag

SEQ ID NO: 219649 - DNA, 25 bp, Artificial sequence
  SiRNA target sequence
aaaaaataaaaaatttattaacaga

SEQ ID NO: 219650 - DNA, 25 bp, Artificial sequence
  SiRNA target sequence
aaaaataaaaaatttattaacagag

SEQ ID NO: 219651 - DNA, 25 bp, Artificial sequence
  SiRNA target sequence
aaaataaaaaatttattaacagagg

SEQ ID NO: 219652 - DNA, 25 bp, Artificial sequence
  SiRNA target sequence
aaataaaaaatttattaacagagga

SEQ ID NO: 219653 - DNA, 25 bp, Artificial sequence
  SiRNA target sequence
aataaaaaatttattaacagaggat

SEQ ID NO: 219654 - DNA, 25 bp, Artificial sequence
  SiRNA target sequence
ataaaaaatttattaacagaggatg

SEQ ID NO: 219655 - DNA, 25 bp, Artificial sequence
  SiRNA target sequence
taaaaaatttattaacagaggatga

SEQ ID NO: 219656 - DNA, 25 bp, Artificial sequence
  SiRNA target sequence
aaaaaatttattaacagaggatgaa

SEQ ID NO: 219657 - DNA, 25 bp, Artificial sequence
  SiRNA target sequence
aaaaatttattaacagaggatgaag

SEQ ID NO: 219658 - DNA, 25 bp, Artificial sequence
  SiRNA target sequence
aaaatttattaacagaggatgaagt

SEQ ID NO: 219659 - DNA, 25 bp, Artificial sequence
  SiRNA target sequence
aaatttattaacagaggatgaagta

SEQ ID NO: 219660 - DNA, 25 bp, Artificial sequence
  SiRNA target sequence
aatttattaacagaggatgaagtag

SEQ ID NO: 219661 - DNA, 25 bp, Artificial sequence
  SiRNA target sequence
atttattaacagaggatgaagtaga

SEQ ID NO: 219662 - DNA, 25 bp, Artificial sequence
  SiRNA target sequence
tttattaacagaggatgaagtagaa

SEQ ID NO: 219663 - DNA, 25 bp, Artificial sequence
  SiRNA target sequence
ttattaacagaggatgaagtagaag

SEQ ID NO: 219664 - DNA, 25 bp, Artificial sequence
  SiRNA target sequence
tattaacagaggatgaagtagaagc

SEQ ID NO: 219665 - DNA, 25 bp, Artificial sequence
  SiRNA target sequence
attaacagaggatgaagtagaagca

SEQ ID NO: 219666 - DNA, 25 bp, Artificial sequence
  SiRNA target sequence
ttaacagaggatgaagtagaagcag

SEQ ID NO: 219667 - DNA, 25 bp, Artificial sequence
  SiRNA target sequence
taacagaggatgaagtagaagcaga

SEQ ID NO: 219668 - DNA, 25 bp, Artificial sequence
  SiRNA target sequence
aacagaggatgaagtagaagcagaa

SEQ ID NO: 219669 - DNA, 25 bp, Artificial sequence
  SiRNA target sequence
acagaggatgaagtagaagcagaag

SEQ ID NO: 219670 - DNA, 25 bp, Artificial sequence
  SiRNA target sequence
cagaggatgaagtagaagcagaagc

SEQ ID NO: 219671 - DNA, 25 bp, Artificial sequence
  SiRNA target sequence
agaggatgaagtagaagcagaagca

SEQ ID NO: 219672 - DNA, 25 bp, Artificial sequence
  SiRNA target sequence
gaggatgaagtagaagcagaagcaa

SEQ ID NO: 219673 - DNA, 25 bp, Artificial sequence
  SiRNA target sequence
aggatgaagtagaagcagaagcaaa

SEQ ID NO: 219674 - DNA, 25 bp, Artificial sequence
  SiRNA target sequence
ggatgaagtagaagcagaagcaaat

SEQ ID NO: 219675 - DNA, 25 bp, Artificial sequence
  SiRNA target sequence
gatgaagtagaagcagaagcaaatt

SEQ ID NO: 219676 - DNA, 25 bp, Artificial sequence
  SiRNA target sequence
atgaagtagaagcagaagcaaattc

SEQ ID NO: 219677 - DNA, 25 bp, Artificial sequence
  SiRNA target sequence
tgaagtagaagcagaagcaaattct

SEQ ID NO: 219678 - DNA, 25 bp, Artificial sequence
  SiRNA target sequence
gaagtagaagcagaagcaaattctg

SEQ ID NO: 219679 - DNA, 25 bp, Artificial sequence
  SiRNA target sequence
aagtagaagcagaagcaaattctgg

SEQ ID NO: 219680 - DNA, 25 bp, Artificial sequence
  SiRNA target sequence
agtagaagcagaagcaaattctgga

SEQ ID NO: 219681 - DNA, 25 bp, Artificial sequence
  SiRNA target sequence
gtagaagcagaagcaaattctggaa

SEQ ID NO: 219682 - DNA, 25 bp, Artificial sequence
  SiRNA target sequence
tagaagcagaagcaaattctggaag

SEQ ID NO: 219683 - DNA, 25 bp, Artificial sequence
  SiRNA target sequence
agaagcagaagcaaattctggaagg

SEQ ID NO: 219684 - DNA, 25 bp, Artificial sequence
  SiRNA target sequence
gaagcagaagcaaattctggaaggg

SEQ ID NO: 219685 - DNA, 25 bp, Artificial sequence
  SiRNA target sequence
aagcagaagcaaattctggaagggg

SEQ ID NO: 219686 - DNA, 25 bp, Artificial sequence
  SiRNA target sequence
agcagaagcaaattctggaaggggc

SEQ ID NO: 219687 - DNA, 25 bp, Artificial sequence
  SiRNA target sequence
gcagaagcaaattctggaaggggca

SEQ ID NO: 219688 - DNA, 25 bp, Artificial sequence
  SiRNA target sequence
cagaagcaaattctggaaggggcat

SEQ ID NO: 219689 - DNA, 25 bp, Artificial sequence
  SiRNA target sequence
agaagcaaattctggaaggggcatt

SEQ ID NO: 219690 - DNA, 25 bp, Artificial sequence
  SiRNA target sequence
gaagcaaattctggaaggggcattt

SEQ ID NO: 219691 - DNA, 25 bp, Artificial sequence
  SiRNA target sequence
aagcaaattctggaaggggcatttt

SEQ ID NO: 219692 - DNA, 25 bp, Artificial sequence
  SiRNA target sequence
agcaaattctggaaggggcatttta

SEQ ID NO: 219693 - DNA, 25 bp, Artificial sequence
  SiRNA target sequence
gcaaattctggaaggggcattttat

SEQ ID NO: 219694 - DNA, 25 bp, Artificial sequence
  SiRNA target sequence
caaattctggaaggggcattttatc

SEQ ID NO: 219695 - DNA, 25 bp, Artificial sequence
  SiRNA target sequence
aaattctggaaggggcattttatca

SEQ ID NO: 219696 - DNA, 25 bp, Artificial sequence
  SiRNA target sequence
aattctggaaggggcattttatcaa

SEQ ID NO: 219697 - DNA, 25 bp, Artificial sequence
  SiRNA target sequence
attctggaaggggcattttatcaat

SEQ ID NO: 219698 - DNA, 25 bp, Artificial sequence
  SiRNA target sequence
ttctggaaggggcattttatcaata

SEQ ID NO: 219699 - DNA, 25 bp, Artificial sequence
  SiRNA target sequence
tctggaaggggcattttatcaatat

SEQ ID NO: 219700 - DNA, 25 bp, Artificial sequence
  SiRNA target sequence
ctggaaggggcattttatcaatatt

SEQ ID NO: 219701 - DNA, 25 bp, Artificial sequence
  SiRNA target sequence
tggaaggggcattttatcaatattt

SEQ ID NO: 219702 - DNA, 25 bp, Artificial sequence
  SiRNA target sequence
ggaaggggcattttatcaatattta

SEQ ID NO: 219703 - DNA, 25 bp, Artificial sequence
  SiRNA target sequence
gaaggggcattttatcaatatttag

SEQ ID NO: 219704 - DNA, 25 bp, Artificial sequence
  SiRNA target sequence
aaggggcattttatcaatatttaga

SEQ ID NO: 219705 - DNA, 25 bp, Artificial sequence
  SiRNA target sequence
aggggcattttatcaatatttagaa

SEQ ID NO: 219706 - DNA, 25 bp, Artificial sequence
  SiRNA target sequence
ggggcattttatcaatatttagaat

SEQ ID NO: 219707 - DNA, 25 bp, Artificial sequence
  SiRNA target sequence
gggcattttatcaatatttagaatt

SEQ ID NO: 219708 - DNA, 25 bp, Artificial sequence
  SiRNA target sequence
ggcattttatcaatatttagaattg

SEQ ID NO: 219709 - DNA, 25 bp, Artificial sequence
  SiRNA target sequence
gcattttatcaatatttagaattgc

SEQ ID NO: 219710 - DNA, 25 bp, Artificial sequence
  SiRNA target sequence
cattttatcaatatttagaattgct

SEQ ID NO: 219711 - DNA, 25 bp, Artificial sequence
  SiRNA target sequence
attttatcaatatttagaattgcta

SEQ ID NO: 219712 - DNA, 25 bp, Artificial sequence
  SiRNA target sequence
ttttatcaatatttagaattgctaa

SEQ ID NO: 219713 - DNA, 25 bp, Artificial sequence
  SiRNA target sequence
tttatcaatatttagaattgctaag

SEQ ID NO: 219714 - DNA, 25 bp, Artificial sequence
  SiRNA target sequence
ttatcaatatttagaattgctaagg

SEQ ID NO: 219715 - DNA, 25 bp, Artificial sequence
  SiRNA target sequence
tatcaatatttagaattgctaaggt

SEQ ID NO: 219716 - DNA, 25 bp, Artificial sequence
  SiRNA target sequence
atcaatatttagaattgctaaggta

SEQ ID NO: 219717 - DNA, 25 bp, Artificial sequence
  SiRNA target sequence
tcaatatttagaattgctaaggtag

SEQ ID NO: 219718 - DNA, 25 bp, Artificial sequence
  SiRNA target sequence
caatatttagaattgctaaggtaga

SEQ ID NO: 219719 - DNA, 25 bp, Artificial sequence
  SiRNA target sequence
aatatttagaattgctaaggtagaa

SEQ ID NO: 219720 - DNA, 25 bp, Artificial sequence
  SiRNA target sequence
atatttagaattgctaaggtagaaa

SEQ ID NO: 219721 - DNA, 25 bp, Artificial sequence
  SiRNA target sequence
tatttagaattgctaaggtagaaag

SEQ ID NO: 219722 - DNA, 25 bp, Artificial sequence
  SiRNA target sequence
atttagaattgctaaggtagaaaga

SEQ ID NO: 219723 - DNA, 25 bp, Artificial sequence
  SiRNA target sequence
tttagaattgctaaggtagaaagaa

SEQ ID NO: 219724 - DNA, 25 bp, Artificial sequence
  SiRNA target sequence
ttagaattgctaaggtagaaagaag

SEQ ID NO: 219725 - DNA, 25 bp, Artificial sequence
  SiRNA target sequence
tagaattgctaaggtagaaagaaga

SEQ ID NO: 219726 - DNA, 25 bp, Artificial sequence
  SiRNA target sequence
agaattgctaaggtagaaagaagaa

SEQ ID NO: 219727 - DNA, 25 bp, Artificial sequence
  SiRNA target sequence
gaattgctaaggtagaaagaagaat

SEQ ID NO: 219728 - DNA, 25 bp, Artificial sequence
  SiRNA target sequence
aattgctaaggtagaaagaagaatg

SEQ ID NO: 219729 - DNA, 25 bp, Artificial sequence
  SiRNA target sequence
attgctaaggtagaaagaagaatgt

SEQ ID NO: 219730 - DNA, 25 bp, Artificial sequence
  SiRNA target sequence
ttgctaaggtagaaagaagaatgtt

SEQ ID NO: 219731 - DNA, 25 bp, Artificial sequence
  SiRNA target sequence
tgctaaggtagaaagaagaatgttt

SEQ ID NO: 219732 - DNA, 25 bp, Artificial sequence
  SiRNA target sequence
gctaaggtagaaagaagaatgtttt

SEQ ID NO: 219733 - DNA, 25 bp, Artificial sequence
  SiRNA target sequence
ctaaggtagaaagaagaatgttttg

SEQ ID NO: 219734 - DNA, 25 bp, Artificial sequence
  SiRNA target sequence
taaggtagaaagaagaatgttttgg

SEQ ID NO: 219735 - DNA, 25 bp, Artificial sequence
  SiRNA target sequence
aaggtagaaagaagaatgttttggc

SEQ ID NO: 219736 - DNA, 25 bp, Artificial sequence
  SiRNA target sequence
aggtagaaagaagaatgttttggct

SEQ ID NO: 219737 - DNA, 25 bp, Artificial sequence
  SiRNA target sequence
ggtagaaagaagaatgttttggctt

SEQ ID NO: 219738 - DNA, 25 bp, Artificial sequence
  SiRNA target sequence
gtagaaagaagaatgttttggctta

SEQ ID NO: 219739 - DNA, 25 bp, Artificial sequence
  SiRNA target sequence
tagaaagaagaatgttttggcttat

SEQ ID NO: 219740 - DNA, 25 bp, Artificial sequence
  SiRNA target sequence
agaaagaagaatgttttggcttatg

SEQ ID NO: 219741 - DNA, 25 bp, Artificial sequence
  SiRNA target sequence
gaaagaagaatgttttggcttatga

SEQ ID NO: 219742 - DNA, 25 bp, Artificial sequence
  SiRNA target sequence
aaagaagaatgttttggcttatgac

SEQ ID NO: 219743 - DNA, 25 bp, Artificial sequence
  SiRNA target sequence
aagaagaatgttttggcttatgacg

SEQ ID NO: 219744 - DNA, 25 bp, Artificial sequence
  SiRNA target sequence
agaagaatgttttggcttatgacgc

SEQ ID NO: 219745 - DNA, 25 bp, Artificial sequence
  SiRNA target sequence
gaagaatgttttggcttatgacgct

SEQ ID NO: 219746 - DNA, 25 bp, Artificial sequence
  SiRNA target sequence
aagaatgttttggcttatgacgctt

SEQ ID NO: 219747 - DNA, 25 bp, Artificial sequence
  SiRNA target sequence
agaatgttttggcttatgacgctta

SEQ ID NO: 219748 - DNA, 25 bp, Artificial sequence
  SiRNA target sequence
gaatgttttggcttatgacgcttat

SEQ ID NO: 219749 - DNA, 25 bp, Artificial sequence
  SiRNA target sequence
aatgttttggcttatgacgcttatg

SEQ ID NO: 219750 - DNA, 25 bp, Artificial sequence
  SiRNA target sequence
atgttttggcttatgacgcttatgt

SEQ ID NO: 219751 - DNA, 25 bp, Artificial sequence
  SiRNA target sequence
tgttttggcttatgacgcttatgtt

SEQ ID NO: 219752 - DNA, 25 bp, Artificial sequence
  SiRNA target sequence
gttttggcttatgacgcttatgttt

SEQ ID NO: 219753 - DNA, 25 bp, Artificial sequence
  SiRNA target sequence
ttttggcttatgacgcttatgtttt

SEQ ID NO: 219754 - DNA, 25 bp, Artificial sequence
  SiRNA target sequence
tttggcttatgacgcttatgttttc

SEQ ID NO: 219755 - DNA, 25 bp, Artificial sequence
  SiRNA target sequence
ttggcttatgacgcttatgttttcg

SEQ ID NO: 219756 - DNA, 25 bp, Artificial sequence
  SiRNA target sequence
tggcttatgacgcttatgttttcgc

SEQ ID NO: 219757 - DNA, 25 bp, Artificial sequence
  SiRNA target sequence
ggcttatgacgcttatgttttcgct

SEQ ID NO: 219758 - DNA, 25 bp, Artificial sequence
  SiRNA target sequence
gcttatgacgcttatgttttcgctt

SEQ ID NO: 219759 - DNA, 25 bp, Artificial sequence
  SiRNA target sequence
cttatgacgcttatgttttcgctta

SEQ ID NO: 219760 - DNA, 25 bp, Artificial sequence
  SiRNA target sequence
ttatgacgcttatgttttcgcttat

SEQ ID NO: 219761 - DNA, 25 bp, Artificial sequence
  SiRNA target sequence
tatgacgcttatgttttcgcttatt

SEQ ID NO: 219762 - DNA, 25 bp, Artificial sequence
  SiRNA target sequence
atgacgcttatgttttcgcttattt

SEQ ID NO: 219763 - DNA, 25 bp, Artificial sequence
  SiRNA target sequence
tgacgcttatgttttcgcttatttc

SEQ ID NO: 219764 - DNA, 25 bp, Artificial sequence
  SiRNA target sequence
gacgcttatgttttcgcttatttcc

SEQ ID NO: 219765 - DNA, 25 bp, Artificial sequence
  SiRNA target sequence
acgcttatgttttcgcttatttcct

SEQ ID NO: 219766 - DNA, 25 bp, Artificial sequence
  SiRNA target sequence
cgcttatgttttcgcttatttcctt

SEQ ID NO: 219767 - DNA, 25 bp, Artificial sequence
  SiRNA target sequence
gcttatgttttcgcttatttccttt

SEQ ID NO: 219768 - DNA, 25 bp, Artificial sequence
  SiRNA target sequence
cttatgttttcgcttatttccttta

SEQ ID NO: 219769 - DNA, 25 bp, Artificial sequence
  SiRNA target sequence
ttatgttttcgcttatttcctttat

SEQ ID NO: 219770 - DNA, 25 bp, Artificial sequence
  SiRNA target sequence
tatgttttcgcttatttcctttatt

SEQ ID NO: 219771 - DNA, 25 bp, Artificial sequence
  SiRNA target sequence
atgttttcgcttatttcctttattt

SEQ ID NO: 219772 - DNA, 25 bp, Artificial sequence
  SiRNA target sequence
tgttttcgcttatttcctttattta

SEQ ID NO: 219773 - DNA, 25 bp, Artificial sequence
  SiRNA target sequence
gttttcgcttatttcctttatttac

SEQ ID NO: 219774 - DNA, 25 bp, Artificial sequence
  SiRNA target sequence
ttttcgcttatttcctttatttact

SEQ ID NO: 219775 - DNA, 25 bp, Artificial sequence
  SiRNA target sequence
tttcgcttatttcctttatttactc

SEQ ID NO: 219776 - DNA, 25 bp, Artificial sequence
  SiRNA target sequence
ttcgcttatttcctttatttactca

SEQ ID NO: 219777 - DNA, 25 bp, Artificial sequence
  SiRNA target sequence
tcgcttatttcctttatttactcag

SEQ ID NO: 219778 - DNA, 25 bp, Artificial sequence
  SiRNA target sequence
cgcttatttcctttatttactcagt

SEQ ID NO: 219779 - DNA, 25 bp, Artificial sequence
  SiRNA target sequence
gcttatttcctttatttactcagta

SEQ ID NO: 219780 - DNA, 25 bp, Artificial sequence
  SiRNA target sequence
cttatttcctttatttactcagtag

SEQ ID NO: 219781 - DNA, 25 bp, Artificial sequence
  SiRNA target sequence
ttatttcctttatttactcagtagg

SEQ ID NO: 219782 - DNA, 25 bp, Artificial sequence
  SiRNA target sequence
tatttcctttatttactcagtagga

SEQ ID NO: 219783 - DNA, 25 bp, Artificial sequence
  SiRNA target sequence
atttcctttatttactcagtaggac

SEQ ID NO: 219784 - DNA, 25 bp, Artificial sequence
  SiRNA target sequence
tttcctttatttactcagtaggacg

SEQ ID NO: 219785 - DNA, 25 bp, Artificial sequence
  SiRNA target sequence
ttcctttatttactcagtaggacga

SEQ ID NO: 219786 - DNA, 25 bp, Artificial sequence
  SiRNA target sequence
tcctttatttactcagtaggacgag

SEQ ID NO: 219787 - DNA, 25 bp, Artificial sequence
  SiRNA target sequence
cctttatttactcagtaggacgagt

SEQ ID NO: 219788 - DNA, 25 bp, Artificial sequence
  SiRNA target sequence
ctttatttactcagtaggacgagtg

SEQ ID NO: 219789 - DNA, 25 bp, Artificial sequence
  SiRNA target sequence
tttatttactcagtaggacgagtgt

SEQ ID NO: 219790 - DNA, 25 bp, Artificial sequence
  SiRNA target sequence
ttatttactcagtaggacgagtgtt

SEQ ID NO: 219791 - DNA, 25 bp, Artificial sequence
  SiRNA target sequence
tatttactcagtaggacgagtgtta

SEQ ID NO: 219792 - DNA, 25 bp, Artificial sequence
  SiRNA target sequence
atttactcagtaggacgagtgttaa

SEQ ID NO: 219793 - DNA, 25 bp, Artificial sequence
  SiRNA target sequence
tttactcagtaggacgagtgttaaa

SEQ ID NO: 219794 - DNA, 25 bp, Artificial sequence
  SiRNA target sequence
ttactcagtaggacgagtgttaaaa

SEQ ID NO: 219795 - DNA, 25 bp, Artificial sequence
  SiRNA target sequence
tactcagtaggacgagtgttaaaag

SEQ ID NO: 219796 - DNA, 25 bp, Artificial sequence
  SiRNA target sequence
actcagtaggacgagtgttaaaaga

SEQ ID NO: 219797 - DNA, 25 bp, Artificial sequence
  SiRNA target sequence
ctcagtaggacgagtgttaaaagat

SEQ ID NO: 219798 - DNA, 25 bp, Artificial sequence
  SiRNA target sequence
tcagtaggacgagtgttaaaagatg

SEQ ID NO: 219799 - DNA, 25 bp, Artificial sequence
  SiRNA target sequence
cagtaggacgagtgttaaaagatgc

SEQ ID NO: 219800 - DNA, 25 bp, Artificial sequence
  SiRNA target sequence
agtaggacgagtgttaaaagatgca

SEQ ID NO: 219801 - DNA, 25 bp, Artificial sequence
  SiRNA target sequence
gtaggacgagtgttaaaagatgcag

SEQ ID NO: 219802 - DNA, 25 bp, Artificial sequence
  SiRNA target sequence
taggacgagtgttaaaagatgcagc

SEQ ID NO: 219803 - DNA, 25 bp, Artificial sequence
  SiRNA target sequence
aggacgagtgttaaaagatgcagca

SEQ ID NO: 219804 - DNA, 25 bp, Artificial sequence
  SiRNA target sequence
ggacgagtgttaaaagatgcagcag

SEQ ID NO: 219805 - DNA, 25 bp, Artificial sequence
  SiRNA target sequence
gacgagtgttaaaagatgcagcagt

SEQ ID NO: 219806 - DNA, 25 bp, Artificial sequence
  SiRNA target sequence
acgagtgttaaaagatgcagcagtt

SEQ ID NO: 219807 - DNA, 25 bp, Artificial sequence
  SiRNA target sequence
cgagtgttaaaagatgcagcagttc

SEQ ID NO: 219808 - DNA, 25 bp, Artificial sequence
  SiRNA target sequence
gagtgttaaaagatgcagcagttct

SEQ ID NO: 219809 - DNA, 25 bp, Artificial sequence
  SiRNA target sequence
agtgttaaaagatgcagcagttctt

SEQ ID NO: 219810 - DNA, 25 bp, Artificial sequence
  SiRNA target sequence
gtgttaaaagatgcagcagttctta

SEQ ID NO: 219811 - DNA, 25 bp, Artificial sequence
  SiRNA target sequence
tgttaaaagatgcagcagttcttag

SEQ ID NO: 219812 - DNA, 25 bp, Artificial sequence
  SiRNA target sequence
gttaaaagatgcagcagttcttagt

SEQ ID NO: 219813 - DNA, 25 bp, Artificial sequence
  SiRNA target sequence
ttaaaagatgcagcagttcttagta

SEQ ID NO: 219814 - DNA, 25 bp, Artificial sequence
  SiRNA target sequence
taaaagatgcagcagttcttagtag

SEQ ID NO: 219815 - DNA, 25 bp, Artificial sequence
  SiRNA target sequence
aaaagatgcagcagttcttagtaga

SEQ ID NO: 219816 - DNA, 25 bp, Artificial sequence
  SiRNA target sequence
aaagatgcagcagttcttagtagac

SEQ ID NO: 219817 - DNA, 25 bp, Artificial sequence
  SiRNA target sequence
aagatgcagcagttcttagtagaca

SEQ ID NO: 219818 - DNA, 25 bp, Artificial sequence
  SiRNA target sequence
agatgcagcagttcttagtagacag

SEQ ID NO: 219819 - DNA, 25 bp, Artificial sequence
  SiRNA target sequence
gatgcagcagttcttagtagacaga

SEQ ID NO: 219820 - DNA, 25 bp, Artificial sequence
  SiRNA target sequence
atgcagcagttcttagtagacagat

SEQ ID NO: 219821 - DNA, 25 bp, Artificial sequence
  SiRNA target sequence
tgcagcagttcttagtagacagatg

SEQ ID NO: 219822 - DNA, 25 bp, Artificial sequence
  SiRNA target sequence
gcagcagttcttagtagacagatgc

SEQ ID NO: 219823 - DNA, 25 bp, Artificial sequence
  SiRNA target sequence
cagcagttcttagtagacagatgcc

SEQ ID NO: 219824 - DNA, 25 bp, Artificial sequence
  SiRNA target sequence
agcagttcttagtagacagatgcca

SEQ ID NO: 219825 - DNA, 25 bp, Artificial sequence
  SiRNA target sequence
gcagttcttagtagacagatgccac

SEQ ID NO: 219826 - DNA, 25 bp, Artificial sequence
  SiRNA target sequence
cagttcttagtagacagatgccact

SEQ ID NO: 219827 - DNA, 25 bp, Artificial sequence
  SiRNA target sequence
agttcttagtagacagatgccacta

SEQ ID NO: 219828 - DNA, 25 bp, Artificial sequence
  SiRNA target sequence
gttcttagtagacagatgccactat

SEQ ID NO: 219829 - DNA, 25 bp, Artificial sequence
  SiRNA target sequence
ttcttagtagacagatgccactatc

SEQ ID NO: 219830 - DNA, 25 bp, Artificial sequence
  SiRNA target sequence
tcttagtagacagatgccactatcc

SEQ ID NO: 219831 - DNA, 25 bp, Artificial sequence
  SiRNA target sequence
cttagtagacagatgccactatcca

SEQ ID NO: 219832 - DNA, 25 bp, Artificial sequence
  SiRNA target sequence
ttagtagacagatgccactatccat

SEQ ID NO: 219833 - DNA, 25 bp, Artificial sequence
  SiRNA target sequence
tagtagacagatgccactatccatt

SEQ ID NO: 219834 - DNA, 25 bp, Artificial sequence
  SiRNA target sequence
agtagacagatgccactatccatta

SEQ ID NO: 219835 - DNA, 25 bp, Artificial sequence
  SiRNA target sequence
gtagacagatgccactatccattaa

SEQ ID NO: 219836 - DNA, 25 bp, Artificial sequence
  SiRNA target sequence
tagacagatgccactatccattaat

SEQ ID NO: 219837 - DNA, 25 bp, Artificial sequence
  SiRNA target sequence
agacagatgccactatccattaatt

SEQ ID NO: 219838 - DNA, 25 bp, Artificial sequence
  SiRNA target sequence
gacagatgccactatccattaattg

SEQ ID NO: 219839 - DNA, 25 bp, Artificial sequence
  SiRNA target sequence
acagatgccactatccattaattgt

SEQ ID NO: 219840 - DNA, 25 bp, Artificial sequence
  SiRNA target sequence
cagatgccactatccattaattgtc

SEQ ID NO: 219841 - DNA, 25 bp, Artificial sequence
  SiRNA target sequence
agatgccactatccattaattgtct

SEQ ID NO: 219842 - DNA, 25 bp, Artificial sequence
  SiRNA target sequence
gatgccactatccattaattgtctt

SEQ ID NO: 219843 - DNA, 25 bp, Artificial sequence
  SiRNA target sequence
atgccactatccattaattgtctta

SEQ ID NO: 219844 - DNA, 25 bp, Artificial sequence
  SiRNA target sequence
tgccactatccattaattgtcttaa

SEQ ID NO: 219845 - DNA, 25 bp, Artificial sequence
  SiRNA target sequence
gccactatccattaattgtcttaaa

SEQ ID NO: 219846 - DNA, 25 bp, Artificial sequence
  SiRNA target sequence
ccactatccattaattgtcttaaaa

SEQ ID NO: 219847 - DNA, 25 bp, Artificial sequence
  SiRNA target sequence
cactatccattaattgtcttaaaag

SEQ ID NO: 219848 - DNA, 25 bp, Artificial sequence
  SiRNA target sequence
actatccattaattgtcttaaaagc

SEQ ID NO: 219849 - DNA, 25 bp, Artificial sequence
  SiRNA target sequence
ctatccattaattgtcttaaaagct

SEQ ID NO: 219850 - DNA, 25 bp, Artificial sequence
  SiRNA target sequence
tatccattaattgtcttaaaagctt

SEQ ID NO: 219851 - DNA, 25 bp, Artificial sequence
  SiRNA target sequence
atccattaattgtcttaaaagcttt

SEQ ID NO: 219852 - DNA, 25 bp, Artificial sequence
  SiRNA target sequence
tccattaattgtcttaaaagctttg

SEQ ID NO: 219853 - DNA, 25 bp, Artificial sequence
  SiRNA target sequence
ccattaattgtcttaaaagctttgt

SEQ ID NO: 219854 - DNA, 25 bp, Artificial sequence
  SiRNA target sequence
cattaattgtcttaaaagctttgta

SEQ ID NO: 219855 - DNA, 25 bp, Artificial sequence
  SiRNA target sequence
attaattgtcttaaaagctttgtaa

SEQ ID NO: 219856 - DNA, 25 bp, Artificial sequence
  SiRNA target sequence
ttaattgtcttaaaagctttgtaat

SEQ ID NO: 219857 - DNA, 25 bp, Artificial sequence
  SiRNA target sequence
taattgtcttaaaagctttgtaatt

SEQ ID NO: 219858 - DNA, 25 bp, Artificial sequence
  SiRNA target sequence
aattgtcttaaaagctttgtaattt

SEQ ID NO: 219859 - DNA, 25 bp, Artificial sequence
  SiRNA target sequence
attgtcttaaaagctttgtaatttt

SEQ ID NO: 219860 - DNA, 25 bp, Artificial sequence
  SiRNA target sequence
ttgtcttaaaagctttgtaatttta

SEQ ID NO: 219861 - DNA, 25 bp, Artificial sequence
  SiRNA target sequence
tgtcttaaaagctttgtaattttac

SEQ ID NO: 219862 - DNA, 25 bp, Artificial sequence
  SiRNA target sequence
gtcttaaaagctttgtaattttacc

SEQ ID NO: 219863 - DNA, 25 bp, Artificial sequence
  SiRNA target sequence
tcttaaaagctttgtaattttacca

SEQ ID NO: 219864 - DNA, 25 bp, Artificial sequence
  SiRNA target sequence
cttaaaagctttgtaattttaccag

SEQ ID NO: 219865 - DNA, 25 bp, Artificial sequence
  SiRNA target sequence
ttaaaagctttgtaattttaccagt

SEQ ID NO: 219866 - DNA, 25 bp, Artificial sequence
  SiRNA target sequence
taaaagctttgtaattttaccagtt

SEQ ID NO: 219867 - DNA, 25 bp, Artificial sequence
  SiRNA target sequence
aaaagctttgtaattttaccagtta

SEQ ID NO: 219868 - DNA, 25 bp, Artificial sequence
  SiRNA target sequence
aaagctttgtaattttaccagttac

SEQ ID NO: 219869 - DNA, 25 bp, Artificial sequence
  SiRNA target sequence
aagctttgtaattttaccagttact

SEQ ID NO: 219870 - DNA, 25 bp, Artificial sequence
  SiRNA target sequence
agctttgtaattttaccagttactc

SEQ ID NO: 219871 - DNA, 25 bp, Artificial sequence
  SiRNA target sequence
gctttgtaattttaccagttactct

SEQ ID NO: 219872 - DNA, 25 bp, Artificial sequence
  SiRNA target sequence
ctttgtaattttaccagttactctt

SEQ ID NO: 219873 - DNA, 25 bp, Artificial sequence
  SiRNA target sequence
tttgtaattttaccagttactcttg

SEQ ID NO: 219874 - DNA, 25 bp, Artificial sequence
  SiRNA target sequence
ttgtaattttaccagttactcttgt

SEQ ID NO: 219875 - DNA, 25 bp, Artificial sequence
  SiRNA target sequence
tgtaattttaccagttactcttgtt

SEQ ID NO: 219876 - DNA, 25 bp, Artificial sequence
  SiRNA target sequence
gtaattttaccagttactcttgttt

SEQ ID NO: 219877 - DNA, 25 bp, Artificial sequence
  SiRNA target sequence
taattttaccagttactcttgtttg

SEQ ID NO: 219878 - DNA, 25 bp, Artificial sequence
  SiRNA target sequence
aattttaccagttactcttgtttgt

SEQ ID NO: 219879 - DNA, 25 bp, Artificial sequence
  SiRNA target sequence
attttaccagttactcttgtttgtg

SEQ ID NO: 219880 - DNA, 25 bp, Artificial sequence
  SiRNA target sequence
ttttaccagttactcttgtttgtgt

SEQ ID NO: 219881 - DNA, 25 bp, Artificial sequence
  SiRNA target sequence
tttaccagttactcttgtttgtgta

SEQ ID NO: 219882 - DNA, 25 bp, Artificial sequence
  SiRNA target sequence
ttaccagttactcttgtttgtgtag

SEQ ID NO: 219883 - DNA, 25 bp, Artificial sequence
  SiRNA target sequence
taccagttactcttgtttgtgtagg

SEQ ID NO: 219884 - DNA, 25 bp, Artificial sequence
  SiRNA target sequence
accagttactcttgtttgtgtagga

SEQ ID NO: 219885 - DNA, 25 bp, Artificial sequence
  SiRNA target sequence
ccagttactcttgtttgtgtaggat

SEQ ID NO: 219886 - DNA, 25 bp, Artificial sequence
  SiRNA target sequence
cagttactcttgtttgtgtaggatt

SEQ ID NO: 219887 - DNA, 25 bp, Artificial sequence
  SiRNA target sequence
agttactcttgtttgtgtaggatta

SEQ ID NO: 219888 - DNA, 25 bp, Artificial sequence
  SiRNA target sequence
gttactcttgtttgtgtaggattaa

SEQ ID NO: 219889 - DNA, 25 bp, Artificial sequence
  SiRNA target sequence
ttactcttgtttgtgtaggattaat

SEQ ID NO: 219890 - DNA, 25 bp, Artificial sequence
  SiRNA target sequence
tactcttgtttgtgtaggattaatt

SEQ ID NO: 219891 - DNA, 25 bp, Artificial sequence
  SiRNA target sequence
actcttgtttgtgtaggattaattc

SEQ ID NO: 219892 - DNA, 25 bp, Artificial sequence
  SiRNA target sequence
ctcttgtttgtgtaggattaattca

SEQ ID NO: 219893 - DNA, 25 bp, Artificial sequence
  SiRNA target sequence
tcttgtttgtgtaggattaattcag

SEQ ID NO: 219894 - DNA, 25 bp, Artificial sequence
  SiRNA target sequence
cttgtttgtgtaggattaattcaga

SEQ ID NO: 219895 - DNA, 25 bp, Artificial sequence
  SiRNA target sequence
ttgtttgtgtaggattaattcagaa

SEQ ID NO: 219896 - DNA, 25 bp, Artificial sequence
  SiRNA target sequence
tgtttgtgtaggattaattcagaag

SEQ ID NO: 219897 - DNA, 25 bp, Artificial sequence
  SiRNA target sequence
gtttgtgtaggattaattcagaagt

SEQ ID NO: 219898 - DNA, 25 bp, Artificial sequence
  SiRNA target sequence
tttgtgtaggattaattcagaagtc

SEQ ID NO: 219899 - DNA, 25 bp, Artificial sequence
  SiRNA target sequence
ttgtgtaggattaattcagaagtct

SEQ ID NO: 219900 - DNA, 25 bp, Artificial sequence
  SiRNA target sequence
tgtgtaggattaattcagaagtcta

SEQ ID NO: 219901 - DNA, 25 bp, Artificial sequence
  SiRNA target sequence
gtgtaggattaattcagaagtctac

SEQ ID NO: 219902 - DNA, 25 bp, Artificial sequence
  SiRNA target sequence
tgtaggattaattcagaagtctaca

SEQ ID NO: 219903 - DNA, 25 bp, Artificial sequence
  SiRNA target sequence
gtaggattaattcagaagtctacac

SEQ ID NO: 219904 - DNA, 25 bp, Artificial sequence
  SiRNA target sequence
taggattaattcagaagtctacact

SEQ ID NO: 219905 - DNA, 25 bp, Artificial sequence
  SiRNA target sequence
aggattaattcagaagtctacactc

SEQ ID NO: 219906 - DNA, 25 bp, Artificial sequence
  SiRNA target sequence
ggattaattcagaagtctacactct

SEQ ID NO: 219907 - DNA, 25 bp, Artificial sequence
  SiRNA target sequence
gattaattcagaagtctacactctc

SEQ ID NO: 219908 - DNA, 25 bp, Artificial sequence
  SiRNA target sequence
attaattcagaagtctacactctct

SEQ ID NO: 219909 - DNA, 25 bp, Artificial sequence
  SiRNA target sequence
ttaattcagaagtctacactctctt

SEQ ID NO: 219910 - DNA, 25 bp, Artificial sequence
  SiRNA target sequence
taattcagaagtctacactctctta

SEQ ID NO: 219911 - DNA, 25 bp, Artificial sequence
  SiRNA target sequence
aattcagaagtctacactctcttat

SEQ ID NO: 219912 - DNA, 25 bp, Artificial sequence
  SiRNA target sequence
attcagaagtctacactctcttatt

SEQ ID NO: 219913 - DNA, 25 bp, Artificial sequence
  SiRNA target sequence
ttcagaagtctacactctcttattc

SEQ ID NO: 219914 - DNA, 25 bp, Artificial sequence
  SiRNA target sequence
tcagaagtctacactctcttattct

SEQ ID NO: 219915 - DNA, 25 bp, Artificial sequence
  SiRNA target sequence
cagaagtctacactctcttattctt

SEQ ID NO: 219916 - DNA, 25 bp, Artificial sequence
  SiRNA target sequence
agaagtctacactctcttattcttt

SEQ ID NO: 219917 - DNA, 25 bp, Artificial sequence
  SiRNA target sequence
gaagtctacactctcttattctttt

SEQ ID NO: 219918 - DNA, 25 bp, Artificial sequence
  SiRNA target sequence
aagtctacactctcttattctttta

SEQ ID NO: 219919 - DNA, 25 bp, Artificial sequence
  SiRNA target sequence
agtctacactctcttattcttttac

SEQ ID NO: 219920 - DNA, 25 bp, Artificial sequence
  SiRNA target sequence
gtctacactctcttattcttttaca

SEQ ID NO: 219921 - DNA, 25 bp, Artificial sequence
  SiRNA target sequence
tctacactctcttattcttttacaa

SEQ ID NO: 219922 - DNA, 25 bp, Artificial sequence
  SiRNA target sequence
ctacactctcttattcttttacaaa

SEQ ID NO: 219923 - DNA, 25 bp, Artificial sequence
  SiRNA target sequence
tacactctcttattcttttacaaaa

SEQ ID NO: 219924 - DNA, 25 bp, Artificial sequence
  SiRNA target sequence
acactctcttattcttttacaaaaa

SEQ ID NO: 219925 - DNA, 25 bp, Artificial sequence
  SiRNA target sequence
cactctcttattcttttacaaaaat

SEQ ID NO: 219926 - DNA, 25 bp, Artificial sequence
  SiRNA target sequence
actctcttattcttttacaaaaata

SEQ ID NO: 219927 - DNA, 25 bp, Artificial sequence
  SiRNA target sequence
ctctcttattcttttacaaaaatat

SEQ ID NO: 219928 - DNA, 25 bp, Artificial sequence
  SiRNA target sequence
tctcttattcttttacaaaaatatt

SEQ ID NO: 219929 - DNA, 25 bp, Artificial sequence
  SiRNA target sequence
ctcttattcttttacaaaaatattt

SEQ ID NO: 219930 - DNA, 25 bp, Artificial sequence
  SiRNA target sequence
tcttattcttttacaaaaatatttg

SEQ ID NO: 219931 - DNA, 25 bp, Artificial sequence
  SiRNA target sequence
cttattcttttacaaaaatatttga

SEQ ID NO: 219932 - DNA, 25 bp, Artificial sequence
  SiRNA target sequence
ttattcttttacaaaaatatttgat

SEQ ID NO: 219933 - DNA, 25 bp, Artificial sequence
  SiRNA target sequence
tattcttttacaaaaatatttgatg

SEQ ID NO: 219934 - DNA, 25 bp, Artificial sequence
  SiRNA target sequence
attcttttacaaaaatatttgatgg

SEQ ID NO: 219935 - DNA, 25 bp, Artificial sequence
  SiRNA target sequence
ttcttttacaaaaatatttgatggt

SEQ ID NO: 219936 - DNA, 25 bp, Artificial sequence
  SiRNA target sequence
tcttttacaaaaatatttgatggtg

SEQ ID NO: 219937 - DNA, 25 bp, Artificial sequence
  SiRNA target sequence
cttttacaaaaatatttgatggtgc

SEQ ID NO: 219938 - DNA, 25 bp, Artificial sequence
  SiRNA target sequence
ttttacaaaaatatttgatggtgca

SEQ ID NO: 219939 - DNA, 25 bp, Artificial sequence
  SiRNA target sequence
tttacaaaaatatttgatggtgcat

SEQ ID NO: 219940 - DNA, 25 bp, Artificial sequence
  SiRNA target sequence
ttacaaaaatatttgatggtgcatt

SEQ ID NO: 219941 - DNA, 25 bp, Artificial sequence
  SiRNA target sequence
tacaaaaatatttgatggtgcattg

SEQ ID NO: 219942 - DNA, 25 bp, Artificial sequence
  SiRNA target sequence
acaaaaatatttgatggtgcattgt

SEQ ID NO: 219943 - DNA, 25 bp, Artificial sequence
  SiRNA target sequence
caaaaatatttgatggtgcattgtt

SEQ ID NO: 219944 - DNA, 25 bp, Artificial sequence
  SiRNA target sequence
aaaaatatttgatggtgcattgtta

SEQ ID NO: 219945 - DNA, 25 bp, Artificial sequence
  SiRNA target sequence
aaaatatttgatggtgcattgttaa

SEQ ID NO: 219946 - DNA, 25 bp, Artificial sequence
  SiRNA target sequence
aaatatttgatggtgcattgttaat

SEQ ID NO: 219947 - DNA, 25 bp, Artificial sequence
  SiRNA target sequence
aatatttgatggtgcattgttaata

SEQ ID NO: 219948 - DNA, 25 bp, Artificial sequence
  SiRNA target sequence
atatttgatggtgcattgttaatat

SEQ ID NO: 219949 - DNA, 25 bp, Artificial sequence
  SiRNA target sequence
tatttgatggtgcattgttaatatt

SEQ ID NO: 219950 - DNA, 25 bp, Artificial sequence
  SiRNA target sequence
atttgatggtgcattgttaatattt

SEQ ID NO: 219951 - DNA, 25 bp, Artificial sequence
  SiRNA target sequence
tttgatggtgcattgttaatatttg

SEQ ID NO: 219952 - DNA, 25 bp, Artificial sequence
  SiRNA target sequence
ttgatggtgcattgttaatatttgc

SEQ ID NO: 219953 - DNA, 25 bp, Artificial sequence
  SiRNA target sequence
tgatggtgcattgttaatatttgct

SEQ ID NO: 219954 - DNA, 25 bp, Artificial sequence
  SiRNA target sequence
gatggtgcattgttaatatttgctt

SEQ ID NO: 219955 - DNA, 25 bp, Artificial sequence
  SiRNA target sequence
atggtgcattgttaatatttgcttt

SEQ ID NO: 219956 - DNA, 25 bp, Artificial sequence
  SiRNA target sequence
tggtgcattgttaatatttgctttt

SEQ ID NO: 219957 - DNA, 25 bp, Artificial sequence
  SiRNA target sequence
ggtgcattgttaatatttgcttttc

SEQ ID NO: 219958 - DNA, 25 bp, Artificial sequence
  SiRNA target sequence
gtgcattgttaatatttgcttttct

SEQ ID NO: 219959 - DNA, 25 bp, Artificial sequence
  SiRNA target sequence
tgcattgttaatatttgcttttctt

SEQ ID NO: 219960 - DNA, 25 bp, Artificial sequence
  SiRNA target sequence
gcattgttaatatttgcttttcttt

SEQ ID NO: 219961 - DNA, 25 bp, Artificial sequence
  SiRNA target sequence
cattgttaatatttgcttttcttta

SEQ ID NO: 219962 - DNA, 25 bp, Artificial sequence
  SiRNA target sequence
attgttaatatttgcttttctttat

SEQ ID NO: 219963 - DNA, 25 bp, Artificial sequence
  SiRNA target sequence
ttgttaatatttgcttttctttata

SEQ ID NO: 219964 - DNA, 25 bp, Artificial sequence
  SiRNA target sequence
tgttaatatttgcttttctttatat

SEQ ID NO: 219965 - DNA, 25 bp, Artificial sequence
  SiRNA target sequence
gttaatatttgcttttctttatatc

SEQ ID NO: 219966 - DNA, 25 bp, Artificial sequence
  SiRNA target sequence
ttaatatttgcttttctttatatca

SEQ ID NO: 219967 - DNA, 25 bp, Artificial sequence
  SiRNA target sequence
taatatttgcttttctttatatcat

SEQ ID NO: 219968 - DNA, 25 bp, Artificial sequence
  SiRNA target sequence
aatatttgcttttctttatatcatt

SEQ ID NO: 219969 - DNA, 25 bp, Artificial sequence
  SiRNA target sequence
atatttgcttttctttatatcattc

SEQ ID NO: 219970 - DNA, 25 bp, Artificial sequence
  SiRNA target sequence
tatttgcttttctttatatcattct

SEQ ID NO: 219971 - DNA, 25 bp, Artificial sequence
  SiRNA target sequence
atttgcttttctttatatcattctt

SEQ ID NO: 219972 - DNA, 25 bp, Artificial sequence
  SiRNA target sequence
tttgcttttctttatatcattcttg

SEQ ID NO: 219973 - DNA, 25 bp, Artificial sequence
  SiRNA target sequence
ttgcttttctttatatcattcttgg

SEQ ID NO: 219974 - DNA, 25 bp, Artificial sequence
  SiRNA target sequence
tgcttttctttatatcattcttggt

SEQ ID NO: 219975 - DNA, 25 bp, Artificial sequence
  SiRNA target sequence
gcttttctttatatcattcttggtc

SEQ ID NO: 219976 - DNA, 25 bp, Artificial sequence
  SiRNA target sequence
cttttctttatatcattcttggtct

SEQ ID NO: 219977 - DNA, 25 bp, Artificial sequence
  SiRNA target sequence
ttttctttatatcattcttggtcta

SEQ ID NO: 219978 - DNA, 25 bp, Artificial sequence
  SiRNA target sequence
tttctttatatcattcttggtctag

SEQ ID NO: 219979 - DNA, 25 bp, Artificial sequence
  SiRNA target sequence
ttctttatatcattcttggtctagt

SEQ ID NO: 219980 - DNA, 25 bp, Artificial sequence
  SiRNA target sequence
tctttatatcattcttggtctagtt

SEQ ID NO: 219981 - DNA, 25 bp, Artificial sequence
  SiRNA target sequence
ctttatatcattcttggtctagttc

SEQ ID NO: 219982 - DNA, 25 bp, Artificial sequence
  SiRNA target sequence
tttatatcattcttggtctagttct

SEQ ID NO: 219983 - DNA, 25 bp, Artificial sequence
  SiRNA target sequence
ttatatcattcttggtctagttctt

SEQ ID NO: 219984 - DNA, 25 bp, Artificial sequence
  SiRNA target sequence
tatatcattcttggtctagttcttc

SEQ ID NO: 219985 - DNA, 25 bp, Artificial sequence
  SiRNA target sequence
atatcattcttggtctagttcttct

SEQ ID NO: 219986 - DNA, 25 bp, Artificial sequence
  SiRNA target sequence
tatcattcttggtctagttcttctt

SEQ ID NO: 219987 - DNA, 25 bp, Artificial sequence
  SiRNA target sequence
atcattcttggtctagttcttcttc

SEQ ID NO: 219988 - DNA, 25 bp, Artificial sequence
  SiRNA target sequence
tcattcttggtctagttcttcttcc

SEQ ID NO: 219989 - DNA, 25 bp, Artificial sequence
  SiRNA target sequence
cattcttggtctagttcttcttcca

SEQ ID NO: 219990 - DNA, 25 bp, Artificial sequence
  SiRNA target sequence
attcttggtctagttcttcttccat

SEQ ID NO: 219991 - DNA, 25 bp, Artificial sequence
  SiRNA target sequence
ttcttggtctagttcttcttccata

SEQ ID NO: 219992 - DNA, 25 bp, Artificial sequence
  SiRNA target sequence
tcttggtctagttcttcttccatat

SEQ ID NO: 219993 - DNA, 25 bp, Artificial sequence
  SiRNA target sequence
cttggtctagttcttcttccatatt

SEQ ID NO: 219994 - DNA, 25 bp, Artificial sequence
  SiRNA target sequence
ttggtctagttcttcttccatattc

SEQ ID NO: 219995 - DNA, 25 bp, Artificial sequence
  SiRNA target sequence
tggtctagttcttcttccatattct

SEQ ID NO: 219996 - DNA, 25 bp, Artificial sequence
  SiRNA target sequence
ggtctagttcttcttccatattctc

SEQ ID NO: 219997 - DNA, 25 bp, Artificial sequence
  SiRNA target sequence
gtctagttcttcttccatattctca

SEQ ID NO: 219998 - DNA, 25 bp, Artificial sequence
  SiRNA target sequence
tctagttcttcttccatattctcat

SEQ ID NO: 219999 - DNA, 25 bp, Artificial sequence
  SiRNA target sequence
ctagttcttcttccatattctcatc

SEQ ID NO: 220000 - DNA, 25 bp, Artificial sequence
  SiRNA target sequence
tagttcttcttccatattctcatct

SEQ ID NO: 220001 - DNA, 25 bp, Artificial sequence
  SiRNA target sequence
agttcttcttccatattctcatctt

SEQ ID NO: 220002 - DNA, 25 bp, Artificial sequence
  SiRNA target sequence
gttcttcttccatattctcatcttt

SEQ ID NO: 220003 - DNA, 25 bp, Artificial sequence
  SiRNA target sequence
ttcttcttccatattctcatctttt

SEQ ID NO: 220004 - DNA, 25 bp, Artificial sequence
  SiRNA target sequence
tcttcttccatattctcatcttttc

SEQ ID NO: 220005 - DNA, 25 bp, Artificial sequence
  SiRNA target sequence
cttcttccatattctcatcttttcc

SEQ ID NO: 220006 - DNA, 25 bp, Artificial sequence
  SiRNA target sequence
ttcttccatattctcatcttttcca

SEQ ID NO: 220007 - DNA, 25 bp, Artificial sequence
  SiRNA target sequence
tcttccatattctcatcttttccag

SEQ ID NO: 220008 - DNA, 25 bp, Artificial sequence
  SiRNA target sequence
cttccatattctcatcttttccagc

SEQ ID NO: 220009 - DNA, 25 bp, Artificial sequence
  SiRNA target sequence
ttccatattctcatcttttccagct

SEQ ID NO: 220010 - DNA, 25 bp, Artificial sequence
  SiRNA target sequence
tccatattctcatcttttccagctt

SEQ ID NO: 220011 - DNA, 25 bp, Artificial sequence
  SiRNA target sequence
ccatattctcatcttttccagcttg

SEQ ID NO: 220012 - DNA, 25 bp, Artificial sequence
  SiRNA target sequence
catattctcatcttttccagcttga

SEQ ID NO: 220013 - DNA, 25 bp, Artificial sequence
  SiRNA target sequence
atattctcatcttttccagcttgat

SEQ ID NO: 220014 - DNA, 25 bp, Artificial sequence
  SiRNA target sequence
tattctcatcttttccagcttgata

SEQ ID NO: 220015 - DNA, 25 bp, Artificial sequence
  SiRNA target sequence
attctcatcttttccagcttgatag

SEQ ID NO: 220016 - DNA, 25 bp, Artificial sequence
  SiRNA target sequence
ttctcatcttttccagcttgatagt

SEQ ID NO: 220017 - DNA, 25 bp, Artificial sequence
  SiRNA target sequence
tctcatcttttccagcttgatagtt

SEQ ID NO: 220018 - DNA, 25 bp, Artificial sequence
  SiRNA target sequence
ctcatcttttccagcttgatagtta

SEQ ID NO: 220019 - DNA, 25 bp, Artificial sequence
  SiRNA target sequence
tcatcttttccagcttgatagttat

SEQ ID NO: 220020 - DNA, 25 bp, Artificial sequence
  SiRNA target sequence
catcttttccagcttgatagttatt

SEQ ID NO: 220021 - DNA, 25 bp, Artificial sequence
  SiRNA target sequence
atcttttccagcttgatagttattt

SEQ ID NO: 220022 - DNA, 25 bp, Artificial sequence
  SiRNA target sequence
tcttttccagcttgatagttatttt

SEQ ID NO: 220023 - DNA, 25 bp, Artificial sequence
  SiRNA target sequence
cttttccagcttgatagttattttt

SEQ ID NO: 220024 - DNA, 25 bp, Artificial sequence
  SiRNA target sequence
ttttccagcttgatagttatttttt

SEQ ID NO: 220025 - DNA, 25 bp, Artificial sequence
  SiRNA target sequence
tttccagcttgatagttattttttt

SEQ ID NO: 220026 - DNA, 25 bp, Artificial sequence
  SiRNA target sequence
ttccagcttgatagttattttttta

SEQ ID NO: 220027 - DNA, 25 bp, Artificial sequence
  SiRNA target sequence
tccagcttgatagttatttttttag

SEQ ID NO: 220028 - DNA, 25 bp, Artificial sequence
  SiRNA target sequence
ccagcttgatagttatttttttaga

SEQ ID NO: 220029 - DNA, 25 bp, Artificial sequence
  SiRNA target sequence
cagcttgatagttatttttttagag

SEQ ID NO: 220030 - DNA, 25 bp, Artificial sequence
  SiRNA target sequence
agcttgatagttatttttttagaga

SEQ ID NO: 220031 - DNA, 25 bp, Artificial sequence
  SiRNA target sequence
gcttgatagttatttttttagagac

SEQ ID NO: 220032 - DNA, 25 bp, Artificial sequence
  SiRNA target sequence
cttgatagttatttttttagagacc

SEQ ID NO: 220033 - DNA, 25 bp, Artificial sequence
  SiRNA target sequence
ttgatagttatttttttagagacct

SEQ ID NO: 220034 - DNA, 25 bp, Artificial sequence
  SiRNA target sequence
tgatagttatttttttagagacctt

SEQ ID NO: 220035 - DNA, 25 bp, Artificial sequence
  SiRNA target sequence
gatagttatttttttagagaccttt

SEQ ID NO: 220036 - DNA, 25 bp, Artificial sequence
  SiRNA target sequence
atagttatttttttagagacctttt

SEQ ID NO: 220037 - DNA, 25 bp, Artificial sequence
  SiRNA target sequence
tagttatttttttagagaccttttt

SEQ ID NO: 220038 - DNA, 25 bp, Artificial sequence
  SiRNA target sequence
agttatttttttagagaccttttta

SEQ ID NO: 220039 - DNA, 25 bp, Artificial sequence
  SiRNA target sequence
gttatttttttagagacctttttag

SEQ ID NO: 220040 - DNA, 25 bp, Artificial sequence
  SiRNA target sequence
ttatttttttagagacctttttagt

SEQ ID NO: 220041 - DNA, 25 bp, Artificial sequence
  SiRNA target sequence
tatttttttagagacctttttagtg

SEQ ID NO: 220042 - DNA, 25 bp, Artificial sequence
  SiRNA target sequence
atttttttagagacctttttagtga

SEQ ID NO: 220043 - DNA, 25 bp, Artificial sequence
  SiRNA target sequence
tttttttagagacctttttagtgat

SEQ ID NO: 220044 - DNA, 25 bp, Artificial sequence
  SiRNA target sequence
ttttttagagacctttttagtgatg

SEQ ID NO: 220045 - DNA, 25 bp, Artificial sequence
  SiRNA target sequence
tttttagagacctttttagtgatgg

SEQ ID NO: 220046 - DNA, 25 bp, Artificial sequence
  SiRNA target sequence
ttttagagacctttttagtgatggg

SEQ ID NO: 220047 - DNA, 25 bp, Artificial sequence
  SiRNA target sequence
tttagagacctttttagtgatggga

SEQ ID NO: 220048 - DNA, 25 bp, Artificial sequence
  SiRNA target sequence
ttagagacctttttagtgatgggaa

SEQ ID NO: 220049 - DNA, 25 bp, Artificial sequence
  SiRNA target sequence
tagagacctttttagtgatgggaaa

SEQ ID NO: 220050 - DNA, 25 bp, Artificial sequence
  SiRNA target sequence
agagacctttttagtgatgggaaat

SEQ ID NO: 220051 - DNA, 25 bp, Artificial sequence
  SiRNA target sequence
gagacctttttagtgatgggaaatg

SEQ ID NO: 220052 - DNA, 25 bp, Artificial sequence
  SiRNA target sequence
agacctttttagtgatgggaaatgt

SEQ ID NO: 220053 - DNA, 25 bp, Artificial sequence
  SiRNA target sequence
gacctttttagtgatgggaaatgtg

SEQ ID NO: 220054 - DNA, 25 bp, Artificial sequence
  SiRNA target sequence
acctttttagtgatgggaaatgtgt

SEQ ID NO: 220055 - DNA, 25 bp, Artificial sequence
  SiRNA target sequence
cctttttagtgatgggaaatgtgtt

SEQ ID NO: 220056 - DNA, 25 bp, Artificial sequence
  SiRNA target sequence
ctttttagtgatgggaaatgtgttg

SEQ ID NO: 220057 - DNA, 25 bp, Artificial sequence
  SiRNA target sequence
tttttagtgatgggaaatgtgttgt

SEQ ID NO: 220058 - DNA, 25 bp, Artificial sequence
  SiRNA target sequence
ttttagtgatgggaaatgtgttgta

SEQ ID NO: 220059 - DNA, 25 bp, Artificial sequence
  SiRNA target sequence
tttagtgatgggaaatgtgttgtaa

SEQ ID NO: 220060 - DNA, 25 bp, Artificial sequence
  SiRNA target sequence
ttagtgatgggaaatgtgttgtaag

SEQ ID NO: 220061 - DNA, 25 bp, Artificial sequence
  SiRNA target sequence
tagtgatgggaaatgtgttgtaaga

SEQ ID NO: 220062 - DNA, 25 bp, Artificial sequence
  SiRNA target sequence
agtgatgggaaatgtgttgtaagag

SEQ ID NO: 220063 - DNA, 25 bp, Artificial sequence
  SiRNA target sequence
gtgatgggaaatgtgttgtaagagg

SEQ ID NO: 220064 - DNA, 25 bp, Artificial sequence
  SiRNA target sequence
tgatgggaaatgtgttgtaagaggc

SEQ ID NO: 220065 - DNA, 25 bp, Artificial sequence
  SiRNA target sequence
gatgggaaatgtgttgtaagaggct

SEQ ID NO: 220066 - DNA, 25 bp, Artificial sequence
  SiRNA target sequence
atgggaaatgtgttgtaagaggcta

SEQ ID NO: 220067 - DNA, 25 bp, Artificial sequence
  SiRNA target sequence
tgggaaatgtgttgtaagaggctat

SEQ ID NO: 220068 - DNA, 25 bp, Artificial sequence
  SiRNA target sequence
gggaaatgtgttgtaagaggctatg

SEQ ID NO: 220069 - DNA, 25 bp, Artificial sequence
  SiRNA target sequence
ggaaatgtgttgtaagaggctatga

SEQ ID NO: 220070 - DNA, 25 bp, Artificial sequence
  SiRNA target sequence
gaaatgtgttgtaagaggctatgat

SEQ ID NO: 220071 - DNA, 25 bp, Artificial sequence
  SiRNA target sequence
aaatgtgttgtaagaggctatgatg

SEQ ID NO: 220072 - DNA, 25 bp, Artificial sequence
  SiRNA target sequence
aatgtgttgtaagaggctatgatgc

SEQ ID NO: 220073 - DNA, 25 bp, Artificial sequence
  SiRNA target sequence
atgtgttgtaagaggctatgatgct

SEQ ID NO: 220074 - DNA, 25 bp, Artificial sequence
  SiRNA target sequence
tgtgttgtaagaggctatgatgctt

SEQ ID NO: 220075 - DNA, 25 bp, Artificial sequence
  SiRNA target sequence
gtgttgtaagaggctatgatgcttt

SEQ ID NO: 220076 - DNA, 25 bp, Artificial sequence
  SiRNA target sequence
tgttgtaagaggctatgatgcttta

SEQ ID NO: 220077 - DNA, 25 bp, Artificial sequence
  SiRNA target sequence
gttgtaagaggctatgatgctttat

SEQ ID NO: 220078 - DNA, 25 bp, Artificial sequence
  SiRNA target sequence
ttgtaagaggctatgatgctttatt

SEQ ID NO: 220079 - DNA, 25 bp, Artificial sequence
  SiRNA target sequence
tgtaagaggctatgatgctttatta

SEQ ID NO: 220080 - DNA, 25 bp, Artificial sequence
  SiRNA target sequence
gtaagaggctatgatgctttattat

SEQ ID NO: 220081 - DNA, 25 bp, Artificial sequence
  SiRNA target sequence
taagaggctatgatgctttattatc

SEQ ID NO: 220082 - DNA, 25 bp, Artificial sequence
  SiRNA target sequence
aagaggctatgatgctttattatct

SEQ ID NO: 220083 - DNA, 25 bp, Artificial sequence
  SiRNA target sequence
agaggctatgatgctttattatctt

SEQ ID NO: 220084 - DNA, 25 bp, Artificial sequence
  SiRNA target sequence
gaggctatgatgctttattatcttt

SEQ ID NO: 220085 - DNA, 25 bp, Artificial sequence
  SiRNA target sequence
aggctatgatgctttattatctttg

SEQ ID NO: 220086 - DNA, 25 bp, Artificial sequence
  SiRNA target sequence
ggctatgatgctttattatctttgg

SEQ ID NO: 220087 - DNA, 25 bp, Artificial sequence
  SiRNA target sequence
gctatgatgctttattatctttggc

SEQ ID NO: 220088 - DNA, 25 bp, Artificial sequence
  SiRNA target sequence
ctatgatgctttattatctttggca

SEQ ID NO: 220089 - DNA, 25 bp, Artificial sequence
  SiRNA target sequence
tatgatgctttattatctttggcac

SEQ ID NO: 220090 - DNA, 25 bp, Artificial sequence
  SiRNA target sequence
atgatgctttattatctttggcact

SEQ ID NO: 220091 - DNA, 25 bp, Artificial sequence
  SiRNA target sequence
tgatgctttattatctttggcactg

SEQ ID NO: 220092 - DNA, 25 bp, Artificial sequence
  SiRNA target sequence
gatgctttattatctttggcactgg

SEQ ID NO: 220093 - DNA, 25 bp, Artificial sequence
  SiRNA target sequence
atgctttattatctttggcactggt

SEQ ID NO: 220094 - DNA, 25 bp, Artificial sequence
  SiRNA target sequence
tgctttattatctttggcactggtc

SEQ ID NO: 220095 - DNA, 25 bp, Artificial sequence
  SiRNA target sequence
gctttattatctttggcactggtct

SEQ ID NO: 220096 - DNA, 25 bp, Artificial sequence
  SiRNA target sequence
ctttattatctttggcactggtctt

SEQ ID NO: 220097 - DNA, 25 bp, Artificial sequence
  SiRNA target sequence
tttattatctttggcactggtcttt

SEQ ID NO: 220098 - DNA, 25 bp, Artificial sequence
  SiRNA target sequence
ttattatctttggcactggtcttta

SEQ ID NO: 220099 - DNA, 25 bp, Artificial sequence
  SiRNA target sequence
tattatctttggcactggtctttaa

SEQ ID NO: 220100 - DNA, 25 bp, Artificial sequence
  SiRNA target sequence
attatctttggcactggtctttaac

SEQ ID NO: 220101 - DNA, 25 bp, Artificial sequence
  SiRNA target sequence
ttatctttggcactggtctttaacg

SEQ ID NO: 220102 - DNA, 25 bp, Artificial sequence
  SiRNA target sequence
tatctttggcactggtctttaacga

SEQ ID NO: 220103 - DNA, 25 bp, Artificial sequence
  SiRNA target sequence
atctttggcactggtctttaacgaa

SEQ ID NO: 220104 - DNA, 25 bp, Artificial sequence
  SiRNA target sequence
tctttggcactggtctttaacgaat

SEQ ID NO: 220105 - DNA, 25 bp, Artificial sequence
  SiRNA target sequence
ctttggcactggtctttaacgaatg

SEQ ID NO: 220106 - DNA, 25 bp, Artificial sequence
  SiRNA target sequence
tttggcactggtctttaacgaatgg

SEQ ID NO: 220107 - DNA, 25 bp, Artificial sequence
  SiRNA target sequence
ttggcactggtctttaacgaatgga

SEQ ID NO: 220108 - DNA, 25 bp, Artificial sequence
  SiRNA target sequence
tggcactggtctttaacgaatggac

SEQ ID NO: 220109 - DNA, 25 bp, Artificial sequence
  SiRNA target sequence
ggcactggtctttaacgaatggaca

SEQ ID NO: 220110 - DNA, 25 bp, Artificial sequence
  SiRNA target sequence
gcactggtctttaacgaatggacat

SEQ ID NO: 220111 - DNA, 25 bp, Artificial sequence
  SiRNA target sequence
cactggtctttaacgaatggacatc

SEQ ID NO: 220112 - DNA, 25 bp, Artificial sequence
  SiRNA target sequence
actggtctttaacgaatggacatcc

SEQ ID NO: 220113 - DNA, 25 bp, Artificial sequence
  SiRNA target sequence
ctggtctttaacgaatggacatcct

SEQ ID NO: 220114 - DNA, 25 bp, Artificial sequence
  SiRNA target sequence
tggtctttaacgaatggacatcctc

SEQ ID NO: 220115 - DNA, 25 bp, Artificial sequence
  SiRNA target sequence
ggtctttaacgaatggacatcctct

SEQ ID NO: 220116 - DNA, 25 bp, Artificial sequence
  SiRNA target sequence
gtctttaacgaatggacatcctctc

SEQ ID NO: 220117 - DNA, 25 bp, Artificial sequence
  SiRNA target sequence
tctttaacgaatggacatcctctct

SEQ ID NO: 220118 - DNA, 25 bp, Artificial sequence
  SiRNA target sequence
ctttaacgaatggacatcctctcta

SEQ ID NO: 220119 - DNA, 25 bp, Artificial sequence
  SiRNA target sequence
tttaacgaatggacatcctctctag

SEQ ID NO: 220120 - DNA, 25 bp, Artificial sequence
  SiRNA target sequence
ttaacgaatggacatcctctctagt

SEQ ID NO: 220121 - DNA, 25 bp, Artificial sequence
  SiRNA target sequence
taacgaatggacatcctctctagtt

SEQ ID NO: 220122 - DNA, 25 bp, Artificial sequence
  SiRNA target sequence
aacgaatggacatcctctctagttt

SEQ ID NO: 220123 - DNA, 25 bp, Artificial sequence
  SiRNA target sequence
acgaatggacatcctctctagttta

SEQ ID NO: 220124 - DNA, 25 bp, Artificial sequence
  SiRNA target sequence
cgaatggacatcctctctagtttac

SEQ ID NO: 220125 - DNA, 25 bp, Artificial sequence
  SiRNA target sequence
gaatggacatcctctctagtttaca

SEQ ID NO: 220126 - DNA, 25 bp, Artificial sequence
  SiRNA target sequence
aatggacatcctctctagtttacat

SEQ ID NO: 220127 - DNA, 25 bp, Artificial sequence
  SiRNA target sequence
atggacatcctctctagtttacatt

SEQ ID NO: 220128 - DNA, 25 bp, Artificial sequence
  SiRNA target sequence
tggacatcctctctagtttacattg

SEQ ID NO: 220129 - DNA, 25 bp, Artificial sequence
  SiRNA target sequence
ggacatcctctctagtttacattgt

SEQ ID NO: 220130 - DNA, 25 bp, Artificial sequence
  SiRNA target sequence
gacatcctctctagtttacattgtt

SEQ ID NO: 220131 - DNA, 25 bp, Artificial sequence
  SiRNA target sequence
acatcctctctagtttacattgttt

SEQ ID NO: 220132 - DNA, 25 bp, Artificial sequence
  SiRNA target sequence
catcctctctagtttacattgtttc

SEQ ID NO: 220133 - DNA, 25 bp, Artificial sequence
  SiRNA target sequence
atcctctctagtttacattgtttca

SEQ ID NO: 220134 - DNA, 25 bp, Artificial sequence
  SiRNA target sequence
tcctctctagtttacattgtttcag

SEQ ID NO: 220135 - DNA, 25 bp, Artificial sequence
  SiRNA target sequence
cctctctagtttacattgtttcaga

SEQ ID NO: 220136 - DNA, 25 bp, Artificial sequence
  SiRNA target sequence
ctctctagtttacattgtttcagaa

SEQ ID NO: 220137 - DNA, 25 bp, Artificial sequence
  SiRNA target sequence
tctctagtttacattgtttcagaaa

SEQ ID NO: 220138 - DNA, 25 bp, Artificial sequence
  SiRNA target sequence
ctctagtttacattgtttcagaaat

SEQ ID NO: 220139 - DNA, 25 bp, Artificial sequence
  SiRNA target sequence
tctagtttacattgtttcagaaatg

SEQ ID NO: 220140 - DNA, 25 bp, Artificial sequence
  SiRNA target sequence
ctagtttacattgtttcagaaatgt

SEQ ID NO: 220141 - DNA, 25 bp, Artificial sequence
  SiRNA target sequence
tagtttacattgtttcagaaatgtt

SEQ ID NO: 220142 - DNA, 25 bp, Artificial sequence
  SiRNA target sequence
agtttacattgtttcagaaatgttt

SEQ ID NO: 220143 - DNA, 25 bp, Artificial sequence
  SiRNA target sequence
gtttacattgtttcagaaatgtttg

SEQ ID NO: 220144 - DNA, 25 bp, Artificial sequence
  SiRNA target sequence
tttacattgtttcagaaatgtttgg

SEQ ID NO: 220145 - DNA, 25 bp, Artificial sequence
  SiRNA target sequence
ttacattgtttcagaaatgtttggt

SEQ ID NO: 220146 - DNA, 25 bp, Artificial sequence
  SiRNA target sequence
tacattgtttcagaaatgtttggta

SEQ ID NO: 220147 - DNA, 25 bp, Artificial sequence
  SiRNA target sequence
acattgtttcagaaatgtttggtaa

SEQ ID NO: 220148 - DNA, 25 bp, Artificial sequence
  SiRNA target sequence
cattgtttcagaaatgtttggtaat

SEQ ID NO: 220149 - DNA, 25 bp, Artificial sequence
  SiRNA target sequence
attgtttcagaaatgtttggtaatt

SEQ ID NO: 220150 - DNA, 25 bp, Artificial sequence
  SiRNA target sequence
ttgtttcagaaatgtttggtaattt

SEQ ID NO: 220151 - DNA, 25 bp, Artificial sequence
  SiRNA target sequence
tgtttcagaaatgtttggtaattta

SEQ ID NO: 220152 - DNA, 25 bp, Artificial sequence
  SiRNA target sequence
gtttcagaaatgtttggtaatttag

SEQ ID NO: 220153 - DNA, 25 bp, Artificial sequence
  SiRNA target sequence
tttcagaaatgtttggtaatttagt

SEQ ID NO: 220154 - DNA, 25 bp, Artificial sequence
  SiRNA target sequence
ttcagaaatgtttggtaatttagta

SEQ ID NO: 220155 - DNA, 25 bp, Artificial sequence
  SiRNA target sequence
tcagaaatgtttggtaatttagtat

SEQ ID NO: 220156 - DNA, 25 bp, Artificial sequence
  SiRNA target sequence
cagaaatgtttggtaatttagtatt

SEQ ID NO: 220157 - DNA, 25 bp, Artificial sequence
  SiRNA target sequence
agaaatgtttggtaatttagtattg

SEQ ID NO: 220158 - DNA, 25 bp, Artificial sequence
  SiRNA target sequence
gaaatgtttggtaatttagtattgt

SEQ ID NO: 220159 - DNA, 25 bp, Artificial sequence
  SiRNA target sequence
aaatgtttggtaatttagtattgtc

SEQ ID NO: 220160 - DNA, 25 bp, Artificial sequence
  SiRNA target sequence
aatgtttggtaatttagtattgtct

SEQ ID NO: 220161 - DNA, 25 bp, Artificial sequence
  SiRNA target sequence
atgtttggtaatttagtattgtctt

SEQ ID NO: 220162 - DNA, 25 bp, Artificial sequence
  SiRNA target sequence
tgtttggtaatttagtattgtctta

SEQ ID NO: 220163 - DNA, 25 bp, Artificial sequence
  SiRNA target sequence
gtttggtaatttagtattgtcttat

SEQ ID NO: 220164 - DNA, 25 bp, Artificial sequence
  SiRNA target sequence
tttggtaatttagtattgtcttatt

SEQ ID NO: 220165 - DNA, 25 bp, Artificial sequence
  SiRNA target sequence
ttggtaatttagtattgtcttattt

SEQ ID NO: 220166 - DNA, 25 bp, Artificial sequence
  SiRNA target sequence
tggtaatttagtattgtcttatttc

SEQ ID NO: 220167 - DNA, 25 bp, Artificial sequence
  SiRNA target sequence
ggtaatttagtattgtcttatttct

SEQ ID NO: 220168 - DNA, 25 bp, Artificial sequence
  SiRNA target sequence
gtaatttagtattgtcttatttctt

SEQ ID NO: 220169 - DNA, 25 bp, Artificial sequence
  SiRNA target sequence
taatttagtattgtcttatttcttc

SEQ ID NO: 220170 - DNA, 25 bp, Artificial sequence
  SiRNA target sequence
aatttagtattgtcttatttcttct

SEQ ID NO: 220171 - DNA, 25 bp, Artificial sequence
  SiRNA target sequence
atttagtattgtcttatttcttctt

SEQ ID NO: 220172 - DNA, 25 bp, Artificial sequence
  SiRNA target sequence
tttagtattgtcttatttcttcttg

SEQ ID NO: 220173 - DNA, 25 bp, Artificial sequence
  SiRNA target sequence
ttagtattgtcttatttcttcttga

SEQ ID NO: 220174 - DNA, 25 bp, Artificial sequence
  SiRNA target sequence
tagtattgtcttatttcttcttgac

SEQ ID NO: 220175 - DNA, 25 bp, Artificial sequence
  SiRNA target sequence
agtattgtcttatttcttcttgacg

SEQ ID NO: 220176 - DNA, 25 bp, Artificial sequence
  SiRNA target sequence
gtattgtcttatttcttcttgacgt

SEQ ID NO: 220177 - DNA, 25 bp, Artificial sequence
  SiRNA target sequence
tattgtcttatttcttcttgacgtt

SEQ ID NO: 220178 - DNA, 25 bp, Artificial sequence
  SiRNA target sequence
attgtcttatttcttcttgacgttt

SEQ ID NO: 220179 - DNA, 25 bp, Artificial sequence
  SiRNA target sequence
ttgtcttatttcttcttgacgtttg

SEQ ID NO: 220180 - DNA, 25 bp, Artificial sequence
  SiRNA target sequence
tgtcttatttcttcttgacgtttgc

SEQ ID NO: 220181 - DNA, 25 bp, Artificial sequence
  SiRNA target sequence
gtcttatttcttcttgacgtttgct

SEQ ID NO: 220182 - DNA, 25 bp, Artificial sequence
  SiRNA target sequence
tcttatttcttcttgacgtttgcta

SEQ ID NO: 220183 - DNA, 25 bp, Artificial sequence
  SiRNA target sequence
cttatttcttcttgacgtttgctaa

SEQ ID NO: 220184 - DNA, 25 bp, Artificial sequence
  SiRNA target sequence
ttatttcttcttgacgtttgctaat

SEQ ID NO: 220185 - DNA, 25 bp, Artificial sequence
  SiRNA target sequence
tatttcttcttgacgtttgctaatt

SEQ ID NO: 220186 - DNA, 25 bp, Artificial sequence
  SiRNA target sequence
atttcttcttgacgtttgctaattc

SEQ ID NO: 220187 - DNA, 25 bp, Artificial sequence
  SiRNA target sequence
tttcttcttgacgtttgctaattct

SEQ ID NO: 220188 - DNA, 25 bp, Artificial sequence
  SiRNA target sequence
ttcttcttgacgtttgctaattctt

SEQ ID NO: 220189 - DNA, 25 bp, Artificial sequence
  SiRNA target sequence
tcttcttgacgtttgctaattcttt

SEQ ID NO: 220190 - DNA, 25 bp, Artificial sequence
  SiRNA target sequence
cttcttgacgtttgctaattcttta

SEQ ID NO: 220191 - DNA, 25 bp, Artificial sequence
  SiRNA target sequence
ttcttgacgtttgctaattctttaa

SEQ ID NO: 220192 - DNA, 25 bp, Artificial sequence
  SiRNA target sequence
tcttgacgtttgctaattctttaac

SEQ ID NO: 220193 - DNA, 25 bp, Artificial sequence
  SiRNA target sequence
cttgacgtttgctaattctttaaca

SEQ ID NO: 220194 - DNA, 25 bp, Artificial sequence
  SiRNA target sequence
ttgacgtttgctaattctttaacaa

SEQ ID NO: 220195 - DNA, 25 bp, Artificial sequence
  SiRNA target sequence
tgacgtttgctaattctttaacaac

SEQ ID NO: 220196 - DNA, 25 bp, Artificial sequence
  SiRNA target sequence
gacgtttgctaattctttaacaact

SEQ ID NO: 220197 - DNA, 25 bp, Artificial sequence
  SiRNA target sequence
acgtttgctaattctttaacaactc

SEQ ID NO: 220198 - DNA, 25 bp, Artificial sequence
  SiRNA target sequence
cgtttgctaattctttaacaactcc

SEQ ID NO: 220199 - DNA, 25 bp, Artificial sequence
  SiRNA target sequence
gtttgctaattctttaacaactcca

SEQ ID NO: 220200 - DNA, 25 bp, Artificial sequence
  SiRNA target sequence
tttgctaattctttaacaactccag

SEQ ID NO: 220201 - DNA, 25 bp, Artificial sequence
  SiRNA target sequence
ttgctaattctttaacaactccagg

SEQ ID NO: 220202 - DNA, 25 bp, Artificial sequence
  SiRNA target sequence
tgctaattctttaacaactccagga

SEQ ID NO: 220203 - DNA, 25 bp, Artificial sequence
  SiRNA target sequence
gctaattctttaacaactccaggac

SEQ ID NO: 220204 - DNA, 25 bp, Artificial sequence
  SiRNA target sequence
ctaattctttaacaactccaggaca

SEQ ID NO: 220205 - DNA, 25 bp, Artificial sequence
  SiRNA target sequence
taattctttaacaactccaggacaa

SEQ ID NO: 220206 - DNA, 25 bp, Artificial sequence
  SiRNA target sequence
aattctttaacaactccaggacaaa

SEQ ID NO: 220207 - DNA, 25 bp, Artificial sequence
  SiRNA target sequence
attctttaacaactccaggacaaag

SEQ ID NO: 220208 - DNA, 25 bp, Artificial sequence
  SiRNA target sequence
ttctttaacaactccaggacaaagt

SEQ ID NO: 220209 - DNA, 25 bp, Artificial sequence
  SiRNA target sequence
tctttaacaactccaggacaaagtg

SEQ ID NO: 220210 - DNA, 25 bp, Artificial sequence
  SiRNA target sequence
ctttaacaactccaggacaaagtgc

SEQ ID NO: 220211 - DNA, 25 bp, Artificial sequence
  SiRNA target sequence
tttaacaactccaggacaaagtgca

SEQ ID NO: 220212 - DNA, 25 bp, Artificial sequence
  SiRNA target sequence
ttaacaactccaggacaaagtgcaa

SEQ ID NO: 220213 - DNA, 25 bp, Artificial sequence
  SiRNA target sequence
taacaactccaggacaaagtgcaag

SEQ ID NO: 220214 - DNA, 25 bp, Artificial sequence
  SiRNA target sequence
aacaactccaggacaaagtgcaaga

SEQ ID NO: 220215 - DNA, 25 bp, Artificial sequence
  SiRNA target sequence
acaactccaggacaaagtgcaagat

SEQ ID NO: 220216 - DNA, 25 bp, Artificial sequence
  SiRNA target sequence
caactccaggacaaagtgcaagatt

SEQ ID NO: 220217 - DNA, 25 bp, Artificial sequence
  SiRNA target sequence
aactccaggacaaagtgcaagattc

SEQ ID NO: 220218 - DNA, 25 bp, Artificial sequence
  SiRNA target sequence
actccaggacaaagtgcaagattca

SEQ ID NO: 220219 - DNA, 25 bp, Artificial sequence
  SiRNA target sequence
ctccaggacaaagtgcaagattcat

SEQ ID NO: 220220 - DNA, 25 bp, Artificial sequence
  SiRNA target sequence
tccaggacaaagtgcaagattcata

SEQ ID NO: 220221 - DNA, 25 bp, Artificial sequence
  SiRNA target sequence
ccaggacaaagtgcaagattcatac

SEQ ID NO: 220222 - DNA, 25 bp, Artificial sequence
  SiRNA target sequence
caggacaaagtgcaagattcatacc

SEQ ID NO: 220223 - DNA, 25 bp, Artificial sequence
  SiRNA target sequence
aggacaaagtgcaagattcatacct

SEQ ID NO: 220224 - DNA, 25 bp, Artificial sequence
  SiRNA target sequence
ggacaaagtgcaagattcatacctt

SEQ ID NO: 220225 - DNA, 25 bp, Artificial sequence
  SiRNA target sequence
gacaaagtgcaagattcataccttt

SEQ ID NO: 220226 - DNA, 25 bp, Artificial sequence
  SiRNA target sequence
acaaagtgcaagattcataccttta

SEQ ID NO: 220227 - DNA, 25 bp, Artificial sequence
  SiRNA target sequence
caaagtgcaagattcatacctttat

SEQ ID NO: 220228 - DNA, 25 bp, Artificial sequence
  SiRNA target sequence
aaagtgcaagattcatacctttatt

SEQ ID NO: 220229 - DNA, 25 bp, Artificial sequence
  SiRNA target sequence
aagtgcaagattcatacctttattt

SEQ ID NO: 220230 - DNA, 25 bp, Artificial sequence
  SiRNA target sequence
agtgcaagattcatacctttatttt

SEQ ID NO: 220231 - DNA, 25 bp, Artificial sequence
  SiRNA target sequence
gtgcaagattcatacctttatttta

SEQ ID NO: 220232 - DNA, 25 bp, Artificial sequence
  SiRNA target sequence
tgcaagattcatacctttattttat

SEQ ID NO: 220233 - DNA, 25 bp, Artificial sequence
  SiRNA target sequence
gcaagattcatacctttattttatg

SEQ ID NO: 220234 - DNA, 25 bp, Artificial sequence
  SiRNA target sequence
caagattcatacctttattttatgt

SEQ ID NO: 220235 - DNA, 25 bp, Artificial sequence
  SiRNA target sequence
aagattcatacctttattttatgtt

SEQ ID NO: 220236 - DNA, 25 bp, Artificial sequence
  SiRNA target sequence
agattcatacctttattttatgttt

SEQ ID NO: 220237 - DNA, 25 bp, Artificial sequence
  SiRNA target sequence
gattcatacctttattttatgtttt

SEQ ID NO: 220238 - DNA, 25 bp, Artificial sequence
  SiRNA target sequence
attcatacctttattttatgttttc

SEQ ID NO: 220239 - DNA, 25 bp, Artificial sequence
  SiRNA target sequence
ttcatacctttattttatgttttct

SEQ ID NO: 220240 - DNA, 25 bp, Artificial sequence
  SiRNA target sequence
tcatacctttattttatgttttctc

SEQ ID NO: 220241 - DNA, 25 bp, Artificial sequence
  SiRNA target sequence
catacctttattttatgttttctcg

SEQ ID NO: 220242 - DNA, 25 bp, Artificial sequence
  SiRNA target sequence
atacctttattttatgttttctcga

SEQ ID NO: 220243 - DNA, 25 bp, Artificial sequence
  SiRNA target sequence
tacctttattttatgttttctcgaa

SEQ ID NO: 220244 - DNA, 25 bp, Artificial sequence
  SiRNA target sequence
acctttattttatgttttctcgaat

SEQ ID NO: 220245 - DNA, 25 bp, Artificial sequence
  SiRNA target sequence
cctttattttatgttttctcgaata

SEQ ID NO: 220246 - DNA, 25 bp, Artificial sequence
  SiRNA target sequence
ctttattttatgttttctcgaatat

SEQ ID NO: 220247 - DNA, 25 bp, Artificial sequence
  SiRNA target sequence
tttattttatgttttctcgaatatt

SEQ ID NO: 220248 - DNA, 25 bp, Artificial sequence
  SiRNA target sequence
ttattttatgttttctcgaatattt

SEQ ID NO: 220249 - DNA, 25 bp, Artificial sequence
  SiRNA target sequence
tattttatgttttctcgaatatttc

SEQ ID NO: 220250 - DNA, 25 bp, Artificial sequence
  SiRNA target sequence
attttatgttttctcgaatatttct

SEQ ID NO: 220251 - DNA, 25 bp, Artificial sequence
  SiRNA target sequence
ttttatgttttctcgaatatttctc

SEQ ID NO: 220252 - DNA, 25 bp, Artificial sequence
  SiRNA target sequence
tttatgttttctcgaatatttctct

SEQ ID NO: 220253 - DNA, 25 bp, Artificial sequence
  SiRNA target sequence
ttatgttttctcgaatatttctctt

SEQ ID NO: 220254 - DNA, 25 bp, Artificial sequence
  SiRNA target sequence
tatgttttctcgaatatttctcttt

SEQ ID NO: 220255 - DNA, 25 bp, Artificial sequence
  SiRNA target sequence
atgttttctcgaatatttctctttt

SEQ ID NO: 220256 - DNA, 25 bp, Artificial sequence
  SiRNA target sequence
tgttttctcgaatatttctcttttc

SEQ ID NO: 220257 - DNA, 25 bp, Artificial sequence
  SiRNA target sequence
gttttctcgaatatttctcttttct

SEQ ID NO: 220258 - DNA, 25 bp, Artificial sequence
  SiRNA target sequence
ttttctcgaatatttctcttttctt

SEQ ID NO: 220259 - DNA, 25 bp, Artificial sequence
  SiRNA target sequence
tttctcgaatatttctcttttctta

SEQ ID NO: 220260 - DNA, 25 bp, Artificial sequence
  SiRNA target sequence
ttctcgaatatttctcttttcttat

SEQ ID NO: 220261 - DNA, 25 bp, Artificial sequence
  SiRNA target sequence
tctcgaatatttctcttttcttatc

SEQ ID NO: 220262 - DNA, 25 bp, Artificial sequence
  SiRNA target sequence
ctcgaatatttctcttttcttatct

SEQ ID NO: 220263 - DNA, 25 bp, Artificial sequence
  SiRNA target sequence
tcgaatatttctcttttcttatctt

SEQ ID NO: 220264 - DNA, 25 bp, Artificial sequence
  SiRNA target sequence
cgaatatttctcttttcttatcttc

SEQ ID NO: 220265 - DNA, 25 bp, Artificial sequence
  SiRNA target sequence
gaatatttctcttttcttatcttct

SEQ ID NO: 220266 - DNA, 25 bp, Artificial sequence
  SiRNA target sequence
aatatttctcttttcttatcttctc

SEQ ID NO: 220267 - DNA, 25 bp, Artificial sequence
  SiRNA target sequence
atatttctcttttcttatcttctca

SEQ ID NO: 220268 - DNA, 25 bp, Artificial sequence
  SiRNA target sequence
tatttctcttttcttatcttctcaa

SEQ ID NO: 220269 - DNA, 25 bp, Artificial sequence
  SiRNA target sequence
atttctcttttcttatcttctcaag

SEQ ID NO: 220270 - DNA, 25 bp, Artificial sequence
  SiRNA target sequence
tttctcttttcttatcttctcaagt

SEQ ID NO: 220271 - DNA, 25 bp, Artificial sequence
  SiRNA target sequence
ttctcttttcttatcttctcaagtg

SEQ ID NO: 220272 - DNA, 25 bp, Artificial sequence
  SiRNA target sequence
tctcttttcttatcttctcaagtga

SEQ ID NO: 220273 - DNA, 25 bp, Artificial sequence
  SiRNA target sequence
ctcttttcttatcttctcaagtgac

SEQ ID NO: 220274 - DNA, 25 bp, Artificial sequence
  SiRNA target sequence
tcttttcttatcttctcaagtgaca

SEQ ID NO: 220275 - DNA, 25 bp, Artificial sequence
  SiRNA target sequence
cttttcttatcttctcaagtgacag

SEQ ID NO: 220276 - DNA, 25 bp, Artificial sequence
  SiRNA target sequence
ttttcttatcttctcaagtgacaga

SEQ ID NO: 220277 - DNA, 25 bp, Artificial sequence
  SiRNA target sequence
tttcttatcttctcaagtgacagaa

SEQ ID NO: 220278 - DNA, 25 bp, Artificial sequence
  SiRNA target sequence
ttcttatcttctcaagtgacagaac

SEQ ID NO: 220279 - DNA, 25 bp, Artificial sequence
  SiRNA target sequence
tcttatcttctcaagtgacagaact

SEQ ID NO: 220280 - DNA, 25 bp, Artificial sequence
  SiRNA target sequence
cttatcttctcaagtgacagaactt

SEQ ID NO: 220281 - DNA, 25 bp, Artificial sequence
  SiRNA target sequence
ttatcttctcaagtgacagaacttt

SEQ ID NO: 220282 - DNA, 25 bp, Artificial sequence
  SiRNA target sequence
tatcttctcaagtgacagaactttt

SEQ ID NO: 220283 - DNA, 25 bp, Artificial sequence
  SiRNA target sequence
atcttctcaagtgacagaacttttt

SEQ ID NO: 220284 - DNA, 25 bp, Artificial sequence
  SiRNA target sequence
tcttctcaagtgacagaacttttta

SEQ ID NO: 220285 - DNA, 25 bp, Artificial sequence
  SiRNA target sequence
cttctcaagtgacagaactttttac

SEQ ID NO: 220286 - DNA, 25 bp, Artificial sequence
  SiRNA target sequence
ttctcaagtgacagaactttttaca

SEQ ID NO: 220287 - DNA, 25 bp, Artificial sequence
  SiRNA target sequence
tctcaagtgacagaactttttacaa

SEQ ID NO: 220288 - DNA, 25 bp, Artificial sequence
  SiRNA target sequence
ctcaagtgacagaactttttacaag

SEQ ID NO: 220289 - DNA, 25 bp, Artificial sequence
  SiRNA target sequence
tcaagtgacagaactttttacaaga

SEQ ID NO: 220290 - DNA, 25 bp, Artificial sequence
  SiRNA target sequence
caagtgacagaactttttacaagat

SEQ ID NO: 220291 - DNA, 25 bp, Artificial sequence
  SiRNA target sequence
aagtgacagaactttttacaagata

SEQ ID NO: 220292 - DNA, 25 bp, Artificial sequence
  SiRNA target sequence
agtgacagaactttttacaagatat

SEQ ID NO: 220293 - DNA, 25 bp, Artificial sequence
  SiRNA target sequence
gtgacagaactttttacaagatata

SEQ ID NO: 220294 - DNA, 25 bp, Artificial sequence
  SiRNA target sequence
tgacagaactttttacaagatatag

SEQ ID NO: 220295 - DNA, 25 bp, Artificial sequence
  SiRNA target sequence
gacagaactttttacaagatataga

SEQ ID NO: 220296 - DNA, 25 bp, Artificial sequence
  SiRNA target sequence
acagaactttttacaagatatagat

SEQ ID NO: 220297 - DNA, 25 bp, Artificial sequence
  SiRNA target sequence
cagaactttttacaagatatagatc

SEQ ID NO: 220298 - DNA, 25 bp, Artificial sequence
  SiRNA target sequence
agaactttttacaagatatagatca

SEQ ID NO: 220299 - DNA, 25 bp, Artificial sequence
  SiRNA target sequence
gaactttttacaagatatagatcaa

SEQ ID NO: 220300 - DNA, 25 bp, Artificial sequence
  SiRNA target sequence
aactttttacaagatatagatcaaa

SEQ ID NO: 220301 - DNA, 25 bp, Artificial sequence
  SiRNA target sequence
actttttacaagatatagatcaaag

SEQ ID NO: 220302 - DNA, 25 bp, Artificial sequence
  SiRNA target sequence
ctttttacaagatatagatcaaagc

SEQ ID NO: 220303 - DNA, 25 bp, Artificial sequence
  SiRNA target sequence
tttttacaagatatagatcaaagct

SEQ ID NO: 220304 - DNA, 25 bp, Artificial sequence
  SiRNA target sequence
ttttacaagatatagatcaaagctc

SEQ ID NO: 220305 - DNA, 25 bp, Artificial sequence
  SiRNA target sequence
tttacaagatatagatcaaagctca

SEQ ID NO: 220306 - DNA, 25 bp, Artificial sequence
  SiRNA target sequence
ttacaagatatagatcaaagctcac

SEQ ID NO: 220307 - DNA, 25 bp, Artificial sequence
  SiRNA target sequence
tacaagatatagatcaaagctcact

SEQ ID NO: 220308 - DNA, 25 bp, Artificial sequence
  SiRNA target sequence
acaagatatagatcaaagctcactt

SEQ ID NO: 220309 - DNA, 25 bp, Artificial sequence
  SiRNA target sequence
caagatatagatcaaagctcacttt

SEQ ID NO: 220310 - DNA, 25 bp, Artificial sequence
  SiRNA target sequence
aagatatagatcaaagctcactttc

SEQ ID NO: 220311 - DNA, 25 bp, Artificial sequence
  SiRNA target sequence
agatatagatcaaagctcactttct

SEQ ID NO: 220312 - DNA, 25 bp, Artificial sequence
  SiRNA target sequence
gatatagatcaaagctcactttctc

SEQ ID NO: 220313 - DNA, 25 bp, Artificial sequence
  SiRNA target sequence
atatagatcaaagctcactttctca

SEQ ID NO: 220314 - DNA, 25 bp, Artificial sequence
  SiRNA target sequence
tatagatcaaagctcactttctcag

SEQ ID NO: 220315 - DNA, 25 bp, Artificial sequence
  SiRNA target sequence
atagatcaaagctcactttctcaga

SEQ ID NO: 220316 - DNA, 25 bp, Artificial sequence
  SiRNA target sequence
tagatcaaagctcactttctcagag

SEQ ID NO: 220317 - DNA, 25 bp, Artificial sequence
  SiRNA target sequence
agatcaaagctcactttctcagagg

SEQ ID NO: 220318 - DNA, 25 bp, Artificial sequence
  SiRNA target sequence
gatcaaagctcactttctcagaggc

SEQ ID NO: 220319 - DNA, 25 bp, Artificial sequence
  SiRNA target sequence
atcaaagctcactttctcagaggcg

SEQ ID NO: 220320 - DNA, 25 bp, Artificial sequence
  SiRNA target sequence
tcaaagctcactttctcagaggcgg

SEQ ID NO: 220321 - DNA, 25 bp, Artificial sequence
  SiRNA target sequence
caaagctcactttctcagaggcgga

SEQ ID NO: 220322 - DNA, 25 bp, Artificial sequence
  SiRNA target sequence
aaagctcactttctcagaggcggaa

SEQ ID NO: 220323 - DNA, 25 bp, Artificial sequence
  SiRNA target sequence
aagctcactttctcagaggcggaat

SEQ ID NO: 220324 - DNA, 25 bp, Artificial sequence
  SiRNA target sequence
agctcactttctcagaggcggaatt

SEQ ID NO: 220325 - DNA, 25 bp, Artificial sequence
  SiRNA target sequence
gctcactttctcagaggcggaattt

SEQ ID NO: 220326 - DNA, 25 bp, Artificial sequence
  SiRNA target sequence
ctcactttctcagaggcggaatttt

SEQ ID NO: 220327 - DNA, 25 bp, Artificial sequence
  SiRNA target sequence
tcactttctcagaggcggaattttt

SEQ ID NO: 220328 - DNA, 25 bp, Artificial sequence
  SiRNA target sequence
cactttctcagaggcggaattttta

SEQ ID NO: 220329 - DNA, 25 bp, Artificial sequence
  SiRNA target sequence
actttctcagaggcggaatttttat

SEQ ID NO: 220330 - DNA, 25 bp, Artificial sequence
  SiRNA target sequence
ctttctcagaggcggaatttttata

SEQ ID NO: 220331 - DNA, 25 bp, Artificial sequence
  SiRNA target sequence
tttctcagaggcggaatttttatat

SEQ ID NO: 220332 - DNA, 25 bp, Artificial sequence
  SiRNA target sequence
ttctcagaggcggaatttttatata

SEQ ID NO: 220333 - DNA, 25 bp, Artificial sequence
  SiRNA target sequence
tctcagaggcggaatttttatataa

SEQ ID NO: 220334 - DNA, 25 bp, Artificial sequence
  SiRNA target sequence
ctcagaggcggaatttttatataat

SEQ ID NO: 220335 - DNA, 25 bp, Artificial sequence
  SiRNA target sequence
tcagaggcggaatttttatataatg

SEQ ID NO: 220336 - DNA, 25 bp, Artificial sequence
  SiRNA target sequence
cagaggcggaatttttatataatgg

SEQ ID NO: 220337 - DNA, 25 bp, Artificial sequence
  SiRNA target sequence
agaggcggaatttttatataatggc

SEQ ID NO: 220338 - DNA, 25 bp, Artificial sequence
  SiRNA target sequence
gaggcggaatttttatataatggct

SEQ ID NO: 220339 - DNA, 25 bp, Artificial sequence
  SiRNA target sequence
aggcggaatttttatataatggctt

SEQ ID NO: 220340 - DNA, 25 bp, Artificial sequence
  SiRNA target sequence
ggcggaatttttatataatggcttt

SEQ ID NO: 220341 - DNA, 25 bp, Artificial sequence
  SiRNA target sequence
gcggaatttttatataatggctttt

SEQ ID NO: 220342 - DNA, 25 bp, Artificial sequence
  SiRNA target sequence
cggaatttttatataatggcttttt

SEQ ID NO: 220343 - DNA, 25 bp, Artificial sequence
  SiRNA target sequence
ggaatttttatataatggctttttt

SEQ ID NO: 220344 - DNA, 25 bp, Artificial sequence
  SiRNA target sequence
gaatttttatataatggcttttttg

SEQ ID NO: 220345 - DNA, 25 bp, Artificial sequence
  SiRNA target sequence
aatttttatataatggcttttttgt

SEQ ID NO: 220346 - DNA, 25 bp, Artificial sequence
  SiRNA target sequence
atttttatataatggcttttttgta

SEQ ID NO: 220347 - DNA, 25 bp, Artificial sequence
  SiRNA target sequence
tttttatataatggcttttttgtat

SEQ ID NO: 220348 - DNA, 25 bp, Artificial sequence
  SiRNA target sequence
ttttatataatggcttttttgtatt

SEQ ID NO: 220349 - DNA, 25 bp, Artificial sequence
  SiRNA target sequence
tttatataatggcttttttgtattt

SEQ ID NO: 220350 - DNA, 25 bp, Artificial sequence
  SiRNA target sequence
ttatataatggcttttttgtatttt

SEQ ID NO: 220351 - DNA, 25 bp, Artificial sequence
  SiRNA target sequence
tatataatggcttttttgtattttc

SEQ ID NO: 220352 - DNA, 25 bp, Artificial sequence
  SiRNA target sequence
atataatggcttttttgtattttct

SEQ ID NO: 220353 - DNA, 25 bp, Artificial sequence
  SiRNA target sequence
tataatggcttttttgtattttctg

SEQ ID NO: 220354 - DNA, 25 bp, Artificial sequence
  SiRNA target sequence
ataatggcttttttgtattttctgg

SEQ ID NO: 220355 - DNA, 25 bp, Artificial sequence
  SiRNA target sequence
taatggcttttttgtattttctgga

SEQ ID NO: 220356 - DNA, 25 bp, Artificial sequence
  SiRNA target sequence
aatggcttttttgtattttctggag

SEQ ID NO: 220357 - DNA, 25 bp, Artificial sequence
  SiRNA target sequence
atggcttttttgtattttctggagt

SEQ ID NO: 220358 - DNA, 25 bp, Artificial sequence
  SiRNA target sequence
tggcttttttgtattttctggagtt

SEQ ID NO: 220359 - DNA, 25 bp, Artificial sequence
  SiRNA target sequence
ggcttttttgtattttctggagttc

SEQ ID NO: 220360 - DNA, 25 bp, Artificial sequence
  SiRNA target sequence
gcttttttgtattttctggagttct

SEQ ID NO: 220361 - DNA, 25 bp, Artificial sequence
  SiRNA target sequence
cttttttgtattttctggagttcta

SEQ ID NO: 220362 - DNA, 25 bp, Artificial sequence
  SiRNA target sequence
ttttttgtattttctggagttctag

SEQ ID NO: 220363 - DNA, 25 bp, Artificial sequence
  SiRNA target sequence
tttttgtattttctggagttctagt

SEQ ID NO: 220364 - DNA, 25 bp, Artificial sequence
  SiRNA target sequence
ttttgtattttctggagttctagta

SEQ ID NO: 220365 - DNA, 25 bp, Artificial sequence
  SiRNA target sequence
tttgtattttctggagttctagtaa

SEQ ID NO: 220366 - DNA, 25 bp, Artificial sequence
  SiRNA target sequence
ttgtattttctggagttctagtaat

SEQ ID NO: 220367 - DNA, 25 bp, Artificial sequence
  SiRNA target sequence
tgtattttctggagttctagtaata

SEQ ID NO: 220368 - DNA, 25 bp, Artificial sequence
  SiRNA target sequence
gtattttctggagttctagtaatag

SEQ ID NO: 220369 - DNA, 25 bp, Artificial sequence
  SiRNA target sequence
tattttctggagttctagtaatagt

SEQ ID NO: 220370 - DNA, 25 bp, Artificial sequence
  SiRNA target sequence
attttctggagttctagtaatagtt

SEQ ID NO: 220371 - DNA, 25 bp, Artificial sequence
  SiRNA target sequence
ttttctggagttctagtaatagtta

SEQ ID NO: 220372 - DNA, 25 bp, Artificial sequence
  SiRNA target sequence
tttctggagttctagtaatagttat

SEQ ID NO: 220373 - DNA, 25 bp, Artificial sequence
  SiRNA target sequence
ttctggagttctagtaatagttata

SEQ ID NO: 220374 - DNA, 25 bp, Artificial sequence
  SiRNA target sequence
tctggagttctagtaatagttatat

SEQ ID NO: 220375 - DNA, 25 bp, Artificial sequence
  SiRNA target sequence
ctggagttctagtaatagttatatt

SEQ ID NO: 220376 - DNA, 25 bp, Artificial sequence
  SiRNA target sequence
tggagttctagtaatagttatattt

SEQ ID NO: 220377 - DNA, 25 bp, Artificial sequence
  SiRNA target sequence
ggagttctagtaatagttatatttt

SEQ ID NO: 220378 - DNA, 25 bp, Artificial sequence
  SiRNA target sequence
gagttctagtaatagttatattttt

SEQ ID NO: 220379 - DNA, 25 bp, Artificial sequence
  SiRNA target sequence
agttctagtaatagttatattttta

SEQ ID NO: 220380 - DNA, 25 bp, Artificial sequence
  SiRNA target sequence
gttctagtaatagttatatttttaa

SEQ ID NO: 220381 - DNA, 25 bp, Artificial sequence
  SiRNA target sequence
ttctagtaatagttatatttttaat

SEQ ID NO: 220382 - DNA, 25 bp, Artificial sequence
  SiRNA target sequence
tctagtaatagttatatttttaatt

SEQ ID NO: 220383 - DNA, 25 bp, Artificial sequence
  SiRNA target sequence
ctagtaatagttatatttttaatta

SEQ ID NO: 220384 - DNA, 25 bp, Artificial sequence
  SiRNA target sequence
tagtaatagttatatttttaattaa

SEQ ID NO: 220385 - DNA, 25 bp, Artificial sequence
  SiRNA target sequence
agtaatagttatatttttaattaaa

SEQ ID NO: 220386 - DNA, 25 bp, Artificial sequence
  SiRNA target sequence
gtaatagttatatttttaattaaaa

SEQ ID NO: 220387 - DNA, 25 bp, Artificial sequence
  SiRNA target sequence
taatagttatatttttaattaaaaa

SEQ ID NO: 220388 - DNA, 25 bp, Artificial sequence
  SiRNA target sequence
aatagttatatttttaattaaaaaa

SEQ ID NO: 220389 - DNA, 25 bp, Artificial sequence
  SiRNA target sequence
atagttatatttttaattaaaaaat

SEQ ID NO: 220390 - DNA, 25 bp, Artificial sequence
  SiRNA target sequence
tagttatatttttaattaaaaaata

SEQ ID NO: 220391 - DNA, 25 bp, Artificial sequence
  SiRNA target sequence
agttatatttttaattaaaaaatat

SEQ ID NO: 220392 - DNA, 25 bp, Artificial sequence
  SiRNA target sequence
gttatatttttaattaaaaaatatt

SEQ ID NO: 220393 - DNA, 25 bp, Artificial sequence
  SiRNA target sequence
ttatatttttaattaaaaaatattt

SEQ ID NO: 220394 - DNA, 25 bp, Artificial sequence
  SiRNA target sequence
tatatttttaattaaaaaatatttg

SEQ ID NO: 220395 - DNA, 25 bp, Artificial sequence
  SiRNA target sequence
atatttttaattaaaaaatatttgg

SEQ ID NO: 220396 - DNA, 25 bp, Artificial sequence
  SiRNA target sequence
tatttttaattaaaaaatatttgga

SEQ ID NO: 220397 - DNA, 25 bp, Artificial sequence
  SiRNA target sequence
atttttaattaaaaaatatttggag

SEQ ID NO: 220398 - DNA, 25 bp, Artificial sequence
  SiRNA target sequence
tttttaattaaaaaatatttggaga

SEQ ID NO: 220399 - DNA, 25 bp, Artificial sequence
  SiRNA target sequence
ttttaattaaaaaatatttggagag

SEQ ID NO: 220400 - DNA, 25 bp, Artificial sequence
  SiRNA target sequence
tttaattaaaaaatatttggagagg

SEQ ID NO: 220401 - DNA, 25 bp, Artificial sequence
  SiRNA target sequence
ttaattaaaaaatatttggagagga

SEQ ID NO: 220402 - DNA, 25 bp, Artificial sequence
  SiRNA target sequence
taattaaaaaatatttggagaggaa

SEQ ID NO: 220403 - DNA, 25 bp, Artificial sequence
  SiRNA target sequence
aattaaaaaatatttggagaggaat

SEQ ID NO: 220404 - DNA, 25 bp, Artificial sequence
  SiRNA target sequence
attaaaaaatatttggagaggaatg

SEQ ID NO: 220405 - DNA, 25 bp, Artificial sequence
  SiRNA target sequence
ttaaaaaatatttggagaggaatgt

SEQ ID NO: 220406 - DNA, 25 bp, Artificial sequence
  SiRNA target sequence
taaaaaatatttggagaggaatgtg

SEQ ID NO: 220407 - DNA, 25 bp, Artificial sequence
  SiRNA target sequence
aaaaaatatttggagaggaatgtga

SEQ ID NO: 220408 - DNA, 25 bp, Artificial sequence
  SiRNA target sequence
aaaaatatttggagaggaatgtgac

SEQ ID NO: 220409 - DNA, 25 bp, Artificial sequence
  SiRNA target sequence
aaaatatttggagaggaatgtgact

SEQ ID NO: 220410 - DNA, 25 bp, Artificial sequence
  SiRNA target sequence
aaatatttggagaggaatgtgacta

SEQ ID NO: 220411 - DNA, 25 bp, Artificial sequence
  SiRNA target sequence
aatatttggagaggaatgtgactaa

SEQ ID NO: 220412 - DNA, 25 bp, Artificial sequence
  SiRNA target sequence
atatttggagaggaatgtgactaac

SEQ ID NO: 220413 - DNA, 25 bp, Artificial sequence
  SiRNA target sequence
tatttggagaggaatgtgactaaca

SEQ ID NO: 220414 - DNA, 25 bp, Artificial sequence
  SiRNA target sequence
atttggagaggaatgtgactaacaa

SEQ ID NO: 220415 - DNA, 25 bp, Artificial sequence
  SiRNA target sequence
tttggagaggaatgtgactaacaaa

SEQ ID NO: 220416 - DNA, 25 bp, Artificial sequence
  SiRNA target sequence
ttggagaggaatgtgactaacaaac

SEQ ID NO: 220417 - DNA, 25 bp, Artificial sequence
  SiRNA target sequence
tggagaggaatgtgactaacaaacc

SEQ ID NO: 220418 - DNA, 25 bp, Artificial sequence
  SiRNA target sequence
ggagaggaatgtgactaacaaacct

SEQ ID NO: 220419 - DNA, 25 bp, Artificial sequence
  SiRNA target sequence
gagaggaatgtgactaacaaacctt

SEQ ID NO: 220420 - DNA, 25 bp, Artificial sequence
  SiRNA target sequence
agaggaatgtgactaacaaaccttt

SEQ ID NO: 220421 - DNA, 25 bp, Artificial sequence
  SiRNA target sequence
gaggaatgtgactaacaaacctttg

SEQ ID NO: 220422 - DNA, 25 bp, Artificial sequence
  SiRNA target sequence
aggaatgtgactaacaaacctttgt

SEQ ID NO: 220423 - DNA, 25 bp, Artificial sequence
  SiRNA target sequence
ggaatgtgactaacaaacctttgtt

SEQ ID NO: 220424 - DNA, 25 bp, Artificial sequence
  SiRNA target sequence
gaatgtgactaacaaacctttgttt

SEQ ID NO: 220425 - DNA, 25 bp, Artificial sequence
  SiRNA target sequence
aatgtgactaacaaacctttgtttg

SEQ ID NO: 220426 - DNA, 25 bp, Artificial sequence
  SiRNA target sequence
atgtgactaacaaacctttgtttgt

SEQ ID NO: 220427 - DNA, 25 bp, Artificial sequence
  SiRNA target sequence
tgtgactaacaaacctttgtttgtt

SEQ ID NO: 220428 - DNA, 25 bp, Artificial sequence
  SiRNA target sequence
gtgactaacaaacctttgtttgttg

SEQ ID NO: 220429 - DNA, 25 bp, Artificial sequence
  SiRNA target sequence
tgactaacaaacctttgtttgttgt

SEQ ID NO: 220430 - DNA, 25 bp, Artificial sequence
  SiRNA target sequence
gactaacaaacctttgtttgttgta

SEQ ID NO: 220431 - DNA, 25 bp, Artificial sequence
  SiRNA target sequence
actaacaaacctttgtttgttgtaa

SEQ ID NO: 220432 - DNA, 25 bp, Artificial sequence
  SiRNA target sequence
ctaacaaacctttgtttgttgtaaa

SEQ ID NO: 220433 - DNA, 25 bp, Artificial sequence
  SiRNA target sequence
taacaaacctttgtttgttgtaaaa

SEQ ID NO: 220434 - DNA, 25 bp, Artificial sequence
  SiRNA target sequence
aacaaacctttgtttgttgtaaaat

SEQ ID NO: 220435 - DNA, 25 bp, Artificial sequence
  SiRNA target sequence
acaaacctttgtttgttgtaaaatc

SEQ ID NO: 220436 - DNA, 25 bp, Artificial sequence
  SiRNA target sequence
caaacctttgtttgttgtaaaatct

SEQ ID NO: 220437 - DNA, 25 bp, Artificial sequence
  SiRNA target sequence
aaacctttgtttgttgtaaaatctg

SEQ ID NO: 220438 - DNA, 25 bp, Artificial sequence
  SiRNA target sequence
aacctttgtttgttgtaaaatctgt

SEQ ID NO: 220439 - DNA, 25 bp, Artificial sequence
  SiRNA target sequence
acctttgtttgttgtaaaatctgtt

SEQ ID NO: 220440 - DNA, 25 bp, Artificial sequence
  SiRNA target sequence
cctttgtttgttgtaaaatctgtta

SEQ ID NO: 220441 - DNA, 25 bp, Artificial sequence
  SiRNA target sequence
ctttgtttgttgtaaaatctgttaa

SEQ ID NO: 220442 - DNA, 25 bp, Artificial sequence
  SiRNA target sequence
tttgtttgttgtaaaatctgttaaa

SEQ ID NO: 220443 - DNA, 25 bp, Artificial sequence
  SiRNA target sequence
ttgtttgttgtaaaatctgttaaaa

SEQ ID NO: 220444 - DNA, 25 bp, Artificial sequence
  SiRNA target sequence
tgtttgttgtaaaatctgttaaaaa

SEQ ID NO: 220445 - DNA, 25 bp, Artificial sequence
  SiRNA target sequence
gtttgttgtaaaatctgttaaaaag

SEQ ID NO: 220446 - DNA, 25 bp, Artificial sequence
  SiRNA target sequence
tttgttgtaaaatctgttaaaaaga

SEQ ID NO: 220447 - DNA, 25 bp, Artificial sequence
  SiRNA target sequence
ttgttgtaaaatctgttaaaaagaa

SEQ ID NO: 220448 - DNA, 25 bp, Artificial sequence
  SiRNA target sequence
tgttgtaaaatctgttaaaaagaag

SEQ ID NO: 220449 - DNA, 25 bp, Artificial sequence
  SiRNA target sequence
gttgtaaaatctgttaaaaagaagg

SEQ ID NO: 220450 - DNA, 25 bp, Artificial sequence
  SiRNA target sequence
ttgtaaaatctgttaaaaagaaggg

SEQ ID NO: 220451 - DNA, 25 bp, Artificial sequence
  SiRNA target sequence
tgtaaaatctgttaaaaagaaggga

SEQ ID NO: 220452 - DNA, 25 bp, Artificial sequence
  SiRNA target sequence
gtaaaatctgttaaaaagaagggac

SEQ ID NO: 220453 - DNA, 25 bp, Artificial sequence
  SiRNA target sequence
taaaatctgttaaaaagaagggacc

SEQ ID NO: 220454 - DNA, 25 bp, Artificial sequence
  SiRNA target sequence
aaaatctgttaaaaagaagggacca

SEQ ID NO: 220455 - DNA, 25 bp, Artificial sequence
  SiRNA target sequence
aaatctgttaaaaagaagggaccaa

SEQ ID NO: 220456 - DNA, 25 bp, Artificial sequence
  SiRNA target sequence
aatctgttaaaaagaagggaccaaa

SEQ ID NO: 220457 - DNA, 25 bp, Artificial sequence
  SiRNA target sequence
atctgttaaaaagaagggaccaaaa

SEQ ID NO: 220458 - DNA, 25 bp, Artificial sequence
  SiRNA target sequence
tctgttaaaaagaagggaccaaaag

SEQ ID NO: 220459 - DNA, 25 bp, Artificial sequence
  SiRNA target sequence
ctgttaaaaagaagggaccaaaagt

SEQ ID NO: 220460 - DNA, 25 bp, Artificial sequence
  SiRNA target sequence
tgttaaaaagaagggaccaaaagtt

SEQ ID NO: 220461 - DNA, 25 bp, Artificial sequence
  SiRNA target sequence
gttaaaaagaagggaccaaaagtta

SEQ ID NO: 220462 - DNA, 25 bp, Artificial sequence
  SiRNA target sequence
ttaaaaagaagggaccaaaagttaa

SEQ ID NO: 220463 - DNA, 25 bp, Artificial sequence
  SiRNA target sequence
taaaaagaagggaccaaaagttaaa

SEQ ID NO: 220464 - DNA, 25 bp, Artificial sequence
  SiRNA target sequence
aaaaagaagggaccaaaagttaaag

SEQ ID NO: 220465 - DNA, 25 bp, Artificial sequence
  SiRNA target sequence
aaaagaagggaccaaaagttaaagt

SEQ ID NO: 220466 - DNA, 25 bp, Artificial sequence
  SiRNA target sequence
aaagaagggaccaaaagttaaagta

SEQ ID NO: 220467 - DNA, 25 bp, Artificial sequence
  SiRNA target sequence
aagaagggaccaaaagttaaagtag

SEQ ID NO: 220468 - DNA, 25 bp, Artificial sequence
  SiRNA target sequence
agaagggaccaaaagttaaagtagg

SEQ ID NO: 220469 - DNA, 25 bp, Artificial sequence
  SiRNA target sequence
gaagggaccaaaagttaaagtagga

SEQ ID NO: 220470 - DNA, 25 bp, Artificial sequence
  SiRNA target sequence
aagggaccaaaagttaaagtaggat

SEQ ID NO: 220471 - DNA, 25 bp, Artificial sequence
  SiRNA target sequence
agggaccaaaagttaaagtaggatt

SEQ ID NO: 220472 - DNA, 25 bp, Artificial sequence
  SiRNA target sequence
gggaccaaaagttaaagtaggattt

SEQ ID NO: 220473 - DNA, 25 bp, Artificial sequence
  SiRNA target sequence
ggaccaaaagttaaagtaggatttg

SEQ ID NO: 220474 - DNA, 25 bp, Artificial sequence
  SiRNA target sequence
gaccaaaagttaaagtaggatttgc

SEQ ID NO: 220475 - DNA, 25 bp, Artificial sequence
  SiRNA target sequence
accaaaagttaaagtaggatttgcg

SEQ ID NO: 220476 - DNA, 25 bp, Artificial sequence
  SiRNA target sequence
ccaaaagttaaagtaggatttgcgg

SEQ ID NO: 220477 - DNA, 25 bp, Artificial sequence
  SiRNA target sequence
caaaagttaaagtaggatttgcgga

SEQ ID NO: 220478 - DNA, 25 bp, Artificial sequence
  SiRNA target sequence
aaaagttaaagtaggatttgcggag

SEQ ID NO: 220479 - DNA, 25 bp, Artificial sequence
  SiRNA target sequence
aaagttaaagtaggatttgcggagg

SEQ ID NO: 220480 - DNA, 25 bp, Artificial sequence
  SiRNA target sequence
aagttaaagtaggatttgcggaggg

SEQ ID NO: 220481 - DNA, 25 bp, Artificial sequence
  SiRNA target sequence
agttaaagtaggatttgcggagggc

SEQ ID NO: 220482 - DNA, 25 bp, Artificial sequence
  SiRNA target sequence
gttaaagtaggatttgcggagggcc

SEQ ID NO: 220483 - DNA, 25 bp, Artificial sequence
  SiRNA target sequence
ttaaagtaggatttgcggagggcct

SEQ ID NO: 220484 - DNA, 25 bp, Artificial sequence
  SiRNA target sequence
taaagtaggatttgcggagggcctt

SEQ ID NO: 220485 - DNA, 25 bp, Artificial sequence
  SiRNA target sequence
aaagtaggatttgcggagggcctta

SEQ ID NO: 220486 - DNA, 25 bp, Artificial sequence
  SiRNA target sequence
aagtaggatttgcggagggccttaa

SEQ ID NO: 220487 - DNA, 25 bp, Artificial sequence
  SiRNA target sequence
agtaggatttgcggagggccttaaa

SEQ ID NO: 220488 - DNA, 25 bp, Artificial sequence
  SiRNA target sequence
gtaggatttgcggagggccttaaag

SEQ ID NO: 220489 - DNA, 25 bp, Artificial sequence
  SiRNA target sequence
taggatttgcggagggccttaaaga

SEQ ID NO: 220490 - DNA, 25 bp, Artificial sequence
  SiRNA target sequence
aggatttgcggagggccttaaagaa

SEQ ID NO: 220491 - DNA, 25 bp, Artificial sequence
  SiRNA target sequence
ggatttgcggagggccttaaagaaa

SEQ ID NO: 220492 - DNA, 25 bp, Artificial sequence
  SiRNA target sequence
gatttgcggagggccttaaagaaat

SEQ ID NO: 220493 - DNA, 25 bp, Artificial sequence
  SiRNA target sequence
atttgcggagggccttaaagaaatg

SEQ ID NO: 220494 - DNA, 25 bp, Artificial sequence
  SiRNA target sequence
tttgcggagggccttaaagaaatga

SEQ ID NO: 220495 - DNA, 25 bp, Artificial sequence
  SiRNA target sequence
ttgcggagggccttaaagaaatgat

SEQ ID NO: 220496 - DNA, 25 bp, Artificial sequence
  SiRNA target sequence
tgcggagggccttaaagaaatgatg

SEQ ID NO: 220497 - DNA, 25 bp, Artificial sequence
  SiRNA target sequence
gcggagggccttaaagaaatgatgg

SEQ ID NO: 220498 - DNA, 25 bp, Artificial sequence
  SiRNA target sequence
cggagggccttaaagaaatgatggc

SEQ ID NO: 220499 - DNA, 25 bp, Artificial sequence
  SiRNA target sequence
ggagggccttaaagaaatgatggca

SEQ ID NO: 220500 - DNA, 25 bp, Artificial sequence
  SiRNA target sequence
gagggccttaaagaaatgatggcat

SEQ ID NO: 220501 - DNA, 25 bp, Artificial sequence
  SiRNA target sequence
agggccttaaagaaatgatggcatc

SEQ ID NO: 220502 - DNA, 25 bp, Artificial sequence
  SiRNA target sequence
gggccttaaagaaatgatggcatca

SEQ ID NO: 220503 - DNA, 25 bp, Artificial sequence
  SiRNA target sequence
ggccttaaagaaatgatggcatcaa

SEQ ID NO: 220504 - DNA, 25 bp, Artificial sequence
  SiRNA target sequence
gccttaaagaaatgatggcatcaaa

SEQ ID NO: 220505 - DNA, 25 bp, Artificial sequence
  SiRNA target sequence
ccttaaagaaatgatggcatcaaag

SEQ ID NO: 220506 - DNA, 25 bp, Artificial sequence
  SiRNA target sequence
cttaaagaaatgatggcatcaaagt

SEQ ID NO: 220507 - DNA, 25 bp, Artificial sequence
  SiRNA target sequence
ttaaagaaatgatggcatcaaagtt

SEQ ID NO: 220508 - DNA, 25 bp, Artificial sequence
  SiRNA target sequence
taaagaaatgatggcatcaaagtta

SEQ ID NO: 220509 - DNA, 25 bp, Artificial sequence
  SiRNA target sequence
aaagaaatgatggcatcaaagttat

SEQ ID NO: 220510 - DNA, 25 bp, Artificial sequence
  SiRNA target sequence
aagaaatgatggcatcaaagttatt

SEQ ID NO: 220511 - DNA, 25 bp, Artificial sequence
  SiRNA target sequence
agaaatgatggcatcaaagttatta

SEQ ID NO: 220512 - DNA, 25 bp, Artificial sequence
  SiRNA target sequence
gaaatgatggcatcaaagttattac

SEQ ID NO: 220513 - DNA, 25 bp, Artificial sequence
  SiRNA target sequence
aaatgatggcatcaaagttattact

SEQ ID NO: 220514 - DNA, 25 bp, Artificial sequence
  SiRNA target sequence
aatgatggcatcaaagttattactt

SEQ ID NO: 220515 - DNA, 25 bp, Artificial sequence
  SiRNA target sequence
atgatggcatcaaagttattactta

SEQ ID NO: 220516 - DNA, 25 bp, Artificial sequence
  SiRNA target sequence
tgatggcatcaaagttattacttaa

SEQ ID NO: 220517 - DNA, 25 bp, Artificial sequence
  SiRNA target sequence
gatggcatcaaagttattacttaac

SEQ ID NO: 220518 - DNA, 25 bp, Artificial sequence
  SiRNA target sequence
atggcatcaaagttattacttaaca

SEQ ID NO: 220519 - DNA, 25 bp, Artificial sequence
  SiRNA target sequence
tggcatcaaagttattacttaacat

SEQ ID NO: 220520 - DNA, 25 bp, Artificial sequence
  SiRNA target sequence
ggcatcaaagttattacttaacatt

SEQ ID NO: 220521 - DNA, 25 bp, Artificial sequence
  SiRNA target sequence
gcatcaaagttattacttaacattt

SEQ ID NO: 220522 - DNA, 25 bp, Artificial sequence
  SiRNA target sequence
catcaaagttattacttaacatttc

SEQ ID NO: 220523 - DNA, 25 bp, Artificial sequence
  SiRNA target sequence
atcaaagttattacttaacatttca

SEQ ID NO: 220524 - DNA, 25 bp, Artificial sequence
  SiRNA target sequence
tcaaagttattacttaacatttcat

SEQ ID NO: 220525 - DNA, 25 bp, Artificial sequence
  SiRNA target sequence
caaagttattacttaacatttcatt

SEQ ID NO: 220526 - DNA, 25 bp, Artificial sequence
  SiRNA target sequence
aaagttattacttaacatttcatta

SEQ ID NO: 220527 - DNA, 25 bp, Artificial sequence
  SiRNA target sequence
aagttattacttaacatttcattaa

SEQ ID NO: 220528 - DNA, 25 bp, Artificial sequence
  SiRNA target sequence
agttattacttaacatttcattaac

SEQ ID NO: 220529 - DNA, 25 bp, Artificial sequence
  SiRNA target sequence
gttattacttaacatttcattaact

SEQ ID NO: 220530 - DNA, 25 bp, Artificial sequence
  SiRNA target sequence
ttattacttaacatttcattaactg

SEQ ID NO: 220531 - DNA, 25 bp, Artificial sequence
  SiRNA target sequence
tattacttaacatttcattaactgt

SEQ ID NO: 220532 - DNA, 25 bp, Artificial sequence
  SiRNA target sequence
attacttaacatttcattaactgtt

SEQ ID NO: 220533 - DNA, 25 bp, Artificial sequence
  SiRNA target sequence
ttacttaacatttcattaactgtta

SEQ ID NO: 220534 - DNA, 25 bp, Artificial sequence
  SiRNA target sequence
tacttaacatttcattaactgttat

SEQ ID NO: 220535 - DNA, 25 bp, Artificial sequence
  SiRNA target sequence
acttaacatttcattaactgttatg

SEQ ID NO: 220536 - DNA, 25 bp, Artificial sequence
  SiRNA target sequence
cttaacatttcattaactgttatgt

SEQ ID NO: 220537 - DNA, 25 bp, Artificial sequence
  SiRNA target sequence
ttaacatttcattaactgttatgtt

SEQ ID NO: 220538 - DNA, 25 bp, Artificial sequence
  SiRNA target sequence
taacatttcattaactgttatgttc

SEQ ID NO: 220539 - DNA, 25 bp, Artificial sequence
  SiRNA target sequence
aacatttcattaactgttatgttct

SEQ ID NO: 220540 - DNA, 25 bp, Artificial sequence
  SiRNA target sequence
acatttcattaactgttatgttcta

SEQ ID NO: 220541 - DNA, 25 bp, Artificial sequence
  SiRNA target sequence
catttcattaactgttatgttctat

SEQ ID NO: 220542 - DNA, 25 bp, Artificial sequence
  SiRNA target sequence
atttcattaactgttatgttctatg

SEQ ID NO: 220543 - DNA, 25 bp, Artificial sequence
  SiRNA target sequence
tttcattaactgttatgttctatgg

SEQ ID NO: 220544 - DNA, 25 bp, Artificial sequence
  SiRNA target sequence
ttcattaactgttatgttctatggt

SEQ ID NO: 220545 - DNA, 25 bp, Artificial sequence
  SiRNA target sequence
tcattaactgttatgttctatggta

SEQ ID NO: 220546 - DNA, 25 bp, Artificial sequence
  SiRNA target sequence
cattaactgttatgttctatggtat

SEQ ID NO: 220547 - DNA, 25 bp, Artificial sequence
  SiRNA target sequence
attaactgttatgttctatggtata

SEQ ID NO: 220548 - DNA, 25 bp, Artificial sequence
  SiRNA target sequence
ttaactgttatgttctatggtatat

SEQ ID NO: 220549 - DNA, 25 bp, Artificial sequence
  SiRNA target sequence
taactgttatgttctatggtatatc

SEQ ID NO: 220550 - DNA, 25 bp, Artificial sequence
  SiRNA target sequence
aactgttatgttctatggtatatca

SEQ ID NO: 220551 - DNA, 25 bp, Artificial sequence
  SiRNA target sequence
actgttatgttctatggtatatcaa

SEQ ID NO: 220552 - DNA, 25 bp, Artificial sequence
  SiRNA target sequence
ctgttatgttctatggtatatcaac

SEQ ID NO: 220553 - DNA, 25 bp, Artificial sequence
  SiRNA target sequence
tgttatgttctatggtatatcaact

SEQ ID NO: 220554 - DNA, 25 bp, Artificial sequence
  SiRNA target sequence
gttatgttctatggtatatcaacta

SEQ ID NO: 220555 - DNA, 25 bp, Artificial sequence
  SiRNA target sequence
ttatgttctatggtatatcaactaa

SEQ ID NO: 220556 - DNA, 25 bp, Artificial sequence
  SiRNA target sequence
tatgttctatggtatatcaactaat

SEQ ID NO: 220557 - DNA, 25 bp, Artificial sequence
  SiRNA target sequence
atgttctatggtatatcaactaatt

SEQ ID NO: 220558 - DNA, 25 bp, Artificial sequence
  SiRNA target sequence
tgttctatggtatatcaactaattt

SEQ ID NO: 220559 - DNA, 25 bp, Artificial sequence
  SiRNA target sequence
gttctatggtatatcaactaattta

SEQ ID NO: 220560 - DNA, 25 bp, Artificial sequence
  SiRNA target sequence
ttctatggtatatcaactaatttaa

SEQ ID NO: 220561 - DNA, 25 bp, Artificial sequence
  SiRNA target sequence
tctatggtatatcaactaatttaat

SEQ ID NO: 220562 - DNA, 25 bp, Artificial sequence
  SiRNA target sequence
ctatggtatatcaactaatttaata

SEQ ID NO: 220563 - DNA, 25 bp, Artificial sequence
  SiRNA target sequence
tatggtatatcaactaatttaatag

SEQ ID NO: 220564 - DNA, 25 bp, Artificial sequence
  SiRNA target sequence
atggtatatcaactaatttaataga

SEQ ID NO: 220565 - DNA, 25 bp, Artificial sequence
  SiRNA target sequence
tggtatatcaactaatttaatagaa

SEQ ID NO: 220566 - DNA, 25 bp, Artificial sequence
  SiRNA target sequence
ggtatatcaactaatttaatagaat

SEQ ID NO: 220567 - DNA, 25 bp, Artificial sequence
  SiRNA target sequence
gtatatcaactaatttaatagaatc

SEQ ID NO: 220568 - DNA, 25 bp, Artificial sequence
  SiRNA target sequence
tatatcaactaatttaatagaatca

SEQ ID NO: 220569 - DNA, 25 bp, Artificial sequence
  SiRNA target sequence
atatcaactaatttaatagaatcaa

SEQ ID NO: 220570 - DNA, 25 bp, Artificial sequence
  SiRNA target sequence
tatcaactaatttaatagaatcaac

SEQ ID NO: 220571 - DNA, 25 bp, Artificial sequence
  SiRNA target sequence
atcaactaatttaatagaatcaaca

SEQ ID NO: 220572 - DNA, 25 bp, Artificial sequence
  SiRNA target sequence
tcaactaatttaatagaatcaacat

SEQ ID NO: 220573 - DNA, 25 bp, Artificial sequence
  SiRNA target sequence
caactaatttaatagaatcaacatt

SEQ ID NO: 220574 - DNA, 25 bp, Artificial sequence
  SiRNA target sequence
aactaatttaatagaatcaacattt

SEQ ID NO: 220575 - DNA, 25 bp, Artificial sequence
  SiRNA target sequence
actaatttaatagaatcaacattta

SEQ ID NO: 220576 - DNA, 25 bp, Artificial sequence
  SiRNA target sequence
ctaatttaatagaatcaacatttaa

SEQ ID NO: 220577 - DNA, 25 bp, Artificial sequence
  SiRNA target sequence
taatttaatagaatcaacatttaaa

SEQ ID NO: 220578 - DNA, 25 bp, Artificial sequence
  SiRNA target sequence
aatttaatagaatcaacatttaaaa

SEQ ID NO: 220579 - DNA, 25 bp, Artificial sequence
  SiRNA target sequence
atttaatagaatcaacatttaaaag

SEQ ID NO: 220580 - DNA, 25 bp, Artificial sequence
  SiRNA target sequence
tttaatagaatcaacatttaaaagt

SEQ ID NO: 220581 - DNA, 25 bp, Artificial sequence
  SiRNA target sequence
ttaatagaatcaacatttaaaagtg

SEQ ID NO: 220582 - DNA, 25 bp, Artificial sequence
  SiRNA target sequence
taatagaatcaacatttaaaagtgg

SEQ ID NO: 220583 - DNA, 25 bp, Artificial sequence
  SiRNA target sequence
aatagaatcaacatttaaaagtgga

SEQ ID NO: 220584 - DNA, 25 bp, Artificial sequence
  SiRNA target sequence
atagaatcaacatttaaaagtggac

SEQ ID NO: 220585 - DNA, 25 bp, Artificial sequence
  SiRNA target sequence
tagaatcaacatttaaaagtggact

SEQ ID NO: 220586 - DNA, 25 bp, Artificial sequence
  SiRNA target sequence
agaatcaacatttaaaagtggactt

SEQ ID NO: 220587 - DNA, 25 bp, Artificial sequence
  SiRNA target sequence
gaatcaacatttaaaagtggacttg

SEQ ID NO: 220588 - DNA, 25 bp, Artificial sequence
  SiRNA target sequence
aatcaacatttaaaagtggacttgt

SEQ ID NO: 220589 - DNA, 25 bp, Artificial sequence
  SiRNA target sequence
atcaacatttaaaagtggacttgtg

SEQ ID NO: 220590 - DNA, 25 bp, Artificial sequence
  SiRNA target sequence
tcaacatttaaaagtggacttgtga

SEQ ID NO: 220591 - DNA, 25 bp, Artificial sequence
  SiRNA target sequence
caacatttaaaagtggacttgtgaa

SEQ ID NO: 220592 - DNA, 25 bp, Artificial sequence
  SiRNA target sequence
aacatttaaaagtggacttgtgaaa

SEQ ID NO: 220593 - DNA, 25 bp, Artificial sequence
  SiRNA target sequence
acatttaaaagtggacttgtgaaag

SEQ ID NO: 220594 - DNA, 25 bp, Artificial sequence
  SiRNA target sequence
catttaaaagtggacttgtgaaagg

SEQ ID NO: 220595 - DNA, 25 bp, Artificial sequence
  SiRNA target sequence
atttaaaagtggacttgtgaaaggt

SEQ ID NO: 220596 - DNA, 25 bp, Artificial sequence
  SiRNA target sequence
tttaaaagtggacttgtgaaaggtg

SEQ ID NO: 220597 - DNA, 25 bp, Artificial sequence
  SiRNA target sequence
ttaaaagtggacttgtgaaaggtgc

SEQ ID NO: 220598 - DNA, 25 bp, Artificial sequence
  SiRNA target sequence
taaaagtggacttgtgaaaggtgca

SEQ ID NO: 220599 - DNA, 25 bp, Artificial sequence
  SiRNA target sequence
aaaagtggacttgtgaaaggtgcag

SEQ ID NO: 220600 - DNA, 25 bp, Artificial sequence
  SiRNA target sequence
aaagtggacttgtgaaaggtgcaga

SEQ ID NO: 220601 - DNA, 25 bp, Artificial sequence
  SiRNA target sequence
aagtggacttgtgaaaggtgcagaa

SEQ ID NO: 220602 - DNA, 25 bp, Artificial sequence
  SiRNA target sequence
agtggacttgtgaaaggtgcagaag

SEQ ID NO: 220603 - DNA, 25 bp, Artificial sequence
  SiRNA target sequence
gtggacttgtgaaaggtgcagaaga

SEQ ID NO: 220604 - DNA, 25 bp, Artificial sequence
  SiRNA target sequence
tggacttgtgaaaggtgcagaagaa

SEQ ID NO: 220605 - DNA, 25 bp, Artificial sequence
  SiRNA target sequence
ggacttgtgaaaggtgcagaagaat

SEQ ID NO: 220606 - DNA, 25 bp, Artificial sequence
  SiRNA target sequence
gacttgtgaaaggtgcagaagaatt

SEQ ID NO: 220607 - DNA, 25 bp, Artificial sequence
  SiRNA target sequence
acttgtgaaaggtgcagaagaatta

SEQ ID NO: 220608 - DNA, 25 bp, Artificial sequence
  SiRNA target sequence
cttgtgaaaggtgcagaagaattaa

SEQ ID NO: 220609 - DNA, 25 bp, Artificial sequence
  SiRNA target sequence
ttgtgaaaggtgcagaagaattaaa

SEQ ID NO: 220610 - DNA, 25 bp, Artificial sequence
  SiRNA target sequence
tgtgaaaggtgcagaagaattaaac

SEQ ID NO: 220611 - DNA, 25 bp, Artificial sequence
  SiRNA target sequence
gtgaaaggtgcagaagaattaaacg

SEQ ID NO: 220612 - DNA, 25 bp, Artificial sequence
  SiRNA target sequence
tgaaaggtgcagaagaattaaacga

SEQ ID NO: 220613 - DNA, 25 bp, Artificial sequence
  SiRNA target sequence
gaaaggtgcagaagaattaaacgag

SEQ ID NO: 220614 - DNA, 25 bp, Artificial sequence
  SiRNA target sequence
aaaggtgcagaagaattaaacgaga

SEQ ID NO: 220615 - DNA, 25 bp, Artificial sequence
  SiRNA target sequence
aaggtgcagaagaattaaacgagaa

SEQ ID NO: 220616 - DNA, 25 bp, Artificial sequence
  SiRNA target sequence
aggtgcagaagaattaaacgagaat

SEQ ID NO: 220617 - DNA, 25 bp, Artificial sequence
  SiRNA target sequence
ggtgcagaagaattaaacgagaata

SEQ ID NO: 220618 - DNA, 25 bp, Artificial sequence
  SiRNA target sequence
gtgcagaagaattaaacgagaatac

SEQ ID NO: 220619 - DNA, 25 bp, Artificial sequence
  SiRNA target sequence
tgcagaagaattaaacgagaatact

SEQ ID NO: 220620 - DNA, 25 bp, Artificial sequence
  SiRNA target sequence
gcagaagaattaaacgagaatacta

SEQ ID NO: 220621 - DNA, 25 bp, Artificial sequence
  SiRNA target sequence
cagaagaattaaacgagaatactaa

SEQ ID NO: 220622 - DNA, 25 bp, Artificial sequence
  SiRNA target sequence
agaagaattaaacgagaatactaaa

SEQ ID NO: 220623 - DNA, 25 bp, Artificial sequence
  SiRNA target sequence
gaagaattaaacgagaatactaaaa

SEQ ID NO: 220624 - DNA, 25 bp, Artificial sequence
  SiRNA target sequence
aagaattaaacgagaatactaaaag

SEQ ID NO: 220625 - DNA, 25 bp, Artificial sequence
  SiRNA target sequence
agaattaaacgagaatactaaaagt

SEQ ID NO: 220626 - DNA, 25 bp, Artificial sequence
  SiRNA target sequence
gaattaaacgagaatactaaaagtt

SEQ ID NO: 220627 - DNA, 25 bp, Artificial sequence
  SiRNA target sequence
aattaaacgagaatactaaaagtta

SEQ ID NO: 220628 - DNA, 25 bp, Artificial sequence
  SiRNA target sequence
attaaacgagaatactaaaagttat

SEQ ID NO: 220629 - DNA, 25 bp, Artificial sequence
  SiRNA target sequence
ttaaacgagaatactaaaagttatt

SEQ ID NO: 220630 - DNA, 25 bp, Artificial sequence
  SiRNA target sequence
taaacgagaatactaaaagttattc

SEQ ID NO: 220631 - DNA, 25 bp, Artificial sequence
  SiRNA target sequence
aaacgagaatactaaaagttattct

SEQ ID NO: 220632 - DNA, 25 bp, Artificial sequence
  SiRNA target sequence
aacgagaatactaaaagttattcta

SEQ ID NO: 220633 - DNA, 25 bp, Artificial sequence
  SiRNA target sequence
acgagaatactaaaagttattctat

SEQ ID NO: 220634 - DNA, 25 bp, Artificial sequence
  SiRNA target sequence
cgagaatactaaaagttattctatg

SEQ ID NO: 220635 - DNA, 25 bp, Artificial sequence
  SiRNA target sequence
gagaatactaaaagttattctatgg

SEQ ID NO: 220636 - DNA, 25 bp, Artificial sequence
  SiRNA target sequence
agaatactaaaagttattctatggg

SEQ ID NO: 220637 - DNA, 25 bp, Artificial sequence
  SiRNA target sequence
gaatactaaaagttattctatggga

SEQ ID NO: 220638 - DNA, 25 bp, Artificial sequence
  SiRNA target sequence
aatactaaaagttattctatgggat

SEQ ID NO: 220639 - DNA, 25 bp, Artificial sequence
  SiRNA target sequence
atactaaaagttattctatgggata

SEQ ID NO: 220640 - DNA, 25 bp, Artificial sequence
  SiRNA target sequence
tactaaaagttattctatgggatat

SEQ ID NO: 220641 - DNA, 25 bp, Artificial sequence
  SiRNA target sequence
actaaaagttattctatgggatata

SEQ ID NO: 220642 - DNA, 25 bp, Artificial sequence
  SiRNA target sequence
ctaaaagttattctatgggatataa

SEQ ID NO: 220643 - DNA, 25 bp, Artificial sequence
  SiRNA target sequence
taaaagttattctatgggatataat

SEQ ID NO: 220644 - DNA, 25 bp, Artificial sequence
  SiRNA target sequence
aaaagttattctatgggatataatt

SEQ ID NO: 220645 - DNA, 25 bp, Artificial sequence
  SiRNA target sequence
aaagttattctatgggatataattc

SEQ ID NO: 220646 - DNA, 25 bp, Artificial sequence
  SiRNA target sequence
aagttattctatgggatataattca

SEQ ID NO: 220647 - DNA, 25 bp, Artificial sequence
  SiRNA target sequence
agttattctatgggatataattcat

SEQ ID NO: 220648 - DNA, 25 bp, Artificial sequence
  SiRNA target sequence
gttattctatgggatataattcatt

SEQ ID NO: 220649 - DNA, 25 bp, Artificial sequence
  SiRNA target sequence
ttattctatgggatataattcattt

SEQ ID NO: 220650 - DNA, 25 bp, Artificial sequence
  SiRNA target sequence
tattctatgggatataattcatttg

SEQ ID NO: 220651 - DNA, 25 bp, Artificial sequence
  SiRNA target sequence
attctatgggatataattcatttga

SEQ ID NO: 220652 - DNA, 25 bp, Artificial sequence
  SiRNA target sequence
ttctatgggatataattcatttgaa

SEQ ID NO: 220653 - DNA, 25 bp, Artificial sequence
  SiRNA target sequence
tctatgggatataattcatttgaac

SEQ ID NO: 220654 - DNA, 25 bp, Artificial sequence
  SiRNA target sequence
ctatgggatataattcatttgaaca

SEQ ID NO: 220655 - DNA, 25 bp, Artificial sequence
  SiRNA target sequence
tatgggatataattcatttgaacaa

SEQ ID NO: 220656 - DNA, 25 bp, Artificial sequence
  SiRNA target sequence
atgggatataattcatttgaacaaa

SEQ ID NO: 220657 - DNA, 25 bp, Artificial sequence
  SiRNA target sequence
tgggatataattcatttgaacaaaa

SEQ ID NO: 220658 - DNA, 25 bp, Artificial sequence
  SiRNA target sequence
gggatataattcatttgaacaaaag

SEQ ID NO: 220659 - DNA, 25 bp, Artificial sequence
  SiRNA target sequence
ggatataattcatttgaacaaaaga

SEQ ID NO: 220660 - DNA, 25 bp, Artificial sequence
  SiRNA target sequence
gatataattcatttgaacaaaagat

SEQ ID NO: 220661 - DNA, 25 bp, Artificial sequence
  SiRNA target sequence
atataattcatttgaacaaaagata

SEQ ID NO: 220662 - DNA, 25 bp, Artificial sequence
  SiRNA target sequence
tataattcatttgaacaaaagatag

SEQ ID NO: 220663 - DNA, 25 bp, Artificial sequence
  SiRNA target sequence
ataattcatttgaacaaaagatagc

SEQ ID NO: 220664 - DNA, 25 bp, Artificial sequence
  SiRNA target sequence
taattcatttgaacaaaagatagca

SEQ ID NO: 220665 - DNA, 25 bp, Artificial sequence
  SiRNA target sequence
aattcatttgaacaaaagatagcat

SEQ ID NO: 220666 - DNA, 25 bp, Artificial sequence
  SiRNA target sequence
attcatttgaacaaaagatagcatc

SEQ ID NO: 220667 - DNA, 25 bp, Artificial sequence
  SiRNA target sequence
ttcatttgaacaaaagatagcatca

SEQ ID NO: 220668 - DNA, 25 bp, Artificial sequence
  SiRNA target sequence
tcatttgaacaaaagatagcatcaa

SEQ ID NO: 220669 - DNA, 25 bp, Artificial sequence
  SiRNA target sequence
catttgaacaaaagatagcatcaat

SEQ ID NO: 220670 - DNA, 25 bp, Artificial sequence
  SiRNA target sequence
atttgaacaaaagatagcatcaata

SEQ ID NO: 220671 - DNA, 25 bp, Artificial sequence
  SiRNA target sequence
tttgaacaaaagatagcatcaataa

SEQ ID NO: 220672 - DNA, 25 bp, Artificial sequence
  SiRNA target sequence
ttgaacaaaagatagcatcaataac

SEQ ID NO: 220673 - DNA, 25 bp, Artificial sequence
  SiRNA target sequence
tgaacaaaagatagcatcaataact

SEQ ID NO: 220674 - DNA, 25 bp, Artificial sequence
  SiRNA target sequence
gaacaaaagatagcatcaataactg

SEQ ID NO: 220675 - DNA, 25 bp, Artificial sequence
  SiRNA target sequence
aacaaaagatagcatcaataactgt

SEQ ID NO: 220676 - DNA, 25 bp, Artificial sequence
  SiRNA target sequence
acaaaagatagcatcaataactgtt

SEQ ID NO: 220677 - DNA, 25 bp, Artificial sequence
  SiRNA target sequence
caaaagatagcatcaataactgtta

SEQ ID NO: 220678 - DNA, 25 bp, Artificial sequence
  SiRNA target sequence
aaaagatagcatcaataactgttat

SEQ ID NO: 220679 - DNA, 25 bp, Artificial sequence
  SiRNA target sequence
aaagatagcatcaataactgttatt

SEQ ID NO: 220680 - DNA, 25 bp, Artificial sequence
  SiRNA target sequence
aagatagcatcaataactgttatta

SEQ ID NO: 220681 - DNA, 25 bp, Artificial sequence
  SiRNA target sequence
agatagcatcaataactgttattat

SEQ ID NO: 220682 - DNA, 25 bp, Artificial sequence
  SiRNA target sequence
gatagcatcaataactgttattatc

SEQ ID NO: 220683 - DNA, 25 bp, Artificial sequence
  SiRNA target sequence
atagcatcaataactgttattatcc

SEQ ID NO: 220684 - DNA, 25 bp, Artificial sequence
  SiRNA target sequence
tagcatcaataactgttattatcct

SEQ ID NO: 220685 - DNA, 25 bp, Artificial sequence
  SiRNA target sequence
agcatcaataactgttattatcctg

SEQ ID NO: 220686 - DNA, 25 bp, Artificial sequence
  SiRNA target sequence
gcatcaataactgttattatcctgc

SEQ ID NO: 220687 - DNA, 25 bp, Artificial sequence
  SiRNA target sequence
catcaataactgttattatcctgct

SEQ ID NO: 220688 - DNA, 25 bp, Artificial sequence
  SiRNA target sequence
atcaataactgttattatcctgctt

SEQ ID NO: 220689 - DNA, 25 bp, Artificial sequence
  SiRNA target sequence
tcaataactgttattatcctgcttt

SEQ ID NO: 220690 - DNA, 25 bp, Artificial sequence
  SiRNA target sequence
caataactgttattatcctgctttt

SEQ ID NO: 220691 - DNA, 25 bp, Artificial sequence
  SiRNA target sequence
aataactgttattatcctgctttta

SEQ ID NO: 220692 - DNA, 25 bp, Artificial sequence
  SiRNA target sequence
ataactgttattatcctgcttttat

SEQ ID NO: 220693 - DNA, 25 bp, Artificial sequence
  SiRNA target sequence
taactgttattatcctgcttttatc

SEQ ID NO: 220694 - DNA, 25 bp, Artificial sequence
  SiRNA target sequence
aactgttattatcctgcttttatca

SEQ ID NO: 220695 - DNA, 25 bp, Artificial sequence
  SiRNA target sequence
actgttattatcctgcttttatcac

SEQ ID NO: 220696 - DNA, 25 bp, Artificial sequence
  SiRNA target sequence
ctgttattatcctgcttttatcacc

SEQ ID NO: 220697 - DNA, 25 bp, Artificial sequence
  SiRNA target sequence
tgttattatcctgcttttatcacca

SEQ ID NO: 220698 - DNA, 25 bp, Artificial sequence
  SiRNA target sequence
gttattatcctgcttttatcaccat

SEQ ID NO: 220699 - DNA, 25 bp, Artificial sequence
  SiRNA target sequence
ttattatcctgcttttatcaccatt

SEQ ID NO: 220700 - DNA, 25 bp, Artificial sequence
  SiRNA target sequence
tattatcctgcttttatcaccattt

SEQ ID NO: 220701 - DNA, 25 bp, Artificial sequence
  SiRNA target sequence
attatcctgcttttatcaccatttc

SEQ ID NO: 220702 - DNA, 25 bp, Artificial sequence
  SiRNA target sequence
ttatcctgcttttatcaccatttcc

SEQ ID NO: 220703 - DNA, 25 bp, Artificial sequence
  SiRNA target sequence
tatcctgcttttatcaccatttcca

SEQ ID NO: 220704 - DNA, 25 bp, Artificial sequence
  SiRNA target sequence
atcctgcttttatcaccatttccaa

SEQ ID NO: 220705 - DNA, 25 bp, Artificial sequence
  SiRNA target sequence
tcctgcttttatcaccatttccaaa

SEQ ID NO: 220706 - DNA, 25 bp, Artificial sequence
  SiRNA target sequence
cctgcttttatcaccatttccaaaa

SEQ ID NO: 220707 - DNA, 25 bp, Artificial sequence
  SiRNA target sequence
ctgcttttatcaccatttccaaaat

SEQ ID NO: 220708 - DNA, 25 bp, Artificial sequence
  SiRNA target sequence
tgcttttatcaccatttccaaaatt

SEQ ID NO: 220709 - DNA, 25 bp, Artificial sequence
  SiRNA target sequence
gcttttatcaccatttccaaaatta

SEQ ID NO: 220710 - DNA, 25 bp, Artificial sequence
  SiRNA target sequence
cttttatcaccatttccaaaattaa

SEQ ID NO: 220711 - DNA, 25 bp, Artificial sequence
  SiRNA target sequence
ttttatcaccatttccaaaattaat

SEQ ID NO: 220712 - DNA, 25 bp, Artificial sequence
  SiRNA target sequence
tttatcaccatttccaaaattaata

SEQ ID NO: 220713 - DNA, 25 bp, Artificial sequence
  SiRNA target sequence
ttatcaccatttccaaaattaatac

SEQ ID NO: 220714 - DNA, 25 bp, Artificial sequence
  SiRNA target sequence
tatcaccatttccaaaattaataca

SEQ ID NO: 220715 - DNA, 25 bp, Artificial sequence
  SiRNA target sequence
atcaccatttccaaaattaatacaa

SEQ ID NO: 220716 - DNA, 25 bp, Artificial sequence
  SiRNA target sequence
tcaccatttccaaaattaatacaaa

SEQ ID NO: 220717 - DNA, 25 bp, Artificial sequence
  SiRNA target sequence
caccatttccaaaattaatacaaac

SEQ ID NO: 220718 - DNA, 25 bp, Artificial sequence
  SiRNA target sequence
accatttccaaaattaatacaaacc

SEQ ID NO: 220719 - DNA, 25 bp, Artificial sequence
  SiRNA target sequence
ccatttccaaaattaatacaaacca

SEQ ID NO: 220720 - DNA, 25 bp, Artificial sequence
  SiRNA target sequence
catttccaaaattaatacaaaccaa

SEQ ID NO: 220721 - DNA, 25 bp, Artificial sequence
  SiRNA target sequence
atttccaaaattaatacaaaccaaa

SEQ ID NO: 220722 - DNA, 25 bp, Artificial sequence
  SiRNA target sequence
tttccaaaattaatacaaaccaaag

SEQ ID NO: 220723 - DNA, 25 bp, Artificial sequence
  SiRNA target sequence
ttccaaaattaatacaaaccaaagg

SEQ ID NO: 220724 - DNA, 25 bp, Artificial sequence
  SiRNA target sequence
tccaaaattaatacaaaccaaagga

SEQ ID NO: 220725 - DNA, 25 bp, Artificial sequence
  SiRNA target sequence
ccaaaattaatacaaaccaaaggat

SEQ ID NO: 220726 - DNA, 25 bp, Artificial sequence
  SiRNA target sequence
caaaattaatacaaaccaaaggatg

SEQ ID NO: 220727 - DNA, 25 bp, Artificial sequence
  SiRNA target sequence
aaaattaatacaaaccaaaggatgg

SEQ ID NO: 220728 - DNA, 25 bp, Artificial sequence
  SiRNA target sequence
aaattaatacaaaccaaaggatgga

SEQ ID NO: 220729 - DNA, 25 bp, Artificial sequence
  SiRNA target sequence
aattaatacaaaccaaaggatggat

SEQ ID NO: 220730 - DNA, 25 bp, Artificial sequence
  SiRNA target sequence
attaatacaaaccaaaggatggata

SEQ ID NO: 220731 - DNA, 25 bp, Artificial sequence
  SiRNA target sequence
ttaatacaaaccaaaggatggatat

SEQ ID NO: 220732 - DNA, 25 bp, Artificial sequence
  SiRNA target sequence
taatacaaaccaaaggatggatatt

SEQ ID NO: 220733 - DNA, 25 bp, Artificial sequence
  SiRNA target sequence
aatacaaaccaaaggatggatattt

SEQ ID NO: 220734 - DNA, 25 bp, Artificial sequence
  SiRNA target sequence
atacaaaccaaaggatggatatttg

SEQ ID NO: 220735 - DNA, 25 bp, Artificial sequence
  SiRNA target sequence
tacaaaccaaaggatggatatttgt

SEQ ID NO: 220736 - DNA, 25 bp, Artificial sequence
  SiRNA target sequence
acaaaccaaaggatggatatttgtt

SEQ ID NO: 220737 - DNA, 25 bp, Artificial sequence
  SiRNA target sequence
caaaccaaaggatggatatttgttg

SEQ ID NO: 220738 - DNA, 25 bp, Artificial sequence
  SiRNA target sequence
aaaccaaaggatggatatttgttgc

SEQ ID NO: 220739 - DNA, 25 bp, Artificial sequence
  SiRNA target sequence
aaccaaaggatggatatttgttgcc

SEQ ID NO: 220740 - DNA, 25 bp, Artificial sequence
  SiRNA target sequence
accaaaggatggatatttgttgcca

SEQ ID NO: 220741 - DNA, 25 bp, Artificial sequence
  SiRNA target sequence
ccaaaggatggatatttgttgccat

SEQ ID NO: 220742 - DNA, 25 bp, Artificial sequence
  SiRNA target sequence
caaaggatggatatttgttgccata

SEQ ID NO: 220743 - DNA, 25 bp, Artificial sequence
  SiRNA target sequence
aaaggatggatatttgttgccatag

SEQ ID NO: 220744 - DNA, 25 bp, Artificial sequence
  SiRNA target sequence
aaggatggatatttgttgccatagc

SEQ ID NO: 220745 - DNA, 25 bp, Artificial sequence
  SiRNA target sequence
aggatggatatttgttgccatagcg

SEQ ID NO: 220746 - DNA, 25 bp, Artificial sequence
  SiRNA target sequence
ggatggatatttgttgccatagcgt

SEQ ID NO: 220747 - DNA, 25 bp, Artificial sequence
  SiRNA target sequence
gatggatatttgttgccatagcgtg

SEQ ID NO: 220748 - DNA, 25 bp, Artificial sequence
  SiRNA target sequence
atggatatttgttgccatagcgtgc

SEQ ID NO: 220749 - DNA, 25 bp, Artificial sequence
  SiRNA target sequence
tggatatttgttgccatagcgtgcc

SEQ ID NO: 220750 - DNA, 25 bp, Artificial sequence
  SiRNA target sequence
ggatatttgttgccatagcgtgccc

SEQ ID NO: 220751 - DNA, 25 bp, Artificial sequence
  SiRNA target sequence
gatatttgttgccatagcgtgccca

SEQ ID NO: 220752 - DNA, 25 bp, Artificial sequence
  SiRNA target sequence
atatttgttgccatagcgtgcccac

SEQ ID NO: 220753 - DNA, 25 bp, Artificial sequence
  SiRNA target sequence
tatttgttgccatagcgtgcccact

SEQ ID NO: 220754 - DNA, 25 bp, Artificial sequence
  SiRNA target sequence
atttgttgccatagcgtgcccactt

SEQ ID NO: 220755 - DNA, 25 bp, Artificial sequence
  SiRNA target sequence
tttgttgccatagcgtgcccactta

SEQ ID NO: 220756 - DNA, 25 bp, Artificial sequence
  SiRNA target sequence
ttgttgccatagcgtgcccacttat

SEQ ID NO: 220757 - DNA, 25 bp, Artificial sequence
  SiRNA target sequence
tgttgccatagcgtgcccacttatt

SEQ ID NO: 220758 - DNA, 25 bp, Artificial sequence
  SiRNA target sequence
gttgccatagcgtgcccacttatta

SEQ ID NO: 220759 - DNA, 25 bp, Artificial sequence
  SiRNA target sequence
ttgccatagcgtgcccacttattac

SEQ ID NO: 220760 - DNA, 25 bp, Artificial sequence
  SiRNA target sequence
tgccatagcgtgcccacttattacc

SEQ ID NO: 220761 - DNA, 25 bp, Artificial sequence
  SiRNA target sequence
gccatagcgtgcccacttattaccc

SEQ ID NO: 220762 - DNA, 25 bp, Artificial sequence
  SiRNA target sequence
ccatagcgtgcccacttattaccct

SEQ ID NO: 220763 - DNA, 25 bp, Artificial sequence
  SiRNA target sequence
catagcgtgcccacttattaccctt

SEQ ID NO: 220764 - DNA, 25 bp, Artificial sequence
  SiRNA target sequence
atagcgtgcccacttattacccttt

SEQ ID NO: 220765 - DNA, 25 bp, Artificial sequence
  SiRNA target sequence
tagcgtgcccacttattaccctttt

SEQ ID NO: 220766 - DNA, 25 bp, Artificial sequence
  SiRNA target sequence
agcgtgcccacttattacccttttt

SEQ ID NO: 220767 - DNA, 25 bp, Artificial sequence
  SiRNA target sequence
gcgtgcccacttattaccctttttg

SEQ ID NO: 220768 - DNA, 25 bp, Artificial sequence
  SiRNA target sequence
cgtgcccacttattaccctttttgc

SEQ ID NO: 220769 - DNA, 25 bp, Artificial sequence
  SiRNA target sequence
gtgcccacttattaccctttttgct

SEQ ID NO: 220770 - DNA, 25 bp, Artificial sequence
  SiRNA target sequence
tgcccacttattaccctttttgctg

SEQ ID NO: 220771 - DNA, 25 bp, Artificial sequence
  SiRNA target sequence
gcccacttattaccctttttgctgt

SEQ ID NO: 220772 - DNA, 25 bp, Artificial sequence
  SiRNA target sequence
cccacttattaccctttttgctgta

SEQ ID NO: 220773 - DNA, 25 bp, Artificial sequence
  SiRNA target sequence
ccacttattaccctttttgctgtag

SEQ ID NO: 220774 - DNA, 25 bp, Artificial sequence
  SiRNA target sequence
cacttattaccctttttgctgtagt

SEQ ID NO: 220775 - DNA, 25 bp, Artificial sequence
  SiRNA target sequence
acttattaccctttttgctgtagtt

SEQ ID NO: 220776 - DNA, 25 bp, Artificial sequence
  SiRNA target sequence
cttattaccctttttgctgtagttt

SEQ ID NO: 220777 - DNA, 25 bp, Artificial sequence
  SiRNA target sequence
ttattaccctttttgctgtagtttc

SEQ ID NO: 220778 - DNA, 25 bp, Artificial sequence
  SiRNA target sequence
tattaccctttttgctgtagtttct

SEQ ID NO: 220779 - DNA, 25 bp, Artificial sequence
  SiRNA target sequence
attaccctttttgctgtagtttctg

SEQ ID NO: 220780 - DNA, 25 bp, Artificial sequence
  SiRNA target sequence
ttaccctttttgctgtagtttctgt

SEQ ID NO: 220781 - DNA, 25 bp, Artificial sequence
  SiRNA target sequence
taccctttttgctgtagtttctgtg

SEQ ID NO: 220782 - DNA, 25 bp, Artificial sequence
  SiRNA target sequence
accctttttgctgtagtttctgtgt

SEQ ID NO: 220783 - DNA, 25 bp, Artificial sequence
  SiRNA target sequence
ccctttttgctgtagtttctgtgtg

SEQ ID NO: 220784 - DNA, 25 bp, Artificial sequence
  SiRNA target sequence
cctttttgctgtagtttctgtgtgt

SEQ ID NO: 220785 - DNA, 25 bp, Artificial sequence
  SiRNA target sequence
ctttttgctgtagtttctgtgtgtg

SEQ ID NO: 220786 - DNA, 25 bp, Artificial sequence
  SiRNA target sequence
tttttgctgtagtttctgtgtgtgg

SEQ ID NO: 220787 - DNA, 25 bp, Artificial sequence
  SiRNA target sequence
ttttgctgtagtttctgtgtgtggt

SEQ ID NO: 220788 - DNA, 25 bp, Artificial sequence
  SiRNA target sequence
tttgctgtagtttctgtgtgtggtc

SEQ ID NO: 220789 - DNA, 25 bp, Artificial sequence
  SiRNA target sequence
ttgctgtagtttctgtgtgtggtct

SEQ ID NO: 220790 - DNA, 25 bp, Artificial sequence
  SiRNA target sequence
tgctgtagtttctgtgtgtggtctt

SEQ ID NO: 220791 - DNA, 25 bp, Artificial sequence
  SiRNA target sequence
gctgtagtttctgtgtgtggtcttg

SEQ ID NO: 220792 - DNA, 25 bp, Artificial sequence
  SiRNA target sequence
ctgtagtttctgtgtgtggtcttgc

SEQ ID NO: 220793 - DNA, 25 bp, Artificial sequence
  SiRNA target sequence
tgtagtttctgtgtgtggtcttgct

SEQ ID NO: 220794 - DNA, 25 bp, Artificial sequence
  SiRNA target sequence
gtagtttctgtgtgtggtcttgctt

SEQ ID NO: 220795 - DNA, 25 bp, Artificial sequence
  SiRNA target sequence
tagtttctgtgtgtggtcttgcttt

SEQ ID NO: 220796 - DNA, 25 bp, Artificial sequence
  SiRNA target sequence
agtttctgtgtgtggtcttgctttt

SEQ ID NO: 220797 - DNA, 25 bp, Artificial sequence
  SiRNA target sequence
gtttctgtgtgtggtcttgcttttt

SEQ ID NO: 220798 - DNA, 25 bp, Artificial sequence
  SiRNA target sequence
tttctgtgtgtggtcttgcttttta

SEQ ID NO: 220799 - DNA, 25 bp, Artificial sequence
  SiRNA target sequence
ttctgtgtgtggtcttgctttttac

SEQ ID NO: 220800 - DNA, 25 bp, Artificial sequence
  SiRNA target sequence
tctgtgtgtggtcttgctttttaca

SEQ ID NO: 220801 - DNA, 25 bp, Artificial sequence
  SiRNA target sequence
ctgtgtgtggtcttgctttttacaa

SEQ ID NO: 220802 - DNA, 25 bp, Artificial sequence
  SiRNA target sequence
tgtgtgtggtcttgctttttacaat

SEQ ID NO: 220803 - DNA, 25 bp, Artificial sequence
  SiRNA target sequence
gtgtgtggtcttgctttttacaatt

SEQ ID NO: 220804 - DNA, 25 bp, Artificial sequence
  SiRNA target sequence
tgtgtggtcttgctttttacaatta

SEQ ID NO: 220805 - DNA, 25 bp, Artificial sequence
  SiRNA target sequence
gtgtggtcttgctttttacaattat

SEQ ID NO: 220806 - DNA, 25 bp, Artificial sequence
  SiRNA target sequence
tgtggtcttgctttttacaattatc

SEQ ID NO: 220807 - DNA, 25 bp, Artificial sequence
  SiRNA target sequence
gtggtcttgctttttacaattatcc

SEQ ID NO: 220808 - DNA, 25 bp, Artificial sequence
  SiRNA target sequence
tggtcttgctttttacaattatccg

SEQ ID NO: 220809 - DNA, 25 bp, Artificial sequence
  SiRNA target sequence
ggtcttgctttttacaattatccgg

SEQ ID NO: 220810 - DNA, 25 bp, Artificial sequence
  SiRNA target sequence
gtcttgctttttacaattatccggc

SEQ ID NO: 220811 - DNA, 25 bp, Artificial sequence
  SiRNA target sequence
tcttgctttttacaattatccggca

SEQ ID NO: 220812 - DNA, 25 bp, Artificial sequence
  SiRNA target sequence
cttgctttttacaattatccggcaa

SEQ ID NO: 220813 - DNA, 25 bp, Artificial sequence
  SiRNA target sequence
ttgctttttacaattatccggcaac

SEQ ID NO: 220814 - DNA, 25 bp, Artificial sequence
  SiRNA target sequence
tgctttttacaattatccggcaaca

SEQ ID NO: 220815 - DNA, 25 bp, Artificial sequence
  SiRNA target sequence
gctttttacaattatccggcaacaa

SEQ ID NO: 220816 - DNA, 25 bp, Artificial sequence
  SiRNA target sequence
ctttttacaattatccggcaacaaa

SEQ ID NO: 220817 - DNA, 25 bp, Artificial sequence
  SiRNA target sequence
tttttacaattatccggcaacaaat

SEQ ID NO: 220818 - DNA, 25 bp, Artificial sequence
  SiRNA target sequence
ttttacaattatccggcaacaaata

SEQ ID NO: 220819 - DNA, 25 bp, Artificial sequence
  SiRNA target sequence
tttacaattatccggcaacaaataa

SEQ ID NO: 220820 - DNA, 25 bp, Artificial sequence
  SiRNA target sequence
ttacaattatccggcaacaaataat

SEQ ID NO: 220821 - DNA, 25 bp, Artificial sequence
  SiRNA target sequence
tacaattatccggcaacaaataatg

SEQ ID NO: 220822 - DNA, 25 bp, Artificial sequence
  SiRNA target sequence
acaattatccggcaacaaataatga

SEQ ID NO: 220823 - DNA, 25 bp, Artificial sequence
  SiRNA target sequence
caattatccggcaacaaataatgac

SEQ ID NO: 220824 - DNA, 25 bp, Artificial sequence
  SiRNA target sequence
aattatccggcaacaaataatgaca

SEQ ID NO: 220825 - DNA, 25 bp, Artificial sequence
  SiRNA target sequence
attatccggcaacaaataatgacac

SEQ ID NO: 220826 - DNA, 25 bp, Artificial sequence
  SiRNA target sequence
ttatccggcaacaaataatgacaca

SEQ ID NO: 220827 - DNA, 25 bp, Artificial sequence
  SiRNA target sequence
tatccggcaacaaataatgacacaa

SEQ ID NO: 220828 - DNA, 25 bp, Artificial sequence
  SiRNA target sequence
atccggcaacaaataatgacacaaa

SEQ ID NO: 220829 - DNA, 25 bp, Artificial sequence
  SiRNA target sequence
tccggcaacaaataatgacacaaat

SEQ ID NO: 220830 - DNA, 25 bp, Artificial sequence
  SiRNA target sequence
ccggcaacaaataatgacacaaatt

SEQ ID NO: 220831 - DNA, 25 bp, Artificial sequence
  SiRNA target sequence
cggcaacaaataatgacacaaattt

SEQ ID NO: 220832 - DNA, 25 bp, Artificial sequence
  SiRNA target sequence
ggcaacaaataatgacacaaatttt

SEQ ID NO: 220833 - DNA, 25 bp, Artificial sequence
  SiRNA target sequence
gcaacaaataatgacacaaattttt

SEQ ID NO: 220834 - DNA, 25 bp, Artificial sequence
  SiRNA target sequence
caacaaataatgacacaaatttttt

SEQ ID NO: 220835 - DNA, 25 bp, Artificial sequence
  SiRNA target sequence
aacaaataatgacacaaattttttt

SEQ ID NO: 220836 - DNA, 25 bp, Artificial sequence
  SiRNA target sequence
acaaataatgacacaaatttttttc

SEQ ID NO: 220837 - DNA, 25 bp, Artificial sequence
  SiRNA target sequence
caaataatgacacaaatttttttct

SEQ ID NO: 220838 - DNA, 25 bp, Artificial sequence
  SiRNA target sequence
aaataatgacacaaatttttttcta

SEQ ID NO: 220839 - DNA, 25 bp, Artificial sequence
  SiRNA target sequence
aataatgacacaaatttttttctaa

SEQ ID NO: 220840 - DNA, 25 bp, Artificial sequence
  SiRNA target sequence
ataatgacacaaatttttttctaaa

SEQ ID NO: 220841 - DNA, 25 bp, Artificial sequence
  SiRNA target sequence
taatgacacaaatttttttctaaat

SEQ ID NO: 220842 - DNA, 25 bp, Artificial sequence
  SiRNA target sequence
aatgacacaaatttttttctaaatt

SEQ ID NO: 220843 - DNA, 25 bp, Artificial sequence
  SiRNA target sequence
atgacacaaatttttttctaaattc

SEQ ID NO: 220844 - DNA, 25 bp, Artificial sequence
  SiRNA target sequence
tgacacaaatttttttctaaattca

SEQ ID NO: 220845 - DNA, 25 bp, Artificial sequence
  SiRNA target sequence
gacacaaatttttttctaaattcat

SEQ ID NO: 220846 - DNA, 25 bp, Artificial sequence
  SiRNA target sequence
acacaaatttttttctaaattcatt

SEQ ID NO: 220847 - DNA, 25 bp, Artificial sequence
  SiRNA target sequence
cacaaatttttttctaaattcatta

SEQ ID NO: 220848 - DNA, 25 bp, Artificial sequence
  SiRNA target sequence
acaaatttttttctaaattcattat

SEQ ID NO: 220849 - DNA, 25 bp, Artificial sequence
  SiRNA target sequence
caaatttttttctaaattcattatg

SEQ ID NO: 220850 - DNA, 25 bp, Artificial sequence
  SiRNA target sequence
aaatttttttctaaattcattatgt

SEQ ID NO: 220851 - DNA, 25 bp, Artificial sequence
  SiRNA target sequence
aatttttttctaaattcattatgtg

SEQ ID NO: 220852 - DNA, 25 bp, Artificial sequence
  SiRNA target sequence
atttttttctaaattcattatgtgc

SEQ ID NO: 220853 - DNA, 25 bp, Artificial sequence
  SiRNA target sequence
tttttttctaaattcattatgtgct

SEQ ID NO: 220854 - DNA, 25 bp, Artificial sequence
  SiRNA target sequence
ttttttctaaattcattatgtgcta

SEQ ID NO: 220855 - DNA, 25 bp, Artificial sequence
  SiRNA target sequence
tttttctaaattcattatgtgctac

SEQ ID NO: 220856 - DNA, 25 bp, Artificial sequence
  SiRNA target sequence
ttttctaaattcattatgtgctacg

SEQ ID NO: 220857 - DNA, 25 bp, Artificial sequence
  SiRNA target sequence
tttctaaattcattatgtgctacgc

SEQ ID NO: 220858 - DNA, 25 bp, Artificial sequence
  SiRNA target sequence
ttctaaattcattatgtgctacgcc

SEQ ID NO: 220859 - DNA, 25 bp, Artificial sequence
  SiRNA target sequence
tctaaattcattatgtgctacgccc

SEQ ID NO: 220860 - DNA, 25 bp, Artificial sequence
  SiRNA target sequence
ctaaattcattatgtgctacgcccg

SEQ ID NO: 220861 - DNA, 25 bp, Artificial sequence
  SiRNA target sequence
taaattcattatgtgctacgcccgg

SEQ ID NO: 220862 - DNA, 25 bp, Artificial sequence
  SiRNA target sequence
aaattcattatgtgctacgcccggt

SEQ ID NO: 220863 - DNA, 25 bp, Artificial sequence
  SiRNA target sequence
aattcattatgtgctacgcccggta

SEQ ID NO: 220864 - DNA, 25 bp, Artificial sequence
  SiRNA target sequence
attcattatgtgctacgcccggtaa

SEQ ID NO: 220865 - DNA, 25 bp, Artificial sequence
  SiRNA target sequence
ttcattatgtgctacgcccggtaaa

SEQ ID NO: 220866 - DNA, 25 bp, Artificial sequence
  SiRNA target sequence
tcattatgtgctacgcccggtaaat

SEQ ID NO: 220867 - DNA, 25 bp, Artificial sequence
  SiRNA target sequence
cattatgtgctacgcccggtaaatc

SEQ ID NO: 220868 - DNA, 25 bp, Artificial sequence
  SiRNA target sequence
attatgtgctacgcccggtaaatcg

SEQ ID NO: 220869 - DNA, 25 bp, Artificial sequence
  SiRNA target sequence
ttatgtgctacgcccggtaaatcgt

SEQ ID NO: 220870 - DNA, 25 bp, Artificial sequence
  SiRNA target sequence
tatgtgctacgcccggtaaatcgtt

SEQ ID NO: 220871 - DNA, 25 bp, Artificial sequence
  SiRNA target sequence
atgtgctacgcccggtaaatcgttt

SEQ ID NO: 220872 - DNA, 25 bp, Artificial sequence
  SiRNA target sequence
tgtgctacgcccggtaaatcgttta

SEQ ID NO: 220873 - DNA, 25 bp, Artificial sequence
  SiRNA target sequence
gtgctacgcccggtaaatcgtttat

SEQ ID NO: 220874 - DNA, 25 bp, Artificial sequence
  SiRNA target sequence
tgctacgcccggtaaatcgtttata

SEQ ID NO: 220875 - DNA, 25 bp, Artificial sequence
  SiRNA target sequence
gctacgcccggtaaatcgtttataa

SEQ ID NO: 220876 - DNA, 25 bp, Artificial sequence
  SiRNA target sequence
ctacgcccggtaaatcgtttataaa

SEQ ID NO: 220877 - DNA, 25 bp, Artificial sequence
  SiRNA target sequence
tacgcccggtaaatcgtttataaaa

SEQ ID NO: 220878 - DNA, 25 bp, Artificial sequence
  SiRNA target sequence
acgcccggtaaatcgtttataaaat

SEQ ID NO: 220879 - DNA, 25 bp, Artificial sequence
  SiRNA target sequence
cgcccggtaaatcgtttataaaatt

SEQ ID NO: 220880 - DNA, 25 bp, Artificial sequence
  SiRNA target sequence
gcccggtaaatcgtttataaaatta

SEQ ID NO: 220881 - DNA, 25 bp, Artificial sequence
  SiRNA target sequence
cccggtaaatcgtttataaaattag

SEQ ID NO: 220882 - DNA, 25 bp, Artificial sequence
  SiRNA target sequence
ccggtaaatcgtttataaaattaga

SEQ ID NO: 220883 - DNA, 25 bp, Artificial sequence
  SiRNA target sequence
cggtaaatcgtttataaaattagaa

SEQ ID NO: 220884 - DNA, 25 bp, Artificial sequence
  SiRNA target sequence
ggtaaatcgtttataaaattagaaa

SEQ ID NO: 220885 - DNA, 25 bp, Artificial sequence
  SiRNA target sequence
gtaaatcgtttataaaattagaaaa

SEQ ID NO: 220886 - DNA, 25 bp, Artificial sequence
  SiRNA target sequence
taaatcgtttataaaattagaaaat

SEQ ID NO: 220887 - DNA, 25 bp, Artificial sequence
  SiRNA target sequence
aaatcgtttataaaattagaaaatg

SEQ ID NO: 220888 - DNA, 25 bp, Artificial sequence
  SiRNA target sequence
aatcgtttataaaattagaaaatgt

SEQ ID NO: 220889 - DNA, 25 bp, Artificial sequence
  SiRNA target sequence
atcgtttataaaattagaaaatgtt

SEQ ID NO: 220890 - DNA, 25 bp, Artificial sequence
  SiRNA target sequence
tcgtttataaaattagaaaatgttt

SEQ ID NO: 220891 - DNA, 25 bp, Artificial sequence
  SiRNA target sequence
cgtttataaaattagaaaatgtttt

SEQ ID NO: 220892 - DNA, 25 bp, Artificial sequence
  SiRNA target sequence
gtttataaaattagaaaatgtttta

SEQ ID NO: 220893 - DNA, 25 bp, Artificial sequence
  SiRNA target sequence
tttataaaattagaaaatgttttag

SEQ ID NO: 220894 - DNA, 25 bp, Artificial sequence
  SiRNA target sequence
ttataaaattagaaaatgttttagg

SEQ ID NO: 220895 - DNA, 25 bp, Artificial sequence
  SiRNA target sequence
tataaaattagaaaatgttttagga

SEQ ID NO: 220896 - DNA, 25 bp, Artificial sequence
  SiRNA target sequence
ataaaattagaaaatgttttaggat

SEQ ID NO: 220897 - DNA, 25 bp, Artificial sequence
  SiRNA target sequence
taaaattagaaaatgttttaggatg

SEQ ID NO: 220898 - DNA, 25 bp, Artificial sequence
  SiRNA target sequence
aaaattagaaaatgttttaggatgt

SEQ ID NO: 220899 - DNA, 25 bp, Artificial sequence
  SiRNA target sequence
aaattagaaaatgttttaggatgtg

SEQ ID NO: 220900 - DNA, 25 bp, Artificial sequence
  SiRNA target sequence
aattagaaaatgttttaggatgtgt

SEQ ID NO: 220901 - DNA, 25 bp, Artificial sequence
  SiRNA target sequence
attagaaaatgttttaggatgtgta

SEQ ID NO: 220902 - DNA, 25 bp, Artificial sequence
  SiRNA target sequence
ttagaaaatgttttaggatgtgtag

SEQ ID NO: 220903 - DNA, 25 bp, Artificial sequence
  SiRNA target sequence
tagaaaatgttttaggatgtgtagc

SEQ ID NO: 220904 - DNA, 25 bp, Artificial sequence
  SiRNA target sequence
agaaaatgttttaggatgtgtagct

SEQ ID NO: 220905 - DNA, 25 bp, Artificial sequence
  SiRNA target sequence
gaaaatgttttaggatgtgtagctg

SEQ ID NO: 220906 - DNA, 25 bp, Artificial sequence
  SiRNA target sequence
aaaatgttttaggatgtgtagctgt

SEQ ID NO: 220907 - DNA, 25 bp, Artificial sequence
  SiRNA target sequence
aaatgttttaggatgtgtagctgta

SEQ ID NO: 220908 - DNA, 25 bp, Artificial sequence
  SiRNA target sequence
aatgttttaggatgtgtagctgtag

SEQ ID NO: 220909 - DNA, 25 bp, Artificial sequence
  SiRNA target sequence
atgttttaggatgtgtagctgtagc

SEQ ID NO: 220910 - DNA, 25 bp, Artificial sequence
  SiRNA target sequence
tgttttaggatgtgtagctgtagct

SEQ ID NO: 220911 - DNA, 25 bp, Artificial sequence
  SiRNA target sequence
gttttaggatgtgtagctgtagctc

SEQ ID NO: 220912 - DNA, 25 bp, Artificial sequence
  SiRNA target sequence
ttttaggatgtgtagctgtagctct

SEQ ID NO: 220913 - DNA, 25 bp, Artificial sequence
  SiRNA target sequence
tttaggatgtgtagctgtagctctt

SEQ ID NO: 220914 - DNA, 25 bp, Artificial sequence
  SiRNA target sequence
ttaggatgtgtagctgtagctctta

SEQ ID NO: 220915 - DNA, 25 bp, Artificial sequence
  SiRNA target sequence
taggatgtgtagctgtagctcttat

SEQ ID NO: 220916 - DNA, 25 bp, Artificial sequence
  SiRNA target sequence
aggatgtgtagctgtagctcttatg

SEQ ID NO: 220917 - DNA, 25 bp, Artificial sequence
  SiRNA target sequence
ggatgtgtagctgtagctcttatga

SEQ ID NO: 220918 - DNA, 25 bp, Artificial sequence
  SiRNA target sequence
gatgtgtagctgtagctcttatgaa

SEQ ID NO: 220919 - DNA, 25 bp, Artificial sequence
  SiRNA target sequence
atgtgtagctgtagctcttatgaaa

SEQ ID NO: 220920 - DNA, 25 bp, Artificial sequence
  SiRNA target sequence
tgtgtagctgtagctcttatgaaag

SEQ ID NO: 220921 - DNA, 25 bp, Artificial sequence
  SiRNA target sequence
gtgtagctgtagctcttatgaaagt

SEQ ID NO: 220922 - DNA, 25 bp, Artificial sequence
  SiRNA target sequence
tgtagctgtagctcttatgaaagta

SEQ ID NO: 220923 - DNA, 25 bp, Artificial sequence
  SiRNA target sequence
gtagctgtagctcttatgaaagtag

SEQ ID NO: 220924 - DNA, 25 bp, Artificial sequence
  SiRNA target sequence
tagctgtagctcttatgaaagtagc

SEQ ID NO: 220925 - DNA, 25 bp, Artificial sequence
  SiRNA target sequence
agctgtagctcttatgaaagtagca

SEQ ID NO: 220926 - DNA, 25 bp, Artificial sequence
  SiRNA target sequence
gctgtagctcttatgaaagtagcaa

SEQ ID NO: 220927 - DNA, 25 bp, Artificial sequence
  SiRNA target sequence
ctgtagctcttatgaaagtagcaaa

SEQ ID NO: 220928 - DNA, 25 bp, Artificial sequence
  SiRNA target sequence
tgtagctcttatgaaagtagcaaaa

SEQ ID NO: 220929 - DNA, 25 bp, Artificial sequence
  SiRNA target sequence
gtagctcttatgaaagtagcaaaat

SEQ ID NO: 220930 - DNA, 25 bp, Artificial sequence
  SiRNA target sequence
tagctcttatgaaagtagcaaaata

SEQ ID NO: 220931 - DNA, 25 bp, Artificial sequence
  SiRNA target sequence
agctcttatgaaagtagcaaaatat

SEQ ID NO: 220932 - DNA, 25 bp, Artificial sequence
  SiRNA target sequence
gctcttatgaaagtagcaaaatatg

SEQ ID NO: 220933 - DNA, 25 bp, Artificial sequence
  SiRNA target sequence
ctcttatgaaagtagcaaaatatgg

SEQ ID NO: 220934 - DNA, 25 bp, Artificial sequence
  SiRNA target sequence
tcttatgaaagtagcaaaatatggc

SEQ ID NO: 220935 - DNA, 25 bp, Artificial sequence
  SiRNA target sequence
cttatgaaagtagcaaaatatggct

SEQ ID NO: 220936 - DNA, 25 bp, Artificial sequence
  SiRNA target sequence
ttatgaaagtagcaaaatatggctc

SEQ ID NO: 220937 - DNA, 25 bp, Artificial sequence
  SiRNA target sequence
tatgaaagtagcaaaatatggctct

SEQ ID NO: 220938 - DNA, 25 bp, Artificial sequence
  SiRNA target sequence
atgaaagtagcaaaatatggctctt

SEQ ID NO: 220939 - DNA, 25 bp, Artificial sequence
  SiRNA target sequence
tgaaagtagcaaaatatggctcttt

SEQ ID NO: 220940 - DNA, 25 bp, Artificial sequence
  SiRNA target sequence
gaaagtagcaaaatatggctctttt

SEQ ID NO: 220941 - DNA, 25 bp, Artificial sequence
  SiRNA target sequence
aaagtagcaaaatatggctcttttg

SEQ ID NO: 220942 - DNA, 25 bp, Artificial sequence
  SiRNA target sequence
aagtagcaaaatatggctcttttga

SEQ ID NO: 220943 - DNA, 25 bp, Artificial sequence
  SiRNA target sequence
agtagcaaaatatggctcttttgat

SEQ ID NO: 220944 - DNA, 25 bp, Artificial sequence
  SiRNA target sequence
gtagcaaaatatggctcttttgata

SEQ ID NO: 220945 - DNA, 25 bp, Artificial sequence
  SiRNA target sequence
tagcaaaatatggctcttttgatat

SEQ ID NO: 220946 - DNA, 25 bp, Artificial sequence
  SiRNA target sequence
agcaaaatatggctcttttgatatt

SEQ ID NO: 220947 - DNA, 25 bp, Artificial sequence
  SiRNA target sequence
gcaaaatatggctcttttgatattt

SEQ ID NO: 220948 - DNA, 25 bp, Artificial sequence
  SiRNA target sequence
caaaatatggctcttttgatatttc

SEQ ID NO: 220949 - DNA, 25 bp, Artificial sequence
  SiRNA target sequence
aaaatatggctcttttgatatttcc

SEQ ID NO: 220950 - DNA, 25 bp, Artificial sequence
  SiRNA target sequence
aaatatggctcttttgatatttcca

SEQ ID NO: 220951 - DNA, 25 bp, Artificial sequence
  SiRNA target sequence
aatatggctcttttgatatttccaa

SEQ ID NO: 220952 - DNA, 25 bp, Artificial sequence
  SiRNA target sequence
atatggctcttttgatatttccaaa

SEQ ID NO: 220953 - DNA, 25 bp, Artificial sequence
  SiRNA target sequence
tatggctcttttgatatttccaaag

SEQ ID NO: 220954 - DNA, 25 bp, Artificial sequence
  SiRNA target sequence
atggctcttttgatatttccaaaga

SEQ ID NO: 220955 - DNA, 25 bp, Artificial sequence
  SiRNA target sequence
tggctcttttgatatttccaaagaa

SEQ ID NO: 220956 - DNA, 25 bp, Artificial sequence
  SiRNA target sequence
ggctcttttgatatttccaaagaag

SEQ ID NO: 220957 - DNA, 25 bp, Artificial sequence
  SiRNA target sequence
gctcttttgatatttccaaagaagc

SEQ ID NO: 220958 - DNA, 25 bp, Artificial sequence
  SiRNA target sequence
ctcttttgatatttccaaagaagcc

SEQ ID NO: 220959 - DNA, 25 bp, Artificial sequence
  SiRNA target sequence
tcttttgatatttccaaagaagcca

SEQ ID NO: 220960 - DNA, 25 bp, Artificial sequence
  SiRNA target sequence
cttttgatatttccaaagaagccat

SEQ ID NO: 220961 - DNA, 25 bp, Artificial sequence
  SiRNA target sequence
ttttgatatttccaaagaagccatt

SEQ ID NO: 220962 - DNA, 25 bp, Artificial sequence
  SiRNA target sequence
tttgatatttccaaagaagccattt

SEQ ID NO: 220963 - DNA, 25 bp, Artificial sequence
  SiRNA target sequence
ttgatatttccaaagaagccatttc

SEQ ID NO: 220964 - DNA, 25 bp, Artificial sequence
  SiRNA target sequence
tgatatttccaaagaagccatttca

SEQ ID NO: 220965 - DNA, 25 bp, Artificial sequence
  SiRNA target sequence
gatatttccaaagaagccatttcaa

SEQ ID NO: 220966 - DNA, 25 bp, Artificial sequence
  SiRNA target sequence
atatttccaaagaagccatttcaat

SEQ ID NO: 220967 - DNA, 25 bp, Artificial sequence
  SiRNA target sequence
tatttccaaagaagccatttcaatg

SEQ ID NO: 220968 - DNA, 25 bp, Artificial sequence
  SiRNA target sequence
atttccaaagaagccatttcaatgc

SEQ ID NO: 220969 - DNA, 25 bp, Artificial sequence
  SiRNA target sequence
tttccaaagaagccatttcaatgca

SEQ ID NO: 220970 - DNA, 25 bp, Artificial sequence
  SiRNA target sequence
ttccaaagaagccatttcaatgcag

SEQ ID NO: 220971 - DNA, 25 bp, Artificial sequence
  SiRNA target sequence
tccaaagaagccatttcaatgcaga

SEQ ID NO: 220972 - DNA, 25 bp, Artificial sequence
  SiRNA target sequence
ccaaagaagccatttcaatgcagat

SEQ ID NO: 220973 - DNA, 25 bp, Artificial sequence
  SiRNA target sequence
caaagaagccatttcaatgcagatt

SEQ ID NO: 220974 - DNA, 25 bp, Artificial sequence
  SiRNA target sequence
aaagaagccatttcaatgcagattg

SEQ ID NO: 220975 - DNA, 25 bp, Artificial sequence
  SiRNA target sequence
aagaagccatttcaatgcagattga

SEQ ID NO: 220976 - DNA, 25 bp, Artificial sequence
  SiRNA target sequence
agaagccatttcaatgcagattgat

SEQ ID NO: 220977 - DNA, 25 bp, Artificial sequence
  SiRNA target sequence
gaagccatttcaatgcagattgatt

SEQ ID NO: 220978 - DNA, 25 bp, Artificial sequence
  SiRNA target sequence
aagccatttcaatgcagattgattc

SEQ ID NO: 220979 - DNA, 25 bp, Artificial sequence
  SiRNA target sequence
agccatttcaatgcagattgattcg

SEQ ID NO: 220980 - DNA, 25 bp, Artificial sequence
  SiRNA target sequence
gccatttcaatgcagattgattcgt

SEQ ID NO: 220981 - DNA, 25 bp, Artificial sequence
  SiRNA target sequence
ccatttcaatgcagattgattcgtc

SEQ ID NO: 220982 - DNA, 25 bp, Artificial sequence
  SiRNA target sequence
catttcaatgcagattgattcgtca

SEQ ID NO: 220983 - DNA, 25 bp, Artificial sequence
  SiRNA target sequence
atttcaatgcagattgattcgtcat

SEQ ID NO: 220984 - DNA, 25 bp, Artificial sequence
  SiRNA target sequence
tttcaatgcagattgattcgtcatt

SEQ ID NO: 220985 - DNA, 25 bp, Artificial sequence
  SiRNA target sequence
ttcaatgcagattgattcgtcattg

SEQ ID NO: 220986 - DNA, 25 bp, Artificial sequence
  SiRNA target sequence
tcaatgcagattgattcgtcattgc

SEQ ID NO: 220987 - DNA, 25 bp, Artificial sequence
  SiRNA target sequence
caatgcagattgattcgtcattgcg

SEQ ID NO: 220988 - DNA, 25 bp, Artificial sequence
  SiRNA target sequence
aatgcagattgattcgtcattgcgt

SEQ ID NO: 220989 - DNA, 25 bp, Artificial sequence
  SiRNA target sequence
atgcagattgattcgtcattgcgtg

SEQ ID NO: 220990 - DNA, 25 bp, Artificial sequence
  SiRNA target sequence
tgcagattgattcgtcattgcgtgc

SEQ ID NO: 220991 - DNA, 25 bp, Artificial sequence
  SiRNA target sequence
gcagattgattcgtcattgcgtgca

SEQ ID NO: 220992 - DNA, 25 bp, Artificial sequence
  SiRNA target sequence
cagattgattcgtcattgcgtgcac

SEQ ID NO: 220993 - DNA, 25 bp, Artificial sequence
  SiRNA target sequence
agattgattcgtcattgcgtgcacg

SEQ ID NO: 220994 - DNA, 25 bp, Artificial sequence
  SiRNA target sequence
gattgattcgtcattgcgtgcacgt

SEQ ID NO: 220995 - DNA, 25 bp, Artificial sequence
  SiRNA target sequence
attgattcgtcattgcgtgcacgtt

SEQ ID NO: 220996 - DNA, 25 bp, Artificial sequence
  SiRNA target sequence
ttgattcgtcattgcgtgcacgtta

SEQ ID NO: 220997 - DNA, 25 bp, Artificial sequence
  SiRNA target sequence
tgattcgtcattgcgtgcacgttat

SEQ ID NO: 220998 - DNA, 25 bp, Artificial sequence
  SiRNA target sequence
gattcgtcattgcgtgcacgttata

SEQ ID NO: 220999 - DNA, 25 bp, Artificial sequence
  SiRNA target sequence
attcgtcattgcgtgcacgttataa

SEQ ID NO: 221000 - DNA, 25 bp, Artificial sequence
  SiRNA target sequence
ttcgtcattgcgtgcacgttataaa

SEQ ID NO: 221001 - DNA, 25 bp, Artificial sequence
  SiRNA target sequence
tcgtcattgcgtgcacgttataaag

SEQ ID NO: 221002 - DNA, 25 bp, Artificial sequence
  SiRNA target sequence
cgtcattgcgtgcacgttataaagg

SEQ ID NO: 221003 - DNA, 25 bp, Artificial sequence
  SiRNA target sequence
gtcattgcgtgcacgttataaagga

SEQ ID NO: 221004 - DNA, 25 bp, Artificial sequence
  SiRNA target sequence
tcattgcgtgcacgttataaaggaa

SEQ ID NO: 221005 - DNA, 25 bp, Artificial sequence
  SiRNA target sequence
cattgcgtgcacgttataaaggaat

SEQ ID NO: 221006 - DNA, 25 bp, Artificial sequence
  SiRNA target sequence
attgcgtgcacgttataaaggaatt

SEQ ID NO: 221007 - DNA, 25 bp, Artificial sequence
  SiRNA target sequence
ttgcgtgcacgttataaaggaattt

SEQ ID NO: 221008 - DNA, 25 bp, Artificial sequence
  SiRNA target sequence
tgcgtgcacgttataaaggaatttt

SEQ ID NO: 221009 - DNA, 25 bp, Artificial sequence
  SiRNA target sequence
gcgtgcacgttataaaggaattttt

SEQ ID NO: 221010 - DNA, 25 bp, Artificial sequence
  SiRNA target sequence
cgtgcacgttataaaggaatttttg

SEQ ID NO: 221011 - DNA, 25 bp, Artificial sequence
  SiRNA target sequence
gtgcacgttataaaggaatttttga

SEQ ID NO: 221012 - DNA, 25 bp, Artificial sequence
  SiRNA target sequence
tgcacgttataaaggaatttttgac

SEQ ID NO: 221013 - DNA, 25 bp, Artificial sequence
  SiRNA target sequence
gcacgttataaaggaatttttgacg

SEQ ID NO: 221014 - DNA, 25 bp, Artificial sequence
  SiRNA target sequence
cacgttataaaggaatttttgacgg

SEQ ID NO: 221015 - DNA, 25 bp, Artificial sequence
  SiRNA target sequence
acgttataaaggaatttttgacggt

SEQ ID NO: 221016 - DNA, 25 bp, Artificial sequence
  SiRNA target sequence
cgttataaaggaatttttgacggtg

SEQ ID NO: 221017 - DNA, 25 bp, Artificial sequence
  SiRNA target sequence
gttataaaggaatttttgacggtgt

SEQ ID NO: 221018 - DNA, 25 bp, Artificial sequence
  SiRNA target sequence
ttataaaggaatttttgacggtgtt

SEQ ID NO: 221019 - DNA, 25 bp, Artificial sequence
  SiRNA target sequence
tataaaggaatttttgacggtgttt

SEQ ID NO: 221020 - DNA, 25 bp, Artificial sequence
  SiRNA target sequence
ataaaggaatttttgacggtgtttt

SEQ ID NO: 221021 - DNA, 25 bp, Artificial sequence
  SiRNA target sequence
taaaggaatttttgacggtgttttt

SEQ ID NO: 221022 - DNA, 25 bp, Artificial sequence
  SiRNA target sequence
aaaggaatttttgacggtgtttttg

SEQ ID NO: 221023 - DNA, 25 bp, Artificial sequence
  SiRNA target sequence
aaggaatttttgacggtgtttttgg

SEQ ID NO: 221024 - DNA, 25 bp, Artificial sequence
  SiRNA target sequence
aggaatttttgacggtgtttttggt

SEQ ID NO: 221025 - DNA, 25 bp, Artificial sequence
  SiRNA target sequence
ggaatttttgacggtgtttttggta

SEQ ID NO: 221026 - DNA, 25 bp, Artificial sequence
  SiRNA target sequence
gaatttttgacggtgtttttggtaa

SEQ ID NO: 221027 - DNA, 25 bp, Artificial sequence
  SiRNA target sequence
aatttttgacggtgtttttggtaag

SEQ ID NO: 221028 - DNA, 25 bp, Artificial sequence
  SiRNA target sequence
atttttgacggtgtttttggtaagt

SEQ ID NO: 221029 - DNA, 25 bp, Artificial sequence
  SiRNA target sequence
tttttgacggtgtttttggtaagtt

SEQ ID NO: 221030 - DNA, 25 bp, Artificial sequence
  SiRNA target sequence
ttttgacggtgtttttggtaagtta

SEQ ID NO: 221031 - DNA, 25 bp, Artificial sequence
  SiRNA target sequence
tttgacggtgtttttggtaagttag

SEQ ID NO: 221032 - DNA, 25 bp, Artificial sequence
  SiRNA target sequence
ttgacggtgtttttggtaagttagg

SEQ ID NO: 221033 - DNA, 25 bp, Artificial sequence
  SiRNA target sequence
tgacggtgtttttggtaagttagga

SEQ ID NO: 221034 - DNA, 25 bp, Artificial sequence
  SiRNA target sequence
gacggtgtttttggtaagttaggaa

SEQ ID NO: 221035 - DNA, 25 bp, Artificial sequence
  SiRNA target sequence
acggtgtttttggtaagttaggaaa

SEQ ID NO: 221036 - DNA, 25 bp, Artificial sequence
  SiRNA target sequence
cggtgtttttggtaagttaggaaaa

SEQ ID NO: 221037 - DNA, 25 bp, Artificial sequence
  SiRNA target sequence
ggtgtttttggtaagttaggaaaat

SEQ ID NO: 221038 - DNA, 25 bp, Artificial sequence
  SiRNA target sequence
gtgtttttggtaagttaggaaaatc

SEQ ID NO: 221039 - DNA, 25 bp, Artificial sequence
  SiRNA target sequence
tgtttttggtaagttaggaaaatct

SEQ ID NO: 221040 - DNA, 25 bp, Artificial sequence
  SiRNA target sequence
gtttttggtaagttaggaaaatctc

SEQ ID NO: 221041 - DNA, 25 bp, Artificial sequence
  SiRNA target sequence
tttttggtaagttaggaaaatctct

SEQ ID NO: 221042 - DNA, 25 bp, Artificial sequence
  SiRNA target sequence
ttttggtaagttaggaaaatctctt

SEQ ID NO: 221043 - DNA, 25 bp, Artificial sequence
  SiRNA target sequence
tttggtaagttaggaaaatctcttg

SEQ ID NO: 221044 - DNA, 25 bp, Artificial sequence
  SiRNA target sequence
ttggtaagttaggaaaatctcttgg

SEQ ID NO: 221045 - DNA, 25 bp, Artificial sequence
  SiRNA target sequence
tggtaagttaggaaaatctcttgga

SEQ ID NO: 221046 - DNA, 25 bp, Artificial sequence
  SiRNA target sequence
ggtaagttaggaaaatctcttggat

SEQ ID NO: 221047 - DNA, 25 bp, Artificial sequence
  SiRNA target sequence
gtaagttaggaaaatctcttggatc

SEQ ID NO: 221048 - DNA, 25 bp, Artificial sequence
  SiRNA target sequence
taagttaggaaaatctcttggatcg

SEQ ID NO: 221049 - DNA, 25 bp, Artificial sequence
  SiRNA target sequence
aagttaggaaaatctcttggatcgt

SEQ ID NO: 221050 - DNA, 25 bp, Artificial sequence
  SiRNA target sequence
agttaggaaaatctcttggatcgtt

SEQ ID NO: 221051 - DNA, 25 bp, Artificial sequence
  SiRNA target sequence
gttaggaaaatctcttggatcgtta

SEQ ID NO: 221052 - DNA, 25 bp, Artificial sequence
  SiRNA target sequence
ttaggaaaatctcttggatcgttat

SEQ ID NO: 221053 - DNA, 25 bp, Artificial sequence
  SiRNA target sequence
taggaaaatctcttggatcgttatt

SEQ ID NO: 221054 - DNA, 25 bp, Artificial sequence
  SiRNA target sequence
aggaaaatctcttggatcgttattt

SEQ ID NO: 221055 - DNA, 25 bp, Artificial sequence
  SiRNA target sequence
ggaaaatctcttggatcgttatttg

SEQ ID NO: 221056 - DNA, 25 bp, Artificial sequence
  SiRNA target sequence
gaaaatctcttggatcgttatttgt

SEQ ID NO: 221057 - DNA, 25 bp, Artificial sequence
  SiRNA target sequence
aaaatctcttggatcgttatttgtg

SEQ ID NO: 221058 - DNA, 25 bp, Artificial sequence
  SiRNA target sequence
aaatctcttggatcgttatttgtgt

SEQ ID NO: 221059 - DNA, 25 bp, Artificial sequence
  SiRNA target sequence
aatctcttggatcgttatttgtgtg

SEQ ID NO: 221060 - DNA, 25 bp, Artificial sequence
  SiRNA target sequence
atctcttggatcgttatttgtgtgg

SEQ ID NO: 221061 - DNA, 25 bp, Artificial sequence
  SiRNA target sequence
tctcttggatcgttatttgtgtgga

SEQ ID NO: 221062 - DNA, 25 bp, Artificial sequence
  SiRNA target sequence
ctcttggatcgttatttgtgtggat

SEQ ID NO: 221063 - DNA, 25 bp, Artificial sequence
  SiRNA target sequence
tcttggatcgttatttgtgtggatt

SEQ ID NO: 221064 - DNA, 25 bp, Artificial sequence
  SiRNA target sequence
cttggatcgttatttgtgtggatta

SEQ ID NO: 221065 - DNA, 25 bp, Artificial sequence
  SiRNA target sequence
ttggatcgttatttgtgtggattat

SEQ ID NO: 221066 - DNA, 25 bp, Artificial sequence
  SiRNA target sequence
tggatcgttatttgtgtggattatg

SEQ ID NO: 221067 - DNA, 25 bp, Artificial sequence
  SiRNA target sequence
ggatcgttatttgtgtggattatgg

SEQ ID NO: 221068 - DNA, 25 bp, Artificial sequence
  SiRNA target sequence
gatcgttatttgtgtggattatggg

SEQ ID NO: 221069 - DNA, 25 bp, Artificial sequence
  SiRNA target sequence
atcgttatttgtgtggattatggga

SEQ ID NO: 221070 - DNA, 25 bp, Artificial sequence
  SiRNA target sequence
tcgttatttgtgtggattatgggat

SEQ ID NO: 221071 - DNA, 25 bp, Artificial sequence
  SiRNA target sequence
cgttatttgtgtggattatgggata

SEQ ID NO: 221072 - DNA, 25 bp, Artificial sequence
  SiRNA target sequence
gttatttgtgtggattatgggatat

SEQ ID NO: 221073 - DNA, 25 bp, Artificial sequence
  SiRNA target sequence
ttatttgtgtggattatgggatatg

SEQ ID NO: 221074 - DNA, 25 bp, Artificial sequence
  SiRNA target sequence
tatttgtgtggattatgggatatgc

SEQ ID NO: 221075 - DNA, 25 bp, Artificial sequence
  SiRNA target sequence
atttgtgtggattatgggatatgca

SEQ ID NO: 221076 - DNA, 25 bp, Artificial sequence
  SiRNA target sequence
tttgtgtggattatgggatatgcat

SEQ ID NO: 221077 - DNA, 25 bp, Artificial sequence
  SiRNA target sequence
ttgtgtggattatgggatatgcatt

SEQ ID NO: 221078 - DNA, 25 bp, Artificial sequence
  SiRNA target sequence
tgtgtggattatgggatatgcattt

SEQ ID NO: 221079 - DNA, 25 bp, Artificial sequence
  SiRNA target sequence
gtgtggattatgggatatgcatttc

SEQ ID NO: 221080 - DNA, 25 bp, Artificial sequence
  SiRNA target sequence
tgtggattatgggatatgcatttca

SEQ ID NO: 221081 - DNA, 25 bp, Artificial sequence
  SiRNA target sequence
gtggattatgggatatgcatttcaa

SEQ ID NO: 221082 - DNA, 25 bp, Artificial sequence
  SiRNA target sequence
tggattatgggatatgcatttcaaa

SEQ ID NO: 221083 - DNA, 25 bp, Artificial sequence
  SiRNA target sequence
ggattatgggatatgcatttcaaac

SEQ ID NO: 221084 - DNA, 25 bp, Artificial sequence
  SiRNA target sequence
gattatgggatatgcatttcaaaca

SEQ ID NO: 221085 - DNA, 25 bp, Artificial sequence
  SiRNA target sequence
attatgggatatgcatttcaaacaa

SEQ ID NO: 221086 - DNA, 25 bp, Artificial sequence
  SiRNA target sequence
ttatgggatatgcatttcaaacaag

SEQ ID NO: 221087 - DNA, 25 bp, Artificial sequence
  SiRNA target sequence
tatgggatatgcatttcaaacaaga

SEQ ID NO: 221088 - DNA, 25 bp, Artificial sequence
  SiRNA target sequence
atgggatatgcatttcaaacaagag

SEQ ID NO: 221089 - DNA, 25 bp, Artificial sequence
  SiRNA target sequence
tgggatatgcatttcaaacaagaga

SEQ ID NO: 221090 - DNA, 25 bp, Artificial sequence
  SiRNA target sequence
gggatatgcatttcaaacaagagat

SEQ ID NO: 221091 - DNA, 25 bp, Artificial sequence
  SiRNA target sequence
ggatatgcatttcaaacaagagatt

SEQ ID NO: 221092 - DNA, 25 bp, Artificial sequence
  SiRNA target sequence
gatatgcatttcaaacaagagattt

SEQ ID NO: 221093 - DNA, 25 bp, Artificial sequence
  SiRNA target sequence
atatgcatttcaaacaagagatttt

SEQ ID NO: 221094 - DNA, 25 bp, Artificial sequence
  SiRNA target sequence
tatgcatttcaaacaagagatttta

SEQ ID NO: 221095 - DNA, 25 bp, Artificial sequence
  SiRNA target sequence
atgcatttcaaacaagagattttag

SEQ ID NO: 221096 - DNA, 25 bp, Artificial sequence
  SiRNA target sequence
tgcatttcaaacaagagattttaga

SEQ ID NO: 221097 - DNA, 25 bp, Artificial sequence
  SiRNA target sequence
gcatttcaaacaagagattttagaa

SEQ ID NO: 221098 - DNA, 25 bp, Artificial sequence
  SiRNA target sequence
catttcaaacaagagattttagaaa

SEQ ID NO: 221099 - DNA, 25 bp, Artificial sequence
  SiRNA target sequence
atttcaaacaagagattttagaaaa

SEQ ID NO: 221100 - DNA, 25 bp, Artificial sequence
  SiRNA target sequence
tttcaaacaagagattttagaaaat

SEQ ID NO: 221101 - DNA, 25 bp, Artificial sequence
  SiRNA target sequence
ttcaaacaagagattttagaaaatt

SEQ ID NO: 221102 - DNA, 25 bp, Artificial sequence
  SiRNA target sequence
tcaaacaagagattttagaaaatta

SEQ ID NO: 221103 - DNA, 25 bp, Artificial sequence
  SiRNA target sequence
caaacaagagattttagaaaattag

SEQ ID NO: 221104 - DNA, 25 bp, Artificial sequence
  SiRNA target sequence
aaacaagagattttagaaaattagc

SEQ ID NO: 221105 - DNA, 25 bp, Artificial sequence
  SiRNA target sequence
aacaagagattttagaaaattagct

SEQ ID NO: 221106 - DNA, 25 bp, Artificial sequence
  SiRNA target sequence
acaagagattttagaaaattagctc

SEQ ID NO: 221107 - DNA, 25 bp, Artificial sequence
  SiRNA target sequence
caagagattttagaaaattagctcc

SEQ ID NO: 221108 - DNA, 25 bp, Artificial sequence
  SiRNA target sequence
aagagattttagaaaattagctccc

SEQ ID NO: 221109 - DNA, 25 bp, Artificial sequence
  SiRNA target sequence
agagattttagaaaattagctccct

SEQ ID NO: 221110 - DNA, 25 bp, Artificial sequence
  SiRNA target sequence
gagattttagaaaattagctccctt

SEQ ID NO: 221111 - DNA, 25 bp, Artificial sequence
  SiRNA target sequence
agattttagaaaattagctccctta

SEQ ID NO: 221112 - DNA, 25 bp, Artificial sequence
  SiRNA target sequence
gattttagaaaattagctcccttat

SEQ ID NO: 221113 - DNA, 25 bp, Artificial sequence
  SiRNA target sequence
attttagaaaattagctcccttatg

SEQ ID NO: 221114 - DNA, 25 bp, Artificial sequence
  SiRNA target sequence
ttttagaaaattagctcccttatgt

SEQ ID NO: 221115 - DNA, 25 bp, Artificial sequence
  SiRNA target sequence
tttagaaaattagctcccttatgta

SEQ ID NO: 221116 - DNA, 25 bp, Artificial sequence
  SiRNA target sequence
ttagaaaattagctcccttatgtat

SEQ ID NO: 221117 - DNA, 25 bp, Artificial sequence
  SiRNA target sequence
tagaaaattagctcccttatgtatc

SEQ ID NO: 221118 - DNA, 25 bp, Artificial sequence
  SiRNA target sequence
agaaaattagctcccttatgtatca

SEQ ID NO: 221119 - DNA, 25 bp, Artificial sequence
  SiRNA target sequence
gaaaattagctcccttatgtatcag

SEQ ID NO: 221120 - DNA, 25 bp, Artificial sequence
  SiRNA target sequence
aaaattagctcccttatgtatcagc

SEQ ID NO: 221121 - DNA, 25 bp, Artificial sequence
  SiRNA target sequence
aaattagctcccttatgtatcagcg

SEQ ID NO: 221122 - DNA, 25 bp, Artificial sequence
  SiRNA target sequence
aattagctcccttatgtatcagcgt

SEQ ID NO: 221123 - DNA, 25 bp, Artificial sequence
  SiRNA target sequence
attagctcccttatgtatcagcgta

SEQ ID NO: 221124 - DNA, 25 bp, Artificial sequence
  SiRNA target sequence
ttagctcccttatgtatcagcgtaa

SEQ ID NO: 221125 - DNA, 25 bp, Artificial sequence
  SiRNA target sequence
tagctcccttatgtatcagcgtaat

SEQ ID NO: 221126 - DNA, 25 bp, Artificial sequence
  SiRNA target sequence
agctcccttatgtatcagcgtaatt

SEQ ID NO: 221127 - DNA, 25 bp, Artificial sequence
  SiRNA target sequence
gctcccttatgtatcagcgtaattg

SEQ ID NO: 221128 - DNA, 25 bp, Artificial sequence
  SiRNA target sequence
ctcccttatgtatcagcgtaattgt

SEQ ID NO: 221129 - DNA, 25 bp, Artificial sequence
  SiRNA target sequence
tcccttatgtatcagcgtaattgtc

SEQ ID NO: 221130 - DNA, 25 bp, Artificial sequence
  SiRNA target sequence
cccttatgtatcagcgtaattgtct

SEQ ID NO: 221131 - DNA, 25 bp, Artificial sequence
  SiRNA target sequence
ccttatgtatcagcgtaattgtctt

SEQ ID NO: 221132 - DNA, 25 bp, Artificial sequence
  SiRNA target sequence
cttatgtatcagcgtaattgtcttt

SEQ ID NO: 221133 - DNA, 25 bp, Artificial sequence
  SiRNA target sequence
ttatgtatcagcgtaattgtctttt

SEQ ID NO: 221134 - DNA, 25 bp, Artificial sequence
  SiRNA target sequence
tatgtatcagcgtaattgtcttttt

SEQ ID NO: 221135 - DNA, 25 bp, Artificial sequence
  SiRNA target sequence
atgtatcagcgtaattgtctttttt

SEQ ID NO: 221136 - DNA, 25 bp, Artificial sequence
  SiRNA target sequence
tgtatcagcgtaattgtcttttttg

SEQ ID NO: 221137 - DNA, 25 bp, Artificial sequence
  SiRNA target sequence
gtatcagcgtaattgtcttttttgt

SEQ ID NO: 221138 - DNA, 25 bp, Artificial sequence
  SiRNA target sequence
tatcagcgtaattgtcttttttgtt

SEQ ID NO: 221139 - DNA, 25 bp, Artificial sequence
  SiRNA target sequence
atcagcgtaattgtcttttttgtta

SEQ ID NO: 221140 - DNA, 25 bp, Artificial sequence
  SiRNA target sequence
tcagcgtaattgtcttttttgttat

SEQ ID NO: 221141 - DNA, 25 bp, Artificial sequence
  SiRNA target sequence
cagcgtaattgtcttttttgttatt

SEQ ID NO: 221142 - DNA, 25 bp, Artificial sequence
  SiRNA target sequence
agcgtaattgtcttttttgttatta

SEQ ID NO: 221143 - DNA, 25 bp, Artificial sequence
  SiRNA target sequence
gcgtaattgtcttttttgttattat

SEQ ID NO: 221144 - DNA, 25 bp, Artificial sequence
  SiRNA target sequence
cgtaattgtcttttttgttattatt

SEQ ID NO: 221145 - DNA, 25 bp, Artificial sequence
  SiRNA target sequence
gtaattgtcttttttgttattattt

SEQ ID NO: 221146 - DNA, 25 bp, Artificial sequence
  SiRNA target sequence
taattgtcttttttgttattatttg

SEQ ID NO: 221147 - DNA, 25 bp, Artificial sequence
  SiRNA target sequence
aattgtcttttttgttattatttgg

SEQ ID NO: 221148 - DNA, 25 bp, Artificial sequence
  SiRNA target sequence
attgtcttttttgttattatttgga

SEQ ID NO: 221149 - DNA, 25 bp, Artificial sequence
  SiRNA target sequence
ttgtcttttttgttattatttggat

SEQ ID NO: 221150 - DNA, 25 bp, Artificial sequence
  SiRNA target sequence
tgtcttttttgttattatttggatt

SEQ ID NO: 221151 - DNA, 25 bp, Artificial sequence
  SiRNA target sequence
gtcttttttgttattatttggattt

SEQ ID NO: 221152 - DNA, 25 bp, Artificial sequence
  SiRNA target sequence
tcttttttgttattatttggattta

SEQ ID NO: 221153 - DNA, 25 bp, Artificial sequence
  SiRNA target sequence
cttttttgttattatttggatttat

SEQ ID NO: 221154 - DNA, 25 bp, Artificial sequence
  SiRNA target sequence
ttttttgttattatttggatttatt

SEQ ID NO: 221155 - DNA, 25 bp, Artificial sequence
  SiRNA target sequence
tttttgttattatttggatttattc

SEQ ID NO: 221156 - DNA, 25 bp, Artificial sequence
  SiRNA target sequence
ttttgttattatttggatttattca

SEQ ID NO: 221157 - DNA, 25 bp, Artificial sequence
  SiRNA target sequence
tttgttattatttggatttattcag

SEQ ID NO: 221158 - DNA, 25 bp, Artificial sequence
  SiRNA target sequence
ttgttattatttggatttattcagt

SEQ ID NO: 221159 - DNA, 25 bp, Artificial sequence
  SiRNA target sequence
tgttattatttggatttattcagtt

SEQ ID NO: 221160 - DNA, 25 bp, Artificial sequence
  SiRNA target sequence
gttattatttggatttattcagtta

SEQ ID NO: 221161 - DNA, 25 bp, Artificial sequence
  SiRNA target sequence
ttattatttggatttattcagttat

SEQ ID NO: 221162 - DNA, 25 bp, Artificial sequence
  SiRNA target sequence
tattatttggatttattcagttatt

SEQ ID NO: 221163 - DNA, 25 bp, Artificial sequence
  SiRNA target sequence
attatttggatttattcagttattt

SEQ ID NO: 221164 - DNA, 25 bp, Artificial sequence
  SiRNA target sequence
ttatttggatttattcagttattta

SEQ ID NO: 221165 - DNA, 25 bp, Artificial sequence
  SiRNA target sequence
tatttggatttattcagttatttat

SEQ ID NO: 221166 - DNA, 25 bp, Artificial sequence
  SiRNA target sequence
atttggatttattcagttatttatt

SEQ ID NO: 221167 - DNA, 25 bp, Artificial sequence
  SiRNA target sequence
tttggatttattcagttatttattt

SEQ ID NO: 221168 - DNA, 25 bp, Artificial sequence
  SiRNA target sequence
ttggatttattcagttatttattta

SEQ ID NO: 221169 - DNA, 25 bp, Artificial sequence
  SiRNA target sequence
tggatttattcagttatttatttaa

SEQ ID NO: 221170 - DNA, 25 bp, Artificial sequence
  SiRNA target sequence
ggatttattcagttatttatttaaa

SEQ ID NO: 221171 - DNA, 25 bp, Artificial sequence
  SiRNA target sequence
gatttattcagttatttatttaaat

SEQ ID NO: 221172 - DNA, 25 bp, Artificial sequence
  SiRNA target sequence
atttattcagttatttatttaaata

SEQ ID NO: 221173 - DNA, 25 bp, Artificial sequence
  SiRNA target sequence
tttattcagttatttatttaaataa

SEQ ID NO: 221174 - DNA, 25 bp, Artificial sequence
  SiRNA target sequence
ttattcagttatttatttaaataag

SEQ ID NO: 221175 - DNA, 25 bp, Artificial sequence
  SiRNA target sequence
tattcagttatttatttaaataaga

SEQ ID NO: 221176 - DNA, 25 bp, Artificial sequence
  SiRNA target sequence
attcagttatttatttaaataagaa

SEQ ID NO: 221177 - DNA, 25 bp, Artificial sequence
  SiRNA target sequence
ttcagttatttatttaaataagaaa

SEQ ID NO: 221178 - DNA, 25 bp, Artificial sequence
  SiRNA target sequence
tcagttatttatttaaataagaaat

SEQ ID NO: 221179 - DNA, 25 bp, Artificial sequence
  SiRNA target sequence
cagttatttatttaaataagaaata

SEQ ID NO: 221180 - DNA, 25 bp, Artificial sequence
  SiRNA target sequence
agttatttatttaaataagaaatac

SEQ ID NO: 221181 - DNA, 25 bp, Artificial sequence
  SiRNA target sequence
gttatttatttaaataagaaataca

SEQ ID NO: 221182 - DNA, 25 bp, Artificial sequence
  SiRNA target sequence
ttatttatttaaataagaaatacaa

SEQ ID NO: 221183 - DNA, 25 bp, Artificial sequence
  SiRNA target sequence
tatttatttaaataagaaatacaaa

SEQ ID NO: 221184 - DNA, 25 bp, Artificial sequence
  SiRNA target sequence
atttatttaaataagaaatacaaag

SEQ ID NO: 221185 - DNA, 25 bp, Artificial sequence
  SiRNA target sequence
tttatttaaataagaaatacaaaga

SEQ ID NO: 221186 - DNA, 25 bp, Artificial sequence
  SiRNA target sequence
ttatttaaataagaaatacaaagaa

SEQ ID NO: 221187 - DNA, 25 bp, Artificial sequence
  SiRNA target sequence
tatttaaataagaaatacaaagaat

SEQ ID NO: 221188 - DNA, 25 bp, Artificial sequence
  SiRNA target sequence
atttaaataagaaatacaaagaatc

SEQ ID NO: 221189 - DNA, 25 bp, Artificial sequence
  SiRNA target sequence
tttaaataagaaatacaaagaatca

SEQ ID NO: 221190 - DNA, 25 bp, Artificial sequence
  SiRNA target sequence
ttaaataagaaatacaaagaatcag

SEQ ID NO: 221191 - DNA, 25 bp, Artificial sequence
  SiRNA target sequence
taaataagaaatacaaagaatcagt

SEQ ID NO: 221192 - DNA, 25 bp, Artificial sequence
  SiRNA target sequence
aaataagaaatacaaagaatcagtt

SEQ ID NO: 221193 - DNA, 25 bp, Artificial sequence
  SiRNA target sequence
aataagaaatacaaagaatcagttg

SEQ ID NO: 221194 - DNA, 25 bp, Artificial sequence
  SiRNA target sequence
ataagaaatacaaagaatcagttgt

SEQ ID NO: 221195 - DNA, 25 bp, Artificial sequence
  SiRNA target sequence
taagaaatacaaagaatcagttgtt

SEQ ID NO: 221196 - DNA, 25 bp, Artificial sequence
  SiRNA target sequence
aagaaatacaaagaatcagttgtta

SEQ ID NO: 221197 - DNA, 25 bp, Artificial sequence
  SiRNA target sequence
agaaatacaaagaatcagttgttag

SEQ ID NO: 221198 - DNA, 25 bp, Artificial sequence
  SiRNA target sequence
gaaatacaaagaatcagttgttagt

SEQ ID NO: 221199 - DNA, 25 bp, Artificial sequence
  SiRNA target sequence
aaatacaaagaatcagttgttagta

SEQ ID NO: 221200 - DNA, 25 bp, Artificial sequence
  SiRNA target sequence
aatacaaagaatcagttgttagtaa

SEQ ID NO: 221201 - DNA, 25 bp, Artificial sequence
  SiRNA target sequence
atacaaagaatcagttgttagtaat

SEQ ID NO: 221202 - DNA, 25 bp, Artificial sequence
  SiRNA target sequence
tacaaagaatcagttgttagtaatt

SEQ ID NO: 221203 - DNA, 25 bp, Artificial sequence
  SiRNA target sequence
acaaagaatcagttgttagtaattt

SEQ ID NO: 221204 - DNA, 25 bp, Artificial sequence
  SiRNA target sequence
caaagaatcagttgttagtaattta

SEQ ID NO: 221205 - DNA, 25 bp, Artificial sequence
  SiRNA target sequence
aaagaatcagttgttagtaatttac

SEQ ID NO: 221206 - DNA, 25 bp, Artificial sequence
  SiRNA target sequence
aagaatcagttgttagtaatttacc

SEQ ID NO: 221207 - DNA, 25 bp, Artificial sequence
  SiRNA target sequence
agaatcagttgttagtaatttaccc

SEQ ID NO: 221208 - DNA, 25 bp, Artificial sequence
  SiRNA target sequence
gaatcagttgttagtaatttaccca

SEQ ID NO: 221209 - DNA, 25 bp, Artificial sequence
  SiRNA target sequence
aatcagttgttagtaatttacccat

SEQ ID NO: 221210 - DNA, 25 bp, Artificial sequence
  SiRNA target sequence
atcagttgttagtaatttacccatc

SEQ ID NO: 221211 - DNA, 25 bp, Artificial sequence
  SiRNA target sequence
tcagttgttagtaatttacccatcg

SEQ ID NO: 221212 - DNA, 25 bp, Artificial sequence
  SiRNA target sequence
cagttgttagtaatttacccatcga

SEQ ID NO: 221213 - DNA, 25 bp, Artificial sequence
  SiRNA target sequence
agttgttagtaatttacccatcgat

SEQ ID NO: 221214 - DNA, 25 bp, Artificial sequence
  SiRNA target sequence
gttgttagtaatttacccatcgatg

SEQ ID NO: 221215 - DNA, 25 bp, Artificial sequence
  SiRNA target sequence
ttgttagtaatttacccatcgatgt

SEQ ID NO: 221216 - DNA, 25 bp, Artificial sequence
  SiRNA target sequence
tgttagtaatttacccatcgatgtt

SEQ ID NO: 221217 - DNA, 25 bp, Artificial sequence
  SiRNA target sequence
gttagtaatttacccatcgatgttg

SEQ ID NO: 221218 - DNA, 25 bp, Artificial sequence
  SiRNA target sequence
ttagtaatttacccatcgatgttga

SEQ ID NO: 221219 - DNA, 25 bp, Artificial sequence
  SiRNA target sequence
tagtaatttacccatcgatgttgat

SEQ ID NO: 221220 - DNA, 25 bp, Artificial sequence
  SiRNA target sequence
agtaatttacccatcgatgttgatt

SEQ ID NO: 221221 - DNA, 25 bp, Artificial sequence
  SiRNA target sequence
gtaatttacccatcgatgttgattt

SEQ ID NO: 221222 - DNA, 25 bp, Artificial sequence
  SiRNA target sequence
taatttacccatcgatgttgatttg

SEQ ID NO: 221223 - DNA, 25 bp, Artificial sequence
  SiRNA target sequence
aatttacccatcgatgttgatttgt

SEQ ID NO: 221224 - DNA, 25 bp, Artificial sequence
  SiRNA target sequence
atttacccatcgatgttgatttgtt

SEQ ID NO: 221225 - DNA, 25 bp, Artificial sequence
  SiRNA target sequence
tttacccatcgatgttgatttgttt

SEQ ID NO: 221226 - DNA, 25 bp, Artificial sequence
  SiRNA target sequence
ttacccatcgatgttgatttgtttg

SEQ ID NO: 221227 - DNA, 25 bp, Artificial sequence
  SiRNA target sequence
tacccatcgatgttgatttgtttgc

SEQ ID NO: 221228 - DNA, 25 bp, Artificial sequence
  SiRNA target sequence
acccatcgatgttgatttgtttgca

SEQ ID NO: 221229 - DNA, 25 bp, Artificial sequence
  SiRNA target sequence
cccatcgatgttgatttgtttgcat

SEQ ID NO: 221230 - DNA, 25 bp, Artificial sequence
  SiRNA target sequence
ccatcgatgttgatttgtttgcatc

SEQ ID NO: 221231 - DNA, 25 bp, Artificial sequence
  SiRNA target sequence
catcgatgttgatttgtttgcatca

SEQ ID NO: 221232 - DNA, 25 bp, Artificial sequence
  SiRNA target sequence
atcgatgttgatttgtttgcatcaa

SEQ ID NO: 221233 - DNA, 25 bp, Artificial sequence
  SiRNA target sequence
tcgatgttgatttgtttgcatcaaa

SEQ ID NO: 221234 - DNA, 25 bp, Artificial sequence
  SiRNA target sequence
cgatgttgatttgtttgcatcaaag

SEQ ID NO: 221235 - DNA, 25 bp, Artificial sequence
  SiRNA target sequence
gatgttgatttgtttgcatcaaagt

SEQ ID NO: 221236 - DNA, 25 bp, Artificial sequence
  SiRNA target sequence
atgttgatttgtttgcatcaaagtt

SEQ ID NO: 221237 - DNA, 25 bp, Artificial sequence
  SiRNA target sequence
tgttgatttgtttgcatcaaagttg

SEQ ID NO: 221238 - DNA, 25 bp, Artificial sequence
  SiRNA target sequence
gttgatttgtttgcatcaaagttgt

SEQ ID NO: 221239 - DNA, 25 bp, Artificial sequence
  SiRNA target sequence
ttgatttgtttgcatcaaagttgtt

SEQ ID NO: 221240 - DNA, 25 bp, Artificial sequence
  SiRNA target sequence
tgatttgtttgcatcaaagttgtta

SEQ ID NO: 221241 - DNA, 25 bp, Artificial sequence
  SiRNA target sequence
gatttgtttgcatcaaagttgttag

SEQ ID NO: 221242 - DNA, 25 bp, Artificial sequence
  SiRNA target sequence
atttgtttgcatcaaagttgttaga

SEQ ID NO: 221243 - DNA, 25 bp, Artificial sequence
  SiRNA target sequence
tttgtttgcatcaaagttgttagat

SEQ ID NO: 221244 - DNA, 25 bp, Artificial sequence
  SiRNA target sequence
ttgtttgcatcaaagttgttagata

SEQ ID NO: 221245 - DNA, 25 bp, Artificial sequence
  SiRNA target sequence
tgtttgcatcaaagttgttagataa

SEQ ID NO: 221246 - DNA, 25 bp, Artificial sequence
  SiRNA target sequence
gtttgcatcaaagttgttagataat

SEQ ID NO: 221247 - DNA, 25 bp, Artificial sequence
  SiRNA target sequence
tttgcatcaaagttgttagataata

SEQ ID NO: 221248 - DNA, 25 bp, Artificial sequence
  SiRNA target sequence
ttgcatcaaagttgttagataataa

SEQ ID NO: 221249 - DNA, 25 bp, Artificial sequence
  SiRNA target sequence
tgcatcaaagttgttagataataaa

SEQ ID NO: 221250 - DNA, 25 bp, Artificial sequence
  SiRNA target sequence
gcatcaaagttgttagataataaaa

SEQ ID NO: 221251 - DNA, 25 bp, Artificial sequence
  SiRNA target sequence
catcaaagttgttagataataaaaa

SEQ ID NO: 221252 - DNA, 25 bp, Artificial sequence
  SiRNA target sequence
atcaaagttgttagataataaaaaa

SEQ ID NO: 221253 - DNA, 25 bp, Artificial sequence
  SiRNA target sequence
tcaaagttgttagataataaaaaag

SEQ ID NO: 221254 - DNA, 25 bp, Artificial sequence
  SiRNA target sequence
caaagttgttagataataaaaaaga

SEQ ID NO: 221255 - DNA, 25 bp, Artificial sequence
  SiRNA target sequence
aaagttgttagataataaaaaagaa

SEQ ID NO: 221256 - DNA, 25 bp, Artificial sequence
  SiRNA target sequence
aagttgttagataataaaaaagaag

SEQ ID NO: 221257 - DNA, 25 bp, Artificial sequence
  SiRNA target sequence
agttgttagataataaaaaagaaga

SEQ ID NO: 221258 - DNA, 25 bp, Artificial sequence
  SiRNA target sequence
gttgttagataataaaaaagaagag

SEQ ID NO: 221259 - DNA, 25 bp, Artificial sequence
  SiRNA target sequence
ttgttagataataaaaaagaagagg

SEQ ID NO: 221260 - DNA, 25 bp, Artificial sequence
  SiRNA target sequence
tgttagataataaaaaagaagagga

SEQ ID NO: 221261 - DNA, 25 bp, Artificial sequence
  SiRNA target sequence
gttagataataaaaaagaagaggaa

SEQ ID NO: 221262 - DNA, 25 bp, Artificial sequence
  SiRNA target sequence
ttagataataaaaaagaagaggaaa

SEQ ID NO: 221263 - DNA, 25 bp, Artificial sequence
  SiRNA target sequence
tagataataaaaaagaagaggaaat

SEQ ID NO: 221264 - DNA, 25 bp, Artificial sequence
  SiRNA target sequence
agataataaaaaagaagaggaaatt

SEQ ID NO: 221265 - DNA, 25 bp, Artificial sequence
  SiRNA target sequence
gataataaaaaagaagaggaaattg

SEQ ID NO: 221266 - DNA, 25 bp, Artificial sequence
  SiRNA target sequence
ataataaaaaagaagaggaaattga

SEQ ID NO: 221267 - DNA, 25 bp, Artificial sequence
  SiRNA target sequence
taataaaaaagaagaggaaattgat

SEQ ID NO: 221268 - DNA, 25 bp, Artificial sequence
  SiRNA target sequence
aataaaaaagaagaggaaattgatg

SEQ ID NO: 221269 - DNA, 25 bp, Artificial sequence
  SiRNA target sequence
ataaaaaagaagaggaaattgatgt

SEQ ID NO: 221270 - DNA, 25 bp, Artificial sequence
  SiRNA target sequence
taaaaaagaagaggaaattgatgtg

SEQ ID NO: 221271 - DNA, 25 bp, Artificial sequence
  SiRNA target sequence
aaaaaagaagaggaaattgatgtgt

SEQ ID NO: 221272 - DNA, 25 bp, Artificial sequence
  SiRNA target sequence
aaaaagaagaggaaattgatgtgtc

SEQ ID NO: 221273 - DNA, 25 bp, Artificial sequence
  SiRNA target sequence
aaaagaagaggaaattgatgtgtca

SEQ ID NO: 221274 - DNA, 25 bp, Artificial sequence
  SiRNA target sequence
aaagaagaggaaattgatgtgtcag

SEQ ID NO: 221275 - DNA, 25 bp, Artificial sequence
  SiRNA target sequence
aagaagaggaaattgatgtgtcagt

SEQ ID NO: 221276 - DNA, 25 bp, Artificial sequence
  SiRNA target sequence
agaagaggaaattgatgtgtcagtg

SEQ ID NO: 221277 - DNA, 25 bp, Artificial sequence
  SiRNA target sequence
gaagaggaaattgatgtgtcagtgc

SEQ ID NO: 221278 - DNA, 25 bp, Artificial sequence
  SiRNA target sequence
aagaggaaattgatgtgtcagtgct

SEQ ID NO: 221279 - DNA, 25 bp, Artificial sequence
  SiRNA target sequence
agaggaaattgatgtgtcagtgctc

SEQ ID NO: 221280 - DNA, 25 bp, Artificial sequence
  SiRNA target sequence
gaggaaattgatgtgtcagtgctcg

SEQ ID NO: 221281 - DNA, 25 bp, Artificial sequence
  SiRNA target sequence
aggaaattgatgtgtcagtgctcgt

SEQ ID NO: 221282 - DNA, 25 bp, Artificial sequence
  SiRNA target sequence
ggaaattgatgtgtcagtgctcgtt

SEQ ID NO: 221283 - DNA, 25 bp, Artificial sequence
  SiRNA target sequence
gaaattgatgtgtcagtgctcgtta

SEQ ID NO: 221284 - DNA, 25 bp, Artificial sequence
  SiRNA target sequence
aaattgatgtgtcagtgctcgttaa

SEQ ID NO: 221285 - DNA, 25 bp, Artificial sequence
  SiRNA target sequence
aattgatgtgtcagtgctcgttaat

SEQ ID NO: 221286 - DNA, 25 bp, Artificial sequence
  SiRNA target sequence
attgatgtgtcagtgctcgttaatt

SEQ ID NO: 221287 - DNA, 25 bp, Artificial sequence
  SiRNA target sequence
ttgatgtgtcagtgctcgttaatta

SEQ ID NO: 221288 - DNA, 25 bp, Artificial sequence
  SiRNA target sequence
tgatgtgtcagtgctcgttaattaa

SEQ ID NO: 221289 - DNA, 26 bp, Artificial sequence
  SiRNA target sequence
atgattgagaggggtattatggaaaa

SEQ ID NO: 221290 - DNA, 26 bp, Artificial sequence
  SiRNA target sequence
tgattgagaggggtattatggaaaaa

SEQ ID NO: 221291 - DNA, 26 bp, Artificial sequence
  SiRNA target sequence
gattgagaggggtattatggaaaaaa

SEQ ID NO: 221292 - DNA, 26 bp, Artificial sequence
  SiRNA target sequence
attgagaggggtattatggaaaaaat

SEQ ID NO: 221293 - DNA, 26 bp, Artificial sequence
  SiRNA target sequence
ttgagaggggtattatggaaaaaata

SEQ ID NO: 221294 - DNA, 26 bp, Artificial sequence
  SiRNA target sequence
tgagaggggtattatggaaaaaataa

SEQ ID NO: 221295 - DNA, 26 bp, Artificial sequence
  SiRNA target sequence
gagaggggtattatggaaaaaataaa

SEQ ID NO: 221296 - DNA, 26 bp, Artificial sequence
  SiRNA target sequence
agaggggtattatggaaaaaataaaa

SEQ ID NO: 221297 - DNA, 26 bp, Artificial sequence
  SiRNA target sequence
gaggggtattatggaaaaaataaaaa

SEQ ID NO: 221298 - DNA, 26 bp, Artificial sequence
  SiRNA target sequence
aggggtattatggaaaaaataaaaaa

SEQ ID NO: 221299 - DNA, 26 bp, Artificial sequence
  SiRNA target sequence
ggggtattatggaaaaaataaaaaat

SEQ ID NO: 221300 - DNA, 26 bp, Artificial sequence
  SiRNA target sequence
gggtattatggaaaaaataaaaaatt

SEQ ID NO: 221301 - DNA, 26 bp, Artificial sequence
  SiRNA target sequence
ggtattatggaaaaaataaaaaattt

SEQ ID NO: 221302 - DNA, 26 bp, Artificial sequence
  SiRNA target sequence
gtattatggaaaaaataaaaaattta

SEQ ID NO: 221303 - DNA, 26 bp, Artificial sequence
  SiRNA target sequence
tattatggaaaaaataaaaaatttat

SEQ ID NO: 221304 - DNA, 26 bp, Artificial sequence
  SiRNA target sequence
attatggaaaaaataaaaaatttatt

SEQ ID NO: 221305 - DNA, 26 bp, Artificial sequence
  SiRNA target sequence
ttatggaaaaaataaaaaatttatta

SEQ ID NO: 221306 - DNA, 26 bp, Artificial sequence
  SiRNA target sequence
tatggaaaaaataaaaaatttattaa

SEQ ID NO: 221307 - DNA, 26 bp, Artificial sequence
  SiRNA target sequence
atggaaaaaataaaaaatttattaac

SEQ ID NO: 221308 - DNA, 26 bp, Artificial sequence
  SiRNA target sequence
tggaaaaaataaaaaatttattaaca

SEQ ID NO: 221309 - DNA, 26 bp, Artificial sequence
  SiRNA target sequence
ggaaaaaataaaaaatttattaacag

SEQ ID NO: 221310 - DNA, 26 bp, Artificial sequence
  SiRNA target sequence
gaaaaaataaaaaatttattaacaga

SEQ ID NO: 221311 - DNA, 26 bp, Artificial sequence
  SiRNA target sequence
aaaaaataaaaaatttattaacagag

SEQ ID NO: 221312 - DNA, 26 bp, Artificial sequence
  SiRNA target sequence
aaaaataaaaaatttattaacagagg

SEQ ID NO: 221313 - DNA, 26 bp, Artificial sequence
  SiRNA target sequence
aaaataaaaaatttattaacagagga

SEQ ID NO: 221314 - DNA, 26 bp, Artificial sequence
  SiRNA target sequence
aaataaaaaatttattaacagaggat

SEQ ID NO: 221315 - DNA, 26 bp, Artificial sequence
  SiRNA target sequence
aataaaaaatttattaacagaggatg

SEQ ID NO: 221316 - DNA, 26 bp, Artificial sequence
  SiRNA target sequence
ataaaaaatttattaacagaggatga

SEQ ID NO: 221317 - DNA, 26 bp, Artificial sequence
  SiRNA target sequence
taaaaaatttattaacagaggatgaa

SEQ ID NO: 221318 - DNA, 26 bp, Artificial sequence
  SiRNA target sequence
aaaaaatttattaacagaggatgaag

SEQ ID NO: 221319 - DNA, 26 bp, Artificial sequence
  SiRNA target sequence
aaaaatttattaacagaggatgaagt

SEQ ID NO: 221320 - DNA, 26 bp, Artificial sequence
  SiRNA target sequence
aaaatttattaacagaggatgaagta

SEQ ID NO: 221321 - DNA, 26 bp, Artificial sequence
  SiRNA target sequence
aaatttattaacagaggatgaagtag

SEQ ID NO: 221322 - DNA, 26 bp, Artificial sequence
  SiRNA target sequence
aatttattaacagaggatgaagtaga

SEQ ID NO: 221323 - DNA, 26 bp, Artificial sequence
  SiRNA target sequence
atttattaacagaggatgaagtagaa

SEQ ID NO: 221324 - DNA, 26 bp, Artificial sequence
  SiRNA target sequence
tttattaacagaggatgaagtagaag

SEQ ID NO: 221325 - DNA, 26 bp, Artificial sequence
  SiRNA target sequence
ttattaacagaggatgaagtagaagc

SEQ ID NO: 221326 - DNA, 26 bp, Artificial sequence
  SiRNA target sequence
tattaacagaggatgaagtagaagca

SEQ ID NO: 221327 - DNA, 26 bp, Artificial sequence
  SiRNA target sequence
attaacagaggatgaagtagaagcag

SEQ ID NO: 221328 - DNA, 26 bp, Artificial sequence
  SiRNA target sequence
ttaacagaggatgaagtagaagcaga

SEQ ID NO: 221329 - DNA, 26 bp, Artificial sequence
  SiRNA target sequence
taacagaggatgaagtagaagcagaa

SEQ ID NO: 221330 - DNA, 26 bp, Artificial sequence
  SiRNA target sequence
aacagaggatgaagtagaagcagaag

SEQ ID NO: 221331 - DNA, 26 bp, Artificial sequence
  SiRNA target sequence
acagaggatgaagtagaagcagaagc

SEQ ID NO: 221332 - DNA, 26 bp, Artificial sequence
  SiRNA target sequence
cagaggatgaagtagaagcagaagca

SEQ ID NO: 221333 - DNA, 26 bp, Artificial sequence
  SiRNA target sequence
agaggatgaagtagaagcagaagcaa

SEQ ID NO: 221334 - DNA, 26 bp, Artificial sequence
  SiRNA target sequence
gaggatgaagtagaagcagaagcaaa

SEQ ID NO: 221335 - DNA, 26 bp, Artificial sequence
  SiRNA target sequence
aggatgaagtagaagcagaagcaaat

SEQ ID NO: 221336 - DNA, 26 bp, Artificial sequence
  SiRNA target sequence
ggatgaagtagaagcagaagcaaatt

SEQ ID NO: 221337 - DNA, 26 bp, Artificial sequence
  SiRNA target sequence
gatgaagtagaagcagaagcaaattc

SEQ ID NO: 221338 - DNA, 26 bp, Artificial sequence
  SiRNA target sequence
atgaagtagaagcagaagcaaattct

SEQ ID NO: 221339 - DNA, 26 bp, Artificial sequence
  SiRNA target sequence
tgaagtagaagcagaagcaaattctg

SEQ ID NO: 221340 - DNA, 26 bp, Artificial sequence
  SiRNA target sequence
gaagtagaagcagaagcaaattctgg

SEQ ID NO: 221341 - DNA, 26 bp, Artificial sequence
  SiRNA target sequence
aagtagaagcagaagcaaattctgga

SEQ ID NO: 221342 - DNA, 26 bp, Artificial sequence
  SiRNA target sequence
agtagaagcagaagcaaattctggaa

SEQ ID NO: 221343 - DNA, 26 bp, Artificial sequence
  SiRNA target sequence
gtagaagcagaagcaaattctggaag

SEQ ID NO: 221344 - DNA, 26 bp, Artificial sequence
  SiRNA target sequence
tagaagcagaagcaaattctggaagg

SEQ ID NO: 221345 - DNA, 26 bp, Artificial sequence
  SiRNA target sequence
agaagcagaagcaaattctggaaggg

SEQ ID NO: 221346 - DNA, 26 bp, Artificial sequence
  SiRNA target sequence
gaagcagaagcaaattctggaagggg

SEQ ID NO: 221347 - DNA, 26 bp, Artificial sequence
  SiRNA target sequence
aagcagaagcaaattctggaaggggc

SEQ ID NO: 221348 - DNA, 26 bp, Artificial sequence
  SiRNA target sequence
agcagaagcaaattctggaaggggca

SEQ ID NO: 221349 - DNA, 26 bp, Artificial sequence
  SiRNA target sequence
gcagaagcaaattctggaaggggcat

SEQ ID NO: 221350 - DNA, 26 bp, Artificial sequence
  SiRNA target sequence
cagaagcaaattctggaaggggcatt

SEQ ID NO: 221351 - DNA, 26 bp, Artificial sequence
  SiRNA target sequence
agaagcaaattctggaaggggcattt

SEQ ID NO: 221352 - DNA, 26 bp, Artificial sequence
  SiRNA target sequence
gaagcaaattctggaaggggcatttt

SEQ ID NO: 221353 - DNA, 26 bp, Artificial sequence
  SiRNA target sequence
aagcaaattctggaaggggcatttta

SEQ ID NO: 221354 - DNA, 26 bp, Artificial sequence
  SiRNA target sequence
agcaaattctggaaggggcattttat

SEQ ID NO: 221355 - DNA, 26 bp, Artificial sequence
  SiRNA target sequence
gcaaattctggaaggggcattttatc

SEQ ID NO: 221356 - DNA, 26 bp, Artificial sequence
  SiRNA target sequence
caaattctggaaggggcattttatca

SEQ ID NO: 221357 - DNA, 26 bp, Artificial sequence
  SiRNA target sequence
aaattctggaaggggcattttatcaa

SEQ ID NO: 221358 - DNA, 26 bp, Artificial sequence
  SiRNA target sequence
aattctggaaggggcattttatcaat

SEQ ID NO: 221359 - DNA, 26 bp, Artificial sequence
  SiRNA target sequence
attctggaaggggcattttatcaata

SEQ ID NO: 221360 - DNA, 26 bp, Artificial sequence
  SiRNA target sequence
ttctggaaggggcattttatcaatat

SEQ ID NO: 221361 - DNA, 26 bp, Artificial sequence
  SiRNA target sequence
tctggaaggggcattttatcaatatt

SEQ ID NO: 221362 - DNA, 26 bp, Artificial sequence
  SiRNA target sequence
ctggaaggggcattttatcaatattt

SEQ ID NO: 221363 - DNA, 26 bp, Artificial sequence
  SiRNA target sequence
tggaaggggcattttatcaatattta

SEQ ID NO: 221364 - DNA, 26 bp, Artificial sequence
  SiRNA target sequence
ggaaggggcattttatcaatatttag

SEQ ID NO: 221365 - DNA, 26 bp, Artificial sequence
  SiRNA target sequence
gaaggggcattttatcaatatttaga

SEQ ID NO: 221366 - DNA, 26 bp, Artificial sequence
  SiRNA target sequence
aaggggcattttatcaatatttagaa

SEQ ID NO: 221367 - DNA, 26 bp, Artificial sequence
  SiRNA target sequence
aggggcattttatcaatatttagaat

SEQ ID NO: 221368 - DNA, 26 bp, Artificial sequence
  SiRNA target sequence
ggggcattttatcaatatttagaatt

SEQ ID NO: 221369 - DNA, 26 bp, Artificial sequence
  SiRNA target sequence
gggcattttatcaatatttagaattg

SEQ ID NO: 221370 - DNA, 26 bp, Artificial sequence
  SiRNA target sequence
ggcattttatcaatatttagaattgc

SEQ ID NO: 221371 - DNA, 26 bp, Artificial sequence
  SiRNA target sequence
gcattttatcaatatttagaattgct

SEQ ID NO: 221372 - DNA, 26 bp, Artificial sequence
  SiRNA target sequence
cattttatcaatatttagaattgcta

SEQ ID NO: 221373 - DNA, 26 bp, Artificial sequence
  SiRNA target sequence
attttatcaatatttagaattgctaa

SEQ ID NO: 221374 - DNA, 26 bp, Artificial sequence
  SiRNA target sequence
ttttatcaatatttagaattgctaag

SEQ ID NO: 221375 - DNA, 26 bp, Artificial sequence
  SiRNA target sequence
tttatcaatatttagaattgctaagg

SEQ ID NO: 221376 - DNA, 26 bp, Artificial sequence
  SiRNA target sequence
ttatcaatatttagaattgctaaggt

SEQ ID NO: 221377 - DNA, 26 bp, Artificial sequence
  SiRNA target sequence
tatcaatatttagaattgctaaggta

SEQ ID NO: 221378 - DNA, 26 bp, Artificial sequence
  SiRNA target sequence
atcaatatttagaattgctaaggtag

SEQ ID NO: 221379 - DNA, 26 bp, Artificial sequence
  SiRNA target sequence
tcaatatttagaattgctaaggtaga

SEQ ID NO: 221380 - DNA, 26 bp, Artificial sequence
  SiRNA target sequence
caatatttagaattgctaaggtagaa

SEQ ID NO: 221381 - DNA, 26 bp, Artificial sequence
  SiRNA target sequence
aatatttagaattgctaaggtagaaa

SEQ ID NO: 221382 - DNA, 26 bp, Artificial sequence
  SiRNA target sequence
atatttagaattgctaaggtagaaag

SEQ ID NO: 221383 - DNA, 26 bp, Artificial sequence
  SiRNA target sequence
tatttagaattgctaaggtagaaaga

SEQ ID NO: 221384 - DNA, 26 bp, Artificial sequence
  SiRNA target sequence
atttagaattgctaaggtagaaagaa

SEQ ID NO: 221385 - DNA, 26 bp, Artificial sequence
  SiRNA target sequence
tttagaattgctaaggtagaaagaag

SEQ ID NO: 221386 - DNA, 26 bp, Artificial sequence
  SiRNA target sequence
ttagaattgctaaggtagaaagaaga

SEQ ID NO: 221387 - DNA, 26 bp, Artificial sequence
  SiRNA target sequence
tagaattgctaaggtagaaagaagaa

SEQ ID NO: 221388 - DNA, 26 bp, Artificial sequence
  SiRNA target sequence
agaattgctaaggtagaaagaagaat

SEQ ID NO: 221389 - DNA, 26 bp, Artificial sequence
  SiRNA target sequence
gaattgctaaggtagaaagaagaatg

SEQ ID NO: 221390 - DNA, 26 bp, Artificial sequence
  SiRNA target sequence
aattgctaaggtagaaagaagaatgt

SEQ ID NO: 221391 - DNA, 26 bp, Artificial sequence
  SiRNA target sequence
attgctaaggtagaaagaagaatgtt

SEQ ID NO: 221392 - DNA, 26 bp, Artificial sequence
  SiRNA target sequence
ttgctaaggtagaaagaagaatgttt

SEQ ID NO: 221393 - DNA, 26 bp, Artificial sequence
  SiRNA target sequence
tgctaaggtagaaagaagaatgtttt

SEQ ID NO: 221394 - DNA, 26 bp, Artificial sequence
  SiRNA target sequence
gctaaggtagaaagaagaatgttttg

SEQ ID NO: 221395 - DNA, 26 bp, Artificial sequence
  SiRNA target sequence
ctaaggtagaaagaagaatgttttgg

SEQ ID NO: 221396 - DNA, 26 bp, Artificial sequence
  SiRNA target sequence
taaggtagaaagaagaatgttttggc

SEQ ID NO: 221397 - DNA, 26 bp, Artificial sequence
  SiRNA target sequence
aaggtagaaagaagaatgttttggct

SEQ ID NO: 221398 - DNA, 26 bp, Artificial sequence
  SiRNA target sequence
aggtagaaagaagaatgttttggctt

SEQ ID NO: 221399 - DNA, 26 bp, Artificial sequence
  SiRNA target sequence
ggtagaaagaagaatgttttggctta

SEQ ID NO: 221400 - DNA, 26 bp, Artificial sequence
  SiRNA target sequence
gtagaaagaagaatgttttggcttat

SEQ ID NO: 221401 - DNA, 26 bp, Artificial sequence
  SiRNA target sequence
tagaaagaagaatgttttggcttatg

SEQ ID NO: 221402 - DNA, 26 bp, Artificial sequence
  SiRNA target sequence
agaaagaagaatgttttggcttatga

SEQ ID NO: 221403 - DNA, 26 bp, Artificial sequence
  SiRNA target sequence
gaaagaagaatgttttggcttatgac

SEQ ID NO: 221404 - DNA, 26 bp, Artificial sequence
  SiRNA target sequence
aaagaagaatgttttggcttatgacg

SEQ ID NO: 221405 - DNA, 26 bp, Artificial sequence
  SiRNA target sequence
aagaagaatgttttggcttatgacgc

SEQ ID NO: 221406 - DNA, 26 bp, Artificial sequence
  SiRNA target sequence
agaagaatgttttggcttatgacgct

SEQ ID NO: 221407 - DNA, 26 bp, Artificial sequence
  SiRNA target sequence
gaagaatgttttggcttatgacgctt

SEQ ID NO: 221408 - DNA, 26 bp, Artificial sequence
  SiRNA target sequence
aagaatgttttggcttatgacgctta

SEQ ID NO: 221409 - DNA, 26 bp, Artificial sequence
  SiRNA target sequence
agaatgttttggcttatgacgcttat

SEQ ID NO: 221410 - DNA, 26 bp, Artificial sequence
  SiRNA target sequence
gaatgttttggcttatgacgcttatg

SEQ ID NO: 221411 - DNA, 26 bp, Artificial sequence
  SiRNA target sequence
aatgttttggcttatgacgcttatgt

SEQ ID NO: 221412 - DNA, 26 bp, Artificial sequence
  SiRNA target sequence
atgttttggcttatgacgcttatgtt

SEQ ID NO: 221413 - DNA, 26 bp, Artificial sequence
  SiRNA target sequence
tgttttggcttatgacgcttatgttt

SEQ ID NO: 221414 - DNA, 26 bp, Artificial sequence
  SiRNA target sequence
gttttggcttatgacgcttatgtttt

SEQ ID NO: 221415 - DNA, 26 bp, Artificial sequence
  SiRNA target sequence
ttttggcttatgacgcttatgttttc

SEQ ID NO: 221416 - DNA, 26 bp, Artificial sequence
  SiRNA target sequence
tttggcttatgacgcttatgttttcg

SEQ ID NO: 221417 - DNA, 26 bp, Artificial sequence
  SiRNA target sequence
ttggcttatgacgcttatgttttcgc

SEQ ID NO: 221418 - DNA, 26 bp, Artificial sequence
  SiRNA target sequence
tggcttatgacgcttatgttttcgct

SEQ ID NO: 221419 - DNA, 26 bp, Artificial sequence
  SiRNA target sequence
ggcttatgacgcttatgttttcgctt

SEQ ID NO: 221420 - DNA, 26 bp, Artificial sequence
  SiRNA target sequence
gcttatgacgcttatgttttcgctta

SEQ ID NO: 221421 - DNA, 26 bp, Artificial sequence
  SiRNA target sequence
cttatgacgcttatgttttcgcttat

SEQ ID NO: 221422 - DNA, 26 bp, Artificial sequence
  SiRNA target sequence
ttatgacgcttatgttttcgcttatt

SEQ ID NO: 221423 - DNA, 26 bp, Artificial sequence
  SiRNA target sequence
tatgacgcttatgttttcgcttattt

SEQ ID NO: 221424 - DNA, 26 bp, Artificial sequence
  SiRNA target sequence
atgacgcttatgttttcgcttatttc

SEQ ID NO: 221425 - DNA, 26 bp, Artificial sequence
  SiRNA target sequence
tgacgcttatgttttcgcttatttcc

SEQ ID NO: 221426 - DNA, 26 bp, Artificial sequence
  SiRNA target sequence
gacgcttatgttttcgcttatttcct

SEQ ID NO: 221427 - DNA, 26 bp, Artificial sequence
  SiRNA target sequence
acgcttatgttttcgcttatttcctt

SEQ ID NO: 221428 - DNA, 26 bp, Artificial sequence
  SiRNA target sequence
cgcttatgttttcgcttatttccttt

SEQ ID NO: 221429 - DNA, 26 bp, Artificial sequence
  SiRNA target sequence
gcttatgttttcgcttatttccttta

SEQ ID NO: 221430 - DNA, 26 bp, Artificial sequence
  SiRNA target sequence
cttatgttttcgcttatttcctttat

SEQ ID NO: 221431 - DNA, 26 bp, Artificial sequence
  SiRNA target sequence
ttatgttttcgcttatttcctttatt

SEQ ID NO: 221432 - DNA, 26 bp, Artificial sequence
  SiRNA target sequence
tatgttttcgcttatttcctttattt

SEQ ID NO: 221433 - DNA, 26 bp, Artificial sequence
  SiRNA target sequence
atgttttcgcttatttcctttattta

SEQ ID NO: 221434 - DNA, 26 bp, Artificial sequence
  SiRNA target sequence
tgttttcgcttatttcctttatttac

SEQ ID NO: 221435 - DNA, 26 bp, Artificial sequence
  SiRNA target sequence
gttttcgcttatttcctttatttact

SEQ ID NO: 221436 - DNA, 26 bp, Artificial sequence
  SiRNA target sequence
ttttcgcttatttcctttatttactc

SEQ ID NO: 221437 - DNA, 26 bp, Artificial sequence
  SiRNA target sequence
tttcgcttatttcctttatttactca

SEQ ID NO: 221438 - DNA, 26 bp, Artificial sequence
  SiRNA target sequence
ttcgcttatttcctttatttactcag

SEQ ID NO: 221439 - DNA, 26 bp, Artificial sequence
  SiRNA target sequence
tcgcttatttcctttatttactcagt

SEQ ID NO: 221440 - DNA, 26 bp, Artificial sequence
  SiRNA target sequence
cgcttatttcctttatttactcagta

SEQ ID NO: 221441 - DNA, 26 bp, Artificial sequence
  SiRNA target sequence
gcttatttcctttatttactcagtag

SEQ ID NO: 221442 - DNA, 26 bp, Artificial sequence
  SiRNA target sequence
cttatttcctttatttactcagtagg

SEQ ID NO: 221443 - DNA, 26 bp, Artificial sequence
  SiRNA target sequence
ttatttcctttatttactcagtagga

SEQ ID NO: 221444 - DNA, 26 bp, Artificial sequence
  SiRNA target sequence
tatttcctttatttactcagtaggac

SEQ ID NO: 221445 - DNA, 26 bp, Artificial sequence
  SiRNA target sequence
atttcctttatttactcagtaggacg

SEQ ID NO: 221446 - DNA, 26 bp, Artificial sequence
  SiRNA target sequence
tttcctttatttactcagtaggacga

SEQ ID NO: 221447 - DNA, 26 bp, Artificial sequence
  SiRNA target sequence
ttcctttatttactcagtaggacgag

SEQ ID NO: 221448 - DNA, 26 bp, Artificial sequence
  SiRNA target sequence
tcctttatttactcagtaggacgagt

SEQ ID NO: 221449 - DNA, 26 bp, Artificial sequence
  SiRNA target sequence
cctttatttactcagtaggacgagtg

SEQ ID NO: 221450 - DNA, 26 bp, Artificial sequence
  SiRNA target sequence
ctttatttactcagtaggacgagtgt

SEQ ID NO: 221451 - DNA, 26 bp, Artificial sequence
  SiRNA target sequence
tttatttactcagtaggacgagtgtt

SEQ ID NO: 221452 - DNA, 26 bp, Artificial sequence
  SiRNA target sequence
ttatttactcagtaggacgagtgtta

SEQ ID NO: 221453 - DNA, 26 bp, Artificial sequence
  SiRNA target sequence
tatttactcagtaggacgagtgttaa

SEQ ID NO: 221454 - DNA, 26 bp, Artificial sequence
  SiRNA target sequence
atttactcagtaggacgagtgttaaa

SEQ ID NO: 221455 - DNA, 26 bp, Artificial sequence
  SiRNA target sequence
tttactcagtaggacgagtgttaaaa

SEQ ID NO: 221456 - DNA, 26 bp, Artificial sequence
  SiRNA target sequence
ttactcagtaggacgagtgttaaaag

SEQ ID NO: 221457 - DNA, 26 bp, Artificial sequence
  SiRNA target sequence
tactcagtaggacgagtgttaaaaga

SEQ ID NO: 221458 - DNA, 26 bp, Artificial sequence
  SiRNA target sequence
actcagtaggacgagtgttaaaagat

SEQ ID NO: 221459 - DNA, 26 bp, Artificial sequence
  SiRNA target sequence
ctcagtaggacgagtgttaaaagatg

SEQ ID NO: 221460 - DNA, 26 bp, Artificial sequence
  SiRNA target sequence
tcagtaggacgagtgttaaaagatgc

SEQ ID NO: 221461 - DNA, 26 bp, Artificial sequence
  SiRNA target sequence
cagtaggacgagtgttaaaagatgca

SEQ ID NO: 221462 - DNA, 26 bp, Artificial sequence
  SiRNA target sequence
agtaggacgagtgttaaaagatgcag

SEQ ID NO: 221463 - DNA, 26 bp, Artificial sequence
  SiRNA target sequence
gtaggacgagtgttaaaagatgcagc

SEQ ID NO: 221464 - DNA, 26 bp, Artificial sequence
  SiRNA target sequence
taggacgagtgttaaaagatgcagca

SEQ ID NO: 221465 - DNA, 26 bp, Artificial sequence
  SiRNA target sequence
aggacgagtgttaaaagatgcagcag

SEQ ID NO: 221466 - DNA, 26 bp, Artificial sequence
  SiRNA target sequence
ggacgagtgttaaaagatgcagcagt

SEQ ID NO: 221467 - DNA, 26 bp, Artificial sequence
  SiRNA target sequence
gacgagtgttaaaagatgcagcagtt

SEQ ID NO: 221468 - DNA, 26 bp, Artificial sequence
  SiRNA target sequence
acgagtgttaaaagatgcagcagttc

SEQ ID NO: 221469 - DNA, 26 bp, Artificial sequence
  SiRNA target sequence
cgagtgttaaaagatgcagcagttct

SEQ ID NO: 221470 - DNA, 26 bp, Artificial sequence
  SiRNA target sequence
gagtgttaaaagatgcagcagttctt

SEQ ID NO: 221471 - DNA, 26 bp, Artificial sequence
  SiRNA target sequence
agtgttaaaagatgcagcagttctta

SEQ ID NO: 221472 - DNA, 26 bp, Artificial sequence
  SiRNA target sequence
gtgttaaaagatgcagcagttcttag

SEQ ID NO: 221473 - DNA, 26 bp, Artificial sequence
  SiRNA target sequence
tgttaaaagatgcagcagttcttagt

SEQ ID NO: 221474 - DNA, 26 bp, Artificial sequence
  SiRNA target sequence
gttaaaagatgcagcagttcttagta

SEQ ID NO: 221475 - DNA, 26 bp, Artificial sequence
  SiRNA target sequence
ttaaaagatgcagcagttcttagtag

SEQ ID NO: 221476 - DNA, 26 bp, Artificial sequence
  SiRNA target sequence
taaaagatgcagcagttcttagtaga

SEQ ID NO: 221477 - DNA, 26 bp, Artificial sequence
  SiRNA target sequence
aaaagatgcagcagttcttagtagac

SEQ ID NO: 221478 - DNA, 26 bp, Artificial sequence
  SiRNA target sequence
aaagatgcagcagttcttagtagaca

SEQ ID NO: 221479 - DNA, 26 bp, Artificial sequence
  SiRNA target sequence
aagatgcagcagttcttagtagacag

SEQ ID NO: 221480 - DNA, 26 bp, Artificial sequence
  SiRNA target sequence
agatgcagcagttcttagtagacaga

SEQ ID NO: 221481 - DNA, 26 bp, Artificial sequence
  SiRNA target sequence
gatgcagcagttcttagtagacagat

SEQ ID NO: 221482 - DNA, 26 bp, Artificial sequence
  SiRNA target sequence
atgcagcagttcttagtagacagatg

SEQ ID NO: 221483 - DNA, 26 bp, Artificial sequence
  SiRNA target sequence
tgcagcagttcttagtagacagatgc

SEQ ID NO: 221484 - DNA, 26 bp, Artificial sequence
  SiRNA target sequence
gcagcagttcttagtagacagatgcc

SEQ ID NO: 221485 - DNA, 26 bp, Artificial sequence
  SiRNA target sequence
cagcagttcttagtagacagatgcca

SEQ ID NO: 221486 - DNA, 26 bp, Artificial sequence
  SiRNA target sequence
agcagttcttagtagacagatgccac

SEQ ID NO: 221487 - DNA, 26 bp, Artificial sequence
  SiRNA target sequence
gcagttcttagtagacagatgccact

SEQ ID NO: 221488 - DNA, 26 bp, Artificial sequence
  SiRNA target sequence
cagttcttagtagacagatgccacta

SEQ ID NO: 221489 - DNA, 26 bp, Artificial sequence
  SiRNA target sequence
agttcttagtagacagatgccactat

SEQ ID NO: 221490 - DNA, 26 bp, Artificial sequence
  SiRNA target sequence
gttcttagtagacagatgccactatc

SEQ ID NO: 221491 - DNA, 26 bp, Artificial sequence
  SiRNA target sequence
ttcttagtagacagatgccactatcc

SEQ ID NO: 221492 - DNA, 26 bp, Artificial sequence
  SiRNA target sequence
tcttagtagacagatgccactatcca

SEQ ID NO: 221493 - DNA, 26 bp, Artificial sequence
  SiRNA target sequence
cttagtagacagatgccactatccat

SEQ ID NO: 221494 - DNA, 26 bp, Artificial sequence
  SiRNA target sequence
ttagtagacagatgccactatccatt

SEQ ID NO: 221495 - DNA, 26 bp, Artificial sequence
  SiRNA target sequence
tagtagacagatgccactatccatta

SEQ ID NO: 221496 - DNA, 26 bp, Artificial sequence
  SiRNA target sequence
agtagacagatgccactatccattaa

SEQ ID NO: 221497 - DNA, 26 bp, Artificial sequence
  SiRNA target sequence
gtagacagatgccactatccattaat

SEQ ID NO: 221498 - DNA, 26 bp, Artificial sequence
  SiRNA target sequence
tagacagatgccactatccattaatt

SEQ ID NO: 221499 - DNA, 26 bp, Artificial sequence
  SiRNA target sequence
agacagatgccactatccattaattg

SEQ ID NO: 221500 - DNA, 26 bp, Artificial sequence
  SiRNA target sequence
gacagatgccactatccattaattgt

SEQ ID NO: 221501 - DNA, 26 bp, Artificial sequence
  SiRNA target sequence
acagatgccactatccattaattgtc

SEQ ID NO: 221502 - DNA, 26 bp, Artificial sequence
  SiRNA target sequence
cagatgccactatccattaattgtct

SEQ ID NO: 221503 - DNA, 26 bp, Artificial sequence
  SiRNA target sequence
agatgccactatccattaattgtctt

SEQ ID NO: 221504 - DNA, 26 bp, Artificial sequence
  SiRNA target sequence
gatgccactatccattaattgtctta

SEQ ID NO: 221505 - DNA, 26 bp, Artificial sequence
  SiRNA target sequence
atgccactatccattaattgtcttaa

SEQ ID NO: 221506 - DNA, 26 bp, Artificial sequence
  SiRNA target sequence
tgccactatccattaattgtcttaaa

SEQ ID NO: 221507 - DNA, 26 bp, Artificial sequence
  SiRNA target sequence
gccactatccattaattgtcttaaaa

SEQ ID NO: 221508 - DNA, 26 bp, Artificial sequence
  SiRNA target sequence
ccactatccattaattgtcttaaaag

SEQ ID NO: 221509 - DNA, 26 bp, Artificial sequence
  SiRNA target sequence
cactatccattaattgtcttaaaagc

SEQ ID NO: 221510 - DNA, 26 bp, Artificial sequence
  SiRNA target sequence
actatccattaattgtcttaaaagct

SEQ ID NO: 221511 - DNA, 26 bp, Artificial sequence
  SiRNA target sequence
ctatccattaattgtcttaaaagctt

SEQ ID NO: 221512 - DNA, 26 bp, Artificial sequence
  SiRNA target sequence
tatccattaattgtcttaaaagcttt

SEQ ID NO: 221513 - DNA, 26 bp, Artificial sequence
  SiRNA target sequence
atccattaattgtcttaaaagctttg

SEQ ID NO: 221514 - DNA, 26 bp, Artificial sequence
  SiRNA target sequence
tccattaattgtcttaaaagctttgt

SEQ ID NO: 221515 - DNA, 26 bp, Artificial sequence
  SiRNA target sequence
ccattaattgtcttaaaagctttgta

SEQ ID NO: 221516 - DNA, 26 bp, Artificial sequence
  SiRNA target sequence
cattaattgtcttaaaagctttgtaa

SEQ ID NO: 221517 - DNA, 26 bp, Artificial sequence
  SiRNA target sequence
attaattgtcttaaaagctttgtaat

SEQ ID NO: 221518 - DNA, 26 bp, Artificial sequence
  SiRNA target sequence
ttaattgtcttaaaagctttgtaatt

SEQ ID NO: 221519 - DNA, 26 bp, Artificial sequence
  SiRNA target sequence
taattgtcttaaaagctttgtaattt

SEQ ID NO: 221520 - DNA, 26 bp, Artificial sequence
  SiRNA target sequence
aattgtcttaaaagctttgtaatttt

SEQ ID NO: 221521 - DNA, 26 bp, Artificial sequence
  SiRNA target sequence
attgtcttaaaagctttgtaatttta

SEQ ID NO: 221522 - DNA, 26 bp, Artificial sequence
  SiRNA target sequence
ttgtcttaaaagctttgtaattttac

SEQ ID NO: 221523 - DNA, 26 bp, Artificial sequence
  SiRNA target sequence
tgtcttaaaagctttgtaattttacc

SEQ ID NO: 221524 - DNA, 26 bp, Artificial sequence
  SiRNA target sequence
gtcttaaaagctttgtaattttacca

SEQ ID NO: 221525 - DNA, 26 bp, Artificial sequence
  SiRNA target sequence
tcttaaaagctttgtaattttaccag

SEQ ID NO: 221526 - DNA, 26 bp, Artificial sequence
  SiRNA target sequence
cttaaaagctttgtaattttaccagt

SEQ ID NO: 221527 - DNA, 26 bp, Artificial sequence
  SiRNA target sequence
ttaaaagctttgtaattttaccagtt

SEQ ID NO: 221528 - DNA, 26 bp, Artificial sequence
  SiRNA target sequence
taaaagctttgtaattttaccagtta

SEQ ID NO: 221529 - DNA, 26 bp, Artificial sequence
  SiRNA target sequence
aaaagctttgtaattttaccagttac

SEQ ID NO: 221530 - DNA, 26 bp, Artificial sequence
  SiRNA target sequence
aaagctttgtaattttaccagttact

SEQ ID NO: 221531 - DNA, 26 bp, Artificial sequence
  SiRNA target sequence
aagctttgtaattttaccagttactc

SEQ ID NO: 221532 - DNA, 26 bp, Artificial sequence
  SiRNA target sequence
agctttgtaattttaccagttactct

SEQ ID NO: 221533 - DNA, 26 bp, Artificial sequence
  SiRNA target sequence
gctttgtaattttaccagttactctt

SEQ ID NO: 221534 - DNA, 26 bp, Artificial sequence
  SiRNA target sequence
ctttgtaattttaccagttactcttg

SEQ ID NO: 221535 - DNA, 26 bp, Artificial sequence
  SiRNA target sequence
tttgtaattttaccagttactcttgt

SEQ ID NO: 221536 - DNA, 26 bp, Artificial sequence
  SiRNA target sequence
ttgtaattttaccagttactcttgtt

SEQ ID NO: 221537 - DNA, 26 bp, Artificial sequence
  SiRNA target sequence
tgtaattttaccagttactcttgttt

SEQ ID NO: 221538 - DNA, 26 bp, Artificial sequence
  SiRNA target sequence
gtaattttaccagttactcttgtttg

SEQ ID NO: 221539 - DNA, 26 bp, Artificial sequence
  SiRNA target sequence
taattttaccagttactcttgtttgt

SEQ ID NO: 221540 - DNA, 26 bp, Artificial sequence
  SiRNA target sequence
aattttaccagttactcttgtttgtg

SEQ ID NO: 221541 - DNA, 26 bp, Artificial sequence
  SiRNA target sequence
attttaccagttactcttgtttgtgt

SEQ ID NO: 221542 - DNA, 26 bp, Artificial sequence
  SiRNA target sequence
ttttaccagttactcttgtttgtgta

SEQ ID NO: 221543 - DNA, 26 bp, Artificial sequence
  SiRNA target sequence
tttaccagttactcttgtttgtgtag

SEQ ID NO: 221544 - DNA, 26 bp, Artificial sequence
  SiRNA target sequence
ttaccagttactcttgtttgtgtagg

SEQ ID NO: 221545 - DNA, 26 bp, Artificial sequence
  SiRNA target sequence
taccagttactcttgtttgtgtagga

SEQ ID NO: 221546 - DNA, 26 bp, Artificial sequence
  SiRNA target sequence
accagttactcttgtttgtgtaggat

SEQ ID NO: 221547 - DNA, 26 bp, Artificial sequence
  SiRNA target sequence
ccagttactcttgtttgtgtaggatt

SEQ ID NO: 221548 - DNA, 26 bp, Artificial sequence
  SiRNA target sequence
cagttactcttgtttgtgtaggatta

SEQ ID NO: 221549 - DNA, 26 bp, Artificial sequence
  SiRNA target sequence
agttactcttgtttgtgtaggattaa

SEQ ID NO: 221550 - DNA, 26 bp, Artificial sequence
  SiRNA target sequence
gttactcttgtttgtgtaggattaat

SEQ ID NO: 221551 - DNA, 26 bp, Artificial sequence
  SiRNA target sequence
ttactcttgtttgtgtaggattaatt

SEQ ID NO: 221552 - DNA, 26 bp, Artificial sequence
  SiRNA target sequence
tactcttgtttgtgtaggattaattc

SEQ ID NO: 221553 - DNA, 26 bp, Artificial sequence
  SiRNA target sequence
actcttgtttgtgtaggattaattca

SEQ ID NO: 221554 - DNA, 26 bp, Artificial sequence
  SiRNA target sequence
ctcttgtttgtgtaggattaattcag

SEQ ID NO: 221555 - DNA, 26 bp, Artificial sequence
  SiRNA target sequence
tcttgtttgtgtaggattaattcaga

SEQ ID NO: 221556 - DNA, 26 bp, Artificial sequence
  SiRNA target sequence
cttgtttgtgtaggattaattcagaa

SEQ ID NO: 221557 - DNA, 26 bp, Artificial sequence
  SiRNA target sequence
ttgtttgtgtaggattaattcagaag

SEQ ID NO: 221558 - DNA, 26 bp, Artificial sequence
  SiRNA target sequence
tgtttgtgtaggattaattcagaagt

SEQ ID NO: 221559 - DNA, 26 bp, Artificial sequence
  SiRNA target sequence
gtttgtgtaggattaattcagaagtc

SEQ ID NO: 221560 - DNA, 26 bp, Artificial sequence
  SiRNA target sequence
tttgtgtaggattaattcagaagtct

SEQ ID NO: 221561 - DNA, 26 bp, Artificial sequence
  SiRNA target sequence
ttgtgtaggattaattcagaagtcta

SEQ ID NO: 221562 - DNA, 26 bp, Artificial sequence
  SiRNA target sequence
tgtgtaggattaattcagaagtctac

SEQ ID NO: 221563 - DNA, 26 bp, Artificial sequence
  SiRNA target sequence
gtgtaggattaattcagaagtctaca

SEQ ID NO: 221564 - DNA, 26 bp, Artificial sequence
  SiRNA target sequence
tgtaggattaattcagaagtctacac

SEQ ID NO: 221565 - DNA, 26 bp, Artificial sequence
  SiRNA target sequence
gtaggattaattcagaagtctacact

SEQ ID NO: 221566 - DNA, 26 bp, Artificial sequence
  SiRNA target sequence
taggattaattcagaagtctacactc

SEQ ID NO: 221567 - DNA, 26 bp, Artificial sequence
  SiRNA target sequence
aggattaattcagaagtctacactct

SEQ ID NO: 221568 - DNA, 26 bp, Artificial sequence
  SiRNA target sequence
ggattaattcagaagtctacactctc

SEQ ID NO: 221569 - DNA, 26 bp, Artificial sequence
  SiRNA target sequence
gattaattcagaagtctacactctct

SEQ ID NO: 221570 - DNA, 26 bp, Artificial sequence
  SiRNA target sequence
attaattcagaagtctacactctctt

SEQ ID NO: 221571 - DNA, 26 bp, Artificial sequence
  SiRNA target sequence
ttaattcagaagtctacactctctta

SEQ ID NO: 221572 - DNA, 26 bp, Artificial sequence
  SiRNA target sequence
taattcagaagtctacactctcttat

SEQ ID NO: 221573 - DNA, 26 bp, Artificial sequence
  SiRNA target sequence
aattcagaagtctacactctcttatt

SEQ ID NO: 221574 - DNA, 26 bp, Artificial sequence
  SiRNA target sequence
attcagaagtctacactctcttattc

SEQ ID NO: 221575 - DNA, 26 bp, Artificial sequence
  SiRNA target sequence
ttcagaagtctacactctcttattct

SEQ ID NO: 221576 - DNA, 26 bp, Artificial sequence
  SiRNA target sequence
tcagaagtctacactctcttattctt

SEQ ID NO: 221577 - DNA, 26 bp, Artificial sequence
  SiRNA target sequence
cagaagtctacactctcttattcttt

SEQ ID NO: 221578 - DNA, 26 bp, Artificial sequence
  SiRNA target sequence
agaagtctacactctcttattctttt

SEQ ID NO: 221579 - DNA, 26 bp, Artificial sequence
  SiRNA target sequence
gaagtctacactctcttattctttta

SEQ ID NO: 221580 - DNA, 26 bp, Artificial sequence
  SiRNA target sequence
aagtctacactctcttattcttttac

SEQ ID NO: 221581 - DNA, 26 bp, Artificial sequence
  SiRNA target sequence
agtctacactctcttattcttttaca

SEQ ID NO: 221582 - DNA, 26 bp, Artificial sequence
  SiRNA target sequence
gtctacactctcttattcttttacaa

SEQ ID NO: 221583 - DNA, 26 bp, Artificial sequence
  SiRNA target sequence
tctacactctcttattcttttacaaa

SEQ ID NO: 221584 - DNA, 26 bp, Artificial sequence
  SiRNA target sequence
ctacactctcttattcttttacaaaa

SEQ ID NO: 221585 - DNA, 26 bp, Artificial sequence
  SiRNA target sequence
tacactctcttattcttttacaaaaa

SEQ ID NO: 221586 - DNA, 26 bp, Artificial sequence
  SiRNA target sequence
acactctcttattcttttacaaaaat

SEQ ID NO: 221587 - DNA, 26 bp, Artificial sequence
  SiRNA target sequence
cactctcttattcttttacaaaaata

SEQ ID NO: 221588 - DNA, 26 bp, Artificial sequence
  SiRNA target sequence
actctcttattcttttacaaaaatat

SEQ ID NO: 221589 - DNA, 26 bp, Artificial sequence
  SiRNA target sequence
ctctcttattcttttacaaaaatatt

SEQ ID NO: 221590 - DNA, 26 bp, Artificial sequence
  SiRNA target sequence
tctcttattcttttacaaaaatattt

SEQ ID NO: 221591 - DNA, 26 bp, Artificial sequence
  SiRNA target sequence
ctcttattcttttacaaaaatatttg

SEQ ID NO: 221592 - DNA, 26 bp, Artificial sequence
  SiRNA target sequence
tcttattcttttacaaaaatatttga

SEQ ID NO: 221593 - DNA, 26 bp, Artificial sequence
  SiRNA target sequence
cttattcttttacaaaaatatttgat

SEQ ID NO: 221594 - DNA, 26 bp, Artificial sequence
  SiRNA target sequence
ttattcttttacaaaaatatttgatg

SEQ ID NO: 221595 - DNA, 26 bp, Artificial sequence
  SiRNA target sequence
tattcttttacaaaaatatttgatgg

SEQ ID NO: 221596 - DNA, 26 bp, Artificial sequence
  SiRNA target sequence
attcttttacaaaaatatttgatggt

SEQ ID NO: 221597 - DNA, 26 bp, Artificial sequence
  SiRNA target sequence
ttcttttacaaaaatatttgatggtg

SEQ ID NO: 221598 - DNA, 26 bp, Artificial sequence
  SiRNA target sequence
tcttttacaaaaatatttgatggtgc

SEQ ID NO: 221599 - DNA, 26 bp, Artificial sequence
  SiRNA target sequence
cttttacaaaaatatttgatggtgca

SEQ ID NO: 221600 - DNA, 26 bp, Artificial sequence
  SiRNA target sequence
ttttacaaaaatatttgatggtgcat

SEQ ID NO: 221601 - DNA, 26 bp, Artificial sequence
  SiRNA target sequence
tttacaaaaatatttgatggtgcatt

SEQ ID NO: 221602 - DNA, 26 bp, Artificial sequence
  SiRNA target sequence
ttacaaaaatatttgatggtgcattg

SEQ ID NO: 221603 - DNA, 26 bp, Artificial sequence
  SiRNA target sequence
tacaaaaatatttgatggtgcattgt

SEQ ID NO: 221604 - DNA, 26 bp, Artificial sequence
  SiRNA target sequence
acaaaaatatttgatggtgcattgtt

SEQ ID NO: 221605 - DNA, 26 bp, Artificial sequence
  SiRNA target sequence
caaaaatatttgatggtgcattgtta

SEQ ID NO: 221606 - DNA, 26 bp, Artificial sequence
  SiRNA target sequence
aaaaatatttgatggtgcattgttaa

SEQ ID NO: 221607 - DNA, 26 bp, Artificial sequence
  SiRNA target sequence
aaaatatttgatggtgcattgttaat

SEQ ID NO: 221608 - DNA, 26 bp, Artificial sequence
  SiRNA target sequence
aaatatttgatggtgcattgttaata

SEQ ID NO: 221609 - DNA, 26 bp, Artificial sequence
  SiRNA target sequence
aatatttgatggtgcattgttaatat

SEQ ID NO: 221610 - DNA, 26 bp, Artificial sequence
  SiRNA target sequence
atatttgatggtgcattgttaatatt

SEQ ID NO: 221611 - DNA, 26 bp, Artificial sequence
  SiRNA target sequence
tatttgatggtgcattgttaatattt

SEQ ID NO: 221612 - DNA, 26 bp, Artificial sequence
  SiRNA target sequence
atttgatggtgcattgttaatatttg

SEQ ID NO: 221613 - DNA, 26 bp, Artificial sequence
  SiRNA target sequence
tttgatggtgcattgttaatatttgc

SEQ ID NO: 221614 - DNA, 26 bp, Artificial sequence
  SiRNA target sequence
ttgatggtgcattgttaatatttgct

SEQ ID NO: 221615 - DNA, 26 bp, Artificial sequence
  SiRNA target sequence
tgatggtgcattgttaatatttgctt

SEQ ID NO: 221616 - DNA, 26 bp, Artificial sequence
  SiRNA target sequence
gatggtgcattgttaatatttgcttt

SEQ ID NO: 221617 - DNA, 26 bp, Artificial sequence
  SiRNA target sequence
atggtgcattgttaatatttgctttt

SEQ ID NO: 221618 - DNA, 26 bp, Artificial sequence
  SiRNA target sequence
tggtgcattgttaatatttgcttttc

SEQ ID NO: 221619 - DNA, 26 bp, Artificial sequence
  SiRNA target sequence
ggtgcattgttaatatttgcttttct

SEQ ID NO: 221620 - DNA, 26 bp, Artificial sequence
  SiRNA target sequence
gtgcattgttaatatttgcttttctt

SEQ ID NO: 221621 - DNA, 26 bp, Artificial sequence
  SiRNA target sequence
tgcattgttaatatttgcttttcttt

SEQ ID NO: 221622 - DNA, 26 bp, Artificial sequence
  SiRNA target sequence
gcattgttaatatttgcttttcttta

SEQ ID NO: 221623 - DNA, 26 bp, Artificial sequence
  SiRNA target sequence
cattgttaatatttgcttttctttat

SEQ ID NO: 221624 - DNA, 26 bp, Artificial sequence
  SiRNA target sequence
attgttaatatttgcttttctttata

SEQ ID NO: 221625 - DNA, 26 bp, Artificial sequence
  SiRNA target sequence
ttgttaatatttgcttttctttatat

SEQ ID NO: 221626 - DNA, 26 bp, Artificial sequence
  SiRNA target sequence
tgttaatatttgcttttctttatatc

SEQ ID NO: 221627 - DNA, 26 bp, Artificial sequence
  SiRNA target sequence
gttaatatttgcttttctttatatca

SEQ ID NO: 221628 - DNA, 26 bp, Artificial sequence
  SiRNA target sequence
ttaatatttgcttttctttatatcat

SEQ ID NO: 221629 - DNA, 26 bp, Artificial sequence
  SiRNA target sequence
taatatttgcttttctttatatcatt

SEQ ID NO: 221630 - DNA, 26 bp, Artificial sequence
  SiRNA target sequence
aatatttgcttttctttatatcattc

SEQ ID NO: 221631 - DNA, 26 bp, Artificial sequence
  SiRNA target sequence
atatttgcttttctttatatcattct

SEQ ID NO: 221632 - DNA, 26 bp, Artificial sequence
  SiRNA target sequence
tatttgcttttctttatatcattctt

SEQ ID NO: 221633 - DNA, 26 bp, Artificial sequence
  SiRNA target sequence
atttgcttttctttatatcattcttg

SEQ ID NO: 221634 - DNA, 26 bp, Artificial sequence
  SiRNA target sequence
tttgcttttctttatatcattcttgg

SEQ ID NO: 221635 - DNA, 26 bp, Artificial sequence
  SiRNA target sequence
ttgcttttctttatatcattcttggt

SEQ ID NO: 221636 - DNA, 26 bp, Artificial sequence
  SiRNA target sequence
tgcttttctttatatcattcttggtc

SEQ ID NO: 221637 - DNA, 26 bp, Artificial sequence
  SiRNA target sequence
gcttttctttatatcattcttggtct

SEQ ID NO: 221638 - DNA, 26 bp, Artificial sequence
  SiRNA target sequence
cttttctttatatcattcttggtcta

SEQ ID NO: 221639 - DNA, 26 bp, Artificial sequence
  SiRNA target sequence
ttttctttatatcattcttggtctag

SEQ ID NO: 221640 - DNA, 26 bp, Artificial sequence
  SiRNA target sequence
tttctttatatcattcttggtctagt

SEQ ID NO: 221641 - DNA, 26 bp, Artificial sequence
  SiRNA target sequence
ttctttatatcattcttggtctagtt

SEQ ID NO: 221642 - DNA, 26 bp, Artificial sequence
  SiRNA target sequence
tctttatatcattcttggtctagttc

SEQ ID NO: 221643 - DNA, 26 bp, Artificial sequence
  SiRNA target sequence
ctttatatcattcttggtctagttct

SEQ ID NO: 221644 - DNA, 26 bp, Artificial sequence
  SiRNA target sequence
tttatatcattcttggtctagttctt

SEQ ID NO: 221645 - DNA, 26 bp, Artificial sequence
  SiRNA target sequence
ttatatcattcttggtctagttcttc

SEQ ID NO: 221646 - DNA, 26 bp, Artificial sequence
  SiRNA target sequence
tatatcattcttggtctagttcttct

SEQ ID NO: 221647 - DNA, 26 bp, Artificial sequence
  SiRNA target sequence
atatcattcttggtctagttcttctt

SEQ ID NO: 221648 - DNA, 26 bp, Artificial sequence
  SiRNA target sequence
tatcattcttggtctagttcttcttc

SEQ ID NO: 221649 - DNA, 26 bp, Artificial sequence
  SiRNA target sequence
atcattcttggtctagttcttcttcc

SEQ ID NO: 221650 - DNA, 26 bp, Artificial sequence
  SiRNA target sequence
tcattcttggtctagttcttcttcca

SEQ ID NO: 221651 - DNA, 26 bp, Artificial sequence
  SiRNA target sequence
cattcttggtctagttcttcttccat

SEQ ID NO: 221652 - DNA, 26 bp, Artificial sequence
  SiRNA target sequence
attcttggtctagttcttcttccata

SEQ ID NO: 221653 - DNA, 26 bp, Artificial sequence
  SiRNA target sequence
ttcttggtctagttcttcttccatat

SEQ ID NO: 221654 - DNA, 26 bp, Artificial sequence
  SiRNA target sequence
tcttggtctagttcttcttccatatt

SEQ ID NO: 221655 - DNA, 26 bp, Artificial sequence
  SiRNA target sequence
cttggtctagttcttcttccatattc

SEQ ID NO: 221656 - DNA, 26 bp, Artificial sequence
  SiRNA target sequence
ttggtctagttcttcttccatattct

SEQ ID NO: 221657 - DNA, 26 bp, Artificial sequence
  SiRNA target sequence
tggtctagttcttcttccatattctc

SEQ ID NO: 221658 - DNA, 26 bp, Artificial sequence
  SiRNA target sequence
ggtctagttcttcttccatattctca

SEQ ID NO: 221659 - DNA, 26 bp, Artificial sequence
  SiRNA target sequence
gtctagttcttcttccatattctcat

SEQ ID NO: 221660 - DNA, 26 bp, Artificial sequence
  SiRNA target sequence
tctagttcttcttccatattctcatc

SEQ ID NO: 221661 - DNA, 26 bp, Artificial sequence
  SiRNA target sequence
ctagttcttcttccatattctcatct

SEQ ID NO: 221662 - DNA, 26 bp, Artificial sequence
  SiRNA target sequence
tagttcttcttccatattctcatctt

SEQ ID NO: 221663 - DNA, 26 bp, Artificial sequence
  SiRNA target sequence
agttcttcttccatattctcatcttt

SEQ ID NO: 221664 - DNA, 26 bp, Artificial sequence
  SiRNA target sequence
gttcttcttccatattctcatctttt

SEQ ID NO: 221665 - DNA, 26 bp, Artificial sequence
  SiRNA target sequence
ttcttcttccatattctcatcttttc

SEQ ID NO: 221666 - DNA, 26 bp, Artificial sequence
  SiRNA target sequence
tcttcttccatattctcatcttttcc

SEQ ID NO: 221667 - DNA, 26 bp, Artificial sequence
  SiRNA target sequence
cttcttccatattctcatcttttcca

SEQ ID NO: 221668 - DNA, 26 bp, Artificial sequence
  SiRNA target sequence
ttcttccatattctcatcttttccag

SEQ ID NO: 221669 - DNA, 26 bp, Artificial sequence
  SiRNA target sequence
tcttccatattctcatcttttccagc

SEQ ID NO: 221670 - DNA, 26 bp, Artificial sequence
  SiRNA target sequence
cttccatattctcatcttttccagct

SEQ ID NO: 221671 - DNA, 26 bp, Artificial sequence
  SiRNA target sequence
ttccatattctcatcttttccagctt

SEQ ID NO: 221672 - DNA, 26 bp, Artificial sequence
  SiRNA target sequence
tccatattctcatcttttccagcttg

SEQ ID NO: 221673 - DNA, 26 bp, Artificial sequence
  SiRNA target sequence
ccatattctcatcttttccagcttga

SEQ ID NO: 221674 - DNA, 26 bp, Artificial sequence
  SiRNA target sequence
catattctcatcttttccagcttgat

SEQ ID NO: 221675 - DNA, 26 bp, Artificial sequence
  SiRNA target sequence
atattctcatcttttccagcttgata

SEQ ID NO: 221676 - DNA, 26 bp, Artificial sequence
  SiRNA target sequence
tattctcatcttttccagcttgatag

SEQ ID NO: 221677 - DNA, 26 bp, Artificial sequence
  SiRNA target sequence
attctcatcttttccagcttgatagt

SEQ ID NO: 221678 - DNA, 26 bp, Artificial sequence
  SiRNA target sequence
ttctcatcttttccagcttgatagtt

SEQ ID NO: 221679 - DNA, 26 bp, Artificial sequence
  SiRNA target sequence
tctcatcttttccagcttgatagtta

SEQ ID NO: 221680 - DNA, 26 bp, Artificial sequence
  SiRNA target sequence
ctcatcttttccagcttgatagttat

SEQ ID NO: 221681 - DNA, 26 bp, Artificial sequence
  SiRNA target sequence
tcatcttttccagcttgatagttatt

SEQ ID NO: 221682 - DNA, 26 bp, Artificial sequence
  SiRNA target sequence
catcttttccagcttgatagttattt

SEQ ID NO: 221683 - DNA, 26 bp, Artificial sequence
  SiRNA target sequence
atcttttccagcttgatagttatttt

SEQ ID NO: 221684 - DNA, 26 bp, Artificial sequence
  SiRNA target sequence
tcttttccagcttgatagttattttt

SEQ ID NO: 221685 - DNA, 26 bp, Artificial sequence
  SiRNA target sequence
cttttccagcttgatagttatttttt

SEQ ID NO: 221686 - DNA, 26 bp, Artificial sequence
  SiRNA target sequence
ttttccagcttgatagttattttttt

SEQ ID NO: 221687 - DNA, 26 bp, Artificial sequence
  SiRNA target sequence
tttccagcttgatagttattttttta

SEQ ID NO: 221688 - DNA, 26 bp, Artificial sequence
  SiRNA target sequence
ttccagcttgatagttatttttttag

SEQ ID NO: 221689 - DNA, 26 bp, Artificial sequence
  SiRNA target sequence
tccagcttgatagttatttttttaga

SEQ ID NO: 221690 - DNA, 26 bp, Artificial sequence
  SiRNA target sequence
ccagcttgatagttatttttttagag

SEQ ID NO: 221691 - DNA, 26 bp, Artificial sequence
  SiRNA target sequence
cagcttgatagttatttttttagaga

SEQ ID NO: 221692 - DNA, 26 bp, Artificial sequence
  SiRNA target sequence
agcttgatagttatttttttagagac

SEQ ID NO: 221693 - DNA, 26 bp, Artificial sequence
  SiRNA target sequence
gcttgatagttatttttttagagacc

SEQ ID NO: 221694 - DNA, 26 bp, Artificial sequence
  SiRNA target sequence
cttgatagttatttttttagagacct

SEQ ID NO: 221695 - DNA, 26 bp, Artificial sequence
  SiRNA target sequence
ttgatagttatttttttagagacctt

SEQ ID NO: 221696 - DNA, 26 bp, Artificial sequence
  SiRNA target sequence
tgatagttatttttttagagaccttt

SEQ ID NO: 221697 - DNA, 26 bp, Artificial sequence
  SiRNA target sequence
gatagttatttttttagagacctttt

SEQ ID NO: 221698 - DNA, 26 bp, Artificial sequence
  SiRNA target sequence
atagttatttttttagagaccttttt

SEQ ID NO: 221699 - DNA, 26 bp, Artificial sequence
  SiRNA target sequence
tagttatttttttagagaccttttta

SEQ ID NO: 221700 - DNA, 26 bp, Artificial sequence
  SiRNA target sequence
agttatttttttagagacctttttag

SEQ ID NO: 221701 - DNA, 26 bp, Artificial sequence
  SiRNA target sequence
gttatttttttagagacctttttagt

SEQ ID NO: 221702 - DNA, 26 bp, Artificial sequence
  SiRNA target sequence
ttatttttttagagacctttttagtg

SEQ ID NO: 221703 - DNA, 26 bp, Artificial sequence
  SiRNA target sequence
tatttttttagagacctttttagtga

SEQ ID NO: 221704 - DNA, 26 bp, Artificial sequence
  SiRNA target sequence
atttttttagagacctttttagtgat

SEQ ID NO: 221705 - DNA, 26 bp, Artificial sequence
  SiRNA target sequence
tttttttagagacctttttagtgatg

SEQ ID NO: 221706 - DNA, 26 bp, Artificial sequence
  SiRNA target sequence
ttttttagagacctttttagtgatgg

SEQ ID NO: 221707 - DNA, 26 bp, Artificial sequence
  SiRNA target sequence
tttttagagacctttttagtgatggg

SEQ ID NO: 221708 - DNA, 26 bp, Artificial sequence
  SiRNA target sequence
ttttagagacctttttagtgatggga

SEQ ID NO: 221709 - DNA, 26 bp, Artificial sequence
  SiRNA target sequence
tttagagacctttttagtgatgggaa

SEQ ID NO: 221710 - DNA, 26 bp, Artificial sequence
  SiRNA target sequence
ttagagacctttttagtgatgggaaa

SEQ ID NO: 221711 - DNA, 26 bp, Artificial sequence
  SiRNA target sequence
tagagacctttttagtgatgggaaat

SEQ ID NO: 221712 - DNA, 26 bp, Artificial sequence
  SiRNA target sequence
agagacctttttagtgatgggaaatg

SEQ ID NO: 221713 - DNA, 26 bp, Artificial sequence
  SiRNA target sequence
gagacctttttagtgatgggaaatgt

SEQ ID NO: 221714 - DNA, 26 bp, Artificial sequence
  SiRNA target sequence
agacctttttagtgatgggaaatgtg

SEQ ID NO: 221715 - DNA, 26 bp, Artificial sequence
  SiRNA target sequence
gacctttttagtgatgggaaatgtgt

SEQ ID NO: 221716 - DNA, 26 bp, Artificial sequence
  SiRNA target sequence
acctttttagtgatgggaaatgtgtt

SEQ ID NO: 221717 - DNA, 26 bp, Artificial sequence
  SiRNA target sequence
cctttttagtgatgggaaatgtgttg

SEQ ID NO: 221718 - DNA, 26 bp, Artificial sequence
  SiRNA target sequence
ctttttagtgatgggaaatgtgttgt

SEQ ID NO: 221719 - DNA, 26 bp, Artificial sequence
  SiRNA target sequence
tttttagtgatgggaaatgtgttgta

SEQ ID NO: 221720 - DNA, 26 bp, Artificial sequence
  SiRNA target sequence
ttttagtgatgggaaatgtgttgtaa

SEQ ID NO: 221721 - DNA, 26 bp, Artificial sequence
  SiRNA target sequence
tttagtgatgggaaatgtgttgtaag

SEQ ID NO: 221722 - DNA, 26 bp, Artificial sequence
  SiRNA target sequence
ttagtgatgggaaatgtgttgtaaga

SEQ ID NO: 221723 - DNA, 26 bp, Artificial sequence
  SiRNA target sequence
tagtgatgggaaatgtgttgtaagag

SEQ ID NO: 221724 - DNA, 26 bp, Artificial sequence
  SiRNA target sequence
agtgatgggaaatgtgttgtaagagg

SEQ ID NO: 221725 - DNA, 26 bp, Artificial sequence
  SiRNA target sequence
gtgatgggaaatgtgttgtaagaggc

SEQ ID NO: 221726 - DNA, 26 bp, Artificial sequence
  SiRNA target sequence
tgatgggaaatgtgttgtaagaggct

SEQ ID NO: 221727 - DNA, 26 bp, Artificial sequence
  SiRNA target sequence
gatgggaaatgtgttgtaagaggcta

SEQ ID NO: 221728 - DNA, 26 bp, Artificial sequence
  SiRNA target sequence
atgggaaatgtgttgtaagaggctat

SEQ ID NO: 221729 - DNA, 26 bp, Artificial sequence
  SiRNA target sequence
tgggaaatgtgttgtaagaggctatg

SEQ ID NO: 221730 - DNA, 26 bp, Artificial sequence
  SiRNA target sequence
gggaaatgtgttgtaagaggctatga

SEQ ID NO: 221731 - DNA, 26 bp, Artificial sequence
  SiRNA target sequence
ggaaatgtgttgtaagaggctatgat

SEQ ID NO: 221732 - DNA, 26 bp, Artificial sequence
  SiRNA target sequence
gaaatgtgttgtaagaggctatgatg

SEQ ID NO: 221733 - DNA, 26 bp, Artificial sequence
  SiRNA target sequence
aaatgtgttgtaagaggctatgatgc

SEQ ID NO: 221734 - DNA, 26 bp, Artificial sequence
  SiRNA target sequence
aatgtgttgtaagaggctatgatgct

SEQ ID NO: 221735 - DNA, 26 bp, Artificial sequence
  SiRNA target sequence
atgtgttgtaagaggctatgatgctt

SEQ ID NO: 221736 - DNA, 26 bp, Artificial sequence
  SiRNA target sequence
tgtgttgtaagaggctatgatgcttt

SEQ ID NO: 221737 - DNA, 26 bp, Artificial sequence
  SiRNA target sequence
gtgttgtaagaggctatgatgcttta

SEQ ID NO: 221738 - DNA, 26 bp, Artificial sequence
  SiRNA target sequence
tgttgtaagaggctatgatgctttat

SEQ ID NO: 221739 - DNA, 26 bp, Artificial sequence
  SiRNA target sequence
gttgtaagaggctatgatgctttatt

SEQ ID NO: 221740 - DNA, 26 bp, Artificial sequence
  SiRNA target sequence
ttgtaagaggctatgatgctttatta

SEQ ID NO: 221741 - DNA, 26 bp, Artificial sequence
  SiRNA target sequence
tgtaagaggctatgatgctttattat

SEQ ID NO: 221742 - DNA, 26 bp, Artificial sequence
  SiRNA target sequence
gtaagaggctatgatgctttattatc

SEQ ID NO: 221743 - DNA, 26 bp, Artificial sequence
  SiRNA target sequence
taagaggctatgatgctttattatct

SEQ ID NO: 221744 - DNA, 26 bp, Artificial sequence
  SiRNA target sequence
aagaggctatgatgctttattatctt

SEQ ID NO: 221745 - DNA, 26 bp, Artificial sequence
  SiRNA target sequence
agaggctatgatgctttattatcttt

SEQ ID NO: 221746 - DNA, 26 bp, Artificial sequence
  SiRNA target sequence
gaggctatgatgctttattatctttg

SEQ ID NO: 221747 - DNA, 26 bp, Artificial sequence
  SiRNA target sequence
aggctatgatgctttattatctttgg

SEQ ID NO: 221748 - DNA, 26 bp, Artificial sequence
  SiRNA target sequence
ggctatgatgctttattatctttggc

SEQ ID NO: 221749 - DNA, 26 bp, Artificial sequence
  SiRNA target sequence
gctatgatgctttattatctttggca

SEQ ID NO: 221750 - DNA, 26 bp, Artificial sequence
  SiRNA target sequence
ctatgatgctttattatctttggcac

SEQ ID NO: 221751 - DNA, 26 bp, Artificial sequence
  SiRNA target sequence
tatgatgctttattatctttggcact

SEQ ID NO: 221752 - DNA, 26 bp, Artificial sequence
  SiRNA target sequence
atgatgctttattatctttggcactg

SEQ ID NO: 221753 - DNA, 26 bp, Artificial sequence
  SiRNA target sequence
tgatgctttattatctttggcactgg

SEQ ID NO: 221754 - DNA, 26 bp, Artificial sequence
  SiRNA target sequence
gatgctttattatctttggcactggt

SEQ ID NO: 221755 - DNA, 26 bp, Artificial sequence
  SiRNA target sequence
atgctttattatctttggcactggtc

SEQ ID NO: 221756 - DNA, 26 bp, Artificial sequence
  SiRNA target sequence
tgctttattatctttggcactggtct

SEQ ID NO: 221757 - DNA, 26 bp, Artificial sequence
  SiRNA target sequence
gctttattatctttggcactggtctt

SEQ ID NO: 221758 - DNA, 26 bp, Artificial sequence
  SiRNA target sequence
ctttattatctttggcactggtcttt

SEQ ID NO: 221759 - DNA, 26 bp, Artificial sequence
  SiRNA target sequence
tttattatctttggcactggtcttta

SEQ ID NO: 221760 - DNA, 26 bp, Artificial sequence
  SiRNA target sequence
ttattatctttggcactggtctttaa

SEQ ID NO: 221761 - DNA, 26 bp, Artificial sequence
  SiRNA target sequence
tattatctttggcactggtctttaac

SEQ ID NO: 221762 - DNA, 26 bp, Artificial sequence
  SiRNA target sequence
attatctttggcactggtctttaacg

SEQ ID NO: 221763 - DNA, 26 bp, Artificial sequence
  SiRNA target sequence
ttatctttggcactggtctttaacga

SEQ ID NO: 221764 - DNA, 26 bp, Artificial sequence
  SiRNA target sequence
tatctttggcactggtctttaacgaa

SEQ ID NO: 221765 - DNA, 26 bp, Artificial sequence
  SiRNA target sequence
atctttggcactggtctttaacgaat

SEQ ID NO: 221766 - DNA, 26 bp, Artificial sequence
  SiRNA target sequence
tctttggcactggtctttaacgaatg

SEQ ID NO: 221767 - DNA, 26 bp, Artificial sequence
  SiRNA target sequence
ctttggcactggtctttaacgaatgg

SEQ ID NO: 221768 - DNA, 26 bp, Artificial sequence
  SiRNA target sequence
tttggcactggtctttaacgaatgga

SEQ ID NO: 221769 - DNA, 26 bp, Artificial sequence
  SiRNA target sequence
ttggcactggtctttaacgaatggac

SEQ ID NO: 221770 - DNA, 26 bp, Artificial sequence
  SiRNA target sequence
tggcactggtctttaacgaatggaca

SEQ ID NO: 221771 - DNA, 26 bp, Artificial sequence
  SiRNA target sequence
ggcactggtctttaacgaatggacat

SEQ ID NO: 221772 - DNA, 26 bp, Artificial sequence
  SiRNA target sequence
gcactggtctttaacgaatggacatc

SEQ ID NO: 221773 - DNA, 26 bp, Artificial sequence
  SiRNA target sequence
cactggtctttaacgaatggacatcc

SEQ ID NO: 221774 - DNA, 26 bp, Artificial sequence
  SiRNA target sequence
actggtctttaacgaatggacatcct

SEQ ID NO: 221775 - DNA, 26 bp, Artificial sequence
  SiRNA target sequence
ctggtctttaacgaatggacatcctc

SEQ ID NO: 221776 - DNA, 26 bp, Artificial sequence
  SiRNA target sequence
tggtctttaacgaatggacatcctct

SEQ ID NO: 221777 - DNA, 26 bp, Artificial sequence
  SiRNA target sequence
ggtctttaacgaatggacatcctctc

SEQ ID NO: 221778 - DNA, 26 bp, Artificial sequence
  SiRNA target sequence
gtctttaacgaatggacatcctctct

SEQ ID NO: 221779 - DNA, 26 bp, Artificial sequence
  SiRNA target sequence
tctttaacgaatggacatcctctcta

SEQ ID NO: 221780 - DNA, 26 bp, Artificial sequence
  SiRNA target sequence
ctttaacgaatggacatcctctctag

SEQ ID NO: 221781 - DNA, 26 bp, Artificial sequence
  SiRNA target sequence
tttaacgaatggacatcctctctagt

SEQ ID NO: 221782 - DNA, 26 bp, Artificial sequence
  SiRNA target sequence
ttaacgaatggacatcctctctagtt

SEQ ID NO: 221783 - DNA, 26 bp, Artificial sequence
  SiRNA target sequence
taacgaatggacatcctctctagttt

SEQ ID NO: 221784 - DNA, 26 bp, Artificial sequence
  SiRNA target sequence
aacgaatggacatcctctctagttta

SEQ ID NO: 221785 - DNA, 26 bp, Artificial sequence
  SiRNA target sequence
acgaatggacatcctctctagtttac

SEQ ID NO: 221786 - DNA, 26 bp, Artificial sequence
  SiRNA target sequence
cgaatggacatcctctctagtttaca

SEQ ID NO: 221787 - DNA, 26 bp, Artificial sequence
  SiRNA target sequence
gaatggacatcctctctagtttacat

SEQ ID NO: 221788 - DNA, 26 bp, Artificial sequence
  SiRNA target sequence
aatggacatcctctctagtttacatt

SEQ ID NO: 221789 - DNA, 26 bp, Artificial sequence
  SiRNA target sequence
atggacatcctctctagtttacattg

SEQ ID NO: 221790 - DNA, 26 bp, Artificial sequence
  SiRNA target sequence
tggacatcctctctagtttacattgt

SEQ ID NO: 221791 - DNA, 26 bp, Artificial sequence
  SiRNA target sequence
ggacatcctctctagtttacattgtt

SEQ ID NO: 221792 - DNA, 26 bp, Artificial sequence
  SiRNA target sequence
gacatcctctctagtttacattgttt

SEQ ID NO: 221793 - DNA, 26 bp, Artificial sequence
  SiRNA target sequence
acatcctctctagtttacattgtttc

SEQ ID NO: 221794 - DNA, 26 bp, Artificial sequence
  SiRNA target sequence
catcctctctagtttacattgtttca

SEQ ID NO: 221795 - DNA, 26 bp, Artificial sequence
  SiRNA target sequence
atcctctctagtttacattgtttcag

SEQ ID NO: 221796 - DNA, 26 bp, Artificial sequence
  SiRNA target sequence
tcctctctagtttacattgtttcaga

SEQ ID NO: 221797 - DNA, 26 bp, Artificial sequence
  SiRNA target sequence
cctctctagtttacattgtttcagaa

SEQ ID NO: 221798 - DNA, 26 bp, Artificial sequence
  SiRNA target sequence
ctctctagtttacattgtttcagaaa

SEQ ID NO: 221799 - DNA, 26 bp, Artificial sequence
  SiRNA target sequence
tctctagtttacattgtttcagaaat

SEQ ID NO: 221800 - DNA, 26 bp, Artificial sequence
  SiRNA target sequence
ctctagtttacattgtttcagaaatg

SEQ ID NO: 221801 - DNA, 26 bp, Artificial sequence
  SiRNA target sequence
tctagtttacattgtttcagaaatgt

SEQ ID NO: 221802 - DNA, 26 bp, Artificial sequence
  SiRNA target sequence
ctagtttacattgtttcagaaatgtt

SEQ ID NO: 221803 - DNA, 26 bp, Artificial sequence
  SiRNA target sequence
tagtttacattgtttcagaaatgttt

SEQ ID NO: 221804 - DNA, 26 bp, Artificial sequence
  SiRNA target sequence
agtttacattgtttcagaaatgtttg

SEQ ID NO: 221805 - DNA, 26 bp, Artificial sequence
  SiRNA target sequence
gtttacattgtttcagaaatgtttgg

SEQ ID NO: 221806 - DNA, 26 bp, Artificial sequence
  SiRNA target sequence
tttacattgtttcagaaatgtttggt

SEQ ID NO: 221807 - DNA, 26 bp, Artificial sequence
  SiRNA target sequence
ttacattgtttcagaaatgtttggta

SEQ ID NO: 221808 - DNA, 26 bp, Artificial sequence
  SiRNA target sequence
tacattgtttcagaaatgtttggtaa

SEQ ID NO: 221809 - DNA, 26 bp, Artificial sequence
  SiRNA target sequence
acattgtttcagaaatgtttggtaat

SEQ ID NO: 221810 - DNA, 26 bp, Artificial sequence
  SiRNA target sequence
cattgtttcagaaatgtttggtaatt

SEQ ID NO: 221811 - DNA, 26 bp, Artificial sequence
  SiRNA target sequence
attgtttcagaaatgtttggtaattt

SEQ ID NO: 221812 - DNA, 26 bp, Artificial sequence
  SiRNA target sequence
ttgtttcagaaatgtttggtaattta

SEQ ID NO: 221813 - DNA, 26 bp, Artificial sequence
  SiRNA target sequence
tgtttcagaaatgtttggtaatttag

SEQ ID NO: 221814 - DNA, 26 bp, Artificial sequence
  SiRNA target sequence
gtttcagaaatgtttggtaatttagt

SEQ ID NO: 221815 - DNA, 26 bp, Artificial sequence
  SiRNA target sequence
tttcagaaatgtttggtaatttagta

SEQ ID NO: 221816 - DNA, 26 bp, Artificial sequence
  SiRNA target sequence
ttcagaaatgtttggtaatttagtat

SEQ ID NO: 221817 - DNA, 26 bp, Artificial sequence
  SiRNA target sequence
tcagaaatgtttggtaatttagtatt

SEQ ID NO: 221818 - DNA, 26 bp, Artificial sequence
  SiRNA target sequence
cagaaatgtttggtaatttagtattg

SEQ ID NO: 221819 - DNA, 26 bp, Artificial sequence
  SiRNA target sequence
agaaatgtttggtaatttagtattgt

SEQ ID NO: 221820 - DNA, 26 bp, Artificial sequence
  SiRNA target sequence
gaaatgtttggtaatttagtattgtc

SEQ ID NO: 221821 - DNA, 26 bp, Artificial sequence
  SiRNA target sequence
aaatgtttggtaatttagtattgtct

SEQ ID NO: 221822 - DNA, 26 bp, Artificial sequence
  SiRNA target sequence
aatgtttggtaatttagtattgtctt

SEQ ID NO: 221823 - DNA, 26 bp, Artificial sequence
  SiRNA target sequence
atgtttggtaatttagtattgtctta

SEQ ID NO: 221824 - DNA, 26 bp, Artificial sequence
  SiRNA target sequence
tgtttggtaatttagtattgtcttat

SEQ ID NO: 221825 - DNA, 26 bp, Artificial sequence
  SiRNA target sequence
gtttggtaatttagtattgtcttatt

SEQ ID NO: 221826 - DNA, 26 bp, Artificial sequence
  SiRNA target sequence
tttggtaatttagtattgtcttattt

SEQ ID NO: 221827 - DNA, 26 bp, Artificial sequence
  SiRNA target sequence
ttggtaatttagtattgtcttatttc

SEQ ID NO: 221828 - DNA, 26 bp, Artificial sequence
  SiRNA target sequence
tggtaatttagtattgtcttatttct

SEQ ID NO: 221829 - DNA, 26 bp, Artificial sequence
  SiRNA target sequence
ggtaatttagtattgtcttatttctt

SEQ ID NO: 221830 - DNA, 26 bp, Artificial sequence
  SiRNA target sequence
gtaatttagtattgtcttatttcttc

SEQ ID NO: 221831 - DNA, 26 bp, Artificial sequence
  SiRNA target sequence
taatttagtattgtcttatttcttct

SEQ ID NO: 221832 - DNA, 26 bp, Artificial sequence
  SiRNA target sequence
aatttagtattgtcttatttcttctt

SEQ ID NO: 221833 - DNA, 26 bp, Artificial sequence
  SiRNA target sequence
atttagtattgtcttatttcttcttg

SEQ ID NO: 221834 - DNA, 26 bp, Artificial sequence
  SiRNA target sequence
tttagtattgtcttatttcttcttga

SEQ ID NO: 221835 - DNA, 26 bp, Artificial sequence
  SiRNA target sequence
ttagtattgtcttatttcttcttgac

SEQ ID NO: 221836 - DNA, 26 bp, Artificial sequence
  SiRNA target sequence
tagtattgtcttatttcttcttgacg

SEQ ID NO: 221837 - DNA, 26 bp, Artificial sequence
  SiRNA target sequence
agtattgtcttatttcttcttgacgt

SEQ ID NO: 221838 - DNA, 26 bp, Artificial sequence
  SiRNA target sequence
gtattgtcttatttcttcttgacgtt

SEQ ID NO: 221839 - DNA, 26 bp, Artificial sequence
  SiRNA target sequence
tattgtcttatttcttcttgacgttt

SEQ ID NO: 221840 - DNA, 26 bp, Artificial sequence
  SiRNA target sequence
attgtcttatttcttcttgacgtttg

SEQ ID NO: 221841 - DNA, 26 bp, Artificial sequence
  SiRNA target sequence
ttgtcttatttcttcttgacgtttgc

SEQ ID NO: 221842 - DNA, 26 bp, Artificial sequence
  SiRNA target sequence
tgtcttatttcttcttgacgtttgct

SEQ ID NO: 221843 - DNA, 26 bp, Artificial sequence
  SiRNA target sequence
gtcttatttcttcttgacgtttgcta

SEQ ID NO: 221844 - DNA, 26 bp, Artificial sequence
  SiRNA target sequence
tcttatttcttcttgacgtttgctaa

SEQ ID NO: 221845 - DNA, 26 bp, Artificial sequence
  SiRNA target sequence
cttatttcttcttgacgtttgctaat

SEQ ID NO: 221846 - DNA, 26 bp, Artificial sequence
  SiRNA target sequence
ttatttcttcttgacgtttgctaatt

SEQ ID NO: 221847 - DNA, 26 bp, Artificial sequence
  SiRNA target sequence
tatttcttcttgacgtttgctaattc

SEQ ID NO: 221848 - DNA, 26 bp, Artificial sequence
  SiRNA target sequence
atttcttcttgacgtttgctaattct

SEQ ID NO: 221849 - DNA, 26 bp, Artificial sequence
  SiRNA target sequence
tttcttcttgacgtttgctaattctt

SEQ ID NO: 221850 - DNA, 26 bp, Artificial sequence
  SiRNA target sequence
ttcttcttgacgtttgctaattcttt

SEQ ID NO: 221851 - DNA, 26 bp, Artificial sequence
  SiRNA target sequence
tcttcttgacgtttgctaattcttta

SEQ ID NO: 221852 - DNA, 26 bp, Artificial sequence
  SiRNA target sequence
cttcttgacgtttgctaattctttaa

SEQ ID NO: 221853 - DNA, 26 bp, Artificial sequence
  SiRNA target sequence
ttcttgacgtttgctaattctttaac

SEQ ID NO: 221854 - DNA, 26 bp, Artificial sequence
  SiRNA target sequence
tcttgacgtttgctaattctttaaca

SEQ ID NO: 221855 - DNA, 26 bp, Artificial sequence
  SiRNA target sequence
cttgacgtttgctaattctttaacaa

SEQ ID NO: 221856 - DNA, 26 bp, Artificial sequence
  SiRNA target sequence
ttgacgtttgctaattctttaacaac

SEQ ID NO: 221857 - DNA, 26 bp, Artificial sequence
  SiRNA target sequence
tgacgtttgctaattctttaacaact

SEQ ID NO: 221858 - DNA, 26 bp, Artificial sequence
  SiRNA target sequence
gacgtttgctaattctttaacaactc

SEQ ID NO: 221859 - DNA, 26 bp, Artificial sequence
  SiRNA target sequence
acgtttgctaattctttaacaactcc

SEQ ID NO: 221860 - DNA, 26 bp, Artificial sequence
  SiRNA target sequence
cgtttgctaattctttaacaactcca

SEQ ID NO: 221861 - DNA, 26 bp, Artificial sequence
  SiRNA target sequence
gtttgctaattctttaacaactccag

SEQ ID NO: 221862 - DNA, 26 bp, Artificial sequence
  SiRNA target sequence
tttgctaattctttaacaactccagg

SEQ ID NO: 221863 - DNA, 26 bp, Artificial sequence
  SiRNA target sequence
ttgctaattctttaacaactccagga

SEQ ID NO: 221864 - DNA, 26 bp, Artificial sequence
  SiRNA target sequence
tgctaattctttaacaactccaggac

SEQ ID NO: 221865 - DNA, 26 bp, Artificial sequence
  SiRNA target sequence
gctaattctttaacaactccaggaca

SEQ ID NO: 221866 - DNA, 26 bp, Artificial sequence
  SiRNA target sequence
ctaattctttaacaactccaggacaa

SEQ ID NO: 221867 - DNA, 26 bp, Artificial sequence
  SiRNA target sequence
taattctttaacaactccaggacaaa

SEQ ID NO: 221868 - DNA, 26 bp, Artificial sequence
  SiRNA target sequence
aattctttaacaactccaggacaaag

SEQ ID NO: 221869 - DNA, 26 bp, Artificial sequence
  SiRNA target sequence
attctttaacaactccaggacaaagt

SEQ ID NO: 221870 - DNA, 26 bp, Artificial sequence
  SiRNA target sequence
ttctttaacaactccaggacaaagtg

SEQ ID NO: 221871 - DNA, 26 bp, Artificial sequence
  SiRNA target sequence
tctttaacaactccaggacaaagtgc

SEQ ID NO: 221872 - DNA, 26 bp, Artificial sequence
  SiRNA target sequence
ctttaacaactccaggacaaagtgca

SEQ ID NO: 221873 - DNA, 26 bp, Artificial sequence
  SiRNA target sequence
tttaacaactccaggacaaagtgcaa

SEQ ID NO: 221874 - DNA, 26 bp, Artificial sequence
  SiRNA target sequence
ttaacaactccaggacaaagtgcaag

SEQ ID NO: 221875 - DNA, 26 bp, Artificial sequence
  SiRNA target sequence
taacaactccaggacaaagtgcaaga

SEQ ID NO: 221876 - DNA, 26 bp, Artificial sequence
  SiRNA target sequence
aacaactccaggacaaagtgcaagat

SEQ ID NO: 221877 - DNA, 26 bp, Artificial sequence
  SiRNA target sequence
acaactccaggacaaagtgcaagatt

SEQ ID NO: 221878 - DNA, 26 bp, Artificial sequence
  SiRNA target sequence
caactccaggacaaagtgcaagattc

SEQ ID NO: 221879 - DNA, 26 bp, Artificial sequence
  SiRNA target sequence
aactccaggacaaagtgcaagattca

SEQ ID NO: 221880 - DNA, 26 bp, Artificial sequence
  SiRNA target sequence
actccaggacaaagtgcaagattcat

SEQ ID NO: 221881 - DNA, 26 bp, Artificial sequence
  SiRNA target sequence
ctccaggacaaagtgcaagattcata

SEQ ID NO: 221882 - DNA, 26 bp, Artificial sequence
  SiRNA target sequence
tccaggacaaagtgcaagattcatac

SEQ ID NO: 221883 - DNA, 26 bp, Artificial sequence
  SiRNA target sequence
ccaggacaaagtgcaagattcatacc

SEQ ID NO: 221884 - DNA, 26 bp, Artificial sequence
  SiRNA target sequence
caggacaaagtgcaagattcatacct

SEQ ID NO: 221885 - DNA, 26 bp, Artificial sequence
  SiRNA target sequence
aggacaaagtgcaagattcatacctt

SEQ ID NO: 221886 - DNA, 26 bp, Artificial sequence
  SiRNA target sequence
ggacaaagtgcaagattcataccttt

SEQ ID NO: 221887 - DNA, 26 bp, Artificial sequence
  SiRNA target sequence
gacaaagtgcaagattcataccttta

SEQ ID NO: 221888 - DNA, 26 bp, Artificial sequence
  SiRNA target sequence
acaaagtgcaagattcatacctttat

SEQ ID NO: 221889 - DNA, 26 bp, Artificial sequence
  SiRNA target sequence
caaagtgcaagattcatacctttatt

SEQ ID NO: 221890 - DNA, 26 bp, Artificial sequence
  SiRNA target sequence
aaagtgcaagattcatacctttattt

SEQ ID NO: 221891 - DNA, 26 bp, Artificial sequence
  SiRNA target sequence
aagtgcaagattcatacctttatttt

SEQ ID NO: 221892 - DNA, 26 bp, Artificial sequence
  SiRNA target sequence
agtgcaagattcatacctttatttta

SEQ ID NO: 221893 - DNA, 26 bp, Artificial sequence
  SiRNA target sequence
gtgcaagattcatacctttattttat

SEQ ID NO: 221894 - DNA, 26 bp, Artificial sequence
  SiRNA target sequence
tgcaagattcatacctttattttatg

SEQ ID NO: 221895 - DNA, 26 bp, Artificial sequence
  SiRNA target sequence
gcaagattcatacctttattttatgt

SEQ ID NO: 221896 - DNA, 26 bp, Artificial sequence
  SiRNA target sequence
caagattcatacctttattttatgtt

SEQ ID NO: 221897 - DNA, 26 bp, Artificial sequence
  SiRNA target sequence
aagattcatacctttattttatgttt

SEQ ID NO: 221898 - DNA, 26 bp, Artificial sequence
  SiRNA target sequence
agattcatacctttattttatgtttt

SEQ ID NO: 221899 - DNA, 26 bp, Artificial sequence
  SiRNA target sequence
gattcatacctttattttatgttttc

SEQ ID NO: 221900 - DNA, 26 bp, Artificial sequence
  SiRNA target sequence
attcatacctttattttatgttttct

SEQ ID NO: 221901 - DNA, 26 bp, Artificial sequence
  SiRNA target sequence
ttcatacctttattttatgttttctc

SEQ ID NO: 221902 - DNA, 26 bp, Artificial sequence
  SiRNA target sequence
tcatacctttattttatgttttctcg

SEQ ID NO: 221903 - DNA, 26 bp, Artificial sequence
  SiRNA target sequence
catacctttattttatgttttctcga

SEQ ID NO: 221904 - DNA, 26 bp, Artificial sequence
  SiRNA target sequence
atacctttattttatgttttctcgaa

SEQ ID NO: 221905 - DNA, 26 bp, Artificial sequence
  SiRNA target sequence
tacctttattttatgttttctcgaat

SEQ ID NO: 221906 - DNA, 26 bp, Artificial sequence
  SiRNA target sequence
acctttattttatgttttctcgaata

SEQ ID NO: 221907 - DNA, 26 bp, Artificial sequence
  SiRNA target sequence
cctttattttatgttttctcgaatat

SEQ ID NO: 221908 - DNA, 26 bp, Artificial sequence
  SiRNA target sequence
ctttattttatgttttctcgaatatt

SEQ ID NO: 221909 - DNA, 26 bp, Artificial sequence
  SiRNA target sequence
tttattttatgttttctcgaatattt

SEQ ID NO: 221910 - DNA, 26 bp, Artificial sequence
  SiRNA target sequence
ttattttatgttttctcgaatatttc

SEQ ID NO: 221911 - DNA, 26 bp, Artificial sequence
  SiRNA target sequence
tattttatgttttctcgaatatttct

SEQ ID NO: 221912 - DNA, 26 bp, Artificial sequence
  SiRNA target sequence
attttatgttttctcgaatatttctc

SEQ ID NO: 221913 - DNA, 26 bp, Artificial sequence
  SiRNA target sequence
ttttatgttttctcgaatatttctct

SEQ ID NO: 221914 - DNA, 26 bp, Artificial sequence
  SiRNA target sequence
tttatgttttctcgaatatttctctt

SEQ ID NO: 221915 - DNA, 26 bp, Artificial sequence
  SiRNA target sequence
ttatgttttctcgaatatttctcttt

SEQ ID NO: 221916 - DNA, 26 bp, Artificial sequence
  SiRNA target sequence
tatgttttctcgaatatttctctttt

SEQ ID NO: 221917 - DNA, 26 bp, Artificial sequence
  SiRNA target sequence
atgttttctcgaatatttctcttttc

SEQ ID NO: 221918 - DNA, 26 bp, Artificial sequence
  SiRNA target sequence
tgttttctcgaatatttctcttttct

SEQ ID NO: 221919 - DNA, 26 bp, Artificial sequence
  SiRNA target sequence
gttttctcgaatatttctcttttctt

SEQ ID NO: 221920 - DNA, 26 bp, Artificial sequence
  SiRNA target sequence
ttttctcgaatatttctcttttctta

SEQ ID NO: 221921 - DNA, 26 bp, Artificial sequence
  SiRNA target sequence
tttctcgaatatttctcttttcttat

SEQ ID NO: 221922 - DNA, 26 bp, Artificial sequence
  SiRNA target sequence
ttctcgaatatttctcttttcttatc

SEQ ID NO: 221923 - DNA, 26 bp, Artificial sequence
  SiRNA target sequence
tctcgaatatttctcttttcttatct

SEQ ID NO: 221924 - DNA, 26 bp, Artificial sequence
  SiRNA target sequence
ctcgaatatttctcttttcttatctt

SEQ ID NO: 221925 - DNA, 26 bp, Artificial sequence
  SiRNA target sequence
tcgaatatttctcttttcttatcttc

SEQ ID NO: 221926 - DNA, 26 bp, Artificial sequence
  SiRNA target sequence
cgaatatttctcttttcttatcttct

SEQ ID NO: 221927 - DNA, 26 bp, Artificial sequence
  SiRNA target sequence
gaatatttctcttttcttatcttctc

SEQ ID NO: 221928 - DNA, 26 bp, Artificial sequence
  SiRNA target sequence
aatatttctcttttcttatcttctca

SEQ ID NO: 221929 - DNA, 26 bp, Artificial sequence
  SiRNA target sequence
atatttctcttttcttatcttctcaa

SEQ ID NO: 221930 - DNA, 26 bp, Artificial sequence
  SiRNA target sequence
tatttctcttttcttatcttctcaag

SEQ ID NO: 221931 - DNA, 26 bp, Artificial sequence
  SiRNA target sequence
atttctcttttcttatcttctcaagt

SEQ ID NO: 221932 - DNA, 26 bp, Artificial sequence
  SiRNA target sequence
tttctcttttcttatcttctcaagtg

SEQ ID NO: 221933 - DNA, 26 bp, Artificial sequence
  SiRNA target sequence
ttctcttttcttatcttctcaagtga

SEQ ID NO: 221934 - DNA, 26 bp, Artificial sequence
  SiRNA target sequence
tctcttttcttatcttctcaagtgac

SEQ ID NO: 221935 - DNA, 26 bp, Artificial sequence
  SiRNA target sequence
ctcttttcttatcttctcaagtgaca

SEQ ID NO: 221936 - DNA, 26 bp, Artificial sequence
  SiRNA target sequence
tcttttcttatcttctcaagtgacag

SEQ ID NO: 221937 - DNA, 26 bp, Artificial sequence
  SiRNA target sequence
cttttcttatcttctcaagtgacaga

SEQ ID NO: 221938 - DNA, 26 bp, Artificial sequence
  SiRNA target sequence
ttttcttatcttctcaagtgacagaa

SEQ ID NO: 221939 - DNA, 26 bp, Artificial sequence
  SiRNA target sequence
tttcttatcttctcaagtgacagaac

SEQ ID NO: 221940 - DNA, 26 bp, Artificial sequence
  SiRNA target sequence
ttcttatcttctcaagtgacagaact

SEQ ID NO: 221941 - DNA, 26 bp, Artificial sequence
  SiRNA target sequence
tcttatcttctcaagtgacagaactt

SEQ ID NO: 221942 - DNA, 26 bp, Artificial sequence
  SiRNA target sequence
cttatcttctcaagtgacagaacttt

SEQ ID NO: 221943 - DNA, 26 bp, Artificial sequence
  SiRNA target sequence
ttatcttctcaagtgacagaactttt

SEQ ID NO: 221944 - DNA, 26 bp, Artificial sequence
  SiRNA target sequence
tatcttctcaagtgacagaacttttt

SEQ ID NO: 221945 - DNA, 26 bp, Artificial sequence
  SiRNA target sequence
atcttctcaagtgacagaacttttta

SEQ ID NO: 221946 - DNA, 26 bp, Artificial sequence
  SiRNA target sequence
tcttctcaagtgacagaactttttac

SEQ ID NO: 221947 - DNA, 26 bp, Artificial sequence
  SiRNA target sequence
cttctcaagtgacagaactttttaca

SEQ ID NO: 221948 - DNA, 26 bp, Artificial sequence
  SiRNA target sequence
ttctcaagtgacagaactttttacaa

SEQ ID NO: 221949 - DNA, 26 bp, Artificial sequence
  SiRNA target sequence
tctcaagtgacagaactttttacaag

SEQ ID NO: 221950 - DNA, 26 bp, Artificial sequence
  SiRNA target sequence
ctcaagtgacagaactttttacaaga

SEQ ID NO: 221951 - DNA, 26 bp, Artificial sequence
  SiRNA target sequence
tcaagtgacagaactttttacaagat

SEQ ID NO: 221952 - DNA, 26 bp, Artificial sequence
  SiRNA target sequence
caagtgacagaactttttacaagata

SEQ ID NO: 221953 - DNA, 26 bp, Artificial sequence
  SiRNA target sequence
aagtgacagaactttttacaagatat

SEQ ID NO: 221954 - DNA, 26 bp, Artificial sequence
  SiRNA target sequence
agtgacagaactttttacaagatata

SEQ ID NO: 221955 - DNA, 26 bp, Artificial sequence
  SiRNA target sequence
gtgacagaactttttacaagatatag

SEQ ID NO: 221956 - DNA, 26 bp, Artificial sequence
  SiRNA target sequence
tgacagaactttttacaagatataga

SEQ ID NO: 221957 - DNA, 26 bp, Artificial sequence
  SiRNA target sequence
gacagaactttttacaagatatagat

SEQ ID NO: 221958 - DNA, 26 bp, Artificial sequence
  SiRNA target sequence
acagaactttttacaagatatagatc

SEQ ID NO: 221959 - DNA, 26 bp, Artificial sequence
  SiRNA target sequence
cagaactttttacaagatatagatca

SEQ ID NO: 221960 - DNA, 26 bp, Artificial sequence
  SiRNA target sequence
agaactttttacaagatatagatcaa

SEQ ID NO: 221961 - DNA, 26 bp, Artificial sequence
  SiRNA target sequence
gaactttttacaagatatagatcaaa

SEQ ID NO: 221962 - DNA, 26 bp, Artificial sequence
  SiRNA target sequence
aactttttacaagatatagatcaaag

SEQ ID NO: 221963 - DNA, 26 bp, Artificial sequence
  SiRNA target sequence
actttttacaagatatagatcaaagc

SEQ ID NO: 221964 - DNA, 26 bp, Artificial sequence
  SiRNA target sequence
ctttttacaagatatagatcaaagct

SEQ ID NO: 221965 - DNA, 26 bp, Artificial sequence
  SiRNA target sequence
tttttacaagatatagatcaaagctc

SEQ ID NO: 221966 - DNA, 26 bp, Artificial sequence
  SiRNA target sequence
ttttacaagatatagatcaaagctca

SEQ ID NO: 221967 - DNA, 26 bp, Artificial sequence
  SiRNA target sequence
tttacaagatatagatcaaagctcac

SEQ ID NO: 221968 - DNA, 26 bp, Artificial sequence
  SiRNA target sequence
ttacaagatatagatcaaagctcact

SEQ ID NO: 221969 - DNA, 26 bp, Artificial sequence
  SiRNA target sequence
tacaagatatagatcaaagctcactt

SEQ ID NO: 221970 - DNA, 26 bp, Artificial sequence
  SiRNA target sequence
acaagatatagatcaaagctcacttt

SEQ ID NO: 221971 - DNA, 26 bp, Artificial sequence
  SiRNA target sequence
caagatatagatcaaagctcactttc

SEQ ID NO: 221972 - DNA, 26 bp, Artificial sequence
  SiRNA target sequence
aagatatagatcaaagctcactttct

SEQ ID NO: 221973 - DNA, 26 bp, Artificial sequence
  SiRNA target sequence
agatatagatcaaagctcactttctc

SEQ ID NO: 221974 - DNA, 26 bp, Artificial sequence
  SiRNA target sequence
gatatagatcaaagctcactttctca

SEQ ID NO: 221975 - DNA, 26 bp, Artificial sequence
  SiRNA target sequence
atatagatcaaagctcactttctcag

SEQ ID NO: 221976 - DNA, 26 bp, Artificial sequence
  SiRNA target sequence
tatagatcaaagctcactttctcaga

SEQ ID NO: 221977 - DNA, 26 bp, Artificial sequence
  SiRNA target sequence
atagatcaaagctcactttctcagag

SEQ ID NO: 221978 - DNA, 26 bp, Artificial sequence
  SiRNA target sequence
tagatcaaagctcactttctcagagg

SEQ ID NO: 221979 - DNA, 26 bp, Artificial sequence
  SiRNA target sequence
agatcaaagctcactttctcagaggc

SEQ ID NO: 221980 - DNA, 26 bp, Artificial sequence
  SiRNA target sequence
gatcaaagctcactttctcagaggcg

SEQ ID NO: 221981 - DNA, 26 bp, Artificial sequence
  SiRNA target sequence
atcaaagctcactttctcagaggcgg

SEQ ID NO: 221982 - DNA, 26 bp, Artificial sequence
  SiRNA target sequence
tcaaagctcactttctcagaggcgga

SEQ ID NO: 221983 - DNA, 26 bp, Artificial sequence
  SiRNA target sequence
caaagctcactttctcagaggcggaa

SEQ ID NO: 221984 - DNA, 26 bp, Artificial sequence
  SiRNA target sequence
aaagctcactttctcagaggcggaat

SEQ ID NO: 221985 - DNA, 26 bp, Artificial sequence
  SiRNA target sequence
aagctcactttctcagaggcggaatt

SEQ ID NO: 221986 - DNA, 26 bp, Artificial sequence
  SiRNA target sequence
agctcactttctcagaggcggaattt

SEQ ID NO: 221987 - DNA, 26 bp, Artificial sequence
  SiRNA target sequence
gctcactttctcagaggcggaatttt

SEQ ID NO: 221988 - DNA, 26 bp, Artificial sequence
  SiRNA target sequence
ctcactttctcagaggcggaattttt

SEQ ID NO: 221989 - DNA, 26 bp, Artificial sequence
  SiRNA target sequence
tcactttctcagaggcggaattttta

SEQ ID NO: 221990 - DNA, 26 bp, Artificial sequence
  SiRNA target sequence
cactttctcagaggcggaatttttat

SEQ ID NO: 221991 - DNA, 26 bp, Artificial sequence
  SiRNA target sequence
actttctcagaggcggaatttttata

SEQ ID NO: 221992 - DNA, 26 bp, Artificial sequence
  SiRNA target sequence
ctttctcagaggcggaatttttatat

SEQ ID NO: 221993 - DNA, 26 bp, Artificial sequence
  SiRNA target sequence
tttctcagaggcggaatttttatata

SEQ ID NO: 221994 - DNA, 26 bp, Artificial sequence
  SiRNA target sequence
ttctcagaggcggaatttttatataa

SEQ ID NO: 221995 - DNA, 26 bp, Artificial sequence
  SiRNA target sequence
tctcagaggcggaatttttatataat

SEQ ID NO: 221996 - DNA, 26 bp, Artificial sequence
  SiRNA target sequence
ctcagaggcggaatttttatataatg

SEQ ID NO: 221997 - DNA, 26 bp, Artificial sequence
  SiRNA target sequence
tcagaggcggaatttttatataatgg

SEQ ID NO: 221998 - DNA, 26 bp, Artificial sequence
  SiRNA target sequence
cagaggcggaatttttatataatggc

SEQ ID NO: 221999 - DNA, 26 bp, Artificial sequence
  SiRNA target sequence
agaggcggaatttttatataatggct

SEQ ID NO: 222000 - DNA, 26 bp, Artificial sequence
  SiRNA target sequence
gaggcggaatttttatataatggctt

SEQ ID NO: 222001 - DNA, 26 bp, Artificial sequence
  SiRNA target sequence
aggcggaatttttatataatggcttt

SEQ ID NO: 222002 - DNA, 26 bp, Artificial sequence
  SiRNA target sequence
ggcggaatttttatataatggctttt

SEQ ID NO: 222003 - DNA, 26 bp, Artificial sequence
  SiRNA target sequence
gcggaatttttatataatggcttttt

SEQ ID NO: 222004 - DNA, 26 bp, Artificial sequence
  SiRNA target sequence
cggaatttttatataatggctttttt

SEQ ID NO: 222005 - DNA, 26 bp, Artificial sequence
  SiRNA target sequence
ggaatttttatataatggcttttttg

SEQ ID NO: 222006 - DNA, 26 bp, Artificial sequence
  SiRNA target sequence
gaatttttatataatggcttttttgt

SEQ ID NO: 222007 - DNA, 26 bp, Artificial sequence
  SiRNA target sequence
aatttttatataatggcttttttgta

SEQ ID NO: 222008 - DNA, 26 bp, Artificial sequence
  SiRNA target sequence
atttttatataatggcttttttgtat

SEQ ID NO: 222009 - DNA, 26 bp, Artificial sequence
  SiRNA target sequence
tttttatataatggcttttttgtatt

SEQ ID NO: 222010 - DNA, 26 bp, Artificial sequence
  SiRNA target sequence
ttttatataatggcttttttgtattt

SEQ ID NO: 222011 - DNA, 26 bp, Artificial sequence
  SiRNA target sequence
tttatataatggcttttttgtatttt

SEQ ID NO: 222012 - DNA, 26 bp, Artificial sequence
  SiRNA target sequence
ttatataatggcttttttgtattttc

SEQ ID NO: 222013 - DNA, 26 bp, Artificial sequence
  SiRNA target sequence
tatataatggcttttttgtattttct

SEQ ID NO: 222014 - DNA, 26 bp, Artificial sequence
  SiRNA target sequence
atataatggcttttttgtattttctg

SEQ ID NO: 222015 - DNA, 26 bp, Artificial sequence
  SiRNA target sequence
tataatggcttttttgtattttctgg

SEQ ID NO: 222016 - DNA, 26 bp, Artificial sequence
  SiRNA target sequence
ataatggcttttttgtattttctgga

SEQ ID NO: 222017 - DNA, 26 bp, Artificial sequence
  SiRNA target sequence
taatggcttttttgtattttctggag

SEQ ID NO: 222018 - DNA, 26 bp, Artificial sequence
  SiRNA target sequence
aatggcttttttgtattttctggagt

SEQ ID NO: 222019 - DNA, 26 bp, Artificial sequence
  SiRNA target sequence
atggcttttttgtattttctggagtt

SEQ ID NO: 222020 - DNA, 26 bp, Artificial sequence
  SiRNA target sequence
tggcttttttgtattttctggagttc

SEQ ID NO: 222021 - DNA, 26 bp, Artificial sequence
  SiRNA target sequence
ggcttttttgtattttctggagttct

SEQ ID NO: 222022 - DNA, 26 bp, Artificial sequence
  SiRNA target sequence
gcttttttgtattttctggagttcta

SEQ ID NO: 222023 - DNA, 26 bp, Artificial sequence
  SiRNA target sequence
cttttttgtattttctggagttctag

SEQ ID NO: 222024 - DNA, 26 bp, Artificial sequence
  SiRNA target sequence
ttttttgtattttctggagttctagt

SEQ ID NO: 222025 - DNA, 26 bp, Artificial sequence
  SiRNA target sequence
tttttgtattttctggagttctagta

SEQ ID NO: 222026 - DNA, 26 bp, Artificial sequence
  SiRNA target sequence
ttttgtattttctggagttctagtaa

SEQ ID NO: 222027 - DNA, 26 bp, Artificial sequence
  SiRNA target sequence
tttgtattttctggagttctagtaat

SEQ ID NO: 222028 - DNA, 26 bp, Artificial sequence
  SiRNA target sequence
ttgtattttctggagttctagtaata

SEQ ID NO: 222029 - DNA, 26 bp, Artificial sequence
  SiRNA target sequence
tgtattttctggagttctagtaatag

SEQ ID NO: 222030 - DNA, 26 bp, Artificial sequence
  SiRNA target sequence
gtattttctggagttctagtaatagt

SEQ ID NO: 222031 - DNA, 26 bp, Artificial sequence
  SiRNA target sequence
tattttctggagttctagtaatagtt

SEQ ID NO: 222032 - DNA, 26 bp, Artificial sequence
  SiRNA target sequence
attttctggagttctagtaatagtta

SEQ ID NO: 222033 - DNA, 26 bp, Artificial sequence
  SiRNA target sequence
ttttctggagttctagtaatagttat

SEQ ID NO: 222034 - DNA, 26 bp, Artificial sequence
  SiRNA target sequence
tttctggagttctagtaatagttata

SEQ ID NO: 222035 - DNA, 26 bp, Artificial sequence
  SiRNA target sequence
ttctggagttctagtaatagttatat

SEQ ID NO: 222036 - DNA, 26 bp, Artificial sequence
  SiRNA target sequence
tctggagttctagtaatagttatatt

SEQ ID NO: 222037 - DNA, 26 bp, Artificial sequence
  SiRNA target sequence
ctggagttctagtaatagttatattt

SEQ ID NO: 222038 - DNA, 26 bp, Artificial sequence
  SiRNA target sequence
tggagttctagtaatagttatatttt

SEQ ID NO: 222039 - DNA, 26 bp, Artificial sequence
  SiRNA target sequence
ggagttctagtaatagttatattttt

SEQ ID NO: 222040 - DNA, 26 bp, Artificial sequence
  SiRNA target sequence
gagttctagtaatagttatattttta

SEQ ID NO: 222041 - DNA, 26 bp, Artificial sequence
  SiRNA target sequence
agttctagtaatagttatatttttaa

SEQ ID NO: 222042 - DNA, 26 bp, Artificial sequence
  SiRNA target sequence
gttctagtaatagttatatttttaat

SEQ ID NO: 222043 - DNA, 26 bp, Artificial sequence
  SiRNA target sequence
ttctagtaatagttatatttttaatt

SEQ ID NO: 222044 - DNA, 26 bp, Artificial sequence
  SiRNA target sequence
tctagtaatagttatatttttaatta

SEQ ID NO: 222045 - DNA, 26 bp, Artificial sequence
  SiRNA target sequence
ctagtaatagttatatttttaattaa

SEQ ID NO: 222046 - DNA, 26 bp, Artificial sequence
  SiRNA target sequence
tagtaatagttatatttttaattaaa

SEQ ID NO: 222047 - DNA, 26 bp, Artificial sequence
  SiRNA target sequence
agtaatagttatatttttaattaaaa

SEQ ID NO: 222048 - DNA, 26 bp, Artificial sequence
  SiRNA target sequence
gtaatagttatatttttaattaaaaa

SEQ ID NO: 222049 - DNA, 26 bp, Artificial sequence
  SiRNA target sequence
taatagttatatttttaattaaaaaa

SEQ ID NO: 222050 - DNA, 26 bp, Artificial sequence
  SiRNA target sequence
aatagttatatttttaattaaaaaat

SEQ ID NO: 222051 - DNA, 26 bp, Artificial sequence
  SiRNA target sequence
atagttatatttttaattaaaaaata

SEQ ID NO: 222052 - DNA, 26 bp, Artificial sequence
  SiRNA target sequence
tagttatatttttaattaaaaaatat

SEQ ID NO: 222053 - DNA, 26 bp, Artificial sequence
  SiRNA target sequence
agttatatttttaattaaaaaatatt

SEQ ID NO: 222054 - DNA, 26 bp, Artificial sequence
  SiRNA target sequence
gttatatttttaattaaaaaatattt

SEQ ID NO: 222055 - DNA, 26 bp, Artificial sequence
  SiRNA target sequence
ttatatttttaattaaaaaatatttg

SEQ ID NO: 222056 - DNA, 26 bp, Artificial sequence
  SiRNA target sequence
tatatttttaattaaaaaatatttgg

SEQ ID NO: 222057 - DNA, 26 bp, Artificial sequence
  SiRNA target sequence
atatttttaattaaaaaatatttgga

SEQ ID NO: 222058 - DNA, 26 bp, Artificial sequence
  SiRNA target sequence
tatttttaattaaaaaatatttggag

SEQ ID NO: 222059 - DNA, 26 bp, Artificial sequence
  SiRNA target sequence
atttttaattaaaaaatatttggaga

SEQ ID NO: 222060 - DNA, 26 bp, Artificial sequence
  SiRNA target sequence
tttttaattaaaaaatatttggagag

SEQ ID NO: 222061 - DNA, 26 bp, Artificial sequence
  SiRNA target sequence
ttttaattaaaaaatatttggagagg

SEQ ID NO: 222062 - DNA, 26 bp, Artificial sequence
  SiRNA target sequence
tttaattaaaaaatatttggagagga

SEQ ID NO: 222063 - DNA, 26 bp, Artificial sequence
  SiRNA target sequence
ttaattaaaaaatatttggagaggaa

SEQ ID NO: 222064 - DNA, 26 bp, Artificial sequence
  SiRNA target sequence
taattaaaaaatatttggagaggaat

SEQ ID NO: 222065 - DNA, 26 bp, Artificial sequence
  SiRNA target sequence
aattaaaaaatatttggagaggaatg

SEQ ID NO: 222066 - DNA, 26 bp, Artificial sequence
  SiRNA target sequence
attaaaaaatatttggagaggaatgt

SEQ ID NO: 222067 - DNA, 26 bp, Artificial sequence
  SiRNA target sequence
ttaaaaaatatttggagaggaatgtg

SEQ ID NO: 222068 - DNA, 26 bp, Artificial sequence
  SiRNA target sequence
taaaaaatatttggagaggaatgtga

SEQ ID NO: 222069 - DNA, 26 bp, Artificial sequence
  SiRNA target sequence
aaaaaatatttggagaggaatgtgac

SEQ ID NO: 222070 - DNA, 26 bp, Artificial sequence
  SiRNA target sequence
aaaaatatttggagaggaatgtgact

SEQ ID NO: 222071 - DNA, 26 bp, Artificial sequence
  SiRNA target sequence
aaaatatttggagaggaatgtgacta

SEQ ID NO: 222072 - DNA, 26 bp, Artificial sequence
  SiRNA target sequence
aaatatttggagaggaatgtgactaa

SEQ ID NO: 222073 - DNA, 26 bp, Artificial sequence
  SiRNA target sequence
aatatttggagaggaatgtgactaac

SEQ ID NO: 222074 - DNA, 26 bp, Artificial sequence
  SiRNA target sequence
atatttggagaggaatgtgactaaca

SEQ ID NO: 222075 - DNA, 26 bp, Artificial sequence
  SiRNA target sequence
tatttggagaggaatgtgactaacaa

SEQ ID NO: 222076 - DNA, 26 bp, Artificial sequence
  SiRNA target sequence
atttggagaggaatgtgactaacaaa

SEQ ID NO: 222077 - DNA, 26 bp, Artificial sequence
  SiRNA target sequence
tttggagaggaatgtgactaacaaac

SEQ ID NO: 222078 - DNA, 26 bp, Artificial sequence
  SiRNA target sequence
ttggagaggaatgtgactaacaaacc

SEQ ID NO: 222079 - DNA, 26 bp, Artificial sequence
  SiRNA target sequence
tggagaggaatgtgactaacaaacct

SEQ ID NO: 222080 - DNA, 26 bp, Artificial sequence
  SiRNA target sequence
ggagaggaatgtgactaacaaacctt

SEQ ID NO: 222081 - DNA, 26 bp, Artificial sequence
  SiRNA target sequence
gagaggaatgtgactaacaaaccttt

SEQ ID NO: 222082 - DNA, 26 bp, Artificial sequence
  SiRNA target sequence
agaggaatgtgactaacaaacctttg

SEQ ID NO: 222083 - DNA, 26 bp, Artificial sequence
  SiRNA target sequence
gaggaatgtgactaacaaacctttgt

SEQ ID NO: 222084 - DNA, 26 bp, Artificial sequence
  SiRNA target sequence
aggaatgtgactaacaaacctttgtt

SEQ ID NO: 222085 - DNA, 26 bp, Artificial sequence
  SiRNA target sequence
ggaatgtgactaacaaacctttgttt

SEQ ID NO: 222086 - DNA, 26 bp, Artificial sequence
  SiRNA target sequence
gaatgtgactaacaaacctttgtttg

SEQ ID NO: 222087 - DNA, 26 bp, Artificial sequence
  SiRNA target sequence
aatgtgactaacaaacctttgtttgt

SEQ ID NO: 222088 - DNA, 26 bp, Artificial sequence
  SiRNA target sequence
atgtgactaacaaacctttgtttgtt

SEQ ID NO: 222089 - DNA, 26 bp, Artificial sequence
  SiRNA target sequence
tgtgactaacaaacctttgtttgttg

SEQ ID NO: 222090 - DNA, 26 bp, Artificial sequence
  SiRNA target sequence
gtgactaacaaacctttgtttgttgt

SEQ ID NO: 222091 - DNA, 26 bp, Artificial sequence
  SiRNA target sequence
tgactaacaaacctttgtttgttgta

SEQ ID NO: 222092 - DNA, 26 bp, Artificial sequence
  SiRNA target sequence
gactaacaaacctttgtttgttgtaa

SEQ ID NO: 222093 - DNA, 26 bp, Artificial sequence
  SiRNA target sequence
actaacaaacctttgtttgttgtaaa

SEQ ID NO: 222094 - DNA, 26 bp, Artificial sequence
  SiRNA target sequence
ctaacaaacctttgtttgttgtaaaa

SEQ ID NO: 222095 - DNA, 26 bp, Artificial sequence
  SiRNA target sequence
taacaaacctttgtttgttgtaaaat

SEQ ID NO: 222096 - DNA, 26 bp, Artificial sequence
  SiRNA target sequence
aacaaacctttgtttgttgtaaaatc

SEQ ID NO: 222097 - DNA, 26 bp, Artificial sequence
  SiRNA target sequence
acaaacctttgtttgttgtaaaatct

SEQ ID NO: 222098 - DNA, 26 bp, Artificial sequence
  SiRNA target sequence
caaacctttgtttgttgtaaaatctg

SEQ ID NO: 222099 - DNA, 26 bp, Artificial sequence
  SiRNA target sequence
aaacctttgtttgttgtaaaatctgt

SEQ ID NO: 222100 - DNA, 26 bp, Artificial sequence
  SiRNA target sequence
aacctttgtttgttgtaaaatctgtt

SEQ ID NO: 222101 - DNA, 26 bp, Artificial sequence
  SiRNA target sequence
acctttgtttgttgtaaaatctgtta

SEQ ID NO: 222102 - DNA, 26 bp, Artificial sequence
  SiRNA target sequence
cctttgtttgttgtaaaatctgttaa

SEQ ID NO: 222103 - DNA, 26 bp, Artificial sequence
  SiRNA target sequence
ctttgtttgttgtaaaatctgttaaa

SEQ ID NO: 222104 - DNA, 26 bp, Artificial sequence
  SiRNA target sequence
tttgtttgttgtaaaatctgttaaaa

SEQ ID NO: 222105 - DNA, 26 bp, Artificial sequence
  SiRNA target sequence
ttgtttgttgtaaaatctgttaaaaa

SEQ ID NO: 222106 - DNA, 26 bp, Artificial sequence
  SiRNA target sequence
tgtttgttgtaaaatctgttaaaaag

SEQ ID NO: 222107 - DNA, 26 bp, Artificial sequence
  SiRNA target sequence
gtttgttgtaaaatctgttaaaaaga

SEQ ID NO: 222108 - DNA, 26 bp, Artificial sequence
  SiRNA target sequence
tttgttgtaaaatctgttaaaaagaa

SEQ ID NO: 222109 - DNA, 26 bp, Artificial sequence
  SiRNA target sequence
ttgttgtaaaatctgttaaaaagaag

SEQ ID NO: 222110 - DNA, 26 bp, Artificial sequence
  SiRNA target sequence
tgttgtaaaatctgttaaaaagaagg

SEQ ID NO: 222111 - DNA, 26 bp, Artificial sequence
  SiRNA target sequence
gttgtaaaatctgttaaaaagaaggg

SEQ ID NO: 222112 - DNA, 26 bp, Artificial sequence
  SiRNA target sequence
ttgtaaaatctgttaaaaagaaggga

SEQ ID NO: 222113 - DNA, 26 bp, Artificial sequence
  SiRNA target sequence
tgtaaaatctgttaaaaagaagggac

SEQ ID NO: 222114 - DNA, 26 bp, Artificial sequence
  SiRNA target sequence
gtaaaatctgttaaaaagaagggacc

SEQ ID NO: 222115 - DNA, 26 bp, Artificial sequence
  SiRNA target sequence
taaaatctgttaaaaagaagggacca

SEQ ID NO: 222116 - DNA, 26 bp, Artificial sequence
  SiRNA target sequence
aaaatctgttaaaaagaagggaccaa

SEQ ID NO: 222117 - DNA, 26 bp, Artificial sequence
  SiRNA target sequence
aaatctgttaaaaagaagggaccaaa

SEQ ID NO: 222118 - DNA, 26 bp, Artificial sequence
  SiRNA target sequence
aatctgttaaaaagaagggaccaaaa

SEQ ID NO: 222119 - DNA, 26 bp, Artificial sequence
  SiRNA target sequence
atctgttaaaaagaagggaccaaaag

SEQ ID NO: 222120 - DNA, 26 bp, Artificial sequence
  SiRNA target sequence
tctgttaaaaagaagggaccaaaagt

SEQ ID NO: 222121 - DNA, 26 bp, Artificial sequence
  SiRNA target sequence
ctgttaaaaagaagggaccaaaagtt

SEQ ID NO: 222122 - DNA, 26 bp, Artificial sequence
  SiRNA target sequence
tgttaaaaagaagggaccaaaagtta

SEQ ID NO: 222123 - DNA, 26 bp, Artificial sequence
  SiRNA target sequence
gttaaaaagaagggaccaaaagttaa

SEQ ID NO: 222124 - DNA, 26 bp, Artificial sequence
  SiRNA target sequence
ttaaaaagaagggaccaaaagttaaa

SEQ ID NO: 222125 - DNA, 26 bp, Artificial sequence
  SiRNA target sequence
taaaaagaagggaccaaaagttaaag

SEQ ID NO: 222126 - DNA, 26 bp, Artificial sequence
  SiRNA target sequence
aaaaagaagggaccaaaagttaaagt

SEQ ID NO: 222127 - DNA, 26 bp, Artificial sequence
  SiRNA target sequence
aaaagaagggaccaaaagttaaagta

SEQ ID NO: 222128 - DNA, 26 bp, Artificial sequence
  SiRNA target sequence
aaagaagggaccaaaagttaaagtag

SEQ ID NO: 222129 - DNA, 26 bp, Artificial sequence
  SiRNA target sequence
aagaagggaccaaaagttaaagtagg

SEQ ID NO: 222130 - DNA, 26 bp, Artificial sequence
  SiRNA target sequence
agaagggaccaaaagttaaagtagga

SEQ ID NO: 222131 - DNA, 26 bp, Artificial sequence
  SiRNA target sequence
gaagggaccaaaagttaaagtaggat

SEQ ID NO: 222132 - DNA, 26 bp, Artificial sequence
  SiRNA target sequence
aagggaccaaaagttaaagtaggatt

SEQ ID NO: 222133 - DNA, 26 bp, Artificial sequence
  SiRNA target sequence
agggaccaaaagttaaagtaggattt

SEQ ID NO: 222134 - DNA, 26 bp, Artificial sequence
  SiRNA target sequence
gggaccaaaagttaaagtaggatttg

SEQ ID NO: 222135 - DNA, 26 bp, Artificial sequence
  SiRNA target sequence
ggaccaaaagttaaagtaggatttgc

SEQ ID NO: 222136 - DNA, 26 bp, Artificial sequence
  SiRNA target sequence
gaccaaaagttaaagtaggatttgcg

SEQ ID NO: 222137 - DNA, 26 bp, Artificial sequence
  SiRNA target sequence
accaaaagttaaagtaggatttgcgg

SEQ ID NO: 222138 - DNA, 26 bp, Artificial sequence
  SiRNA target sequence
ccaaaagttaaagtaggatttgcgga

SEQ ID NO: 222139 - DNA, 26 bp, Artificial sequence
  SiRNA target sequence
caaaagttaaagtaggatttgcggag

SEQ ID NO: 222140 - DNA, 26 bp, Artificial sequence
  SiRNA target sequence
aaaagttaaagtaggatttgcggagg

SEQ ID NO: 222141 - DNA, 26 bp, Artificial sequence
  SiRNA target sequence
aaagttaaagtaggatttgcggaggg

SEQ ID NO: 222142 - DNA, 26 bp, Artificial sequence
  SiRNA target sequence
aagttaaagtaggatttgcggagggc

SEQ ID NO: 222143 - DNA, 26 bp, Artificial sequence
  SiRNA target sequence
agttaaagtaggatttgcggagggcc

SEQ ID NO: 222144 - DNA, 26 bp, Artificial sequence
  SiRNA target sequence
gttaaagtaggatttgcggagggcct

SEQ ID NO: 222145 - DNA, 26 bp, Artificial sequence
  SiRNA target sequence
ttaaagtaggatttgcggagggcctt

SEQ ID NO: 222146 - DNA, 26 bp, Artificial sequence
  SiRNA target sequence
taaagtaggatttgcggagggcctta

SEQ ID NO: 222147 - DNA, 26 bp, Artificial sequence
  SiRNA target sequence
aaagtaggatttgcggagggccttaa

SEQ ID NO: 222148 - DNA, 26 bp, Artificial sequence
  SiRNA target sequence
aagtaggatttgcggagggccttaaa

SEQ ID NO: 222149 - DNA, 26 bp, Artificial sequence
  SiRNA target sequence
agtaggatttgcggagggccttaaag

SEQ ID NO: 222150 - DNA, 26 bp, Artificial sequence
  SiRNA target sequence
gtaggatttgcggagggccttaaaga

SEQ ID NO: 222151 - DNA, 26 bp, Artificial sequence
  SiRNA target sequence
taggatttgcggagggccttaaagaa

SEQ ID NO: 222152 - DNA, 26 bp, Artificial sequence
  SiRNA target sequence
aggatttgcggagggccttaaagaaa

SEQ ID NO: 222153 - DNA, 26 bp, Artificial sequence
  SiRNA target sequence
ggatttgcggagggccttaaagaaat

SEQ ID NO: 222154 - DNA, 26 bp, Artificial sequence
  SiRNA target sequence
gatttgcggagggccttaaagaaatg

SEQ ID NO: 222155 - DNA, 26 bp, Artificial sequence
  SiRNA target sequence
atttgcggagggccttaaagaaatga

SEQ ID NO: 222156 - DNA, 26 bp, Artificial sequence
  SiRNA target sequence
tttgcggagggccttaaagaaatgat

SEQ ID NO: 222157 - DNA, 26 bp, Artificial sequence
  SiRNA target sequence
ttgcggagggccttaaagaaatgatg

SEQ ID NO: 222158 - DNA, 26 bp, Artificial sequence
  SiRNA target sequence
tgcggagggccttaaagaaatgatgg

SEQ ID NO: 222159 - DNA, 26 bp, Artificial sequence
  SiRNA target sequence
gcggagggccttaaagaaatgatggc

SEQ ID NO: 222160 - DNA, 26 bp, Artificial sequence
  SiRNA target sequence
cggagggccttaaagaaatgatggca

SEQ ID NO: 222161 - DNA, 26 bp, Artificial sequence
  SiRNA target sequence
ggagggccttaaagaaatgatggcat

SEQ ID NO: 222162 - DNA, 26 bp, Artificial sequence
  SiRNA target sequence
gagggccttaaagaaatgatggcatc

SEQ ID NO: 222163 - DNA, 26 bp, Artificial sequence
  SiRNA target sequence
agggccttaaagaaatgatggcatca

SEQ ID NO: 222164 - DNA, 26 bp, Artificial sequence
  SiRNA target sequence
gggccttaaagaaatgatggcatcaa

SEQ ID NO: 222165 - DNA, 26 bp, Artificial sequence
  SiRNA target sequence
ggccttaaagaaatgatggcatcaaa

SEQ ID NO: 222166 - DNA, 26 bp, Artificial sequence
  SiRNA target sequence
gccttaaagaaatgatggcatcaaag

SEQ ID NO: 222167 - DNA, 26 bp, Artificial sequence
  SiRNA target sequence
ccttaaagaaatgatggcatcaaagt

SEQ ID NO: 222168 - DNA, 26 bp, Artificial sequence
  SiRNA target sequence
cttaaagaaatgatggcatcaaagtt

SEQ ID NO: 222169 - DNA, 26 bp, Artificial sequence
  SiRNA target sequence
ttaaagaaatgatggcatcaaagtta

SEQ ID NO: 222170 - DNA, 26 bp, Artificial sequence
  SiRNA target sequence
taaagaaatgatggcatcaaagttat

SEQ ID NO: 222171 - DNA, 26 bp, Artificial sequence
  SiRNA target sequence
aaagaaatgatggcatcaaagttatt

SEQ ID NO: 222172 - DNA, 26 bp, Artificial sequence
  SiRNA target sequence
aagaaatgatggcatcaaagttatta

SEQ ID NO: 222173 - DNA, 26 bp, Artificial sequence
  SiRNA target sequence
agaaatgatggcatcaaagttattac

SEQ ID NO: 222174 - DNA, 26 bp, Artificial sequence
  SiRNA target sequence
gaaatgatggcatcaaagttattact

SEQ ID NO: 222175 - DNA, 26 bp, Artificial sequence
  SiRNA target sequence
aaatgatggcatcaaagttattactt

SEQ ID NO: 222176 - DNA, 26 bp, Artificial sequence
  SiRNA target sequence
aatgatggcatcaaagttattactta

SEQ ID NO: 222177 - DNA, 26 bp, Artificial sequence
  SiRNA target sequence
atgatggcatcaaagttattacttaa

SEQ ID NO: 222178 - DNA, 26 bp, Artificial sequence
  SiRNA target sequence
tgatggcatcaaagttattacttaac

SEQ ID NO: 222179 - DNA, 26 bp, Artificial sequence
  SiRNA target sequence
gatggcatcaaagttattacttaaca

SEQ ID NO: 222180 - DNA, 26 bp, Artificial sequence
  SiRNA target sequence
atggcatcaaagttattacttaacat

SEQ ID NO: 222181 - DNA, 26 bp, Artificial sequence
  SiRNA target sequence
tggcatcaaagttattacttaacatt

SEQ ID NO: 222182 - DNA, 26 bp, Artificial sequence
  SiRNA target sequence
ggcatcaaagttattacttaacattt

SEQ ID NO: 222183 - DNA, 26 bp, Artificial sequence
  SiRNA target sequence
gcatcaaagttattacttaacatttc

SEQ ID NO: 222184 - DNA, 26 bp, Artificial sequence
  SiRNA target sequence
catcaaagttattacttaacatttca

SEQ ID NO: 222185 - DNA, 26 bp, Artificial sequence
  SiRNA target sequence
atcaaagttattacttaacatttcat

SEQ ID NO: 222186 - DNA, 26 bp, Artificial sequence
  SiRNA target sequence
tcaaagttattacttaacatttcatt

SEQ ID NO: 222187 - DNA, 26 bp, Artificial sequence
  SiRNA target sequence
caaagttattacttaacatttcatta

SEQ ID NO: 222188 - DNA, 26 bp, Artificial sequence
  SiRNA target sequence
aaagttattacttaacatttcattaa

SEQ ID NO: 222189 - DNA, 26 bp, Artificial sequence
  SiRNA target sequence
aagttattacttaacatttcattaac

SEQ ID NO: 222190 - DNA, 26 bp, Artificial sequence
  SiRNA target sequence
agttattacttaacatttcattaact

SEQ ID NO: 222191 - DNA, 26 bp, Artificial sequence
  SiRNA target sequence
gttattacttaacatttcattaactg

SEQ ID NO: 222192 - DNA, 26 bp, Artificial sequence
  SiRNA target sequence
ttattacttaacatttcattaactgt

SEQ ID NO: 222193 - DNA, 26 bp, Artificial sequence
  SiRNA target sequence
tattacttaacatttcattaactgtt

SEQ ID NO: 222194 - DNA, 26 bp, Artificial sequence
  SiRNA target sequence
attacttaacatttcattaactgtta

SEQ ID NO: 222195 - DNA, 26 bp, Artificial sequence
  SiRNA target sequence
ttacttaacatttcattaactgttat

SEQ ID NO: 222196 - DNA, 26 bp, Artificial sequence
  SiRNA target sequence
tacttaacatttcattaactgttatg

SEQ ID NO: 222197 - DNA, 26 bp, Artificial sequence
  SiRNA target sequence
acttaacatttcattaactgttatgt

SEQ ID NO: 222198 - DNA, 26 bp, Artificial sequence
  SiRNA target sequence
cttaacatttcattaactgttatgtt

SEQ ID NO: 222199 - DNA, 26 bp, Artificial sequence
  SiRNA target sequence
ttaacatttcattaactgttatgttc

SEQ ID NO: 222200 - DNA, 26 bp, Artificial sequence
  SiRNA target sequence
taacatttcattaactgttatgttct

SEQ ID NO: 222201 - DNA, 26 bp, Artificial sequence
  SiRNA target sequence
aacatttcattaactgttatgttcta

SEQ ID NO: 222202 - DNA, 26 bp, Artificial sequence
  SiRNA target sequence
acatttcattaactgttatgttctat

SEQ ID NO: 222203 - DNA, 26 bp, Artificial sequence
  SiRNA target sequence
catttcattaactgttatgttctatg

SEQ ID NO: 222204 - DNA, 26 bp, Artificial sequence
  SiRNA target sequence
atttcattaactgttatgttctatgg

SEQ ID NO: 222205 - DNA, 26 bp, Artificial sequence
  SiRNA target sequence
tttcattaactgttatgttctatggt

SEQ ID NO: 222206 - DNA, 26 bp, Artificial sequence
  SiRNA target sequence
ttcattaactgttatgttctatggta

SEQ ID NO: 222207 - DNA, 26 bp, Artificial sequence
  SiRNA target sequence
tcattaactgttatgttctatggtat

SEQ ID NO: 222208 - DNA, 26 bp, Artificial sequence
  SiRNA target sequence
cattaactgttatgttctatggtata

SEQ ID NO: 222209 - DNA, 26 bp, Artificial sequence
  SiRNA target sequence
attaactgttatgttctatggtatat

SEQ ID NO: 222210 - DNA, 26 bp, Artificial sequence
  SiRNA target sequence
ttaactgttatgttctatggtatatc

SEQ ID NO: 222211 - DNA, 26 bp, Artificial sequence
  SiRNA target sequence
taactgttatgttctatggtatatca

SEQ ID NO: 222212 - DNA, 26 bp, Artificial sequence
  SiRNA target sequence
aactgttatgttctatggtatatcaa

SEQ ID NO: 222213 - DNA, 26 bp, Artificial sequence
  SiRNA target sequence
actgttatgttctatggtatatcaac

SEQ ID NO: 222214 - DNA, 26 bp, Artificial sequence
  SiRNA target sequence
ctgttatgttctatggtatatcaact

SEQ ID NO: 222215 - DNA, 26 bp, Artificial sequence
  SiRNA target sequence
tgttatgttctatggtatatcaacta

SEQ ID NO: 222216 - DNA, 26 bp, Artificial sequence
  SiRNA target sequence
gttatgttctatggtatatcaactaa

SEQ ID NO: 222217 - DNA, 26 bp, Artificial sequence
  SiRNA target sequence
ttatgttctatggtatatcaactaat

SEQ ID NO: 222218 - DNA, 26 bp, Artificial sequence
  SiRNA target sequence
tatgttctatggtatatcaactaatt

SEQ ID NO: 222219 - DNA, 26 bp, Artificial sequence
  SiRNA target sequence
atgttctatggtatatcaactaattt

SEQ ID NO: 222220 - DNA, 26 bp, Artificial sequence
  SiRNA target sequence
tgttctatggtatatcaactaattta

SEQ ID NO: 222221 - DNA, 26 bp, Artificial sequence
  SiRNA target sequence
gttctatggtatatcaactaatttaa

SEQ ID NO: 222222 - DNA, 26 bp, Artificial sequence
  SiRNA target sequence
ttctatggtatatcaactaatttaat

SEQ ID NO: 222223 - DNA, 26 bp, Artificial sequence
  SiRNA target sequence
tctatggtatatcaactaatttaata

SEQ ID NO: 222224 - DNA, 26 bp, Artificial sequence
  SiRNA target sequence
ctatggtatatcaactaatttaatag

SEQ ID NO: 222225 - DNA, 26 bp, Artificial sequence
  SiRNA target sequence
tatggtatatcaactaatttaataga

SEQ ID NO: 222226 - DNA, 26 bp, Artificial sequence
  SiRNA target sequence
atggtatatcaactaatttaatagaa

SEQ ID NO: 222227 - DNA, 26 bp, Artificial sequence
  SiRNA target sequence
tggtatatcaactaatttaatagaat

SEQ ID NO: 222228 - DNA, 26 bp, Artificial sequence
  SiRNA target sequence
ggtatatcaactaatttaatagaatc

SEQ ID NO: 222229 - DNA, 26 bp, Artificial sequence
  SiRNA target sequence
gtatatcaactaatttaatagaatca

SEQ ID NO: 222230 - DNA, 26 bp, Artificial sequence
  SiRNA target sequence
tatatcaactaatttaatagaatcaa

SEQ ID NO: 222231 - DNA, 26 bp, Artificial sequence
  SiRNA target sequence
atatcaactaatttaatagaatcaac

SEQ ID NO: 222232 - DNA, 26 bp, Artificial sequence
  SiRNA target sequence
tatcaactaatttaatagaatcaaca

SEQ ID NO: 222233 - DNA, 26 bp, Artificial sequence
  SiRNA target sequence
atcaactaatttaatagaatcaacat

SEQ ID NO: 222234 - DNA, 26 bp, Artificial sequence
  SiRNA target sequence
tcaactaatttaatagaatcaacatt

SEQ ID NO: 222235 - DNA, 26 bp, Artificial sequence
  SiRNA target sequence
caactaatttaatagaatcaacattt

SEQ ID NO: 222236 - DNA, 26 bp, Artificial sequence
  SiRNA target sequence
aactaatttaatagaatcaacattta

SEQ ID NO: 222237 - DNA, 26 bp, Artificial sequence
  SiRNA target sequence
actaatttaatagaatcaacatttaa

SEQ ID NO: 222238 - DNA, 26 bp, Artificial sequence
  SiRNA target sequence
ctaatttaatagaatcaacatttaaa

SEQ ID NO: 222239 - DNA, 26 bp, Artificial sequence
  SiRNA target sequence
taatttaatagaatcaacatttaaaa

SEQ ID NO: 222240 - DNA, 26 bp, Artificial sequence
  SiRNA target sequence
aatttaatagaatcaacatttaaaag

SEQ ID NO: 222241 - DNA, 26 bp, Artificial sequence
  SiRNA target sequence
atttaatagaatcaacatttaaaagt

SEQ ID NO: 222242 - DNA, 26 bp, Artificial sequence
  SiRNA target sequence
tttaatagaatcaacatttaaaagtg

SEQ ID NO: 222243 - DNA, 26 bp, Artificial sequence
  SiRNA target sequence
ttaatagaatcaacatttaaaagtgg

SEQ ID NO: 222244 - DNA, 26 bp, Artificial sequence
  SiRNA target sequence
taatagaatcaacatttaaaagtgga

SEQ ID NO: 222245 - DNA, 26 bp, Artificial sequence
  SiRNA target sequence
aatagaatcaacatttaaaagtggac

SEQ ID NO: 222246 - DNA, 26 bp, Artificial sequence
  SiRNA target sequence
atagaatcaacatttaaaagtggact

SEQ ID NO: 222247 - DNA, 26 bp, Artificial sequence
  SiRNA target sequence
tagaatcaacatttaaaagtggactt

SEQ ID NO: 222248 - DNA, 26 bp, Artificial sequence
  SiRNA target sequence
agaatcaacatttaaaagtggacttg

SEQ ID NO: 222249 - DNA, 26 bp, Artificial sequence
  SiRNA target sequence
gaatcaacatttaaaagtggacttgt

SEQ ID NO: 222250 - DNA, 26 bp, Artificial sequence
  SiRNA target sequence
aatcaacatttaaaagtggacttgtg

SEQ ID NO: 222251 - DNA, 26 bp, Artificial sequence
  SiRNA target sequence
atcaacatttaaaagtggacttgtga

SEQ ID NO: 222252 - DNA, 26 bp, Artificial sequence
  SiRNA target sequence
tcaacatttaaaagtggacttgtgaa

SEQ ID NO: 222253 - DNA, 26 bp, Artificial sequence
  SiRNA target sequence
caacatttaaaagtggacttgtgaaa

SEQ ID NO: 222254 - DNA, 26 bp, Artificial sequence
  SiRNA target sequence
aacatttaaaagtggacttgtgaaag

SEQ ID NO: 222255 - DNA, 26 bp, Artificial sequence
  SiRNA target sequence
acatttaaaagtggacttgtgaaagg

SEQ ID NO: 222256 - DNA, 26 bp, Artificial sequence
  SiRNA target sequence
catttaaaagtggacttgtgaaaggt

SEQ ID NO: 222257 - DNA, 26 bp, Artificial sequence
  SiRNA target sequence
atttaaaagtggacttgtgaaaggtg

SEQ ID NO: 222258 - DNA, 26 bp, Artificial sequence
  SiRNA target sequence
tttaaaagtggacttgtgaaaggtgc

SEQ ID NO: 222259 - DNA, 26 bp, Artificial sequence
  SiRNA target sequence
ttaaaagtggacttgtgaaaggtgca

SEQ ID NO: 222260 - DNA, 26 bp, Artificial sequence
  SiRNA target sequence
taaaagtggacttgtgaaaggtgcag

SEQ ID NO: 222261 - DNA, 26 bp, Artificial sequence
  SiRNA target sequence
aaaagtggacttgtgaaaggtgcaga

SEQ ID NO: 222262 - DNA, 26 bp, Artificial sequence
  SiRNA target sequence
aaagtggacttgtgaaaggtgcagaa

SEQ ID NO: 222263 - DNA, 26 bp, Artificial sequence
  SiRNA target sequence
aagtggacttgtgaaaggtgcagaag

SEQ ID NO: 222264 - DNA, 26 bp, Artificial sequence
  SiRNA target sequence
agtggacttgtgaaaggtgcagaaga

SEQ ID NO: 222265 - DNA, 26 bp, Artificial sequence
  SiRNA target sequence
gtggacttgtgaaaggtgcagaagaa

SEQ ID NO: 222266 - DNA, 26 bp, Artificial sequence
  SiRNA target sequence
tggacttgtgaaaggtgcagaagaat

SEQ ID NO: 222267 - DNA, 26 bp, Artificial sequence
  SiRNA target sequence
ggacttgtgaaaggtgcagaagaatt

SEQ ID NO: 222268 - DNA, 26 bp, Artificial sequence
  SiRNA target sequence
gacttgtgaaaggtgcagaagaatta

SEQ ID NO: 222269 - DNA, 26 bp, Artificial sequence
  SiRNA target sequence
acttgtgaaaggtgcagaagaattaa

SEQ ID NO: 222270 - DNA, 26 bp, Artificial sequence
  SiRNA target sequence
cttgtgaaaggtgcagaagaattaaa

SEQ ID NO: 222271 - DNA, 26 bp, Artificial sequence
  SiRNA target sequence
ttgtgaaaggtgcagaagaattaaac

SEQ ID NO: 222272 - DNA, 26 bp, Artificial sequence
  SiRNA target sequence
tgtgaaaggtgcagaagaattaaacg

SEQ ID NO: 222273 - DNA, 26 bp, Artificial sequence
  SiRNA target sequence
gtgaaaggtgcagaagaattaaacga

SEQ ID NO: 222274 - DNA, 26 bp, Artificial sequence
  SiRNA target sequence
tgaaaggtgcagaagaattaaacgag

SEQ ID NO: 222275 - DNA, 26 bp, Artificial sequence
  SiRNA target sequence
gaaaggtgcagaagaattaaacgaga

SEQ ID NO: 222276 - DNA, 26 bp, Artificial sequence
  SiRNA target sequence
aaaggtgcagaagaattaaacgagaa

SEQ ID NO: 222277 - DNA, 26 bp, Artificial sequence
  SiRNA target sequence
aaggtgcagaagaattaaacgagaat

SEQ ID NO: 222278 - DNA, 26 bp, Artificial sequence
  SiRNA target sequence
aggtgcagaagaattaaacgagaata

SEQ ID NO: 222279 - DNA, 26 bp, Artificial sequence
  SiRNA target sequence
ggtgcagaagaattaaacgagaatac

SEQ ID NO: 222280 - DNA, 26 bp, Artificial sequence
  SiRNA target sequence
gtgcagaagaattaaacgagaatact

SEQ ID NO: 222281 - DNA, 26 bp, Artificial sequence
  SiRNA target sequence
tgcagaagaattaaacgagaatacta

SEQ ID NO: 222282 - DNA, 26 bp, Artificial sequence
  SiRNA target sequence
gcagaagaattaaacgagaatactaa

SEQ ID NO: 222283 - DNA, 26 bp, Artificial sequence
  SiRNA target sequence
cagaagaattaaacgagaatactaaa

SEQ ID NO: 222284 - DNA, 26 bp, Artificial sequence
  SiRNA target sequence
agaagaattaaacgagaatactaaaa

SEQ ID NO: 222285 - DNA, 26 bp, Artificial sequence
  SiRNA target sequence
gaagaattaaacgagaatactaaaag

SEQ ID NO: 222286 - DNA, 26 bp, Artificial sequence
  SiRNA target sequence
aagaattaaacgagaatactaaaagt

SEQ ID NO: 222287 - DNA, 26 bp, Artificial sequence
  SiRNA target sequence
agaattaaacgagaatactaaaagtt

SEQ ID NO: 222288 - DNA, 26 bp, Artificial sequence
  SiRNA target sequence
gaattaaacgagaatactaaaagtta

SEQ ID NO: 222289 - DNA, 26 bp, Artificial sequence
  SiRNA target sequence
aattaaacgagaatactaaaagttat

SEQ ID NO: 222290 - DNA, 26 bp, Artificial sequence
  SiRNA target sequence
attaaacgagaatactaaaagttatt

SEQ ID NO: 222291 - DNA, 26 bp, Artificial sequence
  SiRNA target sequence
ttaaacgagaatactaaaagttattc

SEQ ID NO: 222292 - DNA, 26 bp, Artificial sequence
  SiRNA target sequence
taaacgagaatactaaaagttattct

SEQ ID NO: 222293 - DNA, 26 bp, Artificial sequence
  SiRNA target sequence
aaacgagaatactaaaagttattcta

SEQ ID NO: 222294 - DNA, 26 bp, Artificial sequence
  SiRNA target sequence
aacgagaatactaaaagttattctat

SEQ ID NO: 222295 - DNA, 26 bp, Artificial sequence
  SiRNA target sequence
acgagaatactaaaagttattctatg

SEQ ID NO: 222296 - DNA, 26 bp, Artificial sequence
  SiRNA target sequence
cgagaatactaaaagttattctatgg

SEQ ID NO: 222297 - DNA, 26 bp, Artificial sequence
  SiRNA target sequence
gagaatactaaaagttattctatggg

SEQ ID NO: 222298 - DNA, 26 bp, Artificial sequence
  SiRNA target sequence
agaatactaaaagttattctatggga

SEQ ID NO: 222299 - DNA, 26 bp, Artificial sequence
  SiRNA target sequence
gaatactaaaagttattctatgggat

SEQ ID NO: 222300 - DNA, 26 bp, Artificial sequence
  SiRNA target sequence
aatactaaaagttattctatgggata

SEQ ID NO: 222301 - DNA, 26 bp, Artificial sequence
  SiRNA target sequence
atactaaaagttattctatgggatat

SEQ ID NO: 222302 - DNA, 26 bp, Artificial sequence
  SiRNA target sequence
tactaaaagttattctatgggatata

SEQ ID NO: 222303 - DNA, 26 bp, Artificial sequence
  SiRNA target sequence
actaaaagttattctatgggatataa

SEQ ID NO: 222304 - DNA, 26 bp, Artificial sequence
  SiRNA target sequence
ctaaaagttattctatgggatataat

SEQ ID NO: 222305 - DNA, 26 bp, Artificial sequence
  SiRNA target sequence
taaaagttattctatgggatataatt

SEQ ID NO: 222306 - DNA, 26 bp, Artificial sequence
  SiRNA target sequence
aaaagttattctatgggatataattc

SEQ ID NO: 222307 - DNA, 26 bp, Artificial sequence
  SiRNA target sequence
aaagttattctatgggatataattca

SEQ ID NO: 222308 - DNA, 26 bp, Artificial sequence
  SiRNA target sequence
aagttattctatgggatataattcat

SEQ ID NO: 222309 - DNA, 26 bp, Artificial sequence
  SiRNA target sequence
agttattctatgggatataattcatt

SEQ ID NO: 222310 - DNA, 26 bp, Artificial sequence
  SiRNA target sequence
gttattctatgggatataattcattt

SEQ ID NO: 222311 - DNA, 26 bp, Artificial sequence
  SiRNA target sequence
ttattctatgggatataattcatttg

SEQ ID NO: 222312 - DNA, 26 bp, Artificial sequence
  SiRNA target sequence
tattctatgggatataattcatttga

SEQ ID NO: 222313 - DNA, 26 bp, Artificial sequence
  SiRNA target sequence
attctatgggatataattcatttgaa

SEQ ID NO: 222314 - DNA, 26 bp, Artificial sequence
  SiRNA target sequence
ttctatgggatataattcatttgaac

SEQ ID NO: 222315 - DNA, 26 bp, Artificial sequence
  SiRNA target sequence
tctatgggatataattcatttgaaca

SEQ ID NO: 222316 - DNA, 26 bp, Artificial sequence
  SiRNA target sequence
ctatgggatataattcatttgaacaa

SEQ ID NO: 222317 - DNA, 26 bp, Artificial sequence
  SiRNA target sequence
tatgggatataattcatttgaacaaa

SEQ ID NO: 222318 - DNA, 26 bp, Artificial sequence
  SiRNA target sequence
atgggatataattcatttgaacaaaa

SEQ ID NO: 222319 - DNA, 26 bp, Artificial sequence
  SiRNA target sequence
tgggatataattcatttgaacaaaag

SEQ ID NO: 222320 - DNA, 26 bp, Artificial sequence
  SiRNA target sequence
gggatataattcatttgaacaaaaga

SEQ ID NO: 222321 - DNA, 26 bp, Artificial sequence
  SiRNA target sequence
ggatataattcatttgaacaaaagat

SEQ ID NO: 222322 - DNA, 26 bp, Artificial sequence
  SiRNA target sequence
gatataattcatttgaacaaaagata

SEQ ID NO: 222323 - DNA, 26 bp, Artificial sequence
  SiRNA target sequence
atataattcatttgaacaaaagatag

SEQ ID NO: 222324 - DNA, 26 bp, Artificial sequence
  SiRNA target sequence
tataattcatttgaacaaaagatagc

SEQ ID NO: 222325 - DNA, 26 bp, Artificial sequence
  SiRNA target sequence
ataattcatttgaacaaaagatagca

SEQ ID NO: 222326 - DNA, 26 bp, Artificial sequence
  SiRNA target sequence
taattcatttgaacaaaagatagcat

SEQ ID NO: 222327 - DNA, 26 bp, Artificial sequence
  SiRNA target sequence
aattcatttgaacaaaagatagcatc

SEQ ID NO: 222328 - DNA, 26 bp, Artificial sequence
  SiRNA target sequence
attcatttgaacaaaagatagcatca

SEQ ID NO: 222329 - DNA, 26 bp, Artificial sequence
  SiRNA target sequence
ttcatttgaacaaaagatagcatcaa

SEQ ID NO: 222330 - DNA, 26 bp, Artificial sequence
  SiRNA target sequence
tcatttgaacaaaagatagcatcaat

SEQ ID NO: 222331 - DNA, 26 bp, Artificial sequence
  SiRNA target sequence
catttgaacaaaagatagcatcaata

SEQ ID NO: 222332 - DNA, 26 bp, Artificial sequence
  SiRNA target sequence
atttgaacaaaagatagcatcaataa

SEQ ID NO: 222333 - DNA, 26 bp, Artificial sequence
  SiRNA target sequence
tttgaacaaaagatagcatcaataac

SEQ ID NO: 222334 - DNA, 26 bp, Artificial sequence
  SiRNA target sequence
ttgaacaaaagatagcatcaataact

SEQ ID NO: 222335 - DNA, 26 bp, Artificial sequence
  SiRNA target sequence
tgaacaaaagatagcatcaataactg

SEQ ID NO: 222336 - DNA, 26 bp, Artificial sequence
  SiRNA target sequence
gaacaaaagatagcatcaataactgt

SEQ ID NO: 222337 - DNA, 26 bp, Artificial sequence
  SiRNA target sequence
aacaaaagatagcatcaataactgtt

SEQ ID NO: 222338 - DNA, 26 bp, Artificial sequence
  SiRNA target sequence
acaaaagatagcatcaataactgtta

SEQ ID NO: 222339 - DNA, 26 bp, Artificial sequence
  SiRNA target sequence
caaaagatagcatcaataactgttat

SEQ ID NO: 222340 - DNA, 26 bp, Artificial sequence
  SiRNA target sequence
aaaagatagcatcaataactgttatt

SEQ ID NO: 222341 - DNA, 26 bp, Artificial sequence
  SiRNA target sequence
aaagatagcatcaataactgttatta

SEQ ID NO: 222342 - DNA, 26 bp, Artificial sequence
  SiRNA target sequence
aagatagcatcaataactgttattat

SEQ ID NO: 222343 - DNA, 26 bp, Artificial sequence
  SiRNA target sequence
agatagcatcaataactgttattatc

SEQ ID NO: 222344 - DNA, 26 bp, Artificial sequence
  SiRNA target sequence
gatagcatcaataactgttattatcc

SEQ ID NO: 222345 - DNA, 26 bp, Artificial sequence
  SiRNA target sequence
atagcatcaataactgttattatcct

SEQ ID NO: 222346 - DNA, 26 bp, Artificial sequence
  SiRNA target sequence
tagcatcaataactgttattatcctg

SEQ ID NO: 222347 - DNA, 26 bp, Artificial sequence
  SiRNA target sequence
agcatcaataactgttattatcctgc

SEQ ID NO: 222348 - DNA, 26 bp, Artificial sequence
  SiRNA target sequence
gcatcaataactgttattatcctgct

SEQ ID NO: 222349 - DNA, 26 bp, Artificial sequence
  SiRNA target sequence
catcaataactgttattatcctgctt

SEQ ID NO: 222350 - DNA, 26 bp, Artificial sequence
  SiRNA target sequence
atcaataactgttattatcctgcttt

SEQ ID NO: 222351 - DNA, 26 bp, Artificial sequence
  SiRNA target sequence
tcaataactgttattatcctgctttt

SEQ ID NO: 222352 - DNA, 26 bp, Artificial sequence
  SiRNA target sequence
caataactgttattatcctgctttta

SEQ ID NO: 222353 - DNA, 26 bp, Artificial sequence
  SiRNA target sequence
aataactgttattatcctgcttttat

SEQ ID NO: 222354 - DNA, 26 bp, Artificial sequence
  SiRNA target sequence
ataactgttattatcctgcttttatc

SEQ ID NO: 222355 - DNA, 26 bp, Artificial sequence
  SiRNA target sequence
taactgttattatcctgcttttatca

SEQ ID NO: 222356 - DNA, 26 bp, Artificial sequence
  SiRNA target sequence
aactgttattatcctgcttttatcac

SEQ ID NO: 222357 - DNA, 26 bp, Artificial sequence
  SiRNA target sequence
actgttattatcctgcttttatcacc

SEQ ID NO: 222358 - DNA, 26 bp, Artificial sequence
  SiRNA target sequence
ctgttattatcctgcttttatcacca

SEQ ID NO: 222359 - DNA, 26 bp, Artificial sequence
  SiRNA target sequence
tgttattatcctgcttttatcaccat

SEQ ID NO: 222360 - DNA, 26 bp, Artificial sequence
  SiRNA target sequence
gttattatcctgcttttatcaccatt

SEQ ID NO: 222361 - DNA, 26 bp, Artificial sequence
  SiRNA target sequence
ttattatcctgcttttatcaccattt

SEQ ID NO: 222362 - DNA, 26 bp, Artificial sequence
  SiRNA target sequence
tattatcctgcttttatcaccatttc

SEQ ID NO: 222363 - DNA, 26 bp, Artificial sequence
  SiRNA target sequence
attatcctgcttttatcaccatttcc

SEQ ID NO: 222364 - DNA, 26 bp, Artificial sequence
  SiRNA target sequence
ttatcctgcttttatcaccatttcca

SEQ ID NO: 222365 - DNA, 26 bp, Artificial sequence
  SiRNA target sequence
tatcctgcttttatcaccatttccaa

SEQ ID NO: 222366 - DNA, 26 bp, Artificial sequence
  SiRNA target sequence
atcctgcttttatcaccatttccaaa

SEQ ID NO: 222367 - DNA, 26 bp, Artificial sequence
  SiRNA target sequence
tcctgcttttatcaccatttccaaaa

SEQ ID NO: 222368 - DNA, 26 bp, Artificial sequence
  SiRNA target sequence
cctgcttttatcaccatttccaaaat

SEQ ID NO: 222369 - DNA, 26 bp, Artificial sequence
  SiRNA target sequence
ctgcttttatcaccatttccaaaatt

SEQ ID NO: 222370 - DNA, 26 bp, Artificial sequence
  SiRNA target sequence
tgcttttatcaccatttccaaaatta

SEQ ID NO: 222371 - DNA, 26 bp, Artificial sequence
  SiRNA target sequence
gcttttatcaccatttccaaaattaa

SEQ ID NO: 222372 - DNA, 26 bp, Artificial sequence
  SiRNA target sequence
cttttatcaccatttccaaaattaat

SEQ ID NO: 222373 - DNA, 26 bp, Artificial sequence
  SiRNA target sequence
ttttatcaccatttccaaaattaata

SEQ ID NO: 222374 - DNA, 26 bp, Artificial sequence
  SiRNA target sequence
tttatcaccatttccaaaattaatac

SEQ ID NO: 222375 - DNA, 26 bp, Artificial sequence
  SiRNA target sequence
ttatcaccatttccaaaattaataca

SEQ ID NO: 222376 - DNA, 26 bp, Artificial sequence
  SiRNA target sequence
tatcaccatttccaaaattaatacaa

SEQ ID NO: 222377 - DNA, 26 bp, Artificial sequence
  SiRNA target sequence
atcaccatttccaaaattaatacaaa

SEQ ID NO: 222378 - DNA, 26 bp, Artificial sequence
  SiRNA target sequence
tcaccatttccaaaattaatacaaac

SEQ ID NO: 222379 - DNA, 26 bp, Artificial sequence
  SiRNA target sequence
caccatttccaaaattaatacaaacc

SEQ ID NO: 222380 - DNA, 26 bp, Artificial sequence
  SiRNA target sequence
accatttccaaaattaatacaaacca

SEQ ID NO: 222381 - DNA, 26 bp, Artificial sequence
  SiRNA target sequence
ccatttccaaaattaatacaaaccaa

SEQ ID NO: 222382 - DNA, 26 bp, Artificial sequence
  SiRNA target sequence
catttccaaaattaatacaaaccaaa

SEQ ID NO: 222383 - DNA, 26 bp, Artificial sequence
  SiRNA target sequence
atttccaaaattaatacaaaccaaag

SEQ ID NO: 222384 - DNA, 26 bp, Artificial sequence
  SiRNA target sequence
tttccaaaattaatacaaaccaaagg

SEQ ID NO: 222385 - DNA, 26 bp, Artificial sequence
  SiRNA target sequence
ttccaaaattaatacaaaccaaagga

SEQ ID NO: 222386 - DNA, 26 bp, Artificial sequence
  SiRNA target sequence
tccaaaattaatacaaaccaaaggat

SEQ ID NO: 222387 - DNA, 26 bp, Artificial sequence
  SiRNA target sequence
ccaaaattaatacaaaccaaaggatg

SEQ ID NO: 222388 - DNA, 26 bp, Artificial sequence
  SiRNA target sequence
caaaattaatacaaaccaaaggatgg

SEQ ID NO: 222389 - DNA, 26 bp, Artificial sequence
  SiRNA target sequence
aaaattaatacaaaccaaaggatgga

SEQ ID NO: 222390 - DNA, 26 bp, Artificial sequence
  SiRNA target sequence
aaattaatacaaaccaaaggatggat

SEQ ID NO: 222391 - DNA, 26 bp, Artificial sequence
  SiRNA target sequence
aattaatacaaaccaaaggatggata

SEQ ID NO: 222392 - DNA, 26 bp, Artificial sequence
  SiRNA target sequence
attaatacaaaccaaaggatggatat

SEQ ID NO: 222393 - DNA, 26 bp, Artificial sequence
  SiRNA target sequence
ttaatacaaaccaaaggatggatatt

SEQ ID NO: 222394 - DNA, 26 bp, Artificial sequence
  SiRNA target sequence
taatacaaaccaaaggatggatattt

SEQ ID NO: 222395 - DNA, 26 bp, Artificial sequence
  SiRNA target sequence
aatacaaaccaaaggatggatatttg

SEQ ID NO: 222396 - DNA, 26 bp, Artificial sequence
  SiRNA target sequence
atacaaaccaaaggatggatatttgt

SEQ ID NO: 222397 - DNA, 26 bp, Artificial sequence
  SiRNA target sequence
tacaaaccaaaggatggatatttgtt

SEQ ID NO: 222398 - DNA, 26 bp, Artificial sequence
  SiRNA target sequence
acaaaccaaaggatggatatttgttg

SEQ ID NO: 222399 - DNA, 26 bp, Artificial sequence
  SiRNA target sequence
caaaccaaaggatggatatttgttgc

SEQ ID NO: 222400 - DNA, 26 bp, Artificial sequence
  SiRNA target sequence
aaaccaaaggatggatatttgttgcc

SEQ ID NO: 222401 - DNA, 26 bp, Artificial sequence
  SiRNA target sequence
aaccaaaggatggatatttgttgcca

SEQ ID NO: 222402 - DNA, 26 bp, Artificial sequence
  SiRNA target sequence
accaaaggatggatatttgttgccat

SEQ ID NO: 222403 - DNA, 26 bp, Artificial sequence
  SiRNA target sequence
ccaaaggatggatatttgttgccata

SEQ ID NO: 222404 - DNA, 26 bp, Artificial sequence
  SiRNA target sequence
caaaggatggatatttgttgccatag

SEQ ID NO: 222405 - DNA, 26 bp, Artificial sequence
  SiRNA target sequence
aaaggatggatatttgttgccatagc

SEQ ID NO: 222406 - DNA, 26 bp, Artificial sequence
  SiRNA target sequence
aaggatggatatttgttgccatagcg

SEQ ID NO: 222407 - DNA, 26 bp, Artificial sequence
  SiRNA target sequence
aggatggatatttgttgccatagcgt

SEQ ID NO: 222408 - DNA, 26 bp, Artificial sequence
  SiRNA target sequence
ggatggatatttgttgccatagcgtg

SEQ ID NO: 222409 - DNA, 26 bp, Artificial sequence
  SiRNA target sequence
gatggatatttgttgccatagcgtgc

SEQ ID NO: 222410 - DNA, 26 bp, Artificial sequence
  SiRNA target sequence
atggatatttgttgccatagcgtgcc

SEQ ID NO: 222411 - DNA, 26 bp, Artificial sequence
  SiRNA target sequence
tggatatttgttgccatagcgtgccc

SEQ ID NO: 222412 - DNA, 26 bp, Artificial sequence
  SiRNA target sequence
ggatatttgttgccatagcgtgccca

SEQ ID NO: 222413 - DNA, 26 bp, Artificial sequence
  SiRNA target sequence
gatatttgttgccatagcgtgcccac

SEQ ID NO: 222414 - DNA, 26 bp, Artificial sequence
  SiRNA target sequence
atatttgttgccatagcgtgcccact

SEQ ID NO: 222415 - DNA, 26 bp, Artificial sequence
  SiRNA target sequence
tatttgttgccatagcgtgcccactt

SEQ ID NO: 222416 - DNA, 26 bp, Artificial sequence
  SiRNA target sequence
atttgttgccatagcgtgcccactta

SEQ ID NO: 222417 - DNA, 26 bp, Artificial sequence
  SiRNA target sequence
tttgttgccatagcgtgcccacttat

SEQ ID NO: 222418 - DNA, 26 bp, Artificial sequence
  SiRNA target sequence
ttgttgccatagcgtgcccacttatt

SEQ ID NO: 222419 - DNA, 26 bp, Artificial sequence
  SiRNA target sequence
tgttgccatagcgtgcccacttatta

SEQ ID NO: 222420 - DNA, 26 bp, Artificial sequence
  SiRNA target sequence
gttgccatagcgtgcccacttattac

SEQ ID NO: 222421 - DNA, 26 bp, Artificial sequence
  SiRNA target sequence
ttgccatagcgtgcccacttattacc

SEQ ID NO: 222422 - DNA, 26 bp, Artificial sequence
  SiRNA target sequence
tgccatagcgtgcccacttattaccc

SEQ ID NO: 222423 - DNA, 26 bp, Artificial sequence
  SiRNA target sequence
gccatagcgtgcccacttattaccct

SEQ ID NO: 222424 - DNA, 26 bp, Artificial sequence
  SiRNA target sequence
ccatagcgtgcccacttattaccctt

SEQ ID NO: 222425 - DNA, 26 bp, Artificial sequence
  SiRNA target sequence
catagcgtgcccacttattacccttt

SEQ ID NO: 222426 - DNA, 26 bp, Artificial sequence
  SiRNA target sequence
atagcgtgcccacttattaccctttt

SEQ ID NO: 222427 - DNA, 26 bp, Artificial sequence
  SiRNA target sequence
tagcgtgcccacttattacccttttt

SEQ ID NO: 222428 - DNA, 26 bp, Artificial sequence
  SiRNA target sequence
agcgtgcccacttattaccctttttg

SEQ ID NO: 222429 - DNA, 26 bp, Artificial sequence
  SiRNA target sequence
gcgtgcccacttattaccctttttgc

SEQ ID NO: 222430 - DNA, 26 bp, Artificial sequence
  SiRNA target sequence
cgtgcccacttattaccctttttgct

SEQ ID NO: 222431 - DNA, 26 bp, Artificial sequence
  SiRNA target sequence
gtgcccacttattaccctttttgctg

SEQ ID NO: 222432 - DNA, 26 bp, Artificial sequence
  SiRNA target sequence
tgcccacttattaccctttttgctgt

SEQ ID NO: 222433 - DNA, 26 bp, Artificial sequence
  SiRNA target sequence
gcccacttattaccctttttgctgta

SEQ ID NO: 222434 - DNA, 26 bp, Artificial sequence
  SiRNA target sequence
cccacttattaccctttttgctgtag

SEQ ID NO: 222435 - DNA, 26 bp, Artificial sequence
  SiRNA target sequence
ccacttattaccctttttgctgtagt

SEQ ID NO: 222436 - DNA, 26 bp, Artificial sequence
  SiRNA target sequence
cacttattaccctttttgctgtagtt

SEQ ID NO: 222437 - DNA, 26 bp, Artificial sequence
  SiRNA target sequence
acttattaccctttttgctgtagttt

SEQ ID NO: 222438 - DNA, 26 bp, Artificial sequence
  SiRNA target sequence
cttattaccctttttgctgtagtttc

SEQ ID NO: 222439 - DNA, 26 bp, Artificial sequence
  SiRNA target sequence
ttattaccctttttgctgtagtttct

SEQ ID NO: 222440 - DNA, 26 bp, Artificial sequence
  SiRNA target sequence
tattaccctttttgctgtagtttctg

SEQ ID NO: 222441 - DNA, 26 bp, Artificial sequence
  SiRNA target sequence
attaccctttttgctgtagtttctgt

SEQ ID NO: 222442 - DNA, 26 bp, Artificial sequence
  SiRNA target sequence
ttaccctttttgctgtagtttctgtg

SEQ ID NO: 222443 - DNA, 26 bp, Artificial sequence
  SiRNA target sequence
taccctttttgctgtagtttctgtgt

SEQ ID NO: 222444 - DNA, 26 bp, Artificial sequence
  SiRNA target sequence
accctttttgctgtagtttctgtgtg

SEQ ID NO: 222445 - DNA, 26 bp, Artificial sequence
  SiRNA target sequence
ccctttttgctgtagtttctgtgtgt

SEQ ID NO: 222446 - DNA, 26 bp, Artificial sequence
  SiRNA target sequence
cctttttgctgtagtttctgtgtgtg

SEQ ID NO: 222447 - DNA, 26 bp, Artificial sequence
  SiRNA target sequence
ctttttgctgtagtttctgtgtgtgg

SEQ ID NO: 222448 - DNA, 26 bp, Artificial sequence
  SiRNA target sequence
tttttgctgtagtttctgtgtgtggt

SEQ ID NO: 222449 - DNA, 26 bp, Artificial sequence
  SiRNA target sequence
ttttgctgtagtttctgtgtgtggtc

SEQ ID NO: 222450 - DNA, 26 bp, Artificial sequence
  SiRNA target sequence
tttgctgtagtttctgtgtgtggtct

SEQ ID NO: 222451 - DNA, 26 bp, Artificial sequence
  SiRNA target sequence
ttgctgtagtttctgtgtgtggtctt

SEQ ID NO: 222452 - DNA, 26 bp, Artificial sequence
  SiRNA target sequence
tgctgtagtttctgtgtgtggtcttg

SEQ ID NO: 222453 - DNA, 26 bp, Artificial sequence
  SiRNA target sequence
gctgtagtttctgtgtgtggtcttgc

SEQ ID NO: 222454 - DNA, 26 bp, Artificial sequence
  SiRNA target sequence
ctgtagtttctgtgtgtggtcttgct

SEQ ID NO: 222455 - DNA, 26 bp, Artificial sequence
  SiRNA target sequence
tgtagtttctgtgtgtggtcttgctt

SEQ ID NO: 222456 - DNA, 26 bp, Artificial sequence
  SiRNA target sequence
gtagtttctgtgtgtggtcttgcttt

SEQ ID NO: 222457 - DNA, 26 bp, Artificial sequence
  SiRNA target sequence
tagtttctgtgtgtggtcttgctttt

SEQ ID NO: 222458 - DNA, 26 bp, Artificial sequence
  SiRNA target sequence
agtttctgtgtgtggtcttgcttttt

SEQ ID NO: 222459 - DNA, 26 bp, Artificial sequence
  SiRNA target sequence
gtttctgtgtgtggtcttgcttttta

SEQ ID NO: 222460 - DNA, 26 bp, Artificial sequence
  SiRNA target sequence
tttctgtgtgtggtcttgctttttac

SEQ ID NO: 222461 - DNA, 26 bp, Artificial sequence
  SiRNA target sequence
ttctgtgtgtggtcttgctttttaca

SEQ ID NO: 222462 - DNA, 26 bp, Artificial sequence
  SiRNA target sequence
tctgtgtgtggtcttgctttttacaa

SEQ ID NO: 222463 - DNA, 26 bp, Artificial sequence
  SiRNA target sequence
ctgtgtgtggtcttgctttttacaat

SEQ ID NO: 222464 - DNA, 26 bp, Artificial sequence
  SiRNA target sequence
tgtgtgtggtcttgctttttacaatt

SEQ ID NO: 222465 - DNA, 26 bp, Artificial sequence
  SiRNA target sequence
gtgtgtggtcttgctttttacaatta

SEQ ID NO: 222466 - DNA, 26 bp, Artificial sequence
  SiRNA target sequence
tgtgtggtcttgctttttacaattat

SEQ ID NO: 222467 - DNA, 26 bp, Artificial sequence
  SiRNA target sequence
gtgtggtcttgctttttacaattatc

SEQ ID NO: 222468 - DNA, 26 bp, Artificial sequence
  SiRNA target sequence
tgtggtcttgctttttacaattatcc

SEQ ID NO: 222469 - DNA, 26 bp, Artificial sequence
  SiRNA target sequence
gtggtcttgctttttacaattatccg

SEQ ID NO: 222470 - DNA, 26 bp, Artificial sequence
  SiRNA target sequence
tggtcttgctttttacaattatccgg

SEQ ID NO: 222471 - DNA, 26 bp, Artificial sequence
  SiRNA target sequence
ggtcttgctttttacaattatccggc

SEQ ID NO: 222472 - DNA, 26 bp, Artificial sequence
  SiRNA target sequence
gtcttgctttttacaattatccggca

SEQ ID NO: 222473 - DNA, 26 bp, Artificial sequence
  SiRNA target sequence
tcttgctttttacaattatccggcaa

SEQ ID NO: 222474 - DNA, 26 bp, Artificial sequence
  SiRNA target sequence
cttgctttttacaattatccggcaac

SEQ ID NO: 222475 - DNA, 26 bp, Artificial sequence
  SiRNA target sequence
ttgctttttacaattatccggcaaca

SEQ ID NO: 222476 - DNA, 26 bp, Artificial sequence
  SiRNA target sequence
tgctttttacaattatccggcaacaa

SEQ ID NO: 222477 - DNA, 26 bp, Artificial sequence
  SiRNA target sequence
gctttttacaattatccggcaacaaa

SEQ ID NO: 222478 - DNA, 26 bp, Artificial sequence
  SiRNA target sequence
ctttttacaattatccggcaacaaat

SEQ ID NO: 222479 - DNA, 26 bp, Artificial sequence
  SiRNA target sequence
tttttacaattatccggcaacaaata

SEQ ID NO: 222480 - DNA, 26 bp, Artificial sequence
  SiRNA target sequence
ttttacaattatccggcaacaaataa

SEQ ID NO: 222481 - DNA, 26 bp, Artificial sequence
  SiRNA target sequence
tttacaattatccggcaacaaataat

SEQ ID NO: 222482 - DNA, 26 bp, Artificial sequence
  SiRNA target sequence
ttacaattatccggcaacaaataatg

SEQ ID NO: 222483 - DNA, 26 bp, Artificial sequence
  SiRNA target sequence
tacaattatccggcaacaaataatga

SEQ ID NO: 222484 - DNA, 26 bp, Artificial sequence
  SiRNA target sequence
acaattatccggcaacaaataatgac

SEQ ID NO: 222485 - DNA, 26 bp, Artificial sequence
  SiRNA target sequence
caattatccggcaacaaataatgaca

SEQ ID NO: 222486 - DNA, 26 bp, Artificial sequence
  SiRNA target sequence
aattatccggcaacaaataatgacac

SEQ ID NO: 222487 - DNA, 26 bp, Artificial sequence
  SiRNA target sequence
attatccggcaacaaataatgacaca

SEQ ID NO: 222488 - DNA, 26 bp, Artificial sequence
  SiRNA target sequence
ttatccggcaacaaataatgacacaa

SEQ ID NO: 222489 - DNA, 26 bp, Artificial sequence
  SiRNA target sequence
tatccggcaacaaataatgacacaaa

SEQ ID NO: 222490 - DNA, 26 bp, Artificial sequence
  SiRNA target sequence
atccggcaacaaataatgacacaaat

SEQ ID NO: 222491 - DNA, 26 bp, Artificial sequence
  SiRNA target sequence
tccggcaacaaataatgacacaaatt

SEQ ID NO: 222492 - DNA, 26 bp, Artificial sequence
  SiRNA target sequence
ccggcaacaaataatgacacaaattt

SEQ ID NO: 222493 - DNA, 26 bp, Artificial sequence
  SiRNA target sequence
cggcaacaaataatgacacaaatttt

SEQ ID NO: 222494 - DNA, 26 bp, Artificial sequence
  SiRNA target sequence
ggcaacaaataatgacacaaattttt

SEQ ID NO: 222495 - DNA, 26 bp, Artificial sequence
  SiRNA target sequence
gcaacaaataatgacacaaatttttt

SEQ ID NO: 222496 - DNA, 26 bp, Artificial sequence
  SiRNA target sequence
caacaaataatgacacaaattttttt

SEQ ID NO: 222497 - DNA, 26 bp, Artificial sequence
  SiRNA target sequence
aacaaataatgacacaaatttttttc

SEQ ID NO: 222498 - DNA, 26 bp, Artificial sequence
  SiRNA target sequence
acaaataatgacacaaatttttttct

SEQ ID NO: 222499 - DNA, 26 bp, Artificial sequence
  SiRNA target sequence
caaataatgacacaaatttttttcta

SEQ ID NO: 222500 - DNA, 26 bp, Artificial sequence
  SiRNA target sequence
aaataatgacacaaatttttttctaa

SEQ ID NO: 222501 - DNA, 26 bp, Artificial sequence
  SiRNA target sequence
aataatgacacaaatttttttctaaa

SEQ ID NO: 222502 - DNA, 26 bp, Artificial sequence
  SiRNA target sequence
ataatgacacaaatttttttctaaat

SEQ ID NO: 222503 - DNA, 26 bp, Artificial sequence
  SiRNA target sequence
taatgacacaaatttttttctaaatt

SEQ ID NO: 222504 - DNA, 26 bp, Artificial sequence
  SiRNA target sequence
aatgacacaaatttttttctaaattc

SEQ ID NO: 222505 - DNA, 26 bp, Artificial sequence
  SiRNA target sequence
atgacacaaatttttttctaaattca

SEQ ID NO: 222506 - DNA, 26 bp, Artificial sequence
  SiRNA target sequence
tgacacaaatttttttctaaattcat

SEQ ID NO: 222507 - DNA, 26 bp, Artificial sequence
  SiRNA target sequence
gacacaaatttttttctaaattcatt

SEQ ID NO: 222508 - DNA, 26 bp, Artificial sequence
  SiRNA target sequence
acacaaatttttttctaaattcatta

SEQ ID NO: 222509 - DNA, 26 bp, Artificial sequence
  SiRNA target sequence
cacaaatttttttctaaattcattat

SEQ ID NO: 222510 - DNA, 26 bp, Artificial sequence
  SiRNA target sequence
acaaatttttttctaaattcattatg

SEQ ID NO: 222511 - DNA, 26 bp, Artificial sequence
  SiRNA target sequence
caaatttttttctaaattcattatgt

SEQ ID NO: 222512 - DNA, 26 bp, Artificial sequence
  SiRNA target sequence
aaatttttttctaaattcattatgtg

SEQ ID NO: 222513 - DNA, 26 bp, Artificial sequence
  SiRNA target sequence
aatttttttctaaattcattatgtgc

SEQ ID NO: 222514 - DNA, 26 bp, Artificial sequence
  SiRNA target sequence
atttttttctaaattcattatgtgct

SEQ ID NO: 222515 - DNA, 26 bp, Artificial sequence
  SiRNA target sequence
tttttttctaaattcattatgtgcta

SEQ ID NO: 222516 - DNA, 26 bp, Artificial sequence
  SiRNA target sequence
ttttttctaaattcattatgtgctac

SEQ ID NO: 222517 - DNA, 26 bp, Artificial sequence
  SiRNA target sequence
tttttctaaattcattatgtgctacg

SEQ ID NO: 222518 - DNA, 26 bp, Artificial sequence
  SiRNA target sequence
ttttctaaattcattatgtgctacgc

SEQ ID NO: 222519 - DNA, 26 bp, Artificial sequence
  SiRNA target sequence
tttctaaattcattatgtgctacgcc

SEQ ID NO: 222520 - DNA, 26 bp, Artificial sequence
  SiRNA target sequence
ttctaaattcattatgtgctacgccc

SEQ ID NO: 222521 - DNA, 26 bp, Artificial sequence
  SiRNA target sequence
tctaaattcattatgtgctacgcccg

SEQ ID NO: 222522 - DNA, 26 bp, Artificial sequence
  SiRNA target sequence
ctaaattcattatgtgctacgcccgg

SEQ ID NO: 222523 - DNA, 26 bp, Artificial sequence
  SiRNA target sequence
taaattcattatgtgctacgcccggt

SEQ ID NO: 222524 - DNA, 26 bp, Artificial sequence
  SiRNA target sequence
aaattcattatgtgctacgcccggta

SEQ ID NO: 222525 - DNA, 26 bp, Artificial sequence
  SiRNA target sequence
aattcattatgtgctacgcccggtaa

SEQ ID NO: 222526 - DNA, 26 bp, Artificial sequence
  SiRNA target sequence
attcattatgtgctacgcccggtaaa

SEQ ID NO: 222527 - DNA, 26 bp, Artificial sequence
  SiRNA target sequence
ttcattatgtgctacgcccggtaaat

SEQ ID NO: 222528 - DNA, 26 bp, Artificial sequence
  SiRNA target sequence
tcattatgtgctacgcccggtaaatc

SEQ ID NO: 222529 - DNA, 26 bp, Artificial sequence
  SiRNA target sequence
cattatgtgctacgcccggtaaatcg

SEQ ID NO: 222530 - DNA, 26 bp, Artificial sequence
  SiRNA target sequence
attatgtgctacgcccggtaaatcgt

SEQ ID NO: 222531 - DNA, 26 bp, Artificial sequence
  SiRNA target sequence
ttatgtgctacgcccggtaaatcgtt

SEQ ID NO: 222532 - DNA, 26 bp, Artificial sequence
  SiRNA target sequence
tatgtgctacgcccggtaaatcgttt

SEQ ID NO: 222533 - DNA, 26 bp, Artificial sequence
  SiRNA target sequence
atgtgctacgcccggtaaatcgttta

SEQ ID NO: 222534 - DNA, 26 bp, Artificial sequence
  SiRNA target sequence
tgtgctacgcccggtaaatcgtttat

SEQ ID NO: 222535 - DNA, 26 bp, Artificial sequence
  SiRNA target sequence
gtgctacgcccggtaaatcgtttata

SEQ ID NO: 222536 - DNA, 26 bp, Artificial sequence
  SiRNA target sequence
tgctacgcccggtaaatcgtttataa

SEQ ID NO: 222537 - DNA, 26 bp, Artificial sequence
  SiRNA target sequence
gctacgcccggtaaatcgtttataaa

SEQ ID NO: 222538 - DNA, 26 bp, Artificial sequence
  SiRNA target sequence
ctacgcccggtaaatcgtttataaaa

SEQ ID NO: 222539 - DNA, 26 bp, Artificial sequence
  SiRNA target sequence
tacgcccggtaaatcgtttataaaat

SEQ ID NO: 222540 - DNA, 26 bp, Artificial sequence
  SiRNA target sequence
acgcccggtaaatcgtttataaaatt

SEQ ID NO: 222541 - DNA, 26 bp, Artificial sequence
  SiRNA target sequence
cgcccggtaaatcgtttataaaatta

SEQ ID NO: 222542 - DNA, 26 bp, Artificial sequence
  SiRNA target sequence
gcccggtaaatcgtttataaaattag

SEQ ID NO: 222543 - DNA, 26 bp, Artificial sequence
  SiRNA target sequence
cccggtaaatcgtttataaaattaga

SEQ ID NO: 222544 - DNA, 26 bp, Artificial sequence
  SiRNA target sequence
ccggtaaatcgtttataaaattagaa

SEQ ID NO: 222545 - DNA, 26 bp, Artificial sequence
  SiRNA target sequence
cggtaaatcgtttataaaattagaaa

SEQ ID NO: 222546 - DNA, 26 bp, Artificial sequence
  SiRNA target sequence
ggtaaatcgtttataaaattagaaaa

SEQ ID NO: 222547 - DNA, 26 bp, Artificial sequence
  SiRNA target sequence
gtaaatcgtttataaaattagaaaat

SEQ ID NO: 222548 - DNA, 26 bp, Artificial sequence
  SiRNA target sequence
taaatcgtttataaaattagaaaatg

SEQ ID NO: 222549 - DNA, 26 bp, Artificial sequence
  SiRNA target sequence
aaatcgtttataaaattagaaaatgt

SEQ ID NO: 222550 - DNA, 26 bp, Artificial sequence
  SiRNA target sequence
aatcgtttataaaattagaaaatgtt

SEQ ID NO: 222551 - DNA, 26 bp, Artificial sequence
  SiRNA target sequence
atcgtttataaaattagaaaatgttt

SEQ ID NO: 222552 - DNA, 26 bp, Artificial sequence
  SiRNA target sequence
tcgtttataaaattagaaaatgtttt

SEQ ID NO: 222553 - DNA, 26 bp, Artificial sequence
  SiRNA target sequence
cgtttataaaattagaaaatgtttta

SEQ ID NO: 222554 - DNA, 26 bp, Artificial sequence
  SiRNA target sequence
gtttataaaattagaaaatgttttag

SEQ ID NO: 222555 - DNA, 26 bp, Artificial sequence
  SiRNA target sequence
tttataaaattagaaaatgttttagg

SEQ ID NO: 222556 - DNA, 26 bp, Artificial sequence
  SiRNA target sequence
ttataaaattagaaaatgttttagga

SEQ ID NO: 222557 - DNA, 26 bp, Artificial sequence
  SiRNA target sequence
tataaaattagaaaatgttttaggat

SEQ ID NO: 222558 - DNA, 26 bp, Artificial sequence
  SiRNA target sequence
ataaaattagaaaatgttttaggatg

SEQ ID NO: 222559 - DNA, 26 bp, Artificial sequence
  SiRNA target sequence
taaaattagaaaatgttttaggatgt

SEQ ID NO: 222560 - DNA, 26 bp, Artificial sequence
  SiRNA target sequence
aaaattagaaaatgttttaggatgtg

SEQ ID NO: 222561 - DNA, 26 bp, Artificial sequence
  SiRNA target sequence
aaattagaaaatgttttaggatgtgt

SEQ ID NO: 222562 - DNA, 26 bp, Artificial sequence
  SiRNA target sequence
aattagaaaatgttttaggatgtgta

SEQ ID NO: 222563 - DNA, 26 bp, Artificial sequence
  SiRNA target sequence
attagaaaatgttttaggatgtgtag

SEQ ID NO: 222564 - DNA, 26 bp, Artificial sequence
  SiRNA target sequence
ttagaaaatgttttaggatgtgtagc

SEQ ID NO: 222565 - DNA, 26 bp, Artificial sequence
  SiRNA target sequence
tagaaaatgttttaggatgtgtagct

SEQ ID NO: 222566 - DNA, 26 bp, Artificial sequence
  SiRNA target sequence
agaaaatgttttaggatgtgtagctg

SEQ ID NO: 222567 - DNA, 26 bp, Artificial sequence
  SiRNA target sequence
gaaaatgttttaggatgtgtagctgt

SEQ ID NO: 222568 - DNA, 26 bp, Artificial sequence
  SiRNA target sequence
aaaatgttttaggatgtgtagctgta

SEQ ID NO: 222569 - DNA, 26 bp, Artificial sequence
  SiRNA target sequence
aaatgttttaggatgtgtagctgtag

SEQ ID NO: 222570 - DNA, 26 bp, Artificial sequence
  SiRNA target sequence
aatgttttaggatgtgtagctgtagc

SEQ ID NO: 222571 - DNA, 26 bp, Artificial sequence
  SiRNA target sequence
atgttttaggatgtgtagctgtagct

SEQ ID NO: 222572 - DNA, 26 bp, Artificial sequence
  SiRNA target sequence
tgttttaggatgtgtagctgtagctc

SEQ ID NO: 222573 - DNA, 26 bp, Artificial sequence
  SiRNA target sequence
gttttaggatgtgtagctgtagctct

SEQ ID NO: 222574 - DNA, 26 bp, Artificial sequence
  SiRNA target sequence
ttttaggatgtgtagctgtagctctt

SEQ ID NO: 222575 - DNA, 26 bp, Artificial sequence
  SiRNA target sequence
tttaggatgtgtagctgtagctctta

SEQ ID NO: 222576 - DNA, 26 bp, Artificial sequence
  SiRNA target sequence
ttaggatgtgtagctgtagctcttat

SEQ ID NO: 222577 - DNA, 26 bp, Artificial sequence
  SiRNA target sequence
taggatgtgtagctgtagctcttatg

SEQ ID NO: 222578 - DNA, 26 bp, Artificial sequence
  SiRNA target sequence
aggatgtgtagctgtagctcttatga

SEQ ID NO: 222579 - DNA, 26 bp, Artificial sequence
  SiRNA target sequence
ggatgtgtagctgtagctcttatgaa

SEQ ID NO: 222580 - DNA, 26 bp, Artificial sequence
  SiRNA target sequence
gatgtgtagctgtagctcttatgaaa

SEQ ID NO: 222581 - DNA, 26 bp, Artificial sequence
  SiRNA target sequence
atgtgtagctgtagctcttatgaaag

SEQ ID NO: 222582 - DNA, 26 bp, Artificial sequence
  SiRNA target sequence
tgtgtagctgtagctcttatgaaagt

SEQ ID NO: 222583 - DNA, 26 bp, Artificial sequence
  SiRNA target sequence
gtgtagctgtagctcttatgaaagta

SEQ ID NO: 222584 - DNA, 26 bp, Artificial sequence
  SiRNA target sequence
tgtagctgtagctcttatgaaagtag

SEQ ID NO: 222585 - DNA, 26 bp, Artificial sequence
  SiRNA target sequence
gtagctgtagctcttatgaaagtagc

SEQ ID NO: 222586 - DNA, 26 bp, Artificial sequence
  SiRNA target sequence
tagctgtagctcttatgaaagtagca

SEQ ID NO: 222587 - DNA, 26 bp, Artificial sequence
  SiRNA target sequence
agctgtagctcttatgaaagtagcaa

SEQ ID NO: 222588 - DNA, 26 bp, Artificial sequence
  SiRNA target sequence
gctgtagctcttatgaaagtagcaaa

SEQ ID NO: 222589 - DNA, 26 bp, Artificial sequence
  SiRNA target sequence
ctgtagctcttatgaaagtagcaaaa

SEQ ID NO: 222590 - DNA, 26 bp, Artificial sequence
  SiRNA target sequence
tgtagctcttatgaaagtagcaaaat

SEQ ID NO: 222591 - DNA, 26 bp, Artificial sequence
  SiRNA target sequence
gtagctcttatgaaagtagcaaaata

SEQ ID NO: 222592 - DNA, 26 bp, Artificial sequence
  SiRNA target sequence
tagctcttatgaaagtagcaaaatat

SEQ ID NO: 222593 - DNA, 26 bp, Artificial sequence
  SiRNA target sequence
agctcttatgaaagtagcaaaatatg

SEQ ID NO: 222594 - DNA, 26 bp, Artificial sequence
  SiRNA target sequence
gctcttatgaaagtagcaaaatatgg

SEQ ID NO: 222595 - DNA, 26 bp, Artificial sequence
  SiRNA target sequence
ctcttatgaaagtagcaaaatatggc

SEQ ID NO: 222596 - DNA, 26 bp, Artificial sequence
  SiRNA target sequence
tcttatgaaagtagcaaaatatggct

SEQ ID NO: 222597 - DNA, 26 bp, Artificial sequence
  SiRNA target sequence
cttatgaaagtagcaaaatatggctc

SEQ ID NO: 222598 - DNA, 26 bp, Artificial sequence
  SiRNA target sequence
ttatgaaagtagcaaaatatggctct

SEQ ID NO: 222599 - DNA, 26 bp, Artificial sequence
  SiRNA target sequence
tatgaaagtagcaaaatatggctctt

SEQ ID NO: 222600 - DNA, 26 bp, Artificial sequence
  SiRNA target sequence
atgaaagtagcaaaatatggctcttt

SEQ ID NO: 222601 - DNA, 26 bp, Artificial sequence
  SiRNA target sequence
tgaaagtagcaaaatatggctctttt

SEQ ID NO: 222602 - DNA, 26 bp, Artificial sequence
  SiRNA target sequence
gaaagtagcaaaatatggctcttttg

SEQ ID NO: 222603 - DNA, 26 bp, Artificial sequence
  SiRNA target sequence
aaagtagcaaaatatggctcttttga

SEQ ID NO: 222604 - DNA, 26 bp, Artificial sequence
  SiRNA target sequence
aagtagcaaaatatggctcttttgat

SEQ ID NO: 222605 - DNA, 26 bp, Artificial sequence
  SiRNA target sequence
agtagcaaaatatggctcttttgata

SEQ ID NO: 222606 - DNA, 26 bp, Artificial sequence
  SiRNA target sequence
gtagcaaaatatggctcttttgatat

SEQ ID NO: 222607 - DNA, 26 bp, Artificial sequence
  SiRNA target sequence
tagcaaaatatggctcttttgatatt

SEQ ID NO: 222608 - DNA, 26 bp, Artificial sequence
  SiRNA target sequence
agcaaaatatggctcttttgatattt

SEQ ID NO: 222609 - DNA, 26 bp, Artificial sequence
  SiRNA target sequence
gcaaaatatggctcttttgatatttc

SEQ ID NO: 222610 - DNA, 26 bp, Artificial sequence
  SiRNA target sequence
caaaatatggctcttttgatatttcc

SEQ ID NO: 222611 - DNA, 26 bp, Artificial sequence
  SiRNA target sequence
aaaatatggctcttttgatatttcca

SEQ ID NO: 222612 - DNA, 26 bp, Artificial sequence
  SiRNA target sequence
aaatatggctcttttgatatttccaa

SEQ ID NO: 222613 - DNA, 26 bp, Artificial sequence
  SiRNA target sequence
aatatggctcttttgatatttccaaa

SEQ ID NO: 222614 - DNA, 26 bp, Artificial sequence
  SiRNA target sequence
atatggctcttttgatatttccaaag

SEQ ID NO: 222615 - DNA, 26 bp, Artificial sequence
  SiRNA target sequence
tatggctcttttgatatttccaaaga

SEQ ID NO: 222616 - DNA, 26 bp, Artificial sequence
  SiRNA target sequence
atggctcttttgatatttccaaagaa

SEQ ID NO: 222617 - DNA, 26 bp, Artificial sequence
  SiRNA target sequence
tggctcttttgatatttccaaagaag

SEQ ID NO: 222618 - DNA, 26 bp, Artificial sequence
  SiRNA target sequence
ggctcttttgatatttccaaagaagc

SEQ ID NO: 222619 - DNA, 26 bp, Artificial sequence
  SiRNA target sequence
gctcttttgatatttccaaagaagcc

SEQ ID NO: 222620 - DNA, 26 bp, Artificial sequence
  SiRNA target sequence
ctcttttgatatttccaaagaagcca

SEQ ID NO: 222621 - DNA, 26 bp, Artificial sequence
  SiRNA target sequence
tcttttgatatttccaaagaagccat

SEQ ID NO: 222622 - DNA, 26 bp, Artificial sequence
  SiRNA target sequence
cttttgatatttccaaagaagccatt

SEQ ID NO: 222623 - DNA, 26 bp, Artificial sequence
  SiRNA target sequence
ttttgatatttccaaagaagccattt

SEQ ID NO: 222624 - DNA, 26 bp, Artificial sequence
  SiRNA target sequence
tttgatatttccaaagaagccatttc

SEQ ID NO: 222625 - DNA, 26 bp, Artificial sequence
  SiRNA target sequence
ttgatatttccaaagaagccatttca

SEQ ID NO: 222626 - DNA, 26 bp, Artificial sequence
  SiRNA target sequence
tgatatttccaaagaagccatttcaa

SEQ ID NO: 222627 - DNA, 26 bp, Artificial sequence
  SiRNA target sequence
gatatttccaaagaagccatttcaat

SEQ ID NO: 222628 - DNA, 26 bp, Artificial sequence
  SiRNA target sequence
atatttccaaagaagccatttcaatg

SEQ ID NO: 222629 - DNA, 26 bp, Artificial sequence
  SiRNA target sequence
tatttccaaagaagccatttcaatgc

SEQ ID NO: 222630 - DNA, 26 bp, Artificial sequence
  SiRNA target sequence
atttccaaagaagccatttcaatgca

SEQ ID NO: 222631 - DNA, 26 bp, Artificial sequence
  SiRNA target sequence
tttccaaagaagccatttcaatgcag

SEQ ID NO: 222632 - DNA, 26 bp, Artificial sequence
  SiRNA target sequence
ttccaaagaagccatttcaatgcaga

SEQ ID NO: 222633 - DNA, 26 bp, Artificial sequence
  SiRNA target sequence
tccaaagaagccatttcaatgcagat

SEQ ID NO: 222634 - DNA, 26 bp, Artificial sequence
  SiRNA target sequence
ccaaagaagccatttcaatgcagatt

SEQ ID NO: 222635 - DNA, 26 bp, Artificial sequence
  SiRNA target sequence
caaagaagccatttcaatgcagattg

SEQ ID NO: 222636 - DNA, 26 bp, Artificial sequence
  SiRNA target sequence
aaagaagccatttcaatgcagattga

SEQ ID NO: 222637 - DNA, 26 bp, Artificial sequence
  SiRNA target sequence
aagaagccatttcaatgcagattgat

SEQ ID NO: 222638 - DNA, 26 bp, Artificial sequence
  SiRNA target sequence
agaagccatttcaatgcagattgatt

SEQ ID NO: 222639 - DNA, 26 bp, Artificial sequence
  SiRNA target sequence
gaagccatttcaatgcagattgattc

SEQ ID NO: 222640 - DNA, 26 bp, Artificial sequence
  SiRNA target sequence
aagccatttcaatgcagattgattcg

SEQ ID NO: 222641 - DNA, 26 bp, Artificial sequence
  SiRNA target sequence
agccatttcaatgcagattgattcgt

SEQ ID NO: 222642 - DNA, 26 bp, Artificial sequence
  SiRNA target sequence
gccatttcaatgcagattgattcgtc

SEQ ID NO: 222643 - DNA, 26 bp, Artificial sequence
  SiRNA target sequence
ccatttcaatgcagattgattcgtca

SEQ ID NO: 222644 - DNA, 26 bp, Artificial sequence
  SiRNA target sequence
catttcaatgcagattgattcgtcat

SEQ ID NO: 222645 - DNA, 26 bp, Artificial sequence
  SiRNA target sequence
atttcaatgcagattgattcgtcatt

SEQ ID NO: 222646 - DNA, 26 bp, Artificial sequence
  SiRNA target sequence
tttcaatgcagattgattcgtcattg

SEQ ID NO: 222647 - DNA, 26 bp, Artificial sequence
  SiRNA target sequence
ttcaatgcagattgattcgtcattgc

SEQ ID NO: 222648 - DNA, 26 bp, Artificial sequence
  SiRNA target sequence
tcaatgcagattgattcgtcattgcg

SEQ ID NO: 222649 - DNA, 26 bp, Artificial sequence
  SiRNA target sequence
caatgcagattgattcgtcattgcgt

SEQ ID NO: 222650 - DNA, 26 bp, Artificial sequence
  SiRNA target sequence
aatgcagattgattcgtcattgcgtg

SEQ ID NO: 222651 - DNA, 26 bp, Artificial sequence
  SiRNA target sequence
atgcagattgattcgtcattgcgtgc

SEQ ID NO: 222652 - DNA, 26 bp, Artificial sequence
  SiRNA target sequence
tgcagattgattcgtcattgcgtgca

SEQ ID NO: 222653 - DNA, 26 bp, Artificial sequence
  SiRNA target sequence
gcagattgattcgtcattgcgtgcac

SEQ ID NO: 222654 - DNA, 26 bp, Artificial sequence
  SiRNA target sequence
cagattgattcgtcattgcgtgcacg

SEQ ID NO: 222655 - DNA, 26 bp, Artificial sequence
  SiRNA target sequence
agattgattcgtcattgcgtgcacgt

SEQ ID NO: 222656 - DNA, 26 bp, Artificial sequence
  SiRNA target sequence
gattgattcgtcattgcgtgcacgtt

SEQ ID NO: 222657 - DNA, 26 bp, Artificial sequence
  SiRNA target sequence
attgattcgtcattgcgtgcacgtta

SEQ ID NO: 222658 - DNA, 26 bp, Artificial sequence
  SiRNA target sequence
ttgattcgtcattgcgtgcacgttat

SEQ ID NO: 222659 - DNA, 26 bp, Artificial sequence
  SiRNA target sequence
tgattcgtcattgcgtgcacgttata

SEQ ID NO: 222660 - DNA, 26 bp, Artificial sequence
  SiRNA target sequence
gattcgtcattgcgtgcacgttataa

SEQ ID NO: 222661 - DNA, 26 bp, Artificial sequence
  SiRNA target sequence
attcgtcattgcgtgcacgttataaa

SEQ ID NO: 222662 - DNA, 26 bp, Artificial sequence
  SiRNA target sequence
ttcgtcattgcgtgcacgttataaag

SEQ ID NO: 222663 - DNA, 26 bp, Artificial sequence
  SiRNA target sequence
tcgtcattgcgtgcacgttataaagg

SEQ ID NO: 222664 - DNA, 26 bp, Artificial sequence
  SiRNA target sequence
cgtcattgcgtgcacgttataaagga

SEQ ID NO: 222665 - DNA, 26 bp, Artificial sequence
  SiRNA target sequence
gtcattgcgtgcacgttataaaggaa

SEQ ID NO: 222666 - DNA, 26 bp, Artificial sequence
  SiRNA target sequence
tcattgcgtgcacgttataaaggaat

SEQ ID NO: 222667 - DNA, 26 bp, Artificial sequence
  SiRNA target sequence
cattgcgtgcacgttataaaggaatt

SEQ ID NO: 222668 - DNA, 26 bp, Artificial sequence
  SiRNA target sequence
attgcgtgcacgttataaaggaattt

SEQ ID NO: 222669 - DNA, 26 bp, Artificial sequence
  SiRNA target sequence
ttgcgtgcacgttataaaggaatttt

SEQ ID NO: 222670 - DNA, 26 bp, Artificial sequence
  SiRNA target sequence
tgcgtgcacgttataaaggaattttt

SEQ ID NO: 222671 - DNA, 26 bp, Artificial sequence
  SiRNA target sequence
gcgtgcacgttataaaggaatttttg

SEQ ID NO: 222672 - DNA, 26 bp, Artificial sequence
  SiRNA target sequence
cgtgcacgttataaaggaatttttga

SEQ ID NO: 222673 - DNA, 26 bp, Artificial sequence
  SiRNA target sequence
gtgcacgttataaaggaatttttgac

SEQ ID NO: 222674 - DNA, 26 bp, Artificial sequence
  SiRNA target sequence
tgcacgttataaaggaatttttgacg

SEQ ID NO: 222675 - DNA, 26 bp, Artificial sequence
  SiRNA target sequence
gcacgttataaaggaatttttgacgg

SEQ ID NO: 222676 - DNA, 26 bp, Artificial sequence
  SiRNA target sequence
cacgttataaaggaatttttgacggt

SEQ ID NO: 222677 - DNA, 26 bp, Artificial sequence
  SiRNA target sequence
acgttataaaggaatttttgacggtg

SEQ ID NO: 222678 - DNA, 26 bp, Artificial sequence
  SiRNA target sequence
cgttataaaggaatttttgacggtgt

SEQ ID NO: 222679 - DNA, 26 bp, Artificial sequence
  SiRNA target sequence
gttataaaggaatttttgacggtgtt

SEQ ID NO: 222680 - DNA, 26 bp, Artificial sequence
  SiRNA target sequence
ttataaaggaatttttgacggtgttt

SEQ ID NO: 222681 - DNA, 26 bp, Artificial sequence
  SiRNA target sequence
tataaaggaatttttgacggtgtttt

SEQ ID NO: 222682 - DNA, 26 bp, Artificial sequence
  SiRNA target sequence
ataaaggaatttttgacggtgttttt

SEQ ID NO: 222683 - DNA, 26 bp, Artificial sequence
  SiRNA target sequence
taaaggaatttttgacggtgtttttg

SEQ ID NO: 222684 - DNA, 26 bp, Artificial sequence
  SiRNA target sequence
aaaggaatttttgacggtgtttttgg

SEQ ID NO: 222685 - DNA, 26 bp, Artificial sequence
  SiRNA target sequence
aaggaatttttgacggtgtttttggt

SEQ ID NO: 222686 - DNA, 26 bp, Artificial sequence
  SiRNA target sequence
aggaatttttgacggtgtttttggta

SEQ ID NO: 222687 - DNA, 26 bp, Artificial sequence
  SiRNA target sequence
ggaatttttgacggtgtttttggtaa

SEQ ID NO: 222688 - DNA, 26 bp, Artificial sequence
  SiRNA target sequence
gaatttttgacggtgtttttggtaag

SEQ ID NO: 222689 - DNA, 26 bp, Artificial sequence
  SiRNA target sequence
aatttttgacggtgtttttggtaagt

SEQ ID NO: 222690 - DNA, 26 bp, Artificial sequence
  SiRNA target sequence
atttttgacggtgtttttggtaagtt

SEQ ID NO: 222691 - DNA, 26 bp, Artificial sequence
  SiRNA target sequence
tttttgacggtgtttttggtaagtta

SEQ ID NO: 222692 - DNA, 26 bp, Artificial sequence
  SiRNA target sequence
ttttgacggtgtttttggtaagttag

SEQ ID NO: 222693 - DNA, 26 bp, Artificial sequence
  SiRNA target sequence
tttgacggtgtttttggtaagttagg

SEQ ID NO: 222694 - DNA, 26 bp, Artificial sequence
  SiRNA target sequence
ttgacggtgtttttggtaagttagga

SEQ ID NO: 222695 - DNA, 26 bp, Artificial sequence
  SiRNA target sequence
tgacggtgtttttggtaagttaggaa

SEQ ID NO: 222696 - DNA, 26 bp, Artificial sequence
  SiRNA target sequence
gacggtgtttttggtaagttaggaaa

SEQ ID NO: 222697 - DNA, 26 bp, Artificial sequence
  SiRNA target sequence
acggtgtttttggtaagttaggaaaa

SEQ ID NO: 222698 - DNA, 26 bp, Artificial sequence
  SiRNA target sequence
cggtgtttttggtaagttaggaaaat

SEQ ID NO: 222699 - DNA, 26 bp, Artificial sequence
  SiRNA target sequence
ggtgtttttggtaagttaggaaaatc

SEQ ID NO: 222700 - DNA, 26 bp, Artificial sequence
  SiRNA target sequence
gtgtttttggtaagttaggaaaatct

SEQ ID NO: 222701 - DNA, 26 bp, Artificial sequence
  SiRNA target sequence
tgtttttggtaagttaggaaaatctc

SEQ ID NO: 222702 - DNA, 26 bp, Artificial sequence
  SiRNA target sequence
gtttttggtaagttaggaaaatctct

SEQ ID NO: 222703 - DNA, 26 bp, Artificial sequence
  SiRNA target sequence
tttttggtaagttaggaaaatctctt

SEQ ID NO: 222704 - DNA, 26 bp, Artificial sequence
  SiRNA target sequence
ttttggtaagttaggaaaatctcttg

SEQ ID NO: 222705 - DNA, 26 bp, Artificial sequence
  SiRNA target sequence
tttggtaagttaggaaaatctcttgg

SEQ ID NO: 222706 - DNA, 26 bp, Artificial sequence
  SiRNA target sequence
ttggtaagttaggaaaatctcttgga

SEQ ID NO: 222707 - DNA, 26 bp, Artificial sequence
  SiRNA target sequence
tggtaagttaggaaaatctcttggat

SEQ ID NO: 222708 - DNA, 26 bp, Artificial sequence
  SiRNA target sequence
ggtaagttaggaaaatctcttggatc

SEQ ID NO: 222709 - DNA, 26 bp, Artificial sequence
  SiRNA target sequence
gtaagttaggaaaatctcttggatcg

SEQ ID NO: 222710 - DNA, 26 bp, Artificial sequence
  SiRNA target sequence
taagttaggaaaatctcttggatcgt

SEQ ID NO: 222711 - DNA, 26 bp, Artificial sequence
  SiRNA target sequence
aagttaggaaaatctcttggatcgtt

SEQ ID NO: 222712 - DNA, 26 bp, Artificial sequence
  SiRNA target sequence
agttaggaaaatctcttggatcgtta

SEQ ID NO: 222713 - DNA, 26 bp, Artificial sequence
  SiRNA target sequence
gttaggaaaatctcttggatcgttat

SEQ ID NO: 222714 - DNA, 26 bp, Artificial sequence
  SiRNA target sequence
ttaggaaaatctcttggatcgttatt

SEQ ID NO: 222715 - DNA, 26 bp, Artificial sequence
  SiRNA target sequence
taggaaaatctcttggatcgttattt

SEQ ID NO: 222716 - DNA, 26 bp, Artificial sequence
  SiRNA target sequence
aggaaaatctcttggatcgttatttg

SEQ ID NO: 222717 - DNA, 26 bp, Artificial sequence
  SiRNA target sequence
ggaaaatctcttggatcgttatttgt

SEQ ID NO: 222718 - DNA, 26 bp, Artificial sequence
  SiRNA target sequence
gaaaatctcttggatcgttatttgtg

SEQ ID NO: 222719 - DNA, 26 bp, Artificial sequence
  SiRNA target sequence
aaaatctcttggatcgttatttgtgt

SEQ ID NO: 222720 - DNA, 26 bp, Artificial sequence
  SiRNA target sequence
aaatctcttggatcgttatttgtgtg

SEQ ID NO: 222721 - DNA, 26 bp, Artificial sequence
  SiRNA target sequence
aatctcttggatcgttatttgtgtgg

SEQ ID NO: 222722 - DNA, 26 bp, Artificial sequence
  SiRNA target sequence
atctcttggatcgttatttgtgtgga

SEQ ID NO: 222723 - DNA, 26 bp, Artificial sequence
  SiRNA target sequence
tctcttggatcgttatttgtgtggat

SEQ ID NO: 222724 - DNA, 26 bp, Artificial sequence
  SiRNA target sequence
ctcttggatcgttatttgtgtggatt

SEQ ID NO: 222725 - DNA, 26 bp, Artificial sequence
  SiRNA target sequence
tcttggatcgttatttgtgtggatta

SEQ ID NO: 222726 - DNA, 26 bp, Artificial sequence
  SiRNA target sequence
cttggatcgttatttgtgtggattat

SEQ ID NO: 222727 - DNA, 26 bp, Artificial sequence
  SiRNA target sequence
ttggatcgttatttgtgtggattatg

SEQ ID NO: 222728 - DNA, 26 bp, Artificial sequence
  SiRNA target sequence
tggatcgttatttgtgtggattatgg

SEQ ID NO: 222729 - DNA, 26 bp, Artificial sequence
  SiRNA target sequence
ggatcgttatttgtgtggattatggg

SEQ ID NO: 222730 - DNA, 26 bp, Artificial sequence
  SiRNA target sequence
gatcgttatttgtgtggattatggga

SEQ ID NO: 222731 - DNA, 26 bp, Artificial sequence
  SiRNA target sequence
atcgttatttgtgtggattatgggat

SEQ ID NO: 222732 - DNA, 26 bp, Artificial sequence
  SiRNA target sequence
tcgttatttgtgtggattatgggata

SEQ ID NO: 222733 - DNA, 26 bp, Artificial sequence
  SiRNA target sequence
cgttatttgtgtggattatgggatat

SEQ ID NO: 222734 - DNA, 26 bp, Artificial sequence
  SiRNA target sequence
gttatttgtgtggattatgggatatg

SEQ ID NO: 222735 - DNA, 26 bp, Artificial sequence
  SiRNA target sequence
ttatttgtgtggattatgggatatgc

SEQ ID NO: 222736 - DNA, 26 bp, Artificial sequence
  SiRNA target sequence
tatttgtgtggattatgggatatgca

SEQ ID NO: 222737 - DNA, 26 bp, Artificial sequence
  SiRNA target sequence
atttgtgtggattatgggatatgcat

SEQ ID NO: 222738 - DNA, 26 bp, Artificial sequence
  SiRNA target sequence
tttgtgtggattatgggatatgcatt

SEQ ID NO: 222739 - DNA, 26 bp, Artificial sequence
  SiRNA target sequence
ttgtgtggattatgggatatgcattt

SEQ ID NO: 222740 - DNA, 26 bp, Artificial sequence
  SiRNA target sequence
tgtgtggattatgggatatgcatttc

SEQ ID NO: 222741 - DNA, 26 bp, Artificial sequence
  SiRNA target sequence
gtgtggattatgggatatgcatttca

SEQ ID NO: 222742 - DNA, 26 bp, Artificial sequence
  SiRNA target sequence
tgtggattatgggatatgcatttcaa

SEQ ID NO: 222743 - DNA, 26 bp, Artificial sequence
  SiRNA target sequence
gtggattatgggatatgcatttcaaa

SEQ ID NO: 222744 - DNA, 26 bp, Artificial sequence
  SiRNA target sequence
tggattatgggatatgcatttcaaac

SEQ ID NO: 222745 - DNA, 26 bp, Artificial sequence
  SiRNA target sequence
ggattatgggatatgcatttcaaaca

SEQ ID NO: 222746 - DNA, 26 bp, Artificial sequence
  SiRNA target sequence
gattatgggatatgcatttcaaacaa

SEQ ID NO: 222747 - DNA, 26 bp, Artificial sequence
  SiRNA target sequence
attatgggatatgcatttcaaacaag

SEQ ID NO: 222748 - DNA, 26 bp, Artificial sequence
  SiRNA target sequence
ttatgggatatgcatttcaaacaaga

SEQ ID NO: 222749 - DNA, 26 bp, Artificial sequence
  SiRNA target sequence
tatgggatatgcatttcaaacaagag

SEQ ID NO: 222750 - DNA, 26 bp, Artificial sequence
  SiRNA target sequence
atgggatatgcatttcaaacaagaga

SEQ ID NO: 222751 - DNA, 26 bp, Artificial sequence
  SiRNA target sequence
tgggatatgcatttcaaacaagagat

SEQ ID NO: 222752 - DNA, 26 bp, Artificial sequence
  SiRNA target sequence
gggatatgcatttcaaacaagagatt

SEQ ID NO: 222753 - DNA, 26 bp, Artificial sequence
  SiRNA target sequence
ggatatgcatttcaaacaagagattt

SEQ ID NO: 222754 - DNA, 26 bp, Artificial sequence
  SiRNA target sequence
gatatgcatttcaaacaagagatttt

SEQ ID NO: 222755 - DNA, 26 bp, Artificial sequence
  SiRNA target sequence
atatgcatttcaaacaagagatttta

SEQ ID NO: 222756 - DNA, 26 bp, Artificial sequence
  SiRNA target sequence
tatgcatttcaaacaagagattttag

SEQ ID NO: 222757 - DNA, 26 bp, Artificial sequence
  SiRNA target sequence
atgcatttcaaacaagagattttaga

SEQ ID NO: 222758 - DNA, 26 bp, Artificial sequence
  SiRNA target sequence
tgcatttcaaacaagagattttagaa

SEQ ID NO: 222759 - DNA, 26 bp, Artificial sequence
  SiRNA target sequence
gcatttcaaacaagagattttagaaa

SEQ ID NO: 222760 - DNA, 26 bp, Artificial sequence
  SiRNA target sequence
catttcaaacaagagattttagaaaa

SEQ ID NO: 222761 - DNA, 26 bp, Artificial sequence
  SiRNA target sequence
atttcaaacaagagattttagaaaat

SEQ ID NO: 222762 - DNA, 26 bp, Artificial sequence
  SiRNA target sequence
tttcaaacaagagattttagaaaatt

SEQ ID NO: 222763 - DNA, 26 bp, Artificial sequence
  SiRNA target sequence
ttcaaacaagagattttagaaaatta

SEQ ID NO: 222764 - DNA, 26 bp, Artificial sequence
  SiRNA target sequence
tcaaacaagagattttagaaaattag

SEQ ID NO: 222765 - DNA, 26 bp, Artificial sequence
  SiRNA target sequence
caaacaagagattttagaaaattagc

SEQ ID NO: 222766 - DNA, 26 bp, Artificial sequence
  SiRNA target sequence
aaacaagagattttagaaaattagct

SEQ ID NO: 222767 - DNA, 26 bp, Artificial sequence
  SiRNA target sequence
aacaagagattttagaaaattagctc

SEQ ID NO: 222768 - DNA, 26 bp, Artificial sequence
  SiRNA target sequence
acaagagattttagaaaattagctcc

SEQ ID NO: 222769 - DNA, 26 bp, Artificial sequence
  SiRNA target sequence
caagagattttagaaaattagctccc

SEQ ID NO: 222770 - DNA, 26 bp, Artificial sequence
  SiRNA target sequence
aagagattttagaaaattagctccct

SEQ ID NO: 222771 - DNA, 26 bp, Artificial sequence
  SiRNA target sequence
agagattttagaaaattagctccctt

SEQ ID NO: 222772 - DNA, 26 bp, Artificial sequence
  SiRNA target sequence
gagattttagaaaattagctccctta

SEQ ID NO: 222773 - DNA, 26 bp, Artificial sequence
  SiRNA target sequence
agattttagaaaattagctcccttat

SEQ ID NO: 222774 - DNA, 26 bp, Artificial sequence
  SiRNA target sequence
gattttagaaaattagctcccttatg

SEQ ID NO: 222775 - DNA, 26 bp, Artificial sequence
  SiRNA target sequence
attttagaaaattagctcccttatgt

SEQ ID NO: 222776 - DNA, 26 bp, Artificial sequence
  SiRNA target sequence
ttttagaaaattagctcccttatgta

SEQ ID NO: 222777 - DNA, 26 bp, Artificial sequence
  SiRNA target sequence
tttagaaaattagctcccttatgtat

SEQ ID NO: 222778 - DNA, 26 bp, Artificial sequence
  SiRNA target sequence
ttagaaaattagctcccttatgtatc

SEQ ID NO: 222779 - DNA, 26 bp, Artificial sequence
  SiRNA target sequence
tagaaaattagctcccttatgtatca

SEQ ID NO: 222780 - DNA, 26 bp, Artificial sequence
  SiRNA target sequence
agaaaattagctcccttatgtatcag

SEQ ID NO: 222781 - DNA, 26 bp, Artificial sequence
  SiRNA target sequence
gaaaattagctcccttatgtatcagc

SEQ ID NO: 222782 - DNA, 26 bp, Artificial sequence
  SiRNA target sequence
aaaattagctcccttatgtatcagcg

SEQ ID NO: 222783 - DNA, 26 bp, Artificial sequence
  SiRNA target sequence
aaattagctcccttatgtatcagcgt

SEQ ID NO: 222784 - DNA, 26 bp, Artificial sequence
  SiRNA target sequence
aattagctcccttatgtatcagcgta

SEQ ID NO: 222785 - DNA, 26 bp, Artificial sequence
  SiRNA target sequence
attagctcccttatgtatcagcgtaa

SEQ ID NO: 222786 - DNA, 26 bp, Artificial sequence
  SiRNA target sequence
ttagctcccttatgtatcagcgtaat

SEQ ID NO: 222787 - DNA, 26 bp, Artificial sequence
  SiRNA target sequence
tagctcccttatgtatcagcgtaatt

SEQ ID NO: 222788 - DNA, 26 bp, Artificial sequence
  SiRNA target sequence
agctcccttatgtatcagcgtaattg

SEQ ID NO: 222789 - DNA, 26 bp, Artificial sequence
  SiRNA target sequence
gctcccttatgtatcagcgtaattgt

SEQ ID NO: 222790 - DNA, 26 bp, Artificial sequence
  SiRNA target sequence
ctcccttatgtatcagcgtaattgtc

SEQ ID NO: 222791 - DNA, 26 bp, Artificial sequence
  SiRNA target sequence
tcccttatgtatcagcgtaattgtct

SEQ ID NO: 222792 - DNA, 26 bp, Artificial sequence
  SiRNA target sequence
cccttatgtatcagcgtaattgtctt

SEQ ID NO: 222793 - DNA, 26 bp, Artificial sequence
  SiRNA target sequence
ccttatgtatcagcgtaattgtcttt

SEQ ID NO: 222794 - DNA, 26 bp, Artificial sequence
  SiRNA target sequence
cttatgtatcagcgtaattgtctttt

SEQ ID NO: 222795 - DNA, 26 bp, Artificial sequence
  SiRNA target sequence
ttatgtatcagcgtaattgtcttttt

SEQ ID NO: 222796 - DNA, 26 bp, Artificial sequence
  SiRNA target sequence
tatgtatcagcgtaattgtctttttt

SEQ ID NO: 222797 - DNA, 26 bp, Artificial sequence
  SiRNA target sequence
atgtatcagcgtaattgtcttttttg

SEQ ID NO: 222798 - DNA, 26 bp, Artificial sequence
  SiRNA target sequence
tgtatcagcgtaattgtcttttttgt

SEQ ID NO: 222799 - DNA, 26 bp, Artificial sequence
  SiRNA target sequence
gtatcagcgtaattgtcttttttgtt

SEQ ID NO: 222800 - DNA, 26 bp, Artificial sequence
  SiRNA target sequence
tatcagcgtaattgtcttttttgtta

SEQ ID NO: 222801 - DNA, 26 bp, Artificial sequence
  SiRNA target sequence
atcagcgtaattgtcttttttgttat

SEQ ID NO: 222802 - DNA, 26 bp, Artificial sequence
  SiRNA target sequence
tcagcgtaattgtcttttttgttatt

SEQ ID NO: 222803 - DNA, 26 bp, Artificial sequence
  SiRNA target sequence
cagcgtaattgtcttttttgttatta

SEQ ID NO: 222804 - DNA, 26 bp, Artificial sequence
  SiRNA target sequence
agcgtaattgtcttttttgttattat

SEQ ID NO: 222805 - DNA, 26 bp, Artificial sequence
  SiRNA target sequence
gcgtaattgtcttttttgttattatt

SEQ ID NO: 222806 - DNA, 26 bp, Artificial sequence
  SiRNA target sequence
cgtaattgtcttttttgttattattt

SEQ ID NO: 222807 - DNA, 26 bp, Artificial sequence
  SiRNA target sequence
gtaattgtcttttttgttattatttg

SEQ ID NO: 222808 - DNA, 26 bp, Artificial sequence
  SiRNA target sequence
taattgtcttttttgttattatttgg

SEQ ID NO: 222809 - DNA, 26 bp, Artificial sequence
  SiRNA target sequence
aattgtcttttttgttattatttgga

SEQ ID NO: 222810 - DNA, 26 bp, Artificial sequence
  SiRNA target sequence
attgtcttttttgttattatttggat

SEQ ID NO: 222811 - DNA, 26 bp, Artificial sequence
  SiRNA target sequence
ttgtcttttttgttattatttggatt

SEQ ID NO: 222812 - DNA, 26 bp, Artificial sequence
  SiRNA target sequence
tgtcttttttgttattatttggattt

SEQ ID NO: 222813 - DNA, 26 bp, Artificial sequence
  SiRNA target sequence
gtcttttttgttattatttggattta

SEQ ID NO: 222814 - DNA, 26 bp, Artificial sequence
  SiRNA target sequence
tcttttttgttattatttggatttat

SEQ ID NO: 222815 - DNA, 26 bp, Artificial sequence
  SiRNA target sequence
cttttttgttattatttggatttatt

SEQ ID NO: 222816 - DNA, 26 bp, Artificial sequence
  SiRNA target sequence
ttttttgttattatttggatttattc

SEQ ID NO: 222817 - DNA, 26 bp, Artificial sequence
  SiRNA target sequence
tttttgttattatttggatttattca

SEQ ID NO: 222818 - DNA, 26 bp, Artificial sequence
  SiRNA target sequence
ttttgttattatttggatttattcag

SEQ ID NO: 222819 - DNA, 26 bp, Artificial sequence
  SiRNA target sequence
tttgttattatttggatttattcagt

SEQ ID NO: 222820 - DNA, 26 bp, Artificial sequence
  SiRNA target sequence
ttgttattatttggatttattcagtt

SEQ ID NO: 222821 - DNA, 26 bp, Artificial sequence
  SiRNA target sequence
tgttattatttggatttattcagtta

SEQ ID NO: 222822 - DNA, 26 bp, Artificial sequence
  SiRNA target sequence
gttattatttggatttattcagttat

SEQ ID NO: 222823 - DNA, 26 bp, Artificial sequence
  SiRNA target sequence
ttattatttggatttattcagttatt

SEQ ID NO: 222824 - DNA, 26 bp, Artificial sequence
  SiRNA target sequence
tattatttggatttattcagttattt

SEQ ID NO: 222825 - DNA, 26 bp, Artificial sequence
  SiRNA target sequence
attatttggatttattcagttattta

SEQ ID NO: 222826 - DNA, 26 bp, Artificial sequence
  SiRNA target sequence
ttatttggatttattcagttatttat

SEQ ID NO: 222827 - DNA, 26 bp, Artificial sequence
  SiRNA target sequence
tatttggatttattcagttatttatt

SEQ ID NO: 222828 - DNA, 26 bp, Artificial sequence
  SiRNA target sequence
atttggatttattcagttatttattt

SEQ ID NO: 222829 - DNA, 26 bp, Artificial sequence
  SiRNA target sequence
tttggatttattcagttatttattta

SEQ ID NO: 222830 - DNA, 26 bp, Artificial sequence
  SiRNA target sequence
ttggatttattcagttatttatttaa

SEQ ID NO: 222831 - DNA, 26 bp, Artificial sequence
  SiRNA target sequence
tggatttattcagttatttatttaaa

SEQ ID NO: 222832 - DNA, 26 bp, Artificial sequence
  SiRNA target sequence
ggatttattcagttatttatttaaat

SEQ ID NO: 222833 - DNA, 26 bp, Artificial sequence
  SiRNA target sequence
gatttattcagttatttatttaaata

SEQ ID NO: 222834 - DNA, 26 bp, Artificial sequence
  SiRNA target sequence
atttattcagttatttatttaaataa

SEQ ID NO: 222835 - DNA, 26 bp, Artificial sequence
  SiRNA target sequence
tttattcagttatttatttaaataag

SEQ ID NO: 222836 - DNA, 26 bp, Artificial sequence
  SiRNA target sequence
ttattcagttatttatttaaataaga

SEQ ID NO: 222837 - DNA, 26 bp, Artificial sequence
  SiRNA target sequence
tattcagttatttatttaaataagaa

SEQ ID NO: 222838 - DNA, 26 bp, Artificial sequence
  SiRNA target sequence
attcagttatttatttaaataagaaa

SEQ ID NO: 222839 - DNA, 26 bp, Artificial sequence
  SiRNA target sequence
ttcagttatttatttaaataagaaat

SEQ ID NO: 222840 - DNA, 26 bp, Artificial sequence
  SiRNA target sequence
tcagttatttatttaaataagaaata

SEQ ID NO: 222841 - DNA, 26 bp, Artificial sequence
  SiRNA target sequence
cagttatttatttaaataagaaatac

SEQ ID NO: 222842 - DNA, 26 bp, Artificial sequence
  SiRNA target sequence
agttatttatttaaataagaaataca

SEQ ID NO: 222843 - DNA, 26 bp, Artificial sequence
  SiRNA target sequence
gttatttatttaaataagaaatacaa

SEQ ID NO: 222844 - DNA, 26 bp, Artificial sequence
  SiRNA target sequence
ttatttatttaaataagaaatacaaa

SEQ ID NO: 222845 - DNA, 26 bp, Artificial sequence
  SiRNA target sequence
tatttatttaaataagaaatacaaag

SEQ ID NO: 222846 - DNA, 26 bp, Artificial sequence
  SiRNA target sequence
atttatttaaataagaaatacaaaga

SEQ ID NO: 222847 - DNA, 26 bp, Artificial sequence
  SiRNA target sequence
tttatttaaataagaaatacaaagaa

SEQ ID NO: 222848 - DNA, 26 bp, Artificial sequence
  SiRNA target sequence
ttatttaaataagaaatacaaagaat

SEQ ID NO: 222849 - DNA, 26 bp, Artificial sequence
  SiRNA target sequence
tatttaaataagaaatacaaagaatc

SEQ ID NO: 222850 - DNA, 26 bp, Artificial sequence
  SiRNA target sequence
atttaaataagaaatacaaagaatca

SEQ ID NO: 222851 - DNA, 26 bp, Artificial sequence
  SiRNA target sequence
tttaaataagaaatacaaagaatcag

SEQ ID NO: 222852 - DNA, 26 bp, Artificial sequence
  SiRNA target sequence
ttaaataagaaatacaaagaatcagt

SEQ ID NO: 222853 - DNA, 26 bp, Artificial sequence
  SiRNA target sequence
taaataagaaatacaaagaatcagtt

SEQ ID NO: 222854 - DNA, 26 bp, Artificial sequence
  SiRNA target sequence
aaataagaaatacaaagaatcagttg

SEQ ID NO: 222855 - DNA, 26 bp, Artificial sequence
  SiRNA target sequence
aataagaaatacaaagaatcagttgt

SEQ ID NO: 222856 - DNA, 26 bp, Artificial sequence
  SiRNA target sequence
ataagaaatacaaagaatcagttgtt

SEQ ID NO: 222857 - DNA, 26 bp, Artificial sequence
  SiRNA target sequence
taagaaatacaaagaatcagttgtta

SEQ ID NO: 222858 - DNA, 26 bp, Artificial sequence
  SiRNA target sequence
aagaaatacaaagaatcagttgttag

SEQ ID NO: 222859 - DNA, 26 bp, Artificial sequence
  SiRNA target sequence
agaaatacaaagaatcagttgttagt

SEQ ID NO: 222860 - DNA, 26 bp, Artificial sequence
  SiRNA target sequence
gaaatacaaagaatcagttgttagta

SEQ ID NO: 222861 - DNA, 26 bp, Artificial sequence
  SiRNA target sequence
aaatacaaagaatcagttgttagtaa

SEQ ID NO: 222862 - DNA, 26 bp, Artificial sequence
  SiRNA target sequence
aatacaaagaatcagttgttagtaat

SEQ ID NO: 222863 - DNA, 26 bp, Artificial sequence
  SiRNA target sequence
atacaaagaatcagttgttagtaatt

SEQ ID NO: 222864 - DNA, 26 bp, Artificial sequence
  SiRNA target sequence
tacaaagaatcagttgttagtaattt

SEQ ID NO: 222865 - DNA, 26 bp, Artificial sequence
  SiRNA target sequence
acaaagaatcagttgttagtaattta

SEQ ID NO: 222866 - DNA, 26 bp, Artificial sequence
  SiRNA target sequence
caaagaatcagttgttagtaatttac

SEQ ID NO: 222867 - DNA, 26 bp, Artificial sequence
  SiRNA target sequence
aaagaatcagttgttagtaatttacc

SEQ ID NO: 222868 - DNA, 26 bp, Artificial sequence
  SiRNA target sequence
aagaatcagttgttagtaatttaccc

SEQ ID NO: 222869 - DNA, 26 bp, Artificial sequence
  SiRNA target sequence
agaatcagttgttagtaatttaccca

SEQ ID NO: 222870 - DNA, 26 bp, Artificial sequence
  SiRNA target sequence
gaatcagttgttagtaatttacccat

SEQ ID NO: 222871 - DNA, 26 bp, Artificial sequence
  SiRNA target sequence
aatcagttgttagtaatttacccatc

SEQ ID NO: 222872 - DNA, 26 bp, Artificial sequence
  SiRNA target sequence
atcagttgttagtaatttacccatcg

SEQ ID NO: 222873 - DNA, 26 bp, Artificial sequence
  SiRNA target sequence
tcagttgttagtaatttacccatcga

SEQ ID NO: 222874 - DNA, 26 bp, Artificial sequence
  SiRNA target sequence
cagttgttagtaatttacccatcgat

SEQ ID NO: 222875 - DNA, 26 bp, Artificial sequence
  SiRNA target sequence
agttgttagtaatttacccatcgatg

SEQ ID NO: 222876 - DNA, 26 bp, Artificial sequence
  SiRNA target sequence
gttgttagtaatttacccatcgatgt

SEQ ID NO: 222877 - DNA, 26 bp, Artificial sequence
  SiRNA target sequence
ttgttagtaatttacccatcgatgtt

SEQ ID NO: 222878 - DNA, 26 bp, Artificial sequence
  SiRNA target sequence
tgttagtaatttacccatcgatgttg

SEQ ID NO: 222879 - DNA, 26 bp, Artificial sequence
  SiRNA target sequence
gttagtaatttacccatcgatgttga

SEQ ID NO: 222880 - DNA, 26 bp, Artificial sequence
  SiRNA target sequence
ttagtaatttacccatcgatgttgat

SEQ ID NO: 222881 - DNA, 26 bp, Artificial sequence
  SiRNA target sequence
tagtaatttacccatcgatgttgatt

SEQ ID NO: 222882 - DNA, 26 bp, Artificial sequence
  SiRNA target sequence
agtaatttacccatcgatgttgattt

SEQ ID NO: 222883 - DNA, 26 bp, Artificial sequence
  SiRNA target sequence
gtaatttacccatcgatgttgatttg

SEQ ID NO: 222884 - DNA, 26 bp, Artificial sequence
  SiRNA target sequence
taatttacccatcgatgttgatttgt

SEQ ID NO: 222885 - DNA, 26 bp, Artificial sequence
  SiRNA target sequence
aatttacccatcgatgttgatttgtt

SEQ ID NO: 222886 - DNA, 26 bp, Artificial sequence
  SiRNA target sequence
atttacccatcgatgttgatttgttt

SEQ ID NO: 222887 - DNA, 26 bp, Artificial sequence
  SiRNA target sequence
tttacccatcgatgttgatttgtttg

SEQ ID NO: 222888 - DNA, 26 bp, Artificial sequence
  SiRNA target sequence
ttacccatcgatgttgatttgtttgc

SEQ ID NO: 222889 - DNA, 26 bp, Artificial sequence
  SiRNA target sequence
tacccatcgatgttgatttgtttgca

SEQ ID NO: 222890 - DNA, 26 bp, Artificial sequence
  SiRNA target sequence
acccatcgatgttgatttgtttgcat

SEQ ID NO: 222891 - DNA, 26 bp, Artificial sequence
  SiRNA target sequence
cccatcgatgttgatttgtttgcatc

SEQ ID NO: 222892 - DNA, 26 bp, Artificial sequence
  SiRNA target sequence
ccatcgatgttgatttgtttgcatca

SEQ ID NO: 222893 - DNA, 26 bp, Artificial sequence
  SiRNA target sequence
catcgatgttgatttgtttgcatcaa

SEQ ID NO: 222894 - DNA, 26 bp, Artificial sequence
  SiRNA target sequence
atcgatgttgatttgtttgcatcaaa

SEQ ID NO: 222895 - DNA, 26 bp, Artificial sequence
  SiRNA target sequence
tcgatgttgatttgtttgcatcaaag

SEQ ID NO: 222896 - DNA, 26 bp, Artificial sequence
  SiRNA target sequence
cgatgttgatttgtttgcatcaaagt

SEQ ID NO: 222897 - DNA, 26 bp, Artificial sequence
  SiRNA target sequence
gatgttgatttgtttgcatcaaagtt

SEQ ID NO: 222898 - DNA, 26 bp, Artificial sequence
  SiRNA target sequence
atgttgatttgtttgcatcaaagttg

SEQ ID NO: 222899 - DNA, 26 bp, Artificial sequence
  SiRNA target sequence
tgttgatttgtttgcatcaaagttgt

SEQ ID NO: 222900 - DNA, 26 bp, Artificial sequence
  SiRNA target sequence
gttgatttgtttgcatcaaagttgtt

SEQ ID NO: 222901 - DNA, 26 bp, Artificial sequence
  SiRNA target sequence
ttgatttgtttgcatcaaagttgtta

SEQ ID NO: 222902 - DNA, 26 bp, Artificial sequence
  SiRNA target sequence
tgatttgtttgcatcaaagttgttag

SEQ ID NO: 222903 - DNA, 26 bp, Artificial sequence
  SiRNA target sequence
gatttgtttgcatcaaagttgttaga

SEQ ID NO: 222904 - DNA, 26 bp, Artificial sequence
  SiRNA target sequence
atttgtttgcatcaaagttgttagat

SEQ ID NO: 222905 - DNA, 26 bp, Artificial sequence
  SiRNA target sequence
tttgtttgcatcaaagttgttagata

SEQ ID NO: 222906 - DNA, 26 bp, Artificial sequence
  SiRNA target sequence
ttgtttgcatcaaagttgttagataa

SEQ ID NO: 222907 - DNA, 26 bp, Artificial sequence
  SiRNA target sequence
tgtttgcatcaaagttgttagataat

SEQ ID NO: 222908 - DNA, 26 bp, Artificial sequence
  SiRNA target sequence
gtttgcatcaaagttgttagataata

SEQ ID NO: 222909 - DNA, 26 bp, Artificial sequence
  SiRNA target sequence
tttgcatcaaagttgttagataataa

SEQ ID NO: 222910 - DNA, 26 bp, Artificial sequence
  SiRNA target sequence
ttgcatcaaagttgttagataataaa

SEQ ID NO: 222911 - DNA, 26 bp, Artificial sequence
  SiRNA target sequence
tgcatcaaagttgttagataataaaa

SEQ ID NO: 222912 - DNA, 26 bp, Artificial sequence
  SiRNA target sequence
gcatcaaagttgttagataataaaaa

SEQ ID NO: 222913 - DNA, 26 bp, Artificial sequence
  SiRNA target sequence
catcaaagttgttagataataaaaaa

SEQ ID NO: 222914 - DNA, 26 bp, Artificial sequence
  SiRNA target sequence
atcaaagttgttagataataaaaaag

SEQ ID NO: 222915 - DNA, 26 bp, Artificial sequence
  SiRNA target sequence
tcaaagttgttagataataaaaaaga

SEQ ID NO: 222916 - DNA, 26 bp, Artificial sequence
  SiRNA target sequence
caaagttgttagataataaaaaagaa

SEQ ID NO: 222917 - DNA, 26 bp, Artificial sequence
  SiRNA target sequence
aaagttgttagataataaaaaagaag

SEQ ID NO: 222918 - DNA, 26 bp, Artificial sequence
  SiRNA target sequence
aagttgttagataataaaaaagaaga

SEQ ID NO: 222919 - DNA, 26 bp, Artificial sequence
  SiRNA target sequence
agttgttagataataaaaaagaagag

SEQ ID NO: 222920 - DNA, 26 bp, Artificial sequence
  SiRNA target sequence
gttgttagataataaaaaagaagagg

SEQ ID NO: 222921 - DNA, 26 bp, Artificial sequence
  SiRNA target sequence
ttgttagataataaaaaagaagagga

SEQ ID NO: 222922 - DNA, 26 bp, Artificial sequence
  SiRNA target sequence
tgttagataataaaaaagaagaggaa

SEQ ID NO: 222923 - DNA, 26 bp, Artificial sequence
  SiRNA target sequence
gttagataataaaaaagaagaggaaa

SEQ ID NO: 222924 - DNA, 26 bp, Artificial sequence
  SiRNA target sequence
ttagataataaaaaagaagaggaaat

SEQ ID NO: 222925 - DNA, 26 bp, Artificial sequence
  SiRNA target sequence
tagataataaaaaagaagaggaaatt

SEQ ID NO: 222926 - DNA, 26 bp, Artificial sequence
  SiRNA target sequence
agataataaaaaagaagaggaaattg

SEQ ID NO: 222927 - DNA, 26 bp, Artificial sequence
  SiRNA target sequence
gataataaaaaagaagaggaaattga

SEQ ID NO: 222928 - DNA, 26 bp, Artificial sequence
  SiRNA target sequence
ataataaaaaagaagaggaaattgat

SEQ ID NO: 222929 - DNA, 26 bp, Artificial sequence
  SiRNA target sequence
taataaaaaagaagaggaaattgatg

SEQ ID NO: 222930 - DNA, 26 bp, Artificial sequence
  SiRNA target sequence
aataaaaaagaagaggaaattgatgt

SEQ ID NO: 222931 - DNA, 26 bp, Artificial sequence
  SiRNA target sequence
ataaaaaagaagaggaaattgatgtg

SEQ ID NO: 222932 - DNA, 26 bp, Artificial sequence
  SiRNA target sequence
taaaaaagaagaggaaattgatgtgt

SEQ ID NO: 222933 - DNA, 26 bp, Artificial sequence
  SiRNA target sequence
aaaaaagaagaggaaattgatgtgtc

SEQ ID NO: 222934 - DNA, 26 bp, Artificial sequence
  SiRNA target sequence
aaaaagaagaggaaattgatgtgtca

SEQ ID NO: 222935 - DNA, 26 bp, Artificial sequence
  SiRNA target sequence
aaaagaagaggaaattgatgtgtcag

SEQ ID NO: 222936 - DNA, 26 bp, Artificial sequence
  SiRNA target sequence
aaagaagaggaaattgatgtgtcagt

SEQ ID NO: 222937 - DNA, 26 bp, Artificial sequence
  SiRNA target sequence
aagaagaggaaattgatgtgtcagtg

SEQ ID NO: 222938 - DNA, 26 bp, Artificial sequence
  SiRNA target sequence
agaagaggaaattgatgtgtcagtgc

SEQ ID NO: 222939 - DNA, 26 bp, Artificial sequence
  SiRNA target sequence
gaagaggaaattgatgtgtcagtgct

SEQ ID NO: 222940 - DNA, 26 bp, Artificial sequence
  SiRNA target sequence
aagaggaaattgatgtgtcagtgctc

SEQ ID NO: 222941 - DNA, 26 bp, Artificial sequence
  SiRNA target sequence
agaggaaattgatgtgtcagtgctcg

SEQ ID NO: 222942 - DNA, 26 bp, Artificial sequence
  SiRNA target sequence
gaggaaattgatgtgtcagtgctcgt

SEQ ID NO: 222943 - DNA, 26 bp, Artificial sequence
  SiRNA target sequence
aggaaattgatgtgtcagtgctcgtt

SEQ ID NO: 222944 - DNA, 26 bp, Artificial sequence
  SiRNA target sequence
ggaaattgatgtgtcagtgctcgtta

SEQ ID NO: 222945 - DNA, 26 bp, Artificial sequence
  SiRNA target sequence
gaaattgatgtgtcagtgctcgttaa

SEQ ID NO: 222946 - DNA, 26 bp, Artificial sequence
  SiRNA target sequence
aaattgatgtgtcagtgctcgttaat

SEQ ID NO: 222947 - DNA, 26 bp, Artificial sequence
  SiRNA target sequence
aattgatgtgtcagtgctcgttaatt

SEQ ID NO: 222948 - DNA, 26 bp, Artificial sequence
  SiRNA target sequence
attgatgtgtcagtgctcgttaatta

SEQ ID NO: 222949 - DNA, 26 bp, Artificial sequence
  SiRNA target sequence
ttgatgtgtcagtgctcgttaattaa

SEQ ID NO: 222950 - DNA, 27 bp, Artificial sequence
  SiRNA target sequence
atgattgagaggggtattatggaaaaa

SEQ ID NO: 222951 - DNA, 27 bp, Artificial sequence
  SiRNA target sequence
tgattgagaggggtattatggaaaaaa

SEQ ID NO: 222952 - DNA, 27 bp, Artificial sequence
  SiRNA target sequence
gattgagaggggtattatggaaaaaat

SEQ ID NO: 222953 - DNA, 27 bp, Artificial sequence
  SiRNA target sequence
attgagaggggtattatggaaaaaata

SEQ ID NO: 222954 - DNA, 27 bp, Artificial sequence
  SiRNA target sequence
ttgagaggggtattatggaaaaaataa

SEQ ID NO: 222955 - DNA, 27 bp, Artificial sequence
  SiRNA target sequence
tgagaggggtattatggaaaaaataaa

SEQ ID NO: 222956 - DNA, 27 bp, Artificial sequence
  SiRNA target sequence
gagaggggtattatggaaaaaataaaa

SEQ ID NO: 222957 - DNA, 27 bp, Artificial sequence
  SiRNA target sequence
agaggggtattatggaaaaaataaaaa

SEQ ID NO: 222958 - DNA, 27 bp, Artificial sequence
  SiRNA target sequence
gaggggtattatggaaaaaataaaaaa

SEQ ID NO: 222959 - DNA, 27 bp, Artificial sequence
  SiRNA target sequence
aggggtattatggaaaaaataaaaaat

SEQ ID NO: 222960 - DNA, 27 bp, Artificial sequence
  SiRNA target sequence
ggggtattatggaaaaaataaaaaatt

SEQ ID NO: 222961 - DNA, 27 bp, Artificial sequence
  SiRNA target sequence
gggtattatggaaaaaataaaaaattt

SEQ ID NO: 222962 - DNA, 27 bp, Artificial sequence
  SiRNA target sequence
ggtattatggaaaaaataaaaaattta

SEQ ID NO: 222963 - DNA, 27 bp, Artificial sequence
  SiRNA target sequence
gtattatggaaaaaataaaaaatttat

SEQ ID NO: 222964 - DNA, 27 bp, Artificial sequence
  SiRNA target sequence
tattatggaaaaaataaaaaatttatt

SEQ ID NO: 222965 - DNA, 27 bp, Artificial sequence
  SiRNA target sequence
attatggaaaaaataaaaaatttatta

SEQ ID NO: 222966 - DNA, 27 bp, Artificial sequence
  SiRNA target sequence
ttatggaaaaaataaaaaatttattaa

SEQ ID NO: 222967 - DNA, 27 bp, Artificial sequence
  SiRNA target sequence
tatggaaaaaataaaaaatttattaac

SEQ ID NO: 222968 - DNA, 27 bp, Artificial sequence
  SiRNA target sequence
atggaaaaaataaaaaatttattaaca

SEQ ID NO: 222969 - DNA, 27 bp, Artificial sequence
  SiRNA target sequence
tggaaaaaataaaaaatttattaacag

SEQ ID NO: 222970 - DNA, 27 bp, Artificial sequence
  SiRNA target sequence
ggaaaaaataaaaaatttattaacaga

SEQ ID NO: 222971 - DNA, 27 bp, Artificial sequence
  SiRNA target sequence
gaaaaaataaaaaatttattaacagag

SEQ ID NO: 222972 - DNA, 27 bp, Artificial sequence
  SiRNA target sequence
aaaaaataaaaaatttattaacagagg

SEQ ID NO: 222973 - DNA, 27 bp, Artificial sequence
  SiRNA target sequence
aaaaataaaaaatttattaacagagga

SEQ ID NO: 222974 - DNA, 27 bp, Artificial sequence
  SiRNA target sequence
aaaataaaaaatttattaacagaggat

SEQ ID NO: 222975 - DNA, 27 bp, Artificial sequence
  SiRNA target sequence
aaataaaaaatttattaacagaggatg

SEQ ID NO: 222976 - DNA, 27 bp, Artificial sequence
  SiRNA target sequence
aataaaaaatttattaacagaggatga

SEQ ID NO: 222977 - DNA, 27 bp, Artificial sequence
  SiRNA target sequence
ataaaaaatttattaacagaggatgaa

SEQ ID NO: 222978 - DNA, 27 bp, Artificial sequence
  SiRNA target sequence
taaaaaatttattaacagaggatgaag

SEQ ID NO: 222979 - DNA, 27 bp, Artificial sequence
  SiRNA target sequence
aaaaaatttattaacagaggatgaagt

SEQ ID NO: 222980 - DNA, 27 bp, Artificial sequence
  SiRNA target sequence
aaaaatttattaacagaggatgaagta

SEQ ID NO: 222981 - DNA, 27 bp, Artificial sequence
  SiRNA target sequence
aaaatttattaacagaggatgaagtag

SEQ ID NO: 222982 - DNA, 27 bp, Artificial sequence
  SiRNA target sequence
aaatttattaacagaggatgaagtaga

SEQ ID NO: 222983 - DNA, 27 bp, Artificial sequence
  SiRNA target sequence
aatttattaacagaggatgaagtagaa

SEQ ID NO: 222984 - DNA, 27 bp, Artificial sequence
  SiRNA target sequence
atttattaacagaggatgaagtagaag

SEQ ID NO: 222985 - DNA, 27 bp, Artificial sequence
  SiRNA target sequence
tttattaacagaggatgaagtagaagc

SEQ ID NO: 222986 - DNA, 27 bp, Artificial sequence
  SiRNA target sequence
ttattaacagaggatgaagtagaagca

SEQ ID NO: 222987 - DNA, 27 bp, Artificial sequence
  SiRNA target sequence
tattaacagaggatgaagtagaagcag

SEQ ID NO: 222988 - DNA, 27 bp, Artificial sequence
  SiRNA target sequence
attaacagaggatgaagtagaagcaga

SEQ ID NO: 222989 - DNA, 27 bp, Artificial sequence
  SiRNA target sequence
ttaacagaggatgaagtagaagcagaa

SEQ ID NO: 222990 - DNA, 27 bp, Artificial sequence
  SiRNA target sequence
taacagaggatgaagtagaagcagaag

SEQ ID NO: 222991 - DNA, 27 bp, Artificial sequence
  SiRNA target sequence
aacagaggatgaagtagaagcagaagc

SEQ ID NO: 222992 - DNA, 27 bp, Artificial sequence
  SiRNA target sequence
acagaggatgaagtagaagcagaagca

SEQ ID NO: 222993 - DNA, 27 bp, Artificial sequence
  SiRNA target sequence
cagaggatgaagtagaagcagaagcaa

SEQ ID NO: 222994 - DNA, 27 bp, Artificial sequence
  SiRNA target sequence
agaggatgaagtagaagcagaagcaaa

SEQ ID NO: 222995 - DNA, 27 bp, Artificial sequence
  SiRNA target sequence
gaggatgaagtagaagcagaagcaaat

SEQ ID NO: 222996 - DNA, 27 bp, Artificial sequence
  SiRNA target sequence
aggatgaagtagaagcagaagcaaatt

SEQ ID NO: 222997 - DNA, 27 bp, Artificial sequence
  SiRNA target sequence
ggatgaagtagaagcagaagcaaattc

SEQ ID NO: 222998 - DNA, 27 bp, Artificial sequence
  SiRNA target sequence
gatgaagtagaagcagaagcaaattct

SEQ ID NO: 222999 - DNA, 27 bp, Artificial sequence
  SiRNA target sequence
atgaagtagaagcagaagcaaattctg

SEQ ID NO: 223000 - DNA, 27 bp, Artificial sequence
  SiRNA target sequence
tgaagtagaagcagaagcaaattctgg

SEQ ID NO: 223001 - DNA, 27 bp, Artificial sequence
  SiRNA target sequence
gaagtagaagcagaagcaaattctgga

SEQ ID NO: 223002 - DNA, 27 bp, Artificial sequence
  SiRNA target sequence
aagtagaagcagaagcaaattctggaa

SEQ ID NO: 223003 - DNA, 27 bp, Artificial sequence
  SiRNA target sequence
agtagaagcagaagcaaattctggaag

SEQ ID NO: 223004 - DNA, 27 bp, Artificial sequence
  SiRNA target sequence
gtagaagcagaagcaaattctggaagg

SEQ ID NO: 223005 - DNA, 27 bp, Artificial sequence
  SiRNA target sequence
tagaagcagaagcaaattctggaaggg

SEQ ID NO: 223006 - DNA, 27 bp, Artificial sequence
  SiRNA target sequence
agaagcagaagcaaattctggaagggg

SEQ ID NO: 223007 - DNA, 27 bp, Artificial sequence
  SiRNA target sequence
gaagcagaagcaaattctggaaggggc

SEQ ID NO: 223008 - DNA, 27 bp, Artificial sequence
  SiRNA target sequence
aagcagaagcaaattctggaaggggca

SEQ ID NO: 223009 - DNA, 27 bp, Artificial sequence
  SiRNA target sequence
agcagaagcaaattctggaaggggcat

SEQ ID NO: 223010 - DNA, 27 bp, Artificial sequence
  SiRNA target sequence
gcagaagcaaattctggaaggggcatt

SEQ ID NO: 223011 - DNA, 27 bp, Artificial sequence
  SiRNA target sequence
cagaagcaaattctggaaggggcattt

SEQ ID NO: 223012 - DNA, 27 bp, Artificial sequence
  SiRNA target sequence
agaagcaaattctggaaggggcatttt

SEQ ID NO: 223013 - DNA, 27 bp, Artificial sequence
  SiRNA target sequence
gaagcaaattctggaaggggcatttta

SEQ ID NO: 223014 - DNA, 27 bp, Artificial sequence
  SiRNA target sequence
aagcaaattctggaaggggcattttat

SEQ ID NO: 223015 - DNA, 27 bp, Artificial sequence
  SiRNA target sequence
agcaaattctggaaggggcattttatc

SEQ ID NO: 223016 - DNA, 27 bp, Artificial sequence
  SiRNA target sequence
gcaaattctggaaggggcattttatca

SEQ ID NO: 223017 - DNA, 27 bp, Artificial sequence
  SiRNA target sequence
caaattctggaaggggcattttatcaa

SEQ ID NO: 223018 - DNA, 27 bp, Artificial sequence
  SiRNA target sequence
aaattctggaaggggcattttatcaat

SEQ ID NO: 223019 - DNA, 27 bp, Artificial sequence
  SiRNA target sequence
aattctggaaggggcattttatcaata

SEQ ID NO: 223020 - DNA, 27 bp, Artificial sequence
  SiRNA target sequence
attctggaaggggcattttatcaatat

SEQ ID NO: 223021 - DNA, 27 bp, Artificial sequence
  SiRNA target sequence
ttctggaaggggcattttatcaatatt

SEQ ID NO: 223022 - DNA, 27 bp, Artificial sequence
  SiRNA target sequence
tctggaaggggcattttatcaatattt

SEQ ID NO: 223023 - DNA, 27 bp, Artificial sequence
  SiRNA target sequence
ctggaaggggcattttatcaatattta

SEQ ID NO: 223024 - DNA, 27 bp, Artificial sequence
  SiRNA target sequence
tggaaggggcattttatcaatatttag

SEQ ID NO: 223025 - DNA, 27 bp, Artificial sequence
  SiRNA target sequence
ggaaggggcattttatcaatatttaga

SEQ ID NO: 223026 - DNA, 27 bp, Artificial sequence
  SiRNA target sequence
gaaggggcattttatcaatatttagaa

SEQ ID NO: 223027 - DNA, 27 bp, Artificial sequence
  SiRNA target sequence
aaggggcattttatcaatatttagaat

SEQ ID NO: 223028 - DNA, 27 bp, Artificial sequence
  SiRNA target sequence
aggggcattttatcaatatttagaatt

SEQ ID NO: 223029 - DNA, 27 bp, Artificial sequence
  SiRNA target sequence
ggggcattttatcaatatttagaattg

SEQ ID NO: 223030 - DNA, 27 bp, Artificial sequence
  SiRNA target sequence
gggcattttatcaatatttagaattgc

SEQ ID NO: 223031 - DNA, 27 bp, Artificial sequence
  SiRNA target sequence
ggcattttatcaatatttagaattgct

SEQ ID NO: 223032 - DNA, 27 bp, Artificial sequence
  SiRNA target sequence
gcattttatcaatatttagaattgcta

SEQ ID NO: 223033 - DNA, 27 bp, Artificial sequence
  SiRNA target sequence
cattttatcaatatttagaattgctaa

SEQ ID NO: 223034 - DNA, 27 bp, Artificial sequence
  SiRNA target sequence
attttatcaatatttagaattgctaag

SEQ ID NO: 223035 - DNA, 27 bp, Artificial sequence
  SiRNA target sequence
ttttatcaatatttagaattgctaagg

SEQ ID NO: 223036 - DNA, 27 bp, Artificial sequence
  SiRNA target sequence
tttatcaatatttagaattgctaaggt

SEQ ID NO: 223037 - DNA, 27 bp, Artificial sequence
  SiRNA target sequence
ttatcaatatttagaattgctaaggta

SEQ ID NO: 223038 - DNA, 27 bp, Artificial sequence
  SiRNA target sequence
tatcaatatttagaattgctaaggtag

SEQ ID NO: 223039 - DNA, 27 bp, Artificial sequence
  SiRNA target sequence
atcaatatttagaattgctaaggtaga

SEQ ID NO: 223040 - DNA, 27 bp, Artificial sequence
  SiRNA target sequence
tcaatatttagaattgctaaggtagaa

SEQ ID NO: 223041 - DNA, 27 bp, Artificial sequence
  SiRNA target sequence
caatatttagaattgctaaggtagaaa

SEQ ID NO: 223042 - DNA, 27 bp, Artificial sequence
  SiRNA target sequence
aatatttagaattgctaaggtagaaag

SEQ ID NO: 223043 - DNA, 27 bp, Artificial sequence
  SiRNA target sequence
atatttagaattgctaaggtagaaaga

SEQ ID NO: 223044 - DNA, 27 bp, Artificial sequence
  SiRNA target sequence
tatttagaattgctaaggtagaaagaa

SEQ ID NO: 223045 - DNA, 27 bp, Artificial sequence
  SiRNA target sequence
atttagaattgctaaggtagaaagaag

SEQ ID NO: 223046 - DNA, 27 bp, Artificial sequence
  SiRNA target sequence
tttagaattgctaaggtagaaagaaga

SEQ ID NO: 223047 - DNA, 27 bp, Artificial sequence
  SiRNA target sequence
ttagaattgctaaggtagaaagaagaa

SEQ ID NO: 223048 - DNA, 27 bp, Artificial sequence
  SiRNA target sequence
tagaattgctaaggtagaaagaagaat

SEQ ID NO: 223049 - DNA, 27 bp, Artificial sequence
  SiRNA target sequence
agaattgctaaggtagaaagaagaatg

SEQ ID NO: 223050 - DNA, 27 bp, Artificial sequence
  SiRNA target sequence
gaattgctaaggtagaaagaagaatgt

SEQ ID NO: 223051 - DNA, 27 bp, Artificial sequence
  SiRNA target sequence
aattgctaaggtagaaagaagaatgtt

SEQ ID NO: 223052 - DNA, 27 bp, Artificial sequence
  SiRNA target sequence
attgctaaggtagaaagaagaatgttt

SEQ ID NO: 223053 - DNA, 27 bp, Artificial sequence
  SiRNA target sequence
ttgctaaggtagaaagaagaatgtttt

SEQ ID NO: 223054 - DNA, 27 bp, Artificial sequence
  SiRNA target sequence
tgctaaggtagaaagaagaatgttttg

SEQ ID NO: 223055 - DNA, 27 bp, Artificial sequence
  SiRNA target sequence
gctaaggtagaaagaagaatgttttgg

SEQ ID NO: 223056 - DNA, 27 bp, Artificial sequence
  SiRNA target sequence
ctaaggtagaaagaagaatgttttggc

SEQ ID NO: 223057 - DNA, 27 bp, Artificial sequence
  SiRNA target sequence
taaggtagaaagaagaatgttttggct

SEQ ID NO: 223058 - DNA, 27 bp, Artificial sequence
  SiRNA target sequence
aaggtagaaagaagaatgttttggctt

SEQ ID NO: 223059 - DNA, 27 bp, Artificial sequence
  SiRNA target sequence
aggtagaaagaagaatgttttggctta

SEQ ID NO: 223060 - DNA, 27 bp, Artificial sequence
  SiRNA target sequence
ggtagaaagaagaatgttttggcttat

SEQ ID NO: 223061 - DNA, 27 bp, Artificial sequence
  SiRNA target sequence
gtagaaagaagaatgttttggcttatg

SEQ ID NO: 223062 - DNA, 27 bp, Artificial sequence
  SiRNA target sequence
tagaaagaagaatgttttggcttatga

SEQ ID NO: 223063 - DNA, 27 bp, Artificial sequence
  SiRNA target sequence
agaaagaagaatgttttggcttatgac

SEQ ID NO: 223064 - DNA, 27 bp, Artificial sequence
  SiRNA target sequence
gaaagaagaatgttttggcttatgacg

SEQ ID NO: 223065 - DNA, 27 bp, Artificial sequence
  SiRNA target sequence
aaagaagaatgttttggcttatgacgc

SEQ ID NO: 223066 - DNA, 27 bp, Artificial sequence
  SiRNA target sequence
aagaagaatgttttggcttatgacgct

SEQ ID NO: 223067 - DNA, 27 bp, Artificial sequence
  SiRNA target sequence
agaagaatgttttggcttatgacgctt

SEQ ID NO: 223068 - DNA, 27 bp, Artificial sequence
  SiRNA target sequence
gaagaatgttttggcttatgacgctta

SEQ ID NO: 223069 - DNA, 27 bp, Artificial sequence
  SiRNA target sequence
aagaatgttttggcttatgacgcttat

SEQ ID NO: 223070 - DNA, 27 bp, Artificial sequence
  SiRNA target sequence
agaatgttttggcttatgacgcttatg

SEQ ID NO: 223071 - DNA, 27 bp, Artificial sequence
  SiRNA target sequence
gaatgttttggcttatgacgcttatgt

SEQ ID NO: 223072 - DNA, 27 bp, Artificial sequence
  SiRNA target sequence
aatgttttggcttatgacgcttatgtt

SEQ ID NO: 223073 - DNA, 27 bp, Artificial sequence
  SiRNA target sequence
atgttttggcttatgacgcttatgttt

SEQ ID NO: 223074 - DNA, 27 bp, Artificial sequence
  SiRNA target sequence
tgttttggcttatgacgcttatgtttt

SEQ ID NO: 223075 - DNA, 27 bp, Artificial sequence
  SiRNA target sequence
gttttggcttatgacgcttatgttttc

SEQ ID NO: 223076 - DNA, 27 bp, Artificial sequence
  SiRNA target sequence
ttttggcttatgacgcttatgttttcg

SEQ ID NO: 223077 - DNA, 27 bp, Artificial sequence
  SiRNA target sequence
tttggcttatgacgcttatgttttcgc

SEQ ID NO: 223078 - DNA, 27 bp, Artificial sequence
  SiRNA target sequence
ttggcttatgacgcttatgttttcgct

SEQ ID NO: 223079 - DNA, 27 bp, Artificial sequence
  SiRNA target sequence
tggcttatgacgcttatgttttcgctt

SEQ ID NO: 223080 - DNA, 27 bp, Artificial sequence
  SiRNA target sequence
ggcttatgacgcttatgttttcgctta

SEQ ID NO: 223081 - DNA, 27 bp, Artificial sequence
  SiRNA target sequence
gcttatgacgcttatgttttcgcttat

SEQ ID NO: 223082 - DNA, 27 bp, Artificial sequence
  SiRNA target sequence
cttatgacgcttatgttttcgcttatt

SEQ ID NO: 223083 - DNA, 27 bp, Artificial sequence
  SiRNA target sequence
ttatgacgcttatgttttcgcttattt

SEQ ID NO: 223084 - DNA, 27 bp, Artificial sequence
  SiRNA target sequence
tatgacgcttatgttttcgcttatttc

SEQ ID NO: 223085 - DNA, 27 bp, Artificial sequence
  SiRNA target sequence
atgacgcttatgttttcgcttatttcc

SEQ ID NO: 223086 - DNA, 27 bp, Artificial sequence
  SiRNA target sequence
tgacgcttatgttttcgcttatttcct

SEQ ID NO: 223087 - DNA, 27 bp, Artificial sequence
  SiRNA target sequence
gacgcttatgttttcgcttatttcctt

SEQ ID NO: 223088 - DNA, 27 bp, Artificial sequence
  SiRNA target sequence
acgcttatgttttcgcttatttccttt

SEQ ID NO: 223089 - DNA, 27 bp, Artificial sequence
  SiRNA target sequence
cgcttatgttttcgcttatttccttta

SEQ ID NO: 223090 - DNA, 27 bp, Artificial sequence
  SiRNA target sequence
gcttatgttttcgcttatttcctttat

SEQ ID NO: 223091 - DNA, 27 bp, Artificial sequence
  SiRNA target sequence
cttatgttttcgcttatttcctttatt

SEQ ID NO: 223092 - DNA, 27 bp, Artificial sequence
  SiRNA target sequence
ttatgttttcgcttatttcctttattt

SEQ ID NO: 223093 - DNA, 27 bp, Artificial sequence
  SiRNA target sequence
tatgttttcgcttatttcctttattta

SEQ ID NO: 223094 - DNA, 27 bp, Artificial sequence
  SiRNA target sequence
atgttttcgcttatttcctttatttac

SEQ ID NO: 223095 - DNA, 27 bp, Artificial sequence
  SiRNA target sequence
tgttttcgcttatttcctttatttact

SEQ ID NO: 223096 - DNA, 27 bp, Artificial sequence
  SiRNA target sequence
gttttcgcttatttcctttatttactc

SEQ ID NO: 223097 - DNA, 27 bp, Artificial sequence
  SiRNA target sequence
ttttcgcttatttcctttatttactca

SEQ ID NO: 223098 - DNA, 27 bp, Artificial sequence
  SiRNA target sequence
tttcgcttatttcctttatttactcag

SEQ ID NO: 223099 - DNA, 27 bp, Artificial sequence
  SiRNA target sequence
ttcgcttatttcctttatttactcagt

SEQ ID NO: 223100 - DNA, 27 bp, Artificial sequence
  SiRNA target sequence
tcgcttatttcctttatttactcagta

SEQ ID NO: 223101 - DNA, 27 bp, Artificial sequence
  SiRNA target sequence
cgcttatttcctttatttactcagtag

SEQ ID NO: 223102 - DNA, 27 bp, Artificial sequence
  SiRNA target sequence
gcttatttcctttatttactcagtagg

SEQ ID NO: 223103 - DNA, 27 bp, Artificial sequence
  SiRNA target sequence
cttatttcctttatttactcagtagga

SEQ ID NO: 223104 - DNA, 27 bp, Artificial sequence
  SiRNA target sequence
ttatttcctttatttactcagtaggac

SEQ ID NO: 223105 - DNA, 27 bp, Artificial sequence
  SiRNA target sequence
tatttcctttatttactcagtaggacg

SEQ ID NO: 223106 - DNA, 27 bp, Artificial sequence
  SiRNA target sequence
atttcctttatttactcagtaggacga

SEQ ID NO: 223107 - DNA, 27 bp, Artificial sequence
  SiRNA target sequence
tttcctttatttactcagtaggacgag

SEQ ID NO: 223108 - DNA, 27 bp, Artificial sequence
  SiRNA target sequence
ttcctttatttactcagtaggacgagt

SEQ ID NO: 223109 - DNA, 27 bp, Artificial sequence
  SiRNA target sequence
tcctttatttactcagtaggacgagtg

SEQ ID NO: 223110 - DNA, 27 bp, Artificial sequence
  SiRNA target sequence
cctttatttactcagtaggacgagtgt

SEQ ID NO: 223111 - DNA, 27 bp, Artificial sequence
  SiRNA target sequence
ctttatttactcagtaggacgagtgtt

SEQ ID NO: 223112 - DNA, 27 bp, Artificial sequence
  SiRNA target sequence
tttatttactcagtaggacgagtgtta

SEQ ID NO: 223113 - DNA, 27 bp, Artificial sequence
  SiRNA target sequence
ttatttactcagtaggacgagtgttaa

SEQ ID NO: 223114 - DNA, 27 bp, Artificial sequence
  SiRNA target sequence
tatttactcagtaggacgagtgttaaa

SEQ ID NO: 223115 - DNA, 27 bp, Artificial sequence
  SiRNA target sequence
atttactcagtaggacgagtgttaaaa

SEQ ID NO: 223116 - DNA, 27 bp, Artificial sequence
  SiRNA target sequence
tttactcagtaggacgagtgttaaaag

SEQ ID NO: 223117 - DNA, 27 bp, Artificial sequence
  SiRNA target sequence
ttactcagtaggacgagtgttaaaaga

SEQ ID NO: 223118 - DNA, 27 bp, Artificial sequence
  SiRNA target sequence
tactcagtaggacgagtgttaaaagat

SEQ ID NO: 223119 - DNA, 27 bp, Artificial sequence
  SiRNA target sequence
actcagtaggacgagtgttaaaagatg

SEQ ID NO: 223120 - DNA, 27 bp, Artificial sequence
  SiRNA target sequence
ctcagtaggacgagtgttaaaagatgc

SEQ ID NO: 223121 - DNA, 27 bp, Artificial sequence
  SiRNA target sequence
tcagtaggacgagtgttaaaagatgca

SEQ ID NO: 223122 - DNA, 27 bp, Artificial sequence
  SiRNA target sequence
cagtaggacgagtgttaaaagatgcag

SEQ ID NO: 223123 - DNA, 27 bp, Artificial sequence
  SiRNA target sequence
agtaggacgagtgttaaaagatgcagc

SEQ ID NO: 223124 - DNA, 27 bp, Artificial sequence
  SiRNA target sequence
gtaggacgagtgttaaaagatgcagca

SEQ ID NO: 223125 - DNA, 27 bp, Artificial sequence
  SiRNA target sequence
taggacgagtgttaaaagatgcagcag

SEQ ID NO: 223126 - DNA, 27 bp, Artificial sequence
  SiRNA target sequence
aggacgagtgttaaaagatgcagcagt

SEQ ID NO: 223127 - DNA, 27 bp, Artificial sequence
  SiRNA target sequence
ggacgagtgttaaaagatgcagcagtt

SEQ ID NO: 223128 - DNA, 27 bp, Artificial sequence
  SiRNA target sequence
gacgagtgttaaaagatgcagcagttc

SEQ ID NO: 223129 - DNA, 27 bp, Artificial sequence
  SiRNA target sequence
acgagtgttaaaagatgcagcagttct

SEQ ID NO: 223130 - DNA, 27 bp, Artificial sequence
  SiRNA target sequence
cgagtgttaaaagatgcagcagttctt

SEQ ID NO: 223131 - DNA, 27 bp, Artificial sequence
  SiRNA target sequence
gagtgttaaaagatgcagcagttctta

SEQ ID NO: 223132 - DNA, 27 bp, Artificial sequence
  SiRNA target sequence
agtgttaaaagatgcagcagttcttag

SEQ ID NO: 223133 - DNA, 27 bp, Artificial sequence
  SiRNA target sequence
gtgttaaaagatgcagcagttcttagt

SEQ ID NO: 223134 - DNA, 27 bp, Artificial sequence
  SiRNA target sequence
tgttaaaagatgcagcagttcttagta

SEQ ID NO: 223135 - DNA, 27 bp, Artificial sequence
  SiRNA target sequence
gttaaaagatgcagcagttcttagtag

SEQ ID NO: 223136 - DNA, 27 bp, Artificial sequence
  SiRNA target sequence
ttaaaagatgcagcagttcttagtaga

SEQ ID NO: 223137 - DNA, 27 bp, Artificial sequence
  SiRNA target sequence
taaaagatgcagcagttcttagtagac

SEQ ID NO: 223138 - DNA, 27 bp, Artificial sequence
  SiRNA target sequence
aaaagatgcagcagttcttagtagaca

SEQ ID NO: 223139 - DNA, 27 bp, Artificial sequence
  SiRNA target sequence
aaagatgcagcagttcttagtagacag

SEQ ID NO: 223140 - DNA, 27 bp, Artificial sequence
  SiRNA target sequence
aagatgcagcagttcttagtagacaga

SEQ ID NO: 223141 - DNA, 27 bp, Artificial sequence
  SiRNA target sequence
agatgcagcagttcttagtagacagat

SEQ ID NO: 223142 - DNA, 27 bp, Artificial sequence
  SiRNA target sequence
gatgcagcagttcttagtagacagatg

SEQ ID NO: 223143 - DNA, 27 bp, Artificial sequence
  SiRNA target sequence
atgcagcagttcttagtagacagatgc

SEQ ID NO: 223144 - DNA, 27 bp, Artificial sequence
  SiRNA target sequence
tgcagcagttcttagtagacagatgcc

SEQ ID NO: 223145 - DNA, 27 bp, Artificial sequence
  SiRNA target sequence
gcagcagttcttagtagacagatgcca

SEQ ID NO: 223146 - DNA, 27 bp, Artificial sequence
  SiRNA target sequence
cagcagttcttagtagacagatgccac

SEQ ID NO: 223147 - DNA, 27 bp, Artificial sequence
  SiRNA target sequence
agcagttcttagtagacagatgccact

SEQ ID NO: 223148 - DNA, 27 bp, Artificial sequence
  SiRNA target sequence
gcagttcttagtagacagatgccacta

SEQ ID NO: 223149 - DNA, 27 bp, Artificial sequence
  SiRNA target sequence
cagttcttagtagacagatgccactat

SEQ ID NO: 223150 - DNA, 27 bp, Artificial sequence
  SiRNA target sequence
agttcttagtagacagatgccactatc

SEQ ID NO: 223151 - DNA, 27 bp, Artificial sequence
  SiRNA target sequence
gttcttagtagacagatgccactatcc

SEQ ID NO: 223152 - DNA, 27 bp, Artificial sequence
  SiRNA target sequence
ttcttagtagacagatgccactatcca

SEQ ID NO: 223153 - DNA, 27 bp, Artificial sequence
  SiRNA target sequence
tcttagtagacagatgccactatccat

SEQ ID NO: 223154 - DNA, 27 bp, Artificial sequence
  SiRNA target sequence
cttagtagacagatgccactatccatt

SEQ ID NO: 223155 - DNA, 27 bp, Artificial sequence
  SiRNA target sequence
ttagtagacagatgccactatccatta

SEQ ID NO: 223156 - DNA, 27 bp, Artificial sequence
  SiRNA target sequence
tagtagacagatgccactatccattaa

SEQ ID NO: 223157 - DNA, 27 bp, Artificial sequence
  SiRNA target sequence
agtagacagatgccactatccattaat

SEQ ID NO: 223158 - DNA, 27 bp, Artificial sequence
  SiRNA target sequence
gtagacagatgccactatccattaatt

SEQ ID NO: 223159 - DNA, 27 bp, Artificial sequence
  SiRNA target sequence
tagacagatgccactatccattaattg

SEQ ID NO: 223160 - DNA, 27 bp, Artificial sequence
  SiRNA target sequence
agacagatgccactatccattaattgt

SEQ ID NO: 223161 - DNA, 27 bp, Artificial sequence
  SiRNA target sequence
gacagatgccactatccattaattgtc

SEQ ID NO: 223162 - DNA, 27 bp, Artificial sequence
  SiRNA target sequence
acagatgccactatccattaattgtct

SEQ ID NO: 223163 - DNA, 27 bp, Artificial sequence
  SiRNA target sequence
cagatgccactatccattaattgtctt

SEQ ID NO: 223164 - DNA, 27 bp, Artificial sequence
  SiRNA target sequence
agatgccactatccattaattgtctta

SEQ ID NO: 223165 - DNA, 27 bp, Artificial sequence
  SiRNA target sequence
gatgccactatccattaattgtcttaa

SEQ ID NO: 223166 - DNA, 27 bp, Artificial sequence
  SiRNA target sequence
atgccactatccattaattgtcttaaa

SEQ ID NO: 223167 - DNA, 27 bp, Artificial sequence
  SiRNA target sequence
tgccactatccattaattgtcttaaaa

SEQ ID NO: 223168 - DNA, 27 bp, Artificial sequence
  SiRNA target sequence
gccactatccattaattgtcttaaaag

SEQ ID NO: 223169 - DNA, 27 bp, Artificial sequence
  SiRNA target sequence
ccactatccattaattgtcttaaaagc

SEQ ID NO: 223170 - DNA, 27 bp, Artificial sequence
  SiRNA target sequence
cactatccattaattgtcttaaaagct

SEQ ID NO: 223171 - DNA, 27 bp, Artificial sequence
  SiRNA target sequence
actatccattaattgtcttaaaagctt

SEQ ID NO: 223172 - DNA, 27 bp, Artificial sequence
  SiRNA target sequence
ctatccattaattgtcttaaaagcttt

SEQ ID NO: 223173 - DNA, 27 bp, Artificial sequence
  SiRNA target sequence
tatccattaattgtcttaaaagctttg

SEQ ID NO: 223174 - DNA, 27 bp, Artificial sequence
  SiRNA target sequence
atccattaattgtcttaaaagctttgt

SEQ ID NO: 223175 - DNA, 27 bp, Artificial sequence
  SiRNA target sequence
tccattaattgtcttaaaagctttgta

SEQ ID NO: 223176 - DNA, 27 bp, Artificial sequence
  SiRNA target sequence
ccattaattgtcttaaaagctttgtaa

SEQ ID NO: 223177 - DNA, 27 bp, Artificial sequence
  SiRNA target sequence
cattaattgtcttaaaagctttgtaat

SEQ ID NO: 223178 - DNA, 27 bp, Artificial sequence
  SiRNA target sequence
attaattgtcttaaaagctttgtaatt

SEQ ID NO: 223179 - DNA, 27 bp, Artificial sequence
  SiRNA target sequence
ttaattgtcttaaaagctttgtaattt

SEQ ID NO: 223180 - DNA, 27 bp, Artificial sequence
  SiRNA target sequence
taattgtcttaaaagctttgtaatttt

SEQ ID NO: 223181 - DNA, 27 bp, Artificial sequence
  SiRNA target sequence
aattgtcttaaaagctttgtaatttta

SEQ ID NO: 223182 - DNA, 27 bp, Artificial sequence
  SiRNA target sequence
attgtcttaaaagctttgtaattttac

SEQ ID NO: 223183 - DNA, 27 bp, Artificial sequence
  SiRNA target sequence
ttgtcttaaaagctttgtaattttacc

SEQ ID NO: 223184 - DNA, 27 bp, Artificial sequence
  SiRNA target sequence
tgtcttaaaagctttgtaattttacca

SEQ ID NO: 223185 - DNA, 27 bp, Artificial sequence
  SiRNA target sequence
gtcttaaaagctttgtaattttaccag

SEQ ID NO: 223186 - DNA, 27 bp, Artificial sequence
  SiRNA target sequence
tcttaaaagctttgtaattttaccagt

SEQ ID NO: 223187 - DNA, 27 bp, Artificial sequence
  SiRNA target sequence
cttaaaagctttgtaattttaccagtt

SEQ ID NO: 223188 - DNA, 27 bp, Artificial sequence
  SiRNA target sequence
ttaaaagctttgtaattttaccagtta

SEQ ID NO: 223189 - DNA, 27 bp, Artificial sequence
  SiRNA target sequence
taaaagctttgtaattttaccagttac

SEQ ID NO: 223190 - DNA, 27 bp, Artificial sequence
  SiRNA target sequence
aaaagctttgtaattttaccagttact

SEQ ID NO: 223191 - DNA, 27 bp, Artificial sequence
  SiRNA target sequence
aaagctttgtaattttaccagttactc

SEQ ID NO: 223192 - DNA, 27 bp, Artificial sequence
  SiRNA target sequence
aagctttgtaattttaccagttactct

SEQ ID NO: 223193 - DNA, 27 bp, Artificial sequence
  SiRNA target sequence
agctttgtaattttaccagttactctt

SEQ ID NO: 223194 - DNA, 27 bp, Artificial sequence
  SiRNA target sequence
gctttgtaattttaccagttactcttg

SEQ ID NO: 223195 - DNA, 27 bp, Artificial sequence
  SiRNA target sequence
ctttgtaattttaccagttactcttgt

SEQ ID NO: 223196 - DNA, 27 bp, Artificial sequence
  SiRNA target sequence
tttgtaattttaccagttactcttgtt

SEQ ID NO: 223197 - DNA, 27 bp, Artificial sequence
  SiRNA target sequence
ttgtaattttaccagttactcttgttt

SEQ ID NO: 223198 - DNA, 27 bp, Artificial sequence
  SiRNA target sequence
tgtaattttaccagttactcttgtttg

SEQ ID NO: 223199 - DNA, 27 bp, Artificial sequence
  SiRNA target sequence
gtaattttaccagttactcttgtttgt

SEQ ID NO: 223200 - DNA, 27 bp, Artificial sequence
  SiRNA target sequence
taattttaccagttactcttgtttgtg

SEQ ID NO: 223201 - DNA, 27 bp, Artificial sequence
  SiRNA target sequence
aattttaccagttactcttgtttgtgt

SEQ ID NO: 223202 - DNA, 27 bp, Artificial sequence
  SiRNA target sequence
attttaccagttactcttgtttgtgta

SEQ ID NO: 223203 - DNA, 27 bp, Artificial sequence
  SiRNA target sequence
ttttaccagttactcttgtttgtgtag

SEQ ID NO: 223204 - DNA, 27 bp, Artificial sequence
  SiRNA target sequence
tttaccagttactcttgtttgtgtagg

SEQ ID NO: 223205 - DNA, 27 bp, Artificial sequence
  SiRNA target sequence
ttaccagttactcttgtttgtgtagga

SEQ ID NO: 223206 - DNA, 27 bp, Artificial sequence
  SiRNA target sequence
taccagttactcttgtttgtgtaggat

SEQ ID NO: 223207 - DNA, 27 bp, Artificial sequence
  SiRNA target sequence
accagttactcttgtttgtgtaggatt

SEQ ID NO: 223208 - DNA, 27 bp, Artificial sequence
  SiRNA target sequence
ccagttactcttgtttgtgtaggatta

SEQ ID NO: 223209 - DNA, 27 bp, Artificial sequence
  SiRNA target sequence
cagttactcttgtttgtgtaggattaa

SEQ ID NO: 223210 - DNA, 27 bp, Artificial sequence
  SiRNA target sequence
agttactcttgtttgtgtaggattaat

SEQ ID NO: 223211 - DNA, 27 bp, Artificial sequence
  SiRNA target sequence
gttactcttgtttgtgtaggattaatt

SEQ ID NO: 223212 - DNA, 27 bp, Artificial sequence
  SiRNA target sequence
ttactcttgtttgtgtaggattaattc

SEQ ID NO: 223213 - DNA, 27 bp, Artificial sequence
  SiRNA target sequence
tactcttgtttgtgtaggattaattca

SEQ ID NO: 223214 - DNA, 27 bp, Artificial sequence
  SiRNA target sequence
actcttgtttgtgtaggattaattcag

SEQ ID NO: 223215 - DNA, 27 bp, Artificial sequence
  SiRNA target sequence
ctcttgtttgtgtaggattaattcaga

SEQ ID NO: 223216 - DNA, 27 bp, Artificial sequence
  SiRNA target sequence
tcttgtttgtgtaggattaattcagaa

SEQ ID NO: 223217 - DNA, 27 bp, Artificial sequence
  SiRNA target sequence
cttgtttgtgtaggattaattcagaag

SEQ ID NO: 223218 - DNA, 27 bp, Artificial sequence
  SiRNA target sequence
ttgtttgtgtaggattaattcagaagt

SEQ ID NO: 223219 - DNA, 27 bp, Artificial sequence
  SiRNA target sequence
tgtttgtgtaggattaattcagaagtc

SEQ ID NO: 223220 - DNA, 27 bp, Artificial sequence
  SiRNA target sequence
gtttgtgtaggattaattcagaagtct

SEQ ID NO: 223221 - DNA, 27 bp, Artificial sequence
  SiRNA target sequence
tttgtgtaggattaattcagaagtcta

SEQ ID NO: 223222 - DNA, 27 bp, Artificial sequence
  SiRNA target sequence
ttgtgtaggattaattcagaagtctac

SEQ ID NO: 223223 - DNA, 27 bp, Artificial sequence
  SiRNA target sequence
tgtgtaggattaattcagaagtctaca

SEQ ID NO: 223224 - DNA, 27 bp, Artificial sequence
  SiRNA target sequence
gtgtaggattaattcagaagtctacac

SEQ ID NO: 223225 - DNA, 27 bp, Artificial sequence
  SiRNA target sequence
tgtaggattaattcagaagtctacact

SEQ ID NO: 223226 - DNA, 27 bp, Artificial sequence
  SiRNA target sequence
gtaggattaattcagaagtctacactc

SEQ ID NO: 223227 - DNA, 27 bp, Artificial sequence
  SiRNA target sequence
taggattaattcagaagtctacactct

SEQ ID NO: 223228 - DNA, 27 bp, Artificial sequence
  SiRNA target sequence
aggattaattcagaagtctacactctc

SEQ ID NO: 223229 - DNA, 27 bp, Artificial sequence
  SiRNA target sequence
ggattaattcagaagtctacactctct

SEQ ID NO: 223230 - DNA, 27 bp, Artificial sequence
  SiRNA target sequence
gattaattcagaagtctacactctctt

SEQ ID NO: 223231 - DNA, 27 bp, Artificial sequence
  SiRNA target sequence
attaattcagaagtctacactctctta

SEQ ID NO: 223232 - DNA, 27 bp, Artificial sequence
  SiRNA target sequence
ttaattcagaagtctacactctcttat

SEQ ID NO: 223233 - DNA, 27 bp, Artificial sequence
  SiRNA target sequence
taattcagaagtctacactctcttatt

SEQ ID NO: 223234 - DNA, 27 bp, Artificial sequence
  SiRNA target sequence
aattcagaagtctacactctcttattc

SEQ ID NO: 223235 - DNA, 27 bp, Artificial sequence
  SiRNA target sequence
attcagaagtctacactctcttattct

SEQ ID NO: 223236 - DNA, 27 bp, Artificial sequence
  SiRNA target sequence
ttcagaagtctacactctcttattctt

SEQ ID NO: 223237 - DNA, 27 bp, Artificial sequence
  SiRNA target sequence
tcagaagtctacactctcttattcttt

SEQ ID NO: 223238 - DNA, 27 bp, Artificial sequence
  SiRNA target sequence
cagaagtctacactctcttattctttt

SEQ ID NO: 223239 - DNA, 27 bp, Artificial sequence
  SiRNA target sequence
agaagtctacactctcttattctttta

SEQ ID NO: 223240 - DNA, 27 bp, Artificial sequence
  SiRNA target sequence
gaagtctacactctcttattcttttac

SEQ ID NO: 223241 - DNA, 27 bp, Artificial sequence
  SiRNA target sequence
aagtctacactctcttattcttttaca

SEQ ID NO: 223242 - DNA, 27 bp, Artificial sequence
  SiRNA target sequence
agtctacactctcttattcttttacaa

SEQ ID NO: 223243 - DNA, 27 bp, Artificial sequence
  SiRNA target sequence
gtctacactctcttattcttttacaaa

SEQ ID NO: 223244 - DNA, 27 bp, Artificial sequence
  SiRNA target sequence
tctacactctcttattcttttacaaaa

SEQ ID NO: 223245 - DNA, 27 bp, Artificial sequence
  SiRNA target sequence
ctacactctcttattcttttacaaaaa

SEQ ID NO: 223246 - DNA, 27 bp, Artificial sequence
  SiRNA target sequence
tacactctcttattcttttacaaaaat

SEQ ID NO: 223247 - DNA, 27 bp, Artificial sequence
  SiRNA target sequence
acactctcttattcttttacaaaaata

SEQ ID NO: 223248 - DNA, 27 bp, Artificial sequence
  SiRNA target sequence
cactctcttattcttttacaaaaatat

SEQ ID NO: 223249 - DNA, 27 bp, Artificial sequence
  SiRNA target sequence
actctcttattcttttacaaaaatatt

SEQ ID NO: 223250 - DNA, 27 bp, Artificial sequence
  SiRNA target sequence
ctctcttattcttttacaaaaatattt

SEQ ID NO: 223251 - DNA, 27 bp, Artificial sequence
  SiRNA target sequence
tctcttattcttttacaaaaatatttg

SEQ ID NO: 223252 - DNA, 27 bp, Artificial sequence
  SiRNA target sequence
ctcttattcttttacaaaaatatttga

SEQ ID NO: 223253 - DNA, 27 bp, Artificial sequence
  SiRNA target sequence
tcttattcttttacaaaaatatttgat

SEQ ID NO: 223254 - DNA, 27 bp, Artificial sequence
  SiRNA target sequence
cttattcttttacaaaaatatttgatg

SEQ ID NO: 223255 - DNA, 27 bp, Artificial sequence
  SiRNA target sequence
ttattcttttacaaaaatatttgatgg

SEQ ID NO: 223256 - DNA, 27 bp, Artificial sequence
  SiRNA target sequence
tattcttttacaaaaatatttgatggt

SEQ ID NO: 223257 - DNA, 27 bp, Artificial sequence
  SiRNA target sequence
attcttttacaaaaatatttgatggtg

SEQ ID NO: 223258 - DNA, 27 bp, Artificial sequence
  SiRNA target sequence
ttcttttacaaaaatatttgatggtgc

SEQ ID NO: 223259 - DNA, 27 bp, Artificial sequence
  SiRNA target sequence
tcttttacaaaaatatttgatggtgca

SEQ ID NO: 223260 - DNA, 27 bp, Artificial sequence
  SiRNA target sequence
cttttacaaaaatatttgatggtgcat

SEQ ID NO: 223261 - DNA, 27 bp, Artificial sequence
  SiRNA target sequence
ttttacaaaaatatttgatggtgcatt

SEQ ID NO: 223262 - DNA, 27 bp, Artificial sequence
  SiRNA target sequence
tttacaaaaatatttgatggtgcattg

SEQ ID NO: 223263 - DNA, 27 bp, Artificial sequence
  SiRNA target sequence
ttacaaaaatatttgatggtgcattgt

SEQ ID NO: 223264 - DNA, 27 bp, Artificial sequence
  SiRNA target sequence
tacaaaaatatttgatggtgcattgtt

SEQ ID NO: 223265 - DNA, 27 bp, Artificial sequence
  SiRNA target sequence
acaaaaatatttgatggtgcattgtta

SEQ ID NO: 223266 - DNA, 27 bp, Artificial sequence
  SiRNA target sequence
caaaaatatttgatggtgcattgttaa

SEQ ID NO: 223267 - DNA, 27 bp, Artificial sequence
  SiRNA target sequence
aaaaatatttgatggtgcattgttaat

SEQ ID NO: 223268 - DNA, 27 bp, Artificial sequence
  SiRNA target sequence
aaaatatttgatggtgcattgttaata

SEQ ID NO: 223269 - DNA, 27 bp, Artificial sequence
  SiRNA target sequence
aaatatttgatggtgcattgttaatat

SEQ ID NO: 223270 - DNA, 27 bp, Artificial sequence
  SiRNA target sequence
aatatttgatggtgcattgttaatatt

SEQ ID NO: 223271 - DNA, 27 bp, Artificial sequence
  SiRNA target sequence
atatttgatggtgcattgttaatattt

SEQ ID NO: 223272 - DNA, 27 bp, Artificial sequence
  SiRNA target sequence
tatttgatggtgcattgttaatatttg

SEQ ID NO: 223273 - DNA, 27 bp, Artificial sequence
  SiRNA target sequence
atttgatggtgcattgttaatatttgc

SEQ ID NO: 223274 - DNA, 27 bp, Artificial sequence
  SiRNA target sequence
tttgatggtgcattgttaatatttgct

SEQ ID NO: 223275 - DNA, 27 bp, Artificial sequence
  SiRNA target sequence
ttgatggtgcattgttaatatttgctt

SEQ ID NO: 223276 - DNA, 27 bp, Artificial sequence
  SiRNA target sequence
tgatggtgcattgttaatatttgcttt

SEQ ID NO: 223277 - DNA, 27 bp, Artificial sequence
  SiRNA target sequence
gatggtgcattgttaatatttgctttt

SEQ ID NO: 223278 - DNA, 27 bp, Artificial sequence
  SiRNA target sequence
atggtgcattgttaatatttgcttttc

SEQ ID NO: 223279 - DNA, 27 bp, Artificial sequence
  SiRNA target sequence
tggtgcattgttaatatttgcttttct

SEQ ID NO: 223280 - DNA, 27 bp, Artificial sequence
  SiRNA target sequence
ggtgcattgttaatatttgcttttctt

SEQ ID NO: 223281 - DNA, 27 bp, Artificial sequence
  SiRNA target sequence
gtgcattgttaatatttgcttttcttt

SEQ ID NO: 223282 - DNA, 27 bp, Artificial sequence
  SiRNA target sequence
tgcattgttaatatttgcttttcttta

SEQ ID NO: 223283 - DNA, 27 bp, Artificial sequence
  SiRNA target sequence
gcattgttaatatttgcttttctttat

SEQ ID NO: 223284 - DNA, 27 bp, Artificial sequence
  SiRNA target sequence
cattgttaatatttgcttttctttata

SEQ ID NO: 223285 - DNA, 27 bp, Artificial sequence
  SiRNA target sequence
attgttaatatttgcttttctttatat

SEQ ID NO: 223286 - DNA, 27 bp, Artificial sequence
  SiRNA target sequence
ttgttaatatttgcttttctttatatc

SEQ ID NO: 223287 - DNA, 27 bp, Artificial sequence
  SiRNA target sequence
tgttaatatttgcttttctttatatca

SEQ ID NO: 223288 - DNA, 27 bp, Artificial sequence
  SiRNA target sequence
gttaatatttgcttttctttatatcat

SEQ ID NO: 223289 - DNA, 27 bp, Artificial sequence
  SiRNA target sequence
ttaatatttgcttttctttatatcatt

SEQ ID NO: 223290 - DNA, 27 bp, Artificial sequence
  SiRNA target sequence
taatatttgcttttctttatatcattc

SEQ ID NO: 223291 - DNA, 27 bp, Artificial sequence
  SiRNA target sequence
aatatttgcttttctttatatcattct

SEQ ID NO: 223292 - DNA, 27 bp, Artificial sequence
  SiRNA target sequence
atatttgcttttctttatatcattctt

SEQ ID NO: 223293 - DNA, 27 bp, Artificial sequence
  SiRNA target sequence
tatttgcttttctttatatcattcttg

SEQ ID NO: 223294 - DNA, 27 bp, Artificial sequence
  SiRNA target sequence
atttgcttttctttatatcattcttgg

SEQ ID NO: 223295 - DNA, 27 bp, Artificial sequence
  SiRNA target sequence
tttgcttttctttatatcattcttggt

SEQ ID NO: 223296 - DNA, 27 bp, Artificial sequence
  SiRNA target sequence
ttgcttttctttatatcattcttggtc

SEQ ID NO: 223297 - DNA, 27 bp, Artificial sequence
  SiRNA target sequence
tgcttttctttatatcattcttggtct

SEQ ID NO: 223298 - DNA, 27 bp, Artificial sequence
  SiRNA target sequence
gcttttctttatatcattcttggtcta

SEQ ID NO: 223299 - DNA, 27 bp, Artificial sequence
  SiRNA target sequence
cttttctttatatcattcttggtctag

SEQ ID NO: 223300 - DNA, 27 bp, Artificial sequence
  SiRNA target sequence
ttttctttatatcattcttggtctagt

SEQ ID NO: 223301 - DNA, 27 bp, Artificial sequence
  SiRNA target sequence
tttctttatatcattcttggtctagtt

SEQ ID NO: 223302 - DNA, 27 bp, Artificial sequence
  SiRNA target sequence
ttctttatatcattcttggtctagttc

SEQ ID NO: 223303 - DNA, 27 bp, Artificial sequence
  SiRNA target sequence
tctttatatcattcttggtctagttct

SEQ ID NO: 223304 - DNA, 27 bp, Artificial sequence
  SiRNA target sequence
ctttatatcattcttggtctagttctt

SEQ ID NO: 223305 - DNA, 27 bp, Artificial sequence
  SiRNA target sequence
tttatatcattcttggtctagttcttc

SEQ ID NO: 223306 - DNA, 27 bp, Artificial sequence
  SiRNA target sequence
ttatatcattcttggtctagttcttct

SEQ ID NO: 223307 - DNA, 27 bp, Artificial sequence
  SiRNA target sequence
tatatcattcttggtctagttcttctt

SEQ ID NO: 223308 - DNA, 27 bp, Artificial sequence
  SiRNA target sequence
atatcattcttggtctagttcttcttc

SEQ ID NO: 223309 - DNA, 27 bp, Artificial sequence
  SiRNA target sequence
tatcattcttggtctagttcttcttcc

SEQ ID NO: 223310 - DNA, 27 bp, Artificial sequence
  SiRNA target sequence
atcattcttggtctagttcttcttcca

SEQ ID NO: 223311 - DNA, 27 bp, Artificial sequence
  SiRNA target sequence
tcattcttggtctagttcttcttccat

SEQ ID NO: 223312 - DNA, 27 bp, Artificial sequence
  SiRNA target sequence
cattcttggtctagttcttcttccata

SEQ ID NO: 223313 - DNA, 27 bp, Artificial sequence
  SiRNA target sequence
attcttggtctagttcttcttccatat

SEQ ID NO: 223314 - DNA, 27 bp, Artificial sequence
  SiRNA target sequence
ttcttggtctagttcttcttccatatt

SEQ ID NO: 223315 - DNA, 27 bp, Artificial sequence
  SiRNA target sequence
tcttggtctagttcttcttccatattc

SEQ ID NO: 223316 - DNA, 27 bp, Artificial sequence
  SiRNA target sequence
cttggtctagttcttcttccatattct

SEQ ID NO: 223317 - DNA, 27 bp, Artificial sequence
  SiRNA target sequence
ttggtctagttcttcttccatattctc

SEQ ID NO: 223318 - DNA, 27 bp, Artificial sequence
  SiRNA target sequence
tggtctagttcttcttccatattctca

SEQ ID NO: 223319 - DNA, 27 bp, Artificial sequence
  SiRNA target sequence
ggtctagttcttcttccatattctcat

SEQ ID NO: 223320 - DNA, 27 bp, Artificial sequence
  SiRNA target sequence
gtctagttcttcttccatattctcatc

SEQ ID NO: 223321 - DNA, 27 bp, Artificial sequence
  SiRNA target sequence
tctagttcttcttccatattctcatct

SEQ ID NO: 223322 - DNA, 27 bp, Artificial sequence
  SiRNA target sequence
ctagttcttcttccatattctcatctt

SEQ ID NO: 223323 - DNA, 27 bp, Artificial sequence
  SiRNA target sequence
tagttcttcttccatattctcatcttt

SEQ ID NO: 223324 - DNA, 27 bp, Artificial sequence
  SiRNA target sequence
agttcttcttccatattctcatctttt

SEQ ID NO: 223325 - DNA, 27 bp, Artificial sequence
  SiRNA target sequence
gttcttcttccatattctcatcttttc

SEQ ID NO: 223326 - DNA, 27 bp, Artificial sequence
  SiRNA target sequence
ttcttcttccatattctcatcttttcc

SEQ ID NO: 223327 - DNA, 27 bp, Artificial sequence
  SiRNA target sequence
tcttcttccatattctcatcttttcca

SEQ ID NO: 223328 - DNA, 27 bp, Artificial sequence
  SiRNA target sequence
cttcttccatattctcatcttttccag

SEQ ID NO: 223329 - DNA, 27 bp, Artificial sequence
  SiRNA target sequence
ttcttccatattctcatcttttccagc

SEQ ID NO: 223330 - DNA, 27 bp, Artificial sequence
  SiRNA target sequence
tcttccatattctcatcttttccagct

SEQ ID NO: 223331 - DNA, 27 bp, Artificial sequence
  SiRNA target sequence
cttccatattctcatcttttccagctt

SEQ ID NO: 223332 - DNA, 27 bp, Artificial sequence
  SiRNA target sequence
ttccatattctcatcttttccagcttg

SEQ ID NO: 223333 - DNA, 27 bp, Artificial sequence
  SiRNA target sequence
tccatattctcatcttttccagcttga

SEQ ID NO: 223334 - DNA, 27 bp, Artificial sequence
  SiRNA target sequence
ccatattctcatcttttccagcttgat

SEQ ID NO: 223335 - DNA, 27 bp, Artificial sequence
  SiRNA target sequence
catattctcatcttttccagcttgata

SEQ ID NO: 223336 - DNA, 27 bp, Artificial sequence
  SiRNA target sequence
atattctcatcttttccagcttgatag

SEQ ID NO: 223337 - DNA, 27 bp, Artificial sequence
  SiRNA target sequence
tattctcatcttttccagcttgatagt

SEQ ID NO: 223338 - DNA, 27 bp, Artificial sequence
  SiRNA target sequence
attctcatcttttccagcttgatagtt

SEQ ID NO: 223339 - DNA, 27 bp, Artificial sequence
  SiRNA target sequence
ttctcatcttttccagcttgatagtta

SEQ ID NO: 223340 - DNA, 27 bp, Artificial sequence
  SiRNA target sequence
tctcatcttttccagcttgatagttat

SEQ ID NO: 223341 - DNA, 27 bp, Artificial sequence
  SiRNA target sequence
ctcatcttttccagcttgatagttatt

SEQ ID NO: 223342 - DNA, 27 bp, Artificial sequence
  SiRNA target sequence
tcatcttttccagcttgatagttattt

SEQ ID NO: 223343 - DNA, 27 bp, Artificial sequence
  SiRNA target sequence
catcttttccagcttgatagttatttt

SEQ ID NO: 223344 - DNA, 27 bp, Artificial sequence
  SiRNA target sequence
atcttttccagcttgatagttattttt

SEQ ID NO: 223345 - DNA, 27 bp, Artificial sequence
  SiRNA target sequence
tcttttccagcttgatagttatttttt

SEQ ID NO: 223346 - DNA, 27 bp, Artificial sequence
  SiRNA target sequence
cttttccagcttgatagttattttttt

SEQ ID NO: 223347 - DNA, 27 bp, Artificial sequence
  SiRNA target sequence
ttttccagcttgatagttattttttta

SEQ ID NO: 223348 - DNA, 27 bp, Artificial sequence
  SiRNA target sequence
tttccagcttgatagttatttttttag

SEQ ID NO: 223349 - DNA, 27 bp, Artificial sequence
  SiRNA target sequence
ttccagcttgatagttatttttttaga

SEQ ID NO: 223350 - DNA, 27 bp, Artificial sequence
  SiRNA target sequence
tccagcttgatagttatttttttagag

SEQ ID NO: 223351 - DNA, 27 bp, Artificial sequence
  SiRNA target sequence
ccagcttgatagttatttttttagaga

SEQ ID NO: 223352 - DNA, 27 bp, Artificial sequence
  SiRNA target sequence
cagcttgatagttatttttttagagac

SEQ ID NO: 223353 - DNA, 27 bp, Artificial sequence
  SiRNA target sequence
agcttgatagttatttttttagagacc

SEQ ID NO: 223354 - DNA, 27 bp, Artificial sequence
  SiRNA target sequence
gcttgatagttatttttttagagacct

SEQ ID NO: 223355 - DNA, 27 bp, Artificial sequence
  SiRNA target sequence
cttgatagttatttttttagagacctt

SEQ ID NO: 223356 - DNA, 27 bp, Artificial sequence
  SiRNA target sequence
ttgatagttatttttttagagaccttt

SEQ ID NO: 223357 - DNA, 27 bp, Artificial sequence
  SiRNA target sequence
tgatagttatttttttagagacctttt

SEQ ID NO: 223358 - DNA, 27 bp, Artificial sequence
  SiRNA target sequence
gatagttatttttttagagaccttttt

SEQ ID NO: 223359 - DNA, 27 bp, Artificial sequence
  SiRNA target sequence
atagttatttttttagagaccttttta

SEQ ID NO: 223360 - DNA, 27 bp, Artificial sequence
  SiRNA target sequence
tagttatttttttagagacctttttag

SEQ ID NO: 223361 - DNA, 27 bp, Artificial sequence
  SiRNA target sequence
agttatttttttagagacctttttagt

SEQ ID NO: 223362 - DNA, 27 bp, Artificial sequence
  SiRNA target sequence
gttatttttttagagacctttttagtg

SEQ ID NO: 223363 - DNA, 27 bp, Artificial sequence
  SiRNA target sequence
ttatttttttagagacctttttagtga

SEQ ID NO: 223364 - DNA, 27 bp, Artificial sequence
  SiRNA target sequence
tatttttttagagacctttttagtgat

SEQ ID NO: 223365 - DNA, 27 bp, Artificial sequence
  SiRNA target sequence
atttttttagagacctttttagtgatg

SEQ ID NO: 223366 - DNA, 27 bp, Artificial sequence
  SiRNA target sequence
tttttttagagacctttttagtgatgg

SEQ ID NO: 223367 - DNA, 27 bp, Artificial sequence
  SiRNA target sequence
ttttttagagacctttttagtgatggg

SEQ ID NO: 223368 - DNA, 27 bp, Artificial sequence
  SiRNA target sequence
tttttagagacctttttagtgatggga

SEQ ID NO: 223369 - DNA, 27 bp, Artificial sequence
  SiRNA target sequence
ttttagagacctttttagtgatgggaa

SEQ ID NO: 223370 - DNA, 27 bp, Artificial sequence
  SiRNA target sequence
tttagagacctttttagtgatgggaaa

SEQ ID NO: 223371 - DNA, 27 bp, Artificial sequence
  SiRNA target sequence
ttagagacctttttagtgatgggaaat

SEQ ID NO: 223372 - DNA, 27 bp, Artificial sequence
  SiRNA target sequence
tagagacctttttagtgatgggaaatg

SEQ ID NO: 223373 - DNA, 27 bp, Artificial sequence
  SiRNA target sequence
agagacctttttagtgatgggaaatgt

SEQ ID NO: 223374 - DNA, 27 bp, Artificial sequence
  SiRNA target sequence
gagacctttttagtgatgggaaatgtg

SEQ ID NO: 223375 - DNA, 27 bp, Artificial sequence
  SiRNA target sequence
agacctttttagtgatgggaaatgtgt

SEQ ID NO: 223376 - DNA, 27 bp, Artificial sequence
  SiRNA target sequence
gacctttttagtgatgggaaatgtgtt

SEQ ID NO: 223377 - DNA, 27 bp, Artificial sequence
  SiRNA target sequence
acctttttagtgatgggaaatgtgttg

SEQ ID NO: 223378 - DNA, 27 bp, Artificial sequence
  SiRNA target sequence
cctttttagtgatgggaaatgtgttgt

SEQ ID NO: 223379 - DNA, 27 bp, Artificial sequence
  SiRNA target sequence
ctttttagtgatgggaaatgtgttgta

SEQ ID NO: 223380 - DNA, 27 bp, Artificial sequence
  SiRNA target sequence
tttttagtgatgggaaatgtgttgtaa

SEQ ID NO: 223381 - DNA, 27 bp, Artificial sequence
  SiRNA target sequence
ttttagtgatgggaaatgtgttgtaag

SEQ ID NO: 223382 - DNA, 27 bp, Artificial sequence
  SiRNA target sequence
tttagtgatgggaaatgtgttgtaaga

SEQ ID NO: 223383 - DNA, 27 bp, Artificial sequence
  SiRNA target sequence
ttagtgatgggaaatgtgttgtaagag

SEQ ID NO: 223384 - DNA, 27 bp, Artificial sequence
  SiRNA target sequence
tagtgatgggaaatgtgttgtaagagg

SEQ ID NO: 223385 - DNA, 27 bp, Artificial sequence
  SiRNA target sequence
agtgatgggaaatgtgttgtaagaggc

SEQ ID NO: 223386 - DNA, 27 bp, Artificial sequence
  SiRNA target sequence
gtgatgggaaatgtgttgtaagaggct

SEQ ID NO: 223387 - DNA, 27 bp, Artificial sequence
  SiRNA target sequence
tgatgggaaatgtgttgtaagaggcta

SEQ ID NO: 223388 - DNA, 27 bp, Artificial sequence
  SiRNA target sequence
gatgggaaatgtgttgtaagaggctat

SEQ ID NO: 223389 - DNA, 27 bp, Artificial sequence
  SiRNA target sequence
atgggaaatgtgttgtaagaggctatg

SEQ ID NO: 223390 - DNA, 27 bp, Artificial sequence
  SiRNA target sequence
tgggaaatgtgttgtaagaggctatga

SEQ ID NO: 223391 - DNA, 27 bp, Artificial sequence
  SiRNA target sequence
gggaaatgtgttgtaagaggctatgat

SEQ ID NO: 223392 - DNA, 27 bp, Artificial sequence
  SiRNA target sequence
ggaaatgtgttgtaagaggctatgatg

SEQ ID NO: 223393 - DNA, 27 bp, Artificial sequence
  SiRNA target sequence
gaaatgtgttgtaagaggctatgatgc

SEQ ID NO: 223394 - DNA, 27 bp, Artificial sequence
  SiRNA target sequence
aaatgtgttgtaagaggctatgatgct

SEQ ID NO: 223395 - DNA, 27 bp, Artificial sequence
  SiRNA target sequence
aatgtgttgtaagaggctatgatgctt

SEQ ID NO: 223396 - DNA, 27 bp, Artificial sequence
  SiRNA target sequence
atgtgttgtaagaggctatgatgcttt

SEQ ID NO: 223397 - DNA, 27 bp, Artificial sequence
  SiRNA target sequence
tgtgttgtaagaggctatgatgcttta

SEQ ID NO: 223398 - DNA, 27 bp, Artificial sequence
  SiRNA target sequence
gtgttgtaagaggctatgatgctttat

SEQ ID NO: 223399 - DNA, 27 bp, Artificial sequence
  SiRNA target sequence
tgttgtaagaggctatgatgctttatt

SEQ ID NO: 223400 - DNA, 27 bp, Artificial sequence
  SiRNA target sequence
gttgtaagaggctatgatgctttatta

SEQ ID NO: 223401 - DNA, 27 bp, Artificial sequence
  SiRNA target sequence
ttgtaagaggctatgatgctttattat

SEQ ID NO: 223402 - DNA, 27 bp, Artificial sequence
  SiRNA target sequence
tgtaagaggctatgatgctttattatc

SEQ ID NO: 223403 - DNA, 27 bp, Artificial sequence
  SiRNA target sequence
gtaagaggctatgatgctttattatct

SEQ ID NO: 223404 - DNA, 27 bp, Artificial sequence
  SiRNA target sequence
taagaggctatgatgctttattatctt

SEQ ID NO: 223405 - DNA, 27 bp, Artificial sequence
  SiRNA target sequence
aagaggctatgatgctttattatcttt

SEQ ID NO: 223406 - DNA, 27 bp, Artificial sequence
  SiRNA target sequence
agaggctatgatgctttattatctttg

SEQ ID NO: 223407 - DNA, 27 bp, Artificial sequence
  SiRNA target sequence
gaggctatgatgctttattatctttgg

SEQ ID NO: 223408 - DNA, 27 bp, Artificial sequence
  SiRNA target sequence
aggctatgatgctttattatctttggc

SEQ ID NO: 223409 - DNA, 27 bp, Artificial sequence
  SiRNA target sequence
ggctatgatgctttattatctttggca

SEQ ID NO: 223410 - DNA, 27 bp, Artificial sequence
  SiRNA target sequence
gctatgatgctttattatctttggcac

SEQ ID NO: 223411 - DNA, 27 bp, Artificial sequence
  SiRNA target sequence
ctatgatgctttattatctttggcact

SEQ ID NO: 223412 - DNA, 27 bp, Artificial sequence
  SiRNA target sequence
tatgatgctttattatctttggcactg

SEQ ID NO: 223413 - DNA, 27 bp, Artificial sequence
  SiRNA target sequence
atgatgctttattatctttggcactgg

SEQ ID NO: 223414 - DNA, 27 bp, Artificial sequence
  SiRNA target sequence
tgatgctttattatctttggcactggt

SEQ ID NO: 223415 - DNA, 27 bp, Artificial sequence
  SiRNA target sequence
gatgctttattatctttggcactggtc

SEQ ID NO: 223416 - DNA, 27 bp, Artificial sequence
  SiRNA target sequence
atgctttattatctttggcactggtct

SEQ ID NO: 223417 - DNA, 27 bp, Artificial sequence
  SiRNA target sequence
tgctttattatctttggcactggtctt

SEQ ID NO: 223418 - DNA, 27 bp, Artificial sequence
  SiRNA target sequence
gctttattatctttggcactggtcttt

SEQ ID NO: 223419 - DNA, 27 bp, Artificial sequence
  SiRNA target sequence
ctttattatctttggcactggtcttta

SEQ ID NO: 223420 - DNA, 27 bp, Artificial sequence
  SiRNA target sequence
tttattatctttggcactggtctttaa

SEQ ID NO: 223421 - DNA, 27 bp, Artificial sequence
  SiRNA target sequence
ttattatctttggcactggtctttaac

SEQ ID NO: 223422 - DNA, 27 bp, Artificial sequence
  SiRNA target sequence
tattatctttggcactggtctttaacg

SEQ ID NO: 223423 - DNA, 27 bp, Artificial sequence
  SiRNA target sequence
attatctttggcactggtctttaacga

SEQ ID NO: 223424 - DNA, 27 bp, Artificial sequence
  SiRNA target sequence
ttatctttggcactggtctttaacgaa

SEQ ID NO: 223425 - DNA, 27 bp, Artificial sequence
  SiRNA target sequence
tatctttggcactggtctttaacgaat

SEQ ID NO: 223426 - DNA, 27 bp, Artificial sequence
  SiRNA target sequence
atctttggcactggtctttaacgaatg

SEQ ID NO: 223427 - DNA, 27 bp, Artificial sequence
  SiRNA target sequence
tctttggcactggtctttaacgaatgg

SEQ ID NO: 223428 - DNA, 27 bp, Artificial sequence
  SiRNA target sequence
ctttggcactggtctttaacgaatgga

SEQ ID NO: 223429 - DNA, 27 bp, Artificial sequence
  SiRNA target sequence
tttggcactggtctttaacgaatggac

SEQ ID NO: 223430 - DNA, 27 bp, Artificial sequence
  SiRNA target sequence
ttggcactggtctttaacgaatggaca

SEQ ID NO: 223431 - DNA, 27 bp, Artificial sequence
  SiRNA target sequence
tggcactggtctttaacgaatggacat

SEQ ID NO: 223432 - DNA, 27 bp, Artificial sequence
  SiRNA target sequence
ggcactggtctttaacgaatggacatc

SEQ ID NO: 223433 - DNA, 27 bp, Artificial sequence
  SiRNA target sequence
gcactggtctttaacgaatggacatcc

SEQ ID NO: 223434 - DNA, 27 bp, Artificial sequence
  SiRNA target sequence
cactggtctttaacgaatggacatcct

SEQ ID NO: 223435 - DNA, 27 bp, Artificial sequence
  SiRNA target sequence
actggtctttaacgaatggacatcctc

SEQ ID NO: 223436 - DNA, 27 bp, Artificial sequence
  SiRNA target sequence
ctggtctttaacgaatggacatcctct

SEQ ID NO: 223437 - DNA, 27 bp, Artificial sequence
  SiRNA target sequence
tggtctttaacgaatggacatcctctc

SEQ ID NO: 223438 - DNA, 27 bp, Artificial sequence
  SiRNA target sequence
ggtctttaacgaatggacatcctctct

SEQ ID NO: 223439 - DNA, 27 bp, Artificial sequence
  SiRNA target sequence
gtctttaacgaatggacatcctctcta

SEQ ID NO: 223440 - DNA, 27 bp, Artificial sequence
  SiRNA target sequence
tctttaacgaatggacatcctctctag

SEQ ID NO: 223441 - DNA, 27 bp, Artificial sequence
  SiRNA target sequence
ctttaacgaatggacatcctctctagt

SEQ ID NO: 223442 - DNA, 27 bp, Artificial sequence
  SiRNA target sequence
tttaacgaatggacatcctctctagtt

SEQ ID NO: 223443 - DNA, 27 bp, Artificial sequence
  SiRNA target sequence
ttaacgaatggacatcctctctagttt

SEQ ID NO: 223444 - DNA, 27 bp, Artificial sequence
  SiRNA target sequence
taacgaatggacatcctctctagttta

SEQ ID NO: 223445 - DNA, 27 bp, Artificial sequence
  SiRNA target sequence
aacgaatggacatcctctctagtttac

SEQ ID NO: 223446 - DNA, 27 bp, Artificial sequence
  SiRNA target sequence
acgaatggacatcctctctagtttaca

SEQ ID NO: 223447 - DNA, 27 bp, Artificial sequence
  SiRNA target sequence
cgaatggacatcctctctagtttacat

SEQ ID NO: 223448 - DNA, 27 bp, Artificial sequence
  SiRNA target sequence
gaatggacatcctctctagtttacatt

SEQ ID NO: 223449 - DNA, 27 bp, Artificial sequence
  SiRNA target sequence
aatggacatcctctctagtttacattg

SEQ ID NO: 223450 - DNA, 27 bp, Artificial sequence
  SiRNA target sequence
atggacatcctctctagtttacattgt

SEQ ID NO: 223451 - DNA, 27 bp, Artificial sequence
  SiRNA target sequence
tggacatcctctctagtttacattgtt

SEQ ID NO: 223452 - DNA, 27 bp, Artificial sequence
  SiRNA target sequence
ggacatcctctctagtttacattgttt

SEQ ID NO: 223453 - DNA, 27 bp, Artificial sequence
  SiRNA target sequence
gacatcctctctagtttacattgtttc

SEQ ID NO: 223454 - DNA, 27 bp, Artificial sequence
  SiRNA target sequence
acatcctctctagtttacattgtttca

SEQ ID NO: 223455 - DNA, 27 bp, Artificial sequence
  SiRNA target sequence
catcctctctagtttacattgtttcag

SEQ ID NO: 223456 - DNA, 27 bp, Artificial sequence
  SiRNA target sequence
atcctctctagtttacattgtttcaga

SEQ ID NO: 223457 - DNA, 27 bp, Artificial sequence
  SiRNA target sequence
tcctctctagtttacattgtttcagaa

SEQ ID NO: 223458 - DNA, 27 bp, Artificial sequence
  SiRNA target sequence
cctctctagtttacattgtttcagaaa

SEQ ID NO: 223459 - DNA, 27 bp, Artificial sequence
  SiRNA target sequence
ctctctagtttacattgtttcagaaat

SEQ ID NO: 223460 - DNA, 27 bp, Artificial sequence
  SiRNA target sequence
tctctagtttacattgtttcagaaatg

SEQ ID NO: 223461 - DNA, 27 bp, Artificial sequence
  SiRNA target sequence
ctctagtttacattgtttcagaaatgt

SEQ ID NO: 223462 - DNA, 27 bp, Artificial sequence
  SiRNA target sequence
tctagtttacattgtttcagaaatgtt

SEQ ID NO: 223463 - DNA, 27 bp, Artificial sequence
  SiRNA target sequence
ctagtttacattgtttcagaaatgttt

SEQ ID NO: 223464 - DNA, 27 bp, Artificial sequence
  SiRNA target sequence
tagtttacattgtttcagaaatgtttg

SEQ ID NO: 223465 - DNA, 27 bp, Artificial sequence
  SiRNA target sequence
agtttacattgtttcagaaatgtttgg

SEQ ID NO: 223466 - DNA, 27 bp, Artificial sequence
  SiRNA target sequence
gtttacattgtttcagaaatgtttggt

SEQ ID NO: 223467 - DNA, 27 bp, Artificial sequence
  SiRNA target sequence
tttacattgtttcagaaatgtttggta

SEQ ID NO: 223468 - DNA, 27 bp, Artificial sequence
  SiRNA target sequence
ttacattgtttcagaaatgtttggtaa

SEQ ID NO: 223469 - DNA, 27 bp, Artificial sequence
  SiRNA target sequence
tacattgtttcagaaatgtttggtaat

SEQ ID NO: 223470 - DNA, 27 bp, Artificial sequence
  SiRNA target sequence
acattgtttcagaaatgtttggtaatt

SEQ ID NO: 223471 - DNA, 27 bp, Artificial sequence
  SiRNA target sequence
cattgtttcagaaatgtttggtaattt

SEQ ID NO: 223472 - DNA, 27 bp, Artificial sequence
  SiRNA target sequence
attgtttcagaaatgtttggtaattta

SEQ ID NO: 223473 - DNA, 27 bp, Artificial sequence
  SiRNA target sequence
ttgtttcagaaatgtttggtaatttag

SEQ ID NO: 223474 - DNA, 27 bp, Artificial sequence
  SiRNA target sequence
tgtttcagaaatgtttggtaatttagt

SEQ ID NO: 223475 - DNA, 27 bp, Artificial sequence
  SiRNA target sequence
gtttcagaaatgtttggtaatttagta

SEQ ID NO: 223476 - DNA, 27 bp, Artificial sequence
  SiRNA target sequence
tttcagaaatgtttggtaatttagtat

SEQ ID NO: 223477 - DNA, 27 bp, Artificial sequence
  SiRNA target sequence
ttcagaaatgtttggtaatttagtatt

SEQ ID NO: 223478 - DNA, 27 bp, Artificial sequence
  SiRNA target sequence
tcagaaatgtttggtaatttagtattg

SEQ ID NO: 223479 - DNA, 27 bp, Artificial sequence
  SiRNA target sequence
cagaaatgtttggtaatttagtattgt

SEQ ID NO: 223480 - DNA, 27 bp, Artificial sequence
  SiRNA target sequence
agaaatgtttggtaatttagtattgtc

SEQ ID NO: 223481 - DNA, 27 bp, Artificial sequence
  SiRNA target sequence
gaaatgtttggtaatttagtattgtct

SEQ ID NO: 223482 - DNA, 27 bp, Artificial sequence
  SiRNA target sequence
aaatgtttggtaatttagtattgtctt

SEQ ID NO: 223483 - DNA, 27 bp, Artificial sequence
  SiRNA target sequence
aatgtttggtaatttagtattgtctta

SEQ ID NO: 223484 - DNA, 27 bp, Artificial sequence
  SiRNA target sequence
atgtttggtaatttagtattgtcttat

SEQ ID NO: 223485 - DNA, 27 bp, Artificial sequence
  SiRNA target sequence
tgtttggtaatttagtattgtcttatt

SEQ ID NO: 223486 - DNA, 27 bp, Artificial sequence
  SiRNA target sequence
gtttggtaatttagtattgtcttattt

SEQ ID NO: 223487 - DNA, 27 bp, Artificial sequence
  SiRNA target sequence
tttggtaatttagtattgtcttatttc

SEQ ID NO: 223488 - DNA, 27 bp, Artificial sequence
  SiRNA target sequence
ttggtaatttagtattgtcttatttct

SEQ ID NO: 223489 - DNA, 27 bp, Artificial sequence
  SiRNA target sequence
tggtaatttagtattgtcttatttctt

SEQ ID NO: 223490 - DNA, 27 bp, Artificial sequence
  SiRNA target sequence
ggtaatttagtattgtcttatttcttc

SEQ ID NO: 223491 - DNA, 27 bp, Artificial sequence
  SiRNA target sequence
gtaatttagtattgtcttatttcttct

SEQ ID NO: 223492 - DNA, 27 bp, Artificial sequence
  SiRNA target sequence
taatttagtattgtcttatttcttctt

SEQ ID NO: 223493 - DNA, 27 bp, Artificial sequence
  SiRNA target sequence
aatttagtattgtcttatttcttcttg

SEQ ID NO: 223494 - DNA, 27 bp, Artificial sequence
  SiRNA target sequence
atttagtattgtcttatttcttcttga

SEQ ID NO: 223495 - DNA, 27 bp, Artificial sequence
  SiRNA target sequence
tttagtattgtcttatttcttcttgac

SEQ ID NO: 223496 - DNA, 27 bp, Artificial sequence
  SiRNA target sequence
ttagtattgtcttatttcttcttgacg

SEQ ID NO: 223497 - DNA, 27 bp, Artificial sequence
  SiRNA target sequence
tagtattgtcttatttcttcttgacgt

SEQ ID NO: 223498 - DNA, 27 bp, Artificial sequence
  SiRNA target sequence
agtattgtcttatttcttcttgacgtt

SEQ ID NO: 223499 - DNA, 27 bp, Artificial sequence
  SiRNA target sequence
gtattgtcttatttcttcttgacgttt

SEQ ID NO: 223500 - DNA, 27 bp, Artificial sequence
  SiRNA target sequence
tattgtcttatttcttcttgacgtttg

SEQ ID NO: 223501 - DNA, 27 bp, Artificial sequence
  SiRNA target sequence
attgtcttatttcttcttgacgtttgc

SEQ ID NO: 223502 - DNA, 27 bp, Artificial sequence
  SiRNA target sequence
ttgtcttatttcttcttgacgtttgct

SEQ ID NO: 223503 - DNA, 27 bp, Artificial sequence
  SiRNA target sequence
tgtcttatttcttcttgacgtttgcta

SEQ ID NO: 223504 - DNA, 27 bp, Artificial sequence
  SiRNA target sequence
gtcttatttcttcttgacgtttgctaa

SEQ ID NO: 223505 - DNA, 27 bp, Artificial sequence
  SiRNA target sequence
tcttatttcttcttgacgtttgctaat

SEQ ID NO: 223506 - DNA, 27 bp, Artificial sequence
  SiRNA target sequence
cttatttcttcttgacgtttgctaatt

SEQ ID NO: 223507 - DNA, 27 bp, Artificial sequence
  SiRNA target sequence
ttatttcttcttgacgtttgctaattc

SEQ ID NO: 223508 - DNA, 27 bp, Artificial sequence
  SiRNA target sequence
tatttcttcttgacgtttgctaattct

SEQ ID NO: 223509 - DNA, 27 bp, Artificial sequence
  SiRNA target sequence
atttcttcttgacgtttgctaattctt

SEQ ID NO: 223510 - DNA, 27 bp, Artificial sequence
  SiRNA target sequence
tttcttcttgacgtttgctaattcttt

SEQ ID NO: 223511 - DNA, 27 bp, Artificial sequence
  SiRNA target sequence
ttcttcttgacgtttgctaattcttta

SEQ ID NO: 223512 - DNA, 27 bp, Artificial sequence
  SiRNA target sequence
tcttcttgacgtttgctaattctttaa

SEQ ID NO: 223513 - DNA, 27 bp, Artificial sequence
  SiRNA target sequence
cttcttgacgtttgctaattctttaac

SEQ ID NO: 223514 - DNA, 27 bp, Artificial sequence
  SiRNA target sequence
ttcttgacgtttgctaattctttaaca

SEQ ID NO: 223515 - DNA, 27 bp, Artificial sequence
  SiRNA target sequence
tcttgacgtttgctaattctttaacaa

SEQ ID NO: 223516 - DNA, 27 bp, Artificial sequence
  SiRNA target sequence
cttgacgtttgctaattctttaacaac

SEQ ID NO: 223517 - DNA, 27 bp, Artificial sequence
  SiRNA target sequence
ttgacgtttgctaattctttaacaact

SEQ ID NO: 223518 - DNA, 27 bp, Artificial sequence
  SiRNA target sequence
tgacgtttgctaattctttaacaactc

SEQ ID NO: 223519 - DNA, 27 bp, Artificial sequence
  SiRNA target sequence
gacgtttgctaattctttaacaactcc

SEQ ID NO: 223520 - DNA, 27 bp, Artificial sequence
  SiRNA target sequence
acgtttgctaattctttaacaactcca

SEQ ID NO: 223521 - DNA, 27 bp, Artificial sequence
  SiRNA target sequence
cgtttgctaattctttaacaactccag

SEQ ID NO: 223522 - DNA, 27 bp, Artificial sequence
  SiRNA target sequence
gtttgctaattctttaacaactccagg

SEQ ID NO: 223523 - DNA, 27 bp, Artificial sequence
  SiRNA target sequence
tttgctaattctttaacaactccagga

SEQ ID NO: 223524 - DNA, 27 bp, Artificial sequence
  SiRNA target sequence
ttgctaattctttaacaactccaggac

SEQ ID NO: 223525 - DNA, 27 bp, Artificial sequence
  SiRNA target sequence
tgctaattctttaacaactccaggaca

SEQ ID NO: 223526 - DNA, 27 bp, Artificial sequence
  SiRNA target sequence
gctaattctttaacaactccaggacaa

SEQ ID NO: 223527 - DNA, 27 bp, Artificial sequence
  SiRNA target sequence
ctaattctttaacaactccaggacaaa

SEQ ID NO: 223528 - DNA, 27 bp, Artificial sequence
  SiRNA target sequence
taattctttaacaactccaggacaaag

SEQ ID NO: 223529 - DNA, 27 bp, Artificial sequence
  SiRNA target sequence
aattctttaacaactccaggacaaagt

SEQ ID NO: 223530 - DNA, 27 bp, Artificial sequence
  SiRNA target sequence
attctttaacaactccaggacaaagtg

SEQ ID NO: 223531 - DNA, 27 bp, Artificial sequence
  SiRNA target sequence
ttctttaacaactccaggacaaagtgc

SEQ ID NO: 223532 - DNA, 27 bp, Artificial sequence
  SiRNA target sequence
tctttaacaactccaggacaaagtgca

SEQ ID NO: 223533 - DNA, 27 bp, Artificial sequence
  SiRNA target sequence
ctttaacaactccaggacaaagtgcaa

SEQ ID NO: 223534 - DNA, 27 bp, Artificial sequence
  SiRNA target sequence
tttaacaactccaggacaaagtgcaag

SEQ ID NO: 223535 - DNA, 27 bp, Artificial sequence
  SiRNA target sequence
ttaacaactccaggacaaagtgcaaga

SEQ ID NO: 223536 - DNA, 27 bp, Artificial sequence
  SiRNA target sequence
taacaactccaggacaaagtgcaagat

SEQ ID NO: 223537 - DNA, 27 bp, Artificial sequence
  SiRNA target sequence
aacaactccaggacaaagtgcaagatt

SEQ ID NO: 223538 - DNA, 27 bp, Artificial sequence
  SiRNA target sequence
acaactccaggacaaagtgcaagattc

SEQ ID NO: 223539 - DNA, 27 bp, Artificial sequence
  SiRNA target sequence
caactccaggacaaagtgcaagattca

SEQ ID NO: 223540 - DNA, 27 bp, Artificial sequence
  SiRNA target sequence
aactccaggacaaagtgcaagattcat

SEQ ID NO: 223541 - DNA, 27 bp, Artificial sequence
  SiRNA target sequence
actccaggacaaagtgcaagattcata

SEQ ID NO: 223542 - DNA, 27 bp, Artificial sequence
  SiRNA target sequence
ctccaggacaaagtgcaagattcatac

SEQ ID NO: 223543 - DNA, 27 bp, Artificial sequence
  SiRNA target sequence
tccaggacaaagtgcaagattcatacc

SEQ ID NO: 223544 - DNA, 27 bp, Artificial sequence
  SiRNA target sequence
ccaggacaaagtgcaagattcatacct

SEQ ID NO: 223545 - DNA, 27 bp, Artificial sequence
  SiRNA target sequence
caggacaaagtgcaagattcatacctt

SEQ ID NO: 223546 - DNA, 27 bp, Artificial sequence
  SiRNA target sequence
aggacaaagtgcaagattcataccttt

SEQ ID NO: 223547 - DNA, 27 bp, Artificial sequence
  SiRNA target sequence
ggacaaagtgcaagattcataccttta

SEQ ID NO: 223548 - DNA, 27 bp, Artificial sequence
  SiRNA target sequence
gacaaagtgcaagattcatacctttat

SEQ ID NO: 223549 - DNA, 27 bp, Artificial sequence
  SiRNA target sequence
acaaagtgcaagattcatacctttatt

SEQ ID NO: 223550 - DNA, 27 bp, Artificial sequence
  SiRNA target sequence
caaagtgcaagattcatacctttattt

SEQ ID NO: 223551 - DNA, 27 bp, Artificial sequence
  SiRNA target sequence
aaagtgcaagattcatacctttatttt

SEQ ID NO: 223552 - DNA, 27 bp, Artificial sequence
  SiRNA target sequence
aagtgcaagattcatacctttatttta

SEQ ID NO: 223553 - DNA, 27 bp, Artificial sequence
  SiRNA target sequence
agtgcaagattcatacctttattttat

SEQ ID NO: 223554 - DNA, 27 bp, Artificial sequence
  SiRNA target sequence
gtgcaagattcatacctttattttatg

SEQ ID NO: 223555 - DNA, 27 bp, Artificial sequence
  SiRNA target sequence
tgcaagattcatacctttattttatgt

SEQ ID NO: 223556 - DNA, 27 bp, Artificial sequence
  SiRNA target sequence
gcaagattcatacctttattttatgtt

SEQ ID NO: 223557 - DNA, 27 bp, Artificial sequence
  SiRNA target sequence
caagattcatacctttattttatgttt

SEQ ID NO: 223558 - DNA, 27 bp, Artificial sequence
  SiRNA target sequence
aagattcatacctttattttatgtttt

SEQ ID NO: 223559 - DNA, 27 bp, Artificial sequence
  SiRNA target sequence
agattcatacctttattttatgttttc

SEQ ID NO: 223560 - DNA, 27 bp, Artificial sequence
  SiRNA target sequence
gattcatacctttattttatgttttct

SEQ ID NO: 223561 - DNA, 27 bp, Artificial sequence
  SiRNA target sequence
attcatacctttattttatgttttctc

SEQ ID NO: 223562 - DNA, 27 bp, Artificial sequence
  SiRNA target sequence
ttcatacctttattttatgttttctcg

SEQ ID NO: 223563 - DNA, 27 bp, Artificial sequence
  SiRNA target sequence
tcatacctttattttatgttttctcga

SEQ ID NO: 223564 - DNA, 27 bp, Artificial sequence
  SiRNA target sequence
catacctttattttatgttttctcgaa

SEQ ID NO: 223565 - DNA, 27 bp, Artificial sequence
  SiRNA target sequence
atacctttattttatgttttctcgaat

SEQ ID NO: 223566 - DNA, 27 bp, Artificial sequence
  SiRNA target sequence
tacctttattttatgttttctcgaata

SEQ ID NO: 223567 - DNA, 27 bp, Artificial sequence
  SiRNA target sequence
acctttattttatgttttctcgaatat

SEQ ID NO: 223568 - DNA, 27 bp, Artificial sequence
  SiRNA target sequence
cctttattttatgttttctcgaatatt

SEQ ID NO: 223569 - DNA, 27 bp, Artificial sequence
  SiRNA target sequence
ctttattttatgttttctcgaatattt

SEQ ID NO: 223570 - DNA, 27 bp, Artificial sequence
  SiRNA target sequence
tttattttatgttttctcgaatatttc

SEQ ID NO: 223571 - DNA, 27 bp, Artificial sequence
  SiRNA target sequence
ttattttatgttttctcgaatatttct

SEQ ID NO: 223572 - DNA, 27 bp, Artificial sequence
  SiRNA target sequence
tattttatgttttctcgaatatttctc

SEQ ID NO: 223573 - DNA, 27 bp, Artificial sequence
  SiRNA target sequence
attttatgttttctcgaatatttctct

SEQ ID NO: 223574 - DNA, 27 bp, Artificial sequence
  SiRNA target sequence
ttttatgttttctcgaatatttctctt

SEQ ID NO: 223575 - DNA, 27 bp, Artificial sequence
  SiRNA target sequence
tttatgttttctcgaatatttctcttt

SEQ ID NO: 223576 - DNA, 27 bp, Artificial sequence
  SiRNA target sequence
ttatgttttctcgaatatttctctttt

SEQ ID NO: 223577 - DNA, 27 bp, Artificial sequence
  SiRNA target sequence
tatgttttctcgaatatttctcttttc

SEQ ID NO: 223578 - DNA, 27 bp, Artificial sequence
  SiRNA target sequence
atgttttctcgaatatttctcttttct

SEQ ID NO: 223579 - DNA, 27 bp, Artificial sequence
  SiRNA target sequence
tgttttctcgaatatttctcttttctt

SEQ ID NO: 223580 - DNA, 27 bp, Artificial sequence
  SiRNA target sequence
gttttctcgaatatttctcttttctta

SEQ ID NO: 223581 - DNA, 27 bp, Artificial sequence
  SiRNA target sequence
ttttctcgaatatttctcttttcttat

SEQ ID NO: 223582 - DNA, 27 bp, Artificial sequence
  SiRNA target sequence
tttctcgaatatttctcttttcttatc

SEQ ID NO: 223583 - DNA, 27 bp, Artificial sequence
  SiRNA target sequence
ttctcgaatatttctcttttcttatct

SEQ ID NO: 223584 - DNA, 27 bp, Artificial sequence
  SiRNA target sequence
tctcgaatatttctcttttcttatctt

SEQ ID NO: 223585 - DNA, 27 bp, Artificial sequence
  SiRNA target sequence
ctcgaatatttctcttttcttatcttc

SEQ ID NO: 223586 - DNA, 27 bp, Artificial sequence
  SiRNA target sequence
tcgaatatttctcttttcttatcttct

SEQ ID NO: 223587 - DNA, 27 bp, Artificial sequence
  SiRNA target sequence
cgaatatttctcttttcttatcttctc

SEQ ID NO: 223588 - DNA, 27 bp, Artificial sequence
  SiRNA target sequence
gaatatttctcttttcttatcttctca

SEQ ID NO: 223589 - DNA, 27 bp, Artificial sequence
  SiRNA target sequence
aatatttctcttttcttatcttctcaa

SEQ ID NO: 223590 - DNA, 27 bp, Artificial sequence
  SiRNA target sequence
atatttctcttttcttatcttctcaag

SEQ ID NO: 223591 - DNA, 27 bp, Artificial sequence
  SiRNA target sequence
tatttctcttttcttatcttctcaagt

SEQ ID NO: 223592 - DNA, 27 bp, Artificial sequence
  SiRNA target sequence
atttctcttttcttatcttctcaagtg

SEQ ID NO: 223593 - DNA, 27 bp, Artificial sequence
  SiRNA target sequence
tttctcttttcttatcttctcaagtga

SEQ ID NO: 223594 - DNA, 27 bp, Artificial sequence
  SiRNA target sequence
ttctcttttcttatcttctcaagtgac

SEQ ID NO: 223595 - DNA, 27 bp, Artificial sequence
  SiRNA target sequence
tctcttttcttatcttctcaagtgaca

SEQ ID NO: 223596 - DNA, 27 bp, Artificial sequence
  SiRNA target sequence
ctcttttcttatcttctcaagtgacag

SEQ ID NO: 223597 - DNA, 27 bp, Artificial sequence
  SiRNA target sequence
tcttttcttatcttctcaagtgacaga

SEQ ID NO: 223598 - DNA, 27 bp, Artificial sequence
  SiRNA target sequence
cttttcttatcttctcaagtgacagaa

SEQ ID NO: 223599 - DNA, 27 bp, Artificial sequence
  SiRNA target sequence
ttttcttatcttctcaagtgacagaac

SEQ ID NO: 223600 - DNA, 27 bp, Artificial sequence
  SiRNA target sequence
tttcttatcttctcaagtgacagaact

SEQ ID NO: 223601 - DNA, 27 bp, Artificial sequence
  SiRNA target sequence
ttcttatcttctcaagtgacagaactt

SEQ ID NO: 223602 - DNA, 27 bp, Artificial sequence
  SiRNA target sequence
tcttatcttctcaagtgacagaacttt

SEQ ID NO: 223603 - DNA, 27 bp, Artificial sequence
  SiRNA target sequence
cttatcttctcaagtgacagaactttt

SEQ ID NO: 223604 - DNA, 27 bp, Artificial sequence
  SiRNA target sequence
ttatcttctcaagtgacagaacttttt

SEQ ID NO: 223605 - DNA, 27 bp, Artificial sequence
  SiRNA target sequence
tatcttctcaagtgacagaacttttta

SEQ ID NO: 223606 - DNA, 27 bp, Artificial sequence
  SiRNA target sequence
atcttctcaagtgacagaactttttac

SEQ ID NO: 223607 - DNA, 27 bp, Artificial sequence
  SiRNA target sequence
tcttctcaagtgacagaactttttaca

SEQ ID NO: 223608 - DNA, 27 bp, Artificial sequence
  SiRNA target sequence
cttctcaagtgacagaactttttacaa

SEQ ID NO: 223609 - DNA, 27 bp, Artificial sequence
  SiRNA target sequence
ttctcaagtgacagaactttttacaag

SEQ ID NO: 223610 - DNA, 27 bp, Artificial sequence
  SiRNA target sequence
tctcaagtgacagaactttttacaaga

SEQ ID NO: 223611 - DNA, 27 bp, Artificial sequence
  SiRNA target sequence
ctcaagtgacagaactttttacaagat

SEQ ID NO: 223612 - DNA, 27 bp, Artificial sequence
  SiRNA target sequence
tcaagtgacagaactttttacaagata

SEQ ID NO: 223613 - DNA, 27 bp, Artificial sequence
  SiRNA target sequence
caagtgacagaactttttacaagatat

SEQ ID NO: 223614 - DNA, 27 bp, Artificial sequence
  SiRNA target sequence
aagtgacagaactttttacaagatata

SEQ ID NO: 223615 - DNA, 27 bp, Artificial sequence
  SiRNA target sequence
agtgacagaactttttacaagatatag

SEQ ID NO: 223616 - DNA, 27 bp, Artificial sequence
  SiRNA target sequence
gtgacagaactttttacaagatataga

SEQ ID NO: 223617 - DNA, 27 bp, Artificial sequence
  SiRNA target sequence
tgacagaactttttacaagatatagat

SEQ ID NO: 223618 - DNA, 27 bp, Artificial sequence
  SiRNA target sequence
gacagaactttttacaagatatagatc

SEQ ID NO: 223619 - DNA, 27 bp, Artificial sequence
  SiRNA target sequence
acagaactttttacaagatatagatca

SEQ ID NO: 223620 - DNA, 27 bp, Artificial sequence
  SiRNA target sequence
cagaactttttacaagatatagatcaa

SEQ ID NO: 223621 - DNA, 27 bp, Artificial sequence
  SiRNA target sequence
agaactttttacaagatatagatcaaa

SEQ ID NO: 223622 - DNA, 27 bp, Artificial sequence
  SiRNA target sequence
gaactttttacaagatatagatcaaag

SEQ ID NO: 223623 - DNA, 27 bp, Artificial sequence
  SiRNA target sequence
aactttttacaagatatagatcaaagc

SEQ ID NO: 223624 - DNA, 27 bp, Artificial sequence
  SiRNA target sequence
actttttacaagatatagatcaaagct

SEQ ID NO: 223625 - DNA, 27 bp, Artificial sequence
  SiRNA target sequence
ctttttacaagatatagatcaaagctc

SEQ ID NO: 223626 - DNA, 27 bp, Artificial sequence
  SiRNA target sequence
tttttacaagatatagatcaaagctca

SEQ ID NO: 223627 - DNA, 27 bp, Artificial sequence
  SiRNA target sequence
ttttacaagatatagatcaaagctcac

SEQ ID NO: 223628 - DNA, 27 bp, Artificial sequence
  SiRNA target sequence
tttacaagatatagatcaaagctcact

SEQ ID NO: 223629 - DNA, 27 bp, Artificial sequence
  SiRNA target sequence
ttacaagatatagatcaaagctcactt

SEQ ID NO: 223630 - DNA, 27 bp, Artificial sequence
  SiRNA target sequence
tacaagatatagatcaaagctcacttt

SEQ ID NO: 223631 - DNA, 27 bp, Artificial sequence
  SiRNA target sequence
acaagatatagatcaaagctcactttc

SEQ ID NO: 223632 - DNA, 27 bp, Artificial sequence
  SiRNA target sequence
caagatatagatcaaagctcactttct

SEQ ID NO: 223633 - DNA, 27 bp, Artificial sequence
  SiRNA target sequence
aagatatagatcaaagctcactttctc

SEQ ID NO: 223634 - DNA, 27 bp, Artificial sequence
  SiRNA target sequence
agatatagatcaaagctcactttctca

SEQ ID NO: 223635 - DNA, 27 bp, Artificial sequence
  SiRNA target sequence
gatatagatcaaagctcactttctcag

SEQ ID NO: 223636 - DNA, 27 bp, Artificial sequence
  SiRNA target sequence
atatagatcaaagctcactttctcaga

SEQ ID NO: 223637 - DNA, 27 bp, Artificial sequence
  SiRNA target sequence
tatagatcaaagctcactttctcagag

SEQ ID NO: 223638 - DNA, 27 bp, Artificial sequence
  SiRNA target sequence
atagatcaaagctcactttctcagagg

SEQ ID NO: 223639 - DNA, 27 bp, Artificial sequence
  SiRNA target sequence
tagatcaaagctcactttctcagaggc

SEQ ID NO: 223640 - DNA, 27 bp, Artificial sequence
  SiRNA target sequence
agatcaaagctcactttctcagaggcg

SEQ ID NO: 223641 - DNA, 27 bp, Artificial sequence
  SiRNA target sequence
gatcaaagctcactttctcagaggcgg

SEQ ID NO: 223642 - DNA, 27 bp, Artificial sequence
  SiRNA target sequence
atcaaagctcactttctcagaggcgga

SEQ ID NO: 223643 - DNA, 27 bp, Artificial sequence
  SiRNA target sequence
tcaaagctcactttctcagaggcggaa

SEQ ID NO: 223644 - DNA, 27 bp, Artificial sequence
  SiRNA target sequence
caaagctcactttctcagaggcggaat

SEQ ID NO: 223645 - DNA, 27 bp, Artificial sequence
  SiRNA target sequence
aaagctcactttctcagaggcggaatt

SEQ ID NO: 223646 - DNA, 27 bp, Artificial sequence
  SiRNA target sequence
aagctcactttctcagaggcggaattt

SEQ ID NO: 223647 - DNA, 27 bp, Artificial sequence
  SiRNA target sequence
agctcactttctcagaggcggaatttt

SEQ ID NO: 223648 - DNA, 27 bp, Artificial sequence
  SiRNA target sequence
gctcactttctcagaggcggaattttt

SEQ ID NO: 223649 - DNA, 27 bp, Artificial sequence
  SiRNA target sequence
ctcactttctcagaggcggaattttta

SEQ ID NO: 223650 - DNA, 27 bp, Artificial sequence
  SiRNA target sequence
tcactttctcagaggcggaatttttat

SEQ ID NO: 223651 - DNA, 27 bp, Artificial sequence
  SiRNA target sequence
cactttctcagaggcggaatttttata

SEQ ID NO: 223652 - DNA, 27 bp, Artificial sequence
  SiRNA target sequence
actttctcagaggcggaatttttatat

SEQ ID NO: 223653 - DNA, 27 bp, Artificial sequence
  SiRNA target sequence
ctttctcagaggcggaatttttatata

SEQ ID NO: 223654 - DNA, 27 bp, Artificial sequence
  SiRNA target sequence
tttctcagaggcggaatttttatataa

SEQ ID NO: 223655 - DNA, 27 bp, Artificial sequence
  SiRNA target sequence
ttctcagaggcggaatttttatataat

SEQ ID NO: 223656 - DNA, 27 bp, Artificial sequence
  SiRNA target sequence
tctcagaggcggaatttttatataatg

SEQ ID NO: 223657 - DNA, 27 bp, Artificial sequence
  SiRNA target sequence
ctcagaggcggaatttttatataatgg

SEQ ID NO: 223658 - DNA, 27 bp, Artificial sequence
  SiRNA target sequence
tcagaggcggaatttttatataatggc

SEQ ID NO: 223659 - DNA, 27 bp, Artificial sequence
  SiRNA target sequence
cagaggcggaatttttatataatggct

SEQ ID NO: 223660 - DNA, 27 bp, Artificial sequence
  SiRNA target sequence
agaggcggaatttttatataatggctt

SEQ ID NO: 223661 - DNA, 27 bp, Artificial sequence
  SiRNA target sequence
gaggcggaatttttatataatggcttt

SEQ ID NO: 223662 - DNA, 27 bp, Artificial sequence
  SiRNA target sequence
aggcggaatttttatataatggctttt

SEQ ID NO: 223663 - DNA, 27 bp, Artificial sequence
  SiRNA target sequence
ggcggaatttttatataatggcttttt

SEQ ID NO: 223664 - DNA, 27 bp, Artificial sequence
  SiRNA target sequence
gcggaatttttatataatggctttttt

SEQ ID NO: 223665 - DNA, 27 bp, Artificial sequence
  SiRNA target sequence
cggaatttttatataatggcttttttg

SEQ ID NO: 223666 - DNA, 27 bp, Artificial sequence
  SiRNA target sequence
ggaatttttatataatggcttttttgt

SEQ ID NO: 223667 - DNA, 27 bp, Artificial sequence
  SiRNA target sequence
gaatttttatataatggcttttttgta

SEQ ID NO: 223668 - DNA, 27 bp, Artificial sequence
  SiRNA target sequence
aatttttatataatggcttttttgtat

SEQ ID NO: 223669 - DNA, 27 bp, Artificial sequence
  SiRNA target sequence
atttttatataatggcttttttgtatt

SEQ ID NO: 223670 - DNA, 27 bp, Artificial sequence
  SiRNA target sequence
tttttatataatggcttttttgtattt

SEQ ID NO: 223671 - DNA, 27 bp, Artificial sequence
  SiRNA target sequence
ttttatataatggcttttttgtatttt

SEQ ID NO: 223672 - DNA, 27 bp, Artificial sequence
  SiRNA target sequence
tttatataatggcttttttgtattttc

SEQ ID NO: 223673 - DNA, 27 bp, Artificial sequence
  SiRNA target sequence
ttatataatggcttttttgtattttct

SEQ ID NO: 223674 - DNA, 27 bp, Artificial sequence
  SiRNA target sequence
tatataatggcttttttgtattttctg

SEQ ID NO: 223675 - DNA, 27 bp, Artificial sequence
  SiRNA target sequence
atataatggcttttttgtattttctgg

SEQ ID NO: 223676 - DNA, 27 bp, Artificial sequence
  SiRNA target sequence
tataatggcttttttgtattttctgga

SEQ ID NO: 223677 - DNA, 27 bp, Artificial sequence
  SiRNA target sequence
ataatggcttttttgtattttctggag

SEQ ID NO: 223678 - DNA, 27 bp, Artificial sequence
  SiRNA target sequence
taatggcttttttgtattttctggagt

SEQ ID NO: 223679 - DNA, 27 bp, Artificial sequence
  SiRNA target sequence
aatggcttttttgtattttctggagtt

SEQ ID NO: 223680 - DNA, 27 bp, Artificial sequence
  SiRNA target sequence
atggcttttttgtattttctggagttc

SEQ ID NO: 223681 - DNA, 27 bp, Artificial sequence
  SiRNA target sequence
tggcttttttgtattttctggagttct

SEQ ID NO: 223682 - DNA, 27 bp, Artificial sequence
  SiRNA target sequence
ggcttttttgtattttctggagttcta

SEQ ID NO: 223683 - DNA, 27 bp, Artificial sequence
  SiRNA target sequence
gcttttttgtattttctggagttctag

SEQ ID NO: 223684 - DNA, 27 bp, Artificial sequence
  SiRNA target sequence
cttttttgtattttctggagttctagt

SEQ ID NO: 223685 - DNA, 27 bp, Artificial sequence
  SiRNA target sequence
ttttttgtattttctggagttctagta

SEQ ID NO: 223686 - DNA, 27 bp, Artificial sequence
  SiRNA target sequence
tttttgtattttctggagttctagtaa

SEQ ID NO: 223687 - DNA, 27 bp, Artificial sequence
  SiRNA target sequence
ttttgtattttctggagttctagtaat

SEQ ID NO: 223688 - DNA, 27 bp, Artificial sequence
  SiRNA target sequence
tttgtattttctggagttctagtaata

SEQ ID NO: 223689 - DNA, 27 bp, Artificial sequence
  SiRNA target sequence
ttgtattttctggagttctagtaatag

SEQ ID NO: 223690 - DNA, 27 bp, Artificial sequence
  SiRNA target sequence
tgtattttctggagttctagtaatagt

SEQ ID NO: 223691 - DNA, 27 bp, Artificial sequence
  SiRNA target sequence
gtattttctggagttctagtaatagtt

SEQ ID NO: 223692 - DNA, 27 bp, Artificial sequence
  SiRNA target sequence
tattttctggagttctagtaatagtta

SEQ ID NO: 223693 - DNA, 27 bp, Artificial sequence
  SiRNA target sequence
attttctggagttctagtaatagttat

SEQ ID NO: 223694 - DNA, 27 bp, Artificial sequence
  SiRNA target sequence
ttttctggagttctagtaatagttata

SEQ ID NO: 223695 - DNA, 27 bp, Artificial sequence
  SiRNA target sequence
tttctggagttctagtaatagttatat

SEQ ID NO: 223696 - DNA, 27 bp, Artificial sequence
  SiRNA target sequence
ttctggagttctagtaatagttatatt

SEQ ID NO: 223697 - DNA, 27 bp, Artificial sequence
  SiRNA target sequence
tctggagttctagtaatagttatattt

SEQ ID NO: 223698 - DNA, 27 bp, Artificial sequence
  SiRNA target sequence
ctggagttctagtaatagttatatttt

SEQ ID NO: 223699 - DNA, 27 bp, Artificial sequence
  SiRNA target sequence
tggagttctagtaatagttatattttt

SEQ ID NO: 223700 - DNA, 27 bp, Artificial sequence
  SiRNA target sequence
ggagttctagtaatagttatattttta

SEQ ID NO: 223701 - DNA, 27 bp, Artificial sequence
  SiRNA target sequence
gagttctagtaatagttatatttttaa

SEQ ID NO: 223702 - DNA, 27 bp, Artificial sequence
  SiRNA target sequence
agttctagtaatagttatatttttaat

SEQ ID NO: 223703 - DNA, 27 bp, Artificial sequence
  SiRNA target sequence
gttctagtaatagttatatttttaatt

SEQ ID NO: 223704 - DNA, 27 bp, Artificial sequence
  SiRNA target sequence
ttctagtaatagttatatttttaatta

SEQ ID NO: 223705 - DNA, 27 bp, Artificial sequence
  SiRNA target sequence
tctagtaatagttatatttttaattaa

SEQ ID NO: 223706 - DNA, 27 bp, Artificial sequence
  SiRNA target sequence
ctagtaatagttatatttttaattaaa

SEQ ID NO: 223707 - DNA, 27 bp, Artificial sequence
  SiRNA target sequence
tagtaatagttatatttttaattaaaa

SEQ ID NO: 223708 - DNA, 27 bp, Artificial sequence
  SiRNA target sequence
agtaatagttatatttttaattaaaaa

SEQ ID NO: 223709 - DNA, 27 bp, Artificial sequence
  SiRNA target sequence
gtaatagttatatttttaattaaaaaa

SEQ ID NO: 223710 - DNA, 27 bp, Artificial sequence
  SiRNA target sequence
taatagttatatttttaattaaaaaat

SEQ ID NO: 223711 - DNA, 27 bp, Artificial sequence
  SiRNA target sequence
aatagttatatttttaattaaaaaata

SEQ ID NO: 223712 - DNA, 27 bp, Artificial sequence
  SiRNA target sequence
atagttatatttttaattaaaaaatat

SEQ ID NO: 223713 - DNA, 27 bp, Artificial sequence
  SiRNA target sequence
tagttatatttttaattaaaaaatatt

SEQ ID NO: 223714 - DNA, 27 bp, Artificial sequence
  SiRNA target sequence
agttatatttttaattaaaaaatattt

SEQ ID NO: 223715 - DNA, 27 bp, Artificial sequence
  SiRNA target sequence
gttatatttttaattaaaaaatatttg

SEQ ID NO: 223716 - DNA, 27 bp, Artificial sequence
  SiRNA target sequence
ttatatttttaattaaaaaatatttgg

SEQ ID NO: 223717 - DNA, 27 bp, Artificial sequence
  SiRNA target sequence
tatatttttaattaaaaaatatttgga

SEQ ID NO: 223718 - DNA, 27 bp, Artificial sequence
  SiRNA target sequence
atatttttaattaaaaaatatttggag

SEQ ID NO: 223719 - DNA, 27 bp, Artificial sequence
  SiRNA target sequence
tatttttaattaaaaaatatttggaga

SEQ ID NO: 223720 - DNA, 27 bp, Artificial sequence
  SiRNA target sequence
atttttaattaaaaaatatttggagag

SEQ ID NO: 223721 - DNA, 27 bp, Artificial sequence
  SiRNA target sequence
tttttaattaaaaaatatttggagagg

SEQ ID NO: 223722 - DNA, 27 bp, Artificial sequence
  SiRNA target sequence
ttttaattaaaaaatatttggagagga

SEQ ID NO: 223723 - DNA, 27 bp, Artificial sequence
  SiRNA target sequence
tttaattaaaaaatatttggagaggaa

SEQ ID NO: 223724 - DNA, 27 bp, Artificial sequence
  SiRNA target sequence
ttaattaaaaaatatttggagaggaat

SEQ ID NO: 223725 - DNA, 27 bp, Artificial sequence
  SiRNA target sequence
taattaaaaaatatttggagaggaatg

SEQ ID NO: 223726 - DNA, 27 bp, Artificial sequence
  SiRNA target sequence
aattaaaaaatatttggagaggaatgt

SEQ ID NO: 223727 - DNA, 27 bp, Artificial sequence
  SiRNA target sequence
attaaaaaatatttggagaggaatgtg

SEQ ID NO: 223728 - DNA, 27 bp, Artificial sequence
  SiRNA target sequence
ttaaaaaatatttggagaggaatgtga

SEQ ID NO: 223729 - DNA, 27 bp, Artificial sequence
  SiRNA target sequence
taaaaaatatttggagaggaatgtgac

SEQ ID NO: 223730 - DNA, 27 bp, Artificial sequence
  SiRNA target sequence
aaaaaatatttggagaggaatgtgact

SEQ ID NO: 223731 - DNA, 27 bp, Artificial sequence
  SiRNA target sequence
aaaaatatttggagaggaatgtgacta

SEQ ID NO: 223732 - DNA, 27 bp, Artificial sequence
  SiRNA target sequence
aaaatatttggagaggaatgtgactaa

SEQ ID NO: 223733 - DNA, 27 bp, Artificial sequence
  SiRNA target sequence
aaatatttggagaggaatgtgactaac

SEQ ID NO: 223734 - DNA, 27 bp, Artificial sequence
  SiRNA target sequence
aatatttggagaggaatgtgactaaca

SEQ ID NO: 223735 - DNA, 27 bp, Artificial sequence
  SiRNA target sequence
atatttggagaggaatgtgactaacaa

SEQ ID NO: 223736 - DNA, 27 bp, Artificial sequence
  SiRNA target sequence
tatttggagaggaatgtgactaacaaa

SEQ ID NO: 223737 - DNA, 27 bp, Artificial sequence
  SiRNA target sequence
atttggagaggaatgtgactaacaaac

SEQ ID NO: 223738 - DNA, 27 bp, Artificial sequence
  SiRNA target sequence
tttggagaggaatgtgactaacaaacc

SEQ ID NO: 223739 - DNA, 27 bp, Artificial sequence
  SiRNA target sequence
ttggagaggaatgtgactaacaaacct

SEQ ID NO: 223740 - DNA, 27 bp, Artificial sequence
  SiRNA target sequence
tggagaggaatgtgactaacaaacctt

SEQ ID NO: 223741 - DNA, 27 bp, Artificial sequence
  SiRNA target sequence
ggagaggaatgtgactaacaaaccttt

SEQ ID NO: 223742 - DNA, 27 bp, Artificial sequence
  SiRNA target sequence
gagaggaatgtgactaacaaacctttg

SEQ ID NO: 223743 - DNA, 27 bp, Artificial sequence
  SiRNA target sequence
agaggaatgtgactaacaaacctttgt

SEQ ID NO: 223744 - DNA, 27 bp, Artificial sequence
  SiRNA target sequence
gaggaatgtgactaacaaacctttgtt

SEQ ID NO: 223745 - DNA, 27 bp, Artificial sequence
  SiRNA target sequence
aggaatgtgactaacaaacctttgttt

SEQ ID NO: 223746 - DNA, 27 bp, Artificial sequence
  SiRNA target sequence
ggaatgtgactaacaaacctttgtttg

SEQ ID NO: 223747 - DNA, 27 bp, Artificial sequence
  SiRNA target sequence
gaatgtgactaacaaacctttgtttgt

SEQ ID NO: 223748 - DNA, 27 bp, Artificial sequence
  SiRNA target sequence
aatgtgactaacaaacctttgtttgtt

SEQ ID NO: 223749 - DNA, 27 bp, Artificial sequence
  SiRNA target sequence
atgtgactaacaaacctttgtttgttg

SEQ ID NO: 223750 - DNA, 27 bp, Artificial sequence
  SiRNA target sequence
tgtgactaacaaacctttgtttgttgt

SEQ ID NO: 223751 - DNA, 27 bp, Artificial sequence
  SiRNA target sequence
gtgactaacaaacctttgtttgttgta

SEQ ID NO: 223752 - DNA, 27 bp, Artificial sequence
  SiRNA target sequence
tgactaacaaacctttgtttgttgtaa

SEQ ID NO: 223753 - DNA, 27 bp, Artificial sequence
  SiRNA target sequence
gactaacaaacctttgtttgttgtaaa

SEQ ID NO: 223754 - DNA, 27 bp, Artificial sequence
  SiRNA target sequence
actaacaaacctttgtttgttgtaaaa

SEQ ID NO: 223755 - DNA, 27 bp, Artificial sequence
  SiRNA target sequence
ctaacaaacctttgtttgttgtaaaat

SEQ ID NO: 223756 - DNA, 27 bp, Artificial sequence
  SiRNA target sequence
taacaaacctttgtttgttgtaaaatc

SEQ ID NO: 223757 - DNA, 27 bp, Artificial sequence
  SiRNA target sequence
aacaaacctttgtttgttgtaaaatct

SEQ ID NO: 223758 - DNA, 27 bp, Artificial sequence
  SiRNA target sequence
acaaacctttgtttgttgtaaaatctg

SEQ ID NO: 223759 - DNA, 27 bp, Artificial sequence
  SiRNA target sequence
caaacctttgtttgttgtaaaatctgt

SEQ ID NO: 223760 - DNA, 27 bp, Artificial sequence
  SiRNA target sequence
aaacctttgtttgttgtaaaatctgtt

SEQ ID NO: 223761 - DNA, 27 bp, Artificial sequence
  SiRNA target sequence
aacctttgtttgttgtaaaatctgtta

SEQ ID NO: 223762 - DNA, 27 bp, Artificial sequence
  SiRNA target sequence
acctttgtttgttgtaaaatctgttaa

SEQ ID NO: 223763 - DNA, 27 bp, Artificial sequence
  SiRNA target sequence
cctttgtttgttgtaaaatctgttaaa

SEQ ID NO: 223764 - DNA, 27 bp, Artificial sequence
  SiRNA target sequence
ctttgtttgttgtaaaatctgttaaaa

SEQ ID NO: 223765 - DNA, 27 bp, Artificial sequence
  SiRNA target sequence
tttgtttgttgtaaaatctgttaaaaa

SEQ ID NO: 223766 - DNA, 27 bp, Artificial sequence
  SiRNA target sequence
ttgtttgttgtaaaatctgttaaaaag

SEQ ID NO: 223767 - DNA, 27 bp, Artificial sequence
  SiRNA target sequence
tgtttgttgtaaaatctgttaaaaaga

SEQ ID NO: 223768 - DNA, 27 bp, Artificial sequence
  SiRNA target sequence
gtttgttgtaaaatctgttaaaaagaa

SEQ ID NO: 223769 - DNA, 27 bp, Artificial sequence
  SiRNA target sequence
tttgttgtaaaatctgttaaaaagaag

SEQ ID NO: 223770 - DNA, 27 bp, Artificial sequence
  SiRNA target sequence
ttgttgtaaaatctgttaaaaagaagg

SEQ ID NO: 223771 - DNA, 27 bp, Artificial sequence
  SiRNA target sequence
tgttgtaaaatctgttaaaaagaaggg

SEQ ID NO: 223772 - DNA, 27 bp, Artificial sequence
  SiRNA target sequence
gttgtaaaatctgttaaaaagaaggga

SEQ ID NO: 223773 - DNA, 27 bp, Artificial sequence
  SiRNA target sequence
ttgtaaaatctgttaaaaagaagggac

SEQ ID NO: 223774 - DNA, 27 bp, Artificial sequence
  SiRNA target sequence
tgtaaaatctgttaaaaagaagggacc

SEQ ID NO: 223775 - DNA, 27 bp, Artificial sequence
  SiRNA target sequence
gtaaaatctgttaaaaagaagggacca

SEQ ID NO: 223776 - DNA, 27 bp, Artificial sequence
  SiRNA target sequence
taaaatctgttaaaaagaagggaccaa

SEQ ID NO: 223777 - DNA, 27 bp, Artificial sequence
  SiRNA target sequence
aaaatctgttaaaaagaagggaccaaa

SEQ ID NO: 223778 - DNA, 27 bp, Artificial sequence
  SiRNA target sequence
aaatctgttaaaaagaagggaccaaaa

SEQ ID NO: 223779 - DNA, 27 bp, Artificial sequence
  SiRNA target sequence
aatctgttaaaaagaagggaccaaaag

SEQ ID NO: 223780 - DNA, 27 bp, Artificial sequence
  SiRNA target sequence
atctgttaaaaagaagggaccaaaagt

SEQ ID NO: 223781 - DNA, 27 bp, Artificial sequence
  SiRNA target sequence
tctgttaaaaagaagggaccaaaagtt

SEQ ID NO: 223782 - DNA, 27 bp, Artificial sequence
  SiRNA target sequence
ctgttaaaaagaagggaccaaaagtta

SEQ ID NO: 223783 - DNA, 27 bp, Artificial sequence
  SiRNA target sequence
tgttaaaaagaagggaccaaaagttaa

SEQ ID NO: 223784 - DNA, 27 bp, Artificial sequence
  SiRNA target sequence
gttaaaaagaagggaccaaaagttaaa

SEQ ID NO: 223785 - DNA, 27 bp, Artificial sequence
  SiRNA target sequence
ttaaaaagaagggaccaaaagttaaag

SEQ ID NO: 223786 - DNA, 27 bp, Artificial sequence
  SiRNA target sequence
taaaaagaagggaccaaaagttaaagt

SEQ ID NO: 223787 - DNA, 27 bp, Artificial sequence
  SiRNA target sequence
aaaaagaagggaccaaaagttaaagta

SEQ ID NO: 223788 - DNA, 27 bp, Artificial sequence
  SiRNA target sequence
aaaagaagggaccaaaagttaaagtag

SEQ ID NO: 223789 - DNA, 27 bp, Artificial sequence
  SiRNA target sequence
aaagaagggaccaaaagttaaagtagg

SEQ ID NO: 223790 - DNA, 27 bp, Artificial sequence
  SiRNA target sequence
aagaagggaccaaaagttaaagtagga

SEQ ID NO: 223791 - DNA, 27 bp, Artificial sequence
  SiRNA target sequence
agaagggaccaaaagttaaagtaggat

SEQ ID NO: 223792 - DNA, 27 bp, Artificial sequence
  SiRNA target sequence
gaagggaccaaaagttaaagtaggatt

SEQ ID NO: 223793 - DNA, 27 bp, Artificial sequence
  SiRNA target sequence
aagggaccaaaagttaaagtaggattt

SEQ ID NO: 223794 - DNA, 27 bp, Artificial sequence
  SiRNA target sequence
agggaccaaaagttaaagtaggatttg

SEQ ID NO: 223795 - DNA, 27 bp, Artificial sequence
  SiRNA target sequence
gggaccaaaagttaaagtaggatttgc

SEQ ID NO: 223796 - DNA, 27 bp, Artificial sequence
  SiRNA target sequence
ggaccaaaagttaaagtaggatttgcg

SEQ ID NO: 223797 - DNA, 27 bp, Artificial sequence
  SiRNA target sequence
gaccaaaagttaaagtaggatttgcgg

SEQ ID NO: 223798 - DNA, 27 bp, Artificial sequence
  SiRNA target sequence
accaaaagttaaagtaggatttgcgga

SEQ ID NO: 223799 - DNA, 27 bp, Artificial sequence
  SiRNA target sequence
ccaaaagttaaagtaggatttgcggag

SEQ ID NO: 223800 - DNA, 27 bp, Artificial sequence
  SiRNA target sequence
caaaagttaaagtaggatttgcggagg

SEQ ID NO: 223801 - DNA, 27 bp, Artificial sequence
  SiRNA target sequence
aaaagttaaagtaggatttgcggaggg

SEQ ID NO: 223802 - DNA, 27 bp, Artificial sequence
  SiRNA target sequence
aaagttaaagtaggatttgcggagggc

SEQ ID NO: 223803 - DNA, 27 bp, Artificial sequence
  SiRNA target sequence
aagttaaagtaggatttgcggagggcc

SEQ ID NO: 223804 - DNA, 27 bp, Artificial sequence
  SiRNA target sequence
agttaaagtaggatttgcggagggcct

SEQ ID NO: 223805 - DNA, 27 bp, Artificial sequence
  SiRNA target sequence
gttaaagtaggatttgcggagggcctt

SEQ ID NO: 223806 - DNA, 27 bp, Artificial sequence
  SiRNA target sequence
ttaaagtaggatttgcggagggcctta

SEQ ID NO: 223807 - DNA, 27 bp, Artificial sequence
  SiRNA target sequence
taaagtaggatttgcggagggccttaa

SEQ ID NO: 223808 - DNA, 27 bp, Artificial sequence
  SiRNA target sequence
aaagtaggatttgcggagggccttaaa

SEQ ID NO: 223809 - DNA, 27 bp, Artificial sequence
  SiRNA target sequence
aagtaggatttgcggagggccttaaag

SEQ ID NO: 223810 - DNA, 27 bp, Artificial sequence
  SiRNA target sequence
agtaggatttgcggagggccttaaaga

SEQ ID NO: 223811 - DNA, 27 bp, Artificial sequence
  SiRNA target sequence
gtaggatttgcggagggccttaaagaa

SEQ ID NO: 223812 - DNA, 27 bp, Artificial sequence
  SiRNA target sequence
taggatttgcggagggccttaaagaaa

SEQ ID NO: 223813 - DNA, 27 bp, Artificial sequence
  SiRNA target sequence
aggatttgcggagggccttaaagaaat

SEQ ID NO: 223814 - DNA, 27 bp, Artificial sequence
  SiRNA target sequence
ggatttgcggagggccttaaagaaatg

SEQ ID NO: 223815 - DNA, 27 bp, Artificial sequence
  SiRNA target sequence
gatttgcggagggccttaaagaaatga

SEQ ID NO: 223816 - DNA, 27 bp, Artificial sequence
  SiRNA target sequence
atttgcggagggccttaaagaaatgat

SEQ ID NO: 223817 - DNA, 27 bp, Artificial sequence
  SiRNA target sequence
tttgcggagggccttaaagaaatgatg

SEQ ID NO: 223818 - DNA, 27 bp, Artificial sequence
  SiRNA target sequence
ttgcggagggccttaaagaaatgatgg

SEQ ID NO: 223819 - DNA, 27 bp, Artificial sequence
  SiRNA target sequence
tgcggagggccttaaagaaatgatggc

SEQ ID NO: 223820 - DNA, 27 bp, Artificial sequence
  SiRNA target sequence
gcggagggccttaaagaaatgatggca

SEQ ID NO: 223821 - DNA, 27 bp, Artificial sequence
  SiRNA target sequence
cggagggccttaaagaaatgatggcat

SEQ ID NO: 223822 - DNA, 27 bp, Artificial sequence
  SiRNA target sequence
ggagggccttaaagaaatgatggcatc

SEQ ID NO: 223823 - DNA, 27 bp, Artificial sequence
  SiRNA target sequence
gagggccttaaagaaatgatggcatca

SEQ ID NO: 223824 - DNA, 27 bp, Artificial sequence
  SiRNA target sequence
agggccttaaagaaatgatggcatcaa

SEQ ID NO: 223825 - DNA, 27 bp, Artificial sequence
  SiRNA target sequence
gggccttaaagaaatgatggcatcaaa

SEQ ID NO: 223826 - DNA, 27 bp, Artificial sequence
  SiRNA target sequence
ggccttaaagaaatgatggcatcaaag

SEQ ID NO: 223827 - DNA, 27 bp, Artificial sequence
  SiRNA target sequence
gccttaaagaaatgatggcatcaaagt

SEQ ID NO: 223828 - DNA, 27 bp, Artificial sequence
  SiRNA target sequence
ccttaaagaaatgatggcatcaaagtt

SEQ ID NO: 223829 - DNA, 27 bp, Artificial sequence
  SiRNA target sequence
cttaaagaaatgatggcatcaaagtta

SEQ ID NO: 223830 - DNA, 27 bp, Artificial sequence
  SiRNA target sequence
ttaaagaaatgatggcatcaaagttat

SEQ ID NO: 223831 - DNA, 27 bp, Artificial sequence
  SiRNA target sequence
taaagaaatgatggcatcaaagttatt

SEQ ID NO: 223832 - DNA, 27 bp, Artificial sequence
  SiRNA target sequence
aaagaaatgatggcatcaaagttatta

SEQ ID NO: 223833 - DNA, 27 bp, Artificial sequence
  SiRNA target sequence
aagaaatgatggcatcaaagttattac

SEQ ID NO: 223834 - DNA, 27 bp, Artificial sequence
  SiRNA target sequence
agaaatgatggcatcaaagttattact

SEQ ID NO: 223835 - DNA, 27 bp, Artificial sequence
  SiRNA target sequence
gaaatgatggcatcaaagttattactt

SEQ ID NO: 223836 - DNA, 27 bp, Artificial sequence
  SiRNA target sequence
aaatgatggcatcaaagttattactta

SEQ ID NO: 223837 - DNA, 27 bp, Artificial sequence
  SiRNA target sequence
aatgatggcatcaaagttattacttaa

SEQ ID NO: 223838 - DNA, 27 bp, Artificial sequence
  SiRNA target sequence
atgatggcatcaaagttattacttaac

SEQ ID NO: 223839 - DNA, 27 bp, Artificial sequence
  SiRNA target sequence
tgatggcatcaaagttattacttaaca

SEQ ID NO: 223840 - DNA, 27 bp, Artificial sequence
  SiRNA target sequence
gatggcatcaaagttattacttaacat

SEQ ID NO: 223841 - DNA, 27 bp, Artificial sequence
  SiRNA target sequence
atggcatcaaagttattacttaacatt

SEQ ID NO: 223842 - DNA, 27 bp, Artificial sequence
  SiRNA target sequence
tggcatcaaagttattacttaacattt

SEQ ID NO: 223843 - DNA, 27 bp, Artificial sequence
  SiRNA target sequence
ggcatcaaagttattacttaacatttc

SEQ ID NO: 223844 - DNA, 27 bp, Artificial sequence
  SiRNA target sequence
gcatcaaagttattacttaacatttca

SEQ ID NO: 223845 - DNA, 27 bp, Artificial sequence
  SiRNA target sequence
catcaaagttattacttaacatttcat

SEQ ID NO: 223846 - DNA, 27 bp, Artificial sequence
  SiRNA target sequence
atcaaagttattacttaacatttcatt

SEQ ID NO: 223847 - DNA, 27 bp, Artificial sequence
  SiRNA target sequence
tcaaagttattacttaacatttcatta

SEQ ID NO: 223848 - DNA, 27 bp, Artificial sequence
  SiRNA target sequence
caaagttattacttaacatttcattaa

SEQ ID NO: 223849 - DNA, 27 bp, Artificial sequence
  SiRNA target sequence
aaagttattacttaacatttcattaac

SEQ ID NO: 223850 - DNA, 27 bp, Artificial sequence
  SiRNA target sequence
aagttattacttaacatttcattaact

SEQ ID NO: 223851 - DNA, 27 bp, Artificial sequence
  SiRNA target sequence
agttattacttaacatttcattaactg

SEQ ID NO: 223852 - DNA, 27 bp, Artificial sequence
  SiRNA target sequence
gttattacttaacatttcattaactgt

SEQ ID NO: 223853 - DNA, 27 bp, Artificial sequence
  SiRNA target sequence
ttattacttaacatttcattaactgtt

SEQ ID NO: 223854 - DNA, 27 bp, Artificial sequence
  SiRNA target sequence
tattacttaacatttcattaactgtta

SEQ ID NO: 223855 - DNA, 27 bp, Artificial sequence
  SiRNA target sequence
attacttaacatttcattaactgttat

SEQ ID NO: 223856 - DNA, 27 bp, Artificial sequence
  SiRNA target sequence
ttacttaacatttcattaactgttatg

SEQ ID NO: 223857 - DNA, 27 bp, Artificial sequence
  SiRNA target sequence
tacttaacatttcattaactgttatgt

SEQ ID NO: 223858 - DNA, 27 bp, Artificial sequence
  SiRNA target sequence
acttaacatttcattaactgttatgtt

SEQ ID NO: 223859 - DNA, 27 bp, Artificial sequence
  SiRNA target sequence
cttaacatttcattaactgttatgttc

SEQ ID NO: 223860 - DNA, 27 bp, Artificial sequence
  SiRNA target sequence
ttaacatttcattaactgttatgttct

SEQ ID NO: 223861 - DNA, 27 bp, Artificial sequence
  SiRNA target sequence
taacatttcattaactgttatgttcta

SEQ ID NO: 223862 - DNA, 27 bp, Artificial sequence
  SiRNA target sequence
aacatttcattaactgttatgttctat

SEQ ID NO: 223863 - DNA, 27 bp, Artificial sequence
  SiRNA target sequence
acatttcattaactgttatgttctatg

SEQ ID NO: 223864 - DNA, 27 bp, Artificial sequence
  SiRNA target sequence
catttcattaactgttatgttctatgg

SEQ ID NO: 223865 - DNA, 27 bp, Artificial sequence
  SiRNA target sequence
atttcattaactgttatgttctatggt

SEQ ID NO: 223866 - DNA, 27 bp, Artificial sequence
  SiRNA target sequence
tttcattaactgttatgttctatggta

SEQ ID NO: 223867 - DNA, 27 bp, Artificial sequence
  SiRNA target sequence
ttcattaactgttatgttctatggtat

SEQ ID NO: 223868 - DNA, 27 bp, Artificial sequence
  SiRNA target sequence
tcattaactgttatgttctatggtata

SEQ ID NO: 223869 - DNA, 27 bp, Artificial sequence
  SiRNA target sequence
cattaactgttatgttctatggtatat

SEQ ID NO: 223870 - DNA, 27 bp, Artificial sequence
  SiRNA target sequence
attaactgttatgttctatggtatatc

SEQ ID NO: 223871 - DNA, 27 bp, Artificial sequence
  SiRNA target sequence
ttaactgttatgttctatggtatatca

SEQ ID NO: 223872 - DNA, 27 bp, Artificial sequence
  SiRNA target sequence
taactgttatgttctatggtatatcaa

SEQ ID NO: 223873 - DNA, 27 bp, Artificial sequence
  SiRNA target sequence
aactgttatgttctatggtatatcaac

SEQ ID NO: 223874 - DNA, 27 bp, Artificial sequence
  SiRNA target sequence
actgttatgttctatggtatatcaact

SEQ ID NO: 223875 - DNA, 27 bp, Artificial sequence
  SiRNA target sequence
ctgttatgttctatggtatatcaacta

SEQ ID NO: 223876 - DNA, 27 bp, Artificial sequence
  SiRNA target sequence
tgttatgttctatggtatatcaactaa

SEQ ID NO: 223877 - DNA, 27 bp, Artificial sequence
  SiRNA target sequence
gttatgttctatggtatatcaactaat

SEQ ID NO: 223878 - DNA, 27 bp, Artificial sequence
  SiRNA target sequence
ttatgttctatggtatatcaactaatt

SEQ ID NO: 223879 - DNA, 27 bp, Artificial sequence
  SiRNA target sequence
tatgttctatggtatatcaactaattt

SEQ ID NO: 223880 - DNA, 27 bp, Artificial sequence
  SiRNA target sequence
atgttctatggtatatcaactaattta

SEQ ID NO: 223881 - DNA, 27 bp, Artificial sequence
  SiRNA target sequence
tgttctatggtatatcaactaatttaa

SEQ ID NO: 223882 - DNA, 27 bp, Artificial sequence
  SiRNA target sequence
gttctatggtatatcaactaatttaat

SEQ ID NO: 223883 - DNA, 27 bp, Artificial sequence
  SiRNA target sequence
ttctatggtatatcaactaatttaata

SEQ ID NO: 223884 - DNA, 27 bp, Artificial sequence
  SiRNA target sequence
tctatggtatatcaactaatttaatag

SEQ ID NO: 223885 - DNA, 27 bp, Artificial sequence
  SiRNA target sequence
ctatggtatatcaactaatttaataga

SEQ ID NO: 223886 - DNA, 27 bp, Artificial sequence
  SiRNA target sequence
tatggtatatcaactaatttaatagaa

SEQ ID NO: 223887 - DNA, 27 bp, Artificial sequence
  SiRNA target sequence
atggtatatcaactaatttaatagaat

SEQ ID NO: 223888 - DNA, 27 bp, Artificial sequence
  SiRNA target sequence
tggtatatcaactaatttaatagaatc

SEQ ID NO: 223889 - DNA, 27 bp, Artificial sequence
  SiRNA target sequence
ggtatatcaactaatttaatagaatca

SEQ ID NO: 223890 - DNA, 27 bp, Artificial sequence
  SiRNA target sequence
gtatatcaactaatttaatagaatcaa

SEQ ID NO: 223891 - DNA, 27 bp, Artificial sequence
  SiRNA target sequence
tatatcaactaatttaatagaatcaac

SEQ ID NO: 223892 - DNA, 27 bp, Artificial sequence
  SiRNA target sequence
atatcaactaatttaatagaatcaaca

SEQ ID NO: 223893 - DNA, 27 bp, Artificial sequence
  SiRNA target sequence
tatcaactaatttaatagaatcaacat

SEQ ID NO: 223894 - DNA, 27 bp, Artificial sequence
  SiRNA target sequence
atcaactaatttaatagaatcaacatt

SEQ ID NO: 223895 - DNA, 27 bp, Artificial sequence
  SiRNA target sequence
tcaactaatttaatagaatcaacattt

SEQ ID NO: 223896 - DNA, 27 bp, Artificial sequence
  SiRNA target sequence
caactaatttaatagaatcaacattta

SEQ ID NO: 223897 - DNA, 27 bp, Artificial sequence
  SiRNA target sequence
aactaatttaatagaatcaacatttaa

SEQ ID NO: 223898 - DNA, 27 bp, Artificial sequence
  SiRNA target sequence
actaatttaatagaatcaacatttaaa

SEQ ID NO: 223899 - DNA, 27 bp, Artificial sequence
  SiRNA target sequence
ctaatttaatagaatcaacatttaaaa

SEQ ID NO: 223900 - DNA, 27 bp, Artificial sequence
  SiRNA target sequence
taatttaatagaatcaacatttaaaag

SEQ ID NO: 223901 - DNA, 27 bp, Artificial sequence
  SiRNA target sequence
aatttaatagaatcaacatttaaaagt

SEQ ID NO: 223902 - DNA, 27 bp, Artificial sequence
  SiRNA target sequence
atttaatagaatcaacatttaaaagtg

SEQ ID NO: 223903 - DNA, 27 bp, Artificial sequence
  SiRNA target sequence
tttaatagaatcaacatttaaaagtgg

SEQ ID NO: 223904 - DNA, 27 bp, Artificial sequence
  SiRNA target sequence
ttaatagaatcaacatttaaaagtgga

SEQ ID NO: 223905 - DNA, 27 bp, Artificial sequence
  SiRNA target sequence
taatagaatcaacatttaaaagtggac

SEQ ID NO: 223906 - DNA, 27 bp, Artificial sequence
  SiRNA target sequence
aatagaatcaacatttaaaagtggact

SEQ ID NO: 223907 - DNA, 27 bp, Artificial sequence
  SiRNA target sequence
atagaatcaacatttaaaagtggactt

SEQ ID NO: 223908 - DNA, 27 bp, Artificial sequence
  SiRNA target sequence
tagaatcaacatttaaaagtggacttg

SEQ ID NO: 223909 - DNA, 27 bp, Artificial sequence
  SiRNA target sequence
agaatcaacatttaaaagtggacttgt

SEQ ID NO: 223910 - DNA, 27 bp, Artificial sequence
  SiRNA target sequence
gaatcaacatttaaaagtggacttgtg

SEQ ID NO: 223911 - DNA, 27 bp, Artificial sequence
  SiRNA target sequence
aatcaacatttaaaagtggacttgtga

SEQ ID NO: 223912 - DNA, 27 bp, Artificial sequence
  SiRNA target sequence
atcaacatttaaaagtggacttgtgaa

SEQ ID NO: 223913 - DNA, 27 bp, Artificial sequence
  SiRNA target sequence
tcaacatttaaaagtggacttgtgaaa

SEQ ID NO: 223914 - DNA, 27 bp, Artificial sequence
  SiRNA target sequence
caacatttaaaagtggacttgtgaaag

SEQ ID NO: 223915 - DNA, 27 bp, Artificial sequence
  SiRNA target sequence
aacatttaaaagtggacttgtgaaagg

SEQ ID NO: 223916 - DNA, 27 bp, Artificial sequence
  SiRNA target sequence
acatttaaaagtggacttgtgaaaggt

SEQ ID NO: 223917 - DNA, 27 bp, Artificial sequence
  SiRNA target sequence
catttaaaagtggacttgtgaaaggtg

SEQ ID NO: 223918 - DNA, 27 bp, Artificial sequence
  SiRNA target sequence
atttaaaagtggacttgtgaaaggtgc

SEQ ID NO: 223919 - DNA, 27 bp, Artificial sequence
  SiRNA target sequence
tttaaaagtggacttgtgaaaggtgca

SEQ ID NO: 223920 - DNA, 27 bp, Artificial sequence
  SiRNA target sequence
ttaaaagtggacttgtgaaaggtgcag

SEQ ID NO: 223921 - DNA, 27 bp, Artificial sequence
  SiRNA target sequence
taaaagtggacttgtgaaaggtgcaga

SEQ ID NO: 223922 - DNA, 27 bp, Artificial sequence
  SiRNA target sequence
aaaagtggacttgtgaaaggtgcagaa

SEQ ID NO: 223923 - DNA, 27 bp, Artificial sequence
  SiRNA target sequence
aaagtggacttgtgaaaggtgcagaag

SEQ ID NO: 223924 - DNA, 27 bp, Artificial sequence
  SiRNA target sequence
aagtggacttgtgaaaggtgcagaaga

SEQ ID NO: 223925 - DNA, 27 bp, Artificial sequence
  SiRNA target sequence
agtggacttgtgaaaggtgcagaagaa

SEQ ID NO: 223926 - DNA, 27 bp, Artificial sequence
  SiRNA target sequence
gtggacttgtgaaaggtgcagaagaat

SEQ ID NO: 223927 - DNA, 27 bp, Artificial sequence
  SiRNA target sequence
tggacttgtgaaaggtgcagaagaatt

SEQ ID NO: 223928 - DNA, 27 bp, Artificial sequence
  SiRNA target sequence
ggacttgtgaaaggtgcagaagaatta

SEQ ID NO: 223929 - DNA, 27 bp, Artificial sequence
  SiRNA target sequence
gacttgtgaaaggtgcagaagaattaa

SEQ ID NO: 223930 - DNA, 27 bp, Artificial sequence
  SiRNA target sequence
acttgtgaaaggtgcagaagaattaaa

SEQ ID NO: 223931 - DNA, 27 bp, Artificial sequence
  SiRNA target sequence
cttgtgaaaggtgcagaagaattaaac

SEQ ID NO: 223932 - DNA, 27 bp, Artificial sequence
  SiRNA target sequence
ttgtgaaaggtgcagaagaattaaacg

SEQ ID NO: 223933 - DNA, 27 bp, Artificial sequence
  SiRNA target sequence
tgtgaaaggtgcagaagaattaaacga

SEQ ID NO: 223934 - DNA, 27 bp, Artificial sequence
  SiRNA target sequence
gtgaaaggtgcagaagaattaaacgag

SEQ ID NO: 223935 - DNA, 27 bp, Artificial sequence
  SiRNA target sequence
tgaaaggtgcagaagaattaaacgaga

SEQ ID NO: 223936 - DNA, 27 bp, Artificial sequence
  SiRNA target sequence
gaaaggtgcagaagaattaaacgagaa

SEQ ID NO: 223937 - DNA, 27 bp, Artificial sequence
  SiRNA target sequence
aaaggtgcagaagaattaaacgagaat

SEQ ID NO: 223938 - DNA, 27 bp, Artificial sequence
  SiRNA target sequence
aaggtgcagaagaattaaacgagaata

SEQ ID NO: 223939 - DNA, 27 bp, Artificial sequence
  SiRNA target sequence
aggtgcagaagaattaaacgagaatac

SEQ ID NO: 223940 - DNA, 27 bp, Artificial sequence
  SiRNA target sequence
ggtgcagaagaattaaacgagaatact

SEQ ID NO: 223941 - DNA, 27 bp, Artificial sequence
  SiRNA target sequence
gtgcagaagaattaaacgagaatacta

SEQ ID NO: 223942 - DNA, 27 bp, Artificial sequence
  SiRNA target sequence
tgcagaagaattaaacgagaatactaa

SEQ ID NO: 223943 - DNA, 27 bp, Artificial sequence
  SiRNA target sequence
gcagaagaattaaacgagaatactaaa

SEQ ID NO: 223944 - DNA, 27 bp, Artificial sequence
  SiRNA target sequence
cagaagaattaaacgagaatactaaaa

SEQ ID NO: 223945 - DNA, 27 bp, Artificial sequence
  SiRNA target sequence
agaagaattaaacgagaatactaaaag

SEQ ID NO: 223946 - DNA, 27 bp, Artificial sequence
  SiRNA target sequence
gaagaattaaacgagaatactaaaagt

SEQ ID NO: 223947 - DNA, 27 bp, Artificial sequence
  SiRNA target sequence
aagaattaaacgagaatactaaaagtt

SEQ ID NO: 223948 - DNA, 27 bp, Artificial sequence
  SiRNA target sequence
agaattaaacgagaatactaaaagtta

SEQ ID NO: 223949 - DNA, 27 bp, Artificial sequence
  SiRNA target sequence
gaattaaacgagaatactaaaagttat

SEQ ID NO: 223950 - DNA, 27 bp, Artificial sequence
  SiRNA target sequence
aattaaacgagaatactaaaagttatt

SEQ ID NO: 223951 - DNA, 27 bp, Artificial sequence
  SiRNA target sequence
attaaacgagaatactaaaagttattc

SEQ ID NO: 223952 - DNA, 27 bp, Artificial sequence
  SiRNA target sequence
ttaaacgagaatactaaaagttattct

SEQ ID NO: 223953 - DNA, 27 bp, Artificial sequence
  SiRNA target sequence
taaacgagaatactaaaagttattcta

SEQ ID NO: 223954 - DNA, 27 bp, Artificial sequence
  SiRNA target sequence
aaacgagaatactaaaagttattctat

SEQ ID NO: 223955 - DNA, 27 bp, Artificial sequence
  SiRNA target sequence
aacgagaatactaaaagttattctatg

SEQ ID NO: 223956 - DNA, 27 bp, Artificial sequence
  SiRNA target sequence
acgagaatactaaaagttattctatgg

SEQ ID NO: 223957 - DNA, 27 bp, Artificial sequence
  SiRNA target sequence
cgagaatactaaaagttattctatggg

SEQ ID NO: 223958 - DNA, 27 bp, Artificial sequence
  SiRNA target sequence
gagaatactaaaagttattctatggga

SEQ ID NO: 223959 - DNA, 27 bp, Artificial sequence
  SiRNA target sequence
agaatactaaaagttattctatgggat

SEQ ID NO: 223960 - DNA, 27 bp, Artificial sequence
  SiRNA target sequence
gaatactaaaagttattctatgggata

SEQ ID NO: 223961 - DNA, 27 bp, Artificial sequence
  SiRNA target sequence
aatactaaaagttattctatgggatat

SEQ ID NO: 223962 - DNA, 27 bp, Artificial sequence
  SiRNA target sequence
atactaaaagttattctatgggatata

SEQ ID NO: 223963 - DNA, 27 bp, Artificial sequence
  SiRNA target sequence
tactaaaagttattctatgggatataa

SEQ ID NO: 223964 - DNA, 27 bp, Artificial sequence
  SiRNA target sequence
actaaaagttattctatgggatataat

SEQ ID NO: 223965 - DNA, 27 bp, Artificial sequence
  SiRNA target sequence
ctaaaagttattctatgggatataatt

SEQ ID NO: 223966 - DNA, 27 bp, Artificial sequence
  SiRNA target sequence
taaaagttattctatgggatataattc

SEQ ID NO: 223967 - DNA, 27 bp, Artificial sequence
  SiRNA target sequence
aaaagttattctatgggatataattca

SEQ ID NO: 223968 - DNA, 27 bp, Artificial sequence
  SiRNA target sequence
aaagttattctatgggatataattcat

SEQ ID NO: 223969 - DNA, 27 bp, Artificial sequence
  SiRNA target sequence
aagttattctatgggatataattcatt

SEQ ID NO: 223970 - DNA, 27 bp, Artificial sequence
  SiRNA target sequence
agttattctatgggatataattcattt

SEQ ID NO: 223971 - DNA, 27 bp, Artificial sequence
  SiRNA target sequence
gttattctatgggatataattcatttg

SEQ ID NO: 223972 - DNA, 27 bp, Artificial sequence
  SiRNA target sequence
ttattctatgggatataattcatttga

SEQ ID NO: 223973 - DNA, 27 bp, Artificial sequence
  SiRNA target sequence
tattctatgggatataattcatttgaa

SEQ ID NO: 223974 - DNA, 27 bp, Artificial sequence
  SiRNA target sequence
attctatgggatataattcatttgaac

SEQ ID NO: 223975 - DNA, 27 bp, Artificial sequence
  SiRNA target sequence
ttctatgggatataattcatttgaaca

SEQ ID NO: 223976 - DNA, 27 bp, Artificial sequence
  SiRNA target sequence
tctatgggatataattcatttgaacaa

SEQ ID NO: 223977 - DNA, 27 bp, Artificial sequence
  SiRNA target sequence
ctatgggatataattcatttgaacaaa

SEQ ID NO: 223978 - DNA, 27 bp, Artificial sequence
  SiRNA target sequence
tatgggatataattcatttgaacaaaa

SEQ ID NO: 223979 - DNA, 27 bp, Artificial sequence
  SiRNA target sequence
atgggatataattcatttgaacaaaag

SEQ ID NO: 223980 - DNA, 27 bp, Artificial sequence
  SiRNA target sequence
tgggatataattcatttgaacaaaaga

SEQ ID NO: 223981 - DNA, 27 bp, Artificial sequence
  SiRNA target sequence
gggatataattcatttgaacaaaagat

SEQ ID NO: 223982 - DNA, 27 bp, Artificial sequence
  SiRNA target sequence
ggatataattcatttgaacaaaagata

SEQ ID NO: 223983 - DNA, 27 bp, Artificial sequence
  SiRNA target sequence
gatataattcatttgaacaaaagatag

SEQ ID NO: 223984 - DNA, 27 bp, Artificial sequence
  SiRNA target sequence
atataattcatttgaacaaaagatagc

SEQ ID NO: 223985 - DNA, 27 bp, Artificial sequence
  SiRNA target sequence
tataattcatttgaacaaaagatagca

SEQ ID NO: 223986 - DNA, 27 bp, Artificial sequence
  SiRNA target sequence
ataattcatttgaacaaaagatagcat

SEQ ID NO: 223987 - DNA, 27 bp, Artificial sequence
  SiRNA target sequence
taattcatttgaacaaaagatagcatc

SEQ ID NO: 223988 - DNA, 27 bp, Artificial sequence
  SiRNA target sequence
aattcatttgaacaaaagatagcatca

SEQ ID NO: 223989 - DNA, 27 bp, Artificial sequence
  SiRNA target sequence
attcatttgaacaaaagatagcatcaa

SEQ ID NO: 223990 - DNA, 27 bp, Artificial sequence
  SiRNA target sequence
ttcatttgaacaaaagatagcatcaat

SEQ ID NO: 223991 - DNA, 27 bp, Artificial sequence
  SiRNA target sequence
tcatttgaacaaaagatagcatcaata

SEQ ID NO: 223992 - DNA, 27 bp, Artificial sequence
  SiRNA target sequence
catttgaacaaaagatagcatcaataa

SEQ ID NO: 223993 - DNA, 27 bp, Artificial sequence
  SiRNA target sequence
atttgaacaaaagatagcatcaataac

SEQ ID NO: 223994 - DNA, 27 bp, Artificial sequence
  SiRNA target sequence
tttgaacaaaagatagcatcaataact

SEQ ID NO: 223995 - DNA, 27 bp, Artificial sequence
  SiRNA target sequence
ttgaacaaaagatagcatcaataactg

SEQ ID NO: 223996 - DNA, 27 bp, Artificial sequence
  SiRNA target sequence
tgaacaaaagatagcatcaataactgt

SEQ ID NO: 223997 - DNA, 27 bp, Artificial sequence
  SiRNA target sequence
gaacaaaagatagcatcaataactgtt

SEQ ID NO: 223998 - DNA, 27 bp, Artificial sequence
  SiRNA target sequence
aacaaaagatagcatcaataactgtta

SEQ ID NO: 223999 - DNA, 27 bp, Artificial sequence
  SiRNA target sequence
acaaaagatagcatcaataactgttat

SEQ ID NO: 224000 - DNA, 27 bp, Artificial sequence
  SiRNA target sequence
caaaagatagcatcaataactgttatt

SEQ ID NO: 224001 - DNA, 27 bp, Artificial sequence
  SiRNA target sequence
aaaagatagcatcaataactgttatta

SEQ ID NO: 224002 - DNA, 27 bp, Artificial sequence
  SiRNA target sequence
aaagatagcatcaataactgttattat

SEQ ID NO: 224003 - DNA, 27 bp, Artificial sequence
  SiRNA target sequence
aagatagcatcaataactgttattatc

SEQ ID NO: 224004 - DNA, 27 bp, Artificial sequence
  SiRNA target sequence
agatagcatcaataactgttattatcc

SEQ ID NO: 224005 - DNA, 27 bp, Artificial sequence
  SiRNA target sequence
gatagcatcaataactgttattatcct

SEQ ID NO: 224006 - DNA, 27 bp, Artificial sequence
  SiRNA target sequence
atagcatcaataactgttattatcctg

SEQ ID NO: 224007 - DNA, 27 bp, Artificial sequence
  SiRNA target sequence
tagcatcaataactgttattatcctgc

SEQ ID NO: 224008 - DNA, 27 bp, Artificial sequence
  SiRNA target sequence
agcatcaataactgttattatcctgct

SEQ ID NO: 224009 - DNA, 27 bp, Artificial sequence
  SiRNA target sequence
gcatcaataactgttattatcctgctt

SEQ ID NO: 224010 - DNA, 27 bp, Artificial sequence
  SiRNA target sequence
catcaataactgttattatcctgcttt

SEQ ID NO: 224011 - DNA, 27 bp, Artificial sequence
  SiRNA target sequence
atcaataactgttattatcctgctttt

SEQ ID NO: 224012 - DNA, 27 bp, Artificial sequence
  SiRNA target sequence
tcaataactgttattatcctgctttta

SEQ ID NO: 224013 - DNA, 27 bp, Artificial sequence
  SiRNA target sequence
caataactgttattatcctgcttttat

SEQ ID NO: 224014 - DNA, 27 bp, Artificial sequence
  SiRNA target sequence
aataactgttattatcctgcttttatc

SEQ ID NO: 224015 - DNA, 27 bp, Artificial sequence
  SiRNA target sequence
ataactgttattatcctgcttttatca

SEQ ID NO: 224016 - DNA, 27 bp, Artificial sequence
  SiRNA target sequence
taactgttattatcctgcttttatcac

SEQ ID NO: 224017 - DNA, 27 bp, Artificial sequence
  SiRNA target sequence
aactgttattatcctgcttttatcacc

SEQ ID NO: 224018 - DNA, 27 bp, Artificial sequence
  SiRNA target sequence
actgttattatcctgcttttatcacca

SEQ ID NO: 224019 - DNA, 27 bp, Artificial sequence
  SiRNA target sequence
ctgttattatcctgcttttatcaccat

SEQ ID NO: 224020 - DNA, 27 bp, Artificial sequence
  SiRNA target sequence
tgttattatcctgcttttatcaccatt

SEQ ID NO: 224021 - DNA, 27 bp, Artificial sequence
  SiRNA target sequence
gttattatcctgcttttatcaccattt

SEQ ID NO: 224022 - DNA, 27 bp, Artificial sequence
  SiRNA target sequence
ttattatcctgcttttatcaccatttc

SEQ ID NO: 224023 - DNA, 27 bp, Artificial sequence
  SiRNA target sequence
tattatcctgcttttatcaccatttcc

SEQ ID NO: 224024 - DNA, 27 bp, Artificial sequence
  SiRNA target sequence
attatcctgcttttatcaccatttcca

SEQ ID NO: 224025 - DNA, 27 bp, Artificial sequence
  SiRNA target sequence
ttatcctgcttttatcaccatttccaa

SEQ ID NO: 224026 - DNA, 27 bp, Artificial sequence
  SiRNA target sequence
tatcctgcttttatcaccatttccaaa

SEQ ID NO: 224027 - DNA, 27 bp, Artificial sequence
  SiRNA target sequence
atcctgcttttatcaccatttccaaaa

SEQ ID NO: 224028 - DNA, 27 bp, Artificial sequence
  SiRNA target sequence
tcctgcttttatcaccatttccaaaat

SEQ ID NO: 224029 - DNA, 27 bp, Artificial sequence
  SiRNA target sequence
cctgcttttatcaccatttccaaaatt

SEQ ID NO: 224030 - DNA, 27 bp, Artificial sequence
  SiRNA target sequence
ctgcttttatcaccatttccaaaatta

SEQ ID NO: 224031 - DNA, 27 bp, Artificial sequence
  SiRNA target sequence
tgcttttatcaccatttccaaaattaa

SEQ ID NO: 224032 - DNA, 27 bp, Artificial sequence
  SiRNA target sequence
gcttttatcaccatttccaaaattaat

SEQ ID NO: 224033 - DNA, 27 bp, Artificial sequence
  SiRNA target sequence
cttttatcaccatttccaaaattaata

SEQ ID NO: 224034 - DNA, 27 bp, Artificial sequence
  SiRNA target sequence
ttttatcaccatttccaaaattaatac

SEQ ID NO: 224035 - DNA, 27 bp, Artificial sequence
  SiRNA target sequence
tttatcaccatttccaaaattaataca

SEQ ID NO: 224036 - DNA, 27 bp, Artificial sequence
  SiRNA target sequence
ttatcaccatttccaaaattaatacaa

SEQ ID NO: 224037 - DNA, 27 bp, Artificial sequence
  SiRNA target sequence
tatcaccatttccaaaattaatacaaa

SEQ ID NO: 224038 - DNA, 27 bp, Artificial sequence
  SiRNA target sequence
atcaccatttccaaaattaatacaaac

SEQ ID NO: 224039 - DNA, 27 bp, Artificial sequence
  SiRNA target sequence
tcaccatttccaaaattaatacaaacc

SEQ ID NO: 224040 - DNA, 27 bp, Artificial sequence
  SiRNA target sequence
caccatttccaaaattaatacaaacca

SEQ ID NO: 224041 - DNA, 27 bp, Artificial sequence
  SiRNA target sequence
accatttccaaaattaatacaaaccaa

SEQ ID NO: 224042 - DNA, 27 bp, Artificial sequence
  SiRNA target sequence
ccatttccaaaattaatacaaaccaaa

SEQ ID NO: 224043 - DNA, 27 bp, Artificial sequence
  SiRNA target sequence
catttccaaaattaatacaaaccaaag

SEQ ID NO: 224044 - DNA, 27 bp, Artificial sequence
  SiRNA target sequence
atttccaaaattaatacaaaccaaagg

SEQ ID NO: 224045 - DNA, 27 bp, Artificial sequence
  SiRNA target sequence
tttccaaaattaatacaaaccaaagga

SEQ ID NO: 224046 - DNA, 27 bp, Artificial sequence
  SiRNA target sequence
ttccaaaattaatacaaaccaaaggat

SEQ ID NO: 224047 - DNA, 27 bp, Artificial sequence
  SiRNA target sequence
tccaaaattaatacaaaccaaaggatg

SEQ ID NO: 224048 - DNA, 27 bp, Artificial sequence
  SiRNA target sequence
ccaaaattaatacaaaccaaaggatgg

SEQ ID NO: 224049 - DNA, 27 bp, Artificial sequence
  SiRNA target sequence
caaaattaatacaaaccaaaggatgga

SEQ ID NO: 224050 - DNA, 27 bp, Artificial sequence
  SiRNA target sequence
aaaattaatacaaaccaaaggatggat

SEQ ID NO: 224051 - DNA, 27 bp, Artificial sequence
  SiRNA target sequence
aaattaatacaaaccaaaggatggata

SEQ ID NO: 224052 - DNA, 27 bp, Artificial sequence
  SiRNA target sequence
aattaatacaaaccaaaggatggatat

SEQ ID NO: 224053 - DNA, 27 bp, Artificial sequence
  SiRNA target sequence
attaatacaaaccaaaggatggatatt

SEQ ID NO: 224054 - DNA, 27 bp, Artificial sequence
  SiRNA target sequence
ttaatacaaaccaaaggatggatattt

SEQ ID NO: 224055 - DNA, 27 bp, Artificial sequence
  SiRNA target sequence
taatacaaaccaaaggatggatatttg

SEQ ID NO: 224056 - DNA, 27 bp, Artificial sequence
  SiRNA target sequence
aatacaaaccaaaggatggatatttgt

SEQ ID NO: 224057 - DNA, 27 bp, Artificial sequence
  SiRNA target sequence
atacaaaccaaaggatggatatttgtt

SEQ ID NO: 224058 - DNA, 27 bp, Artificial sequence
  SiRNA target sequence
tacaaaccaaaggatggatatttgttg

SEQ ID NO: 224059 - DNA, 27 bp, Artificial sequence
  SiRNA target sequence
acaaaccaaaggatggatatttgttgc

SEQ ID NO: 224060 - DNA, 27 bp, Artificial sequence
  SiRNA target sequence
caaaccaaaggatggatatttgttgcc

SEQ ID NO: 224061 - DNA, 27 bp, Artificial sequence
  SiRNA target sequence
aaaccaaaggatggatatttgttgcca

SEQ ID NO: 224062 - DNA, 27 bp, Artificial sequence
  SiRNA target sequence
aaccaaaggatggatatttgttgccat

SEQ ID NO: 224063 - DNA, 27 bp, Artificial sequence
  SiRNA target sequence
accaaaggatggatatttgttgccata

SEQ ID NO: 224064 - DNA, 27 bp, Artificial sequence
  SiRNA target sequence
ccaaaggatggatatttgttgccatag

SEQ ID NO: 224065 - DNA, 27 bp, Artificial sequence
  SiRNA target sequence
caaaggatggatatttgttgccatagc

SEQ ID NO: 224066 - DNA, 27 bp, Artificial sequence
  SiRNA target sequence
aaaggatggatatttgttgccatagcg

SEQ ID NO: 224067 - DNA, 27 bp, Artificial sequence
  SiRNA target sequence
aaggatggatatttgttgccatagcgt

SEQ ID NO: 224068 - DNA, 27 bp, Artificial sequence
  SiRNA target sequence
aggatggatatttgttgccatagcgtg

SEQ ID NO: 224069 - DNA, 27 bp, Artificial sequence
  SiRNA target sequence
ggatggatatttgttgccatagcgtgc

SEQ ID NO: 224070 - DNA, 27 bp, Artificial sequence
  SiRNA target sequence
gatggatatttgttgccatagcgtgcc

SEQ ID NO: 224071 - DNA, 27 bp, Artificial sequence
  SiRNA target sequence
atggatatttgttgccatagcgtgccc

SEQ ID NO: 224072 - DNA, 27 bp, Artificial sequence
  SiRNA target sequence
tggatatttgttgccatagcgtgccca

SEQ ID NO: 224073 - DNA, 27 bp, Artificial sequence
  SiRNA target sequence
ggatatttgttgccatagcgtgcccac

SEQ ID NO: 224074 - DNA, 27 bp, Artificial sequence
  SiRNA target sequence
gatatttgttgccatagcgtgcccact

SEQ ID NO: 224075 - DNA, 27 bp, Artificial sequence
  SiRNA target sequence
atatttgttgccatagcgtgcccactt

SEQ ID NO: 224076 - DNA, 27 bp, Artificial sequence
  SiRNA target sequence
tatttgttgccatagcgtgcccactta

SEQ ID NO: 224077 - DNA, 27 bp, Artificial sequence
  SiRNA target sequence
atttgttgccatagcgtgcccacttat

SEQ ID NO: 224078 - DNA, 27 bp, Artificial sequence
  SiRNA target sequence
tttgttgccatagcgtgcccacttatt

SEQ ID NO: 224079 - DNA, 27 bp, Artificial sequence
  SiRNA target sequence
ttgttgccatagcgtgcccacttatta

SEQ ID NO: 224080 - DNA, 27 bp, Artificial sequence
  SiRNA target sequence
tgttgccatagcgtgcccacttattac

SEQ ID NO: 224081 - DNA, 27 bp, Artificial sequence
  SiRNA target sequence
gttgccatagcgtgcccacttattacc

SEQ ID NO: 224082 - DNA, 27 bp, Artificial sequence
  SiRNA target sequence
ttgccatagcgtgcccacttattaccc

SEQ ID NO: 224083 - DNA, 27 bp, Artificial sequence
  SiRNA target sequence
tgccatagcgtgcccacttattaccct

SEQ ID NO: 224084 - DNA, 27 bp, Artificial sequence
  SiRNA target sequence
gccatagcgtgcccacttattaccctt

SEQ ID NO: 224085 - DNA, 27 bp, Artificial sequence
  SiRNA target sequence
ccatagcgtgcccacttattacccttt

SEQ ID NO: 224086 - DNA, 27 bp, Artificial sequence
  SiRNA target sequence
catagcgtgcccacttattaccctttt

SEQ ID NO: 224087 - DNA, 27 bp, Artificial sequence
  SiRNA target sequence
atagcgtgcccacttattacccttttt

SEQ ID NO: 224088 - DNA, 27 bp, Artificial sequence
  SiRNA target sequence
tagcgtgcccacttattaccctttttg

SEQ ID NO: 224089 - DNA, 27 bp, Artificial sequence
  SiRNA target sequence
agcgtgcccacttattaccctttttgc

SEQ ID NO: 224090 - DNA, 27 bp, Artificial sequence
  SiRNA target sequence
gcgtgcccacttattaccctttttgct

SEQ ID NO: 224091 - DNA, 27 bp, Artificial sequence
  SiRNA target sequence
cgtgcccacttattaccctttttgctg

SEQ ID NO: 224092 - DNA, 27 bp, Artificial sequence
  SiRNA target sequence
gtgcccacttattaccctttttgctgt

SEQ ID NO: 224093 - DNA, 27 bp, Artificial sequence
  SiRNA target sequence
tgcccacttattaccctttttgctgta

SEQ ID NO: 224094 - DNA, 27 bp, Artificial sequence
  SiRNA target sequence
gcccacttattaccctttttgctgtag

SEQ ID NO: 224095 - DNA, 27 bp, Artificial sequence
  SiRNA target sequence
cccacttattaccctttttgctgtagt

SEQ ID NO: 224096 - DNA, 27 bp, Artificial sequence
  SiRNA target sequence
ccacttattaccctttttgctgtagtt

SEQ ID NO: 224097 - DNA, 27 bp, Artificial sequence
  SiRNA target sequence
cacttattaccctttttgctgtagttt

SEQ ID NO: 224098 - DNA, 27 bp, Artificial sequence
  SiRNA target sequence
acttattaccctttttgctgtagtttc

SEQ ID NO: 224099 - DNA, 27 bp, Artificial sequence
  SiRNA target sequence
cttattaccctttttgctgtagtttct

SEQ ID NO: 224100 - DNA, 27 bp, Artificial sequence
  SiRNA target sequence
ttattaccctttttgctgtagtttctg

SEQ ID NO: 224101 - DNA, 27 bp, Artificial sequence
  SiRNA target sequence
tattaccctttttgctgtagtttctgt

SEQ ID NO: 224102 - DNA, 27 bp, Artificial sequence
  SiRNA target sequence
attaccctttttgctgtagtttctgtg

SEQ ID NO: 224103 - DNA, 27 bp, Artificial sequence
  SiRNA target sequence
ttaccctttttgctgtagtttctgtgt

SEQ ID NO: 224104 - DNA, 27 bp, Artificial sequence
  SiRNA target sequence
taccctttttgctgtagtttctgtgtg

SEQ ID NO: 224105 - DNA, 27 bp, Artificial sequence
  SiRNA target sequence
accctttttgctgtagtttctgtgtgt

SEQ ID NO: 224106 - DNA, 27 bp, Artificial sequence
  SiRNA target sequence
ccctttttgctgtagtttctgtgtgtg

SEQ ID NO: 224107 - DNA, 27 bp, Artificial sequence
  SiRNA target sequence
cctttttgctgtagtttctgtgtgtgg

SEQ ID NO: 224108 - DNA, 27 bp, Artificial sequence
  SiRNA target sequence
ctttttgctgtagtttctgtgtgtggt

SEQ ID NO: 224109 - DNA, 27 bp, Artificial sequence
  SiRNA target sequence
tttttgctgtagtttctgtgtgtggtc

SEQ ID NO: 224110 - DNA, 27 bp, Artificial sequence
  SiRNA target sequence
ttttgctgtagtttctgtgtgtggtct

SEQ ID NO: 224111 - DNA, 27 bp, Artificial sequence
  SiRNA target sequence
tttgctgtagtttctgtgtgtggtctt

SEQ ID NO: 224112 - DNA, 27 bp, Artificial sequence
  SiRNA target sequence
ttgctgtagtttctgtgtgtggtcttg

SEQ ID NO: 224113 - DNA, 27 bp, Artificial sequence
  SiRNA target sequence
tgctgtagtttctgtgtgtggtcttgc

SEQ ID NO: 224114 - DNA, 27 bp, Artificial sequence
  SiRNA target sequence
gctgtagtttctgtgtgtggtcttgct

SEQ ID NO: 224115 - DNA, 27 bp, Artificial sequence
  SiRNA target sequence
ctgtagtttctgtgtgtggtcttgctt

SEQ ID NO: 224116 - DNA, 27 bp, Artificial sequence
  SiRNA target sequence
tgtagtttctgtgtgtggtcttgcttt

SEQ ID NO: 224117 - DNA, 27 bp, Artificial sequence
  SiRNA target sequence
gtagtttctgtgtgtggtcttgctttt

SEQ ID NO: 224118 - DNA, 27 bp, Artificial sequence
  SiRNA target sequence
tagtttctgtgtgtggtcttgcttttt

SEQ ID NO: 224119 - DNA, 27 bp, Artificial sequence
  SiRNA target sequence
agtttctgtgtgtggtcttgcttttta

SEQ ID NO: 224120 - DNA, 27 bp, Artificial sequence
  SiRNA target sequence
gtttctgtgtgtggtcttgctttttac

SEQ ID NO: 224121 - DNA, 27 bp, Artificial sequence
  SiRNA target sequence
tttctgtgtgtggtcttgctttttaca

SEQ ID NO: 224122 - DNA, 27 bp, Artificial sequence
  SiRNA target sequence
ttctgtgtgtggtcttgctttttacaa

SEQ ID NO: 224123 - DNA, 27 bp, Artificial sequence
  SiRNA target sequence
tctgtgtgtggtcttgctttttacaat

SEQ ID NO: 224124 - DNA, 27 bp, Artificial sequence
  SiRNA target sequence
ctgtgtgtggtcttgctttttacaatt

SEQ ID NO: 224125 - DNA, 27 bp, Artificial sequence
  SiRNA target sequence
tgtgtgtggtcttgctttttacaatta

SEQ ID NO: 224126 - DNA, 27 bp, Artificial sequence
  SiRNA target sequence
gtgtgtggtcttgctttttacaattat

SEQ ID NO: 224127 - DNA, 27 bp, Artificial sequence
  SiRNA target sequence
tgtgtggtcttgctttttacaattatc

SEQ ID NO: 224128 - DNA, 27 bp, Artificial sequence
  SiRNA target sequence
gtgtggtcttgctttttacaattatcc

SEQ ID NO: 224129 - DNA, 27 bp, Artificial sequence
  SiRNA target sequence
tgtggtcttgctttttacaattatccg

SEQ ID NO: 224130 - DNA, 27 bp, Artificial sequence
  SiRNA target sequence
gtggtcttgctttttacaattatccgg

SEQ ID NO: 224131 - DNA, 27 bp, Artificial sequence
  SiRNA target sequence
tggtcttgctttttacaattatccggc

SEQ ID NO: 224132 - DNA, 27 bp, Artificial sequence
  SiRNA target sequence
ggtcttgctttttacaattatccggca

SEQ ID NO: 224133 - DNA, 27 bp, Artificial sequence
  SiRNA target sequence
gtcttgctttttacaattatccggcaa

SEQ ID NO: 224134 - DNA, 27 bp, Artificial sequence
  SiRNA target sequence
tcttgctttttacaattatccggcaac

SEQ ID NO: 224135 - DNA, 27 bp, Artificial sequence
  SiRNA target sequence
cttgctttttacaattatccggcaaca

SEQ ID NO: 224136 - DNA, 27 bp, Artificial sequence
  SiRNA target sequence
ttgctttttacaattatccggcaacaa

SEQ ID NO: 224137 - DNA, 27 bp, Artificial sequence
  SiRNA target sequence
tgctttttacaattatccggcaacaaa

SEQ ID NO: 224138 - DNA, 27 bp, Artificial sequence
  SiRNA target sequence
gctttttacaattatccggcaacaaat

SEQ ID NO: 224139 - DNA, 27 bp, Artificial sequence
  SiRNA target sequence
ctttttacaattatccggcaacaaata

SEQ ID NO: 224140 - DNA, 27 bp, Artificial sequence
  SiRNA target sequence
tttttacaattatccggcaacaaataa

SEQ ID NO: 224141 - DNA, 27 bp, Artificial sequence
  SiRNA target sequence
ttttacaattatccggcaacaaataat

SEQ ID NO: 224142 - DNA, 27 bp, Artificial sequence
  SiRNA target sequence
tttacaattatccggcaacaaataatg

SEQ ID NO: 224143 - DNA, 27 bp, Artificial sequence
  SiRNA target sequence
ttacaattatccggcaacaaataatga

SEQ ID NO: 224144 - DNA, 27 bp, Artificial sequence
  SiRNA target sequence
tacaattatccggcaacaaataatgac

SEQ ID NO: 224145 - DNA, 27 bp, Artificial sequence
  SiRNA target sequence
acaattatccggcaacaaataatgaca

SEQ ID NO: 224146 - DNA, 27 bp, Artificial sequence
  SiRNA target sequence
caattatccggcaacaaataatgacac

SEQ ID NO: 224147 - DNA, 27 bp, Artificial sequence
  SiRNA target sequence
aattatccggcaacaaataatgacaca

SEQ ID NO: 224148 - DNA, 27 bp, Artificial sequence
  SiRNA target sequence
attatccggcaacaaataatgacacaa

SEQ ID NO: 224149 - DNA, 27 bp, Artificial sequence
  SiRNA target sequence
ttatccggcaacaaataatgacacaaa

SEQ ID NO: 224150 - DNA, 27 bp, Artificial sequence
  SiRNA target sequence
tatccggcaacaaataatgacacaaat

SEQ ID NO: 224151 - DNA, 27 bp, Artificial sequence
  SiRNA target sequence
atccggcaacaaataatgacacaaatt

SEQ ID NO: 224152 - DNA, 27 bp, Artificial sequence
  SiRNA target sequence
tccggcaacaaataatgacacaaattt

SEQ ID NO: 224153 - DNA, 27 bp, Artificial sequence
  SiRNA target sequence
ccggcaacaaataatgacacaaatttt

SEQ ID NO: 224154 - DNA, 27 bp, Artificial sequence
  SiRNA target sequence
cggcaacaaataatgacacaaattttt

SEQ ID NO: 224155 - DNA, 27 bp, Artificial sequence
  SiRNA target sequence
ggcaacaaataatgacacaaatttttt

SEQ ID NO: 224156 - DNA, 27 bp, Artificial sequence
  SiRNA target sequence
gcaacaaataatgacacaaattttttt

SEQ ID NO: 224157 - DNA, 27 bp, Artificial sequence
  SiRNA target sequence
caacaaataatgacacaaatttttttc

SEQ ID NO: 224158 - DNA, 27 bp, Artificial sequence
  SiRNA target sequence
aacaaataatgacacaaatttttttct

SEQ ID NO: 224159 - DNA, 27 bp, Artificial sequence
  SiRNA target sequence
acaaataatgacacaaatttttttcta

SEQ ID NO: 224160 - DNA, 27 bp, Artificial sequence
  SiRNA target sequence
caaataatgacacaaatttttttctaa

SEQ ID NO: 224161 - DNA, 27 bp, Artificial sequence
  SiRNA target sequence
aaataatgacacaaatttttttctaaa

SEQ ID NO: 224162 - DNA, 27 bp, Artificial sequence
  SiRNA target sequence
aataatgacacaaatttttttctaaat

SEQ ID NO: 224163 - DNA, 27 bp, Artificial sequence
  SiRNA target sequence
ataatgacacaaatttttttctaaatt

SEQ ID NO: 224164 - DNA, 27 bp, Artificial sequence
  SiRNA target sequence
taatgacacaaatttttttctaaattc

SEQ ID NO: 224165 - DNA, 27 bp, Artificial sequence
  SiRNA target sequence
aatgacacaaatttttttctaaattca

SEQ ID NO: 224166 - DNA, 27 bp, Artificial sequence
  SiRNA target sequence
atgacacaaatttttttctaaattcat

SEQ ID NO: 224167 - DNA, 27 bp, Artificial sequence
  SiRNA target sequence
tgacacaaatttttttctaaattcatt

SEQ ID NO: 224168 - DNA, 27 bp, Artificial sequence
  SiRNA target sequence
gacacaaatttttttctaaattcatta

SEQ ID NO: 224169 - DNA, 27 bp, Artificial sequence
  SiRNA target sequence
acacaaatttttttctaaattcattat

SEQ ID NO: 224170 - DNA, 27 bp, Artificial sequence
  SiRNA target sequence
cacaaatttttttctaaattcattatg

SEQ ID NO: 224171 - DNA, 27 bp, Artificial sequence
  SiRNA target sequence
acaaatttttttctaaattcattatgt

SEQ ID NO: 224172 - DNA, 27 bp, Artificial sequence
  SiRNA target sequence
caaatttttttctaaattcattatgtg

SEQ ID NO: 224173 - DNA, 27 bp, Artificial sequence
  SiRNA target sequence
aaatttttttctaaattcattatgtgc

SEQ ID NO: 224174 - DNA, 27 bp, Artificial sequence
  SiRNA target sequence
aatttttttctaaattcattatgtgct

SEQ ID NO: 224175 - DNA, 27 bp, Artificial sequence
  SiRNA target sequence
atttttttctaaattcattatgtgcta

SEQ ID NO: 224176 - DNA, 27 bp, Artificial sequence
  SiRNA target sequence
tttttttctaaattcattatgtgctac

SEQ ID NO: 224177 - DNA, 27 bp, Artificial sequence
  SiRNA target sequence
ttttttctaaattcattatgtgctacg

SEQ ID NO: 224178 - DNA, 27 bp, Artificial sequence
  SiRNA target sequence
tttttctaaattcattatgtgctacgc

SEQ ID NO: 224179 - DNA, 27 bp, Artificial sequence
  SiRNA target sequence
ttttctaaattcattatgtgctacgcc

SEQ ID NO: 224180 - DNA, 27 bp, Artificial sequence
  SiRNA target sequence
tttctaaattcattatgtgctacgccc

SEQ ID NO: 224181 - DNA, 27 bp, Artificial sequence
  SiRNA target sequence
ttctaaattcattatgtgctacgcccg

SEQ ID NO: 224182 - DNA, 27 bp, Artificial sequence
  SiRNA target sequence
tctaaattcattatgtgctacgcccgg

SEQ ID NO: 224183 - DNA, 27 bp, Artificial sequence
  SiRNA target sequence
ctaaattcattatgtgctacgcccggt

SEQ ID NO: 224184 - DNA, 27 bp, Artificial sequence
  SiRNA target sequence
taaattcattatgtgctacgcccggta

SEQ ID NO: 224185 - DNA, 27 bp, Artificial sequence
  SiRNA target sequence
aaattcattatgtgctacgcccggtaa

SEQ ID NO: 224186 - DNA, 27 bp, Artificial sequence
  SiRNA target sequence
aattcattatgtgctacgcccggtaaa

SEQ ID NO: 224187 - DNA, 27 bp, Artificial sequence
  SiRNA target sequence
attcattatgtgctacgcccggtaaat

SEQ ID NO: 224188 - DNA, 27 bp, Artificial sequence
  SiRNA target sequence
ttcattatgtgctacgcccggtaaatc

SEQ ID NO: 224189 - DNA, 27 bp, Artificial sequence
  SiRNA target sequence
tcattatgtgctacgcccggtaaatcg

SEQ ID NO: 224190 - DNA, 27 bp, Artificial sequence
  SiRNA target sequence
cattatgtgctacgcccggtaaatcgt

SEQ ID NO: 224191 - DNA, 27 bp, Artificial sequence
  SiRNA target sequence
attatgtgctacgcccggtaaatcgtt

SEQ ID NO: 224192 - DNA, 27 bp, Artificial sequence
  SiRNA target sequence
ttatgtgctacgcccggtaaatcgttt

SEQ ID NO: 224193 - DNA, 27 bp, Artificial sequence
  SiRNA target sequence
tatgtgctacgcccggtaaatcgttta

SEQ ID NO: 224194 - DNA, 27 bp, Artificial sequence
  SiRNA target sequence
atgtgctacgcccggtaaatcgtttat

SEQ ID NO: 224195 - DNA, 27 bp, Artificial sequence
  SiRNA target sequence
tgtgctacgcccggtaaatcgtttata

SEQ ID NO: 224196 - DNA, 27 bp, Artificial sequence
  SiRNA target sequence
gtgctacgcccggtaaatcgtttataa

SEQ ID NO: 224197 - DNA, 27 bp, Artificial sequence
  SiRNA target sequence
tgctacgcccggtaaatcgtttataaa

SEQ ID NO: 224198 - DNA, 27 bp, Artificial sequence
  SiRNA target sequence
gctacgcccggtaaatcgtttataaaa

SEQ ID NO: 224199 - DNA, 27 bp, Artificial sequence
  SiRNA target sequence
ctacgcccggtaaatcgtttataaaat

SEQ ID NO: 224200 - DNA, 27 bp, Artificial sequence
  SiRNA target sequence
tacgcccggtaaatcgtttataaaatt

SEQ ID NO: 224201 - DNA, 27 bp, Artificial sequence
  SiRNA target sequence
acgcccggtaaatcgtttataaaatta

SEQ ID NO: 224202 - DNA, 27 bp, Artificial sequence
  SiRNA target sequence
cgcccggtaaatcgtttataaaattag

SEQ ID NO: 224203 - DNA, 27 bp, Artificial sequence
  SiRNA target sequence
gcccggtaaatcgtttataaaattaga

SEQ ID NO: 224204 - DNA, 27 bp, Artificial sequence
  SiRNA target sequence
cccggtaaatcgtttataaaattagaa

SEQ ID NO: 224205 - DNA, 27 bp, Artificial sequence
  SiRNA target sequence
ccggtaaatcgtttataaaattagaaa

SEQ ID NO: 224206 - DNA, 27 bp, Artificial sequence
  SiRNA target sequence
cggtaaatcgtttataaaattagaaaa

SEQ ID NO: 224207 - DNA, 27 bp, Artificial sequence
  SiRNA target sequence
ggtaaatcgtttataaaattagaaaat

SEQ ID NO: 224208 - DNA, 27 bp, Artificial sequence
  SiRNA target sequence
gtaaatcgtttataaaattagaaaatg

SEQ ID NO: 224209 - DNA, 27 bp, Artificial sequence
  SiRNA target sequence
taaatcgtttataaaattagaaaatgt

SEQ ID NO: 224210 - DNA, 27 bp, Artificial sequence
  SiRNA target sequence
aaatcgtttataaaattagaaaatgtt

SEQ ID NO: 224211 - DNA, 27 bp, Artificial sequence
  SiRNA target sequence
aatcgtttataaaattagaaaatgttt

SEQ ID NO: 224212 - DNA, 27 bp, Artificial sequence
  SiRNA target sequence
atcgtttataaaattagaaaatgtttt

SEQ ID NO: 224213 - DNA, 27 bp, Artificial sequence
  SiRNA target sequence
tcgtttataaaattagaaaatgtttta

SEQ ID NO: 224214 - DNA, 27 bp, Artificial sequence
  SiRNA target sequence
cgtttataaaattagaaaatgttttag

SEQ ID NO: 224215 - DNA, 27 bp, Artificial sequence
  SiRNA target sequence
gtttataaaattagaaaatgttttagg

SEQ ID NO: 224216 - DNA, 27 bp, Artificial sequence
  SiRNA target sequence
tttataaaattagaaaatgttttagga

SEQ ID NO: 224217 - DNA, 27 bp, Artificial sequence
  SiRNA target sequence
ttataaaattagaaaatgttttaggat

SEQ ID NO: 224218 - DNA, 27 bp, Artificial sequence
  SiRNA target sequence
tataaaattagaaaatgttttaggatg

SEQ ID NO: 224219 - DNA, 27 bp, Artificial sequence
  SiRNA target sequence
ataaaattagaaaatgttttaggatgt

SEQ ID NO: 224220 - DNA, 27 bp, Artificial sequence
  SiRNA target sequence
taaaattagaaaatgttttaggatgtg

SEQ ID NO: 224221 - DNA, 27 bp, Artificial sequence
  SiRNA target sequence
aaaattagaaaatgttttaggatgtgt

SEQ ID NO: 224222 - DNA, 27 bp, Artificial sequence
  SiRNA target sequence
aaattagaaaatgttttaggatgtgta

SEQ ID NO: 224223 - DNA, 27 bp, Artificial sequence
  SiRNA target sequence
aattagaaaatgttttaggatgtgtag

SEQ ID NO: 224224 - DNA, 27 bp, Artificial sequence
  SiRNA target sequence
attagaaaatgttttaggatgtgtagc

SEQ ID NO: 224225 - DNA, 27 bp, Artificial sequence
  SiRNA target sequence
ttagaaaatgttttaggatgtgtagct

SEQ ID NO: 224226 - DNA, 27 bp, Artificial sequence
  SiRNA target sequence
tagaaaatgttttaggatgtgtagctg

SEQ ID NO: 224227 - DNA, 27 bp, Artificial sequence
  SiRNA target sequence
agaaaatgttttaggatgtgtagctgt

SEQ ID NO: 224228 - DNA, 27 bp, Artificial sequence
  SiRNA target sequence
gaaaatgttttaggatgtgtagctgta

SEQ ID NO: 224229 - DNA, 27 bp, Artificial sequence
  SiRNA target sequence
aaaatgttttaggatgtgtagctgtag

SEQ ID NO: 224230 - DNA, 27 bp, Artificial sequence
  SiRNA target sequence
aaatgttttaggatgtgtagctgtagc

SEQ ID NO: 224231 - DNA, 27 bp, Artificial sequence
  SiRNA target sequence
aatgttttaggatgtgtagctgtagct

SEQ ID NO: 224232 - DNA, 27 bp, Artificial sequence
  SiRNA target sequence
atgttttaggatgtgtagctgtagctc

SEQ ID NO: 224233 - DNA, 27 bp, Artificial sequence
  SiRNA target sequence
tgttttaggatgtgtagctgtagctct

SEQ ID NO: 224234 - DNA, 27 bp, Artificial sequence
  SiRNA target sequence
gttttaggatgtgtagctgtagctctt

SEQ ID NO: 224235 - DNA, 27 bp, Artificial sequence
  SiRNA target sequence
ttttaggatgtgtagctgtagctctta

SEQ ID NO: 224236 - DNA, 27 bp, Artificial sequence
  SiRNA target sequence
tttaggatgtgtagctgtagctcttat

SEQ ID NO: 224237 - DNA, 27 bp, Artificial sequence
  SiRNA target sequence
ttaggatgtgtagctgtagctcttatg

SEQ ID NO: 224238 - DNA, 27 bp, Artificial sequence
  SiRNA target sequence
taggatgtgtagctgtagctcttatga

SEQ ID NO: 224239 - DNA, 27 bp, Artificial sequence
  SiRNA target sequence
aggatgtgtagctgtagctcttatgaa

SEQ ID NO: 224240 - DNA, 27 bp, Artificial sequence
  SiRNA target sequence
ggatgtgtagctgtagctcttatgaaa

SEQ ID NO: 224241 - DNA, 27 bp, Artificial sequence
  SiRNA target sequence
gatgtgtagctgtagctcttatgaaag

SEQ ID NO: 224242 - DNA, 27 bp, Artificial sequence
  SiRNA target sequence
atgtgtagctgtagctcttatgaaagt

SEQ ID NO: 224243 - DNA, 27 bp, Artificial sequence
  SiRNA target sequence
tgtgtagctgtagctcttatgaaagta

SEQ ID NO: 224244 - DNA, 27 bp, Artificial sequence
  SiRNA target sequence
gtgtagctgtagctcttatgaaagtag

SEQ ID NO: 224245 - DNA, 27 bp, Artificial sequence
  SiRNA target sequence
tgtagctgtagctcttatgaaagtagc

SEQ ID NO: 224246 - DNA, 27 bp, Artificial sequence
  SiRNA target sequence
gtagctgtagctcttatgaaagtagca

SEQ ID NO: 224247 - DNA, 27 bp, Artificial sequence
  SiRNA target sequence
tagctgtagctcttatgaaagtagcaa

SEQ ID NO: 224248 - DNA, 27 bp, Artificial sequence
  SiRNA target sequence
agctgtagctcttatgaaagtagcaaa

SEQ ID NO: 224249 - DNA, 27 bp, Artificial sequence
  SiRNA target sequence
gctgtagctcttatgaaagtagcaaaa

SEQ ID NO: 224250 - DNA, 27 bp, Artificial sequence
  SiRNA target sequence
ctgtagctcttatgaaagtagcaaaat

SEQ ID NO: 224251 - DNA, 27 bp, Artificial sequence
  SiRNA target sequence
tgtagctcttatgaaagtagcaaaata

SEQ ID NO: 224252 - DNA, 27 bp, Artificial sequence
  SiRNA target sequence
gtagctcttatgaaagtagcaaaatat

SEQ ID NO: 224253 - DNA, 27 bp, Artificial sequence
  SiRNA target sequence
tagctcttatgaaagtagcaaaatatg

SEQ ID NO: 224254 - DNA, 27 bp, Artificial sequence
  SiRNA target sequence
agctcttatgaaagtagcaaaatatgg

SEQ ID NO: 224255 - DNA, 27 bp, Artificial sequence
  SiRNA target sequence
gctcttatgaaagtagcaaaatatggc

SEQ ID NO: 224256 - DNA, 27 bp, Artificial sequence
  SiRNA target sequence
ctcttatgaaagtagcaaaatatggct

SEQ ID NO: 224257 - DNA, 27 bp, Artificial sequence
  SiRNA target sequence
tcttatgaaagtagcaaaatatggctc

SEQ ID NO: 224258 - DNA, 27 bp, Artificial sequence
  SiRNA target sequence
cttatgaaagtagcaaaatatggctct

SEQ ID NO: 224259 - DNA, 27 bp, Artificial sequence
  SiRNA target sequence
ttatgaaagtagcaaaatatggctctt

SEQ ID NO: 224260 - DNA, 27 bp, Artificial sequence
  SiRNA target sequence
tatgaaagtagcaaaatatggctcttt

SEQ ID NO: 224261 - DNA, 27 bp, Artificial sequence
  SiRNA target sequence
atgaaagtagcaaaatatggctctttt

SEQ ID NO: 224262 - DNA, 27 bp, Artificial sequence
  SiRNA target sequence
tgaaagtagcaaaatatggctcttttg

SEQ ID NO: 224263 - DNA, 27 bp, Artificial sequence
  SiRNA target sequence
gaaagtagcaaaatatggctcttttga

SEQ ID NO: 224264 - DNA, 27 bp, Artificial sequence
  SiRNA target sequence
aaagtagcaaaatatggctcttttgat

SEQ ID NO: 224265 - DNA, 27 bp, Artificial sequence
  SiRNA target sequence
aagtagcaaaatatggctcttttgata

SEQ ID NO: 224266 - DNA, 27 bp, Artificial sequence
  SiRNA target sequence
agtagcaaaatatggctcttttgatat

SEQ ID NO: 224267 - DNA, 27 bp, Artificial sequence
  SiRNA target sequence
gtagcaaaatatggctcttttgatatt

SEQ ID NO: 224268 - DNA, 27 bp, Artificial sequence
  SiRNA target sequence
tagcaaaatatggctcttttgatattt

SEQ ID NO: 224269 - DNA, 27 bp, Artificial sequence
  SiRNA target sequence
agcaaaatatggctcttttgatatttc

SEQ ID NO: 224270 - DNA, 27 bp, Artificial sequence
  SiRNA target sequence
gcaaaatatggctcttttgatatttcc

SEQ ID NO: 224271 - DNA, 27 bp, Artificial sequence
  SiRNA target sequence
caaaatatggctcttttgatatttcca

SEQ ID NO: 224272 - DNA, 27 bp, Artificial sequence
  SiRNA target sequence
aaaatatggctcttttgatatttccaa

SEQ ID NO: 224273 - DNA, 27 bp, Artificial sequence
  SiRNA target sequence
aaatatggctcttttgatatttccaaa

SEQ ID NO: 224274 - DNA, 27 bp, Artificial sequence
  SiRNA target sequence
aatatggctcttttgatatttccaaag

SEQ ID NO: 224275 - DNA, 27 bp, Artificial sequence
  SiRNA target sequence
atatggctcttttgatatttccaaaga

SEQ ID NO: 224276 - DNA, 27 bp, Artificial sequence
  SiRNA target sequence
tatggctcttttgatatttccaaagaa

SEQ ID NO: 224277 - DNA, 27 bp, Artificial sequence
  SiRNA target sequence
atggctcttttgatatttccaaagaag

SEQ ID NO: 224278 - DNA, 27 bp, Artificial sequence
  SiRNA target sequence
tggctcttttgatatttccaaagaagc

SEQ ID NO: 224279 - DNA, 27 bp, Artificial sequence
  SiRNA target sequence
ggctcttttgatatttccaaagaagcc

SEQ ID NO: 224280 - DNA, 27 bp, Artificial sequence
  SiRNA target sequence
gctcttttgatatttccaaagaagcca

SEQ ID NO: 224281 - DNA, 27 bp, Artificial sequence
  SiRNA target sequence
ctcttttgatatttccaaagaagccat

SEQ ID NO: 224282 - DNA, 27 bp, Artificial sequence
  SiRNA target sequence
tcttttgatatttccaaagaagccatt

SEQ ID NO: 224283 - DNA, 27 bp, Artificial sequence
  SiRNA target sequence
cttttgatatttccaaagaagccattt

SEQ ID NO: 224284 - DNA, 27 bp, Artificial sequence
  SiRNA target sequence
ttttgatatttccaaagaagccatttc

SEQ ID NO: 224285 - DNA, 27 bp, Artificial sequence
  SiRNA target sequence
tttgatatttccaaagaagccatttca

SEQ ID NO: 224286 - DNA, 27 bp, Artificial sequence
  SiRNA target sequence
ttgatatttccaaagaagccatttcaa

SEQ ID NO: 224287 - DNA, 27 bp, Artificial sequence
  SiRNA target sequence
tgatatttccaaagaagccatttcaat

SEQ ID NO: 224288 - DNA, 27 bp, Artificial sequence
  SiRNA target sequence
gatatttccaaagaagccatttcaatg

SEQ ID NO: 224289 - DNA, 27 bp, Artificial sequence
  SiRNA target sequence
atatttccaaagaagccatttcaatgc

SEQ ID NO: 224290 - DNA, 27 bp, Artificial sequence
  SiRNA target sequence
tatttccaaagaagccatttcaatgca

SEQ ID NO: 224291 - DNA, 27 bp, Artificial sequence
  SiRNA target sequence
atttccaaagaagccatttcaatgcag

SEQ ID NO: 224292 - DNA, 27 bp, Artificial sequence
  SiRNA target sequence
tttccaaagaagccatttcaatgcaga

SEQ ID NO: 224293 - DNA, 27 bp, Artificial sequence
  SiRNA target sequence
ttccaaagaagccatttcaatgcagat

SEQ ID NO: 224294 - DNA, 27 bp, Artificial sequence
  SiRNA target sequence
tccaaagaagccatttcaatgcagatt

SEQ ID NO: 224295 - DNA, 27 bp, Artificial sequence
  SiRNA target sequence
ccaaagaagccatttcaatgcagattg

SEQ ID NO: 224296 - DNA, 27 bp, Artificial sequence
  SiRNA target sequence
caaagaagccatttcaatgcagattga

SEQ ID NO: 224297 - DNA, 27 bp, Artificial sequence
  SiRNA target sequence
aaagaagccatttcaatgcagattgat

SEQ ID NO: 224298 - DNA, 27 bp, Artificial sequence
  SiRNA target sequence
aagaagccatttcaatgcagattgatt

SEQ ID NO: 224299 - DNA, 27 bp, Artificial sequence
  SiRNA target sequence
agaagccatttcaatgcagattgattc

SEQ ID NO: 224300 - DNA, 27 bp, Artificial sequence
  SiRNA target sequence
gaagccatttcaatgcagattgattcg

SEQ ID NO: 224301 - DNA, 27 bp, Artificial sequence
  SiRNA target sequence
aagccatttcaatgcagattgattcgt

SEQ ID NO: 224302 - DNA, 27 bp, Artificial sequence
  SiRNA target sequence
agccatttcaatgcagattgattcgtc

SEQ ID NO: 224303 - DNA, 27 bp, Artificial sequence
  SiRNA target sequence
gccatttcaatgcagattgattcgtca

SEQ ID NO: 224304 - DNA, 27 bp, Artificial sequence
  SiRNA target sequence
ccatttcaatgcagattgattcgtcat

SEQ ID NO: 224305 - DNA, 27 bp, Artificial sequence
  SiRNA target sequence
catttcaatgcagattgattcgtcatt

SEQ ID NO: 224306 - DNA, 27 bp, Artificial sequence
  SiRNA target sequence
atttcaatgcagattgattcgtcattg

SEQ ID NO: 224307 - DNA, 27 bp, Artificial sequence
  SiRNA target sequence
tttcaatgcagattgattcgtcattgc

SEQ ID NO: 224308 - DNA, 27 bp, Artificial sequence
  SiRNA target sequence
ttcaatgcagattgattcgtcattgcg

SEQ ID NO: 224309 - DNA, 27 bp, Artificial sequence
  SiRNA target sequence
tcaatgcagattgattcgtcattgcgt

SEQ ID NO: 224310 - DNA, 27 bp, Artificial sequence
  SiRNA target sequence
caatgcagattgattcgtcattgcgtg

SEQ ID NO: 224311 - DNA, 27 bp, Artificial sequence
  SiRNA target sequence
aatgcagattgattcgtcattgcgtgc

SEQ ID NO: 224312 - DNA, 27 bp, Artificial sequence
  SiRNA target sequence
atgcagattgattcgtcattgcgtgca

SEQ ID NO: 224313 - DNA, 27 bp, Artificial sequence
  SiRNA target sequence
tgcagattgattcgtcattgcgtgcac

SEQ ID NO: 224314 - DNA, 27 bp, Artificial sequence
  SiRNA target sequence
gcagattgattcgtcattgcgtgcacg

SEQ ID NO: 224315 - DNA, 27 bp, Artificial sequence
  SiRNA target sequence
cagattgattcgtcattgcgtgcacgt

SEQ ID NO: 224316 - DNA, 27 bp, Artificial sequence
  SiRNA target sequence
agattgattcgtcattgcgtgcacgtt

SEQ ID NO: 224317 - DNA, 27 bp, Artificial sequence
  SiRNA target sequence
gattgattcgtcattgcgtgcacgtta

SEQ ID NO: 224318 - DNA, 27 bp, Artificial sequence
  SiRNA target sequence
attgattcgtcattgcgtgcacgttat

SEQ ID NO: 224319 - DNA, 27 bp, Artificial sequence
  SiRNA target sequence
ttgattcgtcattgcgtgcacgttata

SEQ ID NO: 224320 - DNA, 27 bp, Artificial sequence
  SiRNA target sequence
tgattcgtcattgcgtgcacgttataa

SEQ ID NO: 224321 - DNA, 27 bp, Artificial sequence
  SiRNA target sequence
gattcgtcattgcgtgcacgttataaa

SEQ ID NO: 224322 - DNA, 27 bp, Artificial sequence
  SiRNA target sequence
attcgtcattgcgtgcacgttataaag

SEQ ID NO: 224323 - DNA, 27 bp, Artificial sequence
  SiRNA target sequence
ttcgtcattgcgtgcacgttataaagg

SEQ ID NO: 224324 - DNA, 27 bp, Artificial sequence
  SiRNA target sequence
tcgtcattgcgtgcacgttataaagga

SEQ ID NO: 224325 - DNA, 27 bp, Artificial sequence
  SiRNA target sequence
cgtcattgcgtgcacgttataaaggaa

SEQ ID NO: 224326 - DNA, 27 bp, Artificial sequence
  SiRNA target sequence
gtcattgcgtgcacgttataaaggaat

SEQ ID NO: 224327 - DNA, 27 bp, Artificial sequence
  SiRNA target sequence
tcattgcgtgcacgttataaaggaatt

SEQ ID NO: 224328 - DNA, 27 bp, Artificial sequence
  SiRNA target sequence
cattgcgtgcacgttataaaggaattt

SEQ ID NO: 224329 - DNA, 27 bp, Artificial sequence
  SiRNA target sequence
attgcgtgcacgttataaaggaatttt

SEQ ID NO: 224330 - DNA, 27 bp, Artificial sequence
  SiRNA target sequence
ttgcgtgcacgttataaaggaattttt

SEQ ID NO: 224331 - DNA, 27 bp, Artificial sequence
  SiRNA target sequence
tgcgtgcacgttataaaggaatttttg

SEQ ID NO: 224332 - DNA, 27 bp, Artificial sequence
  SiRNA target sequence
gcgtgcacgttataaaggaatttttga

SEQ ID NO: 224333 - DNA, 27 bp, Artificial sequence
  SiRNA target sequence
cgtgcacgttataaaggaatttttgac

SEQ ID NO: 224334 - DNA, 27 bp, Artificial sequence
  SiRNA target sequence
gtgcacgttataaaggaatttttgacg

SEQ ID NO: 224335 - DNA, 27 bp, Artificial sequence
  SiRNA target sequence
tgcacgttataaaggaatttttgacgg

SEQ ID NO: 224336 - DNA, 27 bp, Artificial sequence
  SiRNA target sequence
gcacgttataaaggaatttttgacggt

SEQ ID NO: 224337 - DNA, 27 bp, Artificial sequence
  SiRNA target sequence
cacgttataaaggaatttttgacggtg

SEQ ID NO: 224338 - DNA, 27 bp, Artificial sequence
  SiRNA target sequence
acgttataaaggaatttttgacggtgt

SEQ ID NO: 224339 - DNA, 27 bp, Artificial sequence
  SiRNA target sequence
cgttataaaggaatttttgacggtgtt

SEQ ID NO: 224340 - DNA, 27 bp, Artificial sequence
  SiRNA target sequence
gttataaaggaatttttgacggtgttt

SEQ ID NO: 224341 - DNA, 27 bp, Artificial sequence
  SiRNA target sequence
ttataaaggaatttttgacggtgtttt

SEQ ID NO: 224342 - DNA, 27 bp, Artificial sequence
  SiRNA target sequence
tataaaggaatttttgacggtgttttt

SEQ ID NO: 224343 - DNA, 27 bp, Artificial sequence
  SiRNA target sequence
ataaaggaatttttgacggtgtttttg

SEQ ID NO: 224344 - DNA, 27 bp, Artificial sequence
  SiRNA target sequence
taaaggaatttttgacggtgtttttgg

SEQ ID NO: 224345 - DNA, 27 bp, Artificial sequence
  SiRNA target sequence
aaaggaatttttgacggtgtttttggt

SEQ ID NO: 224346 - DNA, 27 bp, Artificial sequence
  SiRNA target sequence
aaggaatttttgacggtgtttttggta

SEQ ID NO: 224347 - DNA, 27 bp, Artificial sequence
  SiRNA target sequence
aggaatttttgacggtgtttttggtaa

SEQ ID NO: 224348 - DNA, 27 bp, Artificial sequence
  SiRNA target sequence
ggaatttttgacggtgtttttggtaag

SEQ ID NO: 224349 - DNA, 27 bp, Artificial sequence
  SiRNA target sequence
gaatttttgacggtgtttttggtaagt

SEQ ID NO: 224350 - DNA, 27 bp, Artificial sequence
  SiRNA target sequence
aatttttgacggtgtttttggtaagtt

SEQ ID NO: 224351 - DNA, 27 bp, Artificial sequence
  SiRNA target sequence
atttttgacggtgtttttggtaagtta

SEQ ID NO: 224352 - DNA, 27 bp, Artificial sequence
  SiRNA target sequence
tttttgacggtgtttttggtaagttag

SEQ ID NO: 224353 - DNA, 27 bp, Artificial sequence
  SiRNA target sequence
ttttgacggtgtttttggtaagttagg

SEQ ID NO: 224354 - DNA, 27 bp, Artificial sequence
  SiRNA target sequence
tttgacggtgtttttggtaagttagga

SEQ ID NO: 224355 - DNA, 27 bp, Artificial sequence
  SiRNA target sequence
ttgacggtgtttttggtaagttaggaa

SEQ ID NO: 224356 - DNA, 27 bp, Artificial sequence
  SiRNA target sequence
tgacggtgtttttggtaagttaggaaa

SEQ ID NO: 224357 - DNA, 27 bp, Artificial sequence
  SiRNA target sequence
gacggtgtttttggtaagttaggaaaa

SEQ ID NO: 224358 - DNA, 27 bp, Artificial sequence
  SiRNA target sequence
acggtgtttttggtaagttaggaaaat

SEQ ID NO: 224359 - DNA, 27 bp, Artificial sequence
  SiRNA target sequence
cggtgtttttggtaagttaggaaaatc

SEQ ID NO: 224360 - DNA, 27 bp, Artificial sequence
  SiRNA target sequence
ggtgtttttggtaagttaggaaaatct

SEQ ID NO: 224361 - DNA, 27 bp, Artificial sequence
  SiRNA target sequence
gtgtttttggtaagttaggaaaatctc

SEQ ID NO: 224362 - DNA, 27 bp, Artificial sequence
  SiRNA target sequence
tgtttttggtaagttaggaaaatctct

SEQ ID NO: 224363 - DNA, 27 bp, Artificial sequence
  SiRNA target sequence
gtttttggtaagttaggaaaatctctt

SEQ ID NO: 224364 - DNA, 27 bp, Artificial sequence
  SiRNA target sequence
tttttggtaagttaggaaaatctcttg

SEQ ID NO: 224365 - DNA, 27 bp, Artificial sequence
  SiRNA target sequence
ttttggtaagttaggaaaatctcttgg

SEQ ID NO: 224366 - DNA, 27 bp, Artificial sequence
  SiRNA target sequence
tttggtaagttaggaaaatctcttgga

SEQ ID NO: 224367 - DNA, 27 bp, Artificial sequence
  SiRNA target sequence
ttggtaagttaggaaaatctcttggat

SEQ ID NO: 224368 - DNA, 27 bp, Artificial sequence
  SiRNA target sequence
tggtaagttaggaaaatctcttggatc

SEQ ID NO: 224369 - DNA, 27 bp, Artificial sequence
  SiRNA target sequence
ggtaagttaggaaaatctcttggatcg

SEQ ID NO: 224370 - DNA, 27 bp, Artificial sequence
  SiRNA target sequence
gtaagttaggaaaatctcttggatcgt

SEQ ID NO: 224371 - DNA, 27 bp, Artificial sequence
  SiRNA target sequence
taagttaggaaaatctcttggatcgtt

SEQ ID NO: 224372 - DNA, 27 bp, Artificial sequence
  SiRNA target sequence
aagttaggaaaatctcttggatcgtta

SEQ ID NO: 224373 - DNA, 27 bp, Artificial sequence
  SiRNA target sequence
agttaggaaaatctcttggatcgttat

SEQ ID NO: 224374 - DNA, 27 bp, Artificial sequence
  SiRNA target sequence
gttaggaaaatctcttggatcgttatt

SEQ ID NO: 224375 - DNA, 27 bp, Artificial sequence
  SiRNA target sequence
ttaggaaaatctcttggatcgttattt

SEQ ID NO: 224376 - DNA, 27 bp, Artificial sequence
  SiRNA target sequence
taggaaaatctcttggatcgttatttg

SEQ ID NO: 224377 - DNA, 27 bp, Artificial sequence
  SiRNA target sequence
aggaaaatctcttggatcgttatttgt

SEQ ID NO: 224378 - DNA, 27 bp, Artificial sequence
  SiRNA target sequence
ggaaaatctcttggatcgttatttgtg

SEQ ID NO: 224379 - DNA, 27 bp, Artificial sequence
  SiRNA target sequence
gaaaatctcttggatcgttatttgtgt

SEQ ID NO: 224380 - DNA, 27 bp, Artificial sequence
  SiRNA target sequence
aaaatctcttggatcgttatttgtgtg

SEQ ID NO: 224381 - DNA, 27 bp, Artificial sequence
  SiRNA target sequence
aaatctcttggatcgttatttgtgtgg

SEQ ID NO: 224382 - DNA, 27 bp, Artificial sequence
  SiRNA target sequence
aatctcttggatcgttatttgtgtgga

SEQ ID NO: 224383 - DNA, 27 bp, Artificial sequence
  SiRNA target sequence
atctcttggatcgttatttgtgtggat

SEQ ID NO: 224384 - DNA, 27 bp, Artificial sequence
  SiRNA target sequence
tctcttggatcgttatttgtgtggatt

SEQ ID NO: 224385 - DNA, 27 bp, Artificial sequence
  SiRNA target sequence
ctcttggatcgttatttgtgtggatta

SEQ ID NO: 224386 - DNA, 27 bp, Artificial sequence
  SiRNA target sequence
tcttggatcgttatttgtgtggattat

SEQ ID NO: 224387 - DNA, 27 bp, Artificial sequence
  SiRNA target sequence
cttggatcgttatttgtgtggattatg

SEQ ID NO: 224388 - DNA, 27 bp, Artificial sequence
  SiRNA target sequence
ttggatcgttatttgtgtggattatgg

SEQ ID NO: 224389 - DNA, 27 bp, Artificial sequence
  SiRNA target sequence
tggatcgttatttgtgtggattatggg

SEQ ID NO: 224390 - DNA, 27 bp, Artificial sequence
  SiRNA target sequence
ggatcgttatttgtgtggattatggga

SEQ ID NO: 224391 - DNA, 27 bp, Artificial sequence
  SiRNA target sequence
gatcgttatttgtgtggattatgggat

SEQ ID NO: 224392 - DNA, 27 bp, Artificial sequence
  SiRNA target sequence
atcgttatttgtgtggattatgggata

SEQ ID NO: 224393 - DNA, 27 bp, Artificial sequence
  SiRNA target sequence
tcgttatttgtgtggattatgggatat

SEQ ID NO: 224394 - DNA, 27 bp, Artificial sequence
  SiRNA target sequence
cgttatttgtgtggattatgggatatg

SEQ ID NO: 224395 - DNA, 27 bp, Artificial sequence
  SiRNA target sequence
gttatttgtgtggattatgggatatgc

SEQ ID NO: 224396 - DNA, 27 bp, Artificial sequence
  SiRNA target sequence
ttatttgtgtggattatgggatatgca

SEQ ID NO: 224397 - DNA, 27 bp, Artificial sequence
  SiRNA target sequence
tatttgtgtggattatgggatatgcat

SEQ ID NO: 224398 - DNA, 27 bp, Artificial sequence
  SiRNA target sequence
atttgtgtggattatgggatatgcatt

SEQ ID NO: 224399 - DNA, 27 bp, Artificial sequence
  SiRNA target sequence
tttgtgtggattatgggatatgcattt

SEQ ID NO: 224400 - DNA, 27 bp, Artificial sequence
  SiRNA target sequence
ttgtgtggattatgggatatgcatttc

SEQ ID NO: 224401 - DNA, 27 bp, Artificial sequence
  SiRNA target sequence
tgtgtggattatgggatatgcatttca

SEQ ID NO: 224402 - DNA, 27 bp, Artificial sequence
  SiRNA target sequence
gtgtggattatgggatatgcatttcaa

SEQ ID NO: 224403 - DNA, 27 bp, Artificial sequence
  SiRNA target sequence
tgtggattatgggatatgcatttcaaa

SEQ ID NO: 224404 - DNA, 27 bp, Artificial sequence
  SiRNA target sequence
gtggattatgggatatgcatttcaaac

SEQ ID NO: 224405 - DNA, 27 bp, Artificial sequence
  SiRNA target sequence
tggattatgggatatgcatttcaaaca

SEQ ID NO: 224406 - DNA, 27 bp, Artificial sequence
  SiRNA target sequence
ggattatgggatatgcatttcaaacaa

SEQ ID NO: 224407 - DNA, 27 bp, Artificial sequence
  SiRNA target sequence
gattatgggatatgcatttcaaacaag

SEQ ID NO: 224408 - DNA, 27 bp, Artificial sequence
  SiRNA target sequence
attatgggatatgcatttcaaacaaga

SEQ ID NO: 224409 - DNA, 27 bp, Artificial sequence
  SiRNA target sequence
ttatgggatatgcatttcaaacaagag

SEQ ID NO: 224410 - DNA, 27 bp, Artificial sequence
  SiRNA target sequence
tatgggatatgcatttcaaacaagaga

SEQ ID NO: 224411 - DNA, 27 bp, Artificial sequence
  SiRNA target sequence
atgggatatgcatttcaaacaagagat

SEQ ID NO: 224412 - DNA, 27 bp, Artificial sequence
  SiRNA target sequence
tgggatatgcatttcaaacaagagatt

SEQ ID NO: 224413 - DNA, 27 bp, Artificial sequence
  SiRNA target sequence
gggatatgcatttcaaacaagagattt

SEQ ID NO: 224414 - DNA, 27 bp, Artificial sequence
  SiRNA target sequence
ggatatgcatttcaaacaagagatttt

SEQ ID NO: 224415 - DNA, 27 bp, Artificial sequence
  SiRNA target sequence
gatatgcatttcaaacaagagatttta

SEQ ID NO: 224416 - DNA, 27 bp, Artificial sequence
  SiRNA target sequence
atatgcatttcaaacaagagattttag

SEQ ID NO: 224417 - DNA, 27 bp, Artificial sequence
  SiRNA target sequence
tatgcatttcaaacaagagattttaga

SEQ ID NO: 224418 - DNA, 27 bp, Artificial sequence
  SiRNA target sequence
atgcatttcaaacaagagattttagaa

SEQ ID NO: 224419 - DNA, 27 bp, Artificial sequence
  SiRNA target sequence
tgcatttcaaacaagagattttagaaa

SEQ ID NO: 224420 - DNA, 27 bp, Artificial sequence
  SiRNA target sequence
gcatttcaaacaagagattttagaaaa

SEQ ID NO: 224421 - DNA, 27 bp, Artificial sequence
  SiRNA target sequence
catttcaaacaagagattttagaaaat

SEQ ID NO: 224422 - DNA, 27 bp, Artificial sequence
  SiRNA target sequence
atttcaaacaagagattttagaaaatt

SEQ ID NO: 224423 - DNA, 27 bp, Artificial sequence
  SiRNA target sequence
tttcaaacaagagattttagaaaatta

SEQ ID NO: 224424 - DNA, 27 bp, Artificial sequence
  SiRNA target sequence
ttcaaacaagagattttagaaaattag

SEQ ID NO: 224425 - DNA, 27 bp, Artificial sequence
  SiRNA target sequence
tcaaacaagagattttagaaaattagc

SEQ ID NO: 224426 - DNA, 27 bp, Artificial sequence
  SiRNA target sequence
caaacaagagattttagaaaattagct

SEQ ID NO: 224427 - DNA, 27 bp, Artificial sequence
  SiRNA target sequence
aaacaagagattttagaaaattagctc

SEQ ID NO: 224428 - DNA, 27 bp, Artificial sequence
  SiRNA target sequence
aacaagagattttagaaaattagctcc

SEQ ID NO: 224429 - DNA, 27 bp, Artificial sequence
  SiRNA target sequence
acaagagattttagaaaattagctccc

SEQ ID NO: 224430 - DNA, 27 bp, Artificial sequence
  SiRNA target sequence
caagagattttagaaaattagctccct

SEQ ID NO: 224431 - DNA, 27 bp, Artificial sequence
  SiRNA target sequence
aagagattttagaaaattagctccctt

SEQ ID NO: 224432 - DNA, 27 bp, Artificial sequence
  SiRNA target sequence
agagattttagaaaattagctccctta

SEQ ID NO: 224433 - DNA, 27 bp, Artificial sequence
  SiRNA target sequence
gagattttagaaaattagctcccttat

SEQ ID NO: 224434 - DNA, 27 bp, Artificial sequence
  SiRNA target sequence
agattttagaaaattagctcccttatg

SEQ ID NO: 224435 - DNA, 27 bp, Artificial sequence
  SiRNA target sequence
gattttagaaaattagctcccttatgt

SEQ ID NO: 224436 - DNA, 27 bp, Artificial sequence
  SiRNA target sequence
attttagaaaattagctcccttatgta

SEQ ID NO: 224437 - DNA, 27 bp, Artificial sequence
  SiRNA target sequence
ttttagaaaattagctcccttatgtat

SEQ ID NO: 224438 - DNA, 27 bp, Artificial sequence
  SiRNA target sequence
tttagaaaattagctcccttatgtatc

SEQ ID NO: 224439 - DNA, 27 bp, Artificial sequence
  SiRNA target sequence
ttagaaaattagctcccttatgtatca

SEQ ID NO: 224440 - DNA, 27 bp, Artificial sequence
  SiRNA target sequence
tagaaaattagctcccttatgtatcag

SEQ ID NO: 224441 - DNA, 27 bp, Artificial sequence
  SiRNA target sequence
agaaaattagctcccttatgtatcagc

SEQ ID NO: 224442 - DNA, 27 bp, Artificial sequence
  SiRNA target sequence
gaaaattagctcccttatgtatcagcg

SEQ ID NO: 224443 - DNA, 27 bp, Artificial sequence
  SiRNA target sequence
aaaattagctcccttatgtatcagcgt

SEQ ID NO: 224444 - DNA, 27 bp, Artificial sequence
  SiRNA target sequence
aaattagctcccttatgtatcagcgta

SEQ ID NO: 224445 - DNA, 27 bp, Artificial sequence
  SiRNA target sequence
aattagctcccttatgtatcagcgtaa

SEQ ID NO: 224446 - DNA, 27 bp, Artificial sequence
  SiRNA target sequence
attagctcccttatgtatcagcgtaat

SEQ ID NO: 224447 - DNA, 27 bp, Artificial sequence
  SiRNA target sequence
ttagctcccttatgtatcagcgtaatt

SEQ ID NO: 224448 - DNA, 27 bp, Artificial sequence
  SiRNA target sequence
tagctcccttatgtatcagcgtaattg

SEQ ID NO: 224449 - DNA, 27 bp, Artificial sequence
  SiRNA target sequence
agctcccttatgtatcagcgtaattgt

SEQ ID NO: 224450 - DNA, 27 bp, Artificial sequence
  SiRNA target sequence
gctcccttatgtatcagcgtaattgtc

SEQ ID NO: 224451 - DNA, 27 bp, Artificial sequence
  SiRNA target sequence
ctcccttatgtatcagcgtaattgtct

SEQ ID NO: 224452 - DNA, 27 bp, Artificial sequence
  SiRNA target sequence
tcccttatgtatcagcgtaattgtctt

SEQ ID NO: 224453 - DNA, 27 bp, Artificial sequence
  SiRNA target sequence
cccttatgtatcagcgtaattgtcttt

SEQ ID NO: 224454 - DNA, 27 bp, Artificial sequence
  SiRNA target sequence
ccttatgtatcagcgtaattgtctttt

SEQ ID NO: 224455 - DNA, 27 bp, Artificial sequence
  SiRNA target sequence
cttatgtatcagcgtaattgtcttttt

SEQ ID NO: 224456 - DNA, 27 bp, Artificial sequence
  SiRNA target sequence
ttatgtatcagcgtaattgtctttttt

SEQ ID NO: 224457 - DNA, 27 bp, Artificial sequence
  SiRNA target sequence
tatgtatcagcgtaattgtcttttttg

SEQ ID NO: 224458 - DNA, 27 bp, Artificial sequence
  SiRNA target sequence
atgtatcagcgtaattgtcttttttgt

SEQ ID NO: 224459 - DNA, 27 bp, Artificial sequence
  SiRNA target sequence
tgtatcagcgtaattgtcttttttgtt

SEQ ID NO: 224460 - DNA, 27 bp, Artificial sequence
  SiRNA target sequence
gtatcagcgtaattgtcttttttgtta

SEQ ID NO: 224461 - DNA, 27 bp, Artificial sequence
  SiRNA target sequence
tatcagcgtaattgtcttttttgttat

SEQ ID NO: 224462 - DNA, 27 bp, Artificial sequence
  SiRNA target sequence
atcagcgtaattgtcttttttgttatt

SEQ ID NO: 224463 - DNA, 27 bp, Artificial sequence
  SiRNA target sequence
tcagcgtaattgtcttttttgttatta

SEQ ID NO: 224464 - DNA, 27 bp, Artificial sequence
  SiRNA target sequence
cagcgtaattgtcttttttgttattat

SEQ ID NO: 224465 - DNA, 27 bp, Artificial sequence
  SiRNA target sequence
agcgtaattgtcttttttgttattatt

SEQ ID NO: 224466 - DNA, 27 bp, Artificial sequence
  SiRNA target sequence
gcgtaattgtcttttttgttattattt

SEQ ID NO: 224467 - DNA, 27 bp, Artificial sequence
  SiRNA target sequence
cgtaattgtcttttttgttattatttg

SEQ ID NO: 224468 - DNA, 27 bp, Artificial sequence
  SiRNA target sequence
gtaattgtcttttttgttattatttgg

SEQ ID NO: 224469 - DNA, 27 bp, Artificial sequence
  SiRNA target sequence
taattgtcttttttgttattatttgga

SEQ ID NO: 224470 - DNA, 27 bp, Artificial sequence
  SiRNA target sequence
aattgtcttttttgttattatttggat

SEQ ID NO: 224471 - DNA, 27 bp, Artificial sequence
  SiRNA target sequence
attgtcttttttgttattatttggatt

SEQ ID NO: 224472 - DNA, 27 bp, Artificial sequence
  SiRNA target sequence
ttgtcttttttgttattatttggattt

SEQ ID NO: 224473 - DNA, 27 bp, Artificial sequence
  SiRNA target sequence
tgtcttttttgttattatttggattta

SEQ ID NO: 224474 - DNA, 27 bp, Artificial sequence
  SiRNA target sequence
gtcttttttgttattatttggatttat

SEQ ID NO: 224475 - DNA, 27 bp, Artificial sequence
  SiRNA target sequence
tcttttttgttattatttggatttatt

SEQ ID NO: 224476 - DNA, 27 bp, Artificial sequence
  SiRNA target sequence
cttttttgttattatttggatttattc

SEQ ID NO: 224477 - DNA, 27 bp, Artificial sequence
  SiRNA target sequence
ttttttgttattatttggatttattca

SEQ ID NO: 224478 - DNA, 27 bp, Artificial sequence
  SiRNA target sequence
tttttgttattatttggatttattcag

SEQ ID NO: 224479 - DNA, 27 bp, Artificial sequence
  SiRNA target sequence
ttttgttattatttggatttattcagt

SEQ ID NO: 224480 - DNA, 27 bp, Artificial sequence
  SiRNA target sequence
tttgttattatttggatttattcagtt

SEQ ID NO: 224481 - DNA, 27 bp, Artificial sequence
  SiRNA target sequence
ttgttattatttggatttattcagtta

SEQ ID NO: 224482 - DNA, 27 bp, Artificial sequence
  SiRNA target sequence
tgttattatttggatttattcagttat

SEQ ID NO: 224483 - DNA, 27 bp, Artificial sequence
  SiRNA target sequence
gttattatttggatttattcagttatt

SEQ ID NO: 224484 - DNA, 27 bp, Artificial sequence
  SiRNA target sequence
ttattatttggatttattcagttattt

SEQ ID NO: 224485 - DNA, 27 bp, Artificial sequence
  SiRNA target sequence
tattatttggatttattcagttattta

SEQ ID NO: 224486 - DNA, 27 bp, Artificial sequence
  SiRNA target sequence
attatttggatttattcagttatttat

SEQ ID NO: 224487 - DNA, 27 bp, Artificial sequence
  SiRNA target sequence
ttatttggatttattcagttatttatt

SEQ ID NO: 224488 - DNA, 27 bp, Artificial sequence
  SiRNA target sequence
tatttggatttattcagttatttattt

SEQ ID NO: 224489 - DNA, 27 bp, Artificial sequence
  SiRNA target sequence
atttggatttattcagttatttattta

SEQ ID NO: 224490 - DNA, 27 bp, Artificial sequence
  SiRNA target sequence
tttggatttattcagttatttatttaa

SEQ ID NO: 224491 - DNA, 27 bp, Artificial sequence
  SiRNA target sequence
ttggatttattcagttatttatttaaa

SEQ ID NO: 224492 - DNA, 27 bp, Artificial sequence
  SiRNA target sequence
tggatttattcagttatttatttaaat

SEQ ID NO: 224493 - DNA, 27 bp, Artificial sequence
  SiRNA target sequence
ggatttattcagttatttatttaaata

SEQ ID NO: 224494 - DNA, 27 bp, Artificial sequence
  SiRNA target sequence
gatttattcagttatttatttaaataa

SEQ ID NO: 224495 - DNA, 27 bp, Artificial sequence
  SiRNA target sequence
atttattcagttatttatttaaataag

SEQ ID NO: 224496 - DNA, 27 bp, Artificial sequence
  SiRNA target sequence
tttattcagttatttatttaaataaga

SEQ ID NO: 224497 - DNA, 27 bp, Artificial sequence
  SiRNA target sequence
ttattcagttatttatttaaataagaa

SEQ ID NO: 224498 - DNA, 27 bp, Artificial sequence
  SiRNA target sequence
tattcagttatttatttaaataagaaa

SEQ ID NO: 224499 - DNA, 27 bp, Artificial sequence
  SiRNA target sequence
attcagttatttatttaaataagaaat

SEQ ID NO: 224500 - DNA, 27 bp, Artificial sequence
  SiRNA target sequence
ttcagttatttatttaaataagaaata

SEQ ID NO: 224501 - DNA, 27 bp, Artificial sequence
  SiRNA target sequence
tcagttatttatttaaataagaaatac

SEQ ID NO: 224502 - DNA, 27 bp, Artificial sequence
  SiRNA target sequence
cagttatttatttaaataagaaataca

SEQ ID NO: 224503 - DNA, 27 bp, Artificial sequence
  SiRNA target sequence
agttatttatttaaataagaaatacaa

SEQ ID NO: 224504 - DNA, 27 bp, Artificial sequence
  SiRNA target sequence
gttatttatttaaataagaaatacaaa

SEQ ID NO: 224505 - DNA, 27 bp, Artificial sequence
  SiRNA target sequence
ttatttatttaaataagaaatacaaag

SEQ ID NO: 224506 - DNA, 27 bp, Artificial sequence
  SiRNA target sequence
tatttatttaaataagaaatacaaaga

SEQ ID NO: 224507 - DNA, 27 bp, Artificial sequence
  SiRNA target sequence
atttatttaaataagaaatacaaagaa

SEQ ID NO: 224508 - DNA, 27 bp, Artificial sequence
  SiRNA target sequence
tttatttaaataagaaatacaaagaat

SEQ ID NO: 224509 - DNA, 27 bp, Artificial sequence
  SiRNA target sequence
ttatttaaataagaaatacaaagaatc

SEQ ID NO: 224510 - DNA, 27 bp, Artificial sequence
  SiRNA target sequence
tatttaaataagaaatacaaagaatca

SEQ ID NO: 224511 - DNA, 27 bp, Artificial sequence
  SiRNA target sequence
atttaaataagaaatacaaagaatcag

SEQ ID NO: 224512 - DNA, 27 bp, Artificial sequence
  SiRNA target sequence
tttaaataagaaatacaaagaatcagt

SEQ ID NO: 224513 - DNA, 27 bp, Artificial sequence
  SiRNA target sequence
ttaaataagaaatacaaagaatcagtt

SEQ ID NO: 224514 - DNA, 27 bp, Artificial sequence
  SiRNA target sequence
taaataagaaatacaaagaatcagttg

SEQ ID NO: 224515 - DNA, 27 bp, Artificial sequence
  SiRNA target sequence
aaataagaaatacaaagaatcagttgt

SEQ ID NO: 224516 - DNA, 27 bp, Artificial sequence
  SiRNA target sequence
aataagaaatacaaagaatcagttgtt

SEQ ID NO: 224517 - DNA, 27 bp, Artificial sequence
  SiRNA target sequence
ataagaaatacaaagaatcagttgtta

SEQ ID NO: 224518 - DNA, 27 bp, Artificial sequence
  SiRNA target sequence
taagaaatacaaagaatcagttgttag

SEQ ID NO: 224519 - DNA, 27 bp, Artificial sequence
  SiRNA target sequence
aagaaatacaaagaatcagttgttagt

SEQ ID NO: 224520 - DNA, 27 bp, Artificial sequence
  SiRNA target sequence
agaaatacaaagaatcagttgttagta

SEQ ID NO: 224521 - DNA, 27 bp, Artificial sequence
  SiRNA target sequence
gaaatacaaagaatcagttgttagtaa

SEQ ID NO: 224522 - DNA, 27 bp, Artificial sequence
  SiRNA target sequence
aaatacaaagaatcagttgttagtaat

SEQ ID NO: 224523 - DNA, 27 bp, Artificial sequence
  SiRNA target sequence
aatacaaagaatcagttgttagtaatt

SEQ ID NO: 224524 - DNA, 27 bp, Artificial sequence
  SiRNA target sequence
atacaaagaatcagttgttagtaattt

SEQ ID NO: 224525 - DNA, 27 bp, Artificial sequence
  SiRNA target sequence
tacaaagaatcagttgttagtaattta

SEQ ID NO: 224526 - DNA, 27 bp, Artificial sequence
  SiRNA target sequence
acaaagaatcagttgttagtaatttac

SEQ ID NO: 224527 - DNA, 27 bp, Artificial sequence
  SiRNA target sequence
caaagaatcagttgttagtaatttacc

SEQ ID NO: 224528 - DNA, 27 bp, Artificial sequence
  SiRNA target sequence
aaagaatcagttgttagtaatttaccc

SEQ ID NO: 224529 - DNA, 27 bp, Artificial sequence
  SiRNA target sequence
aagaatcagttgttagtaatttaccca

SEQ ID NO: 224530 - DNA, 27 bp, Artificial sequence
  SiRNA target sequence
agaatcagttgttagtaatttacccat

SEQ ID NO: 224531 - DNA, 27 bp, Artificial sequence
  SiRNA target sequence
gaatcagttgttagtaatttacccatc

SEQ ID NO: 224532 - DNA, 27 bp, Artificial sequence
  SiRNA target sequence
aatcagttgttagtaatttacccatcg

SEQ ID NO: 224533 - DNA, 27 bp, Artificial sequence
  SiRNA target sequence
atcagttgttagtaatttacccatcga

SEQ ID NO: 224534 - DNA, 27 bp, Artificial sequence
  SiRNA target sequence
tcagttgttagtaatttacccatcgat

SEQ ID NO: 224535 - DNA, 27 bp, Artificial sequence
  SiRNA target sequence
cagttgttagtaatttacccatcgatg

SEQ ID NO: 224536 - DNA, 27 bp, Artificial sequence
  SiRNA target sequence
agttgttagtaatttacccatcgatgt

SEQ ID NO: 224537 - DNA, 27 bp, Artificial sequence
  SiRNA target sequence
gttgttagtaatttacccatcgatgtt

SEQ ID NO: 224538 - DNA, 27 bp, Artificial sequence
  SiRNA target sequence
ttgttagtaatttacccatcgatgttg

SEQ ID NO: 224539 - DNA, 27 bp, Artificial sequence
  SiRNA target sequence
tgttagtaatttacccatcgatgttga

SEQ ID NO: 224540 - DNA, 27 bp, Artificial sequence
  SiRNA target sequence
gttagtaatttacccatcgatgttgat

SEQ ID NO: 224541 - DNA, 27 bp, Artificial sequence
  SiRNA target sequence
ttagtaatttacccatcgatgttgatt

SEQ ID NO: 224542 - DNA, 27 bp, Artificial sequence
  SiRNA target sequence
tagtaatttacccatcgatgttgattt

SEQ ID NO: 224543 - DNA, 27 bp, Artificial sequence
  SiRNA target sequence
agtaatttacccatcgatgttgatttg

SEQ ID NO: 224544 - DNA, 27 bp, Artificial sequence
  SiRNA target sequence
gtaatttacccatcgatgttgatttgt

SEQ ID NO: 224545 - DNA, 27 bp, Artificial sequence
  SiRNA target sequence
taatttacccatcgatgttgatttgtt

SEQ ID NO: 224546 - DNA, 27 bp, Artificial sequence
  SiRNA target sequence
aatttacccatcgatgttgatttgttt

SEQ ID NO: 224547 - DNA, 27 bp, Artificial sequence
  SiRNA target sequence
atttacccatcgatgttgatttgtttg

SEQ ID NO: 224548 - DNA, 27 bp, Artificial sequence
  SiRNA target sequence
tttacccatcgatgttgatttgtttgc

SEQ ID NO: 224549 - DNA, 27 bp, Artificial sequence
  SiRNA target sequence
ttacccatcgatgttgatttgtttgca

SEQ ID NO: 224550 - DNA, 27 bp, Artificial sequence
  SiRNA target sequence
tacccatcgatgttgatttgtttgcat

SEQ ID NO: 224551 - DNA, 27 bp, Artificial sequence
  SiRNA target sequence
acccatcgatgttgatttgtttgcatc

SEQ ID NO: 224552 - DNA, 27 bp, Artificial sequence
  SiRNA target sequence
cccatcgatgttgatttgtttgcatca

SEQ ID NO: 224553 - DNA, 27 bp, Artificial sequence
  SiRNA target sequence
ccatcgatgttgatttgtttgcatcaa

SEQ ID NO: 224554 - DNA, 27 bp, Artificial sequence
  SiRNA target sequence
catcgatgttgatttgtttgcatcaaa

SEQ ID NO: 224555 - DNA, 27 bp, Artificial sequence
  SiRNA target sequence
atcgatgttgatttgtttgcatcaaag

SEQ ID NO: 224556 - DNA, 27 bp, Artificial sequence
  SiRNA target sequence
tcgatgttgatttgtttgcatcaaagt

SEQ ID NO: 224557 - DNA, 27 bp, Artificial sequence
  SiRNA target sequence
cgatgttgatttgtttgcatcaaagtt

SEQ ID NO: 224558 - DNA, 27 bp, Artificial sequence
  SiRNA target sequence
gatgttgatttgtttgcatcaaagttg

SEQ ID NO: 224559 - DNA, 27 bp, Artificial sequence
  SiRNA target sequence
atgttgatttgtttgcatcaaagttgt

SEQ ID NO: 224560 - DNA, 27 bp, Artificial sequence
  SiRNA target sequence
tgttgatttgtttgcatcaaagttgtt

SEQ ID NO: 224561 - DNA, 27 bp, Artificial sequence
  SiRNA target sequence
gttgatttgtttgcatcaaagttgtta

SEQ ID NO: 224562 - DNA, 27 bp, Artificial sequence
  SiRNA target sequence
ttgatttgtttgcatcaaagttgttag

SEQ ID NO: 224563 - DNA, 27 bp, Artificial sequence
  SiRNA target sequence
tgatttgtttgcatcaaagttgttaga

SEQ ID NO: 224564 - DNA, 27 bp, Artificial sequence
  SiRNA target sequence
gatttgtttgcatcaaagttgttagat

SEQ ID NO: 224565 - DNA, 27 bp, Artificial sequence
  SiRNA target sequence
atttgtttgcatcaaagttgttagata

SEQ ID NO: 224566 - DNA, 27 bp, Artificial sequence
  SiRNA target sequence
tttgtttgcatcaaagttgttagataa

SEQ ID NO: 224567 - DNA, 27 bp, Artificial sequence
  SiRNA target sequence
ttgtttgcatcaaagttgttagataat

SEQ ID NO: 224568 - DNA, 27 bp, Artificial sequence
  SiRNA target sequence
tgtttgcatcaaagttgttagataata

SEQ ID NO: 224569 - DNA, 27 bp, Artificial sequence
  SiRNA target sequence
gtttgcatcaaagttgttagataataa

SEQ ID NO: 224570 - DNA, 27 bp, Artificial sequence
  SiRNA target sequence
tttgcatcaaagttgttagataataaa

SEQ ID NO: 224571 - DNA, 27 bp, Artificial sequence
  SiRNA target sequence
ttgcatcaaagttgttagataataaaa

SEQ ID NO: 224572 - DNA, 27 bp, Artificial sequence
  SiRNA target sequence
tgcatcaaagttgttagataataaaaa

SEQ ID NO: 224573 - DNA, 27 bp, Artificial sequence
  SiRNA target sequence
gcatcaaagttgttagataataaaaaa

SEQ ID NO: 224574 - DNA, 27 bp, Artificial sequence
  SiRNA target sequence
catcaaagttgttagataataaaaaag

SEQ ID NO: 224575 - DNA, 27 bp, Artificial sequence
  SiRNA target sequence
atcaaagttgttagataataaaaaaga

SEQ ID NO: 224576 - DNA, 27 bp, Artificial sequence
  SiRNA target sequence
tcaaagttgttagataataaaaaagaa

SEQ ID NO: 224577 - DNA, 27 bp, Artificial sequence
  SiRNA target sequence
caaagttgttagataataaaaaagaag

SEQ ID NO: 224578 - DNA, 27 bp, Artificial sequence
  SiRNA target sequence
aaagttgttagataataaaaaagaaga

SEQ ID NO: 224579 - DNA, 27 bp, Artificial sequence
  SiRNA target sequence
aagttgttagataataaaaaagaagag

SEQ ID NO: 224580 - DNA, 27 bp, Artificial sequence
  SiRNA target sequence
agttgttagataataaaaaagaagagg

SEQ ID NO: 224581 - DNA, 27 bp, Artificial sequence
  SiRNA target sequence
gttgttagataataaaaaagaagagga

SEQ ID NO: 224582 - DNA, 27 bp, Artificial sequence
  SiRNA target sequence
ttgttagataataaaaaagaagaggaa

SEQ ID NO: 224583 - DNA, 27 bp, Artificial sequence
  SiRNA target sequence
tgttagataataaaaaagaagaggaaa

SEQ ID NO: 224584 - DNA, 27 bp, Artificial sequence
  SiRNA target sequence
gttagataataaaaaagaagaggaaat

SEQ ID NO: 224585 - DNA, 27 bp, Artificial sequence
  SiRNA target sequence
ttagataataaaaaagaagaggaaatt

SEQ ID NO: 224586 - DNA, 27 bp, Artificial sequence
  SiRNA target sequence
tagataataaaaaagaagaggaaattg

SEQ ID NO: 224587 - DNA, 27 bp, Artificial sequence
  SiRNA target sequence
agataataaaaaagaagaggaaattga

SEQ ID NO: 224588 - DNA, 27 bp, Artificial sequence
  SiRNA target sequence
gataataaaaaagaagaggaaattgat

SEQ ID NO: 224589 - DNA, 27 bp, Artificial sequence
  SiRNA target sequence
ataataaaaaagaagaggaaattgatg

SEQ ID NO: 224590 - DNA, 27 bp, Artificial sequence
  SiRNA target sequence
taataaaaaagaagaggaaattgatgt

SEQ ID NO: 224591 - DNA, 27 bp, Artificial sequence
  SiRNA target sequence
aataaaaaagaagaggaaattgatgtg

SEQ ID NO: 224592 - DNA, 27 bp, Artificial sequence
  SiRNA target sequence
ataaaaaagaagaggaaattgatgtgt

SEQ ID NO: 224593 - DNA, 27 bp, Artificial sequence
  SiRNA target sequence
taaaaaagaagaggaaattgatgtgtc

SEQ ID NO: 224594 - DNA, 27 bp, Artificial sequence
  SiRNA target sequence
aaaaaagaagaggaaattgatgtgtca

SEQ ID NO: 224595 - DNA, 27 bp, Artificial sequence
  SiRNA target sequence
aaaaagaagaggaaattgatgtgtcag

SEQ ID NO: 224596 - DNA, 27 bp, Artificial sequence
  SiRNA target sequence
aaaagaagaggaaattgatgtgtcagt

SEQ ID NO: 224597 - DNA, 27 bp, Artificial sequence
  SiRNA target sequence
aaagaagaggaaattgatgtgtcagtg

SEQ ID NO: 224598 - DNA, 27 bp, Artificial sequence
  SiRNA target sequence
aagaagaggaaattgatgtgtcagtgc

SEQ ID NO: 224599 - DNA, 27 bp, Artificial sequence
  SiRNA target sequence
agaagaggaaattgatgtgtcagtgct

SEQ ID NO: 224600 - DNA, 27 bp, Artificial sequence
  SiRNA target sequence
gaagaggaaattgatgtgtcagtgctc

SEQ ID NO: 224601 - DNA, 27 bp, Artificial sequence
  SiRNA target sequence
aagaggaaattgatgtgtcagtgctcg

SEQ ID NO: 224602 - DNA, 27 bp, Artificial sequence
  SiRNA target sequence
agaggaaattgatgtgtcagtgctcgt

SEQ ID NO: 224603 - DNA, 27 bp, Artificial sequence
  SiRNA target sequence
gaggaaattgatgtgtcagtgctcgtt

SEQ ID NO: 224604 - DNA, 27 bp, Artificial sequence
  SiRNA target sequence
aggaaattgatgtgtcagtgctcgtta

SEQ ID NO: 224605 - DNA, 27 bp, Artificial sequence
  SiRNA target sequence
ggaaattgatgtgtcagtgctcgttaa

SEQ ID NO: 224606 - DNA, 27 bp, Artificial sequence
  SiRNA target sequence
gaaattgatgtgtcagtgctcgttaat

SEQ ID NO: 224607 - DNA, 27 bp, Artificial sequence
  SiRNA target sequence
aaattgatgtgtcagtgctcgttaatt

SEQ ID NO: 224608 - DNA, 27 bp, Artificial sequence
  SiRNA target sequence
aattgatgtgtcagtgctcgttaatta

SEQ ID NO: 224609 - DNA, 27 bp, Artificial sequence
  SiRNA target sequence
attgatgtgtcagtgctcgttaattaa

SEQ ID NO: 224610 - DNA, 19 bp, Artificial sequence
  SiRNA target sequence
atgtcagtagacaattcga

SEQ ID NO: 224611 - DNA, 19 bp, Artificial sequence
  SiRNA target sequence
tgtcagtagacaattcgaa

SEQ ID NO: 224612 - DNA, 19 bp, Artificial sequence
  SiRNA target sequence
gtcagtagacaattcgaaa

SEQ ID NO: 224613 - DNA, 19 bp, Artificial sequence
  SiRNA target sequence
tcagtagacaattcgaaag

SEQ ID NO: 224614 - DNA, 19 bp, Artificial sequence
  SiRNA target sequence
cagtagacaattcgaaagt

SEQ ID NO: 224615 - DNA, 19 bp, Artificial sequence
  SiRNA target sequence
agtagacaattcgaaagtt

SEQ ID NO: 224616 - DNA, 19 bp, Artificial sequence
  SiRNA target sequence
gtagacaattcgaaagttc

SEQ ID NO: 224617 - DNA, 19 bp, Artificial sequence
  SiRNA target sequence
tagacaattcgaaagttct

SEQ ID NO: 224618 - DNA, 19 bp, Artificial sequence
  SiRNA target sequence
agacaattcgaaagttcta

SEQ ID NO: 224619 - DNA, 19 bp, Artificial sequence
  SiRNA target sequence
gacaattcgaaagttctac

SEQ ID NO: 224620 - DNA, 19 bp, Artificial sequence
  SiRNA target sequence
acaattcgaaagttctaca

SEQ ID NO: 224621 - DNA, 19 bp, Artificial sequence
  SiRNA target sequence
caattcgaaagttctacaa

SEQ ID NO: 224622 - DNA, 19 bp, Artificial sequence
  SiRNA target sequence
aattcgaaagttctacaaa

SEQ ID NO: 224623 - DNA, 19 bp, Artificial sequence
  SiRNA target sequence
attcgaaagttctacaaaa

SEQ ID NO: 224624 - DNA, 19 bp, Artificial sequence
  SiRNA target sequence
ttcgaaagttctacaaaat

SEQ ID NO: 224625 - DNA, 19 bp, Artificial sequence
  SiRNA target sequence
tcgaaagttctacaaaata

SEQ ID NO: 224626 - DNA, 19 bp, Artificial sequence
  SiRNA target sequence
cgaaagttctacaaaataa

SEQ ID NO: 224627 - DNA, 19 bp, Artificial sequence
  SiRNA target sequence
gaaagttctacaaaataac

SEQ ID NO: 224628 - DNA, 19 bp, Artificial sequence
  SiRNA target sequence
aaagttctacaaaataacg

SEQ ID NO: 224629 - DNA, 19 bp, Artificial sequence
  SiRNA target sequence
aagttctacaaaataacga

SEQ ID NO: 224630 - DNA, 19 bp, Artificial sequence
  SiRNA target sequence
agttctacaaaataacgaa

SEQ ID NO: 224631 - DNA, 19 bp, Artificial sequence
  SiRNA target sequence
gttctacaaaataacgaaa

SEQ ID NO: 224632 - DNA, 19 bp, Artificial sequence
  SiRNA target sequence
ttctacaaaataacgaaaa

SEQ ID NO: 224633 - DNA, 19 bp, Artificial sequence
  SiRNA target sequence
tctacaaaataacgaaaac

SEQ ID NO: 224634 - DNA, 19 bp, Artificial sequence
  SiRNA target sequence
ctacaaaataacgaaaact

SEQ ID NO: 224635 - DNA, 19 bp, Artificial sequence
  SiRNA target sequence
tacaaaataacgaaaactc

SEQ ID NO: 224636 - DNA, 19 bp, Artificial sequence
  SiRNA target sequence
acaaaataacgaaaactct

SEQ ID NO: 224637 - DNA, 19 bp, Artificial sequence
  SiRNA target sequence
caaaataacgaaaactctg

SEQ ID NO: 224638 - DNA, 19 bp, Artificial sequence
  SiRNA target sequence
aaaataacgaaaactctgc

SEQ ID NO: 224639 - DNA, 19 bp, Artificial sequence
  SiRNA target sequence
aaataacgaaaactctgct

SEQ ID NO: 224640 - DNA, 19 bp, Artificial sequence
  SiRNA target sequence
aataacgaaaactctgctc

SEQ ID NO: 224641 - DNA, 19 bp, Artificial sequence
  SiRNA target sequence
ataacgaaaactctgctct

SEQ ID NO: 224642 - DNA, 19 bp, Artificial sequence
  SiRNA target sequence
taacgaaaactctgctctt

SEQ ID NO: 224643 - DNA, 19 bp, Artificial sequence
  SiRNA target sequence
aacgaaaactctgctcttc

SEQ ID NO: 224644 - DNA, 19 bp, Artificial sequence
  SiRNA target sequence
acgaaaactctgctcttcc

SEQ ID NO: 224645 - DNA, 19 bp, Artificial sequence
  SiRNA target sequence
cgaaaactctgctcttcct

SEQ ID NO: 224646 - DNA, 19 bp, Artificial sequence
  SiRNA target sequence
gaaaactctgctcttccta

SEQ ID NO: 224647 - DNA, 19 bp, Artificial sequence
  SiRNA target sequence
aaaactctgctcttcctac

SEQ ID NO: 224648 - DNA, 19 bp, Artificial sequence
  SiRNA target sequence
aaactctgctcttcctaca

SEQ ID NO: 224649 - DNA, 19 bp, Artificial sequence
  SiRNA target sequence
aactctgctcttcctacag

SEQ ID NO: 224650 - DNA, 19 bp, Artificial sequence
  SiRNA target sequence
actctgctcttcctacaga

SEQ ID NO: 224651 - DNA, 19 bp, Artificial sequence
  SiRNA target sequence
ctctgctcttcctacagaa

SEQ ID NO: 224652 - DNA, 19 bp, Artificial sequence
  SiRNA target sequence
tctgctcttcctacagaag

SEQ ID NO: 224653 - DNA, 19 bp, Artificial sequence
  SiRNA target sequence
ctgctcttcctacagaaga

SEQ ID NO: 224654 - DNA, 19 bp, Artificial sequence
  SiRNA target sequence
tgctcttcctacagaagat

SEQ ID NO: 224655 - DNA, 19 bp, Artificial sequence
  SiRNA target sequence
gctcttcctacagaagatg

SEQ ID NO: 224656 - DNA, 19 bp, Artificial sequence
  SiRNA target sequence
ctcttcctacagaagatga

SEQ ID NO: 224657 - DNA, 19 bp, Artificial sequence
  SiRNA target sequence
tcttcctacagaagatgaa

SEQ ID NO: 224658 - DNA, 19 bp, Artificial sequence
  SiRNA target sequence
cttcctacagaagatgaaa

SEQ ID NO: 224659 - DNA, 19 bp, Artificial sequence
  SiRNA target sequence
ttcctacagaagatgaaat

SEQ ID NO: 224660 - DNA, 19 bp, Artificial sequence
  SiRNA target sequence
tcctacagaagatgaaatt

SEQ ID NO: 224661 - DNA, 19 bp, Artificial sequence
  SiRNA target sequence
cctacagaagatgaaattg

SEQ ID NO: 224662 - DNA, 19 bp, Artificial sequence
  SiRNA target sequence
ctacagaagatgaaattga

SEQ ID NO: 224663 - DNA, 19 bp, Artificial sequence
  SiRNA target sequence
tacagaagatgaaattgag

SEQ ID NO: 224664 - DNA, 19 bp, Artificial sequence
  SiRNA target sequence
acagaagatgaaattgagt

SEQ ID NO: 224665 - DNA, 19 bp, Artificial sequence
  SiRNA target sequence
cagaagatgaaattgagta

SEQ ID NO: 224666 - DNA, 19 bp, Artificial sequence
  SiRNA target sequence
agaagatgaaattgagtat

SEQ ID NO: 224667 - DNA, 19 bp, Artificial sequence
  SiRNA target sequence
gaagatgaaattgagtatg

SEQ ID NO: 224668 - DNA, 19 bp, Artificial sequence
  SiRNA target sequence
aagatgaaattgagtatga

SEQ ID NO: 224669 - DNA, 19 bp, Artificial sequence
  SiRNA target sequence
agatgaaattgagtatgag

SEQ ID NO: 224670 - DNA, 19 bp, Artificial sequence
  SiRNA target sequence
gatgaaattgagtatgagg

SEQ ID NO: 224671 - DNA, 19 bp, Artificial sequence
  SiRNA target sequence
atgaaattgagtatgaggc

SEQ ID NO: 224672 - DNA, 19 bp, Artificial sequence
  SiRNA target sequence
tgaaattgagtatgaggcc

SEQ ID NO: 224673 - DNA, 19 bp, Artificial sequence
  SiRNA target sequence
gaaattgagtatgaggcca

SEQ ID NO: 224674 - DNA, 19 bp, Artificial sequence
  SiRNA target sequence
aaattgagtatgaggccag

SEQ ID NO: 224675 - DNA, 19 bp, Artificial sequence
  SiRNA target sequence
aattgagtatgaggccagc

SEQ ID NO: 224676 - DNA, 19 bp, Artificial sequence
  SiRNA target sequence
attgagtatgaggccagca

SEQ ID NO: 224677 - DNA, 19 bp, Artificial sequence
  SiRNA target sequence
ttgagtatgaggccagcaa

SEQ ID NO: 224678 - DNA, 19 bp, Artificial sequence
  SiRNA target sequence
tgagtatgaggccagcaat

SEQ ID NO: 224679 - DNA, 19 bp, Artificial sequence
  SiRNA target sequence
gagtatgaggccagcaatg

SEQ ID NO: 224680 - DNA, 19 bp, Artificial sequence
  SiRNA target sequence
agtatgaggccagcaatgg

SEQ ID NO: 224681 - DNA, 19 bp, Artificial sequence
  SiRNA target sequence
gtatgaggccagcaatggt

SEQ ID NO: 224682 - DNA, 19 bp, Artificial sequence
  SiRNA target sequence
tatgaggccagcaatggtt

SEQ ID NO: 224683 - DNA, 19 bp, Artificial sequence
  SiRNA target sequence
atgaggccagcaatggttc

SEQ ID NO: 224684 - DNA, 19 bp, Artificial sequence
  SiRNA target sequence
tgaggccagcaatggttct

SEQ ID NO: 224685 - DNA, 19 bp, Artificial sequence
  SiRNA target sequence
gaggccagcaatggttctg

SEQ ID NO: 224686 - DNA, 19 bp, Artificial sequence
  SiRNA target sequence
aggccagcaatggttctgg

SEQ ID NO: 224687 - DNA, 19 bp, Artificial sequence
  SiRNA target sequence
ggccagcaatggttctggt

SEQ ID NO: 224688 - DNA, 19 bp, Artificial sequence
  SiRNA target sequence
gccagcaatggttctggta

SEQ ID NO: 224689 - DNA, 19 bp, Artificial sequence
  SiRNA target sequence
ccagcaatggttctggtat

SEQ ID NO: 224690 - DNA, 19 bp, Artificial sequence
  SiRNA target sequence
cagcaatggttctggtata

SEQ ID NO: 224691 - DNA, 19 bp, Artificial sequence
  SiRNA target sequence
agcaatggttctggtatat

SEQ ID NO: 224692 - DNA, 19 bp, Artificial sequence
  SiRNA target sequence
gcaatggttctggtatata

SEQ ID NO: 224693 - DNA, 19 bp, Artificial sequence
  SiRNA target sequence
caatggttctggtatatat

SEQ ID NO: 224694 - DNA, 19 bp, Artificial sequence
  SiRNA target sequence
aatggttctggtatatatt

SEQ ID NO: 224695 - DNA, 19 bp, Artificial sequence
  SiRNA target sequence
atggttctggtatatattc

SEQ ID NO: 224696 - DNA, 19 bp, Artificial sequence
  SiRNA target sequence
tggttctggtatatattca

SEQ ID NO: 224697 - DNA, 19 bp, Artificial sequence
  SiRNA target sequence
ggttctggtatatattcac

SEQ ID NO: 224698 - DNA, 19 bp, Artificial sequence
  SiRNA target sequence
gttctggtatatattcact

SEQ ID NO: 224699 - DNA, 19 bp, Artificial sequence
  SiRNA target sequence
ttctggtatatattcactt

SEQ ID NO: 224700 - DNA, 19 bp, Artificial sequence
  SiRNA target sequence
tctggtatatattcactta

SEQ ID NO: 224701 - DNA, 19 bp, Artificial sequence
  SiRNA target sequence
ctggtatatattcacttat

SEQ ID NO: 224702 - DNA, 19 bp, Artificial sequence
  SiRNA target sequence
tggtatatattcacttatt

SEQ ID NO: 224703 - DNA, 19 bp, Artificial sequence
  SiRNA target sequence
ggtatatattcacttatta

SEQ ID NO: 224704 - DNA, 19 bp, Artificial sequence
  SiRNA target sequence
gtatatattcacttattag

SEQ ID NO: 224705 - DNA, 19 bp, Artificial sequence
  SiRNA target sequence
tatatattcacttattaga

SEQ ID NO: 224706 - DNA, 19 bp, Artificial sequence
  SiRNA target sequence
atatattcacttattagag

SEQ ID NO: 224707 - DNA, 19 bp, Artificial sequence
  SiRNA target sequence
tatattcacttattagagt

SEQ ID NO: 224708 - DNA, 19 bp, Artificial sequence
  SiRNA target sequence
atattcacttattagagta

SEQ ID NO: 224709 - DNA, 19 bp, Artificial sequence
  SiRNA target sequence
tattcacttattagagtag

SEQ ID NO: 224710 - DNA, 19 bp, Artificial sequence
  SiRNA target sequence
attcacttattagagtagc

SEQ ID NO: 224711 - DNA, 19 bp, Artificial sequence
  SiRNA target sequence
ttcacttattagagtagca

SEQ ID NO: 224712 - DNA, 19 bp, Artificial sequence
  SiRNA target sequence
tcacttattagagtagcaa

SEQ ID NO: 224713 - DNA, 19 bp, Artificial sequence
  SiRNA target sequence
cacttattagagtagcaaa

SEQ ID NO: 224714 - DNA, 19 bp, Artificial sequence
  SiRNA target sequence
acttattagagtagcaaag

SEQ ID NO: 224715 - DNA, 19 bp, Artificial sequence
  SiRNA target sequence
cttattagagtagcaaagg

SEQ ID NO: 224716 - DNA, 19 bp, Artificial sequence
  SiRNA target sequence
ttattagagtagcaaaggt

SEQ ID NO: 224717 - DNA, 19 bp, Artificial sequence
  SiRNA target sequence
tattagagtagcaaaggtt

SEQ ID NO: 224718 - DNA, 19 bp, Artificial sequence
  SiRNA target sequence
attagagtagcaaaggttg

SEQ ID NO: 224719 - DNA, 19 bp, Artificial sequence
  SiRNA target sequence
ttagagtagcaaaggttga

SEQ ID NO: 224720 - DNA, 19 bp, Artificial sequence
  SiRNA target sequence
tagagtagcaaaggttgag

SEQ ID NO: 224721 - DNA, 19 bp, Artificial sequence
  SiRNA target sequence
agagtagcaaaggttgaga

SEQ ID NO: 224722 - DNA, 19 bp, Artificial sequence
  SiRNA target sequence
gagtagcaaaggttgagag

SEQ ID NO: 224723 - DNA, 19 bp, Artificial sequence
  SiRNA target sequence
agtagcaaaggttgagaga

SEQ ID NO: 224724 - DNA, 19 bp, Artificial sequence
  SiRNA target sequence
gtagcaaaggttgagagaa

SEQ ID NO: 224725 - DNA, 19 bp, Artificial sequence
  SiRNA target sequence
tagcaaaggttgagagaaa

SEQ ID NO: 224726 - DNA, 19 bp, Artificial sequence
  SiRNA target sequence
agcaaaggttgagagaaag

SEQ ID NO: 224727 - DNA, 19 bp, Artificial sequence
  SiRNA target sequence
gcaaaggttgagagaaaga

SEQ ID NO: 224728 - DNA, 19 bp, Artificial sequence
  SiRNA target sequence
caaaggttgagagaaagat

SEQ ID NO: 224729 - DNA, 19 bp, Artificial sequence
  SiRNA target sequence
aaaggttgagagaaagatg

SEQ ID NO: 224730 - DNA, 19 bp, Artificial sequence
  SiRNA target sequence
aaggttgagagaaagatgt

SEQ ID NO: 224731 - DNA, 19 bp, Artificial sequence
  SiRNA target sequence
aggttgagagaaagatgtt

SEQ ID NO: 224732 - DNA, 19 bp, Artificial sequence
  SiRNA target sequence
ggttgagagaaagatgttt

SEQ ID NO: 224733 - DNA, 19 bp, Artificial sequence
  SiRNA target sequence
gttgagagaaagatgtttt

SEQ ID NO: 224734 - DNA, 19 bp, Artificial sequence
  SiRNA target sequence
ttgagagaaagatgttttg

SEQ ID NO: 224735 - DNA, 19 bp, Artificial sequence
  SiRNA target sequence
tgagagaaagatgttttgg

SEQ ID NO: 224736 - DNA, 19 bp, Artificial sequence
  SiRNA target sequence
gagagaaagatgttttgga

SEQ ID NO: 224737 - DNA, 19 bp, Artificial sequence
  SiRNA target sequence
agagaaagatgttttggat

SEQ ID NO: 224738 - DNA, 19 bp, Artificial sequence
  SiRNA target sequence
gagaaagatgttttggatc

SEQ ID NO: 224739 - DNA, 19 bp, Artificial sequence
  SiRNA target sequence
agaaagatgttttggatca

SEQ ID NO: 224740 - DNA, 19 bp, Artificial sequence
  SiRNA target sequence
gaaagatgttttggatcat

SEQ ID NO: 224741 - DNA, 19 bp, Artificial sequence
  SiRNA target sequence
aaagatgttttggatcatg

SEQ ID NO: 224742 - DNA, 19 bp, Artificial sequence
  SiRNA target sequence
aagatgttttggatcatgg

SEQ ID NO: 224743 - DNA, 19 bp, Artificial sequence
  SiRNA target sequence
agatgttttggatcatggc

SEQ ID NO: 224744 - DNA, 19 bp, Artificial sequence
  SiRNA target sequence
gatgttttggatcatggca

SEQ ID NO: 224745 - DNA, 19 bp, Artificial sequence
  SiRNA target sequence
atgttttggatcatggcag

SEQ ID NO: 224746 - DNA, 19 bp, Artificial sequence
  SiRNA target sequence
tgttttggatcatggcagc

SEQ ID NO: 224747 - DNA, 19 bp, Artificial sequence
  SiRNA target sequence
gttttggatcatggcagct

SEQ ID NO: 224748 - DNA, 19 bp, Artificial sequence
  SiRNA target sequence
ttttggatcatggcagcta

SEQ ID NO: 224749 - DNA, 19 bp, Artificial sequence
  SiRNA target sequence
tttggatcatggcagctat

SEQ ID NO: 224750 - DNA, 19 bp, Artificial sequence
  SiRNA target sequence
ttggatcatggcagctatg

SEQ ID NO: 224751 - DNA, 19 bp, Artificial sequence
  SiRNA target sequence
tggatcatggcagctatgt

SEQ ID NO: 224752 - DNA, 19 bp, Artificial sequence
  SiRNA target sequence
ggatcatggcagctatgtt

SEQ ID NO: 224753 - DNA, 19 bp, Artificial sequence
  SiRNA target sequence
gatcatggcagctatgttc

SEQ ID NO: 224754 - DNA, 19 bp, Artificial sequence
  SiRNA target sequence
atcatggcagctatgttct

SEQ ID NO: 224755 - DNA, 19 bp, Artificial sequence
  SiRNA target sequence
tcatggcagctatgttctt

SEQ ID NO: 224756 - DNA, 19 bp, Artificial sequence
  SiRNA target sequence
catggcagctatgttcttt

SEQ ID NO: 224757 - DNA, 19 bp, Artificial sequence
  SiRNA target sequence
atggcagctatgttcttta

SEQ ID NO: 224758 - DNA, 19 bp, Artificial sequence
  SiRNA target sequence
tggcagctatgttctttat

SEQ ID NO: 224759 - DNA, 19 bp, Artificial sequence
  SiRNA target sequence
ggcagctatgttctttatt

SEQ ID NO: 224760 - DNA, 19 bp, Artificial sequence
  SiRNA target sequence
gcagctatgttctttatta

SEQ ID NO: 224761 - DNA, 19 bp, Artificial sequence
  SiRNA target sequence
cagctatgttctttattat

SEQ ID NO: 224762 - DNA, 19 bp, Artificial sequence
  SiRNA target sequence
agctatgttctttattatc

SEQ ID NO: 224763 - DNA, 19 bp, Artificial sequence
  SiRNA target sequence
gctatgttctttattatct

SEQ ID NO: 224764 - DNA, 19 bp, Artificial sequence
  SiRNA target sequence
ctatgttctttattatctc

SEQ ID NO: 224765 - DNA, 19 bp, Artificial sequence
  SiRNA target sequence
tatgttctttattatctcc

SEQ ID NO: 224766 - DNA, 19 bp, Artificial sequence
  SiRNA target sequence
atgttctttattatctcct

SEQ ID NO: 224767 - DNA, 19 bp, Artificial sequence
  SiRNA target sequence
tgttctttattatctcctt

SEQ ID NO: 224768 - DNA, 19 bp, Artificial sequence
  SiRNA target sequence
gttctttattatctccttt

SEQ ID NO: 224769 - DNA, 19 bp, Artificial sequence
  SiRNA target sequence
ttctttattatctccttta

SEQ ID NO: 224770 - DNA, 19 bp, Artificial sequence
  SiRNA target sequence
tctttattatctcctttat

SEQ ID NO: 224771 - DNA, 19 bp, Artificial sequence
  SiRNA target sequence
ctttattatctcctttatt

SEQ ID NO: 224772 - DNA, 19 bp, Artificial sequence
  SiRNA target sequence
tttattatctcctttattt

SEQ ID NO: 224773 - DNA, 19 bp, Artificial sequence
  SiRNA target sequence
ttattatctcctttattta

SEQ ID NO: 224774 - DNA, 19 bp, Artificial sequence
  SiRNA target sequence
tattatctcctttatttat

SEQ ID NO: 224775 - DNA, 19 bp, Artificial sequence
  SiRNA target sequence
attatctcctttatttatt

SEQ ID NO: 224776 - DNA, 19 bp, Artificial sequence
  SiRNA target sequence
ttatctcctttatttattc

SEQ ID NO: 224777 - DNA, 19 bp, Artificial sequence
  SiRNA target sequence
tatctcctttatttattcg

SEQ ID NO: 224778 - DNA, 19 bp, Artificial sequence
  SiRNA target sequence
atctcctttatttattcgg

SEQ ID NO: 224779 - DNA, 19 bp, Artificial sequence
  SiRNA target sequence
tctcctttatttattcggt

SEQ ID NO: 224780 - DNA, 19 bp, Artificial sequence
  SiRNA target sequence
ctcctttatttattcggtg

SEQ ID NO: 224781 - DNA, 19 bp, Artificial sequence
  SiRNA target sequence
tcctttatttattcggtgg

SEQ ID NO: 224782 - DNA, 19 bp, Artificial sequence
  SiRNA target sequence
cctttatttattcggtggc

SEQ ID NO: 224783 - DNA, 19 bp, Artificial sequence
  SiRNA target sequence
ctttatttattcggtggct

SEQ ID NO: 224784 - DNA, 19 bp, Artificial sequence
  SiRNA target sequence
tttatttattcggtggcta

SEQ ID NO: 224785 - DNA, 19 bp, Artificial sequence
  SiRNA target sequence
ttatttattcggtggctag

SEQ ID NO: 224786 - DNA, 19 bp, Artificial sequence
  SiRNA target sequence
tatttattcggtggctaga

SEQ ID NO: 224787 - DNA, 19 bp, Artificial sequence
  SiRNA target sequence
atttattcggtggctagag

SEQ ID NO: 224788 - DNA, 19 bp, Artificial sequence
  SiRNA target sequence
tttattcggtggctagagt

SEQ ID NO: 224789 - DNA, 19 bp, Artificial sequence
  SiRNA target sequence
ttattcggtggctagagtg

SEQ ID NO: 224790 - DNA, 19 bp, Artificial sequence
  SiRNA target sequence
tattcggtggctagagtgc

SEQ ID NO: 224791 - DNA, 19 bp, Artificial sequence
  SiRNA target sequence
attcggtggctagagtgct

SEQ ID NO: 224792 - DNA, 19 bp, Artificial sequence
  SiRNA target sequence
ttcggtggctagagtgctt

SEQ ID NO: 224793 - DNA, 19 bp, Artificial sequence
  SiRNA target sequence
tcggtggctagagtgctta

SEQ ID NO: 224794 - DNA, 19 bp, Artificial sequence
  SiRNA target sequence
cggtggctagagtgcttaa

SEQ ID NO: 224795 - DNA, 19 bp, Artificial sequence
  SiRNA target sequence
ggtggctagagtgcttaaa

SEQ ID NO: 224796 - DNA, 19 bp, Artificial sequence
  SiRNA target sequence
gtggctagagtgcttaaag

SEQ ID NO: 224797 - DNA, 19 bp, Artificial sequence
  SiRNA target sequence
tggctagagtgcttaaaga

SEQ ID NO: 224798 - DNA, 19 bp, Artificial sequence
  SiRNA target sequence
ggctagagtgcttaaagat

SEQ ID NO: 224799 - DNA, 19 bp, Artificial sequence
  SiRNA target sequence
gctagagtgcttaaagatg

SEQ ID NO: 224800 - DNA, 19 bp, Artificial sequence
  SiRNA target sequence
ctagagtgcttaaagatgc

SEQ ID NO: 224801 - DNA, 19 bp, Artificial sequence
  SiRNA target sequence
tagagtgcttaaagatgcc

SEQ ID NO: 224802 - DNA, 19 bp, Artificial sequence
  SiRNA target sequence
agagtgcttaaagatgccg

SEQ ID NO: 224803 - DNA, 19 bp, Artificial sequence
  SiRNA target sequence
gagtgcttaaagatgccgc

SEQ ID NO: 224804 - DNA, 19 bp, Artificial sequence
  SiRNA target sequence
agtgcttaaagatgccgct

SEQ ID NO: 224805 - DNA, 19 bp, Artificial sequence
  SiRNA target sequence
gtgcttaaagatgccgctg

SEQ ID NO: 224806 - DNA, 19 bp, Artificial sequence
  SiRNA target sequence
tgcttaaagatgccgctgt

SEQ ID NO: 224807 - DNA, 19 bp, Artificial sequence
  SiRNA target sequence
gcttaaagatgccgctgtt

SEQ ID NO: 224808 - DNA, 19 bp, Artificial sequence
  SiRNA target sequence
cttaaagatgccgctgtta

SEQ ID NO: 224809 - DNA, 19 bp, Artificial sequence
  SiRNA target sequence
ttaaagatgccgctgttat

SEQ ID NO: 224810 - DNA, 19 bp, Artificial sequence
  SiRNA target sequence
taaagatgccgctgttatt

SEQ ID NO: 224811 - DNA, 19 bp, Artificial sequence
  SiRNA target sequence
aaagatgccgctgttattg

SEQ ID NO: 224812 - DNA, 19 bp, Artificial sequence
  SiRNA target sequence
aagatgccgctgttattgg

SEQ ID NO: 224813 - DNA, 19 bp, Artificial sequence
  SiRNA target sequence
agatgccgctgttattggt

SEQ ID NO: 224814 - DNA, 19 bp, Artificial sequence
  SiRNA target sequence
gatgccgctgttattggta

SEQ ID NO: 224815 - DNA, 19 bp, Artificial sequence
  SiRNA target sequence
atgccgctgttattggtaa

SEQ ID NO: 224816 - DNA, 19 bp, Artificial sequence
  SiRNA target sequence
tgccgctgttattggtaaa

SEQ ID NO: 224817 - DNA, 19 bp, Artificial sequence
  SiRNA target sequence
gccgctgttattggtaaac

SEQ ID NO: 224818 - DNA, 19 bp, Artificial sequence
  SiRNA target sequence
ccgctgttattggtaaaca

SEQ ID NO: 224819 - DNA, 19 bp, Artificial sequence
  SiRNA target sequence
cgctgttattggtaaacaa

SEQ ID NO: 224820 - DNA, 19 bp, Artificial sequence
  SiRNA target sequence
gctgttattggtaaacaac

SEQ ID NO: 224821 - DNA, 19 bp, Artificial sequence
  SiRNA target sequence
ctgttattggtaaacaact

SEQ ID NO: 224822 - DNA, 19 bp, Artificial sequence
  SiRNA target sequence
tgttattggtaaacaactc

SEQ ID NO: 224823 - DNA, 19 bp, Artificial sequence
  SiRNA target sequence
gttattggtaaacaactcc

SEQ ID NO: 224824 - DNA, 19 bp, Artificial sequence
  SiRNA target sequence
ttattggtaaacaactccc

SEQ ID NO: 224825 - DNA, 19 bp, Artificial sequence
  SiRNA target sequence
tattggtaaacaactccca

SEQ ID NO: 224826 - DNA, 19 bp, Artificial sequence
  SiRNA target sequence
attggtaaacaactcccag

SEQ ID NO: 224827 - DNA, 19 bp, Artificial sequence
  SiRNA target sequence
ttggtaaacaactcccagc

SEQ ID NO: 224828 - DNA, 19 bp, Artificial sequence
  SiRNA target sequence
tggtaaacaactcccagcg

SEQ ID NO: 224829 - DNA, 19 bp, Artificial sequence
  SiRNA target sequence
ggtaaacaactcccagcgt

SEQ ID NO: 224830 - DNA, 19 bp, Artificial sequence
  SiRNA target sequence
gtaaacaactcccagcgtc

SEQ ID NO: 224831 - DNA, 19 bp, Artificial sequence
  SiRNA target sequence
taaacaactcccagcgtca

SEQ ID NO: 224832 - DNA, 19 bp, Artificial sequence
  SiRNA target sequence
aaacaactcccagcgtcaa

SEQ ID NO: 224833 - DNA, 19 bp, Artificial sequence
  SiRNA target sequence
aacaactcccagcgtcaat

SEQ ID NO: 224834 - DNA, 19 bp, Artificial sequence
  SiRNA target sequence
acaactcccagcgtcaatt

SEQ ID NO: 224835 - DNA, 19 bp, Artificial sequence
  SiRNA target sequence
caactcccagcgtcaattt

SEQ ID NO: 224836 - DNA, 19 bp, Artificial sequence
  SiRNA target sequence
aactcccagcgtcaatttt

SEQ ID NO: 224837 - DNA, 19 bp, Artificial sequence
  SiRNA target sequence
actcccagcgtcaattttc

SEQ ID NO: 224838 - DNA, 19 bp, Artificial sequence
  SiRNA target sequence
ctcccagcgtcaattttct

SEQ ID NO: 224839 - DNA, 19 bp, Artificial sequence
  SiRNA target sequence
tcccagcgtcaattttctt

SEQ ID NO: 224840 - DNA, 19 bp, Artificial sequence
  SiRNA target sequence
cccagcgtcaattttcttt

SEQ ID NO: 224841 - DNA, 19 bp, Artificial sequence
  SiRNA target sequence
ccagcgtcaattttctttt

SEQ ID NO: 224842 - DNA, 19 bp, Artificial sequence
  SiRNA target sequence
cagcgtcaattttcttttt

SEQ ID NO: 224843 - DNA, 19 bp, Artificial sequence
  SiRNA target sequence
agcgtcaattttctttttg

SEQ ID NO: 224844 - DNA, 19 bp, Artificial sequence
  SiRNA target sequence
gcgtcaattttctttttga

SEQ ID NO: 224845 - DNA, 19 bp, Artificial sequence
  SiRNA target sequence
cgtcaattttctttttgaa

SEQ ID NO: 224846 - DNA, 19 bp, Artificial sequence
  SiRNA target sequence
gtcaattttctttttgaaa

SEQ ID NO: 224847 - DNA, 19 bp, Artificial sequence
  SiRNA target sequence
tcaattttctttttgaaat

SEQ ID NO: 224848 - DNA, 19 bp, Artificial sequence
  SiRNA target sequence
caattttctttttgaaatt

SEQ ID NO: 224849 - DNA, 19 bp, Artificial sequence
  SiRNA target sequence
aattttctttttgaaattt

SEQ ID NO: 224850 - DNA, 19 bp, Artificial sequence
  SiRNA target sequence
attttctttttgaaatttg

SEQ ID NO: 224851 - DNA, 19 bp, Artificial sequence
  SiRNA target sequence
ttttctttttgaaatttgt

SEQ ID NO: 224852 - DNA, 19 bp, Artificial sequence
  SiRNA target sequence
tttctttttgaaatttgtt

SEQ ID NO: 224853 - DNA, 19 bp, Artificial sequence
  SiRNA target sequence
ttctttttgaaatttgtta

SEQ ID NO: 224854 - DNA, 19 bp, Artificial sequence
  SiRNA target sequence
tctttttgaaatttgttat

SEQ ID NO: 224855 - DNA, 19 bp, Artificial sequence
  SiRNA target sequence
ctttttgaaatttgttatt

SEQ ID NO: 224856 - DNA, 19 bp, Artificial sequence
  SiRNA target sequence
tttttgaaatttgttatta

SEQ ID NO: 224857 - DNA, 19 bp, Artificial sequence
  SiRNA target sequence
ttttgaaatttgttattat

SEQ ID NO: 224858 - DNA, 19 bp, Artificial sequence
  SiRNA target sequence
tttgaaatttgttattatc

SEQ ID NO: 224859 - DNA, 19 bp, Artificial sequence
  SiRNA target sequence
ttgaaatttgttattatcc

SEQ ID NO: 224860 - DNA, 19 bp, Artificial sequence
  SiRNA target sequence
tgaaatttgttattatcct

SEQ ID NO: 224861 - DNA, 19 bp, Artificial sequence
  SiRNA target sequence
gaaatttgttattatcctt

SEQ ID NO: 224862 - DNA, 19 bp, Artificial sequence
  SiRNA target sequence
aaatttgttattatccttc

SEQ ID NO: 224863 - DNA, 19 bp, Artificial sequence
  SiRNA target sequence
aatttgttattatccttcc

SEQ ID NO: 224864 - DNA, 19 bp, Artificial sequence
  SiRNA target sequence
atttgttattatccttccg

SEQ ID NO: 224865 - DNA, 19 bp, Artificial sequence
  SiRNA target sequence
tttgttattatccttccgt

SEQ ID NO: 224866 - DNA, 19 bp, Artificial sequence
  SiRNA target sequence
ttgttattatccttccgtt

SEQ ID NO: 224867 - DNA, 19 bp, Artificial sequence
  SiRNA target sequence
tgttattatccttccgttc

SEQ ID NO: 224868 - DNA, 19 bp, Artificial sequence
  SiRNA target sequence
gttattatccttccgttct

SEQ ID NO: 224869 - DNA, 19 bp, Artificial sequence
  SiRNA target sequence
ttattatccttccgttctc

SEQ ID NO: 224870 - DNA, 19 bp, Artificial sequence
  SiRNA target sequence
tattatccttccgttctca

SEQ ID NO: 224871 - DNA, 19 bp, Artificial sequence
  SiRNA target sequence
attatccttccgttctcat

SEQ ID NO: 224872 - DNA, 19 bp, Artificial sequence
  SiRNA target sequence
ttatccttccgttctcatt

SEQ ID NO: 224873 - DNA, 19 bp, Artificial sequence
  SiRNA target sequence
tatccttccgttctcattt

SEQ ID NO: 224874 - DNA, 19 bp, Artificial sequence
  SiRNA target sequence
atccttccgttctcattta

SEQ ID NO: 224875 - DNA, 19 bp, Artificial sequence
  SiRNA target sequence
tccttccgttctcatttat

SEQ ID NO: 224876 - DNA, 19 bp, Artificial sequence
  SiRNA target sequence
ccttccgttctcatttatt

SEQ ID NO: 224877 - DNA, 19 bp, Artificial sequence
  SiRNA target sequence
cttccgttctcatttattt

SEQ ID NO: 224878 - DNA, 19 bp, Artificial sequence
  SiRNA target sequence
ttccgttctcatttatttc

SEQ ID NO: 224879 - DNA, 19 bp, Artificial sequence
  SiRNA target sequence
tccgttctcatttatttca

SEQ ID NO: 224880 - DNA, 19 bp, Artificial sequence
  SiRNA target sequence
ccgttctcatttatttcag

SEQ ID NO: 224881 - DNA, 19 bp, Artificial sequence
  SiRNA target sequence
cgttctcatttatttcagt

SEQ ID NO: 224882 - DNA, 19 bp, Artificial sequence
  SiRNA target sequence
gttctcatttatttcagta

SEQ ID NO: 224883 - DNA, 19 bp, Artificial sequence
  SiRNA target sequence
ttctcatttatttcagtag

SEQ ID NO: 224884 - DNA, 19 bp, Artificial sequence
  SiRNA target sequence
tctcatttatttcagtagg

SEQ ID NO: 224885 - DNA, 19 bp, Artificial sequence
  SiRNA target sequence
ctcatttatttcagtaggt

SEQ ID NO: 224886 - DNA, 19 bp, Artificial sequence
  SiRNA target sequence
tcatttatttcagtaggta

SEQ ID NO: 224887 - DNA, 19 bp, Artificial sequence
  SiRNA target sequence
catttatttcagtaggtat

SEQ ID NO: 224888 - DNA, 19 bp, Artificial sequence
  SiRNA target sequence
atttatttcagtaggtatt

SEQ ID NO: 224889 - DNA, 19 bp, Artificial sequence
  SiRNA target sequence
tttatttcagtaggtatta

SEQ ID NO: 224890 - DNA, 19 bp, Artificial sequence
  SiRNA target sequence
ttatttcagtaggtattat

SEQ ID NO: 224891 - DNA, 19 bp, Artificial sequence
  SiRNA target sequence
tatttcagtaggtattatt

SEQ ID NO: 224892 - DNA, 19 bp, Artificial sequence
  SiRNA target sequence
atttcagtaggtattattc

SEQ ID NO: 224893 - DNA, 19 bp, Artificial sequence
  SiRNA target sequence
tttcagtaggtattattca

SEQ ID NO: 224894 - DNA, 19 bp, Artificial sequence
  SiRNA target sequence
ttcagtaggtattattcag

SEQ ID NO: 224895 - DNA, 19 bp, Artificial sequence
  SiRNA target sequence
tcagtaggtattattcaga

SEQ ID NO: 224896 - DNA, 19 bp, Artificial sequence
  SiRNA target sequence
cagtaggtattattcagaa

SEQ ID NO: 224897 - DNA, 19 bp, Artificial sequence
  SiRNA target sequence
agtaggtattattcagaaa

SEQ ID NO: 224898 - DNA, 19 bp, Artificial sequence
  SiRNA target sequence
gtaggtattattcagaaag

SEQ ID NO: 224899 - DNA, 19 bp, Artificial sequence
  SiRNA target sequence
taggtattattcagaaagc

SEQ ID NO: 224900 - DNA, 19 bp, Artificial sequence
  SiRNA target sequence
aggtattattcagaaagct

SEQ ID NO: 224901 - DNA, 19 bp, Artificial sequence
  SiRNA target sequence
ggtattattcagaaagctt

SEQ ID NO: 224902 - DNA, 19 bp, Artificial sequence
  SiRNA target sequence
gtattattcagaaagcttt

SEQ ID NO: 224903 - DNA, 19 bp, Artificial sequence
  SiRNA target sequence
tattattcagaaagcttta

SEQ ID NO: 224904 - DNA, 19 bp, Artificial sequence
  SiRNA target sequence
attattcagaaagctttag

SEQ ID NO: 224905 - DNA, 19 bp, Artificial sequence
  SiRNA target sequence
ttattcagaaagctttaga

SEQ ID NO: 224906 - DNA, 19 bp, Artificial sequence
  SiRNA target sequence
tattcagaaagctttagat

SEQ ID NO: 224907 - DNA, 19 bp, Artificial sequence
  SiRNA target sequence
attcagaaagctttagata

SEQ ID NO: 224908 - DNA, 19 bp, Artificial sequence
  SiRNA target sequence
ttcagaaagctttagataa

SEQ ID NO: 224909 - DNA, 19 bp, Artificial sequence
  SiRNA target sequence
tcagaaagctttagataaa

SEQ ID NO: 224910 - DNA, 19 bp, Artificial sequence
  SiRNA target sequence
cagaaagctttagataaat

SEQ ID NO: 224911 - DNA, 19 bp, Artificial sequence
  SiRNA target sequence
agaaagctttagataaata

SEQ ID NO: 224912 - DNA, 19 bp, Artificial sequence
  SiRNA target sequence
gaaagctttagataaatat

SEQ ID NO: 224913 - DNA, 19 bp, Artificial sequence
  SiRNA target sequence
aaagctttagataaatatc

SEQ ID NO: 224914 - DNA, 19 bp, Artificial sequence
  SiRNA target sequence
aagctttagataaatatcc

SEQ ID NO: 224915 - DNA, 19 bp, Artificial sequence
  SiRNA target sequence
agctttagataaatatcct

SEQ ID NO: 224916 - DNA, 19 bp, Artificial sequence
  SiRNA target sequence
gctttagataaatatcctt

SEQ ID NO: 224917 - DNA, 19 bp, Artificial sequence
  SiRNA target sequence
ctttagataaatatccttt

SEQ ID NO: 224918 - DNA, 19 bp, Artificial sequence
  SiRNA target sequence
tttagataaatatcctttt

SEQ ID NO: 224919 - DNA, 19 bp, Artificial sequence
  SiRNA target sequence
ttagataaatatcctttta

SEQ ID NO: 224920 - DNA, 19 bp, Artificial sequence
  SiRNA target sequence
tagataaatatccttttac

SEQ ID NO: 224921 - DNA, 19 bp, Artificial sequence
  SiRNA target sequence
agataaatatccttttaca

SEQ ID NO: 224922 - DNA, 19 bp, Artificial sequence
  SiRNA target sequence
gataaatatccttttacaa

SEQ ID NO: 224923 - DNA, 19 bp, Artificial sequence
  SiRNA target sequence
ataaatatccttttacaaa

SEQ ID NO: 224924 - DNA, 19 bp, Artificial sequence
  SiRNA target sequence
taaatatccttttacaaaa

SEQ ID NO: 224925 - DNA, 19 bp, Artificial sequence
  SiRNA target sequence
aaatatccttttacaaaaa

SEQ ID NO: 224926 - DNA, 19 bp, Artificial sequence
  SiRNA target sequence
aatatccttttacaaaaat

SEQ ID NO: 224927 - DNA, 19 bp, Artificial sequence
  SiRNA target sequence
atatccttttacaaaaata

SEQ ID NO: 224928 - DNA, 19 bp, Artificial sequence
  SiRNA target sequence
tatccttttacaaaaatat

SEQ ID NO: 224929 - DNA, 19 bp, Artificial sequence
  SiRNA target sequence
atccttttacaaaaatatt

SEQ ID NO: 224930 - DNA, 19 bp, Artificial sequence
  SiRNA target sequence
tccttttacaaaaatattt

SEQ ID NO: 224931 - DNA, 19 bp, Artificial sequence
  SiRNA target sequence
ccttttacaaaaatatttg

SEQ ID NO: 224932 - DNA, 19 bp, Artificial sequence
  SiRNA target sequence
cttttacaaaaatatttga

SEQ ID NO: 224933 - DNA, 19 bp, Artificial sequence
  SiRNA target sequence
ttttacaaaaatatttgat

SEQ ID NO: 224934 - DNA, 19 bp, Artificial sequence
  SiRNA target sequence
tttacaaaaatatttgatg

SEQ ID NO: 224935 - DNA, 19 bp, Artificial sequence
  SiRNA target sequence
ttacaaaaatatttgatgt

SEQ ID NO: 224936 - DNA, 19 bp, Artificial sequence
  SiRNA target sequence
tacaaaaatatttgatgta

SEQ ID NO: 224937 - DNA, 19 bp, Artificial sequence
  SiRNA target sequence
acaaaaatatttgatgtaa

SEQ ID NO: 224938 - DNA, 19 bp, Artificial sequence
  SiRNA target sequence
caaaaatatttgatgtaac

SEQ ID NO: 224939 - DNA, 19 bp, Artificial sequence
  SiRNA target sequence
aaaaatatttgatgtaact

SEQ ID NO: 224940 - DNA, 19 bp, Artificial sequence
  SiRNA target sequence
aaaatatttgatgtaactt

SEQ ID NO: 224941 - DNA, 19 bp, Artificial sequence
  SiRNA target sequence
aaatatttgatgtaacttt

SEQ ID NO: 224942 - DNA, 19 bp, Artificial sequence
  SiRNA target sequence
aatatttgatgtaacttta

SEQ ID NO: 224943 - DNA, 19 bp, Artificial sequence
  SiRNA target sequence
atatttgatgtaactttaa

SEQ ID NO: 224944 - DNA, 19 bp, Artificial sequence
  SiRNA target sequence
tatttgatgtaactttaat

SEQ ID NO: 224945 - DNA, 19 bp, Artificial sequence
  SiRNA target sequence
atttgatgtaactttaata

SEQ ID NO: 224946 - DNA, 19 bp, Artificial sequence
  SiRNA target sequence
tttgatgtaactttaatag

SEQ ID NO: 224947 - DNA, 19 bp, Artificial sequence
  SiRNA target sequence
ttgatgtaactttaatagt

SEQ ID NO: 224948 - DNA, 19 bp, Artificial sequence
  SiRNA target sequence
tgatgtaactttaatagtt

SEQ ID NO: 224949 - DNA, 19 bp, Artificial sequence
  SiRNA target sequence
gatgtaactttaatagttt

SEQ ID NO: 224950 - DNA, 19 bp, Artificial sequence
  SiRNA target sequence
atgtaactttaatagtttt

SEQ ID NO: 224951 - DNA, 19 bp, Artificial sequence
  SiRNA target sequence
tgtaactttaatagttttc

SEQ ID NO: 224952 - DNA, 19 bp, Artificial sequence
  SiRNA target sequence
gtaactttaatagttttcg

SEQ ID NO: 224953 - DNA, 19 bp, Artificial sequence
  SiRNA target sequence
taactttaatagttttcgc

SEQ ID NO: 224954 - DNA, 19 bp, Artificial sequence
  SiRNA target sequence
aactttaatagttttcgct

SEQ ID NO: 224955 - DNA, 19 bp, Artificial sequence
  SiRNA target sequence
actttaatagttttcgctg

SEQ ID NO: 224956 - DNA, 19 bp, Artificial sequence
  SiRNA target sequence
ctttaatagttttcgctgt

SEQ ID NO: 224957 - DNA, 19 bp, Artificial sequence
  SiRNA target sequence
tttaatagttttcgctgtt

SEQ ID NO: 224958 - DNA, 19 bp, Artificial sequence
  SiRNA target sequence
ttaatagttttcgctgttg

SEQ ID NO: 224959 - DNA, 19 bp, Artificial sequence
  SiRNA target sequence
taatagttttcgctgttgc

SEQ ID NO: 224960 - DNA, 19 bp, Artificial sequence
  SiRNA target sequence
aatagttttcgctgttgca

SEQ ID NO: 224961 - DNA, 19 bp, Artificial sequence
  SiRNA target sequence
atagttttcgctgttgcat

SEQ ID NO: 224962 - DNA, 19 bp, Artificial sequence
  SiRNA target sequence
tagttttcgctgttgcatt

SEQ ID NO: 224963 - DNA, 19 bp, Artificial sequence
  SiRNA target sequence
agttttcgctgttgcattt

SEQ ID NO: 224964 - DNA, 19 bp, Artificial sequence
  SiRNA target sequence
gttttcgctgttgcattta

SEQ ID NO: 224965 - DNA, 19 bp, Artificial sequence
  SiRNA target sequence
ttttcgctgttgcatttac

SEQ ID NO: 224966 - DNA, 19 bp, Artificial sequence
  SiRNA target sequence
tttcgctgttgcatttact

SEQ ID NO: 224967 - DNA, 19 bp, Artificial sequence
  SiRNA target sequence
ttcgctgttgcatttacta

SEQ ID NO: 224968 - DNA, 19 bp, Artificial sequence
  SiRNA target sequence
tcgctgttgcatttactat

SEQ ID NO: 224969 - DNA, 19 bp, Artificial sequence
  SiRNA target sequence
cgctgttgcatttactata

SEQ ID NO: 224970 - DNA, 19 bp, Artificial sequence
  SiRNA target sequence
gctgttgcatttactatac

SEQ ID NO: 224971 - DNA, 19 bp, Artificial sequence
  SiRNA target sequence
ctgttgcatttactatact

SEQ ID NO: 224972 - DNA, 19 bp, Artificial sequence
  SiRNA target sequence
tgttgcatttactatactt

SEQ ID NO: 224973 - DNA, 19 bp, Artificial sequence
  SiRNA target sequence
gttgcatttactatacttg

SEQ ID NO: 224974 - DNA, 19 bp, Artificial sequence
  SiRNA target sequence
ttgcatttactatacttgg

SEQ ID NO: 224975 - DNA, 19 bp, Artificial sequence
  SiRNA target sequence
tgcatttactatacttggt

SEQ ID NO: 224976 - DNA, 19 bp, Artificial sequence
  SiRNA target sequence
gcatttactatacttggta

SEQ ID NO: 224977 - DNA, 19 bp, Artificial sequence
  SiRNA target sequence
catttactatacttggtag

SEQ ID NO: 224978 - DNA, 19 bp, Artificial sequence
  SiRNA target sequence
atttactatacttggtagt

SEQ ID NO: 224979 - DNA, 19 bp, Artificial sequence
  SiRNA target sequence
tttactatacttggtagtt

SEQ ID NO: 224980 - DNA, 19 bp, Artificial sequence
  SiRNA target sequence
ttactatacttggtagttt

SEQ ID NO: 224981 - DNA, 19 bp, Artificial sequence
  SiRNA target sequence
tactatacttggtagttta

SEQ ID NO: 224982 - DNA, 19 bp, Artificial sequence
  SiRNA target sequence
actatacttggtagtttat

SEQ ID NO: 224983 - DNA, 19 bp, Artificial sequence
  SiRNA target sequence
ctatacttggtagtttatt

SEQ ID NO: 224984 - DNA, 19 bp, Artificial sequence
  SiRNA target sequence
tatacttggtagtttatta

SEQ ID NO: 224985 - DNA, 19 bp, Artificial sequence
  SiRNA target sequence
atacttggtagtttattac

SEQ ID NO: 224986 - DNA, 19 bp, Artificial sequence
  SiRNA target sequence
tacttggtagtttattact

SEQ ID NO: 224987 - DNA, 19 bp, Artificial sequence
  SiRNA target sequence
acttggtagtttattactt

SEQ ID NO: 224988 - DNA, 19 bp, Artificial sequence
  SiRNA target sequence
cttggtagtttattacttc

SEQ ID NO: 224989 - DNA, 19 bp, Artificial sequence
  SiRNA target sequence
ttggtagtttattacttcc

SEQ ID NO: 224990 - DNA, 19 bp, Artificial sequence
  SiRNA target sequence
tggtagtttattacttccc

SEQ ID NO: 224991 - DNA, 19 bp, Artificial sequence
  SiRNA target sequence
ggtagtttattacttccct

SEQ ID NO: 224992 - DNA, 19 bp, Artificial sequence
  SiRNA target sequence
gtagtttattacttccctt

SEQ ID NO: 224993 - DNA, 19 bp, Artificial sequence
  SiRNA target sequence
tagtttattacttcccttt

SEQ ID NO: 224994 - DNA, 19 bp, Artificial sequence
  SiRNA target sequence
agtttattacttcccttta

SEQ ID NO: 224995 - DNA, 19 bp, Artificial sequence
  SiRNA target sequence
gtttattacttccctttag

SEQ ID NO: 224996 - DNA, 19 bp, Artificial sequence
  SiRNA target sequence
tttattacttccctttagt

SEQ ID NO: 224997 - DNA, 19 bp, Artificial sequence
  SiRNA target sequence
ttattacttccctttagtg

SEQ ID NO: 224998 - DNA, 19 bp, Artificial sequence
  SiRNA target sequence
tattacttccctttagtga

SEQ ID NO: 224999 - DNA, 19 bp, Artificial sequence
  SiRNA target sequence
attacttccctttagtgat

SEQ ID NO: 225000 - DNA, 19 bp, Artificial sequence
  SiRNA target sequence
ttacttccctttagtgatt

SEQ ID NO: 225001 - DNA, 19 bp, Artificial sequence
  SiRNA target sequence
tacttccctttagtgatta

SEQ ID NO: 225002 - DNA, 19 bp, Artificial sequence
  SiRNA target sequence
acttccctttagtgattat

SEQ ID NO: 225003 - DNA, 19 bp, Artificial sequence
  SiRNA target sequence
cttccctttagtgattata

SEQ ID NO: 225004 - DNA, 19 bp, Artificial sequence
  SiRNA target sequence
ttccctttagtgattatat

SEQ ID NO: 225005 - DNA, 19 bp, Artificial sequence
  SiRNA target sequence
tccctttagtgattatatt

SEQ ID NO: 225006 - DNA, 19 bp, Artificial sequence
  SiRNA target sequence
ccctttagtgattatattc

SEQ ID NO: 225007 - DNA, 19 bp, Artificial sequence
  SiRNA target sequence
cctttagtgattatattca

SEQ ID NO: 225008 - DNA, 19 bp, Artificial sequence
  SiRNA target sequence
ctttagtgattatattcag

SEQ ID NO: 225009 - DNA, 19 bp, Artificial sequence
  SiRNA target sequence
tttagtgattatattcaga

SEQ ID NO: 225010 - DNA, 19 bp, Artificial sequence
  SiRNA target sequence
ttagtgattatattcagat

SEQ ID NO: 225011 - DNA, 19 bp, Artificial sequence
  SiRNA target sequence
tagtgattatattcagatt

SEQ ID NO: 225012 - DNA, 19 bp, Artificial sequence
  SiRNA target sequence
agtgattatattcagattc

SEQ ID NO: 225013 - DNA, 19 bp, Artificial sequence
  SiRNA target sequence
gtgattatattcagattca

SEQ ID NO: 225014 - DNA, 19 bp, Artificial sequence
  SiRNA target sequence
tgattatattcagattcaa

SEQ ID NO: 225015 - DNA, 19 bp, Artificial sequence
  SiRNA target sequence
gattatattcagattcaac

SEQ ID NO: 225016 - DNA, 19 bp, Artificial sequence
  SiRNA target sequence
attatattcagattcaacc

SEQ ID NO: 225017 - DNA, 19 bp, Artificial sequence
  SiRNA target sequence
ttatattcagattcaaccg

SEQ ID NO: 225018 - DNA, 19 bp, Artificial sequence
  SiRNA target sequence
tatattcagattcaaccgt

SEQ ID NO: 225019 - DNA, 19 bp, Artificial sequence
  SiRNA target sequence
atattcagattcaaccgtt

SEQ ID NO: 225020 - DNA, 19 bp, Artificial sequence
  SiRNA target sequence
tattcagattcaaccgttt

SEQ ID NO: 225021 - DNA, 19 bp, Artificial sequence
  SiRNA target sequence
attcagattcaaccgtttt

SEQ ID NO: 225022 - DNA, 19 bp, Artificial sequence
  SiRNA target sequence
ttcagattcaaccgttttg

SEQ ID NO: 225023 - DNA, 19 bp, Artificial sequence
  SiRNA target sequence
tcagattcaaccgttttgg

SEQ ID NO: 225024 - DNA, 19 bp, Artificial sequence
  SiRNA target sequence
cagattcaaccgttttggg

SEQ ID NO: 225025 - DNA, 19 bp, Artificial sequence
  SiRNA target sequence
agattcaaccgttttgggc

SEQ ID NO: 225026 - DNA, 19 bp, Artificial sequence
  SiRNA target sequence
gattcaaccgttttgggcc

SEQ ID NO: 225027 - DNA, 19 bp, Artificial sequence
  SiRNA target sequence
attcaaccgttttgggcca

SEQ ID NO: 225028 - DNA, 19 bp, Artificial sequence
  SiRNA target sequence
ttcaaccgttttgggccaa

SEQ ID NO: 225029 - DNA, 19 bp, Artificial sequence
  SiRNA target sequence
tcaaccgttttgggccaaa

SEQ ID NO: 225030 - DNA, 19 bp, Artificial sequence
  SiRNA target sequence
caaccgttttgggccaaag

SEQ ID NO: 225031 - DNA, 19 bp, Artificial sequence
  SiRNA target sequence
aaccgttttgggccaaaga

SEQ ID NO: 225032 - DNA, 19 bp, Artificial sequence
  SiRNA target sequence
accgttttgggccaaagat

SEQ ID NO: 225033 - DNA, 19 bp, Artificial sequence
  SiRNA target sequence
ccgttttgggccaaagata

SEQ ID NO: 225034 - DNA, 19 bp, Artificial sequence
  SiRNA target sequence
cgttttgggccaaagatat

SEQ ID NO: 225035 - DNA, 19 bp, Artificial sequence
  SiRNA target sequence
gttttgggccaaagatatt

SEQ ID NO: 225036 - DNA, 19 bp, Artificial sequence
  SiRNA target sequence
ttttgggccaaagatattt

SEQ ID NO: 225037 - DNA, 19 bp, Artificial sequence
  SiRNA target sequence
tttgggccaaagatatttt

SEQ ID NO: 225038 - DNA, 19 bp, Artificial sequence
  SiRNA target sequence
ttgggccaaagatattttt

SEQ ID NO: 225039 - DNA, 19 bp, Artificial sequence
  SiRNA target sequence
tgggccaaagatatttttg

SEQ ID NO: 225040 - DNA, 19 bp, Artificial sequence
  SiRNA target sequence
gggccaaagatatttttgc

SEQ ID NO: 225041 - DNA, 19 bp, Artificial sequence
  SiRNA target sequence
ggccaaagatatttttgct

SEQ ID NO: 225042 - DNA, 19 bp, Artificial sequence
  SiRNA target sequence
gccaaagatatttttgctg

SEQ ID NO: 225043 - DNA, 19 bp, Artificial sequence
  SiRNA target sequence
ccaaagatatttttgctga

SEQ ID NO: 225044 - DNA, 19 bp, Artificial sequence
  SiRNA target sequence
caaagatatttttgctgat

SEQ ID NO: 225045 - DNA, 19 bp, Artificial sequence
  SiRNA target sequence
aaagatatttttgctgatg

SEQ ID NO: 225046 - DNA, 19 bp, Artificial sequence
  SiRNA target sequence
aagatatttttgctgatgg

SEQ ID NO: 225047 - DNA, 19 bp, Artificial sequence
  SiRNA target sequence
agatatttttgctgatgga

SEQ ID NO: 225048 - DNA, 19 bp, Artificial sequence
  SiRNA target sequence
gatatttttgctgatggaa

SEQ ID NO: 225049 - DNA, 19 bp, Artificial sequence
  SiRNA target sequence
atatttttgctgatggaaa

SEQ ID NO: 225050 - DNA, 19 bp, Artificial sequence
  SiRNA target sequence
tatttttgctgatggaaaa

SEQ ID NO: 225051 - DNA, 19 bp, Artificial sequence
  SiRNA target sequence
atttttgctgatggaaaag

SEQ ID NO: 225052 - DNA, 19 bp, Artificial sequence
  SiRNA target sequence
tttttgctgatggaaaagc

SEQ ID NO: 225053 - DNA, 19 bp, Artificial sequence
  SiRNA target sequence
ttttgctgatggaaaagct

SEQ ID NO: 225054 - DNA, 19 bp, Artificial sequence
  SiRNA target sequence
tttgctgatggaaaagctg

SEQ ID NO: 225055 - DNA, 19 bp, Artificial sequence
  SiRNA target sequence
ttgctgatggaaaagctgt

SEQ ID NO: 225056 - DNA, 19 bp, Artificial sequence
  SiRNA target sequence
tgctgatggaaaagctgtt

SEQ ID NO: 225057 - DNA, 19 bp, Artificial sequence
  SiRNA target sequence
gctgatggaaaagctgttg

SEQ ID NO: 225058 - DNA, 19 bp, Artificial sequence
  SiRNA target sequence
ctgatggaaaagctgttgc

SEQ ID NO: 225059 - DNA, 19 bp, Artificial sequence
  SiRNA target sequence
tgatggaaaagctgttgcc

SEQ ID NO: 225060 - DNA, 19 bp, Artificial sequence
  SiRNA target sequence
gatggaaaagctgttgcca

SEQ ID NO: 225061 - DNA, 19 bp, Artificial sequence
  SiRNA target sequence
atggaaaagctgttgccag

SEQ ID NO: 225062 - DNA, 19 bp, Artificial sequence
  SiRNA target sequence
tggaaaagctgttgccaga

SEQ ID NO: 225063 - DNA, 19 bp, Artificial sequence
  SiRNA target sequence
ggaaaagctgttgccagaa

SEQ ID NO: 225064 - DNA, 19 bp, Artificial sequence
  SiRNA target sequence
gaaaagctgttgccagaag

SEQ ID NO: 225065 - DNA, 19 bp, Artificial sequence
  SiRNA target sequence
aaaagctgttgccagaagt

SEQ ID NO: 225066 - DNA, 19 bp, Artificial sequence
  SiRNA target sequence
aaagctgttgccagaagta

SEQ ID NO: 225067 - DNA, 19 bp, Artificial sequence
  SiRNA target sequence
aagctgttgccagaagtac

SEQ ID NO: 225068 - DNA, 19 bp, Artificial sequence
  SiRNA target sequence
agctgttgccagaagtaca

SEQ ID NO: 225069 - DNA, 19 bp, Artificial sequence
  SiRNA target sequence
gctgttgccagaagtacag

SEQ ID NO: 225070 - DNA, 19 bp, Artificial sequence
  SiRNA target sequence
ctgttgccagaagtacaga

SEQ ID NO: 225071 - DNA, 19 bp, Artificial sequence
  SiRNA target sequence
tgttgccagaagtacagat

SEQ ID NO: 225072 - DNA, 19 bp, Artificial sequence
  SiRNA target sequence
gttgccagaagtacagatt

SEQ ID NO: 225073 - DNA, 19 bp, Artificial sequence
  SiRNA target sequence
ttgccagaagtacagattt

SEQ ID NO: 225074 - DNA, 19 bp, Artificial sequence
  SiRNA target sequence
tgccagaagtacagatttt

SEQ ID NO: 225075 - DNA, 19 bp, Artificial sequence
  SiRNA target sequence
gccagaagtacagattttt

SEQ ID NO: 225076 - DNA, 19 bp, Artificial sequence
  SiRNA target sequence
ccagaagtacagatttttt

SEQ ID NO: 225077 - DNA, 19 bp, Artificial sequence
  SiRNA target sequence
cagaagtacagatttttta

SEQ ID NO: 225078 - DNA, 19 bp, Artificial sequence
  SiRNA target sequence
agaagtacagattttttat

SEQ ID NO: 225079 - DNA, 19 bp, Artificial sequence
  SiRNA target sequence
gaagtacagattttttatt

SEQ ID NO: 225080 - DNA, 19 bp, Artificial sequence
  SiRNA target sequence
aagtacagattttttattt

SEQ ID NO: 225081 - DNA, 19 bp, Artificial sequence
  SiRNA target sequence
agtacagattttttatttt

SEQ ID NO: 225082 - DNA, 19 bp, Artificial sequence
  SiRNA target sequence
gtacagattttttattttc

SEQ ID NO: 225083 - DNA, 19 bp, Artificial sequence
  SiRNA target sequence
tacagattttttattttct

SEQ ID NO: 225084 - DNA, 19 bp, Artificial sequence
  SiRNA target sequence
acagattttttattttcta

SEQ ID NO: 225085 - DNA, 19 bp, Artificial sequence
  SiRNA target sequence
cagattttttattttctat

SEQ ID NO: 225086 - DNA, 19 bp, Artificial sequence
  SiRNA target sequence
agattttttattttctatt

SEQ ID NO: 225087 - DNA, 19 bp, Artificial sequence
  SiRNA target sequence
gattttttattttctattg

SEQ ID NO: 225088 - DNA, 19 bp, Artificial sequence
  SiRNA target sequence
attttttattttctattgc

SEQ ID NO: 225089 - DNA, 19 bp, Artificial sequence
  SiRNA target sequence
ttttttattttctattgca

SEQ ID NO: 225090 - DNA, 19 bp, Artificial sequence
  SiRNA target sequence
tttttattttctattgcac

SEQ ID NO: 225091 - DNA, 19 bp, Artificial sequence
  SiRNA target sequence
ttttattttctattgcact

SEQ ID NO: 225092 - DNA, 19 bp, Artificial sequence
  SiRNA target sequence
tttattttctattgcactt

SEQ ID NO: 225093 - DNA, 19 bp, Artificial sequence
  SiRNA target sequence
ttattttctattgcacttg

SEQ ID NO: 225094 - DNA, 19 bp, Artificial sequence
  SiRNA target sequence
tattttctattgcacttgt

SEQ ID NO: 225095 - DNA, 19 bp, Artificial sequence
  SiRNA target sequence
attttctattgcacttgtt

SEQ ID NO: 225096 - DNA, 19 bp, Artificial sequence
  SiRNA target sequence
ttttctattgcacttgttt

SEQ ID NO: 225097 - DNA, 19 bp, Artificial sequence
  SiRNA target sequence
tttctattgcacttgtttt

SEQ ID NO: 225098 - DNA, 19 bp, Artificial sequence
  SiRNA target sequence
ttctattgcacttgttttc

SEQ ID NO: 225099 - DNA, 19 bp, Artificial sequence
  SiRNA target sequence
tctattgcacttgttttca

SEQ ID NO: 225100 - DNA, 19 bp, Artificial sequence
  SiRNA target sequence
ctattgcacttgttttcaa

SEQ ID NO: 225101 - DNA, 19 bp, Artificial sequence
  SiRNA target sequence
tattgcacttgttttcaat

SEQ ID NO: 225102 - DNA, 19 bp, Artificial sequence
  SiRNA target sequence
attgcacttgttttcaatg

SEQ ID NO: 225103 - DNA, 19 bp, Artificial sequence
  SiRNA target sequence
ttgcacttgttttcaatga

SEQ ID NO: 225104 - DNA, 19 bp, Artificial sequence
  SiRNA target sequence
tgcacttgttttcaatgaa

SEQ ID NO: 225105 - DNA, 19 bp, Artificial sequence
  SiRNA target sequence
gcacttgttttcaatgaat

SEQ ID NO: 225106 - DNA, 19 bp, Artificial sequence
  SiRNA target sequence
cacttgttttcaatgaatg

SEQ ID NO: 225107 - DNA, 19 bp, Artificial sequence
  SiRNA target sequence
acttgttttcaatgaatgg

SEQ ID NO: 225108 - DNA, 19 bp, Artificial sequence
  SiRNA target sequence
cttgttttcaatgaatgga

SEQ ID NO: 225109 - DNA, 19 bp, Artificial sequence
  SiRNA target sequence
ttgttttcaatgaatggac

SEQ ID NO: 225110 - DNA, 19 bp, Artificial sequence
  SiRNA target sequence
tgttttcaatgaatggaca

SEQ ID NO: 225111 - DNA, 19 bp, Artificial sequence
  SiRNA target sequence
gttttcaatgaatggacaa

SEQ ID NO: 225112 - DNA, 19 bp, Artificial sequence
  SiRNA target sequence
ttttcaatgaatggacaag

SEQ ID NO: 225113 - DNA, 19 bp, Artificial sequence
  SiRNA target sequence
tttcaatgaatggacaagt

SEQ ID NO: 225114 - DNA, 19 bp, Artificial sequence
  SiRNA target sequence
ttcaatgaatggacaagtt

SEQ ID NO: 225115 - DNA, 19 bp, Artificial sequence
  SiRNA target sequence
tcaatgaatggacaagttc

SEQ ID NO: 225116 - DNA, 19 bp, Artificial sequence
  SiRNA target sequence
caatgaatggacaagttct

SEQ ID NO: 225117 - DNA, 19 bp, Artificial sequence
  SiRNA target sequence
aatgaatggacaagttctg

SEQ ID NO: 225118 - DNA, 19 bp, Artificial sequence
  SiRNA target sequence
atgaatggacaagttctgc

SEQ ID NO: 225119 - DNA, 19 bp, Artificial sequence
  SiRNA target sequence
tgaatggacaagttctgct

SEQ ID NO: 225120 - DNA, 19 bp, Artificial sequence
  SiRNA target sequence
gaatggacaagttctgcta

SEQ ID NO: 225121 - DNA, 19 bp, Artificial sequence
  SiRNA target sequence
aatggacaagttctgctat

SEQ ID NO: 225122 - DNA, 19 bp, Artificial sequence
  SiRNA target sequence
atggacaagttctgctatc

SEQ ID NO: 225123 - DNA, 19 bp, Artificial sequence
  SiRNA target sequence
tggacaagttctgctatct

SEQ ID NO: 225124 - DNA, 19 bp, Artificial sequence
  SiRNA target sequence
ggacaagttctgctatcta

SEQ ID NO: 225125 - DNA, 19 bp, Artificial sequence
  SiRNA target sequence
gacaagttctgctatctat

SEQ ID NO: 225126 - DNA, 19 bp, Artificial sequence
  SiRNA target sequence
acaagttctgctatctatg

SEQ ID NO: 225127 - DNA, 19 bp, Artificial sequence
  SiRNA target sequence
caagttctgctatctatgt

SEQ ID NO: 225128 - DNA, 19 bp, Artificial sequence
  SiRNA target sequence
aagttctgctatctatgtt

SEQ ID NO: 225129 - DNA, 19 bp, Artificial sequence
  SiRNA target sequence
agttctgctatctatgttt

SEQ ID NO: 225130 - DNA, 19 bp, Artificial sequence
  SiRNA target sequence
gttctgctatctatgtttt

SEQ ID NO: 225131 - DNA, 19 bp, Artificial sequence
  SiRNA target sequence
ttctgctatctatgtttta

SEQ ID NO: 225132 - DNA, 19 bp, Artificial sequence
  SiRNA target sequence
tctgctatctatgttttat

SEQ ID NO: 225133 - DNA, 19 bp, Artificial sequence
  SiRNA target sequence
ctgctatctatgttttatc

SEQ ID NO: 225134 - DNA, 19 bp, Artificial sequence
  SiRNA target sequence
tgctatctatgttttatct

SEQ ID NO: 225135 - DNA, 19 bp, Artificial sequence
  SiRNA target sequence
gctatctatgttttatctg

SEQ ID NO: 225136 - DNA, 19 bp, Artificial sequence
  SiRNA target sequence
ctatctatgttttatctga

SEQ ID NO: 225137 - DNA, 19 bp, Artificial sequence
  SiRNA target sequence
tatctatgttttatctgaa

SEQ ID NO: 225138 - DNA, 19 bp, Artificial sequence
  SiRNA target sequence
atctatgttttatctgaaa

SEQ ID NO: 225139 - DNA, 19 bp, Artificial sequence
  SiRNA target sequence
tctatgttttatctgaaat

SEQ ID NO: 225140 - DNA, 19 bp, Artificial sequence
  SiRNA target sequence
ctatgttttatctgaaatg

SEQ ID NO: 225141 - DNA, 19 bp, Artificial sequence
  SiRNA target sequence
tatgttttatctgaaatgt

SEQ ID NO: 225142 - DNA, 19 bp, Artificial sequence
  SiRNA target sequence
atgttttatctgaaatgtt

SEQ ID NO: 225143 - DNA, 19 bp, Artificial sequence
  SiRNA target sequence
tgttttatctgaaatgttt

SEQ ID NO: 225144 - DNA, 19 bp, Artificial sequence
  SiRNA target sequence
gttttatctgaaatgtttg

SEQ ID NO: 225145 - DNA, 19 bp, Artificial sequence
  SiRNA target sequence
ttttatctgaaatgtttgg

SEQ ID NO: 225146 - DNA, 19 bp, Artificial sequence
  SiRNA target sequence
tttatctgaaatgtttggt

SEQ ID NO: 225147 - DNA, 19 bp, Artificial sequence
  SiRNA target sequence
ttatctgaaatgtttggta

SEQ ID NO: 225148 - DNA, 19 bp, Artificial sequence
  SiRNA target sequence
tatctgaaatgtttggtag

SEQ ID NO: 225149 - DNA, 19 bp, Artificial sequence
  SiRNA target sequence
atctgaaatgtttggtagt

SEQ ID NO: 225150 - DNA, 19 bp, Artificial sequence
  SiRNA target sequence
tctgaaatgtttggtagtt

SEQ ID NO: 225151 - DNA, 19 bp, Artificial sequence
  SiRNA target sequence
ctgaaatgtttggtagttt

SEQ ID NO: 225152 - DNA, 19 bp, Artificial sequence
  SiRNA target sequence
tgaaatgtttggtagtttg

SEQ ID NO: 225153 - DNA, 19 bp, Artificial sequence
  SiRNA target sequence
gaaatgtttggtagtttga

SEQ ID NO: 225154 - DNA, 19 bp, Artificial sequence
  SiRNA target sequence
aaatgtttggtagtttgat

SEQ ID NO: 225155 - DNA, 19 bp, Artificial sequence
  SiRNA target sequence
aatgtttggtagtttgatt

SEQ ID NO: 225156 - DNA, 19 bp, Artificial sequence
  SiRNA target sequence
atgtttggtagtttgattc

SEQ ID NO: 225157 - DNA, 19 bp, Artificial sequence
  SiRNA target sequence
tgtttggtagtttgattct

SEQ ID NO: 225158 - DNA, 19 bp, Artificial sequence
  SiRNA target sequence
gtttggtagtttgattctt

SEQ ID NO: 225159 - DNA, 19 bp, Artificial sequence
  SiRNA target sequence
tttggtagtttgattcttt

SEQ ID NO: 225160 - DNA, 19 bp, Artificial sequence
  SiRNA target sequence
ttggtagtttgattctttc

SEQ ID NO: 225161 - DNA, 19 bp, Artificial sequence
  SiRNA target sequence
tggtagtttgattctttca

SEQ ID NO: 225162 - DNA, 19 bp, Artificial sequence
  SiRNA target sequence
ggtagtttgattctttcat

SEQ ID NO: 225163 - DNA, 19 bp, Artificial sequence
  SiRNA target sequence
gtagtttgattctttcata

SEQ ID NO: 225164 - DNA, 19 bp, Artificial sequence
  SiRNA target sequence
tagtttgattctttcatat

SEQ ID NO: 225165 - DNA, 19 bp, Artificial sequence
  SiRNA target sequence
agtttgattctttcatatt

SEQ ID NO: 225166 - DNA, 19 bp, Artificial sequence
  SiRNA target sequence
gtttgattctttcatattt

SEQ ID NO: 225167 - DNA, 19 bp, Artificial sequence
  SiRNA target sequence
tttgattctttcatattta

SEQ ID NO: 225168 - DNA, 19 bp, Artificial sequence
  SiRNA target sequence
ttgattctttcatatttat

SEQ ID NO: 225169 - DNA, 19 bp, Artificial sequence
  SiRNA target sequence
tgattctttcatatttatt

SEQ ID NO: 225170 - DNA, 19 bp, Artificial sequence
  SiRNA target sequence
gattctttcatatttattt

SEQ ID NO: 225171 - DNA, 19 bp, Artificial sequence
  SiRNA target sequence
attctttcatatttattta

SEQ ID NO: 225172 - DNA, 19 bp, Artificial sequence
  SiRNA target sequence
ttctttcatatttatttat

SEQ ID NO: 225173 - DNA, 19 bp, Artificial sequence
  SiRNA target sequence
tctttcatatttatttatg

SEQ ID NO: 225174 - DNA, 19 bp, Artificial sequence
  SiRNA target sequence
ctttcatatttatttatga

SEQ ID NO: 225175 - DNA, 19 bp, Artificial sequence
  SiRNA target sequence
tttcatatttatttatgac

SEQ ID NO: 225176 - DNA, 19 bp, Artificial sequence
  SiRNA target sequence
ttcatatttatttatgacg

SEQ ID NO: 225177 - DNA, 19 bp, Artificial sequence
  SiRNA target sequence
tcatatttatttatgacgt

SEQ ID NO: 225178 - DNA, 19 bp, Artificial sequence
  SiRNA target sequence
catatttatttatgacgtt

SEQ ID NO: 225179 - DNA, 19 bp, Artificial sequence
  SiRNA target sequence
atatttatttatgacgttt

SEQ ID NO: 225180 - DNA, 19 bp, Artificial sequence
  SiRNA target sequence
tatttatttatgacgtttg

SEQ ID NO: 225181 - DNA, 19 bp, Artificial sequence
  SiRNA target sequence
atttatttatgacgtttgc

SEQ ID NO: 225182 - DNA, 19 bp, Artificial sequence
  SiRNA target sequence
tttatttatgacgtttgct

SEQ ID NO: 225183 - DNA, 19 bp, Artificial sequence
  SiRNA target sequence
ttatttatgacgtttgcta

SEQ ID NO: 225184 - DNA, 19 bp, Artificial sequence
  SiRNA target sequence
tatttatgacgtttgctaa

SEQ ID NO: 225185 - DNA, 19 bp, Artificial sequence
  SiRNA target sequence
atttatgacgtttgctaat

SEQ ID NO: 225186 - DNA, 19 bp, Artificial sequence
  SiRNA target sequence
tttatgacgtttgctaatg

SEQ ID NO: 225187 - DNA, 19 bp, Artificial sequence
  SiRNA target sequence
ttatgacgtttgctaatgg

SEQ ID NO: 225188 - DNA, 19 bp, Artificial sequence
  SiRNA target sequence
tatgacgtttgctaatggt

SEQ ID NO: 225189 - DNA, 19 bp, Artificial sequence
  SiRNA target sequence
atgacgtttgctaatggtc

SEQ ID NO: 225190 - DNA, 19 bp, Artificial sequence
  SiRNA target sequence
tgacgtttgctaatggtct

SEQ ID NO: 225191 - DNA, 19 bp, Artificial sequence
  SiRNA target sequence
gacgtttgctaatggtctt

SEQ ID NO: 225192 - DNA, 19 bp, Artificial sequence
  SiRNA target sequence
acgtttgctaatggtcttt

SEQ ID NO: 225193 - DNA, 19 bp, Artificial sequence
  SiRNA target sequence
cgtttgctaatggtctttc

SEQ ID NO: 225194 - DNA, 19 bp, Artificial sequence
  SiRNA target sequence
gtttgctaatggtctttcg

SEQ ID NO: 225195 - DNA, 19 bp, Artificial sequence
  SiRNA target sequence
tttgctaatggtctttcga

SEQ ID NO: 225196 - DNA, 19 bp, Artificial sequence
  SiRNA target sequence
ttgctaatggtctttcgac

SEQ ID NO: 225197 - DNA, 19 bp, Artificial sequence
  SiRNA target sequence
tgctaatggtctttcgact

SEQ ID NO: 225198 - DNA, 19 bp, Artificial sequence
  SiRNA target sequence
gctaatggtctttcgactc

SEQ ID NO: 225199 - DNA, 19 bp, Artificial sequence
  SiRNA target sequence
ctaatggtctttcgactcc

SEQ ID NO: 225200 - DNA, 19 bp, Artificial sequence
  SiRNA target sequence
taatggtctttcgactcct

SEQ ID NO: 225201 - DNA, 19 bp, Artificial sequence
  SiRNA target sequence
aatggtctttcgactcctg

SEQ ID NO: 225202 - DNA, 19 bp, Artificial sequence
  SiRNA target sequence
atggtctttcgactcctgg

SEQ ID NO: 225203 - DNA, 19 bp, Artificial sequence
  SiRNA target sequence
tggtctttcgactcctgga

SEQ ID NO: 225204 - DNA, 19 bp, Artificial sequence
  SiRNA target sequence
ggtctttcgactcctggac

SEQ ID NO: 225205 - DNA, 19 bp, Artificial sequence
  SiRNA target sequence
gtctttcgactcctggaca

SEQ ID NO: 225206 - DNA, 19 bp, Artificial sequence
  SiRNA target sequence
tctttcgactcctggacag

SEQ ID NO: 225207 - DNA, 19 bp, Artificial sequence
  SiRNA target sequence
ctttcgactcctggacagt

SEQ ID NO: 225208 - DNA, 19 bp, Artificial sequence
  SiRNA target sequence
tttcgactcctggacagtc

SEQ ID NO: 225209 - DNA, 19 bp, Artificial sequence
  SiRNA target sequence
ttcgactcctggacagtcc

SEQ ID NO: 225210 - DNA, 19 bp, Artificial sequence
  SiRNA target sequence
tcgactcctggacagtccg

SEQ ID NO: 225211 - DNA, 19 bp, Artificial sequence
  SiRNA target sequence
cgactcctggacagtccgc

SEQ ID NO: 225212 - DNA, 19 bp, Artificial sequence
  SiRNA target sequence
gactcctggacagtccgct

SEQ ID NO: 225213 - DNA, 19 bp, Artificial sequence
  SiRNA target sequence
actcctggacagtccgcta

SEQ ID NO: 225214 - DNA, 19 bp, Artificial sequence
  SiRNA target sequence
ctcctggacagtccgctag

SEQ ID NO: 225215 - DNA, 19 bp, Artificial sequence
  SiRNA target sequence
tcctggacagtccgctaga

SEQ ID NO: 225216 - DNA, 19 bp, Artificial sequence
  SiRNA target sequence
cctggacagtccgctagat

SEQ ID NO: 225217 - DNA, 19 bp, Artificial sequence
  SiRNA target sequence
ctggacagtccgctagatt

SEQ ID NO: 225218 - DNA, 19 bp, Artificial sequence
  SiRNA target sequence
tggacagtccgctagattt

SEQ ID NO: 225219 - DNA, 19 bp, Artificial sequence
  SiRNA target sequence
ggacagtccgctagatttg

SEQ ID NO: 225220 - DNA, 19 bp, Artificial sequence
  SiRNA target sequence
gacagtccgctagatttgt

SEQ ID NO: 225221 - DNA, 19 bp, Artificial sequence
  SiRNA target sequence
acagtccgctagatttgtc

SEQ ID NO: 225222 - DNA, 19 bp, Artificial sequence
  SiRNA target sequence
cagtccgctagatttgtcc

SEQ ID NO: 225223 - DNA, 19 bp, Artificial sequence
  SiRNA target sequence
agtccgctagatttgtccc

SEQ ID NO: 225224 - DNA, 19 bp, Artificial sequence
  SiRNA target sequence
gtccgctagatttgtccct

SEQ ID NO: 225225 - DNA, 19 bp, Artificial sequence
  SiRNA target sequence
tccgctagatttgtccctt

SEQ ID NO: 225226 - DNA, 19 bp, Artificial sequence
  SiRNA target sequence
ccgctagatttgtcccttt

SEQ ID NO: 225227 - DNA, 19 bp, Artificial sequence
  SiRNA target sequence
cgctagatttgtcccttta

SEQ ID NO: 225228 - DNA, 19 bp, Artificial sequence
  SiRNA target sequence
gctagatttgtccctttat

SEQ ID NO: 225229 - DNA, 19 bp, Artificial sequence
  SiRNA target sequence
ctagatttgtccctttatt

SEQ ID NO: 225230 - DNA, 19 bp, Artificial sequence
  SiRNA target sequence
tagatttgtccctttattt

SEQ ID NO: 225231 - DNA, 19 bp, Artificial sequence
  SiRNA target sequence
agatttgtccctttatttt

SEQ ID NO: 225232 - DNA, 19 bp, Artificial sequence
  SiRNA target sequence
gatttgtccctttatttta

SEQ ID NO: 225233 - DNA, 19 bp, Artificial sequence
  SiRNA target sequence
atttgtccctttattttat

SEQ ID NO: 225234 - DNA, 19 bp, Artificial sequence
  SiRNA target sequence
tttgtccctttattttatg

SEQ ID NO: 225235 - DNA, 19 bp, Artificial sequence
  SiRNA target sequence
ttgtccctttattttatgt

SEQ ID NO: 225236 - DNA, 19 bp, Artificial sequence
  SiRNA target sequence
tgtccctttattttatgtt

SEQ ID NO: 225237 - DNA, 19 bp, Artificial sequence
  SiRNA target sequence
gtccctttattttatgttg

SEQ ID NO: 225238 - DNA, 19 bp, Artificial sequence
  SiRNA target sequence
tccctttattttatgttgg

SEQ ID NO: 225239 - DNA, 19 bp, Artificial sequence
  SiRNA target sequence
ccctttattttatgttgga

SEQ ID NO: 225240 - DNA, 19 bp, Artificial sequence
  SiRNA target sequence
cctttattttatgttggat

SEQ ID NO: 225241 - DNA, 19 bp, Artificial sequence
  SiRNA target sequence
ctttattttatgttggatc

SEQ ID NO: 225242 - DNA, 19 bp, Artificial sequence
  SiRNA target sequence
tttattttatgttggatct

SEQ ID NO: 225243 - DNA, 19 bp, Artificial sequence
  SiRNA target sequence
ttattttatgttggatcta

SEQ ID NO: 225244 - DNA, 19 bp, Artificial sequence
  SiRNA target sequence
tattttatgttggatctaa

SEQ ID NO: 225245 - DNA, 19 bp, Artificial sequence
  SiRNA target sequence
attttatgttggatctaat

SEQ ID NO: 225246 - DNA, 19 bp, Artificial sequence
  SiRNA target sequence
ttttatgttggatctaatt

SEQ ID NO: 225247 - DNA, 19 bp, Artificial sequence
  SiRNA target sequence
tttatgttggatctaattt

SEQ ID NO: 225248 - DNA, 19 bp, Artificial sequence
  SiRNA target sequence
ttatgttggatctaatttg

SEQ ID NO: 225249 - DNA, 19 bp, Artificial sequence
  SiRNA target sequence
tatgttggatctaatttgg

SEQ ID NO: 225250 - DNA, 19 bp, Artificial sequence
  SiRNA target sequence
atgttggatctaatttggc

SEQ ID NO: 225251 - DNA, 19 bp, Artificial sequence
  SiRNA target sequence
tgttggatctaatttggct

SEQ ID NO: 225252 - DNA, 19 bp, Artificial sequence
  SiRNA target sequence
gttggatctaatttggctt

SEQ ID NO: 225253 - DNA, 19 bp, Artificial sequence
  SiRNA target sequence
ttggatctaatttggcttt

SEQ ID NO: 225254 - DNA, 19 bp, Artificial sequence
  SiRNA target sequence
tggatctaatttggcttta

SEQ ID NO: 225255 - DNA, 19 bp, Artificial sequence
  SiRNA target sequence
ggatctaatttggctttac

SEQ ID NO: 225256 - DNA, 19 bp, Artificial sequence
  SiRNA target sequence
gatctaatttggctttact

SEQ ID NO: 225257 - DNA, 19 bp, Artificial sequence
  SiRNA target sequence
atctaatttggctttactt

SEQ ID NO: 225258 - DNA, 19 bp, Artificial sequence
  SiRNA target sequence
tctaatttggctttacttc

SEQ ID NO: 225259 - DNA, 19 bp, Artificial sequence
  SiRNA target sequence
ctaatttggctttacttct

SEQ ID NO: 225260 - DNA, 19 bp, Artificial sequence
  SiRNA target sequence
taatttggctttacttctt

SEQ ID NO: 225261 - DNA, 19 bp, Artificial sequence
  SiRNA target sequence
aatttggctttacttcttt

SEQ ID NO: 225262 - DNA, 19 bp, Artificial sequence
  SiRNA target sequence
atttggctttacttctttc

SEQ ID NO: 225263 - DNA, 19 bp, Artificial sequence
  SiRNA target sequence
tttggctttacttctttca

SEQ ID NO: 225264 - DNA, 19 bp, Artificial sequence
  SiRNA target sequence
ttggctttacttctttcag

SEQ ID NO: 225265 - DNA, 19 bp, Artificial sequence
  SiRNA target sequence
tggctttacttctttcagg

SEQ ID NO: 225266 - DNA, 19 bp, Artificial sequence
  SiRNA target sequence
ggctttacttctttcagga

SEQ ID NO: 225267 - DNA, 19 bp, Artificial sequence
  SiRNA target sequence
gctttacttctttcaggaa

SEQ ID NO: 225268 - DNA, 19 bp, Artificial sequence
  SiRNA target sequence
ctttacttctttcaggaat

SEQ ID NO: 225269 - DNA, 19 bp, Artificial sequence
  SiRNA target sequence
tttacttctttcaggaatg

SEQ ID NO: 225270 - DNA, 19 bp, Artificial sequence
  SiRNA target sequence
ttacttctttcaggaatga

SEQ ID NO: 225271 - DNA, 19 bp, Artificial sequence
  SiRNA target sequence
tacttctttcaggaatgat

SEQ ID NO: 225272 - DNA, 19 bp, Artificial sequence
  SiRNA target sequence
acttctttcaggaatgata

SEQ ID NO: 225273 - DNA, 19 bp, Artificial sequence
  SiRNA target sequence
cttctttcaggaatgataa

SEQ ID NO: 225274 - DNA, 19 bp, Artificial sequence
  SiRNA target sequence
ttctttcaggaatgataaa

SEQ ID NO: 225275 - DNA, 19 bp, Artificial sequence
  SiRNA target sequence
tctttcaggaatgataaat

SEQ ID NO: 225276 - DNA, 19 bp, Artificial sequence
  SiRNA target sequence
ctttcaggaatgataaatt

SEQ ID NO: 225277 - DNA, 19 bp, Artificial sequence
  SiRNA target sequence
tttcaggaatgataaatta

SEQ ID NO: 225278 - DNA, 19 bp, Artificial sequence
  SiRNA target sequence
ttcaggaatgataaattac

SEQ ID NO: 225279 - DNA, 19 bp, Artificial sequence
  SiRNA target sequence
tcaggaatgataaattact

SEQ ID NO: 225280 - DNA, 19 bp, Artificial sequence
  SiRNA target sequence
caggaatgataaattactt

SEQ ID NO: 225281 - DNA, 19 bp, Artificial sequence
  SiRNA target sequence
aggaatgataaattacttt

SEQ ID NO: 225282 - DNA, 19 bp, Artificial sequence
  SiRNA target sequence
ggaatgataaattactttt

SEQ ID NO: 225283 - DNA, 19 bp, Artificial sequence
  SiRNA target sequence
gaatgataaattactttta

SEQ ID NO: 225284 - DNA, 19 bp, Artificial sequence
  SiRNA target sequence
aatgataaattacttttat

SEQ ID NO: 225285 - DNA, 19 bp, Artificial sequence
  SiRNA target sequence
atgataaattacttttata

SEQ ID NO: 225286 - DNA, 19 bp, Artificial sequence
  SiRNA target sequence
tgataaattacttttatag

SEQ ID NO: 225287 - DNA, 19 bp, Artificial sequence
  SiRNA target sequence
gataaattacttttatagt

SEQ ID NO: 225288 - DNA, 19 bp, Artificial sequence
  SiRNA target sequence
ataaattacttttatagtg

SEQ ID NO: 225289 - DNA, 19 bp, Artificial sequence
  SiRNA target sequence
taaattacttttatagtgt

SEQ ID NO: 225290 - DNA, 19 bp, Artificial sequence
  SiRNA target sequence
aaattacttttatagtgta

SEQ ID NO: 225291 - DNA, 19 bp, Artificial sequence
  SiRNA target sequence
aattacttttatagtgtaa

SEQ ID NO: 225292 - DNA, 19 bp, Artificial sequence
  SiRNA target sequence
attacttttatagtgtaag

SEQ ID NO: 225293 - DNA, 19 bp, Artificial sequence
  SiRNA target sequence
ttacttttatagtgtaagt

SEQ ID NO: 225294 - DNA, 19 bp, Artificial sequence
  SiRNA target sequence
tacttttatagtgtaagta

SEQ ID NO: 225295 - DNA, 19 bp, Artificial sequence
  SiRNA target sequence
acttttatagtgtaagtaa

SEQ ID NO: 225296 - DNA, 19 bp, Artificial sequence
  SiRNA target sequence
cttttatagtgtaagtaaa

SEQ ID NO: 225297 - DNA, 19 bp, Artificial sequence
  SiRNA target sequence
ttttatagtgtaagtaaat

SEQ ID NO: 225298 - DNA, 19 bp, Artificial sequence
  SiRNA target sequence
tttatagtgtaagtaaatc

SEQ ID NO: 225299 - DNA, 19 bp, Artificial sequence
  SiRNA target sequence
ttatagtgtaagtaaatct

SEQ ID NO: 225300 - DNA, 19 bp, Artificial sequence
  SiRNA target sequence
tatagtgtaagtaaatcta

SEQ ID NO: 225301 - DNA, 19 bp, Artificial sequence
  SiRNA target sequence
atagtgtaagtaaatctaa

SEQ ID NO: 225302 - DNA, 19 bp, Artificial sequence
  SiRNA target sequence
tagtgtaagtaaatctaaa

SEQ ID NO: 225303 - DNA, 19 bp, Artificial sequence
  SiRNA target sequence
agtgtaagtaaatctaaaa

SEQ ID NO: 225304 - DNA, 19 bp, Artificial sequence
  SiRNA target sequence
gtgtaagtaaatctaaaat

SEQ ID NO: 225305 - DNA, 19 bp, Artificial sequence
  SiRNA target sequence
tgtaagtaaatctaaaatg

SEQ ID NO: 225306 - DNA, 19 bp, Artificial sequence
  SiRNA target sequence
gtaagtaaatctaaaatgt

SEQ ID NO: 225307 - DNA, 19 bp, Artificial sequence
  SiRNA target sequence
taagtaaatctaaaatgtc

SEQ ID NO: 225308 - DNA, 19 bp, Artificial sequence
  SiRNA target sequence
aagtaaatctaaaatgtcg

SEQ ID NO: 225309 - DNA, 19 bp, Artificial sequence
  SiRNA target sequence
agtaaatctaaaatgtcgt

SEQ ID NO: 225310 - DNA, 19 bp, Artificial sequence
  SiRNA target sequence
gtaaatctaaaatgtcgta

SEQ ID NO: 225311 - DNA, 19 bp, Artificial sequence
  SiRNA target sequence
taaatctaaaatgtcgtat

SEQ ID NO: 225312 - DNA, 19 bp, Artificial sequence
  SiRNA target sequence
aaatctaaaatgtcgtatg

SEQ ID NO: 225313 - DNA, 19 bp, Artificial sequence
  SiRNA target sequence
aatctaaaatgtcgtatgt

SEQ ID NO: 225314 - DNA, 19 bp, Artificial sequence
  SiRNA target sequence
atctaaaatgtcgtatgtt

SEQ ID NO: 225315 - DNA, 19 bp, Artificial sequence
  SiRNA target sequence
tctaaaatgtcgtatgttg

SEQ ID NO: 225316 - DNA, 19 bp, Artificial sequence
  SiRNA target sequence
ctaaaatgtcgtatgttgc

SEQ ID NO: 225317 - DNA, 19 bp, Artificial sequence
  SiRNA target sequence
taaaatgtcgtatgttgcg

SEQ ID NO: 225318 - DNA, 19 bp, Artificial sequence
  SiRNA target sequence
aaaatgtcgtatgttgcgg

SEQ ID NO: 225319 - DNA, 19 bp, Artificial sequence
  SiRNA target sequence
aaatgtcgtatgttgcggc

SEQ ID NO: 225320 - DNA, 19 bp, Artificial sequence
  SiRNA target sequence
aatgtcgtatgttgcggcc

SEQ ID NO: 225321 - DNA, 19 bp, Artificial sequence
  SiRNA target sequence
atgtcgtatgttgcggccg

SEQ ID NO: 225322 - DNA, 19 bp, Artificial sequence
  SiRNA target sequence
tgtcgtatgttgcggccga

SEQ ID NO: 225323 - DNA, 19 bp, Artificial sequence
  SiRNA target sequence
gtcgtatgttgcggccgaa

SEQ ID NO: 225324 - DNA, 19 bp, Artificial sequence
  SiRNA target sequence
tcgtatgttgcggccgaaa

SEQ ID NO: 225325 - DNA, 19 bp, Artificial sequence
  SiRNA target sequence
cgtatgttgcggccgaaag

SEQ ID NO: 225326 - DNA, 19 bp, Artificial sequence
  SiRNA target sequence
gtatgttgcggccgaaaga

SEQ ID NO: 225327 - DNA, 19 bp, Artificial sequence
  SiRNA target sequence
tatgttgcggccgaaagat

SEQ ID NO: 225328 - DNA, 19 bp, Artificial sequence
  SiRNA target sequence
atgttgcggccgaaagatt

SEQ ID NO: 225329 - DNA, 19 bp, Artificial sequence
  SiRNA target sequence
tgttgcggccgaaagattt

SEQ ID NO: 225330 - DNA, 19 bp, Artificial sequence
  SiRNA target sequence
gttgcggccgaaagatttt

SEQ ID NO: 225331 - DNA, 19 bp, Artificial sequence
  SiRNA target sequence
ttgcggccgaaagattttt

SEQ ID NO: 225332 - DNA, 19 bp, Artificial sequence
  SiRNA target sequence
tgcggccgaaagatttttt

SEQ ID NO: 225333 - DNA, 19 bp, Artificial sequence
  SiRNA target sequence
gcggccgaaagatttttta

SEQ ID NO: 225334 - DNA, 19 bp, Artificial sequence
  SiRNA target sequence
cggccgaaagattttttaa

SEQ ID NO: 225335 - DNA, 19 bp, Artificial sequence
  SiRNA target sequence
ggccgaaagattttttaat

SEQ ID NO: 225336 - DNA, 19 bp, Artificial sequence
  SiRNA target sequence
gccgaaagattttttaatg

SEQ ID NO: 225337 - DNA, 19 bp, Artificial sequence
  SiRNA target sequence
ccgaaagattttttaatgg

SEQ ID NO: 225338 - DNA, 19 bp, Artificial sequence
  SiRNA target sequence
cgaaagattttttaatgga

SEQ ID NO: 225339 - DNA, 19 bp, Artificial sequence
  SiRNA target sequence
gaaagattttttaatggat

SEQ ID NO: 225340 - DNA, 19 bp, Artificial sequence
  SiRNA target sequence
aaagattttttaatggatt

SEQ ID NO: 225341 - DNA, 19 bp, Artificial sequence
  SiRNA target sequence
aagattttttaatggattt

SEQ ID NO: 225342 - DNA, 19 bp, Artificial sequence
  SiRNA target sequence
agattttttaatggatttt

SEQ ID NO: 225343 - DNA, 19 bp, Artificial sequence
  SiRNA target sequence
gattttttaatggattttt

SEQ ID NO: 225344 - DNA, 19 bp, Artificial sequence
  SiRNA target sequence
attttttaatggatttttt

SEQ ID NO: 225345 - DNA, 19 bp, Artificial sequence
  SiRNA target sequence
ttttttaatggattttttt

SEQ ID NO: 225346 - DNA, 19 bp, Artificial sequence
  SiRNA target sequence
tttttaatggatttttttg

SEQ ID NO: 225347 - DNA, 19 bp, Artificial sequence
  SiRNA target sequence
ttttaatggatttttttgt

SEQ ID NO: 225348 - DNA, 19 bp, Artificial sequence
  SiRNA target sequence
tttaatggatttttttgtc

SEQ ID NO: 225349 - DNA, 19 bp, Artificial sequence
  SiRNA target sequence
ttaatggatttttttgtct

SEQ ID NO: 225350 - DNA, 19 bp, Artificial sequence
  SiRNA target sequence
taatggatttttttgtctg

SEQ ID NO: 225351 - DNA, 19 bp, Artificial sequence
  SiRNA target sequence
aatggatttttttgtctga

SEQ ID NO: 225352 - DNA, 19 bp, Artificial sequence
  SiRNA target sequence
atggatttttttgtctgag

SEQ ID NO: 225353 - DNA, 19 bp, Artificial sequence
  SiRNA target sequence
tggatttttttgtctgagt

SEQ ID NO: 225354 - DNA, 19 bp, Artificial sequence
  SiRNA target sequence
ggatttttttgtctgagtg

SEQ ID NO: 225355 - DNA, 19 bp, Artificial sequence
  SiRNA target sequence
gatttttttgtctgagtgg

SEQ ID NO: 225356 - DNA, 19 bp, Artificial sequence
  SiRNA target sequence
atttttttgtctgagtgga

SEQ ID NO: 225357 - DNA, 19 bp, Artificial sequence
  SiRNA target sequence
tttttttgtctgagtggaa

SEQ ID NO: 225358 - DNA, 19 bp, Artificial sequence
  SiRNA target sequence
ttttttgtctgagtggaat

SEQ ID NO: 225359 - DNA, 19 bp, Artificial sequence
  SiRNA target sequence
tttttgtctgagtggaatt

SEQ ID NO: 225360 - DNA, 19 bp, Artificial sequence
  SiRNA target sequence
ttttgtctgagtggaattc

SEQ ID NO: 225361 - DNA, 19 bp, Artificial sequence
  SiRNA target sequence
tttgtctgagtggaattct

SEQ ID NO: 225362 - DNA, 19 bp, Artificial sequence
  SiRNA target sequence
ttgtctgagtggaattctc

SEQ ID NO: 225363 - DNA, 19 bp, Artificial sequence
  SiRNA target sequence
tgtctgagtggaattctct

SEQ ID NO: 225364 - DNA, 19 bp, Artificial sequence
  SiRNA target sequence
gtctgagtggaattctctg

SEQ ID NO: 225365 - DNA, 19 bp, Artificial sequence
  SiRNA target sequence
tctgagtggaattctctgt

SEQ ID NO: 225366 - DNA, 19 bp, Artificial sequence
  SiRNA target sequence
ctgagtggaattctctgtg

SEQ ID NO: 225367 - DNA, 19 bp, Artificial sequence
  SiRNA target sequence
tgagtggaattctctgtgc

SEQ ID NO: 225368 - DNA, 19 bp, Artificial sequence
  SiRNA target sequence
gagtggaattctctgtgct

SEQ ID NO: 225369 - DNA, 19 bp, Artificial sequence
  SiRNA target sequence
agtggaattctctgtgctg

SEQ ID NO: 225370 - DNA, 19 bp, Artificial sequence
  SiRNA target sequence
gtggaattctctgtgctgt

SEQ ID NO: 225371 - DNA, 19 bp, Artificial sequence
  SiRNA target sequence
tggaattctctgtgctgta

SEQ ID NO: 225372 - DNA, 19 bp, Artificial sequence
  SiRNA target sequence
ggaattctctgtgctgtaa

SEQ ID NO: 225373 - DNA, 19 bp, Artificial sequence
  SiRNA target sequence
gaattctctgtgctgtaat

SEQ ID NO: 225374 - DNA, 19 bp, Artificial sequence
  SiRNA target sequence
aattctctgtgctgtaatt

SEQ ID NO: 225375 - DNA, 19 bp, Artificial sequence
  SiRNA target sequence
attctctgtgctgtaattt

SEQ ID NO: 225376 - DNA, 19 bp, Artificial sequence
  SiRNA target sequence
ttctctgtgctgtaattta

SEQ ID NO: 225377 - DNA, 19 bp, Artificial sequence
  SiRNA target sequence
tctctgtgctgtaatttat

SEQ ID NO: 225378 - DNA, 19 bp, Artificial sequence
  SiRNA target sequence
ctctgtgctgtaatttatc

SEQ ID NO: 225379 - DNA, 19 bp, Artificial sequence
  SiRNA target sequence
tctgtgctgtaatttatct

SEQ ID NO: 225380 - DNA, 19 bp, Artificial sequence
  SiRNA target sequence
ctgtgctgtaatttatctt

SEQ ID NO: 225381 - DNA, 19 bp, Artificial sequence
  SiRNA target sequence
tgtgctgtaatttatcttc

SEQ ID NO: 225382 - DNA, 19 bp, Artificial sequence
  SiRNA target sequence
gtgctgtaatttatcttct

SEQ ID NO: 225383 - DNA, 19 bp, Artificial sequence
  SiRNA target sequence
tgctgtaatttatcttcta

SEQ ID NO: 225384 - DNA, 19 bp, Artificial sequence
  SiRNA target sequence
gctgtaatttatcttctaa

SEQ ID NO: 225385 - DNA, 19 bp, Artificial sequence
  SiRNA target sequence
ctgtaatttatcttctaaa

SEQ ID NO: 225386 - DNA, 19 bp, Artificial sequence
  SiRNA target sequence
tgtaatttatcttctaaaa

SEQ ID NO: 225387 - DNA, 19 bp, Artificial sequence
  SiRNA target sequence
gtaatttatcttctaaaaa

SEQ ID NO: 225388 - DNA, 19 bp, Artificial sequence
  SiRNA target sequence
taatttatcttctaaaaaa

SEQ ID NO: 225389 - DNA, 19 bp, Artificial sequence
  SiRNA target sequence
aatttatcttctaaaaaaa

SEQ ID NO: 225390 - DNA, 19 bp, Artificial sequence
  SiRNA target sequence
atttatcttctaaaaaaat

SEQ ID NO: 225391 - DNA, 19 bp, Artificial sequence
  SiRNA target sequence
tttatcttctaaaaaaata

SEQ ID NO: 225392 - DNA, 19 bp, Artificial sequence
  SiRNA target sequence
ttatcttctaaaaaaatat

SEQ ID NO: 225393 - DNA, 19 bp, Artificial sequence
  SiRNA target sequence
tatcttctaaaaaaatatt

SEQ ID NO: 225394 - DNA, 19 bp, Artificial sequence
  SiRNA target sequence
atcttctaaaaaaatattt

SEQ ID NO: 225395 - DNA, 19 bp, Artificial sequence
  SiRNA target sequence
tcttctaaaaaaatattta

SEQ ID NO: 225396 - DNA, 19 bp, Artificial sequence
  SiRNA target sequence
cttctaaaaaaatatttag

SEQ ID NO: 225397 - DNA, 19 bp, Artificial sequence
  SiRNA target sequence
ttctaaaaaaatatttaga

SEQ ID NO: 225398 - DNA, 19 bp, Artificial sequence
  SiRNA target sequence
tctaaaaaaatatttagaa

SEQ ID NO: 225399 - DNA, 19 bp, Artificial sequence
  SiRNA target sequence
ctaaaaaaatatttagaaa

SEQ ID NO: 225400 - DNA, 19 bp, Artificial sequence
  SiRNA target sequence
taaaaaaatatttagaaaa

SEQ ID NO: 225401 - DNA, 19 bp, Artificial sequence
  SiRNA target sequence
aaaaaaatatttagaaaat

SEQ ID NO: 225402 - DNA, 19 bp, Artificial sequence
  SiRNA target sequence
aaaaaatatttagaaaata

SEQ ID NO: 225403 - DNA, 19 bp, Artificial sequence
  SiRNA target sequence
aaaaatatttagaaaataa

SEQ ID NO: 225404 - DNA, 19 bp, Artificial sequence
  SiRNA target sequence
aaaatatttagaaaataat

SEQ ID NO: 225405 - DNA, 19 bp, Artificial sequence
  SiRNA target sequence
aaatatttagaaaataatg

SEQ ID NO: 225406 - DNA, 19 bp, Artificial sequence
  SiRNA target sequence
aatatttagaaaataatgt

SEQ ID NO: 225407 - DNA, 19 bp, Artificial sequence
  SiRNA target sequence
atatttagaaaataatgtt

SEQ ID NO: 225408 - DNA, 19 bp, Artificial sequence
  SiRNA target sequence
tatttagaaaataatgtta

SEQ ID NO: 225409 - DNA, 19 bp, Artificial sequence
  SiRNA target sequence
atttagaaaataatgttac

SEQ ID NO: 225410 - DNA, 19 bp, Artificial sequence
  SiRNA target sequence
tttagaaaataatgttact

SEQ ID NO: 225411 - DNA, 19 bp, Artificial sequence
  SiRNA target sequence
ttagaaaataatgttacta

SEQ ID NO: 225412 - DNA, 19 bp, Artificial sequence
  SiRNA target sequence
tagaaaataatgttactag

SEQ ID NO: 225413 - DNA, 19 bp, Artificial sequence
  SiRNA target sequence
agaaaataatgttactagc

SEQ ID NO: 225414 - DNA, 19 bp, Artificial sequence
  SiRNA target sequence
gaaaataatgttactagca

SEQ ID NO: 225415 - DNA, 19 bp, Artificial sequence
  SiRNA target sequence
aaaataatgttactagcaa

SEQ ID NO: 225416 - DNA, 19 bp, Artificial sequence
  SiRNA target sequence
aaataatgttactagcaaa

SEQ ID NO: 225417 - DNA, 19 bp, Artificial sequence
  SiRNA target sequence
aataatgttactagcaaac

SEQ ID NO: 225418 - DNA, 19 bp, Artificial sequence
  SiRNA target sequence
ataatgttactagcaaacc

SEQ ID NO: 225419 - DNA, 19 bp, Artificial sequence
  SiRNA target sequence
taatgttactagcaaacca

SEQ ID NO: 225420 - DNA, 19 bp, Artificial sequence
  SiRNA target sequence
aatgttactagcaaaccaa

SEQ ID NO: 225421 - DNA, 19 bp, Artificial sequence
  SiRNA target sequence
atgttactagcaaaccaat

SEQ ID NO: 225422 - DNA, 19 bp, Artificial sequence
  SiRNA target sequence
tgttactagcaaaccaatg

SEQ ID NO: 225423 - DNA, 19 bp, Artificial sequence
  SiRNA target sequence
gttactagcaaaccaatgt

SEQ ID NO: 225424 - DNA, 19 bp, Artificial sequence
  SiRNA target sequence
ttactagcaaaccaatgtt

SEQ ID NO: 225425 - DNA, 19 bp, Artificial sequence
  SiRNA target sequence
tactagcaaaccaatgttt

SEQ ID NO: 225426 - DNA, 19 bp, Artificial sequence
  SiRNA target sequence
actagcaaaccaatgtttg

SEQ ID NO: 225427 - DNA, 19 bp, Artificial sequence
  SiRNA target sequence
ctagcaaaccaatgtttgt

SEQ ID NO: 225428 - DNA, 19 bp, Artificial sequence
  SiRNA target sequence
tagcaaaccaatgtttgtt

SEQ ID NO: 225429 - DNA, 19 bp, Artificial sequence
  SiRNA target sequence
agcaaaccaatgtttgtta

SEQ ID NO: 225430 - DNA, 19 bp, Artificial sequence
  SiRNA target sequence
gcaaaccaatgtttgttag

SEQ ID NO: 225431 - DNA, 19 bp, Artificial sequence
  SiRNA target sequence
caaaccaatgtttgttaga

SEQ ID NO: 225432 - DNA, 19 bp, Artificial sequence
  SiRNA target sequence
aaaccaatgtttgttagaa

SEQ ID NO: 225433 - DNA, 19 bp, Artificial sequence
  SiRNA target sequence
aaccaatgtttgttagaaa

SEQ ID NO: 225434 - DNA, 19 bp, Artificial sequence
  SiRNA target sequence
accaatgtttgttagaaag

SEQ ID NO: 225435 - DNA, 19 bp, Artificial sequence
  SiRNA target sequence
ccaatgtttgttagaaaga

SEQ ID NO: 225436 - DNA, 19 bp, Artificial sequence
  SiRNA target sequence
caatgtttgttagaaagac

SEQ ID NO: 225437 - DNA, 19 bp, Artificial sequence
  SiRNA target sequence
aatgtttgttagaaagact

SEQ ID NO: 225438 - DNA, 19 bp, Artificial sequence
  SiRNA target sequence
atgtttgttagaaagactt

SEQ ID NO: 225439 - DNA, 19 bp, Artificial sequence
  SiRNA target sequence
tgtttgttagaaagacttt

SEQ ID NO: 225440 - DNA, 19 bp, Artificial sequence
  SiRNA target sequence
gtttgttagaaagactttt

SEQ ID NO: 225441 - DNA, 19 bp, Artificial sequence
  SiRNA target sequence
tttgttagaaagactttta

SEQ ID NO: 225442 - DNA, 19 bp, Artificial sequence
  SiRNA target sequence
ttgttagaaagacttttac

SEQ ID NO: 225443 - DNA, 19 bp, Artificial sequence
  SiRNA target sequence
tgttagaaagacttttact

SEQ ID NO: 225444 - DNA, 19 bp, Artificial sequence
  SiRNA target sequence
gttagaaagacttttacta

SEQ ID NO: 225445 - DNA, 19 bp, Artificial sequence
  SiRNA target sequence
ttagaaagacttttactaa

SEQ ID NO: 225446 - DNA, 19 bp, Artificial sequence
  SiRNA target sequence
tagaaagacttttactaaa

SEQ ID NO: 225447 - DNA, 19 bp, Artificial sequence
  SiRNA target sequence
agaaagacttttactaaaa

SEQ ID NO: 225448 - DNA, 19 bp, Artificial sequence
  SiRNA target sequence
gaaagacttttactaaaaa

SEQ ID NO: 225449 - DNA, 19 bp, Artificial sequence
  SiRNA target sequence
aaagacttttactaaaaag

SEQ ID NO: 225450 - DNA, 19 bp, Artificial sequence
  SiRNA target sequence
aagacttttactaaaaaga

SEQ ID NO: 225451 - DNA, 19 bp, Artificial sequence
  SiRNA target sequence
agacttttactaaaaagaa

SEQ ID NO: 225452 - DNA, 19 bp, Artificial sequence
  SiRNA target sequence
gacttttactaaaaagaag

SEQ ID NO: 225453 - DNA, 19 bp, Artificial sequence
  SiRNA target sequence
acttttactaaaaagaaga

SEQ ID NO: 225454 - DNA, 19 bp, Artificial sequence
  SiRNA target sequence
cttttactaaaaagaagag

SEQ ID NO: 225455 - DNA, 19 bp, Artificial sequence
  SiRNA target sequence
ttttactaaaaagaagagt

SEQ ID NO: 225456 - DNA, 19 bp, Artificial sequence
  SiRNA target sequence
tttactaaaaagaagagta

SEQ ID NO: 225457 - DNA, 19 bp, Artificial sequence
  SiRNA target sequence
ttactaaaaagaagagtaa

SEQ ID NO: 225458 - DNA, 19 bp, Artificial sequence
  SiRNA target sequence
tactaaaaagaagagtaaa

SEQ ID NO: 225459 - DNA, 19 bp, Artificial sequence
  SiRNA target sequence
actaaaaagaagagtaaag

SEQ ID NO: 225460 - DNA, 19 bp, Artificial sequence
  SiRNA target sequence
ctaaaaagaagagtaaagt

SEQ ID NO: 225461 - DNA, 19 bp, Artificial sequence
  SiRNA target sequence
taaaaagaagagtaaagtg

SEQ ID NO: 225462 - DNA, 19 bp, Artificial sequence
  SiRNA target sequence
aaaaagaagagtaaagtga

SEQ ID NO: 225463 - DNA, 19 bp, Artificial sequence
  SiRNA target sequence
aaaagaagagtaaagtgaa

SEQ ID NO: 225464 - DNA, 19 bp, Artificial sequence
  SiRNA target sequence
aaagaagagtaaagtgaag

SEQ ID NO: 225465 - DNA, 19 bp, Artificial sequence
  SiRNA target sequence
aagaagagtaaagtgaagg

SEQ ID NO: 225466 - DNA, 19 bp, Artificial sequence
  SiRNA target sequence
agaagagtaaagtgaaggt

SEQ ID NO: 225467 - DNA, 19 bp, Artificial sequence
  SiRNA target sequence
gaagagtaaagtgaaggtt

SEQ ID NO: 225468 - DNA, 19 bp, Artificial sequence
  SiRNA target sequence
aagagtaaagtgaaggttg

SEQ ID NO: 225469 - DNA, 19 bp, Artificial sequence
  SiRNA target sequence
agagtaaagtgaaggttgg

SEQ ID NO: 225470 - DNA, 19 bp, Artificial sequence
  SiRNA target sequence
gagtaaagtgaaggttgga

SEQ ID NO: 225471 - DNA, 19 bp, Artificial sequence
  SiRNA target sequence
agtaaagtgaaggttggat

SEQ ID NO: 225472 - DNA, 19 bp, Artificial sequence
  SiRNA target sequence
gtaaagtgaaggttggatt

SEQ ID NO: 225473 - DNA, 19 bp, Artificial sequence
  SiRNA target sequence
taaagtgaaggttggattt

SEQ ID NO: 225474 - DNA, 19 bp, Artificial sequence
  SiRNA target sequence
aaagtgaaggttggatttg

SEQ ID NO: 225475 - DNA, 19 bp, Artificial sequence
  SiRNA target sequence
aagtgaaggttggatttgt

SEQ ID NO: 225476 - DNA, 19 bp, Artificial sequence
  SiRNA target sequence
agtgaaggttggatttgtt

SEQ ID NO: 225477 - DNA, 19 bp, Artificial sequence
  SiRNA target sequence
gtgaaggttggatttgttg

SEQ ID NO: 225478 - DNA, 19 bp, Artificial sequence
  SiRNA target sequence
tgaaggttggatttgttga

SEQ ID NO: 225479 - DNA, 19 bp, Artificial sequence
  SiRNA target sequence
gaaggttggatttgttgat

SEQ ID NO: 225480 - DNA, 19 bp, Artificial sequence
  SiRNA target sequence
aaggttggatttgttgatg

SEQ ID NO: 225481 - DNA, 19 bp, Artificial sequence
  SiRNA target sequence
aggttggatttgttgatgg

SEQ ID NO: 225482 - DNA, 19 bp, Artificial sequence
  SiRNA target sequence
ggttggatttgttgatgga

SEQ ID NO: 225483 - DNA, 19 bp, Artificial sequence
  SiRNA target sequence
gttggatttgttgatggac

SEQ ID NO: 225484 - DNA, 19 bp, Artificial sequence
  SiRNA target sequence
ttggatttgttgatggact

SEQ ID NO: 225485 - DNA, 19 bp, Artificial sequence
  SiRNA target sequence
tggatttgttgatggactt

SEQ ID NO: 225486 - DNA, 19 bp, Artificial sequence
  SiRNA target sequence
ggatttgttgatggactta

SEQ ID NO: 225487 - DNA, 19 bp, Artificial sequence
  SiRNA target sequence
gatttgttgatggacttat

SEQ ID NO: 225488 - DNA, 19 bp, Artificial sequence
  SiRNA target sequence
atttgttgatggacttatt

SEQ ID NO: 225489 - DNA, 19 bp, Artificial sequence
  SiRNA target sequence
tttgttgatggacttattg

SEQ ID NO: 225490 - DNA, 19 bp, Artificial sequence
  SiRNA target sequence
ttgttgatggacttattga

SEQ ID NO: 225491 - DNA, 19 bp, Artificial sequence
  SiRNA target sequence
tgttgatggacttattgag

SEQ ID NO: 225492 - DNA, 19 bp, Artificial sequence
  SiRNA target sequence
gttgatggacttattgaga

SEQ ID NO: 225493 - DNA, 19 bp, Artificial sequence
  SiRNA target sequence
ttgatggacttattgagat

SEQ ID NO: 225494 - DNA, 19 bp, Artificial sequence
  SiRNA target sequence
tgatggacttattgagatg

SEQ ID NO: 225495 - DNA, 19 bp, Artificial sequence
  SiRNA target sequence
gatggacttattgagatga

SEQ ID NO: 225496 - DNA, 19 bp, Artificial sequence
  SiRNA target sequence
atggacttattgagatgag

SEQ ID NO: 225497 - DNA, 19 bp, Artificial sequence
  SiRNA target sequence
tggacttattgagatgagt

SEQ ID NO: 225498 - DNA, 19 bp, Artificial sequence
  SiRNA target sequence
ggacttattgagatgagta

SEQ ID NO: 225499 - DNA, 19 bp, Artificial sequence
  SiRNA target sequence
gacttattgagatgagtaa

SEQ ID NO: 225500 - DNA, 19 bp, Artificial sequence
  SiRNA target sequence
acttattgagatgagtaaa

SEQ ID NO: 225501 - DNA, 19 bp, Artificial sequence
  SiRNA target sequence
cttattgagatgagtaaat

SEQ ID NO: 225502 - DNA, 19 bp, Artificial sequence
  SiRNA target sequence
ttattgagatgagtaaatc

SEQ ID NO: 225503 - DNA, 19 bp, Artificial sequence
  SiRNA target sequence
tattgagatgagtaaatct

SEQ ID NO: 225504 - DNA, 19 bp, Artificial sequence
  SiRNA target sequence
attgagatgagtaaatcta

SEQ ID NO: 225505 - DNA, 19 bp, Artificial sequence
  SiRNA target sequence
ttgagatgagtaaatctaa

SEQ ID NO: 225506 - DNA, 19 bp, Artificial sequence
  SiRNA target sequence
tgagatgagtaaatctaaa

SEQ ID NO: 225507 - DNA, 19 bp, Artificial sequence
  SiRNA target sequence
gagatgagtaaatctaaac

SEQ ID NO: 225508 - DNA, 19 bp, Artificial sequence
  SiRNA target sequence
agatgagtaaatctaaact

SEQ ID NO: 225509 - DNA, 19 bp, Artificial sequence
  SiRNA target sequence
gatgagtaaatctaaacta

SEQ ID NO: 225510 - DNA, 19 bp, Artificial sequence
  SiRNA target sequence
atgagtaaatctaaactac

SEQ ID NO: 225511 - DNA, 19 bp, Artificial sequence
  SiRNA target sequence
tgagtaaatctaaactact

SEQ ID NO: 225512 - DNA, 19 bp, Artificial sequence
  SiRNA target sequence
gagtaaatctaaactactg

SEQ ID NO: 225513 - DNA, 19 bp, Artificial sequence
  SiRNA target sequence
agtaaatctaaactactgt

SEQ ID NO: 225514 - DNA, 19 bp, Artificial sequence
  SiRNA target sequence
gtaaatctaaactactgtt

SEQ ID NO: 225515 - DNA, 19 bp, Artificial sequence
  SiRNA target sequence
taaatctaaactactgttg

SEQ ID NO: 225516 - DNA, 19 bp, Artificial sequence
  SiRNA target sequence
aaatctaaactactgttga

SEQ ID NO: 225517 - DNA, 19 bp, Artificial sequence
  SiRNA target sequence
aatctaaactactgttgaa

SEQ ID NO: 225518 - DNA, 19 bp, Artificial sequence
  SiRNA target sequence
atctaaactactgttgaat

SEQ ID NO: 225519 - DNA, 19 bp, Artificial sequence
  SiRNA target sequence
tctaaactactgttgaata

SEQ ID NO: 225520 - DNA, 19 bp, Artificial sequence
  SiRNA target sequence
ctaaactactgttgaatat

SEQ ID NO: 225521 - DNA, 19 bp, Artificial sequence
  SiRNA target sequence
taaactactgttgaatatg

SEQ ID NO: 225522 - DNA, 19 bp, Artificial sequence
  SiRNA target sequence
aaactactgttgaatatgt

SEQ ID NO: 225523 - DNA, 19 bp, Artificial sequence
  SiRNA target sequence
aactactgttgaatatgtc

SEQ ID NO: 225524 - DNA, 19 bp, Artificial sequence
  SiRNA target sequence
actactgttgaatatgtca

SEQ ID NO: 225525 - DNA, 19 bp, Artificial sequence
  SiRNA target sequence
ctactgttgaatatgtcat

SEQ ID NO: 225526 - DNA, 19 bp, Artificial sequence
  SiRNA target sequence
tactgttgaatatgtcatt

SEQ ID NO: 225527 - DNA, 19 bp, Artificial sequence
  SiRNA target sequence
actgttgaatatgtcatta

SEQ ID NO: 225528 - DNA, 19 bp, Artificial sequence
  SiRNA target sequence
ctgttgaatatgtcattag

SEQ ID NO: 225529 - DNA, 19 bp, Artificial sequence
  SiRNA target sequence
tgttgaatatgtcattagt

SEQ ID NO: 225530 - DNA, 19 bp, Artificial sequence
  SiRNA target sequence
gttgaatatgtcattagtc

SEQ ID NO: 225531 - DNA, 19 bp, Artificial sequence
  SiRNA target sequence
ttgaatatgtcattagtcg

SEQ ID NO: 225532 - DNA, 19 bp, Artificial sequence
  SiRNA target sequence
tgaatatgtcattagtcgt

SEQ ID NO: 225533 - DNA, 19 bp, Artificial sequence
  SiRNA target sequence
gaatatgtcattagtcgta

SEQ ID NO: 225534 - DNA, 19 bp, Artificial sequence
  SiRNA target sequence
aatatgtcattagtcgtat

SEQ ID NO: 225535 - DNA, 19 bp, Artificial sequence
  SiRNA target sequence
atatgtcattagtcgtatt

SEQ ID NO: 225536 - DNA, 19 bp, Artificial sequence
  SiRNA target sequence
tatgtcattagtcgtatta

SEQ ID NO: 225537 - DNA, 19 bp, Artificial sequence
  SiRNA target sequence
atgtcattagtcgtattat

SEQ ID NO: 225538 - DNA, 19 bp, Artificial sequence
  SiRNA target sequence
tgtcattagtcgtattatt

SEQ ID NO: 225539 - DNA, 19 bp, Artificial sequence
  SiRNA target sequence
gtcattagtcgtattattt

SEQ ID NO: 225540 - DNA, 19 bp, Artificial sequence
  SiRNA target sequence
tcattagtcgtattatttt

SEQ ID NO: 225541 - DNA, 19 bp, Artificial sequence
  SiRNA target sequence
cattagtcgtattatttta

SEQ ID NO: 225542 - DNA, 19 bp, Artificial sequence
  SiRNA target sequence
attagtcgtattattttat

SEQ ID NO: 225543 - DNA, 19 bp, Artificial sequence
  SiRNA target sequence
ttagtcgtattattttatg

SEQ ID NO: 225544 - DNA, 19 bp, Artificial sequence
  SiRNA target sequence
tagtcgtattattttatgc

SEQ ID NO: 225545 - DNA, 19 bp, Artificial sequence
  SiRNA target sequence
agtcgtattattttatgct

SEQ ID NO: 225546 - DNA, 19 bp, Artificial sequence
  SiRNA target sequence
gtcgtattattttatgctg

SEQ ID NO: 225547 - DNA, 19 bp, Artificial sequence
  SiRNA target sequence
tcgtattattttatgctgt

SEQ ID NO: 225548 - DNA, 19 bp, Artificial sequence
  SiRNA target sequence
cgtattattttatgctgtt

SEQ ID NO: 225549 - DNA, 19 bp, Artificial sequence
  SiRNA target sequence
gtattattttatgctgttt

SEQ ID NO: 225550 - DNA, 19 bp, Artificial sequence
  SiRNA target sequence
tattattttatgctgtttc

SEQ ID NO: 225551 - DNA, 19 bp, Artificial sequence
  SiRNA target sequence
attattttatgctgtttct

SEQ ID NO: 225552 - DNA, 19 bp, Artificial sequence
  SiRNA target sequence
ttattttatgctgtttcta

SEQ ID NO: 225553 - DNA, 19 bp, Artificial sequence
  SiRNA target sequence
tattttatgctgtttctac

SEQ ID NO: 225554 - DNA, 19 bp, Artificial sequence
  SiRNA target sequence
attttatgctgtttctacg

SEQ ID NO: 225555 - DNA, 19 bp, Artificial sequence
  SiRNA target sequence
ttttatgctgtttctacga

SEQ ID NO: 225556 - DNA, 19 bp, Artificial sequence
  SiRNA target sequence
tttatgctgtttctacgaa

SEQ ID NO: 225557 - DNA, 19 bp, Artificial sequence
  SiRNA target sequence
ttatgctgtttctacgaat

SEQ ID NO: 225558 - DNA, 19 bp, Artificial sequence
  SiRNA target sequence
tatgctgtttctacgaata

SEQ ID NO: 225559 - DNA, 19 bp, Artificial sequence
  SiRNA target sequence
atgctgtttctacgaatat

SEQ ID NO: 225560 - DNA, 19 bp, Artificial sequence
  SiRNA target sequence
tgctgtttctacgaatatt

SEQ ID NO: 225561 - DNA, 19 bp, Artificial sequence
  SiRNA target sequence
gctgtttctacgaatatta

SEQ ID NO: 225562 - DNA, 19 bp, Artificial sequence
  SiRNA target sequence
ctgtttctacgaatattat

SEQ ID NO: 225563 - DNA, 19 bp, Artificial sequence
  SiRNA target sequence
tgtttctacgaatattatt

SEQ ID NO: 225564 - DNA, 19 bp, Artificial sequence
  SiRNA target sequence
gtttctacgaatattattg

SEQ ID NO: 225565 - DNA, 19 bp, Artificial sequence
  SiRNA target sequence
tttctacgaatattattga

SEQ ID NO: 225566 - DNA, 19 bp, Artificial sequence
  SiRNA target sequence
ttctacgaatattattgag

SEQ ID NO: 225567 - DNA, 19 bp, Artificial sequence
  SiRNA target sequence
tctacgaatattattgagt

SEQ ID NO: 225568 - DNA, 19 bp, Artificial sequence
  SiRNA target sequence
ctacgaatattattgagtc

SEQ ID NO: 225569 - DNA, 19 bp, Artificial sequence
  SiRNA target sequence
tacgaatattattgagtca

SEQ ID NO: 225570 - DNA, 19 bp, Artificial sequence
  SiRNA target sequence
acgaatattattgagtcag

SEQ ID NO: 225571 - DNA, 19 bp, Artificial sequence
  SiRNA target sequence
cgaatattattgagtcagc

SEQ ID NO: 225572 - DNA, 19 bp, Artificial sequence
  SiRNA target sequence
gaatattattgagtcagct

SEQ ID NO: 225573 - DNA, 19 bp, Artificial sequence
  SiRNA target sequence
aatattattgagtcagctt

SEQ ID NO: 225574 - DNA, 19 bp, Artificial sequence
  SiRNA target sequence
atattattgagtcagctta

SEQ ID NO: 225575 - DNA, 19 bp, Artificial sequence
  SiRNA target sequence
tattattgagtcagcttat

SEQ ID NO: 225576 - DNA, 19 bp, Artificial sequence
  SiRNA target sequence
attattgagtcagcttata

SEQ ID NO: 225577 - DNA, 19 bp, Artificial sequence
  SiRNA target sequence
ttattgagtcagcttataa

SEQ ID NO: 225578 - DNA, 19 bp, Artificial sequence
  SiRNA target sequence
tattgagtcagcttataaa

SEQ ID NO: 225579 - DNA, 19 bp, Artificial sequence
  SiRNA target sequence
attgagtcagcttataaat

SEQ ID NO: 225580 - DNA, 19 bp, Artificial sequence
  SiRNA target sequence
ttgagtcagcttataaatc

SEQ ID NO: 225581 - DNA, 19 bp, Artificial sequence
  SiRNA target sequence
tgagtcagcttataaatct

SEQ ID NO: 225582 - DNA, 19 bp, Artificial sequence
  SiRNA target sequence
gagtcagcttataaatctg

SEQ ID NO: 225583 - DNA, 19 bp, Artificial sequence
  SiRNA target sequence
agtcagcttataaatctgc

SEQ ID NO: 225584 - DNA, 19 bp, Artificial sequence
  SiRNA target sequence
gtcagcttataaatctgct

SEQ ID NO: 225585 - DNA, 19 bp, Artificial sequence
  SiRNA target sequence
tcagcttataaatctgctt

SEQ ID NO: 225586 - DNA, 19 bp, Artificial sequence
  SiRNA target sequence
cagcttataaatctgcttt

SEQ ID NO: 225587 - DNA, 19 bp, Artificial sequence
  SiRNA target sequence
agcttataaatctgcttta

SEQ ID NO: 225588 - DNA, 19 bp, Artificial sequence
  SiRNA target sequence
gcttataaatctgctttag

SEQ ID NO: 225589 - DNA, 19 bp, Artificial sequence
  SiRNA target sequence
cttataaatctgctttagc

SEQ ID NO: 225590 - DNA, 19 bp, Artificial sequence
  SiRNA target sequence
ttataaatctgctttagct

SEQ ID NO: 225591 - DNA, 19 bp, Artificial sequence
  SiRNA target sequence
tataaatctgctttagctg

SEQ ID NO: 225592 - DNA, 19 bp, Artificial sequence
  SiRNA target sequence
ataaatctgctttagctgt

SEQ ID NO: 225593 - DNA, 19 bp, Artificial sequence
  SiRNA target sequence
taaatctgctttagctgtc

SEQ ID NO: 225594 - DNA, 19 bp, Artificial sequence
  SiRNA target sequence
aaatctgctttagctgtcg

SEQ ID NO: 225595 - DNA, 19 bp, Artificial sequence
  SiRNA target sequence
aatctgctttagctgtcgg

SEQ ID NO: 225596 - DNA, 19 bp, Artificial sequence
  SiRNA target sequence
atctgctttagctgtcggt

SEQ ID NO: 225597 - DNA, 19 bp, Artificial sequence
  SiRNA target sequence
tctgctttagctgtcggtg

SEQ ID NO: 225598 - DNA, 19 bp, Artificial sequence
  SiRNA target sequence
ctgctttagctgtcggtgc

SEQ ID NO: 225599 - DNA, 19 bp, Artificial sequence
  SiRNA target sequence
tgctttagctgtcggtgct

SEQ ID NO: 225600 - DNA, 19 bp, Artificial sequence
  SiRNA target sequence
gctttagctgtcggtgcta

SEQ ID NO: 225601 - DNA, 19 bp, Artificial sequence
  SiRNA target sequence
ctttagctgtcggtgctaa

SEQ ID NO: 225602 - DNA, 19 bp, Artificial sequence
  SiRNA target sequence
tttagctgtcggtgctaat

SEQ ID NO: 225603 - DNA, 19 bp, Artificial sequence
  SiRNA target sequence
ttagctgtcggtgctaatg

SEQ ID NO: 225604 - DNA, 19 bp, Artificial sequence
  SiRNA target sequence
tagctgtcggtgctaatga

SEQ ID NO: 225605 - DNA, 19 bp, Artificial sequence
  SiRNA target sequence
agctgtcggtgctaatgaa

SEQ ID NO: 225606 - DNA, 19 bp, Artificial sequence
  SiRNA target sequence
gctgtcggtgctaatgaaa

SEQ ID NO: 225607 - DNA, 19 bp, Artificial sequence
  SiRNA target sequence
ctgtcggtgctaatgaaac

SEQ ID NO: 225608 - DNA, 19 bp, Artificial sequence
  SiRNA target sequence
tgtcggtgctaatgaaact

SEQ ID NO: 225609 - DNA, 19 bp, Artificial sequence
  SiRNA target sequence
gtcggtgctaatgaaactg

SEQ ID NO: 225610 - DNA, 19 bp, Artificial sequence
  SiRNA target sequence
tcggtgctaatgaaactgg

SEQ ID NO: 225611 - DNA, 19 bp, Artificial sequence
  SiRNA target sequence
cggtgctaatgaaactggt

SEQ ID NO: 225612 - DNA, 19 bp, Artificial sequence
  SiRNA target sequence
ggtgctaatgaaactggtg

SEQ ID NO: 225613 - DNA, 19 bp, Artificial sequence
  SiRNA target sequence
gtgctaatgaaactggtga

SEQ ID NO: 225614 - DNA, 19 bp, Artificial sequence
  SiRNA target sequence
tgctaatgaaactggtgag

SEQ ID NO: 225615 - DNA, 19 bp, Artificial sequence
  SiRNA target sequence
gctaatgaaactggtgagg

SEQ ID NO: 225616 - DNA, 19 bp, Artificial sequence
  SiRNA target sequence
ctaatgaaactggtgaggc

SEQ ID NO: 225617 - DNA, 19 bp, Artificial sequence
  SiRNA target sequence
taatgaaactggtgaggca

SEQ ID NO: 225618 - DNA, 19 bp, Artificial sequence
  SiRNA target sequence
aatgaaactggtgaggcaa

SEQ ID NO: 225619 - DNA, 19 bp, Artificial sequence
  SiRNA target sequence
atgaaactggtgaggcaaa

SEQ ID NO: 225620 - DNA, 19 bp, Artificial sequence
  SiRNA target sequence
tgaaactggtgaggcaaaa

SEQ ID NO: 225621 - DNA, 19 bp, Artificial sequence
  SiRNA target sequence
gaaactggtgaggcaaaat

SEQ ID NO: 225622 - DNA, 19 bp, Artificial sequence
  SiRNA target sequence
aaactggtgaggcaaaatc

SEQ ID NO: 225623 - DNA, 19 bp, Artificial sequence
  SiRNA target sequence
aactggtgaggcaaaatct

SEQ ID NO: 225624 - DNA, 19 bp, Artificial sequence
  SiRNA target sequence
actggtgaggcaaaatcta

SEQ ID NO: 225625 - DNA, 19 bp, Artificial sequence
  SiRNA target sequence
ctggtgaggcaaaatctac

SEQ ID NO: 225626 - DNA, 19 bp, Artificial sequence
  SiRNA target sequence
tggtgaggcaaaatctacc

SEQ ID NO: 225627 - DNA, 19 bp, Artificial sequence
  SiRNA target sequence
ggtgaggcaaaatctacct

SEQ ID NO: 225628 - DNA, 19 bp, Artificial sequence
  SiRNA target sequence
gtgaggcaaaatctaccta

SEQ ID NO: 225629 - DNA, 19 bp, Artificial sequence
  SiRNA target sequence
tgaggcaaaatctacctat

SEQ ID NO: 225630 - DNA, 19 bp, Artificial sequence
  SiRNA target sequence
gaggcaaaatctacctatg

SEQ ID NO: 225631 - DNA, 19 bp, Artificial sequence
  SiRNA target sequence
aggcaaaatctacctatgc

SEQ ID NO: 225632 - DNA, 19 bp, Artificial sequence
  SiRNA target sequence
ggcaaaatctacctatgct

SEQ ID NO: 225633 - DNA, 19 bp, Artificial sequence
  SiRNA target sequence
gcaaaatctacctatgctt

SEQ ID NO: 225634 - DNA, 19 bp, Artificial sequence
  SiRNA target sequence
caaaatctacctatgcttc

SEQ ID NO: 225635 - DNA, 19 bp, Artificial sequence
  SiRNA target sequence
aaaatctacctatgcttca

SEQ ID NO: 225636 - DNA, 19 bp, Artificial sequence
  SiRNA target sequence
aaatctacctatgcttcaa

SEQ ID NO: 225637 - DNA, 19 bp, Artificial sequence
  SiRNA target sequence
aatctacctatgcttcaat

SEQ ID NO: 225638 - DNA, 19 bp, Artificial sequence
  SiRNA target sequence
atctacctatgcttcaatt

SEQ ID NO: 225639 - DNA, 19 bp, Artificial sequence
  SiRNA target sequence
tctacctatgcttcaattt

SEQ ID NO: 225640 - DNA, 19 bp, Artificial sequence
  SiRNA target sequence
ctacctatgcttcaattta

SEQ ID NO: 225641 - DNA, 19 bp, Artificial sequence
  SiRNA target sequence
tacctatgcttcaatttat

SEQ ID NO: 225642 - DNA, 19 bp, Artificial sequence
  SiRNA target sequence
acctatgcttcaatttata

SEQ ID NO: 225643 - DNA, 19 bp, Artificial sequence
  SiRNA target sequence
cctatgcttcaatttatac

SEQ ID NO: 225644 - DNA, 19 bp, Artificial sequence
  SiRNA target sequence
ctatgcttcaatttataca

SEQ ID NO: 225645 - DNA, 19 bp, Artificial sequence
  SiRNA target sequence
tatgcttcaatttatacat

SEQ ID NO: 225646 - DNA, 19 bp, Artificial sequence
  SiRNA target sequence
atgcttcaatttatacatc

SEQ ID NO: 225647 - DNA, 19 bp, Artificial sequence
  SiRNA target sequence
tgcttcaatttatacatca

SEQ ID NO: 225648 - DNA, 19 bp, Artificial sequence
  SiRNA target sequence
gcttcaatttatacatcaa

SEQ ID NO: 225649 - DNA, 19 bp, Artificial sequence
  SiRNA target sequence
cttcaatttatacatcaat

SEQ ID NO: 225650 - DNA, 19 bp, Artificial sequence
  SiRNA target sequence
ttcaatttatacatcaatt

SEQ ID NO: 225651 - DNA, 19 bp, Artificial sequence
  SiRNA target sequence
tcaatttatacatcaattg

SEQ ID NO: 225652 - DNA, 19 bp, Artificial sequence
  SiRNA target sequence
caatttatacatcaattga

SEQ ID NO: 225653 - DNA, 19 bp, Artificial sequence
  SiRNA target sequence
aatttatacatcaattgaa

SEQ ID NO: 225654 - DNA, 19 bp, Artificial sequence
  SiRNA target sequence
atttatacatcaattgaac

SEQ ID NO: 225655 - DNA, 19 bp, Artificial sequence
  SiRNA target sequence
tttatacatcaattgaaca

SEQ ID NO: 225656 - DNA, 19 bp, Artificial sequence
  SiRNA target sequence
ttatacatcaattgaacaa

SEQ ID NO: 225657 - DNA, 19 bp, Artificial sequence
  SiRNA target sequence
tatacatcaattgaacaat

SEQ ID NO: 225658 - DNA, 19 bp, Artificial sequence
  SiRNA target sequence
atacatcaattgaacaatc

SEQ ID NO: 225659 - DNA, 19 bp, Artificial sequence
  SiRNA target sequence
tacatcaattgaacaatct

SEQ ID NO: 225660 - DNA, 19 bp, Artificial sequence
  SiRNA target sequence
acatcaattgaacaatctg

SEQ ID NO: 225661 - DNA, 19 bp, Artificial sequence
  SiRNA target sequence
catcaattgaacaatctgg

SEQ ID NO: 225662 - DNA, 19 bp, Artificial sequence
  SiRNA target sequence
atcaattgaacaatctgga

SEQ ID NO: 225663 - DNA, 19 bp, Artificial sequence
  SiRNA target sequence
tcaattgaacaatctggag

SEQ ID NO: 225664 - DNA, 19 bp, Artificial sequence
  SiRNA target sequence
caattgaacaatctggagt

SEQ ID NO: 225665 - DNA, 19 bp, Artificial sequence
  SiRNA target sequence
aattgaacaatctggagtt

SEQ ID NO: 225666 - DNA, 19 bp, Artificial sequence
  SiRNA target sequence
attgaacaatctggagttg

SEQ ID NO: 225667 - DNA, 19 bp, Artificial sequence
  SiRNA target sequence
ttgaacaatctggagttgc

SEQ ID NO: 225668 - DNA, 19 bp, Artificial sequence
  SiRNA target sequence
tgaacaatctggagttgct

SEQ ID NO: 225669 - DNA, 19 bp, Artificial sequence
  SiRNA target sequence
gaacaatctggagttgctg

SEQ ID NO: 225670 - DNA, 19 bp, Artificial sequence
  SiRNA target sequence
aacaatctggagttgctgt

SEQ ID NO: 225671 - DNA, 19 bp, Artificial sequence
  SiRNA target sequence
acaatctggagttgctgtt

SEQ ID NO: 225672 - DNA, 19 bp, Artificial sequence
  SiRNA target sequence
caatctggagttgctgtta

SEQ ID NO: 225673 - DNA, 19 bp, Artificial sequence
  SiRNA target sequence
aatctggagttgctgttat

SEQ ID NO: 225674 - DNA, 19 bp, Artificial sequence
  SiRNA target sequence
atctggagttgctgttatt

SEQ ID NO: 225675 - DNA, 19 bp, Artificial sequence
  SiRNA target sequence
tctggagttgctgttattg

SEQ ID NO: 225676 - DNA, 19 bp, Artificial sequence
  SiRNA target sequence
ctggagttgctgttattgt

SEQ ID NO: 225677 - DNA, 19 bp, Artificial sequence
  SiRNA target sequence
tggagttgctgttattgtc

SEQ ID NO: 225678 - DNA, 19 bp, Artificial sequence
  SiRNA target sequence
ggagttgctgttattgtca

SEQ ID NO: 225679 - DNA, 19 bp, Artificial sequence
  SiRNA target sequence
gagttgctgttattgtcat

SEQ ID NO: 225680 - DNA, 19 bp, Artificial sequence
  SiRNA target sequence
agttgctgttattgtcatg

SEQ ID NO: 225681 - DNA, 19 bp, Artificial sequence
  SiRNA target sequence
gttgctgttattgtcatga

SEQ ID NO: 225682 - DNA, 19 bp, Artificial sequence
  SiRNA target sequence
ttgctgttattgtcatgat

SEQ ID NO: 225683 - DNA, 19 bp, Artificial sequence
  SiRNA target sequence
tgctgttattgtcatgatt

SEQ ID NO: 225684 - DNA, 19 bp, Artificial sequence
  SiRNA target sequence
gctgttattgtcatgattt

SEQ ID NO: 225685 - DNA, 19 bp, Artificial sequence
  SiRNA target sequence
ctgttattgtcatgatttt

SEQ ID NO: 225686 - DNA, 19 bp, Artificial sequence
  SiRNA target sequence
tgttattgtcatgattttg

SEQ ID NO: 225687 - DNA, 19 bp, Artificial sequence
  SiRNA target sequence
gttattgtcatgattttgc

SEQ ID NO: 225688 - DNA, 19 bp, Artificial sequence
  SiRNA target sequence
ttattgtcatgattttgct

SEQ ID NO: 225689 - DNA, 19 bp, Artificial sequence
  SiRNA target sequence
tattgtcatgattttgcta

SEQ ID NO: 225690 - DNA, 19 bp, Artificial sequence
  SiRNA target sequence
attgtcatgattttgctac

SEQ ID NO: 225691 - DNA, 19 bp, Artificial sequence
  SiRNA target sequence
ttgtcatgattttgctact

SEQ ID NO: 225692 - DNA, 19 bp, Artificial sequence
  SiRNA target sequence
tgtcatgattttgctactt

SEQ ID NO: 225693 - DNA, 19 bp, Artificial sequence
  SiRNA target sequence
gtcatgattttgctactta

SEQ ID NO: 225694 - DNA, 19 bp, Artificial sequence
  SiRNA target sequence
tcatgattttgctacttac

SEQ ID NO: 225695 - DNA, 19 bp, Artificial sequence
  SiRNA target sequence
catgattttgctacttacc

SEQ ID NO: 225696 - DNA, 19 bp, Artificial sequence
  SiRNA target sequence
atgattttgctacttaccc

SEQ ID NO: 225697 - DNA, 19 bp, Artificial sequence
  SiRNA target sequence
tgattttgctacttacccc

SEQ ID NO: 225698 - DNA, 19 bp, Artificial sequence
  SiRNA target sequence
gattttgctacttacccct

SEQ ID NO: 225699 - DNA, 19 bp, Artificial sequence
  SiRNA target sequence
attttgctacttacccctt

SEQ ID NO: 225700 - DNA, 19 bp, Artificial sequence
  SiRNA target sequence
ttttgctacttaccccttt

SEQ ID NO: 225701 - DNA, 19 bp, Artificial sequence
  SiRNA target sequence
tttgctacttacccctttt

SEQ ID NO: 225702 - DNA, 19 bp, Artificial sequence
  SiRNA target sequence
ttgctacttaccccttttc

SEQ ID NO: 225703 - DNA, 19 bp, Artificial sequence
  SiRNA target sequence
tgctacttaccccttttcc

SEQ ID NO: 225704 - DNA, 19 bp, Artificial sequence
  SiRNA target sequence
gctacttaccccttttcca

SEQ ID NO: 225705 - DNA, 19 bp, Artificial sequence
  SiRNA target sequence
ctacttaccccttttccaa

SEQ ID NO: 225706 - DNA, 19 bp, Artificial sequence
  SiRNA target sequence
tacttaccccttttccaag

SEQ ID NO: 225707 - DNA, 19 bp, Artificial sequence
  SiRNA target sequence
acttaccccttttccaagg

SEQ ID NO: 225708 - DNA, 19 bp, Artificial sequence
  SiRNA target sequence
cttaccccttttccaaggc

SEQ ID NO: 225709 - DNA, 19 bp, Artificial sequence
  SiRNA target sequence
ttaccccttttccaaggct

SEQ ID NO: 225710 - DNA, 19 bp, Artificial sequence
  SiRNA target sequence
taccccttttccaaggctt

SEQ ID NO: 225711 - DNA, 19 bp, Artificial sequence
  SiRNA target sequence
accccttttccaaggctta

SEQ ID NO: 225712 - DNA, 19 bp, Artificial sequence
  SiRNA target sequence
ccccttttccaaggcttat

SEQ ID NO: 225713 - DNA, 19 bp, Artificial sequence
  SiRNA target sequence
cccttttccaaggcttatt

SEQ ID NO: 225714 - DNA, 19 bp, Artificial sequence
  SiRNA target sequence
ccttttccaaggcttatta

SEQ ID NO: 225715 - DNA, 19 bp, Artificial sequence
  SiRNA target sequence
cttttccaaggcttattaa

SEQ ID NO: 225716 - DNA, 19 bp, Artificial sequence
  SiRNA target sequence
ttttccaaggcttattaaa

SEQ ID NO: 225717 - DNA, 19 bp, Artificial sequence
  SiRNA target sequence
tttccaaggcttattaaaa

SEQ ID NO: 225718 - DNA, 19 bp, Artificial sequence
  SiRNA target sequence
ttccaaggcttattaaaac

SEQ ID NO: 225719 - DNA, 19 bp, Artificial sequence
  SiRNA target sequence
tccaaggcttattaaaaca

SEQ ID NO: 225720 - DNA, 19 bp, Artificial sequence
  SiRNA target sequence
ccaaggcttattaaaacaa

SEQ ID NO: 225721 - DNA, 19 bp, Artificial sequence
  SiRNA target sequence
caaggcttattaaaacaaa

SEQ ID NO: 225722 - DNA, 19 bp, Artificial sequence
  SiRNA target sequence
aaggcttattaaaacaaaa

SEQ ID NO: 225723 - DNA, 19 bp, Artificial sequence
  SiRNA target sequence
aggcttattaaaacaaaag

SEQ ID NO: 225724 - DNA, 19 bp, Artificial sequence
  SiRNA target sequence
ggcttattaaaacaaaagg

SEQ ID NO: 225725 - DNA, 19 bp, Artificial sequence
  SiRNA target sequence
gcttattaaaacaaaagga

SEQ ID NO: 225726 - DNA, 19 bp, Artificial sequence
  SiRNA target sequence
cttattaaaacaaaaggat

SEQ ID NO: 225727 - DNA, 19 bp, Artificial sequence
  SiRNA target sequence
ttattaaaacaaaaggatg

SEQ ID NO: 225728 - DNA, 19 bp, Artificial sequence
  SiRNA target sequence
tattaaaacaaaaggatgg

SEQ ID NO: 225729 - DNA, 19 bp, Artificial sequence
  SiRNA target sequence
attaaaacaaaaggatgga

SEQ ID NO: 225730 - DNA, 19 bp, Artificial sequence
  SiRNA target sequence
ttaaaacaaaaggatggat

SEQ ID NO: 225731 - DNA, 19 bp, Artificial sequence
  SiRNA target sequence
taaaacaaaaggatggatt

SEQ ID NO: 225732 - DNA, 19 bp, Artificial sequence
  SiRNA target sequence
aaaacaaaaggatggatta

SEQ ID NO: 225733 - DNA, 19 bp, Artificial sequence
  SiRNA target sequence
aaacaaaaggatggattac

SEQ ID NO: 225734 - DNA, 19 bp, Artificial sequence
  SiRNA target sequence
aacaaaaggatggattaca

SEQ ID NO: 225735 - DNA, 19 bp, Artificial sequence
  SiRNA target sequence
acaaaaggatggattacaa

SEQ ID NO: 225736 - DNA, 19 bp, Artificial sequence
  SiRNA target sequence
caaaaggatggattacaat

SEQ ID NO: 225737 - DNA, 19 bp, Artificial sequence
  SiRNA target sequence
aaaaggatggattacaata

SEQ ID NO: 225738 - DNA, 19 bp, Artificial sequence
  SiRNA target sequence
aaaggatggattacaatag

SEQ ID NO: 225739 - DNA, 19 bp, Artificial sequence
  SiRNA target sequence
aaggatggattacaatagc

SEQ ID NO: 225740 - DNA, 19 bp, Artificial sequence
  SiRNA target sequence
aggatggattacaatagcc

SEQ ID NO: 225741 - DNA, 19 bp, Artificial sequence
  SiRNA target sequence
ggatggattacaatagcca

SEQ ID NO: 225742 - DNA, 19 bp, Artificial sequence
  SiRNA target sequence
gatggattacaatagccat

SEQ ID NO: 225743 - DNA, 19 bp, Artificial sequence
  SiRNA target sequence
atggattacaatagccatt

SEQ ID NO: 225744 - DNA, 19 bp, Artificial sequence
  SiRNA target sequence
tggattacaatagccattc

SEQ ID NO: 225745 - DNA, 19 bp, Artificial sequence
  SiRNA target sequence
ggattacaatagccattct

SEQ ID NO: 225746 - DNA, 19 bp, Artificial sequence
  SiRNA target sequence
gattacaatagccattcta

SEQ ID NO: 225747 - DNA, 19 bp, Artificial sequence
  SiRNA target sequence
attacaatagccattctat

SEQ ID NO: 225748 - DNA, 19 bp, Artificial sequence
  SiRNA target sequence
ttacaatagccattctatg

SEQ ID NO: 225749 - DNA, 19 bp, Artificial sequence
  SiRNA target sequence
tacaatagccattctatgt

SEQ ID NO: 225750 - DNA, 19 bp, Artificial sequence
  SiRNA target sequence
acaatagccattctatgtc

SEQ ID NO: 225751 - DNA, 19 bp, Artificial sequence
  SiRNA target sequence
caatagccattctatgtcc

SEQ ID NO: 225752 - DNA, 19 bp, Artificial sequence
  SiRNA target sequence
aatagccattctatgtcct

SEQ ID NO: 225753 - DNA, 19 bp, Artificial sequence
  SiRNA target sequence
atagccattctatgtccta

SEQ ID NO: 225754 - DNA, 19 bp, Artificial sequence
  SiRNA target sequence
tagccattctatgtcctat

SEQ ID NO: 225755 - DNA, 19 bp, Artificial sequence
  SiRNA target sequence
agccattctatgtcctatt

SEQ ID NO: 225756 - DNA, 19 bp, Artificial sequence
  SiRNA target sequence
gccattctatgtcctatta

SEQ ID NO: 225757 - DNA, 19 bp, Artificial sequence
  SiRNA target sequence
ccattctatgtcctattat

SEQ ID NO: 225758 - DNA, 19 bp, Artificial sequence
  SiRNA target sequence
cattctatgtcctattatt

SEQ ID NO: 225759 - DNA, 19 bp, Artificial sequence
  SiRNA target sequence
attctatgtcctattatta

SEQ ID NO: 225760 - DNA, 19 bp, Artificial sequence
  SiRNA target sequence
ttctatgtcctattattac

SEQ ID NO: 225761 - DNA, 19 bp, Artificial sequence
  SiRNA target sequence
tctatgtcctattattact

SEQ ID NO: 225762 - DNA, 19 bp, Artificial sequence
  SiRNA target sequence
ctatgtcctattattactt

SEQ ID NO: 225763 - DNA, 19 bp, Artificial sequence
  SiRNA target sequence
tatgtcctattattacttt

SEQ ID NO: 225764 - DNA, 19 bp, Artificial sequence
  SiRNA target sequence
atgtcctattattactttt

SEQ ID NO: 225765 - DNA, 19 bp, Artificial sequence
  SiRNA target sequence
tgtcctattattacttttt

SEQ ID NO: 225766 - DNA, 19 bp, Artificial sequence
  SiRNA target sequence
gtcctattattactttttt

SEQ ID NO: 225767 - DNA, 19 bp, Artificial sequence
  SiRNA target sequence
tcctattattacttttttt

SEQ ID NO: 225768 - DNA, 19 bp, Artificial sequence
  SiRNA target sequence
cctattattactttttttt

SEQ ID NO: 225769 - DNA, 19 bp, Artificial sequence
  SiRNA target sequence
ctattattacttttttttc

SEQ ID NO: 225770 - DNA, 19 bp, Artificial sequence
  SiRNA target sequence
tattattacttttttttct

SEQ ID NO: 225771 - DNA, 19 bp, Artificial sequence
  SiRNA target sequence
attattacttttttttctg

SEQ ID NO: 225772 - DNA, 19 bp, Artificial sequence
  SiRNA target sequence
ttattacttttttttctgc

SEQ ID NO: 225773 - DNA, 19 bp, Artificial sequence
  SiRNA target sequence
tattacttttttttctgct

SEQ ID NO: 225774 - DNA, 19 bp, Artificial sequence
  SiRNA target sequence
attacttttttttctgctt

SEQ ID NO: 225775 - DNA, 19 bp, Artificial sequence
  SiRNA target sequence
ttacttttttttctgcttt

SEQ ID NO: 225776 - DNA, 19 bp, Artificial sequence
  SiRNA target sequence
tacttttttttctgctttt

SEQ ID NO: 225777 - DNA, 19 bp, Artificial sequence
  SiRNA target sequence
acttttttttctgcttttg

SEQ ID NO: 225778 - DNA, 19 bp, Artificial sequence
  SiRNA target sequence
cttttttttctgcttttgg

SEQ ID NO: 225779 - DNA, 19 bp, Artificial sequence
  SiRNA target sequence
ttttttttctgcttttggt

SEQ ID NO: 225780 - DNA, 19 bp, Artificial sequence
  SiRNA target sequence
tttttttctgcttttggta

SEQ ID NO: 225781 - DNA, 19 bp, Artificial sequence
  SiRNA target sequence
ttttttctgcttttggtac

SEQ ID NO: 225782 - DNA, 19 bp, Artificial sequence
  SiRNA target sequence
tttttctgcttttggtact

SEQ ID NO: 225783 - DNA, 19 bp, Artificial sequence
  SiRNA target sequence
ttttctgcttttggtactt

SEQ ID NO: 225784 - DNA, 19 bp, Artificial sequence
  SiRNA target sequence
tttctgcttttggtacttt

SEQ ID NO: 225785 - DNA, 19 bp, Artificial sequence
  SiRNA target sequence
ttctgcttttggtactttt

SEQ ID NO: 225786 - DNA, 19 bp, Artificial sequence
  SiRNA target sequence
tctgcttttggtacttttg

SEQ ID NO: 225787 - DNA, 19 bp, Artificial sequence
  SiRNA target sequence
ctgcttttggtacttttgt

SEQ ID NO: 225788 - DNA, 19 bp, Artificial sequence
  SiRNA target sequence
tgcttttggtacttttgta

SEQ ID NO: 225789 - DNA, 19 bp, Artificial sequence
  SiRNA target sequence
gcttttggtacttttgtat

SEQ ID NO: 225790 - DNA, 19 bp, Artificial sequence
  SiRNA target sequence
cttttggtacttttgtatt

SEQ ID NO: 225791 - DNA, 19 bp, Artificial sequence
  SiRNA target sequence
ttttggtacttttgtatta

SEQ ID NO: 225792 - DNA, 19 bp, Artificial sequence
  SiRNA target sequence
tttggtacttttgtattag

SEQ ID NO: 225793 - DNA, 19 bp, Artificial sequence
  SiRNA target sequence
ttggtacttttgtattagc

SEQ ID NO: 225794 - DNA, 19 bp, Artificial sequence
  SiRNA target sequence
tggtacttttgtattagct

SEQ ID NO: 225795 - DNA, 19 bp, Artificial sequence
  SiRNA target sequence
ggtacttttgtattagctt

SEQ ID NO: 225796 - DNA, 19 bp, Artificial sequence
  SiRNA target sequence
gtacttttgtattagctta

SEQ ID NO: 225797 - DNA, 19 bp, Artificial sequence
  SiRNA target sequence
tacttttgtattagcttat

SEQ ID NO: 225798 - DNA, 19 bp, Artificial sequence
  SiRNA target sequence
acttttgtattagcttatt

SEQ ID NO: 225799 - DNA, 19 bp, Artificial sequence
  SiRNA target sequence
cttttgtattagcttattt

SEQ ID NO: 225800 - DNA, 19 bp, Artificial sequence
  SiRNA target sequence
ttttgtattagcttattta

SEQ ID NO: 225801 - DNA, 19 bp, Artificial sequence
  SiRNA target sequence
tttgtattagcttatttaa

SEQ ID NO: 225802 - DNA, 19 bp, Artificial sequence
  SiRNA target sequence
ttgtattagcttatttaaa

SEQ ID NO: 225803 - DNA, 19 bp, Artificial sequence
  SiRNA target sequence
tgtattagcttatttaaac

SEQ ID NO: 225804 - DNA, 19 bp, Artificial sequence
  SiRNA target sequence
gtattagcttatttaaact

SEQ ID NO: 225805 - DNA, 19 bp, Artificial sequence
  SiRNA target sequence
tattagcttatttaaactt

SEQ ID NO: 225806 - DNA, 19 bp, Artificial sequence
  SiRNA target sequence
attagcttatttaaacttc

SEQ ID NO: 225807 - DNA, 19 bp, Artificial sequence
  SiRNA target sequence
ttagcttatttaaacttcc

SEQ ID NO: 225808 - DNA, 19 bp, Artificial sequence
  SiRNA target sequence
tagcttatttaaacttccc

SEQ ID NO: 225809 - DNA, 19 bp, Artificial sequence
  SiRNA target sequence
agcttatttaaacttccca

SEQ ID NO: 225810 - DNA, 19 bp, Artificial sequence
  SiRNA target sequence
gcttatttaaacttcccaa

SEQ ID NO: 225811 - DNA, 19 bp, Artificial sequence
  SiRNA target sequence
cttatttaaacttcccaat

SEQ ID NO: 225812 - DNA, 19 bp, Artificial sequence
  SiRNA target sequence
ttatttaaacttcccaatt

SEQ ID NO: 225813 - DNA, 19 bp, Artificial sequence
  SiRNA target sequence
tatttaaacttcccaatta

SEQ ID NO: 225814 - DNA, 19 bp, Artificial sequence
  SiRNA target sequence
atttaaacttcccaattac

SEQ ID NO: 225815 - DNA, 19 bp, Artificial sequence
  SiRNA target sequence
tttaaacttcccaattaca

SEQ ID NO: 225816 - DNA, 19 bp, Artificial sequence
  SiRNA target sequence
ttaaacttcccaattacaa

SEQ ID NO: 225817 - DNA, 19 bp, Artificial sequence
  SiRNA target sequence
taaacttcccaattacaaa

SEQ ID NO: 225818 - DNA, 19 bp, Artificial sequence
  SiRNA target sequence
aaacttcccaattacaaac

SEQ ID NO: 225819 - DNA, 19 bp, Artificial sequence
  SiRNA target sequence
aacttcccaattacaaaca

SEQ ID NO: 225820 - DNA, 19 bp, Artificial sequence
  SiRNA target sequence
acttcccaattacaaacaa

SEQ ID NO: 225821 - DNA, 19 bp, Artificial sequence
  SiRNA target sequence
cttcccaattacaaacaaa

SEQ ID NO: 225822 - DNA, 19 bp, Artificial sequence
  SiRNA target sequence
ttcccaattacaaacaaag

SEQ ID NO: 225823 - DNA, 19 bp, Artificial sequence
  SiRNA target sequence
tcccaattacaaacaaaga

SEQ ID NO: 225824 - DNA, 19 bp, Artificial sequence
  SiRNA target sequence
cccaattacaaacaaagag

SEQ ID NO: 225825 - DNA, 19 bp, Artificial sequence
  SiRNA target sequence
ccaattacaaacaaagagg

SEQ ID NO: 225826 - DNA, 19 bp, Artificial sequence
  SiRNA target sequence
caattacaaacaaagagga

SEQ ID NO: 225827 - DNA, 19 bp, Artificial sequence
  SiRNA target sequence
aattacaaacaaagaggat

SEQ ID NO: 225828 - DNA, 19 bp, Artificial sequence
  SiRNA target sequence
attacaaacaaagaggata

SEQ ID NO: 225829 - DNA, 19 bp, Artificial sequence
  SiRNA target sequence
ttacaaacaaagaggataa

SEQ ID NO: 225830 - DNA, 19 bp, Artificial sequence
  SiRNA target sequence
tacaaacaaagaggataat

SEQ ID NO: 225831 - DNA, 19 bp, Artificial sequence
  SiRNA target sequence
acaaacaaagaggataata

SEQ ID NO: 225832 - DNA, 19 bp, Artificial sequence
  SiRNA target sequence
caaacaaagaggataatat

SEQ ID NO: 225833 - DNA, 19 bp, Artificial sequence
  SiRNA target sequence
aaacaaagaggataatata

SEQ ID NO: 225834 - DNA, 19 bp, Artificial sequence
  SiRNA target sequence
aacaaagaggataatatat

SEQ ID NO: 225835 - DNA, 19 bp, Artificial sequence
  SiRNA target sequence
acaaagaggataatatatt

SEQ ID NO: 225836 - DNA, 19 bp, Artificial sequence
  SiRNA target sequence
caaagaggataatatattt

SEQ ID NO: 225837 - DNA, 19 bp, Artificial sequence
  SiRNA target sequence
aaagaggataatatatttg

SEQ ID NO: 225838 - DNA, 19 bp, Artificial sequence
  SiRNA target sequence
aagaggataatatatttga

SEQ ID NO: 225839 - DNA, 19 bp, Artificial sequence
  SiRNA target sequence
agaggataatatatttgat

SEQ ID NO: 225840 - DNA, 19 bp, Artificial sequence
  SiRNA target sequence
gaggataatatatttgata

SEQ ID NO: 225841 - DNA, 19 bp, Artificial sequence
  SiRNA target sequence
aggataatatatttgatat

SEQ ID NO: 225842 - DNA, 19 bp, Artificial sequence
  SiRNA target sequence
ggataatatatttgatatt

SEQ ID NO: 225843 - DNA, 19 bp, Artificial sequence
  SiRNA target sequence
gataatatatttgatattt

SEQ ID NO: 225844 - DNA, 19 bp, Artificial sequence
  SiRNA target sequence
ataatatatttgatattta

SEQ ID NO: 225845 - DNA, 19 bp, Artificial sequence
  SiRNA target sequence
taatatatttgatatttac

SEQ ID NO: 225846 - DNA, 19 bp, Artificial sequence
  SiRNA target sequence
aatatatttgatatttacc

SEQ ID NO: 225847 - DNA, 19 bp, Artificial sequence
  SiRNA target sequence
atatatttgatatttaccg

SEQ ID NO: 225848 - DNA, 19 bp, Artificial sequence
  SiRNA target sequence
tatatttgatatttaccgt

SEQ ID NO: 225849 - DNA, 19 bp, Artificial sequence
  SiRNA target sequence
atatttgatatttaccgtt

SEQ ID NO: 225850 - DNA, 19 bp, Artificial sequence
  SiRNA target sequence
tatttgatatttaccgttt

SEQ ID NO: 225851 - DNA, 19 bp, Artificial sequence
  SiRNA target sequence
atttgatatttaccgttta

SEQ ID NO: 225852 - DNA, 19 bp, Artificial sequence
  SiRNA target sequence
tttgatatttaccgtttac

SEQ ID NO: 225853 - DNA, 19 bp, Artificial sequence
  SiRNA target sequence
ttgatatttaccgtttacc

SEQ ID NO: 225854 - DNA, 19 bp, Artificial sequence
  SiRNA target sequence
tgatatttaccgtttaccg

SEQ ID NO: 225855 - DNA, 19 bp, Artificial sequence
  SiRNA target sequence
gatatttaccgtttaccgt

SEQ ID NO: 225856 - DNA, 19 bp, Artificial sequence
  SiRNA target sequence
atatttaccgtttaccgtc

SEQ ID NO: 225857 - DNA, 19 bp, Artificial sequence
  SiRNA target sequence
tatttaccgtttaccgtca

SEQ ID NO: 225858 - DNA, 19 bp, Artificial sequence
  SiRNA target sequence
atttaccgtttaccgtcaa

SEQ ID NO: 225859 - DNA, 19 bp, Artificial sequence
  SiRNA target sequence
tttaccgtttaccgtcaac

SEQ ID NO: 225860 - DNA, 19 bp, Artificial sequence
  SiRNA target sequence
ttaccgtttaccgtcaact

SEQ ID NO: 225861 - DNA, 19 bp, Artificial sequence
  SiRNA target sequence
taccgtttaccgtcaactg

SEQ ID NO: 225862 - DNA, 19 bp, Artificial sequence
  SiRNA target sequence
accgtttaccgtcaactga

SEQ ID NO: 225863 - DNA, 19 bp, Artificial sequence
  SiRNA target sequence
ccgtttaccgtcaactgat

SEQ ID NO: 225864 - DNA, 19 bp, Artificial sequence
  SiRNA target sequence
cgtttaccgtcaactgatt

SEQ ID NO: 225865 - DNA, 19 bp, Artificial sequence
  SiRNA target sequence
gtttaccgtcaactgattc

SEQ ID NO: 225866 - DNA, 19 bp, Artificial sequence
  SiRNA target sequence
tttaccgtcaactgattct

SEQ ID NO: 225867 - DNA, 19 bp, Artificial sequence
  SiRNA target sequence
ttaccgtcaactgattcta

SEQ ID NO: 225868 - DNA, 19 bp, Artificial sequence
  SiRNA target sequence
taccgtcaactgattctat

SEQ ID NO: 225869 - DNA, 19 bp, Artificial sequence
  SiRNA target sequence
accgtcaactgattctata

SEQ ID NO: 225870 - DNA, 19 bp, Artificial sequence
  SiRNA target sequence
ccgtcaactgattctataa

SEQ ID NO: 225871 - DNA, 19 bp, Artificial sequence
  SiRNA target sequence
cgtcaactgattctataat

SEQ ID NO: 225872 - DNA, 19 bp, Artificial sequence
  SiRNA target sequence
gtcaactgattctataatc

SEQ ID NO: 225873 - DNA, 19 bp, Artificial sequence
  SiRNA target sequence
tcaactgattctataatca

SEQ ID NO: 225874 - DNA, 19 bp, Artificial sequence
  SiRNA target sequence
caactgattctataatcaa

SEQ ID NO: 225875 - DNA, 19 bp, Artificial sequence
  SiRNA target sequence
aactgattctataatcaaa

SEQ ID NO: 225876 - DNA, 19 bp, Artificial sequence
  SiRNA target sequence
actgattctataatcaaat

SEQ ID NO: 225877 - DNA, 19 bp, Artificial sequence
  SiRNA target sequence
ctgattctataatcaaatt

SEQ ID NO: 225878 - DNA, 19 bp, Artificial sequence
  SiRNA target sequence
tgattctataatcaaatta

SEQ ID NO: 225879 - DNA, 19 bp, Artificial sequence
  SiRNA target sequence
gattctataatcaaattag

SEQ ID NO: 225880 - DNA, 19 bp, Artificial sequence
  SiRNA target sequence
attctataatcaaattaga

SEQ ID NO: 225881 - DNA, 19 bp, Artificial sequence
  SiRNA target sequence
ttctataatcaaattagaa

SEQ ID NO: 225882 - DNA, 19 bp, Artificial sequence
  SiRNA target sequence
tctataatcaaattagaaa

SEQ ID NO: 225883 - DNA, 19 bp, Artificial sequence
  SiRNA target sequence
ctataatcaaattagaaaa

SEQ ID NO: 225884 - DNA, 19 bp, Artificial sequence
  SiRNA target sequence
tataatcaaattagaaaat

SEQ ID NO: 225885 - DNA, 19 bp, Artificial sequence
  SiRNA target sequence
ataatcaaattagaaaata

SEQ ID NO: 225886 - DNA, 19 bp, Artificial sequence
  SiRNA target sequence
taatcaaattagaaaatat

SEQ ID NO: 225887 - DNA, 19 bp, Artificial sequence
  SiRNA target sequence
aatcaaattagaaaatatt

SEQ ID NO: 225888 - DNA, 19 bp, Artificial sequence
  SiRNA target sequence
atcaaattagaaaatattg

SEQ ID NO: 225889 - DNA, 19 bp, Artificial sequence
  SiRNA target sequence
tcaaattagaaaatattgt

SEQ ID NO: 225890 - DNA, 19 bp, Artificial sequence
  SiRNA target sequence
caaattagaaaatattgtt

SEQ ID NO: 225891 - DNA, 19 bp, Artificial sequence
  SiRNA target sequence
aaattagaaaatattgttg

SEQ ID NO: 225892 - DNA, 19 bp, Artificial sequence
  SiRNA target sequence
aattagaaaatattgttgg

SEQ ID NO: 225893 - DNA, 19 bp, Artificial sequence
  SiRNA target sequence
attagaaaatattgttggt

SEQ ID NO: 225894 - DNA, 19 bp, Artificial sequence
  SiRNA target sequence
ttagaaaatattgttggtg

SEQ ID NO: 225895 - DNA, 19 bp, Artificial sequence
  SiRNA target sequence
tagaaaatattgttggtgt

SEQ ID NO: 225896 - DNA, 19 bp, Artificial sequence
  SiRNA target sequence
agaaaatattgttggtgtc

SEQ ID NO: 225897 - DNA, 19 bp, Artificial sequence
  SiRNA target sequence
gaaaatattgttggtgtca

SEQ ID NO: 225898 - DNA, 19 bp, Artificial sequence
  SiRNA target sequence
aaaatattgttggtgtcat

SEQ ID NO: 225899 - DNA, 19 bp, Artificial sequence
  SiRNA target sequence
aaatattgttggtgtcatt

SEQ ID NO: 225900 - DNA, 19 bp, Artificial sequence
  SiRNA target sequence
aatattgttggtgtcattt

SEQ ID NO: 225901 - DNA, 19 bp, Artificial sequence
  SiRNA target sequence
atattgttggtgtcatttg

SEQ ID NO: 225902 - DNA, 19 bp, Artificial sequence
  SiRNA target sequence
tattgttggtgtcatttgt

SEQ ID NO: 225903 - DNA, 19 bp, Artificial sequence
  SiRNA target sequence
attgttggtgtcatttgtg

SEQ ID NO: 225904 - DNA, 19 bp, Artificial sequence
  SiRNA target sequence
ttgttggtgtcatttgtgt

SEQ ID NO: 225905 - DNA, 19 bp, Artificial sequence
  SiRNA target sequence
tgttggtgtcatttgtgta

SEQ ID NO: 225906 - DNA, 19 bp, Artificial sequence
  SiRNA target sequence
gttggtgtcatttgtgtat

SEQ ID NO: 225907 - DNA, 19 bp, Artificial sequence
  SiRNA target sequence
ttggtgtcatttgtgtatc

SEQ ID NO: 225908 - DNA, 19 bp, Artificial sequence
  SiRNA target sequence
tggtgtcatttgtgtatct

SEQ ID NO: 225909 - DNA, 19 bp, Artificial sequence
  SiRNA target sequence
ggtgtcatttgtgtatctt

SEQ ID NO: 225910 - DNA, 19 bp, Artificial sequence
  SiRNA target sequence
gtgtcatttgtgtatcttt

SEQ ID NO: 225911 - DNA, 19 bp, Artificial sequence
  SiRNA target sequence
tgtcatttgtgtatcttta

SEQ ID NO: 225912 - DNA, 19 bp, Artificial sequence
  SiRNA target sequence
gtcatttgtgtatctttaa

SEQ ID NO: 225913 - DNA, 19 bp, Artificial sequence
  SiRNA target sequence
tcatttgtgtatctttaat

SEQ ID NO: 225914 - DNA, 19 bp, Artificial sequence
  SiRNA target sequence
catttgtgtatctttaatg

SEQ ID NO: 225915 - DNA, 19 bp, Artificial sequence
  SiRNA target sequence
atttgtgtatctttaatga

SEQ ID NO: 225916 - DNA, 19 bp, Artificial sequence
  SiRNA target sequence
tttgtgtatctttaatgaa

SEQ ID NO: 225917 - DNA, 19 bp, Artificial sequence
  SiRNA target sequence
ttgtgtatctttaatgaag

SEQ ID NO: 225918 - DNA, 19 bp, Artificial sequence
  SiRNA target sequence
tgtgtatctttaatgaaga

SEQ ID NO: 225919 - DNA, 19 bp, Artificial sequence
  SiRNA target sequence
gtgtatctttaatgaagat

SEQ ID NO: 225920 - DNA, 19 bp, Artificial sequence
  SiRNA target sequence
tgtatctttaatgaagatt

SEQ ID NO: 225921 - DNA, 19 bp, Artificial sequence
  SiRNA target sequence
gtatctttaatgaagattt

SEQ ID NO: 225922 - DNA, 19 bp, Artificial sequence
  SiRNA target sequence
tatctttaatgaagatttc

SEQ ID NO: 225923 - DNA, 19 bp, Artificial sequence
  SiRNA target sequence
atctttaatgaagatttct

SEQ ID NO: 225924 - DNA, 19 bp, Artificial sequence
  SiRNA target sequence
tctttaatgaagatttcta

SEQ ID NO: 225925 - DNA, 19 bp, Artificial sequence
  SiRNA target sequence
ctttaatgaagatttctaa

SEQ ID NO: 225926 - DNA, 19 bp, Artificial sequence
  SiRNA target sequence
tttaatgaagatttctaaa

SEQ ID NO: 225927 - DNA, 19 bp, Artificial sequence
  SiRNA target sequence
ttaatgaagatttctaaat

SEQ ID NO: 225928 - DNA, 19 bp, Artificial sequence
  SiRNA target sequence
taatgaagatttctaaata

SEQ ID NO: 225929 - DNA, 19 bp, Artificial sequence
  SiRNA target sequence
aatgaagatttctaaatat

SEQ ID NO: 225930 - DNA, 19 bp, Artificial sequence
  SiRNA target sequence
atgaagatttctaaatatg

SEQ ID NO: 225931 - DNA, 19 bp, Artificial sequence
  SiRNA target sequence
tgaagatttctaaatatgc

SEQ ID NO: 225932 - DNA, 19 bp, Artificial sequence
  SiRNA target sequence
gaagatttctaaatatgca

SEQ ID NO: 225933 - DNA, 19 bp, Artificial sequence
  SiRNA target sequence
aagatttctaaatatgcag

SEQ ID NO: 225934 - DNA, 19 bp, Artificial sequence
  SiRNA target sequence
agatttctaaatatgcagc

SEQ ID NO: 225935 - DNA, 19 bp, Artificial sequence
  SiRNA target sequence
gatttctaaatatgcagca

SEQ ID NO: 225936 - DNA, 19 bp, Artificial sequence
  SiRNA target sequence
atttctaaatatgcagcat

SEQ ID NO: 225937 - DNA, 19 bp, Artificial sequence
  SiRNA target sequence
tttctaaatatgcagcatt

SEQ ID NO: 225938 - DNA, 19 bp, Artificial sequence
  SiRNA target sequence
ttctaaatatgcagcattt

SEQ ID NO: 225939 - DNA, 19 bp, Artificial sequence
  SiRNA target sequence
tctaaatatgcagcatttg

SEQ ID NO: 225940 - DNA, 19 bp, Artificial sequence
  SiRNA target sequence
ctaaatatgcagcatttga

SEQ ID NO: 225941 - DNA, 19 bp, Artificial sequence
  SiRNA target sequence
taaatatgcagcatttgat

SEQ ID NO: 225942 - DNA, 19 bp, Artificial sequence
  SiRNA target sequence
aaatatgcagcatttgata

SEQ ID NO: 225943 - DNA, 19 bp, Artificial sequence
  SiRNA target sequence
aatatgcagcatttgatat

SEQ ID NO: 225944 - DNA, 19 bp, Artificial sequence
  SiRNA target sequence
atatgcagcatttgatatc

SEQ ID NO: 225945 - DNA, 19 bp, Artificial sequence
  SiRNA target sequence
tatgcagcatttgatatca

SEQ ID NO: 225946 - DNA, 19 bp, Artificial sequence
  SiRNA target sequence
atgcagcatttgatatcac

SEQ ID NO: 225947 - DNA, 19 bp, Artificial sequence
  SiRNA target sequence
tgcagcatttgatatcaca

SEQ ID NO: 225948 - DNA, 19 bp, Artificial sequence
  SiRNA target sequence
gcagcatttgatatcacaa

SEQ ID NO: 225949 - DNA, 19 bp, Artificial sequence
  SiRNA target sequence
cagcatttgatatcacaaa

SEQ ID NO: 225950 - DNA, 19 bp, Artificial sequence
  SiRNA target sequence
agcatttgatatcacaaaa

SEQ ID NO: 225951 - DNA, 19 bp, Artificial sequence
  SiRNA target sequence
gcatttgatatcacaaaag

SEQ ID NO: 225952 - DNA, 19 bp, Artificial sequence
  SiRNA target sequence
catttgatatcacaaaaga

SEQ ID NO: 225953 - DNA, 19 bp, Artificial sequence
  SiRNA target sequence
atttgatatcacaaaagag

SEQ ID NO: 225954 - DNA, 19 bp, Artificial sequence
  SiRNA target sequence
tttgatatcacaaaagagg

SEQ ID NO: 225955 - DNA, 19 bp, Artificial sequence
  SiRNA target sequence
ttgatatcacaaaagaggc

SEQ ID NO: 225956 - DNA, 19 bp, Artificial sequence
  SiRNA target sequence
tgatatcacaaaagaggct

SEQ ID NO: 225957 - DNA, 19 bp, Artificial sequence
  SiRNA target sequence
gatatcacaaaagaggctt

SEQ ID NO: 225958 - DNA, 19 bp, Artificial sequence
  SiRNA target sequence
atatcacaaaagaggcttt

SEQ ID NO: 225959 - DNA, 19 bp, Artificial sequence
  SiRNA target sequence
tatcacaaaagaggctttg

SEQ ID NO: 225960 - DNA, 19 bp, Artificial sequence
  SiRNA target sequence
atcacaaaagaggctttgt

SEQ ID NO: 225961 - DNA, 19 bp, Artificial sequence
  SiRNA target sequence
tcacaaaagaggctttgtc

SEQ ID NO: 225962 - DNA, 19 bp, Artificial sequence
  SiRNA target sequence
cacaaaagaggctttgtct

SEQ ID NO: 225963 - DNA, 19 bp, Artificial sequence
  SiRNA target sequence
acaaaagaggctttgtcta

SEQ ID NO: 225964 - DNA, 19 bp, Artificial sequence
  SiRNA target sequence
caaaagaggctttgtctat

SEQ ID NO: 225965 - DNA, 19 bp, Artificial sequence
  SiRNA target sequence
aaaagaggctttgtctatg

SEQ ID NO: 225966 - DNA, 19 bp, Artificial sequence
  SiRNA target sequence
aaagaggctttgtctatgc

SEQ ID NO: 225967 - DNA, 19 bp, Artificial sequence
  SiRNA target sequence
aagaggctttgtctatgca

SEQ ID NO: 225968 - DNA, 19 bp, Artificial sequence
  SiRNA target sequence
agaggctttgtctatgcag

SEQ ID NO: 225969 - DNA, 19 bp, Artificial sequence
  SiRNA target sequence
gaggctttgtctatgcaga

SEQ ID NO: 225970 - DNA, 19 bp, Artificial sequence
  SiRNA target sequence
aggctttgtctatgcagat

SEQ ID NO: 225971 - DNA, 19 bp, Artificial sequence
  SiRNA target sequence
ggctttgtctatgcagatt

SEQ ID NO: 225972 - DNA, 19 bp, Artificial sequence
  SiRNA target sequence
gctttgtctatgcagattg

SEQ ID NO: 225973 - DNA, 19 bp, Artificial sequence
  SiRNA target sequence
ctttgtctatgcagattga

SEQ ID NO: 225974 - DNA, 19 bp, Artificial sequence
  SiRNA target sequence
tttgtctatgcagattgat

SEQ ID NO: 225975 - DNA, 19 bp, Artificial sequence
  SiRNA target sequence
ttgtctatgcagattgatg

SEQ ID NO: 225976 - DNA, 19 bp, Artificial sequence
  SiRNA target sequence
tgtctatgcagattgatgg

SEQ ID NO: 225977 - DNA, 19 bp, Artificial sequence
  SiRNA target sequence
gtctatgcagattgatggt

SEQ ID NO: 225978 - DNA, 19 bp, Artificial sequence
  SiRNA target sequence
tctatgcagattgatggtt

SEQ ID NO: 225979 - DNA, 19 bp, Artificial sequence
  SiRNA target sequence
ctatgcagattgatggttc

SEQ ID NO: 225980 - DNA, 19 bp, Artificial sequence
  SiRNA target sequence
tatgcagattgatggttct

SEQ ID NO: 225981 - DNA, 19 bp, Artificial sequence
  SiRNA target sequence
atgcagattgatggttcta

SEQ ID NO: 225982 - DNA, 19 bp, Artificial sequence
  SiRNA target sequence
tgcagattgatggttctat

SEQ ID NO: 225983 - DNA, 19 bp, Artificial sequence
  SiRNA target sequence
gcagattgatggttctata

SEQ ID NO: 225984 - DNA, 19 bp, Artificial sequence
  SiRNA target sequence
cagattgatggttctataa

SEQ ID NO: 225985 - DNA, 19 bp, Artificial sequence
  SiRNA target sequence
agattgatggttctataag

SEQ ID NO: 225986 - DNA, 19 bp, Artificial sequence
  SiRNA target sequence
gattgatggttctataaga

SEQ ID NO: 225987 - DNA, 19 bp, Artificial sequence
  SiRNA target sequence
attgatggttctataagag

SEQ ID NO: 225988 - DNA, 19 bp, Artificial sequence
  SiRNA target sequence
ttgatggttctataagagc

SEQ ID NO: 225989 - DNA, 19 bp, Artificial sequence
  SiRNA target sequence
tgatggttctataagagcg

SEQ ID NO: 225990 - DNA, 19 bp, Artificial sequence
  SiRNA target sequence
gatggttctataagagcga

SEQ ID NO: 225991 - DNA, 19 bp, Artificial sequence
  SiRNA target sequence
atggttctataagagcgaa

SEQ ID NO: 225992 - DNA, 19 bp, Artificial sequence
  SiRNA target sequence
tggttctataagagcgaaa

SEQ ID NO: 225993 - DNA, 19 bp, Artificial sequence
  SiRNA target sequence
ggttctataagagcgaaat

SEQ ID NO: 225994 - DNA, 19 bp, Artificial sequence
  SiRNA target sequence
gttctataagagcgaaata

SEQ ID NO: 225995 - DNA, 19 bp, Artificial sequence
  SiRNA target sequence
ttctataagagcgaaatac

SEQ ID NO: 225996 - DNA, 19 bp, Artificial sequence
  SiRNA target sequence
tctataagagcgaaataca

SEQ ID NO: 225997 - DNA, 19 bp, Artificial sequence
  SiRNA target sequence
ctataagagcgaaatacaa

SEQ ID NO: 225998 - DNA, 19 bp, Artificial sequence
  SiRNA target sequence
tataagagcgaaatacaaa

SEQ ID NO: 225999 - DNA, 19 bp, Artificial sequence
  SiRNA target sequence
ataagagcgaaatacaaag

SEQ ID NO: 226000 - DNA, 19 bp, Artificial sequence
  SiRNA target sequence
taagagcgaaatacaaagg

SEQ ID NO: 226001 - DNA, 19 bp, Artificial sequence
  SiRNA target sequence
aagagcgaaatacaaaggt

SEQ ID NO: 226002 - DNA, 19 bp, Artificial sequence
  SiRNA target sequence
agagcgaaatacaaaggta

SEQ ID NO: 226003 - DNA, 19 bp, Artificial sequence
  SiRNA target sequence
gagcgaaatacaaaggtat

SEQ ID NO: 226004 - DNA, 19 bp, Artificial sequence
  SiRNA target sequence
agcgaaatacaaaggtatt

SEQ ID NO: 226005 - DNA, 19 bp, Artificial sequence
  SiRNA target sequence
gcgaaatacaaaggtattt

SEQ ID NO: 226006 - DNA, 19 bp, Artificial sequence
  SiRNA target sequence
cgaaatacaaaggtatttt

SEQ ID NO: 226007 - DNA, 19 bp, Artificial sequence
  SiRNA target sequence
gaaatacaaaggtattttt

SEQ ID NO: 226008 - DNA, 19 bp, Artificial sequence
  SiRNA target sequence
aaatacaaaggtatttttg

SEQ ID NO: 226009 - DNA, 19 bp, Artificial sequence
  SiRNA target sequence
aatacaaaggtatttttga

SEQ ID NO: 226010 - DNA, 19 bp, Artificial sequence
  SiRNA target sequence
atacaaaggtatttttgat

SEQ ID NO: 226011 - DNA, 19 bp, Artificial sequence
  SiRNA target sequence
tacaaaggtatttttgatg

SEQ ID NO: 226012 - DNA, 19 bp, Artificial sequence
  SiRNA target sequence
acaaaggtatttttgatgg

SEQ ID NO: 226013 - DNA, 19 bp, Artificial sequence
  SiRNA target sequence
caaaggtatttttgatggt

SEQ ID NO: 226014 - DNA, 19 bp, Artificial sequence
  SiRNA target sequence
aaaggtatttttgatggtg

SEQ ID NO: 226015 - DNA, 19 bp, Artificial sequence
  SiRNA target sequence
aaggtatttttgatggtgt

SEQ ID NO: 226016 - DNA, 19 bp, Artificial sequence
  SiRNA target sequence
aggtatttttgatggtgta

SEQ ID NO: 226017 - DNA, 19 bp, Artificial sequence
  SiRNA target sequence
ggtatttttgatggtgtat

SEQ ID NO: 226018 - DNA, 19 bp, Artificial sequence
  SiRNA target sequence
gtatttttgatggtgtatt

SEQ ID NO: 226019 - DNA, 19 bp, Artificial sequence
  SiRNA target sequence
tatttttgatggtgtattt

SEQ ID NO: 226020 - DNA, 19 bp, Artificial sequence
  SiRNA target sequence
atttttgatggtgtatttg

SEQ ID NO: 226021 - DNA, 19 bp, Artificial sequence
  SiRNA target sequence
tttttgatggtgtatttgg

SEQ ID NO: 226022 - DNA, 19 bp, Artificial sequence
  SiRNA target sequence
ttttgatggtgtatttggt

SEQ ID NO: 226023 - DNA, 19 bp, Artificial sequence
  SiRNA target sequence
tttgatggtgtatttggta

SEQ ID NO: 226024 - DNA, 19 bp, Artificial sequence
  SiRNA target sequence
ttgatggtgtatttggtaa

SEQ ID NO: 226025 - DNA, 19 bp, Artificial sequence
  SiRNA target sequence
tgatggtgtatttggtaag

SEQ ID NO: 226026 - DNA, 19 bp, Artificial sequence
  SiRNA target sequence
gatggtgtatttggtaagc

SEQ ID NO: 226027 - DNA, 19 bp, Artificial sequence
  SiRNA target sequence
atggtgtatttggtaagct

SEQ ID NO: 226028 - DNA, 19 bp, Artificial sequence
  SiRNA target sequence
tggtgtatttggtaagctg

SEQ ID NO: 226029 - DNA, 19 bp, Artificial sequence
  SiRNA target sequence
ggtgtatttggtaagctgg

SEQ ID NO: 226030 - DNA, 19 bp, Artificial sequence
  SiRNA target sequence
gtgtatttggtaagctggg

SEQ ID NO: 226031 - DNA, 19 bp, Artificial sequence
  SiRNA target sequence
tgtatttggtaagctgggg

SEQ ID NO: 226032 - DNA, 19 bp, Artificial sequence
  SiRNA target sequence
gtatttggtaagctgggga

SEQ ID NO: 226033 - DNA, 19 bp, Artificial sequence
  SiRNA target sequence
tatttggtaagctggggaa

SEQ ID NO: 226034 - DNA, 19 bp, Artificial sequence
  SiRNA target sequence
atttggtaagctggggaaa

SEQ ID NO: 226035 - DNA, 19 bp, Artificial sequence
  SiRNA target sequence
tttggtaagctggggaaat

SEQ ID NO: 226036 - DNA, 19 bp, Artificial sequence
  SiRNA target sequence
ttggtaagctggggaaatc

SEQ ID NO: 226037 - DNA, 19 bp, Artificial sequence
  SiRNA target sequence
tggtaagctggggaaatct

SEQ ID NO: 226038 - DNA, 19 bp, Artificial sequence
  SiRNA target sequence
ggtaagctggggaaatctt

SEQ ID NO: 226039 - DNA, 19 bp, Artificial sequence
  SiRNA target sequence
gtaagctggggaaatcttt

SEQ ID NO: 226040 - DNA, 19 bp, Artificial sequence
  SiRNA target sequence
taagctggggaaatctttt

SEQ ID NO: 226041 - DNA, 19 bp, Artificial sequence
  SiRNA target sequence
aagctggggaaatcttttg

SEQ ID NO: 226042 - DNA, 19 bp, Artificial sequence
  SiRNA target sequence
agctggggaaatcttttgg

SEQ ID NO: 226043 - DNA, 19 bp, Artificial sequence
  SiRNA target sequence
gctggggaaatcttttgga

SEQ ID NO: 226044 - DNA, 19 bp, Artificial sequence
  SiRNA target sequence
ctggggaaatcttttggat

SEQ ID NO: 226045 - DNA, 19 bp, Artificial sequence
  SiRNA target sequence
tggggaaatcttttggatc

SEQ ID NO: 226046 - DNA, 19 bp, Artificial sequence
  SiRNA target sequence
ggggaaatcttttggatca

SEQ ID NO: 226047 - DNA, 19 bp, Artificial sequence
  SiRNA target sequence
gggaaatcttttggatcag

SEQ ID NO: 226048 - DNA, 19 bp, Artificial sequence
  SiRNA target sequence
ggaaatcttttggatcagt

SEQ ID NO: 226049 - DNA, 19 bp, Artificial sequence
  SiRNA target sequence
gaaatcttttggatcagtt

SEQ ID NO: 226050 - DNA, 19 bp, Artificial sequence
  SiRNA target sequence
aaatcttttggatcagttt

SEQ ID NO: 226051 - DNA, 19 bp, Artificial sequence
  SiRNA target sequence
aatcttttggatcagttta

SEQ ID NO: 226052 - DNA, 19 bp, Artificial sequence
  SiRNA target sequence
atcttttggatcagtttat

SEQ ID NO: 226053 - DNA, 19 bp, Artificial sequence
  SiRNA target sequence
tcttttggatcagtttatg

SEQ ID NO: 226054 - DNA, 19 bp, Artificial sequence
  SiRNA target sequence
cttttggatcagtttatgg

SEQ ID NO: 226055 - DNA, 19 bp, Artificial sequence
  SiRNA target sequence
ttttggatcagtttatgga

SEQ ID NO: 226056 - DNA, 19 bp, Artificial sequence
  SiRNA target sequence
tttggatcagtttatggat

SEQ ID NO: 226057 - DNA, 19 bp, Artificial sequence
  SiRNA target sequence
ttggatcagtttatggatt

SEQ ID NO: 226058 - DNA, 19 bp, Artificial sequence
  SiRNA target sequence
tggatcagtttatggattt

SEQ ID NO: 226059 - DNA, 19 bp, Artificial sequence
  SiRNA target sequence
ggatcagtttatggattta

SEQ ID NO: 226060 - DNA, 19 bp, Artificial sequence
  SiRNA target sequence
gatcagtttatggatttac

SEQ ID NO: 226061 - DNA, 19 bp, Artificial sequence
  SiRNA target sequence
atcagtttatggatttaca

SEQ ID NO: 226062 - DNA, 19 bp, Artificial sequence
  SiRNA target sequence
tcagtttatggatttacaa

SEQ ID NO: 226063 - DNA, 19 bp, Artificial sequence
  SiRNA target sequence
cagtttatggatttacaat

SEQ ID NO: 226064 - DNA, 19 bp, Artificial sequence
  SiRNA target sequence
agtttatggatttacaatt

SEQ ID NO: 226065 - DNA, 19 bp, Artificial sequence
  SiRNA target sequence
gtttatggatttacaatta

SEQ ID NO: 226066 - DNA, 19 bp, Artificial sequence
  SiRNA target sequence
tttatggatttacaattac

SEQ ID NO: 226067 - DNA, 19 bp, Artificial sequence
  SiRNA target sequence
ttatggatttacaattact

SEQ ID NO: 226068 - DNA, 19 bp, Artificial sequence
  SiRNA target sequence
tatggatttacaattacta

SEQ ID NO: 226069 - DNA, 19 bp, Artificial sequence
  SiRNA target sequence
atggatttacaattactac

SEQ ID NO: 226070 - DNA, 19 bp, Artificial sequence
  SiRNA target sequence
tggatttacaattactaca

SEQ ID NO: 226071 - DNA, 19 bp, Artificial sequence
  SiRNA target sequence
ggatttacaattactacat

SEQ ID NO: 226072 - DNA, 19 bp, Artificial sequence
  SiRNA target sequence
gatttacaattactacatt

SEQ ID NO: 226073 - DNA, 19 bp, Artificial sequence
  SiRNA target sequence
atttacaattactacatta

SEQ ID NO: 226074 - DNA, 19 bp, Artificial sequence
  SiRNA target sequence
tttacaattactacattat

SEQ ID NO: 226075 - DNA, 19 bp, Artificial sequence
  SiRNA target sequence
ttacaattactacattatt

SEQ ID NO: 226076 - DNA, 19 bp, Artificial sequence
  SiRNA target sequence
tacaattactacattatta

SEQ ID NO: 226077 - DNA, 19 bp, Artificial sequence
  SiRNA target sequence
acaattactacattattag

SEQ ID NO: 226078 - DNA, 19 bp, Artificial sequence
  SiRNA target sequence
caattactacattattagg

SEQ ID NO: 226079 - DNA, 19 bp, Artificial sequence
  SiRNA target sequence
aattactacattattagga

SEQ ID NO: 226080 - DNA, 19 bp, Artificial sequence
  SiRNA target sequence
attactacattattaggaa

SEQ ID NO: 226081 - DNA, 19 bp, Artificial sequence
  SiRNA target sequence
ttactacattattaggaac

SEQ ID NO: 226082 - DNA, 19 bp, Artificial sequence
  SiRNA target sequence
tactacattattaggaaca

SEQ ID NO: 226083 - DNA, 19 bp, Artificial sequence
  SiRNA target sequence
actacattattaggaacaa

SEQ ID NO: 226084 - DNA, 19 bp, Artificial sequence
  SiRNA target sequence
ctacattattaggaacaag

SEQ ID NO: 226085 - DNA, 19 bp, Artificial sequence
  SiRNA target sequence
tacattattaggaacaaga

SEQ ID NO: 226086 - DNA, 19 bp, Artificial sequence
  SiRNA target sequence
acattattaggaacaagag

SEQ ID NO: 226087 - DNA, 19 bp, Artificial sequence
  SiRNA target sequence
cattattaggaacaagaga

SEQ ID NO: 226088 - DNA, 19 bp, Artificial sequence
  SiRNA target sequence
attattaggaacaagagat

SEQ ID NO: 226089 - DNA, 19 bp, Artificial sequence
  SiRNA target sequence
ttattaggaacaagagatg

SEQ ID NO: 226090 - DNA, 19 bp, Artificial sequence
  SiRNA target sequence
tattaggaacaagagatgt

SEQ ID NO: 226091 - DNA, 19 bp, Artificial sequence
  SiRNA target sequence
attaggaacaagagatgtt

SEQ ID NO: 226092 - DNA, 19 bp, Artificial sequence
  SiRNA target sequence
ttaggaacaagagatgttc

SEQ ID NO: 226093 - DNA, 19 bp, Artificial sequence
  SiRNA target sequence
taggaacaagagatgttcg

SEQ ID NO: 226094 - DNA, 19 bp, Artificial sequence
  SiRNA target sequence
aggaacaagagatgttcgt

SEQ ID NO: 226095 - DNA, 19 bp, Artificial sequence
  SiRNA target sequence
ggaacaagagatgttcgta

SEQ ID NO: 226096 - DNA, 19 bp, Artificial sequence
  SiRNA target sequence
gaacaagagatgttcgtag

SEQ ID NO: 226097 - DNA, 19 bp, Artificial sequence
  SiRNA target sequence
aacaagagatgttcgtaga

SEQ ID NO: 226098 - DNA, 19 bp, Artificial sequence
  SiRNA target sequence
acaagagatgttcgtagag

SEQ ID NO: 226099 - DNA, 19 bp, Artificial sequence
  SiRNA target sequence
caagagatgttcgtagagg

SEQ ID NO: 226100 - DNA, 19 bp, Artificial sequence
  SiRNA target sequence
aagagatgttcgtagaggt

SEQ ID NO: 226101 - DNA, 19 bp, Artificial sequence
  SiRNA target sequence
agagatgttcgtagaggtg

SEQ ID NO: 226102 - DNA, 19 bp, Artificial sequence
  SiRNA target sequence
gagatgttcgtagaggtgc

SEQ ID NO: 226103 - DNA, 19 bp, Artificial sequence
  SiRNA target sequence
agatgttcgtagaggtgct

SEQ ID NO: 226104 - DNA, 19 bp, Artificial sequence
  SiRNA target sequence
gatgttcgtagaggtgctc

SEQ ID NO: 226105 - DNA, 19 bp, Artificial sequence
  SiRNA target sequence
atgttcgtagaggtgctcc

SEQ ID NO: 226106 - DNA, 19 bp, Artificial sequence
  SiRNA target sequence
tgttcgtagaggtgctcct

SEQ ID NO: 226107 - DNA, 19 bp, Artificial sequence
  SiRNA target sequence
gttcgtagaggtgctccta

SEQ ID NO: 226108 - DNA, 19 bp, Artificial sequence
  SiRNA target sequence
ttcgtagaggtgctcctat

SEQ ID NO: 226109 - DNA, 19 bp, Artificial sequence
  SiRNA target sequence
tcgtagaggtgctcctata

SEQ ID NO: 226110 - DNA, 19 bp, Artificial sequence
  SiRNA target sequence
cgtagaggtgctcctatat

SEQ ID NO: 226111 - DNA, 19 bp, Artificial sequence
  SiRNA target sequence
gtagaggtgctcctatatc

SEQ ID NO: 226112 - DNA, 19 bp, Artificial sequence
  SiRNA target sequence
tagaggtgctcctatatcg

SEQ ID NO: 226113 - DNA, 19 bp, Artificial sequence
  SiRNA target sequence
agaggtgctcctatatcgc

SEQ ID NO: 226114 - DNA, 19 bp, Artificial sequence
  SiRNA target sequence
gaggtgctcctatatcgct

SEQ ID NO: 226115 - DNA, 19 bp, Artificial sequence
  SiRNA target sequence
aggtgctcctatatcgctt

SEQ ID NO: 226116 - DNA, 19 bp, Artificial sequence
  SiRNA target sequence
ggtgctcctatatcgcttt

SEQ ID NO: 226117 - DNA, 19 bp, Artificial sequence
  SiRNA target sequence
gtgctcctatatcgctttg

SEQ ID NO: 226118 - DNA, 19 bp, Artificial sequence
  SiRNA target sequence
tgctcctatatcgctttgt

SEQ ID NO: 226119 - DNA, 19 bp, Artificial sequence
  SiRNA target sequence
gctcctatatcgctttgtg

SEQ ID NO: 226120 - DNA, 19 bp, Artificial sequence
  SiRNA target sequence
ctcctatatcgctttgtgt

SEQ ID NO: 226121 - DNA, 19 bp, Artificial sequence
  SiRNA target sequence
tcctatatcgctttgtgtt

SEQ ID NO: 226122 - DNA, 19 bp, Artificial sequence
  SiRNA target sequence
cctatatcgctttgtgttc

SEQ ID NO: 226123 - DNA, 19 bp, Artificial sequence
  SiRNA target sequence
ctatatcgctttgtgttct

SEQ ID NO: 226124 - DNA, 19 bp, Artificial sequence
  SiRNA target sequence
tatatcgctttgtgttcta

SEQ ID NO: 226125 - DNA, 19 bp, Artificial sequence
  SiRNA target sequence
atatcgctttgtgttctaa

SEQ ID NO: 226126 - DNA, 19 bp, Artificial sequence
  SiRNA target sequence
tatcgctttgtgttctaat

SEQ ID NO: 226127 - DNA, 19 bp, Artificial sequence
  SiRNA target sequence
atcgctttgtgttctaata

SEQ ID NO: 226128 - DNA, 19 bp, Artificial sequence
  SiRNA target sequence
tcgctttgtgttctaatat

SEQ ID NO: 226129 - DNA, 19 bp, Artificial sequence
  SiRNA target sequence
cgctttgtgttctaatatt

SEQ ID NO: 226130 - DNA, 19 bp, Artificial sequence
  SiRNA target sequence
gctttgtgttctaatattg

SEQ ID NO: 226131 - DNA, 19 bp, Artificial sequence
  SiRNA target sequence
ctttgtgttctaatattgt

SEQ ID NO: 226132 - DNA, 19 bp, Artificial sequence
  SiRNA target sequence
tttgtgttctaatattgtt

SEQ ID NO: 226133 - DNA, 19 bp, Artificial sequence
  SiRNA target sequence
ttgtgttctaatattgttc

SEQ ID NO: 226134 - DNA, 19 bp, Artificial sequence
  SiRNA target sequence
tgtgttctaatattgttct

SEQ ID NO: 226135 - DNA, 19 bp, Artificial sequence
  SiRNA target sequence
gtgttctaatattgttctg

SEQ ID NO: 226136 - DNA, 19 bp, Artificial sequence
  SiRNA target sequence
tgttctaatattgttctgc

SEQ ID NO: 226137 - DNA, 19 bp, Artificial sequence
  SiRNA target sequence
gttctaatattgttctgcc

SEQ ID NO: 226138 - DNA, 19 bp, Artificial sequence
  SiRNA target sequence
ttctaatattgttctgcct

SEQ ID NO: 226139 - DNA, 19 bp, Artificial sequence
  SiRNA target sequence
tctaatattgttctgcctt

SEQ ID NO: 226140 - DNA, 19 bp, Artificial sequence
  SiRNA target sequence
ctaatattgttctgcctta

SEQ ID NO: 226141 - DNA, 19 bp, Artificial sequence
  SiRNA target sequence
taatattgttctgccttat

SEQ ID NO: 226142 - DNA, 19 bp, Artificial sequence
  SiRNA target sequence
aatattgttctgccttata

SEQ ID NO: 226143 - DNA, 19 bp, Artificial sequence
  SiRNA target sequence
atattgttctgccttatat

SEQ ID NO: 226144 - DNA, 19 bp, Artificial sequence
  SiRNA target sequence
tattgttctgccttatatg

SEQ ID NO: 226145 - DNA, 19 bp, Artificial sequence
  SiRNA target sequence
attgttctgccttatatgg

SEQ ID NO: 226146 - DNA, 19 bp, Artificial sequence
  SiRNA target sequence
ttgttctgccttatatggt

SEQ ID NO: 226147 - DNA, 19 bp, Artificial sequence
  SiRNA target sequence
tgttctgccttatatggtt

SEQ ID NO: 226148 - DNA, 19 bp, Artificial sequence
  SiRNA target sequence
gttctgccttatatggttt

SEQ ID NO: 226149 - DNA, 19 bp, Artificial sequence
  SiRNA target sequence
ttctgccttatatggtttt

SEQ ID NO: 226150 - DNA, 19 bp, Artificial sequence
  SiRNA target sequence
tctgccttatatggtttta

SEQ ID NO: 226151 - DNA, 19 bp, Artificial sequence
  SiRNA target sequence
ctgccttatatggttttat

SEQ ID NO: 226152 - DNA, 19 bp, Artificial sequence
  SiRNA target sequence
tgccttatatggttttatt

SEQ ID NO: 226153 - DNA, 19 bp, Artificial sequence
  SiRNA target sequence
gccttatatggttttattc

SEQ ID NO: 226154 - DNA, 19 bp, Artificial sequence
  SiRNA target sequence
ccttatatggttttattct

SEQ ID NO: 226155 - DNA, 19 bp, Artificial sequence
  SiRNA target sequence
cttatatggttttattctg

SEQ ID NO: 226156 - DNA, 19 bp, Artificial sequence
  SiRNA target sequence
ttatatggttttattctgt

SEQ ID NO: 226157 - DNA, 19 bp, Artificial sequence
  SiRNA target sequence
tatatggttttattctgtt

SEQ ID NO: 226158 - DNA, 19 bp, Artificial sequence
  SiRNA target sequence
atatggttttattctgttt

SEQ ID NO: 226159 - DNA, 19 bp, Artificial sequence
  SiRNA target sequence
tatggttttattctgtttt

SEQ ID NO: 226160 - DNA, 19 bp, Artificial sequence
  SiRNA target sequence
atggttttattctgttttc

SEQ ID NO: 226161 - DNA, 19 bp, Artificial sequence
  SiRNA target sequence
tggttttattctgttttct

SEQ ID NO: 226162 - DNA, 19 bp, Artificial sequence
  SiRNA target sequence
ggttttattctgttttcta

SEQ ID NO: 226163 - DNA, 19 bp, Artificial sequence
  SiRNA target sequence
gttttattctgttttctat

SEQ ID NO: 226164 - DNA, 19 bp, Artificial sequence
  SiRNA target sequence
ttttattctgttttctatc

SEQ ID NO: 226165 - DNA, 19 bp, Artificial sequence
  SiRNA target sequence
tttattctgttttctatct

SEQ ID NO: 226166 - DNA, 19 bp, Artificial sequence
  SiRNA target sequence
ttattctgttttctatctc

SEQ ID NO: 226167 - DNA, 19 bp, Artificial sequence
  SiRNA target sequence
tattctgttttctatctca

SEQ ID NO: 226168 - DNA, 19 bp, Artificial sequence
  SiRNA target sequence
attctgttttctatctcaa

SEQ ID NO: 226169 - DNA, 19 bp, Artificial sequence
  SiRNA target sequence
ttctgttttctatctcaat

SEQ ID NO: 226170 - DNA, 19 bp, Artificial sequence
  SiRNA target sequence
tctgttttctatctcaata

SEQ ID NO: 226171 - DNA, 19 bp, Artificial sequence
  SiRNA target sequence
ctgttttctatctcaatag

SEQ ID NO: 226172 - DNA, 19 bp, Artificial sequence
  SiRNA target sequence
tgttttctatctcaataga

SEQ ID NO: 226173 - DNA, 19 bp, Artificial sequence
  SiRNA target sequence
gttttctatctcaatagaa

SEQ ID NO: 226174 - DNA, 19 bp, Artificial sequence
  SiRNA target sequence
ttttctatctcaatagaaa

SEQ ID NO: 226175 - DNA, 19 bp, Artificial sequence
  SiRNA target sequence
tttctatctcaatagaaaa

SEQ ID NO: 226176 - DNA, 19 bp, Artificial sequence
  SiRNA target sequence
ttctatctcaatagaaaat

SEQ ID NO: 226177 - DNA, 19 bp, Artificial sequence
  SiRNA target sequence
tctatctcaatagaaaata

SEQ ID NO: 226178 - DNA, 19 bp, Artificial sequence
  SiRNA target sequence
ctatctcaatagaaaatat

SEQ ID NO: 226179 - DNA, 19 bp, Artificial sequence
  SiRNA target sequence
tatctcaatagaaaatata

SEQ ID NO: 226180 - DNA, 19 bp, Artificial sequence
  SiRNA target sequence
atctcaatagaaaatataa

SEQ ID NO: 226181 - DNA, 19 bp, Artificial sequence
  SiRNA target sequence
tctcaatagaaaatataaa

SEQ ID NO: 226182 - DNA, 19 bp, Artificial sequence
  SiRNA target sequence
ctcaatagaaaatataaag

SEQ ID NO: 226183 - DNA, 19 bp, Artificial sequence
  SiRNA target sequence
tcaatagaaaatataaaga

SEQ ID NO: 226184 - DNA, 19 bp, Artificial sequence
  SiRNA target sequence
caatagaaaatataaagaa

SEQ ID NO: 226185 - DNA, 19 bp, Artificial sequence
  SiRNA target sequence
aatagaaaatataaagaat

SEQ ID NO: 226186 - DNA, 19 bp, Artificial sequence
  SiRNA target sequence
atagaaaatataaagaatc

SEQ ID NO: 226187 - DNA, 19 bp, Artificial sequence
  SiRNA target sequence
tagaaaatataaagaatct

SEQ ID NO: 226188 - DNA, 19 bp, Artificial sequence
  SiRNA target sequence
agaaaatataaagaatctg

SEQ ID NO: 226189 - DNA, 19 bp, Artificial sequence
  SiRNA target sequence
gaaaatataaagaatctgt

SEQ ID NO: 226190 - DNA, 19 bp, Artificial sequence
  SiRNA target sequence
aaaatataaagaatctgtc

SEQ ID NO: 226191 - DNA, 19 bp, Artificial sequence
  SiRNA target sequence
aaatataaagaatctgtcg

SEQ ID NO: 226192 - DNA, 19 bp, Artificial sequence
  SiRNA target sequence
aatataaagaatctgtcga

SEQ ID NO: 226193 - DNA, 19 bp, Artificial sequence
  SiRNA target sequence
atataaagaatctgtcgag

SEQ ID NO: 226194 - DNA, 19 bp, Artificial sequence
  SiRNA target sequence
tataaagaatctgtcgaga

SEQ ID NO: 226195 - DNA, 19 bp, Artificial sequence
  SiRNA target sequence
ataaagaatctgtcgagaa

SEQ ID NO: 226196 - DNA, 19 bp, Artificial sequence
  SiRNA target sequence
taaagaatctgtcgagaat

SEQ ID NO: 226197 - DNA, 19 bp, Artificial sequence
  SiRNA target sequence
aaagaatctgtcgagaata

SEQ ID NO: 226198 - DNA, 19 bp, Artificial sequence
  SiRNA target sequence
aagaatctgtcgagaataa

SEQ ID NO: 226199 - DNA, 19 bp, Artificial sequence
  SiRNA target sequence
agaatctgtcgagaataat

SEQ ID NO: 226200 - DNA, 19 bp, Artificial sequence
  SiRNA target sequence
gaatctgtcgagaataatg

SEQ ID NO: 226201 - DNA, 19 bp, Artificial sequence
  SiRNA target sequence
aatctgtcgagaataatgc

SEQ ID NO: 226202 - DNA, 19 bp, Artificial sequence
  SiRNA target sequence
atctgtcgagaataatgca

SEQ ID NO: 226203 - DNA, 19 bp, Artificial sequence
  SiRNA target sequence
tctgtcgagaataatgcac

SEQ ID NO: 226204 - DNA, 19 bp, Artificial sequence
  SiRNA target sequence
ctgtcgagaataatgcacc

SEQ ID NO: 226205 - DNA, 19 bp, Artificial sequence
  SiRNA target sequence
tgtcgagaataatgcacca

SEQ ID NO: 226206 - DNA, 19 bp, Artificial sequence
  SiRNA target sequence
gtcgagaataatgcaccaa

SEQ ID NO: 226207 - DNA, 19 bp, Artificial sequence
  SiRNA target sequence
tcgagaataatgcaccaat

SEQ ID NO: 226208 - DNA, 19 bp, Artificial sequence
  SiRNA target sequence
cgagaataatgcaccaatt

SEQ ID NO: 226209 - DNA, 19 bp, Artificial sequence
  SiRNA target sequence
gagaataatgcaccaattg

SEQ ID NO: 226210 - DNA, 19 bp, Artificial sequence
  SiRNA target sequence
agaataatgcaccaattga

SEQ ID NO: 226211 - DNA, 19 bp, Artificial sequence
  SiRNA target sequence
gaataatgcaccaattgat

SEQ ID NO: 226212 - DNA, 19 bp, Artificial sequence
  SiRNA target sequence
aataatgcaccaattgata

SEQ ID NO: 226213 - DNA, 19 bp, Artificial sequence
  SiRNA target sequence
ataatgcaccaattgatat

SEQ ID NO: 226214 - DNA, 19 bp, Artificial sequence
  SiRNA target sequence
taatgcaccaattgatatt

SEQ ID NO: 226215 - DNA, 19 bp, Artificial sequence
  SiRNA target sequence
aatgcaccaattgatattg

SEQ ID NO: 226216 - DNA, 19 bp, Artificial sequence
  SiRNA target sequence
atgcaccaattgatattga

SEQ ID NO: 226217 - DNA, 19 bp, Artificial sequence
  SiRNA target sequence
tgcaccaattgatattgat

SEQ ID NO: 226218 - DNA, 19 bp, Artificial sequence
  SiRNA target sequence
gcaccaattgatattgatt

SEQ ID NO: 226219 - DNA, 19 bp, Artificial sequence
  SiRNA target sequence
caccaattgatattgattt

SEQ ID NO: 226220 - DNA, 19 bp, Artificial sequence
  SiRNA target sequence
accaattgatattgattta

SEQ ID NO: 226221 - DNA, 19 bp, Artificial sequence
  SiRNA target sequence
ccaattgatattgatttat

SEQ ID NO: 226222 - DNA, 19 bp, Artificial sequence
  SiRNA target sequence
caattgatattgatttatt

SEQ ID NO: 226223 - DNA, 19 bp, Artificial sequence
  SiRNA target sequence
aattgatattgatttattc

SEQ ID NO: 226224 - DNA, 19 bp, Artificial sequence
  SiRNA target sequence
attgatattgatttattca

SEQ ID NO: 226225 - DNA, 19 bp, Artificial sequence
  SiRNA target sequence
ttgatattgatttattcac

SEQ ID NO: 226226 - DNA, 19 bp, Artificial sequence
  SiRNA target sequence
tgatattgatttattcact

SEQ ID NO: 226227 - DNA, 19 bp, Artificial sequence
  SiRNA target sequence
gatattgatttattcacta

SEQ ID NO: 226228 - DNA, 19 bp, Artificial sequence
  SiRNA target sequence
atattgatttattcactag

SEQ ID NO: 226229 - DNA, 19 bp, Artificial sequence
  SiRNA target sequence
tattgatttattcactagt

SEQ ID NO: 226230 - DNA, 19 bp, Artificial sequence
  SiRNA target sequence
attgatttattcactagtt

SEQ ID NO: 226231 - DNA, 19 bp, Artificial sequence
  SiRNA target sequence
ttgatttattcactagttc

SEQ ID NO: 226232 - DNA, 19 bp, Artificial sequence
  SiRNA target sequence
tgatttattcactagttca

SEQ ID NO: 226233 - DNA, 19 bp, Artificial sequence
  SiRNA target sequence
gatttattcactagttcaa

SEQ ID NO: 226234 - DNA, 19 bp, Artificial sequence
  SiRNA target sequence
atttattcactagttcaaa

SEQ ID NO: 226235 - DNA, 19 bp, Artificial sequence
  SiRNA target sequence
tttattcactagttcaaaa

SEQ ID NO: 226236 - DNA, 19 bp, Artificial sequence
  SiRNA target sequence
ttattcactagttcaaaag

SEQ ID NO: 226237 - DNA, 19 bp, Artificial sequence
  SiRNA target sequence
tattcactagttcaaaagt

SEQ ID NO: 226238 - DNA, 19 bp, Artificial sequence
  SiRNA target sequence
attcactagttcaaaagtc

SEQ ID NO: 226239 - DNA, 19 bp, Artificial sequence
  SiRNA target sequence
ttcactagttcaaaagtca

SEQ ID NO: 226240 - DNA, 19 bp, Artificial sequence
  SiRNA target sequence
tcactagttcaaaagtcaa

SEQ ID NO: 226241 - DNA, 19 bp, Artificial sequence
  SiRNA target sequence
cactagttcaaaagtcaag

SEQ ID NO: 226242 - DNA, 19 bp, Artificial sequence
  SiRNA target sequence
actagttcaaaagtcaagg

SEQ ID NO: 226243 - DNA, 19 bp, Artificial sequence
  SiRNA target sequence
ctagttcaaaagtcaaggc

SEQ ID NO: 226244 - DNA, 19 bp, Artificial sequence
  SiRNA target sequence
tagttcaaaagtcaaggca

SEQ ID NO: 226245 - DNA, 19 bp, Artificial sequence
  SiRNA target sequence
agttcaaaagtcaaggcac

SEQ ID NO: 226246 - DNA, 19 bp, Artificial sequence
  SiRNA target sequence
gttcaaaagtcaaggcacc

SEQ ID NO: 226247 - DNA, 19 bp, Artificial sequence
  SiRNA target sequence
ttcaaaagtcaaggcacct

SEQ ID NO: 226248 - DNA, 19 bp, Artificial sequence
  SiRNA target sequence
tcaaaagtcaaggcacctt

SEQ ID NO: 226249 - DNA, 19 bp, Artificial sequence
  SiRNA target sequence
caaaagtcaaggcaccttc

SEQ ID NO: 226250 - DNA, 19 bp, Artificial sequence
  SiRNA target sequence
aaaagtcaaggcaccttct

SEQ ID NO: 226251 - DNA, 19 bp, Artificial sequence
  SiRNA target sequence
aaagtcaaggcaccttctt

SEQ ID NO: 226252 - DNA, 19 bp, Artificial sequence
  SiRNA target sequence
aagtcaaggcaccttcttc

SEQ ID NO: 226253 - DNA, 19 bp, Artificial sequence
  SiRNA target sequence
agtcaaggcaccttcttct

SEQ ID NO: 226254 - DNA, 19 bp, Artificial sequence
  SiRNA target sequence
gtcaaggcaccttcttctg

SEQ ID NO: 226255 - DNA, 19 bp, Artificial sequence
  SiRNA target sequence
tcaaggcaccttcttctga

SEQ ID NO: 226256 - DNA, 19 bp, Artificial sequence
  SiRNA target sequence
caaggcaccttcttctgaa

SEQ ID NO: 226257 - DNA, 19 bp, Artificial sequence
  SiRNA target sequence
aaggcaccttcttctgaac

SEQ ID NO: 226258 - DNA, 19 bp, Artificial sequence
  SiRNA target sequence
aggcaccttcttctgaacc

SEQ ID NO: 226259 - DNA, 19 bp, Artificial sequence
  SiRNA target sequence
ggcaccttcttctgaacct

SEQ ID NO: 226260 - DNA, 19 bp, Artificial sequence
  SiRNA target sequence
gcaccttcttctgaaccta

SEQ ID NO: 226261 - DNA, 19 bp, Artificial sequence
  SiRNA target sequence
caccttcttctgaacctac

SEQ ID NO: 226262 - DNA, 19 bp, Artificial sequence
  SiRNA target sequence
accttcttctgaacctact

SEQ ID NO: 226263 - DNA, 19 bp, Artificial sequence
  SiRNA target sequence
ccttcttctgaacctactg

SEQ ID NO: 226264 - DNA, 19 bp, Artificial sequence
  SiRNA target sequence
cttcttctgaacctactgt

SEQ ID NO: 226265 - DNA, 19 bp, Artificial sequence
  SiRNA target sequence
ttcttctgaacctactgtt

SEQ ID NO: 226266 - DNA, 19 bp, Artificial sequence
  SiRNA target sequence
tcttctgaacctactgttg

SEQ ID NO: 226267 - DNA, 19 bp, Artificial sequence
  SiRNA target sequence
cttctgaacctactgttgc

SEQ ID NO: 226268 - DNA, 19 bp, Artificial sequence
  SiRNA target sequence
ttctgaacctactgttgct

SEQ ID NO: 226269 - DNA, 19 bp, Artificial sequence
  SiRNA target sequence
tctgaacctactgttgcta

SEQ ID NO: 226270 - DNA, 19 bp, Artificial sequence
  SiRNA target sequence
ctgaacctactgttgctac

SEQ ID NO: 226271 - DNA, 19 bp, Artificial sequence
  SiRNA target sequence
tgaacctactgttgctacc

SEQ ID NO: 226272 - DNA, 19 bp, Artificial sequence
  SiRNA target sequence
gaacctactgttgctacca

SEQ ID NO: 226273 - DNA, 19 bp, Artificial sequence
  SiRNA target sequence
aacctactgttgctaccaa

SEQ ID NO: 226274 - DNA, 19 bp, Artificial sequence
  SiRNA target sequence
acctactgttgctaccaaa

SEQ ID NO: 226275 - DNA, 19 bp, Artificial sequence
  SiRNA target sequence
cctactgttgctaccaaaa

SEQ ID NO: 226276 - DNA, 19 bp, Artificial sequence
  SiRNA target sequence
ctactgttgctaccaaaag

SEQ ID NO: 226277 - DNA, 19 bp, Artificial sequence
  SiRNA target sequence
tactgttgctaccaaaagt

SEQ ID NO: 226278 - DNA, 19 bp, Artificial sequence
  SiRNA target sequence
actgttgctaccaaaagtg

SEQ ID NO: 226279 - DNA, 19 bp, Artificial sequence
  SiRNA target sequence
ctgttgctaccaaaagtgt

SEQ ID NO: 226280 - DNA, 19 bp, Artificial sequence
  SiRNA target sequence
tgttgctaccaaaagtgtt

SEQ ID NO: 226281 - DNA, 19 bp, Artificial sequence
  SiRNA target sequence
gttgctaccaaaagtgtta

SEQ ID NO: 226282 - DNA, 19 bp, Artificial sequence
  SiRNA target sequence
ttgctaccaaaagtgttac

SEQ ID NO: 226283 - DNA, 19 bp, Artificial sequence
  SiRNA target sequence
tgctaccaaaagtgttact

SEQ ID NO: 226284 - DNA, 19 bp, Artificial sequence
  SiRNA target sequence
gctaccaaaagtgttacta

SEQ ID NO: 226285 - DNA, 19 bp, Artificial sequence
  SiRNA target sequence
ctaccaaaagtgttactac

SEQ ID NO: 226286 - DNA, 19 bp, Artificial sequence
  SiRNA target sequence
taccaaaagtgttactaca

SEQ ID NO: 226287 - DNA, 19 bp, Artificial sequence
  SiRNA target sequence
accaaaagtgttactacag

SEQ ID NO: 226288 - DNA, 19 bp, Artificial sequence
  SiRNA target sequence
ccaaaagtgttactacaga

SEQ ID NO: 226289 - DNA, 19 bp, Artificial sequence
  SiRNA target sequence
caaaagtgttactacagaa

SEQ ID NO: 226290 - DNA, 19 bp, Artificial sequence
  SiRNA target sequence
aaaagtgttactacagaag

SEQ ID NO: 226291 - DNA, 19 bp, Artificial sequence
  SiRNA target sequence
aaagtgttactacagaaga

SEQ ID NO: 226292 - DNA, 19 bp, Artificial sequence
  SiRNA target sequence
aagtgttactacagaagaa

SEQ ID NO: 226293 - DNA, 19 bp, Artificial sequence
  SiRNA target sequence
agtgttactacagaagaat

SEQ ID NO: 226294 - DNA, 19 bp, Artificial sequence
  SiRNA target sequence
gtgttactacagaagaata

SEQ ID NO: 226295 - DNA, 19 bp, Artificial sequence
  SiRNA target sequence
tgttactacagaagaataa

SEQ ID NO: 226296 - DNA, 20 bp, Artificial sequence
  SiRNA target sequence
atgtcagtagacaattcgaa

SEQ ID NO: 226297 - DNA, 20 bp, Artificial sequence
  SiRNA target sequence
tgtcagtagacaattcgaaa

SEQ ID NO: 226298 - DNA, 20 bp, Artificial sequence
  SiRNA target sequence
gtcagtagacaattcgaaag

SEQ ID NO: 226299 - DNA, 20 bp, Artificial sequence
  SiRNA target sequence
tcagtagacaattcgaaagt

SEQ ID NO: 226300 - DNA, 20 bp, Artificial sequence
  SiRNA target sequence
cagtagacaattcgaaagtt

SEQ ID NO: 226301 - DNA, 20 bp, Artificial sequence
  SiRNA target sequence
agtagacaattcgaaagttc

SEQ ID NO: 226302 - DNA, 20 bp, Artificial sequence
  SiRNA target sequence
gtagacaattcgaaagttct

SEQ ID NO: 226303 - DNA, 20 bp, Artificial sequence
  SiRNA target sequence
tagacaattcgaaagttcta

SEQ ID NO: 226304 - DNA, 20 bp, Artificial sequence
  SiRNA target sequence
agacaattcgaaagttctac

SEQ ID NO: 226305 - DNA, 20 bp, Artificial sequence
  SiRNA target sequence
gacaattcgaaagttctaca

SEQ ID NO: 226306 - DNA, 20 bp, Artificial sequence
  SiRNA target sequence
acaattcgaaagttctacaa

SEQ ID NO: 226307 - DNA, 20 bp, Artificial sequence
  SiRNA target sequence
caattcgaaagttctacaaa

SEQ ID NO: 226308 - DNA, 20 bp, Artificial sequence
  SiRNA target sequence
aattcgaaagttctacaaaa

SEQ ID NO: 226309 - DNA, 20 bp, Artificial sequence
  SiRNA target sequence
attcgaaagttctacaaaat

SEQ ID NO: 226310 - DNA, 20 bp, Artificial sequence
  SiRNA target sequence
ttcgaaagttctacaaaata

SEQ ID NO: 226311 - DNA, 20 bp, Artificial sequence
  SiRNA target sequence
tcgaaagttctacaaaataa

SEQ ID NO: 226312 - DNA, 20 bp, Artificial sequence
  SiRNA target sequence
cgaaagttctacaaaataac

SEQ ID NO: 226313 - DNA, 20 bp, Artificial sequence
  SiRNA target sequence
gaaagttctacaaaataacg

SEQ ID NO: 226314 - DNA, 20 bp, Artificial sequence
  SiRNA target sequence
aaagttctacaaaataacga

SEQ ID NO: 226315 - DNA, 20 bp, Artificial sequence
  SiRNA target sequence
aagttctacaaaataacgaa

SEQ ID NO: 226316 - DNA, 20 bp, Artificial sequence
  SiRNA target sequence
agttctacaaaataacgaaa

SEQ ID NO: 226317 - DNA, 20 bp, Artificial sequence
  SiRNA target sequence
gttctacaaaataacgaaaa

SEQ ID NO: 226318 - DNA, 20 bp, Artificial sequence
  SiRNA target sequence
ttctacaaaataacgaaaac

SEQ ID NO: 226319 - DNA, 20 bp, Artificial sequence
  SiRNA target sequence
tctacaaaataacgaaaact

SEQ ID NO: 226320 - DNA, 20 bp, Artificial sequence
  SiRNA target sequence
ctacaaaataacgaaaactc

SEQ ID NO: 226321 - DNA, 20 bp, Artificial sequence
  SiRNA target sequence
tacaaaataacgaaaactct

SEQ ID NO: 226322 - DNA, 20 bp, Artificial sequence
  SiRNA target sequence
acaaaataacgaaaactctg

SEQ ID NO: 226323 - DNA, 20 bp, Artificial sequence
  SiRNA target sequence
caaaataacgaaaactctgc

SEQ ID NO: 226324 - DNA, 20 bp, Artificial sequence
  SiRNA target sequence
aaaataacgaaaactctgct

SEQ ID NO: 226325 - DNA, 20 bp, Artificial sequence
  SiRNA target sequence
aaataacgaaaactctgctc

SEQ ID NO: 226326 - DNA, 20 bp, Artificial sequence
  SiRNA target sequence
aataacgaaaactctgctct

SEQ ID NO: 226327 - DNA, 20 bp, Artificial sequence
  SiRNA target sequence
ataacgaaaactctgctctt

SEQ ID NO: 226328 - DNA, 20 bp, Artificial sequence
  SiRNA target sequence
taacgaaaactctgctcttc

SEQ ID NO: 226329 - DNA, 20 bp, Artificial sequence
  SiRNA target sequence
aacgaaaactctgctcttcc

SEQ ID NO: 226330 - DNA, 20 bp, Artificial sequence
  SiRNA target sequence
acgaaaactctgctcttcct

SEQ ID NO: 226331 - DNA, 20 bp, Artificial sequence
  SiRNA target sequence
cgaaaactctgctcttccta

SEQ ID NO: 226332 - DNA, 20 bp, Artificial sequence
  SiRNA target sequence
gaaaactctgctcttcctac

SEQ ID NO: 226333 - DNA, 20 bp, Artificial sequence
  SiRNA target sequence
aaaactctgctcttcctaca

SEQ ID NO: 226334 - DNA, 20 bp, Artificial sequence
  SiRNA target sequence
aaactctgctcttcctacag

SEQ ID NO: 226335 - DNA, 20 bp, Artificial sequence
  SiRNA target sequence
aactctgctcttcctacaga

SEQ ID NO: 226336 - DNA, 20 bp, Artificial sequence
  SiRNA target sequence
actctgctcttcctacagaa

SEQ ID NO: 226337 - DNA, 20 bp, Artificial sequence
  SiRNA target sequence
ctctgctcttcctacagaag

SEQ ID NO: 226338 - DNA, 20 bp, Artificial sequence
  SiRNA target sequence
tctgctcttcctacagaaga

SEQ ID NO: 226339 - DNA, 20 bp, Artificial sequence
  SiRNA target sequence
ctgctcttcctacagaagat

SEQ ID NO: 226340 - DNA, 20 bp, Artificial sequence
  SiRNA target sequence
tgctcttcctacagaagatg

SEQ ID NO: 226341 - DNA, 20 bp, Artificial sequence
  SiRNA target sequence
gctcttcctacagaagatga

SEQ ID NO: 226342 - DNA, 20 bp, Artificial sequence
  SiRNA target sequence
ctcttcctacagaagatgaa

SEQ ID NO: 226343 - DNA, 20 bp, Artificial sequence
  SiRNA target sequence
tcttcctacagaagatgaaa

SEQ ID NO: 226344 - DNA, 20 bp, Artificial sequence
  SiRNA target sequence
cttcctacagaagatgaaat

SEQ ID NO: 226345 - DNA, 20 bp, Artificial sequence
  SiRNA target sequence
ttcctacagaagatgaaatt

SEQ ID NO: 226346 - DNA, 20 bp, Artificial sequence
  SiRNA target sequence
tcctacagaagatgaaattg

SEQ ID NO: 226347 - DNA, 20 bp, Artificial sequence
  SiRNA target sequence
cctacagaagatgaaattga

SEQ ID NO: 226348 - DNA, 20 bp, Artificial sequence
  SiRNA target sequence
ctacagaagatgaaattgag

SEQ ID NO: 226349 - DNA, 20 bp, Artificial sequence
  SiRNA target sequence
tacagaagatgaaattgagt

SEQ ID NO: 226350 - DNA, 20 bp, Artificial sequence
  SiRNA target sequence
acagaagatgaaattgagta

SEQ ID NO: 226351 - DNA, 20 bp, Artificial sequence
  SiRNA target sequence
cagaagatgaaattgagtat

SEQ ID NO: 226352 - DNA, 20 bp, Artificial sequence
  SiRNA target sequence
agaagatgaaattgagtatg

SEQ ID NO: 226353 - DNA, 20 bp, Artificial sequence
  SiRNA target sequence
gaagatgaaattgagtatga

SEQ ID NO: 226354 - DNA, 20 bp, Artificial sequence
  SiRNA target sequence
aagatgaaattgagtatgag

SEQ ID NO: 226355 - DNA, 20 bp, Artificial sequence
  SiRNA target sequence
agatgaaattgagtatgagg

SEQ ID NO: 226356 - DNA, 20 bp, Artificial sequence
  SiRNA target sequence
gatgaaattgagtatgaggc

SEQ ID NO: 226357 - DNA, 20 bp, Artificial sequence
  SiRNA target sequence
atgaaattgagtatgaggcc

SEQ ID NO: 226358 - DNA, 20 bp, Artificial sequence
  SiRNA target sequence
tgaaattgagtatgaggcca

SEQ ID NO: 226359 - DNA, 20 bp, Artificial sequence
  SiRNA target sequence
gaaattgagtatgaggccag

SEQ ID NO: 226360 - DNA, 20 bp, Artificial sequence
  SiRNA target sequence
aaattgagtatgaggccagc

SEQ ID NO: 226361 - DNA, 20 bp, Artificial sequence
  SiRNA target sequence
aattgagtatgaggccagca

SEQ ID NO: 226362 - DNA, 20 bp, Artificial sequence
  SiRNA target sequence
attgagtatgaggccagcaa

SEQ ID NO: 226363 - DNA, 20 bp, Artificial sequence
  SiRNA target sequence
ttgagtatgaggccagcaat

SEQ ID NO: 226364 - DNA, 20 bp, Artificial sequence
  SiRNA target sequence
tgagtatgaggccagcaatg

SEQ ID NO: 226365 - DNA, 20 bp, Artificial sequence
  SiRNA target sequence
gagtatgaggccagcaatgg

SEQ ID NO: 226366 - DNA, 20 bp, Artificial sequence
  SiRNA target sequence
agtatgaggccagcaatggt

SEQ ID NO: 226367 - DNA, 20 bp, Artificial sequence
  SiRNA target sequence
gtatgaggccagcaatggtt

SEQ ID NO: 226368 - DNA, 20 bp, Artificial sequence
  SiRNA target sequence
tatgaggccagcaatggttc

SEQ ID NO: 226369 - DNA, 20 bp, Artificial sequence
  SiRNA target sequence
atgaggccagcaatggttct

SEQ ID NO: 226370 - DNA, 20 bp, Artificial sequence
  SiRNA target sequence
tgaggccagcaatggttctg

SEQ ID NO: 226371 - DNA, 20 bp, Artificial sequence
  SiRNA target sequence
gaggccagcaatggttctgg

SEQ ID NO: 226372 - DNA, 20 bp, Artificial sequence
  SiRNA target sequence
aggccagcaatggttctggt

SEQ ID NO: 226373 - DNA, 20 bp, Artificial sequence
  SiRNA target sequence
ggccagcaatggttctggta

SEQ ID NO: 226374 - DNA, 20 bp, Artificial sequence
  SiRNA target sequence
gccagcaatggttctggtat

SEQ ID NO: 226375 - DNA, 20 bp, Artificial sequence
  SiRNA target sequence
ccagcaatggttctggtata

SEQ ID NO: 226376 - DNA, 20 bp, Artificial sequence
  SiRNA target sequence
cagcaatggttctggtatat

SEQ ID NO: 226377 - DNA, 20 bp, Artificial sequence
  SiRNA target sequence
agcaatggttctggtatata

SEQ ID NO: 226378 - DNA, 20 bp, Artificial sequence
  SiRNA target sequence
gcaatggttctggtatatat

SEQ ID NO: 226379 - DNA, 20 bp, Artificial sequence
  SiRNA target sequence
caatggttctggtatatatt

SEQ ID NO: 226380 - DNA, 20 bp, Artificial sequence
  SiRNA target sequence
aatggttctggtatatattc

SEQ ID NO: 226381 - DNA, 20 bp, Artificial sequence
  SiRNA target sequence
atggttctggtatatattca

SEQ ID NO: 226382 - DNA, 20 bp, Artificial sequence
  SiRNA target sequence
tggttctggtatatattcac

SEQ ID NO: 226383 - DNA, 20 bp, Artificial sequence
  SiRNA target sequence
ggttctggtatatattcact

SEQ ID NO: 226384 - DNA, 20 bp, Artificial sequence
  SiRNA target sequence
gttctggtatatattcactt

SEQ ID NO: 226385 - DNA, 20 bp, Artificial sequence
  SiRNA target sequence
ttctggtatatattcactta

SEQ ID NO: 226386 - DNA, 20 bp, Artificial sequence
  SiRNA target sequence
tctggtatatattcacttat

SEQ ID NO: 226387 - DNA, 20 bp, Artificial sequence
  SiRNA target sequence
ctggtatatattcacttatt

SEQ ID NO: 226388 - DNA, 20 bp, Artificial sequence
  SiRNA target sequence
tggtatatattcacttatta

SEQ ID NO: 226389 - DNA, 20 bp, Artificial sequence
  SiRNA target sequence
ggtatatattcacttattag

SEQ ID NO: 226390 - DNA, 20 bp, Artificial sequence
  SiRNA target sequence
gtatatattcacttattaga

SEQ ID NO: 226391 - DNA, 20 bp, Artificial sequence
  SiRNA target sequence
tatatattcacttattagag

SEQ ID NO: 226392 - DNA, 20 bp, Artificial sequence
  SiRNA target sequence
atatattcacttattagagt

SEQ ID NO: 226393 - DNA, 20 bp, Artificial sequence
  SiRNA target sequence
tatattcacttattagagta

SEQ ID NO: 226394 - DNA, 20 bp, Artificial sequence
  SiRNA target sequence
atattcacttattagagtag

SEQ ID NO: 226395 - DNA, 20 bp, Artificial sequence
  SiRNA target sequence
tattcacttattagagtagc

SEQ ID NO: 226396 - DNA, 20 bp, Artificial sequence
  SiRNA target sequence
attcacttattagagtagca

SEQ ID NO: 226397 - DNA, 20 bp, Artificial sequence
  SiRNA target sequence
ttcacttattagagtagcaa

SEQ ID NO: 226398 - DNA, 20 bp, Artificial sequence
  SiRNA target sequence
tcacttattagagtagcaaa

SEQ ID NO: 226399 - DNA, 20 bp, Artificial sequence
  SiRNA target sequence
cacttattagagtagcaaag

SEQ ID NO: 226400 - DNA, 20 bp, Artificial sequence
  SiRNA target sequence
acttattagagtagcaaagg

SEQ ID NO: 226401 - DNA, 20 bp, Artificial sequence
  SiRNA target sequence
cttattagagtagcaaaggt

SEQ ID NO: 226402 - DNA, 20 bp, Artificial sequence
  SiRNA target sequence
ttattagagtagcaaaggtt

SEQ ID NO: 226403 - DNA, 20 bp, Artificial sequence
  SiRNA target sequence
tattagagtagcaaaggttg

SEQ ID NO: 226404 - DNA, 20 bp, Artificial sequence
  SiRNA target sequence
attagagtagcaaaggttga

SEQ ID NO: 226405 - DNA, 20 bp, Artificial sequence
  SiRNA target sequence
ttagagtagcaaaggttgag

SEQ ID NO: 226406 - DNA, 20 bp, Artificial sequence
  SiRNA target sequence
tagagtagcaaaggttgaga

SEQ ID NO: 226407 - DNA, 20 bp, Artificial sequence
  SiRNA target sequence
agagtagcaaaggttgagag

SEQ ID NO: 226408 - DNA, 20 bp, Artificial sequence
  SiRNA target sequence
gagtagcaaaggttgagaga

SEQ ID NO: 226409 - DNA, 20 bp, Artificial sequence
  SiRNA target sequence
agtagcaaaggttgagagaa

SEQ ID NO: 226410 - DNA, 20 bp, Artificial sequence
  SiRNA target sequence
gtagcaaaggttgagagaaa

SEQ ID NO: 226411 - DNA, 20 bp, Artificial sequence
  SiRNA target sequence
tagcaaaggttgagagaaag

SEQ ID NO: 226412 - DNA, 20 bp, Artificial sequence
  SiRNA target sequence
agcaaaggttgagagaaaga

SEQ ID NO: 226413 - DNA, 20 bp, Artificial sequence
  SiRNA target sequence
gcaaaggttgagagaaagat

SEQ ID NO: 226414 - DNA, 20 bp, Artificial sequence
  SiRNA target sequence
caaaggttgagagaaagatg

SEQ ID NO: 226415 - DNA, 20 bp, Artificial sequence
  SiRNA target sequence
aaaggttgagagaaagatgt

SEQ ID NO: 226416 - DNA, 20 bp, Artificial sequence
  SiRNA target sequence
aaggttgagagaaagatgtt

SEQ ID NO: 226417 - DNA, 20 bp, Artificial sequence
  SiRNA target sequence
aggttgagagaaagatgttt

SEQ ID NO: 226418 - DNA, 20 bp, Artificial sequence
  SiRNA target sequence
ggttgagagaaagatgtttt

SEQ ID NO: 226419 - DNA, 20 bp, Artificial sequence
  SiRNA target sequence
gttgagagaaagatgttttg

SEQ ID NO: 226420 - DNA, 20 bp, Artificial sequence
  SiRNA target sequence
ttgagagaaagatgttttgg

SEQ ID NO: 226421 - DNA, 20 bp, Artificial sequence
  SiRNA target sequence
tgagagaaagatgttttgga

SEQ ID NO: 226422 - DNA, 20 bp, Artificial sequence
  SiRNA target sequence
gagagaaagatgttttggat

SEQ ID NO: 226423 - DNA, 20 bp, Artificial sequence
  SiRNA target sequence
agagaaagatgttttggatc

SEQ ID NO: 226424 - DNA, 20 bp, Artificial sequence
  SiRNA target sequence
gagaaagatgttttggatca

SEQ ID NO: 226425 - DNA, 20 bp, Artificial sequence
  SiRNA target sequence
agaaagatgttttggatcat

SEQ ID NO: 226426 - DNA, 20 bp, Artificial sequence
  SiRNA target sequence
gaaagatgttttggatcatg

SEQ ID NO: 226427 - DNA, 20 bp, Artificial sequence
  SiRNA target sequence
aaagatgttttggatcatgg

SEQ ID NO: 226428 - DNA, 20 bp, Artificial sequence
  SiRNA target sequence
aagatgttttggatcatggc

SEQ ID NO: 226429 - DNA, 20 bp, Artificial sequence
  SiRNA target sequence
agatgttttggatcatggca

SEQ ID NO: 226430 - DNA, 20 bp, Artificial sequence
  SiRNA target sequence
gatgttttggatcatggcag

SEQ ID NO: 226431 - DNA, 20 bp, Artificial sequence
  SiRNA target sequence
atgttttggatcatggcagc

SEQ ID NO: 226432 - DNA, 20 bp, Artificial sequence
  SiRNA target sequence
tgttttggatcatggcagct

SEQ ID NO: 226433 - DNA, 20 bp, Artificial sequence
  SiRNA target sequence
gttttggatcatggcagcta

SEQ ID NO: 226434 - DNA, 20 bp, Artificial sequence
  SiRNA target sequence
ttttggatcatggcagctat

SEQ ID NO: 226435 - DNA, 20 bp, Artificial sequence
  SiRNA target sequence
tttggatcatggcagctatg

SEQ ID NO: 226436 - DNA, 20 bp, Artificial sequence
  SiRNA target sequence
ttggatcatggcagctatgt

SEQ ID NO: 226437 - DNA, 20 bp, Artificial sequence
  SiRNA target sequence
tggatcatggcagctatgtt

SEQ ID NO: 226438 - DNA, 20 bp, Artificial sequence
  SiRNA target sequence
ggatcatggcagctatgttc

SEQ ID NO: 226439 - DNA, 20 bp, Artificial sequence
  SiRNA target sequence
gatcatggcagctatgttct

SEQ ID NO: 226440 - DNA, 20 bp, Artificial sequence
  SiRNA target sequence
atcatggcagctatgttctt

SEQ ID NO: 226441 - DNA, 20 bp, Artificial sequence
  SiRNA target sequence
tcatggcagctatgttcttt

SEQ ID NO: 226442 - DNA, 20 bp, Artificial sequence
  SiRNA target sequence
catggcagctatgttcttta

SEQ ID NO: 226443 - DNA, 20 bp, Artificial sequence
  SiRNA target sequence
atggcagctatgttctttat

SEQ ID NO: 226444 - DNA, 20 bp, Artificial sequence
  SiRNA target sequence
tggcagctatgttctttatt

SEQ ID NO: 226445 - DNA, 20 bp, Artificial sequence
  SiRNA target sequence
ggcagctatgttctttatta

SEQ ID NO: 226446 - DNA, 20 bp, Artificial sequence
  SiRNA target sequence
gcagctatgttctttattat

SEQ ID NO: 226447 - DNA, 20 bp, Artificial sequence
  SiRNA target sequence
cagctatgttctttattatc

SEQ ID NO: 226448 - DNA, 20 bp, Artificial sequence
  SiRNA target sequence
agctatgttctttattatct

SEQ ID NO: 226449 - DNA, 20 bp, Artificial sequence
  SiRNA target sequence
gctatgttctttattatctc

SEQ ID NO: 226450 - DNA, 20 bp, Artificial sequence
  SiRNA target sequence
ctatgttctttattatctcc

SEQ ID NO: 226451 - DNA, 20 bp, Artificial sequence
  SiRNA target sequence
tatgttctttattatctcct

SEQ ID NO: 226452 - DNA, 20 bp, Artificial sequence
  SiRNA target sequence
atgttctttattatctcctt

SEQ ID NO: 226453 - DNA, 20 bp, Artificial sequence
  SiRNA target sequence
tgttctttattatctccttt

SEQ ID NO: 226454 - DNA, 20 bp, Artificial sequence
  SiRNA target sequence
gttctttattatctccttta

SEQ ID NO: 226455 - DNA, 20 bp, Artificial sequence
  SiRNA target sequence
ttctttattatctcctttat

SEQ ID NO: 226456 - DNA, 20 bp, Artificial sequence
  SiRNA target sequence
tctttattatctcctttatt

SEQ ID NO: 226457 - DNA, 20 bp, Artificial sequence
  SiRNA target sequence
ctttattatctcctttattt

SEQ ID NO: 226458 - DNA, 20 bp, Artificial sequence
  SiRNA target sequence
tttattatctcctttattta

SEQ ID NO: 226459 - DNA, 20 bp, Artificial sequence
  SiRNA target sequence
ttattatctcctttatttat

SEQ ID NO: 226460 - DNA, 20 bp, Artificial sequence
  SiRNA target sequence
tattatctcctttatttatt

SEQ ID NO: 226461 - DNA, 20 bp, Artificial sequence
  SiRNA target sequence
attatctcctttatttattc

SEQ ID NO: 226462 - DNA, 20 bp, Artificial sequence
  SiRNA target sequence
ttatctcctttatttattcg

SEQ ID NO: 226463 - DNA, 20 bp, Artificial sequence
  SiRNA target sequence
tatctcctttatttattcgg

SEQ ID NO: 226464 - DNA, 20 bp, Artificial sequence
  SiRNA target sequence
atctcctttatttattcggt

SEQ ID NO: 226465 - DNA, 20 bp, Artificial sequence
  SiRNA target sequence
tctcctttatttattcggtg

SEQ ID NO: 226466 - DNA, 20 bp, Artificial sequence
  SiRNA target sequence
ctcctttatttattcggtgg

SEQ ID NO: 226467 - DNA, 20 bp, Artificial sequence
  SiRNA target sequence
tcctttatttattcggtggc

SEQ ID NO: 226468 - DNA, 20 bp, Artificial sequence
  SiRNA target sequence
cctttatttattcggtggct

SEQ ID NO: 226469 - DNA, 20 bp, Artificial sequence
  SiRNA target sequence
ctttatttattcggtggcta

SEQ ID NO: 226470 - DNA, 20 bp, Artificial sequence
  SiRNA target sequence
tttatttattcggtggctag

SEQ ID NO: 226471 - DNA, 20 bp, Artificial sequence
  SiRNA target sequence
ttatttattcggtggctaga

SEQ ID NO: 226472 - DNA, 20 bp, Artificial sequence
  SiRNA target sequence
tatttattcggtggctagag

SEQ ID NO: 226473 - DNA, 20 bp, Artificial sequence
  SiRNA target sequence
atttattcggtggctagagt

SEQ ID NO: 226474 - DNA, 20 bp, Artificial sequence
  SiRNA target sequence
tttattcggtggctagagtg

SEQ ID NO: 226475 - DNA, 20 bp, Artificial sequence
  SiRNA target sequence
ttattcggtggctagagtgc

SEQ ID NO: 226476 - DNA, 20 bp, Artificial sequence
  SiRNA target sequence
tattcggtggctagagtgct

SEQ ID NO: 226477 - DNA, 20 bp, Artificial sequence
  SiRNA target sequence
attcggtggctagagtgctt

SEQ ID NO: 226478 - DNA, 20 bp, Artificial sequence
  SiRNA target sequence
ttcggtggctagagtgctta

SEQ ID NO: 226479 - DNA, 20 bp, Artificial sequence
  SiRNA target sequence
tcggtggctagagtgcttaa

SEQ ID NO: 226480 - DNA, 20 bp, Artificial sequence
  SiRNA target sequence
cggtggctagagtgcttaaa

SEQ ID NO: 226481 - DNA, 20 bp, Artificial sequence
  SiRNA target sequence
ggtggctagagtgcttaaag

SEQ ID NO: 226482 - DNA, 20 bp, Artificial sequence
  SiRNA target sequence
gtggctagagtgcttaaaga

SEQ ID NO: 226483 - DNA, 20 bp, Artificial sequence
  SiRNA target sequence
tggctagagtgcttaaagat

SEQ ID NO: 226484 - DNA, 20 bp, Artificial sequence
  SiRNA target sequence
ggctagagtgcttaaagatg

SEQ ID NO: 226485 - DNA, 20 bp, Artificial sequence
  SiRNA target sequence
gctagagtgcttaaagatgc

SEQ ID NO: 226486 - DNA, 20 bp, Artificial sequence
  SiRNA target sequence
ctagagtgcttaaagatgcc

SEQ ID NO: 226487 - DNA, 20 bp, Artificial sequence
  SiRNA target sequence
tagagtgcttaaagatgccg

SEQ ID NO: 226488 - DNA, 20 bp, Artificial sequence
  SiRNA target sequence
agagtgcttaaagatgccgc

SEQ ID NO: 226489 - DNA, 20 bp, Artificial sequence
  SiRNA target sequence
gagtgcttaaagatgccgct

SEQ ID NO: 226490 - DNA, 20 bp, Artificial sequence
  SiRNA target sequence
agtgcttaaagatgccgctg

SEQ ID NO: 226491 - DNA, 20 bp, Artificial sequence
  SiRNA target sequence
gtgcttaaagatgccgctgt

SEQ ID NO: 226492 - DNA, 20 bp, Artificial sequence
  SiRNA target sequence
tgcttaaagatgccgctgtt

SEQ ID NO: 226493 - DNA, 20 bp, Artificial sequence
  SiRNA target sequence
gcttaaagatgccgctgtta

SEQ ID NO: 226494 - DNA, 20 bp, Artificial sequence
  SiRNA target sequence
cttaaagatgccgctgttat

SEQ ID NO: 226495 - DNA, 20 bp, Artificial sequence
  SiRNA target sequence
ttaaagatgccgctgttatt

SEQ ID NO: 226496 - DNA, 20 bp, Artificial sequence
  SiRNA target sequence
taaagatgccgctgttattg

SEQ ID NO: 226497 - DNA, 20 bp, Artificial sequence
  SiRNA target sequence
aaagatgccgctgttattgg

SEQ ID NO: 226498 - DNA, 20 bp, Artificial sequence
  SiRNA target sequence
aagatgccgctgttattggt

SEQ ID NO: 226499 - DNA, 20 bp, Artificial sequence
  SiRNA target sequence
agatgccgctgttattggta

SEQ ID NO: 226500 - DNA, 20 bp, Artificial sequence
  SiRNA target sequence
gatgccgctgttattggtaa

SEQ ID NO: 226501 - DNA, 20 bp, Artificial sequence
  SiRNA target sequence
atgccgctgttattggtaaa

SEQ ID NO: 226502 - DNA, 20 bp, Artificial sequence
  SiRNA target sequence
tgccgctgttattggtaaac

SEQ ID NO: 226503 - DNA, 20 bp, Artificial sequence
  SiRNA target sequence
gccgctgttattggtaaaca

SEQ ID NO: 226504 - DNA, 20 bp, Artificial sequence
  SiRNA target sequence
ccgctgttattggtaaacaa

SEQ ID NO: 226505 - DNA, 20 bp, Artificial sequence
  SiRNA target sequence
cgctgttattggtaaacaac

SEQ ID NO: 226506 - DNA, 20 bp, Artificial sequence
  SiRNA target sequence
gctgttattggtaaacaact

SEQ ID NO: 226507 - DNA, 20 bp, Artificial sequence
  SiRNA target sequence
ctgttattggtaaacaactc

SEQ ID NO: 226508 - DNA, 20 bp, Artificial sequence
  SiRNA target sequence
tgttattggtaaacaactcc

SEQ ID NO: 226509 - DNA, 20 bp, Artificial sequence
  SiRNA target sequence
gttattggtaaacaactccc

SEQ ID NO: 226510 - DNA, 20 bp, Artificial sequence
  SiRNA target sequence
ttattggtaaacaactccca

SEQ ID NO: 226511 - DNA, 20 bp, Artificial sequence
  SiRNA target sequence
tattggtaaacaactcccag

SEQ ID NO: 226512 - DNA, 20 bp, Artificial sequence
  SiRNA target sequence
attggtaaacaactcccagc

SEQ ID NO: 226513 - DNA, 20 bp, Artificial sequence
  SiRNA target sequence
ttggtaaacaactcccagcg

SEQ ID NO: 226514 - DNA, 20 bp, Artificial sequence
  SiRNA target sequence
tggtaaacaactcccagcgt

SEQ ID NO: 226515 - DNA, 20 bp, Artificial sequence
  SiRNA target sequence
ggtaaacaactcccagcgtc

SEQ ID NO: 226516 - DNA, 20 bp, Artificial sequence
  SiRNA target sequence
gtaaacaactcccagcgtca

SEQ ID NO: 226517 - DNA, 20 bp, Artificial sequence
  SiRNA target sequence
taaacaactcccagcgtcaa

SEQ ID NO: 226518 - DNA, 20 bp, Artificial sequence
  SiRNA target sequence
aaacaactcccagcgtcaat

SEQ ID NO: 226519 - DNA, 20 bp, Artificial sequence
  SiRNA target sequence
aacaactcccagcgtcaatt

SEQ ID NO: 226520 - DNA, 20 bp, Artificial sequence
  SiRNA target sequence
acaactcccagcgtcaattt

SEQ ID NO: 226521 - DNA, 20 bp, Artificial sequence
  SiRNA target sequence
caactcccagcgtcaatttt

SEQ ID NO: 226522 - DNA, 20 bp, Artificial sequence
  SiRNA target sequence
aactcccagcgtcaattttc

SEQ ID NO: 226523 - DNA, 20 bp, Artificial sequence
  SiRNA target sequence
actcccagcgtcaattttct

SEQ ID NO: 226524 - DNA, 20 bp, Artificial sequence
  SiRNA target sequence
ctcccagcgtcaattttctt

SEQ ID NO: 226525 - DNA, 20 bp, Artificial sequence
  SiRNA target sequence
tcccagcgtcaattttcttt

SEQ ID NO: 226526 - DNA, 20 bp, Artificial sequence
  SiRNA target sequence
cccagcgtcaattttctttt

SEQ ID NO: 226527 - DNA, 20 bp, Artificial sequence
  SiRNA target sequence
ccagcgtcaattttcttttt

SEQ ID NO: 226528 - DNA, 20 bp, Artificial sequence
  SiRNA target sequence
cagcgtcaattttctttttg

SEQ ID NO: 226529 - DNA, 20 bp, Artificial sequence
  SiRNA target sequence
agcgtcaattttctttttga

SEQ ID NO: 226530 - DNA, 20 bp, Artificial sequence
  SiRNA target sequence
gcgtcaattttctttttgaa

SEQ ID NO: 226531 - DNA, 20 bp, Artificial sequence
  SiRNA target sequence
cgtcaattttctttttgaaa

SEQ ID NO: 226532 - DNA, 20 bp, Artificial sequence
  SiRNA target sequence
gtcaattttctttttgaaat

SEQ ID NO: 226533 - DNA, 20 bp, Artificial sequence
  SiRNA target sequence
tcaattttctttttgaaatt

SEQ ID NO: 226534 - DNA, 20 bp, Artificial sequence
  SiRNA target sequence
caattttctttttgaaattt

SEQ ID NO: 226535 - DNA, 20 bp, Artificial sequence
  SiRNA target sequence
aattttctttttgaaatttg

SEQ ID NO: 226536 - DNA, 20 bp, Artificial sequence
  SiRNA target sequence
attttctttttgaaatttgt

SEQ ID NO: 226537 - DNA, 20 bp, Artificial sequence
  SiRNA target sequence
ttttctttttgaaatttgtt

SEQ ID NO: 226538 - DNA, 20 bp, Artificial sequence
  SiRNA target sequence
tttctttttgaaatttgtta

SEQ ID NO: 226539 - DNA, 20 bp, Artificial sequence
  SiRNA target sequence
ttctttttgaaatttgttat

SEQ ID NO: 226540 - DNA, 20 bp, Artificial sequence
  SiRNA target sequence
tctttttgaaatttgttatt

SEQ ID NO: 226541 - DNA, 20 bp, Artificial sequence
  SiRNA target sequence
ctttttgaaatttgttatta

SEQ ID NO: 226542 - DNA, 20 bp, Artificial sequence
  SiRNA target sequence
tttttgaaatttgttattat

SEQ ID NO: 226543 - DNA, 20 bp, Artificial sequence
  SiRNA target sequence
ttttgaaatttgttattatc

SEQ ID NO: 226544 - DNA, 20 bp, Artificial sequence
  SiRNA target sequence
tttgaaatttgttattatcc

SEQ ID NO: 226545 - DNA, 20 bp, Artificial sequence
  SiRNA target sequence
ttgaaatttgttattatcct

SEQ ID NO: 226546 - DNA, 20 bp, Artificial sequence
  SiRNA target sequence
tgaaatttgttattatcctt

SEQ ID NO: 226547 - DNA, 20 bp, Artificial sequence
  SiRNA target sequence
gaaatttgttattatccttc

SEQ ID NO: 226548 - DNA, 20 bp, Artificial sequence
  SiRNA target sequence
aaatttgttattatccttcc

SEQ ID NO: 226549 - DNA, 20 bp, Artificial sequence
  SiRNA target sequence
aatttgttattatccttccg

SEQ ID NO: 226550 - DNA, 20 bp, Artificial sequence
  SiRNA target sequence
atttgttattatccttccgt

SEQ ID NO: 226551 - DNA, 20 bp, Artificial sequence
  SiRNA target sequence
tttgttattatccttccgtt

SEQ ID NO: 226552 - DNA, 20 bp, Artificial sequence
  SiRNA target sequence
ttgttattatccttccgttc

SEQ ID NO: 226553 - DNA, 20 bp, Artificial sequence
  SiRNA target sequence
tgttattatccttccgttct

SEQ ID NO: 226554 - DNA, 20 bp, Artificial sequence
  SiRNA target sequence
gttattatccttccgttctc

SEQ ID NO: 226555 - DNA, 20 bp, Artificial sequence
  SiRNA target sequence
ttattatccttccgttctca

SEQ ID NO: 226556 - DNA, 20 bp, Artificial sequence
  SiRNA target sequence
tattatccttccgttctcat

SEQ ID NO: 226557 - DNA, 20 bp, Artificial sequence
  SiRNA target sequence
attatccttccgttctcatt

SEQ ID NO: 226558 - DNA, 20 bp, Artificial sequence
  SiRNA target sequence
ttatccttccgttctcattt

SEQ ID NO: 226559 - DNA, 20 bp, Artificial sequence
  SiRNA target sequence
tatccttccgttctcattta

SEQ ID NO: 226560 - DNA, 20 bp, Artificial sequence
  SiRNA target sequence
atccttccgttctcatttat

SEQ ID NO: 226561 - DNA, 20 bp, Artificial sequence
  SiRNA target sequence
tccttccgttctcatttatt

SEQ ID NO: 226562 - DNA, 20 bp, Artificial sequence
  SiRNA target sequence
ccttccgttctcatttattt

SEQ ID NO: 226563 - DNA, 20 bp, Artificial sequence
  SiRNA target sequence
cttccgttctcatttatttc

SEQ ID NO: 226564 - DNA, 20 bp, Artificial sequence
  SiRNA target sequence
ttccgttctcatttatttca

SEQ ID NO: 226565 - DNA, 20 bp, Artificial sequence
  SiRNA target sequence
tccgttctcatttatttcag

SEQ ID NO: 226566 - DNA, 20 bp, Artificial sequence
  SiRNA target sequence
ccgttctcatttatttcagt

SEQ ID NO: 226567 - DNA, 20 bp, Artificial sequence
  SiRNA target sequence
cgttctcatttatttcagta

SEQ ID NO: 226568 - DNA, 20 bp, Artificial sequence
  SiRNA target sequence
gttctcatttatttcagtag

SEQ ID NO: 226569 - DNA, 20 bp, Artificial sequence
  SiRNA target sequence
ttctcatttatttcagtagg

SEQ ID NO: 226570 - DNA, 20 bp, Artificial sequence
  SiRNA target sequence
tctcatttatttcagtaggt

SEQ ID NO: 226571 - DNA, 20 bp, Artificial sequence
  SiRNA target sequence
ctcatttatttcagtaggta

SEQ ID NO: 226572 - DNA, 20 bp, Artificial sequence
  SiRNA target sequence
tcatttatttcagtaggtat

SEQ ID NO: 226573 - DNA, 20 bp, Artificial sequence
  SiRNA target sequence
catttatttcagtaggtatt

SEQ ID NO: 226574 - DNA, 20 bp, Artificial sequence
  SiRNA target sequence
atttatttcagtaggtatta

SEQ ID NO: 226575 - DNA, 20 bp, Artificial sequence
  SiRNA target sequence
tttatttcagtaggtattat

SEQ ID NO: 226576 - DNA, 20 bp, Artificial sequence
  SiRNA target sequence
ttatttcagtaggtattatt

SEQ ID NO: 226577 - DNA, 20 bp, Artificial sequence
  SiRNA target sequence
tatttcagtaggtattattc

SEQ ID NO: 226578 - DNA, 20 bp, Artificial sequence
  SiRNA target sequence
atttcagtaggtattattca

SEQ ID NO: 226579 - DNA, 20 bp, Artificial sequence
  SiRNA target sequence
tttcagtaggtattattcag

SEQ ID NO: 226580 - DNA, 20 bp, Artificial sequence
  SiRNA target sequence
ttcagtaggtattattcaga

SEQ ID NO: 226581 - DNA, 20 bp, Artificial sequence
  SiRNA target sequence
tcagtaggtattattcagaa

SEQ ID NO: 226582 - DNA, 20 bp, Artificial sequence
  SiRNA target sequence
cagtaggtattattcagaaa

SEQ ID NO: 226583 - DNA, 20 bp, Artificial sequence
  SiRNA target sequence
agtaggtattattcagaaag

SEQ ID NO: 226584 - DNA, 20 bp, Artificial sequence
  SiRNA target sequence
gtaggtattattcagaaagc

SEQ ID NO: 226585 - DNA, 20 bp, Artificial sequence
  SiRNA target sequence
taggtattattcagaaagct

SEQ ID NO: 226586 - DNA, 20 bp, Artificial sequence
  SiRNA target sequence
aggtattattcagaaagctt

SEQ ID NO: 226587 - DNA, 20 bp, Artificial sequence
  SiRNA target sequence
ggtattattcagaaagcttt

SEQ ID NO: 226588 - DNA, 20 bp, Artificial sequence
  SiRNA target sequence
gtattattcagaaagcttta

SEQ ID NO: 226589 - DNA, 20 bp, Artificial sequence
  SiRNA target sequence
tattattcagaaagctttag

SEQ ID NO: 226590 - DNA, 20 bp, Artificial sequence
  SiRNA target sequence
attattcagaaagctttaga

SEQ ID NO: 226591 - DNA, 20 bp, Artificial sequence
  SiRNA target sequence
ttattcagaaagctttagat

SEQ ID NO: 226592 - DNA, 20 bp, Artificial sequence
  SiRNA target sequence
tattcagaaagctttagata

SEQ ID NO: 226593 - DNA, 20 bp, Artificial sequence
  SiRNA target sequence
attcagaaagctttagataa

SEQ ID NO: 226594 - DNA, 20 bp, Artificial sequence
  SiRNA target sequence
ttcagaaagctttagataaa

SEQ ID NO: 226595 - DNA, 20 bp, Artificial sequence
  SiRNA target sequence
tcagaaagctttagataaat

SEQ ID NO: 226596 - DNA, 20 bp, Artificial sequence
  SiRNA target sequence
cagaaagctttagataaata

SEQ ID NO: 226597 - DNA, 20 bp, Artificial sequence
  SiRNA target sequence
agaaagctttagataaatat

SEQ ID NO: 226598 - DNA, 20 bp, Artificial sequence
  SiRNA target sequence
gaaagctttagataaatatc

SEQ ID NO: 226599 - DNA, 20 bp, Artificial sequence
  SiRNA target sequence
aaagctttagataaatatcc

SEQ ID NO: 226600 - DNA, 20 bp, Artificial sequence
  SiRNA target sequence
aagctttagataaatatcct

SEQ ID NO: 226601 - DNA, 20 bp, Artificial sequence
  SiRNA target sequence
agctttagataaatatcctt

SEQ ID NO: 226602 - DNA, 20 bp, Artificial sequence
  SiRNA target sequence
gctttagataaatatccttt

SEQ ID NO: 226603 - DNA, 20 bp, Artificial sequence
  SiRNA target sequence
ctttagataaatatcctttt

SEQ ID NO: 226604 - DNA, 20 bp, Artificial sequence
  SiRNA target sequence
tttagataaatatcctttta

SEQ ID NO: 226605 - DNA, 20 bp, Artificial sequence
  SiRNA target sequence
ttagataaatatccttttac

SEQ ID NO: 226606 - DNA, 20 bp, Artificial sequence
  SiRNA target sequence
tagataaatatccttttaca

SEQ ID NO: 226607 - DNA, 20 bp, Artificial sequence
  SiRNA target sequence
agataaatatccttttacaa

SEQ ID NO: 226608 - DNA, 20 bp, Artificial sequence
  SiRNA target sequence
gataaatatccttttacaaa

SEQ ID NO: 226609 - DNA, 20 bp, Artificial sequence
  SiRNA target sequence
ataaatatccttttacaaaa

SEQ ID NO: 226610 - DNA, 20 bp, Artificial sequence
  SiRNA target sequence
taaatatccttttacaaaaa

SEQ ID NO: 226611 - DNA, 20 bp, Artificial sequence
  SiRNA target sequence
aaatatccttttacaaaaat

SEQ ID NO: 226612 - DNA, 20 bp, Artificial sequence
  SiRNA target sequence
aatatccttttacaaaaata

SEQ ID NO: 226613 - DNA, 20 bp, Artificial sequence
  SiRNA target sequence
atatccttttacaaaaatat

SEQ ID NO: 226614 - DNA, 20 bp, Artificial sequence
  SiRNA target sequence
tatccttttacaaaaatatt

SEQ ID NO: 226615 - DNA, 20 bp, Artificial sequence
  SiRNA target sequence
atccttttacaaaaatattt

SEQ ID NO: 226616 - DNA, 20 bp, Artificial sequence
  SiRNA target sequence
tccttttacaaaaatatttg

SEQ ID NO: 226617 - DNA, 20 bp, Artificial sequence
  SiRNA target sequence
ccttttacaaaaatatttga

SEQ ID NO: 226618 - DNA, 20 bp, Artificial sequence
  SiRNA target sequence
cttttacaaaaatatttgat

SEQ ID NO: 226619 - DNA, 20 bp, Artificial sequence
  SiRNA target sequence
ttttacaaaaatatttgatg

SEQ ID NO: 226620 - DNA, 20 bp, Artificial sequence
  SiRNA target sequence
tttacaaaaatatttgatgt

SEQ ID NO: 226621 - DNA, 20 bp, Artificial sequence
  SiRNA target sequence
ttacaaaaatatttgatgta

SEQ ID NO: 226622 - DNA, 20 bp, Artificial sequence
  SiRNA target sequence
tacaaaaatatttgatgtaa

SEQ ID NO: 226623 - DNA, 20 bp, Artificial sequence
  SiRNA target sequence
acaaaaatatttgatgtaac

SEQ ID NO: 226624 - DNA, 20 bp, Artificial sequence
  SiRNA target sequence
caaaaatatttgatgtaact

SEQ ID NO: 226625 - DNA, 20 bp, Artificial sequence
  SiRNA target sequence
aaaaatatttgatgtaactt

SEQ ID NO: 226626 - DNA, 20 bp, Artificial sequence
  SiRNA target sequence
aaaatatttgatgtaacttt

SEQ ID NO: 226627 - DNA, 20 bp, Artificial sequence
  SiRNA target sequence
aaatatttgatgtaacttta

SEQ ID NO: 226628 - DNA, 20 bp, Artificial sequence
  SiRNA target sequence
aatatttgatgtaactttaa

SEQ ID NO: 226629 - DNA, 20 bp, Artificial sequence
  SiRNA target sequence
atatttgatgtaactttaat

SEQ ID NO: 226630 - DNA, 20 bp, Artificial sequence
  SiRNA target sequence
tatttgatgtaactttaata

SEQ ID NO: 226631 - DNA, 20 bp, Artificial sequence
  SiRNA target sequence
atttgatgtaactttaatag

SEQ ID NO: 226632 - DNA, 20 bp, Artificial sequence
  SiRNA target sequence
tttgatgtaactttaatagt

SEQ ID NO: 226633 - DNA, 20 bp, Artificial sequence
  SiRNA target sequence
ttgatgtaactttaatagtt

SEQ ID NO: 226634 - DNA, 20 bp, Artificial sequence
  SiRNA target sequence
tgatgtaactttaatagttt

SEQ ID NO: 226635 - DNA, 20 bp, Artificial sequence
  SiRNA target sequence
gatgtaactttaatagtttt

SEQ ID NO: 226636 - DNA, 20 bp, Artificial sequence
  SiRNA target sequence
atgtaactttaatagttttc

SEQ ID NO: 226637 - DNA, 20 bp, Artificial sequence
  SiRNA target sequence
tgtaactttaatagttttcg

SEQ ID NO: 226638 - DNA, 20 bp, Artificial sequence
  SiRNA target sequence
gtaactttaatagttttcgc

SEQ ID NO: 226639 - DNA, 20 bp, Artificial sequence
  SiRNA target sequence
taactttaatagttttcgct

SEQ ID NO: 226640 - DNA, 20 bp, Artificial sequence
  SiRNA target sequence
aactttaatagttttcgctg

SEQ ID NO: 226641 - DNA, 20 bp, Artificial sequence
  SiRNA target sequence
actttaatagttttcgctgt

SEQ ID NO: 226642 - DNA, 20 bp, Artificial sequence
  SiRNA target sequence
ctttaatagttttcgctgtt

SEQ ID NO: 226643 - DNA, 20 bp, Artificial sequence
  SiRNA target sequence
tttaatagttttcgctgttg

SEQ ID NO: 226644 - DNA, 20 bp, Artificial sequence
  SiRNA target sequence
ttaatagttttcgctgttgc

SEQ ID NO: 226645 - DNA, 20 bp, Artificial sequence
  SiRNA target sequence
taatagttttcgctgttgca

SEQ ID NO: 226646 - DNA, 20 bp, Artificial sequence
  SiRNA target sequence
aatagttttcgctgttgcat

SEQ ID NO: 226647 - DNA, 20 bp, Artificial sequence
  SiRNA target sequence
atagttttcgctgttgcatt

SEQ ID NO: 226648 - DNA, 20 bp, Artificial sequence
  SiRNA target sequence
tagttttcgctgttgcattt

SEQ ID NO: 226649 - DNA, 20 bp, Artificial sequence
  SiRNA target sequence
agttttcgctgttgcattta

SEQ ID NO: 226650 - DNA, 20 bp, Artificial sequence
  SiRNA target sequence
gttttcgctgttgcatttac

SEQ ID NO: 226651 - DNA, 20 bp, Artificial sequence
  SiRNA target sequence
ttttcgctgttgcatttact

SEQ ID NO: 226652 - DNA, 20 bp, Artificial sequence
  SiRNA target sequence
tttcgctgttgcatttacta

SEQ ID NO: 226653 - DNA, 20 bp, Artificial sequence
  SiRNA target sequence
ttcgctgttgcatttactat

SEQ ID NO: 226654 - DNA, 20 bp, Artificial sequence
  SiRNA target sequence
tcgctgttgcatttactata

SEQ ID NO: 226655 - DNA, 20 bp, Artificial sequence
  SiRNA target sequence
cgctgttgcatttactatac

SEQ ID NO: 226656 - DNA, 20 bp, Artificial sequence
  SiRNA target sequence
gctgttgcatttactatact

SEQ ID NO: 226657 - DNA, 20 bp, Artificial sequence
  SiRNA target sequence
ctgttgcatttactatactt

SEQ ID NO: 226658 - DNA, 20 bp, Artificial sequence
  SiRNA target sequence
tgttgcatttactatacttg

SEQ ID NO: 226659 - DNA, 20 bp, Artificial sequence
  SiRNA target sequence
gttgcatttactatacttgg

SEQ ID NO: 226660 - DNA, 20 bp, Artificial sequence
  SiRNA target sequence
ttgcatttactatacttggt

SEQ ID NO: 226661 - DNA, 20 bp, Artificial sequence
  SiRNA target sequence
tgcatttactatacttggta

SEQ ID NO: 226662 - DNA, 20 bp, Artificial sequence
  SiRNA target sequence
gcatttactatacttggtag

SEQ ID NO: 226663 - DNA, 20 bp, Artificial sequence
  SiRNA target sequence
catttactatacttggtagt

SEQ ID NO: 226664 - DNA, 20 bp, Artificial sequence
  SiRNA target sequence
atttactatacttggtagtt

SEQ ID NO: 226665 - DNA, 20 bp, Artificial sequence
  SiRNA target sequence
tttactatacttggtagttt

SEQ ID NO: 226666 - DNA, 20 bp, Artificial sequence
  SiRNA target sequence
ttactatacttggtagttta

SEQ ID NO: 226667 - DNA, 20 bp, Artificial sequence
  SiRNA target sequence
tactatacttggtagtttat

SEQ ID NO: 226668 - DNA, 20 bp, Artificial sequence
  SiRNA target sequence
actatacttggtagtttatt

SEQ ID NO: 226669 - DNA, 20 bp, Artificial sequence
  SiRNA target sequence
ctatacttggtagtttatta

SEQ ID NO: 226670 - DNA, 20 bp, Artificial sequence
  SiRNA target sequence
tatacttggtagtttattac

SEQ ID NO: 226671 - DNA, 20 bp, Artificial sequence
  SiRNA target sequence
atacttggtagtttattact

SEQ ID NO: 226672 - DNA, 20 bp, Artificial sequence
  SiRNA target sequence
tacttggtagtttattactt

SEQ ID NO: 226673 - DNA, 20 bp, Artificial sequence
  SiRNA target sequence
acttggtagtttattacttc

SEQ ID NO: 226674 - DNA, 20 bp, Artificial sequence
  SiRNA target sequence
cttggtagtttattacttcc

SEQ ID NO: 226675 - DNA, 20 bp, Artificial sequence
  SiRNA target sequence
ttggtagtttattacttccc

SEQ ID NO: 226676 - DNA, 20 bp, Artificial sequence
  SiRNA target sequence
tggtagtttattacttccct

SEQ ID NO: 226677 - DNA, 20 bp, Artificial sequence
  SiRNA target sequence
ggtagtttattacttccctt

SEQ ID NO: 226678 - DNA, 20 bp, Artificial sequence
  SiRNA target sequence
gtagtttattacttcccttt

SEQ ID NO: 226679 - DNA, 20 bp, Artificial sequence
  SiRNA target sequence
tagtttattacttcccttta

SEQ ID NO: 226680 - DNA, 20 bp, Artificial sequence
  SiRNA target sequence
agtttattacttccctttag

SEQ ID NO: 226681 - DNA, 20 bp, Artificial sequence
  SiRNA target sequence
gtttattacttccctttagt

SEQ ID NO: 226682 - DNA, 20 bp, Artificial sequence
  SiRNA target sequence
tttattacttccctttagtg

SEQ ID NO: 226683 - DNA, 20 bp, Artificial sequence
  SiRNA target sequence
ttattacttccctttagtga

SEQ ID NO: 226684 - DNA, 20 bp, Artificial sequence
  SiRNA target sequence
tattacttccctttagtgat

SEQ ID NO: 226685 - DNA, 20 bp, Artificial sequence
  SiRNA target sequence
attacttccctttagtgatt

SEQ ID NO: 226686 - DNA, 20 bp, Artificial sequence
  SiRNA target sequence
ttacttccctttagtgatta

SEQ ID NO: 226687 - DNA, 20 bp, Artificial sequence
  SiRNA target sequence
tacttccctttagtgattat

SEQ ID NO: 226688 - DNA, 20 bp, Artificial sequence
  SiRNA target sequence
acttccctttagtgattata

SEQ ID NO: 226689 - DNA, 20 bp, Artificial sequence
  SiRNA target sequence
cttccctttagtgattatat

SEQ ID NO: 226690 - DNA, 20 bp, Artificial sequence
  SiRNA target sequence
ttccctttagtgattatatt

SEQ ID NO: 226691 - DNA, 20 bp, Artificial sequence
  SiRNA target sequence
tccctttagtgattatattc

SEQ ID NO: 226692 - DNA, 20 bp, Artificial sequence
  SiRNA target sequence
ccctttagtgattatattca

SEQ ID NO: 226693 - DNA, 20 bp, Artificial sequence
  SiRNA target sequence
cctttagtgattatattcag

SEQ ID NO: 226694 - DNA, 20 bp, Artificial sequence
  SiRNA target sequence
ctttagtgattatattcaga

SEQ ID NO: 226695 - DNA, 20 bp, Artificial sequence
  SiRNA target sequence
tttagtgattatattcagat

SEQ ID NO: 226696 - DNA, 20 bp, Artificial sequence
  SiRNA target sequence
ttagtgattatattcagatt

SEQ ID NO: 226697 - DNA, 20 bp, Artificial sequence
  SiRNA target sequence
tagtgattatattcagattc

SEQ ID NO: 226698 - DNA, 20 bp, Artificial sequence
  SiRNA target sequence
agtgattatattcagattca

SEQ ID NO: 226699 - DNA, 20 bp, Artificial sequence
  SiRNA target sequence
gtgattatattcagattcaa

SEQ ID NO: 226700 - DNA, 20 bp, Artificial sequence
  SiRNA target sequence
tgattatattcagattcaac

SEQ ID NO: 226701 - DNA, 20 bp, Artificial sequence
  SiRNA target sequence
gattatattcagattcaacc

SEQ ID NO: 226702 - DNA, 20 bp, Artificial sequence
  SiRNA target sequence
attatattcagattcaaccg

SEQ ID NO: 226703 - DNA, 20 bp, Artificial sequence
  SiRNA target sequence
ttatattcagattcaaccgt

SEQ ID NO: 226704 - DNA, 20 bp, Artificial sequence
  SiRNA target sequence
tatattcagattcaaccgtt

SEQ ID NO: 226705 - DNA, 20 bp, Artificial sequence
  SiRNA target sequence
atattcagattcaaccgttt

SEQ ID NO: 226706 - DNA, 20 bp, Artificial sequence
  SiRNA target sequence
tattcagattcaaccgtttt

SEQ ID NO: 226707 - DNA, 20 bp, Artificial sequence
  SiRNA target sequence
attcagattcaaccgttttg

SEQ ID NO: 226708 - DNA, 20 bp, Artificial sequence
  SiRNA target sequence
ttcagattcaaccgttttgg

SEQ ID NO: 226709 - DNA, 20 bp, Artificial sequence
  SiRNA target sequence
tcagattcaaccgttttggg

SEQ ID NO: 226710 - DNA, 20 bp, Artificial sequence
  SiRNA target sequence
cagattcaaccgttttgggc

SEQ ID NO: 226711 - DNA, 20 bp, Artificial sequence
  SiRNA target sequence
agattcaaccgttttgggcc

SEQ ID NO: 226712 - DNA, 20 bp, Artificial sequence
  SiRNA target sequence
gattcaaccgttttgggcca

SEQ ID NO: 226713 - DNA, 20 bp, Artificial sequence
  SiRNA target sequence
attcaaccgttttgggccaa

SEQ ID NO: 226714 - DNA, 20 bp, Artificial sequence
  SiRNA target sequence
ttcaaccgttttgggccaaa

SEQ ID NO: 226715 - DNA, 20 bp, Artificial sequence
  SiRNA target sequence
tcaaccgttttgggccaaag

SEQ ID NO: 226716 - DNA, 20 bp, Artificial sequence
  SiRNA target sequence
caaccgttttgggccaaaga

SEQ ID NO: 226717 - DNA, 20 bp, Artificial sequence
  SiRNA target sequence
aaccgttttgggccaaagat

SEQ ID NO: 226718 - DNA, 20 bp, Artificial sequence
  SiRNA target sequence
accgttttgggccaaagata

SEQ ID NO: 226719 - DNA, 20 bp, Artificial sequence
  SiRNA target sequence
ccgttttgggccaaagatat

SEQ ID NO: 226720 - DNA, 20 bp, Artificial sequence
  SiRNA target sequence
cgttttgggccaaagatatt

SEQ ID NO: 226721 - DNA, 20 bp, Artificial sequence
  SiRNA target sequence
gttttgggccaaagatattt

SEQ ID NO: 226722 - DNA, 20 bp, Artificial sequence
  SiRNA target sequence
ttttgggccaaagatatttt

SEQ ID NO: 226723 - DNA, 20 bp, Artificial sequence
  SiRNA target sequence
tttgggccaaagatattttt

SEQ ID NO: 226724 - DNA, 20 bp, Artificial sequence
  SiRNA target sequence
ttgggccaaagatatttttg

SEQ ID NO: 226725 - DNA, 20 bp, Artificial sequence
  SiRNA target sequence
tgggccaaagatatttttgc

SEQ ID NO: 226726 - DNA, 20 bp, Artificial sequence
  SiRNA target sequence
gggccaaagatatttttgct

SEQ ID NO: 226727 - DNA, 20 bp, Artificial sequence
  SiRNA target sequence
ggccaaagatatttttgctg

SEQ ID NO: 226728 - DNA, 20 bp, Artificial sequence
  SiRNA target sequence
gccaaagatatttttgctga

SEQ ID NO: 226729 - DNA, 20 bp, Artificial sequence
  SiRNA target sequence
ccaaagatatttttgctgat

SEQ ID NO: 226730 - DNA, 20 bp, Artificial sequence
  SiRNA target sequence
caaagatatttttgctgatg

SEQ ID NO: 226731 - DNA, 20 bp, Artificial sequence
  SiRNA target sequence
aaagatatttttgctgatgg

SEQ ID NO: 226732 - DNA, 20 bp, Artificial sequence
  SiRNA target sequence
aagatatttttgctgatgga

SEQ ID NO: 226733 - DNA, 20 bp, Artificial sequence
  SiRNA target sequence
agatatttttgctgatggaa

SEQ ID NO: 226734 - DNA, 20 bp, Artificial sequence
  SiRNA target sequence
gatatttttgctgatggaaa

SEQ ID NO: 226735 - DNA, 20 bp, Artificial sequence
  SiRNA target sequence
atatttttgctgatggaaaa

SEQ ID NO: 226736 - DNA, 20 bp, Artificial sequence
  SiRNA target sequence
tatttttgctgatggaaaag

SEQ ID NO: 226737 - DNA, 20 bp, Artificial sequence
  SiRNA target sequence
atttttgctgatggaaaagc

SEQ ID NO: 226738 - DNA, 20 bp, Artificial sequence
  SiRNA target sequence
tttttgctgatggaaaagct

SEQ ID NO: 226739 - DNA, 20 bp, Artificial sequence
  SiRNA target sequence
ttttgctgatggaaaagctg

SEQ ID NO: 226740 - DNA, 20 bp, Artificial sequence
  SiRNA target sequence
tttgctgatggaaaagctgt

SEQ ID NO: 226741 - DNA, 20 bp, Artificial sequence
  SiRNA target sequence
ttgctgatggaaaagctgtt

SEQ ID NO: 226742 - DNA, 20 bp, Artificial sequence
  SiRNA target sequence
tgctgatggaaaagctgttg

SEQ ID NO: 226743 - DNA, 20 bp, Artificial sequence
  SiRNA target sequence
gctgatggaaaagctgttgc

SEQ ID NO: 226744 - DNA, 20 bp, Artificial sequence
  SiRNA target sequence
ctgatggaaaagctgttgcc

SEQ ID NO: 226745 - DNA, 20 bp, Artificial sequence
  SiRNA target sequence
tgatggaaaagctgttgcca

SEQ ID NO: 226746 - DNA, 20 bp, Artificial sequence
  SiRNA target sequence
gatggaaaagctgttgccag

SEQ ID NO: 226747 - DNA, 20 bp, Artificial sequence
  SiRNA target sequence
atggaaaagctgttgccaga

SEQ ID NO: 226748 - DNA, 20 bp, Artificial sequence
  SiRNA target sequence
tggaaaagctgttgccagaa

SEQ ID NO: 226749 - DNA, 20 bp, Artificial sequence
  SiRNA target sequence
ggaaaagctgttgccagaag

SEQ ID NO: 226750 - DNA, 20 bp, Artificial sequence
  SiRNA target sequence
gaaaagctgttgccagaagt

SEQ ID NO: 226751 - DNA, 20 bp, Artificial sequence
  SiRNA target sequence
aaaagctgttgccagaagta

SEQ ID NO: 226752 - DNA, 20 bp, Artificial sequence
  SiRNA target sequence
aaagctgttgccagaagtac

SEQ ID NO: 226753 - DNA, 20 bp, Artificial sequence
  SiRNA target sequence
aagctgttgccagaagtaca

SEQ ID NO: 226754 - DNA, 20 bp, Artificial sequence
  SiRNA target sequence
agctgttgccagaagtacag

SEQ ID NO: 226755 - DNA, 20 bp, Artificial sequence
  SiRNA target sequence
gctgttgccagaagtacaga

SEQ ID NO: 226756 - DNA, 20 bp, Artificial sequence
  SiRNA target sequence
ctgttgccagaagtacagat

SEQ ID NO: 226757 - DNA, 20 bp, Artificial sequence
  SiRNA target sequence
tgttgccagaagtacagatt

SEQ ID NO: 226758 - DNA, 20 bp, Artificial sequence
  SiRNA target sequence
gttgccagaagtacagattt

SEQ ID NO: 226759 - DNA, 20 bp, Artificial sequence
  SiRNA target sequence
ttgccagaagtacagatttt

SEQ ID NO: 226760 - DNA, 20 bp, Artificial sequence
  SiRNA target sequence
tgccagaagtacagattttt

SEQ ID NO: 226761 - DNA, 20 bp, Artificial sequence
  SiRNA target sequence
gccagaagtacagatttttt

SEQ ID NO: 226762 - DNA, 20 bp, Artificial sequence
  SiRNA target sequence
ccagaagtacagatttttta

SEQ ID NO: 226763 - DNA, 20 bp, Artificial sequence
  SiRNA target sequence
cagaagtacagattttttat

SEQ ID NO: 226764 - DNA, 20 bp, Artificial sequence
  SiRNA target sequence
agaagtacagattttttatt

SEQ ID NO: 226765 - DNA, 20 bp, Artificial sequence
  SiRNA target sequence
gaagtacagattttttattt

SEQ ID NO: 226766 - DNA, 20 bp, Artificial sequence
  SiRNA target sequence
aagtacagattttttatttt

SEQ ID NO: 226767 - DNA, 20 bp, Artificial sequence
  SiRNA target sequence
agtacagattttttattttc

SEQ ID NO: 226768 - DNA, 20 bp, Artificial sequence
  SiRNA target sequence
gtacagattttttattttct

SEQ ID NO: 226769 - DNA, 20 bp, Artificial sequence
  SiRNA target sequence
tacagattttttattttcta

SEQ ID NO: 226770 - DNA, 20 bp, Artificial sequence
  SiRNA target sequence
acagattttttattttctat

SEQ ID NO: 226771 - DNA, 20 bp, Artificial sequence
  SiRNA target sequence
cagattttttattttctatt

SEQ ID NO: 226772 - DNA, 20 bp, Artificial sequence
  SiRNA target sequence
agattttttattttctattg

SEQ ID NO: 226773 - DNA, 20 bp, Artificial sequence
  SiRNA target sequence
gattttttattttctattgc

SEQ ID NO: 226774 - DNA, 20 bp, Artificial sequence
  SiRNA target sequence
attttttattttctattgca

SEQ ID NO: 226775 - DNA, 20 bp, Artificial sequence
  SiRNA target sequence
ttttttattttctattgcac

SEQ ID NO: 226776 - DNA, 20 bp, Artificial sequence
  SiRNA target sequence
tttttattttctattgcact

SEQ ID NO: 226777 - DNA, 20 bp, Artificial sequence
  SiRNA target sequence
ttttattttctattgcactt

SEQ ID NO: 226778 - DNA, 20 bp, Artificial sequence
  SiRNA target sequence
tttattttctattgcacttg

SEQ ID NO: 226779 - DNA, 20 bp, Artificial sequence
  SiRNA target sequence
ttattttctattgcacttgt

SEQ ID NO: 226780 - DNA, 20 bp, Artificial sequence
  SiRNA target sequence
tattttctattgcacttgtt

SEQ ID NO: 226781 - DNA, 20 bp, Artificial sequence
  SiRNA target sequence
attttctattgcacttgttt

SEQ ID NO: 226782 - DNA, 20 bp, Artificial sequence
  SiRNA target sequence
ttttctattgcacttgtttt

SEQ ID NO: 226783 - DNA, 20 bp, Artificial sequence
  SiRNA target sequence
tttctattgcacttgttttc

SEQ ID NO: 226784 - DNA, 20 bp, Artificial sequence
  SiRNA target sequence
ttctattgcacttgttttca

SEQ ID NO: 226785 - DNA, 20 bp, Artificial sequence
  SiRNA target sequence
tctattgcacttgttttcaa

SEQ ID NO: 226786 - DNA, 20 bp, Artificial sequence
  SiRNA target sequence
ctattgcacttgttttcaat

SEQ ID NO: 226787 - DNA, 20 bp, Artificial sequence
  SiRNA target sequence
tattgcacttgttttcaatg

SEQ ID NO: 226788 - DNA, 20 bp, Artificial sequence
  SiRNA target sequence
attgcacttgttttcaatga

SEQ ID NO: 226789 - DNA, 20 bp, Artificial sequence
  SiRNA target sequence
ttgcacttgttttcaatgaa

SEQ ID NO: 226790 - DNA, 20 bp, Artificial sequence
  SiRNA target sequence
tgcacttgttttcaatgaat

SEQ ID NO: 226791 - DNA, 20 bp, Artificial sequence
  SiRNA target sequence
gcacttgttttcaatgaatg

SEQ ID NO: 226792 - DNA, 20 bp, Artificial sequence
  SiRNA target sequence
cacttgttttcaatgaatgg

SEQ ID NO: 226793 - DNA, 20 bp, Artificial sequence
  SiRNA target sequence
acttgttttcaatgaatgga

SEQ ID NO: 226794 - DNA, 20 bp, Artificial sequence
  SiRNA target sequence
cttgttttcaatgaatggac

SEQ ID NO: 226795 - DNA, 20 bp, Artificial sequence
  SiRNA target sequence
ttgttttcaatgaatggaca

SEQ ID NO: 226796 - DNA, 20 bp, Artificial sequence
  SiRNA target sequence
tgttttcaatgaatggacaa

SEQ ID NO: 226797 - DNA, 20 bp, Artificial sequence
  SiRNA target sequence
gttttcaatgaatggacaag

SEQ ID NO: 226798 - DNA, 20 bp, Artificial sequence
  SiRNA target sequence
ttttcaatgaatggacaagt

SEQ ID NO: 226799 - DNA, 20 bp, Artificial sequence
  SiRNA target sequence
tttcaatgaatggacaagtt

SEQ ID NO: 226800 - DNA, 20 bp, Artificial sequence
  SiRNA target sequence
ttcaatgaatggacaagttc

SEQ ID NO: 226801 - DNA, 20 bp, Artificial sequence
  SiRNA target sequence
tcaatgaatggacaagttct

SEQ ID NO: 226802 - DNA, 20 bp, Artificial sequence
  SiRNA target sequence
caatgaatggacaagttctg

SEQ ID NO: 226803 - DNA, 20 bp, Artificial sequence
  SiRNA target sequence
aatgaatggacaagttctgc

SEQ ID NO: 226804 - DNA, 20 bp, Artificial sequence
  SiRNA target sequence
atgaatggacaagttctgct

SEQ ID NO: 226805 - DNA, 20 bp, Artificial sequence
  SiRNA target sequence
tgaatggacaagttctgcta

SEQ ID NO: 226806 - DNA, 20 bp, Artificial sequence
  SiRNA target sequence
gaatggacaagttctgctat

SEQ ID NO: 226807 - DNA, 20 bp, Artificial sequence
  SiRNA target sequence
aatggacaagttctgctatc

SEQ ID NO: 226808 - DNA, 20 bp, Artificial sequence
  SiRNA target sequence
atggacaagttctgctatct

SEQ ID NO: 226809 - DNA, 20 bp, Artificial sequence
  SiRNA target sequence
tggacaagttctgctatcta

SEQ ID NO: 226810 - DNA, 20 bp, Artificial sequence
  SiRNA target sequence
ggacaagttctgctatctat

SEQ ID NO: 226811 - DNA, 20 bp, Artificial sequence
  SiRNA target sequence
gacaagttctgctatctatg

SEQ ID NO: 226812 - DNA, 20 bp, Artificial sequence
  SiRNA target sequence
acaagttctgctatctatgt

SEQ ID NO: 226813 - DNA, 20 bp, Artificial sequence
  SiRNA target sequence
caagttctgctatctatgtt

SEQ ID NO: 226814 - DNA, 20 bp, Artificial sequence
  SiRNA target sequence
aagttctgctatctatgttt

SEQ ID NO: 226815 - DNA, 20 bp, Artificial sequence
  SiRNA target sequence
agttctgctatctatgtttt

SEQ ID NO: 226816 - DNA, 20 bp, Artificial sequence
  SiRNA target sequence
gttctgctatctatgtttta

SEQ ID NO: 226817 - DNA, 20 bp, Artificial sequence
  SiRNA target sequence
ttctgctatctatgttttat

SEQ ID NO: 226818 - DNA, 20 bp, Artificial sequence
  SiRNA target sequence
tctgctatctatgttttatc

SEQ ID NO: 226819 - DNA, 20 bp, Artificial sequence
  SiRNA target sequence
ctgctatctatgttttatct

SEQ ID NO: 226820 - DNA, 20 bp, Artificial sequence
  SiRNA target sequence
tgctatctatgttttatctg

SEQ ID NO: 226821 - DNA, 20 bp, Artificial sequence
  SiRNA target sequence
gctatctatgttttatctga

SEQ ID NO: 226822 - DNA, 20 bp, Artificial sequence
  SiRNA target sequence
ctatctatgttttatctgaa

SEQ ID NO: 226823 - DNA, 20 bp, Artificial sequence
  SiRNA target sequence
tatctatgttttatctgaaa

SEQ ID NO: 226824 - DNA, 20 bp, Artificial sequence
  SiRNA target sequence
atctatgttttatctgaaat

SEQ ID NO: 226825 - DNA, 20 bp, Artificial sequence
  SiRNA target sequence
tctatgttttatctgaaatg

SEQ ID NO: 226826 - DNA, 20 bp, Artificial sequence
  SiRNA target sequence
ctatgttttatctgaaatgt

SEQ ID NO: 226827 - DNA, 20 bp, Artificial sequence
  SiRNA target sequence
tatgttttatctgaaatgtt

SEQ ID NO: 226828 - DNA, 20 bp, Artificial sequence
  SiRNA target sequence
atgttttatctgaaatgttt

SEQ ID NO: 226829 - DNA, 20 bp, Artificial sequence
  SiRNA target sequence
tgttttatctgaaatgtttg

SEQ ID NO: 226830 - DNA, 20 bp, Artificial sequence
  SiRNA target sequence
gttttatctgaaatgtttgg

SEQ ID NO: 226831 - DNA, 20 bp, Artificial sequence
  SiRNA target sequence
ttttatctgaaatgtttggt

SEQ ID NO: 226832 - DNA, 20 bp, Artificial sequence
  SiRNA target sequence
tttatctgaaatgtttggta

SEQ ID NO: 226833 - DNA, 20 bp, Artificial sequence
  SiRNA target sequence
ttatctgaaatgtttggtag

SEQ ID NO: 226834 - DNA, 20 bp, Artificial sequence
  SiRNA target sequence
tatctgaaatgtttggtagt

SEQ ID NO: 226835 - DNA, 20 bp, Artificial sequence
  SiRNA target sequence
atctgaaatgtttggtagtt

SEQ ID NO: 226836 - DNA, 20 bp, Artificial sequence
  SiRNA target sequence
tctgaaatgtttggtagttt

SEQ ID NO: 226837 - DNA, 20 bp, Artificial sequence
  SiRNA target sequence
ctgaaatgtttggtagtttg

SEQ ID NO: 226838 - DNA, 20 bp, Artificial sequence
  SiRNA target sequence
tgaaatgtttggtagtttga

SEQ ID NO: 226839 - DNA, 20 bp, Artificial sequence
  SiRNA target sequence
gaaatgtttggtagtttgat

SEQ ID NO: 226840 - DNA, 20 bp, Artificial sequence
  SiRNA target sequence
aaatgtttggtagtttgatt

SEQ ID NO: 226841 - DNA, 20 bp, Artificial sequence
  SiRNA target sequence
aatgtttggtagtttgattc

SEQ ID NO: 226842 - DNA, 20 bp, Artificial sequence
  SiRNA target sequence
atgtttggtagtttgattct

SEQ ID NO: 226843 - DNA, 20 bp, Artificial sequence
  SiRNA target sequence
tgtttggtagtttgattctt

SEQ ID NO: 226844 - DNA, 20 bp, Artificial sequence
  SiRNA target sequence
gtttggtagtttgattcttt

SEQ ID NO: 226845 - DNA, 20 bp, Artificial sequence
  SiRNA target sequence
tttggtagtttgattctttc

SEQ ID NO: 226846 - DNA, 20 bp, Artificial sequence
  SiRNA target sequence
ttggtagtttgattctttca

SEQ ID NO: 226847 - DNA, 20 bp, Artificial sequence
  SiRNA target sequence
tggtagtttgattctttcat

SEQ ID NO: 226848 - DNA, 20 bp, Artificial sequence
  SiRNA target sequence
ggtagtttgattctttcata

SEQ ID NO: 226849 - DNA, 20 bp, Artificial sequence
  SiRNA target sequence
gtagtttgattctttcatat

SEQ ID NO: 226850 - DNA, 20 bp, Artificial sequence
  SiRNA target sequence
tagtttgattctttcatatt

SEQ ID NO: 226851 - DNA, 20 bp, Artificial sequence
  SiRNA target sequence
agtttgattctttcatattt

SEQ ID NO: 226852 - DNA, 20 bp, Artificial sequence
  SiRNA target sequence
gtttgattctttcatattta

SEQ ID NO: 226853 - DNA, 20 bp, Artificial sequence
  SiRNA target sequence
tttgattctttcatatttat

SEQ ID NO: 226854 - DNA, 20 bp, Artificial sequence
  SiRNA target sequence
ttgattctttcatatttatt

SEQ ID NO: 226855 - DNA, 20 bp, Artificial sequence
  SiRNA target sequence
tgattctttcatatttattt

SEQ ID NO: 226856 - DNA, 20 bp, Artificial sequence
  SiRNA target sequence
gattctttcatatttattta

SEQ ID NO: 226857 - DNA, 20 bp, Artificial sequence
  SiRNA target sequence
attctttcatatttatttat

SEQ ID NO: 226858 - DNA, 20 bp, Artificial sequence
  SiRNA target sequence
ttctttcatatttatttatg

SEQ ID NO: 226859 - DNA, 20 bp, Artificial sequence
  SiRNA target sequence
tctttcatatttatttatga

SEQ ID NO: 226860 - DNA, 20 bp, Artificial sequence
  SiRNA target sequence
ctttcatatttatttatgac

SEQ ID NO: 226861 - DNA, 20 bp, Artificial sequence
  SiRNA target sequence
tttcatatttatttatgacg

SEQ ID NO: 226862 - DNA, 20 bp, Artificial sequence
  SiRNA target sequence
ttcatatttatttatgacgt

SEQ ID NO: 226863 - DNA, 20 bp, Artificial sequence
  SiRNA target sequence
tcatatttatttatgacgtt

SEQ ID NO: 226864 - DNA, 20 bp, Artificial sequence
  SiRNA target sequence
catatttatttatgacgttt

SEQ ID NO: 226865 - DNA, 20 bp, Artificial sequence
  SiRNA target sequence
atatttatttatgacgtttg

SEQ ID NO: 226866 - DNA, 20 bp, Artificial sequence
  SiRNA target sequence
tatttatttatgacgtttgc

SEQ ID NO: 226867 - DNA, 20 bp, Artificial sequence
  SiRNA target sequence
atttatttatgacgtttgct

SEQ ID NO: 226868 - DNA, 20 bp, Artificial sequence
  SiRNA target sequence
tttatttatgacgtttgcta

SEQ ID NO: 226869 - DNA, 20 bp, Artificial sequence
  SiRNA target sequence
ttatttatgacgtttgctaa

SEQ ID NO: 226870 - DNA, 20 bp, Artificial sequence
  SiRNA target sequence
tatttatgacgtttgctaat

SEQ ID NO: 226871 - DNA, 20 bp, Artificial sequence
  SiRNA target sequence
atttatgacgtttgctaatg

SEQ ID NO: 226872 - DNA, 20 bp, Artificial sequence
  SiRNA target sequence
tttatgacgtttgctaatgg

SEQ ID NO: 226873 - DNA, 20 bp, Artificial sequence
  SiRNA target sequence
ttatgacgtttgctaatggt

SEQ ID NO: 226874 - DNA, 20 bp, Artificial sequence
  SiRNA target sequence
tatgacgtttgctaatggtc

SEQ ID NO: 226875 - DNA, 20 bp, Artificial sequence
  SiRNA target sequence
atgacgtttgctaatggtct

SEQ ID NO: 226876 - DNA, 20 bp, Artificial sequence
  SiRNA target sequence
tgacgtttgctaatggtctt

SEQ ID NO: 226877 - DNA, 20 bp, Artificial sequence
  SiRNA target sequence
gacgtttgctaatggtcttt

SEQ ID NO: 226878 - DNA, 20 bp, Artificial sequence
  SiRNA target sequence
acgtttgctaatggtctttc

SEQ ID NO: 226879 - DNA, 20 bp, Artificial sequence
  SiRNA target sequence
cgtttgctaatggtctttcg

SEQ ID NO: 226880 - DNA, 20 bp, Artificial sequence
  SiRNA target sequence
gtttgctaatggtctttcga

SEQ ID NO: 226881 - DNA, 20 bp, Artificial sequence
  SiRNA target sequence
tttgctaatggtctttcgac

SEQ ID NO: 226882 - DNA, 20 bp, Artificial sequence
  SiRNA target sequence
ttgctaatggtctttcgact

SEQ ID NO: 226883 - DNA, 20 bp, Artificial sequence
  SiRNA target sequence
tgctaatggtctttcgactc

SEQ ID NO: 226884 - DNA, 20 bp, Artificial sequence
  SiRNA target sequence
gctaatggtctttcgactcc

SEQ ID NO: 226885 - DNA, 20 bp, Artificial sequence
  SiRNA target sequence
ctaatggtctttcgactcct

SEQ ID NO: 226886 - DNA, 20 bp, Artificial sequence
  SiRNA target sequence
taatggtctttcgactcctg

SEQ ID NO: 226887 - DNA, 20 bp, Artificial sequence
  SiRNA target sequence
aatggtctttcgactcctgg

SEQ ID NO: 226888 - DNA, 20 bp, Artificial sequence
  SiRNA target sequence
atggtctttcgactcctgga

SEQ ID NO: 226889 - DNA, 20 bp, Artificial sequence
  SiRNA target sequence
tggtctttcgactcctggac

SEQ ID NO: 226890 - DNA, 20 bp, Artificial sequence
  SiRNA target sequence
ggtctttcgactcctggaca

SEQ ID NO: 226891 - DNA, 20 bp, Artificial sequence
  SiRNA target sequence
gtctttcgactcctggacag

SEQ ID NO: 226892 - DNA, 20 bp, Artificial sequence
  SiRNA target sequence
tctttcgactcctggacagt

SEQ ID NO: 226893 - DNA, 20 bp, Artificial sequence
  SiRNA target sequence
ctttcgactcctggacagtc

SEQ ID NO: 226894 - DNA, 20 bp, Artificial sequence
  SiRNA target sequence
tttcgactcctggacagtcc

SEQ ID NO: 226895 - DNA, 20 bp, Artificial sequence
  SiRNA target sequence
ttcgactcctggacagtccg

SEQ ID NO: 226896 - DNA, 20 bp, Artificial sequence
  SiRNA target sequence
tcgactcctggacagtccgc

SEQ ID NO: 226897 - DNA, 20 bp, Artificial sequence
  SiRNA target sequence
cgactcctggacagtccgct

SEQ ID NO: 226898 - DNA, 20 bp, Artificial sequence
  SiRNA target sequence
gactcctggacagtccgcta

SEQ ID NO: 226899 - DNA, 20 bp, Artificial sequence
  SiRNA target sequence
actcctggacagtccgctag

SEQ ID NO: 226900 - DNA, 20 bp, Artificial sequence
  SiRNA target sequence
ctcctggacagtccgctaga

SEQ ID NO: 226901 - DNA, 20 bp, Artificial sequence
  SiRNA target sequence
tcctggacagtccgctagat

SEQ ID NO: 226902 - DNA, 20 bp, Artificial sequence
  SiRNA target sequence
cctggacagtccgctagatt

SEQ ID NO: 226903 - DNA, 20 bp, Artificial sequence
  SiRNA target sequence
ctggacagtccgctagattt

SEQ ID NO: 226904 - DNA, 20 bp, Artificial sequence
  SiRNA target sequence
tggacagtccgctagatttg

SEQ ID NO: 226905 - DNA, 20 bp, Artificial sequence
  SiRNA target sequence
ggacagtccgctagatttgt

SEQ ID NO: 226906 - DNA, 20 bp, Artificial sequence
  SiRNA target sequence
gacagtccgctagatttgtc

SEQ ID NO: 226907 - DNA, 20 bp, Artificial sequence
  SiRNA target sequence
acagtccgctagatttgtcc

SEQ ID NO: 226908 - DNA, 20 bp, Artificial sequence
  SiRNA target sequence
cagtccgctagatttgtccc

SEQ ID NO: 226909 - DNA, 20 bp, Artificial sequence
  SiRNA target sequence
agtccgctagatttgtccct

SEQ ID NO: 226910 - DNA, 20 bp, Artificial sequence
  SiRNA target sequence
gtccgctagatttgtccctt

SEQ ID NO: 226911 - DNA, 20 bp, Artificial sequence
  SiRNA target sequence
tccgctagatttgtcccttt

SEQ ID NO: 226912 - DNA, 20 bp, Artificial sequence
  SiRNA target sequence
ccgctagatttgtcccttta

SEQ ID NO: 226913 - DNA, 20 bp, Artificial sequence
  SiRNA target sequence
cgctagatttgtccctttat

SEQ ID NO: 226914 - DNA, 20 bp, Artificial sequence
  SiRNA target sequence
gctagatttgtccctttatt

SEQ ID NO: 226915 - DNA, 20 bp, Artificial sequence
  SiRNA target sequence
ctagatttgtccctttattt

SEQ ID NO: 226916 - DNA, 20 bp, Artificial sequence
  SiRNA target sequence
tagatttgtccctttatttt

SEQ ID NO: 226917 - DNA, 20 bp, Artificial sequence
  SiRNA target sequence
agatttgtccctttatttta

SEQ ID NO: 226918 - DNA, 20 bp, Artificial sequence
  SiRNA target sequence
gatttgtccctttattttat

SEQ ID NO: 226919 - DNA, 20 bp, Artificial sequence
  SiRNA target sequence
atttgtccctttattttatg

SEQ ID NO: 226920 - DNA, 20 bp, Artificial sequence
  SiRNA target sequence
tttgtccctttattttatgt

SEQ ID NO: 226921 - DNA, 20 bp, Artificial sequence
  SiRNA target sequence
ttgtccctttattttatgtt

SEQ ID NO: 226922 - DNA, 20 bp, Artificial sequence
  SiRNA target sequence
tgtccctttattttatgttg

SEQ ID NO: 226923 - DNA, 20 bp, Artificial sequence
  SiRNA target sequence
gtccctttattttatgttgg

SEQ ID NO: 226924 - DNA, 20 bp, Artificial sequence
  SiRNA target sequence
tccctttattttatgttgga

SEQ ID NO: 226925 - DNA, 20 bp, Artificial sequence
  SiRNA target sequence
ccctttattttatgttggat

SEQ ID NO: 226926 - DNA, 20 bp, Artificial sequence
  SiRNA target sequence
cctttattttatgttggatc

SEQ ID NO: 226927 - DNA, 20 bp, Artificial sequence
  SiRNA target sequence
ctttattttatgttggatct

SEQ ID NO: 226928 - DNA, 20 bp, Artificial sequence
  SiRNA target sequence
tttattttatgttggatcta

SEQ ID NO: 226929 - DNA, 20 bp, Artificial sequence
  SiRNA target sequence
ttattttatgttggatctaa

SEQ ID NO: 226930 - DNA, 20 bp, Artificial sequence
  SiRNA target sequence
tattttatgttggatctaat

SEQ ID NO: 226931 - DNA, 20 bp, Artificial sequence
  SiRNA target sequence
attttatgttggatctaatt

SEQ ID NO: 226932 - DNA, 20 bp, Artificial sequence
  SiRNA target sequence
ttttatgttggatctaattt

SEQ ID NO: 226933 - DNA, 20 bp, Artificial sequence
  SiRNA target sequence
tttatgttggatctaatttg

SEQ ID NO: 226934 - DNA, 20 bp, Artificial sequence
  SiRNA target sequence
ttatgttggatctaatttgg

SEQ ID NO: 226935 - DNA, 20 bp, Artificial sequence
  SiRNA target sequence
tatgttggatctaatttggc

SEQ ID NO: 226936 - DNA, 20 bp, Artificial sequence
  SiRNA target sequence
atgttggatctaatttggct

SEQ ID NO: 226937 - DNA, 20 bp, Artificial sequence
  SiRNA target sequence
tgttggatctaatttggctt

SEQ ID NO: 226938 - DNA, 20 bp, Artificial sequence
  SiRNA target sequence
gttggatctaatttggcttt

SEQ ID NO: 226939 - DNA, 20 bp, Artificial sequence
  SiRNA target sequence
ttggatctaatttggcttta

SEQ ID NO: 226940 - DNA, 20 bp, Artificial sequence
  SiRNA target sequence
tggatctaatttggctttac

SEQ ID NO: 226941 - DNA, 20 bp, Artificial sequence
  SiRNA target sequence
ggatctaatttggctttact

SEQ ID NO: 226942 - DNA, 20 bp, Artificial sequence
  SiRNA target sequence
gatctaatttggctttactt

SEQ ID NO: 226943 - DNA, 20 bp, Artificial sequence
  SiRNA target sequence
atctaatttggctttacttc

SEQ ID NO: 226944 - DNA, 20 bp, Artificial sequence
  SiRNA target sequence
tctaatttggctttacttct

SEQ ID NO: 226945 - DNA, 20 bp, Artificial sequence
  SiRNA target sequence
ctaatttggctttacttctt

SEQ ID NO: 226946 - DNA, 20 bp, Artificial sequence
  SiRNA target sequence
taatttggctttacttcttt

SEQ ID NO: 226947 - DNA, 20 bp, Artificial sequence
  SiRNA target sequence
aatttggctttacttctttc

SEQ ID NO: 226948 - DNA, 20 bp, Artificial sequence
  SiRNA target sequence
atttggctttacttctttca

SEQ ID NO: 226949 - DNA, 20 bp, Artificial sequence
  SiRNA target sequence
tttggctttacttctttcag

SEQ ID NO: 226950 - DNA, 20 bp, Artificial sequence
  SiRNA target sequence
ttggctttacttctttcagg

SEQ ID NO: 226951 - DNA, 20 bp, Artificial sequence
  SiRNA target sequence
tggctttacttctttcagga

SEQ ID NO: 226952 - DNA, 20 bp, Artificial sequence
  SiRNA target sequence
ggctttacttctttcaggaa

SEQ ID NO: 226953 - DNA, 20 bp, Artificial sequence
  SiRNA target sequence
gctttacttctttcaggaat

SEQ ID NO: 226954 - DNA, 20 bp, Artificial sequence
  SiRNA target sequence
ctttacttctttcaggaatg

SEQ ID NO: 226955 - DNA, 20 bp, Artificial sequence
  SiRNA target sequence
tttacttctttcaggaatga

SEQ ID NO: 226956 - DNA, 20 bp, Artificial sequence
  SiRNA target sequence
ttacttctttcaggaatgat

SEQ ID NO: 226957 - DNA, 20 bp, Artificial sequence
  SiRNA target sequence
tacttctttcaggaatgata

SEQ ID NO: 226958 - DNA, 20 bp, Artificial sequence
  SiRNA target sequence
acttctttcaggaatgataa

SEQ ID NO: 226959 - DNA, 20 bp, Artificial sequence
  SiRNA target sequence
cttctttcaggaatgataaa

SEQ ID NO: 226960 - DNA, 20 bp, Artificial sequence
  SiRNA target sequence
ttctttcaggaatgataaat

SEQ ID NO: 226961 - DNA, 20 bp, Artificial sequence
  SiRNA target sequence
tctttcaggaatgataaatt

SEQ ID NO: 226962 - DNA, 20 bp, Artificial sequence
  SiRNA target sequence
ctttcaggaatgataaatta

SEQ ID NO: 226963 - DNA, 20 bp, Artificial sequence
  SiRNA target sequence
tttcaggaatgataaattac

SEQ ID NO: 226964 - DNA, 20 bp, Artificial sequence
  SiRNA target sequence
ttcaggaatgataaattact

SEQ ID NO: 226965 - DNA, 20 bp, Artificial sequence
  SiRNA target sequence
tcaggaatgataaattactt

SEQ ID NO: 226966 - DNA, 20 bp, Artificial sequence
  SiRNA target sequence
caggaatgataaattacttt

SEQ ID NO: 226967 - DNA, 20 bp, Artificial sequence
  SiRNA target sequence
aggaatgataaattactttt

SEQ ID NO: 226968 - DNA, 20 bp, Artificial sequence
  SiRNA target sequence
ggaatgataaattactttta

SEQ ID NO: 226969 - DNA, 20 bp, Artificial sequence
  SiRNA target sequence
gaatgataaattacttttat

SEQ ID NO: 226970 - DNA, 20 bp, Artificial sequence
  SiRNA target sequence
aatgataaattacttttata

SEQ ID NO: 226971 - DNA, 20 bp, Artificial sequence
  SiRNA target sequence
atgataaattacttttatag

SEQ ID NO: 226972 - DNA, 20 bp, Artificial sequence
  SiRNA target sequence
tgataaattacttttatagt

SEQ ID NO: 226973 - DNA, 20 bp, Artificial sequence
  SiRNA target sequence
gataaattacttttatagtg

SEQ ID NO: 226974 - DNA, 20 bp, Artificial sequence
  SiRNA target sequence
ataaattacttttatagtgt

SEQ ID NO: 226975 - DNA, 20 bp, Artificial sequence
  SiRNA target sequence
taaattacttttatagtgta

SEQ ID NO: 226976 - DNA, 20 bp, Artificial sequence
  SiRNA target sequence
aaattacttttatagtgtaa

SEQ ID NO: 226977 - DNA, 20 bp, Artificial sequence
  SiRNA target sequence
aattacttttatagtgtaag

SEQ ID NO: 226978 - DNA, 20 bp, Artificial sequence
  SiRNA target sequence
attacttttatagtgtaagt

SEQ ID NO: 226979 - DNA, 20 bp, Artificial sequence
  SiRNA target sequence
ttacttttatagtgtaagta

SEQ ID NO: 226980 - DNA, 20 bp, Artificial sequence
  SiRNA target sequence
tacttttatagtgtaagtaa

SEQ ID NO: 226981 - DNA, 20 bp, Artificial sequence
  SiRNA target sequence
acttttatagtgtaagtaaa

SEQ ID NO: 226982 - DNA, 20 bp, Artificial sequence
  SiRNA target sequence
cttttatagtgtaagtaaat

SEQ ID NO: 226983 - DNA, 20 bp, Artificial sequence
  SiRNA target sequence
ttttatagtgtaagtaaatc

SEQ ID NO: 226984 - DNA, 20 bp, Artificial sequence
  SiRNA target sequence
tttatagtgtaagtaaatct

SEQ ID NO: 226985 - DNA, 20 bp, Artificial sequence
  SiRNA target sequence
ttatagtgtaagtaaatcta

SEQ ID NO: 226986 - DNA, 20 bp, Artificial sequence
  SiRNA target sequence
tatagtgtaagtaaatctaa

SEQ ID NO: 226987 - DNA, 20 bp, Artificial sequence
  SiRNA target sequence
atagtgtaagtaaatctaaa

SEQ ID NO: 226988 - DNA, 20 bp, Artificial sequence
  SiRNA target sequence
tagtgtaagtaaatctaaaa

SEQ ID NO: 226989 - DNA, 20 bp, Artificial sequence
  SiRNA target sequence
agtgtaagtaaatctaaaat

SEQ ID NO: 226990 - DNA, 20 bp, Artificial sequence
  SiRNA target sequence
gtgtaagtaaatctaaaatg

SEQ ID NO: 226991 - DNA, 20 bp, Artificial sequence
  SiRNA target sequence
tgtaagtaaatctaaaatgt

SEQ ID NO: 226992 - DNA, 20 bp, Artificial sequence
  SiRNA target sequence
gtaagtaaatctaaaatgtc

SEQ ID NO: 226993 - DNA, 20 bp, Artificial sequence
  SiRNA target sequence
taagtaaatctaaaatgtcg

SEQ ID NO: 226994 - DNA, 20 bp, Artificial sequence
  SiRNA target sequence
aagtaaatctaaaatgtcgt

SEQ ID NO: 226995 - DNA, 20 bp, Artificial sequence
  SiRNA target sequence
agtaaatctaaaatgtcgta

SEQ ID NO: 226996 - DNA, 20 bp, Artificial sequence
  SiRNA target sequence
gtaaatctaaaatgtcgtat

SEQ ID NO: 226997 - DNA, 20 bp, Artificial sequence
  SiRNA target sequence
taaatctaaaatgtcgtatg

SEQ ID NO: 226998 - DNA, 20 bp, Artificial sequence
  SiRNA target sequence
aaatctaaaatgtcgtatgt

SEQ ID NO: 226999 - DNA, 20 bp, Artificial sequence
  SiRNA target sequence
aatctaaaatgtcgtatgtt

SEQ ID NO: 227000 - DNA, 20 bp, Artificial sequence
  SiRNA target sequence
atctaaaatgtcgtatgttg

SEQ ID NO: 227001 - DNA, 20 bp, Artificial sequence
  SiRNA target sequence
tctaaaatgtcgtatgttgc

SEQ ID NO: 227002 - DNA, 20 bp, Artificial sequence
  SiRNA target sequence
ctaaaatgtcgtatgttgcg

SEQ ID NO: 227003 - DNA, 20 bp, Artificial sequence
  SiRNA target sequence
taaaatgtcgtatgttgcgg

SEQ ID NO: 227004 - DNA, 20 bp, Artificial sequence
  SiRNA target sequence
aaaatgtcgtatgttgcggc

SEQ ID NO: 227005 - DNA, 20 bp, Artificial sequence
  SiRNA target sequence
aaatgtcgtatgttgcggcc

SEQ ID NO: 227006 - DNA, 20 bp, Artificial sequence
  SiRNA target sequence
aatgtcgtatgttgcggccg

SEQ ID NO: 227007 - DNA, 20 bp, Artificial sequence
  SiRNA target sequence
atgtcgtatgttgcggccga

SEQ ID NO: 227008 - DNA, 20 bp, Artificial sequence
  SiRNA target sequence
tgtcgtatgttgcggccgaa

SEQ ID NO: 227009 - DNA, 20 bp, Artificial sequence
  SiRNA target sequence
gtcgtatgttgcggccgaaa

SEQ ID NO: 227010 - DNA, 20 bp, Artificial sequence
  SiRNA target sequence
tcgtatgttgcggccgaaag

SEQ ID NO: 227011 - DNA, 20 bp, Artificial sequence
  SiRNA target sequence
cgtatgttgcggccgaaaga

SEQ ID NO: 227012 - DNA, 20 bp, Artificial sequence
  SiRNA target sequence
gtatgttgcggccgaaagat

SEQ ID NO: 227013 - DNA, 20 bp, Artificial sequence
  SiRNA target sequence
tatgttgcggccgaaagatt

SEQ ID NO: 227014 - DNA, 20 bp, Artificial sequence
  SiRNA target sequence
atgttgcggccgaaagattt

SEQ ID NO: 227015 - DNA, 20 bp, Artificial sequence
  SiRNA target sequence
tgttgcggccgaaagatttt

SEQ ID NO: 227016 - DNA, 20 bp, Artificial sequence
  SiRNA target sequence
gttgcggccgaaagattttt

SEQ ID NO: 227017 - DNA, 20 bp, Artificial sequence
  SiRNA target sequence
ttgcggccgaaagatttttt

SEQ ID NO: 227018 - DNA, 20 bp, Artificial sequence
  SiRNA target sequence
tgcggccgaaagatttttta

SEQ ID NO: 227019 - DNA, 20 bp, Artificial sequence
  SiRNA target sequence
gcggccgaaagattttttaa

SEQ ID NO: 227020 - DNA, 20 bp, Artificial sequence
  SiRNA target sequence
cggccgaaagattttttaat

SEQ ID NO: 227021 - DNA, 20 bp, Artificial sequence
  SiRNA target sequence
ggccgaaagattttttaatg

SEQ ID NO: 227022 - DNA, 20 bp, Artificial sequence
  SiRNA target sequence
gccgaaagattttttaatgg

SEQ ID NO: 227023 - DNA, 20 bp, Artificial sequence
  SiRNA target sequence
ccgaaagattttttaatgga

SEQ ID NO: 227024 - DNA, 20 bp, Artificial sequence
  SiRNA target sequence
cgaaagattttttaatggat

SEQ ID NO: 227025 - DNA, 20 bp, Artificial sequence
  SiRNA target sequence
gaaagattttttaatggatt

SEQ ID NO: 227026 - DNA, 20 bp, Artificial sequence
  SiRNA target sequence
aaagattttttaatggattt

SEQ ID NO: 227027 - DNA, 20 bp, Artificial sequence
  SiRNA target sequence
aagattttttaatggatttt

SEQ ID NO: 227028 - DNA, 20 bp, Artificial sequence
  SiRNA target sequence
agattttttaatggattttt

SEQ ID NO: 227029 - DNA, 20 bp, Artificial sequence
  SiRNA target sequence
gattttttaatggatttttt

SEQ ID NO: 227030 - DNA, 20 bp, Artificial sequence
  SiRNA target sequence
attttttaatggattttttt

SEQ ID NO: 227031 - DNA, 20 bp, Artificial sequence
  SiRNA target sequence
ttttttaatggatttttttg

SEQ ID NO: 227032 - DNA, 20 bp, Artificial sequence
  SiRNA target sequence
tttttaatggatttttttgt

SEQ ID NO: 227033 - DNA, 20 bp, Artificial sequence
  SiRNA target sequence
ttttaatggatttttttgtc

SEQ ID NO: 227034 - DNA, 20 bp, Artificial sequence
  SiRNA target sequence
tttaatggatttttttgtct

SEQ ID NO: 227035 - DNA, 20 bp, Artificial sequence
  SiRNA target sequence
ttaatggatttttttgtctg

SEQ ID NO: 227036 - DNA, 20 bp, Artificial sequence
  SiRNA target sequence
taatggatttttttgtctga

SEQ ID NO: 227037 - DNA, 20 bp, Artificial sequence
  SiRNA target sequence
aatggatttttttgtctgag

SEQ ID NO: 227038 - DNA, 20 bp, Artificial sequence
  SiRNA target sequence
atggatttttttgtctgagt

SEQ ID NO: 227039 - DNA, 20 bp, Artificial sequence
  SiRNA target sequence
tggatttttttgtctgagtg

SEQ ID NO: 227040 - DNA, 20 bp, Artificial sequence
  SiRNA target sequence
ggatttttttgtctgagtgg

SEQ ID NO: 227041 - DNA, 20 bp, Artificial sequence
  SiRNA target sequence
gatttttttgtctgagtgga

SEQ ID NO: 227042 - DNA, 20 bp, Artificial sequence
  SiRNA target sequence
atttttttgtctgagtggaa

SEQ ID NO: 227043 - DNA, 20 bp, Artificial sequence
  SiRNA target sequence
tttttttgtctgagtggaat

SEQ ID NO: 227044 - DNA, 20 bp, Artificial sequence
  SiRNA target sequence
ttttttgtctgagtggaatt

SEQ ID NO: 227045 - DNA, 20 bp, Artificial sequence
  SiRNA target sequence
tttttgtctgagtggaattc

SEQ ID NO: 227046 - DNA, 20 bp, Artificial sequence
  SiRNA target sequence
ttttgtctgagtggaattct

SEQ ID NO: 227047 - DNA, 20 bp, Artificial sequence
  SiRNA target sequence
tttgtctgagtggaattctc

SEQ ID NO: 227048 - DNA, 20 bp, Artificial sequence
  SiRNA target sequence
ttgtctgagtggaattctct

SEQ ID NO: 227049 - DNA, 20 bp, Artificial sequence
  SiRNA target sequence
tgtctgagtggaattctctg

SEQ ID NO: 227050 - DNA, 20 bp, Artificial sequence
  SiRNA target sequence
gtctgagtggaattctctgt

SEQ ID NO: 227051 - DNA, 20 bp, Artificial sequence
  SiRNA target sequence
tctgagtggaattctctgtg

SEQ ID NO: 227052 - DNA, 20 bp, Artificial sequence
  SiRNA target sequence
ctgagtggaattctctgtgc

SEQ ID NO: 227053 - DNA, 20 bp, Artificial sequence
  SiRNA target sequence
tgagtggaattctctgtgct

SEQ ID NO: 227054 - DNA, 20 bp, Artificial sequence
  SiRNA target sequence
gagtggaattctctgtgctg

SEQ ID NO: 227055 - DNA, 20 bp, Artificial sequence
  SiRNA target sequence
agtggaattctctgtgctgt

SEQ ID NO: 227056 - DNA, 20 bp, Artificial sequence
  SiRNA target sequence
gtggaattctctgtgctgta

SEQ ID NO: 227057 - DNA, 20 bp, Artificial sequence
  SiRNA target sequence
tggaattctctgtgctgtaa

SEQ ID NO: 227058 - DNA, 20 bp, Artificial sequence
  SiRNA target sequence
ggaattctctgtgctgtaat

SEQ ID NO: 227059 - DNA, 20 bp, Artificial sequence
  SiRNA target sequence
gaattctctgtgctgtaatt

SEQ ID NO: 227060 - DNA, 20 bp, Artificial sequence
  SiRNA target sequence
aattctctgtgctgtaattt

SEQ ID NO: 227061 - DNA, 20 bp, Artificial sequence
  SiRNA target sequence
attctctgtgctgtaattta

SEQ ID NO: 227062 - DNA, 20 bp, Artificial sequence
  SiRNA target sequence
ttctctgtgctgtaatttat

SEQ ID NO: 227063 - DNA, 20 bp, Artificial sequence
  SiRNA target sequence
tctctgtgctgtaatttatc

SEQ ID NO: 227064 - DNA, 20 bp, Artificial sequence
  SiRNA target sequence
ctctgtgctgtaatttatct

SEQ ID NO: 227065 - DNA, 20 bp, Artificial sequence
  SiRNA target sequence
tctgtgctgtaatttatctt

SEQ ID NO: 227066 - DNA, 20 bp, Artificial sequence
  SiRNA target sequence
ctgtgctgtaatttatcttc

SEQ ID NO: 227067 - DNA, 20 bp, Artificial sequence
  SiRNA target sequence
tgtgctgtaatttatcttct

SEQ ID NO: 227068 - DNA, 20 bp, Artificial sequence
  SiRNA target sequence
gtgctgtaatttatcttcta

SEQ ID NO: 227069 - DNA, 20 bp, Artificial sequence
  SiRNA target sequence
tgctgtaatttatcttctaa

SEQ ID NO: 227070 - DNA, 20 bp, Artificial sequence
  SiRNA target sequence
gctgtaatttatcttctaaa

SEQ ID NO: 227071 - DNA, 20 bp, Artificial sequence
  SiRNA target sequence
ctgtaatttatcttctaaaa

SEQ ID NO: 227072 - DNA, 20 bp, Artificial sequence
  SiRNA target sequence
tgtaatttatcttctaaaaa

SEQ ID NO: 227073 - DNA, 20 bp, Artificial sequence
  SiRNA target sequence
gtaatttatcttctaaaaaa

SEQ ID NO: 227074 - DNA, 20 bp, Artificial sequence
  SiRNA target sequence
taatttatcttctaaaaaaa

SEQ ID NO: 227075 - DNA, 20 bp, Artificial sequence
  SiRNA target sequence
aatttatcttctaaaaaaat

SEQ ID NO: 227076 - DNA, 20 bp, Artificial sequence
  SiRNA target sequence
atttatcttctaaaaaaata

SEQ ID NO: 227077 - DNA, 20 bp, Artificial sequence
  SiRNA target sequence
tttatcttctaaaaaaatat

SEQ ID NO: 227078 - DNA, 20 bp, Artificial sequence
  SiRNA target sequence
ttatcttctaaaaaaatatt

SEQ ID NO: 227079 - DNA, 20 bp, Artificial sequence
  SiRNA target sequence
tatcttctaaaaaaatattt

SEQ ID NO: 227080 - DNA, 20 bp, Artificial sequence
  SiRNA target sequence
atcttctaaaaaaatattta

SEQ ID NO: 227081 - DNA, 20 bp, Artificial sequence
  SiRNA target sequence
tcttctaaaaaaatatttag

SEQ ID NO: 227082 - DNA, 20 bp, Artificial sequence
  SiRNA target sequence
cttctaaaaaaatatttaga

SEQ ID NO: 227083 - DNA, 20 bp, Artificial sequence
  SiRNA target sequence
ttctaaaaaaatatttagaa

SEQ ID NO: 227084 - DNA, 20 bp, Artificial sequence
  SiRNA target sequence
tctaaaaaaatatttagaaa

SEQ ID NO: 227085 - DNA, 20 bp, Artificial sequence
  SiRNA target sequence
ctaaaaaaatatttagaaaa

SEQ ID NO: 227086 - DNA, 20 bp, Artificial sequence
  SiRNA target sequence
taaaaaaatatttagaaaat

SEQ ID NO: 227087 - DNA, 20 bp, Artificial sequence
  SiRNA target sequence
aaaaaaatatttagaaaata

SEQ ID NO: 227088 - DNA, 20 bp, Artificial sequence
  SiRNA target sequence
aaaaaatatttagaaaataa

SEQ ID NO: 227089 - DNA, 20 bp, Artificial sequence
  SiRNA target sequence
aaaaatatttagaaaataat

SEQ ID NO: 227090 - DNA, 20 bp, Artificial sequence
  SiRNA target sequence
aaaatatttagaaaataatg

SEQ ID NO: 227091 - DNA, 20 bp, Artificial sequence
  SiRNA target sequence
aaatatttagaaaataatgt

SEQ ID NO: 227092 - DNA, 20 bp, Artificial sequence
  SiRNA target sequence
aatatttagaaaataatgtt

SEQ ID NO: 227093 - DNA, 20 bp, Artificial sequence
  SiRNA target sequence
atatttagaaaataatgtta

SEQ ID NO: 227094 - DNA, 20 bp, Artificial sequence
  SiRNA target sequence
tatttagaaaataatgttac

SEQ ID NO: 227095 - DNA, 20 bp, Artificial sequence
  SiRNA target sequence
atttagaaaataatgttact

SEQ ID NO: 227096 - DNA, 20 bp, Artificial sequence
  SiRNA target sequence
tttagaaaataatgttacta

SEQ ID NO: 227097 - DNA, 20 bp, Artificial sequence
  SiRNA target sequence
ttagaaaataatgttactag

SEQ ID NO: 227098 - DNA, 20 bp, Artificial sequence
  SiRNA target sequence
tagaaaataatgttactagc

SEQ ID NO: 227099 - DNA, 20 bp, Artificial sequence
  SiRNA target sequence
agaaaataatgttactagca

SEQ ID NO: 227100 - DNA, 20 bp, Artificial sequence
  SiRNA target sequence
gaaaataatgttactagcaa

SEQ ID NO: 227101 - DNA, 20 bp, Artificial sequence
  SiRNA target sequence
aaaataatgttactagcaaa

SEQ ID NO: 227102 - DNA, 20 bp, Artificial sequence
  SiRNA target sequence
aaataatgttactagcaaac

SEQ ID NO: 227103 - DNA, 20 bp, Artificial sequence
  SiRNA target sequence
aataatgttactagcaaacc

SEQ ID NO: 227104 - DNA, 20 bp, Artificial sequence
  SiRNA target sequence
ataatgttactagcaaacca

SEQ ID NO: 227105 - DNA, 20 bp, Artificial sequence
  SiRNA target sequence
taatgttactagcaaaccaa

SEQ ID NO: 227106 - DNA, 20 bp, Artificial sequence
  SiRNA target sequence
aatgttactagcaaaccaat

SEQ ID NO: 227107 - DNA, 20 bp, Artificial sequence
  SiRNA target sequence
atgttactagcaaaccaatg

SEQ ID NO: 227108 - DNA, 20 bp, Artificial sequence
  SiRNA target sequence
tgttactagcaaaccaatgt

SEQ ID NO: 227109 - DNA, 20 bp, Artificial sequence
  SiRNA target sequence
gttactagcaaaccaatgtt

SEQ ID NO: 227110 - DNA, 20 bp, Artificial sequence
  SiRNA target sequence
ttactagcaaaccaatgttt

SEQ ID NO: 227111 - DNA, 20 bp, Artificial sequence
  SiRNA target sequence
tactagcaaaccaatgtttg

SEQ ID NO: 227112 - DNA, 20 bp, Artificial sequence
  SiRNA target sequence
actagcaaaccaatgtttgt

SEQ ID NO: 227113 - DNA, 20 bp, Artificial sequence
  SiRNA target sequence
ctagcaaaccaatgtttgtt

SEQ ID NO: 227114 - DNA, 20 bp, Artificial sequence
  SiRNA target sequence
tagcaaaccaatgtttgtta

SEQ ID NO: 227115 - DNA, 20 bp, Artificial sequence
  SiRNA target sequence
agcaaaccaatgtttgttag

SEQ ID NO: 227116 - DNA, 20 bp, Artificial sequence
  SiRNA target sequence
gcaaaccaatgtttgttaga

SEQ ID NO: 227117 - DNA, 20 bp, Artificial sequence
  SiRNA target sequence
caaaccaatgtttgttagaa

SEQ ID NO: 227118 - DNA, 20 bp, Artificial sequence
  SiRNA target sequence
aaaccaatgtttgttagaaa

SEQ ID NO: 227119 - DNA, 20 bp, Artificial sequence
  SiRNA target sequence
aaccaatgtttgttagaaag

SEQ ID NO: 227120 - DNA, 20 bp, Artificial sequence
  SiRNA target sequence
accaatgtttgttagaaaga

SEQ ID NO: 227121 - DNA, 20 bp, Artificial sequence
  SiRNA target sequence
ccaatgtttgttagaaagac

SEQ ID NO: 227122 - DNA, 20 bp, Artificial sequence
  SiRNA target sequence
caatgtttgttagaaagact

SEQ ID NO: 227123 - DNA, 20 bp, Artificial sequence
  SiRNA target sequence
aatgtttgttagaaagactt

SEQ ID NO: 227124 - DNA, 20 bp, Artificial sequence
  SiRNA target sequence
atgtttgttagaaagacttt

SEQ ID NO: 227125 - DNA, 20 bp, Artificial sequence
  SiRNA target sequence
tgtttgttagaaagactttt

SEQ ID NO: 227126 - DNA, 20 bp, Artificial sequence
  SiRNA target sequence
gtttgttagaaagactttta

SEQ ID NO: 227127 - DNA, 20 bp, Artificial sequence
  SiRNA target sequence
tttgttagaaagacttttac

SEQ ID NO: 227128 - DNA, 20 bp, Artificial sequence
  SiRNA target sequence
ttgttagaaagacttttact

SEQ ID NO: 227129 - DNA, 20 bp, Artificial sequence
  SiRNA target sequence
tgttagaaagacttttacta

SEQ ID NO: 227130 - DNA, 20 bp, Artificial sequence
  SiRNA target sequence
gttagaaagacttttactaa

SEQ ID NO: 227131 - DNA, 20 bp, Artificial sequence
  SiRNA target sequence
ttagaaagacttttactaaa

SEQ ID NO: 227132 - DNA, 20 bp, Artificial sequence
  SiRNA target sequence
tagaaagacttttactaaaa

SEQ ID NO: 227133 - DNA, 20 bp, Artificial sequence
  SiRNA target sequence
agaaagacttttactaaaaa

SEQ ID NO: 227134 - DNA, 20 bp, Artificial sequence
  SiRNA target sequence
gaaagacttttactaaaaag

SEQ ID NO: 227135 - DNA, 20 bp, Artificial sequence
  SiRNA target sequence
aaagacttttactaaaaaga

SEQ ID NO: 227136 - DNA, 20 bp, Artificial sequence
  SiRNA target sequence
aagacttttactaaaaagaa

SEQ ID NO: 227137 - DNA, 20 bp, Artificial sequence
  SiRNA target sequence
agacttttactaaaaagaag

SEQ ID NO: 227138 - DNA, 20 bp, Artificial sequence
  SiRNA target sequence
gacttttactaaaaagaaga

SEQ ID NO: 227139 - DNA, 20 bp, Artificial sequence
  SiRNA target sequence
acttttactaaaaagaagag

SEQ ID NO: 227140 - DNA, 20 bp, Artificial sequence
  SiRNA target sequence
cttttactaaaaagaagagt

SEQ ID NO: 227141 - DNA, 20 bp, Artificial sequence
  SiRNA target sequence
ttttactaaaaagaagagta

SEQ ID NO: 227142 - DNA, 20 bp, Artificial sequence
  SiRNA target sequence
tttactaaaaagaagagtaa

SEQ ID NO: 227143 - DNA, 20 bp, Artificial sequence
  SiRNA target sequence
ttactaaaaagaagagtaaa

SEQ ID NO: 227144 - DNA, 20 bp, Artificial sequence
  SiRNA target sequence
tactaaaaagaagagtaaag

SEQ ID NO: 227145 - DNA, 20 bp, Artificial sequence
  SiRNA target sequence
actaaaaagaagagtaaagt

SEQ ID NO: 227146 - DNA, 20 bp, Artificial sequence
  SiRNA target sequence
ctaaaaagaagagtaaagtg

SEQ ID NO: 227147 - DNA, 20 bp, Artificial sequence
  SiRNA target sequence
taaaaagaagagtaaagtga

SEQ ID NO: 227148 - DNA, 20 bp, Artificial sequence
  SiRNA target sequence
aaaaagaagagtaaagtgaa

SEQ ID NO: 227149 - DNA, 20 bp, Artificial sequence
  SiRNA target sequence
aaaagaagagtaaagtgaag

SEQ ID NO: 227150 - DNA, 20 bp, Artificial sequence
  SiRNA target sequence
aaagaagagtaaagtgaagg

SEQ ID NO: 227151 - DNA, 20 bp, Artificial sequence
  SiRNA target sequence
aagaagagtaaagtgaaggt

SEQ ID NO: 227152 - DNA, 20 bp, Artificial sequence
  SiRNA target sequence
agaagagtaaagtgaaggtt

SEQ ID NO: 227153 - DNA, 20 bp, Artificial sequence
  SiRNA target sequence
gaagagtaaagtgaaggttg

SEQ ID NO: 227154 - DNA, 20 bp, Artificial sequence
  SiRNA target sequence
aagagtaaagtgaaggttgg

SEQ ID NO: 227155 - DNA, 20 bp, Artificial sequence
  SiRNA target sequence
agagtaaagtgaaggttgga

SEQ ID NO: 227156 - DNA, 20 bp, Artificial sequence
  SiRNA target sequence
gagtaaagtgaaggttggat

SEQ ID NO: 227157 - DNA, 20 bp, Artificial sequence
  SiRNA target sequence
agtaaagtgaaggttggatt

SEQ ID NO: 227158 - DNA, 20 bp, Artificial sequence
  SiRNA target sequence
gtaaagtgaaggttggattt

SEQ ID NO: 227159 - DNA, 20 bp, Artificial sequence
  SiRNA target sequence
taaagtgaaggttggatttg

SEQ ID NO: 227160 - DNA, 20 bp, Artificial sequence
  SiRNA target sequence
aaagtgaaggttggatttgt

SEQ ID NO: 227161 - DNA, 20 bp, Artificial sequence
  SiRNA target sequence
aagtgaaggttggatttgtt

SEQ ID NO: 227162 - DNA, 20 bp, Artificial sequence
  SiRNA target sequence
agtgaaggttggatttgttg

SEQ ID NO: 227163 - DNA, 20 bp, Artificial sequence
  SiRNA target sequence
gtgaaggttggatttgttga

SEQ ID NO: 227164 - DNA, 20 bp, Artificial sequence
  SiRNA target sequence
tgaaggttggatttgttgat

SEQ ID NO: 227165 - DNA, 20 bp, Artificial sequence
  SiRNA target sequence
gaaggttggatttgttgatg

SEQ ID NO: 227166 - DNA, 20 bp, Artificial sequence
  SiRNA target sequence
aaggttggatttgttgatgg

SEQ ID NO: 227167 - DNA, 20 bp, Artificial sequence
  SiRNA target sequence
aggttggatttgttgatgga

SEQ ID NO: 227168 - DNA, 20 bp, Artificial sequence
  SiRNA target sequence
ggttggatttgttgatggac

SEQ ID NO: 227169 - DNA, 20 bp, Artificial sequence
  SiRNA target sequence
gttggatttgttgatggact

SEQ ID NO: 227170 - DNA, 20 bp, Artificial sequence
  SiRNA target sequence
ttggatttgttgatggactt

SEQ ID NO: 227171 - DNA, 20 bp, Artificial sequence
  SiRNA target sequence
tggatttgttgatggactta

SEQ ID NO: 227172 - DNA, 20 bp, Artificial sequence
  SiRNA target sequence
ggatttgttgatggacttat

SEQ ID NO: 227173 - DNA, 20 bp, Artificial sequence
  SiRNA target sequence
gatttgttgatggacttatt

SEQ ID NO: 227174 - DNA, 20 bp, Artificial sequence
  SiRNA target sequence
atttgttgatggacttattg

SEQ ID NO: 227175 - DNA, 20 bp, Artificial sequence
  SiRNA target sequence
tttgttgatggacttattga

SEQ ID NO: 227176 - DNA, 20 bp, Artificial sequence
  SiRNA target sequence
ttgttgatggacttattgag

SEQ ID NO: 227177 - DNA, 20 bp, Artificial sequence
  SiRNA target sequence
tgttgatggacttattgaga

SEQ ID NO: 227178 - DNA, 20 bp, Artificial sequence
  SiRNA target sequence
gttgatggacttattgagat

SEQ ID NO: 227179 - DNA, 20 bp, Artificial sequence
  SiRNA target sequence
ttgatggacttattgagatg

SEQ ID NO: 227180 - DNA, 20 bp, Artificial sequence
  SiRNA target sequence
tgatggacttattgagatga

SEQ ID NO: 227181 - DNA, 20 bp, Artificial sequence
  SiRNA target sequence
gatggacttattgagatgag

SEQ ID NO: 227182 - DNA, 20 bp, Artificial sequence
  SiRNA target sequence
atggacttattgagatgagt

SEQ ID NO: 227183 - DNA, 20 bp, Artificial sequence
  SiRNA target sequence
tggacttattgagatgagta

SEQ ID NO: 227184 - DNA, 20 bp, Artificial sequence
  SiRNA target sequence
ggacttattgagatgagtaa

SEQ ID NO: 227185 - DNA, 20 bp, Artificial sequence
  SiRNA target sequence
gacttattgagatgagtaaa

SEQ ID NO: 227186 - DNA, 20 bp, Artificial sequence
  SiRNA target sequence
acttattgagatgagtaaat

SEQ ID NO: 227187 - DNA, 20 bp, Artificial sequence
  SiRNA target sequence
cttattgagatgagtaaatc

SEQ ID NO: 227188 - DNA, 20 bp, Artificial sequence
  SiRNA target sequence
ttattgagatgagtaaatct

SEQ ID NO: 227189 - DNA, 20 bp, Artificial sequence
  SiRNA target sequence
tattgagatgagtaaatcta

SEQ ID NO: 227190 - DNA, 20 bp, Artificial sequence
  SiRNA target sequence
attgagatgagtaaatctaa

SEQ ID NO: 227191 - DNA, 20 bp, Artificial sequence
  SiRNA target sequence
ttgagatgagtaaatctaaa

SEQ ID NO: 227192 - DNA, 20 bp, Artificial sequence
  SiRNA target sequence
tgagatgagtaaatctaaac

SEQ ID NO: 227193 - DNA, 20 bp, Artificial sequence
  SiRNA target sequence
gagatgagtaaatctaaact

SEQ ID NO: 227194 - DNA, 20 bp, Artificial sequence
  SiRNA target sequence
agatgagtaaatctaaacta

SEQ ID NO: 227195 - DNA, 20 bp, Artificial sequence
  SiRNA target sequence
gatgagtaaatctaaactac

SEQ ID NO: 227196 - DNA, 20 bp, Artificial sequence
  SiRNA target sequence
atgagtaaatctaaactact

SEQ ID NO: 227197 - DNA, 20 bp, Artificial sequence
  SiRNA target sequence
tgagtaaatctaaactactg

SEQ ID NO: 227198 - DNA, 20 bp, Artificial sequence
  SiRNA target sequence
gagtaaatctaaactactgt

SEQ ID NO: 227199 - DNA, 20 bp, Artificial sequence
  SiRNA target sequence
agtaaatctaaactactgtt

SEQ ID NO: 227200 - DNA, 20 bp, Artificial sequence
  SiRNA target sequence
gtaaatctaaactactgttg

SEQ ID NO: 227201 - DNA, 20 bp, Artificial sequence
  SiRNA target sequence
taaatctaaactactgttga

SEQ ID NO: 227202 - DNA, 20 bp, Artificial sequence
  SiRNA target sequence
aaatctaaactactgttgaa

SEQ ID NO: 227203 - DNA, 20 bp, Artificial sequence
  SiRNA target sequence
aatctaaactactgttgaat

SEQ ID NO: 227204 - DNA, 20 bp, Artificial sequence
  SiRNA target sequence
atctaaactactgttgaata

SEQ ID NO: 227205 - DNA, 20 bp, Artificial sequence
  SiRNA target sequence
tctaaactactgttgaatat

SEQ ID NO: 227206 - DNA, 20 bp, Artificial sequence
  SiRNA target sequence
ctaaactactgttgaatatg

SEQ ID NO: 227207 - DNA, 20 bp, Artificial sequence
  SiRNA target sequence
taaactactgttgaatatgt

SEQ ID NO: 227208 - DNA, 20 bp, Artificial sequence
  SiRNA target sequence
aaactactgttgaatatgtc

SEQ ID NO: 227209 - DNA, 20 bp, Artificial sequence
  SiRNA target sequence
aactactgttgaatatgtca

SEQ ID NO: 227210 - DNA, 20 bp, Artificial sequence
  SiRNA target sequence
actactgttgaatatgtcat

SEQ ID NO: 227211 - DNA, 20 bp, Artificial sequence
  SiRNA target sequence
ctactgttgaatatgtcatt

SEQ ID NO: 227212 - DNA, 20 bp, Artificial sequence
  SiRNA target sequence
tactgttgaatatgtcatta

SEQ ID NO: 227213 - DNA, 20 bp, Artificial sequence
  SiRNA target sequence
actgttgaatatgtcattag

SEQ ID NO: 227214 - DNA, 20 bp, Artificial sequence
  SiRNA target sequence
ctgttgaatatgtcattagt

SEQ ID NO: 227215 - DNA, 20 bp, Artificial sequence
  SiRNA target sequence
tgttgaatatgtcattagtc

SEQ ID NO: 227216 - DNA, 20 bp, Artificial sequence
  SiRNA target sequence
gttgaatatgtcattagtcg

SEQ ID NO: 227217 - DNA, 20 bp, Artificial sequence
  SiRNA target sequence
ttgaatatgtcattagtcgt

SEQ ID NO: 227218 - DNA, 20 bp, Artificial sequence
  SiRNA target sequence
tgaatatgtcattagtcgta

SEQ ID NO: 227219 - DNA, 20 bp, Artificial sequence
  SiRNA target sequence
gaatatgtcattagtcgtat

SEQ ID NO: 227220 - DNA, 20 bp, Artificial sequence
  SiRNA target sequence
aatatgtcattagtcgtatt

SEQ ID NO: 227221 - DNA, 20 bp, Artificial sequence
  SiRNA target sequence
atatgtcattagtcgtatta

SEQ ID NO: 227222 - DNA, 20 bp, Artificial sequence
  SiRNA target sequence
tatgtcattagtcgtattat

SEQ ID NO: 227223 - DNA, 20 bp, Artificial sequence
  SiRNA target sequence
atgtcattagtcgtattatt

SEQ ID NO: 227224 - DNA, 20 bp, Artificial sequence
  SiRNA target sequence
tgtcattagtcgtattattt

SEQ ID NO: 227225 - DNA, 20 bp, Artificial sequence
  SiRNA target sequence
gtcattagtcgtattatttt

SEQ ID NO: 227226 - DNA, 20 bp, Artificial sequence
  SiRNA target sequence
tcattagtcgtattatttta

SEQ ID NO: 227227 - DNA, 20 bp, Artificial sequence
  SiRNA target sequence
cattagtcgtattattttat

SEQ ID NO: 227228 - DNA, 20 bp, Artificial sequence
  SiRNA target sequence
attagtcgtattattttatg

SEQ ID NO: 227229 - DNA, 20 bp, Artificial sequence
  SiRNA target sequence
ttagtcgtattattttatgc

SEQ ID NO: 227230 - DNA, 20 bp, Artificial sequence
  SiRNA target sequence
tagtcgtattattttatgct

SEQ ID NO: 227231 - DNA, 20 bp, Artificial sequence
  SiRNA target sequence
agtcgtattattttatgctg

SEQ ID NO: 227232 - DNA, 20 bp, Artificial sequence
  SiRNA target sequence
gtcgtattattttatgctgt

SEQ ID NO: 227233 - DNA, 20 bp, Artificial sequence
  SiRNA target sequence
tcgtattattttatgctgtt

SEQ ID NO: 227234 - DNA, 20 bp, Artificial sequence
  SiRNA target sequence
cgtattattttatgctgttt

SEQ ID NO: 227235 - DNA, 20 bp, Artificial sequence
  SiRNA target sequence
gtattattttatgctgtttc

SEQ ID NO: 227236 - DNA, 20 bp, Artificial sequence
  SiRNA target sequence
tattattttatgctgtttct

SEQ ID NO: 227237 - DNA, 20 bp, Artificial sequence
  SiRNA target sequence
attattttatgctgtttcta

SEQ ID NO: 227238 - DNA, 20 bp, Artificial sequence
  SiRNA target sequence
ttattttatgctgtttctac

SEQ ID NO: 227239 - DNA, 20 bp, Artificial sequence
  SiRNA target sequence
tattttatgctgtttctacg

SEQ ID NO: 227240 - DNA, 20 bp, Artificial sequence
  SiRNA target sequence
attttatgctgtttctacga

SEQ ID NO: 227241 - DNA, 20 bp, Artificial sequence
  SiRNA target sequence
ttttatgctgtttctacgaa

SEQ ID NO: 227242 - DNA, 20 bp, Artificial sequence
  SiRNA target sequence
tttatgctgtttctacgaat

SEQ ID NO: 227243 - DNA, 20 bp, Artificial sequence
  SiRNA target sequence
ttatgctgtttctacgaata

SEQ ID NO: 227244 - DNA, 20 bp, Artificial sequence
  SiRNA target sequence
tatgctgtttctacgaatat

SEQ ID NO: 227245 - DNA, 20 bp, Artificial sequence
  SiRNA target sequence
atgctgtttctacgaatatt

SEQ ID NO: 227246 - DNA, 20 bp, Artificial sequence
  SiRNA target sequence
tgctgtttctacgaatatta

SEQ ID NO: 227247 - DNA, 20 bp, Artificial sequence
  SiRNA target sequence
gctgtttctacgaatattat

SEQ ID NO: 227248 - DNA, 20 bp, Artificial sequence
  SiRNA target sequence
ctgtttctacgaatattatt

SEQ ID NO: 227249 - DNA, 20 bp, Artificial sequence
  SiRNA target sequence
tgtttctacgaatattattg

SEQ ID NO: 227250 - DNA, 20 bp, Artificial sequence
  SiRNA target sequence
gtttctacgaatattattga

SEQ ID NO: 227251 - DNA, 20 bp, Artificial sequence
  SiRNA target sequence
tttctacgaatattattgag

SEQ ID NO: 227252 - DNA, 20 bp, Artificial sequence
  SiRNA target sequence
ttctacgaatattattgagt

SEQ ID NO: 227253 - DNA, 20 bp, Artificial sequence
  SiRNA target sequence
tctacgaatattattgagtc

SEQ ID NO: 227254 - DNA, 20 bp, Artificial sequence
  SiRNA target sequence
ctacgaatattattgagtca

SEQ ID NO: 227255 - DNA, 20 bp, Artificial sequence
  SiRNA target sequence
tacgaatattattgagtcag

SEQ ID NO: 227256 - DNA, 20 bp, Artificial sequence
  SiRNA target sequence
acgaatattattgagtcagc

SEQ ID NO: 227257 - DNA, 20 bp, Artificial sequence
  SiRNA target sequence
cgaatattattgagtcagct

SEQ ID NO: 227258 - DNA, 20 bp, Artificial sequence
  SiRNA target sequence
gaatattattgagtcagctt

SEQ ID NO: 227259 - DNA, 20 bp, Artificial sequence
  SiRNA target sequence
aatattattgagtcagctta

SEQ ID NO: 227260 - DNA, 20 bp, Artificial sequence
  SiRNA target sequence
atattattgagtcagcttat

SEQ ID NO: 227261 - DNA, 20 bp, Artificial sequence
  SiRNA target sequence
tattattgagtcagcttata

SEQ ID NO: 227262 - DNA, 20 bp, Artificial sequence
  SiRNA target sequence
attattgagtcagcttataa

SEQ ID NO: 227263 - DNA, 20 bp, Artificial sequence
  SiRNA target sequence
ttattgagtcagcttataaa

SEQ ID NO: 227264 - DNA, 20 bp, Artificial sequence
  SiRNA target sequence
tattgagtcagcttataaat

SEQ ID NO: 227265 - DNA, 20 bp, Artificial sequence
  SiRNA target sequence
attgagtcagcttataaatc

SEQ ID NO: 227266 - DNA, 20 bp, Artificial sequence
  SiRNA target sequence
ttgagtcagcttataaatct

SEQ ID NO: 227267 - DNA, 20 bp, Artificial sequence
  SiRNA target sequence
tgagtcagcttataaatctg

SEQ ID NO: 227268 - DNA, 20 bp, Artificial sequence
  SiRNA target sequence
gagtcagcttataaatctgc

SEQ ID NO: 227269 - DNA, 20 bp, Artificial sequence
  SiRNA target sequence
agtcagcttataaatctgct

SEQ ID NO: 227270 - DNA, 20 bp, Artificial sequence
  SiRNA target sequence
gtcagcttataaatctgctt

SEQ ID NO: 227271 - DNA, 20 bp, Artificial sequence
  SiRNA target sequence
tcagcttataaatctgcttt

SEQ ID NO: 227272 - DNA, 20 bp, Artificial sequence
  SiRNA target sequence
cagcttataaatctgcttta

SEQ ID NO: 227273 - DNA, 20 bp, Artificial sequence
  SiRNA target sequence
agcttataaatctgctttag

SEQ ID NO: 227274 - DNA, 20 bp, Artificial sequence
  SiRNA target sequence
gcttataaatctgctttagc

SEQ ID NO: 227275 - DNA, 20 bp, Artificial sequence
  SiRNA target sequence
cttataaatctgctttagct

SEQ ID NO: 227276 - DNA, 20 bp, Artificial sequence
  SiRNA target sequence
ttataaatctgctttagctg

SEQ ID NO: 227277 - DNA, 20 bp, Artificial sequence
  SiRNA target sequence
tataaatctgctttagctgt

SEQ ID NO: 227278 - DNA, 20 bp, Artificial sequence
  SiRNA target sequence
ataaatctgctttagctgtc

SEQ ID NO: 227279 - DNA, 20 bp, Artificial sequence
  SiRNA target sequence
taaatctgctttagctgtcg

SEQ ID NO: 227280 - DNA, 20 bp, Artificial sequence
  SiRNA target sequence
aaatctgctttagctgtcgg

SEQ ID NO: 227281 - DNA, 20 bp, Artificial sequence
  SiRNA target sequence
aatctgctttagctgtcggt

SEQ ID NO: 227282 - DNA, 20 bp, Artificial sequence
  SiRNA target sequence
atctgctttagctgtcggtg

SEQ ID NO: 227283 - DNA, 20 bp, Artificial sequence
  SiRNA target sequence
tctgctttagctgtcggtgc

SEQ ID NO: 227284 - DNA, 20 bp, Artificial sequence
  SiRNA target sequence
ctgctttagctgtcggtgct

SEQ ID NO: 227285 - DNA, 20 bp, Artificial sequence
  SiRNA target sequence
tgctttagctgtcggtgcta

SEQ ID NO: 227286 - DNA, 20 bp, Artificial sequence
  SiRNA target sequence
gctttagctgtcggtgctaa

SEQ ID NO: 227287 - DNA, 20 bp, Artificial sequence
  SiRNA target sequence
ctttagctgtcggtgctaat

SEQ ID NO: 227288 - DNA, 20 bp, Artificial sequence
  SiRNA target sequence
tttagctgtcggtgctaatg

SEQ ID NO: 227289 - DNA, 20 bp, Artificial sequence
  SiRNA target sequence
ttagctgtcggtgctaatga

SEQ ID NO: 227290 - DNA, 20 bp, Artificial sequence
  SiRNA target sequence
tagctgtcggtgctaatgaa

SEQ ID NO: 227291 - DNA, 20 bp, Artificial sequence
  SiRNA target sequence
agctgtcggtgctaatgaaa

SEQ ID NO: 227292 - DNA, 20 bp, Artificial sequence
  SiRNA target sequence
gctgtcggtgctaatgaaac

SEQ ID NO: 227293 - DNA, 20 bp, Artificial sequence
  SiRNA target sequence
ctgtcggtgctaatgaaact

SEQ ID NO: 227294 - DNA, 20 bp, Artificial sequence
  SiRNA target sequence
tgtcggtgctaatgaaactg

SEQ ID NO: 227295 - DNA, 20 bp, Artificial sequence
  SiRNA target sequence
gtcggtgctaatgaaactgg

SEQ ID NO: 227296 - DNA, 20 bp, Artificial sequence
  SiRNA target sequence
tcggtgctaatgaaactggt

SEQ ID NO: 227297 - DNA, 20 bp, Artificial sequence
  SiRNA target sequence
cggtgctaatgaaactggtg

SEQ ID NO: 227298 - DNA, 20 bp, Artificial sequence
  SiRNA target sequence
ggtgctaatgaaactggtga

SEQ ID NO: 227299 - DNA, 20 bp, Artificial sequence
  SiRNA target sequence
gtgctaatgaaactggtgag

SEQ ID NO: 227300 - DNA, 20 bp, Artificial sequence
  SiRNA target sequence
tgctaatgaaactggtgagg

SEQ ID NO: 227301 - DNA, 20 bp, Artificial sequence
  SiRNA target sequence
gctaatgaaactggtgaggc

SEQ ID NO: 227302 - DNA, 20 bp, Artificial sequence
  SiRNA target sequence
ctaatgaaactggtgaggca

SEQ ID NO: 227303 - DNA, 20 bp, Artificial sequence
  SiRNA target sequence
taatgaaactggtgaggcaa

SEQ ID NO: 227304 - DNA, 20 bp, Artificial sequence
  SiRNA target sequence
aatgaaactggtgaggcaaa

SEQ ID NO: 227305 - DNA, 20 bp, Artificial sequence
  SiRNA target sequence
atgaaactggtgaggcaaaa

SEQ ID NO: 227306 - DNA, 20 bp, Artificial sequence
  SiRNA target sequence
tgaaactggtgaggcaaaat

SEQ ID NO: 227307 - DNA, 20 bp, Artificial sequence
  SiRNA target sequence
gaaactggtgaggcaaaatc

SEQ ID NO: 227308 - DNA, 20 bp, Artificial sequence
  SiRNA target sequence
aaactggtgaggcaaaatct

SEQ ID NO: 227309 - DNA, 20 bp, Artificial sequence
  SiRNA target sequence
aactggtgaggcaaaatcta

SEQ ID NO: 227310 - DNA, 20 bp, Artificial sequence
  SiRNA target sequence
actggtgaggcaaaatctac

SEQ ID NO: 227311 - DNA, 20 bp, Artificial sequence
  SiRNA target sequence
ctggtgaggcaaaatctacc

SEQ ID NO: 227312 - DNA, 20 bp, Artificial sequence
  SiRNA target sequence
tggtgaggcaaaatctacct

SEQ ID NO: 227313 - DNA, 20 bp, Artificial sequence
  SiRNA target sequence
ggtgaggcaaaatctaccta

SEQ ID NO: 227314 - DNA, 20 bp, Artificial sequence
  SiRNA target sequence
gtgaggcaaaatctacctat

SEQ ID NO: 227315 - DNA, 20 bp, Artificial sequence
  SiRNA target sequence
tgaggcaaaatctacctatg

SEQ ID NO: 227316 - DNA, 20 bp, Artificial sequence
  SiRNA target sequence
gaggcaaaatctacctatgc

SEQ ID NO: 227317 - DNA, 20 bp, Artificial sequence
  SiRNA target sequence
aggcaaaatctacctatgct

SEQ ID NO: 227318 - DNA, 20 bp, Artificial sequence
  SiRNA target sequence
ggcaaaatctacctatgctt

SEQ ID NO: 227319 - DNA, 20 bp, Artificial sequence
  SiRNA target sequence
gcaaaatctacctatgcttc

SEQ ID NO: 227320 - DNA, 20 bp, Artificial sequence
  SiRNA target sequence
caaaatctacctatgcttca

SEQ ID NO: 227321 - DNA, 20 bp, Artificial sequence
  SiRNA target sequence
aaaatctacctatgcttcaa

SEQ ID NO: 227322 - DNA, 20 bp, Artificial sequence
  SiRNA target sequence
aaatctacctatgcttcaat

SEQ ID NO: 227323 - DNA, 20 bp, Artificial sequence
  SiRNA target sequence
aatctacctatgcttcaatt

SEQ ID NO: 227324 - DNA, 20 bp, Artificial sequence
  SiRNA target sequence
atctacctatgcttcaattt

SEQ ID NO: 227325 - DNA, 20 bp, Artificial sequence
  SiRNA target sequence
tctacctatgcttcaattta

SEQ ID NO: 227326 - DNA, 20 bp, Artificial sequence
  SiRNA target sequence
ctacctatgcttcaatttat

SEQ ID NO: 227327 - DNA, 20 bp, Artificial sequence
  SiRNA target sequence
tacctatgcttcaatttata

SEQ ID NO: 227328 - DNA, 20 bp, Artificial sequence
  SiRNA target sequence
acctatgcttcaatttatac

SEQ ID NO: 227329 - DNA, 20 bp, Artificial sequence
  SiRNA target sequence
cctatgcttcaatttataca

SEQ ID NO: 227330 - DNA, 20 bp, Artificial sequence
  SiRNA target sequence
ctatgcttcaatttatacat

SEQ ID NO: 227331 - DNA, 20 bp, Artificial sequence
  SiRNA target sequence
tatgcttcaatttatacatc

SEQ ID NO: 227332 - DNA, 20 bp, Artificial sequence
  SiRNA target sequence
atgcttcaatttatacatca

SEQ ID NO: 227333 - DNA, 20 bp, Artificial sequence
  SiRNA target sequence
tgcttcaatttatacatcaa

SEQ ID NO: 227334 - DNA, 20 bp, Artificial sequence
  SiRNA target sequence
gcttcaatttatacatcaat

SEQ ID NO: 227335 - DNA, 20 bp, Artificial sequence
  SiRNA target sequence
cttcaatttatacatcaatt

SEQ ID NO: 227336 - DNA, 20 bp, Artificial sequence
  SiRNA target sequence
ttcaatttatacatcaattg

SEQ ID NO: 227337 - DNA, 20 bp, Artificial sequence
  SiRNA target sequence
tcaatttatacatcaattga

SEQ ID NO: 227338 - DNA, 20 bp, Artificial sequence
  SiRNA target sequence
caatttatacatcaattgaa

SEQ ID NO: 227339 - DNA, 20 bp, Artificial sequence
  SiRNA target sequence
aatttatacatcaattgaac

SEQ ID NO: 227340 - DNA, 20 bp, Artificial sequence
  SiRNA target sequence
atttatacatcaattgaaca

SEQ ID NO: 227341 - DNA, 20 bp, Artificial sequence
  SiRNA target sequence
tttatacatcaattgaacaa

SEQ ID NO: 227342 - DNA, 20 bp, Artificial sequence
  SiRNA target sequence
ttatacatcaattgaacaat

SEQ ID NO: 227343 - DNA, 20 bp, Artificial sequence
  SiRNA target sequence
tatacatcaattgaacaatc

SEQ ID NO: 227344 - DNA, 20 bp, Artificial sequence
  SiRNA target sequence
atacatcaattgaacaatct

SEQ ID NO: 227345 - DNA, 20 bp, Artificial sequence
  SiRNA target sequence
tacatcaattgaacaatctg

SEQ ID NO: 227346 - DNA, 20 bp, Artificial sequence
  SiRNA target sequence
acatcaattgaacaatctgg

SEQ ID NO: 227347 - DNA, 20 bp, Artificial sequence
  SiRNA target sequence
catcaattgaacaatctgga

SEQ ID NO: 227348 - DNA, 20 bp, Artificial sequence
  SiRNA target sequence
atcaattgaacaatctggag

SEQ ID NO: 227349 - DNA, 20 bp, Artificial sequence
  SiRNA target sequence
tcaattgaacaatctggagt

SEQ ID NO: 227350 - DNA, 20 bp, Artificial sequence
  SiRNA target sequence
caattgaacaatctggagtt

SEQ ID NO: 227351 - DNA, 20 bp, Artificial sequence
  SiRNA target sequence
aattgaacaatctggagttg

SEQ ID NO: 227352 - DNA, 20 bp, Artificial sequence
  SiRNA target sequence
attgaacaatctggagttgc

SEQ ID NO: 227353 - DNA, 20 bp, Artificial sequence
  SiRNA target sequence
ttgaacaatctggagttgct

SEQ ID NO: 227354 - DNA, 20 bp, Artificial sequence
  SiRNA target sequence
tgaacaatctggagttgctg

SEQ ID NO: 227355 - DNA, 20 bp, Artificial sequence
  SiRNA target sequence
gaacaatctggagttgctgt

SEQ ID NO: 227356 - DNA, 20 bp, Artificial sequence
  SiRNA target sequence
aacaatctggagttgctgtt

SEQ ID NO: 227357 - DNA, 20 bp, Artificial sequence
  SiRNA target sequence
acaatctggagttgctgtta

SEQ ID NO: 227358 - DNA, 20 bp, Artificial sequence
  SiRNA target sequence
caatctggagttgctgttat

SEQ ID NO: 227359 - DNA, 20 bp, Artificial sequence
  SiRNA target sequence
aatctggagttgctgttatt

SEQ ID NO: 227360 - DNA, 20 bp, Artificial sequence
  SiRNA target sequence
atctggagttgctgttattg

SEQ ID NO: 227361 - DNA, 20 bp, Artificial sequence
  SiRNA target sequence
tctggagttgctgttattgt

SEQ ID NO: 227362 - DNA, 20 bp, Artificial sequence
  SiRNA target sequence
ctggagttgctgttattgtc

SEQ ID NO: 227363 - DNA, 20 bp, Artificial sequence
  SiRNA target sequence
tggagttgctgttattgtca

SEQ ID NO: 227364 - DNA, 20 bp, Artificial sequence
  SiRNA target sequence
ggagttgctgttattgtcat

SEQ ID NO: 227365 - DNA, 20 bp, Artificial sequence
  SiRNA target sequence
gagttgctgttattgtcatg

SEQ ID NO: 227366 - DNA, 20 bp, Artificial sequence
  SiRNA target sequence
agttgctgttattgtcatga

SEQ ID NO: 227367 - DNA, 20 bp, Artificial sequence
  SiRNA target sequence
gttgctgttattgtcatgat

SEQ ID NO: 227368 - DNA, 20 bp, Artificial sequence
  SiRNA target sequence
ttgctgttattgtcatgatt

SEQ ID NO: 227369 - DNA, 20 bp, Artificial sequence
  SiRNA target sequence
tgctgttattgtcatgattt

SEQ ID NO: 227370 - DNA, 20 bp, Artificial sequence
  SiRNA target sequence
gctgttattgtcatgatttt

SEQ ID NO: 227371 - DNA, 20 bp, Artificial sequence
  SiRNA target sequence
ctgttattgtcatgattttg

SEQ ID NO: 227372 - DNA, 20 bp, Artificial sequence
  SiRNA target sequence
tgttattgtcatgattttgc

SEQ ID NO: 227373 - DNA, 20 bp, Artificial sequence
  SiRNA target sequence
gttattgtcatgattttgct

SEQ ID NO: 227374 - DNA, 20 bp, Artificial sequence
  SiRNA target sequence
ttattgtcatgattttgcta

SEQ ID NO: 227375 - DNA, 20 bp, Artificial sequence
  SiRNA target sequence
tattgtcatgattttgctac

SEQ ID NO: 227376 - DNA, 20 bp, Artificial sequence
  SiRNA target sequence
attgtcatgattttgctact

SEQ ID NO: 227377 - DNA, 20 bp, Artificial sequence
  SiRNA target sequence
ttgtcatgattttgctactt

SEQ ID NO: 227378 - DNA, 20 bp, Artificial sequence
  SiRNA target sequence
tgtcatgattttgctactta

SEQ ID NO: 227379 - DNA, 20 bp, Artificial sequence
  SiRNA target sequence
gtcatgattttgctacttac

SEQ ID NO: 227380 - DNA, 20 bp, Artificial sequence
  SiRNA target sequence
tcatgattttgctacttacc

SEQ ID NO: 227381 - DNA, 20 bp, Artificial sequence
  SiRNA target sequence
catgattttgctacttaccc

SEQ ID NO: 227382 - DNA, 20 bp, Artificial sequence
  SiRNA target sequence
atgattttgctacttacccc

SEQ ID NO: 227383 - DNA, 20 bp, Artificial sequence
  SiRNA target sequence
tgattttgctacttacccct

SEQ ID NO: 227384 - DNA, 20 bp, Artificial sequence
  SiRNA target sequence
gattttgctacttacccctt

SEQ ID NO: 227385 - DNA, 20 bp, Artificial sequence
  SiRNA target sequence
attttgctacttaccccttt

SEQ ID NO: 227386 - DNA, 20 bp, Artificial sequence
  SiRNA target sequence
ttttgctacttacccctttt

SEQ ID NO: 227387 - DNA, 20 bp, Artificial sequence
  SiRNA target sequence
tttgctacttaccccttttc

SEQ ID NO: 227388 - DNA, 20 bp, Artificial sequence
  SiRNA target sequence
ttgctacttaccccttttcc

SEQ ID NO: 227389 - DNA, 20 bp, Artificial sequence
  SiRNA target sequence
tgctacttaccccttttcca

SEQ ID NO: 227390 - DNA, 20 bp, Artificial sequence
  SiRNA target sequence
gctacttaccccttttccaa

SEQ ID NO: 227391 - DNA, 20 bp, Artificial sequence
  SiRNA target sequence
ctacttaccccttttccaag

SEQ ID NO: 227392 - DNA, 20 bp, Artificial sequence
  SiRNA target sequence
tacttaccccttttccaagg

SEQ ID NO: 227393 - DNA, 20 bp, Artificial sequence
  SiRNA target sequence
acttaccccttttccaaggc

SEQ ID NO: 227394 - DNA, 20 bp, Artificial sequence
  SiRNA target sequence
cttaccccttttccaaggct

SEQ ID NO: 227395 - DNA, 20 bp, Artificial sequence
  SiRNA target sequence
ttaccccttttccaaggctt

SEQ ID NO: 227396 - DNA, 20 bp, Artificial sequence
  SiRNA target sequence
taccccttttccaaggctta

SEQ ID NO: 227397 - DNA, 20 bp, Artificial sequence
  SiRNA target sequence
accccttttccaaggcttat

SEQ ID NO: 227398 - DNA, 20 bp, Artificial sequence
  SiRNA target sequence
ccccttttccaaggcttatt

SEQ ID NO: 227399 - DNA, 20 bp, Artificial sequence
  SiRNA target sequence
cccttttccaaggcttatta

SEQ ID NO: 227400 - DNA, 20 bp, Artificial sequence
  SiRNA target sequence
ccttttccaaggcttattaa

SEQ ID NO: 227401 - DNA, 20 bp, Artificial sequence
  SiRNA target sequence
cttttccaaggcttattaaa

SEQ ID NO: 227402 - DNA, 20 bp, Artificial sequence
  SiRNA target sequence
ttttccaaggcttattaaaa

SEQ ID NO: 227403 - DNA, 20 bp, Artificial sequence
  SiRNA target sequence
tttccaaggcttattaaaac

SEQ ID NO: 227404 - DNA, 20 bp, Artificial sequence
  SiRNA target sequence
ttccaaggcttattaaaaca

SEQ ID NO: 227405 - DNA, 20 bp, Artificial sequence
  SiRNA target sequence
tccaaggcttattaaaacaa

SEQ ID NO: 227406 - DNA, 20 bp, Artificial sequence
  SiRNA target sequence
ccaaggcttattaaaacaaa

SEQ ID NO: 227407 - DNA, 20 bp, Artificial sequence
  SiRNA target sequence
caaggcttattaaaacaaaa

SEQ ID NO: 227408 - DNA, 20 bp, Artificial sequence
  SiRNA target sequence
aaggcttattaaaacaaaag

SEQ ID NO: 227409 - DNA, 20 bp, Artificial sequence
  SiRNA target sequence
aggcttattaaaacaaaagg

SEQ ID NO: 227410 - DNA, 20 bp, Artificial sequence
  SiRNA target sequence
ggcttattaaaacaaaagga

SEQ ID NO: 227411 - DNA, 20 bp, Artificial sequence
  SiRNA target sequence
gcttattaaaacaaaaggat

SEQ ID NO: 227412 - DNA, 20 bp, Artificial sequence
  SiRNA target sequence
cttattaaaacaaaaggatg

SEQ ID NO: 227413 - DNA, 20 bp, Artificial sequence
  SiRNA target sequence
ttattaaaacaaaaggatgg

SEQ ID NO: 227414 - DNA, 20 bp, Artificial sequence
  SiRNA target sequence
tattaaaacaaaaggatgga

SEQ ID NO: 227415 - DNA, 20 bp, Artificial sequence
  SiRNA target sequence
attaaaacaaaaggatggat

SEQ ID NO: 227416 - DNA, 20 bp, Artificial sequence
  SiRNA target sequence
ttaaaacaaaaggatggatt

SEQ ID NO: 227417 - DNA, 20 bp, Artificial sequence
  SiRNA target sequence
taaaacaaaaggatggatta

SEQ ID NO: 227418 - DNA, 20 bp, Artificial sequence
  SiRNA target sequence
aaaacaaaaggatggattac

SEQ ID NO: 227419 - DNA, 20 bp, Artificial sequence
  SiRNA target sequence
aaacaaaaggatggattaca

SEQ ID NO: 227420 - DNA, 20 bp, Artificial sequence
  SiRNA target sequence
aacaaaaggatggattacaa

SEQ ID NO: 227421 - DNA, 20 bp, Artificial sequence
  SiRNA target sequence
acaaaaggatggattacaat

SEQ ID NO: 227422 - DNA, 20 bp, Artificial sequence
  SiRNA target sequence
caaaaggatggattacaata

SEQ ID NO: 227423 - DNA, 20 bp, Artificial sequence
  SiRNA target sequence
aaaaggatggattacaatag

SEQ ID NO: 227424 - DNA, 20 bp, Artificial sequence
  SiRNA target sequence
aaaggatggattacaatagc

SEQ ID NO: 227425 - DNA, 20 bp, Artificial sequence
  SiRNA target sequence
aaggatggattacaatagcc

SEQ ID NO: 227426 - DNA, 20 bp, Artificial sequence
  SiRNA target sequence
aggatggattacaatagcca

SEQ ID NO: 227427 - DNA, 20 bp, Artificial sequence
  SiRNA target sequence
ggatggattacaatagccat

SEQ ID NO: 227428 - DNA, 20 bp, Artificial sequence
  SiRNA target sequence
gatggattacaatagccatt

SEQ ID NO: 227429 - DNA, 20 bp, Artificial sequence
  SiRNA target sequence
atggattacaatagccattc

SEQ ID NO: 227430 - DNA, 20 bp, Artificial sequence
  SiRNA target sequence
tggattacaatagccattct

SEQ ID NO: 227431 - DNA, 20 bp, Artificial sequence
  SiRNA target sequence
ggattacaatagccattcta

SEQ ID NO: 227432 - DNA, 20 bp, Artificial sequence
  SiRNA target sequence
gattacaatagccattctat

SEQ ID NO: 227433 - DNA, 20 bp, Artificial sequence
  SiRNA target sequence
attacaatagccattctatg

SEQ ID NO: 227434 - DNA, 20 bp, Artificial sequence
  SiRNA target sequence
ttacaatagccattctatgt

SEQ ID NO: 227435 - DNA, 20 bp, Artificial sequence
  SiRNA target sequence
tacaatagccattctatgtc

SEQ ID NO: 227436 - DNA, 20 bp, Artificial sequence
  SiRNA target sequence
acaatagccattctatgtcc

SEQ ID NO: 227437 - DNA, 20 bp, Artificial sequence
  SiRNA target sequence
caatagccattctatgtcct

SEQ ID NO: 227438 - DNA, 20 bp, Artificial sequence
  SiRNA target sequence
aatagccattctatgtccta

SEQ ID NO: 227439 - DNA, 20 bp, Artificial sequence
  SiRNA target sequence
atagccattctatgtcctat

SEQ ID NO: 227440 - DNA, 20 bp, Artificial sequence
  SiRNA target sequence
tagccattctatgtcctatt

SEQ ID NO: 227441 - DNA, 20 bp, Artificial sequence
  SiRNA target sequence
agccattctatgtcctatta

SEQ ID NO: 227442 - DNA, 20 bp, Artificial sequence
  SiRNA target sequence
gccattctatgtcctattat

SEQ ID NO: 227443 - DNA, 20 bp, Artificial sequence
  SiRNA target sequence
ccattctatgtcctattatt

SEQ ID NO: 227444 - DNA, 20 bp, Artificial sequence
  SiRNA target sequence
cattctatgtcctattatta

SEQ ID NO: 227445 - DNA, 20 bp, Artificial sequence
  SiRNA target sequence
attctatgtcctattattac

SEQ ID NO: 227446 - DNA, 20 bp, Artificial sequence
  SiRNA target sequence
ttctatgtcctattattact

SEQ ID NO: 227447 - DNA, 20 bp, Artificial sequence
  SiRNA target sequence
tctatgtcctattattactt

SEQ ID NO: 227448 - DNA, 20 bp, Artificial sequence
  SiRNA target sequence
ctatgtcctattattacttt

SEQ ID NO: 227449 - DNA, 20 bp, Artificial sequence
  SiRNA target sequence
tatgtcctattattactttt

SEQ ID NO: 227450 - DNA, 20 bp, Artificial sequence
  SiRNA target sequence
atgtcctattattacttttt

SEQ ID NO: 227451 - DNA, 20 bp, Artificial sequence
  SiRNA target sequence
tgtcctattattactttttt

SEQ ID NO: 227452 - DNA, 20 bp, Artificial sequence
  SiRNA target sequence
gtcctattattacttttttt

SEQ ID NO: 227453 - DNA, 20 bp, Artificial sequence
  SiRNA target sequence
tcctattattactttttttt

SEQ ID NO: 227454 - DNA, 20 bp, Artificial sequence
  SiRNA target sequence
cctattattacttttttttc

SEQ ID NO: 227455 - DNA, 20 bp, Artificial sequence
  SiRNA target sequence
ctattattacttttttttct

SEQ ID NO: 227456 - DNA, 20 bp, Artificial sequence
  SiRNA target sequence
tattattacttttttttctg

SEQ ID NO: 227457 - DNA, 20 bp, Artificial sequence
  SiRNA target sequence
attattacttttttttctgc

SEQ ID NO: 227458 - DNA, 20 bp, Artificial sequence
  SiRNA target sequence
ttattacttttttttctgct

SEQ ID NO: 227459 - DNA, 20 bp, Artificial sequence
  SiRNA target sequence
tattacttttttttctgctt

SEQ ID NO: 227460 - DNA, 20 bp, Artificial sequence
  SiRNA target sequence
attacttttttttctgcttt

SEQ ID NO: 227461 - DNA, 20 bp, Artificial sequence
  SiRNA target sequence
ttacttttttttctgctttt

SEQ ID NO: 227462 - DNA, 20 bp, Artificial sequence
  SiRNA target sequence
tacttttttttctgcttttg

SEQ ID NO: 227463 - DNA, 20 bp, Artificial sequence
  SiRNA target sequence
acttttttttctgcttttgg

SEQ ID NO: 227464 - DNA, 20 bp, Artificial sequence
  SiRNA target sequence
cttttttttctgcttttggt

SEQ ID NO: 227465 - DNA, 20 bp, Artificial sequence
  SiRNA target sequence
ttttttttctgcttttggta

SEQ ID NO: 227466 - DNA, 20 bp, Artificial sequence
  SiRNA target sequence
tttttttctgcttttggtac

SEQ ID NO: 227467 - DNA, 20 bp, Artificial sequence
  SiRNA target sequence
ttttttctgcttttggtact

SEQ ID NO: 227468 - DNA, 20 bp, Artificial sequence
  SiRNA target sequence
tttttctgcttttggtactt

SEQ ID NO: 227469 - DNA, 20 bp, Artificial sequence
  SiRNA target sequence
ttttctgcttttggtacttt

SEQ ID NO: 227470 - DNA, 20 bp, Artificial sequence
  SiRNA target sequence
tttctgcttttggtactttt

SEQ ID NO: 227471 - DNA, 20 bp, Artificial sequence
  SiRNA target sequence
ttctgcttttggtacttttg

SEQ ID NO: 227472 - DNA, 20 bp, Artificial sequence
  SiRNA target sequence
tctgcttttggtacttttgt

SEQ ID NO: 227473 - DNA, 20 bp, Artificial sequence
  SiRNA target sequence
ctgcttttggtacttttgta

SEQ ID NO: 227474 - DNA, 20 bp, Artificial sequence
  SiRNA target sequence
tgcttttggtacttttgtat

SEQ ID NO: 227475 - DNA, 20 bp, Artificial sequence
  SiRNA target sequence
gcttttggtacttttgtatt

SEQ ID NO: 227476 - DNA, 20 bp, Artificial sequence
  SiRNA target sequence
cttttggtacttttgtatta

SEQ ID NO: 227477 - DNA, 20 bp, Artificial sequence
  SiRNA target sequence
ttttggtacttttgtattag

SEQ ID NO: 227478 - DNA, 20 bp, Artificial sequence
  SiRNA target sequence
tttggtacttttgtattagc

SEQ ID NO: 227479 - DNA, 20 bp, Artificial sequence
  SiRNA target sequence
ttggtacttttgtattagct

SEQ ID NO: 227480 - DNA, 20 bp, Artificial sequence
  SiRNA target sequence
tggtacttttgtattagctt

SEQ ID NO: 227481 - DNA, 20 bp, Artificial sequence
  SiRNA target sequence
ggtacttttgtattagctta

SEQ ID NO: 227482 - DNA, 20 bp, Artificial sequence
  SiRNA target sequence
gtacttttgtattagcttat

SEQ ID NO: 227483 - DNA, 20 bp, Artificial sequence
  SiRNA target sequence
tacttttgtattagcttatt

SEQ ID NO: 227484 - DNA, 20 bp, Artificial sequence
  SiRNA target sequence
acttttgtattagcttattt

SEQ ID NO: 227485 - DNA, 20 bp, Artificial sequence
  SiRNA target sequence
cttttgtattagcttattta

SEQ ID NO: 227486 - DNA, 20 bp, Artificial sequence
  SiRNA target sequence
ttttgtattagcttatttaa

SEQ ID NO: 227487 - DNA, 20 bp, Artificial sequence
  SiRNA target sequence
tttgtattagcttatttaaa

SEQ ID NO: 227488 - DNA, 20 bp, Artificial sequence
  SiRNA target sequence
ttgtattagcttatttaaac

SEQ ID NO: 227489 - DNA, 20 bp, Artificial sequence
  SiRNA target sequence
tgtattagcttatttaaact

SEQ ID NO: 227490 - DNA, 20 bp, Artificial sequence
  SiRNA target sequence
gtattagcttatttaaactt

SEQ ID NO: 227491 - DNA, 20 bp, Artificial sequence
  SiRNA target sequence
tattagcttatttaaacttc

SEQ ID NO: 227492 - DNA, 20 bp, Artificial sequence
  SiRNA target sequence
attagcttatttaaacttcc

SEQ ID NO: 227493 - DNA, 20 bp, Artificial sequence
  SiRNA target sequence
ttagcttatttaaacttccc

SEQ ID NO: 227494 - DNA, 20 bp, Artificial sequence
  SiRNA target sequence
tagcttatttaaacttccca

SEQ ID NO: 227495 - DNA, 20 bp, Artificial sequence
  SiRNA target sequence
agcttatttaaacttcccaa

SEQ ID NO: 227496 - DNA, 20 bp, Artificial sequence
  SiRNA target sequence
gcttatttaaacttcccaat

SEQ ID NO: 227497 - DNA, 20 bp, Artificial sequence
  SiRNA target sequence
cttatttaaacttcccaatt

SEQ ID NO: 227498 - DNA, 20 bp, Artificial sequence
  SiRNA target sequence
ttatttaaacttcccaatta

SEQ ID NO: 227499 - DNA, 20 bp, Artificial sequence
  SiRNA target sequence
tatttaaacttcccaattac

SEQ ID NO: 227500 - DNA, 20 bp, Artificial sequence
  SiRNA target sequence
atttaaacttcccaattaca

SEQ ID NO: 227501 - DNA, 20 bp, Artificial sequence
  SiRNA target sequence
tttaaacttcccaattacaa

SEQ ID NO: 227502 - DNA, 20 bp, Artificial sequence
  SiRNA target sequence
ttaaacttcccaattacaaa

SEQ ID NO: 227503 - DNA, 20 bp, Artificial sequence
  SiRNA target sequence
taaacttcccaattacaaac

SEQ ID NO: 227504 - DNA, 20 bp, Artificial sequence
  SiRNA target sequence
aaacttcccaattacaaaca

SEQ ID NO: 227505 - DNA, 20 bp, Artificial sequence
  SiRNA target sequence
aacttcccaattacaaacaa

SEQ ID NO: 227506 - DNA, 20 bp, Artificial sequence
  SiRNA target sequence
acttcccaattacaaacaaa

SEQ ID NO: 227507 - DNA, 20 bp, Artificial sequence
  SiRNA target sequence
cttcccaattacaaacaaag

SEQ ID NO: 227508 - DNA, 20 bp, Artificial sequence
  SiRNA target sequence
ttcccaattacaaacaaaga

SEQ ID NO: 227509 - DNA, 20 bp, Artificial sequence
  SiRNA target sequence
tcccaattacaaacaaagag

SEQ ID NO: 227510 - DNA, 20 bp, Artificial sequence
  SiRNA target sequence
cccaattacaaacaaagagg

SEQ ID NO: 227511 - DNA, 20 bp, Artificial sequence
  SiRNA target sequence
ccaattacaaacaaagagga

SEQ ID NO: 227512 - DNA, 20 bp, Artificial sequence
  SiRNA target sequence
caattacaaacaaagaggat

SEQ ID NO: 227513 - DNA, 20 bp, Artificial sequence
  SiRNA target sequence
aattacaaacaaagaggata

SEQ ID NO: 227514 - DNA, 20 bp, Artificial sequence
  SiRNA target sequence
attacaaacaaagaggataa

SEQ ID NO: 227515 - DNA, 20 bp, Artificial sequence
  SiRNA target sequence
ttacaaacaaagaggataat

SEQ ID NO: 227516 - DNA, 20 bp, Artificial sequence
  SiRNA target sequence
tacaaacaaagaggataata

SEQ ID NO: 227517 - DNA, 20 bp, Artificial sequence
  SiRNA target sequence
acaaacaaagaggataatat

SEQ ID NO: 227518 - DNA, 20 bp, Artificial sequence
  SiRNA target sequence
caaacaaagaggataatata

SEQ ID NO: 227519 - DNA, 20 bp, Artificial sequence
  SiRNA target sequence
aaacaaagaggataatatat

SEQ ID NO: 227520 - DNA, 20 bp, Artificial sequence
  SiRNA target sequence
aacaaagaggataatatatt

SEQ ID NO: 227521 - DNA, 20 bp, Artificial sequence
  SiRNA target sequence
acaaagaggataatatattt

SEQ ID NO: 227522 - DNA, 20 bp, Artificial sequence
  SiRNA target sequence
caaagaggataatatatttg

SEQ ID NO: 227523 - DNA, 20 bp, Artificial sequence
  SiRNA target sequence
aaagaggataatatatttga

SEQ ID NO: 227524 - DNA, 20 bp, Artificial sequence
  SiRNA target sequence
aagaggataatatatttgat

SEQ ID NO: 227525 - DNA, 20 bp, Artificial sequence
  SiRNA target sequence
agaggataatatatttgata

SEQ ID NO: 227526 - DNA, 20 bp, Artificial sequence
  SiRNA target sequence
gaggataatatatttgatat

SEQ ID NO: 227527 - DNA, 20 bp, Artificial sequence
  SiRNA target sequence
aggataatatatttgatatt

SEQ ID NO: 227528 - DNA, 20 bp, Artificial sequence
  SiRNA target sequence
ggataatatatttgatattt

SEQ ID NO: 227529 - DNA, 20 bp, Artificial sequence
  SiRNA target sequence
gataatatatttgatattta

SEQ ID NO: 227530 - DNA, 20 bp, Artificial sequence
  SiRNA target sequence
ataatatatttgatatttac

SEQ ID NO: 227531 - DNA, 20 bp, Artificial sequence
  SiRNA target sequence
taatatatttgatatttacc

SEQ ID NO: 227532 - DNA, 20 bp, Artificial sequence
  SiRNA target sequence
aatatatttgatatttaccg

SEQ ID NO: 227533 - DNA, 20 bp, Artificial sequence
  SiRNA target sequence
atatatttgatatttaccgt

SEQ ID NO: 227534 - DNA, 20 bp, Artificial sequence
  SiRNA target sequence
tatatttgatatttaccgtt

SEQ ID NO: 227535 - DNA, 20 bp, Artificial sequence
  SiRNA target sequence
atatttgatatttaccgttt

SEQ ID NO: 227536 - DNA, 20 bp, Artificial sequence
  SiRNA target sequence
tatttgatatttaccgttta

SEQ ID NO: 227537 - DNA, 20 bp, Artificial sequence
  SiRNA target sequence
atttgatatttaccgtttac

SEQ ID NO: 227538 - DNA, 20 bp, Artificial sequence
  SiRNA target sequence
tttgatatttaccgtttacc

SEQ ID NO: 227539 - DNA, 20 bp, Artificial sequence
  SiRNA target sequence
ttgatatttaccgtttaccg

SEQ ID NO: 227540 - DNA, 20 bp, Artificial sequence
  SiRNA target sequence
tgatatttaccgtttaccgt

SEQ ID NO: 227541 - DNA, 20 bp, Artificial sequence
  SiRNA target sequence
gatatttaccgtttaccgtc

SEQ ID NO: 227542 - DNA, 20 bp, Artificial sequence
  SiRNA target sequence
atatttaccgtttaccgtca

SEQ ID NO: 227543 - DNA, 20 bp, Artificial sequence
  SiRNA target sequence
tatttaccgtttaccgtcaa

SEQ ID NO: 227544 - DNA, 20 bp, Artificial sequence
  SiRNA target sequence
atttaccgtttaccgtcaac

SEQ ID NO: 227545 - DNA, 20 bp, Artificial sequence
  SiRNA target sequence
tttaccgtttaccgtcaact

SEQ ID NO: 227546 - DNA, 20 bp, Artificial sequence
  SiRNA target sequence
ttaccgtttaccgtcaactg

SEQ ID NO: 227547 - DNA, 20 bp, Artificial sequence
  SiRNA target sequence
taccgtttaccgtcaactga

SEQ ID NO: 227548 - DNA, 20 bp, Artificial sequence
  SiRNA target sequence
accgtttaccgtcaactgat

SEQ ID NO: 227549 - DNA, 20 bp, Artificial sequence
  SiRNA target sequence
ccgtttaccgtcaactgatt

SEQ ID NO: 227550 - DNA, 20 bp, Artificial sequence
  SiRNA target sequence
cgtttaccgtcaactgattc

SEQ ID NO: 227551 - DNA, 20 bp, Artificial sequence
  SiRNA target sequence
gtttaccgtcaactgattct

SEQ ID NO: 227552 - DNA, 20 bp, Artificial sequence
  SiRNA target sequence
tttaccgtcaactgattcta

SEQ ID NO: 227553 - DNA, 20 bp, Artificial sequence
  SiRNA target sequence
ttaccgtcaactgattctat

SEQ ID NO: 227554 - DNA, 20 bp, Artificial sequence
  SiRNA target sequence
taccgtcaactgattctata

SEQ ID NO: 227555 - DNA, 20 bp, Artificial sequence
  SiRNA target sequence
accgtcaactgattctataa

SEQ ID NO: 227556 - DNA, 20 bp, Artificial sequence
  SiRNA target sequence
ccgtcaactgattctataat

SEQ ID NO: 227557 - DNA, 20 bp, Artificial sequence
  SiRNA target sequence
cgtcaactgattctataatc

SEQ ID NO: 227558 - DNA, 20 bp, Artificial sequence
  SiRNA target sequence
gtcaactgattctataatca

SEQ ID NO: 227559 - DNA, 20 bp, Artificial sequence
  SiRNA target sequence
tcaactgattctataatcaa

SEQ ID NO: 227560 - DNA, 20 bp, Artificial sequence
  SiRNA target sequence
caactgattctataatcaaa

SEQ ID NO: 227561 - DNA, 20 bp, Artificial sequence
  SiRNA target sequence
aactgattctataatcaaat

SEQ ID NO: 227562 - DNA, 20 bp, Artificial sequence
  SiRNA target sequence
actgattctataatcaaatt

SEQ ID NO: 227563 - DNA, 20 bp, Artificial sequence
  SiRNA target sequence
ctgattctataatcaaatta

SEQ ID NO: 227564 - DNA, 20 bp, Artificial sequence
  SiRNA target sequence
tgattctataatcaaattag

SEQ ID NO: 227565 - DNA, 20 bp, Artificial sequence
  SiRNA target sequence
gattctataatcaaattaga

SEQ ID NO: 227566 - DNA, 20 bp, Artificial sequence
  SiRNA target sequence
attctataatcaaattagaa

SEQ ID NO: 227567 - DNA, 20 bp, Artificial sequence
  SiRNA target sequence
ttctataatcaaattagaaa

SEQ ID NO: 227568 - DNA, 20 bp, Artificial sequence
  SiRNA target sequence
tctataatcaaattagaaaa

SEQ ID NO: 227569 - DNA, 20 bp, Artificial sequence
  SiRNA target sequence
ctataatcaaattagaaaat

SEQ ID NO: 227570 - DNA, 20 bp, Artificial sequence
  SiRNA target sequence
tataatcaaattagaaaata

SEQ ID NO: 227571 - DNA, 20 bp, Artificial sequence
  SiRNA target sequence
ataatcaaattagaaaatat

SEQ ID NO: 227572 - DNA, 20 bp, Artificial sequence
  SiRNA target sequence
taatcaaattagaaaatatt

SEQ ID NO: 227573 - DNA, 20 bp, Artificial sequence
  SiRNA target sequence
aatcaaattagaaaatattg

SEQ ID NO: 227574 - DNA, 20 bp, Artificial sequence
  SiRNA target sequence
atcaaattagaaaatattgt

SEQ ID NO: 227575 - DNA, 20 bp, Artificial sequence
  SiRNA target sequence
tcaaattagaaaatattgtt

SEQ ID NO: 227576 - DNA, 20 bp, Artificial sequence
  SiRNA target sequence
caaattagaaaatattgttg

SEQ ID NO: 227577 - DNA, 20 bp, Artificial sequence
  SiRNA target sequence
aaattagaaaatattgttgg

SEQ ID NO: 227578 - DNA, 20 bp, Artificial sequence
  SiRNA target sequence
aattagaaaatattgttggt

SEQ ID NO: 227579 - DNA, 20 bp, Artificial sequence
  SiRNA target sequence
attagaaaatattgttggtg

SEQ ID NO: 227580 - DNA, 20 bp, Artificial sequence
  SiRNA target sequence
ttagaaaatattgttggtgt

SEQ ID NO: 227581 - DNA, 20 bp, Artificial sequence
  SiRNA target sequence
tagaaaatattgttggtgtc

SEQ ID NO: 227582 - DNA, 20 bp, Artificial sequence
  SiRNA target sequence
agaaaatattgttggtgtca

SEQ ID NO: 227583 - DNA, 20 bp, Artificial sequence
  SiRNA target sequence
gaaaatattgttggtgtcat

SEQ ID NO: 227584 - DNA, 20 bp, Artificial sequence
  SiRNA target sequence
aaaatattgttggtgtcatt

SEQ ID NO: 227585 - DNA, 20 bp, Artificial sequence
  SiRNA target sequence
aaatattgttggtgtcattt

SEQ ID NO: 227586 - DNA, 20 bp, Artificial sequence
  SiRNA target sequence
aatattgttggtgtcatttg

SEQ ID NO: 227587 - DNA, 20 bp, Artificial sequence
  SiRNA target sequence
atattgttggtgtcatttgt

SEQ ID NO: 227588 - DNA, 20 bp, Artificial sequence
  SiRNA target sequence
tattgttggtgtcatttgtg

SEQ ID NO: 227589 - DNA, 20 bp, Artificial sequence
  SiRNA target sequence
attgttggtgtcatttgtgt

SEQ ID NO: 227590 - DNA, 20 bp, Artificial sequence
  SiRNA target sequence
ttgttggtgtcatttgtgta

SEQ ID NO: 227591 - DNA, 20 bp, Artificial sequence
  SiRNA target sequence
tgttggtgtcatttgtgtat

SEQ ID NO: 227592 - DNA, 20 bp, Artificial sequence
  SiRNA target sequence
gttggtgtcatttgtgtatc

SEQ ID NO: 227593 - DNA, 20 bp, Artificial sequence
  SiRNA target sequence
ttggtgtcatttgtgtatct

SEQ ID NO: 227594 - DNA, 20 bp, Artificial sequence
  SiRNA target sequence
tggtgtcatttgtgtatctt

SEQ ID NO: 227595 - DNA, 20 bp, Artificial sequence
  SiRNA target sequence
ggtgtcatttgtgtatcttt

SEQ ID NO: 227596 - DNA, 20 bp, Artificial sequence
  SiRNA target sequence
gtgtcatttgtgtatcttta

SEQ ID NO: 227597 - DNA, 20 bp, Artificial sequence
  SiRNA target sequence
tgtcatttgtgtatctttaa

SEQ ID NO: 227598 - DNA, 20 bp, Artificial sequence
  SiRNA target sequence
gtcatttgtgtatctttaat

SEQ ID NO: 227599 - DNA, 20 bp, Artificial sequence
  SiRNA target sequence
tcatttgtgtatctttaatg

SEQ ID NO: 227600 - DNA, 20 bp, Artificial sequence
  SiRNA target sequence
catttgtgtatctttaatga

SEQ ID NO: 227601 - DNA, 20 bp, Artificial sequence
  SiRNA target sequence
atttgtgtatctttaatgaa

SEQ ID NO: 227602 - DNA, 20 bp, Artificial sequence
  SiRNA target sequence
tttgtgtatctttaatgaag

SEQ ID NO: 227603 - DNA, 20 bp, Artificial sequence
  SiRNA target sequence
ttgtgtatctttaatgaaga

SEQ ID NO: 227604 - DNA, 20 bp, Artificial sequence
  SiRNA target sequence
tgtgtatctttaatgaagat

SEQ ID NO: 227605 - DNA, 20 bp, Artificial sequence
  SiRNA target sequence
gtgtatctttaatgaagatt

SEQ ID NO: 227606 - DNA, 20 bp, Artificial sequence
  SiRNA target sequence
tgtatctttaatgaagattt

SEQ ID NO: 227607 - DNA, 20 bp, Artificial sequence
  SiRNA target sequence
gtatctttaatgaagatttc

SEQ ID NO: 227608 - DNA, 20 bp, Artificial sequence
  SiRNA target sequence
tatctttaatgaagatttct

SEQ ID NO: 227609 - DNA, 20 bp, Artificial sequence
  SiRNA target sequence
atctttaatgaagatttcta

SEQ ID NO: 227610 - DNA, 20 bp, Artificial sequence
  SiRNA target sequence
tctttaatgaagatttctaa

SEQ ID NO: 227611 - DNA, 20 bp, Artificial sequence
  SiRNA target sequence
ctttaatgaagatttctaaa

SEQ ID NO: 227612 - DNA, 20 bp, Artificial sequence
  SiRNA target sequence
tttaatgaagatttctaaat

SEQ ID NO: 227613 - DNA, 20 bp, Artificial sequence
  SiRNA target sequence
ttaatgaagatttctaaata

SEQ ID NO: 227614 - DNA, 20 bp, Artificial sequence
  SiRNA target sequence
taatgaagatttctaaatat

SEQ ID NO: 227615 - DNA, 20 bp, Artificial sequence
  SiRNA target sequence
aatgaagatttctaaatatg

SEQ ID NO: 227616 - DNA, 20 bp, Artificial sequence
  SiRNA target sequence
atgaagatttctaaatatgc

SEQ ID NO: 227617 - DNA, 20 bp, Artificial sequence
  SiRNA target sequence
tgaagatttctaaatatgca

SEQ ID NO: 227618 - DNA, 20 bp, Artificial sequence
  SiRNA target sequence
gaagatttctaaatatgcag

SEQ ID NO: 227619 - DNA, 20 bp, Artificial sequence
  SiRNA target sequence
aagatttctaaatatgcagc

SEQ ID NO: 227620 - DNA, 20 bp, Artificial sequence
  SiRNA target sequence
agatttctaaatatgcagca

SEQ ID NO: 227621 - DNA, 20 bp, Artificial sequence
  SiRNA target sequence
gatttctaaatatgcagcat

SEQ ID NO: 227622 - DNA, 20 bp, Artificial sequence
  SiRNA target sequence
atttctaaatatgcagcatt

SEQ ID NO: 227623 - DNA, 20 bp, Artificial sequence
  SiRNA target sequence
tttctaaatatgcagcattt

SEQ ID NO: 227624 - DNA, 20 bp, Artificial sequence
  SiRNA target sequence
ttctaaatatgcagcatttg

SEQ ID NO: 227625 - DNA, 20 bp, Artificial sequence
  SiRNA target sequence
tctaaatatgcagcatttga

SEQ ID NO: 227626 - DNA, 20 bp, Artificial sequence
  SiRNA target sequence
ctaaatatgcagcatttgat

SEQ ID NO: 227627 - DNA, 20 bp, Artificial sequence
  SiRNA target sequence
taaatatgcagcatttgata

SEQ ID NO: 227628 - DNA, 20 bp, Artificial sequence
  SiRNA target sequence
aaatatgcagcatttgatat

SEQ ID NO: 227629 - DNA, 20 bp, Artificial sequence
  SiRNA target sequence
aatatgcagcatttgatatc

SEQ ID NO: 227630 - DNA, 20 bp, Artificial sequence
  SiRNA target sequence
atatgcagcatttgatatca

SEQ ID NO: 227631 - DNA, 20 bp, Artificial sequence
  SiRNA target sequence
tatgcagcatttgatatcac

SEQ ID NO: 227632 - DNA, 20 bp, Artificial sequence
  SiRNA target sequence
atgcagcatttgatatcaca

SEQ ID NO: 227633 - DNA, 20 bp, Artificial sequence
  SiRNA target sequence
tgcagcatttgatatcacaa

SEQ ID NO: 227634 - DNA, 20 bp, Artificial sequence
  SiRNA target sequence
gcagcatttgatatcacaaa

SEQ ID NO: 227635 - DNA, 20 bp, Artificial sequence
  SiRNA target sequence
cagcatttgatatcacaaaa

SEQ ID NO: 227636 - DNA, 20 bp, Artificial sequence
  SiRNA target sequence
agcatttgatatcacaaaag

SEQ ID NO: 227637 - DNA, 20 bp, Artificial sequence
  SiRNA target sequence
gcatttgatatcacaaaaga

SEQ ID NO: 227638 - DNA, 20 bp, Artificial sequence
  SiRNA target sequence
catttgatatcacaaaagag

SEQ ID NO: 227639 - DNA, 20 bp, Artificial sequence
  SiRNA target sequence
atttgatatcacaaaagagg

SEQ ID NO: 227640 - DNA, 20 bp, Artificial sequence
  SiRNA target sequence
tttgatatcacaaaagaggc

SEQ ID NO: 227641 - DNA, 20 bp, Artificial sequence
  SiRNA target sequence
ttgatatcacaaaagaggct

SEQ ID NO: 227642 - DNA, 20 bp, Artificial sequence
  SiRNA target sequence
tgatatcacaaaagaggctt

SEQ ID NO: 227643 - DNA, 20 bp, Artificial sequence
  SiRNA target sequence
gatatcacaaaagaggcttt

SEQ ID NO: 227644 - DNA, 20 bp, Artificial sequence
  SiRNA target sequence
atatcacaaaagaggctttg

SEQ ID NO: 227645 - DNA, 20 bp, Artificial sequence
  SiRNA target sequence
tatcacaaaagaggctttgt

SEQ ID NO: 227646 - DNA, 20 bp, Artificial sequence
  SiRNA target sequence
atcacaaaagaggctttgtc

SEQ ID NO: 227647 - DNA, 20 bp, Artificial sequence
  SiRNA target sequence
tcacaaaagaggctttgtct

SEQ ID NO: 227648 - DNA, 20 bp, Artificial sequence
  SiRNA target sequence
cacaaaagaggctttgtcta

SEQ ID NO: 227649 - DNA, 20 bp, Artificial sequence
  SiRNA target sequence
acaaaagaggctttgtctat

SEQ ID NO: 227650 - DNA, 20 bp, Artificial sequence
  SiRNA target sequence
caaaagaggctttgtctatg

SEQ ID NO: 227651 - DNA, 20 bp, Artificial sequence
  SiRNA target sequence
aaaagaggctttgtctatgc

SEQ ID NO: 227652 - DNA, 20 bp, Artificial sequence
  SiRNA target sequence
aaagaggctttgtctatgca

SEQ ID NO: 227653 - DNA, 20 bp, Artificial sequence
  SiRNA target sequence
aagaggctttgtctatgcag

SEQ ID NO: 227654 - DNA, 20 bp, Artificial sequence
  SiRNA target sequence
agaggctttgtctatgcaga

SEQ ID NO: 227655 - DNA, 20 bp, Artificial sequence
  SiRNA target sequence
gaggctttgtctatgcagat

SEQ ID NO: 227656 - DNA, 20 bp, Artificial sequence
  SiRNA target sequence
aggctttgtctatgcagatt

SEQ ID NO: 227657 - DNA, 20 bp, Artificial sequence
  SiRNA target sequence
ggctttgtctatgcagattg

SEQ ID NO: 227658 - DNA, 20 bp, Artificial sequence
  SiRNA target sequence
gctttgtctatgcagattga

SEQ ID NO: 227659 - DNA, 20 bp, Artificial sequence
  SiRNA target sequence
ctttgtctatgcagattgat

SEQ ID NO: 227660 - DNA, 20 bp, Artificial sequence
  SiRNA target sequence
tttgtctatgcagattgatg

SEQ ID NO: 227661 - DNA, 20 bp, Artificial sequence
  SiRNA target sequence
ttgtctatgcagattgatgg

SEQ ID NO: 227662 - DNA, 20 bp, Artificial sequence
  SiRNA target sequence
tgtctatgcagattgatggt

SEQ ID NO: 227663 - DNA, 20 bp, Artificial sequence
  SiRNA target sequence
gtctatgcagattgatggtt

SEQ ID NO: 227664 - DNA, 20 bp, Artificial sequence
  SiRNA target sequence
tctatgcagattgatggttc

SEQ ID NO: 227665 - DNA, 20 bp, Artificial sequence
  SiRNA target sequence
ctatgcagattgatggttct

SEQ ID NO: 227666 - DNA, 20 bp, Artificial sequence
  SiRNA target sequence
tatgcagattgatggttcta

SEQ ID NO: 227667 - DNA, 20 bp, Artificial sequence
  SiRNA target sequence
atgcagattgatggttctat

SEQ ID NO: 227668 - DNA, 20 bp, Artificial sequence
  SiRNA target sequence
tgcagattgatggttctata

SEQ ID NO: 227669 - DNA, 20 bp, Artificial sequence
  SiRNA target sequence
gcagattgatggttctataa

SEQ ID NO: 227670 - DNA, 20 bp, Artificial sequence
  SiRNA target sequence
cagattgatggttctataag

SEQ ID NO: 227671 - DNA, 20 bp, Artificial sequence
  SiRNA target sequence
agattgatggttctataaga

SEQ ID NO: 227672 - DNA, 20 bp, Artificial sequence
  SiRNA target sequence
gattgatggttctataagag

SEQ ID NO: 227673 - DNA, 20 bp, Artificial sequence
  SiRNA target sequence
attgatggttctataagagc

SEQ ID NO: 227674 - DNA, 20 bp, Artificial sequence
  SiRNA target sequence
ttgatggttctataagagcg

SEQ ID NO: 227675 - DNA, 20 bp, Artificial sequence
  SiRNA target sequence
tgatggttctataagagcga

SEQ ID NO: 227676 - DNA, 20 bp, Artificial sequence
  SiRNA target sequence
gatggttctataagagcgaa

SEQ ID NO: 227677 - DNA, 20 bp, Artificial sequence
  SiRNA target sequence
atggttctataagagcgaaa

SEQ ID NO: 227678 - DNA, 20 bp, Artificial sequence
  SiRNA target sequence
tggttctataagagcgaaat

SEQ ID NO: 227679 - DNA, 20 bp, Artificial sequence
  SiRNA target sequence
ggttctataagagcgaaata

SEQ ID NO: 227680 - DNA, 20 bp, Artificial sequence
  SiRNA target sequence
gttctataagagcgaaatac

SEQ ID NO: 227681 - DNA, 20 bp, Artificial sequence
  SiRNA target sequence
ttctataagagcgaaataca

SEQ ID NO: 227682 - DNA, 20 bp, Artificial sequence
  SiRNA target sequence
tctataagagcgaaatacaa

SEQ ID NO: 227683 - DNA, 20 bp, Artificial sequence
  SiRNA target sequence
ctataagagcgaaatacaaa

SEQ ID NO: 227684 - DNA, 20 bp, Artificial sequence
  SiRNA target sequence
tataagagcgaaatacaaag

SEQ ID NO: 227685 - DNA, 20 bp, Artificial sequence
  SiRNA target sequence
ataagagcgaaatacaaagg

SEQ ID NO: 227686 - DNA, 20 bp, Artificial sequence
  SiRNA target sequence
taagagcgaaatacaaaggt

SEQ ID NO: 227687 - DNA, 20 bp, Artificial sequence
  SiRNA target sequence
aagagcgaaatacaaaggta

SEQ ID NO: 227688 - DNA, 20 bp, Artificial sequence
  SiRNA target sequence
agagcgaaatacaaaggtat

SEQ ID NO: 227689 - DNA, 20 bp, Artificial sequence
  SiRNA target sequence
gagcgaaatacaaaggtatt

SEQ ID NO: 227690 - DNA, 20 bp, Artificial sequence
  SiRNA target sequence
agcgaaatacaaaggtattt

SEQ ID NO: 227691 - DNA, 20 bp, Artificial sequence
  SiRNA target sequence
gcgaaatacaaaggtatttt

SEQ ID NO: 227692 - DNA, 20 bp, Artificial sequence
  SiRNA target sequence
cgaaatacaaaggtattttt

SEQ ID NO: 227693 - DNA, 20 bp, Artificial sequence
  SiRNA target sequence
gaaatacaaaggtatttttg

SEQ ID NO: 227694 - DNA, 20 bp, Artificial sequence
  SiRNA target sequence
aaatacaaaggtatttttga

SEQ ID NO: 227695 - DNA, 20 bp, Artificial sequence
  SiRNA target sequence
aatacaaaggtatttttgat

SEQ ID NO: 227696 - DNA, 20 bp, Artificial sequence
  SiRNA target sequence
atacaaaggtatttttgatg

SEQ ID NO: 227697 - DNA, 20 bp, Artificial sequence
  SiRNA target sequence
tacaaaggtatttttgatgg

SEQ ID NO: 227698 - DNA, 20 bp, Artificial sequence
  SiRNA target sequence
acaaaggtatttttgatggt

SEQ ID NO: 227699 - DNA, 20 bp, Artificial sequence
  SiRNA target sequence
caaaggtatttttgatggtg

SEQ ID NO: 227700 - DNA, 20 bp, Artificial sequence
  SiRNA target sequence
aaaggtatttttgatggtgt

SEQ ID NO: 227701 - DNA, 20 bp, Artificial sequence
  SiRNA target sequence
aaggtatttttgatggtgta

SEQ ID NO: 227702 - DNA, 20 bp, Artificial sequence
  SiRNA target sequence
aggtatttttgatggtgtat

SEQ ID NO: 227703 - DNA, 20 bp, Artificial sequence
  SiRNA target sequence
ggtatttttgatggtgtatt

SEQ ID NO: 227704 - DNA, 20 bp, Artificial sequence
  SiRNA target sequence
gtatttttgatggtgtattt

SEQ ID NO: 227705 - DNA, 20 bp, Artificial sequence
  SiRNA target sequence
tatttttgatggtgtatttg

SEQ ID NO: 227706 - DNA, 20 bp, Artificial sequence
  SiRNA target sequence
atttttgatggtgtatttgg

SEQ ID NO: 227707 - DNA, 20 bp, Artificial sequence
  SiRNA target sequence
tttttgatggtgtatttggt

SEQ ID NO: 227708 - DNA, 20 bp, Artificial sequence
  SiRNA target sequence
ttttgatggtgtatttggta

SEQ ID NO: 227709 - DNA, 20 bp, Artificial sequence
  SiRNA target sequence
tttgatggtgtatttggtaa

SEQ ID NO: 227710 - DNA, 20 bp, Artificial sequence
  SiRNA target sequence
ttgatggtgtatttggtaag

SEQ ID NO: 227711 - DNA, 20 bp, Artificial sequence
  SiRNA target sequence
tgatggtgtatttggtaagc

SEQ ID NO: 227712 - DNA, 20 bp, Artificial sequence
  SiRNA target sequence
gatggtgtatttggtaagct

SEQ ID NO: 227713 - DNA, 20 bp, Artificial sequence
  SiRNA target sequence
atggtgtatttggtaagctg

SEQ ID NO: 227714 - DNA, 20 bp, Artificial sequence
  SiRNA target sequence
tggtgtatttggtaagctgg

SEQ ID NO: 227715 - DNA, 20 bp, Artificial sequence
  SiRNA target sequence
ggtgtatttggtaagctggg

SEQ ID NO: 227716 - DNA, 20 bp, Artificial sequence
  SiRNA target sequence
gtgtatttggtaagctgggg

SEQ ID NO: 227717 - DNA, 20 bp, Artificial sequence
  SiRNA target sequence
tgtatttggtaagctgggga

SEQ ID NO: 227718 - DNA, 20 bp, Artificial sequence
  SiRNA target sequence
gtatttggtaagctggggaa

SEQ ID NO: 227719 - DNA, 20 bp, Artificial sequence
  SiRNA target sequence
tatttggtaagctggggaaa

SEQ ID NO: 227720 - DNA, 20 bp, Artificial sequence
  SiRNA target sequence
atttggtaagctggggaaat

SEQ ID NO: 227721 - DNA, 20 bp, Artificial sequence
  SiRNA target sequence
tttggtaagctggggaaatc

SEQ ID NO: 227722 - DNA, 20 bp, Artificial sequence
  SiRNA target sequence
ttggtaagctggggaaatct

SEQ ID NO: 227723 - DNA, 20 bp, Artificial sequence
  SiRNA target sequence
tggtaagctggggaaatctt

SEQ ID NO: 227724 - DNA, 20 bp, Artificial sequence
  SiRNA target sequence
ggtaagctggggaaatcttt

SEQ ID NO: 227725 - DNA, 20 bp, Artificial sequence
  SiRNA target sequence
gtaagctggggaaatctttt

SEQ ID NO: 227726 - DNA, 20 bp, Artificial sequence
  SiRNA target sequence
taagctggggaaatcttttg

SEQ ID NO: 227727 - DNA, 20 bp, Artificial sequence
  SiRNA target sequence
aagctggggaaatcttttgg

SEQ ID NO: 227728 - DNA, 20 bp, Artificial sequence
  SiRNA target sequence
agctggggaaatcttttgga

SEQ ID NO: 227729 - DNA, 20 bp, Artificial sequence
  SiRNA target sequence
gctggggaaatcttttggat

SEQ ID NO: 227730 - DNA, 20 bp, Artificial sequence
  SiRNA target sequence
ctggggaaatcttttggatc

SEQ ID NO: 227731 - DNA, 20 bp, Artificial sequence
  SiRNA target sequence
tggggaaatcttttggatca

SEQ ID NO: 227732 - DNA, 20 bp, Artificial sequence
  SiRNA target sequence
ggggaaatcttttggatcag

SEQ ID NO: 227733 - DNA, 20 bp, Artificial sequence
  SiRNA target sequence
gggaaatcttttggatcagt

SEQ ID NO: 227734 - DNA, 20 bp, Artificial sequence
  SiRNA target sequence
ggaaatcttttggatcagtt

SEQ ID NO: 227735 - DNA, 20 bp, Artificial sequence
  SiRNA target sequence
gaaatcttttggatcagttt

SEQ ID NO: 227736 - DNA, 20 bp, Artificial sequence
  SiRNA target sequence
aaatcttttggatcagttta

SEQ ID NO: 227737 - DNA, 20 bp, Artificial sequence
  SiRNA target sequence
aatcttttggatcagtttat

SEQ ID NO: 227738 - DNA, 20 bp, Artificial sequence
  SiRNA target sequence
atcttttggatcagtttatg

SEQ ID NO: 227739 - DNA, 20 bp, Artificial sequence
  SiRNA target sequence
tcttttggatcagtttatgg

SEQ ID NO: 227740 - DNA, 20 bp, Artificial sequence
  SiRNA target sequence
cttttggatcagtttatgga

SEQ ID NO: 227741 - DNA, 20 bp, Artificial sequence
  SiRNA target sequence
ttttggatcagtttatggat

SEQ ID NO: 227742 - DNA, 20 bp, Artificial sequence
  SiRNA target sequence
tttggatcagtttatggatt

SEQ ID NO: 227743 - DNA, 20 bp, Artificial sequence
  SiRNA target sequence
ttggatcagtttatggattt

SEQ ID NO: 227744 - DNA, 20 bp, Artificial sequence
  SiRNA target sequence
tggatcagtttatggattta

SEQ ID NO: 227745 - DNA, 20 bp, Artificial sequence
  SiRNA target sequence
ggatcagtttatggatttac

SEQ ID NO: 227746 - DNA, 20 bp, Artificial sequence
  SiRNA target sequence
gatcagtttatggatttaca

SEQ ID NO: 227747 - DNA, 20 bp, Artificial sequence
  SiRNA target sequence
atcagtttatggatttacaa

SEQ ID NO: 227748 - DNA, 20 bp, Artificial sequence
  SiRNA target sequence
tcagtttatggatttacaat

SEQ ID NO: 227749 - DNA, 20 bp, Artificial sequence
  SiRNA target sequence
cagtttatggatttacaatt

SEQ ID NO: 227750 - DNA, 20 bp, Artificial sequence
  SiRNA target sequence
agtttatggatttacaatta

SEQ ID NO: 227751 - DNA, 20 bp, Artificial sequence
  SiRNA target sequence
gtttatggatttacaattac

SEQ ID NO: 227752 - DNA, 20 bp, Artificial sequence
  SiRNA target sequence
tttatggatttacaattact

SEQ ID NO: 227753 - DNA, 20 bp, Artificial sequence
  SiRNA target sequence
ttatggatttacaattacta

SEQ ID NO: 227754 - DNA, 20 bp, Artificial sequence
  SiRNA target sequence
tatggatttacaattactac

SEQ ID NO: 227755 - DNA, 20 bp, Artificial sequence
  SiRNA target sequence
atggatttacaattactaca

SEQ ID NO: 227756 - DNA, 20 bp, Artificial sequence
  SiRNA target sequence
tggatttacaattactacat

SEQ ID NO: 227757 - DNA, 20 bp, Artificial sequence
  SiRNA target sequence
ggatttacaattactacatt

SEQ ID NO: 227758 - DNA, 20 bp, Artificial sequence
  SiRNA target sequence
gatttacaattactacatta

SEQ ID NO: 227759 - DNA, 20 bp, Artificial sequence
  SiRNA target sequence
atttacaattactacattat

SEQ ID NO: 227760 - DNA, 20 bp, Artificial sequence
  SiRNA target sequence
tttacaattactacattatt

SEQ ID NO: 227761 - DNA, 20 bp, Artificial sequence
  SiRNA target sequence
ttacaattactacattatta

SEQ ID NO: 227762 - DNA, 20 bp, Artificial sequence
  SiRNA target sequence
tacaattactacattattag

SEQ ID NO: 227763 - DNA, 20 bp, Artificial sequence
  SiRNA target sequence
acaattactacattattagg

SEQ ID NO: 227764 - DNA, 20 bp, Artificial sequence
  SiRNA target sequence
caattactacattattagga

SEQ ID NO: 227765 - DNA, 20 bp, Artificial sequence
  SiRNA target sequence
aattactacattattaggaa

SEQ ID NO: 227766 - DNA, 20 bp, Artificial sequence
  SiRNA target sequence
attactacattattaggaac

SEQ ID NO: 227767 - DNA, 20 bp, Artificial sequence
  SiRNA target sequence
ttactacattattaggaaca

SEQ ID NO: 227768 - DNA, 20 bp, Artificial sequence
  SiRNA target sequence
tactacattattaggaacaa

SEQ ID NO: 227769 - DNA, 20 bp, Artificial sequence
  SiRNA target sequence
actacattattaggaacaag

SEQ ID NO: 227770 - DNA, 20 bp, Artificial sequence
  SiRNA target sequence
ctacattattaggaacaaga

SEQ ID NO: 227771 - DNA, 20 bp, Artificial sequence
  SiRNA target sequence
tacattattaggaacaagag

SEQ ID NO: 227772 - DNA, 20 bp, Artificial sequence
  SiRNA target sequence
acattattaggaacaagaga

SEQ ID NO: 227773 - DNA, 20 bp, Artificial sequence
  SiRNA target sequence
cattattaggaacaagagat

SEQ ID NO: 227774 - DNA, 20 bp, Artificial sequence
  SiRNA target sequence
attattaggaacaagagatg

SEQ ID NO: 227775 - DNA, 20 bp, Artificial sequence
  SiRNA target sequence
ttattaggaacaagagatgt

SEQ ID NO: 227776 - DNA, 20 bp, Artificial sequence
  SiRNA target sequence
tattaggaacaagagatgtt

SEQ ID NO: 227777 - DNA, 20 bp, Artificial sequence
  SiRNA target sequence
attaggaacaagagatgttc

SEQ ID NO: 227778 - DNA, 20 bp, Artificial sequence
  SiRNA target sequence
ttaggaacaagagatgttcg

SEQ ID NO: 227779 - DNA, 20 bp, Artificial sequence
  SiRNA target sequence
taggaacaagagatgttcgt

SEQ ID NO: 227780 - DNA, 20 bp, Artificial sequence
  SiRNA target sequence
aggaacaagagatgttcgta

SEQ ID NO: 227781 - DNA, 20 bp, Artificial sequence
  SiRNA target sequence
ggaacaagagatgttcgtag

SEQ ID NO: 227782 - DNA, 20 bp, Artificial sequence
  SiRNA target sequence
gaacaagagatgttcgtaga

SEQ ID NO: 227783 - DNA, 20 bp, Artificial sequence
  SiRNA target sequence
aacaagagatgttcgtagag

SEQ ID NO: 227784 - DNA, 20 bp, Artificial sequence
  SiRNA target sequence
acaagagatgttcgtagagg

SEQ ID NO: 227785 - DNA, 20 bp, Artificial sequence
  SiRNA target sequence
caagagatgttcgtagaggt

SEQ ID NO: 227786 - DNA, 20 bp, Artificial sequence
  SiRNA target sequence
aagagatgttcgtagaggtg

SEQ ID NO: 227787 - DNA, 20 bp, Artificial sequence
  SiRNA target sequence
agagatgttcgtagaggtgc

SEQ ID NO: 227788 - DNA, 20 bp, Artificial sequence
  SiRNA target sequence
gagatgttcgtagaggtgct

SEQ ID NO: 227789 - DNA, 20 bp, Artificial sequence
  SiRNA target sequence
agatgttcgtagaggtgctc

SEQ ID NO: 227790 - DNA, 20 bp, Artificial sequence
  SiRNA target sequence
gatgttcgtagaggtgctcc

SEQ ID NO: 227791 - DNA, 20 bp, Artificial sequence
  SiRNA target sequence
atgttcgtagaggtgctcct

SEQ ID NO: 227792 - DNA, 20 bp, Artificial sequence
  SiRNA target sequence
tgttcgtagaggtgctccta

SEQ ID NO: 227793 - DNA, 20 bp, Artificial sequence
  SiRNA target sequence
gttcgtagaggtgctcctat

SEQ ID NO: 227794 - DNA, 20 bp, Artificial sequence
  SiRNA target sequence
ttcgtagaggtgctcctata

SEQ ID NO: 227795 - DNA, 20 bp, Artificial sequence
  SiRNA target sequence
tcgtagaggtgctcctatat

SEQ ID NO: 227796 - DNA, 20 bp, Artificial sequence
  SiRNA target sequence
cgtagaggtgctcctatatc

SEQ ID NO: 227797 - DNA, 20 bp, Artificial sequence
  SiRNA target sequence
gtagaggtgctcctatatcg

SEQ ID NO: 227798 - DNA, 20 bp, Artificial sequence
  SiRNA target sequence
tagaggtgctcctatatcgc

SEQ ID NO: 227799 - DNA, 20 bp, Artificial sequence
  SiRNA target sequence
agaggtgctcctatatcgct

SEQ ID NO: 227800 - DNA, 20 bp, Artificial sequence
  SiRNA target sequence
gaggtgctcctatatcgctt

SEQ ID NO: 227801 - DNA, 20 bp, Artificial sequence
  SiRNA target sequence
aggtgctcctatatcgcttt

SEQ ID NO: 227802 - DNA, 20 bp, Artificial sequence
  SiRNA target sequence
ggtgctcctatatcgctttg

SEQ ID NO: 227803 - DNA, 20 bp, Artificial sequence
  SiRNA target sequence
gtgctcctatatcgctttgt

SEQ ID NO: 227804 - DNA, 20 bp, Artificial sequence
  SiRNA target sequence
tgctcctatatcgctttgtg

SEQ ID NO: 227805 - DNA, 20 bp, Artificial sequence
  SiRNA target sequence
gctcctatatcgctttgtgt

SEQ ID NO: 227806 - DNA, 20 bp, Artificial sequence
  SiRNA target sequence
ctcctatatcgctttgtgtt

SEQ ID NO: 227807 - DNA, 20 bp, Artificial sequence
  SiRNA target sequence
tcctatatcgctttgtgttc

SEQ ID NO: 227808 - DNA, 20 bp, Artificial sequence
  SiRNA target sequence
cctatatcgctttgtgttct

SEQ ID NO: 227809 - DNA, 20 bp, Artificial sequence
  SiRNA target sequence
ctatatcgctttgtgttcta

SEQ ID NO: 227810 - DNA, 20 bp, Artificial sequence
  SiRNA target sequence
tatatcgctttgtgttctaa

SEQ ID NO: 227811 - DNA, 20 bp, Artificial sequence
  SiRNA target sequence
atatcgctttgtgttctaat

SEQ ID NO: 227812 - DNA, 20 bp, Artificial sequence
  SiRNA target sequence
tatcgctttgtgttctaata

SEQ ID NO: 227813 - DNA, 20 bp, Artificial sequence
  SiRNA target sequence
atcgctttgtgttctaatat

SEQ ID NO: 227814 - DNA, 20 bp, Artificial sequence
  SiRNA target sequence
tcgctttgtgttctaatatt

SEQ ID NO: 227815 - DNA, 20 bp, Artificial sequence
  SiRNA target sequence
cgctttgtgttctaatattg

SEQ ID NO: 227816 - DNA, 20 bp, Artificial sequence
  SiRNA target sequence
gctttgtgttctaatattgt

SEQ ID NO: 227817 - DNA, 20 bp, Artificial sequence
  SiRNA target sequence
ctttgtgttctaatattgtt

SEQ ID NO: 227818 - DNA, 20 bp, Artificial sequence
  SiRNA target sequence
tttgtgttctaatattgttc

SEQ ID NO: 227819 - DNA, 20 bp, Artificial sequence
  SiRNA target sequence
ttgtgttctaatattgttct

SEQ ID NO: 227820 - DNA, 20 bp, Artificial sequence
  SiRNA target sequence
tgtgttctaatattgttctg

SEQ ID NO: 227821 - DNA, 20 bp, Artificial sequence
  SiRNA target sequence
gtgttctaatattgttctgc

SEQ ID NO: 227822 - DNA, 20 bp, Artificial sequence
  SiRNA target sequence
tgttctaatattgttctgcc

SEQ ID NO: 227823 - DNA, 20 bp, Artificial sequence
  SiRNA target sequence
gttctaatattgttctgcct

SEQ ID NO: 227824 - DNA, 20 bp, Artificial sequence
  SiRNA target sequence
ttctaatattgttctgcctt

SEQ ID NO: 227825 - DNA, 20 bp, Artificial sequence
  SiRNA target sequence
tctaatattgttctgcctta

SEQ ID NO: 227826 - DNA, 20 bp, Artificial sequence
  SiRNA target sequence
ctaatattgttctgccttat

SEQ ID NO: 227827 - DNA, 20 bp, Artificial sequence
  SiRNA target sequence
taatattgttctgccttata

SEQ ID NO: 227828 - DNA, 20 bp, Artificial sequence
  SiRNA target sequence
aatattgttctgccttatat

SEQ ID NO: 227829 - DNA, 20 bp, Artificial sequence
  SiRNA target sequence
atattgttctgccttatatg

SEQ ID NO: 227830 - DNA, 20 bp, Artificial sequence
  SiRNA target sequence
tattgttctgccttatatgg

SEQ ID NO: 227831 - DNA, 20 bp, Artificial sequence
  SiRNA target sequence
attgttctgccttatatggt

SEQ ID NO: 227832 - DNA, 20 bp, Artificial sequence
  SiRNA target sequence
ttgttctgccttatatggtt

SEQ ID NO: 227833 - DNA, 20 bp, Artificial sequence
  SiRNA target sequence
tgttctgccttatatggttt

SEQ ID NO: 227834 - DNA, 20 bp, Artificial sequence
  SiRNA target sequence
gttctgccttatatggtttt

SEQ ID NO: 227835 - DNA, 20 bp, Artificial sequence
  SiRNA target sequence
ttctgccttatatggtttta

SEQ ID NO: 227836 - DNA, 20 bp, Artificial sequence
  SiRNA target sequence
tctgccttatatggttttat

SEQ ID NO: 227837 - DNA, 20 bp, Artificial sequence
  SiRNA target sequence
ctgccttatatggttttatt

SEQ ID NO: 227838 - DNA, 20 bp, Artificial sequence
  SiRNA target sequence
tgccttatatggttttattc

SEQ ID NO: 227839 - DNA, 20 bp, Artificial sequence
  SiRNA target sequence
gccttatatggttttattct

SEQ ID NO: 227840 - DNA, 20 bp, Artificial sequence
  SiRNA target sequence
ccttatatggttttattctg

SEQ ID NO: 227841 - DNA, 20 bp, Artificial sequence
  SiRNA target sequence
cttatatggttttattctgt

SEQ ID NO: 227842 - DNA, 20 bp, Artificial sequence
  SiRNA target sequence
ttatatggttttattctgtt

SEQ ID NO: 227843 - DNA, 20 bp, Artificial sequence
  SiRNA target sequence
tatatggttttattctgttt

SEQ ID NO: 227844 - DNA, 20 bp, Artificial sequence
  SiRNA target sequence
atatggttttattctgtttt

SEQ ID NO: 227845 - DNA, 20 bp, Artificial sequence
  SiRNA target sequence
tatggttttattctgttttc

SEQ ID NO: 227846 - DNA, 20 bp, Artificial sequence
  SiRNA target sequence
atggttttattctgttttct

SEQ ID NO: 227847 - DNA, 20 bp, Artificial sequence
  SiRNA target sequence
tggttttattctgttttcta

SEQ ID NO: 227848 - DNA, 20 bp, Artificial sequence
  SiRNA target sequence
ggttttattctgttttctat

SEQ ID NO: 227849 - DNA, 20 bp, Artificial sequence
  SiRNA target sequence
gttttattctgttttctatc

SEQ ID NO: 227850 - DNA, 20 bp, Artificial sequence
  SiRNA target sequence
ttttattctgttttctatct

SEQ ID NO: 227851 - DNA, 20 bp, Artificial sequence
  SiRNA target sequence
tttattctgttttctatctc

SEQ ID NO: 227852 - DNA, 20 bp, Artificial sequence
  SiRNA target sequence
ttattctgttttctatctca

SEQ ID NO: 227853 - DNA, 20 bp, Artificial sequence
  SiRNA target sequence
tattctgttttctatctcaa

SEQ ID NO: 227854 - DNA, 20 bp, Artificial sequence
  SiRNA target sequence
attctgttttctatctcaat

SEQ ID NO: 227855 - DNA, 20 bp, Artificial sequence
  SiRNA target sequence
ttctgttttctatctcaata

SEQ ID NO: 227856 - DNA, 20 bp, Artificial sequence
  SiRNA target sequence
tctgttttctatctcaatag

SEQ ID NO: 227857 - DNA, 20 bp, Artificial sequence
  SiRNA target sequence
ctgttttctatctcaataga

SEQ ID NO: 227858 - DNA, 20 bp, Artificial sequence
  SiRNA target sequence
tgttttctatctcaatagaa

SEQ ID NO: 227859 - DNA, 20 bp, Artificial sequence
  SiRNA target sequence
gttttctatctcaatagaaa

SEQ ID NO: 227860 - DNA, 20 bp, Artificial sequence
  SiRNA target sequence
ttttctatctcaatagaaaa

SEQ ID NO: 227861 - DNA, 20 bp, Artificial sequence
  SiRNA target sequence
tttctatctcaatagaaaat

SEQ ID NO: 227862 - DNA, 20 bp, Artificial sequence
  SiRNA target sequence
ttctatctcaatagaaaata

SEQ ID NO: 227863 - DNA, 20 bp, Artificial sequence
  SiRNA target sequence
tctatctcaatagaaaatat

SEQ ID NO: 227864 - DNA, 20 bp, Artificial sequence
  SiRNA target sequence
ctatctcaatagaaaatata

SEQ ID NO: 227865 - DNA, 20 bp, Artificial sequence
  SiRNA target sequence
tatctcaatagaaaatataa

SEQ ID NO: 227866 - DNA, 20 bp, Artificial sequence
  SiRNA target sequence
atctcaatagaaaatataaa

SEQ ID NO: 227867 - DNA, 20 bp, Artificial sequence
  SiRNA target sequence
tctcaatagaaaatataaag

SEQ ID NO: 227868 - DNA, 20 bp, Artificial sequence
  SiRNA target sequence
ctcaatagaaaatataaaga

SEQ ID NO: 227869 - DNA, 20 bp, Artificial sequence
  SiRNA target sequence
tcaatagaaaatataaagaa

SEQ ID NO: 227870 - DNA, 20 bp, Artificial sequence
  SiRNA target sequence
caatagaaaatataaagaat

SEQ ID NO: 227871 - DNA, 20 bp, Artificial sequence
  SiRNA target sequence
aatagaaaatataaagaatc

SEQ ID NO: 227872 - DNA, 20 bp, Artificial sequence
  SiRNA target sequence
atagaaaatataaagaatct

SEQ ID NO: 227873 - DNA, 20 bp, Artificial sequence
  SiRNA target sequence
tagaaaatataaagaatctg

SEQ ID NO: 227874 - DNA, 20 bp, Artificial sequence
  SiRNA target sequence
agaaaatataaagaatctgt

SEQ ID NO: 227875 - DNA, 20 bp, Artificial sequence
  SiRNA target sequence
gaaaatataaagaatctgtc

SEQ ID NO: 227876 - DNA, 20 bp, Artificial sequence
  SiRNA target sequence
aaaatataaagaatctgtcg

SEQ ID NO: 227877 - DNA, 20 bp, Artificial sequence
  SiRNA target sequence
aaatataaagaatctgtcga

SEQ ID NO: 227878 - DNA, 20 bp, Artificial sequence
  SiRNA target sequence
aatataaagaatctgtcgag

SEQ ID NO: 227879 - DNA, 20 bp, Artificial sequence
  SiRNA target sequence
atataaagaatctgtcgaga

SEQ ID NO: 227880 - DNA, 20 bp, Artificial sequence
  SiRNA target sequence
tataaagaatctgtcgagaa

SEQ ID NO: 227881 - DNA, 20 bp, Artificial sequence
  SiRNA target sequence
ataaagaatctgtcgagaat

SEQ ID NO: 227882 - DNA, 20 bp, Artificial sequence
  SiRNA target sequence
taaagaatctgtcgagaata

SEQ ID NO: 227883 - DNA, 20 bp, Artificial sequence
  SiRNA target sequence
aaagaatctgtcgagaataa

SEQ ID NO: 227884 - DNA, 20 bp, Artificial sequence
  SiRNA target sequence
aagaatctgtcgagaataat

SEQ ID NO: 227885 - DNA, 20 bp, Artificial sequence
  SiRNA target sequence
agaatctgtcgagaataatg

SEQ ID NO: 227886 - DNA, 20 bp, Artificial sequence
  SiRNA target sequence
gaatctgtcgagaataatgc

SEQ ID NO: 227887 - DNA, 20 bp, Artificial sequence
  SiRNA target sequence
aatctgtcgagaataatgca

SEQ ID NO: 227888 - DNA, 20 bp, Artificial sequence
  SiRNA target sequence
atctgtcgagaataatgcac

SEQ ID NO: 227889 - DNA, 20 bp, Artificial sequence
  SiRNA target sequence
tctgtcgagaataatgcacc

SEQ ID NO: 227890 - DNA, 20 bp, Artificial sequence
  SiRNA target sequence
ctgtcgagaataatgcacca

SEQ ID NO: 227891 - DNA, 20 bp, Artificial sequence
  SiRNA target sequence
tgtcgagaataatgcaccaa

SEQ ID NO: 227892 - DNA, 20 bp, Artificial sequence
  SiRNA target sequence
gtcgagaataatgcaccaat

SEQ ID NO: 227893 - DNA, 20 bp, Artificial sequence
  SiRNA target sequence
tcgagaataatgcaccaatt

SEQ ID NO: 227894 - DNA, 20 bp, Artificial sequence
  SiRNA target sequence
cgagaataatgcaccaattg

SEQ ID NO: 227895 - DNA, 20 bp, Artificial sequence
  SiRNA target sequence
gagaataatgcaccaattga

SEQ ID NO: 227896 - DNA, 20 bp, Artificial sequence
  SiRNA target sequence
agaataatgcaccaattgat

SEQ ID NO: 227897 - DNA, 20 bp, Artificial sequence
  SiRNA target sequence
gaataatgcaccaattgata

SEQ ID NO: 227898 - DNA, 20 bp, Artificial sequence
  SiRNA target sequence
aataatgcaccaattgatat

SEQ ID NO: 227899 - DNA, 20 bp, Artificial sequence
  SiRNA target sequence
ataatgcaccaattgatatt

SEQ ID NO: 227900 - DNA, 20 bp, Artificial sequence
  SiRNA target sequence
taatgcaccaattgatattg

SEQ ID NO: 227901 - DNA, 20 bp, Artificial sequence
  SiRNA target sequence
aatgcaccaattgatattga

SEQ ID NO: 227902 - DNA, 20 bp, Artificial sequence
  SiRNA target sequence
atgcaccaattgatattgat

SEQ ID NO: 227903 - DNA, 20 bp, Artificial sequence
  SiRNA target sequence
tgcaccaattgatattgatt

SEQ ID NO: 227904 - DNA, 20 bp, Artificial sequence
  SiRNA target sequence
gcaccaattgatattgattt

SEQ ID NO: 227905 - DNA, 20 bp, Artificial sequence
  SiRNA target sequence
caccaattgatattgattta

SEQ ID NO: 227906 - DNA, 20 bp, Artificial sequence
  SiRNA target sequence
accaattgatattgatttat

SEQ ID NO: 227907 - DNA, 20 bp, Artificial sequence
  SiRNA target sequence
ccaattgatattgatttatt

SEQ ID NO: 227908 - DNA, 20 bp, Artificial sequence
  SiRNA target sequence
caattgatattgatttattc

SEQ ID NO: 227909 - DNA, 20 bp, Artificial sequence
  SiRNA target sequence
aattgatattgatttattca

SEQ ID NO: 227910 - DNA, 20 bp, Artificial sequence
  SiRNA target sequence
attgatattgatttattcac

SEQ ID NO: 227911 - DNA, 20 bp, Artificial sequence
  SiRNA target sequence
ttgatattgatttattcact

SEQ ID NO: 227912 - DNA, 20 bp, Artificial sequence
  SiRNA target sequence
tgatattgatttattcacta

SEQ ID NO: 227913 - DNA, 20 bp, Artificial sequence
  SiRNA target sequence
gatattgatttattcactag

SEQ ID NO: 227914 - DNA, 20 bp, Artificial sequence
  SiRNA target sequence
atattgatttattcactagt

SEQ ID NO: 227915 - DNA, 20 bp, Artificial sequence
  SiRNA target sequence
tattgatttattcactagtt

SEQ ID NO: 227916 - DNA, 20 bp, Artificial sequence
  SiRNA target sequence
attgatttattcactagttc

SEQ ID NO: 227917 - DNA, 20 bp, Artificial sequence
  SiRNA target sequence
ttgatttattcactagttca

SEQ ID NO: 227918 - DNA, 20 bp, Artificial sequence
  SiRNA target sequence
tgatttattcactagttcaa

SEQ ID NO: 227919 - DNA, 20 bp, Artificial sequence
  SiRNA target sequence
gatttattcactagttcaaa

SEQ ID NO: 227920 - DNA, 20 bp, Artificial sequence
  SiRNA target sequence
atttattcactagttcaaaa

SEQ ID NO: 227921 - DNA, 20 bp, Artificial sequence
  SiRNA target sequence
tttattcactagttcaaaag

SEQ ID NO: 227922 - DNA, 20 bp, Artificial sequence
  SiRNA target sequence
ttattcactagttcaaaagt

SEQ ID NO: 227923 - DNA, 20 bp, Artificial sequence
  SiRNA target sequence
tattcactagttcaaaagtc

SEQ ID NO: 227924 - DNA, 20 bp, Artificial sequence
  SiRNA target sequence
attcactagttcaaaagtca

SEQ ID NO: 227925 - DNA, 20 bp, Artificial sequence
  SiRNA target sequence
ttcactagttcaaaagtcaa

SEQ ID NO: 227926 - DNA, 20 bp, Artificial sequence
  SiRNA target sequence
tcactagttcaaaagtcaag

SEQ ID NO: 227927 - DNA, 20 bp, Artificial sequence
  SiRNA target sequence
cactagttcaaaagtcaagg

SEQ ID NO: 227928 - DNA, 20 bp, Artificial sequence
  SiRNA target sequence
actagttcaaaagtcaaggc

SEQ ID NO: 227929 - DNA, 20 bp, Artificial sequence
  SiRNA target sequence
ctagttcaaaagtcaaggca

SEQ ID NO: 227930 - DNA, 20 bp, Artificial sequence
  SiRNA target sequence
tagttcaaaagtcaaggcac

SEQ ID NO: 227931 - DNA, 20 bp, Artificial sequence
  SiRNA target sequence
agttcaaaagtcaaggcacc

SEQ ID NO: 227932 - DNA, 20 bp, Artificial sequence
  SiRNA target sequence
gttcaaaagtcaaggcacct

SEQ ID NO: 227933 - DNA, 20 bp, Artificial sequence
  SiRNA target sequence
ttcaaaagtcaaggcacctt

SEQ ID NO: 227934 - DNA, 20 bp, Artificial sequence
  SiRNA target sequence
tcaaaagtcaaggcaccttc

SEQ ID NO: 227935 - DNA, 20 bp, Artificial sequence
  SiRNA target sequence
caaaagtcaaggcaccttct

SEQ ID NO: 227936 - DNA, 20 bp, Artificial sequence
  SiRNA target sequence
aaaagtcaaggcaccttctt

SEQ ID NO: 227937 - DNA, 20 bp, Artificial sequence
  SiRNA target sequence
aaagtcaaggcaccttcttc

SEQ ID NO: 227938 - DNA, 20 bp, Artificial sequence
  SiRNA target sequence
aagtcaaggcaccttcttct

SEQ ID NO: 227939 - DNA, 20 bp, Artificial sequence
  SiRNA target sequence
agtcaaggcaccttcttctg

SEQ ID NO: 227940 - DNA, 20 bp, Artificial sequence
  SiRNA target sequence
gtcaaggcaccttcttctga

SEQ ID NO: 227941 - DNA, 20 bp, Artificial sequence
  SiRNA target sequence
tcaaggcaccttcttctgaa

SEQ ID NO: 227942 - DNA, 20 bp, Artificial sequence
  SiRNA target sequence
caaggcaccttcttctgaac

SEQ ID NO: 227943 - DNA, 20 bp, Artificial sequence
  SiRNA target sequence
aaggcaccttcttctgaacc

SEQ ID NO: 227944 - DNA, 20 bp, Artificial sequence
  SiRNA target sequence
aggcaccttcttctgaacct

SEQ ID NO: 227945 - DNA, 20 bp, Artificial sequence
  SiRNA target sequence
ggcaccttcttctgaaccta

SEQ ID NO: 227946 - DNA, 20 bp, Artificial sequence
  SiRNA target sequence
gcaccttcttctgaacctac

SEQ ID NO: 227947 - DNA, 20 bp, Artificial sequence
  SiRNA target sequence
caccttcttctgaacctact

SEQ ID NO: 227948 - DNA, 20 bp, Artificial sequence
  SiRNA target sequence
accttcttctgaacctactg

SEQ ID NO: 227949 - DNA, 20 bp, Artificial sequence
  SiRNA target sequence
ccttcttctgaacctactgt

SEQ ID NO: 227950 - DNA, 20 bp, Artificial sequence
  SiRNA target sequence
cttcttctgaacctactgtt

SEQ ID NO: 227951 - DNA, 20 bp, Artificial sequence
  SiRNA target sequence
ttcttctgaacctactgttg

SEQ ID NO: 227952 - DNA, 20 bp, Artificial sequence
  SiRNA target sequence
tcttctgaacctactgttgc

SEQ ID NO: 227953 - DNA, 20 bp, Artificial sequence
  SiRNA target sequence
cttctgaacctactgttgct

SEQ ID NO: 227954 - DNA, 20 bp, Artificial sequence
  SiRNA target sequence
ttctgaacctactgttgcta

SEQ ID NO: 227955 - DNA, 20 bp, Artificial sequence
  SiRNA target sequence
tctgaacctactgttgctac

SEQ ID NO: 227956 - DNA, 20 bp, Artificial sequence
  SiRNA target sequence
ctgaacctactgttgctacc

SEQ ID NO: 227957 - DNA, 20 bp, Artificial sequence
  SiRNA target sequence
tgaacctactgttgctacca

SEQ ID NO: 227958 - DNA, 20 bp, Artificial sequence
  SiRNA target sequence
gaacctactgttgctaccaa

SEQ ID NO: 227959 - DNA, 20 bp, Artificial sequence
  SiRNA target sequence
aacctactgttgctaccaaa

SEQ ID NO: 227960 - DNA, 20 bp, Artificial sequence
  SiRNA target sequence
acctactgttgctaccaaaa

SEQ ID NO: 227961 - DNA, 20 bp, Artificial sequence
  SiRNA target sequence
cctactgttgctaccaaaag

SEQ ID NO: 227962 - DNA, 20 bp, Artificial sequence
  SiRNA target sequence
ctactgttgctaccaaaagt

SEQ ID NO: 227963 - DNA, 20 bp, Artificial sequence
  SiRNA target sequence
tactgttgctaccaaaagtg

SEQ ID NO: 227964 - DNA, 20 bp, Artificial sequence
  SiRNA target sequence
actgttgctaccaaaagtgt

SEQ ID NO: 227965 - DNA, 20 bp, Artificial sequence
  SiRNA target sequence
ctgttgctaccaaaagtgtt

SEQ ID NO: 227966 - DNA, 20 bp, Artificial sequence
  SiRNA target sequence
tgttgctaccaaaagtgtta

SEQ ID NO: 227967 - DNA, 20 bp, Artificial sequence
  SiRNA target sequence
gttgctaccaaaagtgttac

SEQ ID NO: 227968 - DNA, 20 bp, Artificial sequence
  SiRNA target sequence
ttgctaccaaaagtgttact

SEQ ID NO: 227969 - DNA, 20 bp, Artificial sequence
  SiRNA target sequence
tgctaccaaaagtgttacta

SEQ ID NO: 227970 - DNA, 20 bp, Artificial sequence
  SiRNA target sequence
gctaccaaaagtgttactac

SEQ ID NO: 227971 - DNA, 20 bp, Artificial sequence
  SiRNA target sequence
ctaccaaaagtgttactaca

SEQ ID NO: 227972 - DNA, 20 bp, Artificial sequence
  SiRNA target sequence
taccaaaagtgttactacag

SEQ ID NO: 227973 - DNA, 20 bp, Artificial sequence
  SiRNA target sequence
accaaaagtgttactacaga

SEQ ID NO: 227974 - DNA, 20 bp, Artificial sequence
  SiRNA target sequence
ccaaaagtgttactacagaa

SEQ ID NO: 227975 - DNA, 20 bp, Artificial sequence
  SiRNA target sequence
caaaagtgttactacagaag

SEQ ID NO: 227976 - DNA, 20 bp, Artificial sequence
  SiRNA target sequence
aaaagtgttactacagaaga

SEQ ID NO: 227977 - DNA, 20 bp, Artificial sequence
  SiRNA target sequence
aaagtgttactacagaagaa

SEQ ID NO: 227978 - DNA, 20 bp, Artificial sequence
  SiRNA target sequence
aagtgttactacagaagaat

SEQ ID NO: 227979 - DNA, 20 bp, Artificial sequence
  SiRNA target sequence
agtgttactacagaagaata

SEQ ID NO: 227980 - DNA, 20 bp, Artificial sequence
  SiRNA target sequence
gtgttactacagaagaataa

SEQ ID NO: 227981 - DNA, 21 bp, Artificial sequence
  SiRNA target sequence
atgtcagtagacaattcgaaa

SEQ ID NO: 227982 - DNA, 21 bp, Artificial sequence
  SiRNA target sequence
tgtcagtagacaattcgaaag

SEQ ID NO: 227983 - DNA, 21 bp, Artificial sequence
  SiRNA target sequence
gtcagtagacaattcgaaagt

SEQ ID NO: 227984 - DNA, 21 bp, Artificial sequence
  SiRNA target sequence
tcagtagacaattcgaaagtt

SEQ ID NO: 227985 - DNA, 21 bp, Artificial sequence
  SiRNA target sequence
cagtagacaattcgaaagttc

SEQ ID NO: 227986 - DNA, 21 bp, Artificial sequence
  SiRNA target sequence
agtagacaattcgaaagttct

SEQ ID NO: 227987 - DNA, 21 bp, Artificial sequence
  SiRNA target sequence
gtagacaattcgaaagttcta

SEQ ID NO: 227988 - DNA, 21 bp, Artificial sequence
  SiRNA target sequence
tagacaattcgaaagttctac

SEQ ID NO: 227989 - DNA, 21 bp, Artificial sequence
  SiRNA target sequence
agacaattcgaaagttctaca

SEQ ID NO: 227990 - DNA, 21 bp, Artificial sequence
  SiRNA target sequence
gacaattcgaaagttctacaa

SEQ ID NO: 227991 - DNA, 21 bp, Artificial sequence
  SiRNA target sequence
acaattcgaaagttctacaaa

SEQ ID NO: 227992 - DNA, 21 bp, Artificial sequence
  SiRNA target sequence
caattcgaaagttctacaaaa

SEQ ID NO: 227993 - DNA, 21 bp, Artificial sequence
  SiRNA target sequence
aattcgaaagttctacaaaat

SEQ ID NO: 227994 - DNA, 21 bp, Artificial sequence
  SiRNA target sequence
attcgaaagttctacaaaata

SEQ ID NO: 227995 - DNA, 21 bp, Artificial sequence
  SiRNA target sequence
ttcgaaagttctacaaaataa

SEQ ID NO: 227996 - DNA, 21 bp, Artificial sequence
  SiRNA target sequence
tcgaaagttctacaaaataac

SEQ ID NO: 227997 - DNA, 21 bp, Artificial sequence
  SiRNA target sequence
cgaaagttctacaaaataacg

SEQ ID NO: 227998 - DNA, 21 bp, Artificial sequence
  SiRNA target sequence
gaaagttctacaaaataacga

SEQ ID NO: 227999 - DNA, 21 bp, Artificial sequence
  SiRNA target sequence
aaagttctacaaaataacgaa

SEQ ID NO: 228000 - DNA, 21 bp, Artificial sequence
  SiRNA target sequence
aagttctacaaaataacgaaa

SEQ ID NO: 228001 - DNA, 21 bp, Artificial sequence
  SiRNA target sequence
agttctacaaaataacgaaaa

SEQ ID NO: 228002 - DNA, 21 bp, Artificial sequence
  SiRNA target sequence
gttctacaaaataacgaaaac

SEQ ID NO: 228003 - DNA, 21 bp, Artificial sequence
  SiRNA target sequence
ttctacaaaataacgaaaact

SEQ ID NO: 228004 - DNA, 21 bp, Artificial sequence
  SiRNA target sequence
tctacaaaataacgaaaactc

SEQ ID NO: 228005 - DNA, 21 bp, Artificial sequence
  SiRNA target sequence
ctacaaaataacgaaaactct

SEQ ID NO: 228006 - DNA, 21 bp, Artificial sequence
  SiRNA target sequence
tacaaaataacgaaaactctg

SEQ ID NO: 228007 - DNA, 21 bp, Artificial sequence
  SiRNA target sequence
acaaaataacgaaaactctgc

SEQ ID NO: 228008 - DNA, 21 bp, Artificial sequence
  SiRNA target sequence
caaaataacgaaaactctgct

SEQ ID NO: 228009 - DNA, 21 bp, Artificial sequence
  SiRNA target sequence
aaaataacgaaaactctgctc

SEQ ID NO: 228010 - DNA, 21 bp, Artificial sequence
  SiRNA target sequence
aaataacgaaaactctgctct

SEQ ID NO: 228011 - DNA, 21 bp, Artificial sequence
  SiRNA target sequence
aataacgaaaactctgctctt

SEQ ID NO: 228012 - DNA, 21 bp, Artificial sequence
  SiRNA target sequence
ataacgaaaactctgctcttc

SEQ ID NO: 228013 - DNA, 21 bp, Artificial sequence
  SiRNA target sequence
taacgaaaactctgctcttcc

SEQ ID NO: 228014 - DNA, 21 bp, Artificial sequence
  SiRNA target sequence
aacgaaaactctgctcttcct

SEQ ID NO: 228015 - DNA, 21 bp, Artificial sequence
  SiRNA target sequence
acgaaaactctgctcttccta

SEQ ID NO: 228016 - DNA, 21 bp, Artificial sequence
  SiRNA target sequence
cgaaaactctgctcttcctac

SEQ ID NO: 228017 - DNA, 21 bp, Artificial sequence
  SiRNA target sequence
gaaaactctgctcttcctaca

SEQ ID NO: 228018 - DNA, 21 bp, Artificial sequence
  SiRNA target sequence
aaaactctgctcttcctacag

SEQ ID NO: 228019 - DNA, 21 bp, Artificial sequence
  SiRNA target sequence
aaactctgctcttcctacaga

SEQ ID NO: 228020 - DNA, 21 bp, Artificial sequence
  SiRNA target sequence
aactctgctcttcctacagaa

SEQ ID NO: 228021 - DNA, 21 bp, Artificial sequence
  SiRNA target sequence
actctgctcttcctacagaag

SEQ ID NO: 228022 - DNA, 21 bp, Artificial sequence
  SiRNA target sequence
ctctgctcttcctacagaaga

SEQ ID NO: 228023 - DNA, 21 bp, Artificial sequence
  SiRNA target sequence
tctgctcttcctacagaagat

SEQ ID NO: 228024 - DNA, 21 bp, Artificial sequence
  SiRNA target sequence
ctgctcttcctacagaagatg

SEQ ID NO: 228025 - DNA, 21 bp, Artificial sequence
  SiRNA target sequence
tgctcttcctacagaagatga

SEQ ID NO: 228026 - DNA, 21 bp, Artificial sequence
  SiRNA target sequence
gctcttcctacagaagatgaa

SEQ ID NO: 228027 - DNA, 21 bp, Artificial sequence
  SiRNA target sequence
ctcttcctacagaagatgaaa

SEQ ID NO: 228028 - DNA, 21 bp, Artificial sequence
  SiRNA target sequence
tcttcctacagaagatgaaat

SEQ ID NO: 228029 - DNA, 21 bp, Artificial sequence
  SiRNA target sequence
cttcctacagaagatgaaatt

SEQ ID NO: 228030 - DNA, 21 bp, Artificial sequence
  SiRNA target sequence
ttcctacagaagatgaaattg

SEQ ID NO: 228031 - DNA, 21 bp, Artificial sequence
  SiRNA target sequence
tcctacagaagatgaaattga

SEQ ID NO: 228032 - DNA, 21 bp, Artificial sequence
  SiRNA target sequence
cctacagaagatgaaattgag

SEQ ID NO: 228033 - DNA, 21 bp, Artificial sequence
  SiRNA target sequence
ctacagaagatgaaattgagt

SEQ ID NO: 228034 - DNA, 21 bp, Artificial sequence
  SiRNA target sequence
tacagaagatgaaattgagta

SEQ ID NO: 228035 - DNA, 21 bp, Artificial sequence
  SiRNA target sequence
acagaagatgaaattgagtat

SEQ ID NO: 228036 - DNA, 21 bp, Artificial sequence
  SiRNA target sequence
cagaagatgaaattgagtatg

SEQ ID NO: 228037 - DNA, 21 bp, Artificial sequence
  SiRNA target sequence
agaagatgaaattgagtatga

SEQ ID NO: 228038 - DNA, 21 bp, Artificial sequence
  SiRNA target sequence
gaagatgaaattgagtatgag

SEQ ID NO: 228039 - DNA, 21 bp, Artificial sequence
  SiRNA target sequence
aagatgaaattgagtatgagg

SEQ ID NO: 228040 - DNA, 21 bp, Artificial sequence
  SiRNA target sequence
agatgaaattgagtatgaggc

SEQ ID NO: 228041 - DNA, 21 bp, Artificial sequence
  SiRNA target sequence
gatgaaattgagtatgaggcc

SEQ ID NO: 228042 - DNA, 21 bp, Artificial sequence
  SiRNA target sequence
atgaaattgagtatgaggcca

SEQ ID NO: 228043 - DNA, 21 bp, Artificial sequence
  SiRNA target sequence
tgaaattgagtatgaggccag

SEQ ID NO: 228044 - DNA, 21 bp, Artificial sequence
  SiRNA target sequence
gaaattgagtatgaggccagc

SEQ ID NO: 228045 - DNA, 21 bp, Artificial sequence
  SiRNA target sequence
aaattgagtatgaggccagca

SEQ ID NO: 228046 - DNA, 21 bp, Artificial sequence
  SiRNA target sequence
aattgagtatgaggccagcaa

SEQ ID NO: 228047 - DNA, 21 bp, Artificial sequence
  SiRNA target sequence
attgagtatgaggccagcaat

SEQ ID NO: 228048 - DNA, 21 bp, Artificial sequence
  SiRNA target sequence
ttgagtatgaggccagcaatg

SEQ ID NO: 228049 - DNA, 21 bp, Artificial sequence
  SiRNA target sequence
tgagtatgaggccagcaatgg

SEQ ID NO: 228050 - DNA, 21 bp, Artificial sequence
  SiRNA target sequence
gagtatgaggccagcaatggt

SEQ ID NO: 228051 - DNA, 21 bp, Artificial sequence
  SiRNA target sequence
agtatgaggccagcaatggtt

SEQ ID NO: 228052 - DNA, 21 bp, Artificial sequence
  SiRNA target sequence
gtatgaggccagcaatggttc

SEQ ID NO: 228053 - DNA, 21 bp, Artificial sequence
  SiRNA target sequence
tatgaggccagcaatggttct

SEQ ID NO: 228054 - DNA, 21 bp, Artificial sequence
  SiRNA target sequence
atgaggccagcaatggttctg

SEQ ID NO: 228055 - DNA, 21 bp, Artificial sequence
  SiRNA target sequence
tgaggccagcaatggttctgg

SEQ ID NO: 228056 - DNA, 21 bp, Artificial sequence
  SiRNA target sequence
gaggccagcaatggttctggt

SEQ ID NO: 228057 - DNA, 21 bp, Artificial sequence
  SiRNA target sequence
aggccagcaatggttctggta

SEQ ID NO: 228058 - DNA, 21 bp, Artificial sequence
  SiRNA target sequence
ggccagcaatggttctggtat

SEQ ID NO: 228059 - DNA, 21 bp, Artificial sequence
  SiRNA target sequence
gccagcaatggttctggtata

SEQ ID NO: 228060 - DNA, 21 bp, Artificial sequence
  SiRNA target sequence
ccagcaatggttctggtatat

SEQ ID NO: 228061 - DNA, 21 bp, Artificial sequence
  SiRNA target sequence
cagcaatggttctggtatata

SEQ ID NO: 228062 - DNA, 21 bp, Artificial sequence
  SiRNA target sequence
agcaatggttctggtatatat

SEQ ID NO: 228063 - DNA, 21 bp, Artificial sequence
  SiRNA target sequence
gcaatggttctggtatatatt

SEQ ID NO: 228064 - DNA, 21 bp, Artificial sequence
  SiRNA target sequence
caatggttctggtatatattc

SEQ ID NO: 228065 - DNA, 21 bp, Artificial sequence
  SiRNA target sequence
aatggttctggtatatattca

SEQ ID NO: 228066 - DNA, 21 bp, Artificial sequence
  SiRNA target sequence
atggttctggtatatattcac

SEQ ID NO: 228067 - DNA, 21 bp, Artificial sequence
  SiRNA target sequence
tggttctggtatatattcact

SEQ ID NO: 228068 - DNA, 21 bp, Artificial sequence
  SiRNA target sequence
ggttctggtatatattcactt

SEQ ID NO: 228069 - DNA, 21 bp, Artificial sequence
  SiRNA target sequence
gttctggtatatattcactta

SEQ ID NO: 228070 - DNA, 21 bp, Artificial sequence
  SiRNA target sequence
ttctggtatatattcacttat

SEQ ID NO: 228071 - DNA, 21 bp, Artificial sequence
  SiRNA target sequence
tctggtatatattcacttatt

SEQ ID NO: 228072 - DNA, 21 bp, Artificial sequence
  SiRNA target sequence
ctggtatatattcacttatta

SEQ ID NO: 228073 - DNA, 21 bp, Artificial sequence
  SiRNA target sequence
tggtatatattcacttattag

SEQ ID NO: 228074 - DNA, 21 bp, Artificial sequence
  SiRNA target sequence
ggtatatattcacttattaga

SEQ ID NO: 228075 - DNA, 21 bp, Artificial sequence
  SiRNA target sequence
gtatatattcacttattagag

SEQ ID NO: 228076 - DNA, 21 bp, Artificial sequence
  SiRNA target sequence
tatatattcacttattagagt

SEQ ID NO: 228077 - DNA, 21 bp, Artificial sequence
  SiRNA target sequence
atatattcacttattagagta

SEQ ID NO: 228078 - DNA, 21 bp, Artificial sequence
  SiRNA target sequence
tatattcacttattagagtag

SEQ ID NO: 228079 - DNA, 21 bp, Artificial sequence
  SiRNA target sequence
atattcacttattagagtagc

SEQ ID NO: 228080 - DNA, 21 bp, Artificial sequence
  SiRNA target sequence
tattcacttattagagtagca

SEQ ID NO: 228081 - DNA, 21 bp, Artificial sequence
  SiRNA target sequence
attcacttattagagtagcaa

SEQ ID NO: 228082 - DNA, 21 bp, Artificial sequence
  SiRNA target sequence
ttcacttattagagtagcaaa

SEQ ID NO: 228083 - DNA, 21 bp, Artificial sequence
  SiRNA target sequence
tcacttattagagtagcaaag

SEQ ID NO: 228084 - DNA, 21 bp, Artificial sequence
  SiRNA target sequence
cacttattagagtagcaaagg

SEQ ID NO: 228085 - DNA, 21 bp, Artificial sequence
  SiRNA target sequence
acttattagagtagcaaaggt

SEQ ID NO: 228086 - DNA, 21 bp, Artificial sequence
  SiRNA target sequence
cttattagagtagcaaaggtt

SEQ ID NO: 228087 - DNA, 21 bp, Artificial sequence
  SiRNA target sequence
ttattagagtagcaaaggttg

SEQ ID NO: 228088 - DNA, 21 bp, Artificial sequence
  SiRNA target sequence
tattagagtagcaaaggttga

SEQ ID NO: 228089 - DNA, 21 bp, Artificial sequence
  SiRNA target sequence
attagagtagcaaaggttgag

SEQ ID NO: 228090 - DNA, 21 bp, Artificial sequence
  SiRNA target sequence
ttagagtagcaaaggttgaga

SEQ ID NO: 228091 - DNA, 21 bp, Artificial sequence
  SiRNA target sequence
tagagtagcaaaggttgagag

SEQ ID NO: 228092 - DNA, 21 bp, Artificial sequence
  SiRNA target sequence
agagtagcaaaggttgagaga

SEQ ID NO: 228093 - DNA, 21 bp, Artificial sequence
  SiRNA target sequence
gagtagcaaaggttgagagaa

SEQ ID NO: 228094 - DNA, 21 bp, Artificial sequence
  SiRNA target sequence
agtagcaaaggttgagagaaa

SEQ ID NO: 228095 - DNA, 21 bp, Artificial sequence
  SiRNA target sequence
gtagcaaaggttgagagaaag

SEQ ID NO: 228096 - DNA, 21 bp, Artificial sequence
  SiRNA target sequence
tagcaaaggttgagagaaaga

SEQ ID NO: 228097 - DNA, 21 bp, Artificial sequence
  SiRNA target sequence
agcaaaggttgagagaaagat

SEQ ID NO: 228098 - DNA, 21 bp, Artificial sequence
  SiRNA target sequence
gcaaaggttgagagaaagatg

SEQ ID NO: 228099 - DNA, 21 bp, Artificial sequence
  SiRNA target sequence
caaaggttgagagaaagatgt

SEQ ID NO: 228100 - DNA, 21 bp, Artificial sequence
  SiRNA target sequence
aaaggttgagagaaagatgtt

SEQ ID NO: 228101 - DNA, 21 bp, Artificial sequence
  SiRNA target sequence
aaggttgagagaaagatgttt

SEQ ID NO: 228102 - DNA, 21 bp, Artificial sequence
  SiRNA target sequence
aggttgagagaaagatgtttt

SEQ ID NO: 228103 - DNA, 21 bp, Artificial sequence
  SiRNA target sequence
ggttgagagaaagatgttttg

SEQ ID NO: 228104 - DNA, 21 bp, Artificial sequence
  SiRNA target sequence
gttgagagaaagatgttttgg

SEQ ID NO: 228105 - DNA, 21 bp, Artificial sequence
  SiRNA target sequence
ttgagagaaagatgttttgga

SEQ ID NO: 228106 - DNA, 21 bp, Artificial sequence
  SiRNA target sequence
tgagagaaagatgttttggat

SEQ ID NO: 228107 - DNA, 21 bp, Artificial sequence
  SiRNA target sequence
gagagaaagatgttttggatc

SEQ ID NO: 228108 - DNA, 21 bp, Artificial sequence
  SiRNA target sequence
agagaaagatgttttggatca

SEQ ID NO: 228109 - DNA, 21 bp, Artificial sequence
  SiRNA target sequence
gagaaagatgttttggatcat

SEQ ID NO: 228110 - DNA, 21 bp, Artificial sequence
  SiRNA target sequence
agaaagatgttttggatcatg

SEQ ID NO: 228111 - DNA, 21 bp, Artificial sequence
  SiRNA target sequence
gaaagatgttttggatcatgg

SEQ ID NO: 228112 - DNA, 21 bp, Artificial sequence
  SiRNA target sequence
aaagatgttttggatcatggc

SEQ ID NO: 228113 - DNA, 21 bp, Artificial sequence
  SiRNA target sequence
aagatgttttggatcatggca

SEQ ID NO: 228114 - DNA, 21 bp, Artificial sequence
  SiRNA target sequence
agatgttttggatcatggcag

SEQ ID NO: 228115 - DNA, 21 bp, Artificial sequence
  SiRNA target sequence
gatgttttggatcatggcagc

SEQ ID NO: 228116 - DNA, 21 bp, Artificial sequence
  SiRNA target sequence
atgttttggatcatggcagct

SEQ ID NO: 228117 - DNA, 21 bp, Artificial sequence
  SiRNA target sequence
tgttttggatcatggcagcta

SEQ ID NO: 228118 - DNA, 21 bp, Artificial sequence
  SiRNA target sequence
gttttggatcatggcagctat

SEQ ID NO: 228119 - DNA, 21 bp, Artificial sequence
  SiRNA target sequence
ttttggatcatggcagctatg

SEQ ID NO: 228120 - DNA, 21 bp, Artificial sequence
  SiRNA target sequence
tttggatcatggcagctatgt

SEQ ID NO: 228121 - DNA, 21 bp, Artificial sequence
  SiRNA target sequence
ttggatcatggcagctatgtt

SEQ ID NO: 228122 - DNA, 21 bp, Artificial sequence
  SiRNA target sequence
tggatcatggcagctatgttc

SEQ ID NO: 228123 - DNA, 21 bp, Artificial sequence
  SiRNA target sequence
ggatcatggcagctatgttct

SEQ ID NO: 228124 - DNA, 21 bp, Artificial sequence
  SiRNA target sequence
gatcatggcagctatgttctt

SEQ ID NO: 228125 - DNA, 21 bp, Artificial sequence
  SiRNA target sequence
atcatggcagctatgttcttt

SEQ ID NO: 228126 - DNA, 21 bp, Artificial sequence
  SiRNA target sequence
tcatggcagctatgttcttta

SEQ ID NO: 228127 - DNA, 21 bp, Artificial sequence
  SiRNA target sequence
catggcagctatgttctttat

SEQ ID NO: 228128 - DNA, 21 bp, Artificial sequence
  SiRNA target sequence
atggcagctatgttctttatt

SEQ ID NO: 228129 - DNA, 21 bp, Artificial sequence
  SiRNA target sequence
tggcagctatgttctttatta

SEQ ID NO: 228130 - DNA, 21 bp, Artificial sequence
  SiRNA target sequence
ggcagctatgttctttattat

SEQ ID NO: 228131 - DNA, 21 bp, Artificial sequence
  SiRNA target sequence
gcagctatgttctttattatc

SEQ ID NO: 228132 - DNA, 21 bp, Artificial sequence
  SiRNA target sequence
cagctatgttctttattatct

SEQ ID NO: 228133 - DNA, 21 bp, Artificial sequence
  SiRNA target sequence
agctatgttctttattatctc

SEQ ID NO: 228134 - DNA, 21 bp, Artificial sequence
  SiRNA target sequence
gctatgttctttattatctcc

SEQ ID NO: 228135 - DNA, 21 bp, Artificial sequence
  SiRNA target sequence
ctatgttctttattatctcct

SEQ ID NO: 228136 - DNA, 21 bp, Artificial sequence
  SiRNA target sequence
tatgttctttattatctcctt

SEQ ID NO: 228137 - DNA, 21 bp, Artificial sequence
  SiRNA target sequence
atgttctttattatctccttt

SEQ ID NO: 228138 - DNA, 21 bp, Artificial sequence
  SiRNA target sequence
tgttctttattatctccttta

SEQ ID NO: 228139 - DNA, 21 bp, Artificial sequence
  SiRNA target sequence
gttctttattatctcctttat

SEQ ID NO: 228140 - DNA, 21 bp, Artificial sequence
  SiRNA target sequence
ttctttattatctcctttatt

SEQ ID NO: 228141 - DNA, 21 bp, Artificial sequence
  SiRNA target sequence
tctttattatctcctttattt

SEQ ID NO: 228142 - DNA, 21 bp, Artificial sequence
  SiRNA target sequence
ctttattatctcctttattta

SEQ ID NO: 228143 - DNA, 21 bp, Artificial sequence
  SiRNA target sequence
tttattatctcctttatttat

SEQ ID NO: 228144 - DNA, 21 bp, Artificial sequence
  SiRNA target sequence
ttattatctcctttatttatt

SEQ ID NO: 228145 - DNA, 21 bp, Artificial sequence
  SiRNA target sequence
tattatctcctttatttattc

SEQ ID NO: 228146 - DNA, 21 bp, Artificial sequence
  SiRNA target sequence
attatctcctttatttattcg

SEQ ID NO: 228147 - DNA, 21 bp, Artificial sequence
  SiRNA target sequence
ttatctcctttatttattcgg

SEQ ID NO: 228148 - DNA, 21 bp, Artificial sequence
  SiRNA target sequence
tatctcctttatttattcggt

SEQ ID NO: 228149 - DNA, 21 bp, Artificial sequence
  SiRNA target sequence
atctcctttatttattcggtg

SEQ ID NO: 228150 - DNA, 21 bp, Artificial sequence
  SiRNA target sequence
tctcctttatttattcggtgg

SEQ ID NO: 228151 - DNA, 21 bp, Artificial sequence
  SiRNA target sequence
ctcctttatttattcggtggc

SEQ ID NO: 228152 - DNA, 21 bp, Artificial sequence
  SiRNA target sequence
tcctttatttattcggtggct

SEQ ID NO: 228153 - DNA, 21 bp, Artificial sequence
  SiRNA target sequence
cctttatttattcggtggcta

SEQ ID NO: 228154 - DNA, 21 bp, Artificial sequence
  SiRNA target sequence
ctttatttattcggtggctag

SEQ ID NO: 228155 - DNA, 21 bp, Artificial sequence
  SiRNA target sequence
tttatttattcggtggctaga

SEQ ID NO: 228156 - DNA, 21 bp, Artificial sequence
  SiRNA target sequence
ttatttattcggtggctagag

SEQ ID NO: 228157 - DNA, 21 bp, Artificial sequence
  SiRNA target sequence
tatttattcggtggctagagt

SEQ ID NO: 228158 - DNA, 21 bp, Artificial sequence
  SiRNA target sequence
atttattcggtggctagagtg

SEQ ID NO: 228159 - DNA, 21 bp, Artificial sequence
  SiRNA target sequence
tttattcggtggctagagtgc

SEQ ID NO: 228160 - DNA, 21 bp, Artificial sequence
  SiRNA target sequence
ttattcggtggctagagtgct

SEQ ID NO: 228161 - DNA, 21 bp, Artificial sequence
  SiRNA target sequence
tattcggtggctagagtgctt

SEQ ID NO: 228162 - DNA, 21 bp, Artificial sequence
  SiRNA target sequence
attcggtggctagagtgctta

SEQ ID NO: 228163 - DNA, 21 bp, Artificial sequence
  SiRNA target sequence
ttcggtggctagagtgcttaa

SEQ ID NO: 228164 - DNA, 21 bp, Artificial sequence
  SiRNA target sequence
tcggtggctagagtgcttaaa

SEQ ID NO: 228165 - DNA, 21 bp, Artificial sequence
  SiRNA target sequence
cggtggctagagtgcttaaag

SEQ ID NO: 228166 - DNA, 21 bp, Artificial sequence
  SiRNA target sequence
ggtggctagagtgcttaaaga

SEQ ID NO: 228167 - DNA, 21 bp, Artificial sequence
  SiRNA target sequence
gtggctagagtgcttaaagat

SEQ ID NO: 228168 - DNA, 21 bp, Artificial sequence
  SiRNA target sequence
tggctagagtgcttaaagatg

SEQ ID NO: 228169 - DNA, 21 bp, Artificial sequence
  SiRNA target sequence
ggctagagtgcttaaagatgc

SEQ ID NO: 228170 - DNA, 21 bp, Artificial sequence
  SiRNA target sequence
gctagagtgcttaaagatgcc

SEQ ID NO: 228171 - DNA, 21 bp, Artificial sequence
  SiRNA target sequence
ctagagtgcttaaagatgccg

SEQ ID NO: 228172 - DNA, 21 bp, Artificial sequence
  SiRNA target sequence
tagagtgcttaaagatgccgc

SEQ ID NO: 228173 - DNA, 21 bp, Artificial sequence
  SiRNA target sequence
agagtgcttaaagatgccgct

SEQ ID NO: 228174 - DNA, 21 bp, Artificial sequence
  SiRNA target sequence
gagtgcttaaagatgccgctg

SEQ ID NO: 228175 - DNA, 21 bp, Artificial sequence
  SiRNA target sequence
agtgcttaaagatgccgctgt

SEQ ID NO: 228176 - DNA, 21 bp, Artificial sequence
  SiRNA target sequence
gtgcttaaagatgccgctgtt

SEQ ID NO: 228177 - DNA, 21 bp, Artificial sequence
  SiRNA target sequence
tgcttaaagatgccgctgtta

SEQ ID NO: 228178 - DNA, 21 bp, Artificial sequence
  SiRNA target sequence
gcttaaagatgccgctgttat

SEQ ID NO: 228179 - DNA, 21 bp, Artificial sequence
  SiRNA target sequence
cttaaagatgccgctgttatt

SEQ ID NO: 228180 - DNA, 21 bp, Artificial sequence
  SiRNA target sequence
ttaaagatgccgctgttattg

SEQ ID NO: 228181 - DNA, 21 bp, Artificial sequence
  SiRNA target sequence
taaagatgccgctgttattgg

SEQ ID NO: 228182 - DNA, 21 bp, Artificial sequence
  SiRNA target sequence
aaagatgccgctgttattggt

SEQ ID NO: 228183 - DNA, 21 bp, Artificial sequence
  SiRNA target sequence
aagatgccgctgttattggta

SEQ ID NO: 228184 - DNA, 21 bp, Artificial sequence
  SiRNA target sequence
agatgccgctgttattggtaa

SEQ ID NO: 228185 - DNA, 21 bp, Artificial sequence
  SiRNA target sequence
gatgccgctgttattggtaaa

SEQ ID NO: 228186 - DNA, 21 bp, Artificial sequence
  SiRNA target sequence
atgccgctgttattggtaaac

SEQ ID NO: 228187 - DNA, 21 bp, Artificial sequence
  SiRNA target sequence
tgccgctgttattggtaaaca

SEQ ID NO: 228188 - DNA, 21 bp, Artificial sequence
  SiRNA target sequence
gccgctgttattggtaaacaa

SEQ ID NO: 228189 - DNA, 21 bp, Artificial sequence
  SiRNA target sequence
ccgctgttattggtaaacaac

SEQ ID NO: 228190 - DNA, 21 bp, Artificial sequence
  SiRNA target sequence
cgctgttattggtaaacaact

SEQ ID NO: 228191 - DNA, 21 bp, Artificial sequence
  SiRNA target sequence
gctgttattggtaaacaactc

SEQ ID NO: 228192 - DNA, 21 bp, Artificial sequence
  SiRNA target sequence
ctgttattggtaaacaactcc

SEQ ID NO: 228193 - DNA, 21 bp, Artificial sequence
  SiRNA target sequence
tgttattggtaaacaactccc

SEQ ID NO: 228194 - DNA, 21 bp, Artificial sequence
  SiRNA target sequence
gttattggtaaacaactccca

SEQ ID NO: 228195 - DNA, 21 bp, Artificial sequence
  SiRNA target sequence
ttattggtaaacaactcccag

SEQ ID NO: 228196 - DNA, 21 bp, Artificial sequence
  SiRNA target sequence
tattggtaaacaactcccagc

SEQ ID NO: 228197 - DNA, 21 bp, Artificial sequence
  SiRNA target sequence
attggtaaacaactcccagcg

SEQ ID NO: 228198 - DNA, 21 bp, Artificial sequence
  SiRNA target sequence
ttggtaaacaactcccagcgt

SEQ ID NO: 228199 - DNA, 21 bp, Artificial sequence
  SiRNA target sequence
tggtaaacaactcccagcgtc

SEQ ID NO: 228200 - DNA, 21 bp, Artificial sequence
  SiRNA target sequence
ggtaaacaactcccagcgtca

SEQ ID NO: 228201 - DNA, 21 bp, Artificial sequence
  SiRNA target sequence
gtaaacaactcccagcgtcaa

SEQ ID NO: 228202 - DNA, 21 bp, Artificial sequence
  SiRNA target sequence
taaacaactcccagcgtcaat

SEQ ID NO: 228203 - DNA, 21 bp, Artificial sequence
  SiRNA target sequence
aaacaactcccagcgtcaatt

SEQ ID NO: 228204 - DNA, 21 bp, Artificial sequence
  SiRNA target sequence
aacaactcccagcgtcaattt

SEQ ID NO: 228205 - DNA, 21 bp, Artificial sequence
  SiRNA target sequence
acaactcccagcgtcaatttt

SEQ ID NO: 228206 - DNA, 21 bp, Artificial sequence
  SiRNA target sequence
caactcccagcgtcaattttc

SEQ ID NO: 228207 - DNA, 21 bp, Artificial sequence
  SiRNA target sequence
aactcccagcgtcaattttct

SEQ ID NO: 228208 - DNA, 21 bp, Artificial sequence
  SiRNA target sequence
actcccagcgtcaattttctt

SEQ ID NO: 228209 - DNA, 21 bp, Artificial sequence
  SiRNA target sequence
ctcccagcgtcaattttcttt

SEQ ID NO: 228210 - DNA, 21 bp, Artificial sequence
  SiRNA target sequence
tcccagcgtcaattttctttt

SEQ ID NO: 228211 - DNA, 21 bp, Artificial sequence
  SiRNA target sequence
cccagcgtcaattttcttttt

SEQ ID NO: 228212 - DNA, 21 bp, Artificial sequence
  SiRNA target sequence
ccagcgtcaattttctttttg

SEQ ID NO: 228213 - DNA, 21 bp, Artificial sequence
  SiRNA target sequence
cagcgtcaattttctttttga

SEQ ID NO: 228214 - DNA, 21 bp, Artificial sequence
  SiRNA target sequence
agcgtcaattttctttttgaa

SEQ ID NO: 228215 - DNA, 21 bp, Artificial sequence
  SiRNA target sequence
gcgtcaattttctttttgaaa

SEQ ID NO: 228216 - DNA, 21 bp, Artificial sequence
  SiRNA target sequence
cgtcaattttctttttgaaat

SEQ ID NO: 228217 - DNA, 21 bp, Artificial sequence
  SiRNA target sequence
gtcaattttctttttgaaatt

SEQ ID NO: 228218 - DNA, 21 bp, Artificial sequence
  SiRNA target sequence
tcaattttctttttgaaattt

SEQ ID NO: 228219 - DNA, 21 bp, Artificial sequence
  SiRNA target sequence
caattttctttttgaaatttg

SEQ ID NO: 228220 - DNA, 21 bp, Artificial sequence
  SiRNA target sequence
aattttctttttgaaatttgt

SEQ ID NO: 228221 - DNA, 21 bp, Artificial sequence
  SiRNA target sequence
attttctttttgaaatttgtt

SEQ ID NO: 228222 - DNA, 21 bp, Artificial sequence
  SiRNA target sequence
ttttctttttgaaatttgtta

SEQ ID NO: 228223 - DNA, 21 bp, Artificial sequence
  SiRNA target sequence
tttctttttgaaatttgttat

SEQ ID NO: 228224 - DNA, 21 bp, Artificial sequence
  SiRNA target sequence
ttctttttgaaatttgttatt

SEQ ID NO: 228225 - DNA, 21 bp, Artificial sequence
  SiRNA target sequence
tctttttgaaatttgttatta

SEQ ID NO: 228226 - DNA, 21 bp, Artificial sequence
  SiRNA target sequence
ctttttgaaatttgttattat

SEQ ID NO: 228227 - DNA, 21 bp, Artificial sequence
  SiRNA target sequence
tttttgaaatttgttattatc

SEQ ID NO: 228228 - DNA, 21 bp, Artificial sequence
  SiRNA target sequence
ttttgaaatttgttattatcc

SEQ ID NO: 228229 - DNA, 21 bp, Artificial sequence
  SiRNA target sequence
tttgaaatttgttattatcct

SEQ ID NO: 228230 - DNA, 21 bp, Artificial sequence
  SiRNA target sequence
ttgaaatttgttattatcctt

SEQ ID NO: 228231 - DNA, 21 bp, Artificial sequence
  SiRNA target sequence
tgaaatttgttattatccttc

SEQ ID NO: 228232 - DNA, 21 bp, Artificial sequence
  SiRNA target sequence
gaaatttgttattatccttcc

SEQ ID NO: 228233 - DNA, 21 bp, Artificial sequence
  SiRNA target sequence
aaatttgttattatccttccg

SEQ ID NO: 228234 - DNA, 21 bp, Artificial sequence
  SiRNA target sequence
aatttgttattatccttccgt

SEQ ID NO: 228235 - DNA, 21 bp, Artificial sequence
  SiRNA target sequence
atttgttattatccttccgtt

SEQ ID NO: 228236 - DNA, 21 bp, Artificial sequence
  SiRNA target sequence
tttgttattatccttccgttc

SEQ ID NO: 228237 - DNA, 21 bp, Artificial sequence
  SiRNA target sequence
ttgttattatccttccgttct

SEQ ID NO: 228238 - DNA, 21 bp, Artificial sequence
  SiRNA target sequence
tgttattatccttccgttctc

SEQ ID NO: 228239 - DNA, 21 bp, Artificial sequence
  SiRNA target sequence
gttattatccttccgttctca

SEQ ID NO: 228240 - DNA, 21 bp, Artificial sequence
  SiRNA target sequence
ttattatccttccgttctcat

SEQ ID NO: 228241 - DNA, 21 bp, Artificial sequence
  SiRNA target sequence
tattatccttccgttctcatt

SEQ ID NO: 228242 - DNA, 21 bp, Artificial sequence
  SiRNA target sequence
attatccttccgttctcattt

SEQ ID NO: 228243 - DNA, 21 bp, Artificial sequence
  SiRNA target sequence
ttatccttccgttctcattta

SEQ ID NO: 228244 - DNA, 21 bp, Artificial sequence
  SiRNA target sequence
tatccttccgttctcatttat

SEQ ID NO: 228245 - DNA, 21 bp, Artificial sequence
  SiRNA target sequence
atccttccgttctcatttatt

SEQ ID NO: 228246 - DNA, 21 bp, Artificial sequence
  SiRNA target sequence
tccttccgttctcatttattt

SEQ ID NO: 228247 - DNA, 21 bp, Artificial sequence
  SiRNA target sequence
ccttccgttctcatttatttc

SEQ ID NO: 228248 - DNA, 21 bp, Artificial sequence
  SiRNA target sequence
cttccgttctcatttatttca

SEQ ID NO: 228249 - DNA, 21 bp, Artificial sequence
  SiRNA target sequence
ttccgttctcatttatttcag

SEQ ID NO: 228250 - DNA, 21 bp, Artificial sequence
  SiRNA target sequence
tccgttctcatttatttcagt

SEQ ID NO: 228251 - DNA, 21 bp, Artificial sequence
  SiRNA target sequence
ccgttctcatttatttcagta

SEQ ID NO: 228252 - DNA, 21 bp, Artificial sequence
  SiRNA target sequence
cgttctcatttatttcagtag

SEQ ID NO: 228253 - DNA, 21 bp, Artificial sequence
  SiRNA target sequence
gttctcatttatttcagtagg

SEQ ID NO: 228254 - DNA, 21 bp, Artificial sequence
  SiRNA target sequence
ttctcatttatttcagtaggt

SEQ ID NO: 228255 - DNA, 21 bp, Artificial sequence
  SiRNA target sequence
tctcatttatttcagtaggta

SEQ ID NO: 228256 - DNA, 21 bp, Artificial sequence
  SiRNA target sequence
ctcatttatttcagtaggtat

SEQ ID NO: 228257 - DNA, 21 bp, Artificial sequence
  SiRNA target sequence
tcatttatttcagtaggtatt

SEQ ID NO: 228258 - DNA, 21 bp, Artificial sequence
  SiRNA target sequence
catttatttcagtaggtatta

SEQ ID NO: 228259 - DNA, 21 bp, Artificial sequence
  SiRNA target sequence
atttatttcagtaggtattat

SEQ ID NO: 228260 - DNA, 21 bp, Artificial sequence
  SiRNA target sequence
tttatttcagtaggtattatt

SEQ ID NO: 228261 - DNA, 21 bp, Artificial sequence
  SiRNA target sequence
ttatttcagtaggtattattc

SEQ ID NO: 228262 - DNA, 21 bp, Artificial sequence
  SiRNA target sequence
tatttcagtaggtattattca

SEQ ID NO: 228263 - DNA, 21 bp, Artificial sequence
  SiRNA target sequence
atttcagtaggtattattcag

SEQ ID NO: 228264 - DNA, 21 bp, Artificial sequence
  SiRNA target sequence
tttcagtaggtattattcaga

SEQ ID NO: 228265 - DNA, 21 bp, Artificial sequence
  SiRNA target sequence
ttcagtaggtattattcagaa

SEQ ID NO: 228266 - DNA, 21 bp, Artificial sequence
  SiRNA target sequence
tcagtaggtattattcagaaa

SEQ ID NO: 228267 - DNA, 21 bp, Artificial sequence
  SiRNA target sequence
cagtaggtattattcagaaag

SEQ ID NO: 228268 - DNA, 21 bp, Artificial sequence
  SiRNA target sequence
agtaggtattattcagaaagc

SEQ ID NO: 228269 - DNA, 21 bp, Artificial sequence
  SiRNA target sequence
gtaggtattattcagaaagct

SEQ ID NO: 228270 - DNA, 21 bp, Artificial sequence
  SiRNA target sequence
taggtattattcagaaagctt

SEQ ID NO: 228271 - DNA, 21 bp, Artificial sequence
  SiRNA target sequence
aggtattattcagaaagcttt

SEQ ID NO: 228272 - DNA, 21 bp, Artificial sequence
  SiRNA target sequence
ggtattattcagaaagcttta

SEQ ID NO: 228273 - DNA, 21 bp, Artificial sequence
  SiRNA target sequence
gtattattcagaaagctttag

SEQ ID NO: 228274 - DNA, 21 bp, Artificial sequence
  SiRNA target sequence
tattattcagaaagctttaga

SEQ ID NO: 228275 - DNA, 21 bp, Artificial sequence
  SiRNA target sequence
attattcagaaagctttagat

SEQ ID NO: 228276 - DNA, 21 bp, Artificial sequence
  SiRNA target sequence
ttattcagaaagctttagata

SEQ ID NO: 228277 - DNA, 21 bp, Artificial sequence
  SiRNA target sequence
tattcagaaagctttagataa

SEQ ID NO: 228278 - DNA, 21 bp, Artificial sequence
  SiRNA target sequence
attcagaaagctttagataaa

SEQ ID NO: 228279 - DNA, 21 bp, Artificial sequence
  SiRNA target sequence
ttcagaaagctttagataaat

SEQ ID NO: 228280 - DNA, 21 bp, Artificial sequence
  SiRNA target sequence
tcagaaagctttagataaata

SEQ ID NO: 228281 - DNA, 21 bp, Artificial sequence
  SiRNA target sequence
cagaaagctttagataaatat

SEQ ID NO: 228282 - DNA, 21 bp, Artificial sequence
  SiRNA target sequence
agaaagctttagataaatatc

SEQ ID NO: 228283 - DNA, 21 bp, Artificial sequence
  SiRNA target sequence
gaaagctttagataaatatcc

SEQ ID NO: 228284 - DNA, 21 bp, Artificial sequence
  SiRNA target sequence
aaagctttagataaatatcct

SEQ ID NO: 228285 - DNA, 21 bp, Artificial sequence
  SiRNA target sequence
aagctttagataaatatcctt

SEQ ID NO: 228286 - DNA, 21 bp, Artificial sequence
  SiRNA target sequence
agctttagataaatatccttt

SEQ ID NO: 228287 - DNA, 21 bp, Artificial sequence
  SiRNA target sequence
gctttagataaatatcctttt

SEQ ID NO: 228288 - DNA, 21 bp, Artificial sequence
  SiRNA target sequence
ctttagataaatatcctttta

SEQ ID NO: 228289 - DNA, 21 bp, Artificial sequence
  SiRNA target sequence
tttagataaatatccttttac

SEQ ID NO: 228290 - DNA, 21 bp, Artificial sequence
  SiRNA target sequence
ttagataaatatccttttaca

SEQ ID NO: 228291 - DNA, 21 bp, Artificial sequence
  SiRNA target sequence
tagataaatatccttttacaa

SEQ ID NO: 228292 - DNA, 21 bp, Artificial sequence
  SiRNA target sequence
agataaatatccttttacaaa

SEQ ID NO: 228293 - DNA, 21 bp, Artificial sequence
  SiRNA target sequence
gataaatatccttttacaaaa

SEQ ID NO: 228294 - DNA, 21 bp, Artificial sequence
  SiRNA target sequence
ataaatatccttttacaaaaa

SEQ ID NO: 228295 - DNA, 21 bp, Artificial sequence
  SiRNA target sequence
taaatatccttttacaaaaat

SEQ ID NO: 228296 - DNA, 21 bp, Artificial sequence
  SiRNA target sequence
aaatatccttttacaaaaata

SEQ ID NO: 228297 - DNA, 21 bp, Artificial sequence
  SiRNA target sequence
aatatccttttacaaaaatat

SEQ ID NO: 228298 - DNA, 21 bp, Artificial sequence
  SiRNA target sequence
atatccttttacaaaaatatt

SEQ ID NO: 228299 - DNA, 21 bp, Artificial sequence
  SiRNA target sequence
tatccttttacaaaaatattt

SEQ ID NO: 228300 - DNA, 21 bp, Artificial sequence
  SiRNA target sequence
atccttttacaaaaatatttg

SEQ ID NO: 228301 - DNA, 21 bp, Artificial sequence
  SiRNA target sequence
tccttttacaaaaatatttga

SEQ ID NO: 228302 - DNA, 21 bp, Artificial sequence
  SiRNA target sequence
ccttttacaaaaatatttgat

SEQ ID NO: 228303 - DNA, 21 bp, Artificial sequence
  SiRNA target sequence
cttttacaaaaatatttgatg

SEQ ID NO: 228304 - DNA, 21 bp, Artificial sequence
  SiRNA target sequence
ttttacaaaaatatttgatgt

SEQ ID NO: 228305 - DNA, 21 bp, Artificial sequence
  SiRNA target sequence
tttacaaaaatatttgatgta

SEQ ID NO: 228306 - DNA, 21 bp, Artificial sequence
  SiRNA target sequence
ttacaaaaatatttgatgtaa

SEQ ID NO: 228307 - DNA, 21 bp, Artificial sequence
  SiRNA target sequence
tacaaaaatatttgatgtaac

SEQ ID NO: 228308 - DNA, 21 bp, Artificial sequence
  SiRNA target sequence
acaaaaatatttgatgtaact

SEQ ID NO: 228309 - DNA, 21 bp, Artificial sequence
  SiRNA target sequence
caaaaatatttgatgtaactt

SEQ ID NO: 228310 - DNA, 21 bp, Artificial sequence
  SiRNA target sequence
aaaaatatttgatgtaacttt

SEQ ID NO: 228311 - DNA, 21 bp, Artificial sequence
  SiRNA target sequence
aaaatatttgatgtaacttta

SEQ ID NO: 228312 - DNA, 21 bp, Artificial sequence
  SiRNA target sequence
aaatatttgatgtaactttaa

SEQ ID NO: 228313 - DNA, 21 bp, Artificial sequence
  SiRNA target sequence
aatatttgatgtaactttaat

SEQ ID NO: 228314 - DNA, 21 bp, Artificial sequence
  SiRNA target sequence
atatttgatgtaactttaata

SEQ ID NO: 228315 - DNA, 21 bp, Artificial sequence
  SiRNA target sequence
tatttgatgtaactttaatag

SEQ ID NO: 228316 - DNA, 21 bp, Artificial sequence
  SiRNA target sequence
atttgatgtaactttaatagt

SEQ ID NO: 228317 - DNA, 21 bp, Artificial sequence
  SiRNA target sequence
tttgatgtaactttaatagtt

SEQ ID NO: 228318 - DNA, 21 bp, Artificial sequence
  SiRNA target sequence
ttgatgtaactttaatagttt

SEQ ID NO: 228319 - DNA, 21 bp, Artificial sequence
  SiRNA target sequence
tgatgtaactttaatagtttt

SEQ ID NO: 228320 - DNA, 21 bp, Artificial sequence
  SiRNA target sequence
gatgtaactttaatagttttc

SEQ ID NO: 228321 - DNA, 21 bp, Artificial sequence
  SiRNA target sequence
atgtaactttaatagttttcg

SEQ ID NO: 228322 - DNA, 21 bp, Artificial sequence
  SiRNA target sequence
tgtaactttaatagttttcgc

SEQ ID NO: 228323 - DNA, 21 bp, Artificial sequence
  SiRNA target sequence
gtaactttaatagttttcgct

SEQ ID NO: 228324 - DNA, 21 bp, Artificial sequence
  SiRNA target sequence
taactttaatagttttcgctg

SEQ ID NO: 228325 - DNA, 21 bp, Artificial sequence
  SiRNA target sequence
aactttaatagttttcgctgt

SEQ ID NO: 228326 - DNA, 21 bp, Artificial sequence
  SiRNA target sequence
actttaatagttttcgctgtt

SEQ ID NO: 228327 - DNA, 21 bp, Artificial sequence
  SiRNA target sequence
ctttaatagttttcgctgttg

SEQ ID NO: 228328 - DNA, 21 bp, Artificial sequence
  SiRNA target sequence
tttaatagttttcgctgttgc

SEQ ID NO: 228329 - DNA, 21 bp, Artificial sequence
  SiRNA target sequence
ttaatagttttcgctgttgca

SEQ ID NO: 228330 - DNA, 21 bp, Artificial sequence
  SiRNA target sequence
taatagttttcgctgttgcat

SEQ ID NO: 228331 - DNA, 21 bp, Artificial sequence
  SiRNA target sequence
aatagttttcgctgttgcatt

SEQ ID NO: 228332 - DNA, 21 bp, Artificial sequence
  SiRNA target sequence
atagttttcgctgttgcattt

SEQ ID NO: 228333 - DNA, 21 bp, Artificial sequence
  SiRNA target sequence
tagttttcgctgttgcattta

SEQ ID NO: 228334 - DNA, 21 bp, Artificial sequence
  SiRNA target sequence
agttttcgctgttgcatttac

SEQ ID NO: 228335 - DNA, 21 bp, Artificial sequence
  SiRNA target sequence
gttttcgctgttgcatttact

SEQ ID NO: 228336 - DNA, 21 bp, Artificial sequence
  SiRNA target sequence
ttttcgctgttgcatttacta

SEQ ID NO: 228337 - DNA, 21 bp, Artificial sequence
  SiRNA target sequence
tttcgctgttgcatttactat

SEQ ID NO: 228338 - DNA, 21 bp, Artificial sequence
  SiRNA target sequence
ttcgctgttgcatttactata

SEQ ID NO: 228339 - DNA, 21 bp, Artificial sequence
  SiRNA target sequence
tcgctgttgcatttactatac

SEQ ID NO: 228340 - DNA, 21 bp, Artificial sequence
  SiRNA target sequence
cgctgttgcatttactatact

SEQ ID NO: 228341 - DNA, 21 bp, Artificial sequence
  SiRNA target sequence
gctgttgcatttactatactt

SEQ ID NO: 228342 - DNA, 21 bp, Artificial sequence
  SiRNA target sequence
ctgttgcatttactatacttg

SEQ ID NO: 228343 - DNA, 21 bp, Artificial sequence
  SiRNA target sequence
tgttgcatttactatacttgg

SEQ ID NO: 228344 - DNA, 21 bp, Artificial sequence
  SiRNA target sequence
gttgcatttactatacttggt

SEQ ID NO: 228345 - DNA, 21 bp, Artificial sequence
  SiRNA target sequence
ttgcatttactatacttggta

SEQ ID NO: 228346 - DNA, 21 bp, Artificial sequence
  SiRNA target sequence
tgcatttactatacttggtag

SEQ ID NO: 228347 - DNA, 21 bp, Artificial sequence
  SiRNA target sequence
gcatttactatacttggtagt

SEQ ID NO: 228348 - DNA, 21 bp, Artificial sequence
  SiRNA target sequence
catttactatacttggtagtt

SEQ ID NO: 228349 - DNA, 21 bp, Artificial sequence
  SiRNA target sequence
atttactatacttggtagttt

SEQ ID NO: 228350 - DNA, 21 bp, Artificial sequence
  SiRNA target sequence
tttactatacttggtagttta

SEQ ID NO: 228351 - DNA, 21 bp, Artificial sequence
  SiRNA target sequence
ttactatacttggtagtttat

SEQ ID NO: 228352 - DNA, 21 bp, Artificial sequence
  SiRNA target sequence
tactatacttggtagtttatt

SEQ ID NO: 228353 - DNA, 21 bp, Artificial sequence
  SiRNA target sequence
actatacttggtagtttatta

SEQ ID NO: 228354 - DNA, 21 bp, Artificial sequence
  SiRNA target sequence
ctatacttggtagtttattac

SEQ ID NO: 228355 - DNA, 21 bp, Artificial sequence
  SiRNA target sequence
tatacttggtagtttattact

SEQ ID NO: 228356 - DNA, 21 bp, Artificial sequence
  SiRNA target sequence
atacttggtagtttattactt

SEQ ID NO: 228357 - DNA, 21 bp, Artificial sequence
  SiRNA target sequence
tacttggtagtttattacttc

SEQ ID NO: 228358 - DNA, 21 bp, Artificial sequence
  SiRNA target sequence
acttggtagtttattacttcc

SEQ ID NO: 228359 - DNA, 21 bp, Artificial sequence
  SiRNA target sequence
cttggtagtttattacttccc

SEQ ID NO: 228360 - DNA, 21 bp, Artificial sequence
  SiRNA target sequence
ttggtagtttattacttccct

SEQ ID NO: 228361 - DNA, 21 bp, Artificial sequence
  SiRNA target sequence
tggtagtttattacttccctt

SEQ ID NO: 228362 - DNA, 21 bp, Artificial sequence
  SiRNA target sequence
ggtagtttattacttcccttt

SEQ ID NO: 228363 - DNA, 21 bp, Artificial sequence
  SiRNA target sequence
gtagtttattacttcccttta

SEQ ID NO: 228364 - DNA, 21 bp, Artificial sequence
  SiRNA target sequence
tagtttattacttccctttag

SEQ ID NO: 228365 - DNA, 21 bp, Artificial sequence
  SiRNA target sequence
agtttattacttccctttagt

SEQ ID NO: 228366 - DNA, 21 bp, Artificial sequence
  SiRNA target sequence
gtttattacttccctttagtg

SEQ ID NO: 228367 - DNA, 21 bp, Artificial sequence
  SiRNA target sequence
tttattacttccctttagtga

SEQ ID NO: 228368 - DNA, 21 bp, Artificial sequence
  SiRNA target sequence
ttattacttccctttagtgat

SEQ ID NO: 228369 - DNA, 21 bp, Artificial sequence
  SiRNA target sequence
tattacttccctttagtgatt

SEQ ID NO: 228370 - DNA, 21 bp, Artificial sequence
  SiRNA target sequence
attacttccctttagtgatta

SEQ ID NO: 228371 - DNA, 21 bp, Artificial sequence
  SiRNA target sequence
ttacttccctttagtgattat

SEQ ID NO: 228372 - DNA, 21 bp, Artificial sequence
  SiRNA target sequence
tacttccctttagtgattata

SEQ ID NO: 228373 - DNA, 21 bp, Artificial sequence
  SiRNA target sequence
acttccctttagtgattatat

SEQ ID NO: 228374 - DNA, 21 bp, Artificial sequence
  SiRNA target sequence
cttccctttagtgattatatt

SEQ ID NO: 228375 - DNA, 21 bp, Artificial sequence
  SiRNA target sequence
ttccctttagtgattatattc

SEQ ID NO: 228376 - DNA, 21 bp, Artificial sequence
  SiRNA target sequence
tccctttagtgattatattca

SEQ ID NO: 228377 - DNA, 21 bp, Artificial sequence
  SiRNA target sequence
ccctttagtgattatattcag

SEQ ID NO: 228378 - DNA, 21 bp, Artificial sequence
  SiRNA target sequence
cctttagtgattatattcaga

SEQ ID NO: 228379 - DNA, 21 bp, Artificial sequence
  SiRNA target sequence
ctttagtgattatattcagat

SEQ ID NO: 228380 - DNA, 21 bp, Artificial sequence
  SiRNA target sequence
tttagtgattatattcagatt

SEQ ID NO: 228381 - DNA, 21 bp, Artificial sequence
  SiRNA target sequence
ttagtgattatattcagattc

SEQ ID NO: 228382 - DNA, 21 bp, Artificial sequence
  SiRNA target sequence
tagtgattatattcagattca

SEQ ID NO: 228383 - DNA, 21 bp, Artificial sequence
  SiRNA target sequence
agtgattatattcagattcaa

SEQ ID NO: 228384 - DNA, 21 bp, Artificial sequence
  SiRNA target sequence
gtgattatattcagattcaac

SEQ ID NO: 228385 - DNA, 21 bp, Artificial sequence
  SiRNA target sequence
tgattatattcagattcaacc

SEQ ID NO: 228386 - DNA, 21 bp, Artificial sequence
  SiRNA target sequence
gattatattcagattcaaccg

SEQ ID NO: 228387 - DNA, 21 bp, Artificial sequence
  SiRNA target sequence
attatattcagattcaaccgt

SEQ ID NO: 228388 - DNA, 21 bp, Artificial sequence
  SiRNA target sequence
ttatattcagattcaaccgtt

SEQ ID NO: 228389 - DNA, 21 bp, Artificial sequence
  SiRNA target sequence
tatattcagattcaaccgttt

SEQ ID NO: 228390 - DNA, 21 bp, Artificial sequence
  SiRNA target sequence
atattcagattcaaccgtttt

SEQ ID NO: 228391 - DNA, 21 bp, Artificial sequence
  SiRNA target sequence
tattcagattcaaccgttttg

SEQ ID NO: 228392 - DNA, 21 bp, Artificial sequence
  SiRNA target sequence
attcagattcaaccgttttgg

SEQ ID NO: 228393 - DNA, 21 bp, Artificial sequence
  SiRNA target sequence
ttcagattcaaccgttttggg

SEQ ID NO: 228394 - DNA, 21 bp, Artificial sequence
  SiRNA target sequence
tcagattcaaccgttttgggc

SEQ ID NO: 228395 - DNA, 21 bp, Artificial sequence
  SiRNA target sequence
cagattcaaccgttttgggcc

SEQ ID NO: 228396 - DNA, 21 bp, Artificial sequence
  SiRNA target sequence
agattcaaccgttttgggcca

SEQ ID NO: 228397 - DNA, 21 bp, Artificial sequence
  SiRNA target sequence
gattcaaccgttttgggccaa

SEQ ID NO: 228398 - DNA, 21 bp, Artificial sequence
  SiRNA target sequence
attcaaccgttttgggccaaa

SEQ ID NO: 228399 - DNA, 21 bp, Artificial sequence
  SiRNA target sequence
ttcaaccgttttgggccaaag

SEQ ID NO: 228400 - DNA, 21 bp, Artificial sequence
  SiRNA target sequence
tcaaccgttttgggccaaaga

SEQ ID NO: 228401 - DNA, 21 bp, Artificial sequence
  SiRNA target sequence
caaccgttttgggccaaagat

SEQ ID NO: 228402 - DNA, 21 bp, Artificial sequence
  SiRNA target sequence
aaccgttttgggccaaagata

SEQ ID NO: 228403 - DNA, 21 bp, Artificial sequence
  SiRNA target sequence
accgttttgggccaaagatat

SEQ ID NO: 228404 - DNA, 21 bp, Artificial sequence
  SiRNA target sequence
ccgttttgggccaaagatatt

SEQ ID NO: 228405 - DNA, 21 bp, Artificial sequence
  SiRNA target sequence
cgttttgggccaaagatattt

SEQ ID NO: 228406 - DNA, 21 bp, Artificial sequence
  SiRNA target sequence
gttttgggccaaagatatttt

SEQ ID NO: 228407 - DNA, 21 bp, Artificial sequence
  SiRNA target sequence
ttttgggccaaagatattttt

SEQ ID NO: 228408 - DNA, 21 bp, Artificial sequence
  SiRNA target sequence
tttgggccaaagatatttttg

SEQ ID NO: 228409 - DNA, 21 bp, Artificial sequence
  SiRNA target sequence
ttgggccaaagatatttttgc

SEQ ID NO: 228410 - DNA, 21 bp, Artificial sequence
  SiRNA target sequence
tgggccaaagatatttttgct

SEQ ID NO: 228411 - DNA, 21 bp, Artificial sequence
  SiRNA target sequence
gggccaaagatatttttgctg

SEQ ID NO: 228412 - DNA, 21 bp, Artificial sequence
  SiRNA target sequence
ggccaaagatatttttgctga

SEQ ID NO: 228413 - DNA, 21 bp, Artificial sequence
  SiRNA target sequence
gccaaagatatttttgctgat

SEQ ID NO: 228414 - DNA, 21 bp, Artificial sequence
  SiRNA target sequence
ccaaagatatttttgctgatg

SEQ ID NO: 228415 - DNA, 21 bp, Artificial sequence
  SiRNA target sequence
caaagatatttttgctgatgg

SEQ ID NO: 228416 - DNA, 21 bp, Artificial sequence
  SiRNA target sequence
aaagatatttttgctgatgga

SEQ ID NO: 228417 - DNA, 21 bp, Artificial sequence
  SiRNA target sequence
aagatatttttgctgatggaa

SEQ ID NO: 228418 - DNA, 21 bp, Artificial sequence
  SiRNA target sequence
agatatttttgctgatggaaa

SEQ ID NO: 228419 - DNA, 21 bp, Artificial sequence
  SiRNA target sequence
gatatttttgctgatggaaaa

SEQ ID NO: 228420 - DNA, 21 bp, Artificial sequence
  SiRNA target sequence
atatttttgctgatggaaaag

SEQ ID NO: 228421 - DNA, 21 bp, Artificial sequence
  SiRNA target sequence
tatttttgctgatggaaaagc

SEQ ID NO: 228422 - DNA, 21 bp, Artificial sequence
  SiRNA target sequence
atttttgctgatggaaaagct

SEQ ID NO: 228423 - DNA, 21 bp, Artificial sequence
  SiRNA target sequence
tttttgctgatggaaaagctg

SEQ ID NO: 228424 - DNA, 21 bp, Artificial sequence
  SiRNA target sequence
ttttgctgatggaaaagctgt

SEQ ID NO: 228425 - DNA, 21 bp, Artificial sequence
  SiRNA target sequence
tttgctgatggaaaagctgtt

SEQ ID NO: 228426 - DNA, 21 bp, Artificial sequence
  SiRNA target sequence
ttgctgatggaaaagctgttg

SEQ ID NO: 228427 - DNA, 21 bp, Artificial sequence
  SiRNA target sequence
tgctgatggaaaagctgttgc

SEQ ID NO: 228428 - DNA, 21 bp, Artificial sequence
  SiRNA target sequence
gctgatggaaaagctgttgcc

SEQ ID NO: 228429 - DNA, 21 bp, Artificial sequence
  SiRNA target sequence
ctgatggaaaagctgttgcca

SEQ ID NO: 228430 - DNA, 21 bp, Artificial sequence
  SiRNA target sequence
tgatggaaaagctgttgccag

SEQ ID NO: 228431 - DNA, 21 bp, Artificial sequence
  SiRNA target sequence
gatggaaaagctgttgccaga

SEQ ID NO: 228432 - DNA, 21 bp, Artificial sequence
  SiRNA target sequence
atggaaaagctgttgccagaa

SEQ ID NO: 228433 - DNA, 21 bp, Artificial sequence
  SiRNA target sequence
tggaaaagctgttgccagaag

SEQ ID NO: 228434 - DNA, 21 bp, Artificial sequence
  SiRNA target sequence
ggaaaagctgttgccagaagt

SEQ ID NO: 228435 - DNA, 21 bp, Artificial sequence
  SiRNA target sequence
gaaaagctgttgccagaagta

SEQ ID NO: 228436 - DNA, 21 bp, Artificial sequence
  SiRNA target sequence
aaaagctgttgccagaagtac

SEQ ID NO: 228437 - DNA, 21 bp, Artificial sequence
  SiRNA target sequence
aaagctgttgccagaagtaca

SEQ ID NO: 228438 - DNA, 21 bp, Artificial sequence
  SiRNA target sequence
aagctgttgccagaagtacag

SEQ ID NO: 228439 - DNA, 21 bp, Artificial sequence
  SiRNA target sequence
agctgttgccagaagtacaga

SEQ ID NO: 228440 - DNA, 21 bp, Artificial sequence
  SiRNA target sequence
gctgttgccagaagtacagat

SEQ ID NO: 228441 - DNA, 21 bp, Artificial sequence
  SiRNA target sequence
ctgttgccagaagtacagatt

SEQ ID NO: 228442 - DNA, 21 bp, Artificial sequence
  SiRNA target sequence
tgttgccagaagtacagattt

SEQ ID NO: 228443 - DNA, 21 bp, Artificial sequence
  SiRNA target sequence
gttgccagaagtacagatttt

SEQ ID NO: 228444 - DNA, 21 bp, Artificial sequence
  SiRNA target sequence
ttgccagaagtacagattttt

SEQ ID NO: 228445 - DNA, 21 bp, Artificial sequence
  SiRNA target sequence
tgccagaagtacagatttttt

SEQ ID NO: 228446 - DNA, 21 bp, Artificial sequence
  SiRNA target sequence
gccagaagtacagatttttta

SEQ ID NO: 228447 - DNA, 21 bp, Artificial sequence
  SiRNA target sequence
ccagaagtacagattttttat

SEQ ID NO: 228448 - DNA, 21 bp, Artificial sequence
  SiRNA target sequence
cagaagtacagattttttatt

SEQ ID NO: 228449 - DNA, 21 bp, Artificial sequence
  SiRNA target sequence
agaagtacagattttttattt

SEQ ID NO: 228450 - DNA, 21 bp, Artificial sequence
  SiRNA target sequence
gaagtacagattttttatttt

SEQ ID NO: 228451 - DNA, 21 bp, Artificial sequence
  SiRNA target sequence
aagtacagattttttattttc

SEQ ID NO: 228452 - DNA, 21 bp, Artificial sequence
  SiRNA target sequence
agtacagattttttattttct

SEQ ID NO: 228453 - DNA, 21 bp, Artificial sequence
  SiRNA target sequence
gtacagattttttattttcta

SEQ ID NO: 228454 - DNA, 21 bp, Artificial sequence
  SiRNA target sequence
tacagattttttattttctat

SEQ ID NO: 228455 - DNA, 21 bp, Artificial sequence
  SiRNA target sequence
acagattttttattttctatt

SEQ ID NO: 228456 - DNA, 21 bp, Artificial sequence
  SiRNA target sequence
cagattttttattttctattg

SEQ ID NO: 228457 - DNA, 21 bp, Artificial sequence
  SiRNA target sequence
agattttttattttctattgc

SEQ ID NO: 228458 - DNA, 21 bp, Artificial sequence
  SiRNA target sequence
gattttttattttctattgca

SEQ ID NO: 228459 - DNA, 21 bp, Artificial sequence
  SiRNA target sequence
attttttattttctattgcac

SEQ ID NO: 228460 - DNA, 21 bp, Artificial sequence
  SiRNA target sequence
ttttttattttctattgcact

SEQ ID NO: 228461 - DNA, 21 bp, Artificial sequence
  SiRNA target sequence
tttttattttctattgcactt

SEQ ID NO: 228462 - DNA, 21 bp, Artificial sequence
  SiRNA target sequence
ttttattttctattgcacttg

SEQ ID NO: 228463 - DNA, 21 bp, Artificial sequence
  SiRNA target sequence
tttattttctattgcacttgt

SEQ ID NO: 228464 - DNA, 21 bp, Artificial sequence
  SiRNA target sequence
ttattttctattgcacttgtt

SEQ ID NO: 228465 - DNA, 21 bp, Artificial sequence
  SiRNA target sequence
tattttctattgcacttgttt

SEQ ID NO: 228466 - DNA, 21 bp, Artificial sequence
  SiRNA target sequence
attttctattgcacttgtttt

SEQ ID NO: 228467 - DNA, 21 bp, Artificial sequence
  SiRNA target sequence
ttttctattgcacttgttttc

SEQ ID NO: 228468 - DNA, 21 bp, Artificial sequence
  SiRNA target sequence
tttctattgcacttgttttca

SEQ ID NO: 228469 - DNA, 21 bp, Artificial sequence
  SiRNA target sequence
ttctattgcacttgttttcaa

SEQ ID NO: 228470 - DNA, 21 bp, Artificial sequence
  SiRNA target sequence
tctattgcacttgttttcaat

SEQ ID NO: 228471 - DNA, 21 bp, Artificial sequence
  SiRNA target sequence
ctattgcacttgttttcaatg

SEQ ID NO: 228472 - DNA, 21 bp, Artificial sequence
  SiRNA target sequence
tattgcacttgttttcaatga

SEQ ID NO: 228473 - DNA, 21 bp, Artificial sequence
  SiRNA target sequence
attgcacttgttttcaatgaa

SEQ ID NO: 228474 - DNA, 21 bp, Artificial sequence
  SiRNA target sequence
ttgcacttgttttcaatgaat

SEQ ID NO: 228475 - DNA, 21 bp, Artificial sequence
  SiRNA target sequence
tgcacttgttttcaatgaatg

SEQ ID NO: 228476 - DNA, 21 bp, Artificial sequence
  SiRNA target sequence
gcacttgttttcaatgaatgg

SEQ ID NO: 228477 - DNA, 21 bp, Artificial sequence
  SiRNA target sequence
cacttgttttcaatgaatgga

SEQ ID NO: 228478 - DNA, 21 bp, Artificial sequence
  SiRNA target sequence
acttgttttcaatgaatggac

SEQ ID NO: 228479 - DNA, 21 bp, Artificial sequence
  SiRNA target sequence
cttgttttcaatgaatggaca

SEQ ID NO: 228480 - DNA, 21 bp, Artificial sequence
  SiRNA target sequence
ttgttttcaatgaatggacaa

SEQ ID NO: 228481 - DNA, 21 bp, Artificial sequence
  SiRNA target sequence
tgttttcaatgaatggacaag

SEQ ID NO: 228482 - DNA, 21 bp, Artificial sequence
  SiRNA target sequence
gttttcaatgaatggacaagt

SEQ ID NO: 228483 - DNA, 21 bp, Artificial sequence
  SiRNA target sequence
ttttcaatgaatggacaagtt

SEQ ID NO: 228484 - DNA, 21 bp, Artificial sequence
  SiRNA target sequence
tttcaatgaatggacaagttc

SEQ ID NO: 228485 - DNA, 21 bp, Artificial sequence
  SiRNA target sequence
ttcaatgaatggacaagttct

SEQ ID NO: 228486 - DNA, 21 bp, Artificial sequence
  SiRNA target sequence
tcaatgaatggacaagttctg

SEQ ID NO: 228487 - DNA, 21 bp, Artificial sequence
  SiRNA target sequence
caatgaatggacaagttctgc

SEQ ID NO: 228488 - DNA, 21 bp, Artificial sequence
  SiRNA target sequence
aatgaatggacaagttctgct

SEQ ID NO: 228489 - DNA, 21 bp, Artificial sequence
  SiRNA target sequence
atgaatggacaagttctgcta

SEQ ID NO: 228490 - DNA, 21 bp, Artificial sequence
  SiRNA target sequence
tgaatggacaagttctgctat

SEQ ID NO: 228491 - DNA, 21 bp, Artificial sequence
  SiRNA target sequence
gaatggacaagttctgctatc

SEQ ID NO: 228492 - DNA, 21 bp, Artificial sequence
  SiRNA target sequence
aatggacaagttctgctatct

SEQ ID NO: 228493 - DNA, 21 bp, Artificial sequence
  SiRNA target sequence
atggacaagttctgctatcta

SEQ ID NO: 228494 - DNA, 21 bp, Artificial sequence
  SiRNA target sequence
tggacaagttctgctatctat

SEQ ID NO: 228495 - DNA, 21 bp, Artificial sequence
  SiRNA target sequence
ggacaagttctgctatctatg

SEQ ID NO: 228496 - DNA, 21 bp, Artificial sequence
  SiRNA target sequence
gacaagttctgctatctatgt

SEQ ID NO: 228497 - DNA, 21 bp, Artificial sequence
  SiRNA target sequence
acaagttctgctatctatgtt

SEQ ID NO: 228498 - DNA, 21 bp, Artificial sequence
  SiRNA target sequence
caagttctgctatctatgttt

SEQ ID NO: 228499 - DNA, 21 bp, Artificial sequence
  SiRNA target sequence
aagttctgctatctatgtttt

SEQ ID NO: 228500 - DNA, 21 bp, Artificial sequence
  SiRNA target sequence
agttctgctatctatgtttta

SEQ ID NO: 228501 - DNA, 21 bp, Artificial sequence
  SiRNA target sequence
gttctgctatctatgttttat

SEQ ID NO: 228502 - DNA, 21 bp, Artificial sequence
  SiRNA target sequence
ttctgctatctatgttttatc

SEQ ID NO: 228503 - DNA, 21 bp, Artificial sequence
  SiRNA target sequence
tctgctatctatgttttatct

SEQ ID NO: 228504 - DNA, 21 bp, Artificial sequence
  SiRNA target sequence
ctgctatctatgttttatctg

SEQ ID NO: 228505 - DNA, 21 bp, Artificial sequence
  SiRNA target sequence
tgctatctatgttttatctga

SEQ ID NO: 228506 - DNA, 21 bp, Artificial sequence
  SiRNA target sequence
gctatctatgttttatctgaa

SEQ ID NO: 228507 - DNA, 21 bp, Artificial sequence
  SiRNA target sequence
ctatctatgttttatctgaaa

SEQ ID NO: 228508 - DNA, 21 bp, Artificial sequence
  SiRNA target sequence
tatctatgttttatctgaaat

SEQ ID NO: 228509 - DNA, 21 bp, Artificial sequence
  SiRNA target sequence
atctatgttttatctgaaatg

SEQ ID NO: 228510 - DNA, 21 bp, Artificial sequence
  SiRNA target sequence
tctatgttttatctgaaatgt

SEQ ID NO: 228511 - DNA, 21 bp, Artificial sequence
  SiRNA target sequence
ctatgttttatctgaaatgtt

SEQ ID NO: 228512 - DNA, 21 bp, Artificial sequence
  SiRNA target sequence
tatgttttatctgaaatgttt

SEQ ID NO: 228513 - DNA, 21 bp, Artificial sequence
  SiRNA target sequence
atgttttatctgaaatgtttg

SEQ ID NO: 228514 - DNA, 21 bp, Artificial sequence
  SiRNA target sequence
tgttttatctgaaatgtttgg

SEQ ID NO: 228515 - DNA, 21 bp, Artificial sequence
  SiRNA target sequence
gttttatctgaaatgtttggt

SEQ ID NO: 228516 - DNA, 21 bp, Artificial sequence
  SiRNA target sequence
ttttatctgaaatgtttggta

SEQ ID NO: 228517 - DNA, 21 bp, Artificial sequence
  SiRNA target sequence
tttatctgaaatgtttggtag

SEQ ID NO: 228518 - DNA, 21 bp, Artificial sequence
  SiRNA target sequence
ttatctgaaatgtttggtagt

SEQ ID NO: 228519 - DNA, 21 bp, Artificial sequence
  SiRNA target sequence
tatctgaaatgtttggtagtt

SEQ ID NO: 228520 - DNA, 21 bp, Artificial sequence
  SiRNA target sequence
atctgaaatgtttggtagttt

SEQ ID NO: 228521 - DNA, 21 bp, Artificial sequence
  SiRNA target sequence
tctgaaatgtttggtagtttg

SEQ ID NO: 228522 - DNA, 21 bp, Artificial sequence
  SiRNA target sequence
ctgaaatgtttggtagtttga

SEQ ID NO: 228523 - DNA, 21 bp, Artificial sequence
  SiRNA target sequence
tgaaatgtttggtagtttgat

SEQ ID NO: 228524 - DNA, 21 bp, Artificial sequence
  SiRNA target sequence
gaaatgtttggtagtttgatt

SEQ ID NO: 228525 - DNA, 21 bp, Artificial sequence
  SiRNA target sequence
aaatgtttggtagtttgattc

SEQ ID NO: 228526 - DNA, 21 bp, Artificial sequence
  SiRNA target sequence
aatgtttggtagtttgattct

SEQ ID NO: 228527 - DNA, 21 bp, Artificial sequence
  SiRNA target sequence
atgtttggtagtttgattctt

SEQ ID NO: 228528 - DNA, 21 bp, Artificial sequence
  SiRNA target sequence
tgtttggtagtttgattcttt

SEQ ID NO: 228529 - DNA, 21 bp, Artificial sequence
  SiRNA target sequence
gtttggtagtttgattctttc

SEQ ID NO: 228530 - DNA, 21 bp, Artificial sequence
  SiRNA target sequence
tttggtagtttgattctttca

SEQ ID NO: 228531 - DNA, 21 bp, Artificial sequence
  SiRNA target sequence
ttggtagtttgattctttcat

SEQ ID NO: 228532 - DNA, 21 bp, Artificial sequence
  SiRNA target sequence
tggtagtttgattctttcata

SEQ ID NO: 228533 - DNA, 21 bp, Artificial sequence
  SiRNA target sequence
ggtagtttgattctttcatat

SEQ ID NO: 228534 - DNA, 21 bp, Artificial sequence
  SiRNA target sequence
gtagtttgattctttcatatt

SEQ ID NO: 228535 - DNA, 21 bp, Artificial sequence
  SiRNA target sequence
tagtttgattctttcatattt

SEQ ID NO: 228536 - DNA, 21 bp, Artificial sequence
  SiRNA target sequence
agtttgattctttcatattta

SEQ ID NO: 228537 - DNA, 21 bp, Artificial sequence
  SiRNA target sequence
gtttgattctttcatatttat

SEQ ID NO: 228538 - DNA, 21 bp, Artificial sequence
  SiRNA target sequence
tttgattctttcatatttatt

SEQ ID NO: 228539 - DNA, 21 bp, Artificial sequence
  SiRNA target sequence
ttgattctttcatatttattt

SEQ ID NO: 228540 - DNA, 21 bp, Artificial sequence
  SiRNA target sequence
tgattctttcatatttattta

SEQ ID NO: 228541 - DNA, 21 bp, Artificial sequence
  SiRNA target sequence
gattctttcatatttatttat

SEQ ID NO: 228542 - DNA, 21 bp, Artificial sequence
  SiRNA target sequence
attctttcatatttatttatg

SEQ ID NO: 228543 - DNA, 21 bp, Artificial sequence
  SiRNA target sequence
ttctttcatatttatttatga

SEQ ID NO: 228544 - DNA, 21 bp, Artificial sequence
  SiRNA target sequence
tctttcatatttatttatgac

SEQ ID NO: 228545 - DNA, 21 bp, Artificial sequence
  SiRNA target sequence
ctttcatatttatttatgacg

SEQ ID NO: 228546 - DNA, 21 bp, Artificial sequence
  SiRNA target sequence
tttcatatttatttatgacgt

SEQ ID NO: 228547 - DNA, 21 bp, Artificial sequence
  SiRNA target sequence
ttcatatttatttatgacgtt

SEQ ID NO: 228548 - DNA, 21 bp, Artificial sequence
  SiRNA target sequence
tcatatttatttatgacgttt

SEQ ID NO: 228549 - DNA, 21 bp, Artificial sequence
  SiRNA target sequence
catatttatttatgacgtttg

SEQ ID NO: 228550 - DNA, 21 bp, Artificial sequence
  SiRNA target sequence
atatttatttatgacgtttgc

SEQ ID NO: 228551 - DNA, 21 bp, Artificial sequence
  SiRNA target sequence
tatttatttatgacgtttgct

SEQ ID NO: 228552 - DNA, 21 bp, Artificial sequence
  SiRNA target sequence
atttatttatgacgtttgcta

SEQ ID NO: 228553 - DNA, 21 bp, Artificial sequence
  SiRNA target sequence
tttatttatgacgtttgctaa

SEQ ID NO: 228554 - DNA, 21 bp, Artificial sequence
  SiRNA target sequence
ttatttatgacgtttgctaat

SEQ ID NO: 228555 - DNA, 21 bp, Artificial sequence
  SiRNA target sequence
tatttatgacgtttgctaatg

SEQ ID NO: 228556 - DNA, 21 bp, Artificial sequence
  SiRNA target sequence
atttatgacgtttgctaatgg

SEQ ID NO: 228557 - DNA, 21 bp, Artificial sequence
  SiRNA target sequence
tttatgacgtttgctaatggt

SEQ ID NO: 228558 - DNA, 21 bp, Artificial sequence
  SiRNA target sequence
ttatgacgtttgctaatggtc

SEQ ID NO: 228559 - DNA, 21 bp, Artificial sequence
  SiRNA target sequence
tatgacgtttgctaatggtct

SEQ ID NO: 228560 - DNA, 21 bp, Artificial sequence
  SiRNA target sequence
atgacgtttgctaatggtctt

SEQ ID NO: 228561 - DNA, 21 bp, Artificial sequence
  SiRNA target sequence
tgacgtttgctaatggtcttt

SEQ ID NO: 228562 - DNA, 21 bp, Artificial sequence
  SiRNA target sequence
gacgtttgctaatggtctttc

SEQ ID NO: 228563 - DNA, 21 bp, Artificial sequence
  SiRNA target sequence
acgtttgctaatggtctttcg

SEQ ID NO: 228564 - DNA, 21 bp, Artificial sequence
  SiRNA target sequence
cgtttgctaatggtctttcga

SEQ ID NO: 228565 - DNA, 21 bp, Artificial sequence
  SiRNA target sequence
gtttgctaatggtctttcgac

SEQ ID NO: 228566 - DNA, 21 bp, Artificial sequence
  SiRNA target sequence
tttgctaatggtctttcgact

SEQ ID NO: 228567 - DNA, 21 bp, Artificial sequence
  SiRNA target sequence
ttgctaatggtctttcgactc

SEQ ID NO: 228568 - DNA, 21 bp, Artificial sequence
  SiRNA target sequence
tgctaatggtctttcgactcc

SEQ ID NO: 228569 - DNA, 21 bp, Artificial sequence
  SiRNA target sequence
gctaatggtctttcgactcct

SEQ ID NO: 228570 - DNA, 21 bp, Artificial sequence
  SiRNA target sequence
ctaatggtctttcgactcctg

SEQ ID NO: 228571 - DNA, 21 bp, Artificial sequence
  SiRNA target sequence
taatggtctttcgactcctgg

SEQ ID NO: 228572 - DNA, 21 bp, Artificial sequence
  SiRNA target sequence
aatggtctttcgactcctgga

SEQ ID NO: 228573 - DNA, 21 bp, Artificial sequence
  SiRNA target sequence
atggtctttcgactcctggac

SEQ ID NO: 228574 - DNA, 21 bp, Artificial sequence
  SiRNA target sequence
tggtctttcgactcctggaca

SEQ ID NO: 228575 - DNA, 21 bp, Artificial sequence
  SiRNA target sequence
ggtctttcgactcctggacag

SEQ ID NO: 228576 - DNA, 21 bp, Artificial sequence
  SiRNA target sequence
gtctttcgactcctggacagt

SEQ ID NO: 228577 - DNA, 21 bp, Artificial sequence
  SiRNA target sequence
tctttcgactcctggacagtc

SEQ ID NO: 228578 - DNA, 21 bp, Artificial sequence
  SiRNA target sequence
ctttcgactcctggacagtcc

SEQ ID NO: 228579 - DNA, 21 bp, Artificial sequence
  SiRNA target sequence
tttcgactcctggacagtccg

SEQ ID NO: 228580 - DNA, 21 bp, Artificial sequence
  SiRNA target sequence
ttcgactcctggacagtccgc

SEQ ID NO: 228581 - DNA, 21 bp, Artificial sequence
  SiRNA target sequence
tcgactcctggacagtccgct

SEQ ID NO: 228582 - DNA, 21 bp, Artificial sequence
  SiRNA target sequence
cgactcctggacagtccgcta

SEQ ID NO: 228583 - DNA, 21 bp, Artificial sequence
  SiRNA target sequence
gactcctggacagtccgctag

SEQ ID NO: 228584 - DNA, 21 bp, Artificial sequence
  SiRNA target sequence
actcctggacagtccgctaga

SEQ ID NO: 228585 - DNA, 21 bp, Artificial sequence
  SiRNA target sequence
ctcctggacagtccgctagat

SEQ ID NO: 228586 - DNA, 21 bp, Artificial sequence
  SiRNA target sequence
tcctggacagtccgctagatt

SEQ ID NO: 228587 - DNA, 21 bp, Artificial sequence
  SiRNA target sequence
cctggacagtccgctagattt

SEQ ID NO: 228588 - DNA, 21 bp, Artificial sequence
  SiRNA target sequence
ctggacagtccgctagatttg

SEQ ID NO: 228589 - DNA, 21 bp, Artificial sequence
  SiRNA target sequence
tggacagtccgctagatttgt

SEQ ID NO: 228590 - DNA, 21 bp, Artificial sequence
  SiRNA target sequence
ggacagtccgctagatttgtc

SEQ ID NO: 228591 - DNA, 21 bp, Artificial sequence
  SiRNA target sequence
gacagtccgctagatttgtcc

SEQ ID NO: 228592 - DNA, 21 bp, Artificial sequence
  SiRNA target sequence
acagtccgctagatttgtccc

SEQ ID NO: 228593 - DNA, 21 bp, Artificial sequence
  SiRNA target sequence
cagtccgctagatttgtccct

SEQ ID NO: 228594 - DNA, 21 bp, Artificial sequence
  SiRNA target sequence
agtccgctagatttgtccctt

SEQ ID NO: 228595 - DNA, 21 bp, Artificial sequence
  SiRNA target sequence
gtccgctagatttgtcccttt

SEQ ID NO: 228596 - DNA, 21 bp, Artificial sequence
  SiRNA target sequence
tccgctagatttgtcccttta

SEQ ID NO: 228597 - DNA, 21 bp, Artificial sequence
  SiRNA target sequence
ccgctagatttgtccctttat

SEQ ID NO: 228598 - DNA, 21 bp, Artificial sequence
  SiRNA target sequence
cgctagatttgtccctttatt

SEQ ID NO: 228599 - DNA, 21 bp, Artificial sequence
  SiRNA target sequence
gctagatttgtccctttattt

SEQ ID NO: 228600 - DNA, 21 bp, Artificial sequence
  SiRNA target sequence
ctagatttgtccctttatttt

SEQ ID NO: 228601 - DNA, 21 bp, Artificial sequence
  SiRNA target sequence
tagatttgtccctttatttta

SEQ ID NO: 228602 - DNA, 21 bp, Artificial sequence
  SiRNA target sequence
agatttgtccctttattttat

SEQ ID NO: 228603 - DNA, 21 bp, Artificial sequence
  SiRNA target sequence
gatttgtccctttattttatg

SEQ ID NO: 228604 - DNA, 21 bp, Artificial sequence
  SiRNA target sequence
atttgtccctttattttatgt

SEQ ID NO: 228605 - DNA, 21 bp, Artificial sequence
  SiRNA target sequence
tttgtccctttattttatgtt

SEQ ID NO: 228606 - DNA, 21 bp, Artificial sequence
  SiRNA target sequence
ttgtccctttattttatgttg

SEQ ID NO: 228607 - DNA, 21 bp, Artificial sequence
  SiRNA target sequence
tgtccctttattttatgttgg

SEQ ID NO: 228608 - DNA, 21 bp, Artificial sequence
  SiRNA target sequence
gtccctttattttatgttgga

SEQ ID NO: 228609 - DNA, 21 bp, Artificial sequence
  SiRNA target sequence
tccctttattttatgttggat

SEQ ID NO: 228610 - DNA, 21 bp, Artificial sequence
  SiRNA target sequence
ccctttattttatgttggatc

SEQ ID NO: 228611 - DNA, 21 bp, Artificial sequence
  SiRNA target sequence
cctttattttatgttggatct

SEQ ID NO: 228612 - DNA, 21 bp, Artificial sequence
  SiRNA target sequence
ctttattttatgttggatcta

SEQ ID NO: 228613 - DNA, 21 bp, Artificial sequence
  SiRNA target sequence
tttattttatgttggatctaa

SEQ ID NO: 228614 - DNA, 21 bp, Artificial sequence
  SiRNA target sequence
ttattttatgttggatctaat

SEQ ID NO: 228615 - DNA, 21 bp, Artificial sequence
  SiRNA target sequence
tattttatgttggatctaatt

SEQ ID NO: 228616 - DNA, 21 bp, Artificial sequence
  SiRNA target sequence
attttatgttggatctaattt

SEQ ID NO: 228617 - DNA, 21 bp, Artificial sequence
  SiRNA target sequence
ttttatgttggatctaatttg

SEQ ID NO: 228618 - DNA, 21 bp, Artificial sequence
  SiRNA target sequence
tttatgttggatctaatttgg

SEQ ID NO: 228619 - DNA, 21 bp, Artificial sequence
  SiRNA target sequence
ttatgttggatctaatttggc

SEQ ID NO: 228620 - DNA, 21 bp, Artificial sequence
  SiRNA target sequence
tatgttggatctaatttggct

SEQ ID NO: 228621 - DNA, 21 bp, Artificial sequence
  SiRNA target sequence
atgttggatctaatttggctt

SEQ ID NO: 228622 - DNA, 21 bp, Artificial sequence
  SiRNA target sequence
tgttggatctaatttggcttt

SEQ ID NO: 228623 - DNA, 21 bp, Artificial sequence
  SiRNA target sequence
gttggatctaatttggcttta

SEQ ID NO: 228624 - DNA, 21 bp, Artificial sequence
  SiRNA target sequence
ttggatctaatttggctttac

SEQ ID NO: 228625 - DNA, 21 bp, Artificial sequence
  SiRNA target sequence
tggatctaatttggctttact

SEQ ID NO: 228626 - DNA, 21 bp, Artificial sequence
  SiRNA target sequence
ggatctaatttggctttactt

SEQ ID NO: 228627 - DNA, 21 bp, Artificial sequence
  SiRNA target sequence
gatctaatttggctttacttc

SEQ ID NO: 228628 - DNA, 21 bp, Artificial sequence
  SiRNA target sequence
atctaatttggctttacttct

SEQ ID NO: 228629 - DNA, 21 bp, Artificial sequence
  SiRNA target sequence
tctaatttggctttacttctt

SEQ ID NO: 228630 - DNA, 21 bp, Artificial sequence
  SiRNA target sequence
ctaatttggctttacttcttt

SEQ ID NO: 228631 - DNA, 21 bp, Artificial sequence
  SiRNA target sequence
taatttggctttacttctttc

SEQ ID NO: 228632 - DNA, 21 bp, Artificial sequence
  SiRNA target sequence
aatttggctttacttctttca

SEQ ID NO: 228633 - DNA, 21 bp, Artificial sequence
  SiRNA target sequence
atttggctttacttctttcag

SEQ ID NO: 228634 - DNA, 21 bp, Artificial sequence
  SiRNA target sequence
tttggctttacttctttcagg

SEQ ID NO: 228635 - DNA, 21 bp, Artificial sequence
  SiRNA target sequence
ttggctttacttctttcagga

SEQ ID NO: 228636 - DNA, 21 bp, Artificial sequence
  SiRNA target sequence
tggctttacttctttcaggaa

SEQ ID NO: 228637 - DNA, 21 bp, Artificial sequence
  SiRNA target sequence
ggctttacttctttcaggaat

SEQ ID NO: 228638 - DNA, 21 bp, Artificial sequence
  SiRNA target sequence
gctttacttctttcaggaatg

SEQ ID NO: 228639 - DNA, 21 bp, Artificial sequence
  SiRNA target sequence
ctttacttctttcaggaatga

SEQ ID NO: 228640 - DNA, 21 bp, Artificial sequence
  SiRNA target sequence
tttacttctttcaggaatgat

SEQ ID NO: 228641 - DNA, 21 bp, Artificial sequence
  SiRNA target sequence
ttacttctttcaggaatgata

SEQ ID NO: 228642 - DNA, 21 bp, Artificial sequence
  SiRNA target sequence
tacttctttcaggaatgataa

SEQ ID NO: 228643 - DNA, 21 bp, Artificial sequence
  SiRNA target sequence
acttctttcaggaatgataaa

SEQ ID NO: 228644 - DNA, 21 bp, Artificial sequence
  SiRNA target sequence
cttctttcaggaatgataaat

SEQ ID NO: 228645 - DNA, 21 bp, Artificial sequence
  SiRNA target sequence
ttctttcaggaatgataaatt

SEQ ID NO: 228646 - DNA, 21 bp, Artificial sequence
  SiRNA target sequence
tctttcaggaatgataaatta

SEQ ID NO: 228647 - DNA, 21 bp, Artificial sequence
  SiRNA target sequence
ctttcaggaatgataaattac

SEQ ID NO: 228648 - DNA, 21 bp, Artificial sequence
  SiRNA target sequence
tttcaggaatgataaattact

SEQ ID NO: 228649 - DNA, 21 bp, Artificial sequence
  SiRNA target sequence
ttcaggaatgataaattactt

SEQ ID NO: 228650 - DNA, 21 bp, Artificial sequence
  SiRNA target sequence
tcaggaatgataaattacttt

SEQ ID NO: 228651 - DNA, 21 bp, Artificial sequence
  SiRNA target sequence
caggaatgataaattactttt

SEQ ID NO: 228652 - DNA, 21 bp, Artificial sequence
  SiRNA target sequence
aggaatgataaattactttta

SEQ ID NO: 228653 - DNA, 21 bp, Artificial sequence
  SiRNA target sequence
ggaatgataaattacttttat

SEQ ID NO: 228654 - DNA, 21 bp, Artificial sequence
  SiRNA target sequence
gaatgataaattacttttata

SEQ ID NO: 228655 - DNA, 21 bp, Artificial sequence
  SiRNA target sequence
aatgataaattacttttatag

SEQ ID NO: 228656 - DNA, 21 bp, Artificial sequence
  SiRNA target sequence
atgataaattacttttatagt

SEQ ID NO: 228657 - DNA, 21 bp, Artificial sequence
  SiRNA target sequence
tgataaattacttttatagtg

SEQ ID NO: 228658 - DNA, 21 bp, Artificial sequence
  SiRNA target sequence
gataaattacttttatagtgt

SEQ ID NO: 228659 - DNA, 21 bp, Artificial sequence
  SiRNA target sequence
ataaattacttttatagtgta

SEQ ID NO: 228660 - DNA, 21 bp, Artificial sequence
  SiRNA target sequence
taaattacttttatagtgtaa

SEQ ID NO: 228661 - DNA, 21 bp, Artificial sequence
  SiRNA target sequence
aaattacttttatagtgtaag

SEQ ID NO: 228662 - DNA, 21 bp, Artificial sequence
  SiRNA target sequence
aattacttttatagtgtaagt

SEQ ID NO: 228663 - DNA, 21 bp, Artificial sequence
  SiRNA target sequence
attacttttatagtgtaagta

SEQ ID NO: 228664 - DNA, 21 bp, Artificial sequence
  SiRNA target sequence
ttacttttatagtgtaagtaa

SEQ ID NO: 228665 - DNA, 21 bp, Artificial sequence
  SiRNA target sequence
tacttttatagtgtaagtaaa

SEQ ID NO: 228666 - DNA, 21 bp, Artificial sequence
  SiRNA target sequence
acttttatagtgtaagtaaat

SEQ ID NO: 228667 - DNA, 21 bp, Artificial sequence
  SiRNA target sequence
cttttatagtgtaagtaaatc

SEQ ID NO: 228668 - DNA, 21 bp, Artificial sequence
  SiRNA target sequence
ttttatagtgtaagtaaatct

SEQ ID NO: 228669 - DNA, 21 bp, Artificial sequence
  SiRNA target sequence
tttatagtgtaagtaaatcta

SEQ ID NO: 228670 - DNA, 21 bp, Artificial sequence
  SiRNA target sequence
ttatagtgtaagtaaatctaa

SEQ ID NO: 228671 - DNA, 21 bp, Artificial sequence
  SiRNA target sequence
tatagtgtaagtaaatctaaa

SEQ ID NO: 228672 - DNA, 21 bp, Artificial sequence
  SiRNA target sequence
atagtgtaagtaaatctaaaa

SEQ ID NO: 228673 - DNA, 21 bp, Artificial sequence
  SiRNA target sequence
tagtgtaagtaaatctaaaat

SEQ ID NO: 228674 - DNA, 21 bp, Artificial sequence
  SiRNA target sequence
agtgtaagtaaatctaaaatg

SEQ ID NO: 228675 - DNA, 21 bp, Artificial sequence
  SiRNA target sequence
gtgtaagtaaatctaaaatgt

SEQ ID NO: 228676 - DNA, 21 bp, Artificial sequence
  SiRNA target sequence
tgtaagtaaatctaaaatgtc

SEQ ID NO: 228677 - DNA, 21 bp, Artificial sequence
  SiRNA target sequence
gtaagtaaatctaaaatgtcg

SEQ ID NO: 228678 - DNA, 21 bp, Artificial sequence
  SiRNA target sequence
taagtaaatctaaaatgtcgt

SEQ ID NO: 228679 - DNA, 21 bp, Artificial sequence
  SiRNA target sequence
aagtaaatctaaaatgtcgta

SEQ ID NO: 228680 - DNA, 21 bp, Artificial sequence
  SiRNA target sequence
agtaaatctaaaatgtcgtat

SEQ ID NO: 228681 - DNA, 21 bp, Artificial sequence
  SiRNA target sequence
gtaaatctaaaatgtcgtatg

SEQ ID NO: 228682 - DNA, 21 bp, Artificial sequence
  SiRNA target sequence
taaatctaaaatgtcgtatgt

SEQ ID NO: 228683 - DNA, 21 bp, Artificial sequence
  SiRNA target sequence
aaatctaaaatgtcgtatgtt

SEQ ID NO: 228684 - DNA, 21 bp, Artificial sequence
  SiRNA target sequence
aatctaaaatgtcgtatgttg

SEQ ID NO: 228685 - DNA, 21 bp, Artificial sequence
  SiRNA target sequence
atctaaaatgtcgtatgttgc

SEQ ID NO: 228686 - DNA, 21 bp, Artificial sequence
  SiRNA target sequence
tctaaaatgtcgtatgttgcg

SEQ ID NO: 228687 - DNA, 21 bp, Artificial sequence
  SiRNA target sequence
ctaaaatgtcgtatgttgcgg

SEQ ID NO: 228688 - DNA, 21 bp, Artificial sequence
  SiRNA target sequence
taaaatgtcgtatgttgcggc

SEQ ID NO: 228689 - DNA, 21 bp, Artificial sequence
  SiRNA target sequence
aaaatgtcgtatgttgcggcc

SEQ ID NO: 228690 - DNA, 21 bp, Artificial sequence
  SiRNA target sequence
aaatgtcgtatgttgcggccg

SEQ ID NO: 228691 - DNA, 21 bp, Artificial sequence
  SiRNA target sequence
aatgtcgtatgttgcggccga

SEQ ID NO: 228692 - DNA, 21 bp, Artificial sequence
  SiRNA target sequence
atgtcgtatgttgcggccgaa

SEQ ID NO: 228693 - DNA, 21 bp, Artificial sequence
  SiRNA target sequence
tgtcgtatgttgcggccgaaa

SEQ ID NO: 228694 - DNA, 21 bp, Artificial sequence
  SiRNA target sequence
gtcgtatgttgcggccgaaag

SEQ ID NO: 228695 - DNA, 21 bp, Artificial sequence
  SiRNA target sequence
tcgtatgttgcggccgaaaga

SEQ ID NO: 228696 - DNA, 21 bp, Artificial sequence
  SiRNA target sequence
cgtatgttgcggccgaaagat

SEQ ID NO: 228697 - DNA, 21 bp, Artificial sequence
  SiRNA target sequence
gtatgttgcggccgaaagatt

SEQ ID NO: 228698 - DNA, 21 bp, Artificial sequence
  SiRNA target sequence
tatgttgcggccgaaagattt

SEQ ID NO: 228699 - DNA, 21 bp, Artificial sequence
  SiRNA target sequence
atgttgcggccgaaagatttt

SEQ ID NO: 228700 - DNA, 21 bp, Artificial sequence
  SiRNA target sequence
tgttgcggccgaaagattttt

SEQ ID NO: 228701 - DNA, 21 bp, Artificial sequence
  SiRNA target sequence
gttgcggccgaaagatttttt

SEQ ID NO: 228702 - DNA, 21 bp, Artificial sequence
  SiRNA target sequence
ttgcggccgaaagatttttta

SEQ ID NO: 228703 - DNA, 21 bp, Artificial sequence
  SiRNA target sequence
tgcggccgaaagattttttaa

SEQ ID NO: 228704 - DNA, 21 bp, Artificial sequence
  SiRNA target sequence
gcggccgaaagattttttaat

SEQ ID NO: 228705 - DNA, 21 bp, Artificial sequence
  SiRNA target sequence
cggccgaaagattttttaatg

SEQ ID NO: 228706 - DNA, 21 bp, Artificial sequence
  SiRNA target sequence
ggccgaaagattttttaatgg

SEQ ID NO: 228707 - DNA, 21 bp, Artificial sequence
  SiRNA target sequence
gccgaaagattttttaatgga

SEQ ID NO: 228708 - DNA, 21 bp, Artificial sequence
  SiRNA target sequence
ccgaaagattttttaatggat

SEQ ID NO: 228709 - DNA, 21 bp, Artificial sequence
  SiRNA target sequence
cgaaagattttttaatggatt

SEQ ID NO: 228710 - DNA, 21 bp, Artificial sequence
  SiRNA target sequence
gaaagattttttaatggattt

SEQ ID NO: 228711 - DNA, 21 bp, Artificial sequence
  SiRNA target sequence
aaagattttttaatggatttt

SEQ ID NO: 228712 - DNA, 21 bp, Artificial sequence
  SiRNA target sequence
aagattttttaatggattttt

SEQ ID NO: 228713 - DNA, 21 bp, Artificial sequence
  SiRNA target sequence
agattttttaatggatttttt

SEQ ID NO: 228714 - DNA, 21 bp, Artificial sequence
  SiRNA target sequence
gattttttaatggattttttt

SEQ ID NO: 228715 - DNA, 21 bp, Artificial sequence
  SiRNA target sequence
attttttaatggatttttttg

SEQ ID NO: 228716 - DNA, 21 bp, Artificial sequence
  SiRNA target sequence
ttttttaatggatttttttgt

SEQ ID NO: 228717 - DNA, 21 bp, Artificial sequence
  SiRNA target sequence
tttttaatggatttttttgtc

SEQ ID NO: 228718 - DNA, 21 bp, Artificial sequence
  SiRNA target sequence
ttttaatggatttttttgtct

SEQ ID NO: 228719 - DNA, 21 bp, Artificial sequence
  SiRNA target sequence
tttaatggatttttttgtctg

SEQ ID NO: 228720 - DNA, 21 bp, Artificial sequence
  SiRNA target sequence
ttaatggatttttttgtctga

SEQ ID NO: 228721 - DNA, 21 bp, Artificial sequence
  SiRNA target sequence
taatggatttttttgtctgag

SEQ ID NO: 228722 - DNA, 21 bp, Artificial sequence
  SiRNA target sequence
aatggatttttttgtctgagt

SEQ ID NO: 228723 - DNA, 21 bp, Artificial sequence
  SiRNA target sequence
atggatttttttgtctgagtg

SEQ ID NO: 228724 - DNA, 21 bp, Artificial sequence
  SiRNA target sequence
tggatttttttgtctgagtgg

SEQ ID NO: 228725 - DNA, 21 bp, Artificial sequence
  SiRNA target sequence
ggatttttttgtctgagtgga

SEQ ID NO: 228726 - DNA, 21 bp, Artificial sequence
  SiRNA target sequence
gatttttttgtctgagtggaa

SEQ ID NO: 228727 - DNA, 21 bp, Artificial sequence
  SiRNA target sequence
atttttttgtctgagtggaat

SEQ ID NO: 228728 - DNA, 21 bp, Artificial sequence
  SiRNA target sequence
tttttttgtctgagtggaatt

SEQ ID NO: 228729 - DNA, 21 bp, Artificial sequence
  SiRNA target sequence
ttttttgtctgagtggaattc

SEQ ID NO: 228730 - DNA, 21 bp, Artificial sequence
  SiRNA target sequence
tttttgtctgagtggaattct

SEQ ID NO: 228731 - DNA, 21 bp, Artificial sequence
  SiRNA target sequence
ttttgtctgagtggaattctc

SEQ ID NO: 228732 - DNA, 21 bp, Artificial sequence
  SiRNA target sequence
tttgtctgagtggaattctct

SEQ ID NO: 228733 - DNA, 21 bp, Artificial sequence
  SiRNA target sequence
ttgtctgagtggaattctctg

SEQ ID NO: 228734 - DNA, 21 bp, Artificial sequence
  SiRNA target sequence
tgtctgagtggaattctctgt

SEQ ID NO: 228735 - DNA, 21 bp, Artificial sequence
  SiRNA target sequence
gtctgagtggaattctctgtg

SEQ ID NO: 228736 - DNA, 21 bp, Artificial sequence
  SiRNA target sequence
tctgagtggaattctctgtgc

SEQ ID NO: 228737 - DNA, 21 bp, Artificial sequence
  SiRNA target sequence
ctgagtggaattctctgtgct

SEQ ID NO: 228738 - DNA, 21 bp, Artificial sequence
  SiRNA target sequence
tgagtggaattctctgtgctg

SEQ ID NO: 228739 - DNA, 21 bp, Artificial sequence
  SiRNA target sequence
gagtggaattctctgtgctgt

SEQ ID NO: 228740 - DNA, 21 bp, Artificial sequence
  SiRNA target sequence
agtggaattctctgtgctgta

SEQ ID NO: 228741 - DNA, 21 bp, Artificial sequence
  SiRNA target sequence
gtggaattctctgtgctgtaa

SEQ ID NO: 228742 - DNA, 21 bp, Artificial sequence
  SiRNA target sequence
tggaattctctgtgctgtaat

SEQ ID NO: 228743 - DNA, 21 bp, Artificial sequence
  SiRNA target sequence
ggaattctctgtgctgtaatt

SEQ ID NO: 228744 - DNA, 21 bp, Artificial sequence
  SiRNA target sequence
gaattctctgtgctgtaattt

SEQ ID NO: 228745 - DNA, 21 bp, Artificial sequence
  SiRNA target sequence
aattctctgtgctgtaattta

SEQ ID NO: 228746 - DNA, 21 bp, Artificial sequence
  SiRNA target sequence
attctctgtgctgtaatttat

SEQ ID NO: 228747 - DNA, 21 bp, Artificial sequence
  SiRNA target sequence
ttctctgtgctgtaatttatc

SEQ ID NO: 228748 - DNA, 21 bp, Artificial sequence
  SiRNA target sequence
tctctgtgctgtaatttatct

SEQ ID NO: 228749 - DNA, 21 bp, Artificial sequence
  SiRNA target sequence
ctctgtgctgtaatttatctt

SEQ ID NO: 228750 - DNA, 21 bp, Artificial sequence
  SiRNA target sequence
tctgtgctgtaatttatcttc

SEQ ID NO: 228751 - DNA, 21 bp, Artificial sequence
  SiRNA target sequence
ctgtgctgtaatttatcttct

SEQ ID NO: 228752 - DNA, 21 bp, Artificial sequence
  SiRNA target sequence
tgtgctgtaatttatcttcta

SEQ ID NO: 228753 - DNA, 21 bp, Artificial sequence
  SiRNA target sequence
gtgctgtaatttatcttctaa

SEQ ID NO: 228754 - DNA, 21 bp, Artificial sequence
  SiRNA target sequence
tgctgtaatttatcttctaaa

SEQ ID NO: 228755 - DNA, 21 bp, Artificial sequence
  SiRNA target sequence
gctgtaatttatcttctaaaa

SEQ ID NO: 228756 - DNA, 21 bp, Artificial sequence
  SiRNA target sequence
ctgtaatttatcttctaaaaa

SEQ ID NO: 228757 - DNA, 21 bp, Artificial sequence
  SiRNA target sequence
tgtaatttatcttctaaaaaa

SEQ ID NO: 228758 - DNA, 21 bp, Artificial sequence
  SiRNA target sequence
gtaatttatcttctaaaaaaa

SEQ ID NO: 228759 - DNA, 21 bp, Artificial sequence
  SiRNA target sequence
taatttatcttctaaaaaaat

SEQ ID NO: 228760 - DNA, 21 bp, Artificial sequence
  SiRNA target sequence
aatttatcttctaaaaaaata

SEQ ID NO: 228761 - DNA, 21 bp, Artificial sequence
  SiRNA target sequence
atttatcttctaaaaaaatat

SEQ ID NO: 228762 - DNA, 21 bp, Artificial sequence
  SiRNA target sequence
tttatcttctaaaaaaatatt

SEQ ID NO: 228763 - DNA, 21 bp, Artificial sequence
  SiRNA target sequence
ttatcttctaaaaaaatattt

SEQ ID NO: 228764 - DNA, 21 bp, Artificial sequence
  SiRNA target sequence
tatcttctaaaaaaatattta

SEQ ID NO: 228765 - DNA, 21 bp, Artificial sequence
  SiRNA target sequence
atcttctaaaaaaatatttag

SEQ ID NO: 228766 - DNA, 21 bp, Artificial sequence
  SiRNA target sequence
tcttctaaaaaaatatttaga

SEQ ID NO: 228767 - DNA, 21 bp, Artificial sequence
  SiRNA target sequence
cttctaaaaaaatatttagaa

SEQ ID NO: 228768 - DNA, 21 bp, Artificial sequence
  SiRNA target sequence
ttctaaaaaaatatttagaaa

SEQ ID NO: 228769 - DNA, 21 bp, Artificial sequence
  SiRNA target sequence
tctaaaaaaatatttagaaaa

SEQ ID NO: 228770 - DNA, 21 bp, Artificial sequence
  SiRNA target sequence
ctaaaaaaatatttagaaaat

SEQ ID NO: 228771 - DNA, 21 bp, Artificial sequence
  SiRNA target sequence
taaaaaaatatttagaaaata

SEQ ID NO: 228772 - DNA, 21 bp, Artificial sequence
  SiRNA target sequence
aaaaaaatatttagaaaataa

SEQ ID NO: 228773 - DNA, 21 bp, Artificial sequence
  SiRNA target sequence
aaaaaatatttagaaaataat

SEQ ID NO: 228774 - DNA, 21 bp, Artificial sequence
  SiRNA target sequence
aaaaatatttagaaaataatg

SEQ ID NO: 228775 - DNA, 21 bp, Artificial sequence
  SiRNA target sequence
aaaatatttagaaaataatgt

SEQ ID NO: 228776 - DNA, 21 bp, Artificial sequence
  SiRNA target sequence
aaatatttagaaaataatgtt

SEQ ID NO: 228777 - DNA, 21 bp, Artificial sequence
  SiRNA target sequence
aatatttagaaaataatgtta

SEQ ID NO: 228778 - DNA, 21 bp, Artificial sequence
  SiRNA target sequence
atatttagaaaataatgttac

SEQ ID NO: 228779 - DNA, 21 bp, Artificial sequence
  SiRNA target sequence
tatttagaaaataatgttact

SEQ ID NO: 228780 - DNA, 21 bp, Artificial sequence
  SiRNA target sequence
atttagaaaataatgttacta

SEQ ID NO: 228781 - DNA, 21 bp, Artificial sequence
  SiRNA target sequence
tttagaaaataatgttactag

SEQ ID NO: 228782 - DNA, 21 bp, Artificial sequence
  SiRNA target sequence
ttagaaaataatgttactagc

SEQ ID NO: 228783 - DNA, 21 bp, Artificial sequence
  SiRNA target sequence
tagaaaataatgttactagca

SEQ ID NO: 228784 - DNA, 21 bp, Artificial sequence
  SiRNA target sequence
agaaaataatgttactagcaa

SEQ ID NO: 228785 - DNA, 21 bp, Artificial sequence
  SiRNA target sequence
gaaaataatgttactagcaaa

SEQ ID NO: 228786 - DNA, 21 bp, Artificial sequence
  SiRNA target sequence
aaaataatgttactagcaaac

SEQ ID NO: 228787 - DNA, 21 bp, Artificial sequence
  SiRNA target sequence
aaataatgttactagcaaacc

SEQ ID NO: 228788 - DNA, 21 bp, Artificial sequence
  SiRNA target sequence
aataatgttactagcaaacca

SEQ ID NO: 228789 - DNA, 21 bp, Artificial sequence
  SiRNA target sequence
ataatgttactagcaaaccaa

SEQ ID NO: 228790 - DNA, 21 bp, Artificial sequence
  SiRNA target sequence
taatgttactagcaaaccaat

SEQ ID NO: 228791 - DNA, 21 bp, Artificial sequence
  SiRNA target sequence
aatgttactagcaaaccaatg

SEQ ID NO: 228792 - DNA, 21 bp, Artificial sequence
  SiRNA target sequence
atgttactagcaaaccaatgt

SEQ ID NO: 228793 - DNA, 21 bp, Artificial sequence
  SiRNA target sequence
tgttactagcaaaccaatgtt

SEQ ID NO: 228794 - DNA, 21 bp, Artificial sequence
  SiRNA target sequence
gttactagcaaaccaatgttt

SEQ ID NO: 228795 - DNA, 21 bp, Artificial sequence
  SiRNA target sequence
ttactagcaaaccaatgtttg

SEQ ID NO: 228796 - DNA, 21 bp, Artificial sequence
  SiRNA target sequence
tactagcaaaccaatgtttgt

SEQ ID NO: 228797 - DNA, 21 bp, Artificial sequence
  SiRNA target sequence
actagcaaaccaatgtttgtt

SEQ ID NO: 228798 - DNA, 21 bp, Artificial sequence
  SiRNA target sequence
ctagcaaaccaatgtttgtta

SEQ ID NO: 228799 - DNA, 21 bp, Artificial sequence
  SiRNA target sequence
tagcaaaccaatgtttgttag

SEQ ID NO: 228800 - DNA, 21 bp, Artificial sequence
  SiRNA target sequence
agcaaaccaatgtttgttaga

SEQ ID NO: 228801 - DNA, 21 bp, Artificial sequence
  SiRNA target sequence
gcaaaccaatgtttgttagaa

SEQ ID NO: 228802 - DNA, 21 bp, Artificial sequence
  SiRNA target sequence
caaaccaatgtttgttagaaa

SEQ ID NO: 228803 - DNA, 21 bp, Artificial sequence
  SiRNA target sequence
aaaccaatgtttgttagaaag

SEQ ID NO: 228804 - DNA, 21 bp, Artificial sequence
  SiRNA target sequence
aaccaatgtttgttagaaaga

SEQ ID NO: 228805 - DNA, 21 bp, Artificial sequence
  SiRNA target sequence
accaatgtttgttagaaagac

SEQ ID NO: 228806 - DNA, 21 bp, Artificial sequence
  SiRNA target sequence
ccaatgtttgttagaaagact

SEQ ID NO: 228807 - DNA, 21 bp, Artificial sequence
  SiRNA target sequence
caatgtttgttagaaagactt

SEQ ID NO: 228808 - DNA, 21 bp, Artificial sequence
  SiRNA target sequence
aatgtttgttagaaagacttt

SEQ ID NO: 228809 - DNA, 21 bp, Artificial sequence
  SiRNA target sequence
atgtttgttagaaagactttt

SEQ ID NO: 228810 - DNA, 21 bp, Artificial sequence
  SiRNA target sequence
tgtttgttagaaagactttta

SEQ ID NO: 228811 - DNA, 21 bp, Artificial sequence
  SiRNA target sequence
gtttgttagaaagacttttac

SEQ ID NO: 228812 - DNA, 21 bp, Artificial sequence
  SiRNA target sequence
tttgttagaaagacttttact

SEQ ID NO: 228813 - DNA, 21 bp, Artificial sequence
  SiRNA target sequence
ttgttagaaagacttttacta

SEQ ID NO: 228814 - DNA, 21 bp, Artificial sequence
  SiRNA target sequence
tgttagaaagacttttactaa

SEQ ID NO: 228815 - DNA, 21 bp, Artificial sequence
  SiRNA target sequence
gttagaaagacttttactaaa

SEQ ID NO: 228816 - DNA, 21 bp, Artificial sequence
  SiRNA target sequence
ttagaaagacttttactaaaa

SEQ ID NO: 228817 - DNA, 21 bp, Artificial sequence
  SiRNA target sequence
tagaaagacttttactaaaaa

SEQ ID NO: 228818 - DNA, 21 bp, Artificial sequence
  SiRNA target sequence
agaaagacttttactaaaaag

SEQ ID NO: 228819 - DNA, 21 bp, Artificial sequence
  SiRNA target sequence
gaaagacttttactaaaaaga

SEQ ID NO: 228820 - DNA, 21 bp, Artificial sequence
  SiRNA target sequence
aaagacttttactaaaaagaa

SEQ ID NO: 228821 - DNA, 21 bp, Artificial sequence
  SiRNA target sequence
aagacttttactaaaaagaag

SEQ ID NO: 228822 - DNA, 21 bp, Artificial sequence
  SiRNA target sequence
agacttttactaaaaagaaga

SEQ ID NO: 228823 - DNA, 21 bp, Artificial sequence
  SiRNA target sequence
gacttttactaaaaagaagag

SEQ ID NO: 228824 - DNA, 21 bp, Artificial sequence
  SiRNA target sequence
acttttactaaaaagaagagt

SEQ ID NO: 228825 - DNA, 21 bp, Artificial sequence
  SiRNA target sequence
cttttactaaaaagaagagta

SEQ ID NO: 228826 - DNA, 21 bp, Artificial sequence
  SiRNA target sequence
ttttactaaaaagaagagtaa

SEQ ID NO: 228827 - DNA, 21 bp, Artificial sequence
  SiRNA target sequence
tttactaaaaagaagagtaaa

SEQ ID NO: 228828 - DNA, 21 bp, Artificial sequence
  SiRNA target sequence
ttactaaaaagaagagtaaag

SEQ ID NO: 228829 - DNA, 21 bp, Artificial sequence
  SiRNA target sequence
tactaaaaagaagagtaaagt

SEQ ID NO: 228830 - DNA, 21 bp, Artificial sequence
  SiRNA target sequence
actaaaaagaagagtaaagtg

SEQ ID NO: 228831 - DNA, 21 bp, Artificial sequence
  SiRNA target sequence
ctaaaaagaagagtaaagtga

SEQ ID NO: 228832 - DNA, 21 bp, Artificial sequence
  SiRNA target sequence
taaaaagaagagtaaagtgaa

SEQ ID NO: 228833 - DNA, 21 bp, Artificial sequence
  SiRNA target sequence
aaaaagaagagtaaagtgaag

SEQ ID NO: 228834 - DNA, 21 bp, Artificial sequence
  SiRNA target sequence
aaaagaagagtaaagtgaagg

SEQ ID NO: 228835 - DNA, 21 bp, Artificial sequence
  SiRNA target sequence
aaagaagagtaaagtgaaggt

SEQ ID NO: 228836 - DNA, 21 bp, Artificial sequence
  SiRNA target sequence
aagaagagtaaagtgaaggtt

SEQ ID NO: 228837 - DNA, 21 bp, Artificial sequence
  SiRNA target sequence
agaagagtaaagtgaaggttg

SEQ ID NO: 228838 - DNA, 21 bp, Artificial sequence
  SiRNA target sequence
gaagagtaaagtgaaggttgg

SEQ ID NO: 228839 - DNA, 21 bp, Artificial sequence
  SiRNA target sequence
aagagtaaagtgaaggttgga

SEQ ID NO: 228840 - DNA, 21 bp, Artificial sequence
  SiRNA target sequence
agagtaaagtgaaggttggat

SEQ ID NO: 228841 - DNA, 21 bp, Artificial sequence
  SiRNA target sequence
gagtaaagtgaaggttggatt

SEQ ID NO: 228842 - DNA, 21 bp, Artificial sequence
  SiRNA target sequence
agtaaagtgaaggttggattt

SEQ ID NO: 228843 - DNA, 21 bp, Artificial sequence
  SiRNA target sequence
gtaaagtgaaggttggatttg

SEQ ID NO: 228844 - DNA, 21 bp, Artificial sequence
  SiRNA target sequence
taaagtgaaggttggatttgt

SEQ ID NO: 228845 - DNA, 21 bp, Artificial sequence
  SiRNA target sequence
aaagtgaaggttggatttgtt

SEQ ID NO: 228846 - DNA, 21 bp, Artificial sequence
  SiRNA target sequence
aagtgaaggttggatttgttg

SEQ ID NO: 228847 - DNA, 21 bp, Artificial sequence
  SiRNA target sequence
agtgaaggttggatttgttga

SEQ ID NO: 228848 - DNA, 21 bp, Artificial sequence
  SiRNA target sequence
gtgaaggttggatttgttgat

SEQ ID NO: 228849 - DNA, 21 bp, Artificial sequence
  SiRNA target sequence
tgaaggttggatttgttgatg

SEQ ID NO: 228850 - DNA, 21 bp, Artificial sequence
  SiRNA target sequence
gaaggttggatttgttgatgg

SEQ ID NO: 228851 - DNA, 21 bp, Artificial sequence
  SiRNA target sequence
aaggttggatttgttgatgga

SEQ ID NO: 228852 - DNA, 21 bp, Artificial sequence
  SiRNA target sequence
aggttggatttgttgatggac

SEQ ID NO: 228853 - DNA, 21 bp, Artificial sequence
  SiRNA target sequence
ggttggatttgttgatggact

SEQ ID NO: 228854 - DNA, 21 bp, Artificial sequence
  SiRNA target sequence
gttggatttgttgatggactt

SEQ ID NO: 228855 - DNA, 21 bp, Artificial sequence
  SiRNA target sequence
ttggatttgttgatggactta

SEQ ID NO: 228856 - DNA, 21 bp, Artificial sequence
  SiRNA target sequence
tggatttgttgatggacttat

SEQ ID NO: 228857 - DNA, 21 bp, Artificial sequence
  SiRNA target sequence
ggatttgttgatggacttatt

SEQ ID NO: 228858 - DNA, 21 bp, Artificial sequence
  SiRNA target sequence
gatttgttgatggacttattg

SEQ ID NO: 228859 - DNA, 21 bp, Artificial sequence
  SiRNA target sequence
atttgttgatggacttattga

SEQ ID NO: 228860 - DNA, 21 bp, Artificial sequence
  SiRNA target sequence
tttgttgatggacttattgag

SEQ ID NO: 228861 - DNA, 21 bp, Artificial sequence
  SiRNA target sequence
ttgttgatggacttattgaga

SEQ ID NO: 228862 - DNA, 21 bp, Artificial sequence
  SiRNA target sequence
tgttgatggacttattgagat

SEQ ID NO: 228863 - DNA, 21 bp, Artificial sequence
  SiRNA target sequence
gttgatggacttattgagatg

SEQ ID NO: 228864 - DNA, 21 bp, Artificial sequence
  SiRNA target sequence
ttgatggacttattgagatga

SEQ ID NO: 228865 - DNA, 21 bp, Artificial sequence
  SiRNA target sequence
tgatggacttattgagatgag

SEQ ID NO: 228866 - DNA, 21 bp, Artificial sequence
  SiRNA target sequence
gatggacttattgagatgagt

SEQ ID NO: 228867 - DNA, 21 bp, Artificial sequence
  SiRNA target sequence
atggacttattgagatgagta

SEQ ID NO: 228868 - DNA, 21 bp, Artificial sequence
  SiRNA target sequence
tggacttattgagatgagtaa

SEQ ID NO: 228869 - DNA, 21 bp, Artificial sequence
  SiRNA target sequence
ggacttattgagatgagtaaa

SEQ ID NO: 228870 - DNA, 21 bp, Artificial sequence
  SiRNA target sequence
gacttattgagatgagtaaat

SEQ ID NO: 228871 - DNA, 21 bp, Artificial sequence
  SiRNA target sequence
acttattgagatgagtaaatc

SEQ ID NO: 228872 - DNA, 21 bp, Artificial sequence
  SiRNA target sequence
cttattgagatgagtaaatct

SEQ ID NO: 228873 - DNA, 21 bp, Artificial sequence
  SiRNA target sequence
ttattgagatgagtaaatcta

SEQ ID NO: 228874 - DNA, 21 bp, Artificial sequence
  SiRNA target sequence
tattgagatgagtaaatctaa

SEQ ID NO: 228875 - DNA, 21 bp, Artificial sequence
  SiRNA target sequence
attgagatgagtaaatctaaa

SEQ ID NO: 228876 - DNA, 21 bp, Artificial sequence
  SiRNA target sequence
ttgagatgagtaaatctaaac

SEQ ID NO: 228877 - DNA, 21 bp, Artificial sequence
  SiRNA target sequence
tgagatgagtaaatctaaact

SEQ ID NO: 228878 - DNA, 21 bp, Artificial sequence
  SiRNA target sequence
gagatgagtaaatctaaacta

SEQ ID NO: 228879 - DNA, 21 bp, Artificial sequence
  SiRNA target sequence
agatgagtaaatctaaactac

SEQ ID NO: 228880 - DNA, 21 bp, Artificial sequence
  SiRNA target sequence
gatgagtaaatctaaactact

SEQ ID NO: 228881 - DNA, 21 bp, Artificial sequence
  SiRNA target sequence
atgagtaaatctaaactactg

SEQ ID NO: 228882 - DNA, 21 bp, Artificial sequence
  SiRNA target sequence
tgagtaaatctaaactactgt

SEQ ID NO: 228883 - DNA, 21 bp, Artificial sequence
  SiRNA target sequence
gagtaaatctaaactactgtt

SEQ ID NO: 228884 - DNA, 21 bp, Artificial sequence
  SiRNA target sequence
agtaaatctaaactactgttg

SEQ ID NO: 228885 - DNA, 21 bp, Artificial sequence
  SiRNA target sequence
gtaaatctaaactactgttga

SEQ ID NO: 228886 - DNA, 21 bp, Artificial sequence
  SiRNA target sequence
taaatctaaactactgttgaa

SEQ ID NO: 228887 - DNA, 21 bp, Artificial sequence
  SiRNA target sequence
aaatctaaactactgttgaat

SEQ ID NO: 228888 - DNA, 21 bp, Artificial sequence
  SiRNA target sequence
aatctaaactactgttgaata

SEQ ID NO: 228889 - DNA, 21 bp, Artificial sequence
  SiRNA target sequence
atctaaactactgttgaatat

SEQ ID NO: 228890 - DNA, 21 bp, Artificial sequence
  SiRNA target sequence
tctaaactactgttgaatatg

SEQ ID NO: 228891 - DNA, 21 bp, Artificial sequence
  SiRNA target sequence
ctaaactactgttgaatatgt

SEQ ID NO: 228892 - DNA, 21 bp, Artificial sequence
  SiRNA target sequence
taaactactgttgaatatgtc

SEQ ID NO: 228893 - DNA, 21 bp, Artificial sequence
  SiRNA target sequence
aaactactgttgaatatgtca

SEQ ID NO: 228894 - DNA, 21 bp, Artificial sequence
  SiRNA target sequence
aactactgttgaatatgtcat

SEQ ID NO: 228895 - DNA, 21 bp, Artificial sequence
  SiRNA target sequence
actactgttgaatatgtcatt

SEQ ID NO: 228896 - DNA, 21 bp, Artificial sequence
  SiRNA target sequence
ctactgttgaatatgtcatta

SEQ ID NO: 228897 - DNA, 21 bp, Artificial sequence
  SiRNA target sequence
tactgttgaatatgtcattag

SEQ ID NO: 228898 - DNA, 21 bp, Artificial sequence
  SiRNA target sequence
actgttgaatatgtcattagt

SEQ ID NO: 228899 - DNA, 21 bp, Artificial sequence
  SiRNA target sequence
ctgttgaatatgtcattagtc

SEQ ID NO: 228900 - DNA, 21 bp, Artificial sequence
  SiRNA target sequence
tgttgaatatgtcattagtcg

SEQ ID NO: 228901 - DNA, 21 bp, Artificial sequence
  SiRNA target sequence
gttgaatatgtcattagtcgt

SEQ ID NO: 228902 - DNA, 21 bp, Artificial sequence
  SiRNA target sequence
ttgaatatgtcattagtcgta

SEQ ID NO: 228903 - DNA, 21 bp, Artificial sequence
  SiRNA target sequence
tgaatatgtcattagtcgtat

SEQ ID NO: 228904 - DNA, 21 bp, Artificial sequence
  SiRNA target sequence
gaatatgtcattagtcgtatt

SEQ ID NO: 228905 - DNA, 21 bp, Artificial sequence
  SiRNA target sequence
aatatgtcattagtcgtatta

SEQ ID NO: 228906 - DNA, 21 bp, Artificial sequence
  SiRNA target sequence
atatgtcattagtcgtattat

SEQ ID NO: 228907 - DNA, 21 bp, Artificial sequence
  SiRNA target sequence
tatgtcattagtcgtattatt

SEQ ID NO: 228908 - DNA, 21 bp, Artificial sequence
  SiRNA target sequence
atgtcattagtcgtattattt

SEQ ID NO: 228909 - DNA, 21 bp, Artificial sequence
  SiRNA target sequence
tgtcattagtcgtattatttt

SEQ ID NO: 228910 - DNA, 21 bp, Artificial sequence
  SiRNA target sequence
gtcattagtcgtattatttta

SEQ ID NO: 228911 - DNA, 21 bp, Artificial sequence
  SiRNA target sequence
tcattagtcgtattattttat

SEQ ID NO: 228912 - DNA, 21 bp, Artificial sequence
  SiRNA target sequence
cattagtcgtattattttatg

SEQ ID NO: 228913 - DNA, 21 bp, Artificial sequence
  SiRNA target sequence
attagtcgtattattttatgc

SEQ ID NO: 228914 - DNA, 21 bp, Artificial sequence
  SiRNA target sequence
ttagtcgtattattttatgct

SEQ ID NO: 228915 - DNA, 21 bp, Artificial sequence
  SiRNA target sequence
tagtcgtattattttatgctg

SEQ ID NO: 228916 - DNA, 21 bp, Artificial sequence
  SiRNA target sequence
agtcgtattattttatgctgt

SEQ ID NO: 228917 - DNA, 21 bp, Artificial sequence
  SiRNA target sequence
gtcgtattattttatgctgtt

SEQ ID NO: 228918 - DNA, 21 bp, Artificial sequence
  SiRNA target sequence
tcgtattattttatgctgttt

SEQ ID NO: 228919 - DNA, 21 bp, Artificial sequence
  SiRNA target sequence
cgtattattttatgctgtttc

SEQ ID NO: 228920 - DNA, 21 bp, Artificial sequence
  SiRNA target sequence
gtattattttatgctgtttct

SEQ ID NO: 228921 - DNA, 21 bp, Artificial sequence
  SiRNA target sequence
tattattttatgctgtttcta

SEQ ID NO: 228922 - DNA, 21 bp, Artificial sequence
  SiRNA target sequence
attattttatgctgtttctac

SEQ ID NO: 228923 - DNA, 21 bp, Artificial sequence
  SiRNA target sequence
ttattttatgctgtttctacg

SEQ ID NO: 228924 - DNA, 21 bp, Artificial sequence
  SiRNA target sequence
tattttatgctgtttctacga

SEQ ID NO: 228925 - DNA, 21 bp, Artificial sequence
  SiRNA target sequence
attttatgctgtttctacgaa

SEQ ID NO: 228926 - DNA, 21 bp, Artificial sequence
  SiRNA target sequence
ttttatgctgtttctacgaat

SEQ ID NO: 228927 - DNA, 21 bp, Artificial sequence
  SiRNA target sequence
tttatgctgtttctacgaata

SEQ ID NO: 228928 - DNA, 21 bp, Artificial sequence
  SiRNA target sequence
ttatgctgtttctacgaatat

SEQ ID NO: 228929 - DNA, 21 bp, Artificial sequence
  SiRNA target sequence
tatgctgtttctacgaatatt

SEQ ID NO: 228930 - DNA, 21 bp, Artificial sequence
  SiRNA target sequence
atgctgtttctacgaatatta

SEQ ID NO: 228931 - DNA, 21 bp, Artificial sequence
  SiRNA target sequence
tgctgtttctacgaatattat

SEQ ID NO: 228932 - DNA, 21 bp, Artificial sequence
  SiRNA target sequence
gctgtttctacgaatattatt

SEQ ID NO: 228933 - DNA, 21 bp, Artificial sequence
  SiRNA target sequence
ctgtttctacgaatattattg

SEQ ID NO: 228934 - DNA, 21 bp, Artificial sequence
  SiRNA target sequence
tgtttctacgaatattattga

SEQ ID NO: 228935 - DNA, 21 bp, Artificial sequence
  SiRNA target sequence
gtttctacgaatattattgag

SEQ ID NO: 228936 - DNA, 21 bp, Artificial sequence
  SiRNA target sequence
tttctacgaatattattgagt

SEQ ID NO: 228937 - DNA, 21 bp, Artificial sequence
  SiRNA target sequence
ttctacgaatattattgagtc

SEQ ID NO: 228938 - DNA, 21 bp, Artificial sequence
  SiRNA target sequence
tctacgaatattattgagtca

SEQ ID NO: 228939 - DNA, 21 bp, Artificial sequence
  SiRNA target sequence
ctacgaatattattgagtcag

SEQ ID NO: 228940 - DNA, 21 bp, Artificial sequence
  SiRNA target sequence
tacgaatattattgagtcagc

SEQ ID NO: 228941 - DNA, 21 bp, Artificial sequence
  SiRNA target sequence
acgaatattattgagtcagct

SEQ ID NO: 228942 - DNA, 21 bp, Artificial sequence
  SiRNA target sequence
cgaatattattgagtcagctt

SEQ ID NO: 228943 - DNA, 21 bp, Artificial sequence
  SiRNA target sequence
gaatattattgagtcagctta

SEQ ID NO: 228944 - DNA, 21 bp, Artificial sequence
  SiRNA target sequence
aatattattgagtcagcttat

SEQ ID NO: 228945 - DNA, 21 bp, Artificial sequence
  SiRNA target sequence
atattattgagtcagcttata

SEQ ID NO: 228946 - DNA, 21 bp, Artificial sequence
  SiRNA target sequence
tattattgagtcagcttataa

SEQ ID NO: 228947 - DNA, 21 bp, Artificial sequence
  SiRNA target sequence
attattgagtcagcttataaa

SEQ ID NO: 228948 - DNA, 21 bp, Artificial sequence
  SiRNA target sequence
ttattgagtcagcttataaat

SEQ ID NO: 228949 - DNA, 21 bp, Artificial sequence
  SiRNA target sequence
tattgagtcagcttataaatc

SEQ ID NO: 228950 - DNA, 21 bp, Artificial sequence
  SiRNA target sequence
attgagtcagcttataaatct

SEQ ID NO: 228951 - DNA, 21 bp, Artificial sequence
  SiRNA target sequence
ttgagtcagcttataaatctg

SEQ ID NO: 228952 - DNA, 21 bp, Artificial sequence
  SiRNA target sequence
tgagtcagcttataaatctgc

SEQ ID NO: 228953 - DNA, 21 bp, Artificial sequence
  SiRNA target sequence
gagtcagcttataaatctgct

SEQ ID NO: 228954 - DNA, 21 bp, Artificial sequence
  SiRNA target sequence
agtcagcttataaatctgctt

SEQ ID NO: 228955 - DNA, 21 bp, Artificial sequence
  SiRNA target sequence
gtcagcttataaatctgcttt

SEQ ID NO: 228956 - DNA, 21 bp, Artificial sequence
  SiRNA target sequence
tcagcttataaatctgcttta

SEQ ID NO: 228957 - DNA, 21 bp, Artificial sequence
  SiRNA target sequence
cagcttataaatctgctttag

SEQ ID NO: 228958 - DNA, 21 bp, Artificial sequence
  SiRNA target sequence
agcttataaatctgctttagc

SEQ ID NO: 228959 - DNA, 21 bp, Artificial sequence
  SiRNA target sequence
gcttataaatctgctttagct

SEQ ID NO: 228960 - DNA, 21 bp, Artificial sequence
  SiRNA target sequence
cttataaatctgctttagctg

SEQ ID NO: 228961 - DNA, 21 bp, Artificial sequence
  SiRNA target sequence
ttataaatctgctttagctgt

SEQ ID NO: 228962 - DNA, 21 bp, Artificial sequence
  SiRNA target sequence
tataaatctgctttagctgtc

SEQ ID NO: 228963 - DNA, 21 bp, Artificial sequence
  SiRNA target sequence
ataaatctgctttagctgtcg

SEQ ID NO: 228964 - DNA, 21 bp, Artificial sequence
  SiRNA target sequence
taaatctgctttagctgtcgg

SEQ ID NO: 228965 - DNA, 21 bp, Artificial sequence
  SiRNA target sequence
aaatctgctttagctgtcggt

SEQ ID NO: 228966 - DNA, 21 bp, Artificial sequence
  SiRNA target sequence
aatctgctttagctgtcggtg

SEQ ID NO: 228967 - DNA, 21 bp, Artificial sequence
  SiRNA target sequence
atctgctttagctgtcggtgc

SEQ ID NO: 228968 - DNA, 21 bp, Artificial sequence
  SiRNA target sequence
tctgctttagctgtcggtgct

SEQ ID NO: 228969 - DNA, 21 bp, Artificial sequence
  SiRNA target sequence
ctgctttagctgtcggtgcta

SEQ ID NO: 228970 - DNA, 21 bp, Artificial sequence
  SiRNA target sequence
tgctttagctgtcggtgctaa

SEQ ID NO: 228971 - DNA, 21 bp, Artificial sequence
  SiRNA target sequence
gctttagctgtcggtgctaat

SEQ ID NO: 228972 - DNA, 21 bp, Artificial sequence
  SiRNA target sequence
ctttagctgtcggtgctaatg

SEQ ID NO: 228973 - DNA, 21 bp, Artificial sequence
  SiRNA target sequence
tttagctgtcggtgctaatga

SEQ ID NO: 228974 - DNA, 21 bp, Artificial sequence
  SiRNA target sequence
ttagctgtcggtgctaatgaa

SEQ ID NO: 228975 - DNA, 21 bp, Artificial sequence
  SiRNA target sequence
tagctgtcggtgctaatgaaa

SEQ ID NO: 228976 - DNA, 21 bp, Artificial sequence
  SiRNA target sequence
agctgtcggtgctaatgaaac

SEQ ID NO: 228977 - DNA, 21 bp, Artificial sequence
  SiRNA target sequence
gctgtcggtgctaatgaaact

SEQ ID NO: 228978 - DNA, 21 bp, Artificial sequence
  SiRNA target sequence
ctgtcggtgctaatgaaactg

SEQ ID NO: 228979 - DNA, 21 bp, Artificial sequence
  SiRNA target sequence
tgtcggtgctaatgaaactgg

SEQ ID NO: 228980 - DNA, 21 bp, Artificial sequence
  SiRNA target sequence
gtcggtgctaatgaaactggt

SEQ ID NO: 228981 - DNA, 21 bp, Artificial sequence
  SiRNA target sequence
tcggtgctaatgaaactggtg

SEQ ID NO: 228982 - DNA, 21 bp, Artificial sequence
  SiRNA target sequence
cggtgctaatgaaactggtga

SEQ ID NO: 228983 - DNA, 21 bp, Artificial sequence
  SiRNA target sequence
ggtgctaatgaaactggtgag

SEQ ID NO: 228984 - DNA, 21 bp, Artificial sequence
  SiRNA target sequence
gtgctaatgaaactggtgagg

SEQ ID NO: 228985 - DNA, 21 bp, Artificial sequence
  SiRNA target sequence
tgctaatgaaactggtgaggc

SEQ ID NO: 228986 - DNA, 21 bp, Artificial sequence
  SiRNA target sequence
gctaatgaaactggtgaggca

SEQ ID NO: 228987 - DNA, 21 bp, Artificial sequence
  SiRNA target sequence
ctaatgaaactggtgaggcaa

SEQ ID NO: 228988 - DNA, 21 bp, Artificial sequence
  SiRNA target sequence
taatgaaactggtgaggcaaa

SEQ ID NO: 228989 - DNA, 21 bp, Artificial sequence
  SiRNA target sequence
aatgaaactggtgaggcaaaa

SEQ ID NO: 228990 - DNA, 21 bp, Artificial sequence
  SiRNA target sequence
atgaaactggtgaggcaaaat

SEQ ID NO: 228991 - DNA, 21 bp, Artificial sequence
  SiRNA target sequence
tgaaactggtgaggcaaaatc

SEQ ID NO: 228992 - DNA, 21 bp, Artificial sequence
  SiRNA target sequence
gaaactggtgaggcaaaatct

SEQ ID NO: 228993 - DNA, 21 bp, Artificial sequence
  SiRNA target sequence
aaactggtgaggcaaaatcta

SEQ ID NO: 228994 - DNA, 21 bp, Artificial sequence
  SiRNA target sequence
aactggtgaggcaaaatctac

SEQ ID NO: 228995 - DNA, 21 bp, Artificial sequence
  SiRNA target sequence
actggtgaggcaaaatctacc

SEQ ID NO: 228996 - DNA, 21 bp, Artificial sequence
  SiRNA target sequence
ctggtgaggcaaaatctacct

SEQ ID NO: 228997 - DNA, 21 bp, Artificial sequence
  SiRNA target sequence
tggtgaggcaaaatctaccta

SEQ ID NO: 228998 - DNA, 21 bp, Artificial sequence
  SiRNA target sequence
ggtgaggcaaaatctacctat

SEQ ID NO: 228999 - DNA, 21 bp, Artificial sequence
  SiRNA target sequence
gtgaggcaaaatctacctatg

SEQ ID NO: 229000 - DNA, 21 bp, Artificial sequence
  SiRNA target sequence
tgaggcaaaatctacctatgc

SEQ ID NO: 229001 - DNA, 21 bp, Artificial sequence
  SiRNA target sequence
gaggcaaaatctacctatgct

SEQ ID NO: 229002 - DNA, 21 bp, Artificial sequence
  SiRNA target sequence
aggcaaaatctacctatgctt

SEQ ID NO: 229003 - DNA, 21 bp, Artificial sequence
  SiRNA target sequence
ggcaaaatctacctatgcttc

SEQ ID NO: 229004 - DNA, 21 bp, Artificial sequence
  SiRNA target sequence
gcaaaatctacctatgcttca

SEQ ID NO: 229005 - DNA, 21 bp, Artificial sequence
  SiRNA target sequence
caaaatctacctatgcttcaa

SEQ ID NO: 229006 - DNA, 21 bp, Artificial sequence
  SiRNA target sequence
aaaatctacctatgcttcaat

SEQ ID NO: 229007 - DNA, 21 bp, Artificial sequence
  SiRNA target sequence
aaatctacctatgcttcaatt

SEQ ID NO: 229008 - DNA, 21 bp, Artificial sequence
  SiRNA target sequence
aatctacctatgcttcaattt

SEQ ID NO: 229009 - DNA, 21 bp, Artificial sequence
  SiRNA target sequence
atctacctatgcttcaattta

SEQ ID NO: 229010 - DNA, 21 bp, Artificial sequence
  SiRNA target sequence
tctacctatgcttcaatttat

SEQ ID NO: 229011 - DNA, 21 bp, Artificial sequence
  SiRNA target sequence
ctacctatgcttcaatttata

SEQ ID NO: 229012 - DNA, 21 bp, Artificial sequence
  SiRNA target sequence
tacctatgcttcaatttatac

SEQ ID NO: 229013 - DNA, 21 bp, Artificial sequence
  SiRNA target sequence
acctatgcttcaatttataca

SEQ ID NO: 229014 - DNA, 21 bp, Artificial sequence
  SiRNA target sequence
cctatgcttcaatttatacat

SEQ ID NO: 229015 - DNA, 21 bp, Artificial sequence
  SiRNA target sequence
ctatgcttcaatttatacatc

SEQ ID NO: 229016 - DNA, 21 bp, Artificial sequence
  SiRNA target sequence
tatgcttcaatttatacatca

SEQ ID NO: 229017 - DNA, 21 bp, Artificial sequence
  SiRNA target sequence
atgcttcaatttatacatcaa

SEQ ID NO: 229018 - DNA, 21 bp, Artificial sequence
  SiRNA target sequence
tgcttcaatttatacatcaat

SEQ ID NO: 229019 - DNA, 21 bp, Artificial sequence
  SiRNA target sequence
gcttcaatttatacatcaatt

SEQ ID NO: 229020 - DNA, 21 bp, Artificial sequence
  SiRNA target sequence
cttcaatttatacatcaattg

SEQ ID NO: 229021 - DNA, 21 bp, Artificial sequence
  SiRNA target sequence
ttcaatttatacatcaattga

SEQ ID NO: 229022 - DNA, 21 bp, Artificial sequence
  SiRNA target sequence
tcaatttatacatcaattgaa

SEQ ID NO: 229023 - DNA, 21 bp, Artificial sequence
  SiRNA target sequence
caatttatacatcaattgaac

SEQ ID NO: 229024 - DNA, 21 bp, Artificial sequence
  SiRNA target sequence
aatttatacatcaattgaaca

SEQ ID NO: 229025 - DNA, 21 bp, Artificial sequence
  SiRNA target sequence
atttatacatcaattgaacaa

SEQ ID NO: 229026 - DNA, 21 bp, Artificial sequence
  SiRNA target sequence
tttatacatcaattgaacaat

SEQ ID NO: 229027 - DNA, 21 bp, Artificial sequence
  SiRNA target sequence
ttatacatcaattgaacaatc

SEQ ID NO: 229028 - DNA, 21 bp, Artificial sequence
  SiRNA target sequence
tatacatcaattgaacaatct

SEQ ID NO: 229029 - DNA, 21 bp, Artificial sequence
  SiRNA target sequence
atacatcaattgaacaatctg

SEQ ID NO: 229030 - DNA, 21 bp, Artificial sequence
  SiRNA target sequence
tacatcaattgaacaatctgg

SEQ ID NO: 229031 - DNA, 21 bp, Artificial sequence
  SiRNA target sequence
acatcaattgaacaatctgga

SEQ ID NO: 229032 - DNA, 21 bp, Artificial sequence
  SiRNA target sequence
catcaattgaacaatctggag

SEQ ID NO: 229033 - DNA, 21 bp, Artificial sequence
  SiRNA target sequence
atcaattgaacaatctggagt

SEQ ID NO: 229034 - DNA, 21 bp, Artificial sequence
  SiRNA target sequence
tcaattgaacaatctggagtt

SEQ ID NO: 229035 - DNA, 21 bp, Artificial sequence
  SiRNA target sequence
caattgaacaatctggagttg

SEQ ID NO: 229036 - DNA, 21 bp, Artificial sequence
  SiRNA target sequence
aattgaacaatctggagttgc

SEQ ID NO: 229037 - DNA, 21 bp, Artificial sequence
  SiRNA target sequence
attgaacaatctggagttgct

SEQ ID NO: 229038 - DNA, 21 bp, Artificial sequence
  SiRNA target sequence
ttgaacaatctggagttgctg

SEQ ID NO: 229039 - DNA, 21 bp, Artificial sequence
  SiRNA target sequence
tgaacaatctggagttgctgt

SEQ ID NO: 229040 - DNA, 21 bp, Artificial sequence
  SiRNA target sequence
gaacaatctggagttgctgtt

SEQ ID NO: 229041 - DNA, 21 bp, Artificial sequence
  SiRNA target sequence
aacaatctggagttgctgtta

SEQ ID NO: 229042 - DNA, 21 bp, Artificial sequence
  SiRNA target sequence
acaatctggagttgctgttat

SEQ ID NO: 229043 - DNA, 21 bp, Artificial sequence
  SiRNA target sequence
caatctggagttgctgttatt

SEQ ID NO: 229044 - DNA, 21 bp, Artificial sequence
  SiRNA target sequence
aatctggagttgctgttattg

SEQ ID NO: 229045 - DNA, 21 bp, Artificial sequence
  SiRNA target sequence
atctggagttgctgttattgt

SEQ ID NO: 229046 - DNA, 21 bp, Artificial sequence
  SiRNA target sequence
tctggagttgctgttattgtc

SEQ ID NO: 229047 - DNA, 21 bp, Artificial sequence
  SiRNA target sequence
ctggagttgctgttattgtca

SEQ ID NO: 229048 - DNA, 21 bp, Artificial sequence
  SiRNA target sequence
tggagttgctgttattgtcat

SEQ ID NO: 229049 - DNA, 21 bp, Artificial sequence
  SiRNA target sequence
ggagttgctgttattgtcatg

SEQ ID NO: 229050 - DNA, 21 bp, Artificial sequence
  SiRNA target sequence
gagttgctgttattgtcatga

SEQ ID NO: 229051 - DNA, 21 bp, Artificial sequence
  SiRNA target sequence
agttgctgttattgtcatgat

SEQ ID NO: 229052 - DNA, 21 bp, Artificial sequence
  SiRNA target sequence
gttgctgttattgtcatgatt

SEQ ID NO: 229053 - DNA, 21 bp, Artificial sequence
  SiRNA target sequence
ttgctgttattgtcatgattt

SEQ ID NO: 229054 - DNA, 21 bp, Artificial sequence
  SiRNA target sequence
tgctgttattgtcatgatttt

SEQ ID NO: 229055 - DNA, 21 bp, Artificial sequence
  SiRNA target sequence
gctgttattgtcatgattttg

SEQ ID NO: 229056 - DNA, 21 bp, Artificial sequence
  SiRNA target sequence
ctgttattgtcatgattttgc

SEQ ID NO: 229057 - DNA, 21 bp, Artificial sequence
  SiRNA target sequence
tgttattgtcatgattttgct

SEQ ID NO: 229058 - DNA, 21 bp, Artificial sequence
  SiRNA target sequence
gttattgtcatgattttgcta

SEQ ID NO: 229059 - DNA, 21 bp, Artificial sequence
  SiRNA target sequence
ttattgtcatgattttgctac

SEQ ID NO: 229060 - DNA, 21 bp, Artificial sequence
  SiRNA target sequence
tattgtcatgattttgctact

SEQ ID NO: 229061 - DNA, 21 bp, Artificial sequence
  SiRNA target sequence
attgtcatgattttgctactt

SEQ ID NO: 229062 - DNA, 21 bp, Artificial sequence
  SiRNA target sequence
ttgtcatgattttgctactta

SEQ ID NO: 229063 - DNA, 21 bp, Artificial sequence
  SiRNA target sequence
tgtcatgattttgctacttac

SEQ ID NO: 229064 - DNA, 21 bp, Artificial sequence
  SiRNA target sequence
gtcatgattttgctacttacc

SEQ ID NO: 229065 - DNA, 21 bp, Artificial sequence
  SiRNA target sequence
tcatgattttgctacttaccc

SEQ ID NO: 229066 - DNA, 21 bp, Artificial sequence
  SiRNA target sequence
catgattttgctacttacccc

SEQ ID NO: 229067 - DNA, 21 bp, Artificial sequence
  SiRNA target sequence
atgattttgctacttacccct

SEQ ID NO: 229068 - DNA, 21 bp, Artificial sequence
  SiRNA target sequence
tgattttgctacttacccctt

SEQ ID NO: 229069 - DNA, 21 bp, Artificial sequence
  SiRNA target sequence
gattttgctacttaccccttt

SEQ ID NO: 229070 - DNA, 21 bp, Artificial sequence
  SiRNA target sequence
attttgctacttacccctttt

SEQ ID NO: 229071 - DNA, 21 bp, Artificial sequence
  SiRNA target sequence
ttttgctacttaccccttttc

SEQ ID NO: 229072 - DNA, 21 bp, Artificial sequence
  SiRNA target sequence
tttgctacttaccccttttcc

SEQ ID NO: 229073 - DNA, 21 bp, Artificial sequence
  SiRNA target sequence
ttgctacttaccccttttcca

SEQ ID NO: 229074 - DNA, 21 bp, Artificial sequence
  SiRNA target sequence
tgctacttaccccttttccaa

SEQ ID NO: 229075 - DNA, 21 bp, Artificial sequence
  SiRNA target sequence
gctacttaccccttttccaag

SEQ ID NO: 229076 - DNA, 21 bp, Artificial sequence
  SiRNA target sequence
ctacttaccccttttccaagg
